United States Patent 11,369,692 (MATERIALS AND METHODS FOR TREATMENT OF DUCHENNE MUSCULAR DYSTROPHY) - sequence listing, part 24

SEQ ID NO: 787728 - DNA, 22 bp, Artificial Sequence
  chemically synthesized
taaagggttagtcattattaat

SEQ ID NO: 787729 - DNA, 22 bp, Artificial Sequence
  chemically synthesized
aaagggttagtcattattaatt

SEQ ID NO: 787730 - DNA, 22 bp, Artificial Sequence
  chemically synthesized
aagggttagtcattattaattt

SEQ ID NO: 787731 - DNA, 22 bp, Artificial Sequence
  chemically synthesized
caatacattttgtaaaaattaa

SEQ ID NO: 787732 - DNA, 22 bp, Artificial Sequence
  chemically synthesized
gtcattattaatttttacaaaa

SEQ ID NO: 787733 - DNA, 22 bp, Artificial Sequence
  chemically synthesized
atgtgattgcaatacattttgt

SEQ ID NO: 787734 - DNA, 22 bp, Artificial Sequence
  chemically synthesized
ttaatttttacaaaatgtattg

SEQ ID NO: 787735 - DNA, 22 bp, Artificial Sequence
  chemically synthesized
atttttacaaaatgtattgcaa

SEQ ID NO: 787736 - DNA, 22 bp, Artificial Sequence
  chemically synthesized
cgattaatgtgattgcaataca

SEQ ID NO: 787737 - DNA, 22 bp, Artificial Sequence
  chemically synthesized
ttacaaaatgtattgcaatcac

SEQ ID NO: 787738 - DNA, 22 bp, Artificial Sequence
  chemically synthesized
tacaaaatgtattgcaatcaca

SEQ ID NO: 787739 - DNA, 22 bp, Artificial Sequence
  chemically synthesized
acaaaatgtattgcaatcacat

SEQ ID NO: 787740 - DNA, 22 bp, Artificial Sequence
  chemically synthesized
caaaatgtattgcaatcacatt

SEQ ID NO: 787741 - DNA, 22 bp, Artificial Sequence
  chemically synthesized
tatggttgcgattaatgtgatt

SEQ ID NO: 787742 - DNA, 22 bp, Artificial Sequence
  chemically synthesized
caatcacattaatcgcaaccat

SEQ ID NO: 787743 - DNA, 22 bp, Artificial Sequence
  chemically synthesized
caaagatattatatggttgcga

SEQ ID NO: 787744 - DNA, 22 bp, Artificial Sequence
  chemically synthesized
atcgcaaccatataatatcttt

SEQ ID NO: 787745 - DNA, 22 bp, Artificial Sequence
  chemically synthesized
tatccacattacaaagatatta

SEQ ID NO: 787746 - DNA, 22 bp, Artificial Sequence
  chemically synthesized
atatccacattacaaagatatt

SEQ ID NO: 787747 - DNA, 22 bp, Artificial Sequence
  chemically synthesized
aataacttatatccacattaca

SEQ ID NO: 787748 - DNA, 22 bp, Artificial Sequence
  chemically synthesized
ttgaataacttatatccacatt

SEQ ID NO: 787749 - DNA, 22 bp, Artificial Sequence
  chemically synthesized
tgtaatgtggatataagttatt

SEQ ID NO: 787750 - DNA, 22 bp, Artificial Sequence
  chemically synthesized
gtaatgtggatataagttattc

SEQ ID NO: 787751 - DNA, 22 bp, Artificial Sequence
  chemically synthesized
taatgtggatataagttattca

SEQ ID NO: 787752 - DNA, 22 bp, Artificial Sequence
  chemically synthesized
aagtaatatcacaacgaatgcc

SEQ ID NO: 787753 - DNA, 22 bp, Artificial Sequence
  chemically synthesized
attaaagtaatatcacaacgaa

SEQ ID NO: 787754 - DNA, 22 bp, Artificial Sequence
  chemically synthesized
ttcaataggcattcgttgtgat

SEQ ID NO: 787755 - DNA, 22 bp, Artificial Sequence
  chemically synthesized
aataggcattcgttgtgatatt

SEQ ID NO: 787756 - DNA, 22 bp, Artificial Sequence
  chemically synthesized
gttgtgatattactttaattaa

SEQ ID NO: 787757 - DNA, 22 bp, Artificial Sequence
  chemically synthesized
caaaaaacaagtattaattaaa

SEQ ID NO: 787758 - DNA, 22 bp, Artificial Sequence
  chemically synthesized
acaaaaaacaagtattaattaa

SEQ ID NO: 787759 - DNA, 22 bp, Artificial Sequence
  chemically synthesized
tacaaaaaacaagtattaatta

SEQ ID NO: 787760 - DNA, 22 bp, Artificial Sequence
  chemically synthesized
tgatattactttaattaatact

SEQ ID NO: 787761 - DNA, 22 bp, Artificial Sequence
  chemically synthesized
ctttaattaatacttgtttttt

SEQ ID NO: 787762 - DNA, 22 bp, Artificial Sequence
  chemically synthesized
taattaatacttgttttttgta

SEQ ID NO: 787763 - DNA, 22 bp, Artificial Sequence
  chemically synthesized
aattaatacttgttttttgtaa

SEQ ID NO: 787764 - DNA, 22 bp, Artificial Sequence
  chemically synthesized
attaatacttgttttttgtaaa

SEQ ID NO: 787765 - DNA, 22 bp, Artificial Sequence
  chemically synthesized
atacttgttttttgtaaagtat

SEQ ID NO: 787766 - DNA, 22 bp, Artificial Sequence
  chemically synthesized
gttttttgtaaagtattacccg

SEQ ID NO: 787767 - DNA, 22 bp, Artificial Sequence
  chemically synthesized
ttttttgtaaagtattacccgc

SEQ ID NO: 787768 - DNA, 22 bp, Artificial Sequence
  chemically synthesized
tttgtaaagtattacccgcctt

SEQ ID NO: 787769 - DNA, 22 bp, Artificial Sequence
  chemically synthesized
ttgtaaagtattacccgccttt

SEQ ID NO: 787770 - DNA, 22 bp, Artificial Sequence
  chemically synthesized
tgtaaagtattacccgcctttt

SEQ ID NO: 787771 - DNA, 22 bp, Artificial Sequence
  chemically synthesized
gtaaagtattacccgccttttg

SEQ ID NO: 787772 - DNA, 22 bp, Artificial Sequence
  chemically synthesized
aggacatgccatcaaaaggcgg

SEQ ID NO: 787773 - DNA, 22 bp, Artificial Sequence
  chemically synthesized
taaagtattacccgccttttga

SEQ ID NO: 787774 - DNA, 22 bp, Artificial Sequence
  chemically synthesized
cccgccttttgatggcatgtcc

SEQ ID NO: 787775 - DNA, 22 bp, Artificial Sequence
  chemically synthesized
ttgatggcatgtccttaatgac

SEQ ID NO: 787776 - DNA, 22 bp, Artificial Sequence
  chemically synthesized
tgatggcatgtccttaatgact

SEQ ID NO: 787777 - DNA, 22 bp, Artificial Sequence
  chemically synthesized
gatggcatgtccttaatgacta

SEQ ID NO: 787778 - DNA, 22 bp, Artificial Sequence
  chemically synthesized
atggcatgtccttaatgactac

SEQ ID NO: 787779 - DNA, 22 bp, Artificial Sequence
  chemically synthesized
accaaaagaggggtagtcatta

SEQ ID NO: 787780 - DNA, 22 bp, Artificial Sequence
  chemically synthesized
gcactcaccaaaagaggggtag

SEQ ID NO: 787781 - DNA, 22 bp, Artificial Sequence
  chemically synthesized
aatgactacccctcttttggtg

SEQ ID NO: 787782 - DNA, 22 bp, Artificial Sequence
  chemically synthesized
atgactacccctcttttggtga

SEQ ID NO: 787783 - DNA, 22 bp, Artificial Sequence
  chemically synthesized
atagtgatctggcactcaccaa

SEQ ID NO: 787784 - DNA, 22 bp, Artificial Sequence
  chemically synthesized
cccctcttttggtgagtgccag

SEQ ID NO: 787785 - DNA, 22 bp, Artificial Sequence
  chemically synthesized
ttttggtgagtgccagatcact

SEQ ID NO: 787786 - DNA, 22 bp, Artificial Sequence
  chemically synthesized
ttggtgagtgccagatcactat

SEQ ID NO: 787787 - DNA, 22 bp, Artificial Sequence
  chemically synthesized
tggtgagtgccagatcactatt

SEQ ID NO: 787788 - DNA, 22 bp, Artificial Sequence
  chemically synthesized
ggtgagtgccagatcactatta

SEQ ID NO: 787789 - DNA, 22 bp, Artificial Sequence
  chemically synthesized
gtgagtgccagatcactattaa

SEQ ID NO: 787790 - DNA, 22 bp, Artificial Sequence
  chemically synthesized
taatgaatacaaaaggaattaa

SEQ ID NO: 787791 - DNA, 22 bp, Artificial Sequence
  chemically synthesized
ttataatgaatacaaaaggaat

SEQ ID NO: 787792 - DNA, 22 bp, Artificial Sequence
  chemically synthesized
atgttgttataatgaatacaaa

SEQ ID NO: 787793 - DNA, 22 bp, Artificial Sequence
  chemically synthesized
ttaattccttttgtattcatta

SEQ ID NO: 787794 - DNA, 22 bp, Artificial Sequence
  chemically synthesized
attgatgttgttataatgaata

SEQ ID NO: 787795 - DNA, 22 bp, Artificial Sequence
  chemically synthesized
attccttttgtattcattataa

SEQ ID NO: 787796 - DNA, 22 bp, Artificial Sequence
  chemically synthesized
cctgattgatgttgttataatg

SEQ ID NO: 787797 - DNA, 22 bp, Artificial Sequence
  chemically synthesized
ccctgattgatgttgttataat

SEQ ID NO: 787798 - DNA, 22 bp, Artificial Sequence
  chemically synthesized
cttttgtattcattataacaac

SEQ ID NO: 787799 - DNA, 22 bp, Artificial Sequence
  chemically synthesized
tccctgattgatgttgttataa

SEQ ID NO: 787800 - DNA, 22 bp, Artificial Sequence
  chemically synthesized
ttgtattcattataacaacatc

SEQ ID NO: 787801 - DNA, 22 bp, Artificial Sequence
  chemically synthesized
tgtattcattataacaacatca

SEQ ID NO: 787802 - DNA, 22 bp, Artificial Sequence
  chemically synthesized
gtattcattataacaacatcaa

SEQ ID NO: 787803 - DNA, 22 bp, Artificial Sequence
  chemically synthesized
tattcattataacaacatcaat

SEQ ID NO: 787804 - DNA, 22 bp, Artificial Sequence
  chemically synthesized
attataacaacatcaatcaggg

SEQ ID NO: 787805 - DNA, 22 bp, Artificial Sequence
  chemically synthesized
taacaacatcaatcagggaaag

SEQ ID NO: 787806 - DNA, 22 bp, Artificial Sequence
  chemically synthesized
atagcaaatgagctttccctga

SEQ ID NO: 787807 - DNA, 22 bp, Artificial Sequence
  chemically synthesized
acattaatagcaaatgagcttt

SEQ ID NO: 787808 - DNA, 22 bp, Artificial Sequence
  chemically synthesized
tattcacattaatagcaaatga

SEQ ID NO: 787809 - DNA, 22 bp, Artificial Sequence
  chemically synthesized
ttatattcacattaatagcaaa

SEQ ID NO: 787810 - DNA, 22 bp, Artificial Sequence
  chemically synthesized
cctgttatattcacattaatag

SEQ ID NO: 787811 - DNA, 22 bp, Artificial Sequence
  chemically synthesized
atttgctattaatgtgaatata

SEQ ID NO: 787812 - DNA, 22 bp, Artificial Sequence
  chemically synthesized
gctattaatgtgaatataacag

SEQ ID NO: 787813 - DNA, 22 bp, Artificial Sequence
  chemically synthesized
gaatggaattacctgttatatt

SEQ ID NO: 787814 - DNA, 22 bp, Artificial Sequence
  chemically synthesized
ctattaatgtgaatataacagg

SEQ ID NO: 787815 - DNA, 22 bp, Artificial Sequence
  chemically synthesized
ttaatgtgaatataacaggtaa

SEQ ID NO: 787816 - DNA, 22 bp, Artificial Sequence
  chemically synthesized
gattagaatggaattacctgtt

SEQ ID NO: 787817 - DNA, 22 bp, Artificial Sequence
  chemically synthesized
atgtgaatataacaggtaattc

SEQ ID NO: 787818 - DNA, 22 bp, Artificial Sequence
  chemically synthesized
ctagattagaatggaattacct

SEQ ID NO: 787819 - DNA, 22 bp, Artificial Sequence
  chemically synthesized
atcactactagattagaatgga

SEQ ID NO: 787820 - DNA, 22 bp, Artificial Sequence
  chemically synthesized
cattctaatctagtagtgatta

SEQ ID NO: 787821 - DNA, 22 bp, Artificial Sequence
  chemically synthesized
ccaagtgaacattaatcactac

SEQ ID NO: 787822 - DNA, 22 bp, Artificial Sequence
  chemically synthesized
ctaccaagtgaacattaatcac

SEQ ID NO: 787823 - DNA, 22 bp, Artificial Sequence
  chemically synthesized
taatctagtagtgattaatgtt

SEQ ID NO: 787824 - DNA, 22 bp, Artificial Sequence
  chemically synthesized
atctagtagtgattaatgttca

SEQ ID NO: 787825 - DNA, 22 bp, Artificial Sequence
  chemically synthesized
taattactaccaagtgaacatt

SEQ ID NO: 787826 - DNA, 22 bp, Artificial Sequence
  chemically synthesized
gtagtgattaatgttcacttgg

SEQ ID NO: 787827 - DNA, 22 bp, Artificial Sequence
  chemically synthesized
atgttcacttggtagtaattac

SEQ ID NO: 787828 - DNA, 22 bp, Artificial Sequence
  chemically synthesized
aaatgtgatattgtaattacta

SEQ ID NO: 787829 - DNA, 22 bp, Artificial Sequence
  chemically synthesized
tgaaatgtgatattgtaattac

SEQ ID NO: 787830 - DNA, 22 bp, Artificial Sequence
  chemically synthesized
acttggtagtaattacaatatc

SEQ ID NO: 787831 - DNA, 22 bp, Artificial Sequence
  chemically synthesized
acactctgaaatgtgatattgt

SEQ ID NO: 787832 - DNA, 22 bp, Artificial Sequence
  chemically synthesized
ggtagtaattacaatatcacat

SEQ ID NO: 787833 - DNA, 22 bp, Artificial Sequence
  chemically synthesized
gtagtaattacaatatcacatt

SEQ ID NO: 787834 - DNA, 22 bp, Artificial Sequence
  chemically synthesized
tccagtgctaacactctgaaat

SEQ ID NO: 787835 - DNA, 22 bp, Artificial Sequence
  chemically synthesized
caatatcacatttcagagtgtt

SEQ ID NO: 787836 - DNA, 22 bp, Artificial Sequence
  chemically synthesized
cagagtgttagcactggacaat

SEQ ID NO: 787837 - DNA, 22 bp, Artificial Sequence
  chemically synthesized
agagtgttagcactggacaata

SEQ ID NO: 787838 - DNA, 22 bp, Artificial Sequence
  chemically synthesized
aaaggccacacaaaataagtat

SEQ ID NO: 787839 - DNA, 22 bp, Artificial Sequence
  chemically synthesized
aaaaggccacacaaaataagta

SEQ ID NO: 787840 - DNA, 22 bp, Artificial Sequence
  chemically synthesized
gcactggacaatacttattttg

SEQ ID NO: 787841 - DNA, 22 bp, Artificial Sequence
  chemically synthesized
taaaaggccacacaaaataagt

SEQ ID NO: 787842 - DNA, 22 bp, Artificial Sequence
  chemically synthesized
tttaaaaggccacacaaaataa

SEQ ID NO: 787843 - DNA, 22 bp, Artificial Sequence
  chemically synthesized
gacaatacttattttgtgtggc

SEQ ID NO: 787844 - DNA, 22 bp, Artificial Sequence
  chemically synthesized
tggttctttaaaaggccacaca

SEQ ID NO: 787845 - DNA, 22 bp, Artificial Sequence
  chemically synthesized
ctgtggttctttaaaaggccac

SEQ ID NO: 787846 - DNA, 22 bp, Artificial Sequence
  chemically synthesized
attttgtgtggccttttaaaga

SEQ ID NO: 787847 - DNA, 22 bp, Artificial Sequence
  chemically synthesized
ttttgtgtggccttttaaagaa

SEQ ID NO: 787848 - DNA, 22 bp, Artificial Sequence
  chemically synthesized
tgtgtggccttttaaagaacca

SEQ ID NO: 787849 - DNA, 22 bp, Artificial Sequence
  chemically synthesized
gtgtggccttttaaagaaccac

SEQ ID NO: 787850 - DNA, 22 bp, Artificial Sequence
  chemically synthesized
tgtggccttttaaagaaccaca

SEQ ID NO: 787851 - DNA, 22 bp, Artificial Sequence
  chemically synthesized
agtccagacaagctgctgtggt

SEQ ID NO: 787852 - DNA, 22 bp, Artificial Sequence
  chemically synthesized
taagtccagacaagctgctgtg

SEQ ID NO: 787853 - DNA, 22 bp, Artificial Sequence
  chemically synthesized
ttaaagaaccacagcagcttgt

SEQ ID NO: 787854 - DNA, 22 bp, Artificial Sequence
  chemically synthesized
taaagaaccacagcagcttgtc

SEQ ID NO: 787855 - DNA, 22 bp, Artificial Sequence
  chemically synthesized
aaagaaccacagcagcttgtct

SEQ ID NO: 787856 - DNA, 22 bp, Artificial Sequence
  chemically synthesized
aattctaagtccagacaagctg

SEQ ID NO: 787857 - DNA, 22 bp, Artificial Sequence
  chemically synthesized
aagaaccacagcagcttgtctg

SEQ ID NO: 787858 - DNA, 22 bp, Artificial Sequence
  chemically synthesized
caattctaagtccagacaagct

SEQ ID NO: 787859 - DNA, 22 bp, Artificial Sequence
  chemically synthesized
tcaattctaagtccagacaagc

SEQ ID NO: 787860 - DNA, 22 bp, Artificial Sequence
  chemically synthesized
ttcaattctaagtccagacaag

SEQ ID NO: 787861 - DNA, 22 bp, Artificial Sequence
  chemically synthesized
accttttcaattctaagtccag

SEQ ID NO: 787862 - DNA, 22 bp, Artificial Sequence
  chemically synthesized
aaccttttcaattctaagtcca

SEQ ID NO: 787863 - DNA, 22 bp, Artificial Sequence
  chemically synthesized
taaccttttcaattctaagtcc

SEQ ID NO: 787864 - DNA, 22 bp, Artificial Sequence
  chemically synthesized
tttaaccttttcaattctaagt

SEQ ID NO: 787865 - DNA, 22 bp, Artificial Sequence
  chemically synthesized
ctttaaccttttcaattctaag

SEQ ID NO: 787866 - DNA, 22 bp, Artificial Sequence
  chemically synthesized
tctttaaccttttcaattctaa

SEQ ID NO: 787867 - DNA, 22 bp, Artificial Sequence
  chemically synthesized
gtctggacttagaattgaaaag

SEQ ID NO: 787868 - DNA, 22 bp, Artificial Sequence
  chemically synthesized
cctttctttaaccttttcaatt

SEQ ID NO: 787869 - DNA, 22 bp, Artificial Sequence
  chemically synthesized
tctggacttagaattgaaaagg

SEQ ID NO: 787870 - DNA, 22 bp, Artificial Sequence
  chemically synthesized
attgcctttctttaaccttttc

SEQ ID NO: 787871 - DNA, 22 bp, Artificial Sequence
  chemically synthesized
gacttagaattgaaaaggttaa

SEQ ID NO: 787872 - DNA, 22 bp, Artificial Sequence
  chemically synthesized
gattaattgcctttctttaacc

SEQ ID NO: 787873 - DNA, 22 bp, Artificial Sequence
  chemically synthesized
agaattgaaaaggttaaagaaa

SEQ ID NO: 787874 - DNA, 22 bp, Artificial Sequence
  chemically synthesized
agattaattgcctttctttaac

SEQ ID NO: 787875 - DNA, 22 bp, Artificial Sequence
  chemically synthesized
gaattgaaaaggttaaagaaag

SEQ ID NO: 787876 - DNA, 22 bp, Artificial Sequence
  chemically synthesized
tccttagattaattgcctttct

SEQ ID NO: 787877 - DNA, 22 bp, Artificial Sequence
  chemically synthesized
gtccttagattaattgcctttc

SEQ ID NO: 787878 - DNA, 22 bp, Artificial Sequence
  chemically synthesized
aaaaggttaaagaaaggcaatt

SEQ ID NO: 787879 - DNA, 22 bp, Artificial Sequence
  chemically synthesized
tgtccttagattaattgccttt

SEQ ID NO: 787880 - DNA, 22 bp, Artificial Sequence
  chemically synthesized
tttgtccttagattaattgcct

SEQ ID NO: 787881 - DNA, 22 bp, Artificial Sequence
  chemically synthesized
tctttgtccttagattaattgc

SEQ ID NO: 787882 - DNA, 22 bp, Artificial Sequence
  chemically synthesized
ctctttgtccttagattaattg

SEQ ID NO: 787883 - DNA, 22 bp, Artificial Sequence
  chemically synthesized
tctctttgtccttagattaatt

SEQ ID NO: 787884 - DNA, 22 bp, Artificial Sequence
  chemically synthesized
aagaaaggcaattaatctaagg

SEQ ID NO: 787885 - DNA, 22 bp, Artificial Sequence
  chemically synthesized
atctaaggacaaagagaaagga

SEQ ID NO: 787886 - DNA, 22 bp, Artificial Sequence
  chemically synthesized
ccagccacataagaatcctttc

SEQ ID NO: 787887 - DNA, 22 bp, Artificial Sequence
  chemically synthesized
cccagccacataagaatccttt

SEQ ID NO: 787888 - DNA, 22 bp, Artificial Sequence
  chemically synthesized
aggacaaagagaaaggattctt

SEQ ID NO: 787889 - DNA, 22 bp, Artificial Sequence
  chemically synthesized
tcccagccacataagaatcctt

SEQ ID NO: 787890 - DNA, 22 bp, Artificial Sequence
  chemically synthesized
acctttcccagccacataagaa

SEQ ID NO: 787891 - DNA, 22 bp, Artificial Sequence
  chemically synthesized
ttcacctttcccagccacataa

SEQ ID NO: 787892 - DNA, 22 bp, Artificial Sequence
  chemically synthesized
accattattcacctttcccagc

SEQ ID NO: 787893 - DNA, 22 bp, Artificial Sequence
  chemically synthesized
aaccattattcacctttcccag

SEQ ID NO: 787894 - DNA, 22 bp, Artificial Sequence
  chemically synthesized
ttatgtggctgggaaaggtgaa

SEQ ID NO: 787895 - DNA, 22 bp, Artificial Sequence
  chemically synthesized
acttaaccattattcacctttc

SEQ ID NO: 787896 - DNA, 22 bp, Artificial Sequence
  chemically synthesized
cacttaaccattattcaccttt

SEQ ID NO: 787897 - DNA, 22 bp, Artificial Sequence
  chemically synthesized
atgtggctgggaaaggtgaata

SEQ ID NO: 787898 - DNA, 22 bp, Artificial Sequence
  chemically synthesized
tgtggctgggaaaggtgaataa

SEQ ID NO: 787899 - DNA, 22 bp, Artificial Sequence
  chemically synthesized
taaacccttcacttaaccatta

SEQ ID NO: 787900 - DNA, 22 bp, Artificial Sequence
  chemically synthesized
ggaaaggtgaataatggttaag

SEQ ID NO: 787901 - DNA, 22 bp, Artificial Sequence
  chemically synthesized
gtaaacccttcacttaaccatt

SEQ ID NO: 787902 - DNA, 22 bp, Artificial Sequence
  chemically synthesized
tgtaaacccttcacttaaccat

SEQ ID NO: 787903 - DNA, 22 bp, Artificial Sequence
  chemically synthesized
agtgaagggtttacaaaatttg

SEQ ID NO: 787904 - DNA, 22 bp, Artificial Sequence
  chemically synthesized
accaaaaaatagtaacaaattt

SEQ ID NO: 787905 - DNA, 22 bp, Artificial Sequence
  chemically synthesized
attgaccaaaaaatagtaacaa

SEQ ID NO: 787906 - DNA, 22 bp, Artificial Sequence
  chemically synthesized
acaaaatttgttactatttttt

SEQ ID NO: 787907 - DNA, 22 bp, Artificial Sequence
  chemically synthesized
caaaatttgttactattttttg

SEQ ID NO: 787908 - DNA, 22 bp, Artificial Sequence
  chemically synthesized
gttactattttttggtcaatca

SEQ ID NO: 787909 - DNA, 22 bp, Artificial Sequence
  chemically synthesized
ttactattttttggtcaatcag

SEQ ID NO: 787910 - DNA, 22 bp, Artificial Sequence
  chemically synthesized
ctattttttggtcaatcagtat

SEQ ID NO: 787911 - DNA, 22 bp, Artificial Sequence
  chemically synthesized
ggtacatatgaagcatactgat

SEQ ID NO: 787912 - DNA, 22 bp, Artificial Sequence
  chemically synthesized
ttttttggtcaatcagtatgct

SEQ ID NO: 787913 - DNA, 22 bp, Artificial Sequence
  chemically synthesized
ctgggtacatatgaagcatact

SEQ ID NO: 787914 - DNA, 22 bp, Artificial Sequence
  chemically synthesized
tttggtcaatcagtatgcttca

SEQ ID NO: 787915 - DNA, 22 bp, Artificial Sequence
  chemically synthesized
ttggtcaatcagtatgcttcat

SEQ ID NO: 787916 - DNA, 22 bp, Artificial Sequence
  chemically synthesized
tggtcaatcagtatgcttcata

SEQ ID NO: 787917 - DNA, 22 bp, Artificial Sequence
  chemically synthesized
ggtcaatcagtatgcttcatat

SEQ ID NO: 787918 - DNA, 22 bp, Artificial Sequence
  chemically synthesized
gtcaatcagtatgcttcatatg

SEQ ID NO: 787919 - DNA, 22 bp, Artificial Sequence
  chemically synthesized
caagtcaagtagtgatattact

SEQ ID NO: 787920 - DNA, 22 bp, Artificial Sequence
  chemically synthesized
catatgtacccagtaatatcac

SEQ ID NO: 787921 - DNA, 22 bp, Artificial Sequence
  chemically synthesized
acaagtcaagtagtgatattac

SEQ ID NO: 787922 - DNA, 22 bp, Artificial Sequence
  chemically synthesized
atatgtacccagtaatatcact

SEQ ID NO: 787923 - DNA, 22 bp, Artificial Sequence
  chemically synthesized
tacaagtcaagtagtgatatta

SEQ ID NO: 787924 - DNA, 22 bp, Artificial Sequence
  chemically synthesized
ttttacaagtcaagtagtgata

SEQ ID NO: 787925 - DNA, 22 bp, Artificial Sequence
  chemically synthesized
gttttacaagtcaagtagtgat

SEQ ID NO: 787926 - DNA, 22 bp, Artificial Sequence
  chemically synthesized
tgttttacaagtcaagtagtga

SEQ ID NO: 787927 - DNA, 22 bp, Artificial Sequence
  chemically synthesized
tttgttttacaagtcaagtagt

SEQ ID NO: 787928 - DNA, 22 bp, Artificial Sequence
  chemically synthesized
ctttgttttacaagtcaagtag

SEQ ID NO: 787929 - DNA, 22 bp, Artificial Sequence
  chemically synthesized
tctttgttttacaagtcaagta

SEQ ID NO: 787930 - DNA, 22 bp, Artificial Sequence
  chemically synthesized
agttttctttgttttacaagtc

SEQ ID NO: 787931 - DNA, 22 bp, Artificial Sequence
  chemically synthesized
cagttttctttgttttacaagt

SEQ ID NO: 787932 - DNA, 22 bp, Artificial Sequence
  chemically synthesized
cttgacttgtaaaacaaagaaa

SEQ ID NO: 787933 - DNA, 22 bp, Artificial Sequence
  chemically synthesized
gacttgtaaaacaaagaaaact

SEQ ID NO: 787934 - DNA, 22 bp, Artificial Sequence
  chemically synthesized
acttgtaaaacaaagaaaactg

SEQ ID NO: 787935 - DNA, 22 bp, Artificial Sequence
  chemically synthesized
aacatgtcgatttcagttttct

SEQ ID NO: 787936 - DNA, 22 bp, Artificial Sequence
  chemically synthesized
aaacatgtcgatttcagttttc

SEQ ID NO: 787937 - DNA, 22 bp, Artificial Sequence
  chemically synthesized
taaacatgtcgatttcagtttt

SEQ ID NO: 787938 - DNA, 22 bp, Artificial Sequence
  chemically synthesized
gtaaaacaaagaaaactgaaat

SEQ ID NO: 787939 - DNA, 22 bp, Artificial Sequence
  chemically synthesized
ttaaacatgtcgatttcagttt

SEQ ID NO: 787940 - DNA, 22 bp, Artificial Sequence
  chemically synthesized
taaaacaaagaaaactgaaatc

SEQ ID NO: 787941 - DNA, 22 bp, Artificial Sequence
  chemically synthesized
tttaaacatgtcgatttcagtt

SEQ ID NO: 787942 - DNA, 22 bp, Artificial Sequence
  chemically synthesized
aaacagtggctttttaaacatg

SEQ ID NO: 787943 - DNA, 22 bp, Artificial Sequence
  chemically synthesized
aaatcgacatgtttaaaaagcc

SEQ ID NO: 787944 - DNA, 22 bp, Artificial Sequence
  chemically synthesized
gcatcatggagctaaaacagtg

SEQ ID NO: 787945 - DNA, 22 bp, Artificial Sequence
  chemically synthesized
attggcatcatggagctaaaac

SEQ ID NO: 787946 - DNA, 22 bp, Artificial Sequence
  chemically synthesized
aaaaagccactgttttagctcc

SEQ ID NO: 787947 - DNA, 22 bp, Artificial Sequence
  chemically synthesized
aaaagccactgttttagctcca

SEQ ID NO: 787948 - DNA, 22 bp, Artificial Sequence
  chemically synthesized
aaaattcattggcatcatggag

SEQ ID NO: 787949 - DNA, 22 bp, Artificial Sequence
  chemically synthesized
gaaaattcattggcatcatgga

SEQ ID NO: 787950 - DNA, 22 bp, Artificial Sequence
  chemically synthesized
ttttagctccatgatgccaatg

SEQ ID NO: 787951 - DNA, 22 bp, Artificial Sequence
  chemically synthesized
tagctccatgatgccaatgaat

SEQ ID NO: 787952 - DNA, 22 bp, Artificial Sequence
  chemically synthesized
agctccatgatgccaatgaatt

SEQ ID NO: 787953 - DNA, 22 bp, Artificial Sequence
  chemically synthesized
gctccatgatgccaatgaattt

SEQ ID NO: 787954 - DNA, 22 bp, Artificial Sequence
  chemically synthesized
catgatgccaatgaattttcaa

SEQ ID NO: 787955 - DNA, 22 bp, Artificial Sequence
  chemically synthesized
ggacagggaatccatgtagttt

SEQ ID NO: 787956 - DNA, 22 bp, Artificial Sequence
  chemically synthesized
aggacagggaatccatgtagtt

SEQ ID NO: 787957 - DNA, 22 bp, Artificial Sequence
  chemically synthesized
tcatttaggacagggaatccat

SEQ ID NO: 787958 - DNA, 22 bp, Artificial Sequence
  chemically synthesized
tcaaactacatggattccctgt

SEQ ID NO: 787959 - DNA, 22 bp, Artificial Sequence
  chemically synthesized
caaactacatggattccctgtc

SEQ ID NO: 787960 - DNA, 22 bp, Artificial Sequence
  chemically synthesized
aaactacatggattccctgtcc

SEQ ID NO: 787961 - DNA, 22 bp, Artificial Sequence
  chemically synthesized
catggattccctgtcctaaatg

SEQ ID NO: 787962 - DNA, 22 bp, Artificial Sequence
  chemically synthesized
atagtaatctgtcatttaggac

SEQ ID NO: 787963 - DNA, 22 bp, Artificial Sequence
  chemically synthesized
acattgatagtaatctgtcatt

SEQ ID NO: 787964 - DNA, 22 bp, Artificial Sequence
  chemically synthesized
tcacattgatagtaatctgtca

SEQ ID NO: 787965 - DNA, 22 bp, Artificial Sequence
  chemically synthesized
cctgtcctaaatgacagattac

SEQ ID NO: 787966 - DNA, 22 bp, Artificial Sequence
  chemically synthesized
tcctaaatgacagattactatc

SEQ ID NO: 787967 - DNA, 22 bp, Artificial Sequence
  chemically synthesized
taactctcacattgatagtaat

SEQ ID NO: 787968 - DNA, 22 bp, Artificial Sequence
  chemically synthesized
aatgacagattactatcaatgt

SEQ ID NO: 787969 - DNA, 22 bp, Artificial Sequence
  chemically synthesized
aagataagttgtaactctcaca

SEQ ID NO: 787970 - DNA, 22 bp, Artificial Sequence
  chemically synthesized
aaagataagttgtaactctcac

SEQ ID NO: 787971 - DNA, 22 bp, Artificial Sequence
  chemically synthesized
taaagataagttgtaactctca

SEQ ID NO: 787972 - DNA, 22 bp, Artificial Sequence
  chemically synthesized
ttaaagataagttgtaactctc

SEQ ID NO: 787973 - DNA, 22 bp, Artificial Sequence
  chemically synthesized
ctatcaatgtgagagttacaac

SEQ ID NO: 787974 - DNA, 22 bp, Artificial Sequence
  chemically synthesized
ttttaaagataagttgtaactc

SEQ ID NO: 787975 - DNA, 22 bp, Artificial Sequence
  chemically synthesized
cttttaaagataagttgtaact

SEQ ID NO: 787976 - DNA, 22 bp, Artificial Sequence
  chemically synthesized
tcaatgtgagagttacaactta

SEQ ID NO: 787977 - DNA, 22 bp, Artificial Sequence
  chemically synthesized
caacttatctttaaaagaaggg

SEQ ID NO: 787978 - DNA, 22 bp, Artificial Sequence
  chemically synthesized
atctttaaaagaaggggccctt

SEQ ID NO: 787979 - DNA, 22 bp, Artificial Sequence
  chemically synthesized
tctttaaaagaaggggcccttt

SEQ ID NO: 787980 - DNA, 22 bp, Artificial Sequence
  chemically synthesized
taaaagaaggggcccttttgat

SEQ ID NO: 787981 - DNA, 22 bp, Artificial Sequence
  chemically synthesized
aaaagaaggggcccttttgatg

SEQ ID NO: 787982 - DNA, 22 bp, Artificial Sequence
  chemically synthesized
aaagaaggggcccttttgatgt

SEQ ID NO: 787983 - DNA, 22 bp, Artificial Sequence
  chemically synthesized
caaataaaatgataacatcaaa

SEQ ID NO: 787984 - DNA, 22 bp, Artificial Sequence
  chemically synthesized
acaaataaaatgataacatcaa

SEQ ID NO: 787985 - DNA, 22 bp, Artificial Sequence
  chemically synthesized
atttacaaataaaatgataaca

SEQ ID NO: 787986 - DNA, 22 bp, Artificial Sequence
  chemically synthesized
ctaatttacaaataaaatgata

SEQ ID NO: 787987 - DNA, 22 bp, Artificial Sequence
  chemically synthesized
actaatttacaaataaaatgat

SEQ ID NO: 787988 - DNA, 22 bp, Artificial Sequence
  chemically synthesized
tactaatttacaaataaaatga

SEQ ID NO: 787989 - DNA, 22 bp, Artificial Sequence
  chemically synthesized
ttactaatttacaaataaaatg

SEQ ID NO: 787990 - DNA, 22 bp, Artificial Sequence
  chemically synthesized
ttgatgttatcattttatttgt

SEQ ID NO: 787991 - DNA, 22 bp, Artificial Sequence
  chemically synthesized
tgatgttatcattttatttgta

SEQ ID NO: 787992 - DNA, 22 bp, Artificial Sequence
  chemically synthesized
gatgttatcattttatttgtaa

SEQ ID NO: 787993 - DNA, 22 bp, Artificial Sequence
  chemically synthesized
atttttactaatttacaaataa

SEQ ID NO: 787994 - DNA, 22 bp, Artificial Sequence
  chemically synthesized
atgttatcattttatttgtaaa

SEQ ID NO: 787995 - DNA, 22 bp, Artificial Sequence
  chemically synthesized
aatttttactaatttacaaata

SEQ ID NO: 787996 - DNA, 22 bp, Artificial Sequence
  chemically synthesized
tcattttatttgtaaattagta

SEQ ID NO: 787997 - DNA, 22 bp, Artificial Sequence
  chemically synthesized
tatttgtaaattagtaaaaatt

SEQ ID NO: 787998 - DNA, 22 bp, Artificial Sequence
  chemically synthesized
ggtagaacatttaatttttact

SEQ ID NO: 787999 - DNA, 22 bp, Artificial Sequence
  chemically synthesized
atttgtaaattagtaaaaatta

SEQ ID NO: 788000 - DNA, 22 bp, Artificial Sequence
  chemically synthesized
tttgtaaattagtaaaaattaa

SEQ ID NO: 788001 - DNA, 22 bp, Artificial Sequence
  chemically synthesized
gtaaattagtaaaaattaaatg

SEQ ID NO: 788002 - DNA, 22 bp, Artificial Sequence
  chemically synthesized
taaattagtaaaaattaaatgt

SEQ ID NO: 788003 - DNA, 22 bp, Artificial Sequence
  chemically synthesized
aaaattaggtagaacatttaat

SEQ ID NO: 788004 - DNA, 22 bp, Artificial Sequence
  chemically synthesized
gttcaaaattaggtagaacatt

SEQ ID NO: 788005 - DNA, 22 bp, Artificial Sequence
  chemically synthesized
ggttcaaaattaggtagaacat

SEQ ID NO: 788006 - DNA, 22 bp, Artificial Sequence
  chemically synthesized
gtaaaaattaaatgttctacct

SEQ ID NO: 788007 - DNA, 22 bp, Artificial Sequence
  chemically synthesized
tggttcaaaattaggtagaaca

SEQ ID NO: 788008 - DNA, 22 bp, Artificial Sequence
  chemically synthesized
aatgttctacctaattttgaac

SEQ ID NO: 788009 - DNA, 22 bp, Artificial Sequence
  chemically synthesized
aatataaaggcaattttggttc

SEQ ID NO: 788010 - DNA, 22 bp, Artificial Sequence
  chemically synthesized
tacctaattttgaaccaaaatt

SEQ ID NO: 788011 - DNA, 22 bp, Artificial Sequence
  chemically synthesized
caatataaaggcaattttggtt

SEQ ID NO: 788012 - DNA, 22 bp, Artificial Sequence
  chemically synthesized
tcaatataaaggcaattttggt

SEQ ID NO: 788013 - DNA, 22 bp, Artificial Sequence
  chemically synthesized
cctaattttgaaccaaaattgc

SEQ ID NO: 788014 - DNA, 22 bp, Artificial Sequence
  chemically synthesized
ttcaatataaaggcaattttgg

SEQ ID NO: 788015 - DNA, 22 bp, Artificial Sequence
  chemically synthesized
tttcaatataaaggcaattttg

SEQ ID NO: 788016 - DNA, 22 bp, Artificial Sequence
  chemically synthesized
ttttcaatataaaggcaatttt

SEQ ID NO: 788017 - DNA, 22 bp, Artificial Sequence
  chemically synthesized
attttgaaccaaaattgccttt

SEQ ID NO: 788018 - DNA, 22 bp, Artificial Sequence
  chemically synthesized
tgaaccaaaattgcctttatat

SEQ ID NO: 788019 - DNA, 22 bp, Artificial Sequence
  chemically synthesized
gaaccaaaattgcctttatatt

SEQ ID NO: 788020 - DNA, 22 bp, Artificial Sequence
  chemically synthesized
aaccaaaattgcctttatattg

SEQ ID NO: 788021 - DNA, 22 bp, Artificial Sequence
  chemically synthesized
ggtgatttttttcaatataaag

SEQ ID NO: 788022 - DNA, 22 bp, Artificial Sequence
  chemically synthesized
aggtgatttttttcaatataaa

SEQ ID NO: 788023 - DNA, 22 bp, Artificial Sequence
  chemically synthesized
taggtgatttttttcaatataa

SEQ ID NO: 788024 - DNA, 22 bp, Artificial Sequence
  chemically synthesized
cctttatattgaaaaaaatcac

SEQ ID NO: 788025 - DNA, 22 bp, Artificial Sequence
  chemically synthesized
tatattgaaaaaaatcacctaa

SEQ ID NO: 788026 - DNA, 22 bp, Artificial Sequence
  chemically synthesized
atattgaaaaaaatcacctaaa

SEQ ID NO: 788027 - DNA, 22 bp, Artificial Sequence
  chemically synthesized
tattgaaaaaaatcacctaaaa

SEQ ID NO: 788028 - DNA, 22 bp, Artificial Sequence
  chemically synthesized
aaaaaaatcacctaaaacacat

SEQ ID NO: 788029 - DNA, 22 bp, Artificial Sequence
  chemically synthesized
atatatatcatcgatgtgtttt

SEQ ID NO: 788030 - DNA, 22 bp, Artificial Sequence
  chemically synthesized
taatattaatatatatcatcga

SEQ ID NO: 788031 - DNA, 22 bp, Artificial Sequence
  chemically synthesized
aaacacatcgatgatatatatt

SEQ ID NO: 788032 - DNA, 22 bp, Artificial Sequence
  chemically synthesized
aaatagaataaagctataatat

SEQ ID NO: 788033 - DNA, 22 bp, Artificial Sequence
  chemically synthesized
cctaaaatagaataaagctata

SEQ ID NO: 788034 - DNA, 22 bp, Artificial Sequence
  chemically synthesized
acctaaaatagaataaagctat

SEQ ID NO: 788035 - DNA, 22 bp, Artificial Sequence
  chemically synthesized
atattatagctttattctattt

SEQ ID NO: 788036 - DNA, 22 bp, Artificial Sequence
  chemically synthesized
tatagtttacctaaaatagaat

SEQ ID NO: 788037 - DNA, 22 bp, Artificial Sequence
  chemically synthesized
gtatagtttacctaaaatagaa

SEQ ID NO: 788038 - DNA, 22 bp, Artificial Sequence
  chemically synthesized
tagctttattctattttaggta

SEQ ID NO: 788039 - DNA, 22 bp, Artificial Sequence
  chemically synthesized
tattctattttaggtaaactat

SEQ ID NO: 788040 - DNA, 22 bp, Artificial Sequence
  chemically synthesized
atggaagtttgtatagtttacc

SEQ ID NO: 788041 - DNA, 22 bp, Artificial Sequence
  chemically synthesized
attctattttaggtaaactata

SEQ ID NO: 788042 - DNA, 22 bp, Artificial Sequence
  chemically synthesized
ttctattttaggtaaactatac

SEQ ID NO: 788043 - DNA, 22 bp, Artificial Sequence
  chemically synthesized
tattttaggtaaactatacaaa

SEQ ID NO: 788044 - DNA, 22 bp, Artificial Sequence
  chemically synthesized
atgttaatggaagtttgtatag

SEQ ID NO: 788045 - DNA, 22 bp, Artificial Sequence
  chemically synthesized
ttttaggtaaactatacaaact

SEQ ID NO: 788046 - DNA, 22 bp, Artificial Sequence
  chemically synthesized
taggtaaactatacaaacttcc

SEQ ID NO: 788047 - DNA, 22 bp, Artificial Sequence
  chemically synthesized
gttgatgttaatggaagtttgt

SEQ ID NO: 788048 - DNA, 22 bp, Artificial Sequence
  chemically synthesized
aggtaaactatacaaacttcca

SEQ ID NO: 788049 - DNA, 22 bp, Artificial Sequence
  chemically synthesized
ggtaaactatacaaacttccat

SEQ ID NO: 788050 - DNA, 22 bp, Artificial Sequence
  chemically synthesized
tggttgatgttaatggaagttt

SEQ ID NO: 788051 - DNA, 22 bp, Artificial Sequence
  chemically synthesized
tctggttgatgttaatggaagt

SEQ ID NO: 788052 - DNA, 22 bp, Artificial Sequence
  chemically synthesized
tacaaacttccattaacatcaa

SEQ ID NO: 788053 - DNA, 22 bp, Artificial Sequence
  chemically synthesized
ccattaacatcaaccagagaga

SEQ ID NO: 788054 - DNA, 22 bp, Artificial Sequence
  chemically synthesized
cattaacatcaaccagagagac

SEQ ID NO: 788055 - DNA, 22 bp, Artificial Sequence
  chemically synthesized
acatcaaccagagagactccca

SEQ ID NO: 788056 - DNA, 22 bp, Artificial Sequence
  chemically synthesized
tgtcaatatgtgtgggagtctc

SEQ ID NO: 788057 - DNA, 22 bp, Artificial Sequence
  chemically synthesized
acataacatattgtgtcaatat

SEQ ID NO: 788058 - DNA, 22 bp, Artificial Sequence
  chemically synthesized
atctaacataacatattgtgtc

SEQ ID NO: 788059 - DNA, 22 bp, Artificial Sequence
  chemically synthesized
ccacacatattgacacaatatg

SEQ ID NO: 788060 - DNA, 22 bp, Artificial Sequence
  chemically synthesized
tgatctaacataacatattgtg

SEQ ID NO: 788061 - DNA, 22 bp, Artificial Sequence
  chemically synthesized
ctctgatctaacataacatatt

SEQ ID NO: 788062 - DNA, 22 bp, Artificial Sequence
  chemically synthesized
gcactgctctgatctaacataa

SEQ ID NO: 788063 - DNA, 22 bp, Artificial Sequence
  chemically synthesized
acacaatatgttatgttagatc

SEQ ID NO: 788064 - DNA, 22 bp, Artificial Sequence
  chemically synthesized
aatgactagcactgctctgatc

SEQ ID NO: 788065 - DNA, 22 bp, Artificial Sequence
  chemically synthesized
aaactcaatgactagcactgct

SEQ ID NO: 788066 - DNA, 22 bp, Artificial Sequence
  chemically synthesized
tgttagatcagagcagtgctag

SEQ ID NO: 788067 - DNA, 22 bp, Artificial Sequence
  chemically synthesized
aaaactcaatgactagcactgc

SEQ ID NO: 788068 - DNA, 22 bp, Artificial Sequence
  chemically synthesized
taaaactcaatgactagcactg

SEQ ID NO: 788069 - DNA, 22 bp, Artificial Sequence
  chemically synthesized
gatcagagcagtgctagtcatt

SEQ ID NO: 788070 - DNA, 22 bp, Artificial Sequence
  chemically synthesized
caggattttaaaactcaatgac

SEQ ID NO: 788071 - DNA, 22 bp, Artificial Sequence
  chemically synthesized
ccaggattttaaaactcaatga

SEQ ID NO: 788072 - DNA, 22 bp, Artificial Sequence
  chemically synthesized
atatttccaggattttaaaact

SEQ ID NO: 788073 - DNA, 22 bp, Artificial Sequence
  chemically synthesized
aatatttccaggattttaaaac

SEQ ID NO: 788074 - DNA, 22 bp, Artificial Sequence
  chemically synthesized
gtcattgagttttaaaatcctg

SEQ ID NO: 788075 - DNA, 22 bp, Artificial Sequence
  chemically synthesized
cagtaagtttaatatttccagg

SEQ ID NO: 788076 - DNA, 22 bp, Artificial Sequence
  chemically synthesized
agttttaaaatcctggaaatat

SEQ ID NO: 788077 - DNA, 22 bp, Artificial Sequence
  chemically synthesized
tccagtaagtttaatatttcca

SEQ ID NO: 788078 - DNA, 22 bp, Artificial Sequence
  chemically synthesized
taaaatcctggaaatattaaac

SEQ ID NO: 788079 - DNA, 22 bp, Artificial Sequence
  chemically synthesized
aaaatcctggaaatattaaact

SEQ ID NO: 788080 - DNA, 22 bp, Artificial Sequence
  chemically synthesized
aaatcctggaaatattaaactt

SEQ ID NO: 788081 - DNA, 22 bp, Artificial Sequence
  chemically synthesized
taatgttctccagtaagtttaa

SEQ ID NO: 788082 - DNA, 22 bp, Artificial Sequence
  chemically synthesized
gaaatattaaacttactggaga

SEQ ID NO: 788083 - DNA, 22 bp, Artificial Sequence
  chemically synthesized
cagataacctataatgttctcc

SEQ ID NO: 788084 - DNA, 22 bp, Artificial Sequence
  chemically synthesized
aacttactggagaacattatag

SEQ ID NO: 788085 - DNA, 22 bp, Artificial Sequence
  chemically synthesized
atgcctacagataacctataat

SEQ ID NO: 788086 - DNA, 22 bp, Artificial Sequence
  chemically synthesized
actggagaacattataggttat

SEQ ID NO: 788087 - DNA, 22 bp, Artificial Sequence
  chemically synthesized
tgatgcctacagataacctata

SEQ ID NO: 788088 - DNA, 22 bp, Artificial Sequence
  chemically synthesized
ctggagaacattataggttatc

SEQ ID NO: 788089 - DNA, 22 bp, Artificial Sequence
  chemically synthesized
gagaacattataggttatctgt

SEQ ID NO: 788090 - DNA, 22 bp, Artificial Sequence
  chemically synthesized
taaatctctgatgcctacagat

SEQ ID NO: 788091 - DNA, 22 bp, Artificial Sequence
  chemically synthesized
taggttatctgtaggcatcaga

SEQ ID NO: 788092 - DNA, 22 bp, Artificial Sequence
  chemically synthesized
tctgtaggcatcagagatttat

SEQ ID NO: 788093 - DNA, 22 bp, Artificial Sequence
  chemically synthesized
caccccatatagcctataaatc

SEQ ID NO: 788094 - DNA, 22 bp, Artificial Sequence
  chemically synthesized
taggcatcagagatttataggc

SEQ ID NO: 788095 - DNA, 22 bp, Artificial Sequence
  chemically synthesized
ccaccccatatagcctataaat

SEQ ID NO: 788096 - DNA, 22 bp, Artificial Sequence
  chemically synthesized
tccaccccatatagcctataaa

SEQ ID NO: 788097 - DNA, 22 bp, Artificial Sequence
  chemically synthesized
acatgcattttccaccccatat

SEQ ID NO: 788098 - DNA, 22 bp, Artificial Sequence
  chemically synthesized
ataggctatatggggtggaaaa

SEQ ID NO: 788099 - DNA, 22 bp, Artificial Sequence
  chemically synthesized
taggctatatggggtggaaaat

SEQ ID NO: 788100 - DNA, 22 bp, Artificial Sequence
  chemically synthesized
aggttcacatgcattttccacc

SEQ ID NO: 788101 - DNA, 22 bp, Artificial Sequence
  chemically synthesized
gaggttcacatgcattttccac

SEQ ID NO: 788102 - DNA, 22 bp, Artificial Sequence
  chemically synthesized
tgaggttcacatgcattttcca

SEQ ID NO: 788103 - DNA, 22 bp, Artificial Sequence
  chemically synthesized
ttttgaggttcacatgcatttt

SEQ ID NO: 788104 - DNA, 22 bp, Artificial Sequence
  chemically synthesized
tatggggtggaaaatgcatgtg

SEQ ID NO: 788105 - DNA, 22 bp, Artificial Sequence
  chemically synthesized
aaggttgttttgaggttcacat

SEQ ID NO: 788106 - DNA, 22 bp, Artificial Sequence
  chemically synthesized
caaggttgttttgaggttcaca

SEQ ID NO: 788107 - DNA, 22 bp, Artificial Sequence
  chemically synthesized
tacttcaaggttgttttgaggt

SEQ ID NO: 788108 - DNA, 22 bp, Artificial Sequence
  chemically synthesized
cctatacttcaaggttgttttg

SEQ ID NO: 788109 - DNA, 22 bp, Artificial Sequence
  chemically synthesized
gcctatacttcaaggttgtttt

SEQ ID NO: 788110 - DNA, 22 bp, Artificial Sequence
  chemically synthesized
tcttgcctatacttcaaggttg

SEQ ID NO: 788111 - DNA, 22 bp, Artificial Sequence
  chemically synthesized
aaaacaaccttgaagtataggc

SEQ ID NO: 788112 - DNA, 22 bp, Artificial Sequence
  chemically synthesized
atgacacctgtcttgcctatac

SEQ ID NO: 788113 - DNA, 22 bp, Artificial Sequence
  chemically synthesized
gaagtataggcaagacaggtgt

SEQ ID NO: 788114 - DNA, 22 bp, Artificial Sequence
  chemically synthesized
aagtataggcaagacaggtgtc

SEQ ID NO: 788115 - DNA, 22 bp, Artificial Sequence
  chemically synthesized
tgaaataagattaatgacacct

SEQ ID NO: 788116 - DNA, 22 bp, Artificial Sequence
  chemically synthesized
cgcatctgtgaaataagattaa

SEQ ID NO: 788117 - DNA, 22 bp, Artificial Sequence
  chemically synthesized
agcatcaatctccgcatctgtg

SEQ ID NO: 788118 - DNA, 22 bp, Artificial Sequence
  chemically synthesized
tcagcatcaatctccgcatctg

SEQ ID NO: 788119 - DNA, 22 bp, Artificial Sequence
  chemically synthesized
atcttatttcacagatgcggag

SEQ ID NO: 788120 - DNA, 22 bp, Artificial Sequence
  chemically synthesized
tctcagcatcaatctccgcatc

SEQ ID NO: 788121 - DNA, 22 bp, Artificial Sequence
  chemically synthesized
ctctcagcatcaatctccgcat

SEQ ID NO: 788122 - DNA, 22 bp, Artificial Sequence
  chemically synthesized
atttcacagatgcggagattga

SEQ ID NO: 788123 - DNA, 22 bp, Artificial Sequence
  chemically synthesized
tttcacagatgcggagattgat

SEQ ID NO: 788124 - DNA, 22 bp, Artificial Sequence
  chemically synthesized
acttctctcagcatcaatctcc

SEQ ID NO: 788125 - DNA, 22 bp, Artificial Sequence
  chemically synthesized
aacttctctcagcatcaatctc

SEQ ID NO: 788126 - DNA, 22 bp, Artificial Sequence
  chemically synthesized
cacagatgcggagattgatgct

SEQ ID NO: 788127 - DNA, 22 bp, Artificial Sequence
  chemically synthesized
ttaacttctctcagcatcaatc

SEQ ID NO: 788128 - DNA, 22 bp, Artificial Sequence
  chemically synthesized
acagatgcggagattgatgctg

SEQ ID NO: 788129 - DNA, 22 bp, Artificial Sequence
  chemically synthesized
gggcaagtctcttaacttctct

SEQ ID NO: 788130 - DNA, 22 bp, Artificial Sequence
  chemically synthesized
agggcaagtctcttaacttctc

SEQ ID NO: 788131 - DNA, 22 bp, Artificial Sequence
  chemically synthesized
atgctgagagaagttaagagac

SEQ ID NO: 788132 - DNA, 22 bp, Artificial Sequence
  chemically synthesized
agagaagttaagagacttgccc

SEQ ID NO: 788133 - DNA, 22 bp, Artificial Sequence
  chemically synthesized
tagtgggatttagggcaagtct

SEQ ID NO: 788134 - DNA, 22 bp, Artificial Sequence
  chemically synthesized
tgtagtgggatttagggcaagt

SEQ ID NO: 788135 - DNA, 22 bp, Artificial Sequence
  chemically synthesized
agagacttgccctaaatcccac

SEQ ID NO: 788136 - DNA, 22 bp, Artificial Sequence
  chemically synthesized
cagtaaatgctctgtagtggga

SEQ ID NO: 788137 - DNA, 22 bp, Artificial Sequence
  chemically synthesized
gccctaaatcccactacagagc

SEQ ID NO: 788138 - DNA, 22 bp, Artificial Sequence
  chemically synthesized
ccctaaatcccactacagagca

SEQ ID NO: 788139 - DNA, 22 bp, Artificial Sequence
  chemically synthesized
ggttccagtaaatgctctgtag

SEQ ID NO: 788140 - DNA, 22 bp, Artificial Sequence
  chemically synthesized
aatcccactacagagcatttac

SEQ ID NO: 788141 - DNA, 22 bp, Artificial Sequence
  chemically synthesized
aaagccctgggttccagtaaat

SEQ ID NO: 788142 - DNA, 22 bp, Artificial Sequence
  chemically synthesized
cagagcatttactggaacccag

SEQ ID NO: 788143 - DNA, 22 bp, Artificial Sequence
  chemically synthesized
actggaacccagggcttttaac

SEQ ID NO: 788144 - DNA, 22 bp, Artificial Sequence
  chemically synthesized
ctggaacccagggcttttaact

SEQ ID NO: 788145 - DNA, 22 bp, Artificial Sequence
  chemically synthesized
gaacccagggcttttaacttat

SEQ ID NO: 788146 - DNA, 22 bp, Artificial Sequence
  chemically synthesized
cagtggaaagaccaagaaaata

SEQ ID NO: 788147 - DNA, 22 bp, Artificial Sequence
  chemically synthesized
ttaacttattttcttggtcttt

SEQ ID NO: 788148 - DNA, 22 bp, Artificial Sequence
  chemically synthesized
taacttattttcttggtctttc

SEQ ID NO: 788149 - DNA, 22 bp, Artificial Sequence
  chemically synthesized
aacttattttcttggtctttcc

SEQ ID NO: 788150 - DNA, 22 bp, Artificial Sequence
  chemically synthesized
acttattttcttggtctttcca

SEQ ID NO: 788151 - DNA, 22 bp, Artificial Sequence
  chemically synthesized
attttcttggtctttccactgc

SEQ ID NO: 788152 - DNA, 22 bp, Artificial Sequence
  chemically synthesized
ttttcttggtctttccactgca

SEQ ID NO: 788153 - DNA, 22 bp, Artificial Sequence
  chemically synthesized
tcttggtctttccactgcagcc

SEQ ID NO: 788154 - DNA, 22 bp, Artificial Sequence
  chemically synthesized
cttggtctttccactgcagccc

SEQ ID NO: 788155 - DNA, 22 bp, Artificial Sequence
  chemically synthesized
ttggtctttccactgcagccca

SEQ ID NO: 788156 - DNA, 22 bp, Artificial Sequence
  chemically synthesized
ggtctttccactgcagcccatg

SEQ ID NO: 788157 - DNA, 22 bp, Artificial Sequence
  chemically synthesized
gtctttccactgcagcccatgc

SEQ ID NO: 788158 - DNA, 22 bp, Artificial Sequence
  chemically synthesized
tccactgcagcccatgccatcc

SEQ ID NO: 788159 - DNA, 22 bp, Artificial Sequence
  chemically synthesized
ccactgcagcccatgccatcct

SEQ ID NO: 788160 - DNA, 22 bp, Artificial Sequence
  chemically synthesized
cactgcagcccatgccatcctg

SEQ ID NO: 788161 - DNA, 22 bp, Artificial Sequence
  chemically synthesized
cagcccatgccatcctgcctcc

SEQ ID NO: 788162 - DNA, 22 bp, Artificial Sequence
  chemically synthesized
tcacaagtgagtggaggcagga

SEQ ID NO: 788163 - DNA, 22 bp, Artificial Sequence
  chemically synthesized
caggctgtcacaagtgagtgga

SEQ ID NO: 788164 - DNA, 22 bp, Artificial Sequence
  chemically synthesized
tacaggctgtcacaagtgagtg

SEQ ID NO: 788165 - DNA, 22 bp, Artificial Sequence
  chemically synthesized
tctacaggctgtcacaagtgag

SEQ ID NO: 788166 - DNA, 22 bp, Artificial Sequence
  chemically synthesized
ttctctacaggctgtcacaagt

SEQ ID NO: 788167 - DNA, 22 bp, Artificial Sequence
  chemically synthesized
cctccactcacttgtgacagcc

SEQ ID NO: 788168 - DNA, 22 bp, Artificial Sequence
  chemically synthesized
catctgttctctacaggctgtc

SEQ ID NO: 788169 - DNA, 22 bp, Artificial Sequence
  chemically synthesized
cactcacttgtgacagcctgta

SEQ ID NO: 788170 - DNA, 22 bp, Artificial Sequence
  chemically synthesized
acatctgttctctacaggctgt

SEQ ID NO: 788171 - DNA, 22 bp, Artificial Sequence
  chemically synthesized
ttacatctgttctctacaggct

SEQ ID NO: 788172 - DNA, 22 bp, Artificial Sequence
  chemically synthesized
cttacatctgttctctacaggc

SEQ ID NO: 788173 - DNA, 22 bp, Artificial Sequence
  chemically synthesized
tcttacatctgttctctacagg

SEQ ID NO: 788174 - DNA, 22 bp, Artificial Sequence
  chemically synthesized
acttgtgacagcctgtagagaa

SEQ ID NO: 788175 - DNA, 22 bp, Artificial Sequence
  chemically synthesized
ttcttacatctgttctctacag

SEQ ID NO: 788176 - DNA, 22 bp, Artificial Sequence
  chemically synthesized
gtgacagcctgtagagaacaga

SEQ ID NO: 788177 - DNA, 22 bp, Artificial Sequence
  chemically synthesized
tgacagcctgtagagaacagat

SEQ ID NO: 788178 - DNA, 22 bp, Artificial Sequence
  chemically synthesized
gcaatttttcttacatctgttc

SEQ ID NO: 788179 - DNA, 22 bp, Artificial Sequence
  chemically synthesized
ggcaatttttcttacatctgtt

SEQ ID NO: 788180 - DNA, 22 bp, Artificial Sequence
  chemically synthesized
ttggcaatttttcttacatctg

SEQ ID NO: 788181 - DNA, 22 bp, Artificial Sequence
  chemically synthesized
tagagaacagatgtaagaaaaa

SEQ ID NO: 788182 - DNA, 22 bp, Artificial Sequence
  chemically synthesized
aactcttggcaatttttcttac

SEQ ID NO: 788183 - DNA, 22 bp, Artificial Sequence
  chemically synthesized
ctaaactcttggcaatttttct

SEQ ID NO: 788184 - DNA, 22 bp, Artificial Sequence
  chemically synthesized
gatactcctaaactcttggcaa

SEQ ID NO: 788185 - DNA, 22 bp, Artificial Sequence
  chemically synthesized
ggatactcctaaactcttggca

SEQ ID NO: 788186 - DNA, 22 bp, Artificial Sequence
  chemically synthesized
tttggatactcctaaactcttg

SEQ ID NO: 788187 - DNA, 22 bp, Artificial Sequence
  chemically synthesized
ttatttggatactcctaaactc

SEQ ID NO: 788188 - DNA, 22 bp, Artificial Sequence
  chemically synthesized
gttatttggatactcctaaact

SEQ ID NO: 788189 - DNA, 22 bp, Artificial Sequence
  chemically synthesized
tgttatttggatactcctaaac

SEQ ID NO: 788190 - DNA, 22 bp, Artificial Sequence
  chemically synthesized
ttgttatttggatactcctaaa

SEQ ID NO: 788191 - DNA, 22 bp, Artificial Sequence
  chemically synthesized
ccaagagtttaggagtatccaa

SEQ ID NO: 788192 - DNA, 22 bp, Artificial Sequence
  chemically synthesized
atagtttttgttatttggatac

SEQ ID NO: 788193 - DNA, 22 bp, Artificial Sequence
  chemically synthesized
aggagtatccaaataacaaaaa

SEQ ID NO: 788194 - DNA, 22 bp, Artificial Sequence
  chemically synthesized
atagtctgatagtttttgttat

SEQ ID NO: 788195 - DNA, 22 bp, Artificial Sequence
  chemically synthesized
ggagtatccaaataacaaaaac

SEQ ID NO: 788196 - DNA, 22 bp, Artificial Sequence
  chemically synthesized
gccaccctaatagtctgatagt

SEQ ID NO: 788197 - DNA, 22 bp, Artificial Sequence
  chemically synthesized
ccctggccaccctaatagtctg

SEQ ID NO: 788198 - DNA, 22 bp, Artificial Sequence
  chemically synthesized
tcccctggccaccctaatagtc

SEQ ID NO: 788199 - DNA, 22 bp, Artificial Sequence
  chemically synthesized
ctcccctggccaccctaatagt

SEQ ID NO: 788200 - DNA, 22 bp, Artificial Sequence
  chemically synthesized
tctcccctggccaccctaatag

SEQ ID NO: 788201 - DNA, 22 bp, Artificial Sequence
  chemically synthesized
tttctcccctggccaccctaat

SEQ ID NO: 788202 - DNA, 22 bp, Artificial Sequence
  chemically synthesized
tctttctcccctggccacccta

SEQ ID NO: 788203 - DNA, 22 bp, Artificial Sequence
  chemically synthesized
ctctttctcccctggccaccct

SEQ ID NO: 788204 - DNA, 22 bp, Artificial Sequence
  chemically synthesized
tcagactattagggtggccagg

SEQ ID NO: 788205 - DNA, 22 bp, Artificial Sequence
  chemically synthesized
ttctctttctcccctggccacc

SEQ ID NO: 788206 - DNA, 22 bp, Artificial Sequence
  chemically synthesized
tcttctctttctcccctggcca

SEQ ID NO: 788207 - DNA, 22 bp, Artificial Sequence
  chemically synthesized
ctctcttctctttctcccctgg

SEQ ID NO: 788208 - DNA, 22 bp, Artificial Sequence
  chemically synthesized
cctctcttctctttctcccctg

SEQ ID NO: 788209 - DNA, 22 bp, Artificial Sequence
  chemically synthesized
ttagggtggccaggggagaaag

SEQ ID NO: 788210 - DNA, 22 bp, Artificial Sequence
  chemically synthesized
atttcctctcttctctttctcc

SEQ ID NO: 788211 - DNA, 22 bp, Artificial Sequence
  chemically synthesized
gggtggccaggggagaaagaga

SEQ ID NO: 788212 - DNA, 22 bp, Artificial Sequence
  chemically synthesized
ctgatttcctctcttctctttc

SEQ ID NO: 788213 - DNA, 22 bp, Artificial Sequence
  chemically synthesized
cctgatttcctctcttctcttt

SEQ ID NO: 788214 - DNA, 22 bp, Artificial Sequence
  chemically synthesized
aaaaatcccagccttcctgatt

SEQ ID NO: 788215 - DNA, 22 bp, Artificial Sequence
  chemically synthesized
gaaaaatcccagccttcctgat

SEQ ID NO: 788216 - DNA, 22 bp, Artificial Sequence
  chemically synthesized
gggtgtgcccaaatggtttgaa

SEQ ID NO: 788217 - DNA, 22 bp, Artificial Sequence
  chemically synthesized
ggatttttcaaaccatttgggc

SEQ ID NO: 788218 - DNA, 22 bp, Artificial Sequence
  chemically synthesized
ttcaaaccatttgggcacaccc

SEQ ID NO: 788219 - DNA, 22 bp, Artificial Sequence
  chemically synthesized
tcaaaccatttgggcacacccc

SEQ ID NO: 788220 - DNA, 22 bp, Artificial Sequence
  chemically synthesized
caaaccatttgggcacacccca

SEQ ID NO: 788221 - DNA, 22 bp, Artificial Sequence
  chemically synthesized
aaaccatttgggcacaccccag

SEQ ID NO: 788222 - DNA, 22 bp, Artificial Sequence
  chemically synthesized
aatatgtcaggaataaacctgg

SEQ ID NO: 788223 - DNA, 22 bp, Artificial Sequence
  chemically synthesized
gggcacaccccaggtttattcc

SEQ ID NO: 788224 - DNA, 22 bp, Artificial Sequence
  chemically synthesized
ggcacaccccaggtttattcct

SEQ ID NO: 788225 - DNA, 22 bp, Artificial Sequence
  chemically synthesized
gtattcaatatgtcaggaataa

SEQ ID NO: 788226 - DNA, 22 bp, Artificial Sequence
  chemically synthesized
ggtattcaatatgtcaggaata

SEQ ID NO: 788227 - DNA, 22 bp, Artificial Sequence
  chemically synthesized
cagacttggtattcaatatgtc

SEQ ID NO: 788228 - DNA, 22 bp, Artificial Sequence
  chemically synthesized
acagacttggtattcaatatgt

SEQ ID NO: 788229 - DNA, 22 bp, Artificial Sequence
  chemically synthesized
attcctgacatattgaatacca

SEQ ID NO: 788230 - DNA, 22 bp, Artificial Sequence
  chemically synthesized
ttcctgacatattgaataccaa

SEQ ID NO: 788231 - DNA, 22 bp, Artificial Sequence
  chemically synthesized
tgacttacagacttggtattca

SEQ ID NO: 788232 - DNA, 22 bp, Artificial Sequence
  chemically synthesized
tgtgacttacagacttggtatt

SEQ ID NO: 788233 - DNA, 22 bp, Artificial Sequence
  chemically synthesized
ctgacatattgaataccaagtc

SEQ ID NO: 788234 - DNA, 22 bp, Artificial Sequence
  chemically synthesized
acatattgaataccaagtctgt

SEQ ID NO: 788235 - DNA, 22 bp, Artificial Sequence
  chemically synthesized
aattctgtgacttacagacttg

SEQ ID NO: 788236 - DNA, 22 bp, Artificial Sequence
  chemically synthesized
gaattctgtgacttacagactt

SEQ ID NO: 788237 - DNA, 22 bp, Artificial Sequence
  chemically synthesized
aataccaagtctgtaagtcaca

SEQ ID NO: 788238 - DNA, 22 bp, Artificial Sequence
  chemically synthesized
taatttgaattctgtgacttac

SEQ ID NO: 788239 - DNA, 22 bp, Artificial Sequence
  chemically synthesized
gtaatttgaattctgtgactta

SEQ ID NO: 788240 - DNA, 22 bp, Artificial Sequence
  chemically synthesized
tgtaatttgaattctgtgactt

SEQ ID NO: 788241 - DNA, 22 bp, Artificial Sequence
  chemically synthesized
atggtctttgtaatttgaattc

SEQ ID NO: 788242 - DNA, 22 bp, Artificial Sequence
  chemically synthesized
tgatggtctttgtaatttgaat

SEQ ID NO: 788243 - DNA, 22 bp, Artificial Sequence
  chemically synthesized
taagtcacagaattcaaattac

SEQ ID NO: 788244 - DNA, 22 bp, Artificial Sequence
  chemically synthesized
ctgatggtctttgtaatttgaa

SEQ ID NO: 788245 - DNA, 22 bp, Artificial Sequence
  chemically synthesized
tctgatggtctttgtaatttga

SEQ ID NO: 788246 - DNA, 22 bp, Artificial Sequence
  chemically synthesized
ctttctgatggtctttgtaatt

SEQ ID NO: 788247 - DNA, 22 bp, Artificial Sequence
  chemically synthesized
gctttctgatggtctttgtaat

SEQ ID NO: 788248 - DNA, 22 bp, Artificial Sequence
  chemically synthesized
aaattacaaagaccatcagaaa

SEQ ID NO: 788249 - DNA, 22 bp, Artificial Sequence
  chemically synthesized
caaagaccatcagaaagcaaga

SEQ ID NO: 788250 - DNA, 22 bp, Artificial Sequence
  chemically synthesized
gtagcgcatcaaaaatcttgct

SEQ ID NO: 788251 - DNA, 22 bp, Artificial Sequence
  chemically synthesized
tggtagcgcatcaaaaatcttg

SEQ ID NO: 788252 - DNA, 22 bp, Artificial Sequence
  chemically synthesized
agtggctctggtagcgcatcaa

SEQ ID NO: 788253 - DNA, 22 bp, Artificial Sequence
  chemically synthesized
gtctaagtggctctggtagcgc

SEQ ID NO: 788254 - DNA, 22 bp, Artificial Sequence
  chemically synthesized
aattagtctaagtggctctggt

SEQ ID NO: 788255 - DNA, 22 bp, Artificial Sequence
  chemically synthesized
ttgatgcgctaccagagccact

SEQ ID NO: 788256 - DNA, 22 bp, Artificial Sequence
  chemically synthesized
tgaattagtctaagtggctctg

SEQ ID NO: 788257 - DNA, 22 bp, Artificial Sequence
  chemically synthesized
tgatgcgctaccagagccactt

SEQ ID NO: 788258 - DNA, 22 bp, Artificial Sequence
  chemically synthesized
ctgaattagtctaagtggctct

SEQ ID NO: 788259 - DNA, 22 bp, Artificial Sequence
  chemically synthesized
gatgcgctaccagagccactta

SEQ ID NO: 788260 - DNA, 22 bp, Artificial Sequence
  chemically synthesized
atgcgctaccagagccacttag

SEQ ID NO: 788261 - DNA, 22 bp, Artificial Sequence
  chemically synthesized
gtttctgaattagtctaagtgg

SEQ ID NO: 788262 - DNA, 22 bp, Artificial Sequence
  chemically synthesized
agtttctgaattagtctaagtg

SEQ ID NO: 788263 - DNA, 22 bp, Artificial Sequence
  chemically synthesized
ccagagccacttagactaattc

SEQ ID NO: 788264 - DNA, 22 bp, Artificial Sequence
  chemically synthesized
atcttagtttctgaattagtct

SEQ ID NO: 788265 - DNA, 22 bp, Artificial Sequence
  chemically synthesized
agactaattcagaaactaagat

SEQ ID NO: 788266 - DNA, 22 bp, Artificial Sequence
  chemically synthesized
taggccagcctcatcttagttt

SEQ ID NO: 788267 - DNA, 22 bp, Artificial Sequence
  chemically synthesized
gactaattcagaaactaagatg

SEQ ID NO: 788268 - DNA, 22 bp, Artificial Sequence
  chemically synthesized
ataggccagcctcatcttagtt

SEQ ID NO: 788269 - DNA, 22 bp, Artificial Sequence
  chemically synthesized
atttataggccagcctcatctt

SEQ ID NO: 788270 - DNA, 22 bp, Artificial Sequence
  chemically synthesized
attcagaaactaagatgaggct

SEQ ID NO: 788271 - DNA, 22 bp, Artificial Sequence
  chemically synthesized
catttataggccagcctcatct

SEQ ID NO: 788272 - DNA, 22 bp, Artificial Sequence
  chemically synthesized
agaaactaagatgaggctggcc

SEQ ID NO: 788273 - DNA, 22 bp, Artificial Sequence
  chemically synthesized
ccaataagcttcatttataggc

SEQ ID NO: 788274 - DNA, 22 bp, Artificial Sequence
  chemically synthesized
agatgaggctggcctataaatg

SEQ ID NO: 788275 - DNA, 22 bp, Artificial Sequence
  chemically synthesized
tatctaccaataagcttcattt

SEQ ID NO: 788276 - DNA, 22 bp, Artificial Sequence
  chemically synthesized
gcctataaatgaagcttattgg

SEQ ID NO: 788277 - DNA, 22 bp, Artificial Sequence
  chemically synthesized
taaatgaagcttattggtagat

SEQ ID NO: 788278 - DNA, 22 bp, Artificial Sequence
  chemically synthesized
gagtaccagttgtatctaccaa

SEQ ID NO: 788279 - DNA, 22 bp, Artificial Sequence
  chemically synthesized
ccctggagtaccagttgtatct

SEQ ID NO: 788280 - DNA, 22 bp, Artificial Sequence
  chemically synthesized
ctgccctggagtaccagttgta

SEQ ID NO: 788281 - DNA, 22 bp, Artificial Sequence
  chemically synthesized
gctgccctggagtaccagttgt

SEQ ID NO: 788282 - DNA, 22 bp, Artificial Sequence
  chemically synthesized
tgctgccctggagtaccagttg

SEQ ID NO: 788283 - DNA, 22 bp, Artificial Sequence
  chemically synthesized
attggtagatacaactggtact

SEQ ID NO: 788284 - DNA, 22 bp, Artificial Sequence
  chemically synthesized
ttggtagatacaactggtactc

SEQ ID NO: 788285 - DNA, 22 bp, Artificial Sequence
  chemically synthesized
cctttgctgccctggagtacca

SEQ ID NO: 788286 - DNA, 22 bp, Artificial Sequence
  chemically synthesized
gtagatacaactggtactccag

SEQ ID NO: 788287 - DNA, 22 bp, Artificial Sequence
  chemically synthesized
ccctttgctgccctggagtacc

SEQ ID NO: 788288 - DNA, 22 bp, Artificial Sequence
  chemically synthesized
tcttccctttgctgccctggag

SEQ ID NO: 788289 - DNA, 22 bp, Artificial Sequence
  chemically synthesized
atcttccctttgctgccctgga

SEQ ID NO: 788290 - DNA, 22 bp, Artificial Sequence
  chemically synthesized
tttatcttccctttgctgccct

SEQ ID NO: 788291 - DNA, 22 bp, Artificial Sequence
  chemically synthesized
atttatcttccctttgctgccc

SEQ ID NO: 788292 - DNA, 22 bp, Artificial Sequence
  chemically synthesized
gtactccagggcagcaaaggga

SEQ ID NO: 788293 - DNA, 22 bp, Artificial Sequence
  chemically synthesized
cacagatttatttatcttccct

SEQ ID NO: 788294 - DNA, 22 bp, Artificial Sequence
  chemically synthesized
cagggcagcaaagggaagataa

SEQ ID NO: 788295 - DNA, 22 bp, Artificial Sequence
  chemically synthesized
caaggtgacgcattgcacagat

SEQ ID NO: 788296 - DNA, 22 bp, Artificial Sequence
  chemically synthesized
ccaaggtgacgcattgcacaga

SEQ ID NO: 788297 - DNA, 22 bp, Artificial Sequence
  chemically synthesized
tccaaggtgacgcattgcacag

SEQ ID NO: 788298 - DNA, 22 bp, Artificial Sequence
  chemically synthesized
ttccaaggtgacgcattgcaca

SEQ ID NO: 788299 - DNA, 22 bp, Artificial Sequence
  chemically synthesized
acttttccaaggtgacgcattg

SEQ ID NO: 788300 - DNA, 22 bp, Artificial Sequence
  chemically synthesized
tgcaatgcgtcaccttggaaaa

SEQ ID NO: 788301 - DNA, 22 bp, Artificial Sequence
  chemically synthesized
aataaatagcaattgacttttc

SEQ ID NO: 788302 - DNA, 22 bp, Artificial Sequence
  chemically synthesized
ggaaaagtcaattgctatttat

SEQ ID NO: 788303 - DNA, 22 bp, Artificial Sequence
  chemically synthesized
aaatgaagttaaataaatagca

SEQ ID NO: 788304 - DNA, 22 bp, Artificial Sequence
  chemically synthesized
gaaaagtcaattgctatttatt

SEQ ID NO: 788305 - DNA, 22 bp, Artificial Sequence
  chemically synthesized
gttgaaatgaagttaaataaat

SEQ ID NO: 788306 - DNA, 22 bp, Artificial Sequence
  chemically synthesized
ttggttgaaatgaagttaaata

SEQ ID NO: 788307 - DNA, 22 bp, Artificial Sequence
  chemically synthesized
ctatttatttaacttcatttca

SEQ ID NO: 788308 - DNA, 22 bp, Artificial Sequence
  chemically synthesized
tttatttaacttcatttcaacc

SEQ ID NO: 788309 - DNA, 22 bp, Artificial Sequence
  chemically synthesized
ataataattgttggttgaaatg

SEQ ID NO: 788310 - DNA, 22 bp, Artificial Sequence
  chemically synthesized
atttaacttcatttcaaccaac

SEQ ID NO: 788311 - DNA, 22 bp, Artificial Sequence
  chemically synthesized
ttaataataattgttggttgaa

SEQ ID NO: 788312 - DNA, 22 bp, Artificial Sequence
  chemically synthesized
tttaacttcatttcaaccaaca

SEQ ID NO: 788313 - DNA, 22 bp, Artificial Sequence
  chemically synthesized
ttgttaataataattgttggtt

SEQ ID NO: 788314 - DNA, 22 bp, Artificial Sequence
  chemically synthesized
aacttcatttcaaccaacaatt

SEQ ID NO: 788315 - DNA, 22 bp, Artificial Sequence
  chemically synthesized
acttcatttcaaccaacaatta

SEQ ID NO: 788316 - DNA, 22 bp, Artificial Sequence
  chemically synthesized
catttcaaccaacaattattat

SEQ ID NO: 788317 - DNA, 22 bp, Artificial Sequence
  chemically synthesized
atttcaaccaacaattattatt

SEQ ID NO: 788318 - DNA, 22 bp, Artificial Sequence
  chemically synthesized
caaccaacaattattattaaca

SEQ ID NO: 788319 - DNA, 22 bp, Artificial Sequence
  chemically synthesized
aaccaacaattattattaacaa

SEQ ID NO: 788320 - DNA, 22 bp, Artificial Sequence
  chemically synthesized
aacaagatacgtggttgttgtt

SEQ ID NO: 788321 - DNA, 22 bp, Artificial Sequence
  chemically synthesized
caacaagatacgtggttgttgt

SEQ ID NO: 788322 - DNA, 22 bp, Artificial Sequence
  chemically synthesized
tcaacaagatacgtggttgttg

SEQ ID NO: 788323 - DNA, 22 bp, Artificial Sequence
  chemically synthesized
ttattaacaacaaccacgtatc

SEQ ID NO: 788324 - DNA, 22 bp, Artificial Sequence
  chemically synthesized
ataattttcaacaagatacgtg

SEQ ID NO: 788325 - DNA, 22 bp, Artificial Sequence
  chemically synthesized
ttaacaacaaccacgtatcttg

SEQ ID NO: 788326 - DNA, 22 bp, Artificial Sequence
  chemically synthesized
ttcataattttcaacaagatac

SEQ ID NO: 788327 - DNA, 22 bp, Artificial Sequence
  chemically synthesized
acaacaaccacgtatcttgttg

SEQ ID NO: 788328 - DNA, 22 bp, Artificial Sequence
  chemically synthesized
tattcataattttcaacaagat

SEQ ID NO: 788329 - DNA, 22 bp, Artificial Sequence
  chemically synthesized
atcattctattcataattttca

SEQ ID NO: 788330 - DNA, 22 bp, Artificial Sequence
  chemically synthesized
ttaatcattctattcataattt

SEQ ID NO: 788331 - DNA, 22 bp, Artificial Sequence
  chemically synthesized
tcctgttaatcattctattcat

SEQ ID NO: 788332 - DNA, 22 bp, Artificial Sequence
  chemically synthesized
gtcctgttaatcattctattca

SEQ ID NO: 788333 - DNA, 22 bp, Artificial Sequence
  chemically synthesized
gttgaaaattatgaatagaatg

SEQ ID NO: 788334 - DNA, 22 bp, Artificial Sequence
  chemically synthesized
tgtcctgttaatcattctattc

SEQ ID NO: 788335 - DNA, 22 bp, Artificial Sequence
  chemically synthesized
ttgaaaattatgaatagaatga

SEQ ID NO: 788336 - DNA, 22 bp, Artificial Sequence
  chemically synthesized
aaaattatgaatagaatgatta

SEQ ID NO: 788337 - DNA, 22 bp, Artificial Sequence
  chemically synthesized
tgaatagaatgattaacaggac

SEQ ID NO: 788338 - DNA, 22 bp, Artificial Sequence
  chemically synthesized
aaggcaatgattttgtcctgtt

SEQ ID NO: 788339 - DNA, 22 bp, Artificial Sequence
  chemically synthesized
ttgaaggcaatgattttgtcct

SEQ ID NO: 788340 - DNA, 22 bp, Artificial Sequence
  chemically synthesized
attgaaggcaatgattttgtcc

SEQ ID NO: 788341 - DNA, 22 bp, Artificial Sequence
  chemically synthesized
tgaacttattgaaggcaatgat

SEQ ID NO: 788342 - DNA, 22 bp, Artificial Sequence
  chemically synthesized
acaggacaaaatcattgccttc

SEQ ID NO: 788343 - DNA, 22 bp, Artificial Sequence
  chemically synthesized
tcagctgtgaacttattgaagg

SEQ ID NO: 788344 - DNA, 22 bp, Artificial Sequence
  chemically synthesized
atcagctgtgaacttattgaag

SEQ ID NO: 788345 - DNA, 22 bp, Artificial Sequence
  chemically synthesized
tatcagctgtgaacttattgaa

SEQ ID NO: 788346 - DNA, 22 bp, Artificial Sequence
  chemically synthesized
gagcctttatcagctgtgaact

SEQ ID NO: 788347 - DNA, 22 bp, Artificial Sequence
  chemically synthesized
agagcctttatcagctgtgaac

SEQ ID NO: 788348 - DNA, 22 bp, Artificial Sequence
  chemically synthesized
tagagcctttatcagctgtgaa

SEQ ID NO: 788349 - DNA, 22 bp, Artificial Sequence
  chemically synthesized
ccttcaataagttcacagctga

SEQ ID NO: 788350 - DNA, 22 bp, Artificial Sequence
  chemically synthesized
ttttagagcctttatcagctgt

SEQ ID NO: 788351 - DNA, 22 bp, Artificial Sequence
  chemically synthesized
caataagttcacagctgataaa

SEQ ID NO: 788352 - DNA, 22 bp, Artificial Sequence
  chemically synthesized
aataagttcacagctgataaag

SEQ ID NO: 788353 - DNA, 22 bp, Artificial Sequence
  chemically synthesized
gaaagccctgttttagagcctt

SEQ ID NO: 788354 - DNA, 22 bp, Artificial Sequence
  chemically synthesized
acagctgataaaggctctaaaa

SEQ ID NO: 788355 - DNA, 22 bp, Artificial Sequence
  chemically synthesized
ataaaggctctaaaacagggct

SEQ ID NO: 788356 - DNA, 22 bp, Artificial Sequence
  chemically synthesized
gcatacccattggaaagccctg

SEQ ID NO: 788357 - DNA, 22 bp, Artificial Sequence
  chemically synthesized
agcatacccattggaaagccct

SEQ ID NO: 788358 - DNA, 22 bp, Artificial Sequence
  chemically synthesized
taaaacagggctttccaatggg

SEQ ID NO: 788359 - DNA, 22 bp, Artificial Sequence
  chemically synthesized
aaacagggctttccaatgggta

SEQ ID NO: 788360 - DNA, 22 bp, Artificial Sequence
  chemically synthesized
tccaatgggtatgctaaggcac

SEQ ID NO: 788361 - DNA, 22 bp, Artificial Sequence
  chemically synthesized
ccaatgggtatgctaaggcaca

SEQ ID NO: 788362 - DNA, 22 bp, Artificial Sequence
  chemically synthesized
caatgggtatgctaaggcacat

SEQ ID NO: 788363 - DNA, 22 bp, Artificial Sequence
  chemically synthesized
taacccaatcagggcatgtgcc

SEQ ID NO: 788364 - DNA, 22 bp, Artificial Sequence
  chemically synthesized
aagtacctataacccaatcagg

SEQ ID NO: 788365 - DNA, 22 bp, Artificial Sequence
  chemically synthesized
aggcacatgccctgattgggtt

SEQ ID NO: 788366 - DNA, 22 bp, Artificial Sequence
  chemically synthesized
attgggttataggtacttcaga

SEQ ID NO: 788367 - DNA, 22 bp, Artificial Sequence
  chemically synthesized
agagggatcgatatctgaagta

SEQ ID NO: 788368 - DNA, 22 bp, Artificial Sequence
  chemically synthesized
ggttataggtacttcagatatc

SEQ ID NO: 788369 - DNA, 22 bp, Artificial Sequence
  chemically synthesized
taggtacttcagatatcgatcc

SEQ ID NO: 788370 - DNA, 22 bp, Artificial Sequence
  chemically synthesized
accatcccagggctgagaggga

SEQ ID NO: 788371 - DNA, 22 bp, Artificial Sequence
  chemically synthesized
cagatatcgatccctctcagcc

SEQ ID NO: 788372 - DNA, 22 bp, Artificial Sequence
  chemically synthesized
agatatcgatccctctcagccc

SEQ ID NO: 788373 - DNA, 22 bp, Artificial Sequence
  chemically synthesized
cctaaccatcccagggctgaga

SEQ ID NO: 788374 - DNA, 22 bp, Artificial Sequence
  chemically synthesized
agctgcctaaccatcccagggc

SEQ ID NO: 788375 - DNA, 22 bp, Artificial Sequence
  chemically synthesized
taagctgcctaaccatcccagg

SEQ ID NO: 788376 - DNA, 22 bp, Artificial Sequence
  chemically synthesized
tcagccctgggatggttaggca

SEQ ID NO: 788377 - DNA, 22 bp, Artificial Sequence
  chemically synthesized
agccctgggatggttaggcagc

SEQ ID NO: 788378 - DNA, 22 bp, Artificial Sequence
  chemically synthesized
gccgaagactctaagctgccta

SEQ ID NO: 788379 - DNA, 22 bp, Artificial Sequence
  chemically synthesized
ggatggttaggcagcttagagt

SEQ ID NO: 788380 - DNA, 22 bp, Artificial Sequence
  chemically synthesized
ggcagcttagagtcttcggcca

SEQ ID NO: 788381 - DNA, 22 bp, Artificial Sequence
  chemically synthesized
atcatgatatcaggtaagctgg

SEQ ID NO: 788382 - DNA, 22 bp, Artificial Sequence
  chemically synthesized
agagtcttcggccagcttacct

SEQ ID NO: 788383 - DNA, 22 bp, Artificial Sequence
  chemically synthesized
gagtcttcggccagcttacctg

SEQ ID NO: 788384 - DNA, 22 bp, Artificial Sequence
  chemically synthesized
atgtgttcatcatgatatcagg

SEQ ID NO: 788385 - DNA, 22 bp, Artificial Sequence
  chemically synthesized
cggccagcttacctgatatcat

SEQ ID NO: 788386 - DNA, 22 bp, Artificial Sequence
  chemically synthesized
ggccagcttacctgatatcatg

SEQ ID NO: 788387 - DNA, 22 bp, Artificial Sequence
  chemically synthesized
agttgatgtgttcatcatgata

SEQ ID NO: 788388 - DNA, 22 bp, Artificial Sequence
  chemically synthesized
acctgatatcatgatgaacaca

SEQ ID NO: 788389 - DNA, 22 bp, Artificial Sequence
  chemically synthesized
cctgatatcatgatgaacacat

SEQ ID NO: 788390 - DNA, 22 bp, Artificial Sequence
  chemically synthesized
atatcatgatgaacacatcaac

SEQ ID NO: 788391 - DNA, 22 bp, Artificial Sequence
  chemically synthesized
atatcatgatgaacagattaag

SEQ ID NO: 788392 - DNA, 22 bp, Artificial Sequence
  chemically synthesized
gatatcatgatgaacagattaa

SEQ ID NO: 788393 - DNA, 22 bp, Artificial Sequence
  chemically synthesized
tgatatcatgatgaacagatta

SEQ ID NO: 788394 - DNA, 22 bp, Artificial Sequence
  chemically synthesized
ttgatatcatgatgaacagatt

SEQ ID NO: 788395 - DNA, 22 bp, Artificial Sequence
  chemically synthesized
tttgatatcatgatgaacagat

SEQ ID NO: 788396 - DNA, 22 bp, Artificial Sequence
  chemically synthesized
agtctttttgatatcatgatga

SEQ ID NO: 788397 - DNA, 22 bp, Artificial Sequence
  chemically synthesized
ctcagtctttttgatatcatga

SEQ ID NO: 788398 - DNA, 22 bp, Artificial Sequence
  chemically synthesized
aatctgttcatcatgatatcaa

SEQ ID NO: 788399 - DNA, 22 bp, Artificial Sequence
  chemically synthesized
atctgttcatcatgatatcaaa

SEQ ID NO: 788400 - DNA, 22 bp, Artificial Sequence
  chemically synthesized
ttcatcatgatatcaaaaagac

SEQ ID NO: 788401 - DNA, 22 bp, Artificial Sequence
  chemically synthesized
cagtgttcctcagtctttttga

SEQ ID NO: 788402 - DNA, 22 bp, Artificial Sequence
  chemically synthesized
tgcagtgttcctcagtcttttt

SEQ ID NO: 788403 - DNA, 22 bp, Artificial Sequence
  chemically synthesized
atcatgatatcaaaaagactga

SEQ ID NO: 788404 - DNA, 22 bp, Artificial Sequence
  chemically synthesized
tctgcagtgttcctcagtcttt

SEQ ID NO: 788405 - DNA, 22 bp, Artificial Sequence
  chemically synthesized
ctctgcagtgttcctcagtctt

SEQ ID NO: 788406 - DNA, 22 bp, Artificial Sequence
  chemically synthesized
taagaaagcccaaacttctctg

SEQ ID NO: 788407 - DNA, 22 bp, Artificial Sequence
  chemically synthesized
aggaacactgcagagaagtttg

SEQ ID NO: 788408 - DNA, 22 bp, Artificial Sequence
  chemically synthesized
tgtaagaaagcccaaacttctc

SEQ ID NO: 788409 - DNA, 22 bp, Artificial Sequence
  chemically synthesized
ttctgtaagaaagcccaaactt

SEQ ID NO: 788410 - DNA, 22 bp, Artificial Sequence
  chemically synthesized
cagagaagtttgggctttctta

SEQ ID NO: 788411 - DNA, 22 bp, Artificial Sequence
  chemically synthesized
tacagtcagtctgttctgtaag

SEQ ID NO: 788412 - DNA, 22 bp, Artificial Sequence
  chemically synthesized
gggctttcttacagaacagact

SEQ ID NO: 788413 - DNA, 22 bp, Artificial Sequence
  chemically synthesized
agctatacagtcagtctgttct

SEQ ID NO: 788414 - DNA, 22 bp, Artificial Sequence
  chemically synthesized
ggctttcttacagaacagactg

SEQ ID NO: 788415 - DNA, 22 bp, Artificial Sequence
  chemically synthesized
agctaagctatacagtcagtct

SEQ ID NO: 788416 - DNA, 22 bp, Artificial Sequence
  chemically synthesized
tcttacagaacagactgactgt

SEQ ID NO: 788417 - DNA, 22 bp, Artificial Sequence
  chemically synthesized
cttacagaacagactgactgta

SEQ ID NO: 788418 - DNA, 22 bp, Artificial Sequence
  chemically synthesized
ttacagaacagactgactgtat

SEQ ID NO: 788419 - DNA, 22 bp, Artificial Sequence
  chemically synthesized
cctcagctaagctatacagtca

SEQ ID NO: 788420 - DNA, 22 bp, Artificial Sequence
  chemically synthesized
acagaacagactgactgtatag

SEQ ID NO: 788421 - DNA, 22 bp, Artificial Sequence
  chemically synthesized
cagaacagactgactgtatagc

SEQ ID NO: 788422 - DNA, 22 bp, Artificial Sequence
  chemically synthesized
cagatctccctcagctaagcta

SEQ ID NO: 788423 - DNA, 22 bp, Artificial Sequence
  chemically synthesized
gtctccagatctccctcagcta

SEQ ID NO: 788424 - DNA, 22 bp, Artificial Sequence
  chemically synthesized
actgtatagcttagctgaggga

SEQ ID NO: 788425 - DNA, 22 bp, Artificial Sequence
  chemically synthesized
tggtctccagatctccctcagc

SEQ ID NO: 788426 - DNA, 22 bp, Artificial Sequence
  chemically synthesized
ctggtctccagatctccctcag

SEQ ID NO: 788427 - DNA, 22 bp, Artificial Sequence
  chemically synthesized
tatagcttagctgagggagatc

SEQ ID NO: 788428 - DNA, 22 bp, Artificial Sequence
  chemically synthesized
agctgagggagatctggagacc

SEQ ID NO: 788429 - DNA, 22 bp, Artificial Sequence
  chemically synthesized
gaaacatcttctggtctccaga

SEQ ID NO: 788430 - DNA, 22 bp, Artificial Sequence
  chemically synthesized
gctgagggagatctggagacca

SEQ ID NO: 788431 - DNA, 22 bp, Artificial Sequence
  chemically synthesized
ggaaacatcttctggtctccag

SEQ ID NO: 788432 - DNA, 22 bp, Artificial Sequence
  chemically synthesized
ttggaaacatcttctggtctcc

SEQ ID NO: 788433 - DNA, 22 bp, Artificial Sequence
  chemically synthesized
cttggaaacatcttctggtctc

SEQ ID NO: 788434 - DNA, 22 bp, Artificial Sequence
  chemically synthesized
agggagatctggagaccagaag

SEQ ID NO: 788435 - DNA, 22 bp, Artificial Sequence
  chemically synthesized
tcacacttcttggaaacatctt

SEQ ID NO: 788436 - DNA, 22 bp, Artificial Sequence
  chemically synthesized
atcacacttcttggaaacatct

SEQ ID NO: 788437 - DNA, 22 bp, Artificial Sequence
  chemically synthesized
gagaccagaagatgtttccaag

SEQ ID NO: 788438 - DNA, 22 bp, Artificial Sequence
  chemically synthesized
agatttatcacacttcttggaa

SEQ ID NO: 788439 - DNA, 22 bp, Artificial Sequence
  chemically synthesized
agctgagatttatcacacttct

SEQ ID NO: 788440 - DNA, 22 bp, Artificial Sequence
  chemically synthesized
aagctgagatttatcacacttc

SEQ ID NO: 788441 - DNA, 22 bp, Artificial Sequence
  chemically synthesized
gcttaagctgagatttatcaca

SEQ ID NO: 788442 - DNA, 22 bp, Artificial Sequence
  chemically synthesized
tggcttaagctgagatttatca

SEQ ID NO: 788443 - DNA, 22 bp, Artificial Sequence
  chemically synthesized
ctggcttaagctgagatttatc

SEQ ID NO: 788444 - DNA, 22 bp, Artificial Sequence
  chemically synthesized
ccaagaagtgtgataaatctca

SEQ ID NO: 788445 - DNA, 22 bp, Artificial Sequence
  chemically synthesized
caagaagtgtgataaatctcag

SEQ ID NO: 788446 - DNA, 22 bp, Artificial Sequence
  chemically synthesized
tcttctggcttaagctgagatt

SEQ ID NO: 788447 - DNA, 22 bp, Artificial Sequence
  chemically synthesized
acctgtcttctggcttaagctg

SEQ ID NO: 788448 - DNA, 22 bp, Artificial Sequence
  chemically synthesized
tcacctgtcttctggcttaagc

SEQ ID NO: 788449 - DNA, 22 bp, Artificial Sequence
  chemically synthesized
acaaagactctcacctgtcttc

SEQ ID NO: 788450 - DNA, 22 bp, Artificial Sequence
  chemically synthesized
agcttaagccagaagacaggtg

SEQ ID NO: 788451 - DNA, 22 bp, Artificial Sequence
  chemically synthesized
aagccagaagacaggtgagagt

SEQ ID NO: 788452 - DNA, 22 bp, Artificial Sequence
  chemically synthesized
agccagaagacaggtgagagtc

SEQ ID NO: 788453 - DNA, 22 bp, Artificial Sequence
  chemically synthesized
aaatgttcacaaagactctcac

SEQ ID NO: 788454 - DNA, 22 bp, Artificial Sequence
  chemically synthesized
gctgaaatgttcacaaagactc

SEQ ID NO: 788455 - DNA, 22 bp, Artificial Sequence
  chemically synthesized
aactggctgaaatgttcacaaa

SEQ ID NO: 788456 - DNA, 22 bp, Artificial Sequence
  chemically synthesized
attaaactggctgaaatgttca

SEQ ID NO: 788457 - DNA, 22 bp, Artificial Sequence
  chemically synthesized
ctcattaaactggctgaaatgt

SEQ ID NO: 788458 - DNA, 22 bp, Artificial Sequence
  chemically synthesized
gattgctcattaaactggctga

SEQ ID NO: 788459 - DNA, 22 bp, Artificial Sequence
  chemically synthesized
tgtgaacatttcagccagttta

SEQ ID NO: 788460 - DNA, 22 bp, Artificial Sequence
  chemically synthesized
gtgaacatttcagccagtttaa

SEQ ID NO: 788461 - DNA, 22 bp, Artificial Sequence
  chemically synthesized
ttggattgctcattaaactggc

SEQ ID NO: 788462 - DNA, 22 bp, Artificial Sequence
  chemically synthesized
tgaacatttcagccagtttaat

SEQ ID NO: 788463 - DNA, 22 bp, Artificial Sequence
  chemically synthesized
atgttgttggattgctcattaa

SEQ ID NO: 788464 - DNA, 22 bp, Artificial Sequence
  chemically synthesized
aatgttgttggattgctcatta

SEQ ID NO: 788465 - DNA, 22 bp, Artificial Sequence
  chemically synthesized
cagccagtttaatgagcaatcc

SEQ ID NO: 788466 - DNA, 22 bp, Artificial Sequence
  chemically synthesized
agccagtttaatgagcaatcca

SEQ ID NO: 788467 - DNA, 22 bp, Artificial Sequence
  chemically synthesized
acatgtcttaatgttgttggat

SEQ ID NO: 788468 - DNA, 22 bp, Artificial Sequence
  chemically synthesized
gacatgtcttaatgttgttgga

SEQ ID NO: 788469 - DNA, 22 bp, Artificial Sequence
  chemically synthesized
aatgagcaatccaacaacatta

SEQ ID NO: 788470 - DNA, 22 bp, Artificial Sequence
  chemically synthesized
atgagcaatccaacaacattaa

SEQ ID NO: 788471 - DNA, 22 bp, Artificial Sequence
  chemically synthesized
atcttgacatgtcttaatgttg

SEQ ID NO: 788472 - DNA, 22 bp, Artificial Sequence
  chemically synthesized
ctaatcttgacatgtcttaatg

SEQ ID NO: 788473 - DNA, 22 bp, Artificial Sequence
  chemically synthesized
gctaatcttgacatgtcttaat

SEQ ID NO: 788474 - DNA, 22 bp, Artificial Sequence
  chemically synthesized
aagcttgctaatcttgacatgt

SEQ ID NO: 788475 - DNA, 22 bp, Artificial Sequence
  chemically synthesized
agacatgtcaagattagcaagc

SEQ ID NO: 788476 - DNA, 22 bp, Artificial Sequence
  chemically synthesized
tcacacaatctgaagcttgcta

SEQ ID NO: 788477 - DNA, 22 bp, Artificial Sequence
  chemically synthesized
atcacacaatctgaagcttgct

SEQ ID NO: 788478 - DNA, 22 bp, Artificial Sequence
  chemically synthesized
tatcacacaatctgaagcttgc

SEQ ID NO: 788479 - DNA, 22 bp, Artificial Sequence
  chemically synthesized
ttatcacacaatctgaagcttg

SEQ ID NO: 788480 - DNA, 22 bp, Artificial Sequence
  chemically synthesized
cacttttatcacacaatctgaa

SEQ ID NO: 788481 - DNA, 22 bp, Artificial Sequence
  chemically synthesized
gcacttttatcacacaatctga

SEQ ID NO: 788482 - DNA, 22 bp, Artificial Sequence
  chemically synthesized
tgcacttttatcacacaatctg

SEQ ID NO: 788483 - DNA, 22 bp, Artificial Sequence
  chemically synthesized
tttgcacttttatcacacaatc

SEQ ID NO: 788484 - DNA, 22 bp, Artificial Sequence
  chemically synthesized
gcaagcttcagattgtgtgata

SEQ ID NO: 788485 - DNA, 22 bp, Artificial Sequence
  chemically synthesized
gcgaactctttgcacttttatc

SEQ ID NO: 788486 - DNA, 22 bp, Artificial Sequence
  chemically synthesized
cagattgtgtgataaaagtgca

SEQ ID NO: 788487 - DNA, 22 bp, Artificial Sequence
  chemically synthesized
tagcgaactctttgcactttta

SEQ ID NO: 788488 - DNA, 22 bp, Artificial Sequence
  chemically synthesized
agattgtgtgataaaagtgcaa

SEQ ID NO: 788489 - DNA, 22 bp, Artificial Sequence
  chemically synthesized
tgtgataaaagtgcaaagagtt

SEQ ID NO: 788490 - DNA, 22 bp, Artificial Sequence
  chemically synthesized
agtatggctctagcgaactctt

SEQ ID NO: 788491 - DNA, 22 bp, Artificial Sequence
  chemically synthesized
ttcagtatggctctagcgaact

SEQ ID NO: 788492 - DNA, 22 bp, Artificial Sequence
  chemically synthesized
gctagagccatactgaataatt

SEQ ID NO: 788493 - DNA, 22 bp, Artificial Sequence
  chemically synthesized
gagccatactgaataatttgtc

SEQ ID NO: 788494 - DNA, 22 bp, Artificial Sequence
  chemically synthesized
gcagacaaaggtagaagagaaa

SEQ ID NO: 788495 - DNA, 22 bp, Artificial Sequence
  chemically synthesized
aataatttgtctttctcttcta

SEQ ID NO: 788496 - DNA, 22 bp, Artificial Sequence
  chemically synthesized
ttggcagacaaaggtagaagag

SEQ ID NO: 788497 - DNA, 22 bp, Artificial Sequence
  chemically synthesized
gtctttctcttctacctttgtc

SEQ ID NO: 788498 - DNA, 22 bp, Artificial Sequence
  chemically synthesized
tctttctcttctacctttgtct

SEQ ID NO: 788499 - DNA, 22 bp, Artificial Sequence
  chemically synthesized
tctcttctacctttgtctgcca

SEQ ID NO: 788500 - DNA, 22 bp, Artificial Sequence
  chemically synthesized
ctcttctacctttgtctgccaa

SEQ ID NO: 788501 - DNA, 22 bp, Artificial Sequence
  chemically synthesized
tcttctacctttgtctgccaac

SEQ ID NO: 788502 - DNA, 22 bp, Artificial Sequence
  chemically synthesized
ttctacctttgtctgccaacaa

SEQ ID NO: 788503 - DNA, 22 bp, Artificial Sequence
  chemically synthesized
ctacctttgtctgccaacaatt

SEQ ID NO: 788504 - DNA, 22 bp, Artificial Sequence
  chemically synthesized
gccaatgggtagaattgttggc

SEQ ID NO: 788505 - DNA, 22 bp, Artificial Sequence
  chemically synthesized
tacctttgtctgccaacaattc

SEQ ID NO: 788506 - DNA, 22 bp, Artificial Sequence
  chemically synthesized
ggccaatgggtagaattgttgg

SEQ ID NO: 788507 - DNA, 22 bp, Artificial Sequence
  chemically synthesized
cctttgtctgccaacaattcta

SEQ ID NO: 788508 - DNA, 22 bp, Artificial Sequence
  chemically synthesized
tgtctgccaacaattctaccca

SEQ ID NO: 788509 - DNA, 22 bp, Artificial Sequence
  chemically synthesized
gtctgccaacaattctacccat

SEQ ID NO: 788510 - DNA, 22 bp, Artificial Sequence
  chemically synthesized
tctgccaacaattctacccatt

SEQ ID NO: 788511 - DNA, 22 bp, Artificial Sequence
  chemically synthesized
ccaacaattctacccattggcc

SEQ ID NO: 788512 - DNA, 22 bp, Artificial Sequence
  chemically synthesized
gagaaagaagcatttggccaat

SEQ ID NO: 788513 - DNA, 22 bp, Artificial Sequence
  chemically synthesized
ttagagaaagaagcatttggcc

SEQ ID NO: 788514 - DNA, 22 bp, Artificial Sequence
  chemically synthesized
attagagaaagaagcatttggc

SEQ ID NO: 788515 - DNA, 22 bp, Artificial Sequence
  chemically synthesized
tacccattggccaaatgcttct

SEQ ID NO: 788516 - DNA, 22 bp, Artificial Sequence
  chemically synthesized
cccattggccaaatgcttcttt

SEQ ID NO: 788517 - DNA, 22 bp, Artificial Sequence
  chemically synthesized
gccaaatgcttctttctctaat

SEQ ID NO: 788518 - DNA, 22 bp, Artificial Sequence
  chemically synthesized
tgcaagaacaagaatttattag

SEQ ID NO: 788519 - DNA, 22 bp, Artificial Sequence
  chemically synthesized
ctttctctaataaattcttgtt

SEQ ID NO: 788520 - DNA, 22 bp, Artificial Sequence
  chemically synthesized
tttctctaataaattcttgttc

SEQ ID NO: 788521 - DNA, 22 bp, Artificial Sequence
  chemically synthesized
tctctaataaattcttgttctt

SEQ ID NO: 788522 - DNA, 22 bp, Artificial Sequence
  chemically synthesized
ctctaataaattcttgttcttg

SEQ ID NO: 788523 - DNA, 22 bp, Artificial Sequence
  chemically synthesized
tctaataaattcttgttcttgc

SEQ ID NO: 788524 - DNA, 22 bp, Artificial Sequence
  chemically synthesized
taataaattcttgttcttgcac

SEQ ID NO: 788525 - DNA, 22 bp, Artificial Sequence
  chemically synthesized
ataaattcttgttcttgcacaa

SEQ ID NO: 788526 - DNA, 22 bp, Artificial Sequence
  chemically synthesized
aaaggagcaagtgattgtgcaa

SEQ ID NO: 788527 - DNA, 22 bp, Artificial Sequence
  chemically synthesized
ttgttcttgcacaatcacttgc

SEQ ID NO: 788528 - DNA, 22 bp, Artificial Sequence
  chemically synthesized
gttcttgcacaatcacttgctc

SEQ ID NO: 788529 - DNA, 22 bp, Artificial Sequence
  chemically synthesized
ggtggttcaaaggagcaagtga

SEQ ID NO: 788530 - DNA, 22 bp, Artificial Sequence
  chemically synthesized
ttcttgcacaatcacttgctcc

SEQ ID NO: 788531 - DNA, 22 bp, Artificial Sequence
  chemically synthesized
aggtggttcaaaggagcaagtg

SEQ ID NO: 788532 - DNA, 22 bp, Artificial Sequence
  chemically synthesized
ttgcacaatcacttgctccttt

SEQ ID NO: 788533 - DNA, 22 bp, Artificial Sequence
  chemically synthesized
gcacaatcacttgctcctttga

SEQ ID NO: 788534 - DNA, 22 bp, Artificial Sequence
  chemically synthesized
cacaatcacttgctcctttgaa

SEQ ID NO: 788535 - DNA, 22 bp, Artificial Sequence
  chemically synthesized
ggaaacagcgatttaggtggtt

SEQ ID NO: 788536 - DNA, 22 bp, Artificial Sequence
  chemically synthesized
gggaaacagcgatttaggtggt

SEQ ID NO: 788537 - DNA, 22 bp, Artificial Sequence
  chemically synthesized
tgggaaacagcgatttaggtgg

SEQ ID NO: 788538 - DNA, 22 bp, Artificial Sequence
  chemically synthesized
gctcctttgaaccacctaaatc

SEQ ID NO: 788539 - DNA, 22 bp, Artificial Sequence
  chemically synthesized
ctcctttgaaccacctaaatcg

SEQ ID NO: 788540 - DNA, 22 bp, Artificial Sequence
  chemically synthesized
ctttgaaccacctaaatcgctg

SEQ ID NO: 788541 - DNA, 22 bp, Artificial Sequence
  chemically synthesized
tgaaccacctaaatcgctgttt

SEQ ID NO: 788542 - DNA, 22 bp, Artificial Sequence
  chemically synthesized
gaaccacctaaatcgctgtttc

SEQ ID NO: 788543 - DNA, 22 bp, Artificial Sequence
  chemically synthesized
aaccacctaaatcgctgtttcc

SEQ ID NO: 788544 - DNA, 22 bp, Artificial Sequence
  chemically synthesized
agcaaaccacattttgggaaac

SEQ ID NO: 788545 - DNA, 22 bp, Artificial Sequence
  chemically synthesized
ttcagcaaaccacattttggga

SEQ ID NO: 788546 - DNA, 22 bp, Artificial Sequence
  chemically synthesized
aatcgctgtttcccaaaatgtg

SEQ ID NO: 788547 - DNA, 22 bp, Artificial Sequence
  chemically synthesized
ctgttcagcaaaccacattttg

SEQ ID NO: 788548 - DNA, 22 bp, Artificial Sequence
  chemically synthesized
ccactactgttcagcaaaccac

SEQ ID NO: 788549 - DNA, 22 bp, Artificial Sequence
  chemically synthesized
tttcccaaaatgtggtttgctg

SEQ ID NO: 788550 - DNA, 22 bp, Artificial Sequence
  chemically synthesized
cccaaaatgtggtttgctgaac

SEQ ID NO: 788551 - DNA, 22 bp, Artificial Sequence
  chemically synthesized
cctaccactactgttcagcaaa

SEQ ID NO: 788552 - DNA, 22 bp, Artificial Sequence
  chemically synthesized
ccaaaatgtggtttgctgaaca

SEQ ID NO: 788553 - DNA, 22 bp, Artificial Sequence
  chemically synthesized
gctccctaccactactgttcag

SEQ ID NO: 788554 - DNA, 22 bp, Artificial Sequence
  chemically synthesized
gctgaacagtagtggtagggag

SEQ ID NO: 788555 - DNA, 22 bp, Artificial Sequence
  chemically synthesized
ctgaacagtagtggtagggagc

SEQ ID NO: 788556 - DNA, 22 bp, Artificial Sequence
  chemically synthesized
aacagtagtggtagggagccaa

SEQ ID NO: 788557 - DNA, 22 bp, Artificial Sequence
  chemically synthesized
tgtaacatggtaaattggctcc

SEQ ID NO: 788558 - DNA, 22 bp, Artificial Sequence
  chemically synthesized
tctgtgtaacatggtaaattgg

SEQ ID NO: 788559 - DNA, 22 bp, Artificial Sequence
  chemically synthesized
atctgtgtaacatggtaaattg

SEQ ID NO: 788560 - DNA, 22 bp, Artificial Sequence
  chemically synthesized
tttatctgtgtaacatggtaaa

SEQ ID NO: 788561 - DNA, 22 bp, Artificial Sequence
  chemically synthesized
taagctgtttatctgtgtaaca

SEQ ID NO: 788562 - DNA, 22 bp, Artificial Sequence
  chemically synthesized
aactataagctgtttatctgtg

SEQ ID NO: 788563 - DNA, 22 bp, Artificial Sequence
  chemically synthesized
aaactataagctgtttatctgt

SEQ ID NO: 788564 - DNA, 22 bp, Artificial Sequence
  chemically synthesized
accatgttacacagataaacag

SEQ ID NO: 788565 - DNA, 22 bp, Artificial Sequence
  chemically synthesized
ccatgttacacagataaacagc

SEQ ID NO: 788566 - DNA, 22 bp, Artificial Sequence
  chemically synthesized
aaatttaaactataagctgttt

SEQ ID NO: 788567 - DNA, 22 bp, Artificial Sequence
  chemically synthesized
cacagataaacagcttatagtt

SEQ ID NO: 788568 - DNA, 22 bp, Artificial Sequence
  chemically synthesized
aatgaatattaaaatttaaact

SEQ ID NO: 788569 - DNA, 22 bp, Artificial Sequence
  chemically synthesized
atagtttaaattttaatattca

SEQ ID NO: 788570 - DNA, 22 bp, Artificial Sequence
  chemically synthesized
tagtttaaattttaatattcat

SEQ ID NO: 788571 - DNA, 22 bp, Artificial Sequence
  chemically synthesized
atacagataaaactaaatgaat

SEQ ID NO: 788572 - DNA, 22 bp, Artificial Sequence
  chemically synthesized
aatacagataaaactaaatgaa

SEQ ID NO: 788573 - DNA, 22 bp, Artificial Sequence
  chemically synthesized
aaattttaatattcatttagtt

SEQ ID NO: 788574 - DNA, 22 bp, Artificial Sequence
  chemically synthesized
aattttaatattcatttagttt

SEQ ID NO: 788575 - DNA, 22 bp, Artificial Sequence
  chemically synthesized
cttaatacagataaaactaaat

SEQ ID NO: 788576 - DNA, 22 bp, Artificial Sequence
  chemically synthesized
ccttaatacagataaaactaaa

SEQ ID NO: 788577 - DNA, 22 bp, Artificial Sequence
  chemically synthesized
tccttaatacagataaaactaa

SEQ ID NO: 788578 - DNA, 22 bp, Artificial Sequence
  chemically synthesized
ttccttaatacagataaaacta

SEQ ID NO: 788579 - DNA, 22 bp, Artificial Sequence
  chemically synthesized
taatattcatttagttttatct

SEQ ID NO: 788580 - DNA, 22 bp, Artificial Sequence
  chemically synthesized
tttccttaatacagataaaact

SEQ ID NO: 788581 - DNA, 22 bp, Artificial Sequence
  chemically synthesized
aatattcatttagttttatctg

SEQ ID NO: 788582 - DNA, 22 bp, Artificial Sequence
  chemically synthesized
ttttccttaatacagataaaac

SEQ ID NO: 788583 - DNA, 22 bp, Artificial Sequence
  chemically synthesized
atattcatttagttttatctgt

SEQ ID NO: 788584 - DNA, 22 bp, Artificial Sequence
  chemically synthesized
atttagttttatctgtattaag

SEQ ID NO: 788585 - DNA, 22 bp, Artificial Sequence
  chemically synthesized
cagtgtttttttccttaataca

SEQ ID NO: 788586 - DNA, 22 bp, Artificial Sequence
  chemically synthesized
agttttatctgtattaaggaaa

SEQ ID NO: 788587 - DNA, 22 bp, Artificial Sequence
  chemically synthesized
gttttatctgtattaaggaaaa

SEQ ID NO: 788588 - DNA, 22 bp, Artificial Sequence
  chemically synthesized
atgttgcagtgtttttttcctt

SEQ ID NO: 788589 - DNA, 22 bp, Artificial Sequence
  chemically synthesized
tatctgtattaaggaaaaaaac

SEQ ID NO: 788590 - DNA, 22 bp, Artificial Sequence
  chemically synthesized
atctgtattaaggaaaaaaaca

SEQ ID NO: 788591 - DNA, 22 bp, Artificial Sequence
  chemically synthesized
tctgtattaaggaaaaaaacac

SEQ ID NO: 788592 - DNA, 22 bp, Artificial Sequence
  chemically synthesized
tagtctgatgttgcagtgtttt

SEQ ID NO: 788593 - DNA, 22 bp, Artificial Sequence
  chemically synthesized
tattaaggaaaaaaacactgca

SEQ ID NO: 788594 - DNA, 22 bp, Artificial Sequence
  chemically synthesized
aggaaaaaaacactgcaacatc

SEQ ID NO: 788595 - DNA, 22 bp, Artificial Sequence
  chemically synthesized
ccacaaaactgtagtctgatgt

SEQ ID NO: 788596 - DNA, 22 bp, Artificial Sequence
  chemically synthesized
caacatcagactacagttttgt

SEQ ID NO: 788597 - DNA, 22 bp, Artificial Sequence
  chemically synthesized
agtgataattcccacaaaactg

SEQ ID NO: 788598 - DNA, 22 bp, Artificial Sequence
  chemically synthesized
aagtgataattcccacaaaact

SEQ ID NO: 788599 - DNA, 22 bp, Artificial Sequence
  chemically synthesized
gccttaagtgataattcccaca

SEQ ID NO: 788600 - DNA, 22 bp, Artificial Sequence
  chemically synthesized
agccttaagtgataattcccac

SEQ ID NO: 788601 - DNA, 22 bp, Artificial Sequence
  chemically synthesized
tagccttaagtgataattccca

SEQ ID NO: 788602 - DNA, 22 bp, Artificial Sequence
  chemically synthesized
ttagccttaagtgataattccc

SEQ ID NO: 788603 - DNA, 22 bp, Artificial Sequence
  chemically synthesized
cagttttgtgggaattatcact

SEQ ID NO: 788604 - DNA, 22 bp, Artificial Sequence
  chemically synthesized
cttttagccttaagtgataatt

SEQ ID NO: 788605 - DNA, 22 bp, Artificial Sequence
  chemically synthesized
tgcttttagccttaagtgataa

SEQ ID NO: 788606 - DNA, 22 bp, Artificial Sequence
  chemically synthesized
ctgcttttagccttaagtgata

SEQ ID NO: 788607 - DNA, 22 bp, Artificial Sequence
  chemically synthesized
tctgcttttagccttaagtgat

SEQ ID NO: 788608 - DNA, 22 bp, Artificial Sequence
  chemically synthesized
tgtgggaattatcacttaaggc

SEQ ID NO: 788609 - DNA, 22 bp, Artificial Sequence
  chemically synthesized
gtgggaattatcacttaaggct

SEQ ID NO: 788610 - DNA, 22 bp, Artificial Sequence
  chemically synthesized
ttttctgcttttagccttaagt

SEQ ID NO: 788611 - DNA, 22 bp, Artificial Sequence
  chemically synthesized
tgggaattatcacttaaggcta

SEQ ID NO: 788612 - DNA, 22 bp, Artificial Sequence
  chemically synthesized
gttttctgcttttagccttaag

SEQ ID NO: 788613 - DNA, 22 bp, Artificial Sequence
  chemically synthesized
tgttttctgcttttagccttaa

SEQ ID NO: 788614 - DNA, 22 bp, Artificial Sequence
  chemically synthesized
attttgttttctgcttttagcc

SEQ ID NO: 788615 - DNA, 22 bp, Artificial Sequence
  chemically synthesized
tcacttaaggctaaaagcagaa

SEQ ID NO: 788616 - DNA, 22 bp, Artificial Sequence
  chemically synthesized
aaggctaaaagcagaaaacaaa

SEQ ID NO: 788617 - DNA, 22 bp, Artificial Sequence
  chemically synthesized
aaatcagctcattttgttttct

SEQ ID NO: 788618 - DNA, 22 bp, Artificial Sequence
  chemically synthesized
aggctaaaagcagaaaacaaaa

SEQ ID NO: 788619 - DNA, 22 bp, Artificial Sequence
  chemically synthesized
aaaatcagctcattttgttttc

SEQ ID NO: 788620 - DNA, 22 bp, Artificial Sequence
  chemically synthesized
ttaaaatcagctcattttgttt

SEQ ID NO: 788621 - DNA, 22 bp, Artificial Sequence
  chemically synthesized
cttaaaatcagctcattttgtt

SEQ ID NO: 788622 - DNA, 22 bp, Artificial Sequence
  chemically synthesized
tcttaaaatcagctcattttgt

SEQ ID NO: 788623 - DNA, 22 bp, Artificial Sequence
  chemically synthesized
ttcttaaaatcagctcattttg

SEQ ID NO: 788624 - DNA, 22 bp, Artificial Sequence
  chemically synthesized
aaagcagaaaacaaaatgagct

SEQ ID NO: 788625 - DNA, 22 bp, Artificial Sequence
  chemically synthesized
atgtttttcttaaaatcagctc

SEQ ID NO: 788626 - DNA, 22 bp, Artificial Sequence
  chemically synthesized
aatgtttttcttaaaatcagct

SEQ ID NO: 788627 - DNA, 22 bp, Artificial Sequence
  chemically synthesized
cttaatgtttttcttaaaatca

SEQ ID NO: 788628 - DNA, 22 bp, Artificial Sequence
  chemically synthesized
acttaatgtttttcttaaaatc

SEQ ID NO: 788629 - DNA, 22 bp, Artificial Sequence
  chemically synthesized
tttacttaatgtttttcttaaa

SEQ ID NO: 788630 - DNA, 22 bp, Artificial Sequence
  chemically synthesized
ttatttacttaatgtttttctt

SEQ ID NO: 788631 - DNA, 22 bp, Artificial Sequence
  chemically synthesized
attttaagaaaaacattaagta

SEQ ID NO: 788632 - DNA, 22 bp, Artificial Sequence
  chemically synthesized
taagaaaaacattaagtaaata

SEQ ID NO: 788633 - DNA, 22 bp, Artificial Sequence
  chemically synthesized
aagaaaaacattaagtaaataa

SEQ ID NO: 788634 - DNA, 22 bp, Artificial Sequence
  chemically synthesized
agaaaaacattaagtaaataat

SEQ ID NO: 788635 - DNA, 22 bp, Artificial Sequence
  chemically synthesized
aataacacatatactattattt

SEQ ID NO: 788636 - DNA, 22 bp, Artificial Sequence
  chemically synthesized
gaataacacatatactattatt

SEQ ID NO: 788637 - DNA, 22 bp, Artificial Sequence
  chemically synthesized
tgaataacacatatactattat

SEQ ID NO: 788638 - DNA, 22 bp, Artificial Sequence
  chemically synthesized
ttgaataacacatatactatta

SEQ ID NO: 788639 - DNA, 22 bp, Artificial Sequence
  chemically synthesized
agtaaataatagtatatgtgtt

SEQ ID NO: 788640 - DNA, 22 bp, Artificial Sequence
  chemically synthesized
aatcttttgaataacacatata

SEQ ID NO: 788641 - DNA, 22 bp, Artificial Sequence
  chemically synthesized
ttcaatcttttgaataacacat

SEQ ID NO: 788642 - DNA, 22 bp, Artificial Sequence
  chemically synthesized
cattgttcaatcttttgaataa

SEQ ID NO: 788643 - DNA, 22 bp, Artificial Sequence
  chemically synthesized
ttcaaaagattgaacaatggag

SEQ ID NO: 788644 - DNA, 22 bp, Artificial Sequence
  chemically synthesized
aaaagattgaacaatggagcgt

SEQ ID NO: 788645 - DNA, 22 bp, Artificial Sequence
  chemically synthesized
aacaatggagcgtatatttgtt

SEQ ID NO: 788646 - DNA, 22 bp, Artificial Sequence
  chemically synthesized
tcacagaagcaataggaaacaa

SEQ ID NO: 788647 - DNA, 22 bp, Artificial Sequence
  chemically synthesized
tggaaaattgtcacagaagcaa

SEQ ID NO: 788648 - DNA, 22 bp, Artificial Sequence
  chemically synthesized
atggaaaattgtcacagaagca

SEQ ID NO: 788649 - DNA, 22 bp, Artificial Sequence
  chemically synthesized
gtttcctattgcttctgtgaca

SEQ ID NO: 788650 - DNA, 22 bp, Artificial Sequence
  chemically synthesized
tttcctattgcttctgtgacaa

SEQ ID NO: 788651 - DNA, 22 bp, Artificial Sequence
  chemically synthesized
cctattgcttctgtgacaattt

SEQ ID NO: 788652 - DNA, 22 bp, Artificial Sequence
  chemically synthesized
ctattgcttctgtgacaatttt

SEQ ID NO: 788653 - DNA, 22 bp, Artificial Sequence
  chemically synthesized
ttgcttctgtgacaattttcca

SEQ ID NO: 788654 - DNA, 22 bp, Artificial Sequence
  chemically synthesized
ggccagtaagtttatggaaaat

SEQ ID NO: 788655 - DNA, 22 bp, Artificial Sequence
  chemically synthesized
cttctgtgacaattttccataa

SEQ ID NO: 788656 - DNA, 22 bp, Artificial Sequence
  chemically synthesized
aggccagtaagtttatggaaaa

SEQ ID NO: 788657 - DNA, 22 bp, Artificial Sequence
  chemically synthesized
taggccagtaagtttatggaaa

SEQ ID NO: 788658 - DNA, 22 bp, Artificial Sequence
  chemically synthesized
ctgtgacaattttccataaact

SEQ ID NO: 788659 - DNA, 22 bp, Artificial Sequence
  chemically synthesized
tgtgacaattttccataaactt

SEQ ID NO: 788660 - DNA, 22 bp, Artificial Sequence
  chemically synthesized
ttttaggccagtaagtttatgg

SEQ ID NO: 788661 - DNA, 22 bp, Artificial Sequence
  chemically synthesized
tgacaattttccataaacttac

SEQ ID NO: 788662 - DNA, 22 bp, Artificial Sequence
  chemically synthesized
tgttgttttaggccagtaagtt

SEQ ID NO: 788663 - DNA, 22 bp, Artificial Sequence
  chemically synthesized
gtgttgttttaggccagtaagt

SEQ ID NO: 788664 - DNA, 22 bp, Artificial Sequence
  chemically synthesized
tccataaacttactggcctaaa

SEQ ID NO: 788665 - DNA, 22 bp, Artificial Sequence
  chemically synthesized
ccataaacttactggcctaaaa

SEQ ID NO: 788666 - DNA, 22 bp, Artificial Sequence
  chemically synthesized
cataaacttactggcctaaaac

SEQ ID NO: 788667 - DNA, 22 bp, Artificial Sequence
  chemically synthesized
taagataatcaatttgtgttgt

SEQ ID NO: 788668 - DNA, 22 bp, Artificial Sequence
  chemically synthesized
actggcctaaaacaacacaaat

SEQ ID NO: 788669 - DNA, 22 bp, Artificial Sequence
  chemically synthesized
ctggcctaaaacaacacaaatt

SEQ ID NO: 788670 - DNA, 22 bp, Artificial Sequence
  chemically synthesized
gcctaaaacaacacaaattgat

SEQ ID NO: 788671 - DNA, 22 bp, Artificial Sequence
  chemically synthesized
caaaactataagataatcaatt

SEQ ID NO: 788672 - DNA, 22 bp, Artificial Sequence
  chemically synthesized
ccaaaactataagataatcaat

SEQ ID NO: 788673 - DNA, 22 bp, Artificial Sequence
  chemically synthesized
aaacaacacaaattgattatct

SEQ ID NO: 788674 - DNA, 22 bp, Artificial Sequence
  chemically synthesized
acttccaaaactataagataat

SEQ ID NO: 788675 - DNA, 22 bp, Artificial Sequence
  chemically synthesized
tgacttccaaaactataagata

SEQ ID NO: 788676 - DNA, 22 bp, Artificial Sequence
  chemically synthesized
ctgacttccaaaactataagat

SEQ ID NO: 788677 - DNA, 22 bp, Artificial Sequence
  chemically synthesized
aaacttctgacttccaaaacta

SEQ ID NO: 788678 - DNA, 22 bp, Artificial Sequence
  chemically synthesized
caaacttctgacttccaaaact

SEQ ID NO: 788679 - DNA, 22 bp, Artificial Sequence
  chemically synthesized
attatcttatagttttggaagt

SEQ ID NO: 788680 - DNA, 22 bp, Artificial Sequence
  chemically synthesized
tcttatagttttggaagtcaga

SEQ ID NO: 788681 - DNA, 22 bp, Artificial Sequence
  chemically synthesized
atagttttggaagtcagaagtt

SEQ ID NO: 788682 - DNA, 22 bp, Artificial Sequence
  chemically synthesized
tagttttggaagtcagaagttt

SEQ ID NO: 788683 - DNA, 22 bp, Artificial Sequence
  chemically synthesized
tggaagtcagaagtttgaaatg

SEQ ID NO: 788684 - DNA, 22 bp, Artificial Sequence
  chemically synthesized
atccatgaaacccatttcaaac

SEQ ID NO: 788685 - DNA, 22 bp, Artificial Sequence
  chemically synthesized
ggaagtcagaagtttgaaatgg

SEQ ID NO: 788686 - DNA, 22 bp, Artificial Sequence
  chemically synthesized
aatccatgaaacccatttcaaa

SEQ ID NO: 788687 - DNA, 22 bp, Artificial Sequence
  chemically synthesized
gaagtcagaagtttgaaatggg

SEQ ID NO: 788688 - DNA, 22 bp, Artificial Sequence
  chemically synthesized
taatccatgaaacccatttcaa

SEQ ID NO: 788689 - DNA, 22 bp, Artificial Sequence
  chemically synthesized
attttaatccatgaaacccatt

SEQ ID NO: 788690 - DNA, 22 bp, Artificial Sequence
  chemically synthesized
cattttaatccatgaaacccat

SEQ ID NO: 788691 - DNA, 22 bp, Artificial Sequence
  chemically synthesized
tcattttaatccatgaaaccca

SEQ ID NO: 788692 - DNA, 22 bp, Artificial Sequence
  chemically synthesized
gaaatgggtttcatggattaaa

SEQ ID NO: 788693 - DNA, 22 bp, Artificial Sequence
  chemically synthesized
aaatgggtttcatggattaaaa

SEQ ID NO: 788694 - DNA, 22 bp, Artificial Sequence
  chemically synthesized
ccaacactttcattttaatcca

SEQ ID NO: 788695 - DNA, 22 bp, Artificial Sequence
  chemically synthesized
catggattaaaatgaaagtgtt

SEQ ID NO: 788696 - DNA, 22 bp, Artificial Sequence
  chemically synthesized
atggattaaaatgaaagtgttg

SEQ ID NO: 788697 - DNA, 22 bp, Artificial Sequence
  chemically synthesized
agaaggagtatagccctgccaa

SEQ ID NO: 788698 - DNA, 22 bp, Artificial Sequence
  chemically synthesized
aaatgaaagtgttggcagggct

SEQ ID NO: 788699 - DNA, 22 bp, Artificial Sequence
  chemically synthesized
cagaaggagtatagccctgcca

SEQ ID NO: 788700 - DNA, 22 bp, Artificial Sequence
  chemically synthesized
ttcagaaggagtatagccctgc

SEQ ID NO: 788701 - DNA, 22 bp, Artificial Sequence
  chemically synthesized
cttcagaaggagtatagccctg

SEQ ID NO: 788702 - DNA, 22 bp, Artificial Sequence
  chemically synthesized
agcttcttcagaaggagtatag

SEQ ID NO: 788703 - DNA, 22 bp, Artificial Sequence
  chemically synthesized
taagcttcttcagaaggagtat

SEQ ID NO: 788704 - DNA, 22 bp, Artificial Sequence
  chemically synthesized
gcagggctatactccttctgaa

SEQ ID NO: 788705 - DNA, 22 bp, Artificial Sequence
  chemically synthesized
tcctctaagcttcttcagaagg

SEQ ID NO: 788706 - DNA, 22 bp, Artificial Sequence
  chemically synthesized
tactccttctgaagaagcttag

SEQ ID NO: 788707 - DNA, 22 bp, Artificial Sequence
  chemically synthesized
cttctgaagaagcttagaggac

SEQ ID NO: 788708 - DNA, 22 bp, Artificial Sequence
  chemically synthesized
ctgaagaagcttagaggacaat

SEQ ID NO: 788709 - DNA, 22 bp, Artificial Sequence
  chemically synthesized
tgaagaagcttagaggacaatc

SEQ ID NO: 788710 - DNA, 22 bp, Artificial Sequence
  chemically synthesized
aagaagcttagaggacaatcta

SEQ ID NO: 788711 - DNA, 22 bp, Artificial Sequence
  chemically synthesized
gaaaaggcagggaaatagattg

SEQ ID NO: 788712 - DNA, 22 bp, Artificial Sequence
  chemically synthesized
agaggacaatctatttccctgc

SEQ ID NO: 788713 - DNA, 22 bp, Artificial Sequence
  chemically synthesized
atgctggaaaaggcagggaaat

SEQ ID NO: 788714 - DNA, 22 bp, Artificial Sequence
  chemically synthesized
gaggacaatctatttccctgcc

SEQ ID NO: 788715 - DNA, 22 bp, Artificial Sequence
  chemically synthesized
gtagcatctaatgctggaaaag

SEQ ID NO: 788716 - DNA, 22 bp, Artificial Sequence
  chemically synthesized
tttccctgccttttccagcatt

SEQ ID NO: 788717 - DNA, 22 bp, Artificial Sequence
  chemically synthesized
ccctgccttttccagcattaga

SEQ ID NO: 788718 - DNA, 22 bp, Artificial Sequence
  chemically synthesized
cctgccttttccagcattagat

SEQ ID NO: 788719 - DNA, 22 bp, Artificial Sequence
  chemically synthesized
ccttttccagcattagatgcta

SEQ ID NO: 788720 - DNA, 22 bp, Artificial Sequence
  chemically synthesized
gccaaacaatgttggtagcatc

SEQ ID NO: 788721 - DNA, 22 bp, Artificial Sequence
  chemically synthesized
ttccagcattagatgctaccaa

SEQ ID NO: 788722 - DNA, 22 bp, Artificial Sequence
  chemically synthesized
tccagcattagatgctaccaac

SEQ ID NO: 788723 - DNA, 22 bp, Artificial Sequence
  chemically synthesized
ccagcattagatgctaccaaca

SEQ ID NO: 788724 - DNA, 22 bp, Artificial Sequence
  chemically synthesized
cagcattagatgctaccaacat

SEQ ID NO: 788725 - DNA, 22 bp, Artificial Sequence
  chemically synthesized
gatgctaccaacattgtttggc

SEQ ID NO: 788726 - DNA, 22 bp, Artificial Sequence
  chemically synthesized
ccaacattgtttggctaatggc

SEQ ID NO: 788727 - DNA, 22 bp, Artificial Sequence
  chemically synthesized
aagatagagaaaggggccatta

SEQ ID NO: 788728 - DNA, 22 bp, Artificial Sequence
  chemically synthesized
gaagatagagaaaggggccatt

SEQ ID NO: 788729 - DNA, 22 bp, Artificial Sequence
  chemically synthesized
tgaagatagagaaaggggccat

SEQ ID NO: 788730 - DNA, 22 bp, Artificial Sequence
  chemically synthesized
tttggctaatggcccctttctc

SEQ ID NO: 788731 - DNA, 22 bp, Artificial Sequence
  chemically synthesized
gctttgaagatagagaaagggg

SEQ ID NO: 788732 - DNA, 22 bp, Artificial Sequence
  chemically synthesized
ggctaatggcccctttctctat

SEQ ID NO: 788733 - DNA, 22 bp, Artificial Sequence
  chemically synthesized
ctggctttgaagatagagaaag

SEQ ID NO: 788734 - DNA, 22 bp, Artificial Sequence
  chemically synthesized
gctaatggcccctttctctatc

SEQ ID NO: 788735 - DNA, 22 bp, Artificial Sequence
  chemically synthesized
atggcccctttctctatcttca

SEQ ID NO: 788736 - DNA, 22 bp, Artificial Sequence
  chemically synthesized
tctctatcttcaaagccagcag

SEQ ID NO: 788737 - DNA, 22 bp, Artificial Sequence
  chemically synthesized
ctctatcttcaaagccagcagg

SEQ ID NO: 788738 - DNA, 22 bp, Artificial Sequence
  chemically synthesized
tctatcttcaaagccagcaggg

SEQ ID NO: 788739 - DNA, 22 bp, Artificial Sequence
  chemically synthesized
tatcttcaaagccagcaggggc

SEQ ID NO: 788740 - DNA, 22 bp, Artificial Sequence
  chemically synthesized
tcttcaaagccagcaggggcta

SEQ ID NO: 788741 - DNA, 22 bp, Artificial Sequence
  chemically synthesized
caaagccagcaggggctatctt

SEQ ID NO: 788742 - DNA, 22 bp, Artificial Sequence
  chemically synthesized
aaagccagcaggggctatcttc

SEQ ID NO: 788743 - DNA, 22 bp, Artificial Sequence
  chemically synthesized
tcttcatctctctgactcccac

SEQ ID NO: 788744 - DNA, 22 bp, Artificial Sequence
  chemically synthesized
catctctctgactcccactctc

SEQ ID NO: 788745 - DNA, 22 bp, Artificial Sequence
  chemically synthesized
atctctctgactcccactctcc

SEQ ID NO: 788746 - DNA, 22 bp, Artificial Sequence
  chemically synthesized
tctgactcccactctcctgctt

SEQ ID NO: 788747 - DNA, 22 bp, Artificial Sequence
  chemically synthesized
tgactcccactctcctgcttcc

SEQ ID NO: 788748 - DNA, 22 bp, Artificial Sequence
  chemically synthesized
actcccactctcctgcttccat

SEQ ID NO: 788749 - DNA, 22 bp, Artificial Sequence
  chemically synthesized
atataagtgaaaatggaagcag

SEQ ID NO: 788750 - DNA, 22 bp, Artificial Sequence
  chemically synthesized
ccactctcctgcttccattttc

SEQ ID NO: 788751 - DNA, 22 bp, Artificial Sequence
  chemically synthesized
tcctgcttccattttcacttat

SEQ ID NO: 788752 - DNA, 22 bp, Artificial Sequence
  chemically synthesized
ctgcttccattttcacttatat

SEQ ID NO: 788753 - DNA, 22 bp, Artificial Sequence
  chemically synthesized
accacagggttcatataagtga

SEQ ID NO: 788754 - DNA, 22 bp, Artificial Sequence
  chemically synthesized
cttccattttcacttatatgaa

SEQ ID NO: 788755 - DNA, 22 bp, Artificial Sequence
  chemically synthesized
atctaaccacagggttcatata

SEQ ID NO: 788756 - DNA, 22 bp, Artificial Sequence
  chemically synthesized
ccattttcacttatatgaaccc

SEQ ID NO: 788757 - DNA, 22 bp, Artificial Sequence
  chemically synthesized
cattttcacttatatgaaccct

SEQ ID NO: 788758 - DNA, 22 bp, Artificial Sequence
  chemically synthesized
tcacttatatgaaccctgtggt

SEQ ID NO: 788759 - DNA, 22 bp, Artificial Sequence
  chemically synthesized
cacttatatgaaccctgtggtt

SEQ ID NO: 788760 - DNA, 22 bp, Artificial Sequence
  chemically synthesized
acttatatgaaccctgtggtta

SEQ ID NO: 788761 - DNA, 22 bp, Artificial Sequence
  chemically synthesized
agatgggcctaatctaaccaca

SEQ ID NO: 788762 - DNA, 22 bp, Artificial Sequence
  chemically synthesized
atatgaaccctgtggttagatt

SEQ ID NO: 788763 - DNA, 22 bp, Artificial Sequence
  chemically synthesized
tatgaaccctgtggttagatta

SEQ ID NO: 788764 - DNA, 22 bp, Artificial Sequence
  chemically synthesized
ttcagatgggcctaatctaacc

SEQ ID NO: 788765 - DNA, 22 bp, Artificial Sequence
  chemically synthesized
tggactattcagatgggcctaa

SEQ ID NO: 788766 - DNA, 22 bp, Artificial Sequence
  chemically synthesized
atggactattcagatgggccta

SEQ ID NO: 788767 - DNA, 22 bp, Artificial Sequence
  chemically synthesized
tatggactattcagatgggcct

SEQ ID NO: 788768 - DNA, 22 bp, Artificial Sequence
  chemically synthesized
tggttagattaggcccatctga

SEQ ID NO: 788769 - DNA, 22 bp, Artificial Sequence
  chemically synthesized
gattaggcccatctgaatagtc

SEQ ID NO: 788770 - DNA, 22 bp, Artificial Sequence
  chemically synthesized
ggcccatctgaatagtccataa

SEQ ID NO: 788771 - DNA, 22 bp, Artificial Sequence
  chemically synthesized
agatggggagattttatggact

SEQ ID NO: 788772 - DNA, 22 bp, Artificial Sequence
  chemically synthesized
gagatggggagattttatggac

SEQ ID NO: 788773 - DNA, 22 bp, Artificial Sequence
  chemically synthesized
tgagatggggagattttatgga

SEQ ID NO: 788774 - DNA, 22 bp, Artificial Sequence
  chemically synthesized
aatagtccataaaatctcccca

SEQ ID NO: 788775 - DNA, 22 bp, Artificial Sequence
  chemically synthesized
agcaggtgactttgagatgggg

SEQ ID NO: 788776 - DNA, 22 bp, Artificial Sequence
  chemically synthesized
ctaagcaggtgactttgagatg

SEQ ID NO: 788777 - DNA, 22 bp, Artificial Sequence
  chemically synthesized
aggttgctaagcaggtgacttt

SEQ ID NO: 788778 - DNA, 22 bp, Artificial Sequence
  chemically synthesized
cccatctcaaagtcacctgctt

SEQ ID NO: 788779 - DNA, 22 bp, Artificial Sequence
  chemically synthesized
aaagtcacctgcttagcaacct

SEQ ID NO: 788780 - DNA, 22 bp, Artificial Sequence
  chemically synthesized
cagacggaattaaggttgctaa

SEQ ID NO: 788781 - DNA, 22 bp, Artificial Sequence
  chemically synthesized
atattccagacggaattaaggt

SEQ ID NO: 788782 - DNA, 22 bp, Artificial Sequence
  chemically synthesized
cttagcaaccttaattccgtct

SEQ ID NO: 788783 - DNA, 22 bp, Artificial Sequence
  chemically synthesized
agcaaccttaattccgtctgga

SEQ ID NO: 788784 - DNA, 22 bp, Artificial Sequence
  chemically synthesized
gcaaccttaattccgtctggaa

SEQ ID NO: 788785 - DNA, 22 bp, Artificial Sequence
  chemically synthesized
gcagtagggaattaatattcca

SEQ ID NO: 788786 - DNA, 22 bp, Artificial Sequence
  chemically synthesized
aattccgtctggaatattaatt

SEQ ID NO: 788787 - DNA, 22 bp, Artificial Sequence
  chemically synthesized
attccgtctggaatattaattc

SEQ ID NO: 788788 - DNA, 22 bp, Artificial Sequence
  chemically synthesized
cctggcagtagggaattaatat

SEQ ID NO: 788789 - DNA, 22 bp, Artificial Sequence
  chemically synthesized
cgtctggaatattaattcccta

SEQ ID NO: 788790 - DNA, 22 bp, Artificial Sequence
  chemically synthesized
tgctccctggcagtagggaatt

SEQ ID NO: 788791 - DNA, 22 bp, Artificial Sequence
  chemically synthesized
gaatattaattccctactgcca

SEQ ID NO: 788792 - DNA, 22 bp, Artificial Sequence
  chemically synthesized
tgaatatgctgtgctccctggc

SEQ ID NO: 788793 - DNA, 22 bp, Artificial Sequence
  chemically synthesized
attccctactgccagggagcac

SEQ ID NO: 788794 - DNA, 22 bp, Artificial Sequence
  chemically synthesized
cctactgccagggagcacagca

SEQ ID NO: 788795 - DNA, 22 bp, Artificial Sequence
  chemically synthesized
ctgccagggagcacagcatatt

SEQ ID NO: 788796 - DNA, 22 bp, Artificial Sequence
  chemically synthesized
ccagggagcacagcatattcac

SEQ ID NO: 788797 - DNA, 22 bp, Artificial Sequence
  chemically synthesized
atccccagaacctgtgaatatg

SEQ ID NO: 788798 - DNA, 22 bp, Artificial Sequence
  chemically synthesized
gaagatgttaatccccagaacc

SEQ ID NO: 788799 - DNA, 22 bp, Artificial Sequence
  chemically synthesized
acaggttctggggattaacatc

SEQ ID NO: 788800 - DNA, 22 bp, Artificial Sequence
  chemically synthesized
tggggattaacatcttcgaggg

SEQ ID NO: 788801 - DNA, 22 bp, Artificial Sequence
  chemically synthesized
gggattaacatcttcgaggggc

SEQ ID NO: 788802 - DNA, 22 bp, Artificial Sequence
  chemically synthesized
tggtaggcagaatcatgggccc

SEQ ID NO: 788803 - DNA, 22 bp, Artificial Sequence
  chemically synthesized
acatcttcgaggggcccatgat

SEQ ID NO: 788804 - DNA, 22 bp, Artificial Sequence
  chemically synthesized
cccctgtggtaggcagaatcat

SEQ ID NO: 788805 - DNA, 22 bp, Artificial Sequence
  chemically synthesized
ccccctgtggtaggcagaatca

SEQ ID NO: 788806 - DNA, 22 bp, Artificial Sequence
  chemically synthesized
cgaggggcccatgattctgcct

SEQ ID NO: 788807 - DNA, 22 bp, Artificial Sequence
  chemically synthesized
gaggggcccatgattctgccta

SEQ ID NO: 788808 - DNA, 22 bp, Artificial Sequence
  chemically synthesized
tttccccctgtggtaggcagaa

SEQ ID NO: 788809 - DNA, 22 bp, Artificial Sequence
  chemically synthesized
atttccccctgtggtaggcaga

SEQ ID NO: 788810 - DNA, 22 bp, Artificial Sequence
  chemically synthesized
tatttccccctgtggtaggcag

SEQ ID NO: 788811 - DNA, 22 bp, Artificial Sequence
  chemically synthesized
aagcaagttttatttccccctg

SEQ ID NO: 788812 - DNA, 22 bp, Artificial Sequence
  chemically synthesized
tgcctaccacagggggaaataa

SEQ ID NO: 788813 - DNA, 22 bp, Artificial Sequence
  chemically synthesized
gctaaagcaagttttatttccc

SEQ ID NO: 788814 - DNA, 22 bp, Artificial Sequence
  chemically synthesized
cctaccacagggggaaataaaa

SEQ ID NO: 788815 - DNA, 22 bp, Artificial Sequence
  chemically synthesized
ccacagggggaaataaaacttg

SEQ ID NO: 788816 - DNA, 22 bp, Artificial Sequence
  chemically synthesized
caatatccgattggctaaagca

SEQ ID NO: 788817 - DNA, 22 bp, Artificial Sequence
  chemically synthesized
agcctgcaatatccgattggct

SEQ ID NO: 788818 - DNA, 22 bp, Artificial Sequence
  chemically synthesized
cattaagcctgcaatatccgat

SEQ ID NO: 788819 - DNA, 22 bp, Artificial Sequence
  chemically synthesized
ccattaagcctgcaatatccga

SEQ ID NO: 788820 - DNA, 22 bp, Artificial Sequence
  chemically synthesized
gctttagccaatcggatattgc

SEQ ID NO: 788821 - DNA, 22 bp, Artificial Sequence
  chemically synthesized
ctttagccaatcggatattgca

SEQ ID NO: 788822 - DNA, 22 bp, Artificial Sequence
  chemically synthesized
cttccattaagcctgcaatatc

SEQ ID NO: 788823 - DNA, 22 bp, Artificial Sequence
  chemically synthesized
tagccaatcggatattgcaggc

SEQ ID NO: 788824 - DNA, 22 bp, Artificial Sequence
  chemically synthesized
agccaatcggatattgcaggct

SEQ ID NO: 788825 - DNA, 22 bp, Artificial Sequence
  chemically synthesized
gccaatcggatattgcaggctt

SEQ ID NO: 788826 - DNA, 22 bp, Artificial Sequence
  chemically synthesized
agcccctgcttccattaagcct

SEQ ID NO: 788827 - DNA, 22 bp, Artificial Sequence
  chemically synthesized
ttgagcccctgcttccattaag

SEQ ID NO: 788828 - DNA, 22 bp, Artificial Sequence
  chemically synthesized
gttgagcccctgcttccattaa

SEQ ID NO: 788829 - DNA, 22 bp, Artificial Sequence
  chemically synthesized
caggcttaatggaagcaggggc

SEQ ID NO: 788830 - DNA, 22 bp, Artificial Sequence
  chemically synthesized
aatggaagcaggggctcaacaa

SEQ ID NO: 788831 - DNA, 22 bp, Artificial Sequence
  chemically synthesized
atggaagcaggggctcaacaaa

SEQ ID NO: 788832 - DNA, 22 bp, Artificial Sequence
  chemically synthesized
aacaaattgtttacatgtttgc

SEQ ID NO: 788833 - DNA, 22 bp, Artificial Sequence
  chemically synthesized
aggtgaagagtggaagtgcaaa

SEQ ID NO: 788834 - DNA, 22 bp, Artificial Sequence
  chemically synthesized
tttacatgtttgcacttccact

SEQ ID NO: 788835 - DNA, 22 bp, Artificial Sequence
  chemically synthesized
acatgtttgcacttccactctt

SEQ ID NO: 788836 - DNA, 22 bp, Artificial Sequence
  chemically synthesized
catgtttgcacttccactcttc

SEQ ID NO: 788837 - DNA, 22 bp, Artificial Sequence
  chemically synthesized
tgaaggctgaggtgaagagtgg

SEQ ID NO: 788838 - DNA, 22 bp, Artificial Sequence
  chemically synthesized
gtgaaggctgaggtgaagagtg

SEQ ID NO: 788839 - DNA, 22 bp, Artificial Sequence
  chemically synthesized
tgtgaaggctgaggtgaagagt

SEQ ID NO: 788840 - DNA, 22 bp, Artificial Sequence
  chemically synthesized
ttgtgaaggctgaggtgaagag

SEQ ID NO: 788841 - DNA, 22 bp, Artificial Sequence
  chemically synthesized
tttgtgaaggctgaggtgaaga

SEQ ID NO: 788842 - DNA, 22 bp, Artificial Sequence
  chemically synthesized
gcacttccactcttcacctcag

SEQ ID NO: 788843 - DNA, 22 bp, Artificial Sequence
  chemically synthesized
cacttccactcttcacctcagc

SEQ ID NO: 788844 - DNA, 22 bp, Artificial Sequence
  chemically synthesized
ccactcttcacctcagccttca

SEQ ID NO: 788845 - DNA, 22 bp, Artificial Sequence
  chemically synthesized
cactcttcacctcagccttcac

SEQ ID NO: 788846 - DNA, 22 bp, Artificial Sequence
  chemically synthesized
ttcacctcagccttcacaaaaa

SEQ ID NO: 788847 - DNA, 22 bp, Artificial Sequence
  chemically synthesized
cacctcagccttcacaaaaagg

SEQ ID NO: 788848 - DNA, 22 bp, Artificial Sequence
  chemically synthesized
acctcagccttcacaaaaagga

SEQ ID NO: 788849 - DNA, 22 bp, Artificial Sequence
  chemically synthesized
accagcccgagcaagtcctttt

SEQ ID NO: 788850 - DNA, 22 bp, Artificial Sequence
  chemically synthesized
agccttcacaaaaaggacttgc

SEQ ID NO: 788851 - DNA, 22 bp, Artificial Sequence
  chemically synthesized
cacaaaaaggacttgctcgggc

SEQ ID NO: 788852 - DNA, 22 bp, Artificial Sequence
  chemically synthesized
acaaaaaggacttgctcgggct

SEQ ID NO: 788853 - DNA, 22 bp, Artificial Sequence
  chemically synthesized
cagcaggctaaccagcccgagc

SEQ ID NO: 788854 - DNA, 22 bp, Artificial Sequence
  chemically synthesized
aacatccctccagcaggctaac

SEQ ID NO: 788855 - DNA, 22 bp, Artificial Sequence
  chemically synthesized
gaacatccctccagcaggctaa

SEQ ID NO: 788856 - DNA, 22 bp, Artificial Sequence
  chemically synthesized
gctcgggctggttagcctgctg

SEQ ID NO: 788857 - DNA, 22 bp, Artificial Sequence
  chemically synthesized
ctcgggctggttagcctgctgg

SEQ ID NO: 788858 - DNA, 22 bp, Artificial Sequence
  chemically synthesized
gggctggttagcctgctggagg

SEQ ID NO: 788859 - DNA, 22 bp, Artificial Sequence
  chemically synthesized
acatcttgaacatccctccagc

SEQ ID NO: 788860 - DNA, 22 bp, Artificial Sequence
  chemically synthesized
gttagcctgctggagggatgtt

SEQ ID NO: 788861 - DNA, 22 bp, Artificial Sequence
  chemically synthesized
tcgctcacatcttgaacatccc

SEQ ID NO: 788862 - DNA, 22 bp, Artificial Sequence
  chemically synthesized
gcctgctggagggatgttcaag

SEQ ID NO: 788863 - DNA, 22 bp, Artificial Sequence
  chemically synthesized
tatcgctcacatcttgaacatc

SEQ ID NO: 788864 - DNA, 22 bp, Artificial Sequence
  chemically synthesized
ctggagggatgttcaagatgtg

SEQ ID NO: 788865 - DNA, 22 bp, Artificial Sequence
  chemically synthesized
gagggatgttcaagatgtgagc

SEQ ID NO: 788866 - DNA, 22 bp, Artificial Sequence
  chemically synthesized
ggtcaacacagctctatcgctc

SEQ ID NO: 788867 - DNA, 22 bp, Artificial Sequence
  chemically synthesized
aagatgtgagcgatagagctgt

SEQ ID NO: 788868 - DNA, 22 bp, Artificial Sequence
  chemically synthesized
aaagtggctgggtcaacacagc

SEQ ID NO: 788869 - DNA, 22 bp, Artificial Sequence
  chemically synthesized
agtgtctgaaagtggctgggtc

SEQ ID NO: 788870 - DNA, 22 bp, Artificial Sequence
  chemically synthesized
aagtgtctgaaagtggctgggt

SEQ ID NO: 788871 - DNA, 22 bp, Artificial Sequence
  chemically synthesized
tgttgacccagccactttcaga

SEQ ID NO: 788872 - DNA, 22 bp, Artificial Sequence
  chemically synthesized
agagcttaagtgtctgaaagtg

SEQ ID NO: 788873 - DNA, 22 bp, Artificial Sequence
  chemically synthesized
acccagccactttcagacactt

SEQ ID NO: 788874 - DNA, 22 bp, Artificial Sequence
  chemically synthesized
gagggtagctgagagcttaagt

SEQ ID NO: 788875 - DNA, 22 bp, Artificial Sequence
  chemically synthesized
tcagacacttaagctctcagct

SEQ ID NO: 788876 - DNA, 22 bp, Artificial Sequence
  chemically synthesized
cagacacttaagctctcagcta

SEQ ID NO: 788877 - DNA, 22 bp, Artificial Sequence
  chemically synthesized
agacacttaagctctcagctac

SEQ ID NO: 788878 - DNA, 22 bp, Artificial Sequence
  chemically synthesized
ggaatctggagggtagctgaga

SEQ ID NO: 788879 - DNA, 22 bp, Artificial Sequence
  chemically synthesized
gggaatctggagggtagctgag

SEQ ID NO: 788880 - DNA, 22 bp, Artificial Sequence
  chemically synthesized
ccttgggaatctggagggtagc

SEQ ID NO: 788881 - DNA, 22 bp, Artificial Sequence
  chemically synthesized
aagctctcagctaccctccaga

SEQ ID NO: 788882 - DNA, 22 bp, Artificial Sequence
  chemically synthesized
agctctcagctaccctccagat

SEQ ID NO: 788883 - DNA, 22 bp, Artificial Sequence
  chemically synthesized
ggctcccttgggaatctggagg

SEQ ID NO: 788884 - DNA, 22 bp, Artificial Sequence
  chemically synthesized
tcagctaccctccagattccca

SEQ ID NO: 788885 - DNA, 22 bp, Artificial Sequence
  chemically synthesized
actgggctcccttgggaatctg

SEQ ID NO: 788886 - DNA, 22 bp, Artificial Sequence
  chemically synthesized
agctaccctccagattcccaag

SEQ ID NO: 788887 - DNA, 22 bp, Artificial Sequence
  chemically synthesized
tgactgggctcccttgggaatc

SEQ ID NO: 788888 - DNA, 22 bp, Artificial Sequence
  chemically synthesized
ctctgactgggctcccttggga

SEQ ID NO: 788889 - DNA, 22 bp, Artificial Sequence
  chemically synthesized
ccctccagattcccaagggagc

SEQ ID NO: 788890 - DNA, 22 bp, Artificial Sequence
  chemically synthesized
tctgctctgactgggctccctt

SEQ ID NO: 788891 - DNA, 22 bp, Artificial Sequence
  chemically synthesized
atctgctctgactgggctccct

SEQ ID NO: 788892 - DNA, 22 bp, Artificial Sequence
  chemically synthesized
cagattcccaagggagcccagt

SEQ ID NO: 788893 - DNA, 22 bp, Artificial Sequence
  chemically synthesized
ggtagtttatctgctctgactg

SEQ ID NO: 788894 - DNA, 22 bp, Artificial Sequence
  chemically synthesized
ccaagggagcccagtcagagca

SEQ ID NO: 788895 - DNA, 22 bp, Artificial Sequence
  chemically synthesized
cattgggtagtttatctgctct

SEQ ID NO: 788896 - DNA, 22 bp, Artificial Sequence
  chemically synthesized
acattgggtagtttatctgctc

SEQ ID NO: 788897 - DNA, 22 bp, Artificial Sequence
  chemically synthesized
atggtttacattgggtagttta

SEQ ID NO: 788898 - DNA, 22 bp, Artificial Sequence
  chemically synthesized
tgggctgatggtttacattggg

SEQ ID NO: 788899 - DNA, 22 bp, Artificial Sequence
  chemically synthesized
gtgggctgatggtttacattgg

SEQ ID NO: 788900 - DNA, 22 bp, Artificial Sequence
  chemically synthesized
atttgtgggctgatggtttaca

SEQ ID NO: 788901 - DNA, 22 bp, Artificial Sequence
  chemically synthesized
actaatttgtgggctgatggtt

SEQ ID NO: 788902 - DNA, 22 bp, Artificial Sequence
  chemically synthesized
cccaatgtaaaccatcagccca

SEQ ID NO: 788903 - DNA, 22 bp, Artificial Sequence
  chemically synthesized
agttcactaatttgtgggctga

SEQ ID NO: 788904 - DNA, 22 bp, Artificial Sequence
  chemically synthesized
gagttcactaatttgtgggctg

SEQ ID NO: 788905 - DNA, 22 bp, Artificial Sequence
  chemically synthesized
ttgagttcactaatttgtgggc

SEQ ID NO: 788906 - DNA, 22 bp, Artificial Sequence
  chemically synthesized
cttgagttcactaatttgtggg

SEQ ID NO: 788907 - DNA, 22 bp, Artificial Sequence
  chemically synthesized
aaacagtaggtacttcttgagt

SEQ ID NO: 788908 - DNA, 22 bp, Artificial Sequence
  chemically synthesized
aaaacagtaggtacttcttgag

SEQ ID NO: 788909 - DNA, 22 bp, Artificial Sequence
  chemically synthesized
gtgaactcaagaagtacctact

SEQ ID NO: 788910 - DNA, 22 bp, Artificial Sequence
  chemically synthesized
agtagcttaaaacagtaggtac

SEQ ID NO: 788911 - DNA, 22 bp, Artificial Sequence
  chemically synthesized
aagaagtacctactgttttaag

SEQ ID NO: 788912 - DNA, 22 bp, Artificial Sequence
  chemically synthesized
aaaactcagtagcttaaaacag

SEQ ID NO: 788913 - DNA, 22 bp, Artificial Sequence
  chemically synthesized
ctgttttaagctactgagtttt

SEQ ID NO: 788914 - DNA, 22 bp, Artificial Sequence
  chemically synthesized
ccaaaccgcctcaaaactcagt

SEQ ID NO: 788915 - DNA, 22 bp, Artificial Sequence
  chemically synthesized
ttttaagctactgagttttgag

SEQ ID NO: 788916 - DNA, 22 bp, Artificial Sequence
  chemically synthesized
taagctactgagttttgaggcg

SEQ ID NO: 788917 - DNA, 22 bp, Artificial Sequence
  chemically synthesized
aagctactgagttttgaggcgg

SEQ ID NO: 788918 - DNA, 22 bp, Artificial Sequence
  chemically synthesized
agctactgagttttgaggcggt

SEQ ID NO: 788919 - DNA, 22 bp, Artificial Sequence
  chemically synthesized
ctgagttttgaggcggtttggt

SEQ ID NO: 788920 - DNA, 22 bp, Artificial Sequence
  chemically synthesized
agttttgaggcggtttggtaat

SEQ ID NO: 788921 - DNA, 22 bp, Artificial Sequence
  chemically synthesized
tgaggcggtttggtaatggact

SEQ ID NO: 788922 - DNA, 22 bp, Artificial Sequence
  chemically synthesized
gaggcggtttggtaatggactg

SEQ ID NO: 788923 - DNA, 22 bp, Artificial Sequence
  chemically synthesized
aggcggtttggtaatggactga

SEQ ID NO: 788924 - DNA, 22 bp, Artificial Sequence
  chemically synthesized
tatataatagtatatcagtcca

SEQ ID NO: 788925 - DNA, 22 bp, Artificial Sequence
  chemically synthesized
ggtaatggactgatatactatt

SEQ ID NO: 788926 - DNA, 22 bp, Artificial Sequence
  chemically synthesized
gtaatggactgatatactatta

SEQ ID NO: 788927 - DNA, 22 bp, Artificial Sequence
  chemically synthesized
tatcagttatatataatagtat

SEQ ID NO: 788928 - DNA, 22 bp, Artificial Sequence
  chemically synthesized
tgtctgtatcagttatatataa

SEQ ID NO: 788929 - DNA, 22 bp, Artificial Sequence
  chemically synthesized
atgtctgtatcagttatatata

SEQ ID NO: 788930 - DNA, 22 bp, Artificial Sequence
  chemically synthesized
tatgtctgtatcagttatatat

SEQ ID NO: 788931 - DNA, 22 bp, Artificial Sequence
  chemically synthesized
atatactattatatataactga

SEQ ID NO: 788932 - DNA, 22 bp, Artificial Sequence
  chemically synthesized
ttatatataactgatacagaca

SEQ ID NO: 788933 - DNA, 22 bp, Artificial Sequence
  chemically synthesized
tatataactgatacagacataa

SEQ ID NO: 788934 - DNA, 22 bp, Artificial Sequence
  chemically synthesized
gcaaaagtatcattttatgtct

SEQ ID NO: 788935 - DNA, 22 bp, Artificial Sequence
  chemically synthesized
cctggcaaaagtatcattttat

SEQ ID NO: 788936 - DNA, 22 bp, Artificial Sequence
  chemically synthesized
acctggcaaaagtatcatttta

SEQ ID NO: 788937 - DNA, 22 bp, Artificial Sequence
  chemically synthesized
atacagacataaaatgatactt

SEQ ID NO: 788938 - DNA, 22 bp, Artificial Sequence
  chemically synthesized
atagtttacctggcaaaagtat

SEQ ID NO: 788939 - DNA, 22 bp, Artificial Sequence
  chemically synthesized
aatagtttacctggcaaaagta

SEQ ID NO: 788940 - DNA, 22 bp, Artificial Sequence
  chemically synthesized
taatagtttacctggcaaaagt

SEQ ID NO: 788941 - DNA, 22 bp, Artificial Sequence
  chemically synthesized
ttttaatagtttacctggcaaa

SEQ ID NO: 788942 - DNA, 22 bp, Artificial Sequence
  chemically synthesized
gttttaatagtttacctggcaa

SEQ ID NO: 788943 - DNA, 22 bp, Artificial Sequence
  chemically synthesized
tgttttaatagtttacctggca

SEQ ID NO: 788944 - DNA, 22 bp, Artificial Sequence
  chemically synthesized
ttttgttttaatagtttacctg

SEQ ID NO: 788945 - DNA, 22 bp, Artificial Sequence
  chemically synthesized
gttttgttttaatagtttacct

SEQ ID NO: 788946 - DNA, 22 bp, Artificial Sequence
  chemically synthesized
ttgccaggtaaactattaaaac

SEQ ID NO: 788947 - DNA, 22 bp, Artificial Sequence
  chemically synthesized
tgccaggtaaactattaaaaca

SEQ ID NO: 788948 - DNA, 22 bp, Artificial Sequence
  chemically synthesized
gccaggtaaactattaaaacaa

SEQ ID NO: 788949 - DNA, 22 bp, Artificial Sequence
  chemically synthesized
ccaggtaaactattaaaacaaa

SEQ ID NO: 788950 - DNA, 22 bp, Artificial Sequence
  chemically synthesized
ttaaaacaaaacaagatttacc

SEQ ID NO: 788951 - DNA, 22 bp, Artificial Sequence
  chemically synthesized
aaacaaaacaagatttaccatc

SEQ ID NO: 788952 - DNA, 22 bp, Artificial Sequence
  chemically synthesized
acaatatgatggtaacagtgga

SEQ ID NO: 788953 - DNA, 22 bp, Artificial Sequence
  chemically synthesized
aacaatatgatggtaacagtgg

SEQ ID NO: 788954 - DNA, 22 bp, Artificial Sequence
  chemically synthesized
cttaacaatatgatggtaacag

SEQ ID NO: 788955 - DNA, 22 bp, Artificial Sequence
  chemically synthesized
ccttaacaatatgatggtaaca

SEQ ID NO: 788956 - DNA, 22 bp, Artificial Sequence
  chemically synthesized
accatccactgttaccatcata

SEQ ID NO: 788957 - DNA, 22 bp, Artificial Sequence
  chemically synthesized
ccatccactgttaccatcatat

SEQ ID NO: 788958 - DNA, 22 bp, Artificial Sequence
  chemically synthesized
aaataccccttccttaacaata

SEQ ID NO: 788959 - DNA, 22 bp, Artificial Sequence
  chemically synthesized
ttaccatcatattgttaaggaa

SEQ ID NO: 788960 - DNA, 22 bp, Artificial Sequence
  chemically synthesized
ccatcatattgttaaggaaggg

SEQ ID NO: 788961 - DNA, 22 bp, Artificial Sequence
  chemically synthesized
tggttgaaataccccttcctta

SEQ ID NO: 788962 - DNA, 22 bp, Artificial Sequence
  chemically synthesized
gtggttgaaataccccttcctt

SEQ ID NO: 788963 - DNA, 22 bp, Artificial Sequence
  chemically synthesized
ttgtggttgaaataccccttcc

SEQ ID NO: 788964 - DNA, 22 bp, Artificial Sequence
  chemically synthesized
cttgtggttgaaataccccttc

SEQ ID NO: 788965 - DNA, 22 bp, Artificial Sequence
  chemically synthesized
tttcttgtggttgaaatacccc

SEQ ID NO: 788966 - DNA, 22 bp, Artificial Sequence
  chemically synthesized
ttaaggaaggggtatttcaacc

SEQ ID NO: 788967 - DNA, 22 bp, Artificial Sequence
  chemically synthesized
attatttcttgtggttgaaata

SEQ ID NO: 788968 - DNA, 22 bp, Artificial Sequence
  chemically synthesized
tgattatttcttgtggttgaaa

SEQ ID NO: 788969 - DNA, 22 bp, Artificial Sequence
  chemically synthesized
aggaaggggtatttcaaccaca

SEQ ID NO: 788970 - DNA, 22 bp, Artificial Sequence
  chemically synthesized
ctgattatttcttgtggttgaa

SEQ ID NO: 788971 - DNA, 22 bp, Artificial Sequence
  chemically synthesized
tctgattatttcttgtggttga

SEQ ID NO: 788972 - DNA, 22 bp, Artificial Sequence
  chemically synthesized
tgtctttctgattatttcttgt

SEQ ID NO: 788973 - DNA, 22 bp, Artificial Sequence
  chemically synthesized
agactatgtctttctgattatt

SEQ ID NO: 788974 - DNA, 22 bp, Artificial Sequence
  chemically synthesized
caaccacaagaaataatcagaa

SEQ ID NO: 788975 - DNA, 22 bp, Artificial Sequence
  chemically synthesized
aaccacaagaaataatcagaaa

SEQ ID NO: 788976 - DNA, 22 bp, Artificial Sequence
  chemically synthesized
ggctgagactatgtctttctga

SEQ ID NO: 788977 - DNA, 22 bp, Artificial Sequence
  chemically synthesized
aggctgagactatgtctttctg

SEQ ID NO: 788978 - DNA, 22 bp, Artificial Sequence
  chemically synthesized
ccatttaggctgagactatgtc

SEQ ID NO: 788979 - DNA, 22 bp, Artificial Sequence
  chemically synthesized
ggacagcctaccatttaggctg

SEQ ID NO: 788980 - DNA, 22 bp, Artificial Sequence
  chemically synthesized
aggacagcctaccatttaggct

SEQ ID NO: 788981 - DNA, 22 bp, Artificial Sequence
  chemically synthesized
ttaggacagcctaccatttagg

SEQ ID NO: 788982 - DNA, 22 bp, Artificial Sequence
  chemically synthesized
cttaggacagcctaccatttag

SEQ ID NO: 788983 - DNA, 22 bp, Artificial Sequence
  chemically synthesized
tcttaggacagcctaccattta

SEQ ID NO: 788984 - DNA, 22 bp, Artificial Sequence
  chemically synthesized
ctttcttaggacagcctaccat

SEQ ID NO: 788985 - DNA, 22 bp, Artificial Sequence
  chemically synthesized
agcctaaatggtaggctgtcct

SEQ ID NO: 788986 - DNA, 22 bp, Artificial Sequence
  chemically synthesized
tcatcctcctttcttaggacag

SEQ ID NO: 788987 - DNA, 22 bp, Artificial Sequence
  chemically synthesized
gtcatcctcctttcttaggaca

SEQ ID NO: 788988 - DNA, 22 bp, Artificial Sequence
  chemically synthesized
aatggtaggctgtcctaagaaa

SEQ ID NO: 788989 - DNA, 22 bp, Artificial Sequence
  chemically synthesized
tagcttgtcatcctcctttctt

SEQ ID NO: 788990 - DNA, 22 bp, Artificial Sequence
  chemically synthesized
gtagcttgtcatcctcctttct

SEQ ID NO: 788991 - DNA, 22 bp, Artificial Sequence
  chemically synthesized
agcttgtagcttgtcatcctcc

SEQ ID NO: 788992 - DNA, 22 bp, Artificial Sequence
  chemically synthesized
aagcttgtagcttgtcatcctc

SEQ ID NO: 788993 - DNA, 22 bp, Artificial Sequence
  chemically synthesized
tcctaagaaaggaggatgacaa

SEQ ID NO: 788994 - DNA, 22 bp, Artificial Sequence
  chemically synthesized
tttaagcttgtagcttgtcatc

SEQ ID NO: 788995 - DNA, 22 bp, Artificial Sequence
  chemically synthesized
agaaaggaggatgacaagctac

SEQ ID NO: 788996 - DNA, 22 bp, Artificial Sequence
  chemically synthesized
caagcttaaataatttctcttt

SEQ ID NO: 788997 - DNA, 22 bp, Artificial Sequence
  chemically synthesized
aaataatttctctttctctctc

SEQ ID NO: 788998 - DNA, 22 bp, Artificial Sequence
  chemically synthesized
aataatttctctttctctctct

SEQ ID NO: 788999 - DNA, 22 bp, Artificial Sequence
  chemically synthesized
taaggacagaaagagagagaga

SEQ ID NO: 789000 - DNA, 22 bp, Artificial Sequence
  chemically synthesized
ctctttctctctctctctcttt

SEQ ID NO: 789001 - DNA, 22 bp, Artificial Sequence
  chemically synthesized
tctttctctctctctctctttc

SEQ ID NO: 789002 - DNA, 22 bp, Artificial Sequence
  chemically synthesized
tttctctctctctctctttctg

SEQ ID NO: 789003 - DNA, 22 bp, Artificial Sequence
  chemically synthesized
tctctctctctctctttctgtc

SEQ ID NO: 789004 - DNA, 22 bp, Artificial Sequence
  chemically synthesized
ctctctctctctctttctgtcc

SEQ ID NO: 789005 - DNA, 22 bp, Artificial Sequence
  chemically synthesized
tctctctctctctttctgtcct

SEQ ID NO: 789006 - DNA, 22 bp, Artificial Sequence
  chemically synthesized
tctctctctctttctgtcctta

SEQ ID NO: 789007 - DNA, 22 bp, Artificial Sequence
  chemically synthesized
tctctctctttctgtccttata

SEQ ID NO: 789008 - DNA, 22 bp, Artificial Sequence
  chemically synthesized
tctctctttctgtccttatagt

SEQ ID NO: 789009 - DNA, 22 bp, Artificial Sequence
  chemically synthesized
tctctttctgtccttatagttc

SEQ ID NO: 789010 - DNA, 22 bp, Artificial Sequence
  chemically synthesized
tctttctgtccttatagttctc

SEQ ID NO: 789011 - DNA, 22 bp, Artificial Sequence
  chemically synthesized
tttctgtccttatagttctcat

SEQ ID NO: 789012 - DNA, 22 bp, Artificial Sequence
  chemically synthesized
aataagcagagaaatgagaact

SEQ ID NO: 789013 - DNA, 22 bp, Artificial Sequence
  chemically synthesized
tctgtccttatagttctcattt

SEQ ID NO: 789014 - DNA, 22 bp, Artificial Sequence
  chemically synthesized
ctgtccttatagttctcatttc

SEQ ID NO: 789015 - DNA, 22 bp, Artificial Sequence
  chemically synthesized
tgtccttatagttctcatttct

SEQ ID NO: 789016 - DNA, 22 bp, Artificial Sequence
  chemically synthesized
ctcaataagcagagaaatgaga

SEQ ID NO: 789017 - DNA, 22 bp, Artificial Sequence
  chemically synthesized
cctcaataagcagagaaatgag

SEQ ID NO: 789018 - DNA, 22 bp, Artificial Sequence
  chemically synthesized
tccttatagttctcatttctct

SEQ ID NO: 789019 - DNA, 22 bp, Artificial Sequence
  chemically synthesized
atagttctcatttctctgctta

SEQ ID NO: 789020 - DNA, 22 bp, Artificial Sequence
  chemically synthesized
tagttctcatttctctgcttat

SEQ ID NO: 789021 - DNA, 22 bp, Artificial Sequence
  chemically synthesized
tgaagaagatttcctcaataag

SEQ ID NO: 789022 - DNA, 22 bp, Artificial Sequence
  chemically synthesized
tcatttctctgcttattgagga

SEQ ID NO: 789023 - DNA, 22 bp, Artificial Sequence
  chemically synthesized
atttctctgcttattgaggaaa

SEQ ID NO: 789024 - DNA, 22 bp, Artificial Sequence
  chemically synthesized
ctctgcttattgaggaaatctt

SEQ ID NO: 789025 - DNA, 22 bp, Artificial Sequence
  chemically synthesized
tctgcttattgaggaaatcttc

SEQ ID NO: 789026 - DNA, 22 bp, Artificial Sequence
  chemically synthesized
tgcttattgaggaaatcttctt

SEQ ID NO: 789027 - DNA, 22 bp, Artificial Sequence
  chemically synthesized
cttattgaggaaatcttcttca

SEQ ID NO: 789028 - DNA, 22 bp, Artificial Sequence
  chemically synthesized
attgaggaaatcttcttcacag

SEQ ID NO: 789029 - DNA, 22 bp, Artificial Sequence
  chemically synthesized
ttgaggaaatcttcttcacaga

SEQ ID NO: 789030 - DNA, 22 bp, Artificial Sequence
  chemically synthesized
aaatgcagatgatctgtgaaga

SEQ ID NO: 789031 - DNA, 22 bp, Artificial Sequence
  chemically synthesized
tcaaatgcagatgatctgtgaa

SEQ ID NO: 789032 - DNA, 22 bp, Artificial Sequence
  chemically synthesized
aggaaatcttcttcacagatca

SEQ ID NO: 789033 - DNA, 22 bp, Artificial Sequence
  chemically synthesized
cttcacagatcatctgcatttg

SEQ ID NO: 789034 - DNA, 22 bp, Artificial Sequence
  chemically synthesized
ttcacagatcatctgcatttga

SEQ ID NO: 789035 - DNA, 22 bp, Artificial Sequence
  chemically synthesized
cacagatcatctgcatttgaga

SEQ ID NO: 789036 - DNA, 22 bp, Artificial Sequence
  chemically synthesized
acagatcatctgcatttgagaa

SEQ ID NO: 789037 - DNA, 22 bp, Artificial Sequence
  chemically synthesized
agtcgtgtgtggcagaggttct

SEQ ID NO: 789038 - DNA, 22 bp, Artificial Sequence
  chemically synthesized
cattaagtcgtgtgtggcagag

SEQ ID NO: 789039 - DNA, 22 bp, Artificial Sequence
  chemically synthesized
catttgagaacctctgccacac

SEQ ID NO: 789040 - DNA, 22 bp, Artificial Sequence
  chemically synthesized
gagaacctctgccacacacgac

SEQ ID NO: 789041 - DNA, 22 bp, Artificial Sequence
  chemically synthesized
agaacctctgccacacacgact

SEQ ID NO: 789042 - DNA, 22 bp, Artificial Sequence
  chemically synthesized
tgccacacacgacttaatgtaa

SEQ ID NO: 789043 - DNA, 22 bp, Artificial Sequence
  chemically synthesized
ccacacacgacttaatgtaatg

SEQ ID NO: 789044 - DNA, 22 bp, Artificial Sequence
  chemically synthesized
caatgtgcaaagcattacatta

SEQ ID NO: 789045 - DNA, 22 bp, Artificial Sequence
  chemically synthesized
acaatgtgcaaagcattacatt

SEQ ID NO: 789046 - DNA, 22 bp, Artificial Sequence
  chemically synthesized
agggtttacaatgtgcaaagca

SEQ ID NO: 789047 - DNA, 22 bp, Artificial Sequence
  chemically synthesized
gagggtttacaatgtgcaaagc

SEQ ID NO: 789048 - DNA, 22 bp, Artificial Sequence
  chemically synthesized
ttgagggtttacaatgtgcaaa

SEQ ID NO: 789049 - DNA, 22 bp, Artificial Sequence
  chemically synthesized
aatgtaatgctttgcacattgt

SEQ ID NO: 789050 - DNA, 22 bp, Artificial Sequence
  chemically synthesized
atgtaatgctttgcacattgta

SEQ ID NO: 789051 - DNA, 22 bp, Artificial Sequence
  chemically synthesized
acaacattcttgagggtttaca

SEQ ID NO: 789052 - DNA, 22 bp, Artificial Sequence
  chemically synthesized
aacaacattcttgagggtttac

SEQ ID NO: 789053 - DNA, 22 bp, Artificial Sequence
  chemically synthesized
tgcacattgtaaaccctcaaga

SEQ ID NO: 789054 - DNA, 22 bp, Artificial Sequence
  chemically synthesized
atttaacaacattcttgagggt

SEQ ID NO: 789055 - DNA, 22 bp, Artificial Sequence
  chemically synthesized
gcacattgtaaaccctcaagaa

SEQ ID NO: 789056 - DNA, 22 bp, Artificial Sequence
  chemically synthesized
cacattgtaaaccctcaagaat

SEQ ID NO: 789057 - DNA, 22 bp, Artificial Sequence
  chemically synthesized
ctcatttaacaacattcttgag

SEQ ID NO: 789058 - DNA, 22 bp, Artificial Sequence
  chemically synthesized
taaaccctcaagaatgttgtta

SEQ ID NO: 789059 - DNA, 22 bp, Artificial Sequence
  chemically synthesized
tgattactcatttaacaacatt

SEQ ID NO: 789060 - DNA, 22 bp, Artificial Sequence
  chemically synthesized
acattgtgattactcatttaac

SEQ ID NO: 789061 - DNA, 22 bp, Artificial Sequence
  chemically synthesized
aagaatgttgttaaatgagtaa

SEQ ID NO: 789062 - DNA, 22 bp, Artificial Sequence
  chemically synthesized
attcacattgtgattactcatt

SEQ ID NO: 789063 - DNA, 22 bp, Artificial Sequence
  chemically synthesized
aattcacattgtgattactcat

SEQ ID NO: 789064 - DNA, 22 bp, Artificial Sequence
  chemically synthesized
ttaaatgagtaatcacaatgtg

SEQ ID NO: 789065 - DNA, 22 bp, Artificial Sequence
  chemically synthesized
tgaatgacttaattcacattgt

SEQ ID NO: 789066 - DNA, 22 bp, Artificial Sequence
  chemically synthesized
aatgagtaatcacaatgtgaat

SEQ ID NO: 789067 - DNA, 22 bp, Artificial Sequence
  chemically synthesized
cattgtgaatgacttaattcac

SEQ ID NO: 789068 - DNA, 22 bp, Artificial Sequence
  chemically synthesized
gcagcattccattgtgaatgac

SEQ ID NO: 789069 - DNA, 22 bp, Artificial Sequence
  chemically synthesized
cagaattagcagcattccattg

SEQ ID NO: 789070 - DNA, 22 bp, Artificial Sequence
  chemically synthesized
agtcattcacaatggaatgctg

SEQ ID NO: 789071 - DNA, 22 bp, Artificial Sequence
  chemically synthesized
agttccagaattagcagcattc

SEQ ID NO: 789072 - DNA, 22 bp, Artificial Sequence
  chemically synthesized
ctcagttccagaattagcagca

SEQ ID NO: 789073 - DNA, 22 bp, Artificial Sequence
  chemically synthesized
acaatggaatgctgctaattct

SEQ ID NO: 789074 - DNA, 22 bp, Artificial Sequence
  chemically synthesized
caatgaccacattactcagttc

SEQ ID NO: 789075 - DNA, 22 bp, Artificial Sequence
  chemically synthesized
ctaattctggaactgagtaatg

SEQ ID NO: 789076 - DNA, 22 bp, Artificial Sequence
  chemically synthesized
attctggaactgagtaatgtgg

SEQ ID NO: 789077 - DNA, 22 bp, Artificial Sequence
  chemically synthesized
gtatactgcaatgaccacatta

SEQ ID NO: 789078 - DNA, 22 bp, Artificial Sequence
  chemically synthesized
agtatactgcaatgaccacatt

SEQ ID NO: 789079 - DNA, 22 bp, Artificial Sequence
  chemically synthesized
tggaactgagtaatgtggtcat

SEQ ID NO: 789080 - DNA, 22 bp, Artificial Sequence
  chemically synthesized
gaactgagtaatgtggtcattg

SEQ ID NO: 789081 - DNA, 22 bp, Artificial Sequence
  chemically synthesized
agtaatgtggtcattgcagtat

SEQ ID NO: 789082 - DNA, 22 bp, Artificial Sequence
  chemically synthesized
acgcagcttagtatactgcaat

SEQ ID NO: 789083 - DNA, 22 bp, Artificial Sequence
  chemically synthesized
cacgcagcttagtatactgcaa

SEQ ID NO: 789084 - DNA, 22 bp, Artificial Sequence
  chemically synthesized
tcacgcagcttagtatactgca

SEQ ID NO: 789085 - DNA, 22 bp, Artificial Sequence
  chemically synthesized
gaagttttcacgcagcttagta

SEQ ID NO: 789086 - DNA, 22 bp, Artificial Sequence
  chemically synthesized
tagaagttttcacgcagcttag

SEQ ID NO: 789087 - DNA, 22 bp, Artificial Sequence
  chemically synthesized
ctagaagttttcacgcagctta

SEQ ID NO: 789088 - DNA, 22 bp, Artificial Sequence
  chemically synthesized
tctagaagttttcacgcagctt

SEQ ID NO: 789089 - DNA, 22 bp, Artificial Sequence
  chemically synthesized
ttctagaagttttcacgcagct

SEQ ID NO: 789090 - DNA, 22 bp, Artificial Sequence
  chemically synthesized
tttctagaagttttcacgcagc

SEQ ID NO: 789091 - DNA, 22 bp, Artificial Sequence
  chemically synthesized
cagtatactaagctgcgtgaaa

SEQ ID NO: 789092 - DNA, 22 bp, Artificial Sequence
  chemically synthesized
ttttctagaagttttcacgcag

SEQ ID NO: 789093 - DNA, 22 bp, Artificial Sequence
  chemically synthesized
taatttttttctagaagttttc

SEQ ID NO: 789094 - DNA, 22 bp, Artificial Sequence
  chemically synthesized
tataatttttttctagaagttt

SEQ ID NO: 789095 - DNA, 22 bp, Artificial Sequence
  chemically synthesized
agctgcgtgaaaacttctagaa

SEQ ID NO: 789096 - DNA, 22 bp, Artificial Sequence
  chemically synthesized
tctataatttttttctagaagt

SEQ ID NO: 789097 - DNA, 22 bp, Artificial Sequence
  chemically synthesized
ctctataatttttttctagaag

SEQ ID NO: 789098 - DNA, 22 bp, Artificial Sequence
  chemically synthesized
tctctataatttttttctagaa

SEQ ID NO: 789099 - DNA, 22 bp, Artificial Sequence
  chemically synthesized
ttctctataatttttttctaga

SEQ ID NO: 789100 - DNA, 22 bp, Artificial Sequence
  chemically synthesized
cgtgaaaacttctagaaaaaaa

SEQ ID NO: 789101 - DNA, 22 bp, Artificial Sequence
  chemically synthesized
ctagaaaaaaattatagagaaa

SEQ ID NO: 789102 - DNA, 22 bp, Artificial Sequence
  chemically synthesized
tagaaaaaaattatagagaaaa

SEQ ID NO: 789103 - DNA, 22 bp, Artificial Sequence
  chemically synthesized
gaaaaaaattatagagaaaagt

SEQ ID NO: 789104 - DNA, 22 bp, Artificial Sequence
  chemically synthesized
aaataaaggagaaggcaacttt

SEQ ID NO: 789105 - DNA, 22 bp, Artificial Sequence
  chemically synthesized
ctaaaataaaggagaaggcaac

SEQ ID NO: 789106 - DNA, 22 bp, Artificial Sequence
  chemically synthesized
tagagaaaagttgccttctcct

SEQ ID NO: 789107 - DNA, 22 bp, Artificial Sequence
  chemically synthesized
caatagtattgctaaaataaag

SEQ ID NO: 789108 - DNA, 22 bp, Artificial Sequence
  chemically synthesized
ccttctcctttattttagcaat

SEQ ID NO: 789109 - DNA, 22 bp, Artificial Sequence
  chemically synthesized
tatgctgcaatagtattgctaa

SEQ ID NO: 789110 - DNA, 22 bp, Artificial Sequence
  chemically synthesized
atatgctgcaatagtattgcta

SEQ ID NO: 789111 - DNA, 22 bp, Artificial Sequence
  chemically synthesized
ctcctttattttagcaatacta

SEQ ID NO: 789112 - DNA, 22 bp, Artificial Sequence
  chemically synthesized
tatatgctgcaatagtattgct

SEQ ID NO: 789113 - DNA, 22 bp, Artificial Sequence
  chemically synthesized
tcctttattttagcaatactat

SEQ ID NO: 789114 - DNA, 22 bp, Artificial Sequence
  chemically synthesized
ctttattttagcaatactattg

SEQ ID NO: 789115 - DNA, 22 bp, Artificial Sequence
  chemically synthesized
attttatatgctgcaatagtat

SEQ ID NO: 789116 - DNA, 22 bp, Artificial Sequence
  chemically synthesized
gattttatatgctgcaatagta

SEQ ID NO: 789117 - DNA, 22 bp, Artificial Sequence
  chemically synthesized
tattttagcaatactattgcag

SEQ ID NO: 789118 - DNA, 22 bp, Artificial Sequence
  chemically synthesized
attttagcaatactattgcagc

SEQ ID NO: 789119 - DNA, 22 bp, Artificial Sequence
  chemically synthesized
ttttagcaatactattgcagca

SEQ ID NO: 789120 - DNA, 22 bp, Artificial Sequence
  chemically synthesized
tagcaatactattgcagcatat

SEQ ID NO: 789121 - DNA, 22 bp, Artificial Sequence
  chemically synthesized
agcaatactattgcagcatata

SEQ ID NO: 789122 - DNA, 22 bp, Artificial Sequence
  chemically synthesized
gcaatactattgcagcatataa

SEQ ID NO: 789123 - DNA, 22 bp, Artificial Sequence
  chemically synthesized
ttgcagcatataaaatcaagct

SEQ ID NO: 789124 - DNA, 22 bp, Artificial Sequence
  chemically synthesized
ccataaagtcccagcttgattt

SEQ ID NO: 789125 - DNA, 22 bp, Artificial Sequence
  chemically synthesized
cccataaagtcccagcttgatt

SEQ ID NO: 789126 - DNA, 22 bp, Artificial Sequence
  chemically synthesized
cagcatataaaatcaagctggg

SEQ ID NO: 789127 - DNA, 22 bp, Artificial Sequence
  chemically synthesized
gcaaggcgcagcttcccataaa

SEQ ID NO: 789128 - DNA, 22 bp, Artificial Sequence
  chemically synthesized
aattagcaaggcgcagcttccc

SEQ ID NO: 789129 - DNA, 22 bp, Artificial Sequence
  chemically synthesized
aaattagcaaggcgcagcttcc

SEQ ID NO: 789130 - DNA, 22 bp, Artificial Sequence
  chemically synthesized
taaattagcaaggcgcagcttc

SEQ ID NO: 789131 - DNA, 22 bp, Artificial Sequence
  chemically synthesized
ggactttatgggaagctgcgcc

SEQ ID NO: 789132 - DNA, 22 bp, Artificial Sequence
  chemically synthesized
ttaaattagcaaggcgcagctt

SEQ ID NO: 789133 - DNA, 22 bp, Artificial Sequence
  chemically synthesized
tatgggaagctgcgccttgcta

SEQ ID NO: 789134 - DNA, 22 bp, Artificial Sequence
  chemically synthesized
atgggaagctgcgccttgctaa

SEQ ID NO: 789135 - DNA, 22 bp, Artificial Sequence
  chemically synthesized
tgggaagctgcgccttgctaat

SEQ ID NO: 789136 - DNA, 22 bp, Artificial Sequence
  chemically synthesized
cgccttgctaatttaaaaggac

SEQ ID NO: 789137 - DNA, 22 bp, Artificial Sequence
  chemically synthesized
gctaatttaaaaggacacactg

SEQ ID NO: 789138 - DNA, 22 bp, Artificial Sequence
  chemically synthesized
ctaatttaaaaggacacactga

SEQ ID NO: 789139 - DNA, 22 bp, Artificial Sequence
  chemically synthesized
atttaaaaggacacactgacta

SEQ ID NO: 789140 - DNA, 22 bp, Artificial Sequence
  chemically synthesized
aaaaggacacactgactacatg

SEQ ID NO: 789141 - DNA, 22 bp, Artificial Sequence
  chemically synthesized
aaaggacacactgactacatgc

SEQ ID NO: 789142 - DNA, 22 bp, Artificial Sequence
  chemically synthesized
cccccaagccaatcagcatgta

SEQ ID NO: 789143 - DNA, 22 bp, Artificial Sequence
  chemically synthesized
ccccccaagccaatcagcatgt

SEQ ID NO: 789144 - DNA, 22 bp, Artificial Sequence
  chemically synthesized
actacatgctgattggcttggg

SEQ ID NO: 789145 - DNA, 22 bp, Artificial Sequence
  chemically synthesized
catgctgattggcttgggggga

SEQ ID NO: 789146 - DNA, 22 bp, Artificial Sequence
  chemically synthesized
attggcttggggggaaggattg

SEQ ID NO: 789147 - DNA, 22 bp, Artificial Sequence
  chemically synthesized
gcttggggggaaggattgctta

SEQ ID NO: 789148 - DNA, 22 bp, Artificial Sequence
  chemically synthesized
ggggggaaggattgcttaccat

SEQ ID NO: 789149 - DNA, 22 bp, Artificial Sequence
  chemically synthesized
gggggaaggattgcttaccatg

SEQ ID NO: 789150 - DNA, 22 bp, Artificial Sequence
  chemically synthesized
aaatagaaacaaaacaacatgg

SEQ ID NO: 789151 - DNA, 22 bp, Artificial Sequence
  chemically synthesized
cttaccatgttgttttgtttct

SEQ ID NO: 789152 - DNA, 22 bp, Artificial Sequence
  chemically synthesized
accatgttgttttgtttctatt

SEQ ID NO: 789153 - DNA, 22 bp, Artificial Sequence
  chemically synthesized
ccatgttgttttgtttctattt

SEQ ID NO: 789154 - DNA, 22 bp, Artificial Sequence
  chemically synthesized
ttttgtttctattttaattttc

SEQ ID NO: 789155 - DNA, 22 bp, Artificial Sequence
  chemically synthesized
gcagacaggcaggtgaaaatta

SEQ ID NO: 789156 - DNA, 22 bp, Artificial Sequence
  chemically synthesized
tgtttctattttaattttcacc

SEQ ID NO: 789157 - DNA, 22 bp, Artificial Sequence
  chemically synthesized
gtttctattttaattttcacct

SEQ ID NO: 789158 - DNA, 22 bp, Artificial Sequence
  chemically synthesized
tttctattttaattttcacctg

SEQ ID NO: 789159 - DNA, 22 bp, Artificial Sequence
  chemically synthesized
ctattttaattttcacctgcct

SEQ ID NO: 789160 - DNA, 22 bp, Artificial Sequence
  chemically synthesized
tattttaattttcacctgcctg

SEQ ID NO: 789161 - DNA, 22 bp, Artificial Sequence
  chemically synthesized
ttttaattttcacctgcctgtc

SEQ ID NO: 789162 - DNA, 22 bp, Artificial Sequence
  chemically synthesized
taattttcacctgcctgtctgc

SEQ ID NO: 789163 - DNA, 22 bp, Artificial Sequence
  chemically synthesized
aattttcacctgcctgtctgcg

SEQ ID NO: 789164 - DNA, 22 bp, Artificial Sequence
  chemically synthesized
attttcacctgcctgtctgcga

SEQ ID NO: 789165 - DNA, 22 bp, Artificial Sequence
  chemically synthesized
tcacctgcctgtctgcgaattt

SEQ ID NO: 789166 - DNA, 22 bp, Artificial Sequence
  chemically synthesized
ccatggtaaggaaaattcgcag

SEQ ID NO: 789167 - DNA, 22 bp, Artificial Sequence
  chemically synthesized
cacctgcctgtctgcgaatttt

SEQ ID NO: 789168 - DNA, 22 bp, Artificial Sequence
  chemically synthesized
acctgcctgtctgcgaattttc

SEQ ID NO: 789169 - DNA, 22 bp, Artificial Sequence
  chemically synthesized
cctgtctgcgaattttccttac

SEQ ID NO: 789170 - DNA, 22 bp, Artificial Sequence
  chemically synthesized
aatccattaccatggtaaggaa

SEQ ID NO: 789171 - DNA, 22 bp, Artificial Sequence
  chemically synthesized
aaatccattaccatggtaagga

SEQ ID NO: 789172 - DNA, 22 bp, Artificial Sequence
  chemically synthesized
tctgcgaattttccttaccatg

SEQ ID NO: 789173 - DNA, 22 bp, Artificial Sequence
  chemically synthesized
atttaaatccattaccatggta

SEQ ID NO: 789174 - DNA, 22 bp, Artificial Sequence
  chemically synthesized
cgaattttccttaccatggtaa

SEQ ID NO: 789175 - DNA, 22 bp, Artificial Sequence
  chemically synthesized
attaatttaaatccattaccat

SEQ ID NO: 789176 - DNA, 22 bp, Artificial Sequence
  chemically synthesized
ttgattaatttaaatccattac

SEQ ID NO: 789177 - DNA, 22 bp, Artificial Sequence
  chemically synthesized
tccttaccatggtaatggattt

SEQ ID NO: 789178 - DNA, 22 bp, Artificial Sequence
  chemically synthesized
attgattaatttaaatccatta

SEQ ID NO: 789179 - DNA, 22 bp, Artificial Sequence
  chemically synthesized
ccttaccatggtaatggattta

SEQ ID NO: 789180 - DNA, 22 bp, Artificial Sequence
  chemically synthesized
cttaccatggtaatggatttaa

SEQ ID NO: 789181 - DNA, 22 bp, Artificial Sequence
  chemically synthesized
accatggtaatggatttaaatt

SEQ ID NO: 789182 - DNA, 22 bp, Artificial Sequence
  chemically synthesized
ccatggtaatggatttaaatta

SEQ ID NO: 789183 - DNA, 22 bp, Artificial Sequence
  chemically synthesized
ataacaccttattgattaattt

SEQ ID NO: 789184 - DNA, 22 bp, Artificial Sequence
  chemically synthesized
cataacaccttattgattaatt

SEQ ID NO: 789185 - DNA, 22 bp, Artificial Sequence
  chemically synthesized
aatcttcataacaccttattga

SEQ ID NO: 789186 - DNA, 22 bp, Artificial Sequence
  chemically synthesized
aaattaatcaataaggtgttat

SEQ ID NO: 789187 - DNA, 22 bp, Artificial Sequence
  chemically synthesized
aattaatcaataaggtgttatg

SEQ ID NO: 789188 - DNA, 22 bp, Artificial Sequence
  chemically synthesized
acattaaatcttcataacacct

SEQ ID NO: 789189 - DNA, 22 bp, Artificial Sequence
  chemically synthesized
gacattaaatcttcataacacc

SEQ ID NO: 789190 - DNA, 22 bp, Artificial Sequence
  chemically synthesized
atcaataaggtgttatgaagat

SEQ ID NO: 789191 - DNA, 22 bp, Artificial Sequence
  chemically synthesized
aagtgtatttgacattaaatct

SEQ ID NO: 789192 - DNA, 22 bp, Artificial Sequence
  chemically synthesized
aaagtgtatttgacattaaatc

SEQ ID NO: 789193 - DNA, 22 bp, Artificial Sequence
  chemically synthesized
taaagtgtatttgacattaaat

SEQ ID NO: 789194 - DNA, 22 bp, Artificial Sequence
  chemically synthesized
ttaaagtgtatttgacattaaa

SEQ ID NO: 789195 - DNA, 22 bp, Artificial Sequence
  chemically synthesized
ggtttttaaagtgtatttgaca

SEQ ID NO: 789196 - DNA, 22 bp, Artificial Sequence
  chemically synthesized
tgaagatttaatgtcaaataca

SEQ ID NO: 789197 - DNA, 22 bp, Artificial Sequence
  chemically synthesized
aaactaggtttttaaagtgtat

SEQ ID NO: 789198 - DNA, 22 bp, Artificial Sequence
  chemically synthesized
caaactaggtttttaaagtgta

SEQ ID NO: 789199 - DNA, 22 bp, Artificial Sequence
  chemically synthesized
tcaaactaggtttttaaagtgt

SEQ ID NO: 789200 - DNA, 22 bp, Artificial Sequence
  chemically synthesized
aatgtcaaatacactttaaaaa

SEQ ID NO: 789201 - DNA, 22 bp, Artificial Sequence
  chemically synthesized
atgtcaaatacactttaaaaac

SEQ ID NO: 789202 - DNA, 22 bp, Artificial Sequence
  chemically synthesized
gaagttttcaaactaggttttt

SEQ ID NO: 789203 - DNA, 22 bp, Artificial Sequence
  chemically synthesized
aatagacctggaagttttcaaa

SEQ ID NO: 789204 - DNA, 22 bp, Artificial Sequence
  chemically synthesized
taaaaacctagtttgaaaactt

SEQ ID NO: 789205 - DNA, 22 bp, Artificial Sequence
  chemically synthesized
aaaaacctagtttgaaaacttc

SEQ ID NO: 789206 - DNA, 22 bp, Artificial Sequence
  chemically synthesized
aaaacctagtttgaaaacttcc

SEQ ID NO: 789207 - DNA, 22 bp, Artificial Sequence
  chemically synthesized
gtttgaaaacttccaggtctat

SEQ ID NO: 789208 - DNA, 22 bp, Artificial Sequence
  chemically synthesized
cgacatgtgctaaatagacctg

SEQ ID NO: 789209 - DNA, 22 bp, Artificial Sequence
  chemically synthesized
gaaaacttccaggtctatttag

SEQ ID NO: 789210 - DNA, 22 bp, Artificial Sequence
  chemically synthesized
aaaacttccaggtctatttagc

SEQ ID NO: 789211 - DNA, 22 bp, Artificial Sequence
  chemically synthesized
agccacactacgacatgtgcta

SEQ ID NO: 789212 - DNA, 22 bp, Artificial Sequence
  chemically synthesized
ccaggtctatttagcacatgtc

SEQ ID NO: 789213 - DNA, 22 bp, Artificial Sequence
  chemically synthesized
caggtctatttagcacatgtcg

SEQ ID NO: 789214 - DNA, 22 bp, Artificial Sequence
  chemically synthesized
tttagcacatgtcgtagtgtgg

SEQ ID NO: 789215 - DNA, 22 bp, Artificial Sequence
  chemically synthesized
agcacatgtcgtagtgtggctt

SEQ ID NO: 789216 - DNA, 22 bp, Artificial Sequence
  chemically synthesized
gcacatgtcgtagtgtggctta

SEQ ID NO: 789217 - DNA, 22 bp, Artificial Sequence
  chemically synthesized
atgcaccatgggttaagccaca

SEQ ID NO: 789218 - DNA, 22 bp, Artificial Sequence
  chemically synthesized
ttaatgcaccatgggttaagcc

SEQ ID NO: 789219 - DNA, 22 bp, Artificial Sequence
  chemically synthesized
gttaatgcaccatgggttaagc

SEQ ID NO: 789220 - DNA, 22 bp, Artificial Sequence
  chemically synthesized
tgttaatgcaccatgggttaag

SEQ ID NO: 789221 - DNA, 22 bp, Artificial Sequence
  chemically synthesized
ttttgttaatgcaccatgggtt

SEQ ID NO: 789222 - DNA, 22 bp, Artificial Sequence
  chemically synthesized
attttgttaatgcaccatgggt

SEQ ID NO: 789223 - DNA, 22 bp, Artificial Sequence
  chemically synthesized
tattttgttaatgcaccatggg

SEQ ID NO: 789224 - DNA, 22 bp, Artificial Sequence
  chemically synthesized
acctttattttgttaatgcacc

SEQ ID NO: 789225 - DNA, 22 bp, Artificial Sequence
  chemically synthesized
gacctttattttgttaatgcac

SEQ ID NO: 789226 - DNA, 22 bp, Artificial Sequence
  chemically synthesized
tgacctttattttgttaatgca

SEQ ID NO: 789227 - DNA, 22 bp, Artificial Sequence
  chemically synthesized
aacccatggtgcattaacaaaa

SEQ ID NO: 789228 - DNA, 22 bp, Artificial Sequence
  chemically synthesized
acccatggtgcattaacaaaat

SEQ ID NO: 789229 - DNA, 22 bp, Artificial Sequence
  chemically synthesized
actttgacctttattttgttaa

SEQ ID NO: 789230 - DNA, 22 bp, Artificial Sequence
  chemically synthesized
aactttgacctttattttgtta

SEQ ID NO: 789231 - DNA, 22 bp, Artificial Sequence
  chemically synthesized
aaatttaactttgacctttatt

SEQ ID NO: 789232 - DNA, 22 bp, Artificial Sequence
  chemically synthesized
taaaatttaactttgaccttta

SEQ ID NO: 789233 - DNA, 22 bp, Artificial Sequence
  chemically synthesized
ctaaaatttaactttgaccttt

SEQ ID NO: 789234 - DNA, 22 bp, Artificial Sequence
  chemically synthesized
tctaaaatttaactttgacctt

SEQ ID NO: 789235 - DNA, 22 bp, Artificial Sequence
  chemically synthesized
ttctaaaatttaactttgacct

SEQ ID NO: 789236 - DNA, 22 bp, Artificial Sequence
  chemically synthesized
tttctaaaatttaactttgacc

SEQ ID NO: 789237 - DNA, 22 bp, Artificial Sequence
  chemically synthesized
acaaaataaaggtcaaagttaa

SEQ ID NO: 789238 - DNA, 22 bp, Artificial Sequence
  chemically synthesized
ccctttttctaaaatttaactt

SEQ ID NO: 789239 - DNA, 22 bp, Artificial Sequence
  chemically synthesized
ttcccctttttctaaaatttaa

SEQ ID NO: 789240 - DNA, 22 bp, Artificial Sequence
  chemically synthesized
tgaggaatattgttcccctttt

SEQ ID NO: 789241 - DNA, 22 bp, Artificial Sequence
  chemically synthesized
gtgaggaatattgttccccttt

SEQ ID NO: 789242 - DNA, 22 bp, Artificial Sequence
  chemically synthesized
aattttagaaaaaggggaacaa

SEQ ID NO: 789243 - DNA, 22 bp, Artificial Sequence
  chemically synthesized
tagaaaaaggggaacaatattc

SEQ ID NO: 789244 - DNA, 22 bp, Artificial Sequence
  chemically synthesized
agaaaaaggggaacaatattcc

SEQ ID NO: 789245 - DNA, 22 bp, Artificial Sequence
  chemically synthesized
gaaaaaggggaacaatattcct

SEQ ID NO: 789246 - DNA, 22 bp, Artificial Sequence
  chemically synthesized
gaatgtcttgtgaggaatattg

SEQ ID NO: 789247 - DNA, 22 bp, Artificial Sequence
  chemically synthesized
tcccactggaatgtcttgtgag

SEQ ID NO: 789248 - DNA, 22 bp, Artificial Sequence
  chemically synthesized
atcccactggaatgtcttgtga

SEQ ID NO: 789249 - DNA, 22 bp, Artificial Sequence
  chemically synthesized
tatcccactggaatgtcttgtg

SEQ ID NO: 789250 - DNA, 22 bp, Artificial Sequence
  chemically synthesized
ttatcccactggaatgtcttgt

SEQ ID NO: 789251 - DNA, 22 bp, Artificial Sequence
  chemically synthesized
tttatcccactggaatgtcttg

SEQ ID NO: 789252 - DNA, 22 bp, Artificial Sequence
  chemically synthesized
tgttttttatcccactggaatg

SEQ ID NO: 789253 - DNA, 22 bp, Artificial Sequence
  chemically synthesized
ctcacaagacattccagtggga

SEQ ID NO: 789254 - DNA, 22 bp, Artificial Sequence
  chemically synthesized
acaagacattccagtgggataa

SEQ ID NO: 789255 - DNA, 22 bp, Artificial Sequence
  chemically synthesized
cagtgggataaaaaacacaggt

SEQ ID NO: 789256 - DNA, 22 bp, Artificial Sequence
  chemically synthesized
tcaatatagaaaaaaacctgtg

SEQ ID NO: 789257 - DNA, 22 bp, Artificial Sequence
  chemically synthesized
gtcaatatagaaaaaaacctgt

SEQ ID NO: 789258 - DNA, 22 bp, Artificial Sequence
  chemically synthesized
ggtttgtcaatatagaaaaaaa

SEQ ID NO: 789259 - DNA, 22 bp, Artificial Sequence
  chemically synthesized
agaatctaggtttgtcaatata

SEQ ID NO: 789260 - DNA, 22 bp, Artificial Sequence
  chemically synthesized
taattaagaatctaggtttgtc

SEQ ID NO: 789261 - DNA, 22 bp, Artificial Sequence
  chemically synthesized
ttttctatattgacaaacctag

SEQ ID NO: 789262 - DNA, 22 bp, Artificial Sequence
  chemically synthesized
tttctatattgacaaacctaga

SEQ ID NO: 789263 - DNA, 22 bp, Artificial Sequence
  chemically synthesized
ttctatattgacaaacctagat

SEQ ID NO: 789264 - DNA, 22 bp, Artificial Sequence
  chemically synthesized
ttataattaagaatctaggttt

SEQ ID NO: 789265 - DNA, 22 bp, Artificial Sequence
  chemically synthesized
tctatattgacaaacctagatt

SEQ ID NO: 789266 - DNA, 22 bp, Artificial Sequence
  chemically synthesized
ctatattgacaaacctagattc

SEQ ID NO: 789267 - DNA, 22 bp, Artificial Sequence
  chemically synthesized
tatattgacaaacctagattct

SEQ ID NO: 789268 - DNA, 22 bp, Artificial Sequence
  chemically synthesized
tattgacaaacctagattctta

SEQ ID NO: 789269 - DNA, 22 bp, Artificial Sequence
  chemically synthesized
acaaacctagattcttaattat

SEQ ID NO: 789270 - DNA, 22 bp, Artificial Sequence
  chemically synthesized
ggaagagttattataattaaga

SEQ ID NO: 789271 - DNA, 22 bp, Artificial Sequence
  chemically synthesized
gattcttaattataataactct

SEQ ID NO: 789272 - DNA, 22 bp, Artificial Sequence
  chemically synthesized
ttaattataataactcttccta

SEQ ID NO: 789273 - DNA, 22 bp, Artificial Sequence
  chemically synthesized
gatatagaccattaggaagagt

SEQ ID NO: 789274 - DNA, 22 bp, Artificial Sequence
  chemically synthesized
aattataataactcttcctaat

SEQ ID NO: 789275 - DNA, 22 bp, Artificial Sequence
  chemically synthesized
attataataactcttcctaatg

SEQ ID NO: 789276 - DNA, 22 bp, Artificial Sequence
  chemically synthesized
attagatatagaccattaggaa

SEQ ID NO: 789277 - DNA, 22 bp, Artificial Sequence
  chemically synthesized
taataactcttcctaatggtct

SEQ ID NO: 789278 - DNA, 22 bp, Artificial Sequence
  chemically synthesized
tacctgattagatatagaccat

SEQ ID NO: 789279 - DNA, 22 bp, Artificial Sequence
  chemically synthesized
cactgtacctgattagatatag

SEQ ID NO: 789280 - DNA, 22 bp, Artificial Sequence
  chemically synthesized
ttcctaatggtctatatctaat

SEQ ID NO: 789281 - DNA, 22 bp, Artificial Sequence
  chemically synthesized
cctaatggtctatatctaatca

SEQ ID NO: 789282 - DNA, 22 bp, Artificial Sequence
  chemically synthesized
ctaatggtctatatctaatcag

SEQ ID NO: 789283 - DNA, 22 bp, Artificial Sequence
  chemically synthesized
atattccactgtacctgattag

SEQ ID NO: 789284 - DNA, 22 bp, Artificial Sequence
  chemically synthesized
atggtctatatctaatcaggta

SEQ ID NO: 789285 - DNA, 22 bp, Artificial Sequence
  chemically synthesized
ttaatattccactgtacctgat

SEQ ID NO: 789286 - DNA, 22 bp, Artificial Sequence
  chemically synthesized
attaatattccactgtacctga

SEQ ID NO: 789287 - DNA, 22 bp, Artificial Sequence
  chemically synthesized
tatctaatcaggtacagtggaa

SEQ ID NO: 789288 - DNA, 22 bp, Artificial Sequence
  chemically synthesized
atcaggtacagtggaatattaa

SEQ ID NO: 789289 - DNA, 22 bp, Artificial Sequence
  chemically synthesized
acaatataaccagagaatataa

SEQ ID NO: 789290 - DNA, 22 bp, Artificial Sequence
  chemically synthesized
ataaacatgttttatattctct

SEQ ID NO: 789291 - DNA, 22 bp, Artificial Sequence
  chemically synthesized
aagtatccattaacaatataac

SEQ ID NO: 789292 - DNA, 22 bp, Artificial Sequence
  chemically synthesized
tatattctctggttatattgtt

SEQ ID NO: 789293 - DNA, 22 bp, Artificial Sequence
  chemically synthesized
atattctctggttatattgtta

SEQ ID NO: 789294 - DNA, 22 bp, Artificial Sequence
  chemically synthesized
tattctctggttatattgttaa

SEQ ID NO: 789295 - DNA, 22 bp, Artificial Sequence
  chemically synthesized
tctggttatattgttaatggat

SEQ ID NO: 789296 - DNA, 22 bp, Artificial Sequence
  chemically synthesized
agtgcattgaagtatccattaa

SEQ ID NO: 789297 - DNA, 22 bp, Artificial Sequence
  chemically synthesized
tggttatattgttaatggatac

SEQ ID NO: 789298 - DNA, 22 bp, Artificial Sequence
  chemically synthesized
gttatattgttaatggatactt

SEQ ID NO: 789299 - DNA, 22 bp, Artificial Sequence
  chemically synthesized
attcagtgcattgaagtatcca

SEQ ID NO: 789300 - DNA, 22 bp, Artificial Sequence
  chemically synthesized
taattcagtgcattgaagtatc

SEQ ID NO: 789301 - DNA, 22 bp, Artificial Sequence
  chemically synthesized
tattgttaatggatacttcaat

SEQ ID NO: 789302 - DNA, 22 bp, Artificial Sequence
  chemically synthesized
ctaattcagtgcattgaagtat

SEQ ID NO: 789303 - DNA, 22 bp, Artificial Sequence
  chemically synthesized
ttaatggatacttcaatgcact

SEQ ID NO: 789304 - DNA, 22 bp, Artificial Sequence
  chemically synthesized
atggatacttcaatgcactgaa

SEQ ID NO: 789305 - DNA, 22 bp, Artificial Sequence
  chemically synthesized
tagtgccttctaattcagtgca

SEQ ID NO: 789306 - DNA, 22 bp, Artificial Sequence
  chemically synthesized
caatgcactgaattagaaggca

SEQ ID NO: 789307 - DNA, 22 bp, Artificial Sequence
  chemically synthesized
aatgcactgaattagaaggcac

SEQ ID NO: 789308 - DNA, 22 bp, Artificial Sequence
  chemically synthesized
ataaaacaatatgcactgtagt

SEQ ID NO: 789309 - DNA, 22 bp, Artificial Sequence
  chemically synthesized
aattagaaggcactacagtgca

SEQ ID NO: 789310 - DNA, 22 bp, Artificial Sequence
  chemically synthesized
gataaaacaatatgcactgtag

SEQ ID NO: 789311 - DNA, 22 bp, Artificial Sequence
  chemically synthesized
gaaggcactacagtgcatattg

SEQ ID NO: 789312 - DNA, 22 bp, Artificial Sequence
  chemically synthesized
cccttgataaaacaatatgcac

SEQ ID NO: 789313 - DNA, 22 bp, Artificial Sequence
  chemically synthesized
gcccttgataaaacaatatgca

SEQ ID NO: 789314 - DNA, 22 bp, Artificial Sequence
  chemically synthesized
cagtgcatattgttttatcaag

SEQ ID NO: 789315 - DNA, 22 bp, Artificial Sequence
  chemically synthesized
ttttatcaagggcaagtttatt

SEQ ID NO: 789316 - DNA, 22 bp, Artificial Sequence
  chemically synthesized
catagatgaagcaaaataaact

SEQ ID NO: 789317 - DNA, 22 bp, Artificial Sequence
  chemically synthesized
tatcaagggcaagtttattttg

SEQ ID NO: 789318 - DNA, 22 bp, Artificial Sequence
  chemically synthesized
acatagatgaagcaaaataaac

SEQ ID NO: 789319 - DNA, 22 bp, Artificial Sequence
  chemically synthesized
atcaagggcaagtttattttgc

SEQ ID NO: 789320 - DNA, 22 bp, Artificial Sequence
  chemically synthesized
tacatagatgaagcaaaataaa

SEQ ID NO: 789321 - DNA, 22 bp, Artificial Sequence
  chemically synthesized
tcaagggcaagtttattttgct

SEQ ID NO: 789322 - DNA, 22 bp, Artificial Sequence
  chemically synthesized
ttacatagatgaagcaaaataa

SEQ ID NO: 789323 - DNA, 22 bp, Artificial Sequence
  chemically synthesized
attttgcttcatctatgtaaaa

SEQ ID NO: 789324 - DNA, 22 bp, Artificial Sequence
  chemically synthesized
ttttgcttcatctatgtaaaaa

SEQ ID NO: 789325 - DNA, 22 bp, Artificial Sequence
  chemically synthesized
aaaaaataatgtgtttttacat

SEQ ID NO: 789326 - DNA, 22 bp, Artificial Sequence
  chemically synthesized
caaaaaataatgtgtttttaca

SEQ ID NO: 789327 - DNA, 22 bp, Artificial Sequence
  chemically synthesized
tgcttcatctatgtaaaaacac

SEQ ID NO: 789328 - DNA, 22 bp, Artificial Sequence
  chemically synthesized
tcaaaaaataatgtgtttttac

SEQ ID NO: 789329 - DNA, 22 bp, Artificial Sequence
  chemically synthesized
gcttcatctatgtaaaaacaca

SEQ ID NO: 789330 - DNA, 22 bp, Artificial Sequence
  chemically synthesized
ttcaaaaaataatgtgttttta

SEQ ID NO: 789331 - DNA, 22 bp, Artificial Sequence
  chemically synthesized
cttcatctatgtaaaaacacat

SEQ ID NO: 789332 - DNA, 22 bp, Artificial Sequence
  chemically synthesized
catctatgtaaaaacacattat

SEQ ID NO: 789333 - DNA, 22 bp, Artificial Sequence
  chemically synthesized
tcttttcaaaaaataatgtgtt

SEQ ID NO: 789334 - DNA, 22 bp, Artificial Sequence
  chemically synthesized
atctatgtaaaaacacattatt

SEQ ID NO: 789335 - DNA, 22 bp, Artificial Sequence
  chemically synthesized
tgtaaaaacacattattttttg

SEQ ID NO: 789336 - DNA, 22 bp, Artificial Sequence
  chemically synthesized
aataataagttatcttttcaaa

SEQ ID NO: 789337 - DNA, 22 bp, Artificial Sequence
  chemically synthesized
aaataataagttatcttttcaa

SEQ ID NO: 789338 - DNA, 22 bp, Artificial Sequence
  chemically synthesized
cccttaaataataagttatctt

SEQ ID NO: 789339 - DNA, 22 bp, Artificial Sequence
  chemically synthesized
acccttaaataataagttatct

SEQ ID NO: 789340 - DNA, 22 bp, Artificial Sequence
  chemically synthesized
ttttttgaaaagataacttatt

SEQ ID NO: 789341 - DNA, 22 bp, Artificial Sequence
  chemically synthesized
ttacccttaaataataagttat

SEQ ID NO: 789342 - DNA, 22 bp, Artificial Sequence
  chemically synthesized
tttgaaaagataacttattatt

SEQ ID NO: 789343 - DNA, 22 bp, Artificial Sequence
  chemically synthesized
ttgaaaagataacttattattt

SEQ ID NO: 789344 - DNA, 22 bp, Artificial Sequence
  chemically synthesized
tgaaaagataacttattattta

SEQ ID NO: 789345 - DNA, 22 bp, Artificial Sequence
  chemically synthesized
gaaaagataacttattatttaa

SEQ ID NO: 789346 - DNA, 22 bp, Artificial Sequence
  chemically synthesized
atactcttacccttaaataata

SEQ ID NO: 789347 - DNA, 22 bp, Artificial Sequence
  chemically synthesized
aaaagataacttattatttaag

SEQ ID NO: 789348 - DNA, 22 bp, Artificial Sequence
  chemically synthesized
taatactcttacccttaaataa

SEQ ID NO: 789349 - DNA, 22 bp, Artificial Sequence
  chemically synthesized
atattctaatactcttaccctt

SEQ ID NO: 789350 - DNA, 22 bp, Artificial Sequence
  chemically synthesized
aatattctaatactcttaccct

SEQ ID NO: 789351 - DNA, 22 bp, Artificial Sequence
  chemically synthesized
taatattctaatactcttaccc

SEQ ID NO: 789352 - DNA, 22 bp, Artificial Sequence
  chemically synthesized
ttaatattctaatactcttacc

SEQ ID NO: 789353 - DNA, 22 bp, Artificial Sequence
  chemically synthesized
attatttaagggtaagagtatt

SEQ ID NO: 789354 - DNA, 22 bp, Artificial Sequence
  chemically synthesized
ttatttaagggtaagagtatta

SEQ ID NO: 789355 - DNA, 22 bp, Artificial Sequence
  chemically synthesized
tttaagggtaagagtattagaa

SEQ ID NO: 789356 - DNA, 22 bp, Artificial Sequence
  chemically synthesized
aagggtaagagtattagaatat

SEQ ID NO: 789357 - DNA, 22 bp, Artificial Sequence
  chemically synthesized
agggtaagagtattagaatatt

SEQ ID NO: 789358 - DNA, 22 bp, Artificial Sequence
  chemically synthesized
tgatcaatttttaatattctaa

SEQ ID NO: 789359 - DNA, 22 bp, Artificial Sequence
  chemically synthesized
tgtgatcaatttttaatattct

SEQ ID NO: 789360 - DNA, 22 bp, Artificial Sequence
  chemically synthesized
ctgtgatcaatttttaatattc

SEQ ID NO: 789361 - DNA, 22 bp, Artificial Sequence
  chemically synthesized
tctgtgatcaatttttaatatt

SEQ ID NO: 789362 - DNA, 22 bp, Artificial Sequence
  chemically synthesized
tttctgtgatcaatttttaata

SEQ ID NO: 789363 - DNA, 22 bp, Artificial Sequence
  chemically synthesized
gaatattaaaaattgatcacag

SEQ ID NO: 789364 - DNA, 22 bp, Artificial Sequence
  chemically synthesized
tccatccctctttctgtgatca

SEQ ID NO: 789365 - DNA, 22 bp, Artificial Sequence
  chemically synthesized
atctatccatccctctttctgt

SEQ ID NO: 789366 - DNA, 22 bp, Artificial Sequence
  chemically synthesized
aaaattgatcacagaaagaggg

SEQ ID NO: 789367 - DNA, 22 bp, Artificial Sequence
  chemically synthesized
catattcatctatccatccctc

SEQ ID NO: 789368 - DNA, 22 bp, Artificial Sequence
  chemically synthesized
atcacagaaagagggatggata

SEQ ID NO: 789369 - DNA, 22 bp, Artificial Sequence
  chemically synthesized
ttacatattcatctatccatcc

SEQ ID NO: 789370 - DNA, 22 bp, Artificial Sequence
  chemically synthesized
attacatattcatctatccatc

SEQ ID NO: 789371 - DNA, 22 bp, Artificial Sequence
  chemically synthesized
atttattacatattcatctatc

SEQ ID NO: 789372 - DNA, 22 bp, Artificial Sequence
  chemically synthesized
gatttattacatattcatctat

SEQ ID NO: 789373 - DNA, 22 bp, Artificial Sequence
  chemically synthesized
tacttgatttattacatattca

SEQ ID NO: 789374 - DNA, 22 bp, Artificial Sequence
  chemically synthesized
ctatacttgatttattacatat

SEQ ID NO: 789375 - DNA, 22 bp, Artificial Sequence
  chemically synthesized
actatacttgatttattacata

SEQ ID NO: 789376 - DNA, 22 bp, Artificial Sequence
  chemically synthesized
tactatacttgatttattacat

SEQ ID NO: 789377 - DNA, 22 bp, Artificial Sequence
  chemically synthesized
aaattttactatacttgattta

SEQ ID NO: 789378 - DNA, 22 bp, Artificial Sequence
  chemically synthesized
ccattgaaattttactatactt

SEQ ID NO: 789379 - DNA, 22 bp, Artificial Sequence
  chemically synthesized
gccattgaaattttactatact

SEQ ID NO: 789380 - DNA, 22 bp, Artificial Sequence
  chemically synthesized
tgccattgaaattttactatac

SEQ ID NO: 789381 - DNA, 22 bp, Artificial Sequence
  chemically synthesized
tactttgccattgaaattttac

SEQ ID NO: 789382 - DNA, 22 bp, Artificial Sequence
  chemically synthesized
tatacccagcacctatactttg

SEQ ID NO: 789383 - DNA, 22 bp, Artificial Sequence
  chemically synthesized
caatggcaaagtataggtgctg

SEQ ID NO: 789384 - DNA, 22 bp, Artificial Sequence
  chemically synthesized
aatggcaaagtataggtgctgg

SEQ ID NO: 789385 - DNA, 22 bp, Artificial Sequence
  chemically synthesized
cggtcaacatctgtatacccag

SEQ ID NO: 789386 - DNA, 22 bp, Artificial Sequence
  chemically synthesized
acggtcaacatctgtataccca

SEQ ID NO: 789387 - DNA, 22 bp, Artificial Sequence
  chemically synthesized
ggtatacagatgttgaccgtaa

SEQ ID NO: 789388 - DNA, 22 bp, Artificial Sequence
  chemically synthesized
atcatacagcaaagtcgaaaga

SEQ ID NO: 789389 - DNA, 22 bp, Artificial Sequence
  chemically synthesized
accgtaaatttctttcgacttt

SEQ ID NO: 789390 - DNA, 22 bp, Artificial Sequence
  chemically synthesized
aaatggctaatcatacagcaaa

SEQ ID NO: 789391 - DNA, 22 bp, Artificial Sequence
  chemically synthesized
ctttcgactttgctgtatgatt

SEQ ID NO: 789392 - DNA, 22 bp, Artificial Sequence
  chemically synthesized
tttcgactttgctgtatgatta

SEQ ID NO: 789393 - DNA, 22 bp, Artificial Sequence
  chemically synthesized
atattaaaatggctaatcatac

SEQ ID NO: 789394 - DNA, 22 bp, Artificial Sequence
  chemically synthesized
tcgactttgctgtatgattagc

SEQ ID NO: 789395 - DNA, 22 bp, Artificial Sequence
  chemically synthesized
aatattaaaatggctaatcata

SEQ ID NO: 789396 - DNA, 22 bp, Artificial Sequence
  chemically synthesized
cgactttgctgtatgattagcc

SEQ ID NO: 789397 - DNA, 22 bp, Artificial Sequence
  chemically synthesized
taatattaaaatggctaatcat

SEQ ID NO: 789398 - DNA, 22 bp, Artificial Sequence
  chemically synthesized
gactttgctgtatgattagcca

SEQ ID NO: 789399 - DNA, 22 bp, Artificial Sequence
  chemically synthesized
tgctgtatgattagccatttta

SEQ ID NO: 789400 - DNA, 22 bp, Artificial Sequence
  chemically synthesized
gctgtatgattagccattttaa

SEQ ID NO: 789401 - DNA, 22 bp, Artificial Sequence
  chemically synthesized
ctgtatgattagccattttaat

SEQ ID NO: 789402 - DNA, 22 bp, Artificial Sequence
  chemically synthesized
tcgatgttttaatattaaaatg

SEQ ID NO: 789403 - DNA, 22 bp, Artificial Sequence
  chemically synthesized
tatgattagccattttaatatt

SEQ ID NO: 789404 - DNA, 22 bp, Artificial Sequence
  chemically synthesized
ttgtcgatgttttaatattaaa

SEQ ID NO: 789405 - DNA, 22 bp, Artificial Sequence
  chemically synthesized
ttgttgtcgatgttttaatatt

SEQ ID NO: 789406 - DNA, 22 bp, Artificial Sequence
  chemically synthesized
gccattttaatattaaaacatc

SEQ ID NO: 789407 - DNA, 22 bp, Artificial Sequence
  chemically synthesized
ggattattgttgtcgatgtttt

SEQ ID NO: 789408 - DNA, 22 bp, Artificial Sequence
  chemically synthesized
aggattattgttgtcgatgttt

SEQ ID NO: 789409 - DNA, 22 bp, Artificial Sequence
  chemically synthesized
taatattaaaacatcgacaaca

SEQ ID NO: 789410 - DNA, 22 bp, Artificial Sequence
  chemically synthesized
aatattaaaacatcgacaacaa

SEQ ID NO: 789411 - DNA, 22 bp, Artificial Sequence
  chemically synthesized
atattaaaacatcgacaacaat

SEQ ID NO: 789412 - DNA, 22 bp, Artificial Sequence
  chemically synthesized
caatttaggattattgttgtcg

SEQ ID NO: 789413 - DNA, 22 bp, Artificial Sequence
  chemically synthesized
acaatttaggattattgttgtc

SEQ ID NO: 789414 - DNA, 22 bp, Artificial Sequence
  chemically synthesized
aaacatcgacaacaataatcct

SEQ ID NO: 789415 - DNA, 22 bp, Artificial Sequence
  chemically synthesized
aattgtaagcactgtatcttta

SEQ ID NO: 789416 - DNA, 22 bp, Artificial Sequence
  chemically synthesized
gtatacaagtatgtaaagatac

SEQ ID NO: 789417 - DNA, 22 bp, Artificial Sequence
  chemically synthesized
taagcactgtatctttacatac

SEQ ID NO: 789418 - DNA, 22 bp, Artificial Sequence
  chemically synthesized
tatctttacatacttgtatacc

SEQ ID NO: 789419 - DNA, 22 bp, Artificial Sequence
  chemically synthesized
caaaatggtggcactggtatac

SEQ ID NO: 789420 - DNA, 22 bp, Artificial Sequence
  chemically synthesized
tacatacttgtataccagtgcc

SEQ ID NO: 789421 - DNA, 22 bp, Artificial Sequence
  chemically synthesized
acatacttgtataccagtgcca

SEQ ID NO: 789422 - DNA, 22 bp, Artificial Sequence
  chemically synthesized
gctacaaaatggtggcactggt

SEQ ID NO: 789423 - DNA, 22 bp, Artificial Sequence
  chemically synthesized
catacttgtataccagtgccac

SEQ ID NO: 789424 - DNA, 22 bp, Artificial Sequence
  chemically synthesized
gtataccagtgccaccattttg

SEQ ID NO: 789425 - DNA, 22 bp, Artificial Sequence
  chemically synthesized
tataccagtgccaccattttgt

SEQ ID NO: 789426 - DNA, 22 bp, Artificial Sequence
  chemically synthesized
cagaaaaggaattagctacaaa

SEQ ID NO: 789427 - DNA, 22 bp, Artificial Sequence
  chemically synthesized
acagaaaaggaattagctacaa

SEQ ID NO: 789428 - DNA, 22 bp, Artificial Sequence
  chemically synthesized
ataatcacatttacagaaaagg

SEQ ID NO: 789429 - DNA, 22 bp, Artificial Sequence
  chemically synthesized
tgtagctaattccttttctgta

SEQ ID NO: 789430 - DNA, 22 bp, Artificial Sequence
  chemically synthesized
aataatcacatttacagaaaag

SEQ ID NO: 789431 - DNA, 22 bp, Artificial Sequence
  chemically synthesized
gtagctaattccttttctgtaa

SEQ ID NO: 789432 - DNA, 22 bp, Artificial Sequence
  chemically synthesized
tagctaattccttttctgtaaa

SEQ ID NO: 789433 - DNA, 22 bp, Artificial Sequence
  chemically synthesized
aaggtttaataatcacatttac

SEQ ID NO: 789434 - DNA, 22 bp, Artificial Sequence
  chemically synthesized
attccttttctgtaaatgtgat

SEQ ID NO: 789435 - DNA, 22 bp, Artificial Sequence
  chemically synthesized
cttttctgtaaatgtgattatt

SEQ ID NO: 789436 - DNA, 22 bp, Artificial Sequence
  chemically synthesized
agtgttaaaggtttaataatca

SEQ ID NO: 789437 - DNA, 22 bp, Artificial Sequence
  chemically synthesized
ttctgtaaatgtgattattaaa

SEQ ID NO: 789438 - DNA, 22 bp, Artificial Sequence
  chemically synthesized
cagtgttaaaggtttaataatc

SEQ ID NO: 789439 - DNA, 22 bp, Artificial Sequence
  chemically synthesized
tctgtaaatgtgattattaaac

SEQ ID NO: 789440 - DNA, 22 bp, Artificial Sequence
  chemically synthesized
ctgtaaatgtgattattaaacc

SEQ ID NO: 789441 - DNA, 22 bp, Artificial Sequence
  chemically synthesized
tgtaaatgtgattattaaacct

SEQ ID NO: 789442 - DNA, 22 bp, Artificial Sequence
  chemically synthesized
taaatgtgattattaaaccttt

SEQ ID NO: 789443 - DNA, 22 bp, Artificial Sequence
  chemically synthesized
ttaaacctttaacactgaaata

SEQ ID NO: 789444 - DNA, 22 bp, Artificial Sequence
  chemically synthesized
aacctttaacactgaaatatct

SEQ ID NO: 789445 - DNA, 22 bp, Artificial Sequence
  chemically synthesized
taacactgaaatatctggcaca

SEQ ID NO: 789446 - DNA, 22 bp, Artificial Sequence
  chemically synthesized
catatgtatacatgtgccagat

SEQ ID NO: 789447 - DNA, 22 bp, Artificial Sequence
  chemically synthesized
aacactgaaatatctggcacat

SEQ ID NO: 789448 - DNA, 22 bp, Artificial Sequence
  chemically synthesized
acactgaaatatctggcacatg

SEQ ID NO: 789449 - DNA, 22 bp, Artificial Sequence
  chemically synthesized
gttacatatgtatacatgtgcc

SEQ ID NO: 789450 - DNA, 22 bp, Artificial Sequence
  chemically synthesized
aaatatctggcacatgtataca

SEQ ID NO: 789451 - DNA, 22 bp, Artificial Sequence
  chemically synthesized
gcacatgtatacatatgtaact

SEQ ID NO: 789452 - DNA, 22 bp, Artificial Sequence
  chemically synthesized
gggtacatgtgcacaatgtgca

SEQ ID NO: 789453 - DNA, 22 bp, Artificial Sequence
  chemically synthesized
agggtacatgtgcacaatgtgc

SEQ ID NO: 789454 - DNA, 22 bp, Artificial Sequence
  chemically synthesized
tagggtacatgtgcacaatgtg

SEQ ID NO: 789455 - DNA, 22 bp, Artificial Sequence
  chemically synthesized
agttttagggtacatgtgcaca

SEQ ID NO: 789456 - DNA, 22 bp, Artificial Sequence
  chemically synthesized
aagttttagggtacatgtgcac

SEQ ID NO: 789457 - DNA, 22 bp, Artificial Sequence
  chemically synthesized
acctgcacattgtgcacatgta

SEQ ID NO: 789458 - DNA, 22 bp, Artificial Sequence
  chemically synthesized
taagttttagggtacatgtgca

SEQ ID NO: 789459 - DNA, 22 bp, Artificial Sequence
  chemically synthesized
cacattgtgcacatgtacccta

SEQ ID NO: 789460 - DNA, 22 bp, Artificial Sequence
  chemically synthesized
tactttaagttttagggtacat

SEQ ID NO: 789461 - DNA, 22 bp, Artificial Sequence
  chemically synthesized
ttatactttaagttttagggta

SEQ ID NO: 789462 - DNA, 22 bp, Artificial Sequence
  chemically synthesized
ttattatactttaagttttagg

SEQ ID NO: 789463 - DNA, 22 bp, Artificial Sequence
  chemically synthesized
tgcacatgtaccctaaaactta

SEQ ID NO: 789464 - DNA, 22 bp, Artificial Sequence
  chemically synthesized
ttattattatactttaagtttt

SEQ ID NO: 789465 - DNA, 22 bp, Artificial Sequence
  chemically synthesized
attattattatactttaagttt

SEQ ID NO: 789466 - DNA, 22 bp, Artificial Sequence
  chemically synthesized
tattattattatactttaagtt

SEQ ID NO: 789467 - DNA, 22 bp, Artificial Sequence
  chemically synthesized
ttttattattattatactttaa

SEQ ID NO: 789468 - DNA, 22 bp, Artificial Sequence
  chemically synthesized
attttattattattatacttta

SEQ ID NO: 789469 - DNA, 22 bp, Artificial Sequence
  chemically synthesized
tattttattattattatacttt

SEQ ID NO: 789470 - DNA, 22 bp, Artificial Sequence
  chemically synthesized
ttttattttattattattatac

SEQ ID NO: 789471 - DNA, 22 bp, Artificial Sequence
  chemically synthesized
attttattttattattattata

SEQ ID NO: 789472 - DNA, 22 bp, Artificial Sequence
  chemically synthesized
tattttattttattattattat

SEQ ID NO: 789473 - DNA, 22 bp, Artificial Sequence
  chemically synthesized
aaacttaaagtataataataat

SEQ ID NO: 789474 - DNA, 22 bp, Artificial Sequence
  chemically synthesized
ttattttattttattattatta

SEQ ID NO: 789475 - DNA, 22 bp, Artificial Sequence
  chemically synthesized
aatttttattttattttattat

SEQ ID NO: 789476 - DNA, 22 bp, Artificial Sequence
  chemically synthesized
aaagtataataataataaaata

SEQ ID NO: 789477 - DNA, 22 bp, Artificial Sequence
  chemically synthesized
caatttttattttattttatta

SEQ ID NO: 789478 - DNA, 22 bp, Artificial Sequence
  chemically synthesized
aagtataataataataaaataa

SEQ ID NO: 789479 - DNA, 22 bp, Artificial Sequence
  chemically synthesized
agatatttcaatttttatttta

SEQ ID NO: 789480 - DNA, 22 bp, Artificial Sequence
  chemically synthesized
cagatatttcaatttttatttt

SEQ ID NO: 789481 - DNA, 22 bp, Artificial Sequence
  chemically synthesized
tttcagatatttcaatttttat

SEQ ID NO: 789482 - DNA, 22 bp, Artificial Sequence
  chemically synthesized
gtttcagatatttcaattttta

SEQ ID NO: 789483 - DNA, 22 bp, Artificial Sequence
  chemically synthesized
tgtttcagatatttcaattttt

SEQ ID NO: 789484 - DNA, 22 bp, Artificial Sequence
  chemically synthesized
aaactttgtttcagatatttca

SEQ ID NO: 789485 - DNA, 22 bp, Artificial Sequence
  chemically synthesized
aaatatctgaaacaaagtttta

SEQ ID NO: 789486 - DNA, 22 bp, Artificial Sequence
  chemically synthesized
tacaggatgaacacgcccccta

SEQ ID NO: 789487 - DNA, 22 bp, Artificial Sequence
  chemically synthesized
aaacaaagttttagggggcgtg

SEQ ID NO: 789488 - DNA, 22 bp, Artificial Sequence
  chemically synthesized
agtaagttgtacaggatgaaca

SEQ ID NO: 789489 - DNA, 22 bp, Artificial Sequence
  chemically synthesized
tcagtaagttgtacaggatgaa

SEQ ID NO: 789490 - DNA, 22 bp, Artificial Sequence
  chemically synthesized
tagggggcgtgttcatcctgta

SEQ ID NO: 789491 - DNA, 22 bp, Artificial Sequence
  chemically synthesized
agggggcgtgttcatcctgtac

SEQ ID NO: 789492 - DNA, 22 bp, Artificial Sequence
  chemically synthesized
gggggcgtgttcatcctgtaca

SEQ ID NO: 789493 - DNA, 22 bp, Artificial Sequence
  chemically synthesized
caaatctctcagtaagttgtac

SEQ ID NO: 789494 - DNA, 22 bp, Artificial Sequence
  chemically synthesized
atcctgtacaacttactgagag

SEQ ID NO: 789495 - DNA, 22 bp, Artificial Sequence
  chemically synthesized
tacaacttactgagagatttgt

SEQ ID NO: 789496 - DNA, 22 bp, Artificial Sequence
  chemically synthesized
gtccatagggcattacaaatct

SEQ ID NO: 789497 - DNA, 22 bp, Artificial Sequence
  chemically synthesized
tggtccatagggcattacaaat

SEQ ID NO: 789498 - DNA, 22 bp, Artificial Sequence
  chemically synthesized
actgagagatttgtaatgccct

SEQ ID NO: 789499 - DNA, 22 bp, Artificial Sequence
  chemically synthesized
ctgagagatttgtaatgcccta

SEQ ID NO: 789500 - DNA, 22 bp, Artificial Sequence
  chemically synthesized
gacctctggtccatagggcatt

SEQ ID NO: 789501 - DNA, 22 bp, Artificial Sequence
  chemically synthesized
agagatttgtaatgccctatgg

SEQ ID NO: 789502 - DNA, 22 bp, Artificial Sequence
  chemically synthesized
agactagacctctggtccatag

SEQ ID NO: 789503 - DNA, 22 bp, Artificial Sequence
  chemically synthesized
cagactagacctctggtccata

SEQ ID NO: 789504 - DNA, 22 bp, Artificial Sequence
  chemically synthesized
gtaatgccctatggaccagagg

SEQ ID NO: 789505 - DNA, 22 bp, Artificial Sequence
  chemically synthesized
taatgccctatggaccagaggt

SEQ ID NO: 789506 - DNA, 22 bp, Artificial Sequence
  chemically synthesized
aaacttcagactagacctctgg

SEQ ID NO: 789507 - DNA, 22 bp, Artificial Sequence
  chemically synthesized
tggaccagaggtctagtctgaa

SEQ ID NO: 789508 - DNA, 22 bp, Artificial Sequence
  chemically synthesized
aaaataacctcaaacttcagac

SEQ ID NO: 789509 - DNA, 22 bp, Artificial Sequence
  chemically synthesized
aaaaataacctcaaacttcaga

SEQ ID NO: 789510 - DNA, 22 bp, Artificial Sequence
  chemically synthesized
taaaaataacctcaaacttcag

SEQ ID NO: 789511 - DNA, 22 bp, Artificial Sequence
  chemically synthesized
tttaaaaataacctcaaacttc

SEQ ID NO: 789512 - DNA, 22 bp, Artificial Sequence
  chemically synthesized
ctttaaaaataacctcaaactt

SEQ ID NO: 789513 - DNA, 22 bp, Artificial Sequence
  chemically synthesized
tctttaaaaataacctcaaact

SEQ ID NO: 789514 - DNA, 22 bp, Artificial Sequence
  chemically synthesized
tttctttaaaaataacctcaaa

SEQ ID NO: 789515 - DNA, 22 bp, Artificial Sequence
  chemically synthesized
ttctttctttaaaaataacctc

SEQ ID NO: 789516 - DNA, 22 bp, Artificial Sequence
  chemically synthesized
gtctgaagtttgaggttatttt

SEQ ID NO: 789517 - DNA, 22 bp, Artificial Sequence
  chemically synthesized
attctttctttaaaaataacct

SEQ ID NO: 789518 - DNA, 22 bp, Artificial Sequence
  chemically synthesized
ttattctttctttaaaaataac

SEQ ID NO: 789519 - DNA, 22 bp, Artificial Sequence
  chemically synthesized
aagtttgaggttatttttaaag

SEQ ID NO: 789520 - DNA, 22 bp, Artificial Sequence
  chemically synthesized
gaggttatttttaaagaaagaa

SEQ ID NO: 789521 - DNA, 22 bp, Artificial Sequence
  chemically synthesized
aacgaattcttattctttcttt

SEQ ID NO: 789522 - DNA, 22 bp, Artificial Sequence
  chemically synthesized
aggttatttttaaagaaagaat

SEQ ID NO: 789523 - DNA, 22 bp, Artificial Sequence
  chemically synthesized
tttttaaagaaagaataagaat

SEQ ID NO: 789524 - DNA, 22 bp, Artificial Sequence
  chemically synthesized
ccatcctcaacgaattcttatt

SEQ ID NO: 789525 - DNA, 22 bp, Artificial Sequence
  chemically synthesized
cccatcctcaacgaattcttat

SEQ ID NO: 789526 - DNA, 22 bp, Artificial Sequence
  chemically synthesized
ttaaagaaagaataagaattcg

SEQ ID NO: 789527 - DNA, 22 bp, Artificial Sequence
  chemically synthesized
taaagaaagaataagaattcgt

SEQ ID NO: 789528 - DNA, 22 bp, Artificial Sequence
  chemically synthesized
aaagaaagaataagaattcgtt

SEQ ID NO: 789529 - DNA, 22 bp, Artificial Sequence
  chemically synthesized
aagaaagaataagaattcgttg

SEQ ID NO: 789530 - DNA, 22 bp, Artificial Sequence
  chemically synthesized
cccaacttcccatcctcaacga

SEQ ID NO: 789531 - DNA, 22 bp, Artificial Sequence
  chemically synthesized
tacccaacttcccatcctcaac

SEQ ID NO: 789532 - DNA, 22 bp, Artificial Sequence
  chemically synthesized
ctacccaacttcccatcctcaa

SEQ ID NO: 789533 - DNA, 22 bp, Artificial Sequence
  chemically synthesized
gttgaggatgggaagttgggta

SEQ ID NO: 789534 - DNA, 22 bp, Artificial Sequence
  chemically synthesized
ccgcaaagaccttctacccaac

SEQ ID NO: 789535 - DNA, 22 bp, Artificial Sequence
  chemically synthesized
aggatgggaagttgggtagaag

SEQ ID NO: 789536 - DNA, 22 bp, Artificial Sequence
  chemically synthesized
catctgccgcaaagaccttcta

SEQ ID NO: 789537 - DNA, 22 bp, Artificial Sequence
  chemically synthesized
ccatctgccgcaaagaccttct

SEQ ID NO: 789538 - DNA, 22 bp, Artificial Sequence
  chemically synthesized
ggtagaaggtctttgcggcaga

SEQ ID NO: 789539 - DNA, 22 bp, Artificial Sequence
  chemically synthesized
cgtcccaatacttccatctgcc

SEQ ID NO: 789540 - DNA, 22 bp, Artificial Sequence
  chemically synthesized
acgtcccaatacttccatctgc

SEQ ID NO: 789541 - DNA, 22 bp, Artificial Sequence
  chemically synthesized
tgcggcagatggaagtattggg

SEQ ID NO: 789542 - DNA, 22 bp, Artificial Sequence
  chemically synthesized
tccaccttacgtcccaatactt

SEQ ID NO: 789543 - DNA, 22 bp, Artificial Sequence
  chemically synthesized
gcggcagatggaagtattggga

SEQ ID NO: 789544 - DNA, 22 bp, Artificial Sequence
  chemically synthesized
cggcagatggaagtattgggac

SEQ ID NO: 789545 - DNA, 22 bp, Artificial Sequence
  chemically synthesized
gatattatccaccttacgtccc

SEQ ID NO: 789546 - DNA, 22 bp, Artificial Sequence
  chemically synthesized
cctggatattatccaccttacg

SEQ ID NO: 789547 - DNA, 22 bp, Artificial Sequence
  chemically synthesized
aggctgcctggatattatccac

SEQ ID NO: 789548 - DNA, 22 bp, Artificial Sequence
  chemically synthesized
aaggctgcctggatattatcca

SEQ ID NO: 789549 - DNA, 22 bp, Artificial Sequence
  chemically synthesized
ggacgtaaggtggataatatcc

SEQ ID NO: 789550 - DNA, 22 bp, Artificial Sequence
  chemically synthesized
agtgatatatgtggcagaaaat

SEQ ID NO: 789551 - DNA, 22 bp, Artificial Sequence
  chemically synthesized
gagtgatatatgtggcagaaaa

SEQ ID NO: 789552 - DNA, 22 bp, Artificial Sequence
  chemically synthesized
cttgagtgatatatgtggcaga

SEQ ID NO: 789553 - DNA, 22 bp, Artificial Sequence
  chemically synthesized
tccttgagtgatatatgtggca

SEQ ID NO: 789554 - DNA, 22 bp, Artificial Sequence
  chemically synthesized
aaattttctgccacatatatca

SEQ ID NO: 789555 - DNA, 22 bp, Artificial Sequence
  chemically synthesized
aattttctgccacatatatcac

SEQ ID NO: 789556 - DNA, 22 bp, Artificial Sequence
  chemically synthesized
cactctccttgagtgatatatg

SEQ ID NO: 789557 - DNA, 22 bp, Artificial Sequence
  chemically synthesized
ccactctccttgagtgatatat

SEQ ID NO: 789558 - DNA, 22 bp, Artificial Sequence
  chemically synthesized
ttccactctccttgagtgatat

SEQ ID NO: 789559 - DNA, 22 bp, Artificial Sequence
  chemically synthesized
cttccactctccttgagtgata

SEQ ID NO: 789560 - DNA, 22 bp, Artificial Sequence
  chemically synthesized
tctgccacatatatcactcaag

SEQ ID NO: 789561 - DNA, 22 bp, Artificial Sequence
  chemically synthesized
ctgccacatatatcactcaagg

SEQ ID NO: 789562 - DNA, 22 bp, Artificial Sequence
  chemically synthesized
tgccacatatatcactcaagga

SEQ ID NO: 789563 - DNA, 22 bp, Artificial Sequence
  chemically synthesized
ccacatatatcactcaaggaga

SEQ ID NO: 789564 - DNA, 22 bp, Artificial Sequence
  chemically synthesized
caaggccccatttcttccactc

SEQ ID NO: 789565 - DNA, 22 bp, Artificial Sequence
  chemically synthesized
tccaaggccccatttcttccac

SEQ ID NO: 789566 - DNA, 22 bp, Artificial Sequence
  chemically synthesized
aaggagagtggaagaaatgggg

SEQ ID NO: 789567 - DNA, 22 bp, Artificial Sequence
  chemically synthesized
ggagagattatgtcatgtgtga

SEQ ID NO: 789568 - DNA, 22 bp, Artificial Sequence
  chemically synthesized
gagagattatgtcatgtgtgac

SEQ ID NO: 789569 - DNA, 22 bp, Artificial Sequence
  chemically synthesized
gtgtagcatgcaaggtcacaca

SEQ ID NO: 789570 - DNA, 22 bp, Artificial Sequence
  chemically synthesized
ggtgtagcatgcaaggtcacac

SEQ ID NO: 789571 - DNA, 22 bp, Artificial Sequence
  chemically synthesized
cttggtgtagcatgcaaggtca

SEQ ID NO: 789572 - DNA, 22 bp, Artificial Sequence
  chemically synthesized
tgtcatgtgtgaccttgcatgc

SEQ ID NO: 789573 - DNA, 22 bp, Artificial Sequence
  chemically synthesized
ccacctccttggtgtagcatgc

SEQ ID NO: 789574 - DNA, 22 bp, Artificial Sequence
  chemically synthesized
agataaattcccacctccttgg

SEQ ID NO: 789575 - DNA, 22 bp, Artificial Sequence
  chemically synthesized
aagataaattcccacctccttg

SEQ ID NO: 789576 - DNA, 22 bp, Artificial Sequence
  chemically synthesized
gcatgctacaccaaggaggtgg

SEQ ID NO: 789577 - DNA, 22 bp, Artificial Sequence
  chemically synthesized
taagataaattcccacctcctt

SEQ ID NO: 789578 - DNA, 22 bp, Artificial Sequence
  chemically synthesized
catgctacaccaaggaggtggg

SEQ ID NO: 789579 - DNA, 22 bp, Artificial Sequence
  chemically synthesized
caccaaggaggtgggaatttat

SEQ ID NO: 789580 - DNA, 22 bp, Artificial Sequence
  chemically synthesized
aatacctttaagataaattccc

SEQ ID NO: 789581 - DNA, 22 bp, Artificial Sequence
  chemically synthesized
caatacctttaagataaattcc

SEQ ID NO: 789582 - DNA, 22 bp, Artificial Sequence
  chemically synthesized
ttcaatacctttaagataaatt

SEQ ID NO: 789583 - DNA, 22 bp, Artificial Sequence
  chemically synthesized
aaattcttcaatacctttaaga

SEQ ID NO: 789584 - DNA, 22 bp, Artificial Sequence
  chemically synthesized
gaaattcttcaatacctttaag

SEQ ID NO: 789585 - DNA, 22 bp, Artificial Sequence
  chemically synthesized
atgtttgaaattcttcaatacc

SEQ ID NO: 789586 - DNA, 22 bp, Artificial Sequence
  chemically synthesized
atcttaaaggtattgaagaatt

SEQ ID NO: 789587 - DNA, 22 bp, Artificial Sequence
  chemically synthesized
tcttaaaggtattgaagaattt

SEQ ID NO: 789588 - DNA, 22 bp, Artificial Sequence
  chemically synthesized
aaaggtattgaagaatttcaaa

SEQ ID NO: 789589 - DNA, 22 bp, Artificial Sequence
  chemically synthesized
aaggtattgaagaatttcaaac

SEQ ID NO: 789590 - DNA, 22 bp, Artificial Sequence
  chemically synthesized
aagaatttcaaacatgagtatg

SEQ ID NO: 789591 - DNA, 22 bp, Artificial Sequence
  chemically synthesized
atgccgtcacccccatactcat

SEQ ID NO: 789592 - DNA, 22 bp, Artificial Sequence
  chemically synthesized
caaacatgagtatgggggtgac

SEQ ID NO: 789593 - DNA, 22 bp, Artificial Sequence
  chemically synthesized
aaacatgagtatgggggtgacg

SEQ ID NO: 789594 - DNA, 22 bp, Artificial Sequence
  chemically synthesized
acatgaaggctgatgccgtcac

SEQ ID NO: 789595 - DNA, 22 bp, Artificial Sequence
  chemically synthesized
tgacatgaaggctgatgccgtc

SEQ ID NO: 789596 - DNA, 22 bp, Artificial Sequence
  chemically synthesized
ctgacatgaaggctgatgccgt

SEQ ID NO: 789597 - DNA, 22 bp, Artificial Sequence
  chemically synthesized
tcttctgacatgaaggctgatg

SEQ ID NO: 789598 - DNA, 22 bp, Artificial Sequence
  chemically synthesized
agccagagttatcttctgacat

SEQ ID NO: 789599 - DNA, 22 bp, Artificial Sequence
  chemically synthesized
ctcagccagagttatcttctga

SEQ ID NO: 789600 - DNA, 22 bp, Artificial Sequence
  chemically synthesized
cctcagccagagttatcttctg

SEQ ID NO: 789601 - DNA, 22 bp, Artificial Sequence
  chemically synthesized
catgtcagaagataactctggc

SEQ ID NO: 789602 - DNA, 22 bp, Artificial Sequence
  chemically synthesized
atgtcagaagataactctggct

SEQ ID NO: 789603 - DNA, 22 bp, Artificial Sequence
  chemically synthesized
gcatcacttcctcagccagagt

SEQ ID NO: 789604 - DNA, 22 bp, Artificial Sequence
  chemically synthesized
catctagcatcacttcctcagc

SEQ ID NO: 789605 - DNA, 22 bp, Artificial Sequence
  chemically synthesized
tgcatctagcatcacttcctca

SEQ ID NO: 789606 - DNA, 22 bp, Artificial Sequence
  chemically synthesized
ctgcatctagcatcacttcctc

SEQ ID NO: 789607 - DNA, 22 bp, Artificial Sequence
  chemically synthesized
tctgcatctagcatcacttcct

SEQ ID NO: 789608 - DNA, 22 bp, Artificial Sequence
  chemically synthesized
gtctttctgcatctagcatcac

SEQ ID NO: 789609 - DNA, 22 bp, Artificial Sequence
  chemically synthesized
tggctgaggaagtgatgctaga

SEQ ID NO: 789610 - DNA, 22 bp, Artificial Sequence
  chemically synthesized
gctgaggaagtgatgctagatg

SEQ ID NO: 789611 - DNA, 22 bp, Artificial Sequence
  chemically synthesized
actggtctttctgcatctagca

SEQ ID NO: 789612 - DNA, 22 bp, Artificial Sequence
  chemically synthesized
aggaagtgatgctagatgcaga

SEQ ID NO: 789613 - DNA, 22 bp, Artificial Sequence
  chemically synthesized
ttcactggtctttctgcatcta

SEQ ID NO: 789614 - DNA, 22 bp, Artificial Sequence
  chemically synthesized
gttcactggtctttctgcatct

SEQ ID NO: 789615 - DNA, 22 bp, Artificial Sequence
  chemically synthesized
cggtaacttgttcactggtctt

SEQ ID NO: 789616 - DNA, 22 bp, Artificial Sequence
  chemically synthesized
gatgcagaaagaccagtgaaca

SEQ ID NO: 789617 - DNA, 22 bp, Artificial Sequence
  chemically synthesized
gaaaactccggtaacttgttca

SEQ ID NO: 789618 - DNA, 22 bp, Artificial Sequence
  chemically synthesized
gtatcctagaaaactccggtaa

SEQ ID NO: 789619 - DNA, 22 bp, Artificial Sequence
  chemically synthesized
ttcgtatcctagaaaactccgg

SEQ ID NO: 789620 - DNA, 22 bp, Artificial Sequence
  chemically synthesized
ctattcgtatcctagaaaactc

SEQ ID NO: 789621 - DNA, 22 bp, Artificial Sequence
  chemically synthesized
ttactattcgtatcctagaaaa

SEQ ID NO: 789622 - DNA, 22 bp, Artificial Sequence
  chemically synthesized
ccggagttttctaggatacgaa

SEQ ID NO: 789623 - DNA, 22 bp, Artificial Sequence
  chemically synthesized
atgatgatgctattactattcg

SEQ ID NO: 789624 - DNA, 22 bp, Artificial Sequence
  chemically synthesized
tctaggatacgaatagtaatag

SEQ ID NO: 789625 - DNA, 22 bp, Artificial Sequence
  chemically synthesized
ctgatgatgatgctattactat

SEQ ID NO: 789626 - DNA, 22 bp, Artificial Sequence
  chemically synthesized
ctaggatacgaatagtaatagc

SEQ ID NO: 789627 - DNA, 22 bp, Artificial Sequence
  chemically synthesized
taggatacgaatagtaatagca

SEQ ID NO: 789628 - DNA, 22 bp, Artificial Sequence
  chemically synthesized
ggatacgaatagtaatagcatc

SEQ ID NO: 789629 - DNA, 22 bp, Artificial Sequence
  chemically synthesized
taactgctgatgatgatgctat

SEQ ID NO: 789630 - DNA, 22 bp, Artificial Sequence
  chemically synthesized
ataaagaatagtcactataact

SEQ ID NO: 789631 - DNA, 22 bp, Artificial Sequence
  chemically synthesized
tagtgactattctttattaatt

SEQ ID NO: 789632 - DNA, 22 bp, Artificial Sequence
  chemically synthesized
ttctttattaattgcattttat

SEQ ID NO: 789633 - DNA, 22 bp, Artificial Sequence
  chemically synthesized
tttattaattgcattttatgta

SEQ ID NO: 789634 - DNA, 22 bp, Artificial Sequence
  chemically synthesized
tattaattgcattttatgtacc

SEQ ID NO: 789635 - DNA, 22 bp, Artificial Sequence
  chemically synthesized
attaattgcattttatgtacct

SEQ ID NO: 789636 - DNA, 22 bp, Artificial Sequence
  chemically synthesized
ttaattgcattttatgtacctt

SEQ ID NO: 789637 - DNA, 22 bp, Artificial Sequence
  chemically synthesized
ccatacagagagtaaggtacat

SEQ ID NO: 789638 - DNA, 22 bp, Artificial Sequence
  chemically synthesized
attgcattttatgtaccttact

SEQ ID NO: 789639 - DNA, 22 bp, Artificial Sequence
  chemically synthesized
cattttatgtaccttactctct

SEQ ID NO: 789640 - DNA, 22 bp, Artificial Sequence
  chemically synthesized
aatgagattaccatacagagag

SEQ ID NO: 789641 - DNA, 22 bp, Artificial Sequence
  chemically synthesized
tatgtaccttactctctgtatg

SEQ ID NO: 789642 - DNA, 22 bp, Artificial Sequence
  chemically synthesized
aaatgagattaccatacagaga

SEQ ID NO: 789643 - DNA, 22 bp, Artificial Sequence
  chemically synthesized
atgtaccttactctctgtatgg

SEQ ID NO: 789644 - DNA, 22 bp, Artificial Sequence
  chemically synthesized
tgtaccttactctctgtatggt

SEQ ID NO: 789645 - DNA, 22 bp, Artificial Sequence
  chemically synthesized
aagggcttaaatgagattacca

SEQ ID NO: 789646 - DNA, 22 bp, Artificial Sequence
  chemically synthesized
actctctgtatggtaatctcat

SEQ ID NO: 789647 - DNA, 22 bp, Artificial Sequence
  chemically synthesized
ctctctgtatggtaatctcatt

SEQ ID NO: 789648 - DNA, 22 bp, Artificial Sequence
  chemically synthesized
tctgtatggtaatctcatttaa

SEQ ID NO: 789649 - DNA, 22 bp, Artificial Sequence
  chemically synthesized
tgtatggtaatctcatttaagc

SEQ ID NO: 789650 - DNA, 22 bp, Artificial Sequence
  chemically synthesized
gggtgactaaagggcttaaatg

SEQ ID NO: 789651 - DNA, 22 bp, Artificial Sequence
  chemically synthesized
tatggtaatctcatttaagccc

SEQ ID NO: 789652 - DNA, 22 bp, Artificial Sequence
  chemically synthesized
agggtgactaaagggcttaaat

SEQ ID NO: 789653 - DNA, 22 bp, Artificial Sequence
  chemically synthesized
ttagggtgactaaagggcttaa

SEQ ID NO: 789654 - DNA, 22 bp, Artificial Sequence
  chemically synthesized
cttagggtgactaaagggctta

SEQ ID NO: 789655 - DNA, 22 bp, Artificial Sequence
  chemically synthesized
tttcttagggtgactaaagggc

SEQ ID NO: 789656 - DNA, 22 bp, Artificial Sequence
  chemically synthesized
tgtttcttagggtgactaaagg

SEQ ID NO: 789657 - DNA, 22 bp, Artificial Sequence
  chemically synthesized
ctgtttcttagggtgactaaag

SEQ ID NO: 789658 - DNA, 22 bp, Artificial Sequence
  chemically synthesized
tctgtttcttagggtgactaaa

SEQ ID NO: 789659 - DNA, 22 bp, Artificial Sequence
  chemically synthesized
atttaagccctttagtcaccct

SEQ ID NO: 789660 - DNA, 22 bp, Artificial Sequence
  chemically synthesized
aagccctttagtcaccctaaga

SEQ ID NO: 789661 - DNA, 22 bp, Artificial Sequence
  chemically synthesized
agccctttagtcaccctaagaa

SEQ ID NO: 789662 - DNA, 22 bp, Artificial Sequence
  chemically synthesized
ataaagttttctgtttcttagg

SEQ ID NO: 789663 - DNA, 22 bp, Artificial Sequence
  chemically synthesized
ctcataaagttttctgtttctt

SEQ ID NO: 789664 - DNA, 22 bp, Artificial Sequence
  chemically synthesized
cctcataaagttttctgtttct

SEQ ID NO: 789665 - DNA, 22 bp, Artificial Sequence
  chemically synthesized
tagtcaccctaagaaacagaaa

SEQ ID NO: 789666 - DNA, 22 bp, Artificial Sequence
  chemically synthesized
agtcaccctaagaaacagaaaa

SEQ ID NO: 789667 - DNA, 22 bp, Artificial Sequence
  chemically synthesized
gtcaccctaagaaacagaaaac

SEQ ID NO: 789668 - DNA, 22 bp, Artificial Sequence
  chemically synthesized
agtttcctcataaagttttctg

SEQ ID NO: 789669 - DNA, 22 bp, Artificial Sequence
  chemically synthesized
gcctcagtttcctcataaagtt

SEQ ID NO: 789670 - DNA, 22 bp, Artificial Sequence
  chemically synthesized
agaaacagaaaactttatgagg

SEQ ID NO: 789671 - DNA, 22 bp, Artificial Sequence
  chemically synthesized
tagcctcagtttcctcataaag

SEQ ID NO: 789672 - DNA, 22 bp, Artificial Sequence
  chemically synthesized
ctagcctcagtttcctcataaa

SEQ ID NO: 789673 - DNA, 22 bp, Artificial Sequence
  chemically synthesized
ttctagcctcagtttcctcata

SEQ ID NO: 789674 - DNA, 22 bp, Artificial Sequence
  chemically synthesized
aatctcttctagcctcagtttc

SEQ ID NO: 789675 - DNA, 22 bp, Artificial Sequence
  chemically synthesized
aaatctcttctagcctcagttt

SEQ ID NO: 789676 - DNA, 22 bp, Artificial Sequence
  chemically synthesized
taaatctcttctagcctcagtt

SEQ ID NO: 789677 - DNA, 22 bp, Artificial Sequence
  chemically synthesized
ttaaatctcttctagcctcagt

SEQ ID NO: 789678 - DNA, 22 bp, Artificial Sequence
  chemically synthesized
tatgaggaaactgaggctagaa

SEQ ID NO: 789679 - DNA, 22 bp, Artificial Sequence
  chemically synthesized
atgaggaaactgaggctagaag

SEQ ID NO: 789680 - DNA, 22 bp, Artificial Sequence
  chemically synthesized
tgaggaaactgaggctagaaga

SEQ ID NO: 789681 - DNA, 22 bp, Artificial Sequence
  chemically synthesized
gcaaatttttaaatctcttcta

SEQ ID NO: 789682 - DNA, 22 bp, Artificial Sequence
  chemically synthesized
aggctagaagagatttaaaaat

SEQ ID NO: 789683 - DNA, 22 bp, Artificial Sequence
  chemically synthesized
tcaccgttggcaaatttttaaa

SEQ ID NO: 789684 - DNA, 22 bp, Artificial Sequence
  chemically synthesized
gtcaccgttggcaaatttttaa

SEQ ID NO: 789685 - DNA, 22 bp, Artificial Sequence
  chemically synthesized
gaagagatttaaaaatttgcca

SEQ ID NO: 789686 - DNA, 22 bp, Artificial Sequence
  chemically synthesized
gaatcttgtcaccgttggcaaa

SEQ ID NO: 789687 - DNA, 22 bp, Artificial Sequence
  chemically synthesized
attcgaatcttgtcaccgttgg

SEQ ID NO: 789688 - DNA, 22 bp, Artificial Sequence
  chemically synthesized
aaaaatttgccaacggtgacaa

SEQ ID NO: 789689 - DNA, 22 bp, Artificial Sequence
  chemically synthesized
aaaatttgccaacggtgacaag

SEQ ID NO: 789690 - DNA, 22 bp, Artificial Sequence
  chemically synthesized
gccaacggtgacaagattcgaa

SEQ ID NO: 789691 - DNA, 22 bp, Artificial Sequence
  chemically synthesized
ccaacggtgacaagattcgaat

SEQ ID NO: 789692 - DNA, 22 bp, Artificial Sequence
  chemically synthesized
tgaagtcaagcatacctgattc

SEQ ID NO: 789693 - DNA, 22 bp, Artificial Sequence
  chemically synthesized
tcactgtgaagtcaagcatacc

SEQ ID NO: 789694 - DNA, 22 bp, Artificial Sequence
  chemically synthesized
atcactgtgaagtcaagcatac

SEQ ID NO: 789695 - DNA, 22 bp, Artificial Sequence
  chemically synthesized
gaatcaggtatgcttgacttca

SEQ ID NO: 789696 - DNA, 22 bp, Artificial Sequence
  chemically synthesized
aggcccttatcactgtgaagtc

SEQ ID NO: 789697 - DNA, 22 bp, Artificial Sequence
  chemically synthesized
caggcccttatcactgtgaagt

SEQ ID NO: 789698 - DNA, 22 bp, Artificial Sequence
  chemically synthesized
tggtttcaggcccttatcactg

SEQ ID NO: 789699 - DNA, 22 bp, Artificial Sequence
  chemically synthesized
tatggtttcaggcccttatcac

SEQ ID NO: 789700 - DNA, 22 bp, Artificial Sequence
  chemically synthesized
tctatggtttcaggcccttatc

SEQ ID NO: 789701 - DNA, 22 bp, Artificial Sequence
  chemically synthesized
gacttcacagtgataagggcct

SEQ ID NO: 789702 - DNA, 22 bp, Artificial Sequence
  chemically synthesized
acttcacagtgataagggcctg

SEQ ID NO: 789703 - DNA, 22 bp, Artificial Sequence
  chemically synthesized
cacagtgataagggcctgaaac

SEQ ID NO: 789704 - DNA, 22 bp, Artificial Sequence
  chemically synthesized
tgattctctatggtttcaggcc

SEQ ID NO: 789705 - DNA, 22 bp, Artificial Sequence
  chemically synthesized
acagtgataagggcctgaaacc

SEQ ID NO: 789706 - DNA, 22 bp, Artificial Sequence
  chemically synthesized
tatgattctctatggtttcagg

SEQ ID NO: 789707 - DNA, 22 bp, Artificial Sequence
  chemically synthesized
tctatgattctctatggtttca

SEQ ID NO: 789708 - DNA, 22 bp, Artificial Sequence
  chemically synthesized
ctctatgattctctatggtttc

SEQ ID NO: 789709 - DNA, 22 bp, Artificial Sequence
  chemically synthesized
tctctatgattctctatggttt

SEQ ID NO: 789710 - DNA, 22 bp, Artificial Sequence
  chemically synthesized
ttctctatgattctctatggtt

SEQ ID NO: 789711 - DNA, 22 bp, Artificial Sequence
  chemically synthesized
aagcagatttttctctatgatt

SEQ ID NO: 789712 - DNA, 22 bp, Artificial Sequence
  chemically synthesized
aaaccatagagaatcatagaga

SEQ ID NO: 789713 - DNA, 22 bp, Artificial Sequence
  chemically synthesized
aaagcagatttttctctatgat

SEQ ID NO: 789714 - DNA, 22 bp, Artificial Sequence
  chemically synthesized
tcttaaagcagatttttctcta

SEQ ID NO: 789715 - DNA, 22 bp, Artificial Sequence
  chemically synthesized
agtctgtcttaaagcagatttt

SEQ ID NO: 789716 - DNA, 22 bp, Artificial Sequence
  chemically synthesized
ctaagtctgtcttaaagcagat

SEQ ID NO: 789717 - DNA, 22 bp, Artificial Sequence
  chemically synthesized
cctcctaagtctgtcttaaagc

SEQ ID NO: 789718 - DNA, 22 bp, Artificial Sequence
  chemically synthesized
acctcctaagtctgtcttaaag

SEQ ID NO: 789719 - DNA, 22 bp, Artificial Sequence
  chemically synthesized
tacctcctaagtctgtcttaaa

SEQ ID NO: 789720 - DNA, 22 bp, Artificial Sequence
  chemically synthesized
caaattttacctcctaagtctg

SEQ ID NO: 789721 - DNA, 22 bp, Artificial Sequence
  chemically synthesized
ctttaagacagacttaggaggt

SEQ ID NO: 789722 - DNA, 22 bp, Artificial Sequence
  chemically synthesized
taagacagacttaggaggtaaa

SEQ ID NO: 789723 - DNA, 22 bp, Artificial Sequence
  chemically synthesized
aagacagacttaggaggtaaaa

SEQ ID NO: 789724 - DNA, 22 bp, Artificial Sequence
  chemically synthesized
agacagacttaggaggtaaaat

SEQ ID NO: 789725 - DNA, 22 bp, Artificial Sequence
  chemically synthesized
acacaaaagactgcaaatttta

SEQ ID NO: 789726 - DNA, 22 bp, Artificial Sequence
  chemically synthesized
cactgacacaaaagactgcaaa

SEQ ID NO: 789727 - DNA, 22 bp, Artificial Sequence
  chemically synthesized
aggaggtaaaatttgcagtctt

SEQ ID NO: 789728 - DNA, 22 bp, Artificial Sequence
  chemically synthesized
ggaggtaaaatttgcagtcttt

SEQ ID NO: 789729 - DNA, 22 bp, Artificial Sequence
  chemically synthesized
tgcatatgtctacactgacaca

SEQ ID NO: 789730 - DNA, 22 bp, Artificial Sequence
  chemically synthesized
atgcatatgtctacactgacac

SEQ ID NO: 789731 - DNA, 22 bp, Artificial Sequence
  chemically synthesized
tatgcatatgtctacactgaca

SEQ ID NO: 789732 - DNA, 22 bp, Artificial Sequence
  chemically synthesized
gcagtcttttgtgtcagtgtag

SEQ ID NO: 789733 - DNA, 22 bp, Artificial Sequence
  chemically synthesized
ttatgcatatgtctacactgac

SEQ ID NO: 789734 - DNA, 22 bp, Artificial Sequence
  chemically synthesized
cagtcttttgtgtcagtgtaga

SEQ ID NO: 789735 - DNA, 22 bp, Artificial Sequence
  chemically synthesized
ttttatgcatatgtctacactg

SEQ ID NO: 789736 - DNA, 22 bp, Artificial Sequence
  chemically synthesized
tcttttatgcatatgtctacac

SEQ ID NO: 789737 - DNA, 22 bp, Artificial Sequence
  chemically synthesized
tctcttttatgcatatgtctac

SEQ ID NO: 789738 - DNA, 22 bp, Artificial Sequence
  chemically synthesized
ctctcttttatgcatatgtcta

SEQ ID NO: 789739 - DNA, 22 bp, Artificial Sequence
  chemically synthesized
ttgtgtcagtgtagacatatgc

SEQ ID NO: 789740 - DNA, 22 bp, Artificial Sequence
  chemically synthesized
tgtgtcagtgtagacatatgca

SEQ ID NO: 789741 - DNA, 22 bp, Artificial Sequence
  chemically synthesized
gtgtcagtgtagacatatgcat

SEQ ID NO: 789742 - DNA, 22 bp, Artificial Sequence
  chemically synthesized
tgtcagtgtagacatatgcata

SEQ ID NO: 789743 - DNA, 22 bp, Artificial Sequence
  chemically synthesized
gtgagacttctctcttttatgc

SEQ ID NO: 789744 - DNA, 22 bp, Artificial Sequence
  chemically synthesized
tggtgagacttctctcttttat

SEQ ID NO: 789745 - DNA, 22 bp, Artificial Sequence
  chemically synthesized
attctggtgagacttctctctt

SEQ ID NO: 789746 - DNA, 22 bp, Artificial Sequence
  chemically synthesized
tgattctggtgagacttctctc

SEQ ID NO: 789747 - DNA, 22 bp, Artificial Sequence
  chemically synthesized
ctgattctggtgagacttctct

SEQ ID NO: 789748 - DNA, 22 bp, Artificial Sequence
  chemically synthesized
gaaacttctgattctggtgaga

SEQ ID NO: 789749 - DNA, 22 bp, Artificial Sequence
  chemically synthesized
agctagaaacttctgattctgg

SEQ ID NO: 789750 - DNA, 22 bp, Artificial Sequence
  chemically synthesized
aagctagaaacttctgattctg

SEQ ID NO: 789751 - DNA, 22 bp, Artificial Sequence
  chemically synthesized
tttaagctagaaacttctgatt

SEQ ID NO: 789752 - DNA, 22 bp, Artificial Sequence
  chemically synthesized
accagaatcagaagtttctagc

SEQ ID NO: 789753 - DNA, 22 bp, Artificial Sequence
  chemically synthesized
cccaattatttaagctagaaac

SEQ ID NO: 789754 - DNA, 22 bp, Artificial Sequence
  chemically synthesized
ctagcttaaataattgggtaga

SEQ ID NO: 789755 - DNA, 22 bp, Artificial Sequence
  chemically synthesized
tagcttaaataattgggtagat

SEQ ID NO: 789756 - DNA, 22 bp, Artificial Sequence
  chemically synthesized
gcttaaataattgggtagatgg

SEQ ID NO: 789757 - DNA, 22 bp, Artificial Sequence
  chemically synthesized
agaagatggcaccaccatctac

SEQ ID NO: 789758 - DNA, 22 bp, Artificial Sequence
  chemically synthesized
cagaagatggcaccaccatcta

SEQ ID NO: 789759 - DNA, 22 bp, Artificial Sequence
  chemically synthesized
aaataattgggtagatggtggt

SEQ ID NO: 789760 - DNA, 22 bp, Artificial Sequence
  chemically synthesized
aataattgggtagatggtggtg

SEQ ID NO: 789761 - DNA, 22 bp, Artificial Sequence
  chemically synthesized
tttcagaagatggcaccaccat

SEQ ID NO: 789762 - DNA, 22 bp, Artificial Sequence
  chemically synthesized
tatttcagaagatggcaccacc

SEQ ID NO: 789763 - DNA, 22 bp, Artificial Sequence
  chemically synthesized
tctatttcagaagatggcacca

SEQ ID NO: 789764 - DNA, 22 bp, Artificial Sequence
  chemically synthesized
ggtagatggtggtgccatcttc

SEQ ID NO: 789765 - DNA, 22 bp, Artificial Sequence
  chemically synthesized
ttctctatttcagaagatggca

SEQ ID NO: 789766 - DNA, 22 bp, Artificial Sequence
  chemically synthesized
tattctctatttcagaagatgg

SEQ ID NO: 789767 - DNA, 22 bp, Artificial Sequence
  chemically synthesized
cctctattctctatttcagaag

SEQ ID NO: 789768 - DNA, 22 bp, Artificial Sequence
  chemically synthesized
ctgcctctattctctatttcag

SEQ ID NO: 789769 - DNA, 22 bp, Artificial Sequence
  chemically synthesized
aaatcccctactgcctctattc

SEQ ID NO: 789770 - DNA, 22 bp, Artificial Sequence
  chemically synthesized
ctgaaatagagaatagaggcag

SEQ ID NO: 789771 - DNA, 22 bp, Artificial Sequence
  chemically synthesized
tgaaatagagaatagaggcagt

SEQ ID NO: 789772 - DNA, 22 bp, Artificial Sequence
  chemically synthesized
aaatagagaatagaggcagtag

SEQ ID NO: 789773 - DNA, 22 bp, Artificial Sequence
  chemically synthesized
gcatgtcccaaactgaaatccc

SEQ ID NO: 789774 - DNA, 22 bp, Artificial Sequence
  chemically synthesized
acattagcatgtcccaaactga

SEQ ID NO: 789775 - DNA, 22 bp, Artificial Sequence
  chemically synthesized
aacattagcatgtcccaaactg

SEQ ID NO: 789776 - DNA, 22 bp, Artificial Sequence
  chemically synthesized
taacattagcatgtcccaaact

SEQ ID NO: 789777 - DNA, 22 bp, Artificial Sequence
  chemically synthesized
cagtttgggacatgctaatgtt

SEQ ID NO: 789778 - DNA, 22 bp, Artificial Sequence
  chemically synthesized
agtttgggacatgctaatgtta

SEQ ID NO: 789779 - DNA, 22 bp, Artificial Sequence
  chemically synthesized
atggccacagacattttaacat

SEQ ID NO: 789780 - DNA, 22 bp, Artificial Sequence
  chemically synthesized
gggacatgctaatgttaaaatg

SEQ ID NO: 789781 - DNA, 22 bp, Artificial Sequence
  chemically synthesized
ggacatgctaatgttaaaatgt

SEQ ID NO: 789782 - DNA, 22 bp, Artificial Sequence
  chemically synthesized
ctcatggccacagacattttaa

SEQ ID NO: 789783 - DNA, 22 bp, Artificial Sequence
  chemically synthesized
actcatggccacagacatttta

SEQ ID NO: 789784 - DNA, 22 bp, Artificial Sequence
  chemically synthesized
agtcttactcatggccacagac

SEQ ID NO: 789785 - DNA, 22 bp, Artificial Sequence
  chemically synthesized
gagtcttactcatggccacaga

SEQ ID NO: 789786 - DNA, 22 bp, Artificial Sequence
  chemically synthesized
atgttaaaatgtctgtggccat

SEQ ID NO: 789787 - DNA, 22 bp, Artificial Sequence
  chemically synthesized
tgagtcttactcatggccacag

SEQ ID NO: 789788 - DNA, 22 bp, Artificial Sequence
  chemically synthesized
aaatgtctgtggccatgagtaa

SEQ ID NO: 789789 - DNA, 22 bp, Artificial Sequence
  chemically synthesized
tcaaatattttgagtcttactc

SEQ ID NO: 789790 - DNA, 22 bp, Artificial Sequence
  chemically synthesized
tggccatgagtaagactcaaaa

SEQ ID NO: 789791 - DNA, 22 bp, Artificial Sequence
  chemically synthesized
aagcagttgtcaaatattttga

SEQ ID NO: 789792 - DNA, 22 bp, Artificial Sequence
  chemically synthesized
ctaaagcagttgtcaaatattt

SEQ ID NO: 789793 - DNA, 22 bp, Artificial Sequence
  chemically synthesized
gctaaagcagttgtcaaatatt

SEQ ID NO: 789794 - DNA, 22 bp, Artificial Sequence
  chemically synthesized
tgctaaagcagttgtcaaatat

SEQ ID NO: 789795 - DNA, 22 bp, Artificial Sequence
  chemically synthesized
ttgctaaagcagttgtcaaata

SEQ ID NO: 789796 - DNA, 22 bp, Artificial Sequence
  chemically synthesized
ggcttttgctaaagcagttgtc

SEQ ID NO: 789797 - DNA, 22 bp, Artificial Sequence
  chemically synthesized
aaaatatttgacaactgcttta

SEQ ID NO: 789798 - DNA, 22 bp, Artificial Sequence
  chemically synthesized
gttgggcttttgctaaagcagt

SEQ ID NO: 789799 - DNA, 22 bp, Artificial Sequence
  chemically synthesized
ggttgggcttttgctaaagcag

SEQ ID NO: 789800 - DNA, 22 bp, Artificial Sequence
  chemically synthesized
tttggttgggcttttgctaaag

SEQ ID NO: 789801 - DNA, 22 bp, Artificial Sequence
  chemically synthesized
tatttggttgggcttttgctaa

SEQ ID NO: 789802 - DNA, 22 bp, Artificial Sequence
  chemically synthesized
gacaactgctttagcaaaagcc

SEQ ID NO: 789803 - DNA, 22 bp, Artificial Sequence
  chemically synthesized
tctatttggttgggcttttgct

SEQ ID NO: 789804 - DNA, 22 bp, Artificial Sequence
  chemically synthesized
acaactgctttagcaaaagccc

SEQ ID NO: 789805 - DNA, 22 bp, Artificial Sequence
  chemically synthesized
ctctatttggttgggcttttgc

SEQ ID NO: 789806 - DNA, 22 bp, Artificial Sequence
  chemically synthesized
tctctatttggttgggcttttg

SEQ ID NO: 789807 - DNA, 22 bp, Artificial Sequence
  chemically synthesized
ctttagcaaaagcccaaccaaa

SEQ ID NO: 789808 - DNA, 22 bp, Artificial Sequence
  chemically synthesized
tagcaaaagcccaaccaaatag

SEQ ID NO: 789809 - DNA, 22 bp, Artificial Sequence
  chemically synthesized
agcaaaagcccaaccaaataga

SEQ ID NO: 789810 - DNA, 22 bp, Artificial Sequence
  chemically synthesized
agtagtgttttctctatttggt

SEQ ID NO: 789811 - DNA, 22 bp, Artificial Sequence
  chemically synthesized
gcaaaagcccaaccaaatagag

SEQ ID NO: 789812 - DNA, 22 bp, Artificial Sequence
  chemically synthesized
ataagcacaggtagggtgtact

SEQ ID NO: 789813 - DNA, 22 bp, Artificial Sequence
  chemically synthesized
ctgataagcacaggtagggtgt

SEQ ID NO: 789814 - DNA, 22 bp, Artificial Sequence
  chemically synthesized
ctcagtacaccctacctgtgct

SEQ ID NO: 789815 - DNA, 22 bp, Artificial Sequence
  chemically synthesized
gtacctgctgataagcacaggt

SEQ ID NO: 789816 - DNA, 22 bp, Artificial Sequence
  chemically synthesized
agtacaccctacctgtgcttat

SEQ ID NO: 789817 - DNA, 22 bp, Artificial Sequence
  chemically synthesized
cctgtgcttatcagcaggtacc

SEQ ID NO: 789818 - DNA, 22 bp, Artificial Sequence
  chemically synthesized
gaccacaggactggtacctgct

SEQ ID NO: 789819 - DNA, 22 bp, Artificial Sequence
  chemically synthesized
agaccacaggactggtacctgc

SEQ ID NO: 789820 - DNA, 22 bp, Artificial Sequence
  chemically synthesized
tgcttatcagcaggtaccagtc

SEQ ID NO: 789821 - DNA, 22 bp, Artificial Sequence
  chemically synthesized
tatttagaccacaggactggta

SEQ ID NO: 789822 - DNA, 22 bp, Artificial Sequence
  chemically synthesized
tatatttagaccacaggactgg

SEQ ID NO: 789823 - DNA, 22 bp, Artificial Sequence
  chemically synthesized
atcagcaggtaccagtcctgtg

SEQ ID NO: 789824 - DNA, 22 bp, Artificial Sequence
  chemically synthesized
ctatatttagaccacaggactg

SEQ ID NO: 789825 - DNA, 22 bp, Artificial Sequence
  chemically synthesized
tcagcaggtaccagtcctgtgg

SEQ ID NO: 789826 - DNA, 22 bp, Artificial Sequence
  chemically synthesized
cccagtgaacttctatatttag

SEQ ID NO: 789827 - DNA, 22 bp, Artificial Sequence
  chemically synthesized
caactccccagtgaacttctat

SEQ ID NO: 789828 - DNA, 22 bp, Artificial Sequence
  chemically synthesized
tggtctaaatatagaagttcac

SEQ ID NO: 789829 - DNA, 22 bp, Artificial Sequence
  chemically synthesized
acatctgcaactccccagtgaa

SEQ ID NO: 789830 - DNA, 22 bp, Artificial Sequence
  chemically synthesized
aatatagaagttcactggggag

SEQ ID NO: 789831 - DNA, 22 bp, Artificial Sequence
  chemically synthesized
cattgacatctgcaactcccca

SEQ ID NO: 789832 - DNA, 22 bp, Artificial Sequence
  chemically synthesized
tacattgacatctgcaactccc

SEQ ID NO: 789833 - DNA, 22 bp, Artificial Sequence
  chemically synthesized
gccattctacattgacatctgc

SEQ ID NO: 789834 - DNA, 22 bp, Artificial Sequence
  chemically synthesized
actggggagttgcagatgtcaa

SEQ ID NO: 789835 - DNA, 22 bp, Artificial Sequence
  chemically synthesized
ggccattctacattgacatctg

SEQ ID NO: 789836 - DNA, 22 bp, Artificial Sequence
  chemically synthesized
ttggccattctacattgacatc

SEQ ID NO: 789837 - DNA, 22 bp, Artificial Sequence
  chemically synthesized
gggagttgcagatgtcaatgta

SEQ ID NO: 789838 - DNA, 22 bp, Artificial Sequence
  chemically synthesized
cagatgtcaatgtagaatggcc

SEQ ID NO: 789839 - DNA, 22 bp, Artificial Sequence
  chemically synthesized
tgtacccctcttggccattcta

SEQ ID NO: 789840 - DNA, 22 bp, Artificial Sequence
  chemically synthesized
cctatgtacccctcttggccat

SEQ ID NO: 789841 - DNA, 22 bp, Artificial Sequence
  chemically synthesized
aaagcatatgctgcctatgtac

SEQ ID NO: 789842 - DNA, 22 bp, Artificial Sequence
  chemically synthesized
tcaaagcatatgctgcctatgt

SEQ ID NO: 789843 - DNA, 22 bp, Artificial Sequence
  chemically synthesized
taagcagatgactctcaaagca

SEQ ID NO: 789844 - DNA, 22 bp, Artificial Sequence
  chemically synthesized
gtatctataagcagatgactct

SEQ ID NO: 789845 - DNA, 22 bp, Artificial Sequence
  chemically synthesized
attagtatctataagcagatga

SEQ ID NO: 789846 - DNA, 22 bp, Artificial Sequence
  chemically synthesized
taattagtatctataagcagat

SEQ ID NO: 789847 - DNA, 22 bp, Artificial Sequence
  chemically synthesized
tgagagtcatctgcttatagat

SEQ ID NO: 789848 - DNA, 22 bp, Artificial Sequence
  chemically synthesized
gagagtcatctgcttatagata

SEQ ID NO: 789849 - DNA, 22 bp, Artificial Sequence
  chemically synthesized
agagtcatctgcttatagatac

SEQ ID NO: 789850 - DNA, 22 bp, Artificial Sequence
  chemically synthesized
atccacggctctaattagtatc

SEQ ID NO: 789851 - DNA, 22 bp, Artificial Sequence
  chemically synthesized
catccacggctctaattagtat

SEQ ID NO: 789852 - DNA, 22 bp, Artificial Sequence
  chemically synthesized
cttatagatactaattagagcc

SEQ ID NO: 789853 - DNA, 22 bp, Artificial Sequence
  chemically synthesized
atcttcatccacggctctaatt

SEQ ID NO: 789854 - DNA, 22 bp, Artificial Sequence
  chemically synthesized
atagatactaattagagccgtg

SEQ ID NO: 789855 - DNA, 22 bp, Artificial Sequence
  chemically synthesized
tagatactaattagagccgtgg

SEQ ID NO: 789856 - DNA, 22 bp, Artificial Sequence
  chemically synthesized
tgatctcatcttcatccacggc

SEQ ID NO: 789857 - DNA, 22 bp, Artificial Sequence
  chemically synthesized
tgtgatctcatcttcatccacg

SEQ ID NO: 789858 - DNA, 22 bp, Artificial Sequence
  chemically synthesized
ctgtgatctcatcttcatccac

SEQ ID NO: 789859 - DNA, 22 bp, Artificial Sequence
  chemically synthesized
ttctgtgatctcatcttcatcc

SEQ ID NO: 789860 - DNA, 22 bp, Artificial Sequence
  chemically synthesized
attagagccgtggatgaagatg

SEQ ID NO: 789861 - DNA, 22 bp, Artificial Sequence
  chemically synthesized
gagccgtggatgaagatgagat

SEQ ID NO: 789862 - DNA, 22 bp, Artificial Sequence
  chemically synthesized
catgccacatctcttctgtgat

SEQ ID NO: 789863 - DNA, 22 bp, Artificial Sequence
  chemically synthesized
ccatgccacatctcttctgtga

SEQ ID NO: 789864 - DNA, 22 bp, Artificial Sequence
  chemically synthesized
tccatgccacatctcttctgtg

SEQ ID NO: 789865 - DNA, 22 bp, Artificial Sequence
  chemically synthesized
actttccatgccacatctcttc

SEQ ID NO: 789866 - DNA, 22 bp, Artificial Sequence
  chemically synthesized
cactttccatgccacatctctt

SEQ ID NO: 789867 - DNA, 22 bp, Artificial Sequence
  chemically synthesized
ttcactttccatgccacatctc

SEQ ID NO: 789868 - DNA, 22 bp, Artificial Sequence
  chemically synthesized
cttcactttccatgccacatct

SEQ ID NO: 789869 - DNA, 22 bp, Artificial Sequence
  chemically synthesized
agcacttcttcactttccatgc

SEQ ID NO: 789870 - DNA, 22 bp, Artificial Sequence
  chemically synthesized
ccctcagcacttcttcactttc

SEQ ID NO: 789871 - DNA, 22 bp, Artificial Sequence
  chemically synthesized
cccagatcctaccctcagcact

SEQ ID NO: 789872 - DNA, 22 bp, Artificial Sequence
  chemically synthesized
ctccccagatcctaccctcagc

SEQ ID NO: 789873 - DNA, 22 bp, Artificial Sequence
  chemically synthesized
agggtaggatctggggagcagc

SEQ ID NO: 789874 - DNA, 22 bp, Artificial Sequence
  chemically synthesized
cataataagtatggctgctccc

SEQ ID NO: 789875 - DNA, 22 bp, Artificial Sequence
  chemically synthesized
ccataataagtatggctgctcc

SEQ ID NO: 789876 - DNA, 22 bp, Artificial Sequence
  chemically synthesized
ttccataataagtatggctgct

SEQ ID NO: 789877 - DNA, 22 bp, Artificial Sequence
  chemically synthesized
agcctcttccataataagtatg

SEQ ID NO: 789878 - DNA, 22 bp, Artificial Sequence
  chemically synthesized
gggagcagccatacttattatg

SEQ ID NO: 789879 - DNA, 22 bp, Artificial Sequence
  chemically synthesized
atcctcagcctcttccataata

SEQ ID NO: 789880 - DNA, 22 bp, Artificial Sequence
  chemically synthesized
atgattcatcctcagcctcttc

SEQ ID NO: 789881 - DNA, 22 bp, Artificial Sequence
  chemically synthesized
ctgatgattcatcctcagcctc

SEQ ID NO: 789882 - DNA, 22 bp, Artificial Sequence
  chemically synthesized
cctgatgattcatcctcagcct

SEQ ID NO: 789883 - DNA, 22 bp, Artificial Sequence
  chemically synthesized
tcctgatgattcatcctcagcc

SEQ ID NO: 789884 - DNA, 22 bp, Artificial Sequence
  chemically synthesized
attatggaagaggctgaggatg

SEQ ID NO: 789885 - DNA, 22 bp, Artificial Sequence
  chemically synthesized
ttatggaagaggctgaggatga

SEQ ID NO: 789886 - DNA, 22 bp, Artificial Sequence
  chemically synthesized
tttcctgatgattcatcctcag

SEQ ID NO: 789887 - DNA, 22 bp, Artificial Sequence
  chemically synthesized
tggaagaggctgaggatgaatc

SEQ ID NO: 789888 - DNA, 22 bp, Artificial Sequence
  chemically synthesized
agtctctttcctgatgattcat

SEQ ID NO: 789889 - DNA, 22 bp, Artificial Sequence
  chemically synthesized
gagtctctttcctgatgattca

SEQ ID NO: 789890 - DNA, 22 bp, Artificial Sequence
  chemically synthesized
aggatgaatcatcaggaaagag

SEQ ID NO: 789891 - DNA, 22 bp, Artificial Sequence
  chemically synthesized
cataggacatttgagtctcttt

SEQ ID NO: 789892 - DNA, 22 bp, Artificial Sequence
  chemically synthesized
tctccataggacatttgagtct

SEQ ID NO: 789893 - DNA, 22 bp, Artificial Sequence
  chemically synthesized
acctgtctccataggacatttg

SEQ ID NO: 789894 - DNA, 22 bp, Artificial Sequence
  chemically synthesized
acctgacctgtctccataggac

SEQ ID NO: 789895 - DNA, 22 bp, Artificial Sequence
  chemically synthesized
cacctgacctgtctccatagga

SEQ ID NO: 789896 - DNA, 22 bp, Artificial Sequence
  chemically synthesized
tcacctgacctgtctccatagg

SEQ ID NO: 789897 - DNA, 22 bp, Artificial Sequence
  chemically synthesized
aaatgtcctatggagacaggtc

SEQ ID NO: 789898 - DNA, 22 bp, Artificial Sequence
  chemically synthesized
cccaggttttcacctgacctgt

SEQ ID NO: 789899 - DNA, 22 bp, Artificial Sequence
  chemically synthesized
ccccaggttttcacctgacctg

SEQ ID NO: 789900 - DNA, 22 bp, Artificial Sequence
  chemically synthesized
ttccccaggttttcacctgacc

SEQ ID NO: 789901 - DNA, 22 bp, Artificial Sequence
  chemically synthesized
tggagacaggtcaggtgaaaac

SEQ ID NO: 789902 - DNA, 22 bp, Artificial Sequence
  chemically synthesized
acaccctcttccccaggttttc

SEQ ID NO: 789903 - DNA, 22 bp, Artificial Sequence
  chemically synthesized
taacaccctcttccccaggttt

SEQ ID NO: 789904 - DNA, 22 bp, Artificial Sequence
  chemically synthesized
tctaacaccctcttccccaggt

SEQ ID NO: 789905 - DNA, 22 bp, Artificial Sequence
  chemically synthesized
gttctctaacaccctcttcccc

SEQ ID NO: 789906 - DNA, 22 bp, Artificial Sequence
  chemically synthesized
agttctctaacaccctcttccc

SEQ ID NO: 789907 - DNA, 22 bp, Artificial Sequence
  chemically synthesized
tagttctctaacaccctcttcc

SEQ ID NO: 789908 - DNA, 22 bp, Artificial Sequence
  chemically synthesized
ctttagttctctaacaccctct

SEQ ID NO: 789909 - DNA, 22 bp, Artificial Sequence
  chemically synthesized
tcctttagttctctaacaccct

SEQ ID NO: 789910 - DNA, 22 bp, Artificial Sequence
  chemically synthesized
ctcctttagttctctaacaccc

SEQ ID NO: 789911 - DNA, 22 bp, Artificial Sequence
  chemically synthesized
tctcctttagttctctaacacc

SEQ ID NO: 789912 - DNA, 22 bp, Artificial Sequence
  chemically synthesized
gggaagagggtgttagagaact

SEQ ID NO: 789913 - DNA, 22 bp, Artificial Sequence
  chemically synthesized
taattttctcctttagttctct

SEQ ID NO: 789914 - DNA, 22 bp, Artificial Sequence
  chemically synthesized
gtaattttctcctttagttctc

SEQ ID NO: 789915 - DNA, 22 bp, Artificial Sequence
  chemically synthesized
cttgtaattttctcctttagtt

SEQ ID NO: 789916 - DNA, 22 bp, Artificial Sequence
  chemically synthesized
tccttgtaattttctcctttag

SEQ ID NO: 789917 - DNA, 22 bp, Artificial Sequence
  chemically synthesized
ctccttgtaattttctccttta

SEQ ID NO: 789918 - DNA, 22 bp, Artificial Sequence
  chemically synthesized
agcttctccttgtaattttctc

SEQ ID NO: 789919 - DNA, 22 bp, Artificial Sequence
  chemically synthesized
gagaactaaaggagaaaattac

SEQ ID NO: 789920 - DNA, 22 bp, Artificial Sequence
  chemically synthesized
actcagcttctccttgtaattt

SEQ ID NO: 789921 - DNA, 22 bp, Artificial Sequence
  chemically synthesized
cctgactcagcttctccttgta

SEQ ID NO: 789922 - DNA, 22 bp, Artificial Sequence
  chemically synthesized
aaggagaaaattacaaggagaa

SEQ ID NO: 789923 - DNA, 22 bp, Artificial Sequence
  chemically synthesized
ccaaattgcctgactcagcttc

SEQ ID NO: 789924 - DNA, 22 bp, Artificial Sequence
  chemically synthesized
caaggagaagctgagtcaggca

SEQ ID NO: 789925 - DNA, 22 bp, Artificial Sequence
  chemically synthesized
ccccctgccaaattgcctgact

SEQ ID NO: 789926 - DNA, 22 bp, Artificial Sequence
  chemically synthesized
agtcaggcaatttggcaggggg

SEQ ID NO: 789927 - DNA, 22 bp, Artificial Sequence
  chemically synthesized
agaaaatcaatagcctaccccc

SEQ ID NO: 789928 - DNA, 22 bp, Artificial Sequence
  chemically synthesized
actaagaaaatcaatagcctac

SEQ ID NO: 789929 - DNA, 22 bp, Artificial Sequence
  chemically synthesized
tcactaagaaaatcaatagcct

SEQ ID NO: 789930 - DNA, 22 bp, Artificial Sequence
  chemically synthesized
ggcagggggtaggctattgatt

SEQ ID NO: 789931 - DNA, 22 bp, Artificial Sequence
  chemically synthesized
gcagggggtaggctattgattt

SEQ ID NO: 789932 - DNA, 22 bp, Artificial Sequence
  chemically synthesized
ctctcactaagaaaatcaatag

SEQ ID NO: 789933 - DNA, 22 bp, Artificial Sequence
  chemically synthesized
ttgattttcttagtgagagcag

SEQ ID NO: 789934 - DNA, 22 bp, Artificial Sequence
  chemically synthesized
ccgtgccaggcaaactgctctc

SEQ ID NO: 789935 - DNA, 22 bp, Artificial Sequence
  chemically synthesized
attttcttagtgagagcagttt

SEQ ID NO: 789936 - DNA, 22 bp, Artificial Sequence
  chemically synthesized
ctaccgtgccaggcaaactgct

SEQ ID NO: 789937 - DNA, 22 bp, Artificial Sequence
  chemically synthesized
tcttagtgagagcagtttgcct

SEQ ID NO: 789938 - DNA, 22 bp, Artificial Sequence
  chemically synthesized
cttagtgagagcagtttgcctg

SEQ ID NO: 789939 - DNA, 22 bp, Artificial Sequence
  chemically synthesized
ctcctaccgtgccaggcaaact

SEQ ID NO: 789940 - DNA, 22 bp, Artificial Sequence
  chemically synthesized
ttagtgagagcagtttgcctgg

SEQ ID NO: 789941 - DNA, 22 bp, Artificial Sequence
  chemically synthesized
agtgagagcagtttgcctggca

SEQ ID NO: 789942 - DNA, 22 bp, Artificial Sequence
  chemically synthesized
ttactcctaccgtgccaggcaa

SEQ ID NO: 789943 - DNA, 22 bp, Artificial Sequence
  chemically synthesized
gtgagagcagtttgcctggcac

SEQ ID NO: 789944 - DNA, 22 bp, Artificial Sequence
  chemically synthesized
gctattactcctaccgtgccag

SEQ ID NO: 789945 - DNA, 22 bp, Artificial Sequence
  chemically synthesized
tctggctattactcctaccgtg

SEQ ID NO: 789946 - DNA, 22 bp, Artificial Sequence
  chemically synthesized
atctggctattactcctaccgt

SEQ ID NO: 789947 - DNA, 22 bp, Artificial Sequence
  chemically synthesized
gcctggcacggtaggagtaata

SEQ ID NO: 789948 - DNA, 22 bp, Artificial Sequence
  chemically synthesized
cctggcacggtaggagtaatag

SEQ ID NO: 789949 - DNA, 22 bp, Artificial Sequence
  chemically synthesized
agtccatttatctggctattac

SEQ ID NO: 789950 - DNA, 22 bp, Artificial Sequence
  chemically synthesized
gcacggtaggagtaatagccag

SEQ ID NO: 789951 - DNA, 22 bp, Artificial Sequence
  chemically synthesized
cagtccatttatctggctatta

SEQ ID NO: 789952 - DNA, 22 bp, Artificial Sequence
  chemically synthesized
tcagtccatttatctggctatt

SEQ ID NO: 789953 - DNA, 22 bp, Artificial Sequence
  chemically synthesized
ttcagtccatttatctggctat

SEQ ID NO: 789954 - DNA, 22 bp, Artificial Sequence
  chemically synthesized
acttttcagtccatttatctgg

SEQ ID NO: 789955 - DNA, 22 bp, Artificial Sequence
  chemically synthesized
cccacagctcacttttcagtcc

SEQ ID NO: 789956 - DNA, 22 bp, Artificial Sequence
  chemically synthesized
acccacagctcacttttcagtc

SEQ ID NO: 789957 - DNA, 22 bp, Artificial Sequence
  chemically synthesized
tacccacagctcacttttcagt

SEQ ID NO: 789958 - DNA, 22 bp, Artificial Sequence
  chemically synthesized
tttacccacagctcacttttca

SEQ ID NO: 789959 - DNA, 22 bp, Artificial Sequence
  chemically synthesized
ctttacccacagctcacttttc

SEQ ID NO: 789960 - DNA, 22 bp, Artificial Sequence
  chemically synthesized
accttctttacccacagctcac

SEQ ID NO: 789961 - DNA, 22 bp, Artificial Sequence
  chemically synthesized
gctcaccttctttacccacagc

SEQ ID NO: 789962 - DNA, 22 bp, Artificial Sequence
  chemically synthesized
aaaagtgagctgtgggtaaaga

SEQ ID NO: 789963 - DNA, 22 bp, Artificial Sequence
  chemically synthesized
cctagctcaccttctttaccca

SEQ ID NO: 789964 - DNA, 22 bp, Artificial Sequence
  chemically synthesized
tgggtaaagaaggtgagctagg

SEQ ID NO: 789965 - DNA, 22 bp, Artificial Sequence
  chemically synthesized
aaaaaagaaaagaaaatgtagc

SEQ ID NO: 789966 - DNA, 22 bp, Artificial Sequence
  chemically synthesized
aaaaaaagaaaagaaaatgtag

SEQ ID NO: 789967 - DNA, 22 bp, Artificial Sequence
  chemically synthesized
taaaaaaagaaaagaaaatgta

SEQ ID NO: 789968 - DNA, 22 bp, Artificial Sequence
  chemically synthesized
ggcagctctgctacattttctt

SEQ ID NO: 789969 - DNA, 22 bp, Artificial Sequence
  chemically synthesized
tgctacattttcttttcttttt

SEQ ID NO: 789970 - DNA, 22 bp, Artificial Sequence
  chemically synthesized
ctacattttcttttcttttttt

SEQ ID NO: 789971 - DNA, 22 bp, Artificial Sequence
  chemically synthesized
atcatagaactttaaaaaaaga

SEQ ID NO: 789972 - DNA, 22 bp, Artificial Sequence
  chemically synthesized
cattttcttttctttttttaaa

SEQ ID NO: 789973 - DNA, 22 bp, Artificial Sequence
  chemically synthesized
tcttttctttttttaaagttct

SEQ ID NO: 789974 - DNA, 22 bp, Artificial Sequence
  chemically synthesized
cttttctttttttaaagttcta

SEQ ID NO: 789975 - DNA, 22 bp, Artificial Sequence
  chemically synthesized
ttttctttttttaaagttctat

SEQ ID NO: 789976 - DNA, 22 bp, Artificial Sequence
  chemically synthesized
ttctttttttaaagttctatga

SEQ ID NO: 789977 - DNA, 22 bp, Artificial Sequence
  chemically synthesized
tctttttttaaagttctatgat

SEQ ID NO: 789978 - DNA, 22 bp, Artificial Sequence
  chemically synthesized
aaataaaaattaatcatagaac

SEQ ID NO: 789979 - DNA, 22 bp, Artificial Sequence
  chemically synthesized
ctttttttaaagttctatgatt

SEQ ID NO: 789980 - DNA, 22 bp, Artificial Sequence
  chemically synthesized
aaaataaaaattaatcatagaa

SEQ ID NO: 789981 - DNA, 22 bp, Artificial Sequence
  chemically synthesized
tttttttaaagttctatgatta

SEQ ID NO: 789982 - DNA, 22 bp, Artificial Sequence
  chemically synthesized
tttttaaagttctatgattaat

SEQ ID NO: 789983 - DNA, 22 bp, Artificial Sequence
  chemically synthesized
ttttaaagttctatgattaatt

SEQ ID NO: 789984 - DNA, 22 bp, Artificial Sequence
  chemically synthesized
tttaaagttctatgattaattt

SEQ ID NO: 789985 - DNA, 22 bp, Artificial Sequence
  chemically synthesized
ttaaagttctatgattaatttt

SEQ ID NO: 789986 - DNA, 22 bp, Artificial Sequence
  chemically synthesized
taaagttctatgattaattttt

SEQ ID NO: 789987 - DNA, 22 bp, Artificial Sequence
  chemically synthesized
aaagttctatgattaattttta

SEQ ID NO: 789988 - DNA, 22 bp, Artificial Sequence
  chemically synthesized
aagttctatgattaatttttat

SEQ ID NO: 789989 - DNA, 22 bp, Artificial Sequence
  chemically synthesized
tatgattaatttttattttaag

SEQ ID NO: 789990 - DNA, 22 bp, Artificial Sequence
  chemically synthesized
tgattaatttttattttaagtt

SEQ ID NO: 789991 - DNA, 22 bp, Artificial Sequence
  chemically synthesized
cacatgtaccacggaacttaaa

SEQ ID NO: 789992 - DNA, 22 bp, Artificial Sequence
  chemically synthesized
atttttattttaagttccgtgg

SEQ ID NO: 789993 - DNA, 22 bp, Artificial Sequence
  chemically synthesized
ttattttaagttccgtggtaca

SEQ ID NO: 789994 - DNA, 22 bp, Artificial Sequence
  chemically synthesized
tattttaagttccgtggtacat

SEQ ID NO: 789995 - DNA, 22 bp, Artificial Sequence
  chemically synthesized
cacatcctgcacatgtaccacg

SEQ ID NO: 789996 - DNA, 22 bp, Artificial Sequence
  chemically synthesized
attttaagttccgtggtacatg

SEQ ID NO: 789997 - DNA, 22 bp, Artificial Sequence
  chemically synthesized
ttttaagttccgtggtacatgt

SEQ ID NO: 789998 - DNA, 22 bp, Artificial Sequence
  chemically synthesized
taagttccgtggtacatgtgca

SEQ ID NO: 789999 - DNA, 22 bp, Artificial Sequence
  chemically synthesized
aagttccgtggtacatgtgcag

SEQ ID NO: 790000 - DNA, 22 bp, Artificial Sequence
  chemically synthesized
agttccgtggtacatgtgcagg

SEQ ID NO: 790001 - DNA, 22 bp, Artificial Sequence
  chemically synthesized
cgtggtacatgtgcaggatgtg

SEQ ID NO: 790002 - DNA, 22 bp, Artificial Sequence
  chemically synthesized
tgtaacaaacctgcacatcctg

SEQ ID NO: 790003 - DNA, 22 bp, Artificial Sequence
  chemically synthesized
cctatgtaacaaacctgcacat

SEQ ID NO: 790004 - DNA, 22 bp, Artificial Sequence
  chemically synthesized
acctatgtaacaaacctgcaca

SEQ ID NO: 790005 - DNA, 22 bp, Artificial Sequence
  chemically synthesized
gttacataggtaaacatgtgcc

SEQ ID NO: 790006 - DNA, 22 bp, Artificial Sequence
  chemically synthesized
ttacataggtaaacatgtgcca

SEQ ID NO: 790007 - DNA, 22 bp, Artificial Sequence
  chemically synthesized
cataggtaaacatgtgccatgg

SEQ ID NO: 790008 - DNA, 22 bp, Artificial Sequence
  chemically synthesized
ataggtgcagcaaaccaccatg

SEQ ID NO: 790009 - DNA, 22 bp, Artificial Sequence
  chemically synthesized
ggtgatgggttaataggtgcag

SEQ ID NO: 790010 - DNA, 22 bp, Artificial Sequence
  chemically synthesized
taggtgatgggttaataggtgc

SEQ ID NO: 790011 - DNA, 22 bp, Artificial Sequence
  chemically synthesized
gctgcacctattaacccatcac

SEQ ID NO: 790012 - DNA, 22 bp, Artificial Sequence
  chemically synthesized
ctgcacctattaacccatcacc

SEQ ID NO: 790013 - DNA, 22 bp, Artificial Sequence
  chemically synthesized
cacctattaacccatcacctag

SEQ ID NO: 790014 - DNA, 22 bp, Artificial Sequence
  chemically synthesized
ttaacccatcacctagagatat

SEQ ID NO: 790015 - DNA, 22 bp, Artificial Sequence
  chemically synthesized
acccatcacctagagatatata

SEQ ID NO: 790016 - DNA, 22 bp, Artificial Sequence
  chemically synthesized
gagatatatatatatatatttt

SEQ ID NO: 790017 - DNA, 22 bp, Artificial Sequence
  chemically synthesized
aagtataataataaaatatata

SEQ ID NO: 790018 - DNA, 22 bp, Artificial Sequence
  chemically synthesized
aaagtataataataaaatatat

SEQ ID NO: 790019 - DNA, 22 bp, Artificial Sequence
  chemically synthesized
aaacttaaagtataataataaa

SEQ ID NO: 790020 - DNA, 22 bp, Artificial Sequence
  chemically synthesized
tattattatactttaagtttta

SEQ ID NO: 790021 - DNA, 22 bp, Artificial Sequence
  chemically synthesized
attattatactttaagttttag

SEQ ID NO: 790022 - DNA, 22 bp, Artificial Sequence
  chemically synthesized
tgcatatggaccctaaaactta

SEQ ID NO: 790023 - DNA, 22 bp, Artificial Sequence
  chemically synthesized
ttattatactttaagttttagg

SEQ ID NO: 790024 - DNA, 22 bp, Artificial Sequence
  chemically synthesized
ttatactttaagttttagggtc

SEQ ID NO: 790025 - DNA, 22 bp, Artificial Sequence
  chemically synthesized
acgttgtgcatatggaccctaa

SEQ ID NO: 790026 - DNA, 22 bp, Artificial Sequence
  chemically synthesized
tactttaagttttagggtccat

SEQ ID NO: 790027 - DNA, 22 bp, Artificial Sequence
  chemically synthesized
cacgttgtgcatatggacccta

SEQ ID NO: 790028 - DNA, 22 bp, Artificial Sequence
  chemically synthesized
taagttttagggtccatatgca

SEQ ID NO: 790029 - DNA, 22 bp, Artificial Sequence
  chemically synthesized
accttcacgttgtgcatatgga

SEQ ID NO: 790030 - DNA, 22 bp, Artificial Sequence
  chemically synthesized
aagttttagggtccatatgcac

SEQ ID NO: 790031 - DNA, 22 bp, Artificial Sequence
  chemically synthesized
agttttagggtccatatgcaca

SEQ ID NO: 790032 - DNA, 22 bp, Artificial Sequence
  chemically synthesized
tagggtccatatgcacaacgtg

SEQ ID NO: 790033 - DNA, 22 bp, Artificial Sequence
  chemically synthesized
agggtccatatgcacaacgtga

SEQ ID NO: 790034 - DNA, 22 bp, Artificial Sequence
  chemically synthesized
gggtccatatgcacaacgtgaa

SEQ ID NO: 790035 - DNA, 22 bp, Artificial Sequence
  chemically synthesized
gttacatatgtatacatgtgcc

SEQ ID NO: 790036 - DNA, 22 bp, Artificial Sequence
  chemically synthesized
catatgtatacatgtgccatgt

SEQ ID NO: 790037 - DNA, 22 bp, Artificial Sequence
  chemically synthesized
ggtgcagcacaccaacatggca

SEQ ID NO: 790038 - DNA, 22 bp, Artificial Sequence
  chemically synthesized
ctgggtgcagcacaccaacatg

SEQ ID NO: 790039 - DNA, 22 bp, Artificial Sequence
  chemically synthesized
acgagttactgggtgcagcaca

SEQ ID NO: 790040 - DNA, 22 bp, Artificial Sequence
  chemically synthesized
actgacgagttactgggtgcag

SEQ ID NO: 790041 - DNA, 22 bp, Artificial Sequence
  chemically synthesized
atgttaactgacgagttactgg

SEQ ID NO: 790042 - DNA, 22 bp, Artificial Sequence
  chemically synthesized
gtgtgctgcacccagtaactcg

SEQ ID NO: 790043 - DNA, 22 bp, Artificial Sequence
  chemically synthesized
cacccagtaactcgtcagttaa

SEQ ID NO: 790044 - DNA, 22 bp, Artificial Sequence
  chemically synthesized
gagatacacctaatgttaactg

SEQ ID NO: 790045 - DNA, 22 bp, Artificial Sequence
  chemically synthesized
ggagatacacctaatgttaact

SEQ ID NO: 790046 - DNA, 22 bp, Artificial Sequence
  chemically synthesized
gtcagttaacattaggtgtatc

SEQ ID NO: 790047 - DNA, 22 bp, Artificial Sequence
  chemically synthesized
acattaggtgtatctccaaatg

SEQ ID NO: 790048 - DNA, 22 bp, Artificial Sequence
  chemically synthesized
ggtgtatctccaaatgctatcc

SEQ ID NO: 790049 - DNA, 22 bp, Artificial Sequence
  chemically synthesized
tggggtcgggggaggggggagg

SEQ ID NO: 790050 - DNA, 22 bp, Artificial Sequence
  chemically synthesized
caaatgctatccctcccccctc

SEQ ID NO: 790051 - DNA, 22 bp, Artificial Sequence
  chemically synthesized
ttgtggggtcgggggagggggg

SEQ ID NO: 790052 - DNA, 22 bp, Artificial Sequence
  chemically synthesized
tccctcccccctcccccgaccc

SEQ ID NO: 790053 - DNA, 22 bp, Artificial Sequence
  chemically synthesized
ccccctcccccgaccccacaac

SEQ ID NO: 790054 - DNA, 22 bp, Artificial Sequence
  chemically synthesized
ccccgaccccacaacaggccct

SEQ ID NO: 790055 - DNA, 22 bp, Artificial Sequence
  chemically synthesized
gtgtgtgatgttccccttcctg

SEQ ID NO: 790056 - DNA, 22 bp, Artificial Sequence
  chemically synthesized
aacaatgagaacacatggacac

SEQ ID NO: 790057 - DNA, 22 bp, Artificial Sequence
  chemically synthesized
cccttcctgtgtccatgtgttc

SEQ ID NO: 790058 - DNA, 22 bp, Artificial Sequence
  chemically synthesized
cctgtgtccatgtgttctcatt

SEQ ID NO: 790059 - DNA, 22 bp, Artificial Sequence
  chemically synthesized
ctgtgtccatgtgttctcattg

SEQ ID NO: 790060 - DNA, 22 bp, Artificial Sequence
  chemically synthesized
tgtccatgtgttctcattgttc

SEQ ID NO: 790061 - DNA, 22 bp, Artificial Sequence
  chemically synthesized
acaggtgggaattgaacaatga

SEQ ID NO: 790062 - DNA, 22 bp, Artificial Sequence
  chemically synthesized
actcacaggtgggaattgaaca

SEQ ID NO: 790063 - DNA, 22 bp, Artificial Sequence
  chemically synthesized
tcactcacaggtgggaattgaa

SEQ ID NO: 790064 - DNA, 22 bp, Artificial Sequence
  chemically synthesized
tcattgttcaattcccacctgt

SEQ ID NO: 790065 - DNA, 22 bp, Artificial Sequence
  chemically synthesized
attgttcaattcccacctgtga

SEQ ID NO: 790066 - DNA, 22 bp, Artificial Sequence
  chemically synthesized
ttcaattcccacctgtgagtga

SEQ ID NO: 790067 - DNA, 22 bp, Artificial Sequence
  chemically synthesized
aattcccacctgtgagtgagaa

SEQ ID NO: 790068 - DNA, 22 bp, Artificial Sequence
  chemically synthesized
ccacctgtgagtgagaacatgt

SEQ ID NO: 790069 - DNA, 22 bp, Artificial Sequence
  chemically synthesized
tgagtgagaacatgtggtgttt

SEQ ID NO: 790070 - DNA, 22 bp, Artificial Sequence
  chemically synthesized
tggcaaggacaaaaaaccaaac

SEQ ID NO: 790071 - DNA, 22 bp, Artificial Sequence
  chemically synthesized
agcaaactatggcaaggacaaa

SEQ ID NO: 790072 - DNA, 22 bp, Artificial Sequence
  chemically synthesized
tcagcaaactatggcaaggaca

SEQ ID NO: 790073 - DNA, 22 bp, Artificial Sequence
  chemically synthesized
ggttttttgtccttgccatagt

SEQ ID NO: 790074 - DNA, 22 bp, Artificial Sequence
  chemically synthesized
gttttttgtccttgccatagtt

SEQ ID NO: 790075 - DNA, 22 bp, Artificial Sequence
  chemically synthesized
tttgtccttgccatagtttgct

SEQ ID NO: 790076 - DNA, 22 bp, Artificial Sequence
  chemically synthesized
ttgtccttgccatagtttgctg

SEQ ID NO: 790077 - DNA, 22 bp, Artificial Sequence
  chemically synthesized
tgtccttgccatagtttgctga

SEQ ID NO: 790078 - DNA, 22 bp, Artificial Sequence
  chemically synthesized
gtccttgccatagtttgctgag

SEQ ID NO: 790079 - DNA, 22 bp, Artificial Sequence
  chemically synthesized
gaaaccatcattctcagcaaac

SEQ ID NO: 790080 - DNA, 22 bp, Artificial Sequence
  chemically synthesized
tccttgccatagtttgctgaga

SEQ ID NO: 790081 - DNA, 22 bp, Artificial Sequence
  chemically synthesized
gccatagtttgctgagaatgat

SEQ ID NO: 790082 - DNA, 22 bp, Artificial Sequence
  chemically synthesized
ccatagtttgctgagaatgatg

SEQ ID NO: 790083 - DNA, 22 bp, Artificial Sequence
  chemically synthesized
gctgagaatgatggtttccagc

SEQ ID NO: 790084 - DNA, 22 bp, Artificial Sequence
  chemically synthesized
ctgagaatgatggtttccagct

SEQ ID NO: 790085 - DNA, 22 bp, Artificial Sequence
  chemically synthesized
agaatgatggtttccagcttca

SEQ ID NO: 790086 - DNA, 22 bp, Artificial Sequence
  chemically synthesized
tagggacatggatgaagctgga

SEQ ID NO: 790087 - DNA, 22 bp, Artificial Sequence
  chemically synthesized
gtagggacatggatgaagctgg

SEQ ID NO: 790088 - DNA, 22 bp, Artificial Sequence
  chemically synthesized
tgtagggacatggatgaagctg

SEQ ID NO: 790089 - DNA, 22 bp, Artificial Sequence
  chemically synthesized
atgtcctttgtagggacatgga

SEQ ID NO: 790090 - DNA, 22 bp, Artificial Sequence
  chemically synthesized
ccagcttcatccatgtccctac

SEQ ID NO: 790091 - DNA, 22 bp, Artificial Sequence
  chemically synthesized
cagcttcatccatgtccctaca

SEQ ID NO: 790092 - DNA, 22 bp, Artificial Sequence
  chemically synthesized
catccatgtccctacaaaggac

SEQ ID NO: 790093 - DNA, 22 bp, Artificial Sequence
  chemically synthesized
atccatgtccctacaaaggaca

SEQ ID NO: 790094 - DNA, 22 bp, Artificial Sequence
  chemically synthesized
caaaggacatgaactcatcctt

SEQ ID NO: 790095 - DNA, 22 bp, Artificial Sequence
  chemically synthesized
tgcagccataaaaaaggatgag

SEQ ID NO: 790096 - DNA, 22 bp, Artificial Sequence
  chemically synthesized
atccttttttatggctgcatag

SEQ ID NO: 790097 - DNA, 22 bp, Artificial Sequence
  chemically synthesized
ttttatggctgcatagtattcc

SEQ ID NO: 790098 - DNA, 22 bp, Artificial Sequence
  chemically synthesized
tttatggctgcatagtattcca

SEQ ID NO: 790099 - DNA, 22 bp, Artificial Sequence
  chemically synthesized
ttatggctgcatagtattccat

SEQ ID NO: 790100 - DNA, 22 bp, Artificial Sequence
  chemically synthesized
tatggctgcatagtattccatg

SEQ ID NO: 790101 - DNA, 22 bp, Artificial Sequence
  chemically synthesized
atggctgcatagtattccatgg

SEQ ID NO: 790102 - DNA, 22 bp, Artificial Sequence
  chemically synthesized
tggctgcatagtattccatggt

SEQ ID NO: 790103 - DNA, 22 bp, Artificial Sequence
  chemically synthesized
catagtattccatggtgtatat

SEQ ID NO: 790104 - DNA, 22 bp, Artificial Sequence
  chemically synthesized
agaaaatgtggcacatatacac

SEQ ID NO: 790105 - DNA, 22 bp, Artificial Sequence
  chemically synthesized
gattgagaaaatgtggcacata

SEQ ID NO: 790106 - DNA, 22 bp, Artificial Sequence
  chemically synthesized
catggtgtatatgtgccacatt

SEQ ID NO: 790107 - DNA, 22 bp, Artificial Sequence
  chemically synthesized
tctcaatccagtctatcattgt

SEQ ID NO: 790108 - DNA, 22 bp, Artificial Sequence
  chemically synthesized
ctcaatccagtctatcattgtt

SEQ ID NO: 790109 - DNA, 22 bp, Artificial Sequence
  chemically synthesized
tcaatccagtctatcattgttg

SEQ ID NO: 790110 - DNA, 22 bp, Artificial Sequence
  chemically synthesized
aatccagtctatcattgttgga

SEQ ID NO: 790111 - DNA, 22 bp, Artificial Sequence
  chemically synthesized
gaaccaacccaaatgtccaaca

SEQ ID NO: 790112 - DNA, 22 bp, Artificial Sequence
  chemically synthesized
ggaaccaacccaaatgtccaac

SEQ ID NO: 790113 - DNA, 22 bp, Artificial Sequence
  chemically synthesized
tcattgttggacatttgggttg

SEQ ID NO: 790114 - DNA, 22 bp, Artificial Sequence
  chemically synthesized
ttggacatttgggttggttcca

SEQ ID NO: 790115 - DNA, 22 bp, Artificial Sequence
  chemically synthesized
gacatttgggttggttccaagt

SEQ ID NO: 790116 - DNA, 22 bp, Artificial Sequence
  chemically synthesized
gggttggttccaagtctttgct

SEQ ID NO: 790117 - DNA, 22 bp, Artificial Sequence
  chemically synthesized
ggttggttccaagtctttgcta

SEQ ID NO: 790118 - DNA, 22 bp, Artificial Sequence
  chemically synthesized
ggtgatgggcaatagcaaagac

SEQ ID NO: 790119 - DNA, 22 bp, Artificial Sequence
  chemically synthesized
gttccaagtctttgctattgcc

SEQ ID NO: 790120 - DNA, 22 bp, Artificial Sequence
  chemically synthesized
atatctaggtgatgggcaatag

SEQ ID NO: 790121 - DNA, 22 bp, Artificial Sequence
  chemically synthesized
aatatctaggtgatgggcaata

SEQ ID NO: 790122 - DNA, 22 bp, Artificial Sequence
  chemically synthesized
caagtctttgctattgcccatc

SEQ ID NO: 790123 - DNA, 22 bp, Artificial Sequence
  chemically synthesized
ggcttaatatctaggtgatggg

SEQ ID NO: 790124 - DNA, 22 bp, Artificial Sequence
  chemically synthesized
tgctattgcccatcacctagat

SEQ ID NO: 790125 - DNA, 22 bp, Artificial Sequence
  chemically synthesized
gctattgcccatcacctagata

SEQ ID NO: 790126 - DNA, 22 bp, Artificial Sequence
  chemically synthesized
ctattgcccatcacctagatat

SEQ ID NO: 790127 - DNA, 22 bp, Artificial Sequence
  chemically synthesized
ttgcccatcacctagatattaa

SEQ ID NO: 790128 - DNA, 22 bp, Artificial Sequence
  chemically synthesized
atgcatgctgggcttaatatct

SEQ ID NO: 790129 - DNA, 22 bp, Artificial Sequence
  chemically synthesized
cccatcacctagatattaagcc

SEQ ID NO: 790130 - DNA, 22 bp, Artificial Sequence
  chemically synthesized
gatattaagcccagcatgcatt

SEQ ID NO: 790131 - DNA, 22 bp, Artificial Sequence
  chemically synthesized
ggaaaaatagctaatgcatgct

SEQ ID NO: 790132 - DNA, 22 bp, Artificial Sequence
  chemically synthesized
agcccagcatgcattagctatt

SEQ ID NO: 790133 - DNA, 22 bp, Artificial Sequence
  chemically synthesized
gctatttttcccaatgctctcc

SEQ ID NO: 790134 - DNA, 22 bp, Artificial Sequence
  chemically synthesized
tttttcccaatgctctccctcc

SEQ ID NO: 790135 - DNA, 22 bp, Artificial Sequence
  chemically synthesized
ttcccaatgctctccctcccct

SEQ ID NO: 790136 - DNA, 22 bp, Artificial Sequence
  chemically synthesized
tcccaatgctctccctcccctc

SEQ ID NO: 790137 - DNA, 22 bp, Artificial Sequence
  chemically synthesized
cccaatgctctccctcccctcg

SEQ ID NO: 790138 - DNA, 22 bp, Artificial Sequence
  chemically synthesized
ccaatgctctccctcccctcgc

SEQ ID NO: 790139 - DNA, 22 bp, Artificial Sequence
  chemically synthesized
tcggggggtggggcgaggggag

SEQ ID NO: 790140 - DNA, 22 bp, Artificial Sequence
  chemically synthesized
aggcctgtcggggggtggggcg

SEQ ID NO: 790141 - DNA, 22 bp, Artificial Sequence
  chemically synthesized
tccctcccctcgccccaccccc

SEQ ID NO: 790142 - DNA, 22 bp, Artificial Sequence
  chemically synthesized
cctcccctcgccccaccccccg

SEQ ID NO: 790143 - DNA, 22 bp, Artificial Sequence
  chemically synthesized
ccctcgccccaccccccgacag

SEQ ID NO: 790144 - DNA, 22 bp, Artificial Sequence
  chemically synthesized
gccccaccccccgacaggcctc

SEQ ID NO: 790145 - DNA, 22 bp, Artificial Sequence
  chemically synthesized
atggaggggaacaacacacact

SEQ ID NO: 790146 - DNA, 22 bp, Artificial Sequence
  chemically synthesized
agtgtgtgttgttcccctccat

SEQ ID NO: 790147 - DNA, 22 bp, Artificial Sequence
  chemically synthesized
aacaatgagaacacatggactc

SEQ ID NO: 790148 - DNA, 22 bp, Artificial Sequence
  chemically synthesized
ttcccctccatgagtccatgtg

SEQ ID NO: 790149 - DNA, 22 bp, Artificial Sequence
  chemically synthesized
ccctccatgagtccatgtgttc

SEQ ID NO: 790150 - DNA, 22 bp, Artificial Sequence
  chemically synthesized
catgagtccatgtgttctcatt

SEQ ID NO: 790151 - DNA, 22 bp, Artificial Sequence
  chemically synthesized
aaagtgggagctgaacaatgag

SEQ ID NO: 790152 - DNA, 22 bp, Artificial Sequence
  chemically synthesized
aaaagtgggagctgaacaatga

SEQ ID NO: 790153 - DNA, 22 bp, Artificial Sequence
  chemically synthesized
acttaaaagtgggagctgaaca

SEQ ID NO: 790154 - DNA, 22 bp, Artificial Sequence
  chemically synthesized
tcacttaaaagtgggagctgaa

SEQ ID NO: 790155 - DNA, 22 bp, Artificial Sequence
  chemically synthesized
tcattgttcagctcccactttt

SEQ ID NO: 790156 - DNA, 22 bp, Artificial Sequence
  chemically synthesized
attgttcagctcccacttttaa

SEQ ID NO: 790157 - DNA, 22 bp, Artificial Sequence
  chemically synthesized
ttcagctcccacttttaagtga

SEQ ID NO: 790158 - DNA, 22 bp, Artificial Sequence
  chemically synthesized
agctcccacttttaagtgagaa

SEQ ID NO: 790159 - DNA, 22 bp, Artificial Sequence
  chemically synthesized
ccacttttaagtgagaacatgt

SEQ ID NO: 790160 - DNA, 22 bp, Artificial Sequence
  chemically synthesized
ttaagtgagaacatgtgatatt

SEQ ID NO: 790161 - DNA, 22 bp, Artificial Sequence
  chemically synthesized
taagtgagaacatgtgatattt

SEQ ID NO: 790162 - DNA, 22 bp, Artificial Sequence
  chemically synthesized
aagtgagaacatgtgatatttg

SEQ ID NO: 790163 - DNA, 22 bp, Artificial Sequence
  chemically synthesized
agtgagaacatgtgatatttgc

SEQ ID NO: 790164 - DNA, 22 bp, Artificial Sequence
  chemically synthesized
acacaggaacagaaaagcaaat

SEQ ID NO: 790165 - DNA, 22 bp, Artificial Sequence
  chemically synthesized
agcaaactaacacaggaacaga

SEQ ID NO: 790166 - DNA, 22 bp, Artificial Sequence
  chemically synthesized
tcctcagcaaactaacacagga

SEQ ID NO: 790167 - DNA, 22 bp, Artificial Sequence
  chemically synthesized
gcttttctgttcctgtgttagt

SEQ ID NO: 790168 - DNA, 22 bp, Artificial Sequence
  chemically synthesized
cttttctgttcctgtgttagtt

SEQ ID NO: 790169 - DNA, 22 bp, Artificial Sequence
  chemically synthesized
ttctgttcctgtgttagtttgc

SEQ ID NO: 790170 - DNA, 22 bp, Artificial Sequence
  chemically synthesized
tctgttcctgtgttagtttgct

SEQ ID NO: 790171 - DNA, 22 bp, Artificial Sequence
  chemically synthesized
ctgttcctgtgttagtttgctg

SEQ ID NO: 790172 - DNA, 22 bp, Artificial Sequence
  chemically synthesized
tgttcctgtgttagtttgctga

SEQ ID NO: 790173 - DNA, 22 bp, Artificial Sequence
  chemically synthesized
gaagccattatcctcagcaaac

SEQ ID NO: 790174 - DNA, 22 bp, Artificial Sequence
  chemically synthesized
ttcctgtgttagtttgctgagg

SEQ ID NO: 790175 - DNA, 22 bp, Artificial Sequence
  chemically synthesized
ctgtgttagtttgctgaggata

SEQ ID NO: 790176 - DNA, 22 bp, Artificial Sequence
  chemically synthesized
tgttagtttgctgaggataatg

SEQ ID NO: 790177 - DNA, 22 bp, Artificial Sequence
  chemically synthesized
aggagctggaagccattatcct

SEQ ID NO: 790178 - DNA, 22 bp, Artificial Sequence
  chemically synthesized
gaggagctggaagccattatcc

SEQ ID NO: 790179 - DNA, 22 bp, Artificial Sequence
  chemically synthesized
tgaggagctggaagccattatc

SEQ ID NO: 790180 - DNA, 22 bp, Artificial Sequence
  chemically synthesized
gtttgctgaggataatggcttc

SEQ ID NO: 790181 - DNA, 22 bp, Artificial Sequence
  chemically synthesized
gctgaggataatggcttccagc

SEQ ID NO: 790182 - DNA, 22 bp, Artificial Sequence
  chemically synthesized
gatctttgaggagctggaagcc

SEQ ID NO: 790183 - DNA, 22 bp, Artificial Sequence
  chemically synthesized
ctgaggataatggcttccagct

SEQ ID NO: 790184 - DNA, 22 bp, Artificial Sequence
  chemically synthesized
tagatctttgaggagctggaag

SEQ ID NO: 790185 - DNA, 22 bp, Artificial Sequence
  chemically synthesized
aggataatggcttccagctcct

SEQ ID NO: 790186 - DNA, 22 bp, Artificial Sequence
  chemically synthesized
gttctagatctttgaggagctg

SEQ ID NO: 790187 - DNA, 22 bp, Artificial Sequence
  chemically synthesized
tggttctagatctttgaggagc

SEQ ID NO: 790188 - DNA, 22 bp, Artificial Sequence
  chemically synthesized
ctggttctagatctttgaggag

SEQ ID NO: 790189 - DNA, 22 bp, Artificial Sequence
  chemically synthesized
ccagctcctcaaagatctagaa

SEQ ID NO: 790190 - DNA, 22 bp, Artificial Sequence
  chemically synthesized
cagctcctcaaagatctagaac

SEQ ID NO: 790191 - DNA, 22 bp, Artificial Sequence
  chemically synthesized
ctcaaagatctagaaccagaaa

SEQ ID NO: 790192 - DNA, 22 bp, Artificial Sequence
  chemically synthesized
ggtcaaatggtatttctggttc

SEQ ID NO: 790193 - DNA, 22 bp, Artificial Sequence
  chemically synthesized
aaagatctagaaccagaaatac

SEQ ID NO: 790194 - DNA, 22 bp, Artificial Sequence
  chemically synthesized
ctgggtcaaatggtatttctgg

SEQ ID NO: 790195 - DNA, 22 bp, Artificial Sequence
  chemically synthesized
gaaccagaaataccatttgacc

SEQ ID NO: 790196 - DNA, 22 bp, Artificial Sequence
  chemically synthesized
ggtatataaccaataatgggat

SEQ ID NO: 790197 - DNA, 22 bp, Artificial Sequence
  chemically synthesized
gggtatataaccaataatggga

SEQ ID NO: 790198 - DNA, 22 bp, Artificial Sequence
  chemically synthesized
tgggtatataaccaataatggg

SEQ ID NO: 790199 - DNA, 22 bp, Artificial Sequence
  chemically synthesized
gacccagcaatcccattattgg

SEQ ID NO: 790200 - DNA, 22 bp, Artificial Sequence
  chemically synthesized
acccagcaatcccattattggt

SEQ ID NO: 790201 - DNA, 22 bp, Artificial Sequence
  chemically synthesized
ctttgggtatataaccaataat

SEQ ID NO: 790202 - DNA, 22 bp, Artificial Sequence
  chemically synthesized
tattcctttgggtatataacca

SEQ ID NO: 790203 - DNA, 22 bp, Artificial Sequence
  chemically synthesized
atattcctttgggtatataacc

SEQ ID NO: 790204 - DNA, 22 bp, Artificial Sequence
  chemically synthesized
ttggttatatacccaaaggaat

SEQ ID NO: 790205 - DNA, 22 bp, Artificial Sequence
  chemically synthesized
gttatatacccaaaggaatata

SEQ ID NO: 790206 - DNA, 22 bp, Artificial Sequence
  chemically synthesized
aaatagaatggtttatattcct

SEQ ID NO: 790207 - DNA, 22 bp, Artificial Sequence
  chemically synthesized
aaaatagaatggtttatattcc

SEQ ID NO: 790208 - DNA, 22 bp, Artificial Sequence
  chemically synthesized
taaaatagaatggtttatattc

SEQ ID NO: 790209 - DNA, 22 bp, Artificial Sequence
  chemically synthesized
tatacccaaaggaatataaacc

SEQ ID NO: 790210 - DNA, 22 bp, Artificial Sequence
  chemically synthesized
tattttaaagatacatgcacac

SEQ ID NO: 790211 - DNA, 22 bp, Artificial Sequence
  chemically synthesized
cagtgaacatacgtgtgcatgt

SEQ ID NO: 790212 - DNA, 22 bp, Artificial Sequence
  chemically synthesized
ttttaaagatacatgcacacgt

SEQ ID NO: 790213 - DNA, 22 bp, Artificial Sequence
  chemically synthesized
taaagatacatgcacacgtatg

SEQ ID NO: 790214 - DNA, 22 bp, Artificial Sequence
  chemically synthesized
aaagatacatgcacacgtatgt

SEQ ID NO: 790215 - DNA, 22 bp, Artificial Sequence
  chemically synthesized
aagatacatgcacacgtatgtt

SEQ ID NO: 790216 - DNA, 22 bp, Artificial Sequence
  chemically synthesized
tgaatagtgctgcagtgaacat

SEQ ID NO: 790217 - DNA, 22 bp, Artificial Sequence
  chemically synthesized
ttgtgaatagtgctgcagtgaa

SEQ ID NO: 790218 - DNA, 22 bp, Artificial Sequence
  chemically synthesized
ctattgtgaatagtgctgcagt

SEQ ID NO: 790219 - DNA, 22 bp, Artificial Sequence
  chemically synthesized
gctattgtgaatagtgctgcag

SEQ ID NO: 790220 - DNA, 22 bp, Artificial Sequence
  chemically synthesized
tgctattgtgaatagtgctgca

SEQ ID NO: 790221 - DNA, 22 bp, Artificial Sequence
  chemically synthesized
catgtctttgctattgtgaata

SEQ ID NO: 790222 - DNA, 22 bp, Artificial Sequence
  chemically synthesized
actgcagcactattcacaatag

SEQ ID NO: 790223 - DNA, 22 bp, Artificial Sequence
  chemically synthesized
attccatgtctttgctattgtg

SEQ ID NO: 790224 - DNA, 22 bp, Artificial Sequence
  chemically synthesized
cagcactattcacaatagcaaa

SEQ ID NO: 790225 - DNA, 22 bp, Artificial Sequence
  chemically synthesized
ggttgattccatgtctttgcta

SEQ ID NO: 790226 - DNA, 22 bp, Artificial Sequence
  chemically synthesized
gggttgattccatgtctttgct

SEQ ID NO: 790227 - DNA, 22 bp, Artificial Sequence
  chemically synthesized
ttcacaatagcaaagacatgga

SEQ ID NO: 790228 - DNA, 22 bp, Artificial Sequence
  chemically synthesized
acaatagcaaagacatggaatc

SEQ ID NO: 790229 - DNA, 22 bp, Artificial Sequence
  chemically synthesized
atgggcatttgggttgattcca

SEQ ID NO: 790230 - DNA, 22 bp, Artificial Sequence
  chemically synthesized
tcactgatgggcatttgggttg

SEQ ID NO: 790231 - DNA, 22 bp, Artificial Sequence
  chemically synthesized
tccagtctatcactgatgggca

SEQ ID NO: 790232 - DNA, 22 bp, Artificial Sequence
  chemically synthesized
atccagtctatcactgatgggc

SEQ ID NO: 790233 - DNA, 22 bp, Artificial Sequence
  chemically synthesized
tatccagtctatcactgatggg

SEQ ID NO: 790234 - DNA, 22 bp, Artificial Sequence
  chemically synthesized
tttatccagtctatcactgatg

SEQ ID NO: 790235 - DNA, 22 bp, Artificial Sequence
  chemically synthesized
ctttatccagtctatcactgat

SEQ ID NO: 790236 - DNA, 22 bp, Artificial Sequence
  chemically synthesized
tctttatccagtctatcactga

SEQ ID NO: 790237 - DNA, 22 bp, Artificial Sequence
  chemically synthesized
cacagtgtatatgtaccacatt

SEQ ID NO: 790238 - DNA, 22 bp, Artificial Sequence
  chemically synthesized
gataaagaaaatgtggtacata

SEQ ID NO: 790239 - DNA, 22 bp, Artificial Sequence
  chemically synthesized
cagagtattccacagtgtatat

SEQ ID NO: 790240 - DNA, 22 bp, Artificial Sequence
  chemically synthesized
tggctgcagagtattccacagt

SEQ ID NO: 790241 - DNA, 22 bp, Artificial Sequence
  chemically synthesized
atggctgcagagtattccacag

SEQ ID NO: 790242 - DNA, 22 bp, Artificial Sequence
  chemically synthesized
tatggctgcagagtattccaca

SEQ ID NO: 790243 - DNA, 22 bp, Artificial Sequence
  chemically synthesized
ttatggctgcagagtattccac

SEQ ID NO: 790244 - DNA, 22 bp, Artificial Sequence
  chemically synthesized
tttatggctgcagagtattcca

SEQ ID NO: 790245 - DNA, 22 bp, Artificial Sequence
  chemically synthesized
ctttttatggctgcagagtatt

SEQ ID NO: 790246 - DNA, 22 bp, Artificial Sequence
  chemically synthesized
attcctttttatggctgcagag

SEQ ID NO: 790247 - DNA, 22 bp, Artificial Sequence
  chemically synthesized
tggaatactctgcagccataaa

SEQ ID NO: 790248 - DNA, 22 bp, Artificial Sequence
  chemically synthesized
tgcagccataaaaaggaatgag

SEQ ID NO: 790249 - DNA, 22 bp, Artificial Sequence
  chemically synthesized
caaaggacatgatctcattcct

SEQ ID NO: 790250 - DNA, 22 bp, Artificial Sequence
  chemically synthesized
cagccataaaaaggaatgagat

SEQ ID NO: 790251 - DNA, 22 bp, Artificial Sequence
  chemically synthesized
ctgcaaaggacatgatctcatt

SEQ ID NO: 790252 - DNA, 22 bp, Artificial Sequence
  chemically synthesized
catatgtgttcctgcaaaggac

SEQ ID NO: 790253 - DNA, 22 bp, Artificial Sequence
  chemically synthesized
tagcacagctccatatgtgttc

SEQ ID NO: 790254 - DNA, 22 bp, Artificial Sequence
  chemically synthesized
tgcaggaacacatatggagctg

SEQ ID NO: 790255 - DNA, 22 bp, Artificial Sequence
  chemically synthesized
gcaggaacacatatggagctgt

SEQ ID NO: 790256 - DNA, 22 bp, Artificial Sequence
  chemically synthesized
tgaaactgtagcacagctccat

SEQ ID NO: 790257 - DNA, 22 bp, Artificial Sequence
  chemically synthesized
caggaacacatatggagctgtg

SEQ ID NO: 790258 - DNA, 22 bp, Artificial Sequence
  chemically synthesized
gtgaaactgtagcacagctcca

SEQ ID NO: 790259 - DNA, 22 bp, Artificial Sequence
  chemically synthesized
tgtgaaactgtagcacagctcc

SEQ ID NO: 790260 - DNA, 22 bp, Artificial Sequence
  chemically synthesized
atggccaaactttgtgaaactg

SEQ ID NO: 790261 - DNA, 22 bp, Artificial Sequence
  chemically synthesized
tgatggccaaactttgtgaaac

SEQ ID NO: 790262 - DNA, 22 bp, Artificial Sequence
  chemically synthesized
ctgatggccaaactttgtgaaa

SEQ ID NO: 790263 - DNA, 22 bp, Artificial Sequence
  chemically synthesized
ttctgatggccaaactttgtga

SEQ ID NO: 790264 - DNA, 22 bp, Artificial Sequence
  chemically synthesized
tgctacagtttcacaaagtttg

SEQ ID NO: 790265 - DNA, 22 bp, Artificial Sequence
  chemically synthesized
cctcttctgatggccaaacttt

SEQ ID NO: 790266 - DNA, 22 bp, Artificial Sequence
  chemically synthesized
tccctcttctgatggccaaact

SEQ ID NO: 790267 - DNA, 22 bp, Artificial Sequence
  chemically synthesized
cagtttcacaaagtttggccat

SEQ ID NO: 790268 - DNA, 22 bp, Artificial Sequence
  chemically synthesized
tctccctcttctgatggccaaa

SEQ ID NO: 790269 - DNA, 22 bp, Artificial Sequence
  chemically synthesized
cacaaagtttggccatcagaag

SEQ ID NO: 790270 - DNA, 22 bp, Artificial Sequence
  chemically synthesized
acaaagtttggccatcagaaga

SEQ ID NO: 790271 - DNA, 22 bp, Artificial Sequence
  chemically synthesized
gtgtcaattctctccctcttct

SEQ ID NO: 790272 - DNA, 22 bp, Artificial Sequence
  chemically synthesized
ggccatcagaagagggagagaa

SEQ ID NO: 790273 - DNA, 22 bp, Artificial Sequence
  chemically synthesized
gccatcagaagagggagagaat

SEQ ID NO: 790274 - DNA, 22 bp, Artificial Sequence
  chemically synthesized
tacctagtgtcaattctctccc

SEQ ID NO: 790275 - DNA, 22 bp, Artificial Sequence
  chemically synthesized
cacctgtacctagtgtcaattc

SEQ ID NO: 790276 - DNA, 22 bp, Artificial Sequence
  chemically synthesized
acccctccacctgtacctagtg

SEQ ID NO: 790277 - DNA, 22 bp, Artificial Sequence
  chemically synthesized
cacccctccacctgtacctagt

SEQ ID NO: 790278 - DNA, 22 bp, Artificial Sequence
  chemically synthesized
cttcacccctccacctgtacct

SEQ ID NO: 790279 - DNA, 22 bp, Artificial Sequence
  chemically synthesized
ctccttcacccctccacctgta

SEQ ID NO: 790280 - DNA, 22 bp, Artificial Sequence
  chemically synthesized
acactaggtacaggtggagggg

SEQ ID NO: 790281 - DNA, 22 bp, Artificial Sequence
  chemically synthesized
ccggtgctgctccttcacccct

SEQ ID NO: 790282 - DNA, 22 bp, Artificial Sequence
  chemically synthesized
ggtacaggtggaggggtgaagg

SEQ ID NO: 790283 - DNA, 22 bp, Artificial Sequence
  chemically synthesized
accggtgctgctccttcacccc

SEQ ID NO: 790284 - DNA, 22 bp, Artificial Sequence
  chemically synthesized
tccaagcttaccggtgctgctc

SEQ ID NO: 790285 - DNA, 22 bp, Artificial Sequence
  chemically synthesized
acaaacaaacaattgtccaagc

SEQ ID NO: 790286 - DNA, 22 bp, Artificial Sequence
  chemically synthesized
aacaaacaaacaattgtccaag

SEQ ID NO: 790287 - DNA, 22 bp, Artificial Sequence
  chemically synthesized
taacaaacaaacaattgtccaa

SEQ ID NO: 790288 - DNA, 22 bp, Artificial Sequence
  chemically synthesized
attttaacaaacaaacaattgt

SEQ ID NO: 790289 - DNA, 22 bp, Artificial Sequence
  chemically synthesized
cattttaacaaacaaacaattg

SEQ ID NO: 790290 - DNA, 22 bp, Artificial Sequence
  chemically synthesized
gtacccttcattttaacaaaca

SEQ ID NO: 790291 - DNA, 22 bp, Artificial Sequence
  chemically synthesized
ggacaattgtttgtttgttaaa

SEQ ID NO: 790292 - DNA, 22 bp, Artificial Sequence
  chemically synthesized
gacaattgtttgtttgttaaaa

SEQ ID NO: 790293 - DNA, 22 bp, Artificial Sequence
  chemically synthesized
tggtacccttcattttaacaaa

SEQ ID NO: 790294 - DNA, 22 bp, Artificial Sequence
  chemically synthesized
ccactctggtacccttcatttt

SEQ ID NO: 790295 - DNA, 22 bp, Artificial Sequence
  chemically synthesized
accactctggtacccttcattt

SEQ ID NO: 790296 - DNA, 22 bp, Artificial Sequence
  chemically synthesized
tttgtttgttaaaatgaagggt

SEQ ID NO: 790297 - DNA, 22 bp, Artificial Sequence
  chemically synthesized
gtttgttaaaatgaagggtacc

SEQ ID NO: 790298 - DNA, 22 bp, Artificial Sequence
  chemically synthesized
tttgttaaaatgaagggtacca

SEQ ID NO: 790299 - DNA, 22 bp, Artificial Sequence
  chemically synthesized
tcagcttaccactctggtaccc

SEQ ID NO: 790300 - DNA, 22 bp, Artificial Sequence
  chemically synthesized
gttaaaatgaagggtaccagag

SEQ ID NO: 790301 - DNA, 22 bp, Artificial Sequence
  chemically synthesized
ttaaaatgaagggtaccagagt

SEQ ID NO: 790302 - DNA, 22 bp, Artificial Sequence
  chemically synthesized
ctgtcagcttaccactctggta

SEQ ID NO: 790303 - DNA, 22 bp, Artificial Sequence
  chemically synthesized
gctgtcagcttaccactctggt

SEQ ID NO: 790304 - DNA, 22 bp, Artificial Sequence
  chemically synthesized
aaatgaagggtaccagagtggt

SEQ ID NO: 790305 - DNA, 22 bp, Artificial Sequence
  chemically synthesized
tgctgtcagcttaccactctgg

SEQ ID NO: 790306 - DNA, 22 bp, Artificial Sequence
  chemically synthesized
atcctttgctgtcagcttacca

SEQ ID NO: 790307 - DNA, 22 bp, Artificial Sequence
  chemically synthesized
ctgatcctttgctgtcagctta

SEQ ID NO: 790308 - DNA, 22 bp, Artificial Sequence
  chemically synthesized
ctactgatcctttgctgtcagc

SEQ ID NO: 790309 - DNA, 22 bp, Artificial Sequence
  chemically synthesized
cctactgatcctttgctgtcag

SEQ ID NO: 790310 - DNA, 22 bp, Artificial Sequence
  chemically synthesized
agtcaccttcctactgatcctt

SEQ ID NO: 790311 - DNA, 22 bp, Artificial Sequence
  chemically synthesized
aagtcaccttcctactgatcct

SEQ ID NO: 790312 - DNA, 22 bp, Artificial Sequence
  chemically synthesized
taagtcaccttcctactgatcc

SEQ ID NO: 790313 - DNA, 22 bp, Artificial Sequence
  chemically synthesized
ttaagtcaccttcctactgatc

SEQ ID NO: 790314 - DNA, 22 bp, Artificial Sequence
  chemically synthesized
tttaagtcaccttcctactgat

SEQ ID NO: 790315 - DNA, 22 bp, Artificial Sequence
  chemically synthesized
acagcaaaggatcagtaggaag

SEQ ID NO: 790316 - DNA, 22 bp, Artificial Sequence
  chemically synthesized
tactttttaagtcaccttccta

SEQ ID NO: 790317 - DNA, 22 bp, Artificial Sequence
  chemically synthesized
tatactttttaagtcaccttcc

SEQ ID NO: 790318 - DNA, 22 bp, Artificial Sequence
  chemically synthesized
ctatactttttaagtcaccttc

SEQ ID NO: 790319 - DNA, 22 bp, Artificial Sequence
  chemically synthesized
cttctatactttttaagtcacc

SEQ ID NO: 790320 - DNA, 22 bp, Artificial Sequence
  chemically synthesized
ctccttctatactttttaagtc

SEQ ID NO: 790321 - DNA, 22 bp, Artificial Sequence
  chemically synthesized
tcaagaatctcctccttctata

SEQ ID NO: 790322 - DNA, 22 bp, Artificial Sequence
  chemically synthesized
tgtcaagaatctcctccttcta

SEQ ID NO: 790323 - DNA, 22 bp, Artificial Sequence
  chemically synthesized
ttctgtcaagaatctcctcctt

SEQ ID NO: 790324 - DNA, 22 bp, Artificial Sequence
  chemically synthesized
aaaaagtatagaaggaggagat

SEQ ID NO: 790325 - DNA, 22 bp, Artificial Sequence
  chemically synthesized
gttctgtcaagaatctcctcct

SEQ ID NO: 790326 - DNA, 22 bp, Artificial Sequence
  chemically synthesized
aaaagtatagaaggaggagatt

SEQ ID NO: 790327 - DNA, 22 bp, Artificial Sequence
  chemically synthesized
agccttgttctgtcaagaatct

SEQ ID NO: 790328 - DNA, 22 bp, Artificial Sequence
  chemically synthesized
tgagccttgttctgtcaagaat

SEQ ID NO: 790329 - DNA, 22 bp, Artificial Sequence
  chemically synthesized
ctctgagccttgttctgtcaag

SEQ ID NO: 790330 - DNA, 22 bp, Artificial Sequence
  chemically synthesized
cgtctcctctgagccttgttct

SEQ ID NO: 790331 - DNA, 22 bp, Artificial Sequence
  chemically synthesized
aattccgtctcctctgagcctt

SEQ ID NO: 790332 - DNA, 22 bp, Artificial Sequence
  chemically synthesized
ttgacagaacaaggctcagagg

SEQ ID NO: 790333 - DNA, 22 bp, Artificial Sequence
  chemically synthesized
taaattccgtctcctctgagcc

SEQ ID NO: 790334 - DNA, 22 bp, Artificial Sequence
  chemically synthesized
gacagaacaaggctcagaggag

SEQ ID NO: 790335 - DNA, 22 bp, Artificial Sequence
  chemically synthesized
acagaacaaggctcagaggaga

SEQ ID NO: 790336 - DNA, 22 bp, Artificial Sequence
  chemically synthesized
ttctaaattccgtctcctctga

SEQ ID NO: 790337 - DNA, 22 bp, Artificial Sequence
  chemically synthesized
acaccctgttctaaattccgtc

SEQ ID NO: 790338 - DNA, 22 bp, Artificial Sequence
  chemically synthesized
agaggagacggaatttagaaca

SEQ ID NO: 790339 - DNA, 22 bp, Artificial Sequence
  chemically synthesized
agaacagggtgttagcctcata

SEQ ID NO: 790340 - DNA, 22 bp, Artificial Sequence
  chemically synthesized
gaacagggtgttagcctcatac

SEQ ID NO: 790341 - DNA, 22 bp, Artificial Sequence
  chemically synthesized
taggatatggaaggtgcaagag

SEQ ID NO: 790342 - DNA, 22 bp, Artificial Sequence
  chemically synthesized
gcctcatactcttgcaccttcc

SEQ ID NO: 790343 - DNA, 22 bp, Artificial Sequence
  chemically synthesized
tgtgactataggatatggaagg

SEQ ID NO: 790344 - DNA, 22 bp, Artificial Sequence
  chemically synthesized
atactcttgcaccttccatatc

SEQ ID NO: 790345 - DNA, 22 bp, Artificial Sequence
  chemically synthesized
ttgtgtgactataggatatgga

SEQ ID NO: 790346 - DNA, 22 bp, Artificial Sequence
  chemically synthesized
ttgcaccttccatatcctatag

SEQ ID NO: 790347 - DNA, 22 bp, Artificial Sequence
  chemically synthesized
gctattgtgtgactataggata

SEQ ID NO: 790348 - DNA, 22 bp, Artificial Sequence
  chemically synthesized
gcaccttccatatcctatagtc

SEQ ID NO: 790349 - DNA, 22 bp, Artificial Sequence
  chemically synthesized
tggctattgtgtgactatagga

SEQ ID NO: 790350 - DNA, 22 bp, Artificial Sequence
  chemically synthesized
caccttccatatcctatagtca

SEQ ID NO: 790351 - DNA, 22 bp, Artificial Sequence
  chemically synthesized
ttctggctattgtgtgactata

SEQ ID NO: 790352 - DNA, 22 bp, Artificial Sequence
  chemically synthesized
attctggctattgtgtgactat

SEQ ID NO: 790353 - DNA, 22 bp, Artificial Sequence
  chemically synthesized
ccatatcctatagtcacacaat

SEQ ID NO: 790354 - DNA, 22 bp, Artificial Sequence
  chemically synthesized
catatcctatagtcacacaata

SEQ ID NO: 790355 - DNA, 22 bp, Artificial Sequence
  chemically synthesized
aaaaaaaaacttattctggcta

SEQ ID NO: 790356 - DNA, 22 bp, Artificial Sequence
  chemically synthesized
tagtcacacaatagccagaata

SEQ ID NO: 790357 - DNA, 22 bp, Artificial Sequence
  chemically synthesized
aaaaaaaaaacttattctggct

SEQ ID NO: 790358 - DNA, 22 bp, Artificial Sequence
  chemically synthesized
taaaaaaaaaacttattctggc

SEQ ID NO: 790359 - DNA, 22 bp, Artificial Sequence
  chemically synthesized
ctttaaaaaaaaaacttattct

SEQ ID NO: 790360 - DNA, 22 bp, Artificial Sequence
  chemically synthesized
cctttaaaaaaaaaacttattc

SEQ ID NO: 790361 - DNA, 22 bp, Artificial Sequence
  chemically synthesized
tcctttaaaaaaaaaacttatt

SEQ ID NO: 790362 - DNA, 22 bp, Artificial Sequence
  chemically synthesized
ttttcctttaaaaaaaaaactt

SEQ ID NO: 790363 - DNA, 22 bp, Artificial Sequence
  chemically synthesized
attttcctttaaaaaaaaaact

SEQ ID NO: 790364 - DNA, 22 bp, Artificial Sequence
  chemically synthesized
tgacttattttcctttaaaaaa

SEQ ID NO: 790365 - DNA, 22 bp, Artificial Sequence
  chemically synthesized
gtgacttattttcctttaaaaa

SEQ ID NO: 790366 - DNA, 22 bp, Artificial Sequence
  chemically synthesized
tttttttaaaggaaaataagtc

SEQ ID NO: 790367 - DNA, 22 bp, Artificial Sequence
  chemically synthesized
ttttttaaaggaaaataagtca

SEQ ID NO: 790368 - DNA, 22 bp, Artificial Sequence
  chemically synthesized
tttttaaaggaaaataagtcac

SEQ ID NO: 790369 - DNA, 22 bp, Artificial Sequence
  chemically synthesized
ttttaaaggaaaataagtcaca

SEQ ID NO: 790370 - DNA, 22 bp, Artificial Sequence
  chemically synthesized
tttaaaggaaaataagtcacaa

SEQ ID NO: 790371 - DNA, 22 bp, Artificial Sequence
  chemically synthesized
ttaaaggaaaataagtcacaaa

SEQ ID NO: 790372 - DNA, 22 bp, Artificial Sequence
  chemically synthesized
taaaggaaaataagtcacaaat

SEQ ID NO: 790373 - DNA, 22 bp, Artificial Sequence
  chemically synthesized
aaaggaaaataagtcacaaatt

SEQ ID NO: 790374 - DNA, 22 bp, Artificial Sequence
  chemically synthesized
aaggaaaataagtcacaaattt

SEQ ID NO: 790375 - DNA, 22 bp, Artificial Sequence
  chemically synthesized
ggaaaatagccaataaatttgt

SEQ ID NO: 790376 - DNA, 22 bp, Artificial Sequence
  chemically synthesized
gttgggaaaatagccaataaat

SEQ ID NO: 790377 - DNA, 22 bp, Artificial Sequence
  chemically synthesized
tagttgggaaaatagccaataa

SEQ ID NO: 790378 - DNA, 22 bp, Artificial Sequence
  chemically synthesized
cattctagttgggaaaatagcc

SEQ ID NO: 790379 - DNA, 22 bp, Artificial Sequence
  chemically synthesized
gcattctagttgggaaaatagc

SEQ ID NO: 790380 - DNA, 22 bp, Artificial Sequence
  chemically synthesized
gagtttgcattctagttgggaa

SEQ ID NO: 790381 - DNA, 22 bp, Artificial Sequence
  chemically synthesized
attggctattttcccaactaga

SEQ ID NO: 790382 - DNA, 22 bp, Artificial Sequence
  chemically synthesized
ttggctattttcccaactagaa

SEQ ID NO: 790383 - DNA, 22 bp, Artificial Sequence
  chemically synthesized
attggagtttgcattctagttg

SEQ ID NO: 790384 - DNA, 22 bp, Artificial Sequence
  chemically synthesized
gctattttcccaactagaatgc

SEQ ID NO: 790385 - DNA, 22 bp, Artificial Sequence
  chemically synthesized
ttttcccaactagaatgcaaac

SEQ ID NO: 790386 - DNA, 22 bp, Artificial Sequence
  chemically synthesized
tcccaactagaatgcaaactcc

SEQ ID NO: 790387 - DNA, 22 bp, Artificial Sequence
  chemically synthesized
cccaactagaatgcaaactcca

SEQ ID NO: 790388 - DNA, 22 bp, Artificial Sequence
  chemically synthesized
ccaactagaatgcaaactccaa

SEQ ID NO: 790389 - DNA, 22 bp, Artificial Sequence
  chemically synthesized
gaatgcaaactccaatgaggcg

SEQ ID NO: 790390 - DNA, 22 bp, Artificial Sequence
  chemically synthesized
caggtgtgagccaccgcgcctc

SEQ ID NO: 790391 - DNA, 22 bp, Artificial Sequence
  chemically synthesized
ggattacaggtgtgagccaccg

SEQ ID NO: 790392 - DNA, 22 bp, Artificial Sequence
  chemically synthesized
caatgaggcgcggtggctcaca

SEQ ID NO: 790393 - DNA, 22 bp, Artificial Sequence
  chemically synthesized
ccaaagtgctgggattacaggt

SEQ ID NO: 790394 - DNA, 22 bp, Artificial Sequence
  chemically synthesized
agcctcccaaagtgctgggatt

SEQ ID NO: 790395 - DNA, 22 bp, Artificial Sequence
  chemically synthesized
acacctgtaatcccagcacttt

SEQ ID NO: 790396 - DNA, 22 bp, Artificial Sequence
  chemically synthesized
cccacctcagcctcccaaagtg

SEQ ID NO: 790397 - DNA, 22 bp, Artificial Sequence
  chemically synthesized
taatcccagcactttgggaggc

SEQ ID NO: 790398 - DNA, 22 bp, Artificial Sequence
  chemically synthesized
aagtgatctgcccacctcagcc

SEQ ID NO: 790399 - DNA, 22 bp, Artificial Sequence
  chemically synthesized
ggctcaagtgatctgcccacct

SEQ ID NO: 790400 - DNA, 22 bp, Artificial Sequence
  chemically synthesized
tgggaggctgaggtgggcagat

SEQ ID NO: 790401 - DNA, 22 bp, Artificial Sequence
  chemically synthesized
gggaggctgaggtgggcagatc

SEQ ID NO: 790402 - DNA, 22 bp, Artificial Sequence
  chemically synthesized
ctaggctcaagtgatctgccca

SEQ ID NO: 790403 - DNA, 22 bp, Artificial Sequence
  chemically synthesized
ggaggctgaggtgggcagatca

SEQ ID NO: 790404 - DNA, 22 bp, Artificial Sequence
  chemically synthesized
aatctcctaggctcaagtgatc

SEQ ID NO: 790405 - DNA, 22 bp, Artificial Sequence
  chemically synthesized
aggtgggcagatcacttgagcc

SEQ ID NO: 790406 - DNA, 22 bp, Artificial Sequence
  chemically synthesized
gtctcaatctcctaggctcaag

SEQ ID NO: 790407 - DNA, 22 bp, Artificial Sequence
  chemically synthesized
ggctggtctcaatctcctaggc

SEQ ID NO: 790408 - DNA, 22 bp, Artificial Sequence
  chemically synthesized
cctaggctggtctcaatctcct

SEQ ID NO: 790409 - DNA, 22 bp, Artificial Sequence
  chemically synthesized
gagcctaggagattgagaccag

SEQ ID NO: 790410 - DNA, 22 bp, Artificial Sequence
  chemically synthesized
agcctaggagattgagaccagc

SEQ ID NO: 790411 - DNA, 22 bp, Artificial Sequence
  chemically synthesized
accagttgcctaggctggtctc

SEQ ID NO: 790412 - DNA, 22 bp, Artificial Sequence
  chemically synthesized
caccagttgcctaggctggtct

SEQ ID NO: 790413 - DNA, 22 bp, Artificial Sequence
  chemically synthesized
ggagattgagaccagcctaggc

SEQ ID NO: 790414 - DNA, 22 bp, Artificial Sequence
  chemically synthesized
agaccagcctaggcaactggtg

SEQ ID NO: 790415 - DNA, 22 bp, Artificial Sequence
  chemically synthesized
cagagatggggtttcaccagtt

SEQ ID NO: 790416 - DNA, 22 bp, Artificial Sequence
  chemically synthesized
gcagagatggggtttcaccagt

SEQ ID NO: 790417 - DNA, 22 bp, Artificial Sequence
  chemically synthesized
tgcagagatggggtttcaccag

SEQ ID NO: 790418 - DNA, 22 bp, Artificial Sequence
  chemically synthesized
ttgcagagatggggtttcacca

SEQ ID NO: 790419 - DNA, 22 bp, Artificial Sequence
  chemically synthesized
tttgcagagatggggtttcacc

SEQ ID NO: 790420 - DNA, 22 bp, Artificial Sequence
  chemically synthesized
ttttgcagagatggggtttcac

SEQ ID NO: 790421 - DNA, 22 bp, Artificial Sequence
  chemically synthesized
ggcaactggtgaaaccccatct

SEQ ID NO: 790422 - DNA, 22 bp, Artificial Sequence
  chemically synthesized
tatttttttgcagagatggggt

SEQ ID NO: 790423 - DNA, 22 bp, Artificial Sequence
  chemically synthesized
gtatttttttgcagagatgggg

SEQ ID NO: 790424 - DNA, 22 bp, Artificial Sequence
  chemically synthesized
tgtatttttttgcagagatggg

SEQ ID NO: 790425 - DNA, 22 bp, Artificial Sequence
  chemically synthesized
ttgtatttttttgcagagatgg

SEQ ID NO: 790426 - DNA, 22 bp, Artificial Sequence
  chemically synthesized
tttgtatttttttgcagagatg

SEQ ID NO: 790427 - DNA, 22 bp, Artificial Sequence
  chemically synthesized
gtgaaaccccatctctgcaaaa

SEQ ID NO: 790428 - DNA, 22 bp, Artificial Sequence
  chemically synthesized
attttttgtatttttttgcaga

SEQ ID NO: 790429 - DNA, 22 bp, Artificial Sequence
  chemically synthesized
tgcaaaaaaatacaaaaaatta

SEQ ID NO: 790430 - DNA, 22 bp, Artificial Sequence
  chemically synthesized
caaaaaaatacaaaaaattagc

SEQ ID NO: 790431 - DNA, 22 bp, Artificial Sequence
  chemically synthesized
caggcaagtgccaccatgtcca

SEQ ID NO: 790432 - DNA, 22 bp, Artificial Sequence
  chemically synthesized
gctggacatggtggcacttgcc

SEQ ID NO: 790433 - DNA, 22 bp, Artificial Sequence
  chemically synthesized
gacatggtggcacttgcctgta

SEQ ID NO: 790434 - DNA, 22 bp, Artificial Sequence
  chemically synthesized
ccaagtagcagagactacaggc

SEQ ID NO: 790435 - DNA, 22 bp, Artificial Sequence
  chemically synthesized
agcctcccaagtagcagagact

SEQ ID NO: 790436 - DNA, 22 bp, Artificial Sequence
  chemically synthesized
gcctgtagtctctgctacttgg

SEQ ID NO: 790437 - DNA, 22 bp, Artificial Sequence
  chemically synthesized
cctgtagtctctgctacttggg

SEQ ID NO: 790438 - DNA, 22 bp, Artificial Sequence
  chemically synthesized
tagtctctgctacttgggaggc

SEQ ID NO: 790439 - DNA, 22 bp, Artificial Sequence
  chemically synthesized
tgctacttgggaggctgaggtt

SEQ ID NO: 790440 - DNA, 22 bp, Artificial Sequence
  chemically synthesized
gggtgatccccccaacctcagc

SEQ ID NO: 790441 - DNA, 22 bp, Artificial Sequence
  chemically synthesized
ctacttgggaggctgaggttgg

SEQ ID NO: 790442 - DNA, 22 bp, Artificial Sequence
  chemically synthesized
cttgggaggctgaggttggggg

SEQ ID NO: 790443 - DNA, 22 bp, Artificial Sequence
  chemically synthesized
ggctcgggtgatccccccaacc

SEQ ID NO: 790444 - DNA, 22 bp, Artificial Sequence
  chemically synthesized
gggaggctgaggttggggggat

SEQ ID NO: 790445 - DNA, 22 bp, Artificial Sequence
  chemically synthesized
ggaggctgaggttggggggatc

SEQ ID NO: 790446 - DNA, 22 bp, Artificial Sequence
  chemically synthesized
ctgggctcgggtgatcccccca

SEQ ID NO: 790447 - DNA, 22 bp, Artificial Sequence
  chemically synthesized
cacctcctgggctcgggtgatc

SEQ ID NO: 790448 - DNA, 22 bp, Artificial Sequence
  chemically synthesized
aggttggggggatcacccgagc

SEQ ID NO: 790449 - DNA, 22 bp, Artificial Sequence
  chemically synthesized
caacctccacctcctgggctcg

SEQ ID NO: 790450 - DNA, 22 bp, Artificial Sequence
  chemically synthesized
gggggatcacccgagcccagga

SEQ ID NO: 790451 - DNA, 22 bp, Artificial Sequence
  chemically synthesized
actgcaacctccacctcctggg

SEQ ID NO: 790452 - DNA, 22 bp, Artificial Sequence
  chemically synthesized
gagtgcaatggtatgatcacag

SEQ ID NO: 790453 - DNA, 22 bp, Artificial Sequence
  chemically synthesized
cagtgagctgtgatcataccat

SEQ ID NO: 790454 - DNA, 22 bp, Artificial Sequence
  chemically synthesized
ggctggagtgcaatggtatgat

SEQ ID NO: 790455 - DNA, 22 bp, Artificial Sequence
  chemically synthesized
cctaggctggagtgcaatggta

SEQ ID NO: 790456 - DNA, 22 bp, Artificial Sequence
  chemically synthesized
ttgcctaggctggagtgcaatg

SEQ ID NO: 790457 - DNA, 22 bp, Artificial Sequence
  chemically synthesized
tgttgcctaggctggagtgcaa

SEQ ID NO: 790458 - DNA, 22 bp, Artificial Sequence
  chemically synthesized
tgatcataccattgcactccag

SEQ ID NO: 790459 - DNA, 22 bp, Artificial Sequence
  chemically synthesized
actctgttgcctaggctggagt

SEQ ID NO: 790460 - DNA, 22 bp, Artificial Sequence
  chemically synthesized
cactccagcctaggcaacagag

SEQ ID NO: 790461 - DNA, 22 bp, Artificial Sequence
  chemically synthesized
agacagggtctcactctgttgc

SEQ ID NO: 790462 - DNA, 22 bp, Artificial Sequence
  chemically synthesized
gagacagggtctcactctgttg

SEQ ID NO: 790463 - DNA, 22 bp, Artificial Sequence
  chemically synthesized
tgagacagggtctcactctgtt

SEQ ID NO: 790464 - DNA, 22 bp, Artificial Sequence
  chemically synthesized
ttgagacagggtctcactctgt

SEQ ID NO: 790465 - DNA, 22 bp, Artificial Sequence
  chemically synthesized
cagcctaggcaacagagtgaga

SEQ ID NO: 790466 - DNA, 22 bp, Artificial Sequence
  chemically synthesized
tttgagacagggtctcactctg

SEQ ID NO: 790467 - DNA, 22 bp, Artificial Sequence
  chemically synthesized
ttttgagacagggtctcactct

SEQ ID NO: 790468 - DNA, 22 bp, Artificial Sequence
  chemically synthesized
tttttgagacagggtctcactc

SEQ ID NO: 790469 - DNA, 22 bp, Artificial Sequence
  chemically synthesized
ttttttgagacagggtctcact

SEQ ID NO: 790470 - DNA, 22 bp, Artificial Sequence
  chemically synthesized
tttttttgagacagggtctcac

SEQ ID NO: 790471 - DNA, 22 bp, Artificial Sequence
  chemically synthesized
ttttttttgagacagggtctca

SEQ ID NO: 790472 - DNA, 22 bp, Artificial Sequence
  chemically synthesized
tttttttttgagacagggtctc

SEQ ID NO: 790473 - DNA, 22 bp, Artificial Sequence
  chemically synthesized
ggcaacagagtgagaccctgtc

SEQ ID NO: 790474 - DNA, 22 bp, Artificial Sequence
  chemically synthesized
ttttttttttgagacagggtct

SEQ ID NO: 790475 - DNA, 22 bp, Artificial Sequence
  chemically synthesized
tttttttttttgagacagggtc

SEQ ID NO: 790476 - DNA, 22 bp, Artificial Sequence
  chemically synthesized
ttttttttttttgagacagggt

SEQ ID NO: 790477 - DNA, 22 bp, Artificial Sequence
  chemically synthesized
tttttttttttttgagacaggg

SEQ ID NO: 790478 - DNA, 22 bp, Artificial Sequence
  chemically synthesized
ttttttttttttttgagacagg

SEQ ID NO: 790479 - DNA, 22 bp, Artificial Sequence
  chemically synthesized
tttttttttttttttgagacag

SEQ ID NO: 790480 - DNA, 22 bp, Artificial Sequence
  chemically synthesized
ttttttttttttttttgagaca

SEQ ID NO: 790481 - DNA, 22 bp, Artificial Sequence
  chemically synthesized
tttttttttttttttttgagac

SEQ ID NO: 790482 - DNA, 22 bp, Artificial Sequence
  chemically synthesized
ttttttttttttttttttgaga

SEQ ID NO: 790483 - DNA, 22 bp, Artificial Sequence
  chemically synthesized
tttttttttttttttttttgag

SEQ ID NO: 790484 - DNA, 22 bp, Artificial Sequence
  chemically synthesized
ttttttttttttttttttttga

SEQ ID NO: 790485 - DNA, 22 bp, Artificial Sequence
  chemically synthesized
tttttttttttttttttttttg

SEQ ID NO: 790486 - DNA, 22 bp, Artificial Sequence
  chemically synthesized
tttttttttttttttttttttt

SEQ ID NO: 790487 - DNA, 22 bp, Artificial Sequence
  chemically synthesized
cattcttttttttttttttttt

SEQ ID NO: 790488 - DNA, 22 bp, Artificial Sequence
  chemically synthesized
acattctttttttttttttttt

SEQ ID NO: 790489 - DNA, 22 bp, Artificial Sequence
  chemically synthesized
tctcaaaaaaaaaaaaaaaaaa

SEQ ID NO: 790490 - DNA, 22 bp, Artificial Sequence
  chemically synthesized
aaaaaaaaaaaaaaaaaaaaaa

SEQ ID NO: 790491 - DNA, 22 bp, Artificial Sequence
  chemically synthesized
tatgtttacattcttttttttt

SEQ ID NO: 790492 - DNA, 22 bp, Artificial Sequence
  chemically synthesized
atatgtttacattctttttttt

SEQ ID NO: 790493 - DNA, 22 bp, Artificial Sequence
  chemically synthesized
gagtttatatgtttacattctt

SEQ ID NO: 790494 - DNA, 22 bp, Artificial Sequence
  chemically synthesized
tggagtttatatgtttacattc

SEQ ID NO: 790495 - DNA, 22 bp, Artificial Sequence
  chemically synthesized
acagtggtcccaccctctggag

SEQ ID NO: 790496 - DNA, 22 bp, Artificial Sequence
  chemically synthesized
gcagctaacagtggtcccaccc

SEQ ID NO: 790497 - DNA, 22 bp, Artificial Sequence
  chemically synthesized
cagagggtgggaccactgttag

SEQ ID NO: 790498 - DNA, 22 bp, Artificial Sequence
  chemically synthesized
ggcaagtcgggtccctcgcagc

SEQ ID NO: 790499 - DNA, 22 bp, Artificial Sequence
  chemically synthesized
gttcggcaagtcgggtccctcg

SEQ ID NO: 790500 - DNA, 22 bp, Artificial Sequence
  chemically synthesized
ttagctgcgagggacccgactt

SEQ ID NO: 790501 - DNA, 22 bp, Artificial Sequence
  chemically synthesized
gactggttcggcaagtcgggtc

SEQ ID NO: 790502 - DNA, 22 bp, Artificial Sequence
  chemically synthesized
agactggttcggcaagtcgggt

SEQ ID NO: 790503 - DNA, 22 bp, Artificial Sequence
  chemically synthesized
gctgcgagggacccgacttgcc

SEQ ID NO: 790504 - DNA, 22 bp, Artificial Sequence
  chemically synthesized
cgagggacccgacttgccgaac

SEQ ID NO: 790505 - DNA, 22 bp, Artificial Sequence
  chemically synthesized
gaaatatcttagactggttcgg

SEQ ID NO: 790506 - DNA, 22 bp, Artificial Sequence
  chemically synthesized
gccgaaccagtctaagatattt

SEQ ID NO: 790507 - DNA, 22 bp, Artificial Sequence
  chemically synthesized
ccgaaccagtctaagatatttc

SEQ ID NO: 790508 - DNA, 22 bp, Artificial Sequence
  chemically synthesized
agatatttctagttactccttt

SEQ ID NO: 790509 - DNA, 22 bp, Artificial Sequence
  chemically synthesized
acagggcgaaaaaagagaaaag

SEQ ID NO: 790510 - DNA, 22 bp, Artificial Sequence
  chemically synthesized
ctagttactccttttctctttt

SEQ ID NO: 790511 - DNA, 22 bp, Artificial Sequence
  chemically synthesized
tagttactccttttctcttttt

SEQ ID NO: 790512 - DNA, 22 bp, Artificial Sequence
  chemically synthesized
ttcacagggcgaaaaaagagaa

SEQ ID NO: 790513 - DNA, 22 bp, Artificial Sequence
  chemically synthesized
gttactccttttctcttttttc

SEQ ID NO: 790514 - DNA, 22 bp, Artificial Sequence
  chemically synthesized
aattgttcacagggcgaaaaaa

SEQ ID NO: 790515 - DNA, 22 bp, Artificial Sequence
  chemically synthesized
ctccttttctcttttttcgccc

SEQ ID NO: 790516 - DNA, 22 bp, Artificial Sequence
  chemically synthesized
cttttctcttttttcgccctgt

SEQ ID NO: 790517 - DNA, 22 bp, Artificial Sequence
  chemically synthesized
ttctcttttttcgccctgtgaa

SEQ ID NO: 790518 - DNA, 22 bp, Artificial Sequence
  chemically synthesized
tctcttttttcgccctgtgaac

SEQ ID NO: 790519 - DNA, 22 bp, Artificial Sequence
  chemically synthesized
ctcttttttcgccctgtgaaca

SEQ ID NO: 790520 - DNA, 22 bp, Artificial Sequence
  chemically synthesized
tcttttttcgccctgtgaacaa

SEQ ID NO: 790521 - DNA, 22 bp, Artificial Sequence
  chemically synthesized
ttttttcgccctgtgaacaatt

SEQ ID NO: 790522 - DNA, 22 bp, Artificial Sequence
  chemically synthesized
ttttcgccctgtgaacaattta

SEQ ID NO: 790523 - DNA, 22 bp, Artificial Sequence
  chemically synthesized
tttcgccctgtgaacaatttaa

SEQ ID NO: 790524 - DNA, 22 bp, Artificial Sequence
  chemically synthesized
ttcgccctgtgaacaatttaat

SEQ ID NO: 790525 - DNA, 22 bp, Artificial Sequence
  chemically synthesized
tcgccctgtgaacaatttaata

SEQ ID NO: 790526 - DNA, 22 bp, Artificial Sequence
  chemically synthesized
cgccctgtgaacaatttaatat

SEQ ID NO: 790527 - DNA, 22 bp, Artificial Sequence
  chemically synthesized
gccctgtgaacaatttaatatt

SEQ ID NO: 790528 - DNA, 22 bp, Artificial Sequence
  chemically synthesized
tgaacaatttaatatttggctt

SEQ ID NO: 790529 - DNA, 22 bp, Artificial Sequence
  chemically synthesized
aaaaaaaaaaaaaaaggaagaa

SEQ ID NO: 790530 - DNA, 22 bp, Artificial Sequence
  chemically synthesized
aaaaaaaaaaaaaaaaggaaga

SEQ ID NO: 790531 - DNA, 22 bp, Artificial Sequence
  chemically synthesized
aatatttggcttcttccttttt

SEQ ID NO: 790532 - DNA, 22 bp, Artificial Sequence
  chemically synthesized
atatttggcttcttcctttttt

SEQ ID NO: 790533 - DNA, 22 bp, Artificial Sequence
  chemically synthesized
ggcttcttcctttttttttttt

SEQ ID NO: 790534 - DNA, 22 bp, Artificial Sequence
  chemically synthesized
gcttcttccttttttttttttt

SEQ ID NO: 790535 - DNA, 22 bp, Artificial Sequence
  chemically synthesized
cttcctttttttttttttttta

SEQ ID NO: 790536 - DNA, 22 bp, Artificial Sequence
  chemically synthesized
ttccttttttttttttttttaa

SEQ ID NO: 790537 - DNA, 22 bp, Artificial Sequence
  chemically synthesized
ccttttttttttttttttaaat

SEQ ID NO: 790538 - DNA, 22 bp, Artificial Sequence
  chemically synthesized
cttttttttttttttttaaatt

SEQ ID NO: 790539 - DNA, 22 bp, Artificial Sequence
  chemically synthesized
ttttttttttttttaaatttct

SEQ ID NO: 790540 - DNA, 22 bp, Artificial Sequence
  chemically synthesized
tttttttttttttaaatttctt

SEQ ID NO: 790541 - DNA, 22 bp, Artificial Sequence
  chemically synthesized
ttttttttttttaaatttcttc

SEQ ID NO: 790542 - DNA, 22 bp, Artificial Sequence
  chemically synthesized
tttttttttttaaatttcttcc

SEQ ID NO: 790543 - DNA, 22 bp, Artificial Sequence
  chemically synthesized
ttttttttttaaatttcttcct

SEQ ID NO: 790544 - DNA, 22 bp, Artificial Sequence
  chemically synthesized
tttttttttaaatttcttcctc

SEQ ID NO: 790545 - DNA, 22 bp, Artificial Sequence
  chemically synthesized
ttttttttaaatttcttcctcc

SEQ ID NO: 790546 - DNA, 22 bp, Artificial Sequence
  chemically synthesized
tttttttaaatttcttcctccc

SEQ ID NO: 790547 - DNA, 22 bp, Artificial Sequence
  chemically synthesized
ttttttaaatttcttcctccct

SEQ ID NO: 790548 - DNA, 22 bp, Artificial Sequence
  chemically synthesized
tttttaaatttcttcctcccta

SEQ ID NO: 790549 - DNA, 22 bp, Artificial Sequence
  chemically synthesized
ttttaaatttcttcctccctac

SEQ ID NO: 790550 - DNA, 22 bp, Artificial Sequence
  chemically synthesized
tttaaatttcttcctccctact

SEQ ID NO: 790551 - DNA, 22 bp, Artificial Sequence
  chemically synthesized
ggagtgggaatgagtagggagg

SEQ ID NO: 790552 - DNA, 22 bp, Artificial Sequence
  chemically synthesized
ttaaatttcttcctccctactc

SEQ ID NO: 790553 - DNA, 22 bp, Artificial Sequence
  chemically synthesized
gggagtgggaatgagtagggag

SEQ ID NO: 790554 - DNA, 22 bp, Artificial Sequence
  chemically synthesized
taaatttcttcctccctactca

SEQ ID NO: 790555 - DNA, 22 bp, Artificial Sequence
  chemically synthesized
aaatttcttcctccctactcat

SEQ ID NO: 790556 - DNA, 22 bp, Artificial Sequence
  chemically synthesized
aatttcttcctccctactcatt

SEQ ID NO: 790557 - DNA, 22 bp, Artificial Sequence
  chemically synthesized
gtttgggagtgggaatgagtag

SEQ ID NO: 790558 - DNA, 22 bp, Artificial Sequence
  chemically synthesized
cttcctccctactcattcccac

SEQ ID NO: 790559 - DNA, 22 bp, Artificial Sequence
  chemically synthesized
ttcctccctactcattcccact

SEQ ID NO: 790560 - DNA, 22 bp, Artificial Sequence
  chemically synthesized
tggttggtttgggagtgggaat

SEQ ID NO: 790561 - DNA, 22 bp, Artificial Sequence
  chemically synthesized
cctccctactcattcccactcc

SEQ ID NO: 790562 - DNA, 22 bp, Artificial Sequence
  chemically synthesized
gtggttggtttgggagtgggaa

SEQ ID NO: 790563 - DNA, 22 bp, Artificial Sequence
  chemically synthesized
ctccctactcattcccactccc

SEQ ID NO: 790564 - DNA, 22 bp, Artificial Sequence
  chemically synthesized
tgtggttggtttgggagtggga

SEQ ID NO: 790565 - DNA, 22 bp, Artificial Sequence
  chemically synthesized
cctactcattcccactcccaaa

SEQ ID NO: 790566 - DNA, 22 bp, Artificial Sequence
  chemically synthesized
gctttgtggttggtttgggagt

SEQ ID NO: 790567 - DNA, 22 bp, Artificial Sequence
  chemically synthesized
ctcattcccactcccaaaccaa

SEQ ID NO: 790568 - DNA, 22 bp, Artificial Sequence
  chemically synthesized
attcccactcccaaaccaacca

SEQ ID NO: 790569 - DNA, 22 bp, Artificial Sequence
  chemically synthesized
aggttagctttgtggttggttt

SEQ ID NO: 790570 - DNA, 22 bp, Artificial Sequence
  chemically synthesized
ccactcccaaaccaaccacaaa

SEQ ID NO: 790571 - DNA, 22 bp, Artificial Sequence
  chemically synthesized
ccaaaccaaccacaaagctaac

SEQ ID NO: 790572 - DNA, 22 bp, Artificial Sequence
  chemically synthesized
gaaaaaaagctgaggttagctt

SEQ ID NO: 790573 - DNA, 22 bp, Artificial Sequence
  chemically synthesized
ggaaaaaaagctgaggttagct

SEQ ID NO: 790574 - DNA, 22 bp, Artificial Sequence
  chemically synthesized
acctcagctttttttccaaatt

SEQ ID NO: 790575 - DNA, 22 bp, Artificial Sequence
  chemically synthesized
agctttttttccaaattatccc

SEQ ID NO: 790576 - DNA, 22 bp, Artificial Sequence
  chemically synthesized
atagcaagcaaaagggataatt

SEQ ID NO: 790577 - DNA, 22 bp, Artificial Sequence
  chemically synthesized
tttttccaaattatcccttttg

SEQ ID NO: 790578 - DNA, 22 bp, Artificial Sequence
  chemically synthesized
ttttccaaattatcccttttgc

SEQ ID NO: 790579 - DNA, 22 bp, Artificial Sequence
  chemically synthesized
tgttcatagcaagcaaaaggga

SEQ ID NO: 790580 - DNA, 22 bp, Artificial Sequence
  chemically synthesized
tttccaaattatcccttttgct

SEQ ID NO: 790581 - DNA, 22 bp, Artificial Sequence
  chemically synthesized
gtgttcatagcaagcaaaaggg

SEQ ID NO: 790582 - DNA, 22 bp, Artificial Sequence
  chemically synthesized
ttccaaattatcccttttgctt

SEQ ID NO: 790583 - DNA, 22 bp, Artificial Sequence
  chemically synthesized
tccaaattatcccttttgcttg

SEQ ID NO: 790584 - DNA, 22 bp, Artificial Sequence
  chemically synthesized
ccaaattatcccttttgcttgc

SEQ ID NO: 790585 - DNA, 22 bp, Artificial Sequence
  chemically synthesized
caaattatcccttttgcttgct

SEQ ID NO: 790586 - DNA, 22 bp, Artificial Sequence
  chemically synthesized
aaacttgtgttcatagcaagca

SEQ ID NO: 790587 - DNA, 22 bp, Artificial Sequence
  chemically synthesized
tcccttttgcttgctatgaaca

SEQ ID NO: 790588 - DNA, 22 bp, Artificial Sequence
  chemically synthesized
aggttcaaacttgtgttcatag

SEQ ID NO: 790589 - DNA, 22 bp, Artificial Sequence
  chemically synthesized
ttgcttgctatgaacacaagtt

SEQ ID NO: 790590 - DNA, 22 bp, Artificial Sequence
  chemically synthesized
tgcttgctatgaacacaagttt

SEQ ID NO: 790591 - DNA, 22 bp, Artificial Sequence
  chemically synthesized
gcttgctatgaacacaagtttg

SEQ ID NO: 790592 - DNA, 22 bp, Artificial Sequence
  chemically synthesized
cttgctatgaacacaagtttga

SEQ ID NO: 790593 - DNA, 22 bp, Artificial Sequence
  chemically synthesized
gctatgaacacaagtttgaacc

SEQ ID NO: 790594 - DNA, 22 bp, Artificial Sequence
  chemically synthesized
ctatgaacacaagtttgaacct

SEQ ID NO: 790595 - DNA, 22 bp, Artificial Sequence
  chemically synthesized
tgaacacaagtttgaacctcag

SEQ ID NO: 790596 - DNA, 22 bp, Artificial Sequence
  chemically synthesized
tcaccaacagagctgaggttca

SEQ ID NO: 790597 - DNA, 22 bp, Artificial Sequence
  chemically synthesized
tgggcaaaattatcaccaacag

SEQ ID NO: 790598 - DNA, 22 bp, Artificial Sequence
  chemically synthesized
gaacctcagctctgttggtgat

SEQ ID NO: 790599 - DNA, 22 bp, Artificial Sequence
  chemically synthesized
atgggcaaaattatcaccaaca

SEQ ID NO: 790600 - DNA, 22 bp, Artificial Sequence
  chemically synthesized
aacctcagctctgttggtgata

SEQ ID NO: 790601 - DNA, 22 bp, Artificial Sequence
  chemically synthesized
ttatgggcaaaattatcaccaa

SEQ ID NO: 790602 - DNA, 22 bp, Artificial Sequence
  chemically synthesized
cttatgggcaaaattatcacca

SEQ ID NO: 790603 - DNA, 22 bp, Artificial Sequence
  chemically synthesized
agctctgttggtgataattttg

SEQ ID NO: 790604 - DNA, 22 bp, Artificial Sequence
  chemically synthesized
tgttggtgataattttgcccat

SEQ ID NO: 790605 - DNA, 22 bp, Artificial Sequence
  chemically synthesized
ccagaagcttcttatgggcaaa

SEQ ID NO: 790606 - DNA, 22 bp, Artificial Sequence
  chemically synthesized
ttggtgataattttgcccataa

SEQ ID NO: 790607 - DNA, 22 bp, Artificial Sequence
  chemically synthesized
gccagaagcttcttatgggcaa

SEQ ID NO: 790608 - DNA, 22 bp, Artificial Sequence
  chemically synthesized
tgccagaagcttcttatgggca

SEQ ID NO: 790609 - DNA, 22 bp, Artificial Sequence
  chemically synthesized
ttgccagaagcttcttatgggc

SEQ ID NO: 790610 - DNA, 22 bp, Artificial Sequence
  chemically synthesized
gtgataattttgcccataagaa

SEQ ID NO: 790611 - DNA, 22 bp, Artificial Sequence
  chemically synthesized
tttttgccagaagcttcttatg

SEQ ID NO: 790612 - DNA, 22 bp, Artificial Sequence
  chemically synthesized
atttttgccagaagcttcttat

SEQ ID NO: 790613 - DNA, 22 bp, Artificial Sequence
  chemically synthesized
tatttttgccagaagcttctta

SEQ ID NO: 790614 - DNA, 22 bp, Artificial Sequence
  chemically synthesized
ttttatttttgccagaagcttc

SEQ ID NO: 790615 - DNA, 22 bp, Artificial Sequence
  chemically synthesized
gttttatttttgccagaagctt

SEQ ID NO: 790616 - DNA, 22 bp, Artificial Sequence
  chemically synthesized
tgttttatttttgccagaagct

SEQ ID NO: 790617 - DNA, 22 bp, Artificial Sequence
  chemically synthesized
tgcccataagaagcttctggca

SEQ ID NO: 790618 - DNA, 22 bp, Artificial Sequence
  chemically synthesized
gcccataagaagcttctggcaa

SEQ ID NO: 790619 - DNA, 22 bp, Artificial Sequence
  chemically synthesized
cccataagaagcttctggcaaa

SEQ ID NO: 790620 - DNA, 22 bp, Artificial Sequence
  chemically synthesized
ttttgttttatttttgccagaa

SEQ ID NO: 790621 - DNA, 22 bp, Artificial Sequence
  chemically synthesized
attttgttttatttttgccaga

SEQ ID NO: 790622 - DNA, 22 bp, Artificial Sequence
  chemically synthesized
aagacttattttgttttatttt

SEQ ID NO: 790623 - DNA, 22 bp, Artificial Sequence
  chemically synthesized
ctggcaaaaataaaacaaaata

SEQ ID NO: 790624 - DNA, 22 bp, Artificial Sequence
  chemically synthesized
tggcaaaaataaaacaaaataa

SEQ ID NO: 790625 - DNA, 22 bp, Artificial Sequence
  chemically synthesized
gcaaaaataaaacaaaataagt

SEQ ID NO: 790626 - DNA, 22 bp, Artificial Sequence
  chemically synthesized
aagaatgaggcctaaagactta

SEQ ID NO: 790627 - DNA, 22 bp, Artificial Sequence
  chemically synthesized
ctaaagaatgaggcctaaagac

SEQ ID NO: 790628 - DNA, 22 bp, Artificial Sequence
  chemically synthesized
ggccagcaaaacctcctaaaga

SEQ ID NO: 790629 - DNA, 22 bp, Artificial Sequence
  chemically synthesized
aggccagcaaaacctcctaaag

SEQ ID NO: 790630 - DNA, 22 bp, Artificial Sequence
  chemically synthesized
taggcctcattctttaggaggt

SEQ ID NO: 790631 - DNA, 22 bp, Artificial Sequence
  chemically synthesized
aggcctcattctttaggaggtt

SEQ ID NO: 790632 - DNA, 22 bp, Artificial Sequence
  chemically synthesized
ggcctcattctttaggaggttt

SEQ ID NO: 790633 - DNA, 22 bp, Artificial Sequence
  chemically synthesized
attctttaggaggttttgctgg

SEQ ID NO: 790634 - DNA, 22 bp, Artificial Sequence
  chemically synthesized
tttaggaggttttgctggccta

SEQ ID NO: 790635 - DNA, 22 bp, Artificial Sequence
  chemically synthesized
taggaggttttgctggcctaaa

SEQ ID NO: 790636 - DNA, 22 bp, Artificial Sequence
  chemically synthesized
aggaggttttgctggcctaaat

SEQ ID NO: 790637 - DNA, 22 bp, Artificial Sequence
  chemically synthesized
ggaggttttgctggcctaaatt

SEQ ID NO: 790638 - DNA, 22 bp, Artificial Sequence
  chemically synthesized
aaaagcaaaaacaatttaggcc

SEQ ID NO: 790639 - DNA, 22 bp, Artificial Sequence
  chemically synthesized
tgctggcctaaattgtttttgc

SEQ ID NO: 790640 - DNA, 22 bp, Artificial Sequence
  chemically synthesized
gctggcctaaattgtttttgct

SEQ ID NO: 790641 - DNA, 22 bp, Artificial Sequence
  chemically synthesized
ctggcctaaattgtttttgctt

SEQ ID NO: 790642 - DNA, 22 bp, Artificial Sequence
  chemically synthesized
aaataccattaaaaagcaaaaa

SEQ ID NO: 790643 - DNA, 22 bp, Artificial Sequence
  chemically synthesized
gcctaaattgtttttgcttttt

SEQ ID NO: 790644 - DNA, 22 bp, Artificial Sequence
  chemically synthesized
attaaaataccattaaaaagca

SEQ ID NO: 790645 - DNA, 22 bp, Artificial Sequence
  chemically synthesized
aattgtttttgctttttaatgg

SEQ ID NO: 790646 - DNA, 22 bp, Artificial Sequence
  chemically synthesized
tttttgctttttaatggtattt

SEQ ID NO: 790647 - DNA, 22 bp, Artificial Sequence
  chemically synthesized
ttgctttttaatggtattttaa

SEQ ID NO: 790648 - DNA, 22 bp, Artificial Sequence
  chemically synthesized
gtgaaacactaattaaaatacc

SEQ ID NO: 790649 - DNA, 22 bp, Artificial Sequence
  chemically synthesized
tgctttttaatggtattttaat

SEQ ID NO: 790650 - DNA, 22 bp, Artificial Sequence
  chemically synthesized
ggtgaaacactaattaaaatac

SEQ ID NO: 790651 - DNA, 22 bp, Artificial Sequence
  chemically synthesized
gctttttaatggtattttaatt

SEQ ID NO: 790652 - DNA, 22 bp, Artificial Sequence
  chemically synthesized
ctttttaatggtattttaatta

SEQ ID NO: 790653 - DNA, 22 bp, Artificial Sequence
  chemically synthesized
tttaatggtattttaattagtg

SEQ ID NO: 790654 - DNA, 22 bp, Artificial Sequence
  chemically synthesized
ttaatggtattttaattagtgt

SEQ ID NO: 790655 - DNA, 22 bp, Artificial Sequence
  chemically synthesized
taatggtattttaattagtgtt

SEQ ID NO: 790656 - DNA, 22 bp, Artificial Sequence
  chemically synthesized
aatggtattttaattagtgttt

SEQ ID NO: 790657 - DNA, 22 bp, Artificial Sequence
  chemically synthesized
atggtattttaattagtgtttc

SEQ ID NO: 790658 - DNA, 22 bp, Artificial Sequence
  chemically synthesized
agaaccacacttggtgaaacac

SEQ ID NO: 790659 - DNA, 22 bp, Artificial Sequence
  chemically synthesized
attgagaaccacacttggtgaa

SEQ ID NO: 790660 - DNA, 22 bp, Artificial Sequence
  chemically synthesized
taattagtgtttcaccaagtgt

SEQ ID NO: 790661 - DNA, 22 bp, Artificial Sequence
  chemically synthesized
aattagtgtttcaccaagtgtg

SEQ ID NO: 790662 - DNA, 22 bp, Artificial Sequence
  chemically synthesized
ctgattgagaaccacacttggt

SEQ ID NO: 790663 - DNA, 22 bp, Artificial Sequence
  chemically synthesized
attagtgtttcaccaagtgtgg

SEQ ID NO: 790664 - DNA, 22 bp, Artificial Sequence
  chemically synthesized
ttgctgattgagaaccacactt

SEQ ID NO: 790665 - DNA, 22 bp, Artificial Sequence
  chemically synthesized
gtgtttcaccaagtgtggttct

SEQ ID NO: 790666 - DNA, 22 bp, Artificial Sequence
  chemically synthesized
ttgttgctgattgagaaccaca

SEQ ID NO: 790667 - DNA, 22 bp, Artificial Sequence
  chemically synthesized
caccaagtgtggttctcaatca

SEQ ID NO: 790668 - DNA, 22 bp, Artificial Sequence
  chemically synthesized
accaagtgtggttctcaatcag

SEQ ID NO: 790669 - DNA, 22 bp, Artificial Sequence
  chemically synthesized
ccaggggatactattgttgctg

SEQ ID NO: 790670 - DNA, 22 bp, Artificial Sequence
  chemically synthesized
tcaatcagcaacaatagtatcc

SEQ ID NO: 790671 - DNA, 22 bp, Artificial Sequence
  chemically synthesized
tcaaattcccaggggatactat

SEQ ID NO: 790672 - DNA, 22 bp, Artificial Sequence
  chemically synthesized
aatcagcaacaatagtatcccc

SEQ ID NO: 790673 - DNA, 22 bp, Artificial Sequence
  chemically synthesized
tatcaaattcccaggggatact

SEQ ID NO: 790674 - DNA, 22 bp, Artificial Sequence
  chemically synthesized
ctatcaaattcccaggggatac

SEQ ID NO: 790675 - DNA, 22 bp, Artificial Sequence
  chemically synthesized
catttctatcaaattcccaggg

SEQ ID NO: 790676 - DNA, 22 bp, Artificial Sequence
  chemically synthesized
gcatttctatcaaattcccagg

SEQ ID NO: 790677 - DNA, 22 bp, Artificial Sequence
  chemically synthesized
ataatttgcatttctatcaaat

SEQ ID NO: 790678 - DNA, 22 bp, Artificial Sequence
  chemically synthesized
ggaatttgatagaaatgcaaat

SEQ ID NO: 790679 - DNA, 22 bp, Artificial Sequence
  chemically synthesized
tgagaggggcctgataatttgc

SEQ ID NO: 790680 - DNA, 22 bp, Artificial Sequence
  chemically synthesized
gatagaaatgcaaattatcagg

SEQ ID NO: 790681 - DNA, 22 bp, Artificial Sequence
  chemically synthesized
atagaaatgcaaattatcaggc

SEQ ID NO: 790682 - DNA, 22 bp, Artificial Sequence
  chemically synthesized
gttatgagaggggcctgataat

SEQ ID NO: 790683 - DNA, 22 bp, Artificial Sequence
  chemically synthesized
agttatgagaggggcctgataa

SEQ ID NO: 790684 - DNA, 22 bp, Artificial Sequence
  chemically synthesized
tcaggcccctctcataactaaa

SEQ ID NO: 790685 - DNA, 22 bp, Artificial Sequence
  chemically synthesized
cacaaagtgtaatcatttagtt

SEQ ID NO: 790686 - DNA, 22 bp, Artificial Sequence
  chemically synthesized
tcataactaaatgattacactt

SEQ ID NO: 790687 - DNA, 22 bp, Artificial Sequence
  chemically synthesized
ataactaaatgattacactttg

SEQ ID NO: 790688 - DNA, 22 bp, Artificial Sequence
  chemically synthesized
gatgaagagactccacaaagtg

SEQ ID NO: 790689 - DNA, 22 bp, Artificial Sequence
  chemically synthesized
agatgaagagactccacaaagt

SEQ ID NO: 790690 - DNA, 22 bp, Artificial Sequence
  chemically synthesized
aatgattacactttgtggagtc

SEQ ID NO: 790691 - DNA, 22 bp, Artificial Sequence
  chemically synthesized
aagacatttagatgaagagact

SEQ ID NO: 790692 - DNA, 22 bp, Artificial Sequence
  chemically synthesized
cactttgtggagtctcttcatc

SEQ ID NO: 790693 - DNA, 22 bp, Artificial Sequence
  chemically synthesized
ccactgaagacatttagatgaa

SEQ ID NO: 790694 - DNA, 22 bp, Artificial Sequence
  chemically synthesized
tgtggagtctcttcatctaaat

SEQ ID NO: 790695 - DNA, 22 bp, Artificial Sequence
  chemically synthesized
gccactgaagacatttagatga

SEQ ID NO: 790696 - DNA, 22 bp, Artificial Sequence
  chemically synthesized
gtggagtctcttcatctaaatg

SEQ ID NO: 790697 - DNA, 22 bp, Artificial Sequence
  chemically synthesized
tgccactgaagacatttagatg

SEQ ID NO: 790698 - DNA, 22 bp, Artificial Sequence
  chemically synthesized
tggagtctcttcatctaaatgt

SEQ ID NO: 790699 - DNA, 22 bp, Artificial Sequence
  chemically synthesized
ttgccactgaagacatttagat

SEQ ID NO: 790700 - DNA, 22 bp, Artificial Sequence
  chemically synthesized
gcttttgccactgaagacattt

SEQ ID NO: 790701 - DNA, 22 bp, Artificial Sequence
  chemically synthesized
attggcttttgccactgaagac

SEQ ID NO: 790702 - DNA, 22 bp, Artificial Sequence
  chemically synthesized
ttcatctaaatgtcttcagtgg

SEQ ID NO: 790703 - DNA, 22 bp, Artificial Sequence
  chemically synthesized
cattggcttttgccactgaaga

SEQ ID NO: 790704 - DNA, 22 bp, Artificial Sequence
  chemically synthesized
catctaaatgtcttcagtggca

SEQ ID NO: 790705 - DNA, 22 bp, Artificial Sequence
  chemically synthesized
ttcattggcttttgccactgaa

SEQ ID NO: 790706 - DNA, 22 bp, Artificial Sequence
  chemically synthesized
atctaaatgtcttcagtggcaa

SEQ ID NO: 790707 - DNA, 22 bp, Artificial Sequence
  chemically synthesized
cttcattggcttttgccactga

SEQ ID NO: 790708 - DNA, 22 bp, Artificial Sequence
  chemically synthesized
tcttcattggcttttgccactg

SEQ ID NO: 790709 - DNA, 22 bp, Artificial Sequence
  chemically synthesized
aatgtcttcagtggcaaaagcc

SEQ ID NO: 790710 - DNA, 22 bp, Artificial Sequence
  chemically synthesized
cagtggcaaaagccaatgaaga

SEQ ID NO: 790711 - DNA, 22 bp, Artificial Sequence
  chemically synthesized
agtggcaaaagccaatgaagaa

SEQ ID NO: 790712 - DNA, 22 bp, Artificial Sequence
  chemically synthesized
tatacagagattttcttcattg

SEQ ID NO: 790713 - DNA, 22 bp, Artificial Sequence
  chemically synthesized
tgtatatagttttttttttggt

SEQ ID NO: 790714 - DNA, 22 bp, Artificial Sequence
  chemically synthesized
tatatagttttttttttggttt

SEQ ID NO: 790715 - DNA, 22 bp, Artificial Sequence
  chemically synthesized
tttttttggtttgtttgttttt

SEQ ID NO: 790716 - DNA, 22 bp, Artificial Sequence
  chemically synthesized
ttttttggtttgtttgtttttg

SEQ ID NO: 790717 - DNA, 22 bp, Artificial Sequence
  chemically synthesized
tttttggtttgtttgtttttgt

SEQ ID NO: 790718 - DNA, 22 bp, Artificial Sequence
  chemically synthesized
aaaaacaaacaaacaaaaacaa

SEQ ID NO: 790719 - DNA, 22 bp, Artificial Sequence
  chemically synthesized
ttttggtttgtttgtttttgtt

SEQ ID NO: 790720 - DNA, 22 bp, Artificial Sequence
  chemically synthesized
tttggtttgtttgtttttgttt

SEQ ID NO: 790721 - DNA, 22 bp, Artificial Sequence
  chemically synthesized
ttggtttgtttgtttttgtttg

SEQ ID NO: 790722 - DNA, 22 bp, Artificial Sequence
  chemically synthesized
tggtttgtttgtttttgtttgt

SEQ ID NO: 790723 - DNA, 22 bp, Artificial Sequence
  chemically synthesized
ggtttgtttgtttttgtttgtt

SEQ ID NO: 790724 - DNA, 22 bp, Artificial Sequence
  chemically synthesized
gtttgtttgtttttgtttgttt

SEQ ID NO: 790725 - DNA, 22 bp, Artificial Sequence
  chemically synthesized
gtttgtttttgtttgtttgttt

SEQ ID NO: 790726 - DNA, 22 bp, Artificial Sequence
  chemically synthesized
agaaccattaaaaaacaaacaa

SEQ ID NO: 790727 - DNA, 22 bp, Artificial Sequence
  chemically synthesized
tttgtttttgtttgtttgtttt

SEQ ID NO: 790728 - DNA, 22 bp, Artificial Sequence
  chemically synthesized
gtttttgtttgtttgtttttta

SEQ ID NO: 790729 - DNA, 22 bp, Artificial Sequence
  chemically synthesized
tttttgtttgtttgttttttaa

SEQ ID NO: 790730 - DNA, 22 bp, Artificial Sequence
  chemically synthesized
ttgtttgtttgttttttaatgg

SEQ ID NO: 790731 - DNA, 22 bp, Artificial Sequence
  chemically synthesized
tgtttgtttgttttttaatggt

SEQ ID NO: 790732 - DNA, 22 bp, Artificial Sequence
  chemically synthesized
gtttgtttgttttttaatggtt

SEQ ID NO: 790733 - DNA, 22 bp, Artificial Sequence
  chemically synthesized
tttgtttgttttttaatggttc

SEQ ID NO: 790734 - DNA, 22 bp, Artificial Sequence
  chemically synthesized
gtttgttttttaatggttctca

SEQ ID NO: 790735 - DNA, 22 bp, Artificial Sequence
  chemically synthesized
gagaccaaaccctgagaaccat

SEQ ID NO: 790736 - DNA, 22 bp, Artificial Sequence
  chemically synthesized
tttgttttttaatggttctcag

SEQ ID NO: 790737 - DNA, 22 bp, Artificial Sequence
  chemically synthesized
gttttttaatggttctcagggt

SEQ ID NO: 790738 - DNA, 22 bp, Artificial Sequence
  chemically synthesized
ttttttaatggttctcagggtt

SEQ ID NO: 790739 - DNA, 22 bp, Artificial Sequence
  chemically synthesized
gtctagagaccaaaccctgaga

SEQ ID NO: 790740 - DNA, 22 bp, Artificial Sequence
  chemically synthesized
tttaatggttctcagggtttgg

SEQ ID NO: 790741 - DNA, 22 bp, Artificial Sequence
  chemically synthesized
ttaatggttctcagggtttggt

SEQ ID NO: 790742 - DNA, 22 bp, Artificial Sequence
  chemically synthesized
taatggttctcagggtttggtc

SEQ ID NO: 790743 - DNA, 22 bp, Artificial Sequence
  chemically synthesized
aatggttctcagggtttggtct

SEQ ID NO: 790744 - DNA, 22 bp, Artificial Sequence
  chemically synthesized
atggttctcagggtttggtctc

SEQ ID NO: 790745 - DNA, 22 bp, Artificial Sequence
  chemically synthesized
atggcattggtctagagaccaa

SEQ ID NO: 790746 - DNA, 22 bp, Artificial Sequence
  chemically synthesized
gatggcattggtctagagacca

SEQ ID NO: 790747 - DNA, 22 bp, Artificial Sequence
  chemically synthesized
tgatggcattggtctagagacc

SEQ ID NO: 790748 - DNA, 22 bp, Artificial Sequence
  chemically synthesized
tcagggtttggtctctagacca

SEQ ID NO: 790749 - DNA, 22 bp, Artificial Sequence
  chemically synthesized
attttgatggcattggtctaga

SEQ ID NO: 790750 - DNA, 22 bp, Artificial Sequence
  chemically synthesized
agggtttggtctctagaccaat

SEQ ID NO: 790751 - DNA, 22 bp, Artificial Sequence
  chemically synthesized
cagttgattttgatggcattgg

SEQ ID NO: 790752 - DNA, 22 bp, Artificial Sequence
  chemically synthesized
ccagttgattttgatggcattg

SEQ ID NO: 790753 - DNA, 22 bp, Artificial Sequence
  chemically synthesized
ggtctctagaccaatgccatca

SEQ ID NO: 790754 - DNA, 22 bp, Artificial Sequence
  chemically synthesized
gtctctagaccaatgccatcaa

SEQ ID NO: 790755 - DNA, 22 bp, Artificial Sequence
  chemically synthesized
tagaccaatgccatcaaaatca

SEQ ID NO: 790756 - DNA, 22 bp, Artificial Sequence
  chemically synthesized
acaaatttccagttgattttga

SEQ ID NO: 790757 - DNA, 22 bp, Artificial Sequence
  chemically synthesized
gaccaatgccatcaaaatcaac

SEQ ID NO: 790758 - DNA, 22 bp, Artificial Sequence
  chemically synthesized
ctcacaaatttccagttgattt

SEQ ID NO: 790759 - DNA, 22 bp, Artificial Sequence
  chemically synthesized
acattgctcacaaatttccagt

SEQ ID NO: 790760 - DNA, 22 bp, Artificial Sequence
  chemically synthesized
agaattcacattgctcacaaat

SEQ ID NO: 790761 - DNA, 22 bp, Artificial Sequence
  chemically synthesized
gaaatttgtgagcaatgtgaat

SEQ ID NO: 790762 - DNA, 22 bp, Artificial Sequence
  chemically synthesized
gtgagcaatgtgaattctcagg

SEQ ID NO: 790763 - DNA, 22 bp, Artificial Sequence
  chemically synthesized
tgagcaatgtgaattctcaggt

SEQ ID NO: 790764 - DNA, 22 bp, Artificial Sequence
  chemically synthesized
cagatagggtaggacctgagaa

SEQ ID NO: 790765 - DNA, 22 bp, Artificial Sequence
  chemically synthesized
agttacagatagggtaggacct

SEQ ID NO: 790766 - DNA, 22 bp, Artificial Sequence
  chemically synthesized
cattcagttacagatagggtag

SEQ ID NO: 790767 - DNA, 22 bp, Artificial Sequence
  chemically synthesized
acattcagttacagatagggta

SEQ ID NO: 790768 - DNA, 22 bp, Artificial Sequence
  chemically synthesized
tacattcagttacagatagggt

SEQ ID NO: 790769 - DNA, 22 bp, Artificial Sequence
  chemically synthesized
tcaggtcctaccctatctgtaa

SEQ ID NO: 790770 - DNA, 22 bp, Artificial Sequence
  chemically synthesized
aggtcctaccctatctgtaact

SEQ ID NO: 790771 - DNA, 22 bp, Artificial Sequence
  chemically synthesized
gagttttacattcagttacaga

SEQ ID NO: 790772 - DNA, 22 bp, Artificial Sequence
  chemically synthesized
ccctatctgtaactgaatgtaa

SEQ ID NO: 790773 - DNA, 22 bp, Artificial Sequence
  chemically synthesized
tctgtaactgaatgtaaaactc

SEQ ID NO: 790774 - DNA, 22 bp, Artificial Sequence
  chemically synthesized
taactgaatgtaaaactctagg

SEQ ID NO: 790775 - DNA, 22 bp, Artificial Sequence
  chemically synthesized
aatggtcccatgcctagagttt

SEQ ID NO: 790776 - DNA, 22 bp, Artificial Sequence
  chemically synthesized
aatgtaaaactctaggcatggg

SEQ ID NO: 790777 - DNA, 22 bp, Artificial Sequence
  chemically synthesized
tagaaatacagattgaatggtc

SEQ ID NO: 790778 - DNA, 22 bp, Artificial Sequence
  chemically synthesized
gtagaaatacagattgaatggt

SEQ ID NO: 790779 - DNA, 22 bp, Artificial Sequence
  chemically synthesized
taggcatgggaccattcaatct

SEQ ID NO: 790780 - DNA, 22 bp, Artificial Sequence
  chemically synthesized
ggcatgggaccattcaatctgt

SEQ ID NO: 790781 - DNA, 22 bp, Artificial Sequence
  chemically synthesized
gaggacttgtagaaatacagat

SEQ ID NO: 790782 - DNA, 22 bp, Artificial Sequence
  chemically synthesized
ctagaggacttgtagaaataca

SEQ ID NO: 790783 - DNA, 22 bp, Artificial Sequence
  chemically synthesized
aatctgtatttctacaagtcct

SEQ ID NO: 790784 - DNA, 22 bp, Artificial Sequence
  chemically synthesized
tatttctacaagtcctctagta

SEQ ID NO: 790785 - DNA, 22 bp, Artificial Sequence
  chemically synthesized
aacatgcatcaaagctactaga

SEQ ID NO: 790786 - DNA, 22 bp, Artificial Sequence
  chemically synthesized
gaacatgcatcaaagctactag

SEQ ID NO: 790787 - DNA, 22 bp, Artificial Sequence
  chemically synthesized
ctacaagtcctctagtagcttt

SEQ ID NO: 790788 - DNA, 22 bp, Artificial Sequence
  chemically synthesized
tacaagtcctctagtagctttg

SEQ ID NO: 790789 - DNA, 22 bp, Artificial Sequence
  chemically synthesized
caagtcctctagtagctttgat

SEQ ID NO: 790790 - DNA, 22 bp, Artificial Sequence
  chemically synthesized
gggccgacttgaacatgcatca

SEQ ID NO: 790791 - DNA, 22 bp, Artificial Sequence
  chemically synthesized
agggccgacttgaacatgcatc

SEQ ID NO: 790792 - DNA, 22 bp, Artificial Sequence
  chemically synthesized
tagggccgacttgaacatgcat

SEQ ID NO: 790793 - DNA, 22 bp, Artificial Sequence
  chemically synthesized
tagtagctttgatgcatgttca

SEQ ID NO: 790794 - DNA, 22 bp, Artificial Sequence
  chemically synthesized
gtagctttgatgcatgttcaag

SEQ ID NO: 790795 - DNA, 22 bp, Artificial Sequence
  chemically synthesized
tgatgcatgttcaagtcggccc

SEQ ID NO: 790796 - DNA, 22 bp, Artificial Sequence
  chemically synthesized
gatgcatgttcaagtcggccct

SEQ ID NO: 790797 - DNA, 22 bp, Artificial Sequence
  chemically synthesized
atgcatgttcaagtcggcccta

SEQ ID NO: 790798 - DNA, 22 bp, Artificial Sequence
  chemically synthesized
taaatccaacactttagggccg

SEQ ID NO: 790799 - DNA, 22 bp, Artificial Sequence
  chemically synthesized
taggttataaatccaacacttt

SEQ ID NO: 790800 - DNA, 22 bp, Artificial Sequence
  chemically synthesized
aagtcggccctaaagtgttgga

SEQ ID NO: 790801 - DNA, 22 bp, Artificial Sequence
  chemically synthesized
aagtgttggatttataacctat

SEQ ID NO: 790802 - DNA, 22 bp, Artificial Sequence
  chemically synthesized
gaaagaaacagttataggttat

SEQ ID NO: 790803 - DNA, 22 bp, Artificial Sequence
  chemically synthesized
tagaaagaaacagttataggtt

SEQ ID NO: 790804 - DNA, 22 bp, Artificial Sequence
  chemically synthesized
ctagaaagaaacagttataggt

SEQ ID NO: 790805 - DNA, 22 bp, Artificial Sequence
  chemically synthesized
tctagaaagaaacagttatagg

SEQ ID NO: 790806 - DNA, 22 bp, Artificial Sequence
  chemically synthesized
gatttataacctataactgttt

SEQ ID NO: 790807 - DNA, 22 bp, Artificial Sequence
  chemically synthesized
ttttctagaaagaaacagttat

SEQ ID NO: 790808 - DNA, 22 bp, Artificial Sequence
  chemically synthesized
ataacctataactgtttctttc

SEQ ID NO: 790809 - DNA, 22 bp, Artificial Sequence
  chemically synthesized
taacctataactgtttctttct

SEQ ID NO: 790810 - DNA, 22 bp, Artificial Sequence
  chemically synthesized
taactgtttctttctagaaaac

SEQ ID NO: 790811 - DNA, 22 bp, Artificial Sequence
  chemically synthesized
ccccgacatagttgttttctag

SEQ ID NO: 790812 - DNA, 22 bp, Artificial Sequence
  chemically synthesized
cccccgacatagttgttttcta

SEQ ID NO: 790813 - DNA, 22 bp, Artificial Sequence
  chemically synthesized
tcccccgacatagttgttttct

SEQ ID NO: 790814 - DNA, 22 bp, Artificial Sequence
  chemically synthesized
ttcccccgacatagttgttttc

SEQ ID NO: 790815 - DNA, 22 bp, Artificial Sequence
  chemically synthesized
tttctttctagaaaacaactat

SEQ ID NO: 790816 - DNA, 22 bp, Artificial Sequence
  chemically synthesized
tttttcccccgacatagttgtt

SEQ ID NO: 790817 - DNA, 22 bp, Artificial Sequence
  chemically synthesized
atttttcccccgacatagttgt

SEQ ID NO: 790818 - DNA, 22 bp, Artificial Sequence
  chemically synthesized
ctttctagaaaacaactatgtc

SEQ ID NO: 790819 - DNA, 22 bp, Artificial Sequence
  chemically synthesized
tatttttcccccgacatagttg

SEQ ID NO: 790820 - DNA, 22 bp, Artificial Sequence
  chemically synthesized
tttctagaaaacaactatgtcg

SEQ ID NO: 790821 - DNA, 22 bp, Artificial Sequence
  chemically synthesized
ttatttttcccccgacatagtt

SEQ ID NO: 790822 - DNA, 22 bp, Artificial Sequence
  chemically synthesized
tttatttttcccccgacatagt

SEQ ID NO: 790823 - DNA, 22 bp, Artificial Sequence
  chemically synthesized
tctagaaaacaactatgtcggg

SEQ ID NO: 790824 - DNA, 22 bp, Artificial Sequence
  chemically synthesized
ctagaaaacaactatgtcgggg

SEQ ID NO: 790825 - DNA, 22 bp, Artificial Sequence
  chemically synthesized
tttttatttttcccccgacata

SEQ ID NO: 790826 - DNA, 22 bp, Artificial Sequence
  chemically synthesized
tagaaaacaactatgtcggggg

SEQ ID NO: 790827 - DNA, 22 bp, Artificial Sequence
  chemically synthesized
ctttttatttttcccccgacat

SEQ ID NO: 790828 - DNA, 22 bp, Artificial Sequence
  chemically synthesized
tctttttatttttcccccgaca

SEQ ID NO: 790829 - DNA, 22 bp, Artificial Sequence
  chemically synthesized
gaaaacaactatgtcgggggaa

SEQ ID NO: 790830 - DNA, 22 bp, Artificial Sequence
  chemically synthesized
atagaaaactttctttttattt

SEQ ID NO: 790831 - DNA, 22 bp, Artificial Sequence
  chemically synthesized
tgtcgggggaaaaataaaaaga

SEQ ID NO: 790832 - DNA, 22 bp, Artificial Sequence
  chemically synthesized
attaatagaaaactttcttttt

SEQ ID NO: 790833 - DNA, 22 bp, Artificial Sequence
  chemically synthesized
aattaatagaaaactttctttt

SEQ ID NO: 790834 - DNA, 22 bp, Artificial Sequence
  chemically synthesized
taattaatagaaaactttcttt

SEQ ID NO: 790835 - DNA, 22 bp, Artificial Sequence
  chemically synthesized
ttaattaatagaaaactttctt

SEQ ID NO: 790836 - DNA, 22 bp, Artificial Sequence
  chemically synthesized
cgtttttaattaatagaaaact

SEQ ID NO: 790837 - DNA, 22 bp, Artificial Sequence
  chemically synthesized
tacgtttttaattaatagaaaa

SEQ ID NO: 790838 - DNA, 22 bp, Artificial Sequence
  chemically synthesized
aattctacgtttttaattaata

SEQ ID NO: 790839 - DNA, 22 bp, Artificial Sequence
  chemically synthesized
gaattctacgtttttaattaat

SEQ ID NO: 790840 - DNA, 22 bp, Artificial Sequence
  chemically synthesized
ttgaattctacgtttttaatta

SEQ ID NO: 790841 - DNA, 22 bp, Artificial Sequence
  chemically synthesized
gctcttgaattctacgttttta

SEQ ID NO: 790842 - DNA, 22 bp, Artificial Sequence
  chemically synthesized
agctcttgaattctacgttttt

SEQ ID NO: 790843 - DNA, 22 bp, Artificial Sequence
  chemically synthesized
tagctcttgaattctacgtttt

SEQ ID NO: 790844 - DNA, 22 bp, Artificial Sequence
  chemically synthesized
tctattaattaaaaacgtagaa

SEQ ID NO: 790845 - DNA, 22 bp, Artificial Sequence
  chemically synthesized
ctattaattaaaaacgtagaat

SEQ ID NO: 790846 - DNA, 22 bp, Artificial Sequence
  chemically synthesized
tattaattaaaaacgtagaatt

SEQ ID NO: 790847 - DNA, 22 bp, Artificial Sequence
  chemically synthesized
ctttagctcttgaattctacgt

SEQ ID NO: 790848 - DNA, 22 bp, Artificial Sequence
  chemically synthesized
ttaattaaaaacgtagaattca

SEQ ID NO: 790849 - DNA, 22 bp, Artificial Sequence
  chemically synthesized
attaaaaacgtagaattcaaga

SEQ ID NO: 790850 - DNA, 22 bp, Artificial Sequence
  chemically synthesized
agattcctttagctcttgaatt

SEQ ID NO: 790851 - DNA, 22 bp, Artificial Sequence
  chemically synthesized
aaaacgtagaattcaagagcta

SEQ ID NO: 790852 - DNA, 22 bp, Artificial Sequence
  chemically synthesized
tcctgagattcctttagctctt

SEQ ID NO: 790853 - DNA, 22 bp, Artificial Sequence
  chemically synthesized
atcattgtcctgagattccttt

SEQ ID NO: 790854 - DNA, 22 bp, Artificial Sequence
  chemically synthesized
ctaatcattgtcctgagattcc

SEQ ID NO: 790855 - DNA, 22 bp, Artificial Sequence
  chemically synthesized
gctaatcattgtcctgagattc

SEQ ID NO: 790856 - DNA, 22 bp, Artificial Sequence
  chemically synthesized
aagagctaaaggaatctcagga

SEQ ID NO: 790857 - DNA, 22 bp, Artificial Sequence
  chemically synthesized
tgctaatcattgtcctgagatt

SEQ ID NO: 790858 - DNA, 22 bp, Artificial Sequence
  chemically synthesized
tctttgctaatcattgtcctga

SEQ ID NO: 790859 - DNA, 22 bp, Artificial Sequence
  chemically synthesized
atctttgctaatcattgtcctg

SEQ ID NO: 790860 - DNA, 22 bp, Artificial Sequence
  chemically synthesized
aaggaatctcaggacaatgatt

SEQ ID NO: 790861 - DNA, 22 bp, Artificial Sequence
  chemically synthesized
tatatttatctttgctaatcat

SEQ ID NO: 790862 - DNA, 22 bp, Artificial Sequence
  chemically synthesized
gtatatttatctttgctaatca

SEQ ID NO: 790863 - DNA, 22 bp, Artificial Sequence
  chemically synthesized
tgtatatttatctttgctaatc

SEQ ID NO: 790864 - DNA, 22 bp, Artificial Sequence
  chemically synthesized
ctttgtatatttatctttgcta

SEQ ID NO: 790865 - DNA, 22 bp, Artificial Sequence
  chemically synthesized
aggacaatgattagcaaagata

SEQ ID NO: 790866 - DNA, 22 bp, Artificial Sequence
  chemically synthesized
tattcctttgtatatttatctt

SEQ ID NO: 790867 - DNA, 22 bp, Artificial Sequence
  chemically synthesized
atattcctttgtatatttatct

SEQ ID NO: 790868 - DNA, 22 bp, Artificial Sequence
  chemically synthesized
tatattcctttgtatatttatc

SEQ ID NO: 790869 - DNA, 22 bp, Artificial Sequence
  chemically synthesized
ctttatattcctttgtatattt

SEQ ID NO: 790870 - DNA, 22 bp, Artificial Sequence
  chemically synthesized
actttatattcctttgtatatt

SEQ ID NO: 790871 - DNA, 22 bp, Artificial Sequence
  chemically synthesized
tactttatattcctttgtatat

SEQ ID NO: 790872 - DNA, 22 bp, Artificial Sequence
  chemically synthesized
ttactttatattcctttgtata

SEQ ID NO: 790873 - DNA, 22 bp, Artificial Sequence
  chemically synthesized
gcaaagataaatatacaaagga

SEQ ID NO: 790874 - DNA, 22 bp, Artificial Sequence
  chemically synthesized
catttttactttatattccttt

SEQ ID NO: 790875 - DNA, 22 bp, Artificial Sequence
  chemically synthesized
agttgcatttttactttatatt

SEQ ID NO: 790876 - DNA, 22 bp, Artificial Sequence
  chemically synthesized
cagttgcatttttactttatat

SEQ ID NO: 790877 - DNA, 22 bp, Artificial Sequence
  chemically synthesized
tcagttgcatttttactttata

SEQ ID NO: 790878 - DNA, 22 bp, Artificial Sequence
  chemically synthesized
agccattttcagttgcattttt

SEQ ID NO: 790879 - DNA, 22 bp, Artificial Sequence
  chemically synthesized
cagccattttcagttgcatttt

SEQ ID NO: 790880 - DNA, 22 bp, Artificial Sequence
  chemically synthesized
ttcagccattttcagttgcatt

SEQ ID NO: 790881 - DNA, 22 bp, Artificial Sequence
  chemically synthesized
tcttcagccattttcagttgca

SEQ ID NO: 790882 - DNA, 22 bp, Artificial Sequence
  chemically synthesized
gtccacgttctcttcagccatt

SEQ ID NO: 790883 - DNA, 22 bp, Artificial Sequence
  chemically synthesized
tgtgttagtccacgttctcttc

SEQ ID NO: 790884 - DNA, 22 bp, Artificial Sequence
  chemically synthesized
aaaatggctgaagagaacgtgg

SEQ ID NO: 790885 - DNA, 22 bp, Artificial Sequence
  chemically synthesized
aaacattatgtgttagtccacg

SEQ ID NO: 790886 - DNA, 22 bp, Artificial Sequence
  chemically synthesized
caaacattatgtgttagtccac

SEQ ID NO: 790887 - DNA, 22 bp, Artificial Sequence
  chemically synthesized
tttcaaacattatgtgttagtc

SEQ ID NO: 790888 - DNA, 22 bp, Artificial Sequence
  chemically synthesized
aagagaacgtggactaacacat

SEQ ID NO: 790889 - DNA, 22 bp, Artificial Sequence
  chemically synthesized
tgtttcaaacattatgtgttag

SEQ ID NO: 790890 - DNA, 22 bp, Artificial Sequence
  chemically synthesized
aatagtatactctgtttcaaac

SEQ ID NO: 790891 - DNA, 22 bp, Artificial Sequence
  chemically synthesized
aaatagtatactctgtttcaaa

SEQ ID NO: 790892 - DNA, 22 bp, Artificial Sequence
  chemically synthesized
taaatagtatactctgtttcaa

SEQ ID NO: 790893 - DNA, 22 bp, Artificial Sequence
  chemically synthesized
acacataatgtttgaaacagag

SEQ ID NO: 790894 - DNA, 22 bp, Artificial Sequence
  chemically synthesized
ttaaatagtatactctgtttca

SEQ ID NO: 790895 - DNA, 22 bp, Artificial Sequence
  chemically synthesized
gaaacagagtatactatttaaa

SEQ ID NO: 790896 - DNA, 22 bp, Artificial Sequence
  chemically synthesized
aaacagagtatactatttaaaa

SEQ ID NO: 790897 - DNA, 22 bp, Artificial Sequence
  chemically synthesized
gcacatatgtagcttttaaata

SEQ ID NO: 790898 - DNA, 22 bp, Artificial Sequence
  chemically synthesized
agcacatatgtagcttttaaat

SEQ ID NO: 790899 - DNA, 22 bp, Artificial Sequence
  chemically synthesized
agatttagcacatatgtagctt

SEQ ID NO: 790900 - DNA, 22 bp, Artificial Sequence
  chemically synthesized
tgagatttagcacatatgtagc

SEQ ID NO: 790901 - DNA, 22 bp, Artificial Sequence
  chemically synthesized
tttaaaagctacatatgtgcta

SEQ ID NO: 790902 - DNA, 22 bp, Artificial Sequence
  chemically synthesized
aaaagctacatatgtgctaaat

SEQ ID NO: 790903 - DNA, 22 bp, Artificial Sequence
  chemically synthesized
aaagctacatatgtgctaaatc

SEQ ID NO: 790904 - DNA, 22 bp, Artificial Sequence
  chemically synthesized
catatgtgctaaatctcagaat

SEQ ID NO: 790905 - DNA, 22 bp, Artificial Sequence
  chemically synthesized
gcacatggaaagaagaattctg

SEQ ID NO: 790906 - DNA, 22 bp, Artificial Sequence
  chemically synthesized
aaactagcacatggaaagaaga

SEQ ID NO: 790907 - DNA, 22 bp, Artificial Sequence
  chemically synthesized
aatctcagaattcttctttcca

SEQ ID NO: 790908 - DNA, 22 bp, Artificial Sequence
  chemically synthesized
tcaaactagcacatggaaagaa

SEQ ID NO: 790909 - DNA, 22 bp, Artificial Sequence
  chemically synthesized
cctctcaaactagcacatggaa

SEQ ID NO: 790910 - DNA, 22 bp, Artificial Sequence
  chemically synthesized
agaattcttctttccatgtgct

SEQ ID NO: 790911 - DNA, 22 bp, Artificial Sequence
  chemically synthesized
ttctttccatgtgctagtttga

SEQ ID NO: 790912 - DNA, 22 bp, Artificial Sequence
  chemically synthesized
ctttccatgtgctagtttgaga

SEQ ID NO: 790913 - DNA, 22 bp, Artificial Sequence
  chemically synthesized
tttccatgtgctagtttgagag

SEQ ID NO: 790914 - DNA, 22 bp, Artificial Sequence
  chemically synthesized
tccatgtgctagtttgagaggc

SEQ ID NO: 790915 - DNA, 22 bp, Artificial Sequence
  chemically synthesized
ccatgtgctagtttgagaggca

SEQ ID NO: 790916 - DNA, 22 bp, Artificial Sequence
  chemically synthesized
catgtgctagtttgagaggcaa

SEQ ID NO: 790917 - DNA, 22 bp, Artificial Sequence
  chemically synthesized
tgccagaaataaattgcctctc

SEQ ID NO: 790918 - DNA, 22 bp, Artificial Sequence
  chemically synthesized
gtttgagaggcaatttatttct

SEQ ID NO: 790919 - DNA, 22 bp, Artificial Sequence
  chemically synthesized
gagaggcaatttatttctggca

SEQ ID NO: 790920 - DNA, 22 bp, Artificial Sequence
  chemically synthesized
agaggcaatttatttctggcac

SEQ ID NO: 790921 - DNA, 22 bp, Artificial Sequence
  chemically synthesized
gtataaatgcatatggcagttg

SEQ ID NO: 790922 - DNA, 22 bp, Artificial Sequence
  chemically synthesized
atttctggcacaactgccatat

SEQ ID NO: 790923 - DNA, 22 bp, Artificial Sequence
  chemically synthesized
tttctggcacaactgccatatg

SEQ ID NO: 790924 - DNA, 22 bp, Artificial Sequence
  chemically synthesized
ctggcacaactgccatatgcat

SEQ ID NO: 790925 - DNA, 22 bp, Artificial Sequence
  chemically synthesized
acattagtataaatgcatatgg

SEQ ID NO: 790926 - DNA, 22 bp, Artificial Sequence
  chemically synthesized
tggcacaactgccatatgcatt

SEQ ID NO: 790927 - DNA, 22 bp, Artificial Sequence
  chemically synthesized
cacattagtataaatgcatatg

SEQ ID NO: 790928 - DNA, 22 bp, Artificial Sequence
  chemically synthesized
tcacattagtataaatgcatat

SEQ ID NO: 790929 - DNA, 22 bp, Artificial Sequence
  chemically synthesized
gcacaactgccatatgcattta

SEQ ID NO: 790930 - DNA, 22 bp, Artificial Sequence
  chemically synthesized
ccatatgcatttatactaatgt

SEQ ID NO: 790931 - DNA, 22 bp, Artificial Sequence
  chemically synthesized
caagaagtctttcacattagta

SEQ ID NO: 790932 - DNA, 22 bp, Artificial Sequence
  chemically synthesized
attacaagaagtctttcacatt

SEQ ID NO: 790933 - DNA, 22 bp, Artificial Sequence
  chemically synthesized
tcattacaagaagtctttcaca

SEQ ID NO: 790934 - DNA, 22 bp, Artificial Sequence
  chemically synthesized
ctcattacaagaagtctttcac

SEQ ID NO: 790935 - DNA, 22 bp, Artificial Sequence
  chemically synthesized
atactaatgtgaaagacttctt

SEQ ID NO: 790936 - DNA, 22 bp, Artificial Sequence
  chemically synthesized
ccttctcattacaagaagtctt

SEQ ID NO: 790937 - DNA, 22 bp, Artificial Sequence
  chemically synthesized
tactaatgtgaaagacttcttg

SEQ ID NO: 790938 - DNA, 22 bp, Artificial Sequence
  chemically synthesized
atgtgaaagacttcttgtaatg

SEQ ID NO: 790939 - DNA, 22 bp, Artificial Sequence
  chemically synthesized
aatgcagtgtattaccttctca

SEQ ID NO: 790940 - DNA, 22 bp, Artificial Sequence
  chemically synthesized
ctaaatgcagtgtattaccttc

SEQ ID NO: 790941 - DNA, 22 bp, Artificial Sequence
  chemically synthesized
actaaatgcagtgtattacctt

SEQ ID NO: 790942 - DNA, 22 bp, Artificial Sequence
  chemically synthesized
cttgtaatgagaaggtaataca

SEQ ID NO: 790943 - DNA, 22 bp, Artificial Sequence
  chemically synthesized
ttgtaatgagaaggtaatacac

SEQ ID NO: 790944 - DNA, 22 bp, Artificial Sequence
  chemically synthesized
gtaatgagaaggtaatacactg

SEQ ID NO: 790945 - DNA, 22 bp, Artificial Sequence
  chemically synthesized
gtttactaaatgcagtgtatta

SEQ ID NO: 790946 - DNA, 22 bp, Artificial Sequence
  chemically synthesized
taatgagaaggtaatacactgc

SEQ ID NO: 790947 - DNA, 22 bp, Artificial Sequence
  chemically synthesized
aaaactagtttactaaatgcag

SEQ ID NO: 790948 - DNA, 22 bp, Artificial Sequence
  chemically synthesized
acattgaaaactagtttactaa

SEQ ID NO: 790949 - DNA, 22 bp, Artificial Sequence
  chemically synthesized
tcacattgaaaactagtttact

SEQ ID NO: 790950 - DNA, 22 bp, Artificial Sequence
  chemically synthesized
ctcacattgaaaactagtttac

SEQ ID NO: 790951 - DNA, 22 bp, Artificial Sequence
  chemically synthesized
tctcacattgaaaactagttta

SEQ ID NO: 790952 - DNA, 22 bp, Artificial Sequence
  chemically synthesized
ttctcacattgaaaactagttt

SEQ ID NO: 790953 - DNA, 22 bp, Artificial Sequence
  chemically synthesized
catttagtaaactagttttcaa

SEQ ID NO: 790954 - DNA, 22 bp, Artificial Sequence
  chemically synthesized
agtaaactagttttcaatgtga

SEQ ID NO: 790955 - DNA, 22 bp, Artificial Sequence
  chemically synthesized
gtaaactagttttcaatgtgag

SEQ ID NO: 790956 - DNA, 22 bp, Artificial Sequence
  chemically synthesized
atgtaggcatttttctcacatt

SEQ ID NO: 790957 - DNA, 22 bp, Artificial Sequence
  chemically synthesized
catgtaggcatttttctcacat

SEQ ID NO: 790958 - DNA, 22 bp, Artificial Sequence
  chemically synthesized
tcatgtaggcatttttctcaca

SEQ ID NO: 790959 - DNA, 22 bp, Artificial Sequence
  chemically synthesized
gttttcaatgtgagaaaaatgc

SEQ ID NO: 790960 - DNA, 22 bp, Artificial Sequence
  chemically synthesized
tcaatgtgagaaaaatgcctac

SEQ ID NO: 790961 - DNA, 22 bp, Artificial Sequence
  chemically synthesized
caatgtgagaaaaatgcctaca

SEQ ID NO: 790962 - DNA, 22 bp, Artificial Sequence
  chemically synthesized
aatgtgagaaaaatgcctacat

SEQ ID NO: 790963 - DNA, 22 bp, Artificial Sequence
  chemically synthesized
aagggcaacattttcatgtagg

SEQ ID NO: 790964 - DNA, 22 bp, Artificial Sequence
  chemically synthesized
aaagggcaacattttcatgtag

SEQ ID NO: 790965 - DNA, 22 bp, Artificial Sequence
  chemically synthesized
taaagggcaacattttcatgta

SEQ ID NO: 790966 - DNA, 22 bp, Artificial Sequence
  chemically synthesized
ttaaagggcaacattttcatgt

SEQ ID NO: 790967 - DNA, 22 bp, Artificial Sequence
  chemically synthesized
tttaaagggcaacattttcatg

SEQ ID NO: 790968 - DNA, 22 bp, Artificial Sequence
  chemically synthesized
catgaaaatgttgccctttaaa

SEQ ID NO: 790969 - DNA, 22 bp, Artificial Sequence
  chemically synthesized
ccctttaaaaagcttcccttga

SEQ ID NO: 790970 - DNA, 22 bp, Artificial Sequence
  chemically synthesized
taaaaagcttcccttgactatt

SEQ ID NO: 790971 - DNA, 22 bp, Artificial Sequence
  chemically synthesized
aaaaagcttcccttgactattc

SEQ ID NO: 790972 - DNA, 22 bp, Artificial Sequence
  chemically synthesized
aaaagcttcccttgactattcc

SEQ ID NO: 790973 - DNA, 22 bp, Artificial Sequence
  chemically synthesized
tcaagaatataaacaggaatag

SEQ ID NO: 790974 - DNA, 22 bp, Artificial Sequence
  chemically synthesized
ctatcaagaatataaacaggaa

SEQ ID NO: 790975 - DNA, 22 bp, Artificial Sequence
  chemically synthesized
cccttgactattcctgtttata

SEQ ID NO: 790976 - DNA, 22 bp, Artificial Sequence
  chemically synthesized
tgctatcaagaatataaacagg

SEQ ID NO: 790977 - DNA, 22 bp, Artificial Sequence
  chemically synthesized
ccttgactattcctgtttatat

SEQ ID NO: 790978 - DNA, 22 bp, Artificial Sequence
  chemically synthesized
ttctgctatcaagaatataaac

SEQ ID NO: 790979 - DNA, 22 bp, Artificial Sequence
  chemically synthesized
gactattcctgtttatattctt

SEQ ID NO: 790980 - DNA, 22 bp, Artificial Sequence
  chemically synthesized
actattcctgtttatattcttg

SEQ ID NO: 790981 - DNA, 22 bp, Artificial Sequence
  chemically synthesized
ttcctgtttatattcttgatag

SEQ ID NO: 790982 - DNA, 22 bp, Artificial Sequence
  chemically synthesized
ccaaagctattctgctatcaag

SEQ ID NO: 790983 - DNA, 22 bp, Artificial Sequence
  chemically synthesized
ctgtttatattcttgatagcag

SEQ ID NO: 790984 - DNA, 22 bp, Artificial Sequence
  chemically synthesized
cccaaagctattctgctatcaa

SEQ ID NO: 790985 - DNA, 22 bp, Artificial Sequence
  chemically synthesized
tttatattcttgatagcagaat

SEQ ID NO: 790986 - DNA, 22 bp, Artificial Sequence
  chemically synthesized
atattcttgatagcagaatagc

SEQ ID NO: 790987 - DNA, 22 bp, Artificial Sequence
  chemically synthesized
tattcttgatagcagaatagct

SEQ ID NO: 790988 - DNA, 22 bp, Artificial Sequence
  chemically synthesized
agaacatttcccaaagctattc

SEQ ID NO: 790989 - DNA, 22 bp, Artificial Sequence
  chemically synthesized
ttgatagcagaatagctttggg

SEQ ID NO: 790990 - DNA, 22 bp, Artificial Sequence
  chemically synthesized
ttcagaacatttcccaaagcta

SEQ ID NO: 790991 - DNA, 22 bp, Artificial Sequence
  chemically synthesized
gatagcagaatagctttgggaa

SEQ ID NO: 790992 - DNA, 22 bp, Artificial Sequence
  chemically synthesized
tattcagaacatttcccaaagc

SEQ ID NO: 790993 - DNA, 22 bp, Artificial Sequence
  chemically synthesized
atagcagaatagctttgggaaa

SEQ ID NO: 790994 - DNA, 22 bp, Artificial Sequence
  chemically synthesized
gattctattcagaacatttccc

SEQ ID NO: 790995 - DNA, 22 bp, Artificial Sequence
  chemically synthesized
ggattctattcagaacatttcc

SEQ ID NO: 790996 - DNA, 22 bp, Artificial Sequence
  chemically synthesized
tggattctattcagaacatttc

SEQ ID NO: 790997 - DNA, 22 bp, Artificial Sequence
  chemically synthesized
tgggaaatgttctgaatagaat

SEQ ID NO: 790998 - DNA, 22 bp, Artificial Sequence
  chemically synthesized
gagtagctttggattctattca

SEQ ID NO: 790999 - DNA, 22 bp, Artificial Sequence
  chemically synthesized
gggaaatgttctgaatagaatc

SEQ ID NO: 791000 - DNA, 22 bp, Artificial Sequence
  chemically synthesized
agagtagctttggattctattc

SEQ ID NO: 791001 - DNA, 22 bp, Artificial Sequence
  chemically synthesized
ggaaatgttctgaatagaatcc

SEQ ID NO: 791002 - DNA, 22 bp, Artificial Sequence
  chemically synthesized
tagagtagctttggattctatt

SEQ ID NO: 791003 - DNA, 22 bp, Artificial Sequence
  chemically synthesized
tctttagagtagctttggattc

SEQ ID NO: 791004 - DNA, 22 bp, Artificial Sequence
  chemically synthesized
tgaatagaatccaaagctactc

SEQ ID NO: 791005 - DNA, 22 bp, Artificial Sequence
  chemically synthesized
aatagaatccaaagctactcta

SEQ ID NO: 791006 - DNA, 22 bp, Artificial Sequence
  chemically synthesized
tcagcctatctttagagtagct

SEQ ID NO: 791007 - DNA, 22 bp, Artificial Sequence
  chemically synthesized
gtcagcctatctttagagtagc

SEQ ID NO: 791008 - DNA, 22 bp, Artificial Sequence
  chemically synthesized
tatggtgacaaccttgtcagcc

SEQ ID NO: 791009 - DNA, 22 bp, Artificial Sequence
  chemically synthesized
ctctaaagataggctgacaagg

SEQ ID NO: 791010 - DNA, 22 bp, Artificial Sequence
  chemically synthesized
taaagataggctgacaaggttg

SEQ ID NO: 791011 - DNA, 22 bp, Artificial Sequence
  chemically synthesized
aagataggctgacaaggttgtc

SEQ ID NO: 791012 - DNA, 22 bp, Artificial Sequence
  chemically synthesized
acaaggttgtcaccatacagtt

SEQ ID NO: 791013 - DNA, 22 bp, Artificial Sequence
  chemically synthesized
atggtacataggaactgtatgg

SEQ ID NO: 791014 - DNA, 22 bp, Artificial Sequence
  chemically synthesized
agattcatggtacataggaact

SEQ ID NO: 791015 - DNA, 22 bp, Artificial Sequence
  chemically synthesized
taagattcatggtacataggaa

SEQ ID NO: 791016 - DNA, 22 bp, Artificial Sequence
  chemically synthesized
tcaccatacagttcctatgtac

SEQ ID NO: 791017 - DNA, 22 bp, Artificial Sequence
  chemically synthesized
attctaagattcatggtacata

SEQ ID NO: 791018 - DNA, 22 bp, Artificial Sequence
  chemically synthesized
gattctaagattcatggtacat

SEQ ID NO: 791019 - DNA, 22 bp, Artificial Sequence
  chemically synthesized
ttgattctaagattcatggtac

SEQ ID NO: 791020 - DNA, 22 bp, Artificial Sequence
  chemically synthesized
ctatgtaccatgaatcttagaa

SEQ ID NO: 791021 - DNA, 22 bp, Artificial Sequence
  chemically synthesized
aaacgttcttgattctaagatt

SEQ ID NO: 791022 - DNA, 22 bp, Artificial Sequence
  chemically synthesized
tgtaccatgaatcttagaatca

SEQ ID NO: 791023 - DNA, 22 bp, Artificial Sequence
  chemically synthesized
attcaaacgttcttgattctaa

SEQ ID NO: 791024 - DNA, 22 bp, Artificial Sequence
  chemically synthesized
gattcaaacgttcttgattcta

SEQ ID NO: 791025 - DNA, 22 bp, Artificial Sequence
  chemically synthesized
agaaatgtcttgattcaaacgt

SEQ ID NO: 791026 - DNA, 22 bp, Artificial Sequence
  chemically synthesized
agaatcaagaacgtttgaatca

SEQ ID NO: 791027 - DNA, 22 bp, Artificial Sequence
  chemically synthesized
tgagaaatgtcttgattcaaac

SEQ ID NO: 791028 - DNA, 22 bp, Artificial Sequence
  chemically synthesized
gaatcaagaacgtttgaatcaa

SEQ ID NO: 791029 - DNA, 22 bp, Artificial Sequence
  chemically synthesized
gctctgagaaatgtcttgattc

SEQ ID NO: 791030 - DNA, 22 bp, Artificial Sequence
  chemically synthesized
agattggctctgagaaatgtct

SEQ ID NO: 791031 - DNA, 22 bp, Artificial Sequence
  chemically synthesized
gaatcaagacatttctcagagc

SEQ ID NO: 791032 - DNA, 22 bp, Artificial Sequence
  chemically synthesized
aatcaagacatttctcagagcc

SEQ ID NO: 791033 - DNA, 22 bp, Artificial Sequence
  chemically synthesized
ctcagagccaatctgagatatg

SEQ ID NO: 791034 - DNA, 22 bp, Artificial Sequence
  chemically synthesized
tcagagccaatctgagatatgt

SEQ ID NO: 791035 - DNA, 22 bp, Artificial Sequence
  chemically synthesized
agagccaatctgagatatgtgt

SEQ ID NO: 791036 - DNA, 22 bp, Artificial Sequence
  chemically synthesized
aaatagatacatataaatatac

SEQ ID NO: 791037 - DNA, 22 bp, Artificial Sequence
  chemically synthesized
agatatgtgtatatttatatgt

SEQ ID NO: 791038 - DNA, 22 bp, Artificial Sequence
  chemically synthesized
tctcaaatagatacatataaat

SEQ ID NO: 791039 - DNA, 22 bp, Artificial Sequence
  chemically synthesized
agagttgtctcaaatagataca

SEQ ID NO: 791040 - DNA, 22 bp, Artificial Sequence
  chemically synthesized
cctgagagttgtctcaaataga

SEQ ID NO: 791041 - DNA, 22 bp, Artificial Sequence
  chemically synthesized
ttccctgagagttgtctcaaat

SEQ ID NO: 791042 - DNA, 22 bp, Artificial Sequence
  chemically synthesized
gttccctgagagttgtctcaaa

SEQ ID NO: 791043 - DNA, 22 bp, Artificial Sequence
  chemically synthesized
atatgtatctatttgagacaac

SEQ ID NO: 791044 - DNA, 22 bp, Artificial Sequence
  chemically synthesized
tatgtatctatttgagacaact

SEQ ID NO: 791045 - DNA, 22 bp, Artificial Sequence
  chemically synthesized
atgtcttgttccctgagagttg

SEQ ID NO: 791046 - DNA, 22 bp, Artificial Sequence
  chemically synthesized
gatgtcttgttccctgagagtt

SEQ ID NO: 791047 - DNA, 22 bp, Artificial Sequence
  chemically synthesized
tgatgtcttgttccctgagagt

SEQ ID NO: 791048 - DNA, 22 bp, Artificial Sequence
  chemically synthesized
ttgatgtcttgttccctgagag

SEQ ID NO: 791049 - DNA, 22 bp, Artificial Sequence
  chemically synthesized
tttgagacaactctcagggaac

SEQ ID NO: 791050 - DNA, 22 bp, Artificial Sequence
  chemically synthesized
tttttgatgtcttgttccctga

SEQ ID NO: 791051 - DNA, 22 bp, Artificial Sequence
  chemically synthesized
gtttttgatgtcttgttccctg

SEQ ID NO: 791052 - DNA, 22 bp, Artificial Sequence
  chemically synthesized
gagacaactctcagggaacaag

SEQ ID NO: 791053 - DNA, 22 bp, Artificial Sequence
  chemically synthesized
agacaactctcagggaacaaga

SEQ ID NO: 791054 - DNA, 22 bp, Artificial Sequence
  chemically synthesized
atcaatttgtttttgatgtctt

SEQ ID NO: 791055 - DNA, 22 bp, Artificial Sequence
  chemically synthesized
gatcaatttgtttttgatgtct

SEQ ID NO: 791056 - DNA, 22 bp, Artificial Sequence
  chemically synthesized
tgatcaatttgtttttgatgtc

SEQ ID NO: 791057 - DNA, 22 bp, Artificial Sequence
  chemically synthesized
tcagggaacaagacatcaaaaa

SEQ ID NO: 791058 - DNA, 22 bp, Artificial Sequence
  chemically synthesized
ttgatcaatttgtttttgatgt

SEQ ID NO: 791059 - DNA, 22 bp, Artificial Sequence
  chemically synthesized
agggaacaagacatcaaaaaca

SEQ ID NO: 791060 - DNA, 22 bp, Artificial Sequence
  chemically synthesized
agcgtataaccttttgatcaat

SEQ ID NO: 791061 - DNA, 22 bp, Artificial Sequence
  chemically synthesized
gagcgtataaccttttgatcaa

SEQ ID NO: 791062 - DNA, 22 bp, Artificial Sequence
  chemically synthesized
atttgagcgtataaccttttga

SEQ ID NO: 791063 - DNA, 22 bp, Artificial Sequence
  chemically synthesized
atcaaaaggttatacgctcaaa

SEQ ID NO: 791064 - DNA, 22 bp, Artificial Sequence
  chemically synthesized
aaatgcaacattcatttgagcg

SEQ ID NO: 791065 - DNA, 22 bp, Artificial Sequence
  chemically synthesized
cgttaaaatgcaacattcattt

SEQ ID NO: 791066 - DNA, 22 bp, Artificial Sequence
  chemically synthesized
actgcgttaaaatgcaacattc

SEQ ID NO: 791067 - DNA, 22 bp, Artificial Sequence
  chemically synthesized
tacgctcaaatgaatgttgcat

SEQ ID NO: 791068 - DNA, 22 bp, Artificial Sequence
  chemically synthesized
ctcactgcgttaaaatgcaaca

SEQ ID NO: 791069 - DNA, 22 bp, Artificial Sequence
  chemically synthesized
aaatgaatgttgcattttaacg

SEQ ID NO: 791070 - DNA, 22 bp, Artificial Sequence
  chemically synthesized
taccattactcactgcgttaaa

SEQ ID NO: 791071 - DNA, 22 bp, Artificial Sequence
  chemically synthesized
aattgtaccattactcactgcg

SEQ ID NO: 791072 - DNA, 22 bp, Artificial Sequence
  chemically synthesized
ctaaattgtaccattactcact

SEQ ID NO: 791073 - DNA, 22 bp, Artificial Sequence
  chemically synthesized
cattttaacgcagtgagtaatg

SEQ ID NO: 791074 - DNA, 22 bp, Artificial Sequence
  chemically synthesized
gttcctaaattgtaccattact

SEQ ID NO: 791075 - DNA, 22 bp, Artificial Sequence
  chemically synthesized
agttcctaaattgtaccattac

SEQ ID NO: 791076 - DNA, 22 bp, Artificial Sequence
  chemically synthesized
taacgcagtgagtaatggtaca

SEQ ID NO: 791077 - DNA, 22 bp, Artificial Sequence
  chemically synthesized
aacgcagtgagtaatggtacaa

SEQ ID NO: 791078 - DNA, 22 bp, Artificial Sequence
  chemically synthesized
acgcagtgagtaatggtacaat

SEQ ID NO: 791079 - DNA, 22 bp, Artificial Sequence
  chemically synthesized
aaaaagagtttagttcctaaat

SEQ ID NO: 791080 - DNA, 22 bp, Artificial Sequence
  chemically synthesized
caaaaagagtttagttcctaaa

SEQ ID NO: 791081 - DNA, 22 bp, Artificial Sequence
  chemically synthesized
aaaggcagtttcaaaaagagtt

SEQ ID NO: 791082 - DNA, 22 bp, Artificial Sequence
  chemically synthesized
gaaaggcagtttcaaaaagagt

SEQ ID NO: 791083 - DNA, 22 bp, Artificial Sequence
  chemically synthesized
aggaactaaactctttttgaaa

SEQ ID NO: 791084 - DNA, 22 bp, Artificial Sequence
  chemically synthesized
ggaactaaactctttttgaaac

SEQ ID NO: 791085 - DNA, 22 bp, Artificial Sequence
  chemically synthesized
tcttgaaaggcagtttcaaaaa

SEQ ID NO: 791086 - DNA, 22 bp, Artificial Sequence
  chemically synthesized
aactctttttgaaactgccttt

SEQ ID NO: 791087 - DNA, 22 bp, Artificial Sequence
  chemically synthesized
caaactgtcttgaaaggcagtt

SEQ ID NO: 791088 - DNA, 22 bp, Artificial Sequence
  chemically synthesized
tttttgaaactgcctttcaaga

SEQ ID NO: 791089 - DNA, 22 bp, Artificial Sequence
  chemically synthesized
taattgcaaactgtcttgaaag

SEQ ID NO: 791090 - DNA, 22 bp, Artificial Sequence
  chemically synthesized
tttgaaactgcctttcaagaca

SEQ ID NO: 791091 - DNA, 22 bp, Artificial Sequence
  chemically synthesized
gtaattgcaaactgtcttgaaa

SEQ ID NO: 791092 - DNA, 22 bp, Artificial Sequence
  chemically synthesized
ttgaaactgcctttcaagacag

SEQ ID NO: 791093 - DNA, 22 bp, Artificial Sequence
  chemically synthesized
tgtaattgcaaactgtcttgaa

SEQ ID NO: 791094 - DNA, 22 bp, Artificial Sequence
  chemically synthesized
tgaaactgcctttcaagacagt

SEQ ID NO: 791095 - DNA, 22 bp, Artificial Sequence
  chemically synthesized
ttgtaattgcaaactgtcttga

SEQ ID NO: 791096 - DNA, 22 bp, Artificial Sequence
  chemically synthesized
gaaactgcctttcaagacagtt

SEQ ID NO: 791097 - DNA, 22 bp, Artificial Sequence
  chemically synthesized
aaactgcctttcaagacagttt

SEQ ID NO: 791098 - DNA, 22 bp, Artificial Sequence
  chemically synthesized
ttttgtaattgcaaactgtctt

SEQ ID NO: 791099 - DNA, 22 bp, Artificial Sequence
  chemically synthesized
cttttgtaattgcaaactgtct

SEQ ID NO: 791100 - DNA, 22 bp, Artificial Sequence
  chemically synthesized
cctttcaagacagtttgcaatt

SEQ ID NO: 791101 - DNA, 22 bp, Artificial Sequence
  chemically synthesized
tcaagacagtttgcaattacaa

SEQ ID NO: 791102 - DNA, 22 bp, Artificial Sequence
  chemically synthesized
caagacagtttgcaattacaaa

SEQ ID NO: 791103 - DNA, 22 bp, Artificial Sequence
  chemically synthesized
aagacagtttgcaattacaaaa

SEQ ID NO: 791104 - DNA, 22 bp, Artificial Sequence
  chemically synthesized
gcaattacaaaagaaatgttca

SEQ ID NO: 791105 - DNA, 22 bp, Artificial Sequence
  chemically synthesized
caattacaaaagaaatgttcat

SEQ ID NO: 791106 - DNA, 22 bp, Artificial Sequence
  chemically synthesized
caaaagaaatgttcatgggtat

SEQ ID NO: 791107 - DNA, 22 bp, Artificial Sequence
  chemically synthesized
aaataaaaaaagtagataccca

SEQ ID NO: 791108 - DNA, 22 bp, Artificial Sequence
  chemically synthesized
caaataaaaaaagtagataccc

SEQ ID NO: 791109 - DNA, 22 bp, Artificial Sequence
  chemically synthesized
tcaaataaaaaaagtagatacc

SEQ ID NO: 791110 - DNA, 22 bp, Artificial Sequence
  chemically synthesized
ttcaaataaaaaaagtagatac

SEQ ID NO: 791111 - DNA, 22 bp, Artificial Sequence
  chemically synthesized
atgggtatctactttttttatt

SEQ ID NO: 791112 - DNA, 22 bp, Artificial Sequence
  chemically synthesized
gatgcaatcaatttttcaaata

SEQ ID NO: 791113 - DNA, 22 bp, Artificial Sequence
  chemically synthesized
ctttttttatttgaaaaattga

SEQ ID NO: 791114 - DNA, 22 bp, Artificial Sequence
  chemically synthesized
tttttatttgaaaaattgattg

SEQ ID NO: 791115 - DNA, 22 bp, Artificial Sequence
  chemically synthesized
ttttatttgaaaaattgattgc

SEQ ID NO: 791116 - DNA, 22 bp, Artificial Sequence
  chemically synthesized
tttatttgaaaaattgattgca

SEQ ID NO: 791117 - DNA, 22 bp, Artificial Sequence
  chemically synthesized
ttatttgaaaaattgattgcat

SEQ ID NO: 791118 - DNA, 22 bp, Artificial Sequence
  chemically synthesized
tatttgaaaaattgattgcatc

SEQ ID NO: 791119 - DNA, 22 bp, Artificial Sequence
  chemically synthesized
atttgaaaaattgattgcatct

SEQ ID NO: 791120 - DNA, 22 bp, Artificial Sequence
  chemically synthesized
tttgaaaaattgattgcatcta

SEQ ID NO: 791121 - DNA, 22 bp, Artificial Sequence
  chemically synthesized
gaaaaattgattgcatctaggt

SEQ ID NO: 791122 - DNA, 22 bp, Artificial Sequence
  chemically synthesized
aaaaattgattgcatctaggtt

SEQ ID NO: 791123 - DNA, 22 bp, Artificial Sequence
  chemically synthesized
attgcatctaggtttaccattc

SEQ ID NO: 791124 - DNA, 22 bp, Artificial Sequence
  chemically synthesized
aacaaaatgcatgaatggtaaa

SEQ ID NO: 791125 - DNA, 22 bp, Artificial Sequence
  chemically synthesized
catctaggtttaccattcatgc

SEQ ID NO: 791126 - DNA, 22 bp, Artificial Sequence
  chemically synthesized
tgttgaacaaaatgcatgaatg

SEQ ID NO: 791127 - DNA, 22 bp, Artificial Sequence
  chemically synthesized
atgttgaacaaaatgcatgaat

SEQ ID NO: 791128 - DNA, 22 bp, Artificial Sequence
  chemically synthesized
tatgttgaacaaaatgcatgaa

SEQ ID NO: 791129 - DNA, 22 bp, Artificial Sequence
  chemically synthesized
ttatgttgaacaaaatgcatga

SEQ ID NO: 791130 - DNA, 22 bp, Artificial Sequence
  chemically synthesized
ggtttaccattcatgcattttg

SEQ ID NO: 791131 - DNA, 22 bp, Artificial Sequence
  chemically synthesized
accattcatgcattttgttcaa

SEQ ID NO: 791132 - DNA, 22 bp, Artificial Sequence
  chemically synthesized
ccattcatgcattttgttcaac

SEQ ID NO: 791133 - DNA, 22 bp, Artificial Sequence
  chemically synthesized
aaatatttttatgttgaacaaa

SEQ ID NO: 791134 - DNA, 22 bp, Artificial Sequence
  chemically synthesized
atgcattttgttcaacataaaa

SEQ ID NO: 791135 - DNA, 22 bp, Artificial Sequence
  chemically synthesized
tcagtctaaaatatttttatgt

SEQ ID NO: 791136 - DNA, 22 bp, Artificial Sequence
  chemically synthesized
gtcagtctaaaatatttttatg

SEQ ID NO: 791137 - DNA, 22 bp, Artificial Sequence
  chemically synthesized
tgtcagtctaaaatatttttat

SEQ ID NO: 791138 - DNA, 22 bp, Artificial Sequence
  chemically synthesized
ttgtcagtctaaaatattttta

SEQ ID NO: 791139 - DNA, 22 bp, Artificial Sequence
  chemically synthesized
tttgtcagtctaaaatattttt

SEQ ID NO: 791140 - DNA, 22 bp, Artificial Sequence
  chemically synthesized
tgttcaacataaaaatatttta

SEQ ID NO: 791141 - DNA, 22 bp, Artificial Sequence
  chemically synthesized
gttcaacataaaaatattttag

SEQ ID NO: 791142 - DNA, 22 bp, Artificial Sequence
  chemically synthesized
ttttttgtcagtctaaaatatt

SEQ ID NO: 791143 - DNA, 22 bp, Artificial Sequence
  chemically synthesized
ttcaacataaaaatattttaga

SEQ ID NO: 791144 - DNA, 22 bp, Artificial Sequence
  chemically synthesized
attttttgtcagtctaaaatat

SEQ ID NO: 791145 - DNA, 22 bp, Artificial Sequence
  chemically synthesized
aacataaaaatattttagactg

SEQ ID NO: 791146 - DNA, 22 bp, Artificial Sequence
  chemically synthesized
aaagtagaatttattttttgtc

SEQ ID NO: 791147 - DNA, 22 bp, Artificial Sequence
  chemically synthesized
gaaagtagaatttattttttgt

SEQ ID NO: 791148 - DNA, 22 bp, Artificial Sequence
  chemically synthesized
tgaaagtagaatttattttttg

SEQ ID NO: 791149 - DNA, 22 bp, Artificial Sequence
  chemically synthesized
tagactgacaaaaaataaattc

SEQ ID NO: 791150 - DNA, 22 bp, Artificial Sequence
  chemically synthesized
agactgacaaaaaataaattct

SEQ ID NO: 791151 - DNA, 22 bp, Artificial Sequence
  chemically synthesized
tattttgaaagtagaatttatt

SEQ ID NO: 791152 - DNA, 22 bp, Artificial Sequence
  chemically synthesized
gactgacaaaaaataaattcta

SEQ ID NO: 791153 - DNA, 22 bp, Artificial Sequence
  chemically synthesized
atattttgaaagtagaatttat

SEQ ID NO: 791154 - DNA, 22 bp, Artificial Sequence
  chemically synthesized
tatattttgaaagtagaattta

SEQ ID NO: 791155 - DNA, 22 bp, Artificial Sequence
  chemically synthesized
ttatattttgaaagtagaattt

SEQ ID NO: 791156 - DNA, 22 bp, Artificial Sequence
  chemically synthesized
acaaaaaataaattctactttc

SEQ ID NO: 791157 - DNA, 22 bp, Artificial Sequence
  chemically synthesized
aaggtatcaaatttttatattt

SEQ ID NO: 791158 - DNA, 22 bp, Artificial Sequence
  chemically synthesized
aaaggtatcaaatttttatatt

SEQ ID NO: 791159 - DNA, 22 bp, Artificial Sequence
  chemically synthesized
taaaggtatcaaatttttatat

SEQ ID NO: 791160 - DNA, 22 bp, Artificial Sequence
  chemically synthesized
tactttcaaaatataaaaattt

SEQ ID NO: 791161 - DNA, 22 bp, Artificial Sequence
  chemically synthesized
ctttcaaaatataaaaatttga

SEQ ID NO: 791162 - DNA, 22 bp, Artificial Sequence
  chemically synthesized
tcaaaatataaaaatttgatac

SEQ ID NO: 791163 - DNA, 22 bp, Artificial Sequence
  chemically synthesized
acatctttaaaggtatcaaatt

SEQ ID NO: 791164 - DNA, 22 bp, Artificial Sequence
  chemically synthesized
caaaatataaaaatttgatacc

SEQ ID NO: 791165 - DNA, 22 bp, Artificial Sequence
  chemically synthesized
aacatctttaaaggtatcaaat

SEQ ID NO: 791166 - DNA, 22 bp, Artificial Sequence
  chemically synthesized
aaaatataaaaatttgatacct

SEQ ID NO: 791167 - DNA, 22 bp, Artificial Sequence
  chemically synthesized
taacatctttaaaggtatcaaa

SEQ ID NO: 791168 - DNA, 22 bp, Artificial Sequence
  chemically synthesized
ttaacatctttaaaggtatcaa

SEQ ID NO: 791169 - DNA, 22 bp, Artificial Sequence
  chemically synthesized
tttaacatctttaaaggtatca

SEQ ID NO: 791170 - DNA, 22 bp, Artificial Sequence
  chemically synthesized
ttttaacatctttaaaggtatc

SEQ ID NO: 791171 - DNA, 22 bp, Artificial Sequence
  chemically synthesized
ttttttaacatctttaaaggta

SEQ ID NO: 791172 - DNA, 22 bp, Artificial Sequence
  chemically synthesized
cttttttaacatctttaaaggt

SEQ ID NO: 791173 - DNA, 22 bp, Artificial Sequence
  chemically synthesized
tcttttttaacatctttaaagg

SEQ ID NO: 791174 - DNA, 22 bp, Artificial Sequence
  chemically synthesized
ttcttttttaacatctttaaag

SEQ ID NO: 791175 - DNA, 22 bp, Artificial Sequence
  chemically synthesized
tttcttttttaacatctttaaa

SEQ ID NO: 791176 - DNA, 22 bp, Artificial Sequence
  chemically synthesized
gatacctttaaagatgttaaaa

SEQ ID NO: 791177 - DNA, 22 bp, Artificial Sequence
  chemically synthesized
tgtctttttcttttttaacatc

SEQ ID NO: 791178 - DNA, 22 bp, Artificial Sequence
  chemically synthesized
atacctttaaagatgttaaaaa

SEQ ID NO: 791179 - DNA, 22 bp, Artificial Sequence
  chemically synthesized
tgtgtctttttcttttttaaca

SEQ ID NO: 791180 - DNA, 22 bp, Artificial Sequence
  chemically synthesized
ttctgtgtctttttctttttta

SEQ ID NO: 791181 - DNA, 22 bp, Artificial Sequence
  chemically synthesized
taaagatgttaaaaaagaaaaa

SEQ ID NO: 791182 - DNA, 22 bp, Artificial Sequence
  chemically synthesized
ctattctgtgtctttttctttt

SEQ ID NO: 791183 - DNA, 22 bp, Artificial Sequence
  chemically synthesized
aaagatgttaaaaaagaaaaag

SEQ ID NO: 791184 - DNA, 22 bp, Artificial Sequence
  chemically synthesized
aagatgttaaaaaagaaaaaga

SEQ ID NO: 791185 - DNA, 22 bp, Artificial Sequence
  chemically synthesized
ttactattctgtgtctttttct

SEQ ID NO: 791186 - DNA, 22 bp, Artificial Sequence
  chemically synthesized
ttgttactattctgtgtctttt

SEQ ID NO: 791187 - DNA, 22 bp, Artificial Sequence
  chemically synthesized
aaaaagaaaaagacacagaata

SEQ ID NO: 791188 - DNA, 22 bp, Artificial Sequence
  chemically synthesized
cgttgttgttactattctgtgt

SEQ ID NO: 791189 - DNA, 22 bp, Artificial Sequence
  chemically synthesized
ctacgttgttgttactattctg

SEQ ID NO: 791190 - DNA, 22 bp, Artificial Sequence
  chemically synthesized
ttcctacgttgttgttactatt

SEQ ID NO: 791191 - DNA, 22 bp, Artificial Sequence
  chemically synthesized
tacaattattcctacgttgttg

SEQ ID NO: 791192 - DNA, 22 bp, Artificial Sequence
  chemically synthesized
ggagcctatacaattattccta

SEQ ID NO: 791193 - DNA, 22 bp, Artificial Sequence
  chemically synthesized
aggagcctatacaattattcct

SEQ ID NO: 791194 - DNA, 22 bp, Artificial Sequence
  chemically synthesized
atggtcaccttaggagcctata

SEQ ID NO: 791195 - DNA, 22 bp, Artificial Sequence
  chemically synthesized
aatggtcaccttaggagcctat

SEQ ID NO: 791196 - DNA, 22 bp, Artificial Sequence
  chemically synthesized
ttaatggtcaccttaggagcct

SEQ ID NO: 791197 - DNA, 22 bp, Artificial Sequence
  chemically synthesized
gaattcttaatggtcaccttag

SEQ ID NO: 791198 - DNA, 22 bp, Artificial Sequence
  chemically synthesized
tataggctcctaaggtgaccat

SEQ ID NO: 791199 - DNA, 22 bp, Artificial Sequence
  chemically synthesized
taagttagaattcttaatggtc

SEQ ID NO: 791200 - DNA, 22 bp, Artificial Sequence
  chemically synthesized
ctaaggtgaccattaagaattc

SEQ ID NO: 791201 - DNA, 22 bp, Artificial Sequence
  chemically synthesized
atacctgtaagttagaattctt

SEQ ID NO: 791202 - DNA, 22 bp, Artificial Sequence
  chemically synthesized
aggtgaccattaagaattctaa

SEQ ID NO: 791203 - DNA, 22 bp, Artificial Sequence
  chemically synthesized
aatacctgtaagttagaattct

SEQ ID NO: 791204 - DNA, 22 bp, Artificial Sequence
  chemically synthesized
agaattctaacttacaggtatt

SEQ ID NO: 791205 - DNA, 22 bp, Artificial Sequence
  chemically synthesized
aataaaaaacttaatacctgta

SEQ ID NO: 791206 - DNA, 22 bp, Artificial Sequence
  chemically synthesized
aaataaaaaacttaatacctgt

SEQ ID NO: 791207 - DNA, 22 bp, Artificial Sequence
  chemically synthesized
taaataaaaaacttaatacctg

SEQ ID NO: 791208 - DNA, 22 bp, Artificial Sequence
  chemically synthesized
ttaaataaaaaacttaatacct

SEQ ID NO: 791209 - DNA, 22 bp, Artificial Sequence
  chemically synthesized
tttaaataaaaaacttaatacc

SEQ ID NO: 791210 - DNA, 22 bp, Artificial Sequence
  chemically synthesized
ttttaaataaaaaacttaatac

SEQ ID NO: 791211 - DNA, 22 bp, Artificial Sequence
  chemically synthesized
taacttacaggtattaagtttt

SEQ ID NO: 791212 - DNA, 22 bp, Artificial Sequence
  chemically synthesized
acttacaggtattaagtttttt

SEQ ID NO: 791213 - DNA, 22 bp, Artificial Sequence
  chemically synthesized
atttttttaaataaaaaactta

SEQ ID NO: 791214 - DNA, 22 bp, Artificial Sequence
  chemically synthesized
acaggtattaagttttttattt

SEQ ID NO: 791215 - DNA, 22 bp, Artificial Sequence
  chemically synthesized
caggtattaagttttttattta

SEQ ID NO: 791216 - DNA, 22 bp, Artificial Sequence
  chemically synthesized
gaacaactgatttttttaaata

SEQ ID NO: 791217 - DNA, 22 bp, Artificial Sequence
  chemically synthesized
cgaacaactgatttttttaaat

SEQ ID NO: 791218 - DNA, 22 bp, Artificial Sequence
  chemically synthesized
cttcgaacaactgattttttta

SEQ ID NO: 791219 - DNA, 22 bp, Artificial Sequence
  chemically synthesized
agttttttatttaaaaaaatca

SEQ ID NO: 791220 - DNA, 22 bp, Artificial Sequence
  chemically synthesized
ccttcgaacaactgattttttt

SEQ ID NO: 791221 - DNA, 22 bp, Artificial Sequence
  chemically synthesized
tttatttaaaaaaatcagttgt

SEQ ID NO: 791222 - DNA, 22 bp, Artificial Sequence
  chemically synthesized
tgtttccttcgaacaactgatt

SEQ ID NO: 791223 - DNA, 22 bp, Artificial Sequence
  chemically synthesized
ttatttaaaaaaatcagttgtt

SEQ ID NO: 791224 - DNA, 22 bp, Artificial Sequence
  chemically synthesized
tatttaaaaaaatcagttgttc

SEQ ID NO: 791225 - DNA, 22 bp, Artificial Sequence
  chemically synthesized
atttaaaaaaatcagttgttcg

SEQ ID NO: 791226 - DNA, 22 bp, Artificial Sequence
  chemically synthesized
tttaaaaaaatcagttgttcga

SEQ ID NO: 791227 - DNA, 22 bp, Artificial Sequence
  chemically synthesized
aaattgtgtttccttcgaacaa

SEQ ID NO: 791228 - DNA, 22 bp, Artificial Sequence
  chemically synthesized
aaaaaaatcagttgttcgaagg

SEQ ID NO: 791229 - DNA, 22 bp, Artificial Sequence
  chemically synthesized
aaaaaatcagttgttcgaagga

SEQ ID NO: 791230 - DNA, 22 bp, Artificial Sequence
  chemically synthesized
attgaaattgtgtttccttcga

SEQ ID NO: 791231 - DNA, 22 bp, Artificial Sequence
  chemically synthesized
tctaattgaaattgtgtttcct

SEQ ID NO: 791232 - DNA, 22 bp, Artificial Sequence
  chemically synthesized
ctgtctaattgaaattgtgttt

SEQ ID NO: 791233 - DNA, 22 bp, Artificial Sequence
  chemically synthesized
ctcctgtctaattgaaattgtg

SEQ ID NO: 791234 - DNA, 22 bp, Artificial Sequence
  chemically synthesized
ttcgaaggaaacacaatttcaa

SEQ ID NO: 791235 - DNA, 22 bp, Artificial Sequence
  chemically synthesized
gaaggaaacacaatttcaatta

SEQ ID NO: 791236 - DNA, 22 bp, Artificial Sequence
  chemically synthesized
aacatactcctcctgtctaatt

SEQ ID NO: 791237 - DNA, 22 bp, Artificial Sequence
  chemically synthesized
gaacatactcctcctgtctaat

SEQ ID NO: 791238 - DNA, 22 bp, Artificial Sequence
  chemically synthesized
ttgaacatactcctcctgtcta

SEQ ID NO: 791239 - DNA, 22 bp, Artificial Sequence
  chemically synthesized
caattagacaggaggagtatgt

SEQ ID NO: 791240 - DNA, 22 bp, Artificial Sequence
  chemically synthesized
aattagacaggaggagtatgtt

SEQ ID NO: 791241 - DNA, 22 bp, Artificial Sequence
  chemically synthesized
tacaataggtctcttgaacata

SEQ ID NO: 791242 - DNA, 22 bp, Artificial Sequence
  chemically synthesized
gacaggaggagtatgttcaaga

SEQ ID NO: 791243 - DNA, 22 bp, Artificial Sequence
  chemically synthesized
tagtatccatgttgtacaatag

SEQ ID NO: 791244 - DNA, 22 bp, Artificial Sequence
  chemically synthesized
actatagtatccatgttgtaca

SEQ ID NO: 791245 - DNA, 22 bp, Artificial Sequence
  chemically synthesized
aagagacctattgtacaacatg

SEQ ID NO: 791246 - DNA, 22 bp, Artificial Sequence
  chemically synthesized
ttaactatagtatccatgttgt

SEQ ID NO: 791247 - DNA, 22 bp, Artificial Sequence
  chemically synthesized
ctgttaactatagtatccatgt

SEQ ID NO: 791248 - DNA, 22 bp, Artificial Sequence
  chemically synthesized
ttgtacaacatggatactatag

SEQ ID NO: 791249 - DNA, 22 bp, Artificial Sequence
  chemically synthesized
tacaacatggatactatagtta

SEQ ID NO: 791250 - DNA, 22 bp, Artificial Sequence
  chemically synthesized
tagttaacagcaatgtattata

SEQ ID NO: 791251 - DNA, 22 bp, Artificial Sequence
  chemically synthesized
gcaagtatcaagtatataatac

SEQ ID NO: 791252 - DNA, 22 bp, Artificial Sequence
  chemically synthesized
agcaagtatcaagtatataata

SEQ ID NO: 791253 - DNA, 22 bp, Artificial Sequence
  chemically synthesized
ttagcaagtatcaagtatataa

SEQ ID NO: 791254 - DNA, 22 bp, Artificial Sequence
  chemically synthesized
acagcaatgtattatatacttg

SEQ ID NO: 791255 - DNA, 22 bp, Artificial Sequence
  chemically synthesized
gagtatactcttagcaagtatc

SEQ ID NO: 791256 - DNA, 22 bp, Artificial Sequence
  chemically synthesized
agagtatactcttagcaagtat

SEQ ID NO: 791257 - DNA, 22 bp, Artificial Sequence
  chemically synthesized
tatacttgatacttgctaagag

SEQ ID NO: 791258 - DNA, 22 bp, Artificial Sequence
  chemically synthesized
gatacttgctaagagtatactc

SEQ ID NO: 791259 - DNA, 22 bp, Artificial Sequence
  chemically synthesized
atacttgctaagagtatactct

SEQ ID NO: 791260 - DNA, 22 bp, Artificial Sequence
  chemically synthesized
tggtgagaacacttagagtata

SEQ ID NO: 791261 - DNA, 22 bp, Artificial Sequence
  chemically synthesized
gtggtgagaacacttagagtat

SEQ ID NO: 791262 - DNA, 22 bp, Artificial Sequence
  chemically synthesized
gctaagagtatactctaagtgt

SEQ ID NO: 791263 - DNA, 22 bp, Artificial Sequence
  chemically synthesized
tttgtggtgagaacacttagag

SEQ ID NO: 791264 - DNA, 22 bp, Artificial Sequence
  chemically synthesized
ctaagagtatactctaagtgtt

SEQ ID NO: 791265 - DNA, 22 bp, Artificial Sequence
  chemically synthesized
atttgtggtgagaacacttaga

SEQ ID NO: 791266 - DNA, 22 bp, Artificial Sequence
  chemically synthesized
tatttgtggtgagaacacttag

SEQ ID NO: 791267 - DNA, 22 bp, Artificial Sequence
  chemically synthesized
agagtatactctaagtgttctc

SEQ ID NO: 791268 - DNA, 22 bp, Artificial Sequence
  chemically synthesized
acatacactttatttgtggtga

SEQ ID NO: 791269 - DNA, 22 bp, Artificial Sequence
  chemically synthesized
taagtgttctcaccacaaataa

SEQ ID NO: 791270 - DNA, 22 bp, Artificial Sequence
  chemically synthesized
cctcacatacactttatttgtg

SEQ ID NO: 791271 - DNA, 22 bp, Artificial Sequence
  chemically synthesized
agtgttctcaccacaaataaag

SEQ ID NO: 791272 - DNA, 22 bp, Artificial Sequence
  chemically synthesized
tcaccacaaataaagtgtatgt

SEQ ID NO: 791273 - DNA, 22 bp, Artificial Sequence
  chemically synthesized
accacaaataaagtgtatgtga

SEQ ID NO: 791274 - DNA, 22 bp, Artificial Sequence
  chemically synthesized
tcgtatgcattacctcacatac

SEQ ID NO: 791275 - DNA, 22 bp, Artificial Sequence
  chemically synthesized
aatcaagccaattatcgtatgc

SEQ ID NO: 791276 - DNA, 22 bp, Artificial Sequence
  chemically synthesized
tggaatggctaaatcaagccaa

SEQ ID NO: 791277 - DNA, 22 bp, Artificial Sequence
  chemically synthesized
gcttgatttagccattccacaa

SEQ ID NO: 791278 - DNA, 22 bp, Artificial Sequence
  chemically synthesized
atatacccatacattgtggaat

SEQ ID NO: 791279 - DNA, 22 bp, Artificial Sequence
  chemically synthesized
gatatacccatacattgtggaa

SEQ ID NO: 791280 - DNA, 22 bp, Artificial Sequence
  chemically synthesized
tgatatacccatacattgtgga

SEQ ID NO: 791281 - DNA, 22 bp, Artificial Sequence
  chemically synthesized
gatttagccattccacaatgta

SEQ ID NO: 791282 - DNA, 22 bp, Artificial Sequence
  chemically synthesized
atttagccattccacaatgtat

SEQ ID NO: 791283 - DNA, 22 bp, Artificial Sequence
  chemically synthesized
agccattccacaatgtatgggt

SEQ ID NO: 791284 - DNA, 22 bp, Artificial Sequence
  chemically synthesized
gccattccacaatgtatgggta

SEQ ID NO: 791285 - DNA, 22 bp, Artificial Sequence
  chemically synthesized
cacaatgtatgggtatatcaaa

SEQ ID NO: 791286 - DNA, 22 bp, Artificial Sequence
  chemically synthesized
atggtgtacaacatgatgtttt

SEQ ID NO: 791287 - DNA, 22 bp, Artificial Sequence
  chemically synthesized
tatatattcatggtgtacaaca

SEQ ID NO: 791288 - DNA, 22 bp, Artificial Sequence
  chemically synthesized
ataaaggttgtatatattcatg

SEQ ID NO: 791289 - DNA, 22 bp, Artificial Sequence
  chemically synthesized
aattgataaaggttgtatatat

SEQ ID NO: 791290 - DNA, 22 bp, Artificial Sequence
  chemically synthesized
aaattgataaaggttgtatata

SEQ ID NO: 791291 - DNA, 22 bp, Artificial Sequence
  chemically synthesized
tacaccatgaatatatacaacc

SEQ ID NO: 791292 - DNA, 22 bp, Artificial Sequence
  chemically synthesized
tttaaattgataaaggttgtat

SEQ ID NO: 791293 - DNA, 22 bp, Artificial Sequence
  chemically synthesized
gtttaaattgataaaggttgta

SEQ ID NO: 791294 - DNA, 22 bp, Artificial Sequence
  chemically synthesized
tcttgtttaaattgataaaggt

SEQ ID NO: 791295 - DNA, 22 bp, Artificial Sequence
  chemically synthesized
attatcttgtttaaattgataa

SEQ ID NO: 791296 - DNA, 22 bp, Artificial Sequence
  chemically synthesized
aattatcttgtttaaattgata

SEQ ID NO: 791297 - DNA, 22 bp, Artificial Sequence
  chemically synthesized
taattatcttgtttaaattgat

SEQ ID NO: 791298 - DNA, 22 bp, Artificial Sequence
  chemically synthesized
ttaattatcttgtttaaattga

SEQ ID NO: 791299 - DNA, 22 bp, Artificial Sequence
  chemically synthesized
atttttaattatcttgtttaaa

SEQ ID NO: 791300 - DNA, 22 bp, Artificial Sequence
  chemically synthesized
tatcaatttaaacaagataatt

SEQ ID NO: 791301 - DNA, 22 bp, Artificial Sequence
  chemically synthesized
atcaatttaaacaagataatta

SEQ ID NO: 791302 - DNA, 22 bp, Artificial Sequence
  chemically synthesized
tcaatttaaacaagataattaa

SEQ ID NO: 791303 - DNA, 22 bp, Artificial Sequence
  chemically synthesized
agtaatacaactgatttttaat

SEQ ID NO: 791304 - DNA, 22 bp, Artificial Sequence
  chemically synthesized
aagtaatacaactgatttttaa

SEQ ID NO: 791305 - DNA, 22 bp, Artificial Sequence
  chemically synthesized
aaacaagataattaaaaatcag

SEQ ID NO: 791306 - DNA, 22 bp, Artificial Sequence
  chemically synthesized
aacaagataattaaaaatcagt

SEQ ID NO: 791307 - DNA, 22 bp, Artificial Sequence
  chemically synthesized
acaagcaacttaagtaatacaa

SEQ ID NO: 791308 - DNA, 22 bp, Artificial Sequence
  chemically synthesized
aacaagcaacttaagtaataca

SEQ ID NO: 791309 - DNA, 22 bp, Artificial Sequence
  chemically synthesized
taacaagcaacttaagtaatac

SEQ ID NO: 791310 - DNA, 22 bp, Artificial Sequence
  chemically synthesized
aaaatcagttgtattacttaag

SEQ ID NO: 791311 - DNA, 22 bp, Artificial Sequence
  chemically synthesized
tattacttaagttgcttgttaa

SEQ ID NO: 791312 - DNA, 22 bp, Artificial Sequence
  chemically synthesized
cttaagttgcttgttaaaatat

SEQ ID NO: 791313 - DNA, 22 bp, Artificial Sequence
  chemically synthesized
cagtaacagatacatattttaa

SEQ ID NO: 791314 - DNA, 22 bp, Artificial Sequence
  chemically synthesized
aagttgcttgttaaaatatgta

SEQ ID NO: 791315 - DNA, 22 bp, Artificial Sequence
  chemically synthesized
agttgcttgttaaaatatgtat

SEQ ID NO: 791316 - DNA, 22 bp, Artificial Sequence
  chemically synthesized
attacagtaacagatacatatt

SEQ ID NO: 791317 - DNA, 22 bp, Artificial Sequence
  chemically synthesized
cttgttaaaatatgtatctgtt

SEQ ID NO: 791318 - DNA, 22 bp, Artificial Sequence
  chemically synthesized
tattgattacagtaacagatac

SEQ ID NO: 791319 - DNA, 22 bp, Artificial Sequence
  chemically synthesized
gtattgattacagtaacagata

SEQ ID NO: 791320 - DNA, 22 bp, Artificial Sequence
  chemically synthesized
gttaaaatatgtatctgttact

SEQ ID NO: 791321 - DNA, 22 bp, Artificial Sequence
  chemically synthesized
ttaaaatatgtatctgttactg

SEQ ID NO: 791322 - DNA, 22 bp, Artificial Sequence
  chemically synthesized
tttgtattgattacagtaacag

SEQ ID NO: 791323 - DNA, 22 bp, Artificial Sequence
  chemically synthesized
aaatatgtatctgttactgtaa

SEQ ID NO: 791324 - DNA, 22 bp, Artificial Sequence
  chemically synthesized
ataattatttgtattgattaca

SEQ ID NO: 791325 - DNA, 22 bp, Artificial Sequence
  chemically synthesized
cataattatttgtattgattac

SEQ ID NO: 791326 - DNA, 22 bp, Artificial Sequence
  chemically synthesized
cttcataattatttgtattgat

SEQ ID NO: 791327 - DNA, 22 bp, Artificial Sequence
  chemically synthesized
ttactgtaatcaatacaaataa

SEQ ID NO: 791328 - DNA, 22 bp, Artificial Sequence
  chemically synthesized
ctgtaatcaatacaaataatta

SEQ ID NO: 791329 - DNA, 22 bp, Artificial Sequence
  chemically synthesized
taatcaatacaaataattatga

SEQ ID NO: 791330 - DNA, 22 bp, Artificial Sequence
  chemically synthesized
ccagcatgcatgaactgcttca

SEQ ID NO: 791331 - DNA, 22 bp, Artificial Sequence
  chemically synthesized
gccagcatgcatgaactgcttc

SEQ ID NO: 791332 - DNA, 22 bp, Artificial Sequence
  chemically synthesized
tgccagcatgcatgaactgctt

SEQ ID NO: 791333 - DNA, 22 bp, Artificial Sequence
  chemically synthesized
gctttgccagcatgcatgaact

SEQ ID NO: 791334 - DNA, 22 bp, Artificial Sequence
  chemically synthesized
actggctttgccagcatgcatg

SEQ ID NO: 791335 - DNA, 22 bp, Artificial Sequence
  chemically synthesized
gactggctttgccagcatgcat

SEQ ID NO: 791336 - DNA, 22 bp, Artificial Sequence
  chemically synthesized
tgaagcagttcatgcatgctgg

SEQ ID NO: 791337 - DNA, 22 bp, Artificial Sequence
  chemically synthesized
cgaatggcttgactggctttgc

SEQ ID NO: 791338 - DNA, 22 bp, Artificial Sequence
  chemically synthesized
acgaatggcttgactggctttg

SEQ ID NO: 791339 - DNA, 22 bp, Artificial Sequence
  chemically synthesized
atgcatgctggcaaagccagtc

SEQ ID NO: 791340 - DNA, 22 bp, Artificial Sequence
  chemically synthesized
gcaaagccagtcaagccattcg

SEQ ID NO: 791341 - DNA, 22 bp, Artificial Sequence
  chemically synthesized
ccaacgagaggcacttacgaat

SEQ ID NO: 791342 - DNA, 22 bp, Artificial Sequence
  chemically synthesized
actgccaacgagaggcacttac

SEQ ID NO: 791343 - DNA, 22 bp, Artificial Sequence
  chemically synthesized
gtaagtgcctctcgttggcagt

SEQ ID NO: 791344 - DNA, 22 bp, Artificial Sequence
  chemically synthesized
tcgttggcagtgaatgtatttt

SEQ ID NO: 791345 - DNA, 22 bp, Artificial Sequence
  chemically synthesized
gttggcagtgaatgtatttttt

SEQ ID NO: 791346 - DNA, 22 bp, Artificial Sequence
  chemically synthesized
ggaggccaaggaaaaaaaatac

SEQ ID NO: 791347 - DNA, 22 bp, Artificial Sequence
  chemically synthesized
aggaggccaaggaaaaaaaata

SEQ ID NO: 791348 - DNA, 22 bp, Artificial Sequence
  chemically synthesized
gcagtgaatgtattttttttcc

SEQ ID NO: 791349 - DNA, 22 bp, Artificial Sequence
  chemically synthesized
tttttccttggcctcctaaggc

SEQ ID NO: 791350 - DNA, 22 bp, Artificial Sequence
  chemically synthesized
ttttccttggcctcctaaggcc

SEQ ID NO: 791351 - DNA, 22 bp, Artificial Sequence
  chemically synthesized
tttccttggcctcctaaggccc

SEQ ID NO: 791352 - DNA, 22 bp, Artificial Sequence
  chemically synthesized
ttccttggcctcctaaggccct

SEQ ID NO: 791353 - DNA, 22 bp, Artificial Sequence
  chemically synthesized
tccttggcctcctaaggccctt

SEQ ID NO: 791354 - DNA, 22 bp, Artificial Sequence
  chemically synthesized
ccttggcctcctaaggccctta

SEQ ID NO: 791355 - DNA, 22 bp, Artificial Sequence
  chemically synthesized
cttggcctcctaaggcccttat

SEQ ID NO: 791356 - DNA, 22 bp, Artificial Sequence
  chemically synthesized
acccagaaaaagtcataagggc

SEQ ID NO: 791357 - DNA, 22 bp, Artificial Sequence
  chemically synthesized
ggcctcctaaggcccttatgac

SEQ ID NO: 791358 - DNA, 22 bp, Artificial Sequence
  chemically synthesized
gcctcctaaggcccttatgact

SEQ ID NO: 791359 - DNA, 22 bp, Artificial Sequence
  chemically synthesized
ctaaggcccttatgactttttc

SEQ ID NO: 791360 - DNA, 22 bp, Artificial Sequence
  chemically synthesized
acaaagctgacccagaaaaagt

SEQ ID NO: 791361 - DNA, 22 bp, Artificial Sequence
  chemically synthesized
aggcccttatgactttttctgg

SEQ ID NO: 791362 - DNA, 22 bp, Artificial Sequence
  chemically synthesized
atgactttttctgggtcagctt

SEQ ID NO: 791363 - DNA, 22 bp, Artificial Sequence
  chemically synthesized
tgactttttctgggtcagcttt

SEQ ID NO: 791364 - DNA, 22 bp, Artificial Sequence
  chemically synthesized
agtgagaggagttaacaaagct

SEQ ID NO: 791365 - DNA, 22 bp, Artificial Sequence
  chemically synthesized
tttctgggtcagctttgttaac

SEQ ID NO: 791366 - DNA, 22 bp, Artificial Sequence
  chemically synthesized
ttctgggtcagctttgttaact

SEQ ID NO: 791367 - DNA, 22 bp, Artificial Sequence
  chemically synthesized
tctgggtcagctttgttaactc

SEQ ID NO: 791368 - DNA, 22 bp, Artificial Sequence
  chemically synthesized
ctgggtcagctttgttaactcc

SEQ ID NO: 791369 - DNA, 22 bp, Artificial Sequence
  chemically synthesized
tgggtcagctttgttaactcct

SEQ ID NO: 791370 - DNA, 22 bp, Artificial Sequence
  chemically synthesized
ggtcagctttgttaactcctct

SEQ ID NO: 791371 - DNA, 22 bp, Artificial Sequence
  chemically synthesized
agaatggagctaagtgagagga

SEQ ID NO: 791372 - DNA, 22 bp, Artificial Sequence
  chemically synthesized
tgttaactcctctcacttagct

SEQ ID NO: 791373 - DNA, 22 bp, Artificial Sequence
  chemically synthesized
gttaactcctctcacttagctc

SEQ ID NO: 791374 - DNA, 22 bp, Artificial Sequence
  chemically synthesized
ttaactcctctcacttagctcc

SEQ ID NO: 791375 - DNA, 22 bp, Artificial Sequence
  chemically synthesized
accattgagaatggagctaagt

SEQ ID NO: 791376 - DNA, 22 bp, Artificial Sequence
  chemically synthesized
actcctctcacttagctccatt

SEQ ID NO: 791377 - DNA, 22 bp, Artificial Sequence
  chemically synthesized
gctgaccattgagaatggagct

SEQ ID NO: 791378 - DNA, 22 bp, Artificial Sequence
  chemically synthesized
ctctcacttagctccattctca

SEQ ID NO: 791379 - DNA, 22 bp, Artificial Sequence
  chemically synthesized
tcacttagctccattctcaatg

SEQ ID NO: 791380 - DNA, 22 bp, Artificial Sequence
  chemically synthesized
acttagctccattctcaatggt

SEQ ID NO: 791381 - DNA, 22 bp, Artificial Sequence
  chemically synthesized
agctccattctcaatggtcagc

SEQ ID NO: 791382 - DNA, 22 bp, Artificial Sequence
  chemically synthesized
atcccaagcctcgctgaccatt

SEQ ID NO: 791383 - DNA, 22 bp, Artificial Sequence
  chemically synthesized
gctccattctcaatggtcagcg

SEQ ID NO: 791384 - DNA, 22 bp, Artificial Sequence
  chemically synthesized
cattctcaatggtcagcgaggc

SEQ ID NO: 791385 - DNA, 22 bp, Artificial Sequence
  chemically synthesized
tcaatggtcagcgaggcttggg

SEQ ID NO: 791386 - DNA, 22 bp, Artificial Sequence
  chemically synthesized
aatggtcagcgaggcttgggat

SEQ ID NO: 791387 - DNA, 22 bp, Artificial Sequence
  chemically synthesized
gggattagtcattttcactttt

SEQ ID NO: 791388 - DNA, 22 bp, Artificial Sequence
  chemically synthesized
ggattagtcattttcacttttc

SEQ ID NO: 791389 - DNA, 22 bp, Artificial Sequence
  chemically synthesized
gtcattttcacttttcttggta

SEQ ID NO: 791390 - DNA, 22 bp, Artificial Sequence
  chemically synthesized
tcacttttcttggtacatggac

SEQ ID NO: 791391 - DNA, 22 bp, Artificial Sequence
  chemically synthesized
cacttttcttggtacatggacc

SEQ ID NO: 791392 - DNA, 22 bp, Artificial Sequence
  chemically synthesized
acttttcttggtacatggacct

SEQ ID NO: 791393 - DNA, 22 bp, Artificial Sequence
  chemically synthesized
ttcttggtacatggacctctct

SEQ ID NO: 791394 - DNA, 22 bp, Artificial Sequence
  chemically synthesized
tcttggtacatggacctctctc

SEQ ID NO: 791395 - DNA, 22 bp, Artificial Sequence
  chemically synthesized
agagtacggggggagagaggtc

SEQ ID NO: 791396 - DNA, 22 bp, Artificial Sequence
  chemically synthesized
cttggtacatggacctctctcc

SEQ ID NO: 791397 - DNA, 22 bp, Artificial Sequence
  chemically synthesized
ttggtacatggacctctctccc

SEQ ID NO: 791398 - DNA, 22 bp, Artificial Sequence
  chemically synthesized
ggtacatggacctctctccccc

SEQ ID NO: 791399 - DNA, 22 bp, Artificial Sequence
  chemically synthesized
gtacatggacctctctcccccc

SEQ ID NO: 791400 - DNA, 22 bp, Artificial Sequence
  chemically synthesized
aaatactgagagtacgggggga

SEQ ID NO: 791401 - DNA, 22 bp, Artificial Sequence
  chemically synthesized
tctccccccgtactctcagtat

SEQ ID NO: 791402 - DNA, 22 bp, Artificial Sequence
  chemically synthesized
tccccccgtactctcagtattt

SEQ ID NO: 791403 - DNA, 22 bp, Artificial Sequence
  chemically synthesized
cccccgtactctcagtatttca

SEQ ID NO: 791404 - DNA, 22 bp, Artificial Sequence
  chemically synthesized
cagtcaaatgataattgaaata

SEQ ID NO: 791405 - DNA, 22 bp, Artificial Sequence
  chemically synthesized
tctacagtcaaatgataattga

SEQ ID NO: 791406 - DNA, 22 bp, Artificial Sequence
  chemically synthesized
atctacagtcaaatgataattg

SEQ ID NO: 791407 - DNA, 22 bp, Artificial Sequence
  chemically synthesized
tcagtatttcaattatcatttg

SEQ ID NO: 791408 - DNA, 22 bp, Artificial Sequence
  chemically synthesized
agtatttcaattatcatttgac

SEQ ID NO: 791409 - DNA, 22 bp, Artificial Sequence
  chemically synthesized
ggagcttatctacagtcaaatg

SEQ ID NO: 791410 - DNA, 22 bp, Artificial Sequence
  chemically synthesized
gggagcttatctacagtcaaat

SEQ ID NO: 791411 - DNA, 22 bp, Artificial Sequence
  chemically synthesized
caattatcatttgactgtagat

SEQ ID NO: 791412 - DNA, 22 bp, Artificial Sequence
  chemically synthesized
aattatcatttgactgtagata

SEQ ID NO: 791413 - DNA, 22 bp, Artificial Sequence
  chemically synthesized
tcatttgactgtagataagctc

SEQ ID NO: 791414 - DNA, 22 bp, Artificial Sequence
  chemically synthesized
aaataaagatttgggagcttat

SEQ ID NO: 791415 - DNA, 22 bp, Artificial Sequence
  chemically synthesized
gactgtagataagctcccaaat

SEQ ID NO: 791416 - DNA, 22 bp, Artificial Sequence
  chemically synthesized
actgtagataagctcccaaatc

SEQ ID NO: 791417 - DNA, 22 bp, Artificial Sequence
  chemically synthesized
agctgaaataaagatttgggag

SEQ ID NO: 791418 - DNA, 22 bp, Artificial Sequence
  chemically synthesized
tagataagctcccaaatcttta

SEQ ID NO: 791419 - DNA, 22 bp, Artificial Sequence
  chemically synthesized
aggatagaatattaagctgaaa

SEQ ID NO: 791420 - DNA, 22 bp, Artificial Sequence
  chemically synthesized
ccaaatctttatttcagcttaa

SEQ ID NO: 791421 - DNA, 22 bp, Artificial Sequence
  chemically synthesized
aaattcaggatagaatattaag

SEQ ID NO: 791422 - DNA, 22 bp, Artificial Sequence
  chemically synthesized
tatttcagcttaatattctatc

SEQ ID NO: 791423 - DNA, 22 bp, Artificial Sequence
  chemically synthesized
atttcagcttaatattctatcc

SEQ ID NO: 791424 - DNA, 22 bp, Artificial Sequence
  chemically synthesized
tttcagcttaatattctatcct

SEQ ID NO: 791425 - DNA, 22 bp, Artificial Sequence
  chemically synthesized
cagcttaatattctatcctgaa

SEQ ID NO: 791426 - DNA, 22 bp, Artificial Sequence
  chemically synthesized
agcttaatattctatcctgaat

SEQ ID NO: 791427 - DNA, 22 bp, Artificial Sequence
  chemically synthesized
tgtgagtctgaaattcaggata

SEQ ID NO: 791428 - DNA, 22 bp, Artificial Sequence
  chemically synthesized
gctgtgtgagtctgaaattcag

SEQ ID NO: 791429 - DNA, 22 bp, Artificial Sequence
  chemically synthesized
aatattctatcctgaatttcag

SEQ ID NO: 791430 - DNA, 22 bp, Artificial Sequence
  chemically synthesized
atattctatcctgaatttcaga

SEQ ID NO: 791431 - DNA, 22 bp, Artificial Sequence
  chemically synthesized
tatcctgaatttcagactcaca

SEQ ID NO: 791432 - DNA, 22 bp, Artificial Sequence
  chemically synthesized
ggcagttggctgtgtgagtctg

SEQ ID NO: 791433 - DNA, 22 bp, Artificial Sequence
  chemically synthesized
gggcagttggctgtgtgagtct

SEQ ID NO: 791434 - DNA, 22 bp, Artificial Sequence
  chemically synthesized
tcctgaatttcagactcacaca

SEQ ID NO: 791435 - DNA, 22 bp, Artificial Sequence
  chemically synthesized
ttgggcagttggctgtgtgagt

SEQ ID NO: 791436 - DNA, 22 bp, Artificial Sequence
  chemically synthesized
aatttcagactcacacagccaa

SEQ ID NO: 791437 - DNA, 22 bp, Artificial Sequence
  chemically synthesized
cagactcacacagccaactgcc

SEQ ID NO: 791438 - DNA, 22 bp, Artificial Sequence
  chemically synthesized
agactcacacagccaactgccc

SEQ ID NO: 791439 - DNA, 22 bp, Artificial Sequence
  chemically synthesized
agggaatattcttgggcagttg

SEQ ID NO: 791440 - DNA, 22 bp, Artificial Sequence
  chemically synthesized
acacagccaactgcccaagaat

SEQ ID NO: 791441 - DNA, 22 bp, Artificial Sequence
  chemically synthesized
cccaagaatattccctgaactt

SEQ ID NO: 791442 - DNA, 22 bp, Artificial Sequence
  chemically synthesized
gggaatatccaaaaggcggaca

SEQ ID NO: 791443 - DNA, 22 bp, Artificial Sequence
  chemically synthesized
agggaatatccaaaaggcggac

SEQ ID NO: 791444 - DNA, 22 bp, Artificial Sequence
  chemically synthesized
cctgaacttgtccgccttttgg

SEQ ID NO: 791445 - DNA, 22 bp, Artificial Sequence
  chemically synthesized
tttagggaatatccaaaaggcg

SEQ ID NO: 791446 - DNA, 22 bp, Artificial Sequence
  chemically synthesized
aacttgtccgccttttggatat

SEQ ID NO: 791447 - DNA, 22 bp, Artificial Sequence
  chemically synthesized
gtccgccttttggatattccct

SEQ ID NO: 791448 - DNA, 22 bp, Artificial Sequence
  chemically synthesized
tccgccttttggatattcccta

SEQ ID NO: 791449 - DNA, 22 bp, Artificial Sequence
  chemically synthesized
ggacgtgtcctgtttagggaat

SEQ ID NO: 791450 - DNA, 22 bp, Artificial Sequence
  chemically synthesized
aggacgtgtcctgtttagggaa

SEQ ID NO: 791451 - DNA, 22 bp, Artificial Sequence
  chemically synthesized
atttaggacgtgtcctgtttag

SEQ ID NO: 791452 - DNA, 22 bp, Artificial Sequence
  chemically synthesized
ttggatattccctaaacaggac

SEQ ID NO: 791453 - DNA, 22 bp, Artificial Sequence
  chemically synthesized
tggatattccctaaacaggaca

SEQ ID NO: 791454 - DNA, 22 bp, Artificial Sequence
  chemically synthesized
ggatattccctaaacaggacac

SEQ ID NO: 791455 - DNA, 22 bp, Artificial Sequence
  chemically synthesized
gatattccctaaacaggacacg

SEQ ID NO: 791456 - DNA, 22 bp, Artificial Sequence
  chemically synthesized
agaacactgatttaggacgtgt

SEQ ID NO: 791457 - DNA, 22 bp, Artificial Sequence
  chemically synthesized
gagaacactgatttaggacgtg

SEQ ID NO: 791458 - DNA, 22 bp, Artificial Sequence
  chemically synthesized
cctaaacaggacacgtcctaaa

SEQ ID NO: 791459 - DNA, 22 bp, Artificial Sequence
  chemically synthesized
tgagaacactgatttaggacgt

SEQ ID NO: 791460 - DNA, 22 bp, Artificial Sequence
  chemically synthesized
aacaggacacgtcctaaatcag

SEQ ID NO: 791461 - DNA, 22 bp, Artificial Sequence
  chemically synthesized
gtgagggaccaggctttgagaa

SEQ ID NO: 791462 - DNA, 22 bp, Artificial Sequence
  chemically synthesized
aatcagtgttctcaaagcctgg

SEQ ID NO: 791463 - DNA, 22 bp, Artificial Sequence
  chemically synthesized
atgccgctggtgagggaccagg

SEQ ID NO: 791464 - DNA, 22 bp, Artificial Sequence
  chemically synthesized
gatgccgctggtgagggaccag

SEQ ID NO: 791465 - DNA, 22 bp, Artificial Sequence
  chemically synthesized
tgatgccgctggtgagggacca

SEQ ID NO: 791466 - DNA, 22 bp, Artificial Sequence
  chemically synthesized
tcaaagcctggtccctcaccag

SEQ ID NO: 791467 - DNA, 22 bp, Artificial Sequence
  chemically synthesized
aaagcctggtccctcaccagcg

SEQ ID NO: 791468 - DNA, 22 bp, Artificial Sequence
  chemically synthesized
catgattttgatgccgctggtg

SEQ ID NO: 791469 - DNA, 22 bp, Artificial Sequence
  chemically synthesized
ccatgattttgatgccgctggt

SEQ ID NO: 791470 - DNA, 22 bp, Artificial Sequence
  chemically synthesized
ttccatgattttgatgccgctg

SEQ ID NO: 791471 - DNA, 22 bp, Artificial Sequence
  chemically synthesized
gtccctcaccagcggcatcaaa

SEQ ID NO: 791472 - DNA, 22 bp, Artificial Sequence
  chemically synthesized
caaagttcttccatgattttga

SEQ ID NO: 791473 - DNA, 22 bp, Artificial Sequence
  chemically synthesized
accagcggcatcaaaatcatgg

SEQ ID NO: 791474 - DNA, 22 bp, Artificial Sequence
  chemically synthesized
tacaaagttcttccatgatttt

SEQ ID NO: 791475 - DNA, 22 bp, Artificial Sequence
  chemically synthesized
ctacaaagttcttccatgattt

SEQ ID NO: 791476 - DNA, 22 bp, Artificial Sequence
  chemically synthesized
catttctacaaagttcttccat

SEQ ID NO: 791477 - DNA, 22 bp, Artificial Sequence
  chemically synthesized
gcatttctacaaagttcttcca

SEQ ID NO: 791478 - DNA, 22 bp, Artificial Sequence
  chemically synthesized
gggagggcacagataatttgca

SEQ ID NO: 791479 - DNA, 22 bp, Artificial Sequence
  chemically synthesized
tgtagaaatgcaaattatctgt

SEQ ID NO: 791480 - DNA, 22 bp, Artificial Sequence
  chemically synthesized
gtagaaatgcaaattatctgtg

SEQ ID NO: 791481 - DNA, 22 bp, Artificial Sequence
  chemically synthesized
tagaaatgcaaattatctgtgc

SEQ ID NO: 791482 - DNA, 22 bp, Artificial Sequence
  chemically synthesized
gggaggtctggggagggcacag

SEQ ID NO: 791483 - DNA, 22 bp, Artificial Sequence
  chemically synthesized
attggggaggtctggggagggc

SEQ ID NO: 791484 - DNA, 22 bp, Artificial Sequence
  chemically synthesized
taattggggaggtctggggagg

SEQ ID NO: 791485 - DNA, 22 bp, Artificial Sequence
  chemically synthesized
ctaattggggaggtctggggag

SEQ ID NO: 791486 - DNA, 22 bp, Artificial Sequence
  chemically synthesized
tctgtgccctccccagacctcc

SEQ ID NO: 791487 - DNA, 22 bp, Artificial Sequence
  chemically synthesized
agcttctaattggggaggtctg

SEQ ID NO: 791488 - DNA, 22 bp, Artificial Sequence
  chemically synthesized
aagcttctaattggggaggtct

SEQ ID NO: 791489 - DNA, 22 bp, Artificial Sequence
  chemically synthesized
tgccctccccagacctccccaa

SEQ ID NO: 791490 - DNA, 22 bp, Artificial Sequence
  chemically synthesized
cccttaagcttctaattgggga

SEQ ID NO: 791491 - DNA, 22 bp, Artificial Sequence
  chemically synthesized
acccttaagcttctaattgggg

SEQ ID NO: 791492 - DNA, 22 bp, Artificial Sequence
  chemically synthesized
tacccttaagcttctaattggg

SEQ ID NO: 791493 - DNA, 22 bp, Artificial Sequence
  chemically synthesized
cccagacctccccaattagaag

SEQ ID NO: 791494 - DNA, 22 bp, Artificial Sequence
  chemically synthesized
cccaattagaagcttaagggta

SEQ ID NO: 791495 - DNA, 22 bp, Artificial Sequence
  chemically synthesized
atatgcagatgaccgttttacc

SEQ ID NO: 791496 - DNA, 22 bp, Artificial Sequence
  chemically synthesized
gaagcttaagggtaaaacggtc

SEQ ID NO: 791497 - DNA, 22 bp, Artificial Sequence
  chemically synthesized
ttaatatgcagatgaccgtttt

SEQ ID NO: 791498 - DNA, 22 bp, Artificial Sequence
  chemically synthesized
gttaatatgcagatgaccgttt

SEQ ID NO: 791499 - DNA, 22 bp, Artificial Sequence
  chemically synthesized
aagggtaaaacggtcatctgca

SEQ ID NO: 791500 - DNA, 22 bp, Artificial Sequence
  chemically synthesized
agggtaaaacggtcatctgcat

SEQ ID NO: 791501 - DNA, 22 bp, Artificial Sequence
  chemically synthesized
gaaaacttgttaatatgcagat

SEQ ID NO: 791502 - DNA, 22 bp, Artificial Sequence
  chemically synthesized
ctggaaaacttgttaatatgca

SEQ ID NO: 791503 - DNA, 22 bp, Artificial Sequence
  chemically synthesized
gaatctcctggaaaacttgtta

SEQ ID NO: 791504 - DNA, 22 bp, Artificial Sequence
  chemically synthesized
cactggaatctcctggaaaact

SEQ ID NO: 791505 - DNA, 22 bp, Artificial Sequence
  chemically synthesized
catattaacaagttttccagga

SEQ ID NO: 791506 - DNA, 22 bp, Artificial Sequence
  chemically synthesized
gctccactggaatctcctggaa

SEQ ID NO: 791507 - DNA, 22 bp, Artificial Sequence
  chemically synthesized
agctccactggaatctcctgga

SEQ ID NO: 791508 - DNA, 22 bp, Artificial Sequence
  chemically synthesized
tagctccactggaatctcctgg

SEQ ID NO: 791509 - DNA, 22 bp, Artificial Sequence
  chemically synthesized
acaagttttccaggagattcca

SEQ ID NO: 791510 - DNA, 22 bp, Artificial Sequence
  chemically synthesized
aaactttagctccactggaatc

SEQ ID NO: 791511 - DNA, 22 bp, Artificial Sequence
  chemically synthesized
tcaaactttagctccactggaa

SEQ ID NO: 791512 - DNA, 22 bp, Artificial Sequence
  chemically synthesized
tccaggagattccagtggagct

SEQ ID NO: 791513 - DNA, 22 bp, Artificial Sequence
  chemically synthesized
ccaggagattccagtggagcta

SEQ ID NO: 791514 - DNA, 22 bp, Artificial Sequence
  chemically synthesized
caggagattccagtggagctaa

SEQ ID NO: 791515 - DNA, 22 bp, Artificial Sequence
  chemically synthesized
cagtggagctaaagtttgagaa

SEQ ID NO: 791516 - DNA, 22 bp, Artificial Sequence
  chemically synthesized
ggcatgatataggacagtggtt

SEQ ID NO: 791517 - DNA, 22 bp, Artificial Sequence
  chemically synthesized
aagtttgagaaccactgtccta

SEQ ID NO: 791518 - DNA, 22 bp, Artificial Sequence
  chemically synthesized
gagaaccactgtcctatatcat

SEQ ID NO: 791519 - DNA, 22 bp, Artificial Sequence
  chemically synthesized
agaaccactgtcctatatcatg

SEQ ID NO: 791520 - DNA, 22 bp, Artificial Sequence
  chemically synthesized
tcctatatcatgcccagcgttt

SEQ ID NO: 791521 - DNA, 22 bp, Artificial Sequence
  chemically synthesized
taaatacacagagtaaacgctg

SEQ ID NO: 791522 - DNA, 22 bp, Artificial Sequence
  chemically synthesized
tatcatgcccagcgtttactct

SEQ ID NO: 791523 - DNA, 22 bp, Artificial Sequence
  chemically synthesized
aaaacattataaatacacagag

SEQ ID NO: 791524 - DNA, 22 bp, Artificial Sequence
  chemically synthesized
aaaaacattataaatacacaga

SEQ ID NO: 791525 - DNA, 22 bp, Artificial Sequence
  chemically synthesized
taaaaacattataaatacacag

SEQ ID NO: 791526 - DNA, 22 bp, Artificial Sequence
  chemically synthesized
ttaaaaacattataaatacaca

SEQ ID NO: 791527 - DNA, 22 bp, Artificial Sequence
  chemically synthesized
tttaaaaacattataaatacac

SEQ ID NO: 791528 - DNA, 22 bp, Artificial Sequence
  chemically synthesized
actctgtgtatttataatgttt

SEQ ID NO: 791529 - DNA, 22 bp, Artificial Sequence
  chemically synthesized
ctctgtgtatttataatgtttt

SEQ ID NO: 791530 - DNA, 22 bp, Artificial Sequence
  chemically synthesized
tgtgtatttataatgtttttaa

SEQ ID NO: 791531 - DNA, 22 bp, Artificial Sequence
  chemically synthesized
tgtatttataatgtttttaaaa

SEQ ID NO: 791532 - DNA, 22 bp, Artificial Sequence
  chemically synthesized
ataatgtttttaaaaaatttcc

SEQ ID NO: 791533 - DNA, 22 bp, Artificial Sequence
  chemically synthesized
taatgtttttaaaaaatttcca

SEQ ID NO: 791534 - DNA, 22 bp, Artificial Sequence
  chemically synthesized
aagcatccataaaatatggaaa

SEQ ID NO: 791535 - DNA, 22 bp, Artificial Sequence
  chemically synthesized
ttaaaaaatttccatattttat

SEQ ID NO: 791536 - DNA, 22 bp, Artificial Sequence
  chemically synthesized
taaaaaatttccatattttatg

SEQ ID NO: 791537 - DNA, 22 bp, Artificial Sequence
  chemically synthesized
aaaaaatttccatattttatgg

SEQ ID NO: 791538 - DNA, 22 bp, Artificial Sequence
  chemically synthesized
aaaaatttccatattttatgga

SEQ ID NO: 791539 - DNA, 22 bp, Artificial Sequence
  chemically synthesized
aagatgttcaagcatccataaa

SEQ ID NO: 791540 - DNA, 22 bp, Artificial Sequence
  chemically synthesized
ccatattttatggatgcttgaa

SEQ ID NO: 791541 - DNA, 22 bp, Artificial Sequence
  chemically synthesized
catattttatggatgcttgaac

SEQ ID NO: 791542 - DNA, 22 bp, Artificial Sequence
  chemically synthesized
caaggacctcaagatgttcaag

SEQ ID NO: 791543 - DNA, 22 bp, Artificial Sequence
  chemically synthesized
ccaaggacctcaagatgttcaa

SEQ ID NO: 791544 - DNA, 22 bp, Artificial Sequence
  chemically synthesized
tatggatgcttgaacatcttga

SEQ ID NO: 791545 - DNA, 22 bp, Artificial Sequence
  chemically synthesized
atggatgcttgaacatcttgag

SEQ ID NO: 791546 - DNA, 22 bp, Artificial Sequence
  chemically synthesized
tggatgcttgaacatcttgagg

SEQ ID NO: 791547 - DNA, 22 bp, Artificial Sequence
  chemically synthesized
gccttccaaggacctcaagatg

SEQ ID NO: 791548 - DNA, 22 bp, Artificial Sequence
  chemically synthesized
cctggccttccaaggacctcaa

SEQ ID NO: 791549 - DNA, 22 bp, Artificial Sequence
  chemically synthesized
tccctggccttccaaggacctc

SEQ ID NO: 791550 - DNA, 22 bp, Artificial Sequence
  chemically synthesized
gaacatcttgaggtccttggaa

SEQ ID NO: 791551 - DNA, 22 bp, Artificial Sequence
  chemically synthesized
aacatcttgaggtccttggaag

SEQ ID NO: 791552 - DNA, 22 bp, Artificial Sequence
  chemically synthesized
gaggtccttggaaggccaggga

SEQ ID NO: 791553 - DNA, 22 bp, Artificial Sequence
  chemically synthesized
aggtccttggaaggccagggag

SEQ ID NO: 791554 - DNA, 22 bp, Artificial Sequence
  chemically synthesized
ggaggggcagtctctccctggc

SEQ ID NO: 791555 - DNA, 22 bp, Artificial Sequence
  chemically synthesized
gccctgggaggggcagtctctc

SEQ ID NO: 791556 - DNA, 22 bp, Artificial Sequence
  chemically synthesized
ggaaggccagggagagactgcc

SEQ ID NO: 791557 - DNA, 22 bp, Artificial Sequence
  chemically synthesized
gaaggccagggagagactgccc

SEQ ID NO: 791558 - DNA, 22 bp, Artificial Sequence
  chemically synthesized
gctagccctgggaggggcagtc

SEQ ID NO: 791559 - DNA, 22 bp, Artificial Sequence
  chemically synthesized
ggaattagctagccctgggagg

SEQ ID NO: 791560 - DNA, 22 bp, Artificial Sequence
  chemically synthesized
aggaattagctagccctgggag

SEQ ID NO: 791561 - DNA, 22 bp, Artificial Sequence
  chemically synthesized
taggaattagctagccctggga

SEQ ID NO: 791562 - DNA, 22 bp, Artificial Sequence
  chemically synthesized
tctttaggaattagctagccct

SEQ ID NO: 791563 - DNA, 22 bp, Artificial Sequence
  chemically synthesized
ctatctttaggaattagctagc

SEQ ID NO: 791564 - DNA, 22 bp, Artificial Sequence
  chemically synthesized
cccctcccagggctagctaatt

SEQ ID NO: 791565 - DNA, 22 bp, Artificial Sequence
  chemically synthesized
gctatctttaggaattagctag

SEQ ID NO: 791566 - DNA, 22 bp, Artificial Sequence
  chemically synthesized
tttgctatctttaggaattagc

SEQ ID NO: 791567 - DNA, 22 bp, Artificial Sequence
  chemically synthesized
ccagggctagctaattcctaaa

SEQ ID NO: 791568 - DNA, 22 bp, Artificial Sequence
  chemically synthesized
caagttatttgctatctttagg

SEQ ID NO: 791569 - DNA, 22 bp, Artificial Sequence
  chemically synthesized
acaagttatttgctatctttag

SEQ ID NO: 791570 - DNA, 22 bp, Artificial Sequence
  chemically synthesized
gctaattcctaaagatagcaaa

SEQ ID NO: 791571 - DNA, 22 bp, Artificial Sequence
  chemically synthesized
attcctaaagatagcaaataac

SEQ ID NO: 791572 - DNA, 22 bp, Artificial Sequence
  chemically synthesized
ctaaagatagcaaataacttgt

SEQ ID NO: 791573 - DNA, 22 bp, Artificial Sequence
  chemically synthesized
aagatagcaaataacttgtaaa

SEQ ID NO: 791574 - DNA, 22 bp, Artificial Sequence
  chemically synthesized
gtaaacttgctcccttgtggat

SEQ ID NO: 791575 - DNA, 22 bp, Artificial Sequence
  chemically synthesized
taaacttgctcccttgtggatt

SEQ ID NO: 791576 - DNA, 22 bp, Artificial Sequence
  chemically synthesized
gctcccttgtggatttgttgga

SEQ ID NO: 791577 - DNA, 22 bp, Artificial Sequence
  chemically synthesized
ctcccttgtggatttgttggat

SEQ ID NO: 791578 - DNA, 22 bp, Artificial Sequence
  chemically synthesized
tataacgaaaagcaatccaaca

SEQ ID NO: 791579 - DNA, 22 bp, Artificial Sequence
  chemically synthesized
ccttgtggatttgttggattgc

SEQ ID NO: 791580 - DNA, 22 bp, Artificial Sequence
  chemically synthesized
gtataacgaaaagcaatccaac

SEQ ID NO: 791581 - DNA, 22 bp, Artificial Sequence
  chemically synthesized
gtggatttgttggattgctttt

SEQ ID NO: 791582 - DNA, 22 bp, Artificial Sequence
  chemically synthesized
gtttgtataacgaaaagcaatc

SEQ ID NO: 791583 - DNA, 22 bp, Artificial Sequence
  chemically synthesized
tggatttgttggattgcttttc

SEQ ID NO: 791584 - DNA, 22 bp, Artificial Sequence
  chemically synthesized
gttggtttgtataacgaaaagc

SEQ ID NO: 791585 - DNA, 22 bp, Artificial Sequence
  chemically synthesized
gttggattgcttttcgttatac

SEQ ID NO: 791586 - DNA, 22 bp, Artificial Sequence
  chemically synthesized
ttggattgcttttcgttataca

SEQ ID NO: 791587 - DNA, 22 bp, Artificial Sequence
  chemically synthesized
gattagttggtttgtataacga

SEQ ID NO: 791588 - DNA, 22 bp, Artificial Sequence
  chemically synthesized
ggattagttggtttgtataacg

SEQ ID NO: 791589 - DNA, 22 bp, Artificial Sequence
  chemically synthesized
tggattagttggtttgtataac

SEQ ID NO: 791590 - DNA, 22 bp, Artificial Sequence
  chemically synthesized
gattgcttttcgttatacaaac

SEQ ID NO: 791591 - DNA, 22 bp, Artificial Sequence
  chemically synthesized
cttttcgttatacaaaccaact

SEQ ID NO: 791592 - DNA, 22 bp, Artificial Sequence
  chemically synthesized
ttcgttatacaaaccaactaat

SEQ ID NO: 791593 - DNA, 22 bp, Artificial Sequence
  chemically synthesized
tcgttatacaaaccaactaatc

SEQ ID NO: 791594 - DNA, 22 bp, Artificial Sequence
  chemically synthesized
cgttatacaaaccaactaatcc

SEQ ID NO: 791595 - DNA, 22 bp, Artificial Sequence
  chemically synthesized
gttatacaaaccaactaatcca

SEQ ID NO: 791596 - DNA, 22 bp, Artificial Sequence
  chemically synthesized
gggatacggactttggattagt

SEQ ID NO: 791597 - DNA, 22 bp, Artificial Sequence
  chemically synthesized
tacaaaccaactaatccaaagt

SEQ ID NO: 791598 - DNA, 22 bp, Artificial Sequence
  chemically synthesized
atccaaagtccgtatccccaac

SEQ ID NO: 791599 - DNA, 22 bp, Artificial Sequence
  chemically synthesized
gatgaagaaggtagttggggat

SEQ ID NO: 791600 - DNA, 22 bp, Artificial Sequence
  chemically synthesized
gtgtaacaacagttagatgaag

SEQ ID NO: 791601 - DNA, 22 bp, Artificial Sequence
  chemically synthesized
ggtgtaacaacagttagatgaa

SEQ ID NO: 791602 - DNA, 22 bp, Artificial Sequence
  chemically synthesized
gtttggtgtaacaacagttaga

SEQ ID NO: 791603 - DNA, 22 bp, Artificial Sequence
  chemically synthesized
ccttcttcatctaactgttgtt

SEQ ID NO: 791604 - DNA, 22 bp, Artificial Sequence
  chemically synthesized
cttcatctaactgttgttacac

SEQ ID NO: 791605 - DNA, 22 bp, Artificial Sequence
  chemically synthesized
ttcatctaactgttgttacacc

SEQ ID NO: 791606 - DNA, 22 bp, Artificial Sequence
  chemically synthesized
catctaactgttgttacaccaa

SEQ ID NO: 791607 - DNA, 22 bp, Artificial Sequence
  chemically synthesized
atctaactgttgttacaccaaa

SEQ ID NO: 791608 - DNA, 22 bp, Artificial Sequence
  chemically synthesized
actgttgttacaccaaaccaat

SEQ ID NO: 791609 - DNA, 22 bp, Artificial Sequence
  chemically synthesized
gggtgggggaaatattggtttg

SEQ ID NO: 791610 - DNA, 22 bp, Artificial Sequence
  chemically synthesized
ttgttacaccaaaccaatattt

SEQ ID NO: 791611 - DNA, 22 bp, Artificial Sequence
  chemically synthesized
ttacaccaaaccaatatttccc

SEQ ID NO: 791612 - DNA, 22 bp, Artificial Sequence
  chemically synthesized
caccaaaccaatatttccccca

SEQ ID NO: 791613 - DNA, 22 bp, Artificial Sequence
  chemically synthesized
gggtgaggggaaaaagttaggg

SEQ ID NO: 791614 - DNA, 22 bp, Artificial Sequence
  chemically synthesized
cccccaccctaactttttcccc

SEQ ID NO: 791615 - DNA, 22 bp, Artificial Sequence
  chemically synthesized
ccccaccctaactttttcccct

SEQ ID NO: 791616 - DNA, 22 bp, Artificial Sequence
  chemically synthesized
gtaccaagccctagggtgaggg

SEQ ID NO: 791617 - DNA, 22 bp, Artificial Sequence
  chemically synthesized
actttttcccctcaccctaggg

SEQ ID NO: 791618 - DNA, 22 bp, Artificial Sequence
  chemically synthesized
tctggtaccaagccctagggtg

SEQ ID NO: 791619 - DNA, 22 bp, Artificial Sequence
  chemically synthesized
tttcccctcaccctagggcttg

SEQ ID NO: 791620 - DNA, 22 bp, Artificial Sequence
  chemically synthesized
gttgtctggtaccaagccctag

SEQ ID NO: 791621 - DNA, 22 bp, Artificial Sequence
  chemically synthesized
ttcccctcaccctagggcttgg

SEQ ID NO: 791622 - DNA, 22 bp, Artificial Sequence
  chemically synthesized
tcccctcaccctagggcttggt

SEQ ID NO: 791623 - DNA, 22 bp, Artificial Sequence
  chemically synthesized
tggttgtctggtaccaagccct

SEQ ID NO: 791624 - DNA, 22 bp, Artificial Sequence
  chemically synthesized
cccctcaccctagggcttggta

SEQ ID NO: 791625 - DNA, 22 bp, Artificial Sequence
  chemically synthesized
ccctcaccctagggcttggtac

SEQ ID NO: 791626 - DNA, 22 bp, Artificial Sequence
  chemically synthesized
accctagggcttggtaccagac

SEQ ID NO: 791627 - DNA, 22 bp, Artificial Sequence
  chemically synthesized
gggcttggtaccagacaaccag

SEQ ID NO: 791628 - DNA, 22 bp, Artificial Sequence
  chemically synthesized
taaaagtggtctctggttgtct

SEQ ID NO: 791629 - DNA, 22 bp, Artificial Sequence
  chemically synthesized
gctgtaaaagtggtctctggtt

SEQ ID NO: 791630 - DNA, 22 bp, Artificial Sequence
  chemically synthesized
ggtaccagacaaccagagacca

SEQ ID NO: 791631 - DNA, 22 bp, Artificial Sequence
  chemically synthesized
gtaccagacaaccagagaccac

SEQ ID NO: 791632 - DNA, 22 bp, Artificial Sequence
  chemically synthesized
ctggctgtaaaagtggtctctg

SEQ ID NO: 791633 - DNA, 22 bp, Artificial Sequence
  chemically synthesized
cctggctgtaaaagtggtctct

SEQ ID NO: 791634 - DNA, 22 bp, Artificial Sequence
  chemically synthesized
caaaatttcctggctgtaaaag

SEQ ID NO: 791635 - DNA, 22 bp, Artificial Sequence
  chemically synthesized
ccaaaatttcctggctgtaaaa

SEQ ID NO: 791636 - DNA, 22 bp, Artificial Sequence
  chemically synthesized
aaataatttccaaaatttcctg

SEQ ID NO: 791637 - DNA, 22 bp, Artificial Sequence
  chemically synthesized
ttacagccaggaaattttggaa

SEQ ID NO: 791638 - DNA, 22 bp, Artificial Sequence
  chemically synthesized
tacagccaggaaattttggaaa

SEQ ID NO: 791639 - DNA, 22 bp, Artificial Sequence
  chemically synthesized
acagccaggaaattttggaaat

SEQ ID NO: 791640 - DNA, 22 bp, Artificial Sequence
  chemically synthesized
cagccaggaaattttggaaatt

SEQ ID NO: 791641 - DNA, 22 bp, Artificial Sequence
  chemically synthesized
gatagttcaaataatttccaaa

SEQ ID NO: 791642 - DNA, 22 bp, Artificial Sequence
  chemically synthesized
ggactggatagttcaaataatt

SEQ ID NO: 791643 - DNA, 22 bp, Artificial Sequence
  chemically synthesized
aggactggatagttcaaataat

SEQ ID NO: 791644 - DNA, 22 bp, Artificial Sequence
  chemically synthesized
tggaaattatttgaactatcca

SEQ ID NO: 791645 - DNA, 22 bp, Artificial Sequence
  chemically synthesized
ggaaattatttgaactatccag

SEQ ID NO: 791646 - DNA, 22 bp, Artificial Sequence
  chemically synthesized
gaaattatttgaactatccagt

SEQ ID NO: 791647 - DNA, 22 bp, Artificial Sequence
  chemically synthesized
agcaagtttaggactggatagt

SEQ ID NO: 791648 - DNA, 22 bp, Artificial Sequence
  chemically synthesized
tttgaactatccagtcctaaac

SEQ ID NO: 791649 - DNA, 22 bp, Artificial Sequence
  chemically synthesized
gaactatccagtcctaaacttg

SEQ ID NO: 791650 - DNA, 22 bp, Artificial Sequence
  chemically synthesized
aactatccagtcctaaacttgc

SEQ ID NO: 791651 - DNA, 22 bp, Artificial Sequence
  chemically synthesized
tccagtcctaaacttgctcaga

SEQ ID NO: 791652 - DNA, 22 bp, Artificial Sequence
  chemically synthesized
aacttgctcagacttgcctatt

SEQ ID NO: 791653 - DNA, 22 bp, Artificial Sequence
  chemically synthesized
gctcagacttgcctattctacc

SEQ ID NO: 791654 - DNA, 22 bp, Artificial Sequence
  chemically synthesized
ctcagacttgcctattctacct

SEQ ID NO: 791655 - DNA, 22 bp, Artificial Sequence
  chemically synthesized
agacttgcctattctacctcac

SEQ ID NO: 791656 - DNA, 22 bp, Artificial Sequence
  chemically synthesized
caaggaaaagaaatgagtgagg

SEQ ID NO: 791657 - DNA, 22 bp, Artificial Sequence
  chemically synthesized
ccaaggaaaagaaatgagtgag

SEQ ID NO: 791658 - DNA, 22 bp, Artificial Sequence
  chemically synthesized
gcctattctacctcactcattt

SEQ ID NO: 791659 - DNA, 22 bp, Artificial Sequence
  chemically synthesized
cctattctacctcactcatttc

SEQ ID NO: 791660 - DNA, 22 bp, Artificial Sequence
  chemically synthesized
ttctacctcactcatttctttt

SEQ ID NO: 791661 - DNA, 22 bp, Artificial Sequence
  chemically synthesized
tggtttccaaggaaaagaaatg

SEQ ID NO: 791662 - DNA, 22 bp, Artificial Sequence
  chemically synthesized
tacctcactcatttcttttcct

SEQ ID NO: 791663 - DNA, 22 bp, Artificial Sequence
  chemically synthesized
ttgtggtttccaaggaaaagaa

SEQ ID NO: 791664 - DNA, 22 bp, Artificial Sequence
  chemically synthesized
attgtggtttccaaggaaaaga

SEQ ID NO: 791665 - DNA, 22 bp, Artificial Sequence
  chemically synthesized
cctcactcatttcttttccttg

SEQ ID NO: 791666 - DNA, 22 bp, Artificial Sequence
  chemically synthesized
tattgtggtttccaaggaaaag

SEQ ID NO: 791667 - DNA, 22 bp, Artificial Sequence
  chemically synthesized
actcatttcttttccttggaaa

SEQ ID NO: 791668 - DNA, 22 bp, Artificial Sequence
  chemically synthesized
atttcttttccttggaaaccac

SEQ ID NO: 791669 - DNA, 22 bp, Artificial Sequence
  chemically synthesized
cttttccttggaaaccacaata

SEQ ID NO: 791670 - DNA, 22 bp, Artificial Sequence
  chemically synthesized
ttttccttggaaaccacaataa

SEQ ID NO: 791671 - DNA, 22 bp, Artificial Sequence
  chemically synthesized
ttccttggaaaccacaataaag

SEQ ID NO: 791672 - DNA, 22 bp, Artificial Sequence
  chemically synthesized
tccttggaaaccacaataaagg

SEQ ID NO: 791673 - DNA, 22 bp, Artificial Sequence
  chemically synthesized
ccttggaaaccacaataaaggg

SEQ ID NO: 791674 - DNA, 22 bp, Artificial Sequence
  chemically synthesized
cttggaaaccacaataaagggt

SEQ ID NO: 791675 - DNA, 22 bp, Artificial Sequence
  chemically synthesized
ggaaaccacaataaagggtttg

SEQ ID NO: 791676 - DNA, 22 bp, Artificial Sequence
  chemically synthesized
gaaaccacaataaagggtttgg

SEQ ID NO: 791677 - DNA, 22 bp, Artificial Sequence
  chemically synthesized
gggctgtgctttccttttctgc

SEQ ID NO: 791678 - DNA, 22 bp, Artificial Sequence
  chemically synthesized
ggctgtgctttccttttctgcc

SEQ ID NO: 791679 - DNA, 22 bp, Artificial Sequence
  chemically synthesized
cagagtcggtcagcaggcagaa

SEQ ID NO: 791680 - DNA, 22 bp, Artificial Sequence
  chemically synthesized
tgctttccttttctgcctgctg

SEQ ID NO: 791681 - DNA, 22 bp, Artificial Sequence
  chemically synthesized
tccttttctgcctgctgaccga

SEQ ID NO: 791682 - DNA, 22 bp, Artificial Sequence
  chemically synthesized
ccttttctgcctgctgaccgac

SEQ ID NO: 791683 - DNA, 22 bp, Artificial Sequence
  chemically synthesized
cttttctgcctgctgaccgact

SEQ ID NO: 791684 - DNA, 22 bp, Artificial Sequence
  chemically synthesized
ttctgcctgctgaccgactctg

SEQ ID NO: 791685 - DNA, 22 bp, Artificial Sequence
  chemically synthesized
tctgcctgctgaccgactctgg

SEQ ID NO: 791686 - DNA, 22 bp, Artificial Sequence
  chemically synthesized
ctgcctgctgaccgactctgga

SEQ ID NO: 791687 - DNA, 22 bp, Artificial Sequence
  chemically synthesized
tgcctgctgaccgactctggaa

SEQ ID NO: 791688 - DNA, 22 bp, Artificial Sequence
  chemically synthesized
cctgctgaccgactctggaact

SEQ ID NO: 791689 - DNA, 22 bp, Artificial Sequence
  chemically synthesized
ctgaccgactctggaacttttt

SEQ ID NO: 791690 - DNA, 22 bp, Artificial Sequence
  chemically synthesized
accgactctggaacttttttcc

SEQ ID NO: 791691 - DNA, 22 bp, Artificial Sequence
  chemically synthesized
cgccatgcaaagccatgcagga

SEQ ID NO: 791692 - DNA, 22 bp, Artificial Sequence
  chemically synthesized
tggaacttttttcctgcatggc

SEQ ID NO: 791693 - DNA, 22 bp, Artificial Sequence
  chemically synthesized
gaacttttttcctgcatggctt

SEQ ID NO: 791694 - DNA, 22 bp, Artificial Sequence
  chemically synthesized
ttttcctgcatggctttgcatg

SEQ ID NO: 791695 - DNA, 22 bp, Artificial Sequence
  chemically synthesized
tttcctgcatggctttgcatgg

SEQ ID NO: 791696 - DNA, 22 bp, Artificial Sequence
  chemically synthesized
ttcctgcatggctttgcatggc

SEQ ID NO: 791697 - DNA, 22 bp, Artificial Sequence
  chemically synthesized
tcctgcatggctttgcatggcg

SEQ ID NO: 791698 - DNA, 22 bp, Artificial Sequence
  chemically synthesized
cctgcatggctttgcatggcgt

SEQ ID NO: 791699 - DNA, 22 bp, Artificial Sequence
  chemically synthesized
ctgcatggctttgcatggcgta

SEQ ID NO: 791700 - DNA, 22 bp, Artificial Sequence
  chemically synthesized
catggctttgcatggcgtagta

SEQ ID NO: 791701 - DNA, 22 bp, Artificial Sequence
  chemically synthesized
aagggaagagtacatactacgc

SEQ ID NO: 791702 - DNA, 22 bp, Artificial Sequence
  chemically synthesized
tcaagggaagagtacatactac

SEQ ID NO: 791703 - DNA, 22 bp, Artificial Sequence
  chemically synthesized
tgcatggcgtagtatgtactct

SEQ ID NO: 791704 - DNA, 22 bp, Artificial Sequence
  chemically synthesized
gcatggcgtagtatgtactctt

SEQ ID NO: 791705 - DNA, 22 bp, Artificial Sequence
  chemically synthesized
catggcgtagtatgtactcttc

SEQ ID NO: 791706 - DNA, 22 bp, Artificial Sequence
  chemically synthesized
acagttctcaagggaagagtac

SEQ ID NO: 791707 - DNA, 22 bp, Artificial Sequence
  chemically synthesized
ctcacagttctcaagggaagag

SEQ ID NO: 791708 - DNA, 22 bp, Artificial Sequence
  chemically synthesized
attactcacagttctcaaggga

SEQ ID NO: 791709 - DNA, 22 bp, Artificial Sequence
  chemically synthesized
gattactcacagttctcaaggg

SEQ ID NO: 791710 - DNA, 22 bp, Artificial Sequence
  chemically synthesized
ttcccttgagaactgtgagtaa

SEQ ID NO: 791711 - DNA, 22 bp, Artificial Sequence
  chemically synthesized
aaagaagtttgattactcacag

SEQ ID NO: 791712 - DNA, 22 bp, Artificial Sequence
  chemically synthesized
cccttgagaactgtgagtaatc

SEQ ID NO: 791713 - DNA, 22 bp, Artificial Sequence
  chemically synthesized
ccttgagaactgtgagtaatca

SEQ ID NO: 791714 - DNA, 22 bp, Artificial Sequence
  chemically synthesized
cattaaaagaagtttgattact

SEQ ID NO: 791715 - DNA, 22 bp, Artificial Sequence
  chemically synthesized
gagaactgtgagtaatcaaact

SEQ ID NO: 791716 - DNA, 22 bp, Artificial Sequence
  chemically synthesized
agaactgtgagtaatcaaactt

SEQ ID NO: 791717 - DNA, 22 bp, Artificial Sequence
  chemically synthesized
tgagtaatcaaacttcttttaa

SEQ ID NO: 791718 - DNA, 22 bp, Artificial Sequence
  chemically synthesized
cttttaatggaattgatctctc

SEQ ID NO: 791719 - DNA, 22 bp, Artificial Sequence
  chemically synthesized
aatgacaatatagagagatcaa

SEQ ID NO: 791720 - DNA, 22 bp, Artificial Sequence
  chemically synthesized
ttttaatggaattgatctctct

SEQ ID NO: 791721 - DNA, 22 bp, Artificial Sequence
  chemically synthesized
ttaatggaattgatctctctat

SEQ ID NO: 791722 - DNA, 22 bp, Artificial Sequence
  chemically synthesized
taatggaattgatctctctata

SEQ ID NO: 791723 - DNA, 22 bp, Artificial Sequence
  chemically synthesized
aatggaattgatctctctatat

SEQ ID NO: 791724 - DNA, 22 bp, Artificial Sequence
  chemically synthesized
atggaattgatctctctatatt

SEQ ID NO: 791725 - DNA, 22 bp, Artificial Sequence
  chemically synthesized
cagaaatgactgaatgacaata

SEQ ID NO: 791726 - DNA, 22 bp, Artificial Sequence
  chemically synthesized
acagaaatgactgaatgacaat

SEQ ID NO: 791727 - DNA, 22 bp, Artificial Sequence
  chemically synthesized
tacagaaatgactgaatgacaa

SEQ ID NO: 791728 - DNA, 22 bp, Artificial Sequence
  chemically synthesized
atctctctatattgtcattcag

SEQ ID NO: 791729 - DNA, 22 bp, Artificial Sequence
  chemically synthesized
ctttacagaaatgactgaatga

SEQ ID NO: 791730 - DNA, 22 bp, Artificial Sequence
  chemically synthesized
gctttacagaaatgactgaatg

SEQ ID NO: 791731 - DNA, 22 bp, Artificial Sequence
  chemically synthesized
tctatattgtcattcagtcatt

SEQ ID NO: 791732 - DNA, 22 bp, Artificial Sequence
  chemically synthesized
tatattgtcattcagtcatttc

SEQ ID NO: 791733 - DNA, 22 bp, Artificial Sequence
  chemically synthesized
tattgtcattcagtcatttctg

SEQ ID NO: 791734 - DNA, 22 bp, Artificial Sequence
  chemically synthesized
tcattcagtcatttctgtaaag

SEQ ID NO: 791735 - DNA, 22 bp, Artificial Sequence
  chemically synthesized
cacagggatttgctttacagaa

SEQ ID NO: 791736 - DNA, 22 bp, Artificial Sequence
  chemically synthesized
gttgcacagggatttgctttac

SEQ ID NO: 791737 - DNA, 22 bp, Artificial Sequence
  chemically synthesized
agttgcacagggatttgcttta

SEQ ID NO: 791738 - DNA, 22 bp, Artificial Sequence
  chemically synthesized
agtcatttctgtaaagcaaatc

SEQ ID NO: 791739 - DNA, 22 bp, Artificial Sequence
  chemically synthesized
tagttgcacagggatttgcttt

SEQ ID NO: 791740 - DNA, 22 bp, Artificial Sequence
  chemically synthesized
ctgtaaagcaaatccctgtgca

SEQ ID NO: 791741 - DNA, 22 bp, Artificial Sequence
  chemically synthesized
tgtaaagcaaatccctgtgcaa

SEQ ID NO: 791742 - DNA, 22 bp, Artificial Sequence
  chemically synthesized
taaagcaaatccctgtgcaact

SEQ ID NO: 791743 - DNA, 22 bp, Artificial Sequence
  chemically synthesized
ggaggggcagggtattttagtt

SEQ ID NO: 791744 - DNA, 22 bp, Artificial Sequence
  chemically synthesized
tgttgggaggggcagggtattt

SEQ ID NO: 791745 - DNA, 22 bp, Artificial Sequence
  chemically synthesized
tgcaactaaaataccctgcccc

SEQ ID NO: 791746 - DNA, 22 bp, Artificial Sequence
  chemically synthesized
gattatgttgggaggggcaggg

SEQ ID NO: 791747 - DNA, 22 bp, Artificial Sequence
  chemically synthesized
agattatgttgggaggggcagg

SEQ ID NO: 791748 - DNA, 22 bp, Artificial Sequence
  chemically synthesized
aaataccctgcccctcccaaca

SEQ ID NO: 791749 - DNA, 22 bp, Artificial Sequence
  chemically synthesized
cccctcccaacataatctaagt

SEQ ID NO: 791750 - DNA, 22 bp, Artificial Sequence
  chemically synthesized
ccaacataatctaagtcttggg

SEQ ID NO: 791751 - DNA, 22 bp, Artificial Sequence
  chemically synthesized
accgaagtagggaacccaagac

SEQ ID NO: 791752 - DNA, 22 bp, Artificial Sequence
  chemically synthesized
caccgaagtagggaacccaaga

SEQ ID NO: 791753 - DNA, 22 bp, Artificial Sequence
  chemically synthesized
gaaaccttcaccgaagtaggga

SEQ ID NO: 791754 - DNA, 22 bp, Artificial Sequence
  chemically synthesized
agtcttgggttccctacttcgg

SEQ ID NO: 791755 - DNA, 22 bp, Artificial Sequence
  chemically synthesized
gggttccctacttcggtgaagg

SEQ ID NO: 791756 - DNA, 22 bp, Artificial Sequence
  chemically synthesized
gacagctagaaaccttcaccga

SEQ ID NO: 791757 - DNA, 22 bp, Artificial Sequence
  chemically synthesized
ggttccctacttcggtgaaggt

SEQ ID NO: 791758 - DNA, 22 bp, Artificial Sequence
  chemically synthesized
ggacagctagaaaccttcaccg

SEQ ID NO: 791759 - DNA, 22 bp, Artificial Sequence
  chemically synthesized
tggacagctagaaaccttcacc

SEQ ID NO: 791760 - DNA, 22 bp, Artificial Sequence
  chemically synthesized
ttggacagctagaaaccttcac

SEQ ID NO: 791761 - DNA, 22 bp, Artificial Sequence
  chemically synthesized
tttggacagctagaaaccttca

SEQ ID NO: 791762 - DNA, 22 bp, Artificial Sequence
  chemically synthesized
cctacttcggtgaaggtttcta

SEQ ID NO: 791763 - DNA, 22 bp, Artificial Sequence
  chemically synthesized
ctttttggacagctagaaacct

SEQ ID NO: 791764 - DNA, 22 bp, Artificial Sequence
  chemically synthesized
tactttttggacagctagaaac

SEQ ID NO: 791765 - DNA, 22 bp, Artificial Sequence
  chemically synthesized
cttcggtgaaggtttctagctg

SEQ ID NO: 791766 - DNA, 22 bp, Artificial Sequence
  chemically synthesized
ctactttttggacagctagaaa

SEQ ID NO: 791767 - DNA, 22 bp, Artificial Sequence
  chemically synthesized
cggtgaaggtttctagctgtcc

SEQ ID NO: 791768 - DNA, 22 bp, Artificial Sequence
  chemically synthesized
ggtgaaggtttctagctgtcca

SEQ ID NO: 791769 - DNA, 22 bp, Artificial Sequence
  chemically synthesized
ctagctgtccaaaaagtagaaa

SEQ ID NO: 791770 - DNA, 22 bp, Artificial Sequence
  chemically synthesized
tagctgtccaaaaagtagaaac

SEQ ID NO: 791771 - DNA, 22 bp, Artificial Sequence
  chemically synthesized
gctgtccaaaaagtagaaactt

SEQ ID NO: 791772 - DNA, 22 bp, Artificial Sequence
  chemically synthesized
tccaaaaagtagaaactttact

SEQ ID NO: 791773 - DNA, 22 bp, Artificial Sequence
  chemically synthesized
atatacaaaaggaaaaagtaaa

SEQ ID NO: 791774 - DNA, 22 bp, Artificial Sequence
  chemically synthesized
gtaatggattaatatacaaaag

SEQ ID NO: 791775 - DNA, 22 bp, Artificial Sequence
  chemically synthesized
tactttttccttttgtatatta

SEQ ID NO: 791776 - DNA, 22 bp, Artificial Sequence
  chemically synthesized
actttttccttttgtatattaa

SEQ ID NO: 791777 - DNA, 22 bp, Artificial Sequence
  chemically synthesized
tctagtaatggattaatataca

SEQ ID NO: 791778 - DNA, 22 bp, Artificial Sequence
  chemically synthesized
ctttttccttttgtatattaat

SEQ ID NO: 791779 - DNA, 22 bp, Artificial Sequence
  chemically synthesized
ctatctagtaatggattaatat

SEQ ID NO: 791780 - DNA, 22 bp, Artificial Sequence
  chemically synthesized
tttccttttgtatattaatcca

SEQ ID NO: 791781 - DNA, 22 bp, Artificial Sequence
  chemically synthesized
gctatctagtaatggattaata

SEQ ID NO: 791782 - DNA, 22 bp, Artificial Sequence
  chemically synthesized
ttccttttgtatattaatccat

SEQ ID NO: 791783 - DNA, 22 bp, Artificial Sequence
  chemically synthesized
tgctatctagtaatggattaat

SEQ ID NO: 791784 - DNA, 22 bp, Artificial Sequence
  chemically synthesized
tccttttgtatattaatccatt

SEQ ID NO: 791785 - DNA, 22 bp, Artificial Sequence
  chemically synthesized
ccttttgtatattaatccatta

SEQ ID NO: 791786 - DNA, 22 bp, Artificial Sequence
  chemically synthesized
cttttgtatattaatccattac

SEQ ID NO: 791787 - DNA, 22 bp, Artificial Sequence
  chemically synthesized
ttgtatattaatccattactag

SEQ ID NO: 791788 - DNA, 22 bp, Artificial Sequence
  chemically synthesized
tgtatattaatccattactaga

SEQ ID NO: 791789 - DNA, 22 bp, Artificial Sequence
  chemically synthesized
gtatattaatccattactagat

SEQ ID NO: 791790 - DNA, 22 bp, Artificial Sequence
  chemically synthesized
tatattaatccattactagata

SEQ ID NO: 791791 - DNA, 22 bp, Artificial Sequence
  chemically synthesized
atccattactagatagcaaagt

SEQ ID NO: 791792 - DNA, 22 bp, Artificial Sequence
  chemically synthesized
ctagatagcaaagtctatgttt

SEQ ID NO: 791793 - DNA, 22 bp, Artificial Sequence
  chemically synthesized
aaaaaaaaaaaaaaaaacatag

SEQ ID NO: 791794 - DNA, 22 bp, Artificial Sequence
  chemically synthesized
gatagcaaagtctatgtttttt

SEQ ID NO: 791795 - DNA, 22 bp, Artificial Sequence
  chemically synthesized
caagttgaaaaaaaaaaaaaaa

SEQ ID NO: 791796 - DNA, 22 bp, Artificial Sequence
  chemically synthesized
tgtttttttttttttttttcaa

SEQ ID NO: 791797 - DNA, 22 bp, Artificial Sequence
  chemically synthesized
atagattccaagttgaaaaaaa

SEQ ID NO: 791798 - DNA, 22 bp, Artificial Sequence
  chemically synthesized
ttttttttttttttcaacttgg

SEQ ID NO: 791799 - DNA, 22 bp, Artificial Sequence
  chemically synthesized
tttttttttttttcaacttgga

SEQ ID NO: 791800 - DNA, 22 bp, Artificial Sequence
  chemically synthesized
ttttttttttttcaacttggaa

SEQ ID NO: 791801 - DNA, 22 bp, Artificial Sequence
  chemically synthesized
tttttttttttcaacttggaat

SEQ ID NO: 791802 - DNA, 22 bp, Artificial Sequence
  chemically synthesized
ttttttttttcaacttggaatc

SEQ ID NO: 791803 - DNA, 22 bp, Artificial Sequence
  chemically synthesized
tttttttttcaacttggaatct

SEQ ID NO: 791804 - DNA, 22 bp, Artificial Sequence
  chemically synthesized
ttttttttcaacttggaatcta

SEQ ID NO: 791805 - DNA, 22 bp, Artificial Sequence
  chemically synthesized
tttttttcaacttggaatctat

SEQ ID NO: 791806 - DNA, 22 bp, Artificial Sequence
  chemically synthesized
ttttttcaacttggaatctatt

SEQ ID NO: 791807 - DNA, 22 bp, Artificial Sequence
  chemically synthesized
tttttcaacttggaatctatta

SEQ ID NO: 791808 - DNA, 22 bp, Artificial Sequence
  chemically synthesized
ttttcaacttggaatctattaa

SEQ ID NO: 791809 - DNA, 22 bp, Artificial Sequence
  chemically synthesized
tttcaacttggaatctattaac

SEQ ID NO: 791810 - DNA, 22 bp, Artificial Sequence
  chemically synthesized
ttcaacttggaatctattaacc

SEQ ID NO: 791811 - DNA, 22 bp, Artificial Sequence
  chemically synthesized
tcaacttggaatctattaacct

SEQ ID NO: 791812 - DNA, 22 bp, Artificial Sequence
  chemically synthesized
caacttggaatctattaacctc

SEQ ID NO: 791813 - DNA, 22 bp, Artificial Sequence
  chemically synthesized
aacttggaatctattaacctct

SEQ ID NO: 791814 - DNA, 22 bp, Artificial Sequence
  chemically synthesized
gtataagtgggggaaagaggtt

SEQ ID NO: 791815 - DNA, 22 bp, Artificial Sequence
  chemically synthesized
ggaatctattaacctctttccc

SEQ ID NO: 791816 - DNA, 22 bp, Artificial Sequence
  chemically synthesized
gaatctattaacctctttcccc

SEQ ID NO: 791817 - DNA, 22 bp, Artificial Sequence
  chemically synthesized
gagtattggtataagtggggga

SEQ ID NO: 791818 - DNA, 22 bp, Artificial Sequence
  chemically synthesized
ttaacctctttcccccacttat

SEQ ID NO: 791819 - DNA, 22 bp, Artificial Sequence
  chemically synthesized
acctctttcccccacttatacc

SEQ ID NO: 791820 - DNA, 22 bp, Artificial Sequence
  chemically synthesized
aactggagtattggtataagtg

SEQ ID NO: 791821 - DNA, 22 bp, Artificial Sequence
  chemically synthesized
aaactggagtattggtataagt

SEQ ID NO: 791822 - DNA, 22 bp, Artificial Sequence
  chemically synthesized
tttcccccacttataccaatac

SEQ ID NO: 791823 - DNA, 22 bp, Artificial Sequence
  chemically synthesized
tcccccacttataccaatactc

SEQ ID NO: 791824 - DNA, 22 bp, Artificial Sequence
  chemically synthesized
cccccacttataccaatactcc

SEQ ID NO: 791825 - DNA, 22 bp, Artificial Sequence
  chemically synthesized
gtggcttaaactggagtattgg

SEQ ID NO: 791826 - DNA, 22 bp, Artificial Sequence
  chemically synthesized
ccccacttataccaatactcca

SEQ ID NO: 791827 - DNA, 22 bp, Artificial Sequence
  chemically synthesized
ataccaatactccagtttaagc

SEQ ID NO: 791828 - DNA, 22 bp, Artificial Sequence
  chemically synthesized
aacacactggtggcttaaactg

SEQ ID NO: 791829 - DNA, 22 bp, Artificial Sequence
  chemically synthesized
taccaatactccagtttaagcc

SEQ ID NO: 791830 - DNA, 22 bp, Artificial Sequence
  chemically synthesized
aagcccagttgaacacactggt

SEQ ID NO: 791831 - DNA, 22 bp, Artificial Sequence
  chemically synthesized
cagtttaagccaccagtgtgtt

SEQ ID NO: 791832 - DNA, 22 bp, Artificial Sequence
  chemically synthesized
ttgaagcccagttgaacacact

SEQ ID NO: 791833 - DNA, 22 bp, Artificial Sequence
  chemically synthesized
aagccaccagtgtgttcaactg

SEQ ID NO: 791834 - DNA, 22 bp, Artificial Sequence
  chemically synthesized
agccaccagtgtgttcaactgg

SEQ ID NO: 791835 - DNA, 22 bp, Artificial Sequence
  chemically synthesized
agttattgaagcccagttgaac

SEQ ID NO: 791836 - DNA, 22 bp, Artificial Sequence
  chemically synthesized
gttaagttattgaagcccagtt

SEQ ID NO: 791837 - DNA, 22 bp, Artificial Sequence
  chemically synthesized
cgttaagttattgaagcccagt

SEQ ID NO: 791838 - DNA, 22 bp, Artificial Sequence
  chemically synthesized
aactgggcttcaataacttaac

SEQ ID NO: 791839 - DNA, 22 bp, Artificial Sequence
  chemically synthesized
ggcttcaataacttaacgaagg

SEQ ID NO: 791840 - DNA, 22 bp, Artificial Sequence
  chemically synthesized
aggcaaaaatatccttcgttaa

SEQ ID NO: 791841 - DNA, 22 bp, Artificial Sequence
  chemically synthesized
caataacttaacgaaggatatt

SEQ ID NO: 791842 - DNA, 22 bp, Artificial Sequence
  chemically synthesized
aataacttaacgaaggatattt

SEQ ID NO: 791843 - DNA, 22 bp, Artificial Sequence
  chemically synthesized
aacgaaggatatttttgcctca

SEQ ID NO: 791844 - DNA, 22 bp, Artificial Sequence
  chemically synthesized
acgaaggatatttttgcctcag

SEQ ID NO: 791845 - DNA, 22 bp, Artificial Sequence
  chemically synthesized
aaatgaagggcataaactgagg

SEQ ID NO: 791846 - DNA, 22 bp, Artificial Sequence
  chemically synthesized
gattgaaatgaagggcataaac

SEQ ID NO: 791847 - DNA, 22 bp, Artificial Sequence
  chemically synthesized
ttgcctcagtttatgcccttca

SEQ ID NO: 791848 - DNA, 22 bp, Artificial Sequence
  chemically synthesized
tgcctcagtttatgcccttcat

SEQ ID NO: 791849 - DNA, 22 bp, Artificial Sequence
  chemically synthesized
gcctcagtttatgcccttcatt

SEQ ID NO: 791850 - DNA, 22 bp, Artificial Sequence
  chemically synthesized
cctcagtttatgcccttcattt

SEQ ID NO: 791851 - DNA, 22 bp, Artificial Sequence
  chemically synthesized
agtttatgcccttcatttcaat

SEQ ID NO: 791852 - DNA, 22 bp, Artificial Sequence
  chemically synthesized
aaaaggtaaattggattgaaat

SEQ ID NO: 791853 - DNA, 22 bp, Artificial Sequence
  chemically synthesized
aaaaaggtaaattggattgaaa

SEQ ID NO: 791854 - DNA, 22 bp, Artificial Sequence
  chemically synthesized
atgcccttcatttcaatccaat

SEQ ID NO: 791855 - DNA, 22 bp, Artificial Sequence
  chemically synthesized
tgcccttcatttcaatccaatt

SEQ ID NO: 791856 - DNA, 22 bp, Artificial Sequence
  chemically synthesized
atttaaaaaggtaaattggatt

SEQ ID NO: 791857 - DNA, 22 bp, Artificial Sequence
  chemically synthesized
catttaaaaaggtaaattggat

SEQ ID NO: 791858 - DNA, 22 bp, Artificial Sequence
  chemically synthesized
catttcaatccaatttaccttt

SEQ ID NO: 791859 - DNA, 22 bp, Artificial Sequence
  chemically synthesized
atttcaatccaatttacctttt

SEQ ID NO: 791860 - DNA, 22 bp, Artificial Sequence
  chemically synthesized
caatccaatttacctttttaaa

SEQ ID NO: 791861 - DNA, 22 bp, Artificial Sequence
  chemically synthesized
aatccaatttacctttttaaat

SEQ ID NO: 791862 - DNA, 22 bp, Artificial Sequence
  chemically synthesized
agcagaggagtgacttcattta

SEQ ID NO: 791863 - DNA, 22 bp, Artificial Sequence
  chemically synthesized
acctttttaaatgaagtcactc

SEQ ID NO: 791864 - DNA, 22 bp, Artificial Sequence
  chemically synthesized
tgttaagcagaggagtgacttc

SEQ ID NO: 791865 - DNA, 22 bp, Artificial Sequence
  chemically synthesized
cctttttaaatgaagtcactcc

SEQ ID NO: 791866 - DNA, 22 bp, Artificial Sequence
  chemically synthesized
tgtgttaagcagaggagtgact

SEQ ID NO: 791867 - DNA, 22 bp, Artificial Sequence
  chemically synthesized
tttaaatgaagtcactcctctg

SEQ ID NO: 791868 - DNA, 22 bp, Artificial Sequence
  chemically synthesized
ttaaatgaagtcactcctctgc

SEQ ID NO: 791869 - DNA, 22 bp, Artificial Sequence
  chemically synthesized
taaatgaagtcactcctctgct

SEQ ID NO: 791870 - DNA, 22 bp, Artificial Sequence
  chemically synthesized
aaatgaagtcactcctctgctt

SEQ ID NO: 791871 - DNA, 22 bp, Artificial Sequence
  chemically synthesized
aatgaagtcactcctctgctta

SEQ ID NO: 791872 - DNA, 22 bp, Artificial Sequence
  chemically synthesized
aaggttctgtgttaagcagagg

SEQ ID NO: 791873 - DNA, 22 bp, Artificial Sequence
  chemically synthesized
ctctgcttaacacagaaccttt

SEQ ID NO: 791874 - DNA, 22 bp, Artificial Sequence
  chemically synthesized
tgcttaacacagaacctttagt

SEQ ID NO: 791875 - DNA, 22 bp, Artificial Sequence
  chemically synthesized
cttaacacagaacctttagtgg

SEQ ID NO: 791876 - DNA, 22 bp, Artificial Sequence
  chemically synthesized
aacacagaacctttagtggttt

SEQ ID NO: 791877 - DNA, 22 bp, Artificial Sequence
  chemically synthesized
acacagaacctttagtggtttt

SEQ ID NO: 791878 - DNA, 22 bp, Artificial Sequence
  chemically synthesized
catgacaatggtaaaaaccact

SEQ ID NO: 791879 - DNA, 22 bp, Artificial Sequence
  chemically synthesized
gcatgacaatggtaaaaaccac

SEQ ID NO: 791880 - DNA, 22 bp, Artificial Sequence
  chemically synthesized
cttgcatgacaatggtaaaaac

SEQ ID NO: 791881 - DNA, 22 bp, Artificial Sequence
  chemically synthesized
acttgcatgacaatggtaaaaa

SEQ ID NO: 791882 - DNA, 22 bp, Artificial Sequence
  chemically synthesized
tacttgcatgacaatggtaaaa

SEQ ID NO: 791883 - DNA, 22 bp, Artificial Sequence
  chemically synthesized
ttacttgcatgacaatggtaaa

SEQ ID NO: 791884 - DNA, 22 bp, Artificial Sequence
  chemically synthesized
tttacttgcatgacaatggtaa

SEQ ID NO: 791885 - DNA, 22 bp, Artificial Sequence
  chemically synthesized
ttttacttgcatgacaatggta

SEQ ID NO: 791886 - DNA, 22 bp, Artificial Sequence
  chemically synthesized
tttttacttgcatgacaatggt

SEQ ID NO: 791887 - DNA, 22 bp, Artificial Sequence
  chemically synthesized
tagtggtttttaccattgtcat

SEQ ID NO: 791888 - DNA, 22 bp, Artificial Sequence
  chemically synthesized
ttttttacttgcatgacaatgg

SEQ ID NO: 791889 - DNA, 22 bp, Artificial Sequence
  chemically synthesized
agtggtttttaccattgtcatg

SEQ ID NO: 791890 - DNA, 22 bp, Artificial Sequence
  chemically synthesized
tttttttacttgcatgacaatg

SEQ ID NO: 791891 - DNA, 22 bp, Artificial Sequence
  chemically synthesized
gtggtttttaccattgtcatgc

SEQ ID NO: 791892 - DNA, 22 bp, Artificial Sequence
  chemically synthesized
ttttttttacttgcatgacaat

SEQ ID NO: 791893 - DNA, 22 bp, Artificial Sequence
  chemically synthesized
tttttttttacttgcatgacaa

SEQ ID NO: 791894 - DNA, 22 bp, Artificial Sequence
  chemically synthesized
ttttttttttacttgcatgaca

SEQ ID NO: 791895 - DNA, 22 bp, Artificial Sequence
  chemically synthesized
tttttttttttacttgcatgac

SEQ ID NO: 791896 - DNA, 22 bp, Artificial Sequence
  chemically synthesized
ttaccattgtcatgcaagtaaa

SEQ ID NO: 791897 - DNA, 22 bp, Artificial Sequence
  chemically synthesized
taccattgtcatgcaagtaaaa

SEQ ID NO: 791898 - DNA, 22 bp, Artificial Sequence
  chemically synthesized
accattgtcatgcaagtaaaaa

SEQ ID NO: 791899 - DNA, 22 bp, Artificial Sequence
  chemically synthesized
ccattgtcatgcaagtaaaaaa

SEQ ID NO: 791900 - DNA, 22 bp, Artificial Sequence
  chemically synthesized
tcatgcaagtaaaaaaaaaaaa

SEQ ID NO: 791901 - DNA, 22 bp, Artificial Sequence
  chemically synthesized
gtaagggtcagatttttttttt

SEQ ID NO: 791902 - DNA, 22 bp, Artificial Sequence
  chemically synthesized
gaaagttagtaagggtcagatt

SEQ ID NO: 791903 - DNA, 22 bp, Artificial Sequence
  chemically synthesized
ggagagatgaagctagaaagtt

SEQ ID NO: 791904 - DNA, 22 bp, Artificial Sequence
  chemically synthesized
acccttactaactttctagctt

SEQ ID NO: 791905 - DNA, 22 bp, Artificial Sequence
  chemically synthesized
aattgggagagatgaagctaga

SEQ ID NO: 791906 - DNA, 22 bp, Artificial Sequence
  chemically synthesized
gaattgggagagatgaagctag

SEQ ID NO: 791907 - DNA, 22 bp, Artificial Sequence
  chemically synthesized
actaactttctagcttcatctc

SEQ ID NO: 791908 - DNA, 22 bp, Artificial Sequence
  chemically synthesized
ctaactttctagcttcatctct

SEQ ID NO: 791909 - DNA, 22 bp, Artificial Sequence
  chemically synthesized
gagtttgaattgggagagatga

SEQ ID NO: 791910 - DNA, 22 bp, Artificial Sequence
  chemically synthesized
actttctagcttcatctctccc

SEQ ID NO: 791911 - DNA, 22 bp, Artificial Sequence
  chemically synthesized
tctagcttcatctctcccaatt

SEQ ID NO: 791912 - DNA, 22 bp, Artificial Sequence
  chemically synthesized
ctagcttcatctctcccaattc

SEQ ID NO: 791913 - DNA, 22 bp, Artificial Sequence
  chemically synthesized
tagcttcatctctcccaattca

SEQ ID NO: 791914 - DNA, 22 bp, Artificial Sequence
  chemically synthesized
gcttcatctctcccaattcaaa

SEQ ID NO: 791915 - DNA, 22 bp, Artificial Sequence
  chemically synthesized
gtaaacctagagtttgaattgg

SEQ ID NO: 791916 - DNA, 22 bp, Artificial Sequence
  chemically synthesized
ggtaaacctagagtttgaattg

SEQ ID NO: 791917 - DNA, 22 bp, Artificial Sequence
  chemically synthesized
catctctcccaattcaaactct

SEQ ID NO: 791918 - DNA, 22 bp, Artificial Sequence
  chemically synthesized
cttggtaaacctagagtttgaa

SEQ ID NO: 791919 - DNA, 22 bp, Artificial Sequence
  chemically synthesized
atctctcccaattcaaactcta

SEQ ID NO: 791920 - DNA, 22 bp, Artificial Sequence
  chemically synthesized
ctgcttggtaaacctagagttt

SEQ ID NO: 791921 - DNA, 22 bp, Artificial Sequence
  chemically synthesized
tcccaattcaaactctaggttt

SEQ ID NO: 791922 - DNA, 22 bp, Artificial Sequence
  chemically synthesized
ccaattcaaactctaggtttac

SEQ ID NO: 791923 - DNA, 22 bp, Artificial Sequence
  chemically synthesized
agaggattgctgcttggtaaac

SEQ ID NO: 791924 - DNA, 22 bp, Artificial Sequence
  chemically synthesized
gagaggattgctgcttggtaaa

SEQ ID NO: 791925 - DNA, 22 bp, Artificial Sequence
  chemically synthesized
tgagaggattgctgcttggtaa

SEQ ID NO: 791926 - DNA, 22 bp, Artificial Sequence
  chemically synthesized
aaactctaggtttaccaagcag

SEQ ID NO: 791927 - DNA, 22 bp, Artificial Sequence
  chemically synthesized
taggtttaccaagcagcaatcc

SEQ ID NO: 791928 - DNA, 22 bp, Artificial Sequence
  chemically synthesized
ggtttaccaagcagcaatcctc

SEQ ID NO: 791929 - DNA, 22 bp, Artificial Sequence
  chemically synthesized
accaagcagcaatcctctcaaa

SEQ ID NO: 791930 - DNA, 22 bp, Artificial Sequence
  chemically synthesized
ccaagcagcaatcctctcaaaa

SEQ ID NO: 791931 - DNA, 22 bp, Artificial Sequence
  chemically synthesized
aagtcatgggaaagtgattttg

SEQ ID NO: 791932 - DNA, 22 bp, Artificial Sequence
  chemically synthesized
tcaaaatcactttcccatgact

SEQ ID NO: 791933 - DNA, 22 bp, Artificial Sequence
  chemically synthesized
tgcacaagtctgaagtcatggg

SEQ ID NO: 791934 - DNA, 22 bp, Artificial Sequence
  chemically synthesized
aaaatcactttcccatgacttc

SEQ ID NO: 791935 - DNA, 22 bp, Artificial Sequence
  chemically synthesized
tcccatgacttcagacttgtgc

SEQ ID NO: 791936 - DNA, 22 bp, Artificial Sequence
  chemically synthesized
cccatgacttcagacttgtgca

SEQ ID NO: 791937 - DNA, 22 bp, Artificial Sequence
  chemically synthesized
ccatgacttcagacttgtgcac

SEQ ID NO: 791938 - DNA, 22 bp, Artificial Sequence
  chemically synthesized
agccaggcaacatactgtgcac

SEQ ID NO: 791939 - DNA, 22 bp, Artificial Sequence
  chemically synthesized
taagccaggcaacatactgtgc

SEQ ID NO: 791940 - DNA, 22 bp, Artificial Sequence
  chemically synthesized
tctaagccaggcaacatactgt

SEQ ID NO: 791941 - DNA, 22 bp, Artificial Sequence
  chemically synthesized
cagacttgtgcacagtatgttg

SEQ ID NO: 791942 - DNA, 22 bp, Artificial Sequence
  chemically synthesized
agacttgtgcacagtatgttgc

SEQ ID NO: 791943 - DNA, 22 bp, Artificial Sequence
  chemically synthesized
gtgcacagtatgttgcctggct

SEQ ID NO: 791944 - DNA, 22 bp, Artificial Sequence
  chemically synthesized
tgcacagtatgttgcctggctt

SEQ ID NO: 791945 - DNA, 22 bp, Artificial Sequence
  chemically synthesized
cctggcttagagaatactcctc

SEQ ID NO: 791946 - DNA, 22 bp, Artificial Sequence
  chemically synthesized
gcttagagaatactcctcatgt

SEQ ID NO: 791947 - DNA, 22 bp, Artificial Sequence
  chemically synthesized
agagaatactcctcatgtttcc

SEQ ID NO: 791948 - DNA, 22 bp, Artificial Sequence
  chemically synthesized
gagaatactcctcatgtttcct

SEQ ID NO: 791949 - DNA, 22 bp, Artificial Sequence
  chemically synthesized
gtcaggtagggggaaggaaaca

SEQ ID NO: 791950 - DNA, 22 bp, Artificial Sequence
  chemically synthesized
ctcatgtttccttccccctacc

SEQ ID NO: 791951 - DNA, 22 bp, Artificial Sequence
  chemically synthesized
atgtttccttccccctacctga

SEQ ID NO: 791952 - DNA, 22 bp, Artificial Sequence
  chemically synthesized
agagatgggttggtcaggtagg

SEQ ID NO: 791953 - DNA, 22 bp, Artificial Sequence
  chemically synthesized
ccttccccctacctgaccaacc

SEQ ID NO: 791954 - DNA, 22 bp, Artificial Sequence
  chemically synthesized
cttccccctacctgaccaaccc

SEQ ID NO: 791955 - DNA, 22 bp, Artificial Sequence
  chemically synthesized
ccccctacctgaccaacccatc

SEQ ID NO: 791956 - DNA, 22 bp, Artificial Sequence
  chemically synthesized
cccctacctgaccaacccatct

SEQ ID NO: 791957 - DNA, 22 bp, Artificial Sequence
  chemically synthesized
aatggagacctaagagatgggt

SEQ ID NO: 791958 - DNA, 22 bp, Artificial Sequence
  chemically synthesized
cctgaccaacccatctcttagg

SEQ ID NO: 791959 - DNA, 22 bp, Artificial Sequence
  chemically synthesized
acatctaaatggagacctaaga

SEQ ID NO: 791960 - DNA, 22 bp, Artificial Sequence
  chemically synthesized
accaacccatctcttaggtctc

SEQ ID NO: 791961 - DNA, 22 bp, Artificial Sequence
  chemically synthesized
ctgacatctaaatggagaccta

SEQ ID NO: 791962 - DNA, 22 bp, Artificial Sequence
  chemically synthesized
ctcctgacatctaaatggagac

SEQ ID NO: 791963 - DNA, 22 bp, Artificial Sequence
  chemically synthesized
ttaggtctccatttagatgtca

SEQ ID NO: 791964 - DNA, 22 bp, Artificial Sequence
  chemically synthesized
aggtctccatttagatgtcagg

SEQ ID NO: 791965 - DNA, 22 bp, Artificial Sequence
  chemically synthesized
ggtctccatttagatgtcagga

SEQ ID NO: 791966 - DNA, 22 bp, Artificial Sequence
  chemically synthesized
catttagatgtcaggaggagcc

SEQ ID NO: 791967 - DNA, 22 bp, Artificial Sequence
  chemically synthesized
aaggcatgaagaaaggctcctc

SEQ ID NO: 791968 - DNA, 22 bp, Artificial Sequence
  chemically synthesized
agatgtcaggaggagcctttct

SEQ ID NO: 791969 - DNA, 22 bp, Artificial Sequence
  chemically synthesized
gatgtcaggaggagcctttctt

SEQ ID NO: 791970 - DNA, 22 bp, Artificial Sequence
  chemically synthesized
agcctgaaggcatgaagaaagg

SEQ ID NO: 791971 - DNA, 22 bp, Artificial Sequence
  chemically synthesized
tcttcatgccttcaggctcagc

SEQ ID NO: 791972 - DNA, 22 bp, Artificial Sequence
  chemically synthesized
cttcatgccttcaggctcagct

SEQ ID NO: 791973 - DNA, 22 bp, Artificial Sequence
  chemically synthesized
ttcatgccttcaggctcagcta

SEQ ID NO: 791974 - DNA, 22 bp, Artificial Sequence
  chemically synthesized
catgccttcaggctcagctatt

SEQ ID NO: 791975 - DNA, 22 bp, Artificial Sequence
  chemically synthesized
atgccttcaggctcagctattc

SEQ ID NO: 791976 - DNA, 22 bp, Artificial Sequence
  chemically synthesized
caggctcagctattctatcatt

SEQ ID NO: 791977 - DNA, 22 bp, Artificial Sequence
  chemically synthesized
aggctcagctattctatcattc

SEQ ID NO: 791978 - DNA, 22 bp, Artificial Sequence
  chemically synthesized
agctattctatcattccgggtt

SEQ ID NO: 791979 - DNA, 22 bp, Artificial Sequence
  chemically synthesized
ttctatcattccgggttctatc

SEQ ID NO: 791980 - DNA, 22 bp, Artificial Sequence
  chemically synthesized
tatcattccgggttctatccta

SEQ ID NO: 791981 - DNA, 22 bp, Artificial Sequence
  chemically synthesized
tcattccgggttctatcctatc

SEQ ID NO: 791982 - DNA, 22 bp, Artificial Sequence
  chemically synthesized
cgggttctatcctatcccattt

SEQ ID NO: 791983 - DNA, 22 bp, Artificial Sequence
  chemically synthesized
tatcctatcccatttcctgcta

SEQ ID NO: 791984 - DNA, 22 bp, Artificial Sequence
  chemically synthesized
tcctatcccatttcctgctatc

SEQ ID NO: 791985 - DNA, 22 bp, Artificial Sequence
  chemically synthesized
tcccatttcctgctatctccct

SEQ ID NO: 791986 - DNA, 22 bp, Artificial Sequence
  chemically synthesized
cctgctatctccctgacttatt

SEQ ID NO: 791987 - DNA, 22 bp, Artificial Sequence
  chemically synthesized
ctgctatctccctgacttattg

SEQ ID NO: 791988 - DNA, 22 bp, Artificial Sequence
  chemically synthesized
ctatctccctgacttattgggg

SEQ ID NO: 791989 - DNA, 22 bp, Artificial Sequence
  chemically synthesized
acagaaataggacccccaataa

SEQ ID NO: 791990 - DNA, 22 bp, Artificial Sequence
  chemically synthesized
gacagaaataggacccccaata

SEQ ID NO: 791991 - DNA, 22 bp, Artificial Sequence
  chemically synthesized
tctccctgacttattgggggtc

SEQ ID NO: 791992 - DNA, 22 bp, Artificial Sequence
  chemically synthesized
tgacagaaataggacccccaat

SEQ ID NO: 791993 - DNA, 22 bp, Artificial Sequence
  chemically synthesized
cctgacttattgggggtcctat

SEQ ID NO: 791994 - DNA, 22 bp, Artificial Sequence
  chemically synthesized
attttgacagaaataggacccc

SEQ ID NO: 791995 - DNA, 22 bp, Artificial Sequence
  chemically synthesized
ctgattttgacagaaataggac

SEQ ID NO: 791996 - DNA, 22 bp, Artificial Sequence
  chemically synthesized
acttattgggggtcctatttct

SEQ ID NO: 791997 - DNA, 22 bp, Artificial Sequence
  chemically synthesized
gctgattttgacagaaatagga

SEQ ID NO: 791998 - DNA, 22 bp, Artificial Sequence
  chemically synthesized
tgctgattttgacagaaatagg

SEQ ID NO: 791999 - DNA, 22 bp, Artificial Sequence
  chemically synthesized
attgggggtcctatttctgtca

SEQ ID NO: 792000 - DNA, 22 bp, Artificial Sequence
  chemically synthesized
ctttgctgattttgacagaaat

SEQ ID NO: 792001 - DNA, 22 bp, Artificial Sequence
  chemically synthesized
ttgggggtcctatttctgtcaa

SEQ ID NO: 792002 - DNA, 22 bp, Artificial Sequence
  chemically synthesized
cctttgctgattttgacagaaa

SEQ ID NO: 792003 - DNA, 22 bp, Artificial Sequence
  chemically synthesized
tcctttgctgattttgacagaa

SEQ ID NO: 792004 - DNA, 22 bp, Artificial Sequence
  chemically synthesized
ggggtcctatttctgtcaaaat

SEQ ID NO: 792005 - DNA, 22 bp, Artificial Sequence
  chemically synthesized
cccgctttcctttgctgatttt

SEQ ID NO: 792006 - DNA, 22 bp, Artificial Sequence
  chemically synthesized
tttctgtcaaaatcagcaaagg

SEQ ID NO: 792007 - DNA, 22 bp, Artificial Sequence
  chemically synthesized
ctgtcaaaatcagcaaaggaaa

SEQ ID NO: 792008 - DNA, 22 bp, Artificial Sequence
  chemically synthesized
acccctacccgctttcctttgc

SEQ ID NO: 792009 - DNA, 22 bp, Artificial Sequence
  chemically synthesized
tgtcaaaatcagcaaaggaaag

SEQ ID NO: 792010 - DNA, 22 bp, Artificial Sequence
  chemically synthesized
tcaaaatcagcaaaggaaagcg

SEQ ID NO: 792011 - DNA, 22 bp, Artificial Sequence
  chemically synthesized
ccctaacccctacccgctttcc

SEQ ID NO: 792012 - DNA, 22 bp, Artificial Sequence
  chemically synthesized
cccctaacccctacccgctttc

SEQ ID NO: 792013 - DNA, 22 bp, Artificial Sequence
  chemically synthesized
ttcccctaacccctacccgctt

SEQ ID NO: 792014 - DNA, 22 bp, Artificial Sequence
  chemically synthesized
cttcccctaacccctacccgct

SEQ ID NO: 792015 - DNA, 22 bp, Artificial Sequence
  chemically synthesized
cttcttcccctaacccctaccc

SEQ ID NO: 792016 - DNA, 22 bp, Artificial Sequence
  chemically synthesized
acccccagttccttcttcccct

SEQ ID NO: 792017 - DNA, 22 bp, Artificial Sequence
  chemically synthesized
tcacccccagttccttcttccc

SEQ ID NO: 792018 - DNA, 22 bp, Artificial Sequence
  chemically synthesized
ctcacccccagttccttcttcc

SEQ ID NO: 792019 - DNA, 22 bp, Artificial Sequence
  chemically synthesized
cttctcacccccagttccttct

SEQ ID NO: 792020 - DNA, 22 bp, Artificial Sequence
  chemically synthesized
ccttctcacccccagttccttc

SEQ ID NO: 792021 - DNA, 22 bp, Artificial Sequence
  chemically synthesized
tcttccttctcacccccagttc

SEQ ID NO: 792022 - DNA, 22 bp, Artificial Sequence
  chemically synthesized
ggggaagaaggaactgggggtg

SEQ ID NO: 792023 - DNA, 22 bp, Artificial Sequence
  chemically synthesized
atgcatattgtcttccttctca

SEQ ID NO: 792024 - DNA, 22 bp, Artificial Sequence
  chemically synthesized
tcctgatgcatattgtcttcct

SEQ ID NO: 792025 - DNA, 22 bp, Artificial Sequence
  chemically synthesized
atcctgatgcatattgtcttcc

SEQ ID NO: 792026 - DNA, 22 bp, Artificial Sequence
  chemically synthesized
tatcctgatgcatattgtcttc

SEQ ID NO: 792027 - DNA, 22 bp, Artificial Sequence
  chemically synthesized
ggggtgagaaggaagacaatat

SEQ ID NO: 792028 - DNA, 22 bp, Artificial Sequence
  chemically synthesized
ctttatcctgatgcatattgtc

SEQ ID NO: 792029 - DNA, 22 bp, Artificial Sequence
  chemically synthesized
attcctttatcctgatgcatat

SEQ ID NO: 792030 - DNA, 22 bp, Artificial Sequence
  chemically synthesized
agaatgccaacagctcattcct

SEQ ID NO: 792031 - DNA, 22 bp, Artificial Sequence
  chemically synthesized
aactaagaatgccaacagctca

SEQ ID NO: 792032 - DNA, 22 bp, Artificial Sequence
  chemically synthesized
caactaagaatgccaacagctc

SEQ ID NO: 792033 - DNA, 22 bp, Artificial Sequence
  chemically synthesized
agagtttcaactaagaatgcca

SEQ ID NO: 792034 - DNA, 22 bp, Artificial Sequence
  chemically synthesized
cagagtttcaactaagaatgcc

SEQ ID NO: 792035 - DNA, 22 bp, Artificial Sequence
  chemically synthesized
ttggcattcttagttgaaactc

SEQ ID NO: 792036 - DNA, 22 bp, Artificial Sequence
  chemically synthesized
gcattcttagttgaaactctga

SEQ ID NO: 792037 - DNA, 22 bp, Artificial Sequence
  chemically synthesized
atggaaaatgccttcagagttt

SEQ ID NO: 792038 - DNA, 22 bp, Artificial Sequence
  chemically synthesized
ttagttgaaactctgaaggcat

SEQ ID NO: 792039 - DNA, 22 bp, Artificial Sequence
  chemically synthesized
cactcatggaaaatgccttcag

SEQ ID NO: 792040 - DNA, 22 bp, Artificial Sequence
  chemically synthesized
acactcatggaaaatgccttca

SEQ ID NO: 792041 - DNA, 22 bp, Artificial Sequence
  chemically synthesized
agttgaaactctgaaggcattt

SEQ ID NO: 792042 - DNA, 22 bp, Artificial Sequence
  chemically synthesized
gttgaaactctgaaggcatttt

SEQ ID NO: 792043 - DNA, 22 bp, Artificial Sequence
  chemically synthesized
aaactctgaaggcattttccat

SEQ ID NO: 792044 - DNA, 22 bp, Artificial Sequence
  chemically synthesized
tagcgtttacactcatggaaaa

SEQ ID NO: 792045 - DNA, 22 bp, Artificial Sequence
  chemically synthesized
tgaaggcattttccatgagtgt

SEQ ID NO: 792046 - DNA, 22 bp, Artificial Sequence
  chemically synthesized
aaggcattttccatgagtgtaa

SEQ ID NO: 792047 - DNA, 22 bp, Artificial Sequence
  chemically synthesized
tgaaagtgattatagcgtttac

SEQ ID NO: 792048 - DNA, 22 bp, Artificial Sequence
  chemically synthesized
tccatgagtgtaaacgctataa

SEQ ID NO: 792049 - DNA, 22 bp, Artificial Sequence
  chemically synthesized
ccatgagtgtaaacgctataat

SEQ ID NO: 792050 - DNA, 22 bp, Artificial Sequence
  chemically synthesized
catgagtgtaaacgctataatc

SEQ ID NO: 792051 - DNA, 22 bp, Artificial Sequence
  chemically synthesized
aaggtgatctgtgaaagtgatt

SEQ ID NO: 792052 - DNA, 22 bp, Artificial Sequence
  chemically synthesized
gaaggtgatctgtgaaagtgat

SEQ ID NO: 792053 - DNA, 22 bp, Artificial Sequence
  chemically synthesized
tgaaggtgatctgtgaaagtga

SEQ ID NO: 792054 - DNA, 22 bp, Artificial Sequence
  chemically synthesized
ttgaaggtgatctgtgaaagtg

SEQ ID NO: 792055 - DNA, 22 bp, Artificial Sequence
  chemically synthesized
taatcactttcacagatcacct

SEQ ID NO: 792056 - DNA, 22 bp, Artificial Sequence
  chemically synthesized
tcacagatcaccttcaaaaata

SEQ ID NO: 792057 - DNA, 22 bp, Artificial Sequence
  chemically synthesized
cacagatcaccttcaaaaatac

SEQ ID NO: 792058 - DNA, 22 bp, Artificial Sequence
  chemically synthesized
acagatcaccttcaaaaatact

SEQ ID NO: 792059 - DNA, 22 bp, Artificial Sequence
  chemically synthesized
aataagaggtcaaacatggcag

SEQ ID NO: 792060 - DNA, 22 bp, Artificial Sequence
  chemically synthesized
caaaaatactgccatgtttgac

SEQ ID NO: 792061 - DNA, 22 bp, Artificial Sequence
  chemically synthesized
aaaaatactgccatgtttgacc

SEQ ID NO: 792062 - DNA, 22 bp, Artificial Sequence
  chemically synthesized
ccatgtttgacctcttatttag

SEQ ID NO: 792063 - DNA, 22 bp, Artificial Sequence
  chemically synthesized
gataacaatgtcaactaaataa

SEQ ID NO: 792064 - DNA, 22 bp, Artificial Sequence
  chemically synthesized
gacctcttatttagttgacatt

SEQ ID NO: 792065 - DNA, 22 bp, Artificial Sequence
  chemically synthesized
acctcttatttagttgacattg

SEQ ID NO: 792066 - DNA, 22 bp, Artificial Sequence
  chemically synthesized
ttatttagttgacattgttatc

SEQ ID NO: 792067 - DNA, 22 bp, Artificial Sequence
  chemically synthesized
atttagttgacattgttatcta

SEQ ID NO: 792068 - DNA, 22 bp, Artificial Sequence
  chemically synthesized
tttagttgacattgttatctag

SEQ ID NO: 792069 - DNA, 22 bp, Artificial Sequence
  chemically synthesized
agttgacattgttatctagatt

SEQ ID NO: 792070 - DNA, 22 bp, Artificial Sequence
  chemically synthesized
gttgacattgttatctagattg

SEQ ID NO: 792071 - DNA, 22 bp, Artificial Sequence
  chemically synthesized
acattgttatctagattgacat

SEQ ID NO: 792072 - DNA, 22 bp, Artificial Sequence
  chemically synthesized
ttatctagattgacatttattg

SEQ ID NO: 792073 - DNA, 22 bp, Artificial Sequence
  chemically synthesized
tctagattgacatttattgacc

SEQ ID NO: 792074 - DNA, 22 bp, Artificial Sequence
  chemically synthesized
agtaaaacaaaatgggtcaata

SEQ ID NO: 792075 - DNA, 22 bp, Artificial Sequence
  chemically synthesized
gattgacatttattgacccatt

SEQ ID NO: 792076 - DNA, 22 bp, Artificial Sequence
  chemically synthesized
agactaagtaaaacaaaatggg

SEQ ID NO: 792077 - DNA, 22 bp, Artificial Sequence
  chemically synthesized
acatttattgacccattttgtt

SEQ ID NO: 792078 - DNA, 22 bp, Artificial Sequence
  chemically synthesized
cattgagactaagtaaaacaaa

SEQ ID NO: 792079 - DNA, 22 bp, Artificial Sequence
  chemically synthesized
acattgagactaagtaaaacaa

SEQ ID NO: 792080 - DNA, 22 bp, Artificial Sequence
  chemically synthesized
attgacccattttgttttactt

SEQ ID NO: 792081 - DNA, 22 bp, Artificial Sequence
  chemically synthesized
ttgacccattttgttttactta

SEQ ID NO: 792082 - DNA, 22 bp, Artificial Sequence
  chemically synthesized
cttacattgagactaagtaaaa

SEQ ID NO: 792083 - DNA, 22 bp, Artificial Sequence
  chemically synthesized
acccattttgttttacttagtc

SEQ ID NO: 792084 - DNA, 22 bp, Artificial Sequence
  chemically synthesized
tgttttacttagtctcaatgta

SEQ ID NO: 792085 - DNA, 22 bp, Artificial Sequence
  chemically synthesized
gttttacttagtctcaatgtaa

SEQ ID NO: 792086 - DNA, 22 bp, Artificial Sequence
  chemically synthesized
agatatcattgcttacattgag

SEQ ID NO: 792087 - DNA, 22 bp, Artificial Sequence
  chemically synthesized
ttttacttagtctcaatgtaag

SEQ ID NO: 792088 - DNA, 22 bp, Artificial Sequence
  chemically synthesized
aagatatcattgcttacattga

SEQ ID NO: 792089 - DNA, 22 bp, Artificial Sequence
  chemically synthesized
taagatatcattgcttacattg

SEQ ID NO: 792090 - DNA, 22 bp, Artificial Sequence
  chemically synthesized
tacttagtctcaatgtaagcaa

SEQ ID NO: 792091 - DNA, 22 bp, Artificial Sequence
  chemically synthesized
acttagtctcaatgtaagcaat

SEQ ID NO: 792092 - DNA, 22 bp, Artificial Sequence
  chemically synthesized
cttagtctcaatgtaagcaatg

SEQ ID NO: 792093 - DNA, 22 bp, Artificial Sequence
  chemically synthesized
attttaagatatcattgcttac

SEQ ID NO: 792094 - DNA, 22 bp, Artificial Sequence
  chemically synthesized
agtctcaatgtaagcaatgata

SEQ ID NO: 792095 - DNA, 22 bp, Artificial Sequence
  chemically synthesized
gtctcaatgtaagcaatgatat

SEQ ID NO: 792096 - DNA, 22 bp, Artificial Sequence
  chemically synthesized
aatgtaagcaatgatatcttaa

SEQ ID NO: 792097 - DNA, 22 bp, Artificial Sequence
  chemically synthesized
taaacagttgattttaagatat

SEQ ID NO: 792098 - DNA, 22 bp, Artificial Sequence
  chemically synthesized
aaaatcaactgtttatagtacc

SEQ ID NO: 792099 - DNA, 22 bp, Artificial Sequence
  chemically synthesized
aaatcaactgtttatagtaccg

SEQ ID NO: 792100 - DNA, 22 bp, Artificial Sequence
  chemically synthesized
ggcaaatatagccggtactata

SEQ ID NO: 792101 - DNA, 22 bp, Artificial Sequence
  chemically synthesized
aggcaaatatagccggtactat

SEQ ID NO: 792102 - DNA, 22 bp, Artificial Sequence
  chemically synthesized
taggcaaatatagccggtacta

SEQ ID NO: 792103 - DNA, 22 bp, Artificial Sequence
  chemically synthesized
tttatagtaccggctatatttg

SEQ ID NO: 792104 - DNA, 22 bp, Artificial Sequence
  chemically synthesized
atgtgttttaggcaaatatagc

SEQ ID NO: 792105 - DNA, 22 bp, Artificial Sequence
  chemically synthesized
aatgtgttttaggcaaatatag

SEQ ID NO: 792106 - DNA, 22 bp, Artificial Sequence
  chemically synthesized
atagtaccggctatatttgcct

SEQ ID NO: 792107 - DNA, 22 bp, Artificial Sequence
  chemically synthesized
tagtaccggctatatttgccta

SEQ ID NO: 792108 - DNA, 22 bp, Artificial Sequence
  chemically synthesized
tttaatgtgttttaggcaaata

SEQ ID NO: 792109 - DNA, 22 bp, Artificial Sequence
  chemically synthesized
atctatttaatgtgttttaggc

SEQ ID NO: 792110 - DNA, 22 bp, Artificial Sequence
  chemically synthesized
aatctatttaatgtgttttagg

SEQ ID NO: 792111 - DNA, 22 bp, Artificial Sequence
  chemically synthesized
atttaatctatttaatgtgttt

SEQ ID NO: 792112 - DNA, 22 bp, Artificial Sequence
  chemically synthesized
aatttaatctatttaatgtgtt

SEQ ID NO: 792113 - DNA, 22 bp, Artificial Sequence
  chemically synthesized
tatttgcctaaaacacattaaa

SEQ ID NO: 792114 - DNA, 22 bp, Artificial Sequence
  chemically synthesized
gcctaaaacacattaaatagat

SEQ ID NO: 792115 - DNA, 22 bp, Artificial Sequence
  chemically synthesized
cctaaaacacattaaatagatt

SEQ ID NO: 792116 - DNA, 22 bp, Artificial Sequence
  chemically synthesized
tgtgaatttaatttaatctatt

SEQ ID NO: 792117 - DNA, 22 bp, Artificial Sequence
  chemically synthesized
aaacacattaaatagattaaat

SEQ ID NO: 792118 - DNA, 22 bp, Artificial Sequence
  chemically synthesized
attatgtgaatttaatttaatc

SEQ ID NO: 792119 - DNA, 22 bp, Artificial Sequence
  chemically synthesized
taattatgtgaatttaatttaa

SEQ ID NO: 792120 - DNA, 22 bp, Artificial Sequence
  chemically synthesized
aatagattaaattaaattcaca

SEQ ID NO: 792121 - DNA, 22 bp, Artificial Sequence
  chemically synthesized
ataaaattctaattatgtgaat

SEQ ID NO: 792122 - DNA, 22 bp, Artificial Sequence
  chemically synthesized
tcataaaattctaattatgtga

SEQ ID NO: 792123 - DNA, 22 bp, Artificial Sequence
  chemically synthesized
aattaaattcacataattagaa

SEQ ID NO: 792124 - DNA, 22 bp, Artificial Sequence
  chemically synthesized
actctcataaaattctaattat

SEQ ID NO: 792125 - DNA, 22 bp, Artificial Sequence
  chemically synthesized
tcactctcataaaattctaatt

SEQ ID NO: 792126 - DNA, 22 bp, Artificial Sequence
  chemically synthesized
ctcactctcataaaattctaat

SEQ ID NO: 792127 - DNA, 22 bp, Artificial Sequence
  chemically synthesized
aattcacataattagaatttta

SEQ ID NO: 792128 - DNA, 22 bp, Artificial Sequence
  chemically synthesized
acataattagaattttatgaga

SEQ ID NO: 792129 - DNA, 22 bp, Artificial Sequence
  chemically synthesized
agtaatttctcactctcataaa

SEQ ID NO: 792130 - DNA, 22 bp, Artificial Sequence
  chemically synthesized
gaattttatgagagtgagaaat

SEQ ID NO: 792131 - DNA, 22 bp, Artificial Sequence
  chemically synthesized
tacccattaagtaatttctcac

SEQ ID NO: 792132 - DNA, 22 bp, Artificial Sequence
  chemically synthesized
tatgagagtgagaaattactta

SEQ ID NO: 792133 - DNA, 22 bp, Artificial Sequence
  chemically synthesized
atgagagtgagaaattacttaa

SEQ ID NO: 792134 - DNA, 22 bp, Artificial Sequence
  chemically synthesized
tgagagtgagaaattacttaat

SEQ ID NO: 792135 - DNA, 22 bp, Artificial Sequence
  chemically synthesized
ataagatgcattgtacccatta

SEQ ID NO: 792136 - DNA, 22 bp, Artificial Sequence
  chemically synthesized
aataagatgcattgtacccatt

SEQ ID NO: 792137 - DNA, 22 bp, Artificial Sequence
  chemically synthesized
cttaatgggtacaatgcatctt

SEQ ID NO: 792138 - DNA, 22 bp, Artificial Sequence
  chemically synthesized
aatgggtacaatgcatcttatt

SEQ ID NO: 792139 - DNA, 22 bp, Artificial Sequence
  chemically synthesized
atgggtacaatgcatcttatta

SEQ ID NO: 792140 - DNA, 22 bp, Artificial Sequence
  chemically synthesized
gggtatccatcaccttaataag

SEQ ID NO: 792141 - DNA, 22 bp, Artificial Sequence
  chemically synthesized
agggtatccatcaccttaataa

SEQ ID NO: 792142 - DNA, 22 bp, Artificial Sequence
  chemically synthesized
tagggtatccatcaccttaata

SEQ ID NO: 792143 - DNA, 22 bp, Artificial Sequence
  chemically synthesized
ttagggtatccatcaccttaat

SEQ ID NO: 792144 - DNA, 22 bp, Artificial Sequence
  chemically synthesized
attaaggtgatggataccctaa

SEQ ID NO: 792145 - DNA, 22 bp, Artificial Sequence
  chemically synthesized
ttaaggtgatggataccctaaa

SEQ ID NO: 792146 - DNA, 22 bp, Artificial Sequence
  chemically synthesized
aggtgatggataccctaaaagg

SEQ ID NO: 792147 - DNA, 22 bp, Artificial Sequence
  chemically synthesized
tgtaatggtcacgtcaggcctt

SEQ ID NO: 792148 - DNA, 22 bp, Artificial Sequence
  chemically synthesized
aaaggcctgacgtgaccattac

SEQ ID NO: 792149 - DNA, 22 bp, Artificial Sequence
  chemically synthesized
catgcatagattgtgtaatggt

SEQ ID NO: 792150 - DNA, 22 bp, Artificial Sequence
  chemically synthesized
ttacatgcatagattgtgtaat

SEQ ID NO: 792151 - DNA, 22 bp, Artificial Sequence
  chemically synthesized
gttacatgcatagattgtgtaa

SEQ ID NO: 792152 - DNA, 22 bp, Artificial Sequence
  chemically synthesized
tgttacatgcatagattgtgta

SEQ ID NO: 792153 - DNA, 22 bp, Artificial Sequence
  chemically synthesized
acgtgaccattacacaatctat

SEQ ID NO: 792154 - DNA, 22 bp, Artificial Sequence
  chemically synthesized
cacaatctatgcatgtaacaaa

SEQ ID NO: 792155 - DNA, 22 bp, Artificial Sequence
  chemically synthesized
tgaggtacaagtataattttgt

SEQ ID NO: 792156 - DNA, 22 bp, Artificial Sequence
  chemically synthesized
atgaggtacaagtataattttg

SEQ ID NO: 792157 - DNA, 22 bp, Artificial Sequence
  chemically synthesized
tgcatgtaacaaaattatactt

SEQ ID NO: 792158 - DNA, 22 bp, Artificial Sequence
  chemically synthesized
tataaatttatgaggtacaagt

SEQ ID NO: 792159 - DNA, 22 bp, Artificial Sequence
  chemically synthesized
atataaatttatgaggtacaag

SEQ ID NO: 792160 - DNA, 22 bp, Artificial Sequence
  chemically synthesized
tttatataaatttatgaggtac

SEQ ID NO: 792161 - DNA, 22 bp, Artificial Sequence
  chemically synthesized
atttatataaatttatgaggta

SEQ ID NO: 792162 - DNA, 22 bp, Artificial Sequence
  chemically synthesized
tatttatataaatttatgaggt

SEQ ID NO: 792163 - DNA, 22 bp, Artificial Sequence
  chemically synthesized
ttttatttatataaatttatga

SEQ ID NO: 792164 - DNA, 22 bp, Artificial Sequence
  chemically synthesized
gttttatttatataaatttatg

SEQ ID NO: 792165 - DNA, 22 bp, Artificial Sequence
  chemically synthesized
tacttgtacctcataaatttat

SEQ ID NO: 792166 - DNA, 22 bp, Artificial Sequence
  chemically synthesized
tttgttttatttatataaattt

SEQ ID NO: 792167 - DNA, 22 bp, Artificial Sequence
  chemically synthesized
atttgttttatttatataaatt

SEQ ID NO: 792168 - DNA, 22 bp, Artificial Sequence
  chemically synthesized
gtacctcataaatttatataaa

SEQ ID NO: 792169 - DNA, 22 bp, Artificial Sequence
  chemically synthesized
tacctcataaatttatataaat

SEQ ID NO: 792170 - DNA, 22 bp, Artificial Sequence
  chemically synthesized
agtttatttgttttatttatat

SEQ ID NO: 792171 - DNA, 22 bp, Artificial Sequence
  chemically synthesized
ataaatttatataaataaaaca

SEQ ID NO: 792172 - DNA, 22 bp, Artificial Sequence
  chemically synthesized
ggaggcattgagtttatttgtt

SEQ ID NO: 792173 - DNA, 22 bp, Artificial Sequence
  chemically synthesized
gggaggcattgagtttatttgt

SEQ ID NO: 792174 - DNA, 22 bp, Artificial Sequence
  chemically synthesized
atataaataaaacaaataaact

SEQ ID NO: 792175 - DNA, 22 bp, Artificial Sequence
  chemically synthesized
tgggaggcattgagtttatttg

SEQ ID NO: 792176 - DNA, 22 bp, Artificial Sequence
  chemically synthesized
tataaataaaacaaataaactc

SEQ ID NO: 792177 - DNA, 22 bp, Artificial Sequence
  chemically synthesized
ttttgggaggcattgagtttat

SEQ ID NO: 792178 - DNA, 22 bp, Artificial Sequence
  chemically synthesized
attttgggaggcattgagttta

SEQ ID NO: 792179 - DNA, 22 bp, Artificial Sequence
  chemically synthesized
tgtatttattttgggaggcatt

SEQ ID NO: 792180 - DNA, 22 bp, Artificial Sequence
  chemically synthesized
acaattatgtatttattttggg

SEQ ID NO: 792181 - DNA, 22 bp, Artificial Sequence
  chemically synthesized
tgacaattatgtatttattttg

SEQ ID NO: 792182 - DNA, 22 bp, Artificial Sequence
  chemically synthesized
aatgcctcccaaaataaataca

SEQ ID NO: 792183 - DNA, 22 bp, Artificial Sequence
  chemically synthesized
caaactctgacaattatgtatt

SEQ ID NO: 792184 - DNA, 22 bp, Artificial Sequence
  chemically synthesized
acaaactctgacaattatgtat

SEQ ID NO: 792185 - DNA, 22 bp, Artificial Sequence
  chemically synthesized
tacaaactctgacaattatgta

SEQ ID NO: 792186 - DNA, 22 bp, Artificial Sequence
  chemically synthesized
ttacaaactctgacaattatgt

SEQ ID NO: 792187 - DNA, 22 bp, Artificial Sequence
  chemically synthesized
ccaaaataaatacataattgtc

SEQ ID NO: 792188 - DNA, 22 bp, Artificial Sequence
  chemically synthesized
atacttttacaaactctgacaa

SEQ ID NO: 792189 - DNA, 22 bp, Artificial Sequence
  chemically synthesized
gatacttttacaaactctgaca

SEQ ID NO: 792190 - DNA, 22 bp, Artificial Sequence
  chemically synthesized
tcagagtttgtaaaagtatcaa

SEQ ID NO: 792191 - DNA, 22 bp, Artificial Sequence
  chemically synthesized
catggcacatggcttgatactt

SEQ ID NO: 792192 - DNA, 22 bp, Artificial Sequence
  chemically synthesized
ttacatggcacatggcttgata

SEQ ID NO: 792193 - DNA, 22 bp, Artificial Sequence
  chemically synthesized
gtaaaagtatcaagccatgtgc

SEQ ID NO: 792194 - DNA, 22 bp, Artificial Sequence
  chemically synthesized
taaaagtatcaagccatgtgcc

SEQ ID NO: 792195 - DNA, 22 bp, Artificial Sequence
  chemically synthesized
gaagaatgaaaatggaatatta

SEQ ID NO: 792196 - DNA, 22 bp, Artificial Sequence
  chemically synthesized
ccactggaagaatgaaaatgga

SEQ ID NO: 792197 - DNA, 22 bp, Artificial Sequence
  chemically synthesized
cccactggaagaatgaaaatgg

SEQ ID NO: 792198 - DNA, 22 bp, Artificial Sequence
  chemically synthesized
cttcccactggaagaatgaaaa

SEQ ID NO: 792199 - DNA, 22 bp, Artificial Sequence
  chemically synthesized
acttcccactggaagaatgaaa

SEQ ID NO: 792200 - DNA, 22 bp, Artificial Sequence
  chemically synthesized
tttacttcccactggaagaatg

SEQ ID NO: 792201 - DNA, 22 bp, Artificial Sequence
  chemically synthesized
ttgtttacttcccactggaaga

SEQ ID NO: 792202 - DNA, 22 bp, Artificial Sequence
  chemically synthesized
attgtttacttcccactggaag

SEQ ID NO: 792203 - DNA, 22 bp, Artificial Sequence
  chemically synthesized
cattttcattcttccagtggga

SEQ ID NO: 792204 - DNA, 22 bp, Artificial Sequence
  chemically synthesized
ccttattgtttacttcccactg

SEQ ID NO: 792205 - DNA, 22 bp, Artificial Sequence
  chemically synthesized
cccttattgtttacttcccact

SEQ ID NO: 792206 - DNA, 22 bp, Artificial Sequence
  chemically synthesized
tcccttattgtttacttcccac

SEQ ID NO: 792207 - DNA, 22 bp, Artificial Sequence
  chemically synthesized
tcattcttccagtgggaagtaa

SEQ ID NO: 792208 - DNA, 22 bp, Artificial Sequence
  chemically synthesized
ttcccttattgtttacttccca

SEQ ID NO: 792209 - DNA, 22 bp, Artificial Sequence
  chemically synthesized
cattcttccagtgggaagtaaa

SEQ ID NO: 792210 - DNA, 22 bp, Artificial Sequence
  chemically synthesized
attcttccagtgggaagtaaac

SEQ ID NO: 792211 - DNA, 22 bp, Artificial Sequence
  chemically synthesized
ttccagtgggaagtaaacaata

SEQ ID NO: 792212 - DNA, 22 bp, Artificial Sequence
  chemically synthesized
taatttttcccttattgtttac

SEQ ID NO: 792213 - DNA, 22 bp, Artificial Sequence
  chemically synthesized
ccagtgggaagtaaacaataag

SEQ ID NO: 792214 - DNA, 22 bp, Artificial Sequence
  chemically synthesized
cagtgggaagtaaacaataagg

SEQ ID NO: 792215 - DNA, 22 bp, Artificial Sequence
  chemically synthesized
tcatctataatttttcccttat

SEQ ID NO: 792216 - DNA, 22 bp, Artificial Sequence
  chemically synthesized
tctgtcatctataatttttccc

SEQ ID NO: 792217 - DNA, 22 bp, Artificial Sequence
  chemically synthesized
tatacattatctgtcatctata

SEQ ID NO: 792218 - DNA, 22 bp, Artificial Sequence
  chemically synthesized
tgacatacctatatacattatc

SEQ ID NO: 792219 - DNA, 22 bp, Artificial Sequence
  chemically synthesized
atgacatacctatatacattat

SEQ ID NO: 792220 - DNA, 22 bp, Artificial Sequence
  chemically synthesized
tagatgacagataatgtatata

SEQ ID NO: 792221 - DNA, 22 bp, Artificial Sequence
  chemically synthesized
aatttatgacatacctatatac

SEQ ID NO: 792222 - DNA, 22 bp, Artificial Sequence
  chemically synthesized
attcaatttatgacatacctat

SEQ ID NO: 792223 - DNA, 22 bp, Artificial Sequence
  chemically synthesized
ggctaattcaatttatgacata

SEQ ID NO: 792224 - DNA, 22 bp, Artificial Sequence
  chemically synthesized
ctaggctaattcaatttatgac

SEQ ID NO: 792225 - DNA, 22 bp, Artificial Sequence
  chemically synthesized
cctaggctaattcaatttatga

SEQ ID NO: 792226 - DNA, 22 bp, Artificial Sequence
  chemically synthesized
atttcctaggctaattcaattt

SEQ ID NO: 792227 - DNA, 22 bp, Artificial Sequence
  chemically synthesized
taattaatttcctaggctaatt

SEQ ID NO: 792228 - DNA, 22 bp, Artificial Sequence
  chemically synthesized
aattagcctaggaaattaatta

SEQ ID NO: 792229 - DNA, 22 bp, Artificial Sequence
  chemically synthesized
gcctaggaaattaattataatt

SEQ ID NO: 792230 - DNA, 22 bp, Artificial Sequence
  chemically synthesized
ggaaattaattataatttatat

SEQ ID NO: 792231 - DNA, 22 bp, Artificial Sequence
  chemically synthesized
ccacagggagaaatataaatta

SEQ ID NO: 792232 - DNA, 22 bp, Artificial Sequence
  chemically synthesized
gccacagggagaaatataaatt

SEQ ID NO: 792233 - DNA, 22 bp, Artificial Sequence
  chemically synthesized
attataatttatatttctccct

SEQ ID NO: 792234 - DNA, 22 bp, Artificial Sequence
  chemically synthesized
aaatacatttgccacagggaga

SEQ ID NO: 792235 - DNA, 22 bp, Artificial Sequence
  chemically synthesized
taatttatatttctccctgtgg

SEQ ID NO: 792236 - DNA, 22 bp, Artificial Sequence
  chemically synthesized
gaaatacatttgccacagggag

SEQ ID NO: 792237 - DNA, 22 bp, Artificial Sequence
  chemically synthesized
atatttctccctgtggcaaatg

SEQ ID NO: 792238 - DNA, 22 bp, Artificial Sequence
  chemically synthesized
tatttctccctgtggcaaatgt

SEQ ID NO: 792239 - DNA, 22 bp, Artificial Sequence
  chemically synthesized
ctccctgtggcaaatgtatttc

SEQ ID NO: 792240 - DNA, 22 bp, Artificial Sequence
  chemically synthesized
tccctgtggcaaatgtatttca

SEQ ID NO: 792241 - DNA, 22 bp, Artificial Sequence
  chemically synthesized
cctgtggcaaatgtatttcaaa

SEQ ID NO: 792242 - DNA, 22 bp, Artificial Sequence
  chemically synthesized
agatgtgtggtatttgaaatac

SEQ ID NO: 792243 - DNA, 22 bp, Artificial Sequence
  chemically synthesized
tggcaaatgtatttcaaatacc

SEQ ID NO: 792244 - DNA, 22 bp, Artificial Sequence
  chemically synthesized
caattaagatgtgtggtatttg

SEQ ID NO: 792245 - DNA, 22 bp, Artificial Sequence
  chemically synthesized
acaattaagatgtgtggtattt

SEQ ID NO: 792246 - DNA, 22 bp, Artificial Sequence
  chemically synthesized
gtttacaattaagatgtgtggt

SEQ ID NO: 792247 - DNA, 22 bp, Artificial Sequence
  chemically synthesized
agtttacaattaagatgtgtgg

SEQ ID NO: 792248 - DNA, 22 bp, Artificial Sequence
  chemically synthesized
cttagtttacaattaagatgtg

SEQ ID NO: 792249 - DNA, 22 bp, Artificial Sequence
  chemically synthesized
acttagtttacaattaagatgt

SEQ ID NO: 792250 - DNA, 22 bp, Artificial Sequence
  chemically synthesized
tacttagtttacaattaagatg

SEQ ID NO: 792251 - DNA, 22 bp, Artificial Sequence
  chemically synthesized
caaataccacacatcttaattg

SEQ ID NO: 792252 - DNA, 22 bp, Artificial Sequence
  chemically synthesized
ttacttagtttacaattaagat

SEQ ID NO: 792253 - DNA, 22 bp, Artificial Sequence
  chemically synthesized
aaataccacacatcttaattgt

SEQ ID NO: 792254 - DNA, 22 bp, Artificial Sequence
  chemically synthesized
tttacttagtttacaattaaga

SEQ ID NO: 792255 - DNA, 22 bp, Artificial Sequence
  chemically synthesized
ttttacttagtttacaattaag

SEQ ID NO: 792256 - DNA, 22 bp, Artificial Sequence
  chemically synthesized
tttttacttagtttacaattaa

SEQ ID NO: 792257 - DNA, 22 bp, Artificial Sequence
  chemically synthesized
ttttttacttagtttacaatta

SEQ ID NO: 792258 - DNA, 22 bp, Artificial Sequence
  chemically synthesized
tttttttacttagtttacaatt

SEQ ID NO: 792259 - DNA, 22 bp, Artificial Sequence
  chemically synthesized
ttttttttacttagtttacaat

SEQ ID NO: 792260 - DNA, 22 bp, Artificial Sequence
  chemically synthesized
aattgtaaactaagtaaaaaaa

SEQ ID NO: 792261 - DNA, 22 bp, Artificial Sequence
  chemically synthesized
taagtagtcttttttttttact

SEQ ID NO: 792262 - DNA, 22 bp, Artificial Sequence
  chemically synthesized
attgtaaactaagtaaaaaaaa

SEQ ID NO: 792263 - DNA, 22 bp, Artificial Sequence
  chemically synthesized
taaactaagtaaaaaaaaaaga

SEQ ID NO: 792264 - DNA, 22 bp, Artificial Sequence
  chemically synthesized
gattataagtagtctttttttt

SEQ ID NO: 792265 - DNA, 22 bp, Artificial Sequence
  chemically synthesized
tagattataagtagtctttttt

SEQ ID NO: 792266 - DNA, 22 bp, Artificial Sequence
  chemically synthesized
ctagattataagtagtcttttt

SEQ ID NO: 792267 - DNA, 22 bp, Artificial Sequence
  chemically synthesized
agtaaaaaaaaaagactactta

SEQ ID NO: 792268 - DNA, 22 bp, Artificial Sequence
  chemically synthesized
tcaagggccttctagattataa

SEQ ID NO: 792269 - DNA, 22 bp, Artificial Sequence
  chemically synthesized
aattatcaagggccttctagat

SEQ ID NO: 792270 - DNA, 22 bp, Artificial Sequence
  chemically synthesized
caattatcaagggccttctaga

SEQ ID NO: 792271 - DNA, 22 bp, Artificial Sequence
  chemically synthesized
cttataatctagaaggcccttg

SEQ ID NO: 792272 - DNA, 22 bp, Artificial Sequence
  chemically synthesized
ataatctagaaggcccttgata

SEQ ID NO: 792273 - DNA, 22 bp, Artificial Sequence
  chemically synthesized
taatctagaaggcccttgataa

SEQ ID NO: 792274 - DNA, 22 bp, Artificial Sequence
  chemically synthesized
agtgtatttcaattatcaaggg

SEQ ID NO: 792275 - DNA, 22 bp, Artificial Sequence
  chemically synthesized
ctaagtgtatttcaattatcaa

SEQ ID NO: 792276 - DNA, 22 bp, Artificial Sequence
  chemically synthesized
gaaggcccttgataattgaaat

SEQ ID NO: 792277 - DNA, 22 bp, Artificial Sequence
  chemically synthesized
attgctaagtgtatttcaatta

SEQ ID NO: 792278 - DNA, 22 bp, Artificial Sequence
  chemically synthesized
ttcattgctaagtgtatttcaa

SEQ ID NO: 792279 - DNA, 22 bp, Artificial Sequence
  chemically synthesized
gattgttcattgctaagtgtat

SEQ ID NO: 792280 - DNA, 22 bp, Artificial Sequence
  chemically synthesized
gataattgaaatacacttagca

SEQ ID NO: 792281 - DNA, 22 bp, Artificial Sequence
  chemically synthesized
ataattgaaatacacttagcaa

SEQ ID NO: 792282 - DNA, 22 bp, Artificial Sequence
  chemically synthesized
aaatacacttagcaatgaacaa

SEQ ID NO: 792283 - DNA, 22 bp, Artificial Sequence
  chemically synthesized
agcaatgaacaatcgagtttat

SEQ ID NO: 792284 - DNA, 22 bp, Artificial Sequence
  chemically synthesized
tgaatcagcaaaataaactcga

SEQ ID NO: 792285 - DNA, 22 bp, Artificial Sequence
  chemically synthesized
gcaatgaacaatcgagtttatt

SEQ ID NO: 792286 - DNA, 22 bp, Artificial Sequence
  chemically synthesized
tgaattgtgaatcagcaaaata

SEQ ID NO: 792287 - DNA, 22 bp, Artificial Sequence
  chemically synthesized
gtgaattgtgaatcagcaaaat

SEQ ID NO: 792288 - DNA, 22 bp, Artificial Sequence
  chemically synthesized
cttgtgaattgtgaatcagcaa

SEQ ID NO: 792289 - DNA, 22 bp, Artificial Sequence
  chemically synthesized
agattacttgtgaattgtgaat

SEQ ID NO: 792290 - DNA, 22 bp, Artificial Sequence
  chemically synthesized
aagattacttgtgaattgtgaa

SEQ ID NO: 792291 - DNA, 22 bp, Artificial Sequence
  chemically synthesized
attttgctgattcacaattcac

SEQ ID NO: 792292 - DNA, 22 bp, Artificial Sequence
  chemically synthesized
ttttgctgattcacaattcaca

SEQ ID NO: 792293 - DNA, 22 bp, Artificial Sequence
  chemically synthesized
accttaagattacttgtgaatt

SEQ ID NO: 792294 - DNA, 22 bp, Artificial Sequence
  chemically synthesized
tgctgattcacaattcacaagt

SEQ ID NO: 792295 - DNA, 22 bp, Artificial Sequence
  chemically synthesized
gctgattcacaattcacaagta

SEQ ID NO: 792296 - DNA, 22 bp, Artificial Sequence
  chemically synthesized
ctgattcacaattcacaagtaa

SEQ ID NO: 792297 - DNA, 22 bp, Artificial Sequence
  chemically synthesized
attcacaattcacaagtaatct

SEQ ID NO: 792298 - DNA, 22 bp, Artificial Sequence
  chemically synthesized
acaattcacaagtaatcttaag

SEQ ID NO: 792299 - DNA, 22 bp, Artificial Sequence
  chemically synthesized
acaagtaatcttaaggtcaggt

SEQ ID NO: 792300 - DNA, 22 bp, Artificial Sequence
  chemically synthesized
cgaatgagcaatcagaaacctg

SEQ ID NO: 792301 - DNA, 22 bp, Artificial Sequence
  chemically synthesized
aaggtcaggtttctgattgctc

SEQ ID NO: 792302 - DNA, 22 bp, Artificial Sequence
  chemically synthesized
aggtcaggtttctgattgctca

SEQ ID NO: 792303 - DNA, 22 bp, Artificial Sequence
  chemically synthesized
gaaaacaactacgaatgagcaa

SEQ ID NO: 792304 - DNA, 22 bp, Artificial Sequence
  chemically synthesized
ggaaaacaactacgaatgagca

SEQ ID NO: 792305 - DNA, 22 bp, Artificial Sequence
  chemically synthesized
tggaaaacaactacgaatgagc

SEQ ID NO: 792306 - DNA, 22 bp, Artificial Sequence
  chemically synthesized
ctgattgctcattcgtagttgt

SEQ ID NO: 792307 - DNA, 22 bp, Artificial Sequence
  chemically synthesized
tgattgctcattcgtagttgtt

SEQ ID NO: 792308 - DNA, 22 bp, Artificial Sequence
  chemically synthesized
attgctcattcgtagttgtttt

SEQ ID NO: 792309 - DNA, 22 bp, Artificial Sequence
  chemically synthesized
tcaacactttggaaaacaacta

SEQ ID NO: 792310 - DNA, 22 bp, Artificial Sequence
  chemically synthesized
ctcattcgtagttgttttccaa

SEQ ID NO: 792311 - DNA, 22 bp, Artificial Sequence
  chemically synthesized
gattatcaacactttggaaaac

SEQ ID NO: 792312 - DNA, 22 bp, Artificial Sequence
  chemically synthesized
attcgtagttgttttccaaagt

SEQ ID NO: 792313 - DNA, 22 bp, Artificial Sequence
  chemically synthesized
gtagttgttttccaaagtgttg

SEQ ID NO: 792314 - DNA, 22 bp, Artificial Sequence
  chemically synthesized
ttttccaaagtgttgataatct

SEQ ID NO: 792315 - DNA, 22 bp, Artificial Sequence
  chemically synthesized
tccaaagtgttgataatctaat

SEQ ID NO: 792316 - DNA, 22 bp, Artificial Sequence
  chemically synthesized
ccaaagtgttgataatctaatt

SEQ ID NO: 792317 - DNA, 22 bp, Artificial Sequence
  chemically synthesized
gagcacaaacaaaattagatta

SEQ ID NO: 792318 - DNA, 22 bp, Artificial Sequence
  chemically synthesized
caaagtgttgataatctaattt

SEQ ID NO: 792319 - DNA, 22 bp, Artificial Sequence
  chemically synthesized
ggagcacaaacaaaattagatt

SEQ ID NO: 792320 - DNA, 22 bp, Artificial Sequence
  chemically synthesized
ataatctaattttgtttgtgct

SEQ ID NO: 792321 - DNA, 22 bp, Artificial Sequence
  chemically synthesized
gaagaatcatttggagcacaaa

SEQ ID NO: 792322 - DNA, 22 bp, Artificial Sequence
  chemically synthesized
cattggaagaatcatttggagc

SEQ ID NO: 792323 - DNA, 22 bp, Artificial Sequence
  chemically synthesized
attttgtttgtgctccaaatga

SEQ ID NO: 792324 - DNA, 22 bp, Artificial Sequence
  chemically synthesized
gcattggaagaatcatttggag

SEQ ID NO: 792325 - DNA, 22 bp, Artificial Sequence
  chemically synthesized
tgcattggaagaatcatttgga

SEQ ID NO: 792326 - DNA, 22 bp, Artificial Sequence
  chemically synthesized
ttgcattggaagaatcatttgg

SEQ ID NO: 792327 - DNA, 22 bp, Artificial Sequence
  chemically synthesized
tttgcattggaagaatcatttg

SEQ ID NO: 792328 - DNA, 22 bp, Artificial Sequence
  chemically synthesized
tgtttgtgctccaaatgattct

SEQ ID NO: 792329 - DNA, 22 bp, Artificial Sequence
  chemically synthesized
gtttgtgctccaaatgattctt

SEQ ID NO: 792330 - DNA, 22 bp, Artificial Sequence
  chemically synthesized
tttgtgctccaaatgattcttc

SEQ ID NO: 792331 - DNA, 22 bp, Artificial Sequence
  chemically synthesized
gtgctccaaatgattcttccaa

SEQ ID NO: 792332 - DNA, 22 bp, Artificial Sequence
  chemically synthesized
tgctccaaatgattcttccaat

SEQ ID NO: 792333 - DNA, 22 bp, Artificial Sequence
  chemically synthesized
ggacctttttgcattggaagaa

SEQ ID NO: 792334 - DNA, 22 bp, Artificial Sequence
  chemically synthesized
caaatgattcttccaatgcaaa

SEQ ID NO: 792335 - DNA, 22 bp, Artificial Sequence
  chemically synthesized
caaagcagctgggacctttttg

SEQ ID NO: 792336 - DNA, 22 bp, Artificial Sequence
  chemically synthesized
gcaaagcagctgggaccttttt

SEQ ID NO: 792337 - DNA, 22 bp, Artificial Sequence
  chemically synthesized
tgcaaagcagctgggacctttt

SEQ ID NO: 792338 - DNA, 22 bp, Artificial Sequence
  chemically synthesized
ttccaatgcaaaaaggtcccag

SEQ ID NO: 792339 - DNA, 22 bp, Artificial Sequence
  chemically synthesized
ccaatgcaaaaaggtcccagct

SEQ ID NO: 792340 - DNA, 22 bp, Artificial Sequence
  chemically synthesized
cctttgcaaagcagctgggacc

SEQ ID NO: 792341 - DNA, 22 bp, Artificial Sequence
  chemically synthesized
caatgcaaaaaggtcccagctg

SEQ ID NO: 792342 - DNA, 22 bp, Artificial Sequence
  chemically synthesized
cctacctttgcaaagcagctgg

SEQ ID NO: 792343 - DNA, 22 bp, Artificial Sequence
  chemically synthesized
ggcaaacctacctacctttgca

SEQ ID NO: 792344 - DNA, 22 bp, Artificial Sequence
  chemically synthesized
aggcaaacctacctacctttgc

SEQ ID NO: 792345 - DNA, 22 bp, Artificial Sequence
  chemically synthesized
taggcaaacctacctacctttg

SEQ ID NO: 792346 - DNA, 22 bp, Artificial Sequence
  chemically synthesized
ttaggcaaacctacctaccttt

SEQ ID NO: 792347 - DNA, 22 bp, Artificial Sequence
  chemically synthesized
atttttaggcaaacctacctac

SEQ ID NO: 792348 - DNA, 22 bp, Artificial Sequence
  chemically synthesized
gatttttaggcaaacctaccta

SEQ ID NO: 792349 - DNA, 22 bp, Artificial Sequence
  chemically synthesized
ctttgcaaaggtaggtaggttt

SEQ ID NO: 792350 - DNA, 22 bp, Artificial Sequence
  chemically synthesized
ttgatttttaggcaaacctacc

SEQ ID NO: 792351 - DNA, 22 bp, Artificial Sequence
  chemically synthesized
tgcaaaggtaggtaggtttgcc

SEQ ID NO: 792352 - DNA, 22 bp, Artificial Sequence
  chemically synthesized
gcaaaggtaggtaggtttgcct

SEQ ID NO: 792353 - DNA, 22 bp, Artificial Sequence
  chemically synthesized
caaaggtaggtaggtttgccta

SEQ ID NO: 792354 - DNA, 22 bp, Artificial Sequence
  chemically synthesized
tgggtgatgtcgttcttgattt

SEQ ID NO: 792355 - DNA, 22 bp, Artificial Sequence
  chemically synthesized
gtgggtgatgtcgttcttgatt

SEQ ID NO: 792356 - DNA, 22 bp, Artificial Sequence
  chemically synthesized
gcctaaaaatcaagaacgacat

SEQ ID NO: 792357 - DNA, 22 bp, Artificial Sequence
  chemically synthesized
cctaaaaatcaagaacgacatc

SEQ ID NO: 792358 - DNA, 22 bp, Artificial Sequence
  chemically synthesized
aaaatcaagaacgacatcaccc

SEQ ID NO: 792359 - DNA, 22 bp, Artificial Sequence
  chemically synthesized
acaagaaaatgtcttgtgggtg

SEQ ID NO: 792360 - DNA, 22 bp, Artificial Sequence
  chemically synthesized
aacaagaaaatgtcttgtgggt

SEQ ID NO: 792361 - DNA, 22 bp, Artificial Sequence
  chemically synthesized
gcaacttaacaagaaaatgtct

SEQ ID NO: 792362 - DNA, 22 bp, Artificial Sequence
  chemically synthesized
cgcaacttaacaagaaaatgtc

SEQ ID NO: 792363 - DNA, 22 bp, Artificial Sequence
  chemically synthesized
cttcgcaacttaacaagaaaat

SEQ ID NO: 792364 - DNA, 22 bp, Artificial Sequence
  chemically synthesized
aaagttacttcgcaacttaaca

SEQ ID NO: 792365 - DNA, 22 bp, Artificial Sequence
  chemically synthesized
tcttgttaagttgcgaagtaac

SEQ ID NO: 792366 - DNA, 22 bp, Artificial Sequence
  chemically synthesized
cttgttaagttgcgaagtaact

SEQ ID NO: 792367 - DNA, 22 bp, Artificial Sequence
  chemically synthesized
ttgttaagttgcgaagtaactt

SEQ ID NO: 792368 - DNA, 22 bp, Artificial Sequence
  chemically synthesized
aaaatatactaaaagttacttc

SEQ ID NO: 792369 - DNA, 22 bp, Artificial Sequence
  chemically synthesized
gttaagttgcgaagtaactttt

SEQ ID NO: 792370 - DNA, 22 bp, Artificial Sequence
  chemically synthesized
ttaagttgcgaagtaactttta

SEQ ID NO: 792371 - DNA, 22 bp, Artificial Sequence
  chemically synthesized
gtctgaaaatatactaaaagtt

SEQ ID NO: 792372 - DNA, 22 bp, Artificial Sequence
  chemically synthesized
agttgcgaagtaacttttagta

SEQ ID NO: 792373 - DNA, 22 bp, Artificial Sequence
  chemically synthesized
cgaagtaacttttagtatattt

SEQ ID NO: 792374 - DNA, 22 bp, Artificial Sequence
  chemically synthesized
ggaaaacactagtctgaaaata

SEQ ID NO: 792375 - DNA, 22 bp, Artificial Sequence
  chemically synthesized
gtctaggaaaacactagtctga

SEQ ID NO: 792376 - DNA, 22 bp, Artificial Sequence
  chemically synthesized
ttagtatattttcagactagtg

SEQ ID NO: 792377 - DNA, 22 bp, Artificial Sequence
  chemically synthesized
tagtatattttcagactagtgt

SEQ ID NO: 792378 - DNA, 22 bp, Artificial Sequence
  chemically synthesized
agtatattttcagactagtgtt

SEQ ID NO: 792379 - DNA, 22 bp, Artificial Sequence
  chemically synthesized
gtatattttcagactagtgttt

SEQ ID NO: 792380 - DNA, 22 bp, Artificial Sequence
  chemically synthesized
tcagactagtgttttcctagac

SEQ ID NO: 792381 - DNA, 22 bp, Artificial Sequence
  chemically synthesized
cagactagtgttttcctagact

SEQ ID NO: 792382 - DNA, 22 bp, Artificial Sequence
  chemically synthesized
agactagtgttttcctagacta

SEQ ID NO: 792383 - DNA, 22 bp, Artificial Sequence
  chemically synthesized
gtgttttcctagactagtgtac

SEQ ID NO: 792384 - DNA, 22 bp, Artificial Sequence
  chemically synthesized
agatcatgcatggggtacacta

SEQ ID NO: 792385 - DNA, 22 bp, Artificial Sequence
  chemically synthesized
tcctagactagtgtaccccatg

SEQ ID NO: 792386 - DNA, 22 bp, Artificial Sequence
  chemically synthesized
attcagatcatgcatggggtac

SEQ ID NO: 792387 - DNA, 22 bp, Artificial Sequence
  chemically synthesized
cctagactagtgtaccccatgc

SEQ ID NO: 792388 - DNA, 22 bp, Artificial Sequence
  chemically synthesized
ctagactagtgtaccccatgca

SEQ ID NO: 792389 - DNA, 22 bp, Artificial Sequence
  chemically synthesized
gactagtgtaccccatgcatga

SEQ ID NO: 792390 - DNA, 22 bp, Artificial Sequence
  chemically synthesized
gtgtaccccatgcatgatctga

SEQ ID NO: 792391 - DNA, 22 bp, Artificial Sequence
  chemically synthesized
agagcaagtctgattcagatca

SEQ ID NO: 792392 - DNA, 22 bp, Artificial Sequence
  chemically synthesized
atggaagattaagagcaagtct

SEQ ID NO: 792393 - DNA, 22 bp, Artificial Sequence
  chemically synthesized
aatggaagattaagagcaagtc

SEQ ID NO: 792394 - DNA, 22 bp, Artificial Sequence
  chemically synthesized
taatggaagattaagagcaagt

SEQ ID NO: 792395 - DNA, 22 bp, Artificial Sequence
  chemically synthesized
ttaatggaagattaagagcaag

SEQ ID NO: 792396 - DNA, 22 bp, Artificial Sequence
  chemically synthesized
tttttaatggaagattaagagc

SEQ ID NO: 792397 - DNA, 22 bp, Artificial Sequence
  chemically synthesized
gtttttaatggaagattaagag

SEQ ID NO: 792398 - DNA, 22 bp, Artificial Sequence
  chemically synthesized
aatcagacttgctcttaatctt

SEQ ID NO: 792399 - DNA, 22 bp, Artificial Sequence
  chemically synthesized
gctcttaatcttccattaaaaa

SEQ ID NO: 792400 - DNA, 22 bp, Artificial Sequence
  chemically synthesized
ctcttaatcttccattaaaaac

SEQ ID NO: 792401 - DNA, 22 bp, Artificial Sequence
  chemically synthesized
gaatgaaagtcttgtttttaat

SEQ ID NO: 792402 - DNA, 22 bp, Artificial Sequence
  chemically synthesized
ttaatcttccattaaaaacaag

SEQ ID NO: 792403 - DNA, 22 bp, Artificial Sequence
  chemically synthesized
aatcttccattaaaaacaagac

SEQ ID NO: 792404 - DNA, 22 bp, Artificial Sequence
  chemically synthesized
atcttccattaaaaacaagact

SEQ ID NO: 792405 - DNA, 22 bp, Artificial Sequence
  chemically synthesized
atatctagaatgaaagtcttgt

SEQ ID NO: 792406 - DNA, 22 bp, Artificial Sequence
  chemically synthesized
ccattaaaaacaagactttcat

SEQ ID NO: 792407 - DNA, 22 bp, Artificial Sequence
  chemically synthesized
cattaaaaacaagactttcatt

SEQ ID NO: 792408 - DNA, 22 bp, Artificial Sequence
  chemically synthesized
aaattcatatctagaatgaaag

SEQ ID NO: 792409 - DNA, 22 bp, Artificial Sequence
  chemically synthesized
aaaacaagactttcattctaga

SEQ ID NO: 792410 - DNA, 22 bp, Artificial Sequence
  chemically synthesized
tcattctagatatgaattttag

SEQ ID NO: 792411 - DNA, 22 bp, Artificial Sequence
  chemically synthesized
cattctagatatgaattttagt

SEQ ID NO: 792412 - DNA, 22 bp, Artificial Sequence
  chemically synthesized
attctagatatgaattttagtc

SEQ ID NO: 792413 - DNA, 22 bp, Artificial Sequence
  chemically synthesized
agaataagatatcagactaaaa

SEQ ID NO: 792414 - DNA, 22 bp, Artificial Sequence
  chemically synthesized
aagaataagatatcagactaaa

SEQ ID NO: 792415 - DNA, 22 bp, Artificial Sequence
  chemically synthesized
tagatatgaattttagtctgat

SEQ ID NO: 792416 - DNA, 22 bp, Artificial Sequence
  chemically synthesized
taagaataagatatcagactaa

SEQ ID NO: 792417 - DNA, 22 bp, Artificial Sequence
  chemically synthesized
gatatgaattttagtctgatat

SEQ ID NO: 792418 - DNA, 22 bp, Artificial Sequence
  chemically synthesized
tagtctgatatcttattcttaa

SEQ ID NO: 792419 - DNA, 22 bp, Artificial Sequence
  chemically synthesized
agtctgatatcttattcttaaa

SEQ ID NO: 792420 - DNA, 22 bp, Artificial Sequence
  chemically synthesized
gtctgatatcttattcttaaag

SEQ ID NO: 792421 - DNA, 22 bp, Artificial Sequence
  chemically synthesized
tgataagaaagtagtctttaag

SEQ ID NO: 792422 - DNA, 22 bp, Artificial Sequence
  chemically synthesized
gtgataagaaagtagtctttaa

SEQ ID NO: 792423 - DNA, 22 bp, Artificial Sequence
  chemically synthesized
atatcttattcttaaagactac

SEQ ID NO: 792424 - DNA, 22 bp, Artificial Sequence
  chemically synthesized
tgtgataagaaagtagtcttta

SEQ ID NO: 792425 - DNA, 22 bp, Artificial Sequence
  chemically synthesized
attcttaaagactactttctta

SEQ ID NO: 792426 - DNA, 22 bp, Artificial Sequence
  chemically synthesized
ttcttaaagactactttcttat

SEQ ID NO: 792427 - DNA, 22 bp, Artificial Sequence
  chemically synthesized
ttaaagactactttcttatcac

SEQ ID NO: 792428 - DNA, 22 bp, Artificial Sequence
  chemically synthesized
aaagactactttcttatcacaa

SEQ ID NO: 792429 - DNA, 22 bp, Artificial Sequence
  chemically synthesized
aagactactttcttatcacaaa

SEQ ID NO: 792430 - DNA, 22 bp, Artificial Sequence
  chemically synthesized
gtgatgtgagaactttgtgata

SEQ ID NO: 792431 - DNA, 22 bp, Artificial Sequence
  chemically synthesized
ctttcttatcacaaagttctca

SEQ ID NO: 792432 - DNA, 22 bp, Artificial Sequence
  chemically synthesized
gatattggtgatgtgagaactt

SEQ ID NO: 792433 - DNA, 22 bp, Artificial Sequence
  chemically synthesized
ggatattggtgatgtgagaact

SEQ ID NO: 792434 - DNA, 22 bp, Artificial Sequence
  chemically synthesized
tcttatcacaaagttctcacat

SEQ ID NO: 792435 - DNA, 22 bp, Artificial Sequence
  chemically synthesized
cttatcacaaagttctcacatc

SEQ ID NO: 792436 - DNA, 22 bp, Artificial Sequence
  chemically synthesized
ttatcacaaagttctcacatca

SEQ ID NO: 792437 - DNA, 22 bp, Artificial Sequence
  chemically synthesized
gtttggatattggtgatgtgag

SEQ ID NO: 792438 - DNA, 22 bp, Artificial Sequence
  chemically synthesized
atcacaaagttctcacatcacc

SEQ ID NO: 792439 - DNA, 22 bp, Artificial Sequence
  chemically synthesized
ggtttggatattggtgatgtga

SEQ ID NO: 792440 - DNA, 22 bp, Artificial Sequence
  chemically synthesized
tcacaaagttctcacatcacca

SEQ ID NO: 792441 - DNA, 22 bp, Artificial Sequence
  chemically synthesized
aatgtcttggtttggatattgg

SEQ ID NO: 792442 - DNA, 22 bp, Artificial Sequence
  chemically synthesized
aaatgtcttggtttggatattg

SEQ ID NO: 792443 - DNA, 22 bp, Artificial Sequence
  chemically synthesized
tcacatcaccaatatccaaacc

SEQ ID NO: 792444 - DNA, 22 bp, Artificial Sequence
  chemically synthesized
tcttaaatgtcttggtttggat

SEQ ID NO: 792445 - DNA, 22 bp, Artificial Sequence
  chemically synthesized
acatcaccaatatccaaaccaa

SEQ ID NO: 792446 - DNA, 22 bp, Artificial Sequence
  chemically synthesized
agaatgttgtcttaaatgtctt

SEQ ID NO: 792447 - DNA, 22 bp, Artificial Sequence
  chemically synthesized
tcacccctgagaatgttgtctt

SEQ ID NO: 792448 - DNA, 22 bp, Artificial Sequence
  chemically synthesized
atcacccctgagaatgttgtct

SEQ ID NO: 792449 - DNA, 22 bp, Artificial Sequence
  chemically synthesized
tagtcatttatcacccctgaga

SEQ ID NO: 792450 - DNA, 22 bp, Artificial Sequence
  chemically synthesized
aagacaacattctcaggggtga

SEQ ID NO: 792451 - DNA, 22 bp, Artificial Sequence
  chemically synthesized
agacaacattctcaggggtgat

SEQ ID NO: 792452 - DNA, 22 bp, Artificial Sequence
  chemically synthesized
tcaggggtgataaatgactaca

SEQ ID NO: 792453 - DNA, 22 bp, Artificial Sequence
  chemically synthesized
aaagcgcaaaaactgtagtcat

SEQ ID NO: 792454 - DNA, 22 bp, Artificial Sequence
  chemically synthesized
aggggtgataaatgactacagt

SEQ ID NO: 792455 - DNA, 22 bp, Artificial Sequence
  chemically synthesized
aaaagcgcaaaaactgtagtca

SEQ ID NO: 792456 - DNA, 22 bp, Artificial Sequence
  chemically synthesized
taaaagcgcaaaaactgtagtc

SEQ ID NO: 792457 - DNA, 22 bp, Artificial Sequence
  chemically synthesized
ttttaaaagcgcaaaaactgta

SEQ ID NO: 792458 - DNA, 22 bp, Artificial Sequence
  chemically synthesized
ccaagcctattttaaaagcgca

SEQ ID NO: 792459 - DNA, 22 bp, Artificial Sequence
  chemically synthesized
cccaagcctattttaaaagcgc

SEQ ID NO: 792460 - DNA, 22 bp, Artificial Sequence
  chemically synthesized
cagtttttgcgcttttaaaata

SEQ ID NO: 792461 - DNA, 22 bp, Artificial Sequence
  chemically synthesized
ttgcgcttttaaaataggcttg

SEQ ID NO: 792462 - DNA, 22 bp, Artificial Sequence
  chemically synthesized
tgcgcttttaaaataggcttgg

SEQ ID NO: 792463 - DNA, 22 bp, Artificial Sequence
  chemically synthesized
gcgcttttaaaataggcttggg

SEQ ID NO: 792464 - DNA, 22 bp, Artificial Sequence
  chemically synthesized
cgcttttaaaataggcttggga

SEQ ID NO: 792465 - DNA, 22 bp, Artificial Sequence
  chemically synthesized
ttaaaataggcttgggaaatga

SEQ ID NO: 792466 - DNA, 22 bp, Artificial Sequence
  chemically synthesized
taaaataggcttgggaaatgac

SEQ ID NO: 792467 - DNA, 22 bp, Artificial Sequence
  chemically synthesized
aaaataggcttgggaaatgacc

SEQ ID NO: 792468 - DNA, 22 bp, Artificial Sequence
  chemically synthesized
aaataggcttgggaaatgacct

SEQ ID NO: 792469 - DNA, 22 bp, Artificial Sequence
  chemically synthesized
gggaaatgacctgtattttgca

SEQ ID NO: 792470 - DNA, 22 bp, Artificial Sequence
  chemically synthesized
tgatgcacgtaatgcaaaatac

SEQ ID NO: 792471 - DNA, 22 bp, Artificial Sequence
  chemically synthesized
ggaaatgacctgtattttgcat

SEQ ID NO: 792472 - DNA, 22 bp, Artificial Sequence
  chemically synthesized
atgatgcacgtaatgcaaaata

SEQ ID NO: 792473 - DNA, 22 bp, Artificial Sequence
  chemically synthesized
gaagtttatgatgcacgtaatg

SEQ ID NO: 792474 - DNA, 22 bp, Artificial Sequence
  chemically synthesized
tattttgcattacgtgcatcat

SEQ ID NO: 792475 - DNA, 22 bp, Artificial Sequence
  chemically synthesized
tgcattacgtgcatcataaact

SEQ ID NO: 792476 - DNA, 22 bp, Artificial Sequence
  chemically synthesized
gcattacgtgcatcataaactt

SEQ ID NO: 792477 - DNA, 22 bp, Artificial Sequence
  chemically synthesized
cattacgtgcatcataaacttc

SEQ ID NO: 792478 - DNA, 22 bp, Artificial Sequence
  chemically synthesized
taagagcaattagaagtttatg

SEQ ID NO: 792479 - DNA, 22 bp, Artificial Sequence
  chemically synthesized
tgtaagagcaattagaagttta

SEQ ID NO: 792480 - DNA, 22 bp, Artificial Sequence
  chemically synthesized
cgtgcatcataaacttctaatt

SEQ ID NO: 792481 - DNA, 22 bp, Artificial Sequence
  chemically synthesized
cagaacactctgtaagagcaat

SEQ ID NO: 792482 - DNA, 22 bp, Artificial Sequence
  chemically synthesized
acagaacactctgtaagagcaa

SEQ ID NO: 792483 - DNA, 22 bp, Artificial Sequence
  chemically synthesized
tacagaacactctgtaagagca

SEQ ID NO: 792484 - DNA, 22 bp, Artificial Sequence
  chemically synthesized
ttacagaacactctgtaagagc

SEQ ID NO: 792485 - DNA, 22 bp, Artificial Sequence
  chemically synthesized
tttacagaacactctgtaagag

SEQ ID NO: 792486 - DNA, 22 bp, Artificial Sequence
  chemically synthesized
ttttacagaacactctgtaaga

SEQ ID NO: 792487 - DNA, 22 bp, Artificial Sequence
  chemically synthesized
ttttttacagaacactctgtaa

SEQ ID NO: 792488 - DNA, 22 bp, Artificial Sequence
  chemically synthesized
ctaattgctcttacagagtgtt

SEQ ID NO: 792489 - DNA, 22 bp, Artificial Sequence
  chemically synthesized
taattgctcttacagagtgttc

SEQ ID NO: 792490 - DNA, 22 bp, Artificial Sequence
  chemically synthesized
attgctcttacagagtgttctg

SEQ ID NO: 792491 - DNA, 22 bp, Artificial Sequence
  chemically synthesized
ctcttacagagtgttctgtaaa

SEQ ID NO: 792492 - DNA, 22 bp, Artificial Sequence
  chemically synthesized
ttacagagtgttctgtaaaaaa

SEQ ID NO: 792493 - DNA, 22 bp, Artificial Sequence
  chemically synthesized
acagagtgttctgtaaaaaaga

SEQ ID NO: 792494 - DNA, 22 bp, Artificial Sequence
  chemically synthesized
cagagtgttctgtaaaaaagaa

SEQ ID NO: 792495 - DNA, 22 bp, Artificial Sequence
  chemically synthesized
aagaatggtggatattcttttt

SEQ ID NO: 792496 - DNA, 22 bp, Artificial Sequence
  chemically synthesized
aaagaatggtggatattctttt

SEQ ID NO: 792497 - DNA, 22 bp, Artificial Sequence
  chemically synthesized
taaagaatggtggatattcttt

SEQ ID NO: 792498 - DNA, 22 bp, Artificial Sequence
  chemically synthesized
ttaaagaatggtggatattctt

SEQ ID NO: 792499 - DNA, 22 bp, Artificial Sequence
  chemically synthesized
tgtaaaaaagaatatccaccat

SEQ ID NO: 792500 - DNA, 22 bp, Artificial Sequence
  chemically synthesized
taaaaaagaatatccaccattc

SEQ ID NO: 792501 - DNA, 22 bp, Artificial Sequence
  chemically synthesized
atgccatagtatttttaaagaa

SEQ ID NO: 792502 - DNA, 22 bp, Artificial Sequence
  chemically synthesized
aatgccatagtatttttaaaga

SEQ ID NO: 792503 - DNA, 22 bp, Artificial Sequence
  chemically synthesized
agtcttaatgccatagtatttt

SEQ ID NO: 792504 - DNA, 22 bp, Artificial Sequence
  chemically synthesized
cagtcttaatgccatagtattt

SEQ ID NO: 792505 - DNA, 22 bp, Artificial Sequence
  chemically synthesized
tttaaaaatactatggcattaa

SEQ ID NO: 792506 - DNA, 22 bp, Artificial Sequence
  chemically synthesized
agggcttcagtcttaatgccat

SEQ ID NO: 792507 - DNA, 22 bp, Artificial Sequence
  chemically synthesized
taaaaatactatggcattaaga

SEQ ID NO: 792508 - DNA, 22 bp, Artificial Sequence
  chemically synthesized
tcagggcttcagtcttaatgcc

SEQ ID NO: 792509 - DNA, 22 bp, Artificial Sequence
  chemically synthesized
aaaaatactatggcattaagac

SEQ ID NO: 792510 - DNA, 22 bp, Artificial Sequence
  chemically synthesized
aaaatactatggcattaagact

SEQ ID NO: 792511 - DNA, 22 bp, Artificial Sequence
  chemically synthesized
acatctctcagggcttcagtct

SEQ ID NO: 792512 - DNA, 22 bp, Artificial Sequence
  chemically synthesized
aacatctctcagggcttcagtc

SEQ ID NO: 792513 - DNA, 22 bp, Artificial Sequence
  chemically synthesized
tggcattaagactgaagccctg

SEQ ID NO: 792514 - DNA, 22 bp, Artificial Sequence
  chemically synthesized
tcttaacatctctcagggcttc

SEQ ID NO: 792515 - DNA, 22 bp, Artificial Sequence
  chemically synthesized
agactgaagccctgagagatgt

SEQ ID NO: 792516 - DNA, 22 bp, Artificial Sequence
  chemically synthesized
aatagtctatcttaacatctct

SEQ ID NO: 792517 - DNA, 22 bp, Artificial Sequence
  chemically synthesized
aaatagtctatcttaacatctc

SEQ ID NO: 792518 - DNA, 22 bp, Artificial Sequence
  chemically synthesized
aagccctgagagatgttaagat

SEQ ID NO: 792519 - DNA, 22 bp, Artificial Sequence
  chemically synthesized
cagagtttaaatagtctatctt

SEQ ID NO: 792520 - DNA, 22 bp, Artificial Sequence
  chemically synthesized
agagatgttaagatagactatt

SEQ ID NO: 792521 - DNA, 22 bp, Artificial Sequence
  chemically synthesized
agatagactatttaaactctgt

SEQ ID NO: 792522 - DNA, 22 bp, Artificial Sequence
  chemically synthesized
ccaaatgtagtctacagagttt

SEQ ID NO: 792523 - DNA, 22 bp, Artificial Sequence
  chemically synthesized
tttaaactctgtagactacatt

SEQ ID NO: 792524 - DNA, 22 bp, Artificial Sequence
  chemically synthesized
gaagcattcccaaatgtagtct

SEQ ID NO: 792525 - DNA, 22 bp, Artificial Sequence
  chemically synthesized
ggaagcattcccaaatgtagtc

SEQ ID NO: 792526 - DNA, 22 bp, Artificial Sequence
  chemically synthesized
aaactctgtagactacatttgg

SEQ ID NO: 792527 - DNA, 22 bp, Artificial Sequence
  chemically synthesized
aactctgtagactacatttggg

SEQ ID NO: 792528 - DNA, 22 bp, Artificial Sequence
  chemically synthesized
accttggaagcattcccaaatg

SEQ ID NO: 792529 - DNA, 22 bp, Artificial Sequence
  chemically synthesized
tgtagactacatttgggaatgc

SEQ ID NO: 792530 - DNA, 22 bp, Artificial Sequence
  chemically synthesized
ctaaccttggaagcattcccaa

SEQ ID NO: 792531 - DNA, 22 bp, Artificial Sequence
  chemically synthesized
tagactacatttgggaatgctt

SEQ ID NO: 792532 - DNA, 22 bp, Artificial Sequence
  chemically synthesized
actgctaaccttggaagcattc

SEQ ID NO: 792533 - DNA, 22 bp, Artificial Sequence
  chemically synthesized
cactgctaaccttggaagcatt

SEQ ID NO: 792534 - DNA, 22 bp, Artificial Sequence
  chemically synthesized
ttcactgctaaccttggaagca

SEQ ID NO: 792535 - DNA, 22 bp, Artificial Sequence
  chemically synthesized
catttgggaatgcttccaaggt

SEQ ID NO: 792536 - DNA, 22 bp, Artificial Sequence
  chemically synthesized
gggaatgcttccaaggttagca

SEQ ID NO: 792537 - DNA, 22 bp, Artificial Sequence
  chemically synthesized
ggaatgcttccaaggttagcag

SEQ ID NO: 792538 - DNA, 22 bp, Artificial Sequence
  chemically synthesized
atgagtcactcttcactgctaa

SEQ ID NO: 792539 - DNA, 22 bp, Artificial Sequence
  chemically synthesized
actgatgagtcactcttcactg

SEQ ID NO: 792540 - DNA, 22 bp, Artificial Sequence
  chemically synthesized
cactgatgagtcactcttcact

SEQ ID NO: 792541 - DNA, 22 bp, Artificial Sequence
  chemically synthesized
ccaaggttagcagtgaagagtg

SEQ ID NO: 792542 - DNA, 22 bp, Artificial Sequence
  chemically synthesized
caaggttagcagtgaagagtga

SEQ ID NO: 792543 - DNA, 22 bp, Artificial Sequence
  chemically synthesized
cggcccttcactgatgagtcac

SEQ ID NO: 792544 - DNA, 22 bp, Artificial Sequence
  chemically synthesized
ccggcccttcactgatgagtca

SEQ ID NO: 792545 - DNA, 22 bp, Artificial Sequence
  chemically synthesized
gcagtgaagagtgactcatcag

SEQ ID NO: 792546 - DNA, 22 bp, Artificial Sequence
  chemically synthesized
atcagtgaagggccggaagttc

SEQ ID NO: 792547 - DNA, 22 bp, Artificial Sequence
  chemically synthesized
aaccaaaaggaaaagaacttcc

SEQ ID NO: 792548 - DNA, 22 bp, Artificial Sequence
  chemically synthesized
agagatccacattaaaccaaaa

SEQ ID NO: 792549 - DNA, 22 bp, Artificial Sequence
  chemically synthesized
gagagatccacattaaaccaaa

SEQ ID NO: 792550 - DNA, 22 bp, Artificial Sequence
  chemically synthesized
ttttccttttggtttaatgtgg

SEQ ID NO: 792551 - DNA, 22 bp, Artificial Sequence
  chemically synthesized
ttccttttggtttaatgtggat

SEQ ID NO: 792552 - DNA, 22 bp, Artificial Sequence
  chemically synthesized
tccttttggtttaatgtggatc

SEQ ID NO: 792553 - DNA, 22 bp, Artificial Sequence
  chemically synthesized
ccttttggtttaatgtggatct

SEQ ID NO: 792554 - DNA, 22 bp, Artificial Sequence
  chemically synthesized
cttttggtttaatgtggatctc

SEQ ID NO: 792555 - DNA, 22 bp, Artificial Sequence
  chemically synthesized
gaaagtagtttgagagatccac

SEQ ID NO: 792556 - DNA, 22 bp, Artificial Sequence
  chemically synthesized
ttggtttaatgtggatctctca

SEQ ID NO: 792557 - DNA, 22 bp, Artificial Sequence
  chemically synthesized
tggtttaatgtggatctctcaa

SEQ ID NO: 792558 - DNA, 22 bp, Artificial Sequence
  chemically synthesized
ggtttaatgtggatctctcaaa

SEQ ID NO: 792559 - DNA, 22 bp, Artificial Sequence
  chemically synthesized
gtttaatgtggatctctcaaac

SEQ ID NO: 792560 - DNA, 22 bp, Artificial Sequence
  chemically synthesized
ccatattagaaagtagtttgag

SEQ ID NO: 792561 - DNA, 22 bp, Artificial Sequence
  chemically synthesized
aatgtggatctctcaaactact

SEQ ID NO: 792562 - DNA, 22 bp, Artificial Sequence
  chemically synthesized
atgtggatctctcaaactactt

SEQ ID NO: 792563 - DNA, 22 bp, Artificial Sequence
  chemically synthesized
gtggttaccatattagaaagta

SEQ ID NO: 792564 - DNA, 22 bp, Artificial Sequence
  chemically synthesized
tcaaactactttctaatatggt

SEQ ID NO: 792565 - DNA, 22 bp, Artificial Sequence
  chemically synthesized
aaactactttctaatatggtaa

SEQ ID NO: 792566 - DNA, 22 bp, Artificial Sequence
  chemically synthesized
ctttctaatatggtaaccacta

SEQ ID NO: 792567 - DNA, 22 bp, Artificial Sequence
  chemically synthesized
tctaatatggtaaccactagac

SEQ ID NO: 792568 - DNA, 22 bp, Artificial Sequence
  chemically synthesized
ctaatatggtaaccactagaca

SEQ ID NO: 792569 - DNA, 22 bp, Artificial Sequence
  chemically synthesized
agtagccatatgtgtctagtgg

SEQ ID NO: 792570 - DNA, 22 bp, Artificial Sequence
  chemically synthesized
taatatggtaaccactagacac

SEQ ID NO: 792571 - DNA, 22 bp, Artificial Sequence
  chemically synthesized
atatggtaaccactagacacat

SEQ ID NO: 792572 - DNA, 22 bp, Artificial Sequence
  chemically synthesized
aagtgctcagtagccatatgtg

SEQ ID NO: 792573 - DNA, 22 bp, Artificial Sequence
  chemically synthesized
caagtgctcagtagccatatgt

SEQ ID NO: 792574 - DNA, 22 bp, Artificial Sequence
  chemically synthesized
gacacatatggctactgagcac

SEQ ID NO: 792575 - DNA, 22 bp, Artificial Sequence
  chemically synthesized
agatcagccacatttcaagtgc

SEQ ID NO: 792576 - DNA, 22 bp, Artificial Sequence
  chemically synthesized
agttcagatcagccacatttca

SEQ ID NO: 792577 - DNA, 22 bp, Artificial Sequence
  chemically synthesized
ctgagcacttgaaatgtggctg

SEQ ID NO: 792578 - DNA, 22 bp, Artificial Sequence
  chemically synthesized
agcacttgaaatgtggctgatc

SEQ ID NO: 792579 - DNA, 22 bp, Artificial Sequence
  chemically synthesized
cagcgcaactcagttcagatca

SEQ ID NO: 792580 - DNA, 22 bp, Artificial Sequence
  chemically synthesized
acagcgcaactcagttcagatc

SEQ ID NO: 792581 - DNA, 22 bp, Artificial Sequence
  chemically synthesized
gaaatgtggctgatctgaactg

SEQ ID NO: 792582 - DNA, 22 bp, Artificial Sequence
  chemically synthesized
aaatgtggctgatctgaactga

SEQ ID NO: 792583 - DNA, 22 bp, Artificial Sequence
  chemically synthesized
ttacagcgcaactcagttcaga

SEQ ID NO: 792584 - DNA, 22 bp, Artificial Sequence
  chemically synthesized
ctcttacagcgcaactcagttc

SEQ ID NO: 792585 - DNA, 22 bp, Artificial Sequence
  chemically synthesized
actcttacagcgcaactcagtt

SEQ ID NO: 792586 - DNA, 22 bp, Artificial Sequence
  chemically synthesized
tactcttacagcgcaactcagt

SEQ ID NO: 792587 - DNA, 22 bp, Artificial Sequence
  chemically synthesized
atctgaactgagttgcgctgta

SEQ ID NO: 792588 - DNA, 22 bp, Artificial Sequence
  chemically synthesized
gtaagttttactcttacagcgc

SEQ ID NO: 792589 - DNA, 22 bp, Artificial Sequence
  chemically synthesized
aactgagttgcgctgtaagagt

SEQ ID NO: 792590 - DNA, 22 bp, Artificial Sequence
  chemically synthesized
aaatctggtaagttttactctt

SEQ ID NO: 792591 - DNA, 22 bp, Artificial Sequence
  chemically synthesized
agttgcgctgtaagagtaaaac

SEQ ID NO: 792592 - DNA, 22 bp, Artificial Sequence
  chemically synthesized
aaaatctggtaagttttactct

SEQ ID NO: 792593 - DNA, 22 bp, Artificial Sequence
  chemically synthesized
cgctgtaagagtaaaacttacc

SEQ ID NO: 792594 - DNA, 22 bp, Artificial Sequence
  chemically synthesized
agtatttaaaatctggtaagtt

SEQ ID NO: 792595 - DNA, 22 bp, Artificial Sequence
  chemically synthesized
taagagtaaaacttaccagatt

SEQ ID NO: 792596 - DNA, 22 bp, Artificial Sequence
  chemically synthesized
cgttaagtatttaaaatctggt

SEQ ID NO: 792597 - DNA, 22 bp, Artificial Sequence
  chemically synthesized
ccgttaagtatttaaaatctgg

SEQ ID NO: 792598 - DNA, 22 bp, Artificial Sequence
  chemically synthesized
tccgttaagtatttaaaatctg

SEQ ID NO: 792599 - DNA, 22 bp, Artificial Sequence
  chemically synthesized
ttccgttaagtatttaaaatct

SEQ ID NO: 792600 - DNA, 22 bp, Artificial Sequence
  chemically synthesized
tttccgttaagtatttaaaatc

SEQ ID NO: 792601 - DNA, 22 bp, Artificial Sequence
  chemically synthesized
gattttttccgttaagtattta

SEQ ID NO: 792602 - DNA, 22 bp, Artificial Sequence
  chemically synthesized
accagattttaaatacttaacg

SEQ ID NO: 792603 - DNA, 22 bp, Artificial Sequence
  chemically synthesized
ccagattttaaatacttaacgg

SEQ ID NO: 792604 - DNA, 22 bp, Artificial Sequence
  chemically synthesized
attagattttttccgttaagta

SEQ ID NO: 792605 - DNA, 22 bp, Artificial Sequence
  chemically synthesized
ttaattagattttttccgttaa

SEQ ID NO: 792606 - DNA, 22 bp, Artificial Sequence
  chemically synthesized
taaatacttaacggaaaaaatc

SEQ ID NO: 792607 - DNA, 22 bp, Artificial Sequence
  chemically synthesized
aaatacttaacggaaaaaatct

SEQ ID NO: 792608 - DNA, 22 bp, Artificial Sequence
  chemically synthesized
aatacttaacggaaaaaatcta

SEQ ID NO: 792609 - DNA, 22 bp, Artificial Sequence
  chemically synthesized
caaaagttattaattagatttt

SEQ ID NO: 792610 - DNA, 22 bp, Artificial Sequence
  chemically synthesized
ttacaaaagttattaattagat

SEQ ID NO: 792611 - DNA, 22 bp, Artificial Sequence
  chemically synthesized
aacggaaaaaatctaattaata

SEQ ID NO: 792612 - DNA, 22 bp, Artificial Sequence
  chemically synthesized
acggaaaaaatctaattaataa

SEQ ID NO: 792613 - DNA, 22 bp, Artificial Sequence
  chemically synthesized
acatgtaattgttacaaaagtt

SEQ ID NO: 792614 - DNA, 22 bp, Artificial Sequence
  chemically synthesized
aacatgtaattgttacaaaagt

SEQ ID NO: 792615 - DNA, 22 bp, Artificial Sequence
  chemically synthesized
taacatgtaattgttacaaaag

SEQ ID NO: 792616 - DNA, 22 bp, Artificial Sequence
  chemically synthesized
attaataacttttgtaacaatt

SEQ ID NO: 792617 - DNA, 22 bp, Artificial Sequence
  chemically synthesized
tcattttaacatgtaattgtta

SEQ ID NO: 792618 - DNA, 22 bp, Artificial Sequence
  chemically synthesized
ataacttttgtaacaattacat

SEQ ID NO: 792619 - DNA, 22 bp, Artificial Sequence
  chemically synthesized
ttgtaacaattacatgttaaaa

SEQ ID NO: 792620 - DNA, 22 bp, Artificial Sequence
  chemically synthesized
tgtaacaattacatgttaaaat

SEQ ID NO: 792621 - DNA, 22 bp, Artificial Sequence
  chemically synthesized
gtaacaattacatgttaaaatg

SEQ ID NO: 792622 - DNA, 22 bp, Artificial Sequence
  chemically synthesized
taacaattacatgttaaaatga

SEQ ID NO: 792623 - DNA, 22 bp, Artificial Sequence
  chemically synthesized
catgttaaaatgacaatgtttt

SEQ ID NO: 792624 - DNA, 22 bp, Artificial Sequence
  chemically synthesized
aaatgacaatgttttgggtata

SEQ ID NO: 792625 - DNA, 22 bp, Artificial Sequence
  chemically synthesized
tatataacccaatatacccaaa

SEQ ID NO: 792626 - DNA, 22 bp, Artificial Sequence
  chemically synthesized
aacagtatgttgtatataaccc

SEQ ID NO: 792627 - DNA, 22 bp, Artificial Sequence
  chemically synthesized
caacagtatgttgtatataacc

SEQ ID NO: 792628 - DNA, 22 bp, Artificial Sequence
  chemically synthesized
tgggtatattgggttatataca

SEQ ID NO: 792629 - DNA, 22 bp, Artificial Sequence
  chemically synthesized
gggtatattgggttatatacaa

SEQ ID NO: 792630 - DNA, 22 bp, Artificial Sequence
  chemically synthesized
ggtatattgggttatatacaac

SEQ ID NO: 792631 - DNA, 22 bp, Artificial Sequence
  chemically synthesized
atttcaacagtatgttgtatat

SEQ ID NO: 792632 - DNA, 22 bp, Artificial Sequence
  chemically synthesized
ggttatatacaacatactgttg

SEQ ID NO: 792633 - DNA, 22 bp, Artificial Sequence
  chemically synthesized
tatacaacatactgttgaaatt

SEQ ID NO: 792634 - DNA, 22 bp, Artificial Sequence
  chemically synthesized
ttgaaattaatttcacttcttt

SEQ ID NO: 792635 - DNA, 22 bp, Artificial Sequence
  chemically synthesized
aaaaaataaaaataaagaagtg

SEQ ID NO: 792636 - DNA, 22 bp, Artificial Sequence
  chemically synthesized
aaattaatttcacttctttatt

SEQ ID NO: 792637 - DNA, 22 bp, Artificial Sequence
  chemically synthesized
atttcacttctttatttttatt

SEQ ID NO: 792638 - DNA, 22 bp, Artificial Sequence
  chemically synthesized
cacttctttatttttatttttt

SEQ ID NO: 792639 - DNA, 22 bp, Artificial Sequence
  chemically synthesized
gtaggcacactgaaaaaataaa

SEQ ID NO: 792640 - DNA, 22 bp, Artificial Sequence
  chemically synthesized
acttctttatttttattttttc

SEQ ID NO: 792641 - DNA, 22 bp, Artificial Sequence
  chemically synthesized
tagtaggcacactgaaaaaata

SEQ ID NO: 792642 - DNA, 22 bp, Artificial Sequence
  chemically synthesized
tctagtaggcacactgaaaaaa

SEQ ID NO: 792643 - DNA, 22 bp, Artificial Sequence
  chemically synthesized
ctttatttttattttttcagtg

SEQ ID NO: 792644 - DNA, 22 bp, Artificial Sequence
  chemically synthesized
ctctagtaggcacactgaaaaa

SEQ ID NO: 792645 - DNA, 22 bp, Artificial Sequence
  chemically synthesized
tttatttttattttttcagtgt

SEQ ID NO: 792646 - DNA, 22 bp, Artificial Sequence
  chemically synthesized
tatttttattttttcagtgtgc

SEQ ID NO: 792647 - DNA, 22 bp, Artificial Sequence
  chemically synthesized
atttttattttttcagtgtgcc

SEQ ID NO: 792648 - DNA, 22 bp, Artificial Sequence
  chemically synthesized
tttttattttttcagtgtgcct

SEQ ID NO: 792649 - DNA, 22 bp, Artificial Sequence
  chemically synthesized
aatttctctagtaggcacactg

SEQ ID NO: 792650 - DNA, 22 bp, Artificial Sequence
  chemically synthesized
aaatttctctagtaggcacact

SEQ ID NO: 792651 - DNA, 22 bp, Artificial Sequence
  chemically synthesized
ttattttttcagtgtgcctact

SEQ ID NO: 792652 - DNA, 22 bp, Artificial Sequence
  chemically synthesized
tattttttcagtgtgcctacta

SEQ ID NO: 792653 - DNA, 22 bp, Artificial Sequence
  chemically synthesized
attttttcagtgtgcctactag

SEQ ID NO: 792654 - DNA, 22 bp, Artificial Sequence
  chemically synthesized
ttttttcagtgtgcctactaga

SEQ ID NO: 792655 - DNA, 22 bp, Artificial Sequence
  chemically synthesized
tttcagtgtgcctactagagaa

SEQ ID NO: 792656 - DNA, 22 bp, Artificial Sequence
  chemically synthesized
ttcagtgtgcctactagagaaa

SEQ ID NO: 792657 - DNA, 22 bp, Artificial Sequence
  chemically synthesized
tcagtgtgcctactagagaaat

SEQ ID NO: 792658 - DNA, 22 bp, Artificial Sequence
  chemically synthesized
cagtgtgcctactagagaaatt

SEQ ID NO: 792659 - DNA, 22 bp, Artificial Sequence
  chemically synthesized
agtgtgcctactagagaaattt

SEQ ID NO: 792660 - DNA, 22 bp, Artificial Sequence
  chemically synthesized
ctagagaaatttaaattacata

SEQ ID NO: 792661 - DNA, 22 bp, Artificial Sequence
  chemically synthesized
gagaaatttaaattacatatgt

SEQ ID NO: 792662 - DNA, 22 bp, Artificial Sequence
  chemically synthesized
aaattacatatgtggctcacat

SEQ ID NO: 792663 - DNA, 22 bp, Artificial Sequence
  chemically synthesized
aattacatatgtggctcacatt

SEQ ID NO: 792664 - DNA, 22 bp, Artificial Sequence
  chemically synthesized
cccagtagaaataaaatgtgag

SEQ ID NO: 792665 - DNA, 22 bp, Artificial Sequence
  chemically synthesized
tgcccagtagaaataaaatgtg

SEQ ID NO: 792666 - DNA, 22 bp, Artificial Sequence
  chemically synthesized
catatgtggctcacattttatt

SEQ ID NO: 792667 - DNA, 22 bp, Artificial Sequence
  chemically synthesized
cagcagctctgcccagtagaaa

SEQ ID NO: 792668 - DNA, 22 bp, Artificial Sequence
  chemically synthesized
ctacagcagctctgcccagtag

SEQ ID NO: 792669 - DNA, 22 bp, Artificial Sequence
  chemically synthesized
acattttatttctactgggcag

SEQ ID NO: 792670 - DNA, 22 bp, Artificial Sequence
  chemically synthesized
actacagcagctctgcccagta

SEQ ID NO: 792671 - DNA, 22 bp, Artificial Sequence
  chemically synthesized
tactacagcagctctgcccagt

SEQ ID NO: 792672 - DNA, 22 bp, Artificial Sequence
  chemically synthesized
attttactacagcagctctgcc

SEQ ID NO: 792673 - DNA, 22 bp, Artificial Sequence
  chemically synthesized
tatttctactgggcagagctgc

SEQ ID NO: 792674 - DNA, 22 bp, Artificial Sequence
  chemically synthesized
cattttactacagcagctctgc

SEQ ID NO: 792675 - DNA, 22 bp, Artificial Sequence
  chemically synthesized
atttctactgggcagagctgct

SEQ ID NO: 792676 - DNA, 22 bp, Artificial Sequence
  chemically synthesized
tttctactgggcagagctgctg

SEQ ID NO: 792677 - DNA, 22 bp, Artificial Sequence
  chemically synthesized
ttcattttactacagcagctct

SEQ ID NO: 792678 - DNA, 22 bp, Artificial Sequence
  chemically synthesized
tcttcattttactacagcagct

SEQ ID NO: 792679 - DNA, 22 bp, Artificial Sequence
  chemically synthesized
ctactgggcagagctgctgtag

SEQ ID NO: 792680 - DNA, 22 bp, Artificial Sequence
  chemically synthesized
tactgggcagagctgctgtagt

SEQ ID NO: 792681 - DNA, 22 bp, Artificial Sequence
  chemically synthesized
ttctcttcattttactacagca

SEQ ID NO: 792682 - DNA, 22 bp, Artificial Sequence
  chemically synthesized
ctgggcagagctgctgtagtaa

SEQ ID NO: 792683 - DNA, 22 bp, Artificial Sequence
  chemically synthesized
gttctcttcattttactacagc

SEQ ID NO: 792684 - DNA, 22 bp, Artificial Sequence
  chemically synthesized
ttgttctcttcattttactaca

SEQ ID NO: 792685 - DNA, 22 bp, Artificial Sequence
  chemically synthesized
ggcagagctgctgtagtaaaat

SEQ ID NO: 792686 - DNA, 22 bp, Artificial Sequence
  chemically synthesized
ttcttgttctcttcattttact

SEQ ID NO: 792687 - DNA, 22 bp, Artificial Sequence
  chemically synthesized
ctgtagtaaaatgaagagaaca

SEQ ID NO: 792688 - DNA, 22 bp, Artificial Sequence
  chemically synthesized
tggggctattcttgttctcttc

SEQ ID NO: 792689 - DNA, 22 bp, Artificial Sequence
  chemically synthesized
tagtaaaatgaagagaacaaga

SEQ ID NO: 792690 - DNA, 22 bp, Artificial Sequence
  chemically synthesized
agatatctgtggggctattctt

SEQ ID NO: 792691 - DNA, 22 bp, Artificial Sequence
  chemically synthesized
taacaatgaaaactaagatatc

SEQ ID NO: 792692 - DNA, 22 bp, Artificial Sequence
  chemically synthesized
gtaacaatgaaaactaagatat

SEQ ID NO: 792693 - DNA, 22 bp, Artificial Sequence
  chemically synthesized
gcttgtaacaatgaaaactaag

SEQ ID NO: 792694 - DNA, 22 bp, Artificial Sequence
  chemically synthesized
ttggcttgtaacaatgaaaact

SEQ ID NO: 792695 - DNA, 22 bp, Artificial Sequence
  chemically synthesized
ataaattgttggcttgtaacaa

SEQ ID NO: 792696 - DNA, 22 bp, Artificial Sequence
  chemically synthesized
agttttcattgttacaagccaa

SEQ ID NO: 792697 - DNA, 22 bp, Artificial Sequence
  chemically synthesized
tctaataaattgttggcttgta

SEQ ID NO: 792698 - DNA, 22 bp, Artificial Sequence
  chemically synthesized
gttttcattgttacaagccaac

SEQ ID NO: 792699 - DNA, 22 bp, Artificial Sequence
  chemically synthesized
tcattgttacaagccaacaatt

SEQ ID NO: 792700 - DNA, 22 bp, Artificial Sequence
  chemically synthesized
cattgttacaagccaacaattt

SEQ ID NO: 792701 - DNA, 22 bp, Artificial Sequence
  chemically synthesized
attgttacaagccaacaattta

SEQ ID NO: 792702 - DNA, 22 bp, Artificial Sequence
  chemically synthesized
ttacaagccaacaatttattag

SEQ ID NO: 792703 - DNA, 22 bp, Artificial Sequence
  chemically synthesized
caagccaacaatttattagaca

SEQ ID NO: 792704 - DNA, 22 bp, Artificial Sequence
  chemically synthesized
aagtcagagaaaattgtctaat

SEQ ID NO: 792705 - DNA, 22 bp, Artificial Sequence
  chemically synthesized
caagtcagagaaaattgtctaa

SEQ ID NO: 792706 - DNA, 22 bp, Artificial Sequence
  chemically synthesized
tgtcatttcaagtcagagaaaa

SEQ ID NO: 792707 - DNA, 22 bp, Artificial Sequence
  chemically synthesized
gtgtcatttcaagtcagagaaa

SEQ ID NO: 792708 - DNA, 22 bp, Artificial Sequence
  chemically synthesized
tgtgtcatttcaagtcagagaa

SEQ ID NO: 792709 - DNA, 22 bp, Artificial Sequence
  chemically synthesized
attagacaattttctctgactt

SEQ ID NO: 792710 - DNA, 22 bp, Artificial Sequence
  chemically synthesized
ttgtgtcatttcaagtcagaga

SEQ ID NO: 792711 - DNA, 22 bp, Artificial Sequence
  chemically synthesized
ttagacaattttctctgacttg

SEQ ID NO: 792712 - DNA, 22 bp, Artificial Sequence
  chemically synthesized
gacaattttctctgacttgaaa

SEQ ID NO: 792713 - DNA, 22 bp, Artificial Sequence
  chemically synthesized
agatttttgtgtcatttcaagt

SEQ ID NO: 792714 - DNA, 22 bp, Artificial Sequence
  chemically synthesized
tgagatttttgtgtcatttcaa

SEQ ID NO: 792715 - DNA, 22 bp, Artificial Sequence
  chemically synthesized
tctgagatttttgtgtcatttc

SEQ ID NO: 792716 - DNA, 22 bp, Artificial Sequence
  chemically synthesized
tctctgacttgaaatgacacaa

SEQ ID NO: 792717 - DNA, 22 bp, Artificial Sequence
  chemically synthesized
ctctgacttgaaatgacacaaa

SEQ ID NO: 792718 - DNA, 22 bp, Artificial Sequence
  chemically synthesized
tctgacttgaaatgacacaaaa

SEQ ID NO: 792719 - DNA, 22 bp, Artificial Sequence
  chemically synthesized
tgacttgaaatgacacaaaaat

SEQ ID NO: 792720 - DNA, 22 bp, Artificial Sequence
  chemically synthesized
acttgaaatgacacaaaaatct

SEQ ID NO: 792721 - DNA, 22 bp, Artificial Sequence
  chemically synthesized
gaaatgacacaaaaatctcaga

SEQ ID NO: 792722 - DNA, 22 bp, Artificial Sequence
  chemically synthesized
aaatgacacaaaaatctcagag

SEQ ID NO: 792723 - DNA, 22 bp, Artificial Sequence
  chemically synthesized
acaccacaggatctctctgaga

SEQ ID NO: 792724 - DNA, 22 bp, Artificial Sequence
  chemically synthesized
caaacgctcacaccacaggatc

SEQ ID NO: 792725 - DNA, 22 bp, Artificial Sequence
  chemically synthesized
actccaaacgctcacaccacag

SEQ ID NO: 792726 - DNA, 22 bp, Artificial Sequence
  chemically synthesized
tgactccaaacgctcacaccac

SEQ ID NO: 792727 - DNA, 22 bp, Artificial Sequence
  chemically synthesized
agagagatcctgtggtgtgagc

SEQ ID NO: 792728 - DNA, 22 bp, Artificial Sequence
  chemically synthesized
tggtgtgagcgtttggagtcag

SEQ ID NO: 792729 - DNA, 22 bp, Artificial Sequence
  chemically synthesized
ggagtcagaggcctatttttca

SEQ ID NO: 792730 - DNA, 22 bp, Artificial Sequence
  chemically synthesized
gagtcagaggcctatttttcat

SEQ ID NO: 792731 - DNA, 22 bp, Artificial Sequence
  chemically synthesized
aaccagaacaatggtccatgaa

SEQ ID NO: 792732 - DNA, 22 bp, Artificial Sequence
  chemically synthesized
aactaaaccagaacaatggtcc

SEQ ID NO: 792733 - DNA, 22 bp, Artificial Sequence
  chemically synthesized
ttaaactaaaccagaacaatgg

SEQ ID NO: 792734 - DNA, 22 bp, Artificial Sequence
  chemically synthesized
tttttcatggaccattgttctg

SEQ ID NO: 792735 - DNA, 22 bp, Artificial Sequence
  chemically synthesized
gttaaactaaaccagaacaatg

SEQ ID NO: 792736 - DNA, 22 bp, Artificial Sequence
  chemically synthesized
ttcatggaccattgttctggtt

SEQ ID NO: 792737 - DNA, 22 bp, Artificial Sequence
  chemically synthesized
tcatggaccattgttctggttt

SEQ ID NO: 792738 - DNA, 22 bp, Artificial Sequence
  chemically synthesized
catggaccattgttctggttta

SEQ ID NO: 792739 - DNA, 22 bp, Artificial Sequence
  chemically synthesized
atggaccattgttctggtttag

SEQ ID NO: 792740 - DNA, 22 bp, Artificial Sequence
  chemically synthesized
tagtagatttgttaaactaaac

SEQ ID NO: 792741 - DNA, 22 bp, Artificial Sequence
  chemically synthesized
cactatagtagatttgttaaac

SEQ ID NO: 792742 - DNA, 22 bp, Artificial Sequence
  chemically synthesized
ttctggtttagtttaacaaatc

SEQ ID NO: 792743 - DNA, 22 bp, Artificial Sequence
  chemically synthesized
tggtttagtttaacaaatctac

SEQ ID NO: 792744 - DNA, 22 bp, Artificial Sequence
  chemically synthesized
tattacactatagtagatttgt

SEQ ID NO: 792745 - DNA, 22 bp, Artificial Sequence
  chemically synthesized
gtttagtttaacaaatctacta

SEQ ID NO: 792746 - DNA, 22 bp, Artificial Sequence
  chemically synthesized
tactatattacactatagtaga

SEQ ID NO: 792747 - DNA, 22 bp, Artificial Sequence
  chemically synthesized
agtttaacaaatctactatagt

SEQ ID NO: 792748 - DNA, 22 bp, Artificial Sequence
  chemically synthesized
atactatattacactatagtag

SEQ ID NO: 792749 - DNA, 22 bp, Artificial Sequence
  chemically synthesized
gtttaacaaatctactatagtg

SEQ ID NO: 792750 - DNA, 22 bp, Artificial Sequence
  chemically synthesized
aacaaatctactatagtgtaat

SEQ ID NO: 792751 - DNA, 22 bp, Artificial Sequence
  chemically synthesized
acaaatctactatagtgtaata

SEQ ID NO: 792752 - DNA, 22 bp, Artificial Sequence
  chemically synthesized
ctatagtgtaatatagtataaa

SEQ ID NO: 792753 - DNA, 22 bp, Artificial Sequence
  chemically synthesized
tagtgtaatatagtataaacta

SEQ ID NO: 792754 - DNA, 22 bp, Artificial Sequence
  chemically synthesized
aatgaacaaaaatgcaaaaata

SEQ ID NO: 792755 - DNA, 22 bp, Artificial Sequence
  chemically synthesized
taaatgaacaaaaatgcaaaaa

SEQ ID NO: 792756 - DNA, 22 bp, Artificial Sequence
  chemically synthesized
ctaaatgaacaaaaatgcaaaa

SEQ ID NO: 792757 - DNA, 22 bp, Artificial Sequence
  chemically synthesized
ataaacttctaaatgaacaaaa

SEQ ID NO: 792758 - DNA, 22 bp, Artificial Sequence
  chemically synthesized
cataaacttctaaatgaacaaa

SEQ ID NO: 792759 - DNA, 22 bp, Artificial Sequence
  chemically synthesized
tcataaacttctaaatgaacaa

SEQ ID NO: 792760 - DNA, 22 bp, Artificial Sequence
  chemically synthesized
tttttgcatttttgttcattta

SEQ ID NO: 792761 - DNA, 22 bp, Artificial Sequence
  chemically synthesized
ttgcatttttgttcatttagaa

SEQ ID NO: 792762 - DNA, 22 bp, Artificial Sequence
  chemically synthesized
actttcataaacttctaaatga

SEQ ID NO: 792763 - DNA, 22 bp, Artificial Sequence
  chemically synthesized
tgcatttttgttcatttagaag

SEQ ID NO: 792764 - DNA, 22 bp, Artificial Sequence
  chemically synthesized
gcatttttgttcatttagaagt

SEQ ID NO: 792765 - DNA, 22 bp, Artificial Sequence
  chemically synthesized
catttttgttcatttagaagtt

SEQ ID NO: 792766 - DNA, 22 bp, Artificial Sequence
  chemically synthesized
ctgactttcataaacttctaaa

SEQ ID NO: 792767 - DNA, 22 bp, Artificial Sequence
  chemically synthesized
gctgactttcataaacttctaa

SEQ ID NO: 792768 - DNA, 22 bp, Artificial Sequence
  chemically synthesized
ttgttcatttagaagtttatga

SEQ ID NO: 792769 - DNA, 22 bp, Artificial Sequence
  chemically synthesized
tgttcatttagaagtttatgaa

SEQ ID NO: 792770 - DNA, 22 bp, Artificial Sequence
  chemically synthesized
atcttgctgactttcataaact

SEQ ID NO: 792771 - DNA, 22 bp, Artificial Sequence
  chemically synthesized
gttcatttagaagtttatgaaa

SEQ ID NO: 792772 - DNA, 22 bp, Artificial Sequence
  chemically synthesized
ttcatttagaagtttatgaaag

SEQ ID NO: 792773 - DNA, 22 bp, Artificial Sequence
  chemically synthesized
atttagaagtttatgaaagtca

SEQ ID NO: 792774 - DNA, 22 bp, Artificial Sequence
  chemically synthesized
agaagtttatgaaagtcagcaa

SEQ ID NO: 792775 - DNA, 22 bp, Artificial Sequence
  chemically synthesized
gaagtttatgaaagtcagcaag

SEQ ID NO: 792776 - DNA, 22 bp, Artificial Sequence
  chemically synthesized
atgaaagtcagcaagatgagca

SEQ ID NO: 792777 - DNA, 22 bp, Artificial Sequence
  chemically synthesized
tgaaagtcagcaagatgagcat

SEQ ID NO: 792778 - DNA, 22 bp, Artificial Sequence
  chemically synthesized
catcatacatcaatcacaaaaa

SEQ ID NO: 792779 - DNA, 22 bp, Artificial Sequence
  chemically synthesized
ttgcatcatacatcaatcacaa

SEQ ID NO: 792780 - DNA, 22 bp, Artificial Sequence
  chemically synthesized
attgcatcatacatcaatcaca

SEQ ID NO: 792781 - DNA, 22 bp, Artificial Sequence
  chemically synthesized
ttgtgattgatgtatgatgcaa

SEQ ID NO: 792782 - DNA, 22 bp, Artificial Sequence
  chemically synthesized
tgtgattgatgtatgatgcaat

SEQ ID NO: 792783 - DNA, 22 bp, Artificial Sequence
  chemically synthesized
gcaatgcaatttattgcatcat

SEQ ID NO: 792784 - DNA, 22 bp, Artificial Sequence
  chemically synthesized
gtgattgatgtatgatgcaata

SEQ ID NO: 792785 - DNA, 22 bp, Artificial Sequence
  chemically synthesized
tgattgatgtatgatgcaataa

SEQ ID NO: 792786 - DNA, 22 bp, Artificial Sequence
  chemically synthesized
aattggcaatgcaatttattgc

SEQ ID NO: 792787 - DNA, 22 bp, Artificial Sequence
  chemically synthesized
taaattggcaatgcaatttatt

SEQ ID NO: 792788 - DNA, 22 bp, Artificial Sequence
  chemically synthesized
atgtatgatgcaataaattgca

SEQ ID NO: 792789 - DNA, 22 bp, Artificial Sequence
  chemically synthesized
ctaaattggcaatgcaatttat

SEQ ID NO: 792790 - DNA, 22 bp, Artificial Sequence
  chemically synthesized
catttctaaattggcaatgcaa

SEQ ID NO: 792791 - DNA, 22 bp, Artificial Sequence
  chemically synthesized
ttacatttctaaattggcaatg

SEQ ID NO: 792792 - DNA, 22 bp, Artificial Sequence
  chemically synthesized
agattattacatttctaaattg

SEQ ID NO: 792793 - DNA, 22 bp, Artificial Sequence
  chemically synthesized
cattgccaatttagaaatgtaa

SEQ ID NO: 792794 - DNA, 22 bp, Artificial Sequence
  chemically synthesized
ccaatttagaaatgtaataatc

SEQ ID NO: 792795 - DNA, 22 bp, Artificial Sequence
  chemically synthesized
atgatcaaaaattcagattatt

SEQ ID NO: 792796 - DNA, 22 bp, Artificial Sequence
  chemically synthesized
gatgatcaaaaattcagattat

SEQ ID NO: 792797 - DNA, 22 bp, Artificial Sequence
  chemically synthesized
agaaatgtaataatctgaattt

SEQ ID NO: 792798 - DNA, 22 bp, Artificial Sequence
  chemically synthesized
gaaatgtaataatctgaatttt

SEQ ID NO: 792799 - DNA, 22 bp, Artificial Sequence
  chemically synthesized
tgcataaacttgatgatcaaaa

SEQ ID NO: 792800 - DNA, 22 bp, Artificial Sequence
  chemically synthesized
aatttttgatcatcaagtttat

SEQ ID NO: 792801 - DNA, 22 bp, Artificial Sequence
  chemically synthesized
aaaaatacattatgcataaact

SEQ ID NO: 792802 - DNA, 22 bp, Artificial Sequence
  chemically synthesized
ttgatcatcaagtttatgcata

SEQ ID NO: 792803 - DNA, 22 bp, Artificial Sequence
  chemically synthesized
tcaaaaatacattatgcataaa

SEQ ID NO: 792804 - DNA, 22 bp, Artificial Sequence
  chemically synthesized
tgatcatcaagtttatgcataa

SEQ ID NO: 792805 - DNA, 22 bp, Artificial Sequence
  chemically synthesized
gatcatcaagtttatgcataat

SEQ ID NO: 792806 - DNA, 22 bp, Artificial Sequence
  chemically synthesized
tctcaaaaatacattatgcata

SEQ ID NO: 792807 - DNA, 22 bp, Artificial Sequence
  chemically synthesized
atcatcaagtttatgcataatg

SEQ ID NO: 792808 - DNA, 22 bp, Artificial Sequence
  chemically synthesized
ctctcaaaaatacattatgcat

SEQ ID NO: 792809 - DNA, 22 bp, Artificial Sequence
  chemically synthesized
tctctcaaaaatacattatgca

SEQ ID NO: 792810 - DNA, 22 bp, Artificial Sequence
  chemically synthesized
ttttctctcaaaaatacattat

SEQ ID NO: 792811 - DNA, 22 bp, Artificial Sequence
  chemically synthesized
attttctctcaaaaatacatta

SEQ ID NO: 792812 - DNA, 22 bp, Artificial Sequence
  chemically synthesized
tgtttattttctctcaaaaata

SEQ ID NO: 792813 - DNA, 22 bp, Artificial Sequence
  chemically synthesized
gtgtttattttctctcaaaaat

SEQ ID NO: 792814 - DNA, 22 bp, Artificial Sequence
  chemically synthesized
atgcataatgtatttttgagag

SEQ ID NO: 792815 - DNA, 22 bp, Artificial Sequence
  chemically synthesized
tgcataatgtatttttgagaga

SEQ ID NO: 792816 - DNA, 22 bp, Artificial Sequence
  chemically synthesized
cttgtgtttattttctctcaaa

SEQ ID NO: 792817 - DNA, 22 bp, Artificial Sequence
  chemically synthesized
gcttgtgtttattttctctcaa

SEQ ID NO: 792818 - DNA, 22 bp, Artificial Sequence
  chemically synthesized
tgcttgtgtttattttctctca

SEQ ID NO: 792819 - DNA, 22 bp, Artificial Sequence
  chemically synthesized
tttgcttgtgtttattttctct

SEQ ID NO: 792820 - DNA, 22 bp, Artificial Sequence
  chemically synthesized
attctttgcttgtgtttatttt

SEQ ID NO: 792821 - DNA, 22 bp, Artificial Sequence
  chemically synthesized
ttgattctttgcttgtgtttat

SEQ ID NO: 792822 - DNA, 22 bp, Artificial Sequence
  chemically synthesized
ttgagagaaaataaacacaagc

SEQ ID NO: 792823 - DNA, 22 bp, Artificial Sequence
  chemically synthesized
tgagagaaaataaacacaagca

SEQ ID NO: 792824 - DNA, 22 bp, Artificial Sequence
  chemically synthesized
gagagaaaataaacacaagcaa

SEQ ID NO: 792825 - DNA, 22 bp, Artificial Sequence
  chemically synthesized
agagaaaataaacacaagcaaa

SEQ ID NO: 792826 - DNA, 22 bp, Artificial Sequence
  chemically synthesized
gggaaatgctattgattctttg

SEQ ID NO: 792827 - DNA, 22 bp, Artificial Sequence
  chemically synthesized
ggggctggggaaatgctattga

SEQ ID NO: 792828 - DNA, 22 bp, Artificial Sequence
  chemically synthesized
ccccgaggattgggggctgggg

SEQ ID NO: 792829 - DNA, 22 bp, Artificial Sequence
  chemically synthesized
ccccagcccccaatcctcgggg

SEQ ID NO: 792830 - DNA, 22 bp, Artificial Sequence
  chemically synthesized
cccagcccccaatcctcggggg

SEQ ID NO: 792831 - DNA, 22 bp, Artificial Sequence
  chemically synthesized
aatataatgagagagaatctcc

SEQ ID NO: 792832 - DNA, 22 bp, Artificial Sequence
  chemically synthesized
gggggagattctctctcattat

SEQ ID NO: 792833 - DNA, 22 bp, Artificial Sequence
  chemically synthesized
aaagaggaaattaaatataatg

SEQ ID NO: 792834 - DNA, 22 bp, Artificial Sequence
  chemically synthesized
attcaaagaggaaattaaatat

SEQ ID NO: 792835 - DNA, 22 bp, Artificial Sequence
  chemically synthesized
tctctcattatatttaatttcc

SEQ ID NO: 792836 - DNA, 22 bp, Artificial Sequence
  chemically synthesized
tctcattatatttaatttcctc

SEQ ID NO: 792837 - DNA, 22 bp, Artificial Sequence
  chemically synthesized
tcattatatttaatttcctctt

SEQ ID NO: 792838 - DNA, 22 bp, Artificial Sequence
  chemically synthesized
attatatttaatttcctctttg

SEQ ID NO: 792839 - DNA, 22 bp, Artificial Sequence
  chemically synthesized
aaatgagttaattcaaagagga

SEQ ID NO: 792840 - DNA, 22 bp, Artificial Sequence
  chemically synthesized
aaaatgagttaattcaaagagg

SEQ ID NO: 792841 - DNA, 22 bp, Artificial Sequence
  chemically synthesized
taaaatgagttaattcaaagag

SEQ ID NO: 792842 - DNA, 22 bp, Artificial Sequence
  chemically synthesized
tatttaatttcctctttgaatt

SEQ ID NO: 792843 - DNA, 22 bp, Artificial Sequence
  chemically synthesized
ttaaaatgagttaattcaaaga

SEQ ID NO: 792844 - DNA, 22 bp, Artificial Sequence
  chemically synthesized
tcttttaaaatgagttaattca

SEQ ID NO: 792845 - DNA, 22 bp, Artificial Sequence
  chemically synthesized
aatttcctctttgaattaactc

SEQ ID NO: 792846 - DNA, 22 bp, Artificial Sequence
  chemically synthesized
atttcctctttgaattaactca

SEQ ID NO: 792847 - DNA, 22 bp, Artificial Sequence
  chemically synthesized
ctgtcttttaaaatgagttaat

SEQ ID NO: 792848 - DNA, 22 bp, Artificial Sequence
  chemically synthesized
actgtcttttaaaatgagttaa

SEQ ID NO: 792849 - DNA, 22 bp, Artificial Sequence
  chemically synthesized
tactgtcttttaaaatgagtta

SEQ ID NO: 792850 - DNA, 22 bp, Artificial Sequence
  chemically synthesized
cctctttgaattaactcatttt

SEQ ID NO: 792851 - DNA, 22 bp, Artificial Sequence
  chemically synthesized
ctctttgaattaactcatttta

SEQ ID NO: 792852 - DNA, 22 bp, Artificial Sequence
  chemically synthesized
ttttactgtcttttaaaatgag

SEQ ID NO: 792853 - DNA, 22 bp, Artificial Sequence
  chemically synthesized
tttgaattaactcattttaaaa

SEQ ID NO: 792854 - DNA, 22 bp, Artificial Sequence
  chemically synthesized
tgaattaactcattttaaaaga

SEQ ID NO: 792855 - DNA, 22 bp, Artificial Sequence
  chemically synthesized
gaattaactcattttaaaagac

SEQ ID NO: 792856 - DNA, 22 bp, Artificial Sequence
  chemically synthesized
aattaactcattttaaaagaca

SEQ ID NO: 792857 - DNA, 22 bp, Artificial Sequence
  chemically synthesized
agcctattttactgtcttttaa

SEQ ID NO: 792858 - DNA, 22 bp, Artificial Sequence
  chemically synthesized
gagcctattttactgtctttta

SEQ ID NO: 792859 - DNA, 22 bp, Artificial Sequence
  chemically synthesized
actcattttaaaagacagtaaa

SEQ ID NO: 792860 - DNA, 22 bp, Artificial Sequence
  chemically synthesized
attttaaaagacagtaaaatag

SEQ ID NO: 792861 - DNA, 22 bp, Artificial Sequence
  chemically synthesized
aaacatttgagcctattttact

SEQ ID NO: 792862 - DNA, 22 bp, Artificial Sequence
  chemically synthesized
taaaagacagtaaaataggctc

SEQ ID NO: 792863 - DNA, 22 bp, Artificial Sequence
  chemically synthesized
aaaagacagtaaaataggctca

SEQ ID NO: 792864 - DNA, 22 bp, Artificial Sequence
  chemically synthesized
aaagacagtaaaataggctcaa

SEQ ID NO: 792865 - DNA, 22 bp, Artificial Sequence
  chemically synthesized
agaaaaaaatcagaaatacaat

SEQ ID NO: 792866 - DNA, 22 bp, Artificial Sequence
  chemically synthesized
cagaaaaaaatcagaaatacaa

SEQ ID NO: 792867 - DNA, 22 bp, Artificial Sequence
  chemically synthesized
aaatgttttaattgtatttctg

SEQ ID NO: 792868 - DNA, 22 bp, Artificial Sequence
  chemically synthesized
acttcagaaaaaaatcagaaat

SEQ ID NO: 792869 - DNA, 22 bp, Artificial Sequence
  chemically synthesized
aacttcagaaaaaaatcagaaa

SEQ ID NO: 792870 - DNA, 22 bp, Artificial Sequence
  chemically synthesized
ttaacttcagaaaaaaatcaga

SEQ ID NO: 792871 - DNA, 22 bp, Artificial Sequence
  chemically synthesized
taattgtatttctgattttttt

SEQ ID NO: 792872 - DNA, 22 bp, Artificial Sequence
  chemically synthesized
aattgtatttctgatttttttc

SEQ ID NO: 792873 - DNA, 22 bp, Artificial Sequence
  chemically synthesized
ctcttaacttcagaaaaaaatc

SEQ ID NO: 792874 - DNA, 22 bp, Artificial Sequence
  chemically synthesized
attgtatttctgatttttttct

SEQ ID NO: 792875 - DNA, 22 bp, Artificial Sequence
  chemically synthesized
gctcttaacttcagaaaaaaat

SEQ ID NO: 792876 - DNA, 22 bp, Artificial Sequence
  chemically synthesized
tgctcttaacttcagaaaaaaa

SEQ ID NO: 792877 - DNA, 22 bp, Artificial Sequence
  chemically synthesized
tatttctgatttttttctgaag

SEQ ID NO: 792878 - DNA, 22 bp, Artificial Sequence
  chemically synthesized
ctttgctcttaacttcagaaaa

SEQ ID NO: 792879 - DNA, 22 bp, Artificial Sequence
  chemically synthesized
ctgatttttttctgaagttaag

SEQ ID NO: 792880 - DNA, 22 bp, Artificial Sequence
  chemically synthesized
tgatttttttctgaagttaaga

SEQ ID NO: 792881 - DNA, 22 bp, Artificial Sequence
  chemically synthesized
agtctactttgctcttaacttc

SEQ ID NO: 792882 - DNA, 22 bp, Artificial Sequence
  chemically synthesized
atttttttctgaagttaagagc

SEQ ID NO: 792883 - DNA, 22 bp, Artificial Sequence
  chemically synthesized
actcagtctactttgctcttaa

SEQ ID NO: 792884 - DNA, 22 bp, Artificial Sequence
  chemically synthesized
ttttctgaagttaagagcaaag

SEQ ID NO: 792885 - DNA, 22 bp, Artificial Sequence
  chemically synthesized
tttctgaagttaagagcaaagt

SEQ ID NO: 792886 - DNA, 22 bp, Artificial Sequence
  chemically synthesized
ttctgaagttaagagcaaagta

SEQ ID NO: 792887 - DNA, 22 bp, Artificial Sequence
  chemically synthesized
tctgaagttaagagcaaagtag

SEQ ID NO: 792888 - DNA, 22 bp, Artificial Sequence
  chemically synthesized
ctgaagttaagagcaaagtaga

SEQ ID NO: 792889 - DNA, 22 bp, Artificial Sequence
  chemically synthesized
tgaagttaagagcaaagtagac

SEQ ID NO: 792890 - DNA, 22 bp, Artificial Sequence
  chemically synthesized
tcaattcactcagtctactttg

SEQ ID NO: 792891 - DNA, 22 bp, Artificial Sequence
  chemically synthesized
aagttaagagcaaagtagactg

SEQ ID NO: 792892 - DNA, 22 bp, Artificial Sequence
  chemically synthesized
ccatctgtcaattcactcagtc

SEQ ID NO: 792893 - DNA, 22 bp, Artificial Sequence
  chemically synthesized
agagcaaagtagactgagtgaa

SEQ ID NO: 792894 - DNA, 22 bp, Artificial Sequence
  chemically synthesized
agtgaattgacagatggtaatg

SEQ ID NO: 792895 - DNA, 22 bp, Artificial Sequence
  chemically synthesized
aaataaatggtgtgcaaaatca

SEQ ID NO: 792896 - DNA, 22 bp, Artificial Sequence
  chemically synthesized
acagatggtaatgattttgcac

SEQ ID NO: 792897 - DNA, 22 bp, Artificial Sequence
  chemically synthesized
gtcctgaaataaatggtgtgca

SEQ ID NO: 792898 - DNA, 22 bp, Artificial Sequence
  chemically synthesized
ccgttagtcctgaaataaatgg

SEQ ID NO: 792899 - DNA, 22 bp, Artificial Sequence
  chemically synthesized
gccgttagtcctgaaataaatg

SEQ ID NO: 792900 - DNA, 22 bp, Artificial Sequence
  chemically synthesized
tgcacaccatttatttcaggac

SEQ ID NO: 792901 - DNA, 22 bp, Artificial Sequence
  chemically synthesized
gcacaccatttatttcaggact

SEQ ID NO: 792902 - DNA, 22 bp, Artificial Sequence
  chemically synthesized
cacaccatttatttcaggacta

SEQ ID NO: 792903 - DNA, 22 bp, Artificial Sequence
  chemically synthesized
atagaacttgccgttagtcctg

SEQ ID NO: 792904 - DNA, 22 bp, Artificial Sequence
  chemically synthesized
aatagaacttgccgttagtcct

SEQ ID NO: 792905 - DNA, 22 bp, Artificial Sequence
  chemically synthesized
taatagaacttgccgttagtcc

SEQ ID NO: 792906 - DNA, 22 bp, Artificial Sequence
  chemically synthesized
ctttaatagaacttgccgttag

SEQ ID NO: 792907 - DNA, 22 bp, Artificial Sequence
  chemically synthesized
atttcaggactaacggcaagtt

SEQ ID NO: 792908 - DNA, 22 bp, Artificial Sequence
  chemically synthesized
tttcaggactaacggcaagttc

SEQ ID NO: 792909 - DNA, 22 bp, Artificial Sequence
  chemically synthesized
caggactaacggcaagttctat

SEQ ID NO: 792910 - DNA, 22 bp, Artificial Sequence
  chemically synthesized
aggactaacggcaagttctatt

SEQ ID NO: 792911 - DNA, 22 bp, Artificial Sequence
  chemically synthesized
ggaggaactactttaatagaac

SEQ ID NO: 792912 - DNA, 22 bp, Artificial Sequence
  chemically synthesized
aggaggaactactttaatagaa

SEQ ID NO: 792913 - DNA, 22 bp, Artificial Sequence
  chemically synthesized
cttaggaggaactactttaata

SEQ ID NO: 792914 - DNA, 22 bp, Artificial Sequence
  chemically synthesized
acggcaagttctattaaagtag

SEQ ID NO: 792915 - DNA, 22 bp, Artificial Sequence
  chemically synthesized
agataaactccttaggaggaac

SEQ ID NO: 792916 - DNA, 22 bp, Artificial Sequence
  chemically synthesized
tattaaagtagttcctcctaag

SEQ ID NO: 792917 - DNA, 22 bp, Artificial Sequence
  chemically synthesized
ttaaagtagttcctcctaagga

SEQ ID NO: 792918 - DNA, 22 bp, Artificial Sequence
  chemically synthesized
gttgagataaactccttaggag

SEQ ID NO: 792919 - DNA, 22 bp, Artificial Sequence
  chemically synthesized
aagtagttcctcctaaggagtt

SEQ ID NO: 792920 - DNA, 22 bp, Artificial Sequence
  chemically synthesized
actggttgagataaactcctta

SEQ ID NO: 792921 - DNA, 22 bp, Artificial Sequence
  chemically synthesized
ctcctaaggagtttatctcaac

SEQ ID NO: 792922 - DNA, 22 bp, Artificial Sequence
  chemically synthesized
ctaaggagtttatctcaaccag

SEQ ID NO: 792923 - DNA, 22 bp, Artificial Sequence
  chemically synthesized
aatggaaattcactggttgaga

SEQ ID NO: 792924 - DNA, 22 bp, Artificial Sequence
  chemically synthesized
aggagtttatctcaaccagtga

SEQ ID NO: 792925 - DNA, 22 bp, Artificial Sequence
  chemically synthesized
aaggctgaatggaaattcactg

SEQ ID NO: 792926 - DNA, 22 bp, Artificial Sequence
  chemically synthesized
atctcaaccagtgaatttccat

SEQ ID NO: 792927 - DNA, 22 bp, Artificial Sequence
  chemically synthesized
tctcaaccagtgaatttccatt

SEQ ID NO: 792928 - DNA, 22 bp, Artificial Sequence
  chemically synthesized
aaccagtgaatttccattcagc

SEQ ID NO: 792929 - DNA, 22 bp, Artificial Sequence
  chemically synthesized
agtcaagtgttaaaggctgaat

SEQ ID NO: 792930 - DNA, 22 bp, Artificial Sequence
  chemically synthesized
gagtcaagtgttaaaggctgaa

SEQ ID NO: 792931 - DNA, 22 bp, Artificial Sequence
  chemically synthesized
ccattcagcctttaacacttga

SEQ ID NO: 792932 - DNA, 22 bp, Artificial Sequence
  chemically synthesized
cattcagcctttaacacttgac

SEQ ID NO: 792933 - DNA, 22 bp, Artificial Sequence
  chemically synthesized
agcctttaacacttgactcaaa

SEQ ID NO: 792934 - DNA, 22 bp, Artificial Sequence
  chemically synthesized
gaggaggaggtggcatttgagt

SEQ ID NO: 792935 - DNA, 22 bp, Artificial Sequence
  chemically synthesized
agaggaggaggtggcatttgag

SEQ ID NO: 792936 - DNA, 22 bp, Artificial Sequence
  chemically synthesized
tagaggaggaggtggcatttga

SEQ ID NO: 792937 - DNA, 22 bp, Artificial Sequence
  chemically synthesized
taacacttgactcaaatgccac

SEQ ID NO: 792938 - DNA, 22 bp, Artificial Sequence
  chemically synthesized
ttagaggaggaggtggcatttg

SEQ ID NO: 792939 - DNA, 22 bp, Artificial Sequence
  chemically synthesized
aacacttgactcaaatgccacc

SEQ ID NO: 792940 - DNA, 22 bp, Artificial Sequence
  chemically synthesized
tttagaggaggaggtggcattt

SEQ ID NO: 792941 - DNA, 22 bp, Artificial Sequence
  chemically synthesized
acacttgactcaaatgccacct

SEQ ID NO: 792942 - DNA, 22 bp, Artificial Sequence
  chemically synthesized
gactcaaatgccacctcctcct

SEQ ID NO: 792943 - DNA, 22 bp, Artificial Sequence
  chemically synthesized
actcaaatgccacctcctcctc

SEQ ID NO: 792944 - DNA, 22 bp, Artificial Sequence
  chemically synthesized
aaatgccacctcctcctctaaa

SEQ ID NO: 792945 - DNA, 22 bp, Artificial Sequence
  chemically synthesized
cccaataggaccaggcaaggct

SEQ ID NO: 792946 - DNA, 22 bp, Artificial Sequence
  chemically synthesized
ctcctctaaaaagccttgcctg

SEQ ID NO: 792947 - DNA, 22 bp, Artificial Sequence
  chemically synthesized
ctctaaaaagccttgcctggtc

SEQ ID NO: 792948 - DNA, 22 bp, Artificial Sequence
  chemically synthesized
taaaaagccttgcctggtccta

SEQ ID NO: 792949 - DNA, 22 bp, Artificial Sequence
  chemically synthesized
aaaagccttgcctggtcctatt

SEQ ID NO: 792950 - DNA, 22 bp, Artificial Sequence
  chemically synthesized
gcctggtcctattgggcagtta

SEQ ID NO: 792951 - DNA, 22 bp, Artificial Sequence
  chemically synthesized
cctggtcctattgggcagttat

SEQ ID NO: 792952 - DNA, 22 bp, Artificial Sequence
  chemically synthesized
gtcctattgggcagttatccac

SEQ ID NO: 792953 - DNA, 22 bp, Artificial Sequence
  chemically synthesized
ggagaatatgcagtggataact

SEQ ID NO: 792954 - DNA, 22 bp, Artificial Sequence
  chemically synthesized
taggagaatatgcagtggataa

SEQ ID NO: 792955 - DNA, 22 bp, Artificial Sequence
  chemically synthesized
ttgggcagttatccactgcata

SEQ ID NO: 792956 - DNA, 22 bp, Artificial Sequence
  chemically synthesized
ggcagttatccactgcatattc

SEQ ID NO: 792957 - DNA, 22 bp, Artificial Sequence
  chemically synthesized
tccactgcatattctcctagag

SEQ ID NO: 792958 - DNA, 22 bp, Artificial Sequence
  chemically synthesized
catattctcctagagcattatg

SEQ ID NO: 792959 - DNA, 22 bp, Artificial Sequence
  chemically synthesized
tcctagagcattatgccttata

SEQ ID NO: 792960 - DNA, 22 bp, Artificial Sequence
  chemically synthesized
ctagagcattatgccttatata

SEQ ID NO: 792961 - DNA, 22 bp, Artificial Sequence
  chemically synthesized
aataagagaaatatatataagg

SEQ ID NO: 792962 - DNA, 22 bp, Artificial Sequence
  chemically synthesized
gagcattatgccttatatatat

SEQ ID NO: 792963 - DNA, 22 bp, Artificial Sequence
  chemically synthesized
tgccttatatatatttctctta

SEQ ID NO: 792964 - DNA, 22 bp, Artificial Sequence
  chemically synthesized
atatatatttctcttattgaat

SEQ ID NO: 792965 - DNA, 22 bp, Artificial Sequence
  chemically synthesized
tatatatttctcttattgaatt

SEQ ID NO: 792966 - DNA, 22 bp, Artificial Sequence
  chemically synthesized
ggacagcgaggagaaattcaat

SEQ ID NO: 792967 - DNA, 22 bp, Artificial Sequence
  chemically synthesized
gggacagcgaggagaaattcaa

SEQ ID NO: 792968 - DNA, 22 bp, Artificial Sequence
  chemically synthesized
gtttgggacagcgaggagaaat

SEQ ID NO: 792969 - DNA, 22 bp, Artificial Sequence
  chemically synthesized
ctcttattgaatttctcctcgc

SEQ ID NO: 792970 - DNA, 22 bp, Artificial Sequence
  chemically synthesized
tagtttgggacagcgaggagaa

SEQ ID NO: 792971 - DNA, 22 bp, Artificial Sequence
  chemically synthesized
tcttattgaatttctcctcgct

SEQ ID NO: 792972 - DNA, 22 bp, Artificial Sequence
  chemically synthesized
ttattgaatttctcctcgctgt

SEQ ID NO: 792973 - DNA, 22 bp, Artificial Sequence
  chemically synthesized
attgaatttctcctcgctgtcc

SEQ ID NO: 792974 - DNA, 22 bp, Artificial Sequence
  chemically synthesized
ttgaatttctcctcgctgtccc

SEQ ID NO: 792975 - DNA, 22 bp, Artificial Sequence
  chemically synthesized
aatttctcctcgctgtcccaaa

SEQ ID NO: 792976 - DNA, 22 bp, Artificial Sequence
  chemically synthesized
ctcctcgctgtcccaaactaga

SEQ ID NO: 792977 - DNA, 22 bp, Artificial Sequence
  chemically synthesized
tcctcgctgtcccaaactagag

SEQ ID NO: 792978 - DNA, 22 bp, Artificial Sequence
  chemically synthesized
ctcgctgtcccaaactagagtg

SEQ ID NO: 792979 - DNA, 22 bp, Artificial Sequence
  chemically synthesized
tcaggaagcacacactctagtt

SEQ ID NO: 792980 - DNA, 22 bp, Artificial Sequence
  chemically synthesized
gctgtcccaaactagagtgtgt

SEQ ID NO: 792981 - DNA, 22 bp, Artificial Sequence
  chemically synthesized
tcccaaactagagtgtgtgctt

SEQ ID NO: 792982 - DNA, 22 bp, Artificial Sequence
  chemically synthesized
agccatgttgtcaggaagcaca

SEQ ID NO: 792983 - DNA, 22 bp, Artificial Sequence
  chemically synthesized
cagccatgttgtcaggaagcac

SEQ ID NO: 792984 - DNA, 22 bp, Artificial Sequence
  chemically synthesized
acttcagccatgttgtcaggaa

SEQ ID NO: 792985 - DNA, 22 bp, Artificial Sequence
  chemically synthesized
gagtgtgtgcttcctgacaaca

SEQ ID NO: 792986 - DNA, 22 bp, Artificial Sequence
  chemically synthesized
aggttgacttcagccatgttgt

SEQ ID NO: 792987 - DNA, 22 bp, Artificial Sequence
  chemically synthesized
cctgacaacatggctgaagtca

SEQ ID NO: 792988 - DNA, 22 bp, Artificial Sequence
  chemically synthesized
ctgacaacatggctgaagtcaa

SEQ ID NO: 792989 - DNA, 22 bp, Artificial Sequence
  chemically synthesized
gtaagactcaggttgacttcag

SEQ ID NO: 792990 - DNA, 22 bp, Artificial Sequence
  chemically synthesized
acaacatggctgaagtcaacct

SEQ ID NO: 792991 - DNA, 22 bp, Artificial Sequence
  chemically synthesized
aagtcaacctgagtcttactaa

SEQ ID NO: 792992 - DNA, 22 bp, Artificial Sequence
  chemically synthesized
ataatacagagattagtaagac

SEQ ID NO: 792993 - DNA, 22 bp, Artificial Sequence
  chemically synthesized
gtcattgataatacagagatta

SEQ ID NO: 792994 - DNA, 22 bp, Artificial Sequence
  chemically synthesized
agtcttactaatctctgtatta

SEQ ID NO: 792995 - DNA, 22 bp, Artificial Sequence
  chemically synthesized
gactagtcattgataatacaga

SEQ ID NO: 792996 - DNA, 22 bp, Artificial Sequence
  chemically synthesized
actaatctctgtattatcaatg

SEQ ID NO: 792997 - DNA, 22 bp, Artificial Sequence
  chemically synthesized
ctaatctctgtattatcaatga

SEQ ID NO: 792998 - DNA, 22 bp, Artificial Sequence
  chemically synthesized
ggcactggactagtcattgata

SEQ ID NO: 792999 - DNA, 22 bp, Artificial Sequence
  chemically synthesized
atctctgtattatcaatgacta

SEQ ID NO: 793000 - DNA, 22 bp, Artificial Sequence
  chemically synthesized
tgtattatcaatgactagtcca

SEQ ID NO: 793001 - DNA, 22 bp, Artificial Sequence
  chemically synthesized
tatgttgggcactggactagtc

SEQ ID NO: 793002 - DNA, 22 bp, Artificial Sequence
  chemically synthesized
tattatcaatgactagtccagt

SEQ ID NO: 793003 - DNA, 22 bp, Artificial Sequence
  chemically synthesized
ttatatgttgggcactggacta

SEQ ID NO: 793004 - DNA, 22 bp, Artificial Sequence
  chemically synthesized
tcaatgactagtccagtgccca

SEQ ID NO: 793005 - DNA, 22 bp, Artificial Sequence
  chemically synthesized
gatgtctattatatgttgggca

SEQ ID NO: 793006 - DNA, 22 bp, Artificial Sequence
  chemically synthesized
ggatgtctattatatgttgggc

SEQ ID NO: 793007 - DNA, 22 bp, Artificial Sequence
  chemically synthesized
tggatgtctattatatgttggg

SEQ ID NO: 793008 - DNA, 22 bp, Artificial Sequence
  chemically synthesized
gtccagtgcccaacatataata

SEQ ID NO: 793009 - DNA, 22 bp, Artificial Sequence
  chemically synthesized
gaatatatgcacattttggatg

SEQ ID NO: 793010 - DNA, 22 bp, Artificial Sequence
  chemically synthesized
agaaacctggaatatatgcaca

SEQ ID NO: 793011 - DNA, 22 bp, Artificial Sequence
  chemically synthesized
attgagaaacctggaatatatg

SEQ ID NO: 793012 - DNA, 22 bp, Artificial Sequence
  chemically synthesized
ataccatctcattgagaaacct

SEQ ID NO: 793013 - DNA, 22 bp, Artificial Sequence
  chemically synthesized
gcaatattaataccatctcatt

SEQ ID NO: 793014 - DNA, 22 bp, Artificial Sequence
  chemically synthesized
ggcaatattaataccatctcat

SEQ ID NO: 793015 - DNA, 22 bp, Artificial Sequence
  chemically synthesized
caggtttctcaatgagatggta

SEQ ID NO: 793016 - DNA, 22 bp, Artificial Sequence
  chemically synthesized
atatttggcaatattaatacca

SEQ ID NO: 793017 - DNA, 22 bp, Artificial Sequence
  chemically synthesized
ctcaatgagatggtattaatat

SEQ ID NO: 793018 - DNA, 22 bp, Artificial Sequence
  chemically synthesized
tcaatgagatggtattaatatt

SEQ ID NO: 793019 - DNA, 22 bp, Artificial Sequence
  chemically synthesized
aatgagatggtattaatattgc

SEQ ID NO: 793020 - DNA, 22 bp, Artificial Sequence
  chemically synthesized
tacctaatatttggcaatatta

SEQ ID NO: 793021 - DNA, 22 bp, Artificial Sequence
  chemically synthesized
agtacactatacctaatatttg

SEQ ID NO: 793022 - DNA, 22 bp, Artificial Sequence
  chemically synthesized
ttaagtacactatacctaatat

SEQ ID NO: 793023 - DNA, 22 bp, Artificial Sequence
  chemically synthesized
atattgccaaatattaggtata

SEQ ID NO: 793024 - DNA, 22 bp, Artificial Sequence
  chemically synthesized
ccaaatattaggtatagtgtac

SEQ ID NO: 793025 - DNA, 22 bp, Artificial Sequence
  chemically synthesized
gacatactgttaagtacactat

SEQ ID NO: 793026 - DNA, 22 bp, Artificial Sequence
  chemically synthesized
actagacatactgttaagtaca

SEQ ID NO: 793027 - DNA, 22 bp, Artificial Sequence
  chemically synthesized
aactagacatactgttaagtac

SEQ ID NO: 793028 - DNA, 22 bp, Artificial Sequence
  chemically synthesized
taactagacatactgttaagta

SEQ ID NO: 793029 - DNA, 22 bp, Artificial Sequence
  chemically synthesized
ggtatagtgtacttaacagtat

SEQ ID NO: 793030 - DNA, 22 bp, Artificial Sequence
  chemically synthesized
aacagtatgtctagttaaaaca

SEQ ID NO: 793031 - DNA, 22 bp, Artificial Sequence
  chemically synthesized
acagtatgtctagttaaaacat

SEQ ID NO: 793032 - DNA, 22 bp, Artificial Sequence
  chemically synthesized
catatatgtagaatatatgtat

SEQ ID NO: 793033 - DNA, 22 bp, Artificial Sequence
  chemically synthesized
gttaaaacatacatatattcta

SEQ ID NO: 793034 - DNA, 22 bp, Artificial Sequence
  chemically synthesized
aactacatatatgtagaatata

SEQ ID NO: 793035 - DNA, 22 bp, Artificial Sequence
  chemically synthesized
aaactacatatatgtagaatat

SEQ ID NO: 793036 - DNA, 22 bp, Artificial Sequence
  chemically synthesized
aaacatacatatattctacata

SEQ ID NO: 793037 - DNA, 22 bp, Artificial Sequence
  chemically synthesized
gagaaatttaaactacatatat

SEQ ID NO: 793038 - DNA, 22 bp, Artificial Sequence
  chemically synthesized
ctagagaaatttaaactacata

SEQ ID NO: 793039 - DNA, 22 bp, Artificial Sequence
  chemically synthesized
tacatatatgtagtttaaattt

SEQ ID NO: 793040 - DNA, 22 bp, Artificial Sequence
  chemically synthesized
tgcctactagagaaatttaaac

SEQ ID NO: 793041 - DNA, 22 bp, Artificial Sequence
  chemically synthesized
catatatgtagtttaaatttct

SEQ ID NO: 793042 - DNA, 22 bp, Artificial Sequence
  chemically synthesized
ctgtgcctactagagaaattta

SEQ ID NO: 793043 - DNA, 22 bp, Artificial Sequence
  chemically synthesized
actgtgcctactagagaaattt

SEQ ID NO: 793044 - DNA, 22 bp, Artificial Sequence
  chemically synthesized
tactgtgcctactagagaaatt

SEQ ID NO: 793045 - DNA, 22 bp, Artificial Sequence
  chemically synthesized
ttactgtgcctactagagaaat

SEQ ID NO: 793046 - DNA, 22 bp, Artificial Sequence
  chemically synthesized
tttactgtgcctactagagaaa

SEQ ID NO: 793047 - DNA, 22 bp, Artificial Sequence
  chemically synthesized
ttttactgtgcctactagagaa

SEQ ID NO: 793048 - DNA, 22 bp, Artificial Sequence
  chemically synthesized
tttttactgtgcctactagaga

SEQ ID NO: 793049 - DNA, 22 bp, Artificial Sequence
  chemically synthesized
ttttttactgtgcctactagag

SEQ ID NO: 793050 - DNA, 22 bp, Artificial Sequence
  chemically synthesized
tttttttactgtgcctactaga

SEQ ID NO: 793051 - DNA, 22 bp, Artificial Sequence
  chemically synthesized
ctttttttttactgtgcctact

SEQ ID NO: 793052 - DNA, 22 bp, Artificial Sequence
  chemically synthesized
actttttttttactgtgcctac

SEQ ID NO: 793053 - DNA, 22 bp, Artificial Sequence
  chemically synthesized
aaatttctctagtaggcacagt

SEQ ID NO: 793054 - DNA, 22 bp, Artificial Sequence
  chemically synthesized
tactttttttttactgtgccta

SEQ ID NO: 793055 - DNA, 22 bp, Artificial Sequence
  chemically synthesized
aatttctctagtaggcacagta

SEQ ID NO: 793056 - DNA, 22 bp, Artificial Sequence
  chemically synthesized
ttactttttttttactgtgcct

SEQ ID NO: 793057 - DNA, 22 bp, Artificial Sequence
  chemically synthesized
tttttactttttttttactgtg

SEQ ID NO: 793058 - DNA, 22 bp, Artificial Sequence
  chemically synthesized
atttttactttttttttactgt

SEQ ID NO: 793059 - DNA, 22 bp, Artificial Sequence
  chemically synthesized
ctctagtaggcacagtaaaaaa

SEQ ID NO: 793060 - DNA, 22 bp, Artificial Sequence
  chemically synthesized
tctagtaggcacagtaaaaaaa

SEQ ID NO: 793061 - DNA, 22 bp, Artificial Sequence
  chemically synthesized
tagtaggcacagtaaaaaaaaa

SEQ ID NO: 793062 - DNA, 22 bp, Artificial Sequence
  chemically synthesized
gtaggcacagtaaaaaaaaagt

SEQ ID NO: 793063 - DNA, 22 bp, Artificial Sequence
  chemically synthesized
tacatatatattctatatatat

SEQ ID NO: 793064 - DNA, 22 bp, Artificial Sequence
  chemically synthesized
catatatattctatatatatat

SEQ ID NO: 793065 - DNA, 22 bp, Artificial Sequence
  chemically synthesized
tgtgccatatatatatatatat

SEQ ID NO: 793066 - DNA, 22 bp, Artificial Sequence
  chemically synthesized
tatgtgccatatatatatatat

SEQ ID NO: 793067 - DNA, 22 bp, Artificial Sequence
  chemically synthesized
ctatgtgccatatatatatata

SEQ ID NO: 793068 - DNA, 22 bp, Artificial Sequence
  chemically synthesized
tatatatatatatatatatata

SEQ ID NO: 793069 - DNA, 22 bp, Artificial Sequence
  chemically synthesized
tatatatatatatatatatatg

SEQ ID NO: 793070 - DNA, 22 bp, Artificial Sequence
  chemically synthesized
aaatatttctatgtgccatata

SEQ ID NO: 793071 - DNA, 22 bp, Artificial Sequence
  chemically synthesized
attaaaatatttctatgtgcca

SEQ ID NO: 793072 - DNA, 22 bp, Artificial Sequence
  chemically synthesized
ctcattaaaatatttctatgtg

SEQ ID NO: 793073 - DNA, 22 bp, Artificial Sequence
  chemically synthesized
gccatcatcaaattcctcatta

SEQ ID NO: 793074 - DNA, 22 bp, Artificial Sequence
  chemically synthesized
aaaattggccatcatcaaattc

SEQ ID NO: 793075 - DNA, 22 bp, Artificial Sequence
  chemically synthesized
taatgaggaatttgatgatggc

SEQ ID NO: 793076 - DNA, 22 bp, Artificial Sequence
  chemically synthesized
aatgaggaatttgatgatggcc

SEQ ID NO: 793077 - DNA, 22 bp, Artificial Sequence
  chemically synthesized
atgaggaatttgatgatggcca

SEQ ID NO: 793078 - DNA, 22 bp, Artificial Sequence
  chemically synthesized
aatcattgaaaattggccatca

SEQ ID NO: 793079 - DNA, 22 bp, Artificial Sequence
  chemically synthesized
ttaaatcattgaaaattggcca

SEQ ID NO: 793080 - DNA, 22 bp, Artificial Sequence
  chemically synthesized
gttattaaatcattgaaaattg

SEQ ID NO: 793081 - DNA, 22 bp, Artificial Sequence
  chemically synthesized
ggttattaaatcattgaaaatt

SEQ ID NO: 793082 - DNA, 22 bp, Artificial Sequence
  chemically synthesized
gatgatggccaattttcaatga

SEQ ID NO: 793083 - DNA, 22 bp, Artificial Sequence
  chemically synthesized
atgatggccaattttcaatgat

SEQ ID NO: 793084 - DNA, 22 bp, Artificial Sequence
  chemically synthesized
acttggttattaaatcattgaa

SEQ ID NO: 793085 - DNA, 22 bp, Artificial Sequence
  chemically synthesized
aaaattgacttggttattaaat

SEQ ID NO: 793086 - DNA, 22 bp, Artificial Sequence
  chemically synthesized
attaaaaattgacttggttatt

SEQ ID NO: 793087 - DNA, 22 bp, Artificial Sequence
  chemically synthesized
tcaatgatttaataaccaagtc

SEQ ID NO: 793088 - DNA, 22 bp, Artificial Sequence
  chemically synthesized
taattaaaaattgacttggtta

SEQ ID NO: 793089 - DNA, 22 bp, Artificial Sequence
  chemically synthesized
caatgatttaataaccaagtca

SEQ ID NO: 793090 - DNA, 22 bp, Artificial Sequence
  chemically synthesized
aatgatttaataaccaagtcaa

SEQ ID NO: 793091 - DNA, 22 bp, Artificial Sequence
  chemically synthesized
tctctaattaaaaattgacttg

SEQ ID NO: 793092 - DNA, 22 bp, Artificial Sequence
  chemically synthesized
aataaccaagtcaatttttaat

SEQ ID NO: 793093 - DNA, 22 bp, Artificial Sequence
  chemically synthesized
ataaccaagtcaatttttaatt

SEQ ID NO: 793094 - DNA, 22 bp, Artificial Sequence
  chemically synthesized
taaattgtctctaattaaaaat

SEQ ID NO: 793095 - DNA, 22 bp, Artificial Sequence
  chemically synthesized
ataaattgtctctaattaaaaa

SEQ ID NO: 793096 - DNA, 22 bp, Artificial Sequence
  chemically synthesized
cttataaattgtctctaattaa

SEQ ID NO: 793097 - DNA, 22 bp, Artificial Sequence
  chemically synthesized
acttataaattgtctctaatta

SEQ ID NO: 793098 - DNA, 22 bp, Artificial Sequence
  chemically synthesized
tacttataaattgtctctaatt

SEQ ID NO: 793099 - DNA, 22 bp, Artificial Sequence
  chemically synthesized
ttacttataaattgtctctaat

SEQ ID NO: 793100 - DNA, 22 bp, Artificial Sequence
  chemically synthesized
ttaattagagacaatttataag

SEQ ID NO: 793101 - DNA, 22 bp, Artificial Sequence
  chemically synthesized
taattagagacaatttataagt

SEQ ID NO: 793102 - DNA, 22 bp, Artificial Sequence
  chemically synthesized
aattagagacaatttataagta

SEQ ID NO: 793103 - DNA, 22 bp, Artificial Sequence
  chemically synthesized
aaggtcaatttttacttataaa

SEQ ID NO: 793104 - DNA, 22 bp, Artificial Sequence
  chemically synthesized
attagagacaatttataagtaa

SEQ ID NO: 793105 - DNA, 22 bp, Artificial Sequence
  chemically synthesized
caaggtcaatttttacttataa

SEQ ID NO: 793106 - DNA, 22 bp, Artificial Sequence
  chemically synthesized
tcaaggtcaatttttacttata

SEQ ID NO: 793107 - DNA, 22 bp, Artificial Sequence
  chemically synthesized
ttcaaggtcaatttttacttat

SEQ ID NO: 793108 - DNA, 22 bp, Artificial Sequence
  chemically synthesized
gagacaatttataagtaaaaat

SEQ ID NO: 793109 - DNA, 22 bp, Artificial Sequence
  chemically synthesized
ataagtaaaaattgaccttgaa

SEQ ID NO: 793110 - DNA, 22 bp, Artificial Sequence
  chemically synthesized
taagtaaaaattgaccttgaaa

SEQ ID NO: 793111 - DNA, 22 bp, Artificial Sequence
  chemically synthesized
tgtgtgtgtgtgtgtgagacac

SEQ ID NO: 793112 - DNA, 22 bp, Artificial Sequence
  chemically synthesized
gtgtgtgtgtgtgtgtgagaca

SEQ ID NO: 793113 - DNA, 22 bp, Artificial Sequence
  chemically synthesized
accttgaaaagtgtctcacaca

SEQ ID NO: 793114 - DNA, 22 bp, Artificial Sequence
  chemically synthesized
tgtgtgtgtgtgtgtgtgagac

SEQ ID NO: 793115 - DNA, 22 bp, Artificial Sequence
  chemically synthesized
gaaaagtgtctcacacacacac

SEQ ID NO: 793116 - DNA, 22 bp, Artificial Sequence
  chemically synthesized
aaaagtgtctcacacacacaca

SEQ ID NO: 793117 - DNA, 22 bp, Artificial Sequence
  chemically synthesized
tgtctttgtgtgtgtgtgtgtg

SEQ ID NO: 793118 - DNA, 22 bp, Artificial Sequence
  chemically synthesized
cattatgtctttgtgtgtgtgt

SEQ ID NO: 793119 - DNA, 22 bp, Artificial Sequence
  chemically synthesized
ttccattatgtctttgtgtgtg

SEQ ID NO: 793120 - DNA, 22 bp, Artificial Sequence
  chemically synthesized
acacacacacacacacaaagac

SEQ ID NO: 793121 - DNA, 22 bp, Artificial Sequence
  chemically synthesized
ttattccattatgtctttgtgt

SEQ ID NO: 793122 - DNA, 22 bp, Artificial Sequence
  chemically synthesized
attattccattatgtctttgtg

SEQ ID NO: 793123 - DNA, 22 bp, Artificial Sequence
  chemically synthesized
tattattccattatgtctttgt

SEQ ID NO: 793124 - DNA, 22 bp, Artificial Sequence
  chemically synthesized
ttattattccattatgtctttg

SEQ ID NO: 793125 - DNA, 22 bp, Artificial Sequence
  chemically synthesized
gaaggtcttttattattccatt

SEQ ID NO: 793126 - DNA, 22 bp, Artificial Sequence
  chemically synthesized
gtgactagaaggtcttttatta

SEQ ID NO: 793127 - DNA, 22 bp, Artificial Sequence
  chemically synthesized
ggtgactagaaggtcttttatt

SEQ ID NO: 793128 - DNA, 22 bp, Artificial Sequence
  chemically synthesized
atttggtgactagaaggtcttt

SEQ ID NO: 793129 - DNA, 22 bp, Artificial Sequence
  chemically synthesized
aatttggtgactagaaggtctt

SEQ ID NO: 793130 - DNA, 22 bp, Artificial Sequence
  chemically synthesized
gaagacaaatatttaatttggt

SEQ ID NO: 793131 - DNA, 22 bp, Artificial Sequence
  chemically synthesized
agaagacaaatatttaatttgg

SEQ ID NO: 793132 - DNA, 22 bp, Artificial Sequence
  chemically synthesized
ctagtcaccaaattaaatattt

SEQ ID NO: 793133 - DNA, 22 bp, Artificial Sequence
  chemically synthesized
catttagaagacaaatatttaa

SEQ ID NO: 793134 - DNA, 22 bp, Artificial Sequence
  chemically synthesized
tagtcaccaaattaaatatttg

SEQ ID NO: 793135 - DNA, 22 bp, Artificial Sequence
  chemically synthesized
gtcaccaaattaaatatttgtc

SEQ ID NO: 793136 - DNA, 22 bp, Artificial Sequence
  chemically synthesized
aatatttgtcttctaaatgcaa

SEQ ID NO: 793137 - DNA, 22 bp, Artificial Sequence
  chemically synthesized
gtcttctaaatgcaatcacttc

SEQ ID NO: 793138 - DNA, 22 bp, Artificial Sequence
  chemically synthesized
tcttctaaatgcaatcacttcg

SEQ ID NO: 793139 - DNA, 22 bp, Artificial Sequence
  chemically synthesized
agcaaacgtaatcgaagtgatt

SEQ ID NO: 793140 - DNA, 22 bp, Artificial Sequence
  chemically synthesized
cagcaaacgtaatcgaagtgat

SEQ ID NO: 793141 - DNA, 22 bp, Artificial Sequence
  chemically synthesized
tcagcaaacgtaatcgaagtga

SEQ ID NO: 793142 - DNA, 22 bp, Artificial Sequence
  chemically synthesized
ctaaatgcaatcacttcgatta

SEQ ID NO: 793143 - DNA, 22 bp, Artificial Sequence
  chemically synthesized
taaatgcaatcacttcgattac

SEQ ID NO: 793144 - DNA, 22 bp, Artificial Sequence
  chemically synthesized
aatgcaatcacttcgattacgt

SEQ ID NO: 793145 - DNA, 22 bp, Artificial Sequence
  chemically synthesized
ggtaatcctttcagcaaacgta

SEQ ID NO: 793146 - DNA, 22 bp, Artificial Sequence
  chemically synthesized
gggtaatcctttcagcaaacgt

SEQ ID NO: 793147 - DNA, 22 bp, Artificial Sequence
  chemically synthesized
cgattacgtttgctgaaaggat

SEQ ID NO: 793148 - DNA, 22 bp, Artificial Sequence
  chemically synthesized
gattacgtttgctgaaaggatt

SEQ ID NO: 793149 - DNA, 22 bp, Artificial Sequence
  chemically synthesized
cgtttgctgaaaggattaccca

SEQ ID NO: 793150 - DNA, 22 bp, Artificial Sequence
  chemically synthesized
gctgaaaggattacccaaggct

SEQ ID NO: 793151 - DNA, 22 bp, Artificial Sequence
  chemically synthesized
tagcaaaaaaagagccttgggt

SEQ ID NO: 793152 - DNA, 22 bp, Artificial Sequence
  chemically synthesized
ctgaaaggattacccaaggctc

SEQ ID NO: 793153 - DNA, 22 bp, Artificial Sequence
  chemically synthesized
aaaggattacccaaggctcttt

SEQ ID NO: 793154 - DNA, 22 bp, Artificial Sequence
  chemically synthesized
aataattgtagcaaaaaaagag

SEQ ID NO: 793155 - DNA, 22 bp, Artificial Sequence
  chemically synthesized
cccaaggctctttttttgctac

SEQ ID NO: 793156 - DNA, 22 bp, Artificial Sequence
  chemically synthesized
tttttttgctacaattatttaa

SEQ ID NO: 793157 - DNA, 22 bp, Artificial Sequence
  chemically synthesized
tttttgctacaattatttaatt

SEQ ID NO: 793158 - DNA, 22 bp, Artificial Sequence
  chemically synthesized
ttttgctacaattatttaatta

SEQ ID NO: 793159 - DNA, 22 bp, Artificial Sequence
  chemically synthesized
tttgctacaattatttaattat

SEQ ID NO: 793160 - DNA, 22 bp, Artificial Sequence
  chemically synthesized
ttgctacaattatttaattata

SEQ ID NO: 793161 - DNA, 22 bp, Artificial Sequence
  chemically synthesized
tgctacaattatttaattatac

SEQ ID NO: 793162 - DNA, 22 bp, Artificial Sequence
  chemically synthesized
gctacaattatttaattatact

SEQ ID NO: 793163 - DNA, 22 bp, Artificial Sequence
  chemically synthesized
ctacaattatttaattatactc

SEQ ID NO: 793164 - DNA, 22 bp, Artificial Sequence
  chemically synthesized
caattatttaattatactcatg

SEQ ID NO: 793165 - DNA, 22 bp, Artificial Sequence
  chemically synthesized
caaatgagtcaaaaccatgagt

SEQ ID NO: 793166 - DNA, 22 bp, Artificial Sequence
  chemically synthesized
acaaatgagtcaaaaccatgag

SEQ ID NO: 793167 - DNA, 22 bp, Artificial Sequence
  chemically synthesized
tttaattatactcatggttttg

SEQ ID NO: 793168 - DNA, 22 bp, Artificial Sequence
  chemically synthesized
aattatactcatggttttgact

SEQ ID NO: 793169 - DNA, 22 bp, Artificial Sequence
  chemically synthesized
attatactcatggttttgactc

SEQ ID NO: 793170 - DNA, 22 bp, Artificial Sequence
  chemically synthesized
tactcatggttttgactcattt

SEQ ID NO: 793171 - DNA, 22 bp, Artificial Sequence
  chemically synthesized
agatgggcatttacaaatgagt

SEQ ID NO: 793172 - DNA, 22 bp, Artificial Sequence
  chemically synthesized
atggttttgactcatttgtaaa

SEQ ID NO: 793173 - DNA, 22 bp, Artificial Sequence
  chemically synthesized
tgactcatttgtaaatgcccat

SEQ ID NO: 793174 - DNA, 22 bp, Artificial Sequence
  chemically synthesized
ataaaacctcagatgggcattt

SEQ ID NO: 793175 - DNA, 22 bp, Artificial Sequence
  chemically synthesized
gactcatttgtaaatgcccatc

SEQ ID NO: 793176 - DNA, 22 bp, Artificial Sequence
  chemically synthesized
actcatttgtaaatgcccatct

SEQ ID NO: 793177 - DNA, 22 bp, Artificial Sequence
  chemically synthesized
atttgtaaatgcccatctgagg

SEQ ID NO: 793178 - DNA, 22 bp, Artificial Sequence
  chemically synthesized
gtaaatgcccatctgaggtttt

SEQ ID NO: 793179 - DNA, 22 bp, Artificial Sequence
  chemically synthesized
taaatgcccatctgaggtttta

SEQ ID NO: 793180 - DNA, 22 bp, Artificial Sequence
  chemically synthesized
aggttttattaatcctgctcat

SEQ ID NO: 793181 - DNA, 22 bp, Artificial Sequence
  chemically synthesized
ggtcaacatatagtaatgagca

SEQ ID NO: 793182 - DNA, 22 bp, Artificial Sequence
  chemically synthesized
tattaatcctgctcattactat

SEQ ID NO: 793183 - DNA, 22 bp, Artificial Sequence
  chemically synthesized
attaatcctgctcattactata

SEQ ID NO: 793184 - DNA, 22 bp, Artificial Sequence
  chemically synthesized
ttaatcctgctcattactatat

SEQ ID NO: 793185 - DNA, 22 bp, Artificial Sequence
  chemically synthesized
atcctgctcattactatatgtt

SEQ ID NO: 793186 - DNA, 22 bp, Artificial Sequence
  chemically synthesized
ctcattactatatgttgaccca

SEQ ID NO: 793187 - DNA, 22 bp, Artificial Sequence
  chemically synthesized
attactatatgttgacccagtc

SEQ ID NO: 793188 - DNA, 22 bp, Artificial Sequence
  chemically synthesized
ctatatgttgacccagtctatt

SEQ ID NO: 793189 - DNA, 22 bp, Artificial Sequence
  chemically synthesized
gagatgagatcacaatagactg

SEQ ID NO: 793190 - DNA, 22 bp, Artificial Sequence
  chemically synthesized
agagatgagatcacaatagact

SEQ ID NO: 793191 - DNA, 22 bp, Artificial Sequence
  chemically synthesized
tatgttgacccagtctattgtg

SEQ ID NO: 793192 - DNA, 22 bp, Artificial Sequence
  chemically synthesized
acccagtctattgtgatctcat

SEQ ID NO: 793193 - DNA, 22 bp, Artificial Sequence
  chemically synthesized
ataaaaccttagagatgagatc

SEQ ID NO: 793194 - DNA, 22 bp, Artificial Sequence
  chemically synthesized
tgctcataaaaccttagagatg

SEQ ID NO: 793195 - DNA, 22 bp, Artificial Sequence
  chemically synthesized
ttgtgatctcatctctaaggtt

SEQ ID NO: 793196 - DNA, 22 bp, Artificial Sequence
  chemically synthesized
tgatctcatctctaaggtttta

SEQ ID NO: 793197 - DNA, 22 bp, Artificial Sequence
  chemically synthesized
atctctaaggttttatgagcac

SEQ ID NO: 793198 - DNA, 22 bp, Artificial Sequence
  chemically synthesized
atgaatatcaggctgtgctcat

SEQ ID NO: 793199 - DNA, 22 bp, Artificial Sequence
  chemically synthesized
catgaatatcaggctgtgctca

SEQ ID NO: 793200 - DNA, 22 bp, Artificial Sequence
  chemically synthesized
taaggttttatgagcacagcct

SEQ ID NO: 793201 - DNA, 22 bp, Artificial Sequence
  chemically synthesized
aggttttatgagcacagcctga

SEQ ID NO: 793202 - DNA, 22 bp, Artificial Sequence
  chemically synthesized
gaaaatttcatgaatatcaggc

SEQ ID NO: 793203 - DNA, 22 bp, Artificial Sequence
  chemically synthesized
tatgagcacagcctgatattca

SEQ ID NO: 793204 - DNA, 22 bp, Artificial Sequence
  chemically synthesized
atgagcacagcctgatattcat

SEQ ID NO: 793205 - DNA, 22 bp, Artificial Sequence
  chemically synthesized
tgagcacagcctgatattcatg

SEQ ID NO: 793206 - DNA, 22 bp, Artificial Sequence
  chemically synthesized
caaacccctggaaaatttcatg

SEQ ID NO: 793207 - DNA, 22 bp, Artificial Sequence
  chemically synthesized
acaaacccctggaaaatttcat

SEQ ID NO: 793208 - DNA, 22 bp, Artificial Sequence
  chemically synthesized
tacaaacccctggaaaatttca

SEQ ID NO: 793209 - DNA, 22 bp, Artificial Sequence
  chemically synthesized
ttacaaacccctggaaaatttc

SEQ ID NO: 793210 - DNA, 22 bp, Artificial Sequence
  chemically synthesized
atattcatgaaattttccaggg

SEQ ID NO: 793211 - DNA, 22 bp, Artificial Sequence
  chemically synthesized
atgaaattttccaggggtttgt

SEQ ID NO: 793212 - DNA, 22 bp, Artificial Sequence
  chemically synthesized
tccaggggtttgtaaaaatttc

SEQ ID NO: 793213 - DNA, 22 bp, Artificial Sequence
  chemically synthesized
ccaggggtttgtaaaaatttct

SEQ ID NO: 793214 - DNA, 22 bp, Artificial Sequence
  chemically synthesized
caggggtttgtaaaaatttctg

SEQ ID NO: 793215 - DNA, 22 bp, Artificial Sequence
  chemically synthesized
ataatatgatcacccagaaatt

SEQ ID NO: 793216 - DNA, 22 bp, Artificial Sequence
  chemically synthesized
aataatatgatcacccagaaat

SEQ ID NO: 793217 - DNA, 22 bp, Artificial Sequence
  chemically synthesized
taataatatgatcacccagaaa

SEQ ID NO: 793218 - DNA, 22 bp, Artificial Sequence
  chemically synthesized
cctttaataatatgatcaccca

SEQ ID NO: 793219 - DNA, 22 bp, Artificial Sequence
  chemically synthesized
gtaaaaatttctgggtgatcat

SEQ ID NO: 793220 - DNA, 22 bp, Artificial Sequence
  chemically synthesized
taaaaatttctgggtgatcata

SEQ ID NO: 793221 - DNA, 22 bp, Artificial Sequence
  chemically synthesized
ctgggtgatcatattattaaag

SEQ ID NO: 793222 - DNA, 22 bp, Artificial Sequence
  chemically synthesized
tgggtgatcatattattaaagg

SEQ ID NO: 793223 - DNA, 22 bp, Artificial Sequence
  chemically synthesized
ggtgatcatattattaaaggta

SEQ ID NO: 793224 - DNA, 22 bp, Artificial Sequence
  chemically synthesized
gagaatagacataactaccttt

SEQ ID NO: 793225 - DNA, 22 bp, Artificial Sequence
  chemically synthesized
cgagaatagacataactacctt

SEQ ID NO: 793226 - DNA, 22 bp, Artificial Sequence
  chemically synthesized
tcgagaatagacataactacct

SEQ ID NO: 793227 - DNA, 22 bp, Artificial Sequence
  chemically synthesized
ttttcgagaatagacataacta

SEQ ID NO: 793228 - DNA, 22 bp, Artificial Sequence
  chemically synthesized
attttcgagaatagacataact

SEQ ID NO: 793229 - DNA, 22 bp, Artificial Sequence
  chemically synthesized
ttaaaggtagttatgtctattc

SEQ ID NO: 793230 - DNA, 22 bp, Artificial Sequence
  chemically synthesized
aaggtagttatgtctattctcg

SEQ ID NO: 793231 - DNA, 22 bp, Artificial Sequence
  chemically synthesized
tgtctattctcgaaaataaaca

SEQ ID NO: 793232 - DNA, 22 bp, Artificial Sequence
  chemically synthesized
taatgaaaagatatgtttattt

SEQ ID NO: 793233 - DNA, 22 bp, Artificial Sequence
  chemically synthesized
ttctcgaaaataaacatatctt

SEQ ID NO: 793234 - DNA, 22 bp, Artificial Sequence
  chemically synthesized
gcattgtaatgaaaagatatgt

SEQ ID NO: 793235 - DNA, 22 bp, Artificial Sequence
  chemically synthesized
ggcattgtaatgaaaagatatg

SEQ ID NO: 793236 - DNA, 22 bp, Artificial Sequence
  chemically synthesized
tcgaaaataaacatatcttttc

SEQ ID NO: 793237 - DNA, 22 bp, Artificial Sequence
  chemically synthesized
gaaaataaacatatcttttcat

SEQ ID NO: 793238 - DNA, 22 bp, Artificial Sequence
  chemically synthesized
ccacgatcatgtatttggcatt

SEQ ID NO: 793239 - DNA, 22 bp, Artificial Sequence
  chemically synthesized
ttcattacaatgccaaatacat

SEQ ID NO: 793240 - DNA, 22 bp, Artificial Sequence
  chemically synthesized
tcattacaatgccaaatacatg

SEQ ID NO: 793241 - DNA, 22 bp, Artificial Sequence
  chemically synthesized
cattacaatgccaaatacatga

SEQ ID NO: 793242 - DNA, 22 bp, Artificial Sequence
  chemically synthesized
attacaatgccaaatacatgat

SEQ ID NO: 793243 - DNA, 22 bp, Artificial Sequence
  chemically synthesized
atccctcccacgatcatgtatt

SEQ ID NO: 793244 - DNA, 22 bp, Artificial Sequence
  chemically synthesized
gatccctcccacgatcatgtat

SEQ ID NO: 793245 - DNA, 22 bp, Artificial Sequence
  chemically synthesized
tgatccctcccacgatcatgta

SEQ ID NO: 793246 - DNA, 22 bp, Artificial Sequence
  chemically synthesized
caatgccaaatacatgatcgtg

SEQ ID NO: 793247 - DNA, 22 bp, Artificial Sequence
  chemically synthesized
tttgatccctcccacgatcatg

SEQ ID NO: 793248 - DNA, 22 bp, Artificial Sequence
  chemically synthesized
ctttgatccctcccacgatcat

SEQ ID NO: 793249 - DNA, 22 bp, Artificial Sequence
  chemically synthesized
aatcatgtacacacttctttga

SEQ ID NO: 793250 - DNA, 22 bp, Artificial Sequence
  chemically synthesized
agcagctaaatcatgtacacac

SEQ ID NO: 793251 - DNA, 22 bp, Artificial Sequence
  chemically synthesized
aaccagttgagcagctaaatca

SEQ ID NO: 793252 - DNA, 22 bp, Artificial Sequence
  chemically synthesized
agtaattaaaccagttgagcag

SEQ ID NO: 793253 - DNA, 22 bp, Artificial Sequence
  chemically synthesized
aaagtgttgagtaattaaacca

SEQ ID NO: 793254 - DNA, 22 bp, Artificial Sequence
  chemically synthesized
agctgctcaactggtttaatta

SEQ ID NO: 793255 - DNA, 22 bp, Artificial Sequence
  chemically synthesized
gctgctcaactggtttaattac

SEQ ID NO: 793256 - DNA, 22 bp, Artificial Sequence
  chemically synthesized
ctcaactggtttaattactcaa

SEQ ID NO: 793257 - DNA, 22 bp, Artificial Sequence
  chemically synthesized
atagctaaaagtgttgagtaat

SEQ ID NO: 793258 - DNA, 22 bp, Artificial Sequence
  chemically synthesized
catagctaaaagtgttgagtaa

SEQ ID NO: 793259 - DNA, 22 bp, Artificial Sequence
  chemically synthesized
aactggtttaattactcaacac

SEQ ID NO: 793260 - DNA, 22 bp, Artificial Sequence
  chemically synthesized
ttcatagctaaaagtgttgagt

SEQ ID NO: 793261 - DNA, 22 bp, Artificial Sequence
  chemically synthesized
tcttcatagctaaaagtgttga

SEQ ID NO: 793262 - DNA, 22 bp, Artificial Sequence
  chemically synthesized
gtttaattactcaacactttta

SEQ ID NO: 793263 - DNA, 22 bp, Artificial Sequence
  chemically synthesized
aactctcttcatagctaaaagt

SEQ ID NO: 793264 - DNA, 22 bp, Artificial Sequence
  chemically synthesized
aattactcaacacttttagcta

SEQ ID NO: 793265 - DNA, 22 bp, Artificial Sequence
  chemically synthesized
attactcaacacttttagctat

SEQ ID NO: 793266 - DNA, 22 bp, Artificial Sequence
  chemically synthesized
ctcaacacttttagctatgaag

SEQ ID NO: 793267 - DNA, 22 bp, Artificial Sequence
  chemically synthesized
aacacttttagctatgaagaga

SEQ ID NO: 793268 - DNA, 22 bp, Artificial Sequence
  chemically synthesized
taatggtctaaactctcttcat

SEQ ID NO: 793269 - DNA, 22 bp, Artificial Sequence
  chemically synthesized
ttataatggtctaaactctctt

SEQ ID NO: 793270 - DNA, 22 bp, Artificial Sequence
  chemically synthesized
ttagctatgaagagagtttaga

SEQ ID NO: 793271 - DNA, 22 bp, Artificial Sequence
  chemically synthesized
tagctatgaagagagtttagac

SEQ ID NO: 793272 - DNA, 22 bp, Artificial Sequence
  chemically synthesized
agctatgaagagagtttagacc

SEQ ID NO: 793273 - DNA, 22 bp, Artificial Sequence
  chemically synthesized
gctatgaagagagtttagacca

SEQ ID NO: 793274 - DNA, 22 bp, Artificial Sequence
  chemically synthesized
ggactattataatggtctaaac

SEQ ID NO: 793275 - DNA, 22 bp, Artificial Sequence
  chemically synthesized
tgaagagagtttagaccattat

SEQ ID NO: 793276 - DNA, 22 bp, Artificial Sequence
  chemically synthesized
agaccattataatagtcctaga

SEQ ID NO: 793277 - DNA, 22 bp, Artificial Sequence
  chemically synthesized
gaccattataatagtcctagat

SEQ ID NO: 793278 - DNA, 22 bp, Artificial Sequence
  chemically synthesized
taagaataaaaaatctaggact

SEQ ID NO: 793279 - DNA, 22 bp, Artificial Sequence
  chemically synthesized
taatagtcctagattttttatt

SEQ ID NO: 793280 - DNA, 22 bp, Artificial Sequence
  chemically synthesized
aatatggatataaattataaga

SEQ ID NO: 793281 - DNA, 22 bp, Artificial Sequence
  chemically synthesized
gattttttattcttataattta

SEQ ID NO: 793282 - DNA, 22 bp, Artificial Sequence
  chemically synthesized
taaatatggatataaattataa

SEQ ID NO: 793283 - DNA, 22 bp, Artificial Sequence
  chemically synthesized
tttattcttataatttatatcc

SEQ ID NO: 793284 - DNA, 22 bp, Artificial Sequence
  chemically synthesized
ttattcttataatttatatcca

SEQ ID NO: 793285 - DNA, 22 bp, Artificial Sequence
  chemically synthesized
tattcttataatttatatccat

SEQ ID NO: 793286 - DNA, 22 bp, Artificial Sequence
  chemically synthesized
attcttataatttatatccata

SEQ ID NO: 793287 - DNA, 22 bp, Artificial Sequence
  chemically synthesized
ttcttataatttatatccatat

SEQ ID NO: 793288 - DNA, 22 bp, Artificial Sequence
  chemically synthesized
ttataatttatatccatattta

SEQ ID NO: 793289 - DNA, 22 bp, Artificial Sequence
  chemically synthesized
ataatttatatccatatttaga

SEQ ID NO: 793290 - DNA, 22 bp, Artificial Sequence
  chemically synthesized
taatttatatccatatttagag

SEQ ID NO: 793291 - DNA, 22 bp, Artificial Sequence
  chemically synthesized
aacatgagtaaccaatgctcta

SEQ ID NO: 793292 - DNA, 22 bp, Artificial Sequence
  chemically synthesized
atatccatatttagagcattgg

SEQ ID NO: 793293 - DNA, 22 bp, Artificial Sequence
  chemically synthesized
caacatgagtaaccaatgctct

SEQ ID NO: 793294 - DNA, 22 bp, Artificial Sequence
  chemically synthesized
tatccatatttagagcattggt

SEQ ID NO: 793295 - DNA, 22 bp, Artificial Sequence
  chemically synthesized
tatatttcaacatgagtaacca

SEQ ID NO: 793296 - DNA, 22 bp, Artificial Sequence
  chemically synthesized
atatatttcaacatgagtaacc

SEQ ID NO: 793297 - DNA, 22 bp, Artificial Sequence
  chemically synthesized
tatatatttcaacatgagtaac

SEQ ID NO: 793298 - DNA, 22 bp, Artificial Sequence
  chemically synthesized
agagcattggttactcatgttg

SEQ ID NO: 793299 - DNA, 22 bp, Artificial Sequence
  chemically synthesized
gagcattggttactcatgttga

SEQ ID NO: 793300 - DNA, 22 bp, Artificial Sequence
  chemically synthesized
aaccctttatatatttcaacat

SEQ ID NO: 793301 - DNA, 22 bp, Artificial Sequence
  chemically synthesized
caaccctttatatatttcaaca

SEQ ID NO: 793302 - DNA, 22 bp, Artificial Sequence
  chemically synthesized
ttcaaccctttatatatttcaa

SEQ ID NO: 793303 - DNA, 22 bp, Artificial Sequence
  chemically synthesized
cttcaaccctttatatatttca

SEQ ID NO: 793304 - DNA, 22 bp, Artificial Sequence
  chemically synthesized
gttactcatgttgaaatatata

SEQ ID NO: 793305 - DNA, 22 bp, Artificial Sequence
  chemically synthesized
ctcatgttgaaatatataaagg

SEQ ID NO: 793306 - DNA, 22 bp, Artificial Sequence
  chemically synthesized
taacttcttcaaccctttatat

SEQ ID NO: 793307 - DNA, 22 bp, Artificial Sequence
  chemically synthesized
ataacttcttcaaccctttata

SEQ ID NO: 793308 - DNA, 22 bp, Artificial Sequence
  chemically synthesized
atgttgaaatatataaagggtt

SEQ ID NO: 793309 - DNA, 22 bp, Artificial Sequence
  chemically synthesized
aaatatataaagggttgaagaa

SEQ ID NO: 793310 - DNA, 22 bp, Artificial Sequence
  chemically synthesized
gagaaatatgatcccttataac

SEQ ID NO: 793311 - DNA, 22 bp, Artificial Sequence
  chemically synthesized
aagaagttataagggatcatat

SEQ ID NO: 793312 - DNA, 22 bp, Artificial Sequence
  chemically synthesized
gagtaaaatctggagaaatatg

SEQ ID NO: 793313 - DNA, 22 bp, Artificial Sequence
  chemically synthesized
taagggatcatatttctccaga

SEQ ID NO: 793314 - DNA, 22 bp, Artificial Sequence
  chemically synthesized
aagatcatctggagtaaaatct

SEQ ID NO: 793315 - DNA, 22 bp, Artificial Sequence
  chemically synthesized
tgaagatcatctggagtaaaat

SEQ ID NO: 793316 - DNA, 22 bp, Artificial Sequence
  chemically synthesized
ctctgaagatcatctggagtaa

SEQ ID NO: 793317 - DNA, 22 bp, Artificial Sequence
  chemically synthesized
actctgaagatcatctggagta

SEQ ID NO: 793318 - DNA, 22 bp, Artificial Sequence
  chemically synthesized
ctccagattttactccagatga

SEQ ID NO: 793319 - DNA, 22 bp, Artificial Sequence
  chemically synthesized
tccagattttactccagatgat

SEQ ID NO: 793320 - DNA, 22 bp, Artificial Sequence
  chemically synthesized
acttactctgaagatcatctgg

SEQ ID NO: 793321 - DNA, 22 bp, Artificial Sequence
  chemically synthesized
cagattttactccagatgatct

SEQ ID NO: 793322 - DNA, 22 bp, Artificial Sequence
  chemically synthesized
caaattgacttactctgaagat

SEQ ID NO: 793323 - DNA, 22 bp, Artificial Sequence
  chemically synthesized
tactccagatgatcttcagagt

SEQ ID NO: 793324 - DNA, 22 bp, Artificial Sequence
  chemically synthesized
acaaattgacttactctgaaga

SEQ ID NO: 793325 - DNA, 22 bp, Artificial Sequence
  chemically synthesized
actccagatgatcttcagagta

SEQ ID NO: 793326 - DNA, 22 bp, Artificial Sequence
  chemically synthesized
ctccagatgatcttcagagtaa

SEQ ID NO: 793327 - DNA, 22 bp, Artificial Sequence
  chemically synthesized
cagatgatcttcagagtaagtc

SEQ ID NO: 793328 - DNA, 22 bp, Artificial Sequence
  chemically synthesized
tatgcggtttacaaattgactt

SEQ ID NO: 793329 - DNA, 22 bp, Artificial Sequence
  chemically synthesized
tatatgcggtttacaaattgac

SEQ ID NO: 793330 - DNA, 22 bp, Artificial Sequence
  chemically synthesized
ctatatgcggtttacaaattga

SEQ ID NO: 793331 - DNA, 22 bp, Artificial Sequence
  chemically synthesized
tctatatgcggtttacaaattg

SEQ ID NO: 793332 - DNA, 22 bp, Artificial Sequence
  chemically synthesized
cagagtaagtcaatttgtaaac

SEQ ID NO: 793333 - DNA, 22 bp, Artificial Sequence
  chemically synthesized
agagtaagtcaatttgtaaacc

SEQ ID NO: 793334 - DNA, 22 bp, Artificial Sequence
  chemically synthesized
gattttctatatgcggtttaca

SEQ ID NO: 793335 - DNA, 22 bp, Artificial Sequence
  chemically synthesized
agattttctatatgcggtttac

SEQ ID NO: 793336 - DNA, 22 bp, Artificial Sequence
  chemically synthesized
tagattttctatatgcggttta

SEQ ID NO: 793337 - DNA, 22 bp, Artificial Sequence
  chemically synthesized
ttagattttctatatgcggttt

SEQ ID NO: 793338 - DNA, 22 bp, Artificial Sequence
  chemically synthesized
cacttttagattttctatatgc

SEQ ID NO: 793339 - DNA, 22 bp, Artificial Sequence
  chemically synthesized
ccacttttagattttctatatg

SEQ ID NO: 793340 - DNA, 22 bp, Artificial Sequence
  chemically synthesized
gtaaaccgcatatagaaaatct

SEQ ID NO: 793341 - DNA, 22 bp, Artificial Sequence
  chemically synthesized
taaaccgcatatagaaaatcta

SEQ ID NO: 793342 - DNA, 22 bp, Artificial Sequence
  chemically synthesized
taatacggaggcaataaaaatt

SEQ ID NO: 793343 - DNA, 22 bp, Artificial Sequence
  chemically synthesized
tgtaatacggaggcaataaaaa

SEQ ID NO: 793344 - DNA, 22 bp, Artificial Sequence
  chemically synthesized
aaagtggaaatttttattgcct

SEQ ID NO: 793345 - DNA, 22 bp, Artificial Sequence
  chemically synthesized
ctctgtaatacggaggcaataa

SEQ ID NO: 793346 - DNA, 22 bp, Artificial Sequence
  chemically synthesized
tcctctgtaatacggaggcaat

SEQ ID NO: 793347 - DNA, 22 bp, Artificial Sequence
  chemically synthesized
ctcctctgtaatacggaggcaa

SEQ ID NO: 793348 - DNA, 22 bp, Artificial Sequence
  chemically synthesized
tctcctctgtaatacggaggca

SEQ ID NO: 793349 - DNA, 22 bp, Artificial Sequence
  chemically synthesized
ttattgcctccgtattacagag

SEQ ID NO: 793350 - DNA, 22 bp, Artificial Sequence
  chemically synthesized
tattgcctccgtattacagagg

SEQ ID NO: 793351 - DNA, 22 bp, Artificial Sequence
  chemically synthesized
attgcctccgtattacagagga

SEQ ID NO: 793352 - DNA, 22 bp, Artificial Sequence
  chemically synthesized
ttgcctccgtattacagaggag

SEQ ID NO: 793353 - DNA, 22 bp, Artificial Sequence
  chemically synthesized
tgtgccaccattttctcctctg

SEQ ID NO: 793354 - DNA, 22 bp, Artificial Sequence
  chemically synthesized
cctccgtattacagaggagaaa

SEQ ID NO: 793355 - DNA, 22 bp, Artificial Sequence
  chemically synthesized
cgtattacagaggagaaaatgg

SEQ ID NO: 793356 - DNA, 22 bp, Artificial Sequence
  chemically synthesized
aactgtgtgccaccattttctc

SEQ ID NO: 793357 - DNA, 22 bp, Artificial Sequence
  chemically synthesized
aaactgtgtgccaccattttct

SEQ ID NO: 793358 - DNA, 22 bp, Artificial Sequence
  chemically synthesized
cttaaactgtgtgccaccattt

SEQ ID NO: 793359 - DNA, 22 bp, Artificial Sequence
  chemically synthesized
cagaggagaaaatggtggcaca

SEQ ID NO: 793360 - DNA, 22 bp, Artificial Sequence
  chemically synthesized
gcaaattacttaaactgtgtgc

SEQ ID NO: 793361 - DNA, 22 bp, Artificial Sequence
  chemically synthesized
tgaccctggcaaattacttaaa

SEQ ID NO: 793362 - DNA, 22 bp, Artificial Sequence
  chemically synthesized
atgaccctggcaaattacttaa

SEQ ID NO: 793363 - DNA, 22 bp, Artificial Sequence
  chemically synthesized
tatgaccctggcaaattactta

SEQ ID NO: 793364 - DNA, 22 bp, Artificial Sequence
  chemically synthesized
cctttatgaccctggcaaatta

SEQ ID NO: 793365 - DNA, 22 bp, Artificial Sequence
  chemically synthesized
ccagctacctttatgaccctgg

SEQ ID NO: 793366 - DNA, 22 bp, Artificial Sequence
  chemically synthesized
accagctacctttatgaccctg

SEQ ID NO: 793367 - DNA, 22 bp, Artificial Sequence
  chemically synthesized
aagtaatttgccagggtcataa

SEQ ID NO: 793368 - DNA, 22 bp, Artificial Sequence
  chemically synthesized
taccagctacctttatgaccct

SEQ ID NO: 793369 - DNA, 22 bp, Artificial Sequence
  chemically synthesized
agtaatttgccagggtcataaa

SEQ ID NO: 793370 - DNA, 22 bp, Artificial Sequence
  chemically synthesized
caagtctttaccagctaccttt

SEQ ID NO: 793371 - DNA, 22 bp, Artificial Sequence
  chemically synthesized
gccagggtcataaaggtagctg

SEQ ID NO: 793372 - DNA, 22 bp, Artificial Sequence
  chemically synthesized
ccagggtcataaaggtagctgg

SEQ ID NO: 793373 - DNA, 22 bp, Artificial Sequence
  chemically synthesized
aaccccctccaagtctttacca

SEQ ID NO: 793374 - DNA, 22 bp, Artificial Sequence
  chemically synthesized
aaaccccctccaagtctttacc

SEQ ID NO: 793375 - DNA, 22 bp, Artificial Sequence
  chemically synthesized
ggtttaaaccccctccaagtct

SEQ ID NO: 793376 - DNA, 22 bp, Artificial Sequence
  chemically synthesized
gggtttaaaccccctccaagtc

SEQ ID NO: 793377 - DNA, 22 bp, Artificial Sequence
  chemically synthesized
gtaaagacttggagggggttta

SEQ ID NO: 793378 - DNA, 22 bp, Artificial Sequence
  chemically synthesized
cagagcttgggtttaaaccccc

SEQ ID NO: 793379 - DNA, 22 bp, Artificial Sequence
  chemically synthesized
tagctacagagcttgggtttaa

SEQ ID NO: 793380 - DNA, 22 bp, Artificial Sequence
  chemically synthesized
tatagctacagagcttgggttt

SEQ ID NO: 793381 - DNA, 22 bp, Artificial Sequence
  chemically synthesized
ggagggggtttaaacccaagct

SEQ ID NO: 793382 - DNA, 22 bp, Artificial Sequence
  chemically synthesized
gagggggtttaaacccaagctc

SEQ ID NO: 793383 - DNA, 22 bp, Artificial Sequence
  chemically synthesized
gaagattctatagctacagagc

SEQ ID NO: 793384 - DNA, 22 bp, Artificial Sequence
  chemically synthesized
aaacccaagctctgtagctata

SEQ ID NO: 793385 - DNA, 22 bp, Artificial Sequence
  chemically synthesized
aacccaagctctgtagctatag

SEQ ID NO: 793386 - DNA, 22 bp, Artificial Sequence
  chemically synthesized
gtatccagttggaagattctat

SEQ ID NO: 793387 - DNA, 22 bp, Artificial Sequence
  chemically synthesized
tctagtatccagttggaagatt

SEQ ID NO: 793388 - DNA, 22 bp, Artificial Sequence
  chemically synthesized
tgtagctatagaatcttccaac

SEQ ID NO: 793389 - DNA, 22 bp, Artificial Sequence
  chemically synthesized
gtctagtatccagttggaagat

SEQ ID NO: 793390 - DNA, 22 bp, Artificial Sequence
  chemically synthesized
tgtctagtatccagttggaaga

SEQ ID NO: 793391 - DNA, 22 bp, Artificial Sequence
  chemically synthesized
tagctatagaatcttccaactg

SEQ ID NO: 793392 - DNA, 22 bp, Artificial Sequence
  chemically synthesized
ttttgtctagtatccagttgga

SEQ ID NO: 793393 - DNA, 22 bp, Artificial Sequence
  chemically synthesized
gttttgtctagtatccagttgg

SEQ ID NO: 793394 - DNA, 22 bp, Artificial Sequence
  chemically synthesized
tgttttgtctagtatccagttg

SEQ ID NO: 793395 - DNA, 22 bp, Artificial Sequence
  chemically synthesized
ttgttttgtctagtatccagtt

SEQ ID NO: 793396 - DNA, 22 bp, Artificial Sequence
  chemically synthesized
tagaatcttccaactggatact

SEQ ID NO: 793397 - DNA, 22 bp, Artificial Sequence
  chemically synthesized
ggaacttttgttttgtctagta

SEQ ID NO: 793398 - DNA, 22 bp, Artificial Sequence
  chemically synthesized
tgggaacttttgttttgtctag

SEQ ID NO: 793399 - DNA, 22 bp, Artificial Sequence
  chemically synthesized
ccaactggatactagacaaaac

SEQ ID NO: 793400 - DNA, 22 bp, Artificial Sequence
  chemically synthesized
caactggatactagacaaaaca

SEQ ID NO: 793401 - DNA, 22 bp, Artificial Sequence
  chemically synthesized
gatactagacaaaacaaaagtt

SEQ ID NO: 793402 - DNA, 22 bp, Artificial Sequence
  chemically synthesized
gacaaaacaaaagttcccagag

SEQ ID NO: 793403 - DNA, 22 bp, Artificial Sequence
  chemically synthesized
atgtgcagcgaagctctgggaa

SEQ ID NO: 793404 - DNA, 22 bp, Artificial Sequence
  chemically synthesized
aatctaatgtgcagcgaagctc

SEQ ID NO: 793405 - DNA, 22 bp, Artificial Sequence
  chemically synthesized
agctcaatctaatgtgcagcga

SEQ ID NO: 793406 - DNA, 22 bp, Artificial Sequence
  chemically synthesized
ctcagctcaatctaatgtgcag

SEQ ID NO: 793407 - DNA, 22 bp, Artificial Sequence
  chemically synthesized
ccagagcttcgctgcacattag

SEQ ID NO: 793408 - DNA, 22 bp, Artificial Sequence
  chemically synthesized
caaactactcagctcaatctaa

SEQ ID NO: 793409 - DNA, 22 bp, Artificial Sequence
  chemically synthesized
acaaactactcagctcaatcta

SEQ ID NO: 793410 - DNA, 22 bp, Artificial Sequence
  chemically synthesized
cgctgcacattagattgagctg

SEQ ID NO: 793411 - DNA, 22 bp, Artificial Sequence
  chemically synthesized
ttacaaactactcagctcaatc

SEQ ID NO: 793412 - DNA, 22 bp, Artificial Sequence
  chemically synthesized
gctgcacattagattgagctga

SEQ ID NO: 793413 - DNA, 22 bp, Artificial Sequence
  chemically synthesized
cacattagattgagctgagtag

SEQ ID NO: 793414 - DNA, 22 bp, Artificial Sequence
  chemically synthesized
gattgagctgagtagtttgtaa

SEQ ID NO: 793415 - DNA, 22 bp, Artificial Sequence
  chemically synthesized
ggcatcataattcttacaaact

SEQ ID NO: 793416 - DNA, 22 bp, Artificial Sequence
  chemically synthesized
gggcatcataattcttacaaac

SEQ ID NO: 793417 - DNA, 22 bp, Artificial Sequence
  chemically synthesized
agctgagtagtttgtaagaatt

SEQ ID NO: 793418 - DNA, 22 bp, Artificial Sequence
  chemically synthesized
agtagtttgtaagaattatgat

SEQ ID NO: 793419 - DNA, 22 bp, Artificial Sequence
  chemically synthesized
tgggacttgggcatcataattc

SEQ ID NO: 793420 - DNA, 22 bp, Artificial Sequence
  chemically synthesized
tgtgggacttgggcatcataat

SEQ ID NO: 793421 - DNA, 22 bp, Artificial Sequence
  chemically synthesized
gtaagaattatgatgcccaagt

SEQ ID NO: 793422 - DNA, 22 bp, Artificial Sequence
  chemically synthesized
gtgttctgtgggacttgggcat

SEQ ID NO: 793423 - DNA, 22 bp, Artificial Sequence
  chemically synthesized
taagaattatgatgcccaagtc

SEQ ID NO: 793424 - DNA, 22 bp, Artificial Sequence
  chemically synthesized
ttggtgttctgtgggacttggg

SEQ ID NO: 793425 - DNA, 22 bp, Artificial Sequence
  chemically synthesized
attggtgttctgtgggacttgg

SEQ ID NO: 793426 - DNA, 22 bp, Artificial Sequence
  chemically synthesized
tattggtgttctgtgggacttg

SEQ ID NO: 793427 - DNA, 22 bp, Artificial Sequence
  chemically synthesized
ttttattggtgttctgtgggac

SEQ ID NO: 793428 - DNA, 22 bp, Artificial Sequence
  chemically synthesized
attttattggtgttctgtggga

SEQ ID NO: 793429 - DNA, 22 bp, Artificial Sequence
  chemically synthesized
tgatgcccaagtcccacagaac

SEQ ID NO: 793430 - DNA, 22 bp, Artificial Sequence
  chemically synthesized
tattttattggtgttctgtggg

SEQ ID NO: 793431 - DNA, 22 bp, Artificial Sequence
  chemically synthesized
agagttttattttattggtgtt

SEQ ID NO: 793432 - DNA, 22 bp, Artificial Sequence
  chemically synthesized
ctgagagttttattttattggt

SEQ ID NO: 793433 - DNA, 22 bp, Artificial Sequence
  chemically synthesized
cctgagagttttattttattgg

SEQ ID NO: 793434 - DNA, 22 bp, Artificial Sequence
  chemically synthesized
acaagatttcctgagagtttta

SEQ ID NO: 793435 - DNA, 22 bp, Artificial Sequence
  chemically synthesized
cacaagatttcctgagagtttt

SEQ ID NO: 793436 - DNA, 22 bp, Artificial Sequence
  chemically synthesized
tcacaagatttcctgagagttt

SEQ ID NO: 793437 - DNA, 22 bp, Artificial Sequence
  chemically synthesized
gttttcacaagatttcctgaga

SEQ ID NO: 793438 - DNA, 22 bp, Artificial Sequence
  chemically synthesized
ggttttcacaagatttcctgag

SEQ ID NO: 793439 - DNA, 22 bp, Artificial Sequence
  chemically synthesized
tggttttcacaagatttcctga

SEQ ID NO: 793440 - DNA, 22 bp, Artificial Sequence
  chemically synthesized
aaactttggttttcacaagatt

SEQ ID NO: 793441 - DNA, 22 bp, Artificial Sequence
  chemically synthesized
gaaactttggttttcacaagat

SEQ ID NO: 793442 - DNA, 22 bp, Artificial Sequence
  chemically synthesized
tgaaactttggttttcacaaga

SEQ ID NO: 793443 - DNA, 22 bp, Artificial Sequence
  chemically synthesized
ttgaaactttggttttcacaag

SEQ ID NO: 793444 - DNA, 22 bp, Artificial Sequence
  chemically synthesized
ttttgaaactttggttttcaca

SEQ ID NO: 793445 - DNA, 22 bp, Artificial Sequence
  chemically synthesized
tcaggaaatcttgtgaaaacca

SEQ ID NO: 793446 - DNA, 22 bp, Artificial Sequence
  chemically synthesized
aggaaatcttgtgaaaaccaaa

SEQ ID NO: 793447 - DNA, 22 bp, Artificial Sequence
  chemically synthesized
attcttttgaaactttggtttt

SEQ ID NO: 793448 - DNA, 22 bp, Artificial Sequence
  chemically synthesized
cattcttttgaaactttggttt

SEQ ID NO: 793449 - DNA, 22 bp, Artificial Sequence
  chemically synthesized
gtgaaaaccaaagtttcaaaag

SEQ ID NO: 793450 - DNA, 22 bp, Artificial Sequence
  chemically synthesized
tgaaaaccaaagtttcaaaaga

SEQ ID NO: 793451 - DNA, 22 bp, Artificial Sequence
  chemically synthesized
agtaaagtttcattcttttgaa

SEQ ID NO: 793452 - DNA, 22 bp, Artificial Sequence
  chemically synthesized
agcatcaattgagtaaagtttc

SEQ ID NO: 793453 - DNA, 22 bp, Artificial Sequence
  chemically synthesized
gagcatcaattgagtaaagttt

SEQ ID NO: 793454 - DNA, 22 bp, Artificial Sequence
  chemically synthesized
tgagcatcaattgagtaaagtt

SEQ ID NO: 793455 - DNA, 22 bp, Artificial Sequence
  chemically synthesized
caaaagaatgaaactttactca

SEQ ID NO: 793456 - DNA, 22 bp, Artificial Sequence
  chemically synthesized
aaaagaatgaaactttactcaa

SEQ ID NO: 793457 - DNA, 22 bp, Artificial Sequence
  chemically synthesized
acaaaatacactttgagcatca

SEQ ID NO: 793458 - DNA, 22 bp, Artificial Sequence
  chemically synthesized
aacaaaatacactttgagcatc

SEQ ID NO: 793459 - DNA, 22 bp, Artificial Sequence
  chemically synthesized
tactcaattgatgctcaaagtg

SEQ ID NO: 793460 - DNA, 22 bp, Artificial Sequence
  chemically synthesized
actcaattgatgctcaaagtgt

SEQ ID NO: 793461 - DNA, 22 bp, Artificial Sequence
  chemically synthesized
ctcaattgatgctcaaagtgta

SEQ ID NO: 793462 - DNA, 22 bp, Artificial Sequence
  chemically synthesized
aattgatgctcaaagtgtattt

SEQ ID NO: 793463 - DNA, 22 bp, Artificial Sequence
  chemically synthesized
aagtacatcttaacaaaataca

SEQ ID NO: 793464 - DNA, 22 bp, Artificial Sequence
  chemically synthesized
caagtacatcttaacaaaatac

SEQ ID NO: 793465 - DNA, 22 bp, Artificial Sequence
  chemically synthesized
atgctcaaagtgtattttgtta

SEQ ID NO: 793466 - DNA, 22 bp, Artificial Sequence
  chemically synthesized
tcaagtacatcttaacaaaata

SEQ ID NO: 793467 - DNA, 22 bp, Artificial Sequence
  chemically synthesized
aaagtgtattttgttaagatgt

SEQ ID NO: 793468 - DNA, 22 bp, Artificial Sequence
  chemically synthesized
aaatgacattttcaagtacatc

SEQ ID NO: 793469 - DNA, 22 bp, Artificial Sequence
  chemically synthesized
tgttaagatgtacttgaaaatg

SEQ ID NO: 793470 - DNA, 22 bp, Artificial Sequence
  chemically synthesized
gttaagatgtacttgaaaatgt

SEQ ID NO: 793471 - DNA, 22 bp, Artificial Sequence
  chemically synthesized
ttaagatgtacttgaaaatgtc

SEQ ID NO: 793472 - DNA, 22 bp, Artificial Sequence
  chemically synthesized
agatgtacttgaaaatgtcatt

SEQ ID NO: 793473 - DNA, 22 bp, Artificial Sequence
  chemically synthesized
gaaaatgtcatttgagcctctc

SEQ ID NO: 793474 - DNA, 22 bp, Artificial Sequence
  chemically synthesized
aaaatgtcatttgagcctctct

SEQ ID NO: 793475 - DNA, 22 bp, Artificial Sequence
  chemically synthesized
taaacaatcagataagagaggc

SEQ ID NO: 793476 - DNA, 22 bp, Artificial Sequence
  chemically synthesized
tgtaaacaatcagataagagag

SEQ ID NO: 793477 - DNA, 22 bp, Artificial Sequence
  chemically synthesized
ctctgtaaacaatcagataaga

SEQ ID NO: 793478 - DNA, 22 bp, Artificial Sequence
  chemically synthesized
gctctgtaaacaatcagataag

SEQ ID NO: 793479 - DNA, 22 bp, Artificial Sequence
  chemically synthesized
tgctctgtaaacaatcagataa

SEQ ID NO: 793480 - DNA, 22 bp, Artificial Sequence
  chemically synthesized
ttgctctgtaaacaatcagata

SEQ ID NO: 793481 - DNA, 22 bp, Artificial Sequence
  chemically synthesized
tttgctctgtaaacaatcagat

SEQ ID NO: 793482 - DNA, 22 bp, Artificial Sequence
  chemically synthesized
gagcctctcttatctgattgtt

SEQ ID NO: 793483 - DNA, 22 bp, Artificial Sequence
  chemically synthesized
agcctctcttatctgattgttt

SEQ ID NO: 793484 - DNA, 22 bp, Artificial Sequence
  chemically synthesized
tttttgctctgtaaacaatcag

SEQ ID NO: 793485 - DNA, 22 bp, Artificial Sequence
  chemically synthesized
ctttttgctctgtaaacaatca

SEQ ID NO: 793486 - DNA, 22 bp, Artificial Sequence
  chemically synthesized
tctttttgctctgtaaacaatc

SEQ ID NO: 793487 - DNA, 22 bp, Artificial Sequence
  chemically synthesized
ttctttttgctctgtaaacaat

SEQ ID NO: 793488 - DNA, 22 bp, Artificial Sequence
  chemically synthesized
tttctttttgctctgtaaacaa

SEQ ID NO: 793489 - DNA, 22 bp, Artificial Sequence
  chemically synthesized
ttttctttttgctctgtaaaca

SEQ ID NO: 793490 - DNA, 22 bp, Artificial Sequence
  chemically synthesized
tcttatctgattgtttacagag

SEQ ID NO: 793491 - DNA, 22 bp, Artificial Sequence
  chemically synthesized
tttttctttttgctctgtaaac

SEQ ID NO: 793492 - DNA, 22 bp, Artificial Sequence
  chemically synthesized
ttatctgattgtttacagagca

SEQ ID NO: 793493 - DNA, 22 bp, Artificial Sequence
  chemically synthesized
ttttttttctttttgctctgta

SEQ ID NO: 793494 - DNA, 22 bp, Artificial Sequence
  chemically synthesized
atctgattgtttacagagcaaa

SEQ ID NO: 793495 - DNA, 22 bp, Artificial Sequence
  chemically synthesized
tctgattgtttacagagcaaaa

SEQ ID NO: 793496 - DNA, 22 bp, Artificial Sequence
  chemically synthesized
gctattttttttctttttgctc

SEQ ID NO: 793497 - DNA, 22 bp, Artificial Sequence
  chemically synthesized
attgtttacagagcaaaaagaa

SEQ ID NO: 793498 - DNA, 22 bp, Artificial Sequence
  chemically synthesized
tttacagagcaaaaagaaaaaa

SEQ ID NO: 793499 - DNA, 22 bp, Artificial Sequence
  chemically synthesized
acagagcaaaaagaaaaaaaat

SEQ ID NO: 793500 - DNA, 22 bp, Artificial Sequence
  chemically synthesized
cagagcaaaaagaaaaaaaata

SEQ ID NO: 793501 - DNA, 22 bp, Artificial Sequence
  chemically synthesized
tcagaagttagctatttttttt

SEQ ID NO: 793502 - DNA, 22 bp, Artificial Sequence
  chemically synthesized
atcagaagttagctattttttt

SEQ ID NO: 793503 - DNA, 22 bp, Artificial Sequence
  chemically synthesized
tatcagaagttagctatttttt

SEQ ID NO: 793504 - DNA, 22 bp, Artificial Sequence
  chemically synthesized
ggttttatcagaagttagctat

SEQ ID NO: 793505 - DNA, 22 bp, Artificial Sequence
  chemically synthesized
gggttttatcagaagttagcta

SEQ ID NO: 793506 - DNA, 22 bp, Artificial Sequence
  chemically synthesized
tgggttttatcagaagttagct

SEQ ID NO: 793507 - DNA, 22 bp, Artificial Sequence
  chemically synthesized
ttgggttttatcagaagttagc

SEQ ID NO: 793508 - DNA, 22 bp, Artificial Sequence
  chemically synthesized
atagtttttgggttttatcaga

SEQ ID NO: 793509 - DNA, 22 bp, Artificial Sequence
  chemically synthesized
catagtttttgggttttatcag

SEQ ID NO: 793510 - DNA, 22 bp, Artificial Sequence
  chemically synthesized
ttcatagtttttgggttttatc

SEQ ID NO: 793511 - DNA, 22 bp, Artificial Sequence
  chemically synthesized
acttctgataaaacccaaaaac

SEQ ID NO: 793512 - DNA, 22 bp, Artificial Sequence
  chemically synthesized
ctgataaaacccaaaaactatg

SEQ ID NO: 793513 - DNA, 22 bp, Artificial Sequence
  chemically synthesized
tgataaaacccaaaaactatga

SEQ ID NO: 793514 - DNA, 22 bp, Artificial Sequence
  chemically synthesized
ataaaacccaaaaactatgaag

SEQ ID NO: 793515 - DNA, 22 bp, Artificial Sequence
  chemically synthesized
tgacgaggcatggggaattctt

SEQ ID NO: 793516 - DNA, 22 bp, Artificial Sequence
  chemically synthesized
atgacgaggcatggggaattct

SEQ ID NO: 793517 - DNA, 22 bp, Artificial Sequence
  chemically synthesized
tatgacgaggcatggggaattc

SEQ ID NO: 793518 - DNA, 22 bp, Artificial Sequence
  chemically synthesized
ttatgacgaggcatggggaatt

SEQ ID NO: 793519 - DNA, 22 bp, Artificial Sequence
  chemically synthesized
cttttatgacgaggcatgggga

SEQ ID NO: 793520 - DNA, 22 bp, Artificial Sequence
  chemically synthesized
tgaagaattccccatgcctcgt

SEQ ID NO: 793521 - DNA, 22 bp, Artificial Sequence
  chemically synthesized
cccatgcctcgtcataaaagta

SEQ ID NO: 793522 - DNA, 22 bp, Artificial Sequence
  chemically synthesized
taaagtcgaggaaaaagctact

SEQ ID NO: 793523 - DNA, 22 bp, Artificial Sequence
  chemically synthesized
gtcataaaagtagctttttcct

SEQ ID NO: 793524 - DNA, 22 bp, Artificial Sequence
  chemically synthesized
aaatcaaataaaatctataaag

SEQ ID NO: 793525 - DNA, 22 bp, Artificial Sequence
  chemically synthesized
aaaatcaaataaaatctataaa

SEQ ID NO: 793526 - DNA, 22 bp, Artificial Sequence
  chemically synthesized
tttcctcgactttatagatttt

SEQ ID NO: 793527 - DNA, 22 bp, Artificial Sequence
  chemically synthesized
ttcctcgactttatagatttta

SEQ ID NO: 793528 - DNA, 22 bp, Artificial Sequence
  chemically synthesized
tcctcgactttatagattttat

SEQ ID NO: 793529 - DNA, 22 bp, Artificial Sequence
  chemically synthesized
cctcgactttatagattttatt

SEQ ID NO: 793530 - DNA, 22 bp, Artificial Sequence
  chemically synthesized
ctcgactttatagattttattt

SEQ ID NO: 793531 - DNA, 22 bp, Artificial Sequence
  chemically synthesized
aaatttaaaatcaaataaaatc

SEQ ID NO: 793532 - DNA, 22 bp, Artificial Sequence
  chemically synthesized
gactttatagattttatttgat

SEQ ID NO: 793533 - DNA, 22 bp, Artificial Sequence
  chemically synthesized
tatagattttatttgattttaa

SEQ ID NO: 793534 - DNA, 22 bp, Artificial Sequence
  chemically synthesized
atagattttatttgattttaaa

SEQ ID NO: 793535 - DNA, 22 bp, Artificial Sequence
  chemically synthesized
tagattttatttgattttaaat

SEQ ID NO: 793536 - DNA, 22 bp, Artificial Sequence
  chemically synthesized
tatttgattttaaattttagtc

SEQ ID NO: 793537 - DNA, 22 bp, Artificial Sequence
  chemically synthesized
atttgattttaaattttagtcc

SEQ ID NO: 793538 - DNA, 22 bp, Artificial Sequence
  chemically synthesized
tttgattttaaattttagtcca

SEQ ID NO: 793539 - DNA, 22 bp, Artificial Sequence
  chemically synthesized
gattttaaattttagtccacat

SEQ ID NO: 793540 - DNA, 22 bp, Artificial Sequence
  chemically synthesized
attttaaattttagtccacatt

SEQ ID NO: 793541 - DNA, 22 bp, Artificial Sequence
  chemically synthesized
taaattttagtccacattttca

SEQ ID NO: 793542 - DNA, 22 bp, Artificial Sequence
  chemically synthesized
aaattttagtccacattttcat

SEQ ID NO: 793543 - DNA, 22 bp, Artificial Sequence
  chemically synthesized
aattttagtccacattttcatg

SEQ ID NO: 793544 - DNA, 22 bp, Artificial Sequence
  chemically synthesized
agggccaaatacacatgaaaat

SEQ ID NO: 793545 - DNA, 22 bp, Artificial Sequence
  chemically synthesized
gagggccaaatacacatgaaaa

SEQ ID NO: 793546 - DNA, 22 bp, Artificial Sequence
  chemically synthesized
tagtccacattttcatgtgtat

SEQ ID NO: 793547 - DNA, 22 bp, Artificial Sequence
  chemically synthesized
agtccacattttcatgtgtatt

SEQ ID NO: 793548 - DNA, 22 bp, Artificial Sequence
  chemically synthesized
gtttgagggccaaatacacatg

SEQ ID NO: 793549 - DNA, 22 bp, Artificial Sequence
  chemically synthesized
gtccacattttcatgtgtattt

SEQ ID NO: 793550 - DNA, 22 bp, Artificial Sequence
  chemically synthesized
ggtttgagggccaaatacacat

SEQ ID NO: 793551 - DNA, 22 bp, Artificial Sequence
  chemically synthesized
catgcttggtttgagggccaaa

SEQ ID NO: 793552 - DNA, 22 bp, Artificial Sequence
  chemically synthesized
tcatgtgtatttggccctcaaa

SEQ ID NO: 793553 - DNA, 22 bp, Artificial Sequence
  chemically synthesized
catgtgtatttggccctcaaac

SEQ ID NO: 793554 - DNA, 22 bp, Artificial Sequence
  chemically synthesized
atgtgtatttggccctcaaacc

SEQ ID NO: 793555 - DNA, 22 bp, Artificial Sequence
  chemically synthesized
aattacatgcttggtttgaggg

SEQ ID NO: 793556 - DNA, 22 bp, Artificial Sequence
  chemically synthesized
aaattacatgcttggtttgagg

SEQ ID NO: 793557 - DNA, 22 bp, Artificial Sequence
  chemically synthesized
taaattacatgcttggtttgag

SEQ ID NO: 793558 - DNA, 22 bp, Artificial Sequence
  chemically synthesized
ttaaattacatgcttggtttga

SEQ ID NO: 793559 - DNA, 22 bp, Artificial Sequence
  chemically synthesized
tttaaattacatgcttggtttg

SEQ ID NO: 793560 - DNA, 22 bp, Artificial Sequence
  chemically synthesized
ggccctcaaaccaagcatgtaa

SEQ ID NO: 793561 - DNA, 22 bp, Artificial Sequence
  chemically synthesized
gccctcaaaccaagcatgtaat

SEQ ID NO: 793562 - DNA, 22 bp, Artificial Sequence
  chemically synthesized
acaattttttaaattacatgct

SEQ ID NO: 793563 - DNA, 22 bp, Artificial Sequence
  chemically synthesized
aaaccaagcatgtaatttaaaa

SEQ ID NO: 793564 - DNA, 22 bp, Artificial Sequence
  chemically synthesized
cataagaaaaagtatgagttaa

SEQ ID NO: 793565 - DNA, 22 bp, Artificial Sequence
  chemically synthesized
aaaaaattgttaactcatactt

SEQ ID NO: 793566 - DNA, 22 bp, Artificial Sequence
  chemically synthesized
aaaaattgttaactcatacttt

SEQ ID NO: 793567 - DNA, 22 bp, Artificial Sequence
  chemically synthesized
attacataagaaaaagtatgag

SEQ ID NO: 793568 - DNA, 22 bp, Artificial Sequence
  chemically synthesized
taattacataagaaaaagtatg

SEQ ID NO: 793569 - DNA, 22 bp, Artificial Sequence
  chemically synthesized
actctaattacataagaaaaag

SEQ ID NO: 793570 - DNA, 22 bp, Artificial Sequence
  chemically synthesized
aactctaattacataagaaaaa

SEQ ID NO: 793571 - DNA, 22 bp, Artificial Sequence
  chemically synthesized
ttaactcatactttttcttatg

SEQ ID NO: 793572 - DNA, 22 bp, Artificial Sequence
  chemically synthesized
taactctaattacataagaaaa

SEQ ID NO: 793573 - DNA, 22 bp, Artificial Sequence
  chemically synthesized
ttaactctaattacataagaaa

SEQ ID NO: 793574 - DNA, 22 bp, Artificial Sequence
  chemically synthesized
actcatactttttcttatgtaa

SEQ ID NO: 793575 - DNA, 22 bp, Artificial Sequence
  chemically synthesized
atactttttcttatgtaattag

SEQ ID NO: 793576 - DNA, 22 bp, Artificial Sequence
  chemically synthesized
acaatgatttttaactctaatt

SEQ ID NO: 793577 - DNA, 22 bp, Artificial Sequence
  chemically synthesized
aacaatgatttttaactctaat

SEQ ID NO: 793578 - DNA, 22 bp, Artificial Sequence
  chemically synthesized
tttcttatgtaattagagttaa

SEQ ID NO: 793579 - DNA, 22 bp, Artificial Sequence
  chemically synthesized
taacaatgatttttaactctaa

SEQ ID NO: 793580 - DNA, 22 bp, Artificial Sequence
  chemically synthesized
ttcttatgtaattagagttaaa

SEQ ID NO: 793581 - DNA, 22 bp, Artificial Sequence
  chemically synthesized
tcttatgtaattagagttaaaa

SEQ ID NO: 793582 - DNA, 22 bp, Artificial Sequence
  chemically synthesized
cttatgtaattagagttaaaaa

SEQ ID NO: 793583 - DNA, 22 bp, Artificial Sequence
  chemically synthesized
ttatgtaattagagttaaaaat

SEQ ID NO: 793584 - DNA, 22 bp, Artificial Sequence
  chemically synthesized
actttaacaatgatttttaact

SEQ ID NO: 793585 - DNA, 22 bp, Artificial Sequence
  chemically synthesized
cactttaacaatgatttttaac

SEQ ID NO: 793586 - DNA, 22 bp, Artificial Sequence
  chemically synthesized
atgtaattagagttaaaaatca

SEQ ID NO: 793587 - DNA, 22 bp, Artificial Sequence
  chemically synthesized
tcactttaacaatgatttttaa

SEQ ID NO: 793588 - DNA, 22 bp, Artificial Sequence
  chemically synthesized
tgtaattagagttaaaaatcat

SEQ ID NO: 793589 - DNA, 22 bp, Artificial Sequence
  chemically synthesized
ttcactttaacaatgattttta

SEQ ID NO: 793590 - DNA, 22 bp, Artificial Sequence
  chemically synthesized
tttcactttaacaatgattttt

SEQ ID NO: 793591 - DNA, 22 bp, Artificial Sequence
  chemically synthesized
ttttcactttaacaatgatttt

SEQ ID NO: 793592 - DNA, 22 bp, Artificial Sequence
  chemically synthesized
tttttttcactttaacaatgat

SEQ ID NO: 793593 - DNA, 22 bp, Artificial Sequence
  chemically synthesized
atttttttcactttaacaatga

SEQ ID NO: 793594 - DNA, 22 bp, Artificial Sequence
  chemically synthesized
tatttttttcactttaacaatg

SEQ ID NO: 793595 - DNA, 22 bp, Artificial Sequence
  chemically synthesized
gagttaaaaatcattgttaaag

SEQ ID NO: 793596 - DNA, 22 bp, Artificial Sequence
  chemically synthesized
aaaatcattgttaaagtgaaaa

SEQ ID NO: 793597 - DNA, 22 bp, Artificial Sequence
  chemically synthesized
tatagacaaacgttttattttt

SEQ ID NO: 793598 - DNA, 22 bp, Artificial Sequence
  chemically synthesized
ttaaagtgaaaaaaataaaacg

SEQ ID NO: 793599 - DNA, 22 bp, Artificial Sequence
  chemically synthesized
attatatagacaaacgttttat

SEQ ID NO: 793600 - DNA, 22 bp, Artificial Sequence
  chemically synthesized
aagtgaaaaaaataaaacgttt

SEQ ID NO: 793601 - DNA, 22 bp, Artificial Sequence
  chemically synthesized
caataatattcattatatagac

SEQ ID NO: 793602 - DNA, 22 bp, Artificial Sequence
  chemically synthesized
acaataatattcattatataga

SEQ ID NO: 793603 - DNA, 22 bp, Artificial Sequence
  chemically synthesized
tacaataatattcattatatag

SEQ ID NO: 793604 - DNA, 22 bp, Artificial Sequence
  chemically synthesized
atatgctttacaataatattca

SEQ ID NO: 793605 - DNA, 22 bp, Artificial Sequence
  chemically synthesized
aatatgctttacaataatattc

SEQ ID NO: 793606 - DNA, 22 bp, Artificial Sequence
  chemically synthesized
gtctatataatgaatattattg

SEQ ID NO: 793607 - DNA, 22 bp, Artificial Sequence
  chemically synthesized
tctatataatgaatattattgt

SEQ ID NO: 793608 - DNA, 22 bp, Artificial Sequence
  chemically synthesized
tataatgaatattattgtaaag

SEQ ID NO: 793609 - DNA, 22 bp, Artificial Sequence
  chemically synthesized
acatttaatatgctttacaata

SEQ ID NO: 793610 - DNA, 22 bp, Artificial Sequence
  chemically synthesized
aacatttaatatgctttacaat

SEQ ID NO: 793611 - DNA, 22 bp, Artificial Sequence
  chemically synthesized
tttaacatttaatatgctttac

SEQ ID NO: 793612 - DNA, 22 bp, Artificial Sequence
  chemically synthesized
atttaacatttaatatgcttta

SEQ ID NO: 793613 - DNA, 22 bp, Artificial Sequence
  chemically synthesized
tatttaacatttaatatgcttt

SEQ ID NO: 793614 - DNA, 22 bp, Artificial Sequence
  chemically synthesized
ggattttatttaacatttaata

SEQ ID NO: 793615 - DNA, 22 bp, Artificial Sequence
  chemically synthesized
ttgtaaagcatattaaatgtta

SEQ ID NO: 793616 - DNA, 22 bp, Artificial Sequence
  chemically synthesized
attaggattttatttaacattt

SEQ ID NO: 793617 - DNA, 22 bp, Artificial Sequence
  chemically synthesized
taaagcatattaaatgttaaat

SEQ ID NO: 793618 - DNA, 22 bp, Artificial Sequence
  chemically synthesized
gtatattaattaggattttatt

SEQ ID NO: 793619 - DNA, 22 bp, Artificial Sequence
  chemically synthesized
aatgttaaataaaatcctaatt

SEQ ID NO: 793620 - DNA, 22 bp, Artificial Sequence
  chemically synthesized
tattagtatattaattaggatt

SEQ ID NO: 793621 - DNA, 22 bp, Artificial Sequence
  chemically synthesized
atattagtatattaattaggat

SEQ ID NO: 793622 - DNA, 22 bp, Artificial Sequence
  chemically synthesized
aataaaatcctaattaatatac

SEQ ID NO: 793623 - DNA, 22 bp, Artificial Sequence
  chemically synthesized
taagagcttatattagtatatt

SEQ ID NO: 793624 - DNA, 22 bp, Artificial Sequence
  chemically synthesized
ataagagcttatattagtatat

SEQ ID NO: 793625 - DNA, 22 bp, Artificial Sequence
  chemically synthesized
tataagagcttatattagtata

SEQ ID NO: 793626 - DNA, 22 bp, Artificial Sequence
  chemically synthesized
aactttataagagcttatatta

SEQ ID NO: 793627 - DNA, 22 bp, Artificial Sequence
  chemically synthesized
gaactttataagagcttatatt

SEQ ID NO: 793628 - DNA, 22 bp, Artificial Sequence
  chemically synthesized
attaatatactaatataagctc

SEQ ID NO: 793629 - DNA, 22 bp, Artificial Sequence
  chemically synthesized
tttgaactttataagagcttat

SEQ ID NO: 793630 - DNA, 22 bp, Artificial Sequence
  chemically synthesized
atatactaatataagctcttat

SEQ ID NO: 793631 - DNA, 22 bp, Artificial Sequence
  chemically synthesized
attatttgaactttataagagc

SEQ ID NO: 793632 - DNA, 22 bp, Artificial Sequence
  chemically synthesized
aattatttgaactttataagag

SEQ ID NO: 793633 - DNA, 22 bp, Artificial Sequence
  chemically synthesized
tttaattatttgaactttataa

SEQ ID NO: 793634 - DNA, 22 bp, Artificial Sequence
  chemically synthesized
atataagctcttataaagttca

SEQ ID NO: 793635 - DNA, 22 bp, Artificial Sequence
  chemically synthesized
ttataaagttcaaataattaaa

SEQ ID NO: 793636 - DNA, 22 bp, Artificial Sequence
  chemically synthesized
ataaagttcaaataattaaaca

SEQ ID NO: 793637 - DNA, 22 bp, Artificial Sequence
  chemically synthesized
taaagttcaaataattaaacaa

SEQ ID NO: 793638 - DNA, 22 bp, Artificial Sequence
  chemically synthesized
ataatataaatattgtttaatt

SEQ ID NO: 793639 - DNA, 22 bp, Artificial Sequence
  chemically synthesized
aaataattaaacaatatttata

SEQ ID NO: 793640 - DNA, 22 bp, Artificial Sequence
  chemically synthesized
tgaaatgttgataatataaata

SEQ ID NO: 793641 - DNA, 22 bp, Artificial Sequence
  chemically synthesized
atgaaatgttgataatataaat

SEQ ID NO: 793642 - DNA, 22 bp, Artificial Sequence
  chemically synthesized
tcttatgaaatgttgataatat

SEQ ID NO: 793643 - DNA, 22 bp, Artificial Sequence
  chemically synthesized
atcttatgaaatgttgataata

SEQ ID NO: 793644 - DNA, 22 bp, Artificial Sequence
  chemically synthesized
aacaatatttatattatcaaca

SEQ ID NO: 793645 - DNA, 22 bp, Artificial Sequence
  chemically synthesized
tatcttatgaaatgttgataat

SEQ ID NO: 793646 - DNA, 22 bp, Artificial Sequence
  chemically synthesized
gtgtgttttatcttatgaaatg

SEQ ID NO: 793647 - DNA, 22 bp, Artificial Sequence
  chemically synthesized
agtgtgttttatcttatgaaat

SEQ ID NO: 793648 - DNA, 22 bp, Artificial Sequence
  chemically synthesized
atattatcaacatttcataaga

SEQ ID NO: 793649 - DNA, 22 bp, Artificial Sequence
  chemically synthesized
tattatcaacatttcataagat

SEQ ID NO: 793650 - DNA, 22 bp, Artificial Sequence
  chemically synthesized
tttagtgtgttttatcttatga

SEQ ID NO: 793651 - DNA, 22 bp, Artificial Sequence
  chemically synthesized
tcaacatttcataagataaaac

SEQ ID NO: 793652 - DNA, 22 bp, Artificial Sequence
  chemically synthesized
attatttagtgtgttttatctt

SEQ ID NO: 793653 - DNA, 22 bp, Artificial Sequence
  chemically synthesized
aattatttagtgtgttttatct

SEQ ID NO: 793654 - DNA, 22 bp, Artificial Sequence
  chemically synthesized
taattatttagtgtgttttatc

SEQ ID NO: 793655 - DNA, 22 bp, Artificial Sequence
  chemically synthesized
ttaattatttagtgtgttttat

SEQ ID NO: 793656 - DNA, 22 bp, Artificial Sequence
  chemically synthesized
cataagataaaacacactaaat

SEQ ID NO: 793657 - DNA, 22 bp, Artificial Sequence
  chemically synthesized
ataagataaaacacactaaata

SEQ ID NO: 793658 - DNA, 22 bp, Artificial Sequence
  chemically synthesized
catggtggaagagcttttaatt

SEQ ID NO: 793659 - DNA, 22 bp, Artificial Sequence
  chemically synthesized
gcatggtggaagagcttttaat

SEQ ID NO: 793660 - DNA, 22 bp, Artificial Sequence
  chemically synthesized
tgcatggtggaagagcttttaa

SEQ ID NO: 793661 - DNA, 22 bp, Artificial Sequence
  chemically synthesized
ttgcatggtggaagagctttta

SEQ ID NO: 793662 - DNA, 22 bp, Artificial Sequence
  chemically synthesized
aataattaaaagctcttccacc

SEQ ID NO: 793663 - DNA, 22 bp, Artificial Sequence
  chemically synthesized
gtcatttttgcatggtggaaga

SEQ ID NO: 793664 - DNA, 22 bp, Artificial Sequence
  chemically synthesized
agtcatttttgcatggtggaag

SEQ ID NO: 793665 - DNA, 22 bp, Artificial Sequence
  chemically synthesized
aaagctcttccaccatgcaaaa

SEQ ID NO: 793666 - DNA, 22 bp, Artificial Sequence
  chemically synthesized
aaaaatcgtttagtcatttttg

SEQ ID NO: 793667 - DNA, 22 bp, Artificial Sequence
  chemically synthesized
ttccaccatgcaaaaatgacta

SEQ ID NO: 793668 - DNA, 22 bp, Artificial Sequence
  chemically synthesized
ccaccatgcaaaaatgactaaa

SEQ ID NO: 793669 - DNA, 22 bp, Artificial Sequence
  chemically synthesized
caccatgcaaaaatgactaaac

SEQ ID NO: 793670 - DNA, 22 bp, Artificial Sequence
  chemically synthesized
gaaattaaaaaatcgtttagtc

SEQ ID NO: 793671 - DNA, 22 bp, Artificial Sequence
  chemically synthesized
agaaattaaaaaatcgtttagt

SEQ ID NO: 793672 - DNA, 22 bp, Artificial Sequence
  chemically synthesized
tagaaattaaaaaatcgtttag

SEQ ID NO: 793673 - DNA, 22 bp, Artificial Sequence
  chemically synthesized
aaaaagctttagaaattaaaaa

SEQ ID NO: 793674 - DNA, 22 bp, Artificial Sequence
  chemically synthesized
aacgattttttaatttctaaag

SEQ ID NO: 793675 - DNA, 22 bp, Artificial Sequence
  chemically synthesized
acagtaatctcaaaaagcttta

SEQ ID NO: 793676 - DNA, 22 bp, Artificial Sequence
  chemically synthesized
cacagtaatctcaaaaagcttt

SEQ ID NO: 793677 - DNA, 22 bp, Artificial Sequence
  chemically synthesized
tcacagtaatctcaaaaagctt

SEQ ID NO: 793678 - DNA, 22 bp, Artificial Sequence
  chemically synthesized
tttaatttctaaagctttttga

SEQ ID NO: 793679 - DNA, 22 bp, Artificial Sequence
  chemically synthesized
ttaatttctaaagctttttgag

SEQ ID NO: 793680 - DNA, 22 bp, Artificial Sequence
  chemically synthesized
taatttctaaagctttttgaga

SEQ ID NO: 793681 - DNA, 22 bp, Artificial Sequence
  chemically synthesized
aatttctaaagctttttgagat

SEQ ID NO: 793682 - DNA, 22 bp, Artificial Sequence
  chemically synthesized
atttctaaagctttttgagatt

SEQ ID NO: 793683 - DNA, 22 bp, Artificial Sequence
  chemically synthesized
ctaaagctttttgagattactg

SEQ ID NO: 793684 - DNA, 22 bp, Artificial Sequence
  chemically synthesized
tgtcccctttcacagtaatctc

SEQ ID NO: 793685 - DNA, 22 bp, Artificial Sequence
  chemically synthesized
taaagctttttgagattactgt

SEQ ID NO: 793686 - DNA, 22 bp, Artificial Sequence
  chemically synthesized
aagctttttgagattactgtga

SEQ ID NO: 793687 - DNA, 22 bp, Artificial Sequence
  chemically synthesized
aaactatgtcccctttcacagt

SEQ ID NO: 793688 - DNA, 22 bp, Artificial Sequence
  chemically synthesized
tttgagattactgtgaaagggg

SEQ ID NO: 793689 - DNA, 22 bp, Artificial Sequence
  chemically synthesized
ctgaaactatgtcccctttcac

SEQ ID NO: 793690 - DNA, 22 bp, Artificial Sequence
  chemically synthesized
ttgagattactgtgaaagggga

SEQ ID NO: 793691 - DNA, 22 bp, Artificial Sequence
  chemically synthesized
cctgaaactatgtcccctttca

SEQ ID NO: 793692 - DNA, 22 bp, Artificial Sequence
  chemically synthesized
tgagattactgtgaaaggggac

SEQ ID NO: 793693 - DNA, 22 bp, Artificial Sequence
  chemically synthesized
tcctgaaactatgtcccctttc

SEQ ID NO: 793694 - DNA, 22 bp, Artificial Sequence
  chemically synthesized
gagattactgtgaaaggggaca

SEQ ID NO: 793695 - DNA, 22 bp, Artificial Sequence
  chemically synthesized
agattactgtgaaaggggacat

SEQ ID NO: 793696 - DNA, 22 bp, Artificial Sequence
  chemically synthesized
acctttcctgaaactatgtccc

SEQ ID NO: 793697 - DNA, 22 bp, Artificial Sequence
  chemically synthesized
ctgtgaaaggggacatagtttc

SEQ ID NO: 793698 - DNA, 22 bp, Artificial Sequence
  chemically synthesized
ctcacctttcctgaaactatgt

SEQ ID NO: 793699 - DNA, 22 bp, Artificial Sequence
  chemically synthesized
actcacctttcctgaaactatg

SEQ ID NO: 793700 - DNA, 22 bp, Artificial Sequence
  chemically synthesized
tgaaaggggacatagtttcagg

SEQ ID NO: 793701 - DNA, 22 bp, Artificial Sequence
  chemically synthesized
atatagtgtttactcacctttc

SEQ ID NO: 793702 - DNA, 22 bp, Artificial Sequence
  chemically synthesized
gtctaatatagtgtttactcac

SEQ ID NO: 793703 - DNA, 22 bp, Artificial Sequence
  chemically synthesized
caggaaaggtgagtaaacacta

SEQ ID NO: 793704 - DNA, 22 bp, Artificial Sequence
  chemically synthesized
aggaaaggtgagtaaacactat

SEQ ID NO: 793705 - DNA, 22 bp, Artificial Sequence
  chemically synthesized
agaaatgctagtctaatatagt

SEQ ID NO: 793706 - DNA, 22 bp, Artificial Sequence
  chemically synthesized
tattagactagcatttctcaat

SEQ ID NO: 793707 - DNA, 22 bp, Artificial Sequence
  chemically synthesized
gactagcatttctcaattttta

SEQ ID NO: 793708 - DNA, 22 bp, Artificial Sequence
  chemically synthesized
gcatttctcaatttttatacta

SEQ ID NO: 793709 - DNA, 22 bp, Artificial Sequence
  chemically synthesized
ggccaaaatgtcagtagtataa

SEQ ID NO: 793710 - DNA, 22 bp, Artificial Sequence
  chemically synthesized
aggccaaaatgtcagtagtata

SEQ ID NO: 793711 - DNA, 22 bp, Artificial Sequence
  chemically synthesized
ctcaatttttatactactgaca

SEQ ID NO: 793712 - DNA, 22 bp, Artificial Sequence
  chemically synthesized
tttaggccaaaatgtcagtagt

SEQ ID NO: 793713 - DNA, 22 bp, Artificial Sequence
  chemically synthesized
tcaatttttatactactgacat

SEQ ID NO: 793714 - DNA, 22 bp, Artificial Sequence
  chemically synthesized
aatttttatactactgacattt

SEQ ID NO: 793715 - DNA, 22 bp, Artificial Sequence
  chemically synthesized
ttatactactgacattttggcc

SEQ ID NO: 793716 - DNA, 22 bp, Artificial Sequence
  chemically synthesized
tatactactgacattttggcct

SEQ ID NO: 793717 - DNA, 22 bp, Artificial Sequence
  chemically synthesized
atactactgacattttggccta

SEQ ID NO: 793718 - DNA, 22 bp, Artificial Sequence
  chemically synthesized
tactactgacattttggcctaa

SEQ ID NO: 793719 - DNA, 22 bp, Artificial Sequence
  chemically synthesized
cacaaggaattatttaggccaa

SEQ ID NO: 793720 - DNA, 22 bp, Artificial Sequence
  chemically synthesized
ctgacattttggcctaaataat

SEQ ID NO: 793721 - DNA, 22 bp, Artificial Sequence
  chemically synthesized
acattttggcctaaataattcc

SEQ ID NO: 793722 - DNA, 22 bp, Artificial Sequence
  chemically synthesized
tggcctaaataattccttgtgg

SEQ ID NO: 793723 - DNA, 22 bp, Artificial Sequence
  chemically synthesized
ggcctaaataattccttgtgga

SEQ ID NO: 793724 - DNA, 22 bp, Artificial Sequence
  chemically synthesized
gcctaaataattccttgtggag

SEQ ID NO: 793725 - DNA, 22 bp, Artificial Sequence
  chemically synthesized
aataattccttgtggagggcta

SEQ ID NO: 793726 - DNA, 22 bp, Artificial Sequence
  chemically synthesized
caatgcataggatagccctcca

SEQ ID NO: 793727 - DNA, 22 bp, Artificial Sequence
  chemically synthesized
cttgtggagggctatcctatgc

SEQ ID NO: 793728 - DNA, 22 bp, Artificial Sequence
  chemically synthesized
gtggagggctatcctatgcatt

SEQ ID NO: 793729 - DNA, 22 bp, Artificial Sequence
  chemically synthesized
tggagggctatcctatgcattg

SEQ ID NO: 793730 - DNA, 22 bp, Artificial Sequence
  chemically synthesized
tcctatgcattgtaggatattt

SEQ ID NO: 793731 - DNA, 22 bp, Artificial Sequence
  chemically synthesized
tgcattgtaggatattttatac

SEQ ID NO: 793732 - DNA, 22 bp, Artificial Sequence
  chemically synthesized
taggatattttataccatatct

SEQ ID NO: 793733 - DNA, 22 bp, Artificial Sequence
  chemically synthesized
gtgggtagaggccagatatggt

SEQ ID NO: 793734 - DNA, 22 bp, Artificial Sequence
  chemically synthesized
aagtctagtgggtagaggccag

SEQ ID NO: 793735 - DNA, 22 bp, Artificial Sequence
  chemically synthesized
tataccatatctggcctctacc

SEQ ID NO: 793736 - DNA, 22 bp, Artificial Sequence
  chemically synthesized
ataccatatctggcctctaccc

SEQ ID NO: 793737 - DNA, 22 bp, Artificial Sequence
  chemically synthesized
taccatatctggcctctaccca

SEQ ID NO: 793738 - DNA, 22 bp, Artificial Sequence
  chemically synthesized
gagatacaactgaagtctagtg

SEQ ID NO: 793739 - DNA, 22 bp, Artificial Sequence
  chemically synthesized
gcctctacccactagacttcag

SEQ ID NO: 793740 - DNA, 22 bp, Artificial Sequence
  chemically synthesized
gattggagatacaactgaagtc

SEQ ID NO: 793741 - DNA, 22 bp, Artificial Sequence
  chemically synthesized
tacccactagacttcagttgta

SEQ ID NO: 793742 - DNA, 22 bp, Artificial Sequence
  chemically synthesized
ctggattggagatacaactgaa

SEQ ID NO: 793743 - DNA, 22 bp, Artificial Sequence
  chemically synthesized
cccactagacttcagttgtatc

SEQ ID NO: 793744 - DNA, 22 bp, Artificial Sequence
  chemically synthesized
ttactggattggagatacaact

SEQ ID NO: 793745 - DNA, 22 bp, Artificial Sequence
  chemically synthesized
ttattactggattggagataca

SEQ ID NO: 793746 - DNA, 22 bp, Artificial Sequence
  chemically synthesized
gacttcagttgtatctccaatc

SEQ ID NO: 793747 - DNA, 22 bp, Artificial Sequence
  chemically synthesized
attattattactggattggaga

SEQ ID NO: 793748 - DNA, 22 bp, Artificial Sequence
  chemically synthesized
aattattattactggattggag

SEQ ID NO: 793749 - DNA, 22 bp, Artificial Sequence
  chemically synthesized
taattattattactggattgga

SEQ ID NO: 793750 - DNA, 22 bp, Artificial Sequence
  chemically synthesized
ttaattattattactggattgg

SEQ ID NO: 793751 - DNA, 22 bp, Artificial Sequence
  chemically synthesized
cagttgtatctccaatccagta

SEQ ID NO: 793752 - DNA, 22 bp, Artificial Sequence
  chemically synthesized
agttgtatctccaatccagtaa

SEQ ID NO: 793753 - DNA, 22 bp, Artificial Sequence
  chemically synthesized
tatctccaatccagtaataata

SEQ ID NO: 793754 - DNA, 22 bp, Artificial Sequence
  chemically synthesized
gaggcatttttaattattatta

SEQ ID NO: 793755 - DNA, 22 bp, Artificial Sequence
  chemically synthesized
caatccagtaataataattaaa

SEQ ID NO: 793756 - DNA, 22 bp, Artificial Sequence
  chemically synthesized
gcaatatctggaggcattttta

SEQ ID NO: 793757 - DNA, 22 bp, Artificial Sequence
  chemically synthesized
agcaatatctggaggcattttt

SEQ ID NO: 793758 - DNA, 22 bp, Artificial Sequence
  chemically synthesized
aaaatgcctccagatattgcta

SEQ ID NO: 793759 - DNA, 22 bp, Artificial Sequence
  chemically synthesized
caccaagtggacatttagcaat

SEQ ID NO: 793760 - DNA, 22 bp, Artificial Sequence
  chemically synthesized
cctccaccaagtggacatttag

SEQ ID NO: 793761 - DNA, 22 bp, Artificial Sequence
  chemically synthesized
acctccaccaagtggacattta

SEQ ID NO: 793762 - DNA, 22 bp, Artificial Sequence
  chemically synthesized
tacctccaccaagtggacattt

SEQ ID NO: 793763 - DNA, 22 bp, Artificial Sequence
  chemically synthesized
cagatattgctaaatgtccact

SEQ ID NO: 793764 - DNA, 22 bp, Artificial Sequence
  chemically synthesized
ttacctccaccaagtggacatt

SEQ ID NO: 793765 - DNA, 22 bp, Artificial Sequence
  chemically synthesized
ctaaatgtccacttggtggagg

SEQ ID NO: 793766 - DNA, 22 bp, Artificial Sequence
  chemically synthesized
aatgtccacttggtggaggtaa

SEQ ID NO: 793767 - DNA, 22 bp, Artificial Sequence
  chemically synthesized
ggtggaggtaaaaatatccccc

SEQ ID NO: 793768 - DNA, 22 bp, Artificial Sequence
  chemically synthesized
aaaatggggggcgggggatatt

SEQ ID NO: 793769 - DNA, 22 bp, Artificial Sequence
  chemically synthesized
gtggaggtaaaaatatcccccg

SEQ ID NO: 793770 - DNA, 22 bp, Artificial Sequence
  chemically synthesized
tcaaaatggggggcgggggata

SEQ ID NO: 793771 - DNA, 22 bp, Artificial Sequence
  chemically synthesized
caatggttctcaaaatgggggg

SEQ ID NO: 793772 - DNA, 22 bp, Artificial Sequence
  chemically synthesized
ttgcaatggttctcaaaatggg

SEQ ID NO: 793773 - DNA, 22 bp, Artificial Sequence
  chemically synthesized
tctattgcaatggttctcaaaa

SEQ ID NO: 793774 - DNA, 22 bp, Artificial Sequence
  chemically synthesized
gtctattgcaatggttctcaaa

SEQ ID NO: 793775 - DNA, 22 bp, Artificial Sequence
  chemically synthesized
atttgtctattgcaatggttct

SEQ ID NO: 793776 - DNA, 22 bp, Artificial Sequence
  chemically synthesized
agctaatttgtctattgcaatg

SEQ ID NO: 793777 - DNA, 22 bp, Artificial Sequence
  chemically synthesized
tgagctaatttgtctattgcaa

SEQ ID NO: 793778 - DNA, 22 bp, Artificial Sequence
  chemically synthesized
tgagaaccattgcaatagacaa

SEQ ID NO: 793779 - DNA, 22 bp, Artificial Sequence
  chemically synthesized
gagaaccattgcaatagacaaa

SEQ ID NO: 793780 - DNA, 22 bp, Artificial Sequence
  chemically synthesized
agaaccattgcaatagacaaat

SEQ ID NO: 793781 - DNA, 22 bp, Artificial Sequence
  chemically synthesized
caatagacaaattagctcagag

SEQ ID NO: 793782 - DNA, 22 bp, Artificial Sequence
  chemically synthesized
gagatgacataactctgagcta

SEQ ID NO: 793783 - DNA, 22 bp, Artificial Sequence
  chemically synthesized
agagatgacataactctgagct

SEQ ID NO: 793784 - DNA, 22 bp, Artificial Sequence
  chemically synthesized
tttagagatgacataactctga

SEQ ID NO: 793785 - DNA, 22 bp, Artificial Sequence
  chemically synthesized
agttgtttagagatgacataac

SEQ ID NO: 793786 - DNA, 22 bp, Artificial Sequence
  chemically synthesized
gctcagagttatgtcatctcta

SEQ ID NO: 793787 - DNA, 22 bp, Artificial Sequence
  chemically synthesized
tgctaagttgtttagagatgac

SEQ ID NO: 793788 - DNA, 22 bp, Artificial Sequence
  chemically synthesized
atgctaagttgtttagagatga

SEQ ID NO: 793789 - DNA, 22 bp, Artificial Sequence
  chemically synthesized
agagttatgtcatctctaaaca

SEQ ID NO: 793790 - DNA, 22 bp, Artificial Sequence
  chemically synthesized
tttatgctaagttgtttagaga

SEQ ID NO: 793791 - DNA, 22 bp, Artificial Sequence
  chemically synthesized
gtttatgctaagttgtttagag

SEQ ID NO: 793792 - DNA, 22 bp, Artificial Sequence
  chemically synthesized
gtttgtttatgctaagttgttt

SEQ ID NO: 793793 - DNA, 22 bp, Artificial Sequence
  chemically synthesized
tgtcatctctaaacaacttagc

SEQ ID NO: 793794 - DNA, 22 bp, Artificial Sequence
  chemically synthesized
tagtttgtttatgctaagttgt

SEQ ID NO: 793795 - DNA, 22 bp, Artificial Sequence
  chemically synthesized
tctagtttgtttatgctaagtt

SEQ ID NO: 793796 - DNA, 22 bp, Artificial Sequence
  chemically synthesized
ctctagtttgtttatgctaagt

SEQ ID NO: 793797 - DNA, 22 bp, Artificial Sequence
  chemically synthesized
taaacaacttagcataaacaaa

SEQ ID NO: 793798 - DNA, 22 bp, Artificial Sequence
  chemically synthesized
aacaacttagcataaacaaact

SEQ ID NO: 793799 - DNA, 22 bp, Artificial Sequence
  chemically synthesized
agcataaacaaactagagaagc

SEQ ID NO: 793800 - DNA, 22 bp, Artificial Sequence
  chemically synthesized
gcataaacaaactagagaagcc

SEQ ID NO: 793801 - DNA, 22 bp, Artificial Sequence
  chemically synthesized
agaccagaagtcgaaagggctt

SEQ ID NO: 793802 - DNA, 22 bp, Artificial Sequence
  chemically synthesized
cagaccagaagtcgaaagggct

SEQ ID NO: 793803 - DNA, 22 bp, Artificial Sequence
  chemically synthesized
ttcagaccagaagtcgaaaggg

SEQ ID NO: 793804 - DNA, 22 bp, Artificial Sequence
  chemically synthesized
gagaagccctttcgacttctgg

SEQ ID NO: 793805 - DNA, 22 bp, Artificial Sequence
  chemically synthesized
tagacacgcagaattcttcaga

SEQ ID NO: 793806 - DNA, 22 bp, Artificial Sequence
  chemically synthesized
tcgacttctggtctgaagaatt

SEQ ID NO: 793807 - DNA, 22 bp, Artificial Sequence
  chemically synthesized
cgacttctggtctgaagaattc

SEQ ID NO: 793808 - DNA, 22 bp, Artificial Sequence
  chemically synthesized
gacttctggtctgaagaattct

SEQ ID NO: 793809 - DNA, 22 bp, Artificial Sequence
  chemically synthesized
tattatagacacgcagaattct

SEQ ID NO: 793810 - DNA, 22 bp, Artificial Sequence
  chemically synthesized
gtattatagacacgcagaattc

SEQ ID NO: 793811 - DNA, 22 bp, Artificial Sequence
  chemically synthesized
ctggtctgaagaattctgcgtg

SEQ ID NO: 793812 - DNA, 22 bp, Artificial Sequence
  chemically synthesized
tggtctgaagaattctgcgtgt

SEQ ID NO: 793813 - DNA, 22 bp, Artificial Sequence
  chemically synthesized
gtctgaagaattctgcgtgtct

SEQ ID NO: 793814 - DNA, 22 bp, Artificial Sequence
  chemically synthesized
aacttgtattatagacacgcag

SEQ ID NO: 793815 - DNA, 22 bp, Artificial Sequence
  chemically synthesized
aagaattctgcgtgtctataat

SEQ ID NO: 793816 - DNA, 22 bp, Artificial Sequence
  chemically synthesized
tgcgtgtctataatacaagttt

SEQ ID NO: 793817 - DNA, 22 bp, Artificial Sequence
  chemically synthesized
cgtgtctataatacaagtttaa

SEQ ID NO: 793818 - DNA, 22 bp, Artificial Sequence
  chemically synthesized
ggtacatatcaattaaacttgt

SEQ ID NO: 793819 - DNA, 22 bp, Artificial Sequence
  chemically synthesized
aggtacatatcaattaaacttg

SEQ ID NO: 793820 - DNA, 22 bp, Artificial Sequence
  chemically synthesized
taatacaagtttaattgatatg

SEQ ID NO: 793821 - DNA, 22 bp, Artificial Sequence
  chemically synthesized
ataataacttaggtacatatca

SEQ ID NO: 793822 - DNA, 22 bp, Artificial Sequence
  chemically synthesized
aattgatatgtacctaagttat

SEQ ID NO: 793823 - DNA, 22 bp, Artificial Sequence
  chemically synthesized
tatcagctgataataacttagg

SEQ ID NO: 793824 - DNA, 22 bp, Artificial Sequence
  chemically synthesized
attgatatgtacctaagttatt

SEQ ID NO: 793825 - DNA, 22 bp, Artificial Sequence
  chemically synthesized
ttatatcagctgataataactt

SEQ ID NO: 793826 - DNA, 22 bp, Artificial Sequence
  chemically synthesized
atatgtacctaagttattatca

SEQ ID NO: 793827 - DNA, 22 bp, Artificial Sequence
  chemically synthesized
agttattatcagctgatataac

SEQ ID NO: 793828 - DNA, 22 bp, Artificial Sequence
  chemically synthesized
ttatcagctgatataacaattt

SEQ ID NO: 793829 - DNA, 22 bp, Artificial Sequence
  chemically synthesized
agaaagcatcacaaattgttat

SEQ ID NO: 793830 - DNA, 22 bp, Artificial Sequence
  chemically synthesized
tcagctgatataacaatttgtg

SEQ ID NO: 793831 - DNA, 22 bp, Artificial Sequence
  chemically synthesized
atgattcagaaagcatcacaaa

SEQ ID NO: 793832 - DNA, 22 bp, Artificial Sequence
  chemically synthesized
gatgattcagaaagcatcacaa

SEQ ID NO: 793833 - DNA, 22 bp, Artificial Sequence
  chemically synthesized
tgatgattcagaaagcatcaca

SEQ ID NO: 793834 - DNA, 22 bp, Artificial Sequence
  chemically synthesized
atataacaatttgtgatgcttt

SEQ ID NO: 793835 - DNA, 22 bp, Artificial Sequence
  chemically synthesized
ttgatgattcagaaagcatcac

SEQ ID NO: 793836 - DNA, 22 bp, Artificial Sequence
  chemically synthesized
tttgatgattcagaaagcatca

SEQ ID NO: 793837 - DNA, 22 bp, Artificial Sequence
  chemically synthesized
ttttgatgattcagaaagcatc

SEQ ID NO: 793838 - DNA, 22 bp, Artificial Sequence
  chemically synthesized
gtgatgctttctgaatcatcaa

SEQ ID NO: 793839 - DNA, 22 bp, Artificial Sequence
  chemically synthesized
tgatgctttctgaatcatcaaa

SEQ ID NO: 793840 - DNA, 22 bp, Artificial Sequence
  chemically synthesized
aaacaacatttttttgatgatt

SEQ ID NO: 793841 - DNA, 22 bp, Artificial Sequence
  chemically synthesized
agcattcaaacaacattttttt

SEQ ID NO: 793842 - DNA, 22 bp, Artificial Sequence
  chemically synthesized
tctgaatcatcaaaaaaatgtt

SEQ ID NO: 793843 - DNA, 22 bp, Artificial Sequence
  chemically synthesized
aagcattcaaacaacatttttt

SEQ ID NO: 793844 - DNA, 22 bp, Artificial Sequence
  chemically synthesized
ctgaatcatcaaaaaaatgttg

SEQ ID NO: 793845 - DNA, 22 bp, Artificial Sequence
  chemically synthesized
tgaatcatcaaaaaaatgttgt

SEQ ID NO: 793846 - DNA, 22 bp, Artificial Sequence
  chemically synthesized
aatcatcaaaaaaatgttgttt

SEQ ID NO: 793847 - DNA, 22 bp, Artificial Sequence
  chemically synthesized
agcatcttaagcattcaaacaa

SEQ ID NO: 793848 - DNA, 22 bp, Artificial Sequence
  chemically synthesized
caaaacacattaagcatcttaa

SEQ ID NO: 793849 - DNA, 22 bp, Artificial Sequence
  chemically synthesized
tttgaatgcttaagatgcttaa

SEQ ID NO: 793850 - DNA, 22 bp, Artificial Sequence
  chemically synthesized
tattacaaaacacattaagcat

SEQ ID NO: 793851 - DNA, 22 bp, Artificial Sequence
  chemically synthesized
gaatgcttaagatgcttaatgt

SEQ ID NO: 793852 - DNA, 22 bp, Artificial Sequence
  chemically synthesized
aatgcttaagatgcttaatgtg

SEQ ID NO: 793853 - DNA, 22 bp, Artificial Sequence
  chemically synthesized
gtatactgtattacaaaacaca

SEQ ID NO: 793854 - DNA, 22 bp, Artificial Sequence
  chemically synthesized
aagatgcttaatgtgttttgta

SEQ ID NO: 793855 - DNA, 22 bp, Artificial Sequence
  chemically synthesized
agtatactgtattacaaaacac

SEQ ID NO: 793856 - DNA, 22 bp, Artificial Sequence
  chemically synthesized
agatgcttaatgtgttttgtaa

SEQ ID NO: 793857 - DNA, 22 bp, Artificial Sequence
  chemically synthesized
tagtatactgtattacaaaaca

SEQ ID NO: 793858 - DNA, 22 bp, Artificial Sequence
  chemically synthesized
ttagtatactgtattacaaaac

SEQ ID NO: 793859 - DNA, 22 bp, Artificial Sequence
  chemically synthesized
aatgtgttttgtaatacagtat

SEQ ID NO: 793860 - DNA, 22 bp, Artificial Sequence
  chemically synthesized
atgtgttttgtaatacagtata

SEQ ID NO: 793861 - DNA, 22 bp, Artificial Sequence
  chemically synthesized
caaggtttttagtatactgtat

SEQ ID NO: 793862 - DNA, 22 bp, Artificial Sequence
  chemically synthesized
ccaaggtttttagtatactgta

SEQ ID NO: 793863 - DNA, 22 bp, Artificial Sequence
  chemically synthesized
tgtaatacagtatactaaaaac

SEQ ID NO: 793864 - DNA, 22 bp, Artificial Sequence
  chemically synthesized
atgatttccaaggtttttagta

SEQ ID NO: 793865 - DNA, 22 bp, Artificial Sequence
  chemically synthesized
gtaatacagtatactaaaaacc

SEQ ID NO: 793866 - DNA, 22 bp, Artificial Sequence
  chemically synthesized
taatacagtatactaaaaacct

SEQ ID NO: 793867 - DNA, 22 bp, Artificial Sequence
  chemically synthesized
attaatgatttccaaggttttt

SEQ ID NO: 793868 - DNA, 22 bp, Artificial Sequence
  chemically synthesized
agttaattaatgatttccaagg

SEQ ID NO: 793869 - DNA, 22 bp, Artificial Sequence
  chemically synthesized
cagttaattaatgatttccaag

SEQ ID NO: 793870 - DNA, 22 bp, Artificial Sequence
  chemically synthesized
aaaaccttggaaatcattaatt

SEQ ID NO: 793871 - DNA, 22 bp, Artificial Sequence
  chemically synthesized
tatggcttcagttaattaatga

SEQ ID NO: 793872 - DNA, 22 bp, Artificial Sequence
  chemically synthesized
ggaaatcattaattaactgaag

SEQ ID NO: 793873 - DNA, 22 bp, Artificial Sequence
  chemically synthesized
gaaatcattaattaactgaagc

SEQ ID NO: 793874 - DNA, 22 bp, Artificial Sequence
  chemically synthesized
tcaaaattatatggcttcagtt

SEQ ID NO: 793875 - DNA, 22 bp, Artificial Sequence
  chemically synthesized
attaactgaagccatataattt

SEQ ID NO: 793876 - DNA, 22 bp, Artificial Sequence
  chemically synthesized
actgaagccatataattttgat

SEQ ID NO: 793877 - DNA, 22 bp, Artificial Sequence
  chemically synthesized
aagccatataattttgatagtt

SEQ ID NO: 793878 - DNA, 22 bp, Artificial Sequence
  chemically synthesized
aagtgcccagtaaccaaactat

SEQ ID NO: 793879 - DNA, 22 bp, Artificial Sequence
  chemically synthesized
gattaaagtgcccagtaaccaa

SEQ ID NO: 793880 - DNA, 22 bp, Artificial Sequence
  chemically synthesized
tgatagtttggttactgggcac

SEQ ID NO: 793881 - DNA, 22 bp, Artificial Sequence
  chemically synthesized
gatagtttggttactgggcact

SEQ ID NO: 793882 - DNA, 22 bp, Artificial Sequence
  chemically synthesized
atagtttggttactgggcactt

SEQ ID NO: 793883 - DNA, 22 bp, Artificial Sequence
  chemically synthesized
cagattagattaaagtgcccag

SEQ ID NO: 793884 - DNA, 22 bp, Artificial Sequence
  chemically synthesized
acagattagattaaagtgccca

SEQ ID NO: 793885 - DNA, 22 bp, Artificial Sequence
  chemically synthesized
ggttactgggcactttaatcta

SEQ ID NO: 793886 - DNA, 22 bp, Artificial Sequence
  chemically synthesized
gttactgggcactttaatctaa

SEQ ID NO: 793887 - DNA, 22 bp, Artificial Sequence
  chemically synthesized
gaagatttacagattagattaa

SEQ ID NO: 793888 - DNA, 22 bp, Artificial Sequence
  chemically synthesized
ctgggcactttaatctaatctg

SEQ ID NO: 793889 - DNA, 22 bp, Artificial Sequence
  chemically synthesized
ttggaagatttacagattagat

SEQ ID NO: 793890 - DNA, 22 bp, Artificial Sequence
  chemically synthesized
ggcactttaatctaatctgtaa

SEQ ID NO: 793891 - DNA, 22 bp, Artificial Sequence
  chemically synthesized
gaaatctattggaagatttaca

SEQ ID NO: 793892 - DNA, 22 bp, Artificial Sequence
  chemically synthesized
ggaaatctattggaagatttac

SEQ ID NO: 793893 - DNA, 22 bp, Artificial Sequence
  chemically synthesized
taatctaatctgtaaatcttcc

SEQ ID NO: 793894 - DNA, 22 bp, Artificial Sequence
  chemically synthesized
aatctaatctgtaaatcttcca

SEQ ID NO: 793895 - DNA, 22 bp, Artificial Sequence
  chemically synthesized
atctaatctgtaaatcttccaa

SEQ ID NO: 793896 - DNA, 22 bp, Artificial Sequence
  chemically synthesized
agtttggaaatctattggaaga

SEQ ID NO: 793897 - DNA, 22 bp, Artificial Sequence
  chemically synthesized
tgagtttggaaatctattggaa

SEQ ID NO: 793898 - DNA, 22 bp, Artificial Sequence
  chemically synthesized
atctgtaaatcttccaatagat

SEQ ID NO: 793899 - DNA, 22 bp, Artificial Sequence
  chemically synthesized
taaatcttccaatagatttcca

SEQ ID NO: 793900 - DNA, 22 bp, Artificial Sequence
  chemically synthesized
ccaatagatttccaaactcaga

SEQ ID NO: 793901 - DNA, 22 bp, Artificial Sequence
  chemically synthesized
caatagatttccaaactcagaa

SEQ ID NO: 793902 - DNA, 22 bp, Artificial Sequence
  chemically synthesized
ccaaactcagaattttcatcct

SEQ ID NO: 793903 - DNA, 22 bp, Artificial Sequence
  chemically synthesized
accaatcagagcaggatgaaaa

SEQ ID NO: 793904 - DNA, 22 bp, Artificial Sequence
  chemically synthesized
caaactcagaattttcatcctg

SEQ ID NO: 793905 - DNA, 22 bp, Artificial Sequence
  chemically synthesized
agaattttcatcctgctctgat

SEQ ID NO: 793906 - DNA, 22 bp, Artificial Sequence
  chemically synthesized
tcatcctgctctgattggttaa

SEQ ID NO: 793907 - DNA, 22 bp, Artificial Sequence
  chemically synthesized
catcctgctctgattggttaat

SEQ ID NO: 793908 - DNA, 22 bp, Artificial Sequence
  chemically synthesized
atcctgctctgattggttaatc

SEQ ID NO: 793909 - DNA, 22 bp, Artificial Sequence
  chemically synthesized
ctctgattggttaatctttggt

SEQ ID NO: 793910 - DNA, 22 bp, Artificial Sequence
  chemically synthesized
tgattggttaatctttggtggg

SEQ ID NO: 793911 - DNA, 22 bp, Artificial Sequence
  chemically synthesized
attggttaatctttggtgggat

SEQ ID NO: 793912 - DNA, 22 bp, Artificial Sequence
  chemically synthesized
gttaatctttggtgggatttac

SEQ ID NO: 793913 - DNA, 22 bp, Artificial Sequence
  chemically synthesized
atctttggtgggatttaccatt

SEQ ID NO: 793914 - DNA, 22 bp, Artificial Sequence
  chemically synthesized
taatgcaatggataaatggtaa

SEQ ID NO: 793915 - DNA, 22 bp, Artificial Sequence
  chemically synthesized
tggtgggatttaccatttatcc

SEQ ID NO: 793916 - DNA, 22 bp, Artificial Sequence
  chemically synthesized
ggtgggatttaccatttatcca

SEQ ID NO: 793917 - DNA, 22 bp, Artificial Sequence
  chemically synthesized
gtgggatttaccatttatccat

SEQ ID NO: 793918 - DNA, 22 bp, Artificial Sequence
  chemically synthesized
accatttatccattgcattata

SEQ ID NO: 793919 - DNA, 22 bp, Artificial Sequence
  chemically synthesized
ccatttatccattgcattataa

SEQ ID NO: 793920 - DNA, 22 bp, Artificial Sequence
  chemically synthesized
atccattgcattataattattt

SEQ ID NO: 793921 - DNA, 22 bp, Artificial Sequence
  chemically synthesized
tccattgcattataattatttg

SEQ ID NO: 793922 - DNA, 22 bp, Artificial Sequence
  chemically synthesized
tatgataaggcacagcaaataa

SEQ ID NO: 793923 - DNA, 22 bp, Artificial Sequence
  chemically synthesized
atatgataaggcacagcaaata

SEQ ID NO: 793924 - DNA, 22 bp, Artificial Sequence
  chemically synthesized
tatatgataaggcacagcaaat

SEQ ID NO: 793925 - DNA, 22 bp, Artificial Sequence
  chemically synthesized
cattataattatttgctgtgcc

SEQ ID NO: 793926 - DNA, 22 bp, Artificial Sequence
  chemically synthesized
tctttatatgataaggcacagc

SEQ ID NO: 793927 - DNA, 22 bp, Artificial Sequence
  chemically synthesized
gtctttatatgataaggcacag

SEQ ID NO: 793928 - DNA, 22 bp, Artificial Sequence
  chemically synthesized
tgtctttatatgataaggcaca

SEQ ID NO: 793929 - DNA, 22 bp, Artificial Sequence
  chemically synthesized
taattatttgctgtgccttatc

SEQ ID NO: 793930 - DNA, 22 bp, Artificial Sequence
  chemically synthesized
tttgctgtgccttatcatataa

SEQ ID NO: 793931 - DNA, 22 bp, Artificial Sequence
  chemically synthesized
gctgtgccttatcatataaaga

SEQ ID NO: 793932 - DNA, 22 bp, Artificial Sequence
  chemically synthesized
ctgtgccttatcatataaagac

SEQ ID NO: 793933 - DNA, 22 bp, Artificial Sequence
  chemically synthesized
cacacccaattttgtctttata

SEQ ID NO: 793934 - DNA, 22 bp, Artificial Sequence
  chemically synthesized
tgccttatcatataaagacaaa

SEQ ID NO: 793935 - DNA, 22 bp, Artificial Sequence
  chemically synthesized
ctccacacccaattttgtcttt

SEQ ID NO: 793936 - DNA, 22 bp, Artificial Sequence
  chemically synthesized
atcatataaagacaaaattggg

SEQ ID NO: 793937 - DNA, 22 bp, Artificial Sequence
  chemically synthesized
tcatataaagacaaaattgggt

SEQ ID NO: 793938 - DNA, 22 bp, Artificial Sequence
  chemically synthesized
gaaagtatgggcaactactcca

SEQ ID NO: 793939 - DNA, 22 bp, Artificial Sequence
  chemically synthesized
ggtgtggagtagttgcccatac

SEQ ID NO: 793940 - DNA, 22 bp, Artificial Sequence
  chemically synthesized
aatgatatgccctggaaagtat

SEQ ID NO: 793941 - DNA, 22 bp, Artificial Sequence
  chemically synthesized
cccatactttccagggcatatc

SEQ ID NO: 793942 - DNA, 22 bp, Artificial Sequence
  chemically synthesized
agtgtgggtctcaatgatatgc

SEQ ID NO: 793943 - DNA, 22 bp, Artificial Sequence
  chemically synthesized
ctgagtgtgggtctcaatgata

SEQ ID NO: 793944 - DNA, 22 bp, Artificial Sequence
  chemically synthesized
tccagggcatatcattgagacc

SEQ ID NO: 793945 - DNA, 22 bp, Artificial Sequence
  chemically synthesized
ccagggcatatcattgagaccc

SEQ ID NO: 793946 - DNA, 22 bp, Artificial Sequence
  chemically synthesized
cagggcatatcattgagaccca

SEQ ID NO: 793947 - DNA, 22 bp, Artificial Sequence
  chemically synthesized
aagaacataataacctactgag

SEQ ID NO: 793948 - DNA, 22 bp, Artificial Sequence
  chemically synthesized
agacccacactcagtaggttat

SEQ ID NO: 793949 - DNA, 22 bp, Artificial Sequence
  chemically synthesized
agtaggttattatgttctttaa

SEQ ID NO: 793950 - DNA, 22 bp, Artificial Sequence
  chemically synthesized
aatgtgtaaaccattaaagaac

SEQ ID NO: 793951 - DNA, 22 bp, Artificial Sequence
  chemically synthesized
caatgtgtaaaccattaaagaa

SEQ ID NO: 793952 - DNA, 22 bp, Artificial Sequence
  chemically synthesized
ccttcaatgtgtaaaccattaa

SEQ ID NO: 793953 - DNA, 22 bp, Artificial Sequence
  chemically synthesized
cccttcaatgtgtaaaccatta

SEQ ID NO: 793954 - DNA, 22 bp, Artificial Sequence
  chemically synthesized
ttatgttctttaatggtttaca

SEQ ID NO: 793955 - DNA, 22 bp, Artificial Sequence
  chemically synthesized
tgttctttaatggtttacacat

SEQ ID NO: 793956 - DNA, 22 bp, Artificial Sequence
  chemically synthesized
tttaatggtttacacattgaag

SEQ ID NO: 793957 - DNA, 22 bp, Artificial Sequence
  chemically synthesized
taatggtttacacattgaaggg

SEQ ID NO: 793958 - DNA, 22 bp, Artificial Sequence
  chemically synthesized
aatggtttacacattgaaggga

SEQ ID NO: 793959 - DNA, 22 bp, Artificial Sequence
  chemically synthesized
atggtttacacattgaagggaa

SEQ ID NO: 793960 - DNA, 22 bp, Artificial Sequence
  chemically synthesized
aggaaaggtgaaacttcccttc

SEQ ID NO: 793961 - DNA, 22 bp, Artificial Sequence
  chemically synthesized
caggaaaggtgaaacttccctt

SEQ ID NO: 793962 - DNA, 22 bp, Artificial Sequence
  chemically synthesized
acacattgaagggaagtttcac

SEQ ID NO: 793963 - DNA, 22 bp, Artificial Sequence
  chemically synthesized
cacattgaagggaagtttcacc

SEQ ID NO: 793964 - DNA, 22 bp, Artificial Sequence
  chemically synthesized
aagggaagtttcacctttcctg

SEQ ID NO: 793965 - DNA, 22 bp, Artificial Sequence
  chemically synthesized
tgaaagggggtatagtttcagg

SEQ ID NO: 793966 - DNA, 22 bp, Artificial Sequence
  chemically synthesized
ctgtgaaagggggtatagtttc

SEQ ID NO: 793967 - DNA, 22 bp, Artificial Sequence
  chemically synthesized
cacctttcctgaaactataccc

SEQ ID NO: 793968 - DNA, 22 bp, Artificial Sequence
  chemically synthesized
acctttcctgaaactatacccc

SEQ ID NO: 793969 - DNA, 22 bp, Artificial Sequence
  chemically synthesized
agattactgtgaaagggggtat

SEQ ID NO: 793970 - DNA, 22 bp, Artificial Sequence
  chemically synthesized
gagattactgtgaaagggggta

SEQ ID NO: 793971 - DNA, 22 bp, Artificial Sequence
  chemically synthesized
tcctgaaactataccccctttc

SEQ ID NO: 793972 - DNA, 22 bp, Artificial Sequence
  chemically synthesized
tgagattactgtgaaagggggt

SEQ ID NO: 793973 - DNA, 22 bp, Artificial Sequence
  chemically synthesized
cctgaaactataccccctttca

SEQ ID NO: 793974 - DNA, 22 bp, Artificial Sequence
  chemically synthesized
ttgagattactgtgaaaggggg

SEQ ID NO: 793975 - DNA, 22 bp, Artificial Sequence
  chemically synthesized
ctgaaactataccccctttcac

SEQ ID NO: 793976 - DNA, 22 bp, Artificial Sequence
  chemically synthesized
tttgagattactgtgaaagggg

SEQ ID NO: 793977 - DNA, 22 bp, Artificial Sequence
  chemically synthesized
aaactataccccctttcacagt

SEQ ID NO: 793978 - DNA, 22 bp, Artificial Sequence
  chemically synthesized
aggctttttgagattactgtga

SEQ ID NO: 793979 - DNA, 22 bp, Artificial Sequence
  chemically synthesized
taaggctttttgagattactgt

SEQ ID NO: 793980 - DNA, 22 bp, Artificial Sequence
  chemically synthesized
taccccctttcacagtaatctc

SEQ ID NO: 793981 - DNA, 22 bp, Artificial Sequence
  chemically synthesized
ctaaggctttttgagattactg

SEQ ID NO: 793982 - DNA, 22 bp, Artificial Sequence
  chemically synthesized
atttctaaggctttttgagatt

SEQ ID NO: 793983 - DNA, 22 bp, Artificial Sequence
  chemically synthesized
ttaatttctaaggctttttgag

SEQ ID NO: 793984 - DNA, 22 bp, Artificial Sequence
  chemically synthesized
tcacagtaatctcaaaaagcct

SEQ ID NO: 793985 - DNA, 22 bp, Artificial Sequence
  chemically synthesized
cacagtaatctcaaaaagcctt

SEQ ID NO: 793986 - DNA, 22 bp, Artificial Sequence
  chemically synthesized
acagtaatctcaaaaagcctta

SEQ ID NO: 793987 - DNA, 22 bp, Artificial Sequence
  chemically synthesized
aataaattgttaatttctaagg

SEQ ID NO: 793988 - DNA, 22 bp, Artificial Sequence
  chemically synthesized
aaaaagccttagaaattaacaa

SEQ ID NO: 793989 - DNA, 22 bp, Artificial Sequence
  chemically synthesized
agaaattaacaatttatttagt

SEQ ID NO: 793990 - DNA, 22 bp, Artificial Sequence
  chemically synthesized
gaaattaacaatttatttagtc

SEQ ID NO: 793991 - DNA, 22 bp, Artificial Sequence
  chemically synthesized
caccgtgcaaaaatgactaaat

SEQ ID NO: 793992 - DNA, 22 bp, Artificial Sequence
  chemically synthesized
ccaccgtgcaaaaatgactaaa

SEQ ID NO: 793993 - DNA, 22 bp, Artificial Sequence
  chemically synthesized
ttccaccgtgcaaaaatgacta

SEQ ID NO: 793994 - DNA, 22 bp, Artificial Sequence
  chemically synthesized
acaatttatttagtcatttttg

SEQ ID NO: 793995 - DNA, 22 bp, Artificial Sequence
  chemically synthesized
aaaactcttccaccgtgcaaaa

SEQ ID NO: 793996 - DNA, 22 bp, Artificial Sequence
  chemically synthesized
atttagtcatttttgcacggtg

SEQ ID NO: 793997 - DNA, 22 bp, Artificial Sequence
  chemically synthesized
tttagtcatttttgcacggtgg

SEQ ID NO: 793998 - DNA, 22 bp, Artificial Sequence
  chemically synthesized
agtcatttttgcacggtggaag

SEQ ID NO: 793999 - DNA, 22 bp, Artificial Sequence
  chemically synthesized
gtcatttttgcacggtggaaga

SEQ ID NO: 794000 - DNA, 22 bp, Artificial Sequence
  chemically synthesized
aataattaaaaactcttccacc

SEQ ID NO: 794001 - DNA, 22 bp, Artificial Sequence
  chemically synthesized
ttgcacggtggaagagttttta

SEQ ID NO: 794002 - DNA, 22 bp, Artificial Sequence
  chemically synthesized
tgcacggtggaagagtttttaa

SEQ ID NO: 794003 - DNA, 22 bp, Artificial Sequence
  chemically synthesized
gcacggtggaagagtttttaat

SEQ ID NO: 794004 - DNA, 22 bp, Artificial Sequence
  chemically synthesized
cacggtggaagagtttttaatt

SEQ ID NO: 794005 - DNA, 22 bp, Artificial Sequence
  chemically synthesized
taatacgataaacacattaaat

SEQ ID NO: 794006 - DNA, 22 bp, Artificial Sequence
  chemically synthesized
ataatacgataaacacattaaa

SEQ ID NO: 794007 - DNA, 22 bp, Artificial Sequence
  chemically synthesized
tataatacgataaacacattaa

SEQ ID NO: 794008 - DNA, 22 bp, Artificial Sequence
  chemically synthesized
ttaattatttaatgtgtttatc

SEQ ID NO: 794009 - DNA, 22 bp, Artificial Sequence
  chemically synthesized
taattatttaatgtgtttatcg

SEQ ID NO: 794010 - DNA, 22 bp, Artificial Sequence
  chemically synthesized
aattatttaatgtgtttatcgt

SEQ ID NO: 794011 - DNA, 22 bp, Artificial Sequence
  chemically synthesized
attatttaatgtgtttatcgta

SEQ ID NO: 794012 - DNA, 22 bp, Artificial Sequence
  chemically synthesized
tttaatgtgtttatcgtattat

SEQ ID NO: 794013 - DNA, 22 bp, Artificial Sequence
  chemically synthesized
aatgtgtttatcgtattataaa

SEQ ID NO: 794014 - DNA, 22 bp, Artificial Sequence
  chemically synthesized
tatgatcaatgttttataatac

SEQ ID NO: 794015 - DNA, 22 bp, Artificial Sequence
  chemically synthesized
atgtgtttatcgtattataaaa

SEQ ID NO: 794016 - DNA, 22 bp, Artificial Sequence
  chemically synthesized
atatgatcaatgttttataata

SEQ ID NO: 794017 - DNA, 22 bp, Artificial Sequence
  chemically synthesized
atcgtattataaaacattgatc

SEQ ID NO: 794018 - DNA, 22 bp, Artificial Sequence
  chemically synthesized
tcgtattataaaacattgatca

SEQ ID NO: 794019 - DNA, 22 bp, Artificial Sequence
  chemically synthesized
aacaatatttatatgatcaatg

SEQ ID NO: 794020 - DNA, 22 bp, Artificial Sequence
  chemically synthesized
taaaacattgatcatataaata

SEQ ID NO: 794021 - DNA, 22 bp, Artificial Sequence
  chemically synthesized
atcatataaatattgtttaatt

SEQ ID NO: 794022 - DNA, 22 bp, Artificial Sequence
  chemically synthesized
taaagtacaaataattaaacaa

SEQ ID NO: 794023 - DNA, 22 bp, Artificial Sequence
  chemically synthesized
ttataaagtacaaataattaaa

SEQ ID NO: 794024 - DNA, 22 bp, Artificial Sequence
  chemically synthesized
atgtaagctattataaagtaca

SEQ ID NO: 794025 - DNA, 22 bp, Artificial Sequence
  chemically synthesized
tttaattatttgtactttataa

SEQ ID NO: 794026 - DNA, 22 bp, Artificial Sequence
  chemically synthesized
aattatttgtactttataatag

SEQ ID NO: 794027 - DNA, 22 bp, Artificial Sequence
  chemically synthesized
attatttgtactttataatagc

SEQ ID NO: 794028 - DNA, 22 bp, Artificial Sequence
  chemically synthesized
atatactaatgtaagctattat

SEQ ID NO: 794029 - DNA, 22 bp, Artificial Sequence
  chemically synthesized
tttgtactttataatagcttac

SEQ ID NO: 794030 - DNA, 22 bp, Artificial Sequence
  chemically synthesized
gtactttataatagcttacatt

SEQ ID NO: 794031 - DNA, 22 bp, Artificial Sequence
  chemically synthesized
tactttataatagcttacatta

SEQ ID NO: 794032 - DNA, 22 bp, Artificial Sequence
  chemically synthesized
tataatagcttacattagtata

SEQ ID NO: 794033 - DNA, 22 bp, Artificial Sequence
  chemically synthesized
taaaaatcctaatatactaatg

SEQ ID NO: 794034 - DNA, 22 bp, Artificial Sequence
  chemically synthesized
ataatagcttacattagtatat

SEQ ID NO: 794035 - DNA, 22 bp, Artificial Sequence
  chemically synthesized
taatagcttacattagtatatt

SEQ ID NO: 794036 - DNA, 22 bp, Artificial Sequence
  chemically synthesized
aatgttataaaaatcctaatat

SEQ ID NO: 794037 - DNA, 22 bp, Artificial Sequence
  chemically synthesized
acattagtatattaggattttt

SEQ ID NO: 794038 - DNA, 22 bp, Artificial Sequence
  chemically synthesized
cattagtatattaggattttta

SEQ ID NO: 794039 - DNA, 22 bp, Artificial Sequence
  chemically synthesized
gtatattaggatttttataaca

SEQ ID NO: 794040 - DNA, 22 bp, Artificial Sequence
  chemically synthesized
taaagcatattaaatgttataa

SEQ ID NO: 794041 - DNA, 22 bp, Artificial Sequence
  chemically synthesized
ctataaagcatattaaatgtta

SEQ ID NO: 794042 - DNA, 22 bp, Artificial Sequence
  chemically synthesized
ggatttttataacatttaatat

SEQ ID NO: 794043 - DNA, 22 bp, Artificial Sequence
  chemically synthesized
ttataacatttaatatgcttta

SEQ ID NO: 794044 - DNA, 22 bp, Artificial Sequence
  chemically synthesized
tataacatttaatatgctttat

SEQ ID NO: 794045 - DNA, 22 bp, Artificial Sequence
  chemically synthesized
ataacatttaatatgctttata

SEQ ID NO: 794046 - DNA, 22 bp, Artificial Sequence
  chemically synthesized
taacatttaatatgctttatag

SEQ ID NO: 794047 - DNA, 22 bp, Artificial Sequence
  chemically synthesized
cataacaaatactactataaag

SEQ ID NO: 794048 - DNA, 22 bp, Artificial Sequence
  chemically synthesized
tctacataacaaatactactat

SEQ ID NO: 794049 - DNA, 22 bp, Artificial Sequence
  chemically synthesized
gtctacataacaaatactacta

SEQ ID NO: 794050 - DNA, 22 bp, Artificial Sequence
  chemically synthesized
aatatgctttatagtagtattt

SEQ ID NO: 794051 - DNA, 22 bp, Artificial Sequence
  chemically synthesized
atatgctttatagtagtatttg

SEQ ID NO: 794052 - DNA, 22 bp, Artificial Sequence
  chemically synthesized
aatcatttgtctacataacaaa

SEQ ID NO: 794053 - DNA, 22 bp, Artificial Sequence
  chemically synthesized
gaatcatttgtctacataacaa

SEQ ID NO: 794054 - DNA, 22 bp, Artificial Sequence
  chemically synthesized
tatagtagtatttgttatgtag

SEQ ID NO: 794055 - DNA, 22 bp, Artificial Sequence
  chemically synthesized
atagtagtatttgttatgtaga

SEQ ID NO: 794056 - DNA, 22 bp, Artificial Sequence
  chemically synthesized
tagtagtatttgttatgtagac

SEQ ID NO: 794057 - DNA, 22 bp, Artificial Sequence
  chemically synthesized
gttatgtagacaaatgattcaa

SEQ ID NO: 794058 - DNA, 22 bp, Artificial Sequence
  chemically synthesized
ttatgtagacaaatgattcaaa

SEQ ID NO: 794059 - DNA, 22 bp, Artificial Sequence
  chemically synthesized
tgtagacaaatgattcaaatat

SEQ ID NO: 794060 - DNA, 22 bp, Artificial Sequence
  chemically synthesized
acaatgaggcaaatatttgaat

SEQ ID NO: 794061 - DNA, 22 bp, Artificial Sequence
  chemically synthesized
aacaatgaggcaaatatttgaa

SEQ ID NO: 794062 - DNA, 22 bp, Artificial Sequence
  chemically synthesized
taacaatgaggcaaatatttga

SEQ ID NO: 794063 - DNA, 22 bp, Artificial Sequence
  chemically synthesized
ttaacaatgaggcaaatatttg

SEQ ID NO: 794064 - DNA, 22 bp, Artificial Sequence
  chemically synthesized
agtgagcttttaacaatgaggc

SEQ ID NO: 794065 - DNA, 22 bp, Artificial Sequence
  chemically synthesized
aagtgagcttttaacaatgagg

SEQ ID NO: 794066 - DNA, 22 bp, Artificial Sequence
  chemically synthesized
aaatatttgcctcattgttaaa

SEQ ID NO: 794067 - DNA, 22 bp, Artificial Sequence
  chemically synthesized
gcctcattgttaaaagctcact

SEQ ID NO: 794068 - DNA, 22 bp, Artificial Sequence
  chemically synthesized
cctcattgttaaaagctcactt

SEQ ID NO: 794069 - DNA, 22 bp, Artificial Sequence
  chemically synthesized
tgtcaaaacatttaagtgagct

SEQ ID NO: 794070 - DNA, 22 bp, Artificial Sequence
  chemically synthesized
atgtcaaaacatttaagtgagc

SEQ ID NO: 794071 - DNA, 22 bp, Artificial Sequence
  chemically synthesized
attgttaaaagctcacttaaat

SEQ ID NO: 794072 - DNA, 22 bp, Artificial Sequence
  chemically synthesized
ttaaaagctcacttaaatgttt

SEQ ID NO: 794073 - DNA, 22 bp, Artificial Sequence
  chemically synthesized
aaagctcacttaaatgttttga

SEQ ID NO: 794074 - DNA, 22 bp, Artificial Sequence
  chemically synthesized
tgtgagcttatgtcaaaacatt

SEQ ID NO: 794075 - DNA, 22 bp, Artificial Sequence
  chemically synthesized
aaattatgtgagcttatgtcaa

SEQ ID NO: 794076 - DNA, 22 bp, Artificial Sequence
  chemically synthesized
acttaaatgttttgacataagc

SEQ ID NO: 794077 - DNA, 22 bp, Artificial Sequence
  chemically synthesized
caaattatgtgagcttatgtca

SEQ ID NO: 794078 - DNA, 22 bp, Artificial Sequence
  chemically synthesized
tcaaattatgtgagcttatgtc

SEQ ID NO: 794079 - DNA, 22 bp, Artificial Sequence
  chemically synthesized
aaatgttttgacataagctcac

SEQ ID NO: 794080 - DNA, 22 bp, Artificial Sequence
  chemically synthesized
aatgttttgacataagctcaca

SEQ ID NO: 794081 - DNA, 22 bp, Artificial Sequence
  chemically synthesized
atattttcaaattatgtgagct

SEQ ID NO: 794082 - DNA, 22 bp, Artificial Sequence
  chemically synthesized
aatattttcaaattatgtgagc

SEQ ID NO: 794083 - DNA, 22 bp, Artificial Sequence
  chemically synthesized
ttaatattttcaaattatgtga

SEQ ID NO: 794084 - DNA, 22 bp, Artificial Sequence
  chemically synthesized
tgacataagctcacataatttg

SEQ ID NO: 794085 - DNA, 22 bp, Artificial Sequence
  chemically synthesized
gacataagctcacataatttga

SEQ ID NO: 794086 - DNA, 22 bp, Artificial Sequence
  chemically synthesized
acataagctcacataatttgaa

SEQ ID NO: 794087 - DNA, 22 bp, Artificial Sequence
  chemically synthesized
aaattcttaatattttcaaatt

SEQ ID NO: 794088 - DNA, 22 bp, Artificial Sequence
  chemically synthesized
caaattcttaatattttcaaat

SEQ ID NO: 794089 - DNA, 22 bp, Artificial Sequence
  chemically synthesized
tagcttcaaattcttaatattt

SEQ ID NO: 794090 - DNA, 22 bp, Artificial Sequence
  chemically synthesized
acataatttgaaaatattaaga

SEQ ID NO: 794091 - DNA, 22 bp, Artificial Sequence
  chemically synthesized
tatagcttcaaattcttaatat

SEQ ID NO: 794092 - DNA, 22 bp, Artificial Sequence
  chemically synthesized
aaattctatagcttcaaattct

SEQ ID NO: 794093 - DNA, 22 bp, Artificial Sequence
  chemically synthesized
caaattctatagcttcaaattc

SEQ ID NO: 794094 - DNA, 22 bp, Artificial Sequence
  chemically synthesized
gaaaatattaagaatttgaagc

SEQ ID NO: 794095 - DNA, 22 bp, Artificial Sequence
  chemically synthesized
tcaaattctatagcttcaaatt

SEQ ID NO: 794096 - DNA, 22 bp, Artificial Sequence
  chemically synthesized
aaaatattaagaatttgaagct

SEQ ID NO: 794097 - DNA, 22 bp, Artificial Sequence
  chemically synthesized
atgttttcaaattctatagctt

SEQ ID NO: 794098 - DNA, 22 bp, Artificial Sequence
  chemically synthesized
agaatttgaagctatagaattt

SEQ ID NO: 794099 - DNA, 22 bp, Artificial Sequence
  chemically synthesized
aatgcattaatgttttcaaatt

SEQ ID NO: 794100 - DNA, 22 bp, Artificial Sequence
  chemically synthesized
gaagctatagaatttgaaaaca

SEQ ID NO: 794101 - DNA, 22 bp, Artificial Sequence
  chemically synthesized
aagctatagaatttgaaaacat

SEQ ID NO: 794102 - DNA, 22 bp, Artificial Sequence
  chemically synthesized
tagaatttgaaaacattaatgc

SEQ ID NO: 794103 - DNA, 22 bp, Artificial Sequence
  chemically synthesized
catatggaattcaatgcattaa

SEQ ID NO: 794104 - DNA, 22 bp, Artificial Sequence
  chemically synthesized
ccatatggaattcaatgcatta

SEQ ID NO: 794105 - DNA, 22 bp, Artificial Sequence
  chemically synthesized
ttccatatggaattcaatgcat

SEQ ID NO: 794106 - DNA, 22 bp, Artificial Sequence
  chemically synthesized
cttccatatggaattcaatgca

SEQ ID NO: 794107 - DNA, 22 bp, Artificial Sequence
  chemically synthesized
gaaaacattaatgcattgaatt

SEQ ID NO: 794108 - DNA, 22 bp, Artificial Sequence
  chemically synthesized
tcttccatatggaattcaatgc

SEQ ID NO: 794109 - DNA, 22 bp, Artificial Sequence
  chemically synthesized
aaaacattaatgcattgaattc

SEQ ID NO: 794110 - DNA, 22 bp, Artificial Sequence
  chemically synthesized
aacagactttcttccatatgga

SEQ ID NO: 794111 - DNA, 22 bp, Artificial Sequence
  chemically synthesized
atgcattgaattccatatggaa

SEQ ID NO: 794112 - DNA, 22 bp, Artificial Sequence
  chemically synthesized
aactaaacagactttcttccat

SEQ ID NO: 794113 - DNA, 22 bp, Artificial Sequence
  chemically synthesized
aattccatatggaagaaagtct

SEQ ID NO: 794114 - DNA, 22 bp, Artificial Sequence
  chemically synthesized
catatggaagaaagtctgttta

SEQ ID NO: 794115 - DNA, 22 bp, Artificial Sequence
  chemically synthesized
aagtccctcaactaaacagact

SEQ ID NO: 794116 - DNA, 22 bp, Artificial Sequence
  chemically synthesized
tttagttgagggacttcaatat

SEQ ID NO: 794117 - DNA, 22 bp, Artificial Sequence
  chemically synthesized
agttgagggacttcaatatgct

SEQ ID NO: 794118 - DNA, 22 bp, Artificial Sequence
  chemically synthesized
gttgagggacttcaatatgctt

SEQ ID NO: 794119 - DNA, 22 bp, Artificial Sequence
  chemically synthesized
agaagtggaaaatggaagcata

SEQ ID NO: 794120 - DNA, 22 bp, Artificial Sequence
  chemically synthesized
agggacttcaatatgcttccat

SEQ ID NO: 794121 - DNA, 22 bp, Artificial Sequence
  chemically synthesized
cagaagtggaaaatggaagcat

SEQ ID NO: 794122 - DNA, 22 bp, Artificial Sequence
  chemically synthesized
caatatgcttccattttccact

SEQ ID NO: 794123 - DNA, 22 bp, Artificial Sequence
  chemically synthesized
aatatgcttccattttccactt

SEQ ID NO: 794124 - DNA, 22 bp, Artificial Sequence
  chemically synthesized
ccattttccacttctgaagatc

SEQ ID NO: 794125 - DNA, 22 bp, Artificial Sequence
  chemically synthesized
cattttccacttctgaagatct

SEQ ID NO: 794126 - DNA, 22 bp, Artificial Sequence
  chemically synthesized
ccatgagccgaaacagatcttc

SEQ ID NO: 794127 - DNA, 22 bp, Artificial Sequence
  chemically synthesized
accatgagccgaaacagatctt

SEQ ID NO: 794128 - DNA, 22 bp, Artificial Sequence
  chemically synthesized
tccacttctgaagatctgtttc

SEQ ID NO: 794129 - DNA, 22 bp, Artificial Sequence
  chemically synthesized
ccacttctgaagatctgtttcg

SEQ ID NO: 794130 - DNA, 22 bp, Artificial Sequence
  chemically synthesized
cacttctgaagatctgtttcgg

SEQ ID NO: 794131 - DNA, 22 bp, Artificial Sequence
  chemically synthesized
ctgaagatctgtttcggctcat

SEQ ID NO: 794132 - DNA, 22 bp, Artificial Sequence
  chemically synthesized
tgaagatctgtttcggctcatg

SEQ ID NO: 794133 - DNA, 22 bp, Artificial Sequence
  chemically synthesized
aagatctgtttcggctcatggt

SEQ ID NO: 794134 - DNA, 22 bp, Artificial Sequence
  chemically synthesized
tttcggctcatggtaaatatta

SEQ ID NO: 794135 - DNA, 22 bp, Artificial Sequence
  chemically synthesized
cggctcatggtaaatattacat

SEQ ID NO: 794136 - DNA, 22 bp, Artificial Sequence
  chemically synthesized
ggctcatggtaaatattacatc

SEQ ID NO: 794137 - DNA, 22 bp, Artificial Sequence
  chemically synthesized
gggagcgagggtaaagatgtaa

SEQ ID NO: 794138 - DNA, 22 bp, Artificial Sequence
  chemically synthesized
ggggagcgagggtaaagatgta

SEQ ID NO: 794139 - DNA, 22 bp, Artificial Sequence
  chemically synthesized
atggtaaatattacatctttac

SEQ ID NO: 794140 - DNA, 22 bp, Artificial Sequence
  chemically synthesized
aagcatttggggagcgagggta

SEQ ID NO: 794141 - DNA, 22 bp, Artificial Sequence
  chemically synthesized
catctttaccctcgctccccaa

SEQ ID NO: 794142 - DNA, 22 bp, Artificial Sequence
  chemically synthesized
atccatctgaagcatttgggga

SEQ ID NO: 794143 - DNA, 22 bp, Artificial Sequence
  chemically synthesized
aatccatctgaagcatttgggg

SEQ ID NO: 794144 - DNA, 22 bp, Artificial Sequence
  chemically synthesized
taccctcgctccccaaatgctt

SEQ ID NO: 794145 - DNA, 22 bp, Artificial Sequence
  chemically synthesized
accctcgctccccaaatgcttc

SEQ ID NO: 794146 - DNA, 22 bp, Artificial Sequence
  chemically synthesized
ccctcgctccccaaatgcttca

SEQ ID NO: 794147 - DNA, 22 bp, Artificial Sequence
  chemically synthesized
gctccccaaatgcttcagatgg

SEQ ID NO: 794148 - DNA, 22 bp, Artificial Sequence
  chemically synthesized
cccaaatgcttcagatggatta

SEQ ID NO: 794149 - DNA, 22 bp, Artificial Sequence
  chemically synthesized
cagatggattaagcaccattct

SEQ ID NO: 794150 - DNA, 22 bp, Artificial Sequence
  chemically synthesized
ccccacacaaaaagaatggtgc

SEQ ID NO: 794151 - DNA, 22 bp, Artificial Sequence
  chemically synthesized
agatggattaagcaccattctt

SEQ ID NO: 794152 - DNA, 22 bp, Artificial Sequence
  chemically synthesized
cagctcccccacacaaaaagaa

SEQ ID NO: 794153 - DNA, 22 bp, Artificial Sequence
  chemically synthesized
tccagctcccccacacaaaaag

SEQ ID NO: 794154 - DNA, 22 bp, Artificial Sequence
  chemically synthesized
tctccagctcccccacacaaaa

SEQ ID NO: 794155 - DNA, 22 bp, Artificial Sequence
  chemically synthesized
agcaccattctttttgtgtggg

SEQ ID NO: 794156 - DNA, 22 bp, Artificial Sequence
  chemically synthesized
tctctccagctcccccacacaa

SEQ ID NO: 794157 - DNA, 22 bp, Artificial Sequence
  chemically synthesized
ctctctccagctcccccacaca

SEQ ID NO: 794158 - DNA, 22 bp, Artificial Sequence
  chemically synthesized
tttctctctccagctcccccac

SEQ ID NO: 794159 - DNA, 22 bp, Artificial Sequence
  chemically synthesized
tttttgtgtgggggagctggag

SEQ ID NO: 794160 - DNA, 22 bp, Artificial Sequence
  chemically synthesized
atctatttctctctccagctcc

SEQ ID NO: 794161 - DNA, 22 bp, Artificial Sequence
  chemically synthesized
tttgtgtgggggagctggagag

SEQ ID NO: 794162 - DNA, 22 bp, Artificial Sequence
  chemically synthesized
ttgtgtgggggagctggagaga

SEQ ID NO: 794163 - DNA, 22 bp, Artificial Sequence
  chemically synthesized
tgtgtgggggagctggagagag

SEQ ID NO: 794164 - DNA, 22 bp, Artificial Sequence
  chemically synthesized
gtgtgggggagctggagagaga

SEQ ID NO: 794165 - DNA, 22 bp, Artificial Sequence
  chemically synthesized
tgtgggggagctggagagagaa

SEQ ID NO: 794166 - DNA, 22 bp, Artificial Sequence
  chemically synthesized
gagagagaaatagatgaatatc

SEQ ID NO: 794167 - DNA, 22 bp, Artificial Sequence
  chemically synthesized
ggatggaatcaagggtgtggaa

SEQ ID NO: 794168 - DNA, 22 bp, Artificial Sequence
  chemically synthesized
ttaggatggaatcaagggtgtg

SEQ ID NO: 794169 - DNA, 22 bp, Artificial Sequence
  chemically synthesized
gttaggatggaatcaagggtgt

SEQ ID NO: 794170 - DNA, 22 bp, Artificial Sequence
  chemically synthesized
gtacttgttaggatggaatcaa

SEQ ID NO: 794171 - DNA, 22 bp, Artificial Sequence
  chemically synthesized
ttggtacttgttaggatggaat

SEQ ID NO: 794172 - DNA, 22 bp, Artificial Sequence
  chemically synthesized
ccacacccttgattccatccta

SEQ ID NO: 794173 - DNA, 22 bp, Artificial Sequence
  chemically synthesized
attggtacttgttaggatggaa

SEQ ID NO: 794174 - DNA, 22 bp, Artificial Sequence
  chemically synthesized
cacacccttgattccatcctaa

SEQ ID NO: 794175 - DNA, 22 bp, Artificial Sequence
  chemically synthesized
tttattggtacttgttaggatg

SEQ ID NO: 794176 - DNA, 22 bp, Artificial Sequence
  chemically synthesized
ctatttattggtacttgttagg

SEQ ID NO: 794177 - DNA, 22 bp, Artificial Sequence
  chemically synthesized
gattccatcctaacaagtacca

SEQ ID NO: 794178 - DNA, 22 bp, Artificial Sequence
  chemically synthesized
attccatcctaacaagtaccaa

SEQ ID NO: 794179 - DNA, 22 bp, Artificial Sequence
  chemically synthesized
catcctaacaagtaccaataaa

SEQ ID NO: 794180 - DNA, 22 bp, Artificial Sequence
  chemically synthesized
acaagtaccaataaatagcaac

SEQ ID NO: 794181 - DNA, 22 bp, Artificial Sequence
  chemically synthesized
tagaggaggtgagaagttgcta

SEQ ID NO: 794182 - DNA, 22 bp, Artificial Sequence
  chemically synthesized
tatagaggaggtgagaagttgc

SEQ ID NO: 794183 - DNA, 22 bp, Artificial Sequence
  chemically synthesized
aagacaacctctatagaggagg

SEQ ID NO: 794184 - DNA, 22 bp, Artificial Sequence
  chemically synthesized
attgaagacaacctctatagag

SEQ ID NO: 794185 - DNA, 22 bp, Artificial Sequence
  chemically synthesized
aattgaagacaacctctataga

SEQ ID NO: 794186 - DNA, 22 bp, Artificial Sequence
  chemically synthesized
taattgaagacaacctctatag

SEQ ID NO: 794187 - DNA, 22 bp, Artificial Sequence
  chemically synthesized
ttaattgaagacaacctctata

SEQ ID NO: 794188 - DNA, 22 bp, Artificial Sequence
  chemically synthesized
ctcacctcctctatagaggttg

SEQ ID NO: 794189 - DNA, 22 bp, Artificial Sequence
  chemically synthesized
tcacctcctctatagaggttgt

SEQ ID NO: 794190 - DNA, 22 bp, Artificial Sequence
  chemically synthesized
acctcctctatagaggttgtct

SEQ ID NO: 794191 - DNA, 22 bp, Artificial Sequence
  chemically synthesized
gtgtatttttaattgaagacaa

SEQ ID NO: 794192 - DNA, 22 bp, Artificial Sequence
  chemically synthesized
ctctatagaggttgtcttcaat

SEQ ID NO: 794193 - DNA, 22 bp, Artificial Sequence
  chemically synthesized
tagtgtatttttaattgaagac

SEQ ID NO: 794194 - DNA, 22 bp, Artificial Sequence
  chemically synthesized
tatagaggttgtcttcaattaa

SEQ ID NO: 794195 - DNA, 22 bp, Artificial Sequence
  chemically synthesized
tctagtgtatttttaattgaag

SEQ ID NO: 794196 - DNA, 22 bp, Artificial Sequence
  chemically synthesized
tagaggttgtcttcaattaaaa

SEQ ID NO: 794197 - DNA, 22 bp, Artificial Sequence
  chemically synthesized
taatctctctagtgtattttta

SEQ ID NO: 794198 - DNA, 22 bp, Artificial Sequence
  chemically synthesized
tcttcaattaaaaatacactag

SEQ ID NO: 794199 - DNA, 22 bp, Artificial Sequence
  chemically synthesized
tggttataatctctctagtgta

SEQ ID NO: 794200 - DNA, 22 bp, Artificial Sequence
  chemically synthesized
caattaaaaatacactagagag

SEQ ID NO: 794201 - DNA, 22 bp, Artificial Sequence
  chemically synthesized
tatggttataatctctctagtg

SEQ ID NO: 794202 - DNA, 22 bp, Artificial Sequence
  chemically synthesized
aattaaaaatacactagagaga

SEQ ID NO: 794203 - DNA, 22 bp, Artificial Sequence
  chemically synthesized
ctatggttataatctctctagt

SEQ ID NO: 794204 - DNA, 22 bp, Artificial Sequence
  chemically synthesized
tctatggttataatctctctag

SEQ ID NO: 794205 - DNA, 22 bp, Artificial Sequence
  chemically synthesized
aaaatacactagagagattata

SEQ ID NO: 794206 - DNA, 22 bp, Artificial Sequence
  chemically synthesized
aatgtcctttctatggttataa

SEQ ID NO: 794207 - DNA, 22 bp, Artificial Sequence
  chemically synthesized
ctcaatgtcctttctatggtta

SEQ ID NO: 794208 - DNA, 22 bp, Artificial Sequence
  chemically synthesized
gagagattataaccatagaaag

SEQ ID NO: 794209 - DNA, 22 bp, Artificial Sequence
  chemically synthesized
taaccatagaaaggacattgag

SEQ ID NO: 794210 - DNA, 22 bp, Artificial Sequence
  chemically synthesized
gccgaaagcactactcaatgtc

SEQ ID NO: 794211 - DNA, 22 bp, Artificial Sequence
  chemically synthesized
ccaattagccgaaagcactact

SEQ ID NO: 794212 - DNA, 22 bp, Artificial Sequence
  chemically synthesized
agtagtgctttcggctaattgg

SEQ ID NO: 794213 - DNA, 22 bp, Artificial Sequence
  chemically synthesized
gaaggaatgtactgccaattag

SEQ ID NO: 794214 - DNA, 22 bp, Artificial Sequence
  chemically synthesized
ggaaggaatgtactgccaatta

SEQ ID NO: 794215 - DNA, 22 bp, Artificial Sequence
  chemically synthesized
tggaaggaatgtactgccaatt

SEQ ID NO: 794216 - DNA, 22 bp, Artificial Sequence
  chemically synthesized
tcggctaattggcagtacattc

SEQ ID NO: 794217 - DNA, 22 bp, Artificial Sequence
  chemically synthesized
aaattttggaaggaatgtactg

SEQ ID NO: 794218 - DNA, 22 bp, Artificial Sequence
  chemically synthesized
cggctaattggcagtacattcc

SEQ ID NO: 794219 - DNA, 22 bp, Artificial Sequence
  chemically synthesized
ggctaattggcagtacattcct

SEQ ID NO: 794220 - DNA, 22 bp, Artificial Sequence
  chemically synthesized
tgaaattttggaaggaatgtac

SEQ ID NO: 794221 - DNA, 22 bp, Artificial Sequence
  chemically synthesized
attggcagtacattccttccaa

SEQ ID NO: 794222 - DNA, 22 bp, Artificial Sequence
  chemically synthesized
gcagtacattccttccaaaatt

SEQ ID NO: 794223 - DNA, 22 bp, Artificial Sequence
  chemically synthesized
aggtacctctgaaattttggaa

SEQ ID NO: 794224 - DNA, 22 bp, Artificial Sequence
  chemically synthesized
aattgaggtacctctgaaattt

SEQ ID NO: 794225 - DNA, 22 bp, Artificial Sequence
  chemically synthesized
cttccaaaatttcagaggtacc

SEQ ID NO: 794226 - DNA, 22 bp, Artificial Sequence
  chemically synthesized
ccaaaatttcagaggtacctca

SEQ ID NO: 794227 - DNA, 22 bp, Artificial Sequence
  chemically synthesized
caaaatttcagaggtacctcaa

SEQ ID NO: 794228 - DNA, 22 bp, Artificial Sequence
  chemically synthesized
aggggagtcattaaattgaggt

SEQ ID NO: 794229 - DNA, 22 bp, Artificial Sequence
  chemically synthesized
ttcaggggagtcattaaattga

SEQ ID NO: 794230 - DNA, 22 bp, Artificial Sequence
  chemically synthesized
attcaggggagtcattaaattg

SEQ ID NO: 794231 - DNA, 22 bp, Artificial Sequence
  chemically synthesized
cagaggtacctcaatttaatga

SEQ ID NO: 794232 - DNA, 22 bp, Artificial Sequence
  chemically synthesized
tattcaggggagtcattaaatt

SEQ ID NO: 794233 - DNA, 22 bp, Artificial Sequence
  chemically synthesized
agaggtacctcaatttaatgac

SEQ ID NO: 794234 - DNA, 22 bp, Artificial Sequence
  chemically synthesized
ctttattcaggggagtcattaa

SEQ ID NO: 794235 - DNA, 22 bp, Artificial Sequence
  chemically synthesized
aatttaatgactcccctgaata

SEQ ID NO: 794236 - DNA, 22 bp, Artificial Sequence
  chemically synthesized
aaccaattactttattcagggg

SEQ ID NO: 794237 - DNA, 22 bp, Artificial Sequence
  chemically synthesized
caaccaattactttattcaggg

SEQ ID NO: 794238 - DNA, 22 bp, Artificial Sequence
  chemically synthesized
aatgactcccctgaataaagta

SEQ ID NO: 794239 - DNA, 22 bp, Artificial Sequence
  chemically synthesized
atgactcccctgaataaagtaa

SEQ ID NO: 794240 - DNA, 22 bp, Artificial Sequence
  chemically synthesized
ccctgaataaagtaattggttg

SEQ ID NO: 794241 - DNA, 22 bp, Artificial Sequence
  chemically synthesized
caaagtaaatttcaaccaatta

SEQ ID NO: 794242 - DNA, 22 bp, Artificial Sequence
  chemically synthesized
aataaagtaattggttgaaatt

SEQ ID NO: 794243 - DNA, 22 bp, Artificial Sequence
  chemically synthesized
agaactgcaaagtaaatttcaa

SEQ ID NO: 794244 - DNA, 22 bp, Artificial Sequence
  chemically synthesized
tattaagaactgcaaagtaaat

SEQ ID NO: 794245 - DNA, 22 bp, Artificial Sequence
  chemically synthesized
gttgaaatttactttgcagttc

SEQ ID NO: 794246 - DNA, 22 bp, Artificial Sequence
  chemically synthesized
aaatttactttgcagttcttaa

SEQ ID NO: 794247 - DNA, 22 bp, Artificial Sequence
  chemically synthesized
actttgcagttcttaatataac

SEQ ID NO: 794248 - DNA, 22 bp, Artificial Sequence
  chemically synthesized
ctttgcagttcttaatataact

SEQ ID NO: 794249 - DNA, 22 bp, Artificial Sequence
  chemically synthesized
atgatgggcccaaagttatatt

SEQ ID NO: 794250 - DNA, 22 bp, Artificial Sequence
  chemically synthesized
tgcagttcttaatataactttg

SEQ ID NO: 794251 - DNA, 22 bp, Artificial Sequence
  chemically synthesized
gcagttcttaatataactttgg

SEQ ID NO: 794252 - DNA, 22 bp, Artificial Sequence
  chemically synthesized
ctaatgatgggcccaaagttat

SEQ ID NO: 794253 - DNA, 22 bp, Artificial Sequence
  chemically synthesized
cagttcttaatataactttggg

SEQ ID NO: 794254 - DNA, 22 bp, Artificial Sequence
  chemically synthesized
gctaatgatgggcccaaagtta

SEQ ID NO: 794255 - DNA, 22 bp, Artificial Sequence
  chemically synthesized
ttgctaatgatgggcccaaagt

SEQ ID NO: 794256 - DNA, 22 bp, Artificial Sequence
  chemically synthesized
ttaatataactttgggcccatc

SEQ ID NO: 794257 - DNA, 22 bp, Artificial Sequence
  chemically synthesized
aatataactttgggcccatcat

SEQ ID NO: 794258 - DNA, 22 bp, Artificial Sequence
  chemically synthesized
gagttcttgctaatgatgggcc

SEQ ID NO: 794259 - DNA, 22 bp, Artificial Sequence
  chemically synthesized
atataactttgggcccatcatt

SEQ ID NO: 794260 - DNA, 22 bp, Artificial Sequence
  chemically synthesized
agagttcttgctaatgatgggc

SEQ ID NO: 794261 - DNA, 22 bp, Artificial Sequence
  chemically synthesized
tagagttcttgctaatgatggg

SEQ ID NO: 794262 - DNA, 22 bp, Artificial Sequence
  chemically synthesized
ttagagttcttgctaatgatgg

SEQ ID NO: 794263 - DNA, 22 bp, Artificial Sequence
  chemically synthesized
tttagagttcttgctaatgatg

SEQ ID NO: 794264 - DNA, 22 bp, Artificial Sequence
  chemically synthesized
ctttttagagttcttgctaatg

SEQ ID NO: 794265 - DNA, 22 bp, Artificial Sequence
  chemically synthesized
cctttttagagttcttgctaat

SEQ ID NO: 794266 - DNA, 22 bp, Artificial Sequence
  chemically synthesized
tcctttttagagttcttgctaa

SEQ ID NO: 794267 - DNA, 22 bp, Artificial Sequence
  chemically synthesized
tgggcccatcattagcaagaac

SEQ ID NO: 794268 - DNA, 22 bp, Artificial Sequence
  chemically synthesized
ttcctttttagagttcttgcta

SEQ ID NO: 794269 - DNA, 22 bp, Artificial Sequence
  chemically synthesized
gggcccatcattagcaagaact

SEQ ID NO: 794270 - DNA, 22 bp, Artificial Sequence
  chemically synthesized
ggcccatcattagcaagaactc

SEQ ID NO: 794271 - DNA, 22 bp, Artificial Sequence
  chemically synthesized
tttttcctttttagagttcttg

SEQ ID NO: 794272 - DNA, 22 bp, Artificial Sequence
  chemically synthesized
gtttttcctttttagagttctt

SEQ ID NO: 794273 - DNA, 22 bp, Artificial Sequence
  chemically synthesized
tgtttttcctttttagagttct

SEQ ID NO: 794274 - DNA, 22 bp, Artificial Sequence
  chemically synthesized
ttgtttttcctttttagagttc

SEQ ID NO: 794275 - DNA, 22 bp, Artificial Sequence
  chemically synthesized
tttttgtttttcctttttagag

SEQ ID NO: 794276 - DNA, 22 bp, Artificial Sequence
  chemically synthesized
gtttttgtttttcctttttaga

SEQ ID NO: 794277 - DNA, 22 bp, Artificial Sequence
  chemically synthesized
tgtttttgtttttcctttttag

SEQ ID NO: 794278 - DNA, 22 bp, Artificial Sequence
  chemically synthesized
gcaagaactctaaaaaggaaaa

SEQ ID NO: 794279 - DNA, 22 bp, Artificial Sequence
  chemically synthesized
accccagttttgtttttgtttt

SEQ ID NO: 794280 - DNA, 22 bp, Artificial Sequence
  chemically synthesized
taaaaaggaaaaacaaaaacaa

SEQ ID NO: 794281 - DNA, 22 bp, Artificial Sequence
  chemically synthesized
aaaaggaaaaacaaaaacaaaa

SEQ ID NO: 794282 - DNA, 22 bp, Artificial Sequence
  chemically synthesized
aatatatactgaccccagtttt

SEQ ID NO: 794283 - DNA, 22 bp, Artificial Sequence
  chemically synthesized
aaatatatactgaccccagttt

SEQ ID NO: 794284 - DNA, 22 bp, Artificial Sequence
  chemically synthesized
atttaaatatatactgacccca

SEQ ID NO: 794285 - DNA, 22 bp, Artificial Sequence
  chemically synthesized
catttaaatatatactgacccc

SEQ ID NO: 794286 - DNA, 22 bp, Artificial Sequence
  chemically synthesized
tgcttcatttaaatatatactg

SEQ ID NO: 794287 - DNA, 22 bp, Artificial Sequence
  chemically synthesized
gtgcttcatttaaatatatact

SEQ ID NO: 794288 - DNA, 22 bp, Artificial Sequence
  chemically synthesized
cttgtgcttcatttaaatatat

SEQ ID NO: 794289 - DNA, 22 bp, Artificial Sequence
  chemically synthesized
ccttgtgcttcatttaaatata

SEQ ID NO: 794290 - DNA, 22 bp, Artificial Sequence
  chemically synthesized
tccttgtgcttcatttaaatat

SEQ ID NO: 794291 - DNA, 22 bp, Artificial Sequence
  chemically synthesized
ttccttgtgcttcatttaaata

SEQ ID NO: 794292 - DNA, 22 bp, Artificial Sequence
  chemically synthesized
gggtcagtatatatttaaatga

SEQ ID NO: 794293 - DNA, 22 bp, Artificial Sequence
  chemically synthesized
tttccttgtgcttcatttaaat

SEQ ID NO: 794294 - DNA, 22 bp, Artificial Sequence
  chemically synthesized
ttttccttgtgcttcatttaaa

SEQ ID NO: 794295 - DNA, 22 bp, Artificial Sequence
  chemically synthesized
aaatgaagcacaaggaaaaaag

SEQ ID NO: 794296 - DNA, 22 bp, Artificial Sequence
  chemically synthesized
aaagtgaaataccttttttcct

SEQ ID NO: 794297 - DNA, 22 bp, Artificial Sequence
  chemically synthesized
aatgaagcacaaggaaaaaagg

SEQ ID NO: 794298 - DNA, 22 bp, Artificial Sequence
  chemically synthesized
gaaagtgaaataccttttttcc

SEQ ID NO: 794299 - DNA, 22 bp, Artificial Sequence
  chemically synthesized
tgaaagtgaaataccttttttc

SEQ ID NO: 794300 - DNA, 22 bp, Artificial Sequence
  chemically synthesized
cactttcaaaggacctatgctg

SEQ ID NO: 794301 - DNA, 22 bp, Artificial Sequence
  chemically synthesized
aaaaaaaaaaaacagcataggt

SEQ ID NO: 794302 - DNA, 22 bp, Artificial Sequence
  chemically synthesized
actttcaaaggacctatgctgt

SEQ ID NO: 794303 - DNA, 22 bp, Artificial Sequence
  chemically synthesized
caaaaaaaaaaaacagcatagg

SEQ ID NO: 794304 - DNA, 22 bp, Artificial Sequence
  chemically synthesized
tcaaaggacctatgctgttttt

SEQ ID NO: 794305 - DNA, 22 bp, Artificial Sequence
  chemically synthesized
caaaggacctatgctgtttttt

SEQ ID NO: 794306 - DNA, 22 bp, Artificial Sequence
  chemically synthesized
aaaggacctatgctgttttttt

SEQ ID NO: 794307 - DNA, 22 bp, Artificial Sequence
  chemically synthesized
caatcttcaaaaaaaaaaaaca

SEQ ID NO: 794308 - DNA, 22 bp, Artificial Sequence
  chemically synthesized
tgctgttttttttttttgaaga

SEQ ID NO: 794309 - DNA, 22 bp, Artificial Sequence
  chemically synthesized
ttttttttttttgaagattgca

SEQ ID NO: 794310 - DNA, 22 bp, Artificial Sequence
  chemically synthesized
taaaatagatgagttgcaatct

SEQ ID NO: 794311 - DNA, 22 bp, Artificial Sequence
  chemically synthesized
tttttttttgaagattgcaact

SEQ ID NO: 794312 - DNA, 22 bp, Artificial Sequence
  chemically synthesized
ttttttttgaagattgcaactc

SEQ ID NO: 794313 - DNA, 22 bp, Artificial Sequence
  chemically synthesized
tttttttgaagattgcaactca

SEQ ID NO: 794314 - DNA, 22 bp, Artificial Sequence
  chemically synthesized
ttttttgaagattgcaactcat

SEQ ID NO: 794315 - DNA, 22 bp, Artificial Sequence
  chemically synthesized
tttttgaagattgcaactcatc

SEQ ID NO: 794316 - DNA, 22 bp, Artificial Sequence
  chemically synthesized
tattataaaatagatgagttgc

SEQ ID NO: 794317 - DNA, 22 bp, Artificial Sequence
  chemically synthesized
ttttgaagattgcaactcatct

SEQ ID NO: 794318 - DNA, 22 bp, Artificial Sequence
  chemically synthesized
tttgaagattgcaactcatcta

SEQ ID NO: 794319 - DNA, 22 bp, Artificial Sequence
  chemically synthesized
ttgaagattgcaactcatctat

SEQ ID NO: 794320 - DNA, 22 bp, Artificial Sequence
  chemically synthesized
tgaagattgcaactcatctatt

SEQ ID NO: 794321 - DNA, 22 bp, Artificial Sequence
  chemically synthesized
gaagattgcaactcatctattt

SEQ ID NO: 794322 - DNA, 22 bp, Artificial Sequence
  chemically synthesized
aagattgcaactcatctatttt

SEQ ID NO: 794323 - DNA, 22 bp, Artificial Sequence
  chemically synthesized
tcattatattataaaatagatg

SEQ ID NO: 794324 - DNA, 22 bp, Artificial Sequence
  chemically synthesized
ttgtcattatattataaaatag

SEQ ID NO: 794325 - DNA, 22 bp, Artificial Sequence
  chemically synthesized
caactcatctattttataatat

SEQ ID NO: 794326 - DNA, 22 bp, Artificial Sequence
  chemically synthesized
atctattttataatataatgac

SEQ ID NO: 794327 - DNA, 22 bp, Artificial Sequence
  chemically synthesized
agaggcaatattattgtcatta

SEQ ID NO: 794328 - DNA, 22 bp, Artificial Sequence
  chemically synthesized
ttttataatataatgacaataa

SEQ ID NO: 794329 - DNA, 22 bp, Artificial Sequence
  chemically synthesized
actcagaggcaatattattgtc

SEQ ID NO: 794330 - DNA, 22 bp, Artificial Sequence
  chemically synthesized
tataatataatgacaataatat

SEQ ID NO: 794331 - DNA, 22 bp, Artificial Sequence
  chemically synthesized
ataatataatgacaataatatt

SEQ ID NO: 794332 - DNA, 22 bp, Artificial Sequence
  chemically synthesized
taatataatgacaataatattg

SEQ ID NO: 794333 - DNA, 22 bp, Artificial Sequence
  chemically synthesized
cacagttaactcagaggcaata

SEQ ID NO: 794334 - DNA, 22 bp, Artificial Sequence
  chemically synthesized
ttacacagttaactcagaggca

SEQ ID NO: 794335 - DNA, 22 bp, Artificial Sequence
  chemically synthesized
cctctgagttaactgtgtaata

SEQ ID NO: 794336 - DNA, 22 bp, Artificial Sequence
  chemically synthesized
tgagttaactgtgtaataattc

SEQ ID NO: 794337 - DNA, 22 bp, Artificial Sequence
  chemically synthesized
cagtacccaaagtgaattatta

SEQ ID NO: 794338 - DNA, 22 bp, Artificial Sequence
  chemically synthesized
agttaactgtgtaataattcac

SEQ ID NO: 794339 - DNA, 22 bp, Artificial Sequence
  chemically synthesized
ttgcagtacccaaagtgaatta

SEQ ID NO: 794340 - DNA, 22 bp, Artificial Sequence
  chemically synthesized
actgtgtaataattcactttgg

SEQ ID NO: 794341 - DNA, 22 bp, Artificial Sequence
  chemically synthesized
aattattgcagtacccaaagtg

SEQ ID NO: 794342 - DNA, 22 bp, Artificial Sequence
  chemically synthesized
tgtaataattcactttgggtac

SEQ ID NO: 794343 - DNA, 22 bp, Artificial Sequence
  chemically synthesized
ctcaattattgcagtacccaaa

SEQ ID NO: 794344 - DNA, 22 bp, Artificial Sequence
  chemically synthesized
gctcaattattgcagtacccaa

SEQ ID NO: 794345 - DNA, 22 bp, Artificial Sequence
  chemically synthesized
tttgctcaattattgcagtacc

SEQ ID NO: 794346 - DNA, 22 bp, Artificial Sequence
  chemically synthesized
tgtttgctcaattattgcagta

SEQ ID NO: 794347 - DNA, 22 bp, Artificial Sequence
  chemically synthesized
ctgtttgctcaattattgcagt

SEQ ID NO: 794348 - DNA, 22 bp, Artificial Sequence
  chemically synthesized
actttgggtactgcaataattg

SEQ ID NO: 794349 - DNA, 22 bp, Artificial Sequence
  chemically synthesized
tgggtactgcaataattgagca

SEQ ID NO: 794350 - DNA, 22 bp, Artificial Sequence
  chemically synthesized
gggtactgcaataattgagcaa

SEQ ID NO: 794351 - DNA, 22 bp, Artificial Sequence
  chemically synthesized
ggtactgcaataattgagcaaa

SEQ ID NO: 794352 - DNA, 22 bp, Artificial Sequence
  chemically synthesized
gtaccagcttctgtttgctcaa

SEQ ID NO: 794353 - DNA, 22 bp, Artificial Sequence
  chemically synthesized
tggtaccagcttctgtttgctc

SEQ ID NO: 794354 - DNA, 22 bp, Artificial Sequence
  chemically synthesized
caataattgagcaaacagaagc

SEQ ID NO: 794355 - DNA, 22 bp, Artificial Sequence
  chemically synthesized
agcaaacagaagctggtaccag

SEQ ID NO: 794356 - DNA, 22 bp, Artificial Sequence
  chemically synthesized
aataaaagaaaggaatgcctct

SEQ ID NO: 794357 - DNA, 22 bp, Artificial Sequence
  chemically synthesized
cactaaataaaagaaaggaatg

SEQ ID NO: 794358 - DNA, 22 bp, Artificial Sequence
  chemically synthesized
gtaccagaggcattcctttctt

SEQ ID NO: 794359 - DNA, 22 bp, Artificial Sequence
  chemically synthesized
tgaaaaaatattacactaaata

SEQ ID NO: 794360 - DNA, 22 bp, Artificial Sequence
  chemically synthesized
ctttcttttatttagtgtaata

SEQ ID NO: 794361 - DNA, 22 bp, Artificial Sequence
  chemically synthesized
aattatgaaaaaatattacact

SEQ ID NO: 794362 - DNA, 22 bp, Artificial Sequence
  chemically synthesized
tcttttatttagtgtaatattt

SEQ ID NO: 794363 - DNA, 22 bp, Artificial Sequence
  chemically synthesized
cttttatttagtgtaatatttt

SEQ ID NO: 794364 - DNA, 22 bp, Artificial Sequence
  chemically synthesized
ttttatttagtgtaatattttt

SEQ ID NO: 794365 - DNA, 22 bp, Artificial Sequence
  chemically synthesized
attaaattatgaaaaaatatta

SEQ ID NO: 794366 - DNA, 22 bp, Artificial Sequence
  chemically synthesized
ttatttagtgtaatattttttc

SEQ ID NO: 794367 - DNA, 22 bp, Artificial Sequence
  chemically synthesized
tcattaaattatgaaaaaatat

SEQ ID NO: 794368 - DNA, 22 bp, Artificial Sequence
  chemically synthesized
tatttagtgtaatattttttca

SEQ ID NO: 794369 - DNA, 22 bp, Artificial Sequence
  chemically synthesized
ctcattaaattatgaaaaaata

SEQ ID NO: 794370 - DNA, 22 bp, Artificial Sequence
  chemically synthesized
atttagtgtaatattttttcat

SEQ ID NO: 794371 - DNA, 22 bp, Artificial Sequence
  chemically synthesized
tttagtgtaatattttttcata

SEQ ID NO: 794372 - DNA, 22 bp, Artificial Sequence
  chemically synthesized
agtgtaatattttttcataatt

SEQ ID NO: 794373 - DNA, 22 bp, Artificial Sequence
  chemically synthesized
gtgtaatattttttcataattt

SEQ ID NO: 794374 - DNA, 22 bp, Artificial Sequence
  chemically synthesized
aaatgtttctcattaaattatg

SEQ ID NO: 794375 - DNA, 22 bp, Artificial Sequence
  chemically synthesized
gaaatgtttctcattaaattat

SEQ ID NO: 794376 - DNA, 22 bp, Artificial Sequence
  chemically synthesized
tgaaatgtttctcattaaatta

SEQ ID NO: 794377 - DNA, 22 bp, Artificial Sequence
  chemically synthesized
ttgaaatgtttctcattaaatt

SEQ ID NO: 794378 - DNA, 22 bp, Artificial Sequence
  chemically synthesized
cttttgaaatgtttctcattaa

SEQ ID NO: 794379 - DNA, 22 bp, Artificial Sequence
  chemically synthesized
tttcataatttaatgagaaaca

SEQ ID NO: 794380 - DNA, 22 bp, Artificial Sequence
  chemically synthesized
ttcataatttaatgagaaacat

SEQ ID NO: 794381 - DNA, 22 bp, Artificial Sequence
  chemically synthesized
tcataatttaatgagaaacatt

SEQ ID NO: 794382 - DNA, 22 bp, Artificial Sequence
  chemically synthesized
cataatttaatgagaaacattt

SEQ ID NO: 794383 - DNA, 22 bp, Artificial Sequence
  chemically synthesized
ataatttaatgagaaacatttc

SEQ ID NO: 794384 - DNA, 22 bp, Artificial Sequence
  chemically synthesized
aatgagaaacatttcaaaagca

SEQ ID NO: 794385 - DNA, 22 bp, Artificial Sequence
  chemically synthesized
atgagaaacatttcaaaagcaa

SEQ ID NO: 794386 - DNA, 22 bp, Artificial Sequence
  chemically synthesized
acatgaaaggataaaaacgttg

SEQ ID NO: 794387 - DNA, 22 bp, Artificial Sequence
  chemically synthesized
aacatgaaaggataaaaacgtt

SEQ ID NO: 794388 - DNA, 22 bp, Artificial Sequence
  chemically synthesized
atttaacatgaaaggataaaaa

SEQ ID NO: 794389 - DNA, 22 bp, Artificial Sequence
  chemically synthesized
caaaagcaacgtttttatcctt

SEQ ID NO: 794390 - DNA, 22 bp, Artificial Sequence
  chemically synthesized
aaaagcaacgtttttatccttt

SEQ ID NO: 794391 - DNA, 22 bp, Artificial Sequence
  chemically synthesized
taaattaatttaacatgaaagg

SEQ ID NO: 794392 - DNA, 22 bp, Artificial Sequence
  chemically synthesized
ttatcctttcatgttaaattaa

SEQ ID NO: 794393 - DNA, 22 bp, Artificial Sequence
  chemically synthesized
tagcattgtaaattaatttaac

SEQ ID NO: 794394 - DNA, 22 bp, Artificial Sequence
  chemically synthesized
tatcctttcatgttaaattaat

SEQ ID NO: 794395 - DNA, 22 bp, Artificial Sequence
  chemically synthesized
atagcattgtaaattaatttaa

SEQ ID NO: 794396 - DNA, 22 bp, Artificial Sequence
  chemically synthesized
atcctttcatgttaaattaatt

SEQ ID NO: 794397 - DNA, 22 bp, Artificial Sequence
  chemically synthesized
tcctttcatgttaaattaattt

SEQ ID NO: 794398 - DNA, 22 bp, Artificial Sequence
  chemically synthesized
tagcttatagcattgtaaatta

SEQ ID NO: 794399 - DNA, 22 bp, Artificial Sequence
  chemically synthesized
tcatgttaaattaatttacaat

SEQ ID NO: 794400 - DNA, 22 bp, Artificial Sequence
  chemically synthesized
catgttaaattaatttacaatg

SEQ ID NO: 794401 - DNA, 22 bp, Artificial Sequence
  chemically synthesized
atgttaaattaatttacaatgc

SEQ ID NO: 794402 - DNA, 22 bp, Artificial Sequence
  chemically synthesized
ttatagcttatagcattgtaaa

SEQ ID NO: 794403 - DNA, 22 bp, Artificial Sequence
  chemically synthesized
attatagcttatagcattgtaa

SEQ ID NO: 794404 - DNA, 22 bp, Artificial Sequence
  chemically synthesized
tattatagcttatagcattgta

SEQ ID NO: 794405 - DNA, 22 bp, Artificial Sequence
  chemically synthesized
aattaatttacaatgctataag

SEQ ID NO: 794406 - DNA, 22 bp, Artificial Sequence
  chemically synthesized
attttattatagcttatagcat

SEQ ID NO: 794407 - DNA, 22 bp, Artificial Sequence
  chemically synthesized
tcattttattatagcttatagc

SEQ ID NO: 794408 - DNA, 22 bp, Artificial Sequence
  chemically synthesized
tctcattttattatagcttata

SEQ ID NO: 794409 - DNA, 22 bp, Artificial Sequence
  chemically synthesized
atttacaatgctataagctata

SEQ ID NO: 794410 - DNA, 22 bp, Artificial Sequence
  chemically synthesized
ctctcattttattatagcttat

SEQ ID NO: 794411 - DNA, 22 bp, Artificial Sequence
  chemically synthesized
acaatgctataagctataataa

SEQ ID NO: 794412 - DNA, 22 bp, Artificial Sequence
  chemically synthesized
caatgctataagctataataaa

SEQ ID NO: 794413 - DNA, 22 bp, Artificial Sequence
  chemically synthesized
atggtttctctcattttattat

SEQ ID NO: 794414 - DNA, 22 bp, Artificial Sequence
  chemically synthesized
ctgatggtttctctcattttat

SEQ ID NO: 794415 - DNA, 22 bp, Artificial Sequence
  chemically synthesized
gctgatggtttctctcatttta

SEQ ID NO: 794416 - DNA, 22 bp, Artificial Sequence
  chemically synthesized
tgctgatggtttctctcatttt

SEQ ID NO: 794417 - DNA, 22 bp, Artificial Sequence
  chemically synthesized
taagctataataaaatgagaga

SEQ ID NO: 794418 - DNA, 22 bp, Artificial Sequence
  chemically synthesized
ttgctgatggtttctctcattt

SEQ ID NO: 794419 - DNA, 22 bp, Artificial Sequence
  chemically synthesized
tttgctgatggtttctctcatt

SEQ ID NO: 794420 - DNA, 22 bp, Artificial Sequence
  chemically synthesized
ctttttgctgatggtttctctc

SEQ ID NO: 794421 - DNA, 22 bp, Artificial Sequence
  chemically synthesized
gctttttgctgatggtttctct

SEQ ID NO: 794422 - DNA, 22 bp, Artificial Sequence
  chemically synthesized
tgctttttgctgatggtttctc

SEQ ID NO: 794423 - DNA, 22 bp, Artificial Sequence
  chemically synthesized
taataaaatgagagaaaccatc

SEQ ID NO: 794424 - DNA, 22 bp, Artificial Sequence
  chemically synthesized
ttgctttttgctgatggtttct

SEQ ID NO: 794425 - DNA, 22 bp, Artificial Sequence
  chemically synthesized
acttttgctttttgctgatggt

SEQ ID NO: 794426 - DNA, 22 bp, Artificial Sequence
  chemically synthesized
ttaacttttgctttttgctgat

SEQ ID NO: 794427 - DNA, 22 bp, Artificial Sequence
  chemically synthesized
attaacttttgctttttgctga

SEQ ID NO: 794428 - DNA, 22 bp, Artificial Sequence
  chemically synthesized
tattaacttttgctttttgctg

SEQ ID NO: 794429 - DNA, 22 bp, Artificial Sequence
  chemically synthesized
tctttattaacttttgcttttt

SEQ ID NO: 794430 - DNA, 22 bp, Artificial Sequence
  chemically synthesized
agaatatctgtctttattaact

SEQ ID NO: 794431 - DNA, 22 bp, Artificial Sequence
  chemically synthesized
aagaatatctgtctttattaac

SEQ ID NO: 794432 - DNA, 22 bp, Artificial Sequence
  chemically synthesized
taagaatatctgtctttattaa

SEQ ID NO: 794433 - DNA, 22 bp, Artificial Sequence
  chemically synthesized
aaactttaagaatatctgtctt

SEQ ID NO: 794434 - DNA, 22 bp, Artificial Sequence
  chemically synthesized
gaaactttaagaatatctgtct

SEQ ID NO: 794435 - DNA, 22 bp, Artificial Sequence
  chemically synthesized
agtccttgaaactttaagaata

SEQ ID NO: 794436 - DNA, 22 bp, Artificial Sequence
  chemically synthesized
ataaagacagatattcttaaag

SEQ ID NO: 794437 - DNA, 22 bp, Artificial Sequence
  chemically synthesized
cagtccttgaaactttaagaat

SEQ ID NO: 794438 - DNA, 22 bp, Artificial Sequence
  chemically synthesized
tcagtccttgaaactttaagaa

SEQ ID NO: 794439 - DNA, 22 bp, Artificial Sequence
  chemically synthesized
ttcagtccttgaaactttaaga

SEQ ID NO: 794440 - DNA, 22 bp, Artificial Sequence
  chemically synthesized
tttcagtccttgaaactttaag

SEQ ID NO: 794441 - DNA, 22 bp, Artificial Sequence
  chemically synthesized
ttttcagtccttgaaactttaa

SEQ ID NO: 794442 - DNA, 22 bp, Artificial Sequence
  chemically synthesized
agcttttttcagtccttgaaac

SEQ ID NO: 794443 - DNA, 22 bp, Artificial Sequence
  chemically synthesized
gagcttttttcagtccttgaaa

SEQ ID NO: 794444 - DNA, 22 bp, Artificial Sequence
  chemically synthesized
ttaaagtttcaaggactgaaaa

SEQ ID NO: 794445 - DNA, 22 bp, Artificial Sequence
  chemically synthesized
tgatttgagcttttttcagtcc

SEQ ID NO: 794446 - DNA, 22 bp, Artificial Sequence
  chemically synthesized
gtgatttgagcttttttcagtc

SEQ ID NO: 794447 - DNA, 22 bp, Artificial Sequence
  chemically synthesized
aaagtttcaaggactgaaaaaa

SEQ ID NO: 794448 - DNA, 22 bp, Artificial Sequence
  chemically synthesized
tgtgatttgagcttttttcagt

SEQ ID NO: 794449 - DNA, 22 bp, Artificial Sequence
  chemically synthesized
aagtttcaaggactgaaaaaag

SEQ ID NO: 794450 - DNA, 22 bp, Artificial Sequence
  chemically synthesized
ttgtgatttgagcttttttcag

SEQ ID NO: 794451 - DNA, 22 bp, Artificial Sequence
  chemically synthesized
caaggactgaaaaaagctcaaa

SEQ ID NO: 794452 - DNA, 22 bp, Artificial Sequence
  chemically synthesized
aaggactgaaaaaagctcaaat

SEQ ID NO: 794453 - DNA, 22 bp, Artificial Sequence
  chemically synthesized
aaaaaagctcaaatcacaaaag

SEQ ID NO: 794454 - DNA, 22 bp, Artificial Sequence
  chemically synthesized
aaatcacaaaagtatttggttt

SEQ ID NO: 794455 - DNA, 22 bp, Artificial Sequence
  chemically synthesized
aaccaagccacaaaaaaaggag

SEQ ID NO: 794456 - DNA, 22 bp, Artificial Sequence
  chemically synthesized
ggtttctcctttttttgtggct

SEQ ID NO: 794457 - DNA, 22 bp, Artificial Sequence
  chemically synthesized
gtttctcctttttttgtggctt

SEQ ID NO: 794458 - DNA, 22 bp, Artificial Sequence
  chemically synthesized
tgacaaattgaaccaagccaca

SEQ ID NO: 794459 - DNA, 22 bp, Artificial Sequence
  chemically synthesized
ctcctttttttgtggcttggtt

SEQ ID NO: 794460 - DNA, 22 bp, Artificial Sequence
  chemically synthesized
tcctttttttgtggcttggttc

SEQ ID NO: 794461 - DNA, 22 bp, Artificial Sequence
  chemically synthesized
ctttttttgtggcttggttcaa

SEQ ID NO: 794462 - DNA, 22 bp, Artificial Sequence
  chemically synthesized
tttttgtggcttggttcaattt

SEQ ID NO: 794463 - DNA, 22 bp, Artificial Sequence
  chemically synthesized
ttttgtggcttggttcaatttg

SEQ ID NO: 794464 - DNA, 22 bp, Artificial Sequence
  chemically synthesized
tttgtggcttggttcaatttgt

SEQ ID NO: 794465 - DNA, 22 bp, Artificial Sequence
  chemically synthesized
ttgtggcttggttcaatttgtc

SEQ ID NO: 794466 - DNA, 22 bp, Artificial Sequence
  chemically synthesized
agaacaaattatgacaaattga

SEQ ID NO: 794467 - DNA, 22 bp, Artificial Sequence
  chemically synthesized
tgtggcttggttcaatttgtca

SEQ ID NO: 794468 - DNA, 22 bp, Artificial Sequence
  chemically synthesized
gtggcttggttcaatttgtcat

SEQ ID NO: 794469 - DNA, 22 bp, Artificial Sequence
  chemically synthesized
tggcttggttcaatttgtcata

SEQ ID NO: 794470 - DNA, 22 bp, Artificial Sequence
  chemically synthesized
ggttcaatttgtcataatttgt

SEQ ID NO: 794471 - DNA, 22 bp, Artificial Sequence
  chemically synthesized
gttcaatttgtcataatttgtt

SEQ ID NO: 794472 - DNA, 22 bp, Artificial Sequence
  chemically synthesized
aatttgtcataatttgttctca

SEQ ID NO: 794473 - DNA, 22 bp, Artificial Sequence
  chemically synthesized
taagtacaaaataattgagaac

SEQ ID NO: 794474 - DNA, 22 bp, Artificial Sequence
  chemically synthesized
gtcataatttgttctcaattat

SEQ ID NO: 794475 - DNA, 22 bp, Artificial Sequence
  chemically synthesized
tcataatttgttctcaattatt

SEQ ID NO: 794476 - DNA, 22 bp, Artificial Sequence
  chemically synthesized
gctgtaagtacaaaataattga

SEQ ID NO: 794477 - DNA, 22 bp, Artificial Sequence
  chemically synthesized
tgctagctgtaagtacaaaata

SEQ ID NO: 794478 - DNA, 22 bp, Artificial Sequence
  chemically synthesized
gttctcaattattttgtactta

SEQ ID NO: 794479 - DNA, 22 bp, Artificial Sequence
  chemically synthesized
ttctcaattattttgtacttac

SEQ ID NO: 794480 - DNA, 22 bp, Artificial Sequence
  chemically synthesized
tgttatgctagctgtaagtaca

SEQ ID NO: 794481 - DNA, 22 bp, Artificial Sequence
  chemically synthesized
tcaattattttgtacttacagc

SEQ ID NO: 794482 - DNA, 22 bp, Artificial Sequence
  chemically synthesized
aattattttgtacttacagcta

SEQ ID NO: 794483 - DNA, 22 bp, Artificial Sequence
  chemically synthesized
ttttgtacttacagctagcata

SEQ ID NO: 794484 - DNA, 22 bp, Artificial Sequence
  chemically synthesized
atcaatattatgttatgctagc

SEQ ID NO: 794485 - DNA, 22 bp, Artificial Sequence
  chemically synthesized
catcaatattatgttatgctag

SEQ ID NO: 794486 - DNA, 22 bp, Artificial Sequence
  chemically synthesized
tgtacttacagctagcataaca

SEQ ID NO: 794487 - DNA, 22 bp, Artificial Sequence
  chemically synthesized
gtacttacagctagcataacat

SEQ ID NO: 794488 - DNA, 22 bp, Artificial Sequence
  chemically synthesized
tacttacagctagcataacata

SEQ ID NO: 794489 - DNA, 22 bp, Artificial Sequence
  chemically synthesized
cttcatcaatattatgttatgc

SEQ ID NO: 794490 - DNA, 22 bp, Artificial Sequence
  chemically synthesized
tccttcatcaatattatgttat

SEQ ID NO: 794491 - DNA, 22 bp, Artificial Sequence
  chemically synthesized
ctccttcatcaatattatgtta

SEQ ID NO: 794492 - DNA, 22 bp, Artificial Sequence
  chemically synthesized
tctccttcatcaatattatgtt

SEQ ID NO: 794493 - DNA, 22 bp, Artificial Sequence
  chemically synthesized
acagctagcataacataatatt

SEQ ID NO: 794494 - DNA, 22 bp, Artificial Sequence
  chemically synthesized
ttctccttcatcaatattatgt

SEQ ID NO: 794495 - DNA, 22 bp, Artificial Sequence
  chemically synthesized
cagctagcataacataatattg

SEQ ID NO: 794496 - DNA, 22 bp, Artificial Sequence
  chemically synthesized
gcataacataatattgatgaag

SEQ ID NO: 794497 - DNA, 22 bp, Artificial Sequence
  chemically synthesized
agtaatgcatcttttctccttc

SEQ ID NO: 794498 - DNA, 22 bp, Artificial Sequence
  chemically synthesized
cagtaatgcatcttttctcctt

SEQ ID NO: 794499 - DNA, 22 bp, Artificial Sequence
  chemically synthesized
tcagtaatgcatcttttctcct

SEQ ID NO: 794500 - DNA, 22 bp, Artificial Sequence
  chemically synthesized
ctttcagtaatgcatcttttct

SEQ ID NO: 794501 - DNA, 22 bp, Artificial Sequence
  chemically synthesized
actttcagtaatgcatcttttc

SEQ ID NO: 794502 - DNA, 22 bp, Artificial Sequence
  chemically synthesized
atgaaggagaaaagatgcatta

SEQ ID NO: 794503 - DNA, 22 bp, Artificial Sequence
  chemically synthesized
tgtatgtttactttcagtaatg

SEQ ID NO: 794504 - DNA, 22 bp, Artificial Sequence
  chemically synthesized
attatgtatgtttactttcagt

SEQ ID NO: 794505 - DNA, 22 bp, Artificial Sequence
  chemically synthesized
aattatgtatgtttactttcag

SEQ ID NO: 794506 - DNA, 22 bp, Artificial Sequence
  chemically synthesized
taattatgtatgtttactttca

SEQ ID NO: 794507 - DNA, 22 bp, Artificial Sequence
  chemically synthesized
ggtgattttaattatgtatgtt

SEQ ID NO: 794508 - DNA, 22 bp, Artificial Sequence
  chemically synthesized
aggtgattttaattatgtatgt

SEQ ID NO: 794509 - DNA, 22 bp, Artificial Sequence
  chemically synthesized
ctgaaagtaaacatacataatt

SEQ ID NO: 794510 - DNA, 22 bp, Artificial Sequence
  chemically synthesized
ttaggtgattttaattatgtat

SEQ ID NO: 794511 - DNA, 22 bp, Artificial Sequence
  chemically synthesized
cttaggtgattttaattatgta

SEQ ID NO: 794512 - DNA, 22 bp, Artificial Sequence
  chemically synthesized
aaagtaaacatacataattaaa

SEQ ID NO: 794513 - DNA, 22 bp, Artificial Sequence
  chemically synthesized
tttcttaggtgattttaattat

SEQ ID NO: 794514 - DNA, 22 bp, Artificial Sequence
  chemically synthesized
ttgtttcttaggtgattttaat

SEQ ID NO: 794515 - DNA, 22 bp, Artificial Sequence
  chemically synthesized
gttgtttcttaggtgattttaa

SEQ ID NO: 794516 - DNA, 22 bp, Artificial Sequence
  chemically synthesized
tgttgtttcttaggtgatttta

SEQ ID NO: 794517 - DNA, 22 bp, Artificial Sequence
  chemically synthesized
aaatcacctaagaaacaacaaa

SEQ ID NO: 794518 - DNA, 22 bp, Artificial Sequence
  chemically synthesized
aagtacatcgcaaagttttgtt

SEQ ID NO: 794519 - DNA, 22 bp, Artificial Sequence
  chemically synthesized
ctgaagtacatcgcaaagtttt

SEQ ID NO: 794520 - DNA, 22 bp, Artificial Sequence
  chemically synthesized
actgaagtacatcgcaaagttt

SEQ ID NO: 794521 - DNA, 22 bp, Artificial Sequence
  chemically synthesized
agaaacaacaaaactttgcgat

SEQ ID NO: 794522 - DNA, 22 bp, Artificial Sequence
  chemically synthesized
gagtagtttactgaagtacatc

SEQ ID NO: 794523 - DNA, 22 bp, Artificial Sequence
  chemically synthesized
agagtagtttactgaagtacat

SEQ ID NO: 794524 - DNA, 22 bp, Artificial Sequence
  chemically synthesized
tgcgatgtacttcagtaaacta

SEQ ID NO: 794525 - DNA, 22 bp, Artificial Sequence
  chemically synthesized
gcgatgtacttcagtaaactac

SEQ ID NO: 794526 - DNA, 22 bp, Artificial Sequence
  chemically synthesized
cgatgtacttcagtaaactact

SEQ ID NO: 794527 - DNA, 22 bp, Artificial Sequence
  chemically synthesized
tataaatcttagagtagtttac

SEQ ID NO: 794528 - DNA, 22 bp, Artificial Sequence
  chemically synthesized
gtataaatcttagagtagttta

SEQ ID NO: 794529 - DNA, 22 bp, Artificial Sequence
  chemically synthesized
tgtataaatcttagagtagttt

SEQ ID NO: 794530 - DNA, 22 bp, Artificial Sequence
  chemically synthesized
tttgtataaatcttagagtagt

SEQ ID NO: 794531 - DNA, 22 bp, Artificial Sequence
  chemically synthesized
ctttgtataaatcttagagtag

SEQ ID NO: 794532 - DNA, 22 bp, Artificial Sequence
  chemically synthesized
cagtaaactactctaagattta

SEQ ID NO: 794533 - DNA, 22 bp, Artificial Sequence
  chemically synthesized
agtaaactactctaagatttat

SEQ ID NO: 794534 - DNA, 22 bp, Artificial Sequence
  chemically synthesized
catcatagccttctttgtataa

SEQ ID NO: 794535 - DNA, 22 bp, Artificial Sequence
  chemically synthesized
ctctaagatttatacaaagaag

SEQ ID NO: 794536 - DNA, 22 bp, Artificial Sequence
  chemically synthesized
aattacatcatagccttctttg

SEQ ID NO: 794537 - DNA, 22 bp, Artificial Sequence
  chemically synthesized
taagatttatacaaagaaggct

SEQ ID NO: 794538 - DNA, 22 bp, Artificial Sequence
  chemically synthesized
agatttatacaaagaaggctat

SEQ ID NO: 794539 - DNA, 22 bp, Artificial Sequence
  chemically synthesized
atacaaagaaggctatgatgta

SEQ ID NO: 794540 - DNA, 22 bp, Artificial Sequence
  chemically synthesized
tacaaagaaggctatgatgtaa

SEQ ID NO: 794541 - DNA, 22 bp, Artificial Sequence
  chemically synthesized
taccagtacatgttaaattaca

SEQ ID NO: 794542 - DNA, 22 bp, Artificial Sequence
  chemically synthesized
ataccagtacatgttaaattac

SEQ ID NO: 794543 - DNA, 22 bp, Artificial Sequence
  chemically synthesized
tgatgtaatttaacatgtactg

SEQ ID NO: 794544 - DNA, 22 bp, Artificial Sequence
  chemically synthesized
cccaaagaagtttataccagta

SEQ ID NO: 794545 - DNA, 22 bp, Artificial Sequence
  chemically synthesized
gcccaaagaagtttataccagt

SEQ ID NO: 794546 - DNA, 22 bp, Artificial Sequence
  chemically synthesized
tgcccaaagaagtttataccag

SEQ ID NO: 794547 - DNA, 22 bp, Artificial Sequence
  chemically synthesized
aacatgtactggtataaacttc

SEQ ID NO: 794548 - DNA, 22 bp, Artificial Sequence
  chemically synthesized
acatgtactggtataaacttct

SEQ ID NO: 794549 - DNA, 22 bp, Artificial Sequence
  chemically synthesized
aattttgcccaaagaagtttat

SEQ ID NO: 794550 - DNA, 22 bp, Artificial Sequence
  chemically synthesized
gaattttgcccaaagaagttta

SEQ ID NO: 794551 - DNA, 22 bp, Artificial Sequence
  chemically synthesized
tgaattttgcccaaagaagttt

SEQ ID NO: 794552 - DNA, 22 bp, Artificial Sequence
  chemically synthesized
aaattttgaattttgcccaaag

SEQ ID NO: 794553 - DNA, 22 bp, Artificial Sequence
  chemically synthesized
gaaattttgaattttgcccaaa

SEQ ID NO: 794554 - DNA, 22 bp, Artificial Sequence
  chemically synthesized
gtataaacttctttgggcaaaa

SEQ ID NO: 794555 - DNA, 22 bp, Artificial Sequence
  chemically synthesized
atcatcgcttgaaattttgaat

SEQ ID NO: 794556 - DNA, 22 bp, Artificial Sequence
  chemically synthesized
ctttgggcaaaattcaaaattt

SEQ ID NO: 794557 - DNA, 22 bp, Artificial Sequence
  chemically synthesized
tttgggcaaaattcaaaatttc

SEQ ID NO: 794558 - DNA, 22 bp, Artificial Sequence
  chemically synthesized
ttcatcatcgcttgaaattttg

SEQ ID NO: 794559 - DNA, 22 bp, Artificial Sequence
  chemically synthesized
tgggcaaaattcaaaatttcaa

SEQ ID NO: 794560 - DNA, 22 bp, Artificial Sequence
  chemically synthesized
attcatcatcgcttgaaatttt

SEQ ID NO: 794561 - DNA, 22 bp, Artificial Sequence
  chemically synthesized
gggcaaaattcaaaatttcaag

SEQ ID NO: 794562 - DNA, 22 bp, Artificial Sequence
  chemically synthesized
tattcatcatcgcttgaaattt

SEQ ID NO: 794563 - DNA, 22 bp, Artificial Sequence
  chemically synthesized
ggcaaaattcaaaatttcaagc

SEQ ID NO: 794564 - DNA, 22 bp, Artificial Sequence
  chemically synthesized
tgctttattcatcatcgcttga

SEQ ID NO: 794565 - DNA, 22 bp, Artificial Sequence
  chemically synthesized
atgctttattcatcatcgcttg

SEQ ID NO: 794566 - DNA, 22 bp, Artificial Sequence
  chemically synthesized
cttatgctttattcatcatcgc

SEQ ID NO: 794567 - DNA, 22 bp, Artificial Sequence
  chemically synthesized
ccttatgctttattcatcatcg

SEQ ID NO: 794568 - DNA, 22 bp, Artificial Sequence
  chemically synthesized
aaaatttcaagcgatgatgaat

SEQ ID NO: 794569 - DNA, 22 bp, Artificial Sequence
  chemically synthesized
tccttatgctttattcatcatc

SEQ ID NO: 794570 - DNA, 22 bp, Artificial Sequence
  chemically synthesized
caagcgatgatgaataaagcat

SEQ ID NO: 794571 - DNA, 22 bp, Artificial Sequence
  chemically synthesized
aagcgatgatgaataaagcata

SEQ ID NO: 794572 - DNA, 22 bp, Artificial Sequence
  chemically synthesized
caataacatgaactttccttat

SEQ ID NO: 794573 - DNA, 22 bp, Artificial Sequence
  chemically synthesized
cattccaataacatgaactttc

SEQ ID NO: 794574 - DNA, 22 bp, Artificial Sequence
  chemically synthesized
aacagagaactccattccaata

SEQ ID NO: 794575 - DNA, 22 bp, Artificial Sequence
  chemically synthesized
aaacagagaactccattccaat

SEQ ID NO: 794576 - DNA, 22 bp, Artificial Sequence
  chemically synthesized
atgttattggaatggagttctc

SEQ ID NO: 794577 - DNA, 22 bp, Artificial Sequence
  chemically synthesized
ttggaatggagttctctgttta

SEQ ID NO: 794578 - DNA, 22 bp, Artificial Sequence
  chemically synthesized
gaatggagttctctgtttaagc

SEQ ID NO: 794579 - DNA, 22 bp, Artificial Sequence
  chemically synthesized
gagtgtccataatatgcttaaa

SEQ ID NO: 794580 - DNA, 22 bp, Artificial Sequence
  chemically synthesized
tctgtttaagcatattatggac

SEQ ID NO: 794581 - DNA, 22 bp, Artificial Sequence
  chemically synthesized
tcaaattggagtgtccataata

SEQ ID NO: 794582 - DNA, 22 bp, Artificial Sequence
  chemically synthesized
tgtttaagcatattatggacac

SEQ ID NO: 794583 - DNA, 22 bp, Artificial Sequence
  chemically synthesized
tttaagcatattatggacactc

SEQ ID NO: 794584 - DNA, 22 bp, Artificial Sequence
  chemically synthesized
aagcatattatggacactccaa

SEQ ID NO: 794585 - DNA, 22 bp, Artificial Sequence
  chemically synthesized
agcatattatggacactccaat

SEQ ID NO: 794586 - DNA, 22 bp, Artificial Sequence
  chemically synthesized
tggacactccaatttgacagat

SEQ ID NO: 794587 - DNA, 22 bp, Artificial Sequence
  chemically synthesized
tatcagagtagtatctgtcaaa

SEQ ID NO: 794588 - DNA, 22 bp, Artificial Sequence
  chemically synthesized
agctgtatcagagtagtatctg

SEQ ID NO: 794589 - DNA, 22 bp, Artificial Sequence
  chemically synthesized
ttaagctgtatcagagtagtat

SEQ ID NO: 794590 - DNA, 22 bp, Artificial Sequence
  chemically synthesized
caatttgacagatactactctg

SEQ ID NO: 794591 - DNA, 22 bp, Artificial Sequence
  chemically synthesized
attaagctgtatcagagtagta

SEQ ID NO: 794592 - DNA, 22 bp, Artificial Sequence
  chemically synthesized
gacagatactactctgatacag

SEQ ID NO: 794593 - DNA, 22 bp, Artificial Sequence
  chemically synthesized
acagatactactctgatacagc

SEQ ID NO: 794594 - DNA, 22 bp, Artificial Sequence
  chemically synthesized
aatacaaatttattaagctgta

SEQ ID NO: 794595 - DNA, 22 bp, Artificial Sequence
  chemically synthesized
ctctgatacagcttaataaatt

SEQ ID NO: 794596 - DNA, 22 bp, Artificial Sequence
  chemically synthesized
agcagctgaatacaaatttatt

SEQ ID NO: 794597 - DNA, 22 bp, Artificial Sequence
  chemically synthesized
tgatacagcttaataaatttgt

SEQ ID NO: 794598 - DNA, 22 bp, Artificial Sequence
  chemically synthesized
cagcagctgaatacaaatttat

SEQ ID NO: 794599 - DNA, 22 bp, Artificial Sequence
  chemically synthesized
atacagcttaataaatttgtat

SEQ ID NO: 794600 - DNA, 22 bp, Artificial Sequence
  chemically synthesized
gtgtttcagcagctgaatacaa

SEQ ID NO: 794601 - DNA, 22 bp, Artificial Sequence
  chemically synthesized
gttagtgtttcagcagctgaat

SEQ ID NO: 794602 - DNA, 22 bp, Artificial Sequence
  chemically synthesized
aataaatttgtattcagctgct

SEQ ID NO: 794603 - DNA, 22 bp, Artificial Sequence
  chemically synthesized
ataaatttgtattcagctgctg

SEQ ID NO: 794604 - DNA, 22 bp, Artificial Sequence
  chemically synthesized
tcgttagtgtttcagcagctga

SEQ ID NO: 794605 - DNA, 22 bp, Artificial Sequence
  chemically synthesized
aattctcgttagtgtttcagca

SEQ ID NO: 794606 - DNA, 22 bp, Artificial Sequence
  chemically synthesized
tcaattctcgttagtgtttcag

SEQ ID NO: 794607 - DNA, 22 bp, Artificial Sequence
  chemically synthesized
gtattcagctgctgaaacacta

SEQ ID NO: 794608 - DNA, 22 bp, Artificial Sequence
  chemically synthesized
ctcaattctcgttagtgtttca

SEQ ID NO: 794609 - DNA, 22 bp, Artificial Sequence
  chemically synthesized
tattcagctgctgaaacactaa

SEQ ID NO: 794610 - DNA, 22 bp, Artificial Sequence
  chemically synthesized
agctgctgaaacactaacgaga

SEQ ID NO: 794611 - DNA, 22 bp, Artificial Sequence
  chemically synthesized
ctgaaacactaacgagaattga

SEQ ID NO: 794612 - DNA, 22 bp, Artificial Sequence
  chemically synthesized
aaacactaacgagaattgagaa

SEQ ID NO: 794613 - DNA, 22 bp, Artificial Sequence
  chemically synthesized
acgagaattgagaagacctggg

SEQ ID NO: 794614 - DNA, 22 bp, Artificial Sequence
  chemically synthesized
aaaggtccaacagcccaggtct

SEQ ID NO: 794615 - DNA, 22 bp, Artificial Sequence
  chemically synthesized
caaaggtccaacagcccaggtc

SEQ ID NO: 794616 - DNA, 22 bp, Artificial Sequence
  chemically synthesized
gacttcaaaggtccaacagccc

SEQ ID NO: 794617 - DNA, 22 bp, Artificial Sequence
  chemically synthesized
tggacttcaaaggtccaacagc

SEQ ID NO: 794618 - DNA, 22 bp, Artificial Sequence
  chemically synthesized
agaagacctgggctgttggacc

SEQ ID NO: 794619 - DNA, 22 bp, Artificial Sequence
  chemically synthesized
aaatctctggacttcaaaggtc

SEQ ID NO: 794620 - DNA, 22 bp, Artificial Sequence
  chemically synthesized
ggctgttggacctttgaagtcc

SEQ ID NO: 794621 - DNA, 22 bp, Artificial Sequence
  chemically synthesized
agagttgaaatctctggacttc

SEQ ID NO: 794622 - DNA, 22 bp, Artificial Sequence
  chemically synthesized
ttggacctttgaagtccagaga

SEQ ID NO: 794623 - DNA, 22 bp, Artificial Sequence
  chemically synthesized
tgagagttgaaatctctggact

SEQ ID NO: 794624 - DNA, 22 bp, Artificial Sequence
  chemically synthesized
gacctttgaagtccagagattt

SEQ ID NO: 794625 - DNA, 22 bp, Artificial Sequence
  chemically synthesized
tgaagtccagagatttcaactc

SEQ ID NO: 794626 - DNA, 22 bp, Artificial Sequence
  chemically synthesized
gaagtccagagatttcaactct

SEQ ID NO: 794627 - DNA, 22 bp, Artificial Sequence
  chemically synthesized
aagtccagagatttcaactctc

SEQ ID NO: 794628 - DNA, 22 bp, Artificial Sequence
  chemically synthesized
aagatgaaaaccaggttctgag

SEQ ID NO: 794629 - DNA, 22 bp, Artificial Sequence
  chemically synthesized
caactctcagaacctggttttc

SEQ ID NO: 794630 - DNA, 22 bp, Artificial Sequence
  chemically synthesized
tcaattaaagatgaaaaccagg

SEQ ID NO: 794631 - DNA, 22 bp, Artificial Sequence
  chemically synthesized
aactctcagaacctggttttca

SEQ ID NO: 794632 - DNA, 22 bp, Artificial Sequence
  chemically synthesized
tatcaattaaagatgaaaacca

SEQ ID NO: 794633 - DNA, 22 bp, Artificial Sequence
  chemically synthesized
tcagaacctggttttcatcttt

SEQ ID NO: 794634 - DNA, 22 bp, Artificial Sequence
  chemically synthesized
agaacctggttttcatctttaa

SEQ ID NO: 794635 - DNA, 22 bp, Artificial Sequence
  chemically synthesized
tccaattctatcaattaaagat

SEQ ID NO: 794636 - DNA, 22 bp, Artificial Sequence
  chemically synthesized
gttttcatctttaattgataga

SEQ ID NO: 794637 - DNA, 22 bp, Artificial Sequence
  chemically synthesized
aggttgtccaattctatcaatt

SEQ ID NO: 794638 - DNA, 22 bp, Artificial Sequence
  chemically synthesized
gaggttgtccaattctatcaat

SEQ ID NO: 794639 - DNA, 22 bp, Artificial Sequence
  chemically synthesized
ttgaggttgtccaattctatca

SEQ ID NO: 794640 - DNA, 22 bp, Artificial Sequence
  chemically synthesized
tcatctttaattgatagaattg

SEQ ID NO: 794641 - DNA, 22 bp, Artificial Sequence
  chemically synthesized
cttgaggttgtccaattctatc

SEQ ID NO: 794642 - DNA, 22 bp, Artificial Sequence
  chemically synthesized
catctttaattgatagaattgg

SEQ ID NO: 794643 - DNA, 22 bp, Artificial Sequence
  chemically synthesized
atctttaattgatagaattgga

SEQ ID NO: 794644 - DNA, 22 bp, Artificial Sequence
  chemically synthesized
ttcttgaggttgtccaattcta

SEQ ID NO: 794645 - DNA, 22 bp, Artificial Sequence
  chemically synthesized
tcttcttgaggttgtccaattc

SEQ ID NO: 794646 - DNA, 22 bp, Artificial Sequence
  chemically synthesized
taattgatagaattggacaacc

SEQ ID NO: 794647 - DNA, 22 bp, Artificial Sequence
  chemically synthesized
ctctcttcttgaggttgtccaa

SEQ ID NO: 794648 - DNA, 22 bp, Artificial Sequence
  chemically synthesized
aattgatagaattggacaacct

SEQ ID NO: 794649 - DNA, 22 bp, Artificial Sequence
  chemically synthesized
attgatagaattggacaacctc

SEQ ID NO: 794650 - DNA, 22 bp, Artificial Sequence
  chemically synthesized
atagaattggacaacctcaaga

SEQ ID NO: 794651 - DNA, 22 bp, Artificial Sequence
  chemically synthesized
caagtgaaactactctcttctt

SEQ ID NO: 794652 - DNA, 22 bp, Artificial Sequence
  chemically synthesized
gacaacctcaagaagagagtag

SEQ ID NO: 794653 - DNA, 22 bp, Artificial Sequence
  chemically synthesized
aagaagagagtagtttcacttg

SEQ ID NO: 794654 - DNA, 22 bp, Artificial Sequence
  chemically synthesized
atgagcagcccagcaccatcac

SEQ ID NO: 794655 - DNA, 22 bp, Artificial Sequence
  chemically synthesized
cacttggagtgatggtgctggg

SEQ ID NO: 794656 - DNA, 22 bp, Artificial Sequence
  chemically synthesized
acttggagtgatggtgctgggc

SEQ ID NO: 794657 - DNA, 22 bp, Artificial Sequence
  chemically synthesized
ggagtgatggtgctgggctgct

SEQ ID NO: 794658 - DNA, 22 bp, Artificial Sequence
  chemically synthesized
gagtgatggtgctgggctgctc

SEQ ID NO: 794659 - DNA, 22 bp, Artificial Sequence
  chemically synthesized
cagaatcctcatgagcagccca

SEQ ID NO: 794660 - DNA, 22 bp, Artificial Sequence
  chemically synthesized
acctgcagaatcctcatgagca

SEQ ID NO: 794661 - DNA, 22 bp, Artificial Sequence
  chemically synthesized
aacctgcagaatcctcatgagc

SEQ ID NO: 794662 - DNA, 22 bp, Artificial Sequence
  chemically synthesized
catttaacctgcagaatcctca

SEQ ID NO: 794663 - DNA, 22 bp, Artificial Sequence
  chemically synthesized
ggctgctcatgaggattctgca

SEQ ID NO: 794664 - DNA, 22 bp, Artificial Sequence
  chemically synthesized
actgcatttaacctgcagaatc

SEQ ID NO: 794665 - DNA, 22 bp, Artificial Sequence
  chemically synthesized
gactgcatttaacctgcagaat

SEQ ID NO: 794666 - DNA, 22 bp, Artificial Sequence
  chemically synthesized
ctcatgaggattctgcaggtta

SEQ ID NO: 794667 - DNA, 22 bp, Artificial Sequence
  chemically synthesized
atgaggattctgcaggttaaat

SEQ ID NO: 794668 - DNA, 22 bp, Artificial Sequence
  chemically synthesized
tagtgcttgactgcatttaacc

SEQ ID NO: 794669 - DNA, 22 bp, Artificial Sequence
  chemically synthesized
tgcaggttaaatgcagtcaagc

SEQ ID NO: 794670 - DNA, 22 bp, Artificial Sequence
  chemically synthesized
caggttaaatgcagtcaagcac

SEQ ID NO: 794671 - DNA, 22 bp, Artificial Sequence
  chemically synthesized
ataccgtgctatagtgcttgac

SEQ ID NO: 794672 - DNA, 22 bp, Artificial Sequence
  chemically synthesized
aatgcagtcaagcactatagca

SEQ ID NO: 794673 - DNA, 22 bp, Artificial Sequence
  chemically synthesized
tggatagcaaataacctgatac

SEQ ID NO: 794674 - DNA, 22 bp, Artificial Sequence
  chemically synthesized
tagcacggtatcaggttatttg

SEQ ID NO: 794675 - DNA, 22 bp, Artificial Sequence
  chemically synthesized
gtctatggatagcaaataacct

SEQ ID NO: 794676 - DNA, 22 bp, Artificial Sequence
  chemically synthesized
tctagtctatggatagcaaata

SEQ ID NO: 794677 - DNA, 22 bp, Artificial Sequence
  chemically synthesized
ttatctagtctatggatagcaa

SEQ ID NO: 794678 - DNA, 22 bp, Artificial Sequence
  chemically synthesized
ctattatctagtctatggatag

SEQ ID NO: 794679 - DNA, 22 bp, Artificial Sequence
  chemically synthesized
gctattatctagtctatggata

SEQ ID NO: 794680 - DNA, 22 bp, Artificial Sequence
  chemically synthesized
tgctattatctagtctatggat

SEQ ID NO: 794681 - DNA, 22 bp, Artificial Sequence
  chemically synthesized
ttgctattatctagtctatgga

SEQ ID NO: 794682 - DNA, 22 bp, Artificial Sequence
  chemically synthesized
tttgctatccatagactagata

SEQ ID NO: 794683 - DNA, 22 bp, Artificial Sequence
  chemically synthesized
gctatccatagactagataata

SEQ ID NO: 794684 - DNA, 22 bp, Artificial Sequence
  chemically synthesized
ctatccatagactagataatag

SEQ ID NO: 794685 - DNA, 22 bp, Artificial Sequence
  chemically synthesized
caaggacttttgctattatcta

SEQ ID NO: 794686 - DNA, 22 bp, Artificial Sequence
  chemically synthesized
gcaaggacttttgctattatct

SEQ ID NO: 794687 - DNA, 22 bp, Artificial Sequence
  chemically synthesized
tccatagactagataatagcaa

SEQ ID NO: 794688 - DNA, 22 bp, Artificial Sequence
  chemically synthesized
aaatttgcaaggacttttgcta

SEQ ID NO: 794689 - DNA, 22 bp, Artificial Sequence
  chemically synthesized
gaaatttgcaaggacttttgct

SEQ ID NO: 794690 - DNA, 22 bp, Artificial Sequence
  chemically synthesized
tgaaatttgcaaggacttttgc

SEQ ID NO: 794691 - DNA, 22 bp, Artificial Sequence
  chemically synthesized
gataatagcaaaagtccttgca

SEQ ID NO: 794692 - DNA, 22 bp, Artificial Sequence
  chemically synthesized
agtcatagaactttgaaatttg

SEQ ID NO: 794693 - DNA, 22 bp, Artificial Sequence
  chemically synthesized
actgagtcatagaactttgaaa

SEQ ID NO: 794694 - DNA, 22 bp, Artificial Sequence
  chemically synthesized
tcactgagtcatagaactttga

SEQ ID NO: 794695 - DNA, 22 bp, Artificial Sequence
  chemically synthesized
gcaaatttcaaagttctatgac

SEQ ID NO: 794696 - DNA, 22 bp, Artificial Sequence
  chemically synthesized
caaatttcaaagttctatgact

SEQ ID NO: 794697 - DNA, 22 bp, Artificial Sequence
  chemically synthesized
caaagttctatgactcagtgag

SEQ ID NO: 794698 - DNA, 22 bp, Artificial Sequence
  chemically synthesized
aaagttctatgactcagtgaga

SEQ ID NO: 794699 - DNA, 22 bp, Artificial Sequence
  chemically synthesized
aataataaatgttctcactgag

SEQ ID NO: 794700 - DNA, 22 bp, Artificial Sequence
  chemically synthesized
gctaaataataaatgttctcac

SEQ ID NO: 794701 - DNA, 22 bp, Artificial Sequence
  chemically synthesized
tatgactcagtgagaacattta

SEQ ID NO: 794702 - DNA, 22 bp, Artificial Sequence
  chemically synthesized
ctggctaaataataaatgttct

SEQ ID NO: 794703 - DNA, 22 bp, Artificial Sequence
  chemically synthesized
gctggctaaataataaatgttc

SEQ ID NO: 794704 - DNA, 22 bp, Artificial Sequence
  chemically synthesized
tgactcagtgagaacatttatt

SEQ ID NO: 794705 - DNA, 22 bp, Artificial Sequence
  chemically synthesized
cttgctggctaaataataaatg

SEQ ID NO: 794706 - DNA, 22 bp, Artificial Sequence
  chemically synthesized
acttgctggctaaataataaat

SEQ ID NO: 794707 - DNA, 22 bp, Artificial Sequence
  chemically synthesized
agtgagaacatttattatttag

SEQ ID NO: 794708 - DNA, 22 bp, Artificial Sequence
  chemically synthesized
tgtgcttacttgctggctaaat

SEQ ID NO: 794709 - DNA, 22 bp, Artificial Sequence
  chemically synthesized
attatttagccagcaagtaagc

SEQ ID NO: 794710 - DNA, 22 bp, Artificial Sequence
  chemically synthesized
ttatttagccagcaagtaagca

SEQ ID NO: 794711 - DNA, 22 bp, Artificial Sequence
  chemically synthesized
aatagtgggctatgtgcttact

SEQ ID NO: 794712 - DNA, 22 bp, Artificial Sequence
  chemically synthesized
tttagccagcaagtaagcacat

SEQ ID NO: 794713 - DNA, 22 bp, Artificial Sequence
  chemically synthesized
agccagcaagtaagcacatagc

SEQ ID NO: 794714 - DNA, 22 bp, Artificial Sequence
  chemically synthesized
gccagcaagtaagcacatagcc

SEQ ID NO: 794715 - DNA, 22 bp, Artificial Sequence
  chemically synthesized
tatgtacagacacatgctgaat

SEQ ID NO: 794716 - DNA, 22 bp, Artificial Sequence
  chemically synthesized
ggatgttatatgtacagacaca

SEQ ID NO: 794717 - DNA, 22 bp, Artificial Sequence
  chemically synthesized
taggatgttatatgtacagaca

SEQ ID NO: 794718 - DNA, 22 bp, Artificial Sequence
  chemically synthesized
ttcagcatgtgtctgtacatat

SEQ ID NO: 794719 - DNA, 22 bp, Artificial Sequence
  chemically synthesized
agcatgtgtctgtacatataac

SEQ ID NO: 794720 - DNA, 22 bp, Artificial Sequence
  chemically synthesized
agtagtagggctctaggatgtt

SEQ ID NO: 794721 - DNA, 22 bp, Artificial Sequence
  chemically synthesized
gagtagtagggctctaggatgt

SEQ ID NO: 794722 - DNA, 22 bp, Artificial Sequence
  chemically synthesized
tgagtagtagggctctaggatg

SEQ ID NO: 794723 - DNA, 22 bp, Artificial Sequence
  chemically synthesized
tacatataacatcctagagccc

SEQ ID NO: 794724 - DNA, 22 bp, Artificial Sequence
  chemically synthesized
gcgcacactttgagtagtaggg

SEQ ID NO: 794725 - DNA, 22 bp, Artificial Sequence
  chemically synthesized
tggcgcacactttgagtagtag

SEQ ID NO: 794726 - DNA, 22 bp, Artificial Sequence
  chemically synthesized
gagccctactactcaaagtgtg

SEQ ID NO: 794727 - DNA, 22 bp, Artificial Sequence
  chemically synthesized
tcagtctctggcgcacactttg

SEQ ID NO: 794728 - DNA, 22 bp, Artificial Sequence
  chemically synthesized
ctgtcagtctctggcgcacact

SEQ ID NO: 794729 - DNA, 22 bp, Artificial Sequence
  chemically synthesized
ctgctgtcagtctctggcgcac

SEQ ID NO: 794730 - DNA, 22 bp, Artificial Sequence
  chemically synthesized
ctactcaaagtgtgcgccagag

SEQ ID NO: 794731 - DNA, 22 bp, Artificial Sequence
  chemically synthesized
ctcaaagtgtgcgccagagact

SEQ ID NO: 794732 - DNA, 22 bp, Artificial Sequence
  chemically synthesized
aaagtgtgcgccagagactgac

SEQ ID NO: 794733 - DNA, 22 bp, Artificial Sequence
  chemically synthesized
agtaggtcccaggtgatgctgc

SEQ ID NO: 794734 - DNA, 22 bp, Artificial Sequence
  chemically synthesized
attcagtaggtcccaggtgatg

SEQ ID NO: 794735 - DNA, 22 bp, Artificial Sequence
  chemically synthesized
acagcagcagcatcacctggga

SEQ ID NO: 794736 - DNA, 22 bp, Artificial Sequence
  chemically synthesized
ggacctactgaatcagcatctc

SEQ ID NO: 794737 - DNA, 22 bp, Artificial Sequence
  chemically synthesized
gccccaaccccagagatgctga

SEQ ID NO: 794738 - DNA, 22 bp, Artificial Sequence
  chemically synthesized
agccccaaccccagagatgctg

SEQ ID NO: 794739 - DNA, 22 bp, Artificial Sequence
  chemically synthesized
cttagccccaaccccagagatg

SEQ ID NO: 794740 - DNA, 22 bp, Artificial Sequence
  chemically synthesized
ctgaatcagcatctctggggtt

SEQ ID NO: 794741 - DNA, 22 bp, Artificial Sequence
  chemically synthesized
aatcagcatctctggggttggg

SEQ ID NO: 794742 - DNA, 22 bp, Artificial Sequence
  chemically synthesized
aaacatagattacttagcccca

SEQ ID NO: 794743 - DNA, 22 bp, Artificial Sequence
  chemically synthesized
ttaaaacatagattacttagcc

SEQ ID NO: 794744 - DNA, 22 bp, Artificial Sequence
  chemically synthesized
gttaaaacatagattacttagc

SEQ ID NO: 794745 - DNA, 22 bp, Artificial Sequence
  chemically synthesized
tggggttggggctaagtaatct

SEQ ID NO: 794746 - DNA, 22 bp, Artificial Sequence
  chemically synthesized
gggttggggctaagtaatctat

SEQ ID NO: 794747 - DNA, 22 bp, Artificial Sequence
  chemically synthesized
gagagcttgttaaaacatagat

SEQ ID NO: 794748 - DNA, 22 bp, Artificial Sequence
  chemically synthesized
gggctaagtaatctatgtttta

SEQ ID NO: 794749 - DNA, 22 bp, Artificial Sequence
  chemically synthesized
cctggagagcttgttaaaacat

SEQ ID NO: 794750 - DNA, 22 bp, Artificial Sequence
  chemically synthesized
agtaatctatgttttaacaagc

SEQ ID NO: 794751 - DNA, 22 bp, Artificial Sequence
  chemically synthesized
tgttttaacaagctctccaggc

SEQ ID NO: 794752 - DNA, 22 bp, Artificial Sequence
  chemically synthesized
atatgcatagcaattgcctgga

SEQ ID NO: 794753 - DNA, 22 bp, Artificial Sequence
  chemically synthesized
aatatgcatagcaattgcctgg

SEQ ID NO: 794754 - DNA, 22 bp, Artificial Sequence
  chemically synthesized
taacaagctctccaggcaattg

SEQ ID NO: 794755 - DNA, 22 bp, Artificial Sequence
  chemically synthesized
aacaagctctccaggcaattgc

SEQ ID NO: 794756 - DNA, 22 bp, Artificial Sequence
  chemically synthesized
ttaatatgcatagcaattgcct

SEQ ID NO: 794757 - DNA, 22 bp, Artificial Sequence
  chemically synthesized
acaagctctccaggcaattgct

SEQ ID NO: 794758 - DNA, 22 bp, Artificial Sequence
  chemically synthesized
tcttaatatgcatagcaattgc

SEQ ID NO: 794759 - DNA, 22 bp, Artificial Sequence
  chemically synthesized
ctcttaatatgcatagcaattg

SEQ ID NO: 794760 - DNA, 22 bp, Artificial Sequence
  chemically synthesized
tccaggcaattgctatgcatat

SEQ ID NO: 794761 - DNA, 22 bp, Artificial Sequence
  chemically synthesized
caggcaattgctatgcatatta

SEQ ID NO: 794762 - DNA, 22 bp, Artificial Sequence
  chemically synthesized
aatcagtgcttctcttaatatg

SEQ ID NO: 794763 - DNA, 22 bp, Artificial Sequence
  chemically synthesized
tgaatcagtgcttctcttaata

SEQ ID NO: 794764 - DNA, 22 bp, Artificial Sequence
  chemically synthesized
ctatgcatattaagagaagcac

SEQ ID NO: 794765 - DNA, 22 bp, Artificial Sequence
  chemically synthesized
tgcatattaagagaagcactga

SEQ ID NO: 794766 - DNA, 22 bp, Artificial Sequence
  chemically synthesized
acaatgctctgaatcagtgctt

SEQ ID NO: 794767 - DNA, 22 bp, Artificial Sequence
  chemically synthesized
tcacaatgctctgaatcagtgc

SEQ ID NO: 794768 - DNA, 22 bp, Artificial Sequence
  chemically synthesized
tgttctcacaatgctctgaatc

SEQ ID NO: 794769 - DNA, 22 bp, Artificial Sequence
  chemically synthesized
agagaagcactgattcagagca

SEQ ID NO: 794770 - DNA, 22 bp, Artificial Sequence
  chemically synthesized
tatgttctcacaatgctctgaa

SEQ ID NO: 794771 - DNA, 22 bp, Artificial Sequence
  chemically synthesized
ctatgttctcacaatgctctga

SEQ ID NO: 794772 - DNA, 22 bp, Artificial Sequence
  chemically synthesized
gaatatcttctatgttctcaca

SEQ ID NO: 794773 - DNA, 22 bp, Artificial Sequence
  chemically synthesized
attcagagcattgtgagaacat

SEQ ID NO: 794774 - DNA, 22 bp, Artificial Sequence
  chemically synthesized
agagcattgtgagaacatagaa

SEQ ID NO: 794775 - DNA, 22 bp, Artificial Sequence
  chemically synthesized
aggcaaagcctagaatatcttc

SEQ ID NO: 794776 - DNA, 22 bp, Artificial Sequence
  chemically synthesized
gaggcaaagcctagaatatctt

SEQ ID NO: 794777 - DNA, 22 bp, Artificial Sequence
  chemically synthesized
tgagaacatagaagatattcta

SEQ ID NO: 794778 - DNA, 22 bp, Artificial Sequence
  chemically synthesized
ttgaggcaaagcctagaatatc

SEQ ID NO: 794779 - DNA, 22 bp, Artificial Sequence
  chemically synthesized
aagttcttgaggcaaagcctag

SEQ ID NO: 794780 - DNA, 22 bp, Artificial Sequence
  chemically synthesized
tccaaaactaaagttcttgagg

SEQ ID NO: 794781 - DNA, 22 bp, Artificial Sequence
  chemically synthesized
atccaaaactaaagttcttgag

SEQ ID NO: 794782 - DNA, 22 bp, Artificial Sequence
  chemically synthesized
tatccaaaactaaagttcttga

SEQ ID NO: 794783 - DNA, 22 bp, Artificial Sequence
  chemically synthesized
taggctttgcctcaagaacttt

SEQ ID NO: 794784 - DNA, 22 bp, Artificial Sequence
  chemically synthesized
ggctttgcctcaagaactttag

SEQ ID NO: 794785 - DNA, 22 bp, Artificial Sequence
  chemically synthesized
ttttatccaaaactaaagttct

SEQ ID NO: 794786 - DNA, 22 bp, Artificial Sequence
  chemically synthesized
tgcctcaagaactttagttttg

SEQ ID NO: 794787 - DNA, 22 bp, Artificial Sequence
  chemically synthesized
gcctcaagaactttagttttgg

SEQ ID NO: 794788 - DNA, 22 bp, Artificial Sequence
  chemically synthesized
catctattttatccaaaactaa

SEQ ID NO: 794789 - DNA, 22 bp, Artificial Sequence
  chemically synthesized
cctcaagaactttagttttgga

SEQ ID NO: 794790 - DNA, 22 bp, Artificial Sequence
  chemically synthesized
acatctattttatccaaaacta

SEQ ID NO: 794791 - DNA, 22 bp, Artificial Sequence
  chemically synthesized
tacatctattttatccaaaact

SEQ ID NO: 794792 - DNA, 22 bp, Artificial Sequence
  chemically synthesized
aagaactttagttttggataaa

SEQ ID NO: 794793 - DNA, 22 bp, Artificial Sequence
  chemically synthesized
ttttacatctattttatccaaa

SEQ ID NO: 794794 - DNA, 22 bp, Artificial Sequence
  chemically synthesized
agttgttttacatctattttat

SEQ ID NO: 794795 - DNA, 22 bp, Artificial Sequence
  chemically synthesized
tagttttggataaaatagatgt

SEQ ID NO: 794796 - DNA, 22 bp, Artificial Sequence
  chemically synthesized
ctaagttgttttacatctattt

SEQ ID NO: 794797 - DNA, 22 bp, Artificial Sequence
  chemically synthesized
agttttggataaaatagatgta

SEQ ID NO: 794798 - DNA, 22 bp, Artificial Sequence
  chemically synthesized
gctaagttgttttacatctatt

SEQ ID NO: 794799 - DNA, 22 bp, Artificial Sequence
  chemically synthesized
gttttggataaaatagatgtaa

SEQ ID NO: 794800 - DNA, 22 bp, Artificial Sequence
  chemically synthesized
tgctaagttgttttacatctat

SEQ ID NO: 794801 - DNA, 22 bp, Artificial Sequence
  chemically synthesized
tggataaaatagatgtaaaaca

SEQ ID NO: 794802 - DNA, 22 bp, Artificial Sequence
  chemically synthesized
ggataaaatagatgtaaaacaa

SEQ ID NO: 794803 - DNA, 22 bp, Artificial Sequence
  chemically synthesized
gataaaatagatgtaaaacaac

SEQ ID NO: 794804 - DNA, 22 bp, Artificial Sequence
  chemically synthesized
tgaaagattttgctaagttgtt

SEQ ID NO: 794805 - DNA, 22 bp, Artificial Sequence
  chemically synthesized
attatgaaagattttgctaagt

SEQ ID NO: 794806 - DNA, 22 bp, Artificial Sequence
  chemically synthesized
cattatgaaagattttgctaag

SEQ ID NO: 794807 - DNA, 22 bp, Artificial Sequence
  chemically synthesized
cttcattatgaaagattttgct

SEQ ID NO: 794808 - DNA, 22 bp, Artificial Sequence
  chemically synthesized
cagatattacttcattatgaaa

SEQ ID NO: 794809 - DNA, 22 bp, Artificial Sequence
  chemically synthesized
agcaaaatctttcataatgaag

SEQ ID NO: 794810 - DNA, 22 bp, Artificial Sequence
  chemically synthesized
gcaaaatctttcataatgaagt

SEQ ID NO: 794811 - DNA, 22 bp, Artificial Sequence
  chemically synthesized
aatgaatgacctacagatatta

SEQ ID NO: 794812 - DNA, 22 bp, Artificial Sequence
  chemically synthesized
tcataatgaagtaatatctgta

SEQ ID NO: 794813 - DNA, 22 bp, Artificial Sequence
  chemically synthesized
cataatgaagtaatatctgtag

SEQ ID NO: 794814 - DNA, 22 bp, Artificial Sequence
  chemically synthesized
ataatgaagtaatatctgtagg

SEQ ID NO: 794815 - DNA, 22 bp, Artificial Sequence
  chemically synthesized
ttgaatgaatgacctacagata

SEQ ID NO: 794816 - DNA, 22 bp, Artificial Sequence
  chemically synthesized
gttgaatgaatgacctacagat

SEQ ID NO: 794817 - DNA, 22 bp, Artificial Sequence
  chemically synthesized
aatatttgttgaatgaatgacc

SEQ ID NO: 794818 - DNA, 22 bp, Artificial Sequence
  chemically synthesized
tcaatatttgttgaatgaatga

SEQ ID NO: 794819 - DNA, 22 bp, Artificial Sequence
  chemically synthesized
taggtcattcattcaacaaata

SEQ ID NO: 794820 - DNA, 22 bp, Artificial Sequence
  chemically synthesized
acaaatagtaggttctcaatat

SEQ ID NO: 794821 - DNA, 22 bp, Artificial Sequence
  chemically synthesized
attcaacaaatattgagaacct

SEQ ID NO: 794822 - DNA, 22 bp, Artificial Sequence
  chemically synthesized
aacaaatattgagaacctacta

SEQ ID NO: 794823 - DNA, 22 bp, Artificial Sequence
  chemically synthesized
acacaatgcctaacaaatagta

SEQ ID NO: 794824 - DNA, 22 bp, Artificial Sequence
  chemically synthesized
agaacctactatttgttaggca

SEQ ID NO: 794825 - DNA, 22 bp, Artificial Sequence
  chemically synthesized
ctatttgttaggcattgtgtta

SEQ ID NO: 794826 - DNA, 22 bp, Artificial Sequence
  chemically synthesized
taaccccagccactaacacaat

SEQ ID NO: 794827 - DNA, 22 bp, Artificial Sequence
  chemically synthesized
tttgttaggcattgtgttagtg

SEQ ID NO: 794828 - DNA, 22 bp, Artificial Sequence
  chemically synthesized
ttataaccccagccactaacac

SEQ ID NO: 794829 - DNA, 22 bp, Artificial Sequence
  chemically synthesized
gttaggcattgtgttagtggct

SEQ ID NO: 794830 - DNA, 22 bp, Artificial Sequence
  chemically synthesized
ttaggcattgtgttagtggctg

SEQ ID NO: 794831 - DNA, 22 bp, Artificial Sequence
  chemically synthesized
ggcattgtgttagtggctgggg

SEQ ID NO: 794832 - DNA, 22 bp, Artificial Sequence
  chemically synthesized
tgttagtggctggggttataat

SEQ ID NO: 794833 - DNA, 22 bp, Artificial Sequence
  chemically synthesized
gtggctggggttataatagttc

SEQ ID NO: 794834 - DNA, 22 bp, Artificial Sequence
  chemically synthesized
taagcgtcacaaaagcagaact

SEQ ID NO: 794835 - DNA, 22 bp, Artificial Sequence
  chemically synthesized
gggttataatagttctgctttt

SEQ ID NO: 794836 - DNA, 22 bp, Artificial Sequence
  chemically synthesized
gattgtaagcgtcacaaaagca

SEQ ID NO: 794837 - DNA, 22 bp, Artificial Sequence
  chemically synthesized
taatagttctgcttttgtgacg

SEQ ID NO: 794838 - DNA, 22 bp, Artificial Sequence
  chemically synthesized
actagattgtaagcgtcacaaa

SEQ ID NO: 794839 - DNA, 22 bp, Artificial Sequence
  chemically synthesized
cactagattgtaagcgtcacaa

SEQ ID NO: 794840 - DNA, 22 bp, Artificial Sequence
  chemically synthesized
tgcttttgtgacgcttacaatc

SEQ ID NO: 794841 - DNA, 22 bp, Artificial Sequence
  chemically synthesized
cttttgtgacgcttacaatcta

SEQ ID NO: 794842 - DNA, 22 bp, Artificial Sequence
  chemically synthesized
ggtatacttcactagattgtaa

SEQ ID NO: 794843 - DNA, 22 bp, Artificial Sequence
  chemically synthesized
gggtatacttcactagattgta

SEQ ID NO: 794844 - DNA, 22 bp, Artificial Sequence
  chemically synthesized
ttgtgacgcttacaatctagtg

SEQ ID NO: 794845 - DNA, 22 bp, Artificial Sequence
  chemically synthesized
tgtgacgcttacaatctagtga

SEQ ID NO: 794846 - DNA, 22 bp, Artificial Sequence
  chemically synthesized
tttgggtatacttcactagatt

SEQ ID NO: 794847 - DNA, 22 bp, Artificial Sequence
  chemically synthesized
gtgacgcttacaatctagtgaa

SEQ ID NO: 794848 - DNA, 22 bp, Artificial Sequence
  chemically synthesized
atttgggtatacttcactagat

SEQ ID NO: 794849 - DNA, 22 bp, Artificial Sequence
  chemically synthesized
tgacgcttacaatctagtgaag

SEQ ID NO: 794850 - DNA, 22 bp, Artificial Sequence
  chemically synthesized
tttatttgggtatacttcacta

SEQ ID NO: 794851 - DNA, 22 bp, Artificial Sequence
  chemically synthesized
gtttatttgggtatacttcact

SEQ ID NO: 794852 - DNA, 22 bp, Artificial Sequence
  chemically synthesized
acaatctagtgaagtataccca

SEQ ID NO: 794853 - DNA, 22 bp, Artificial Sequence
  chemically synthesized
caatctagtgaagtatacccaa

SEQ ID NO: 794854 - DNA, 22 bp, Artificial Sequence
  chemically synthesized
tatatttgtttatttgggtata

SEQ ID NO: 794855 - DNA, 22 bp, Artificial Sequence
  chemically synthesized
atatatttgtttatttgggtat

SEQ ID NO: 794856 - DNA, 22 bp, Artificial Sequence
  chemically synthesized
gtgaagtatacccaaataaaca

SEQ ID NO: 794857 - DNA, 22 bp, Artificial Sequence
  chemically synthesized
aaatttatatatttgtttattt

SEQ ID NO: 794858 - DNA, 22 bp, Artificial Sequence
  chemically synthesized
aaaatttatatatttgtttatt

SEQ ID NO: 794859 - DNA, 22 bp, Artificial Sequence
  chemically synthesized
taaaatttatatatttgtttat

SEQ ID NO: 794860 - DNA, 22 bp, Artificial Sequence
  chemically synthesized
ttaaaatttatatatttgttta

SEQ ID NO: 794861 - DNA, 22 bp, Artificial Sequence
  chemically synthesized
aaaaccgtatttttaaaattta

SEQ ID NO: 794862 - DNA, 22 bp, Artificial Sequence
  chemically synthesized
aaaaaccgtatttttaaaattt

SEQ ID NO: 794863 - DNA, 22 bp, Artificial Sequence
  chemically synthesized
taaaaaccgtatttttaaaatt

SEQ ID NO: 794864 - DNA, 22 bp, Artificial Sequence
  chemically synthesized
ttaaaaaccgtatttttaaaat

SEQ ID NO: 794865 - DNA, 22 bp, Artificial Sequence
  chemically synthesized
tttaaaaaccgtatttttaaaa

SEQ ID NO: 794866 - DNA, 22 bp, Artificial Sequence
  chemically synthesized
catagtattttttaaaaaccgt

SEQ ID NO: 794867 - DNA, 22 bp, Artificial Sequence
  chemically synthesized
ctgcatagtattttttaaaaac

SEQ ID NO: 794868 - DNA, 22 bp, Artificial Sequence
  chemically synthesized
cctgcatagtattttttaaaaa

SEQ ID NO: 794869 - DNA, 22 bp, Artificial Sequence
  chemically synthesized
taaaaatacggtttttaaaaaa

SEQ ID NO: 794870 - DNA, 22 bp, Artificial Sequence
  chemically synthesized
aaaaatacggtttttaaaaaat

SEQ ID NO: 794871 - DNA, 22 bp, Artificial Sequence
  chemically synthesized
aaaatacggtttttaaaaaata

SEQ ID NO: 794872 - DNA, 22 bp, Artificial Sequence
  chemically synthesized
tttcctgcatagtattttttaa

SEQ ID NO: 794873 - DNA, 22 bp, Artificial Sequence
  chemically synthesized
ttatttcctgcatagtattttt

SEQ ID NO: 794874 - DNA, 22 bp, Artificial Sequence
  chemically synthesized
ttaaaaaatactatgcaggaaa

SEQ ID NO: 794875 - DNA, 22 bp, Artificial Sequence
  chemically synthesized
taaaaaatactatgcaggaaat

SEQ ID NO: 794876 - DNA, 22 bp, Artificial Sequence
  chemically synthesized
aaaaaatactatgcaggaaata

SEQ ID NO: 794877 - DNA, 22 bp, Artificial Sequence
  chemically synthesized
aaaaatactatgcaggaaataa

SEQ ID NO: 794878 - DNA, 22 bp, Artificial Sequence
  chemically synthesized
atagcaccattattatttcctg

SEQ ID NO: 794879 - DNA, 22 bp, Artificial Sequence
  chemically synthesized
catagcaccattattatttcct

SEQ ID NO: 794880 - DNA, 22 bp, Artificial Sequence
  chemically synthesized
tcatagcaccattattatttcc

SEQ ID NO: 794881 - DNA, 22 bp, Artificial Sequence
  chemically synthesized
ttttcatagcaccattattatt

SEQ ID NO: 794882 - DNA, 22 bp, Artificial Sequence
  chemically synthesized
gttttcatagcaccattattat

SEQ ID NO: 794883 - DNA, 22 bp, Artificial Sequence
  chemically synthesized
tgttttcatagcaccattatta

SEQ ID NO: 794884 - DNA, 22 bp, Artificial Sequence
  chemically synthesized
tttgttttcatagcaccattat

SEQ ID NO: 794885 - DNA, 22 bp, Artificial Sequence
  chemically synthesized
tgcaggaaataataatggtgct

SEQ ID NO: 794886 - DNA, 22 bp, Artificial Sequence
  chemically synthesized
ttctttgttttcatagcaccat

SEQ ID NO: 794887 - DNA, 22 bp, Artificial Sequence
  chemically synthesized
tgttctttgttttcatagcacc

SEQ ID NO: 794888 - DNA, 22 bp, Artificial Sequence
  chemically synthesized
ctgttctttgttttcatagcac

SEQ ID NO: 794889 - DNA, 22 bp, Artificial Sequence
  chemically synthesized
aaagccatttctgttctttgtt

SEQ ID NO: 794890 - DNA, 22 bp, Artificial Sequence
  chemically synthesized
tgaaaacaaagaacagaaatgg

SEQ ID NO: 794891 - DNA, 22 bp, Artificial Sequence
  chemically synthesized
cacccctcaaagccatttctgt

SEQ ID NO: 794892 - DNA, 22 bp, Artificial Sequence
  chemically synthesized
tccacccctcaaagccatttct

SEQ ID NO: 794893 - DNA, 22 bp, Artificial Sequence
  chemically synthesized
aatgtatcactctccacccctc

SEQ ID NO: 794894 - DNA, 22 bp, Artificial Sequence
  chemically synthesized
tgaggggtggagagtgatacat

SEQ ID NO: 794895 - DNA, 22 bp, Artificial Sequence
  chemically synthesized
aaataaagttaaatgtatcact

SEQ ID NO: 794896 - DNA, 22 bp, Artificial Sequence
  chemically synthesized
gaggggtggagagtgatacatt

SEQ ID NO: 794897 - DNA, 22 bp, Artificial Sequence
  chemically synthesized
aaaataaagttaaatgtatcac

SEQ ID NO: 794898 - DNA, 22 bp, Artificial Sequence
  chemically synthesized
aggggtggagagtgatacattt

SEQ ID NO: 794899 - DNA, 22 bp, Artificial Sequence
  chemically synthesized
acaatttaaaataaagttaaat

SEQ ID NO: 794900 - DNA, 22 bp, Artificial Sequence
  chemically synthesized
ttaacaatttaaaataaagtta

SEQ ID NO: 794901 - DNA, 22 bp, Artificial Sequence
  chemically synthesized
ttattaacaatttaaaataaag

SEQ ID NO: 794902 - DNA, 22 bp, Artificial Sequence
  chemically synthesized
acatattattattaacaattta

SEQ ID NO: 794903 - DNA, 22 bp, Artificial Sequence
  chemically synthesized
aacatattattattaacaattt

SEQ ID NO: 794904 - DNA, 22 bp, Artificial Sequence
  chemically synthesized
aactttattttaaattgttaat

SEQ ID NO: 794905 - DNA, 22 bp, Artificial Sequence
  chemically synthesized
actttattttaaattgttaata

SEQ ID NO: 794906 - DNA, 22 bp, Artificial Sequence
  chemically synthesized
tattttaaattgttaataataa

SEQ ID NO: 794907 - DNA, 22 bp, Artificial Sequence
  chemically synthesized
aatcttaacatattattattaa

SEQ ID NO: 794908 - DNA, 22 bp, Artificial Sequence
  chemically synthesized
attttaaattgttaataataat

SEQ ID NO: 794909 - DNA, 22 bp, Artificial Sequence
  chemically synthesized
ttttaaattgttaataataata

SEQ ID NO: 794910 - DNA, 22 bp, Artificial Sequence
  chemically synthesized
actaaatcttaacatattatta

SEQ ID NO: 794911 - DNA, 22 bp, Artificial Sequence
  chemically synthesized
taaattgttaataataatatgt

SEQ ID NO: 794912 - DNA, 22 bp, Artificial Sequence
  chemically synthesized
aaattgttaataataatatgtt

SEQ ID NO: 794913 - DNA, 22 bp, Artificial Sequence
  chemically synthesized
aattgttaataataatatgtta

SEQ ID NO: 794914 - DNA, 22 bp, Artificial Sequence
  chemically synthesized
tcaactaactaaatcttaacat

SEQ ID NO: 794915 - DNA, 22 bp, Artificial Sequence
  chemically synthesized
ttaataataatatgttaagatt

SEQ ID NO: 794916 - DNA, 22 bp, Artificial Sequence
  chemically synthesized
atcaactaactaaatcttaaca

SEQ ID NO: 794917 - DNA, 22 bp, Artificial Sequence
  chemically synthesized
ataataatatgttaagatttag

SEQ ID NO: 794918 - DNA, 22 bp, Artificial Sequence
  chemically synthesized
atttatcaactaactaaatctt

SEQ ID NO: 794919 - DNA, 22 bp, Artificial Sequence
  chemically synthesized
ctgatttatcaactaactaaat

SEQ ID NO: 794920 - DNA, 22 bp, Artificial Sequence
  chemically synthesized
gctgatttatcaactaactaaa

SEQ ID NO: 794921 - DNA, 22 bp, Artificial Sequence
  chemically synthesized
gtatttgctgatttatcaacta

SEQ ID NO: 794922 - DNA, 22 bp, Artificial Sequence
  chemically synthesized
agatttagttagttgataaatc

SEQ ID NO: 794923 - DNA, 22 bp, Artificial Sequence
  chemically synthesized
agttagttgataaatcagcaaa

SEQ ID NO: 794924 - DNA, 22 bp, Artificial Sequence
  chemically synthesized
gttagttgataaatcagcaaat

SEQ ID NO: 794925 - DNA, 22 bp, Artificial Sequence
  chemically synthesized
gttgataaatcagcaaatacca

SEQ ID NO: 794926 - DNA, 22 bp, Artificial Sequence
  chemically synthesized
ataaatcagcaaataccaactg

SEQ ID NO: 794927 - DNA, 22 bp, Artificial Sequence
  chemically synthesized
ggtgcagagcatgcatgcagtt

SEQ ID NO: 794928 - DNA, 22 bp, Artificial Sequence
  chemically synthesized
tctgggtgcagagcatgcatgc

SEQ ID NO: 794929 - DNA, 22 bp, Artificial Sequence
  chemically synthesized
atctgggtgcagagcatgcatg

SEQ ID NO: 794930 - DNA, 22 bp, Artificial Sequence
  chemically synthesized
catgcatgctctgcacccagat

SEQ ID NO: 794931 - DNA, 22 bp, Artificial Sequence
  chemically synthesized
cacaagatgcttatctgggtgc

SEQ ID NO: 794932 - DNA, 22 bp, Artificial Sequence
  chemically synthesized
tattccacaagatgcttatctg

SEQ ID NO: 794933 - DNA, 22 bp, Artificial Sequence
  chemically synthesized
atattccacaagatgcttatct

SEQ ID NO: 794934 - DNA, 22 bp, Artificial Sequence
  chemically synthesized
ttatattccacaagatgcttat

SEQ ID NO: 794935 - DNA, 22 bp, Artificial Sequence
  chemically synthesized
tgcacccagataagcatcttgt

SEQ ID NO: 794936 - DNA, 22 bp, Artificial Sequence
  chemically synthesized
cacccagataagcatcttgtgg

SEQ ID NO: 794937 - DNA, 22 bp, Artificial Sequence
  chemically synthesized
cagggcatactcttatattcca

SEQ ID NO: 794938 - DNA, 22 bp, Artificial Sequence
  chemically synthesized
ctccagggcatactcttatatt

SEQ ID NO: 794939 - DNA, 22 bp, Artificial Sequence
  chemically synthesized
taaactcctccagggcatactc

SEQ ID NO: 794940 - DNA, 22 bp, Artificial Sequence
  chemically synthesized
gtggaatataagagtatgccct

SEQ ID NO: 794941 - DNA, 22 bp, Artificial Sequence
  chemically synthesized
tggaatataagagtatgccctg

SEQ ID NO: 794942 - DNA, 22 bp, Artificial Sequence
  chemically synthesized
attataaactcctccagggcat

SEQ ID NO: 794943 - DNA, 22 bp, Artificial Sequence
  chemically synthesized
caactgattataaactcctcca

SEQ ID NO: 794944 - DNA, 22 bp, Artificial Sequence
  chemically synthesized
ccaactgattataaactcctcc

SEQ ID NO: 794945 - DNA, 22 bp, Artificial Sequence
  chemically synthesized
tccaactgattataaactcctc

SEQ ID NO: 794946 - DNA, 22 bp, Artificial Sequence
  chemically synthesized
tctttccaactgattataaact

SEQ ID NO: 794947 - DNA, 22 bp, Artificial Sequence
  chemically synthesized
atctttccaactgattataaac

SEQ ID NO: 794948 - DNA, 22 bp, Artificial Sequence
  chemically synthesized
aatcttatctttccaactgatt

SEQ ID NO: 794949 - DNA, 22 bp, Artificial Sequence
  chemically synthesized
gaggagtttataatcagttgga

SEQ ID NO: 794950 - DNA, 22 bp, Artificial Sequence
  chemically synthesized
gtgattaaatcttatctttcca

SEQ ID NO: 794951 - DNA, 22 bp, Artificial Sequence
  chemically synthesized
ataatcagttggaaagataaga

SEQ ID NO: 794952 - DNA, 22 bp, Artificial Sequence
  chemically synthesized
taatcagttggaaagataagat

SEQ ID NO: 794953 - DNA, 22 bp, Artificial Sequence
  chemically synthesized
tagttggtgattaaatcttatc

SEQ ID NO: 794954 - DNA, 22 bp, Artificial Sequence
  chemically synthesized
attatagttggtgattaaatct

SEQ ID NO: 794955 - DNA, 22 bp, Artificial Sequence
  chemically synthesized
gaaagataagatttaatcacca

SEQ ID NO: 794956 - DNA, 22 bp, Artificial Sequence
  chemically synthesized
cggacaccatactgattatagt

SEQ ID NO: 794957 - DNA, 22 bp, Artificial Sequence
  chemically synthesized
ctgcggacaccatactgattat

SEQ ID NO: 794958 - DNA, 22 bp, Artificial Sequence
  chemically synthesized
aatcaccaactataatcagtat

SEQ ID NO: 794959 - DNA, 22 bp, Artificial Sequence
  chemically synthesized
atcaccaactataatcagtatg

SEQ ID NO: 794960 - DNA, 22 bp, Artificial Sequence
  chemically synthesized
aagtggtctactgcggacacca

SEQ ID NO: 794961 - DNA, 22 bp, Artificial Sequence
  chemically synthesized
taaagtggtctactgcggacac

SEQ ID NO: 794962 - DNA, 22 bp, Artificial Sequence
  chemically synthesized
taatcagtatggtgtccgcagt

SEQ ID NO: 794963 - DNA, 22 bp, Artificial Sequence
  chemically synthesized
aacaaagggccattctaaagtg

SEQ ID NO: 794964 - DNA, 22 bp, Artificial Sequence
  chemically synthesized
caacaaagggccattctaaagt

SEQ ID NO: 794965 - DNA, 22 bp, Artificial Sequence
  chemically synthesized
tagaatggccctttgttgaaac

SEQ ID NO: 794966 - DNA, 22 bp, Artificial Sequence
  chemically synthesized
agaatggccctttgttgaaact

SEQ ID NO: 794967 - DNA, 22 bp, Artificial Sequence
  chemically synthesized
gaatggccctttgttgaaactc

SEQ ID NO: 794968 - DNA, 22 bp, Artificial Sequence
  chemically synthesized
agtaagaagcagagaggagaga

SEQ ID NO: 794969 - DNA, 22 bp, Artificial Sequence
  chemically synthesized
tgttgaaactctctcctctctg

SEQ ID NO: 794970 - DNA, 22 bp, Artificial Sequence
  chemically synthesized
ttaagtaagaagcagagaggag

SEQ ID NO: 794971 - DNA, 22 bp, Artificial Sequence
  chemically synthesized
gttgaaactctctcctctctgc

SEQ ID NO: 794972 - DNA, 22 bp, Artificial Sequence
  chemically synthesized
attaagtaagaagcagagagga

SEQ ID NO: 794973 - DNA, 22 bp, Artificial Sequence
  chemically synthesized
ttgaaactctctcctctctgct

SEQ ID NO: 794974 - DNA, 22 bp, Artificial Sequence
  chemically synthesized
aaactctctcctctctgcttct

SEQ ID NO: 794975 - DNA, 22 bp, Artificial Sequence
  chemically synthesized
tctcctctctgcttcttactta

SEQ ID NO: 794976 - DNA, 22 bp, Artificial Sequence
  chemically synthesized
tcctctctgcttcttacttaat

SEQ ID NO: 794977 - DNA, 22 bp, Artificial Sequence
  chemically synthesized
ctctctgcttcttacttaataa

SEQ ID NO: 794978 - DNA, 22 bp, Artificial Sequence
  chemically synthesized
tctgcttcttacttaataagct

SEQ ID NO: 794979 - DNA, 22 bp, Artificial Sequence
  chemically synthesized
gaaaaccagaaaagcttattaa

SEQ ID NO: 794980 - DNA, 22 bp, Artificial Sequence
  chemically synthesized
tgcttcttacttaataagcttt

SEQ ID NO: 794981 - DNA, 22 bp, Artificial Sequence
  chemically synthesized
cttcttacttaataagcttttc

SEQ ID NO: 794982 - DNA, 22 bp, Artificial Sequence
  chemically synthesized
cttacttaataagcttttctgg

SEQ ID NO: 794983 - DNA, 22 bp, Artificial Sequence
  chemically synthesized
ttacttaataagcttttctggt

SEQ ID NO: 794984 - DNA, 22 bp, Artificial Sequence
  chemically synthesized
acttaataagcttttctggttt

SEQ ID NO: 794985 - DNA, 22 bp, Artificial Sequence
  chemically synthesized
cttaataagcttttctggtttt

SEQ ID NO: 794986 - DNA, 22 bp, Artificial Sequence
  chemically synthesized
aataagcttttctggttttcca

SEQ ID NO: 794987 - DNA, 22 bp, Artificial Sequence
  chemically synthesized
ataagcttttctggttttccaa

SEQ ID NO: 794988 - DNA, 22 bp, Artificial Sequence
  chemically synthesized
gaaaaccaggaattggaaaacc

SEQ ID NO: 794989 - DNA, 22 bp, Artificial Sequence
  chemically synthesized
ttctggttttccaattcctggt

SEQ ID NO: 794990 - DNA, 22 bp, Artificial Sequence
  chemically synthesized
tctggttttccaattcctggtt

SEQ ID NO: 794991 - DNA, 22 bp, Artificial Sequence
  chemically synthesized
ctggttttccaattcctggttt

SEQ ID NO: 794992 - DNA, 22 bp, Artificial Sequence
  chemically synthesized
tggttttccaattcctggtttt

SEQ ID NO: 794993 - DNA, 22 bp, Artificial Sequence
  chemically synthesized
cacagtgaattagaaaaccagg

SEQ ID NO: 794994 - DNA, 22 bp, Artificial Sequence
  chemically synthesized
gttttccaattcctggttttct

SEQ ID NO: 794995 - DNA, 22 bp, Artificial Sequence
  chemically synthesized
gcacagtgaattagaaaaccag

SEQ ID NO: 794996 - DNA, 22 bp, Artificial Sequence
  chemically synthesized
tccaattcctggttttctaatt

SEQ ID NO: 794997 - DNA, 22 bp, Artificial Sequence
  chemically synthesized
tcttgcacagtgaattagaaaa

SEQ ID NO: 794998 - DNA, 22 bp, Artificial Sequence
  chemically synthesized
ccaattcctggttttctaattc

SEQ ID NO: 794999 - DNA, 22 bp, Artificial Sequence
  chemically synthesized
gtcttgcacagtgaattagaaa

SEQ ID NO: 795000 - DNA, 22 bp, Artificial Sequence
  chemically synthesized
caattcctggttttctaattca

SEQ ID NO: 795001 - DNA, 22 bp, Artificial Sequence
  chemically synthesized
aaatttgtcttgcacagtgaat

SEQ ID NO: 795002 - DNA, 22 bp, Artificial Sequence
  chemically synthesized
ctggttttctaattcactgtgc

SEQ ID NO: 795003 - DNA, 22 bp, Artificial Sequence
  chemically synthesized
aaaatttgtcttgcacagtgaa

SEQ ID NO: 795004 - DNA, 22 bp, Artificial Sequence
  chemically synthesized
taaaatttgtcttgcacagtga

SEQ ID NO: 795005 - DNA, 22 bp, Artificial Sequence
  chemically synthesized
ttaaaatttgtcttgcacagtg

SEQ ID NO: 795006 - DNA, 22 bp, Artificial Sequence
  chemically synthesized
gttttctaattcactgtgcaag

SEQ ID NO: 795007 - DNA, 22 bp, Artificial Sequence
  chemically synthesized
tttaaaatttgtcttgcacagt

SEQ ID NO: 795008 - DNA, 22 bp, Artificial Sequence
  chemically synthesized
tttttaaaatttgtcttgcaca

SEQ ID NO: 795009 - DNA, 22 bp, Artificial Sequence
  chemically synthesized
tctaattcactgtgcaagacaa

SEQ ID NO: 795010 - DNA, 22 bp, Artificial Sequence
  chemically synthesized
tctttttaaaatttgtcttgca

SEQ ID NO: 795011 - DNA, 22 bp, Artificial Sequence
  chemically synthesized
ctaattcactgtgcaagacaaa

SEQ ID NO: 795012 - DNA, 22 bp, Artificial Sequence
  chemically synthesized
ctctttttaaaatttgtcttgc

SEQ ID NO: 795013 - DNA, 22 bp, Artificial Sequence
  chemically synthesized
taattcactgtgcaagacaaat

SEQ ID NO: 795014 - DNA, 22 bp, Artificial Sequence
  chemically synthesized
attcactgtgcaagacaaattt

SEQ ID NO: 795015 - DNA, 22 bp, Artificial Sequence
  chemically synthesized
atttctctttttaaaatttgtc

SEQ ID NO: 795016 - DNA, 22 bp, Artificial Sequence
  chemically synthesized
actgtgcaagacaaattttaaa

SEQ ID NO: 795017 - DNA, 22 bp, Artificial Sequence
  chemically synthesized
tgcaagacaaattttaaaaaga

SEQ ID NO: 795018 - DNA, 22 bp, Artificial Sequence
  chemically synthesized
agccaacattgatttctctttt

SEQ ID NO: 795019 - DNA, 22 bp, Artificial Sequence
  chemically synthesized
cagccaacattgatttctcttt

SEQ ID NO: 795020 - DNA, 22 bp, Artificial Sequence
  chemically synthesized
atttcagccaacattgatttct

SEQ ID NO: 795021 - DNA, 22 bp, Artificial Sequence
  chemically synthesized
taaaaagagaaatcaatgttgg

SEQ ID NO: 795022 - DNA, 22 bp, Artificial Sequence
  chemically synthesized
cattaatttcagccaacattga

SEQ ID NO: 795023 - DNA, 22 bp, Artificial Sequence
  chemically synthesized
aaaaagagaaatcaatgttggc

SEQ ID NO: 795024 - DNA, 22 bp, Artificial Sequence
  chemically synthesized
aaaagagaaatcaatgttggct

SEQ ID NO: 795025 - DNA, 22 bp, Artificial Sequence
  chemically synthesized
tgcattaatttcagccaacatt

SEQ ID NO: 795026 - DNA, 22 bp, Artificial Sequence
  chemically synthesized
cacagaacattctgcattaatt

SEQ ID NO: 795027 - DNA, 22 bp, Artificial Sequence
  chemically synthesized
ccacagaacattctgcattaat

SEQ ID NO: 795028 - DNA, 22 bp, Artificial Sequence
  chemically synthesized
ttccacagaacattctgcatta

SEQ ID NO: 795029 - DNA, 22 bp, Artificial Sequence
  chemically synthesized
cttccacagaacattctgcatt

SEQ ID NO: 795030 - DNA, 22 bp, Artificial Sequence
  chemically synthesized
ttcttccacagaacattctgca

SEQ ID NO: 795031 - DNA, 22 bp, Artificial Sequence
  chemically synthesized
gctgaaattaatgcagaatgtt

SEQ ID NO: 795032 - DNA, 22 bp, Artificial Sequence
  chemically synthesized
aaattaatgcagaatgttctgt

SEQ ID NO: 795033 - DNA, 22 bp, Artificial Sequence
  chemically synthesized
aattcttcttccacagaacatt

SEQ ID NO: 795034 - DNA, 22 bp, Artificial Sequence
  chemically synthesized
gaattcttcttccacagaacat

SEQ ID NO: 795035 - DNA, 22 bp, Artificial Sequence
  chemically synthesized
atgcagaatgttctgtggaaga

SEQ ID NO: 795036 - DNA, 22 bp, Artificial Sequence
  chemically synthesized
aagacccatcttgaattcttct

SEQ ID NO: 795037 - DNA, 22 bp, Artificial Sequence
  chemically synthesized
caagacccatcttgaattcttc

SEQ ID NO: 795038 - DNA, 22 bp, Artificial Sequence
  chemically synthesized
cttcaagacccatcttgaattc

SEQ ID NO: 795039 - DNA, 22 bp, Artificial Sequence
  chemically synthesized
tgtggaagaagaattcaagatg

SEQ ID NO: 795040 - DNA, 22 bp, Artificial Sequence
  chemically synthesized
ctgcttcaagacccatcttgaa

SEQ ID NO: 795041 - DNA, 22 bp, Artificial Sequence
  chemically synthesized
tggaagaagaattcaagatggg

SEQ ID NO: 795042 - DNA, 22 bp, Artificial Sequence
  chemically synthesized
ctactgcttcaagacccatctt

SEQ ID NO: 795043 - DNA, 22 bp, Artificial Sequence
  chemically synthesized
tactactgcttcaagacccatc

SEQ ID NO: 795044 - DNA, 22 bp, Artificial Sequence
  chemically synthesized
tacattctactactgcttcaag

SEQ ID NO: 795045 - DNA, 22 bp, Artificial Sequence
  chemically synthesized
atacattctactactgcttcaa

SEQ ID NO: 795046 - DNA, 22 bp, Artificial Sequence
  chemically synthesized
tatacattctactactgcttca

SEQ ID NO: 795047 - DNA, 22 bp, Artificial Sequence
  chemically synthesized
aagatgggtcttgaagcagtag

SEQ ID NO: 795048 - DNA, 22 bp, Artificial Sequence
  chemically synthesized
acctttatacattctactactg

SEQ ID NO: 795049 - DNA, 22 bp, Artificial Sequence
  chemically synthesized
cacctttatacattctactact

SEQ ID NO: 795050 - DNA, 22 bp, Artificial Sequence
  chemically synthesized
tcttcacctttatacattctac

SEQ ID NO: 795051 - DNA, 22 bp, Artificial Sequence
  chemically synthesized
atcttcacctttatacattcta

SEQ ID NO: 795052 - DNA, 22 bp, Artificial Sequence
  chemically synthesized
gaagcagtagtagaatgtataa

SEQ ID NO: 795053 - DNA, 22 bp, Artificial Sequence
  chemically synthesized
aagcagtagtagaatgtataaa

SEQ ID NO: 795054 - DNA, 22 bp, Artificial Sequence
  chemically synthesized
tttatcttcacctttatacatt

SEQ ID NO: 795055 - DNA, 22 bp, Artificial Sequence
  chemically synthesized
atttatcttcacctttatacat

SEQ ID NO: 795056 - DNA, 22 bp, Artificial Sequence
  chemically synthesized
cttatttatcttcacctttata

SEQ ID NO: 795057 - DNA, 22 bp, Artificial Sequence
  chemically synthesized
ccttatttatcttcacctttat

SEQ ID NO: 795058 - DNA, 22 bp, Artificial Sequence
  chemically synthesized
aaatgacttccttatttatctt

SEQ ID NO: 795059 - DNA, 22 bp, Artificial Sequence
  chemically synthesized
aaaatgacttccttatttatct

SEQ ID NO: 795060 - DNA, 22 bp, Artificial Sequence
  chemically synthesized
ttaaaatgacttccttatttat

SEQ ID NO: 795061 - DNA, 22 bp, Artificial Sequence
  chemically synthesized
acaatagtggtattcttaaaat

SEQ ID NO: 795062 - DNA, 22 bp, Artificial Sequence
  chemically synthesized
atactaacaatagtggtattct

SEQ ID NO: 795063 - DNA, 22 bp, Artificial Sequence
  chemically synthesized
ttaatactaacaatagtggtat

SEQ ID NO: 795064 - DNA, 22 bp, Artificial Sequence
  chemically synthesized
ttattaatactaacaatagtgg

SEQ ID NO: 795065 - DNA, 22 bp, Artificial Sequence
  chemically synthesized
taagaataccactattgttagt

SEQ ID NO: 795066 - DNA, 22 bp, Artificial Sequence
  chemically synthesized
aagaataccactattgttagta

SEQ ID NO: 795067 - DNA, 22 bp, Artificial Sequence
  chemically synthesized
agaataccactattgttagtat

SEQ ID NO: 795068 - DNA, 22 bp, Artificial Sequence
  chemically synthesized
gagttattattaatactaacaa

SEQ ID NO: 795069 - DNA, 22 bp, Artificial Sequence
  chemically synthesized
ttgttagtattaataataactc

SEQ ID NO: 795070 - DNA, 22 bp, Artificial Sequence
  chemically synthesized
ttagtattaataataactccaa

SEQ ID NO: 795071 - DNA, 22 bp, Artificial Sequence
  chemically synthesized
gaaataaaatgattggagttat

SEQ ID NO: 795072 - DNA, 22 bp, Artificial Sequence
  chemically synthesized
gtattaataataactccaatca

SEQ ID NO: 795073 - DNA, 22 bp, Artificial Sequence
  chemically synthesized
ttagaaataaaatgattggagt

SEQ ID NO: 795074 - DNA, 22 bp, Artificial Sequence
  chemically synthesized
ataataactccaatcattttat

SEQ ID NO: 795075 - DNA, 22 bp, Artificial Sequence
  chemically synthesized
caatcattttatttctaataac

SEQ ID NO: 795076 - DNA, 22 bp, Artificial Sequence
  chemically synthesized
atgacagtaccagttattagaa

SEQ ID NO: 795077 - DNA, 22 bp, Artificial Sequence
  chemically synthesized
catgacagtaccagttattaga

SEQ ID NO: 795078 - DNA, 22 bp, Artificial Sequence
  chemically synthesized
tcatgacagtaccagttattag

SEQ ID NO: 795079 - DNA, 22 bp, Artificial Sequence
  chemically synthesized
tatttctaataactggtactgt

SEQ ID NO: 795080 - DNA, 22 bp, Artificial Sequence
  chemically synthesized
atttctaataactggtactgtc

SEQ ID NO: 795081 - DNA, 22 bp, Artificial Sequence
  chemically synthesized
tttctaataactggtactgtca

SEQ ID NO: 795082 - DNA, 22 bp, Artificial Sequence
  chemically synthesized
ctaataactggtactgtcatga

SEQ ID NO: 795083 - DNA, 22 bp, Artificial Sequence
  chemically synthesized
acagatcatctttcatgacagt

SEQ ID NO: 795084 - DNA, 22 bp, Artificial Sequence
  chemically synthesized
taataactggtactgtcatgaa

SEQ ID NO: 795085 - DNA, 22 bp, Artificial Sequence
  chemically synthesized
ataactggtactgtcatgaaag

SEQ ID NO: 795086 - DNA, 22 bp, Artificial Sequence
  chemically synthesized
gtactgtcatgaaagatgatct

SEQ ID NO: 795087 - DNA, 22 bp, Artificial Sequence
  chemically synthesized
atatgtggtattaacagatcat

SEQ ID NO: 795088 - DNA, 22 bp, Artificial Sequence
  chemically synthesized
tgatatgtggtattaacagatc

SEQ ID NO: 795089 - DNA, 22 bp, Artificial Sequence
  chemically synthesized
tcatgaaagatgatctgttaat

SEQ ID NO: 795090 - DNA, 22 bp, Artificial Sequence
  chemically synthesized
ctgatatgtggtattaacagat

SEQ ID NO: 795091 - DNA, 22 bp, Artificial Sequence
  chemically synthesized
aaacccttctgatatgtggtat

SEQ ID NO: 795092 - DNA, 22 bp, Artificial Sequence
  chemically synthesized
aactaaaacccttctgatatgt

SEQ ID NO: 795093 - DNA, 22 bp, Artificial Sequence
  chemically synthesized
ttaataccacatatcagaaggg

SEQ ID NO: 795094 - DNA, 22 bp, Artificial Sequence
  chemically synthesized
gggctgaactaaaacccttctg

SEQ ID NO: 795095 - DNA, 22 bp, Artificial Sequence
  chemically synthesized
ataccacatatcagaagggttt

SEQ ID NO: 795096 - DNA, 22 bp, Artificial Sequence
  chemically synthesized
taaacacaatgtatcatgtctg

SEQ ID NO: 795097 - DNA, 22 bp, Artificial Sequence
  chemically synthesized
tagttcagccccagacatgata

SEQ ID NO: 795098 - DNA, 22 bp, Artificial Sequence
  chemically synthesized
ataaacacaatgtatcatgtct

SEQ ID NO: 795099 - DNA, 22 bp, Artificial Sequence
  chemically synthesized
agttcagccccagacatgatac

SEQ ID NO: 795100 - DNA, 22 bp, Artificial Sequence
  chemically synthesized
gttcagccccagacatgataca

SEQ ID NO: 795101 - DNA, 22 bp, Artificial Sequence
  chemically synthesized
agccccagacatgatacattgt

SEQ ID NO: 795102 - DNA, 22 bp, Artificial Sequence
  chemically synthesized
ccaaagtaatgaaagaaaactt

SEQ ID NO: 795103 - DNA, 22 bp, Artificial Sequence
  chemically synthesized
gccaaagtaatgaaagaaaact

SEQ ID NO: 795104 - DNA, 22 bp, Artificial Sequence
  chemically synthesized
tttgccaaagtaatgaaagaaa

SEQ ID NO: 795105 - DNA, 22 bp, Artificial Sequence
  chemically synthesized
tgtttataagttttctttcatt

SEQ ID NO: 795106 - DNA, 22 bp, Artificial Sequence
  chemically synthesized
ataagttttctttcattacttt

SEQ ID NO: 795107 - DNA, 22 bp, Artificial Sequence
  chemically synthesized
taagttttctttcattactttg

SEQ ID NO: 795108 - DNA, 22 bp, Artificial Sequence
  chemically synthesized
tctttcattactttggcaaaca

SEQ ID NO: 795109 - DNA, 22 bp, Artificial Sequence
  chemically synthesized
ctttcattactttggcaaacaa

SEQ ID NO: 795110 - DNA, 22 bp, Artificial Sequence
  chemically synthesized
tttcattactttggcaaacaac

SEQ ID NO: 795111 - DNA, 22 bp, Artificial Sequence
  chemically synthesized
aaatcaaaagacgttgtttgcc

SEQ ID NO: 795112 - DNA, 22 bp, Artificial Sequence
  chemically synthesized
tcattactttggcaaacaacgt

SEQ ID NO: 795113 - DNA, 22 bp, Artificial Sequence
  chemically synthesized
cattactttggcaaacaacgtc

SEQ ID NO: 795114 - DNA, 22 bp, Artificial Sequence
  chemically synthesized
attactttggcaaacaacgtct

SEQ ID NO: 795115 - DNA, 22 bp, Artificial Sequence
  chemically synthesized
ctttggcaaacaacgtcttttg

SEQ ID NO: 795116 - DNA, 22 bp, Artificial Sequence
  chemically synthesized
tggcaaacaacgtcttttgatt

SEQ ID NO: 795117 - DNA, 22 bp, Artificial Sequence
  chemically synthesized
ggcaaacaacgtcttttgattt

SEQ ID NO: 795118 - DNA, 22 bp, Artificial Sequence
  chemically synthesized
aaaggaaggttaaaatcaaaag

SEQ ID NO: 795119 - DNA, 22 bp, Artificial Sequence
  chemically synthesized
gcaaacaacgtcttttgatttt

SEQ ID NO: 795120 - DNA, 22 bp, Artificial Sequence
  chemically synthesized
gtcattgaaaggaaggttaaaa

SEQ ID NO: 795121 - DNA, 22 bp, Artificial Sequence
  chemically synthesized
agtcattgaaaggaaggttaaa

SEQ ID NO: 795122 - DNA, 22 bp, Artificial Sequence
  chemically synthesized
ttgattttaaccttcctttcaa

SEQ ID NO: 795123 - DNA, 22 bp, Artificial Sequence
  chemically synthesized
tgattttaaccttcctttcaat

SEQ ID NO: 795124 - DNA, 22 bp, Artificial Sequence
  chemically synthesized
gattttaaccttcctttcaatg

SEQ ID NO: 795125 - DNA, 22 bp, Artificial Sequence
  chemically synthesized
attttaaccttcctttcaatga

SEQ ID NO: 795126 - DNA, 22 bp, Artificial Sequence
  chemically synthesized
gagtcccccttagtcattgaaa

SEQ ID NO: 795127 - DNA, 22 bp, Artificial Sequence
  chemically synthesized
taaccttcctttcaatgactaa

SEQ ID NO: 795128 - DNA, 22 bp, Artificial Sequence
  chemically synthesized
ttagagtcccccttagtcattg

SEQ ID NO: 795129 - DNA, 22 bp, Artificial Sequence
  chemically synthesized
aaccttcctttcaatgactaag

SEQ ID NO: 795130 - DNA, 22 bp, Artificial Sequence
  chemically synthesized
attagagtcccccttagtcatt

SEQ ID NO: 795131 - DNA, 22 bp, Artificial Sequence
  chemically synthesized
accttcctttcaatgactaagg

SEQ ID NO: 795132 - DNA, 22 bp, Artificial Sequence
  chemically synthesized
cctttcaatgactaagggggac

SEQ ID NO: 795133 - DNA, 22 bp, Artificial Sequence
  chemically synthesized
ctttcaatgactaagggggact

SEQ ID NO: 795134 - DNA, 22 bp, Artificial Sequence
  chemically synthesized
gatacttattagagtccccctt

SEQ ID NO: 795135 - DNA, 22 bp, Artificial Sequence
  chemically synthesized
tcaatgactaagggggactcta

SEQ ID NO: 795136 - DNA, 22 bp, Artificial Sequence
  chemically synthesized
caatgactaagggggactctaa

SEQ ID NO: 795137 - DNA, 22 bp, Artificial Sequence
  chemically synthesized
cctagatacttattagagtccc

SEQ ID NO: 795138 - DNA, 22 bp, Artificial Sequence
  chemically synthesized
aatgactaagggggactctaat

SEQ ID NO: 795139 - DNA, 22 bp, Artificial Sequence
  chemically synthesized
tacctagatacttattagagtc

SEQ ID NO: 795140 - DNA, 22 bp, Artificial Sequence
  chemically synthesized
agggggactctaataagtatct

SEQ ID NO: 795141 - DNA, 22 bp, Artificial Sequence
  chemically synthesized
acaattctacctagatacttat

SEQ ID NO: 795142 - DNA, 22 bp, Artificial Sequence
  chemically synthesized
gacaattctacctagatactta

SEQ ID NO: 795143 - DNA, 22 bp, Artificial Sequence
  chemically synthesized
tgacaattctacctagatactt

SEQ ID NO: 795144 - DNA, 22 bp, Artificial Sequence
  chemically synthesized
tttgacaattctacctagatac

SEQ ID NO: 795145 - DNA, 22 bp, Artificial Sequence
  chemically synthesized
ctttgacaattctacctagata

SEQ ID NO: 795146 - DNA, 22 bp, Artificial Sequence
  chemically synthesized
taataagtatctaggtagaatt

SEQ ID NO: 795147 - DNA, 22 bp, Artificial Sequence
  chemically synthesized
atcttctttgacaattctacct

SEQ ID NO: 795148 - DNA, 22 bp, Artificial Sequence
  chemically synthesized
ataagtatctaggtagaattgt

SEQ ID NO: 795149 - DNA, 22 bp, Artificial Sequence
  chemically synthesized
actcatcttctttgacaattct

SEQ ID NO: 795150 - DNA, 22 bp, Artificial Sequence
  chemically synthesized
ggtagaattgtcaaagaagatg

SEQ ID NO: 795151 - DNA, 22 bp, Artificial Sequence
  chemically synthesized
tcaaagaagatgagtcagtatt

SEQ ID NO: 795152 - DNA, 22 bp, Artificial Sequence
  chemically synthesized
taacagtcaatatgtaaatact

SEQ ID NO: 795153 - DNA, 22 bp, Artificial Sequence
  chemically synthesized
gtaacagtcaatatgtaaatac

SEQ ID NO: 795154 - DNA, 22 bp, Artificial Sequence
  chemically synthesized
tgtagtgcttgtaacagtcaat

SEQ ID NO: 795155 - DNA, 22 bp, Artificial Sequence
  chemically synthesized
gtgtagtgcttgtaacagtcaa

SEQ ID NO: 795156 - DNA, 22 bp, Artificial Sequence
  chemically synthesized
acatattgactgttacaagcac

SEQ ID NO: 795157 - DNA, 22 bp, Artificial Sequence
  chemically synthesized
catattgactgttacaagcact

SEQ ID NO: 795158 - DNA, 22 bp, Artificial Sequence
  chemically synthesized
tgtaacaaccatttgtgtagtg

SEQ ID NO: 795159 - DNA, 22 bp, Artificial Sequence
  chemically synthesized
actgttacaagcactacacaaa

SEQ ID NO: 795160 - DNA, 22 bp, Artificial Sequence
  chemically synthesized
ttacaagcactacacaaatggt

SEQ ID NO: 795161 - DNA, 22 bp, Artificial Sequence
  chemically synthesized
caagcactacacaaatggttgt

SEQ ID NO: 795162 - DNA, 22 bp, Artificial Sequence
  chemically synthesized
aagtatgttatgtaacaaccat

SEQ ID NO: 795163 - DNA, 22 bp, Artificial Sequence
  chemically synthesized
caagtatgttatgtaacaacca

SEQ ID NO: 795164 - DNA, 22 bp, Artificial Sequence
  chemically synthesized
atttcaagtatgttatgtaaca

SEQ ID NO: 795165 - DNA, 22 bp, Artificial Sequence
  chemically synthesized
catttcaagtatgttatgtaac

SEQ ID NO: 795166 - DNA, 22 bp, Artificial Sequence
  chemically synthesized
cacaaatggttgttacataaca

SEQ ID NO: 795167 - DNA, 22 bp, Artificial Sequence
  chemically synthesized
atttcatttcaagtatgttatg

SEQ ID NO: 795168 - DNA, 22 bp, Artificial Sequence
  chemically synthesized
taatttcatttcaagtatgtta

SEQ ID NO: 795169 - DNA, 22 bp, Artificial Sequence
  chemically synthesized
ttacataacatacttgaaatga

SEQ ID NO: 795170 - DNA, 22 bp, Artificial Sequence
  chemically synthesized
cataacatacttgaaatgaaat

SEQ ID NO: 795171 - DNA, 22 bp, Artificial Sequence
  chemically synthesized
cgtaggtaactctaatttcatt

SEQ ID NO: 795172 - DNA, 22 bp, Artificial Sequence
  chemically synthesized
gcgtaggtaactctaatttcat

SEQ ID NO: 795173 - DNA, 22 bp, Artificial Sequence
  chemically synthesized
gaaatgaaattagagttaccta

SEQ ID NO: 795174 - DNA, 22 bp, Artificial Sequence
  chemically synthesized
aaatgaaattagagttacctac

SEQ ID NO: 795175 - DNA, 22 bp, Artificial Sequence
  chemically synthesized
gagttacctacgcaaatatatg

SEQ ID NO: 795176 - DNA, 22 bp, Artificial Sequence
  chemically synthesized
cctacgcaaatatatgtgtgtg

SEQ ID NO: 795177 - DNA, 22 bp, Artificial Sequence
  chemically synthesized
cgcaaatatatgtgtgtgtatc

SEQ ID NO: 795178 - DNA, 22 bp, Artificial Sequence
  chemically synthesized
aaaaaaaaaaaacaagatacac

SEQ ID NO: 795179 - DNA, 22 bp, Artificial Sequence
  chemically synthesized
aattaaaaaaaaaaaaacaaga

SEQ ID NO: 795180 - DNA, 22 bp, Artificial Sequence
  chemically synthesized
tcaattaaaaaaaaaaaaacaa

SEQ ID NO: 795181 - DNA, 22 bp, Artificial Sequence
  chemically synthesized
tctcaattaaaaaaaaaaaaac

SEQ ID NO: 795182 - DNA, 22 bp, Artificial Sequence
  chemically synthesized
tctctcaattaaaaaaaaaaaa

SEQ ID NO: 795183 - DNA, 22 bp, Artificial Sequence
  chemically synthesized
tctctctcaattaaaaaaaaaa

SEQ ID NO: 795184 - DNA, 22 bp, Artificial Sequence
  chemically synthesized
gtttttttttttttaattgaga

SEQ ID NO: 795185 - DNA, 22 bp, Artificial Sequence
  chemically synthesized
tttttttttttttaattgagag

SEQ ID NO: 795186 - DNA, 22 bp, Artificial Sequence
  chemically synthesized
ttttttttttaattgagagaga

SEQ ID NO: 795187 - DNA, 22 bp, Artificial Sequence
  chemically synthesized
tttttttttaattgagagagag

SEQ ID NO: 795188 - DNA, 22 bp, Artificial Sequence
  chemically synthesized
ttttttttaattgagagagaga

SEQ ID NO: 795189 - DNA, 22 bp, Artificial Sequence
  chemically synthesized
tttttttaattgagagagagag

SEQ ID NO: 795190 - DNA, 22 bp, Artificial Sequence
  chemically synthesized
ttttttaattgagagagagagg

SEQ ID NO: 795191 - DNA, 22 bp, Artificial Sequence
  chemically synthesized
tttttaattgagagagagaggg

SEQ ID NO: 795192 - DNA, 22 bp, Artificial Sequence
  chemically synthesized
ttttaattgagagagagagggt

SEQ ID NO: 795193 - DNA, 22 bp, Artificial Sequence
  chemically synthesized
tttaattgagagagagagggtc

SEQ ID NO: 795194 - DNA, 22 bp, Artificial Sequence
  chemically synthesized
ttaattgagagagagagggtct

SEQ ID NO: 795195 - DNA, 22 bp, Artificial Sequence
  chemically synthesized
ggtgacagaatgagaccctctc

SEQ ID NO: 795196 - DNA, 22 bp, Artificial Sequence
  chemically synthesized
taattgagagagagagggtctc

SEQ ID NO: 795197 - DNA, 22 bp, Artificial Sequence
  chemically synthesized
aattgagagagagagggtctca

SEQ ID NO: 795198 - DNA, 22 bp, Artificial Sequence
  chemically synthesized
attgagagagagagggtctcat

SEQ ID NO: 795199 - DNA, 22 bp, Artificial Sequence
  chemically synthesized
agagagagagggtctcattctg

SEQ ID NO: 795200 - DNA, 22 bp, Artificial Sequence
  chemically synthesized
cagtctaggtgacagaatgaga

SEQ ID NO: 795201 - DNA, 22 bp, Artificial Sequence
  chemically synthesized
tactccagtctaggtgacagaa

SEQ ID NO: 795202 - DNA, 22 bp, Artificial Sequence
  chemically synthesized
ctgtactccagtctaggtgaca

SEQ ID NO: 795203 - DNA, 22 bp, Artificial Sequence
  chemically synthesized
tgctactgtactccagtctagg

SEQ ID NO: 795204 - DNA, 22 bp, Artificial Sequence
  chemically synthesized
attctgtcacctagactggagt

SEQ ID NO: 795205 - DNA, 22 bp, Artificial Sequence
  chemically synthesized
tgactatgctactgtactccag

SEQ ID NO: 795206 - DNA, 22 bp, Artificial Sequence
  chemically synthesized
tgtcacctagactggagtacag

SEQ ID NO: 795207 - DNA, 22 bp, Artificial Sequence
  chemically synthesized
tcacctagactggagtacagta

SEQ ID NO: 795208 - DNA, 22 bp, Artificial Sequence
  chemically synthesized
gactggagtacagtagcatagt

SEQ ID NO: 795209 - DNA, 22 bp, Artificial Sequence
  chemically synthesized
cagggagctgtgactatgctac

SEQ ID NO: 795210 - DNA, 22 bp, Artificial Sequence
  chemically synthesized
gagtacagtagcatagtcacag

SEQ ID NO: 795211 - DNA, 22 bp, Artificial Sequence
  chemically synthesized
caaggctgcagggagctgtgac

SEQ ID NO: 795212 - DNA, 22 bp, Artificial Sequence
  chemically synthesized
ggaggtcaaggctgcaaggctg

SEQ ID NO: 795213 - DNA, 22 bp, Artificial Sequence
  chemically synthesized
agcctgggaggtcaaggctgca

SEQ ID NO: 795214 - DNA, 22 bp, Artificial Sequence
  chemically synthesized
gagcctgggaggtcaaggctgc

SEQ ID NO: 795215 - DNA, 22 bp, Artificial Sequence
  chemically synthesized
cctgcagccttgcagccttgac

SEQ ID NO: 795216 - DNA, 22 bp, Artificial Sequence
  chemically synthesized
cttgagcctgggaggtcaaggc

SEQ ID NO: 795217 - DNA, 22 bp, Artificial Sequence
  chemically synthesized
cagccttgcagccttgacctcc

SEQ ID NO: 795218 - DNA, 22 bp, Artificial Sequence
  chemically synthesized
gcagccttgacctcccaggctc

SEQ ID NO: 795219 - DNA, 22 bp, Artificial Sequence
  chemically synthesized
cagccttgacctcccaggctca

SEQ ID NO: 795220 - DNA, 22 bp, Artificial Sequence
  chemically synthesized
aggcaggaggattgcttgagcc

SEQ ID NO: 795221 - DNA, 22 bp, Artificial Sequence
  chemically synthesized
gacctcccaggctcaagcaatc

SEQ ID NO: 795222 - DNA, 22 bp, Artificial Sequence
  chemically synthesized
acctcccaggctcaagcaatcc

SEQ ID NO: 795223 - DNA, 22 bp, Artificial Sequence
  chemically synthesized
ccaggctcaagcaatcctcctg

SEQ ID NO: 795224 - DNA, 22 bp, Artificial Sequence
  chemically synthesized
aggacgctgaggcaggaggatt

SEQ ID NO: 795225 - DNA, 22 bp, Artificial Sequence
  chemically synthesized
ctcaggacgctgaggcaggagg

SEQ ID NO: 795226 - DNA, 22 bp, Artificial Sequence
  chemically synthesized
aagcaatcctcctgcctcagcg

SEQ ID NO: 795227 - DNA, 22 bp, Artificial Sequence
  chemically synthesized
taatcccagctactcaggacgc

SEQ ID NO: 795228 - DNA, 22 bp, Artificial Sequence
  chemically synthesized
tgtaatcccagctactcaggac

SEQ ID NO: 795229 - DNA, 22 bp, Artificial Sequence
  chemically synthesized
ctgcctcagcgtcctgagtagc

SEQ ID NO: 795230 - DNA, 22 bp, Artificial Sequence
  chemically synthesized
cctcagcgtcctgagtagctgg

SEQ ID NO: 795231 - DNA, 22 bp, Artificial Sequence
  chemically synthesized
agcgtcctgagtagctgggatt

SEQ ID NO: 795232 - DNA, 22 bp, Artificial Sequence
  chemically synthesized
agtagctgggattacagaggtg

SEQ ID NO: 795233 - DNA, 22 bp, Artificial Sequence
  chemically synthesized
gatgtggtggaacacctctgta

SEQ ID NO: 795234 - DNA, 22 bp, Artificial Sequence
  chemically synthesized
ggattacagaggtgttccacca

SEQ ID NO: 795235 - DNA, 22 bp, Artificial Sequence
  chemically synthesized
aaaaatagttggatgtggtgga

SEQ ID NO: 795236 - DNA, 22 bp, Artificial Sequence
  chemically synthesized
aaaaaatagttggatgtggtgg

SEQ ID NO: 795237 - DNA, 22 bp, Artificial Sequence
  chemically synthesized
taaaaaatagttggatgtggtg

SEQ ID NO: 795238 - DNA, 22 bp, Artificial Sequence
  chemically synthesized
cagaggtgttccaccacatcca

SEQ ID NO: 795239 - DNA, 22 bp, Artificial Sequence
  chemically synthesized
ttaaaaaatagttggatgtggt

SEQ ID NO: 795240 - DNA, 22 bp, Artificial Sequence
  chemically synthesized
tttaaaaaatagttggatgtgg

SEQ ID NO: 795241 - DNA, 22 bp, Artificial Sequence
  chemically synthesized
caccacatccaactatttttta

SEQ ID NO: 795242 - DNA, 22 bp, Artificial Sequence
  chemically synthesized
ccaaaaaaattttttaaaaaat

SEQ ID NO: 795243 - DNA, 22 bp, Artificial Sequence
  chemically synthesized
taccaaaaaaattttttaaaaa

SEQ ID NO: 795244 - DNA, 22 bp, Artificial Sequence
  chemically synthesized
cgtctctaccaaaaaaattttt

SEQ ID NO: 795245 - DNA, 22 bp, Artificial Sequence
  chemically synthesized
ttttttaaaaaatttttttggt

SEQ ID NO: 795246 - DNA, 22 bp, Artificial Sequence
  chemically synthesized
tttaaaaaatttttttggtaga

SEQ ID NO: 795247 - DNA, 22 bp, Artificial Sequence
  chemically synthesized
ttaaaaaatttttttggtagag

SEQ ID NO: 795248 - DNA, 22 bp, Artificial Sequence
  chemically synthesized
taaaaaatttttttggtagaga

SEQ ID NO: 795249 - DNA, 22 bp, Artificial Sequence
  chemically synthesized
aaaaaatttttttggtagagac

SEQ ID NO: 795250 - DNA, 22 bp, Artificial Sequence
  chemically synthesized
aaaaatttttttggtagagacg

SEQ ID NO: 795251 - DNA, 22 bp, Artificial Sequence
  chemically synthesized
ggaaccatagcaagactccgtc

SEQ ID NO: 795252 - DNA, 22 bp, Artificial Sequence
  chemically synthesized
ttttggtagagacggagtcttg

SEQ ID NO: 795253 - DNA, 22 bp, Artificial Sequence
  chemically synthesized
tttggtagagacggagtcttgc

SEQ ID NO: 795254 - DNA, 22 bp, Artificial Sequence
  chemically synthesized
ttggtagagacggagtcttgct

SEQ ID NO: 795255 - DNA, 22 bp, Artificial Sequence
  chemically synthesized
tggtagagacggagtcttgcta

SEQ ID NO: 795256 - DNA, 22 bp, Artificial Sequence
  chemically synthesized
ggtagagacggagtcttgctat

SEQ ID NO: 795257 - DNA, 22 bp, Artificial Sequence
  chemically synthesized
gtagagacggagtcttgctatg

SEQ ID NO: 795258 - DNA, 22 bp, Artificial Sequence
  chemically synthesized
gagaccagtctgggaaccatag

SEQ ID NO: 795259 - DNA, 22 bp, Artificial Sequence
  chemically synthesized
gctatggttcccagactggtct

SEQ ID NO: 795260 - DNA, 22 bp, Artificial Sequence
  chemically synthesized
ctatggttcccagactggtctc

SEQ ID NO: 795261 - DNA, 22 bp, Artificial Sequence
  chemically synthesized
agcccaggagttcgagaccagt

SEQ ID NO: 795262 - DNA, 22 bp, Artificial Sequence
  chemically synthesized
gagcccaggagttcgagaccag

SEQ ID NO: 795263 - DNA, 22 bp, Artificial Sequence
  chemically synthesized
tggttcccagactggtctcgaa

SEQ ID NO: 795264 - DNA, 22 bp, Artificial Sequence
  chemically synthesized
ccagactggtctcgaactcctg

SEQ ID NO: 795265 - DNA, 22 bp, Artificial Sequence
  chemically synthesized
gtctcgaactcctgggctcaag

SEQ ID NO: 795266 - DNA, 22 bp, Artificial Sequence
  chemically synthesized
aggcaggagaatcgcttgagcc

SEQ ID NO: 795267 - DNA, 22 bp, Artificial Sequence
  chemically synthesized
gaactcctgggctcaagcgatt

SEQ ID NO: 795268 - DNA, 22 bp, Artificial Sequence
  chemically synthesized
ggaggctaaggcaggagaatcg

SEQ ID NO: 795269 - DNA, 22 bp, Artificial Sequence
  chemically synthesized
ctgggctcaagcgattctcctg

SEQ ID NO: 795270 - DNA, 22 bp, Artificial Sequence
  chemically synthesized
gggaggctaaggcaggagaatc

SEQ ID NO: 795271 - DNA, 22 bp, Artificial Sequence
  chemically synthesized
ggctcaagcgattctcctgcct

SEQ ID NO: 795272 - DNA, 22 bp, Artificial Sequence
  chemically synthesized
aagcgattctcctgccttagcc

SEQ ID NO: 795273 - DNA, 22 bp, Artificial Sequence
  chemically synthesized
taatcccagcaatttgggaggc

SEQ ID NO: 795274 - DNA, 22 bp, Artificial Sequence
  chemically synthesized
tcctgccttagcctcccaaatt

SEQ ID NO: 795275 - DNA, 22 bp, Artificial Sequence
  chemically synthesized
ctgccttagcctcccaaattgc

SEQ ID NO: 795276 - DNA, 22 bp, Artificial Sequence
  chemically synthesized
ccttagcctcccaaattgctgg

SEQ ID NO: 795277 - DNA, 22 bp, Artificial Sequence
  chemically synthesized
acgactgtaatcccagcaattt

SEQ ID NO: 795278 - DNA, 22 bp, Artificial Sequence
  chemically synthesized
agcctcccaaattgctgggatt

SEQ ID NO: 795279 - DNA, 22 bp, Artificial Sequence
  chemically synthesized
gcctcccaaattgctgggatta

SEQ ID NO: 795280 - DNA, 22 bp, Artificial Sequence
  chemically synthesized
ccaaattgctgggattacagtc

SEQ ID NO: 795281 - DNA, 22 bp, Artificial Sequence
  chemically synthesized
ctgggattacagtcgtgagcca

SEQ ID NO: 795282 - DNA, 22 bp, Artificial Sequence
  chemically synthesized
ggattacagtcgtgagccacct

SEQ ID NO: 795283 - DNA, 22 bp, Artificial Sequence
  chemically synthesized
cagtcgtgagccaccttgcctg

SEQ ID NO: 795284 - DNA, 22 bp, Artificial Sequence
  chemically synthesized
aaagatatacacacagccaggc

SEQ ID NO: 795285 - DNA, 22 bp, Artificial Sequence
  chemically synthesized
acattaaaagatatacacacag

SEQ ID NO: 795286 - DNA, 22 bp, Artificial Sequence
  chemically synthesized
aacattaaaagatatacacaca

SEQ ID NO: 795287 - DNA, 22 bp, Artificial Sequence
  chemically synthesized
gcctggctgtgtgtatatcttt

SEQ ID NO: 795288 - DNA, 22 bp, Artificial Sequence
  chemically synthesized
cctggctgtgtgtatatctttt

SEQ ID NO: 795289 - DNA, 22 bp, Artificial Sequence
  chemically synthesized
taaaagtttaacattaaaagat

SEQ ID NO: 795290 - DNA, 22 bp, Artificial Sequence
  chemically synthesized
gctgtgtgtatatcttttaatg

SEQ ID NO: 795291 - DNA, 22 bp, Artificial Sequence
  chemically synthesized
ctgtaaaagtttaacattaaaa

SEQ ID NO: 795292 - DNA, 22 bp, Artificial Sequence
  chemically synthesized
tgtgtatatcttttaatgttaa

SEQ ID NO: 795293 - DNA, 22 bp, Artificial Sequence
  chemically synthesized
tactgtaaaagtttaacattaa

SEQ ID NO: 795294 - DNA, 22 bp, Artificial Sequence
  chemically synthesized
ctactgtaaaagtttaacatta

SEQ ID NO: 795295 - DNA, 22 bp, Artificial Sequence
  chemically synthesized
ttaatgttaaacttttacagta

SEQ ID NO: 795296 - DNA, 22 bp, Artificial Sequence
  chemically synthesized
taatgttaaacttttacagtag

SEQ ID NO: 795297 - DNA, 22 bp, Artificial Sequence
  chemically synthesized
aatgttaaacttttacagtaga

SEQ ID NO: 795298 - DNA, 22 bp, Artificial Sequence
  chemically synthesized
atgttaaacttttacagtagaa

SEQ ID NO: 795299 - DNA, 22 bp, Artificial Sequence
  chemically synthesized
aacttttacagtagaaatactc

SEQ ID NO: 795300 - DNA, 22 bp, Artificial Sequence
  chemically synthesized
aaaagcaaatagtgagtatttc

SEQ ID NO: 795301 - DNA, 22 bp, Artificial Sequence
  chemically synthesized
ttacagtagaaatactcactat

SEQ ID NO: 795302 - DNA, 22 bp, Artificial Sequence
  chemically synthesized
tacagtagaaatactcactatt

SEQ ID NO: 795303 - DNA, 22 bp, Artificial Sequence
  chemically synthesized
acagtagaaatactcactattt

SEQ ID NO: 795304 - DNA, 22 bp, Artificial Sequence
  chemically synthesized
cagtagaaatactcactatttg

SEQ ID NO: 795305 - DNA, 22 bp, Artificial Sequence
  chemically synthesized
agagcaagcaattgaaaagcaa

SEQ ID NO: 795306 - DNA, 22 bp, Artificial Sequence
  chemically synthesized
cagagcaagcaattgaaaagca

SEQ ID NO: 795307 - DNA, 22 bp, Artificial Sequence
  chemically synthesized
ttcagagcaagcaattgaaaag

SEQ ID NO: 795308 - DNA, 22 bp, Artificial Sequence
  chemically synthesized
actatttgcttttcaattgctt

SEQ ID NO: 795309 - DNA, 22 bp, Artificial Sequence
  chemically synthesized
tgctcttcagagcaagcaattg

SEQ ID NO: 795310 - DNA, 22 bp, Artificial Sequence
  chemically synthesized
tttgcttttcaattgcttgctc

SEQ ID NO: 795311 - DNA, 22 bp, Artificial Sequence
  chemically synthesized
gcttttcaattgcttgctctga

SEQ ID NO: 795312 - DNA, 22 bp, Artificial Sequence
  chemically synthesized
cttttcaattgcttgctctgaa

SEQ ID NO: 795313 - DNA, 22 bp, Artificial Sequence
  chemically synthesized
ttcaattgcttgctctgaagag

SEQ ID NO: 795314 - DNA, 22 bp, Artificial Sequence
  chemically synthesized
tcaattgcttgctctgaagagc

SEQ ID NO: 795315 - DNA, 22 bp, Artificial Sequence
  chemically synthesized
caattgcttgctctgaagagca

SEQ ID NO: 795316 - DNA, 22 bp, Artificial Sequence
  chemically synthesized
agtaaagcattgtgctcttcag

SEQ ID NO: 795317 - DNA, 22 bp, Artificial Sequence
  chemically synthesized
aattgcttgctctgaagagcac

SEQ ID NO: 795318 - DNA, 22 bp, Artificial Sequence
  chemically synthesized
ttcagtaaagcattgtgctctt

SEQ ID NO: 795319 - DNA, 22 bp, Artificial Sequence
  chemically synthesized
tgttcagtaaagcattgtgctc

SEQ ID NO: 795320 - DNA, 22 bp, Artificial Sequence
  chemically synthesized
cttgctctgaagagcacaatgc

SEQ ID NO: 795321 - DNA, 22 bp, Artificial Sequence
  chemically synthesized
gctctgaagagcacaatgcttt

SEQ ID NO: 795322 - DNA, 22 bp, Artificial Sequence
  chemically synthesized
ctctgaagagcacaatgcttta

SEQ ID NO: 795323 - DNA, 22 bp, Artificial Sequence
  chemically synthesized
atctctgttcagtaaagcattg

SEQ ID NO: 795324 - DNA, 22 bp, Artificial Sequence
  chemically synthesized
gatctctgttcagtaaagcatt

SEQ ID NO: 795325 - DNA, 22 bp, Artificial Sequence
  chemically synthesized
tgatctctgttcagtaaagcat

SEQ ID NO: 795326 - DNA, 22 bp, Artificial Sequence
  chemically synthesized
tgaagagcacaatgctttactg

SEQ ID NO: 795327 - DNA, 22 bp, Artificial Sequence
  chemically synthesized
ttgatctctgttcagtaaagca

SEQ ID NO: 795328 - DNA, 22 bp, Artificial Sequence
  chemically synthesized
aagagcacaatgctttactgaa

SEQ ID NO: 795329 - DNA, 22 bp, Artificial Sequence
  chemically synthesized
ggtgggtttttgatctctgttc

SEQ ID NO: 795330 - DNA, 22 bp, Artificial Sequence
  chemically synthesized
actaggtgggtttttgatctct

SEQ ID NO: 795331 - DNA, 22 bp, Artificial Sequence
  chemically synthesized
aactaggtgggtttttgatctc

SEQ ID NO: 795332 - DNA, 22 bp, Artificial Sequence
  chemically synthesized
tactgaacagagatcaaaaacc

SEQ ID NO: 795333 - DNA, 22 bp, Artificial Sequence
  chemically synthesized
tttaactaggtgggtttttgat

SEQ ID NO: 795334 - DNA, 22 bp, Artificial Sequence
  chemically synthesized
actgaacagagatcaaaaaccc

SEQ ID NO: 795335 - DNA, 22 bp, Artificial Sequence
  chemically synthesized
ctgaacagagatcaaaaaccca

SEQ ID NO: 795336 - DNA, 22 bp, Artificial Sequence
  chemically synthesized
ctgtttaactaggtgggttttt

SEQ ID NO: 795337 - DNA, 22 bp, Artificial Sequence
  chemically synthesized
cctgtttaactaggtgggtttt

SEQ ID NO: 795338 - DNA, 22 bp, Artificial Sequence
  chemically synthesized
aacagagatcaaaaacccacct

SEQ ID NO: 795339 - DNA, 22 bp, Artificial Sequence
  chemically synthesized
tttcctgtttaactaggtgggt

SEQ ID NO: 795340 - DNA, 22 bp, Artificial Sequence
  chemically synthesized
atttcctgtttaactaggtggg

SEQ ID NO: 795341 - DNA, 22 bp, Artificial Sequence
  chemically synthesized
gtcttatttcctgtttaactag

SEQ ID NO: 795342 - DNA, 22 bp, Artificial Sequence
  chemically synthesized
ttagtcttatttcctgtttaac

SEQ ID NO: 795343 - DNA, 22 bp, Artificial Sequence
  chemically synthesized
attagtcttatttcctgtttaa

SEQ ID NO: 795344 - DNA, 22 bp, Artificial Sequence
  chemically synthesized
tattagtcttatttcctgttta

SEQ ID NO: 795345 - DNA, 22 bp, Artificial Sequence
  chemically synthesized
ttattagtcttatttcctgttt

SEQ ID NO: 795346 - DNA, 22 bp, Artificial Sequence
  chemically synthesized
aatatttttattagtcttattt

SEQ ID NO: 795347 - DNA, 22 bp, Artificial Sequence
  chemically synthesized
gttaaacaggaaataagactaa

SEQ ID NO: 795348 - DNA, 22 bp, Artificial Sequence
  chemically synthesized
aacaggaaataagactaataaa

SEQ ID NO: 795349 - DNA, 22 bp, Artificial Sequence
  chemically synthesized
aataagaccattaaatattttt

SEQ ID NO: 795350 - DNA, 22 bp, Artificial Sequence
  chemically synthesized
ttaaataagaccattaaatatt

SEQ ID NO: 795351 - DNA, 22 bp, Artificial Sequence
  chemically synthesized
tagttgttaaataagaccatta

SEQ ID NO: 795352 - DNA, 22 bp, Artificial Sequence
  chemically synthesized
ataaaaatatttaatggtctta

SEQ ID NO: 795353 - DNA, 22 bp, Artificial Sequence
  chemically synthesized
tatagttgttaaataagaccat

SEQ ID NO: 795354 - DNA, 22 bp, Artificial Sequence
  chemically synthesized
ttctatagttgttaaataagac

SEQ ID NO: 795355 - DNA, 22 bp, Artificial Sequence
  chemically synthesized
attctatagttgttaaataaga

SEQ ID NO: 795356 - DNA, 22 bp, Artificial Sequence
  chemically synthesized
tattctatagttgttaaataag

SEQ ID NO: 795357 - DNA, 22 bp, Artificial Sequence
  chemically synthesized
agttttattctatagttgttaa

SEQ ID NO: 795358 - DNA, 22 bp, Artificial Sequence
  chemically synthesized
aatggtcttatttaacaactat

SEQ ID NO: 795359 - DNA, 22 bp, Artificial Sequence
  chemically synthesized
cagttttattctatagttgtta

SEQ ID NO: 795360 - DNA, 22 bp, Artificial Sequence
  chemically synthesized
atggtcttatttaacaactata

SEQ ID NO: 795361 - DNA, 22 bp, Artificial Sequence
  chemically synthesized
tcagttttattctatagttgtt

SEQ ID NO: 795362 - DNA, 22 bp, Artificial Sequence
  chemically synthesized
ttttcagttttattctatagtt

SEQ ID NO: 795363 - DNA, 22 bp, Artificial Sequence
  chemically synthesized
atttaacaactatagaataaaa

SEQ ID NO: 795364 - DNA, 22 bp, Artificial Sequence
  chemically synthesized
tactgttttcagttttattcta

SEQ ID NO: 795365 - DNA, 22 bp, Artificial Sequence
  chemically synthesized
tttaacaactatagaataaaac

SEQ ID NO: 795366 - DNA, 22 bp, Artificial Sequence
  chemically synthesized
aacaactatagaataaaactga

SEQ ID NO: 795367 - DNA, 22 bp, Artificial Sequence
  chemically synthesized
actgtactgttttcagttttat

SEQ ID NO: 795368 - DNA, 22 bp, Artificial Sequence
  chemically synthesized
acaactatagaataaaactgaa

SEQ ID NO: 795369 - DNA, 22 bp, Artificial Sequence
  chemically synthesized
cactgtactgttttcagtttta

SEQ ID NO: 795370 - DNA, 22 bp, Artificial Sequence
  chemically synthesized
tttcactgtactgttttcagtt

SEQ ID NO: 795371 - DNA, 22 bp, Artificial Sequence
  chemically synthesized
atttcactgtactgttttcagt

SEQ ID NO: 795372 - DNA, 22 bp, Artificial Sequence
  chemically synthesized
tatttcactgtactgttttcag

SEQ ID NO: 795373 - DNA, 22 bp, Artificial Sequence
  chemically synthesized
tagaataaaactgaaaacagta

SEQ ID NO: 795374 - DNA, 22 bp, Artificial Sequence
  chemically synthesized
tttatttcactgtactgttttc

SEQ ID NO: 795375 - DNA, 22 bp, Artificial Sequence
  chemically synthesized
ctttatttcactgtactgtttt

SEQ ID NO: 795376 - DNA, 22 bp, Artificial Sequence
  chemically synthesized
tctttatttcactgtactgttt

SEQ ID NO: 795377 - DNA, 22 bp, Artificial Sequence
  chemically synthesized
aaaacagtacagtgaaataaag

SEQ ID NO: 795378 - DNA, 22 bp, Artificial Sequence
  chemically synthesized
gtacaaaggaattttctttatt

SEQ ID NO: 795379 - DNA, 22 bp, Artificial Sequence
  chemically synthesized
gtaccgatatcatgcagtgaca

SEQ ID NO: 795380 - DNA, 22 bp, Artificial Sequence
  chemically synthesized
ctttgtaccaatgtcactgcat

SEQ ID NO: 795381 - DNA, 22 bp, Artificial Sequence
  chemically synthesized
agtaccgatatcatgcagtgac

SEQ ID NO: 795382 - DNA, 22 bp, Artificial Sequence
  chemically synthesized
tgtaccaatgtcactgcatgat

SEQ ID NO: 795383 - DNA, 22 bp, Artificial Sequence
  chemically synthesized
tttagtaccgatatcatgcagt

SEQ ID NO: 795384 - DNA, 22 bp, Artificial Sequence
  chemically synthesized
gtaccaatgtcactgcatgata

SEQ ID NO: 795385 - DNA, 22 bp, Artificial Sequence
  chemically synthesized
gtttagtaccgatatcatgcag

SEQ ID NO: 795386 - DNA, 22 bp, Artificial Sequence
  chemically synthesized
taccaatgtcactgcatgatat

SEQ ID NO: 795387 - DNA, 22 bp, Artificial Sequence
  chemically synthesized
agaacaatttgtttagtaccga

SEQ ID NO: 795388 - DNA, 22 bp, Artificial Sequence
  chemically synthesized
ctgagaacaatttgtttagtac

SEQ ID NO: 795389 - DNA, 22 bp, Artificial Sequence
  chemically synthesized
catgatatcggtactaaacaaa

SEQ ID NO: 795390 - DNA, 22 bp, Artificial Sequence
  chemically synthesized
tagctcctgagaacaatttgtt

SEQ ID NO: 795391 - DNA, 22 bp, Artificial Sequence
  chemically synthesized
gtagctcctgagaacaatttgt

SEQ ID NO: 795392 - DNA, 22 bp, Artificial Sequence
  chemically synthesized
aatatgacttgtagctcctgag

SEQ ID NO: 795393 - DNA, 22 bp, Artificial Sequence
  chemically synthesized
aacaaattgttctcaggagcta

SEQ ID NO: 795394 - DNA, 22 bp, Artificial Sequence
  chemically synthesized
accacctgaatatgacttgtag

SEQ ID NO: 795395 - DNA, 22 bp, Artificial Sequence
  chemically synthesized
ttctcaggagctacaagtcata

SEQ ID NO: 795396 - DNA, 22 bp, Artificial Sequence
  chemically synthesized
tgaccacctgaatatgacttgt

SEQ ID NO: 795397 - DNA, 22 bp, Artificial Sequence
  chemically synthesized
ctgaccacctgaatatgacttg

SEQ ID NO: 795398 - DNA, 22 bp, Artificial Sequence
  chemically synthesized
tcaggagctacaagtcatattc

SEQ ID NO: 795399 - DNA, 22 bp, Artificial Sequence
  chemically synthesized
aggagctacaagtcatattcag

SEQ ID NO: 795400 - DNA, 22 bp, Artificial Sequence
  chemically synthesized
caagtcatattcaggtggtcag

SEQ ID NO: 795401 - DNA, 22 bp, Artificial Sequence
  chemically synthesized
tgtaaggtaaagtttctgacca

SEQ ID NO: 795402 - DNA, 22 bp, Artificial Sequence
  chemically synthesized
attgtgtaaggtaaagtttctg

SEQ ID NO: 795403 - DNA, 22 bp, Artificial Sequence
  chemically synthesized
tcattgtgtaaggtaaagtttc

SEQ ID NO: 795404 - DNA, 22 bp, Artificial Sequence
  chemically synthesized
ctcattgtgtaaggtaaagttt

SEQ ID NO: 795405 - DNA, 22 bp, Artificial Sequence
  chemically synthesized
aggtggtcagaaactttacctt

SEQ ID NO: 795406 - DNA, 22 bp, Artificial Sequence
  chemically synthesized
catttctcattgtgtaaggtaa

SEQ ID NO: 795407 - DNA, 22 bp, Artificial Sequence
  chemically synthesized
agatactacatttctcattgtg

SEQ ID NO: 795408 - DNA, 22 bp, Artificial Sequence
  chemically synthesized
cagatactacatttctcattgt

SEQ ID NO: 795409 - DNA, 22 bp, Artificial Sequence
  chemically synthesized
taccttacacaatgagaaatgt

SEQ ID NO: 795410 - DNA, 22 bp, Artificial Sequence
  chemically synthesized
accttacacaatgagaaatgta

SEQ ID NO: 795411 - DNA, 22 bp, Artificial Sequence
  chemically synthesized
ccttacacaatgagaaatgtag

SEQ ID NO: 795412 - DNA, 22 bp, Artificial Sequence
  chemically synthesized
cagatatttcagatactacatt

SEQ ID NO: 795413 - DNA, 22 bp, Artificial Sequence
  chemically synthesized
acacaatgagaaatgtagtatc

SEQ ID NO: 795414 - DNA, 22 bp, Artificial Sequence
  chemically synthesized
cacaatgagaaatgtagtatct

SEQ ID NO: 795415 - DNA, 22 bp, Artificial Sequence
  chemically synthesized
gttgcagatatttcagatacta

SEQ ID NO: 795416 - DNA, 22 bp, Artificial Sequence
  chemically synthesized
actagttgcagatatttcagat

SEQ ID NO: 795417 - DNA, 22 bp, Artificial Sequence
  chemically synthesized
aacctaactagttgcagatatt

SEQ ID NO: 795418 - DNA, 22 bp, Artificial Sequence
  chemically synthesized
aaacctaactagttgcagatat

SEQ ID NO: 795419 - DNA, 22 bp, Artificial Sequence
  chemically synthesized
ttaaacctaactagttgcagat

SEQ ID NO: 795420 - DNA, 22 bp, Artificial Sequence
  chemically synthesized
cttaaacctaactagttgcaga

SEQ ID NO: 795421 - DNA, 22 bp, Artificial Sequence
  chemically synthesized
tcttaaacctaactagttgcag

SEQ ID NO: 795422 - DNA, 22 bp, Artificial Sequence
  chemically synthesized
ttcttaaacctaactagttgca

SEQ ID NO: 795423 - DNA, 22 bp, Artificial Sequence
  chemically synthesized
ttttcttaaacctaactagttg

SEQ ID NO: 795424 - DNA, 22 bp, Artificial Sequence
  chemically synthesized
cttttcttaaacctaactagtt

SEQ ID NO: 795425 - DNA, 22 bp, Artificial Sequence
  chemically synthesized
tcttttcttaaacctaactagt

SEQ ID NO: 795426 - DNA, 22 bp, Artificial Sequence
  chemically synthesized
aaatatctgcaactagttaggt

SEQ ID NO: 795427 - DNA, 22 bp, Artificial Sequence
  chemically synthesized
caactagttaggtttaagaaaa

SEQ ID NO: 795428 - DNA, 22 bp, Artificial Sequence
  chemically synthesized
gttaggtttaagaaaagaaaac

SEQ ID NO: 795429 - DNA, 22 bp, Artificial Sequence
  chemically synthesized
ccccaatggtaagagttttctt

SEQ ID NO: 795430 - DNA, 22 bp, Artificial Sequence
  chemically synthesized
cccccaatggtaagagttttct

SEQ ID NO: 795431 - DNA, 22 bp, Artificial Sequence
  chemically synthesized
ggtttaagaaaagaaaactctt

SEQ ID NO: 795432 - DNA, 22 bp, Artificial Sequence
  chemically synthesized
tcccccaatggtaagagttttc

SEQ ID NO: 795433 - DNA, 22 bp, Artificial Sequence
  chemically synthesized
ttttcccccaatggtaagagtt

SEQ ID NO: 795434 - DNA, 22 bp, Artificial Sequence
  chemically synthesized
attttcccccaatggtaagagt

SEQ ID NO: 795435 - DNA, 22 bp, Artificial Sequence
  chemically synthesized
aagaaaagaaaactcttaccat

SEQ ID NO: 795436 - DNA, 22 bp, Artificial Sequence
  chemically synthesized
agaaaagaaaactcttaccatt

SEQ ID NO: 795437 - DNA, 22 bp, Artificial Sequence
  chemically synthesized
aaaggatttattttcccccaat

SEQ ID NO: 795438 - DNA, 22 bp, Artificial Sequence
  chemically synthesized
taaaaggatttattttccccca

SEQ ID NO: 795439 - DNA, 22 bp, Artificial Sequence
  chemically synthesized
ctaaaaggatttattttccccc

SEQ ID NO: 795440 - DNA, 22 bp, Artificial Sequence
  chemically synthesized
tttctaaaaggatttattttcc

SEQ ID NO: 795441 - DNA, 22 bp, Artificial Sequence
  chemically synthesized
ttaccattgggggaaaataaat

SEQ ID NO: 795442 - DNA, 22 bp, Artificial Sequence
  chemically synthesized
accattgggggaaaataaatcc

SEQ ID NO: 795443 - DNA, 22 bp, Artificial Sequence
  chemically synthesized
ccattgggggaaaataaatcct

SEQ ID NO: 795444 - DNA, 22 bp, Artificial Sequence
  chemically synthesized
aatcctatttctaaaaggattt

SEQ ID NO: 795445 - DNA, 22 bp, Artificial Sequence
  chemically synthesized
ggggaaaataaatccttttaga

SEQ ID NO: 795446 - DNA, 22 bp, Artificial Sequence
  chemically synthesized
acagttcaatcctatttctaaa

SEQ ID NO: 795447 - DNA, 22 bp, Artificial Sequence
  chemically synthesized
ttgacagttcaatcctatttct

SEQ ID NO: 795448 - DNA, 22 bp, Artificial Sequence
  chemically synthesized
attgacagttcaatcctatttc

SEQ ID NO: 795449 - DNA, 22 bp, Artificial Sequence
  chemically synthesized
tattgacagttcaatcctattt

SEQ ID NO: 795450 - DNA, 22 bp, Artificial Sequence
  chemically synthesized
ttagaaataggattgaactgtc

SEQ ID NO: 795451 - DNA, 22 bp, Artificial Sequence
  chemically synthesized
tagaaataggattgaactgtca

SEQ ID NO: 795452 - DNA, 22 bp, Artificial Sequence
  chemically synthesized
agaaataggattgaactgtcaa

SEQ ID NO: 795453 - DNA, 22 bp, Artificial Sequence
  chemically synthesized
taaacagctttattgacagttc

SEQ ID NO: 795454 - DNA, 22 bp, Artificial Sequence
  chemically synthesized
gaaataggattgaactgtcaat

SEQ ID NO: 795455 - DNA, 22 bp, Artificial Sequence
  chemically synthesized
ttataaacagctttattgacag

SEQ ID NO: 795456 - DNA, 22 bp, Artificial Sequence
  chemically synthesized
attataaacagctttattgaca

SEQ ID NO: 795457 - DNA, 22 bp, Artificial Sequence
  chemically synthesized
aactgtcaataaagctgtttat

SEQ ID NO: 795458 - DNA, 22 bp, Artificial Sequence
  chemically synthesized
taagaatttattataaacagct

SEQ ID NO: 795459 - DNA, 22 bp, Artificial Sequence
  chemically synthesized
ataagaatttattataaacagc

SEQ ID NO: 795460 - DNA, 22 bp, Artificial Sequence
  chemically synthesized
tataagaatttattataaacag

SEQ ID NO: 795461 - DNA, 22 bp, Artificial Sequence
  chemically synthesized
tcaataaagctgtttataataa

SEQ ID NO: 795462 - DNA, 22 bp, Artificial Sequence
  chemically synthesized
aactttataagaatttattata

SEQ ID NO: 795463 - DNA, 22 bp, Artificial Sequence
  chemically synthesized
atgttaaactttataagaattt

SEQ ID NO: 795464 - DNA, 22 bp, Artificial Sequence
  chemically synthesized
catgttaaactttataagaatt

SEQ ID NO: 795465 - DNA, 22 bp, Artificial Sequence
  chemically synthesized
tcatgttaaactttataagaat

SEQ ID NO: 795466 - DNA, 22 bp, Artificial Sequence
  chemically synthesized
tttataataaattcttataaag

SEQ ID NO: 795467 - DNA, 22 bp, Artificial Sequence
  chemically synthesized
ataataaattcttataaagttt

SEQ ID NO: 795468 - DNA, 22 bp, Artificial Sequence
  chemically synthesized
taataaattcttataaagttta

SEQ ID NO: 795469 - DNA, 22 bp, Artificial Sequence
  chemically synthesized
cagtcctttcatgttaaacttt

SEQ ID NO: 795470 - DNA, 22 bp, Artificial Sequence
  chemically synthesized
acagtcctttcatgttaaactt

SEQ ID NO: 795471 - DNA, 22 bp, Artificial Sequence
  chemically synthesized
tacagtcctttcatgttaaact

SEQ ID NO: 795472 - DNA, 22 bp, Artificial Sequence
  chemically synthesized
ttacagtcctttcatgttaaac

SEQ ID NO: 795473 - DNA, 22 bp, Artificial Sequence
  chemically synthesized
tttttacagtcctttcatgtta

SEQ ID NO: 795474 - DNA, 22 bp, Artificial Sequence
  chemically synthesized
ttataaagtttaacatgaaagg

SEQ ID NO: 795475 - DNA, 22 bp, Artificial Sequence
  chemically synthesized
ataaagtttaacatgaaaggac

SEQ ID NO: 795476 - DNA, 22 bp, Artificial Sequence
  chemically synthesized
taaagtttaacatgaaaggact

SEQ ID NO: 795477 - DNA, 22 bp, Artificial Sequence
  chemically synthesized
aataacatctgtttttacagtc

SEQ ID NO: 795478 - DNA, 22 bp, Artificial Sequence
  chemically synthesized
gaataacatctgtttttacagt

SEQ ID NO: 795479 - DNA, 22 bp, Artificial Sequence
  chemically synthesized
aacatgaaaggactgtaaaaac

SEQ ID NO: 795480 - DNA, 22 bp, Artificial Sequence
  chemically synthesized
tgaataacatctgtttttacag

SEQ ID NO: 795481 - DNA, 22 bp, Artificial Sequence
  chemically synthesized
acatgaaaggactgtaaaaaca

SEQ ID NO: 795482 - DNA, 22 bp, Artificial Sequence
  chemically synthesized
ttgaataacatctgtttttaca

SEQ ID NO: 795483 - DNA, 22 bp, Artificial Sequence
  chemically synthesized
ttttgaataacatctgttttta

SEQ ID NO: 795484 - DNA, 22 bp, Artificial Sequence
  chemically synthesized
cttttgaataacatctgttttt

SEQ ID NO: 795485 - DNA, 22 bp, Artificial Sequence
  chemically synthesized
tcttttgaataacatctgtttt

SEQ ID NO: 795486 - DNA, 22 bp, Artificial Sequence
  chemically synthesized
taaaaacagatgttattcaaaa

SEQ ID NO: 795487 - DNA, 22 bp, Artificial Sequence
  chemically synthesized
ttcaaaagaaaatcacatctga

SEQ ID NO: 795488 - DNA, 22 bp, Artificial Sequence
  chemically synthesized
tagcaataaaaatcagatgtga

SEQ ID NO: 795489 - DNA, 22 bp, Artificial Sequence
  chemically synthesized
aaaagaaaatcacatctgattt

SEQ ID NO: 795490 - DNA, 22 bp, Artificial Sequence
  chemically synthesized
atttttattgctacagcctctc

SEQ ID NO: 795491 - DNA, 22 bp, Artificial Sequence
  chemically synthesized
ttattgctacagcctctcactg

SEQ ID NO: 795492 - DNA, 22 bp, Artificial Sequence
  chemically synthesized
tattgctacagcctctcactga

SEQ ID NO: 795493 - DNA, 22 bp, Artificial Sequence
  chemically synthesized
attgctacagcctctcactgac

SEQ ID NO: 795494 - DNA, 22 bp, Artificial Sequence
  chemically synthesized
ttgctacagcctctcactgact

SEQ ID NO: 795495 - DNA, 22 bp, Artificial Sequence
  chemically synthesized
ctacagcctctcactgactttt

SEQ ID NO: 795496 - DNA, 22 bp, Artificial Sequence
  chemically synthesized
cagcctctcactgacttttgtc

SEQ ID NO: 795497 - DNA, 22 bp, Artificial Sequence
  chemically synthesized
catgaaaaatgagacaaaagtc

SEQ ID NO: 795498 - DNA, 22 bp, Artificial Sequence
  chemically synthesized
tcactgacttttgtctcatttt

SEQ ID NO: 795499 - DNA, 22 bp, Artificial Sequence
  chemically synthesized
aaagcctccatgaaaaatgaga

SEQ ID NO: 795500 - DNA, 22 bp, Artificial Sequence
  chemically synthesized
actgacttttgtctcatttttc

SEQ ID NO: 795501 - DNA, 22 bp, Artificial Sequence
  chemically synthesized
aaaagcctccatgaaaaatgag

SEQ ID NO: 795502 - DNA, 22 bp, Artificial Sequence
  chemically synthesized
acttttgtctcatttttcatgg

SEQ ID NO: 795503 - DNA, 22 bp, Artificial Sequence
  chemically synthesized
aaacttaaaagcctccatgaaa

SEQ ID NO: 795504 - DNA, 22 bp, Artificial Sequence
  chemically synthesized
ttgtctcatttttcatggaggc

SEQ ID NO: 795505 - DNA, 22 bp, Artificial Sequence
  chemically synthesized
tgtctcatttttcatggaggct

SEQ ID NO: 795506 - DNA, 22 bp, Artificial Sequence
  chemically synthesized
ttaaaacttaaaagcctccatg

SEQ ID NO: 795507 - DNA, 22 bp, Artificial Sequence
  chemically synthesized
gtctcatttttcatggaggctt

SEQ ID NO: 795508 - DNA, 22 bp, Artificial Sequence
  chemically synthesized
gttaaaacttaaaagcctccat

SEQ ID NO: 795509 - DNA, 22 bp, Artificial Sequence
  chemically synthesized
tctcatttttcatggaggcttt

SEQ ID NO: 795510 - DNA, 22 bp, Artificial Sequence
  chemically synthesized
tgttaaaacttaaaagcctcca

SEQ ID NO: 795511 - DNA, 22 bp, Artificial Sequence
  chemically synthesized
atttttcatggaggcttttaag

SEQ ID NO: 795512 - DNA, 22 bp, Artificial Sequence
  chemically synthesized
tattttgttaaaacttaaaagc

SEQ ID NO: 795513 - DNA, 22 bp, Artificial Sequence
  chemically synthesized
gtattttgttaaaacttaaaag

SEQ ID NO: 795514 - DNA, 22 bp, Artificial Sequence
  chemically synthesized
tgtattttgttaaaacttaaaa

SEQ ID NO: 795515 - DNA, 22 bp, Artificial Sequence
  chemically synthesized
ttcatggaggcttttaagtttt

SEQ ID NO: 795516 - DNA, 22 bp, Artificial Sequence
  chemically synthesized
tcatggaggcttttaagtttta

SEQ ID NO: 795517 - DNA, 22 bp, Artificial Sequence
  chemically synthesized
catggaggcttttaagttttaa

SEQ ID NO: 795518 - DNA, 22 bp, Artificial Sequence
  chemically synthesized
atggaggcttttaagttttaac

SEQ ID NO: 795519 - DNA, 22 bp, Artificial Sequence
  chemically synthesized
aattttgtattttgttaaaact

SEQ ID NO: 795520 - DNA, 22 bp, Artificial Sequence
  chemically synthesized
caattttgtattttgttaaaac

SEQ ID NO: 795521 - DNA, 22 bp, Artificial Sequence
  chemically synthesized
ttcaattttgtattttgttaaa

SEQ ID NO: 795522 - DNA, 22 bp, Artificial Sequence
  chemically synthesized
ttaagttttaacaaaatacaaa

SEQ ID NO: 795523 - DNA, 22 bp, Artificial Sequence
  chemically synthesized
taagttttaacaaaatacaaaa

SEQ ID NO: 795524 - DNA, 22 bp, Artificial Sequence
  chemically synthesized
aagttttaacaaaatacaaaat

SEQ ID NO: 795525 - DNA, 22 bp, Artificial Sequence
  chemically synthesized
aaaagctcttcaattttgtatt

SEQ ID NO: 795526 - DNA, 22 bp, Artificial Sequence
  chemically synthesized
agttttaacaaaatacaaaatt

SEQ ID NO: 795527 - DNA, 22 bp, Artificial Sequence
  chemically synthesized
aaaaagctcttcaattttgtat

SEQ ID NO: 795528 - DNA, 22 bp, Artificial Sequence
  chemically synthesized
taaaaagctcttcaattttgta

SEQ ID NO: 795529 - DNA, 22 bp, Artificial Sequence
  chemically synthesized
ttaaaaagctcttcaattttgt

SEQ ID NO: 795530 - DNA, 22 bp, Artificial Sequence
  chemically synthesized
ttttaaaaagctcttcaatttt

SEQ ID NO: 795531 - DNA, 22 bp, Artificial Sequence
  chemically synthesized
taacaaaatacaaaattgaaga

SEQ ID NO: 795532 - DNA, 22 bp, Artificial Sequence
  chemically synthesized
cttttaaaaagctcttcaattt

SEQ ID NO: 795533 - DNA, 22 bp, Artificial Sequence
  chemically synthesized
aacaaaatacaaaattgaagag

SEQ ID NO: 795534 - DNA, 22 bp, Artificial Sequence
  chemically synthesized
acaaaatacaaaattgaagagc

SEQ ID NO: 795535 - DNA, 22 bp, Artificial Sequence
  chemically synthesized
ttcttttaaaaagctcttcaat

SEQ ID NO: 795536 - DNA, 22 bp, Artificial Sequence
  chemically synthesized
aagagctttttaaaagaagaga

SEQ ID NO: 795537 - DNA, 22 bp, Artificial Sequence
  chemically synthesized
tacatcgcataaatctcttctt

SEQ ID NO: 795538 - DNA, 22 bp, Artificial Sequence
  chemically synthesized
tatacatcgcataaatctcttc

SEQ ID NO: 795539 - DNA, 22 bp, Artificial Sequence
  chemically synthesized
ctatacatcgcataaatctctt

SEQ ID NO: 795540 - DNA, 22 bp, Artificial Sequence
  chemically synthesized
tctatacatcgcataaatctct

SEQ ID NO: 795541 - DNA, 22 bp, Artificial Sequence
  chemically synthesized
tttaaaagaagagatttatgcg

SEQ ID NO: 795542 - DNA, 22 bp, Artificial Sequence
  chemically synthesized
ttaaaagaagagatttatgcga

SEQ ID NO: 795543 - DNA, 22 bp, Artificial Sequence
  chemically synthesized
taaaagaagagatttatgcgat

SEQ ID NO: 795544 - DNA, 22 bp, Artificial Sequence
  chemically synthesized
aaaagaagagatttatgcgatg

SEQ ID NO: 795545 - DNA, 22 bp, Artificial Sequence
  chemically synthesized
aaagaagagatttatgcgatgt

SEQ ID NO: 795546 - DNA, 22 bp, Artificial Sequence
  chemically synthesized
cagaaaatctttctatacatcg

SEQ ID NO: 795547 - DNA, 22 bp, Artificial Sequence
  chemically synthesized
taactccagaaaatctttctat

SEQ ID NO: 795548 - DNA, 22 bp, Artificial Sequence
  chemically synthesized
ataactccagaaaatctttcta

SEQ ID NO: 795549 - DNA, 22 bp, Artificial Sequence
  chemically synthesized
tataactccagaaaatctttct

SEQ ID NO: 795550 - DNA, 22 bp, Artificial Sequence
  chemically synthesized
atgcgatgtatagaaagatttt

SEQ ID NO: 795551 - DNA, 22 bp, Artificial Sequence
  chemically synthesized
tgcgatgtatagaaagattttc

SEQ ID NO: 795552 - DNA, 22 bp, Artificial Sequence
  chemically synthesized
gtgatcaggattttataactcc

SEQ ID NO: 795553 - DNA, 22 bp, Artificial Sequence
  chemically synthesized
tctggagttataaaatcctgat

SEQ ID NO: 795554 - DNA, 22 bp, Artificial Sequence
  chemically synthesized
ctggagttataaaatcctgatc

SEQ ID NO: 795555 - DNA, 22 bp, Artificial Sequence
  chemically synthesized
agtatatctggtgatcaggatt

SEQ ID NO: 795556 - DNA, 22 bp, Artificial Sequence
  chemically synthesized
tggagttataaaatcctgatca

SEQ ID NO: 795557 - DNA, 22 bp, Artificial Sequence
  chemically synthesized
gagttataaaatcctgatcacc

SEQ ID NO: 795558 - DNA, 22 bp, Artificial Sequence
  chemically synthesized
ctaagtatatctggtgatcagg

SEQ ID NO: 795559 - DNA, 22 bp, Artificial Sequence
  chemically synthesized
cctaagtatatctggtgatcag

SEQ ID NO: 795560 - DNA, 22 bp, Artificial Sequence
  chemically synthesized
taaaatcctgatcaccagatat

SEQ ID NO: 795561 - DNA, 22 bp, Artificial Sequence
  chemically synthesized
atcatttcctaagtatatctgg

SEQ ID NO: 795562 - DNA, 22 bp, Artificial Sequence
  chemically synthesized
aatcatttcctaagtatatctg

SEQ ID NO: 795563 - DNA, 22 bp, Artificial Sequence
  chemically synthesized
ttaatcatttcctaagtatatc

SEQ ID NO: 795564 - DNA, 22 bp, Artificial Sequence
  chemically synthesized
cttaatcatttcctaagtatat

SEQ ID NO: 795565 - DNA, 22 bp, Artificial Sequence
  chemically synthesized
atcaccagatatacttaggaaa

SEQ ID NO: 795566 - DNA, 22 bp, Artificial Sequence
  chemically synthesized
agccttcttaatcatttcctaa

SEQ ID NO: 795567 - DNA, 22 bp, Artificial Sequence
  chemically synthesized
ccattcagccttcttaatcatt

SEQ ID NO: 795568 - DNA, 22 bp, Artificial Sequence
  chemically synthesized
accattcagccttcttaatcat

SEQ ID NO: 795569 - DNA, 22 bp, Artificial Sequence
  chemically synthesized
tgtttaccattcagccttctta

SEQ ID NO: 795570 - DNA, 22 bp, Artificial Sequence
  chemically synthesized
aggaaatgattaagaaggctga

SEQ ID NO: 795571 - DNA, 22 bp, Artificial Sequence
  chemically synthesized
ggaaatgattaagaaggctgaa

SEQ ID NO: 795572 - DNA, 22 bp, Artificial Sequence
  chemically synthesized
gagtctatgtttaccattcagc

SEQ ID NO: 795573 - DNA, 22 bp, Artificial Sequence
  chemically synthesized
tagagtctatgtttaccattca

SEQ ID NO: 795574 - DNA, 22 bp, Artificial Sequence
  chemically synthesized
ctagagtctatgtttaccattc

SEQ ID NO: 795575 - DNA, 22 bp, Artificial Sequence
  chemically synthesized
agaaggctgaatggtaaacata

SEQ ID NO: 795576 - DNA, 22 bp, Artificial Sequence
  chemically synthesized
catttctagagtctatgtttac

SEQ ID NO: 795577 - DNA, 22 bp, Artificial Sequence
  chemically synthesized
aatggtaaacatagactctaga

SEQ ID NO: 795578 - DNA, 22 bp, Artificial Sequence
  chemically synthesized
aaagaagagagaaaatgataat

SEQ ID NO: 795579 - DNA, 22 bp, Artificial Sequence
  chemically synthesized
tagaaatgtaattatcattttc

SEQ ID NO: 795580 - DNA, 22 bp, Artificial Sequence
  chemically synthesized
gaaatgtaattatcattttctc

SEQ ID NO: 795581 - DNA, 22 bp, Artificial Sequence
  chemically synthesized
ataattaaaagaagagagaaaa

SEQ ID NO: 795582 - DNA, 22 bp, Artificial Sequence
  chemically synthesized
aataattaaaagaagagagaaa

SEQ ID NO: 795583 - DNA, 22 bp, Artificial Sequence
  chemically synthesized
taataattaaaagaagagagaa

SEQ ID NO: 795584 - DNA, 22 bp, Artificial Sequence
  chemically synthesized
ttaataattaaaagaagagaga

SEQ ID NO: 795585 - DNA, 22 bp, Artificial Sequence
  chemically synthesized
tcattttctctcttcttttaat

SEQ ID NO: 795586 - DNA, 22 bp, Artificial Sequence
  chemically synthesized
tctctcttcttttaattattaa

SEQ ID NO: 795587 - DNA, 22 bp, Artificial Sequence
  chemically synthesized
aatgcaagatttttaataatta

SEQ ID NO: 795588 - DNA, 22 bp, Artificial Sequence
  chemically synthesized
ctctcttcttttaattattaaa

SEQ ID NO: 795589 - DNA, 22 bp, Artificial Sequence
  chemically synthesized
aaatgcaagatttttaataatt

SEQ ID NO: 795590 - DNA, 22 bp, Artificial Sequence
  chemically synthesized
tctcttcttttaattattaaaa

SEQ ID NO: 795591 - DNA, 22 bp, Artificial Sequence
  chemically synthesized
tcttcttttaattattaaaaat

SEQ ID NO: 795592 - DNA, 22 bp, Artificial Sequence
  chemically synthesized
ttcttttaattattaaaaatct

SEQ ID NO: 795593 - DNA, 22 bp, Artificial Sequence
  chemically synthesized
cttttaattattaaaaatcttg

SEQ ID NO: 795594 - DNA, 22 bp, Artificial Sequence
  chemically synthesized
agaccttaaatgcaagattttt

SEQ ID NO: 795595 - DNA, 22 bp, Artificial Sequence
  chemically synthesized
ttttaattattaaaaatcttgc

SEQ ID NO: 795596 - DNA, 22 bp, Artificial Sequence
  chemically synthesized
cagaccttaaatgcaagatttt

SEQ ID NO: 795597 - DNA, 22 bp, Artificial Sequence
  chemically synthesized
ttaattattaaaaatcttgcat

SEQ ID NO: 795598 - DNA, 22 bp, Artificial Sequence
  chemically synthesized
taattattaaaaatcttgcatt

SEQ ID NO: 795599 - DNA, 22 bp, Artificial Sequence
  chemically synthesized
aattattaaaaatcttgcattt

SEQ ID NO: 795600 - DNA, 22 bp, Artificial Sequence
  chemically synthesized
attattaaaaatcttgcattta

SEQ ID NO: 795601 - DNA, 22 bp, Artificial Sequence
  chemically synthesized
gcaaacttcagaccttaaatgc

SEQ ID NO: 795602 - DNA, 22 bp, Artificial Sequence
  chemically synthesized
ttaaaaatcttgcatttaaggt

SEQ ID NO: 795603 - DNA, 22 bp, Artificial Sequence
  chemically synthesized
aaaatcttgcatttaaggtctg

SEQ ID NO: 795604 - DNA, 22 bp, Artificial Sequence
  chemically synthesized
gtctggcaaacttcagacctta

SEQ ID NO: 795605 - DNA, 22 bp, Artificial Sequence
  chemically synthesized
gattagtctggcaaacttcaga

SEQ ID NO: 795606 - DNA, 22 bp, Artificial Sequence
  chemically synthesized
ggattagtctggcaaacttcag

SEQ ID NO: 795607 - DNA, 22 bp, Artificial Sequence
  chemically synthesized
gcatttaaggtctgaagtttgc

SEQ ID NO: 795608 - DNA, 22 bp, Artificial Sequence
  chemically synthesized
catttaaggtctgaagtttgcc

SEQ ID NO: 795609 - DNA, 22 bp, Artificial Sequence
  chemically synthesized
aaggtctgaagtttgccagact

SEQ ID NO: 795610 - DNA, 22 bp, Artificial Sequence
  chemically synthesized
aggtctgaagtttgccagacta

SEQ ID NO: 795611 - DNA, 22 bp, Artificial Sequence
  chemically synthesized
gtaaatttggattagtctggca

SEQ ID NO: 795612 - DNA, 22 bp, Artificial Sequence
  chemically synthesized
actagtaaatttggattagtct

SEQ ID NO: 795613 - DNA, 22 bp, Artificial Sequence
  chemically synthesized
tcactagtaaatttggattagt

SEQ ID NO: 795614 - DNA, 22 bp, Artificial Sequence
  chemically synthesized
aagtttgccagactaatccaaa

SEQ ID NO: 795615 - DNA, 22 bp, Artificial Sequence
  chemically synthesized
gccagactaatccaaatttact

SEQ ID NO: 795616 - DNA, 22 bp, Artificial Sequence
  chemically synthesized
ccagactaatccaaatttacta

SEQ ID NO: 795617 - DNA, 22 bp, Artificial Sequence
  chemically synthesized
aaggatgcctctcactagtaaa

SEQ ID NO: 795618 - DNA, 22 bp, Artificial Sequence
  chemically synthesized
atccaaatttactagtgagagg

SEQ ID NO: 795619 - DNA, 22 bp, Artificial Sequence
  chemically synthesized
aggagaattcaaggatgcctct

SEQ ID NO: 795620 - DNA, 22 bp, Artificial Sequence
  chemically synthesized
actagtgagaggcatccttgaa

SEQ ID NO: 795621 - DNA, 22 bp, Artificial Sequence
  chemically synthesized
ctagtgagaggcatccttgaat

SEQ ID NO: 795622 - DNA, 22 bp, Artificial Sequence
  chemically synthesized
gtgagaggcatccttgaattct

SEQ ID NO: 795623 - DNA, 22 bp, Artificial Sequence
  chemically synthesized
aacagattaaggagaattcaag

SEQ ID NO: 795624 - DNA, 22 bp, Artificial Sequence
  chemically synthesized
agtaactaaacagattaaggag

SEQ ID NO: 795625 - DNA, 22 bp, Artificial Sequence
  chemically synthesized
aagtaactaaacagattaagga

SEQ ID NO: 795626 - DNA, 22 bp, Artificial Sequence
  chemically synthesized
taagtaactaaacagattaagg

SEQ ID NO: 795627 - DNA, 22 bp, Artificial Sequence
  chemically synthesized
gaattctccttaatctgtttag

SEQ ID NO: 795628 - DNA, 22 bp, Artificial Sequence
  chemically synthesized
aattctccttaatctgtttagt

SEQ ID NO: 795629 - DNA, 22 bp, Artificial Sequence
  chemically synthesized
aacattttaagtaactaaacag

SEQ ID NO: 795630 - DNA, 22 bp, Artificial Sequence
  chemically synthesized
aaacattttaagtaactaaaca

SEQ ID NO: 795631 - DNA, 22 bp, Artificial Sequence
  chemically synthesized
tccttaatctgtttagttactt

SEQ ID NO: 795632 - DNA, 22 bp, Artificial Sequence
  chemically synthesized
cttaatctgtttagttacttaa

SEQ ID NO: 795633 - DNA, 22 bp, Artificial Sequence
  chemically synthesized
aatctgtttagttacttaaaat

SEQ ID NO: 795634 - DNA, 22 bp, Artificial Sequence
  chemically synthesized
atctgtttagttacttaaaatg

SEQ ID NO: 795635 - DNA, 22 bp, Artificial Sequence
  chemically synthesized
gaaagtcttaaacattttaagt

SEQ ID NO: 795636 - DNA, 22 bp, Artificial Sequence
  chemically synthesized
attagaaagtcttaaacatttt

SEQ ID NO: 795637 - DNA, 22 bp, Artificial Sequence
  chemically synthesized
tttagttacttaaaatgtttaa

SEQ ID NO: 795638 - DNA, 22 bp, Artificial Sequence
  chemically synthesized
gattagaaagtcttaaacattt

SEQ ID NO: 795639 - DNA, 22 bp, Artificial Sequence
  chemically synthesized
ttgattagaaagtcttaaacat

SEQ ID NO: 795640 - DNA, 22 bp, Artificial Sequence
  chemically synthesized
agttacttaaaatgtttaagac

SEQ ID NO: 795641 - DNA, 22 bp, Artificial Sequence
  chemically synthesized
gttacttaaaatgtttaagact

SEQ ID NO: 795642 - DNA, 22 bp, Artificial Sequence
  chemically synthesized
tcttgattagaaagtcttaaac

SEQ ID NO: 795643 - DNA, 22 bp, Artificial Sequence
  chemically synthesized
ctcttgattagaaagtcttaaa

SEQ ID NO: 795644 - DNA, 22 bp, Artificial Sequence
  chemically synthesized
cttaaaatgtttaagactttct

SEQ ID NO: 795645 - DNA, 22 bp, Artificial Sequence
  chemically synthesized
aaaatgtttaagactttctaat

SEQ ID NO: 795646 - DNA, 22 bp, Artificial Sequence
  chemically synthesized
aaatgtttaagactttctaatc

SEQ ID NO: 795647 - DNA, 22 bp, Artificial Sequence
  chemically synthesized
taggcttctcttgattagaaag

SEQ ID NO: 795648 - DNA, 22 bp, Artificial Sequence
  chemically synthesized
gagactgtaggcttctcttgat

SEQ ID NO: 795649 - DNA, 22 bp, Artificial Sequence
  chemically synthesized
aagactttctaatcaagagaag

SEQ ID NO: 795650 - DNA, 22 bp, Artificial Sequence
  chemically synthesized
cgagactgtaggcttctcttga

SEQ ID NO: 795651 - DNA, 22 bp, Artificial Sequence
  chemically synthesized
agactttctaatcaagagaagc

SEQ ID NO: 795652 - DNA, 22 bp, Artificial Sequence
  chemically synthesized
tgccttcgagactgtaggcttc

SEQ ID NO: 795653 - DNA, 22 bp, Artificial Sequence
  chemically synthesized
tctaatcaagagaagcctacag

SEQ ID NO: 795654 - DNA, 22 bp, Artificial Sequence
  chemically synthesized
ctaatcaagagaagcctacagt

SEQ ID NO: 795655 - DNA, 22 bp, Artificial Sequence
  chemically synthesized
taatcaagagaagcctacagtc

SEQ ID NO: 795656 - DNA, 22 bp, Artificial Sequence
  chemically synthesized
atcaagagaagcctacagtctc

SEQ ID NO: 795657 - DNA, 22 bp, Artificial Sequence
  chemically synthesized
ggagagaacattatgccttcga

SEQ ID NO: 795658 - DNA, 22 bp, Artificial Sequence
  chemically synthesized
cggagagaacattatgccttcg

SEQ ID NO: 795659 - DNA, 22 bp, Artificial Sequence
  chemically synthesized
gtttcggagagaacattatgcc

SEQ ID NO: 795660 - DNA, 22 bp, Artificial Sequence
  chemically synthesized
cagtctcgaaggcataatgttc

SEQ ID NO: 795661 - DNA, 22 bp, Artificial Sequence
  chemically synthesized
aattggtttcggagagaacatt

SEQ ID NO: 795662 - DNA, 22 bp, Artificial Sequence
  chemically synthesized
gaaggcataatgttctctccga

SEQ ID NO: 795663 - DNA, 22 bp, Artificial Sequence
  chemically synthesized
aagttaaattggtttcggagag

SEQ ID NO: 795664 - DNA, 22 bp, Artificial Sequence
  chemically synthesized
aataacctaaagttaaattggt

SEQ ID NO: 795665 - DNA, 22 bp, Artificial Sequence
  chemically synthesized
tctccgaaaccaatttaacttt

SEQ ID NO: 795666 - DNA, 22 bp, Artificial Sequence
  chemically synthesized
tccgaaaccaatttaactttag

SEQ ID NO: 795667 - DNA, 22 bp, Artificial Sequence
  chemically synthesized
caattaaataacctaaagttaa

SEQ ID NO: 795668 - DNA, 22 bp, Artificial Sequence
  chemically synthesized
cgaaaccaatttaactttaggt

SEQ ID NO: 795669 - DNA, 22 bp, Artificial Sequence
  chemically synthesized
gagttccaattaaataacctaa

SEQ ID NO: 795670 - DNA, 22 bp, Artificial Sequence
  chemically synthesized
ggagttccaattaaataaccta

SEQ ID NO: 795671 - DNA, 22 bp, Artificial Sequence
  chemically synthesized
tggagttccaattaaataacct

SEQ ID NO: 795672 - DNA, 22 bp, Artificial Sequence
  chemically synthesized
tttggagttccaattaaataac

SEQ ID NO: 795673 - DNA, 22 bp, Artificial Sequence
  chemically synthesized
aactttaggttatttaattgga

SEQ ID NO: 795674 - DNA, 22 bp, Artificial Sequence
  chemically synthesized
attctttggagttccaattaaa

SEQ ID NO: 795675 - DNA, 22 bp, Artificial Sequence
  chemically synthesized
actttaggttatttaattggaa

SEQ ID NO: 795676 - DNA, 22 bp, Artificial Sequence
  chemically synthesized
taattctttggagttccaatta

SEQ ID NO: 795677 - DNA, 22 bp, Artificial Sequence
  chemically synthesized
ctaattctttggagttccaatt

SEQ ID NO: 795678 - DNA, 22 bp, Artificial Sequence
  chemically synthesized
taggttatttaattggaactcc

SEQ ID NO: 795679 - DNA, 22 bp, Artificial Sequence
  chemically synthesized
aggttatttaattggaactcca

SEQ ID NO: 795680 - DNA, 22 bp, Artificial Sequence
  chemically synthesized
ggttatttaattggaactccaa

SEQ ID NO: 795681 - DNA, 22 bp, Artificial Sequence
  chemically synthesized
tttaattggaactccaaagaat

SEQ ID NO: 795682 - DNA, 22 bp, Artificial Sequence
  chemically synthesized
aattggaactccaaagaattag

SEQ ID NO: 795683 - DNA, 22 bp, Artificial Sequence
  chemically synthesized
attggaactccaaagaattaga

SEQ ID NO: 795684 - DNA, 22 bp, Artificial Sequence
  chemically synthesized
gaactccaaagaattagaagtt

SEQ ID NO: 795685 - DNA, 22 bp, Artificial Sequence
  chemically synthesized
caaagaattagaagttcattct

SEQ ID NO: 795686 - DNA, 22 bp, Artificial Sequence
  chemically synthesized
tgaagaatgccaaggaaataga

SEQ ID NO: 795687 - DNA, 22 bp, Artificial Sequence
  chemically synthesized
gaagttcattctatttccttgg

SEQ ID NO: 795688 - DNA, 22 bp, Artificial Sequence
  chemically synthesized
attctatttccttggcattctt

SEQ ID NO: 795689 - DNA, 22 bp, Artificial Sequence
  chemically synthesized
tgccaggtgctgtgaagaatgc

SEQ ID NO: 795690 - DNA, 22 bp, Artificial Sequence
  chemically synthesized
tatttccttggcattcttcaca

SEQ ID NO: 795691 - DNA, 22 bp, Artificial Sequence
  chemically synthesized
tttccttggcattcttcacagc

SEQ ID NO: 795692 - DNA, 22 bp, Artificial Sequence
  chemically synthesized
acactgtgccaggtgctgtgaa

SEQ ID NO: 795693 - DNA, 22 bp, Artificial Sequence
  chemically synthesized
ccttggcattcttcacagcacc

SEQ ID NO: 795694 - DNA, 22 bp, Artificial Sequence
  chemically synthesized
aacactgtgccaggtgctgtga

SEQ ID NO: 795695 - DNA, 22 bp, Artificial Sequence
  chemically synthesized
cttggcattcttcacagcacct

SEQ ID NO: 795696 - DNA, 22 bp, Artificial Sequence
  chemically synthesized
ggcattcttcacagcacctggc

SEQ ID NO: 795697 - DNA, 22 bp, Artificial Sequence
  chemically synthesized
gcattcttcacagcacctggca

SEQ ID NO: 795698 - DNA, 22 bp, Artificial Sequence
  chemically synthesized
atatgtacttaacactgtgcca

SEQ ID NO: 795699 - DNA, 22 bp, Artificial Sequence
  chemically synthesized
ttcacagcacctggcacagtgt

SEQ ID NO: 795700 - DNA, 22 bp, Artificial Sequence
  chemically synthesized
cacagcacctggcacagtgtta

SEQ ID NO: 795701 - DNA, 22 bp, Artificial Sequence
  chemically synthesized
acagcacctggcacagtgttaa

SEQ ID NO: 795702 - DNA, 22 bp, Artificial Sequence
  chemically synthesized
agcatctaatatgtacttaaca

SEQ ID NO: 795703 - DNA, 22 bp, Artificial Sequence
  chemically synthesized
ttgagcatctaatatgtactta

SEQ ID NO: 795704 - DNA, 22 bp, Artificial Sequence
  chemically synthesized
attgagcatctaatatgtactt

SEQ ID NO: 795705 - DNA, 22 bp, Artificial Sequence
  chemically synthesized
gcacagtgttaagtacatatta

SEQ ID NO: 795706 - DNA, 22 bp, Artificial Sequence
  chemically synthesized
aaaaatatttattgagcatcta

SEQ ID NO: 795707 - DNA, 22 bp, Artificial Sequence
  chemically synthesized
caaaaatatttattgagcatct

SEQ ID NO: 795708 - DNA, 22 bp, Artificial Sequence
  chemically synthesized
agtacatattagatgctcaata

SEQ ID NO: 795709 - DNA, 22 bp, Artificial Sequence
  chemically synthesized
cttcaaaaatatttattgagca

SEQ ID NO: 795710 - DNA, 22 bp, Artificial Sequence
  chemically synthesized
actccttcaaaaatatttattg

SEQ ID NO: 795711 - DNA, 22 bp, Artificial Sequence
  chemically synthesized
gatgctcaataaatatttttga

SEQ ID NO: 795712 - DNA, 22 bp, Artificial Sequence
  chemically synthesized
agcaatgttcactccttcaaaa

SEQ ID NO: 795713 - DNA, 22 bp, Artificial Sequence
  chemically synthesized
aagcaatgttcactccttcaaa

SEQ ID NO: 795714 - DNA, 22 bp, Artificial Sequence
  chemically synthesized
aataaatatttttgaaggagtg

SEQ ID NO: 795715 - DNA, 22 bp, Artificial Sequence
  chemically synthesized
ttaagcaatgttcactccttca

SEQ ID NO: 795716 - DNA, 22 bp, Artificial Sequence
  chemically synthesized
cctcttaagcaatgttcactcc

SEQ ID NO: 795717 - DNA, 22 bp, Artificial Sequence
  chemically synthesized
ccctcttaagcaatgttcactc

SEQ ID NO: 795718 - DNA, 22 bp, Artificial Sequence
  chemically synthesized
tttccctcttaagcaatgttca

SEQ ID NO: 795719 - DNA, 22 bp, Artificial Sequence
  chemically synthesized
atttccctcttaagcaatgttc

SEQ ID NO: 795720 - DNA, 22 bp, Artificial Sequence
  chemically synthesized
ttgaaggagtgaacattgctta

SEQ ID NO: 795721 - DNA, 22 bp, Artificial Sequence
  chemically synthesized
ttatttccctcttaagcaatgt

SEQ ID NO: 795722 - DNA, 22 bp, Artificial Sequence
  chemically synthesized
tgaaggagtgaacattgcttaa

SEQ ID NO: 795723 - DNA, 22 bp, Artificial Sequence
  chemically synthesized
gaaggagtgaacattgcttaag

SEQ ID NO: 795724 - DNA, 22 bp, Artificial Sequence
  chemically synthesized
aaggagtgaacattgcttaaga

SEQ ID NO: 795725 - DNA, 22 bp, Artificial Sequence
  chemically synthesized
ctcttatttccctcttaagcaa

SEQ ID NO: 795726 - DNA, 22 bp, Artificial Sequence
  chemically synthesized
atagttcctcttatttccctct

SEQ ID NO: 795727 - DNA, 22 bp, Artificial Sequence
  chemically synthesized
aatagttcctcttatttccctc

SEQ ID NO: 795728 - DNA, 22 bp, Artificial Sequence
  chemically synthesized
tcttaatagttcctcttatttc

SEQ ID NO: 795729 - DNA, 22 bp, Artificial Sequence
  chemically synthesized
tatcttaatagttcctcttatt

SEQ ID NO: 795730 - DNA, 22 bp, Artificial Sequence
  chemically synthesized
cttaagagggaaataagaggaa

SEQ ID NO: 795731 - DNA, 22 bp, Artificial Sequence
  chemically synthesized
ctatcttaatagttcctcttat

SEQ ID NO: 795732 - DNA, 22 bp, Artificial Sequence
  chemically synthesized
aagagggaaataagaggaacta

SEQ ID NO: 795733 - DNA, 22 bp, Artificial Sequence
  chemically synthesized
agagggaaataagaggaactat

SEQ ID NO: 795734 - DNA, 22 bp, Artificial Sequence
  chemically synthesized
aatatcttctatcttaatagtt

SEQ ID NO: 795735 - DNA, 22 bp, Artificial Sequence
  chemically synthesized
aaatatcttctatcttaatagt

SEQ ID NO: 795736 - DNA, 22 bp, Artificial Sequence
  chemically synthesized
ggaatttaaatatcttctatct

SEQ ID NO: 795737 - DNA, 22 bp, Artificial Sequence
  chemically synthesized
aggaatttaaatatcttctatc

SEQ ID NO: 795738 - DNA, 22 bp, Artificial Sequence
  chemically synthesized
taggaatttaaatatcttctat

SEQ ID NO: 795739 - DNA, 22 bp, Artificial Sequence
  chemically synthesized
ttaagatagaagatatttaaat

SEQ ID NO: 795740 - DNA, 22 bp, Artificial Sequence
  chemically synthesized
agatagaagatatttaaattcc

SEQ ID NO: 795741 - DNA, 22 bp, Artificial Sequence
  chemically synthesized
catgaatagggaagaaataatt

SEQ ID NO: 795742 - DNA, 22 bp, Artificial Sequence
  chemically synthesized
aaattcctaaaattatttcttc

SEQ ID NO: 795743 - DNA, 22 bp, Artificial Sequence
  chemically synthesized
tccatgaatagggaagaaataa

SEQ ID NO: 795744 - DNA, 22 bp, Artificial Sequence
  chemically synthesized
aattcctaaaattatttcttcc

SEQ ID NO: 795745 - DNA, 22 bp, Artificial Sequence
  chemically synthesized
ctaaaattatttcttccctatt

SEQ ID NO: 795746 - DNA, 22 bp, Artificial Sequence
  chemically synthesized
aaattatttcttccctattcat

SEQ ID NO: 795747 - DNA, 22 bp, Artificial Sequence
  chemically synthesized
atcatatcctctccatgaatag

SEQ ID NO: 795748 - DNA, 22 bp, Artificial Sequence
  chemically synthesized
taatcatatcctctccatgaat

SEQ ID NO: 795749 - DNA, 22 bp, Artificial Sequence
  chemically synthesized
ctaatcatatcctctccatgaa

SEQ ID NO: 795750 - DNA, 22 bp, Artificial Sequence
  chemically synthesized
tttcttccctattcatggagag

SEQ ID NO: 795751 - DNA, 22 bp, Artificial Sequence
  chemically synthesized
tctaatcatatcctctccatga

SEQ ID NO: 795752 - DNA, 22 bp, Artificial Sequence
  chemically synthesized
cttccctattcatggagaggat

SEQ ID NO: 795753 - DNA, 22 bp, Artificial Sequence
  chemically synthesized
ttccctattcatggagaggata

SEQ ID NO: 795754 - DNA, 22 bp, Artificial Sequence
  chemically synthesized
tctttctaatcatatcctctcc

SEQ ID NO: 795755 - DNA, 22 bp, Artificial Sequence
  chemically synthesized
ccctattcatggagaggatatg

SEQ ID NO: 795756 - DNA, 22 bp, Artificial Sequence
  chemically synthesized
cctattcatggagaggatatga

SEQ ID NO: 795757 - DNA, 22 bp, Artificial Sequence
  chemically synthesized
ttcatggagaggatatgattag

SEQ ID NO: 795758 - DNA, 22 bp, Artificial Sequence
  chemically synthesized
atggagaggatatgattagaaa

SEQ ID NO: 795759 - DNA, 22 bp, Artificial Sequence
  chemically synthesized
tatacaattgtctttctaatca

SEQ ID NO: 795760 - DNA, 22 bp, Artificial Sequence
  chemically synthesized
aaactatatacaattgtctttc

SEQ ID NO: 795761 - DNA, 22 bp, Artificial Sequence
  chemically synthesized
ttaaaactatatacaattgtct

SEQ ID NO: 795762 - DNA, 22 bp, Artificial Sequence
  chemically synthesized
attaaaactatatacaattgtc

SEQ ID NO: 795763 - DNA, 22 bp, Artificial Sequence
  chemically synthesized
tattaaaactatatacaattgt

SEQ ID NO: 795764 - DNA, 22 bp, Artificial Sequence
  chemically synthesized
gaaagacaattgtatatagttt

SEQ ID NO: 795765 - DNA, 22 bp, Artificial Sequence
  chemically synthesized
tatatagttttaataaaatcta

SEQ ID NO: 795766 - DNA, 22 bp, Artificial Sequence
  chemically synthesized
aacaaaaccaaaataaatagat

SEQ ID NO: 795767 - DNA, 22 bp, Artificial Sequence
  chemically synthesized
taataaaatctatttattttgg

SEQ ID NO: 795768 - DNA, 22 bp, Artificial Sequence
  chemically synthesized
cattaaacaaaaccaaaataaa

SEQ ID NO: 795769 - DNA, 22 bp, Artificial Sequence
  chemically synthesized
aataaaatctatttattttggt

SEQ ID NO: 795770 - DNA, 22 bp, Artificial Sequence
  chemically synthesized
ataaaatctatttattttggtt

SEQ ID NO: 795771 - DNA, 22 bp, Artificial Sequence
  chemically synthesized
tggaattgcattaaacaaaacc

SEQ ID NO: 795772 - DNA, 22 bp, Artificial Sequence
  chemically synthesized
gtggaattgcattaaacaaaac

SEQ ID NO: 795773 - DNA, 22 bp, Artificial Sequence
  chemically synthesized
tttattttggttttgtttaatg

SEQ ID NO: 795774 - DNA, 22 bp, Artificial Sequence
  chemically synthesized
attttggttttgtttaatgcaa

SEQ ID NO: 795775 - DNA, 22 bp, Artificial Sequence
  chemically synthesized
ttttggttttgtttaatgcaat

SEQ ID NO: 795776 - DNA, 22 bp, Artificial Sequence
  chemically synthesized
tggttttgtttaatgcaattcc

SEQ ID NO: 795777 - DNA, 22 bp, Artificial Sequence
  chemically synthesized
ggttttgtttaatgcaattcca

SEQ ID NO: 795778 - DNA, 22 bp, Artificial Sequence
  chemically synthesized
agtaaaagcttgtggaattgca

SEQ ID NO: 795779 - DNA, 22 bp, Artificial Sequence
  chemically synthesized
gttttgtttaatgcaattccac

SEQ ID NO: 795780 - DNA, 22 bp, Artificial Sequence
  chemically synthesized
tgtttaatgcaattccacaagc

SEQ ID NO: 795781 - DNA, 22 bp, Artificial Sequence
  chemically synthesized
gtttaatgcaattccacaagct

SEQ ID NO: 795782 - DNA, 22 bp, Artificial Sequence
  chemically synthesized
tttaatgcaattccacaagctt

SEQ ID NO: 795783 - DNA, 22 bp, Artificial Sequence
  chemically synthesized
aatgcaattccacaagctttta

SEQ ID NO: 795784 - DNA, 22 bp, Artificial Sequence
  chemically synthesized
atgcaattccacaagcttttac

SEQ ID NO: 795785 - DNA, 22 bp, Artificial Sequence
  chemically synthesized
cacaagcttttactgagtttgc

SEQ ID NO: 795786 - DNA, 22 bp, Artificial Sequence
  chemically synthesized
agtgtcaagatagtgcaaactc

SEQ ID NO: 795787 - DNA, 22 bp, Artificial Sequence
  chemically synthesized
cagtgtcaagatagtgcaaact

SEQ ID NO: 795788 - DNA, 22 bp, Artificial Sequence
  chemically synthesized
ttactgagtttgcactatcttg

SEQ ID NO: 795789 - DNA, 22 bp, Artificial Sequence
  chemically synthesized
tactgagtttgcactatcttga

SEQ ID NO: 795790 - DNA, 22 bp, Artificial Sequence
  chemically synthesized
agcatttcagtgtcaagatagt

SEQ ID NO: 795791 - DNA, 22 bp, Artificial Sequence
  chemically synthesized
actgagtttgcactatcttgac

SEQ ID NO: 795792 - DNA, 22 bp, Artificial Sequence
  chemically synthesized
cagcatttcagtgtcaagatag

SEQ ID NO: 795793 - DNA, 22 bp, Artificial Sequence
  chemically synthesized
ctgagtttgcactatcttgaca

SEQ ID NO: 795794 - DNA, 22 bp, Artificial Sequence
  chemically synthesized
agtttgcactatcttgacactg

SEQ ID NO: 795795 - DNA, 22 bp, Artificial Sequence
  chemically synthesized
gcactatcttgacactgaaatg

SEQ ID NO: 795796 - DNA, 22 bp, Artificial Sequence
  chemically synthesized
aaatgtcttcagcatttcagtg

SEQ ID NO: 795797 - DNA, 22 bp, Artificial Sequence
  chemically synthesized
cactatcttgacactgaaatgc

SEQ ID NO: 795798 - DNA, 22 bp, Artificial Sequence
  chemically synthesized
aaaatgtcttcagcatttcagt

SEQ ID NO: 795799 - DNA, 22 bp, Artificial Sequence
  chemically synthesized
taaaatgtcttcagcatttcag

SEQ ID NO: 795800 - DNA, 22 bp, Artificial Sequence
  chemically synthesized
ttaaaatgtcttcagcatttca

SEQ ID NO: 795801 - DNA, 22 bp, Artificial Sequence
  chemically synthesized
tcttgacactgaaatgctgaag

SEQ ID NO: 795802 - DNA, 22 bp, Artificial Sequence
  chemically synthesized
taatttttaaaatgtcttcagc

SEQ ID NO: 795803 - DNA, 22 bp, Artificial Sequence
  chemically synthesized
gacactgaaatgctgaagacat

SEQ ID NO: 795804 - DNA, 22 bp, Artificial Sequence
  chemically synthesized
acactgaaatgctgaagacatt

SEQ ID NO: 795805 - DNA, 22 bp, Artificial Sequence
  chemically synthesized
tgtaatttttaaaatgtcttca

SEQ ID NO: 795806 - DNA, 22 bp, Artificial Sequence
  chemically synthesized
aaatgctgaagacattttaaaa

SEQ ID NO: 795807 - DNA, 22 bp, Artificial Sequence
  chemically synthesized
agtgattctgtaatttttaaaa

SEQ ID NO: 795808 - DNA, 22 bp, Artificial Sequence
  chemically synthesized
gagtgattctgtaatttttaaa

SEQ ID NO: 795809 - DNA, 22 bp, Artificial Sequence
  chemically synthesized
ttgagtgattctgtaattttta

SEQ ID NO: 795810 - DNA, 22 bp, Artificial Sequence
  chemically synthesized
cttgagtgattctgtaattttt

SEQ ID NO: 795811 - DNA, 22 bp, Artificial Sequence
  chemically synthesized
aagacattttaaaaattacaga

SEQ ID NO: 795812 - DNA, 22 bp, Artificial Sequence
  chemically synthesized
agcttcttgagtgattctgtaa

SEQ ID NO: 795813 - DNA, 22 bp, Artificial Sequence
  chemically synthesized
aagcttcttgagtgattctgta

SEQ ID NO: 795814 - DNA, 22 bp, Artificial Sequence
  chemically synthesized
taagcttcttgagtgattctgt

SEQ ID NO: 795815 - DNA, 22 bp, Artificial Sequence
  chemically synthesized
taaaaattacagaatcactcaa

SEQ ID NO: 795816 - DNA, 22 bp, Artificial Sequence
  chemically synthesized
aaaaattacagaatcactcaag

SEQ ID NO: 795817 - DNA, 22 bp, Artificial Sequence
  chemically synthesized
aactttaagcttcttgagtgat

SEQ ID NO: 795818 - DNA, 22 bp, Artificial Sequence
  chemically synthesized
aaaattacagaatcactcaaga

SEQ ID NO: 795819 - DNA, 22 bp, Artificial Sequence
  chemically synthesized
cagaatcactcaagaagcttaa

SEQ ID NO: 795820 - DNA, 22 bp, Artificial Sequence
  chemically synthesized
acacaccactaaactttaagct

SEQ ID NO: 795821 - DNA, 22 bp, Artificial Sequence
  chemically synthesized
caaattaacacaccactaaact

SEQ ID NO: 795822 - DNA, 22 bp, Artificial Sequence
  chemically synthesized
aagaagcttaaagtttagtggt

SEQ ID NO: 795823 - DNA, 22 bp, Artificial Sequence
  chemically synthesized
aaagtttagtggtgtgttaatt

SEQ ID NO: 795824 - DNA, 22 bp, Artificial Sequence
  chemically synthesized
aagtttagtggtgtgttaattt

SEQ ID NO: 795825 - DNA, 22 bp, Artificial Sequence
  chemically synthesized
agtggtgtgttaatttgcagat

SEQ ID NO: 795826 - DNA, 22 bp, Artificial Sequence
  chemically synthesized
gtggtgtgttaatttgcagatg

SEQ ID NO: 795827 - DNA, 22 bp, Artificial Sequence
  chemically synthesized
aaagcagaatcaaatcatctgc

SEQ ID NO: 795828 - DNA, 22 bp, Artificial Sequence
  chemically synthesized
atttgcagatgatttgattctg

SEQ ID NO: 795829 - DNA, 22 bp, Artificial Sequence
  chemically synthesized
aacaagttaaaagcagaatcaa

SEQ ID NO: 795830 - DNA, 22 bp, Artificial Sequence
  chemically synthesized
aaacaagttaaaagcagaatca

SEQ ID NO: 795831 - DNA, 22 bp, Artificial Sequence
  chemically synthesized
gcagatgatttgattctgcttt

SEQ ID NO: 795832 - DNA, 22 bp, Artificial Sequence
  chemically synthesized
cagatgatttgattctgctttt

SEQ ID NO: 795833 - DNA, 22 bp, Artificial Sequence
  chemically synthesized
tccttaaacaagttaaaagcag

SEQ ID NO: 795834 - DNA, 22 bp, Artificial Sequence
  chemically synthesized
gattctgcttttaacttgttta

SEQ ID NO: 795835 - DNA, 22 bp, Artificial Sequence
  chemically synthesized
attctgcttttaacttgtttaa

SEQ ID NO: 795836 - DNA, 22 bp, Artificial Sequence
  chemically synthesized
tgcttttaacttgtttaaggac

SEQ ID NO: 795837 - DNA, 22 bp, Artificial Sequence
  chemically synthesized
aacagagatcactgtccttaaa

SEQ ID NO: 795838 - DNA, 22 bp, Artificial Sequence
  chemically synthesized
cttttaacttgtttaaggacag

SEQ ID NO: 795839 - DNA, 22 bp, Artificial Sequence
  chemically synthesized
ttaacttgtttaaggacagtga

SEQ ID NO: 795840 - DNA, 22 bp, Artificial Sequence
  chemically synthesized
taacttgtttaaggacagtgat

SEQ ID NO: 795841 - DNA, 22 bp, Artificial Sequence
  chemically synthesized
aacttgtttaaggacagtgatc

SEQ ID NO: 795842 - DNA, 22 bp, Artificial Sequence
  chemically synthesized
acttgtttaaggacagtgatct

SEQ ID NO: 795843 - DNA, 22 bp, Artificial Sequence
  chemically synthesized
gtttaaggacagtgatctctgt

SEQ ID NO: 795844 - DNA, 22 bp, Artificial Sequence
  chemically synthesized
tttaaggacagtgatctctgtt

SEQ ID NO: 795845 - DNA, 22 bp, Artificial Sequence
  chemically synthesized
agtgtggcattaaacagagatc

SEQ ID NO: 795846 - DNA, 22 bp, Artificial Sequence
  chemically synthesized
cagtgtggcattaaacagagat

SEQ ID NO: 795847 - DNA, 22 bp, Artificial Sequence
  chemically synthesized
tcagtgtggcattaaacagaga

SEQ ID NO: 795848 - DNA, 22 bp, Artificial Sequence
  chemically synthesized
aaggacagtgatctctgtttaa

SEQ ID NO: 795849 - DNA, 22 bp, Artificial Sequence
  chemically synthesized
aggacagtgatctctgtttaat

SEQ ID NO: 795850 - DNA, 22 bp, Artificial Sequence
  chemically synthesized
tgtttaatgccacactgaaagt

SEQ ID NO: 795851 - DNA, 22 bp, Artificial Sequence
  chemically synthesized
tgaacacatagtactttcagtg

SEQ ID NO: 795852 - DNA, 22 bp, Artificial Sequence
  chemically synthesized
tttaatgccacactgaaagtac

SEQ ID NO: 795853 - DNA, 22 bp, Artificial Sequence
  chemically synthesized
ttatgaacacatagtactttca

SEQ ID NO: 795854 - DNA, 22 bp, Artificial Sequence
  chemically synthesized
attatgaacacatagtactttc

SEQ ID NO: 795855 - DNA, 22 bp, Artificial Sequence
  chemically synthesized
aatgccacactgaaagtactat

SEQ ID NO: 795856 - DNA, 22 bp, Artificial Sequence
  chemically synthesized
atgccacactgaaagtactatg

SEQ ID NO: 795857 - DNA, 22 bp, Artificial Sequence
  chemically synthesized
tttattatgaacacatagtact

SEQ ID NO: 795858 - DNA, 22 bp, Artificial Sequence
  chemically synthesized
agaaattgtttattatgaacac

SEQ ID NO: 795859 - DNA, 22 bp, Artificial Sequence
  chemically synthesized
aaagtactatgtgttcataata

SEQ ID NO: 795860 - DNA, 22 bp, Artificial Sequence
  chemically synthesized
tgtgttcataataaacaatttc

SEQ ID NO: 795861 - DNA, 22 bp, Artificial Sequence
  chemically synthesized
ataagatcattcagaaattgtt

SEQ ID NO: 795862 - DNA, 22 bp, Artificial Sequence
  chemically synthesized
ataataaacaatttctgaatga

SEQ ID NO: 795863 - DNA, 22 bp, Artificial Sequence
  chemically synthesized
atgagctcataagatcattcag

SEQ ID NO: 795864 - DNA, 22 bp, Artificial Sequence
  chemically synthesized
ctgaatgatcttatgagctcat

SEQ ID NO: 795865 - DNA, 22 bp, Artificial Sequence
  chemically synthesized
tgaatgatcttatgagctcatt

SEQ ID NO: 795866 - DNA, 22 bp, Artificial Sequence
  chemically synthesized
aatgatcttatgagctcattag

SEQ ID NO: 795867 - DNA, 22 bp, Artificial Sequence
  chemically synthesized
atgagctcattagtatgtctca

SEQ ID NO: 795868 - DNA, 22 bp, Artificial Sequence
  chemically synthesized
tgagctcattagtatgtctcat

SEQ ID NO: 795869 - DNA, 22 bp, Artificial Sequence
  chemically synthesized
aagcaataaaccacatgagaca

SEQ ID NO: 795870 - DNA, 22 bp, Artificial Sequence
  chemically synthesized
aaagcaataaaccacatgagac

SEQ ID NO: 795871 - DNA, 22 bp, Artificial Sequence
  chemically synthesized
taaagcaataaaccacatgaga

SEQ ID NO: 795872 - DNA, 22 bp, Artificial Sequence
  chemically synthesized
attagtatgtctcatgtggttt

SEQ ID NO: 795873 - DNA, 22 bp, Artificial Sequence
  chemically synthesized
gtatgtctcatgtggtttattg

SEQ ID NO: 795874 - DNA, 22 bp, Artificial Sequence
  chemically synthesized
tgagattttaaagcaataaacc

SEQ ID NO: 795875 - DNA, 22 bp, Artificial Sequence
  chemically synthesized
attatgagattttaaagcaata

SEQ ID NO: 795876 - DNA, 22 bp, Artificial Sequence
  chemically synthesized
atgtggtttattgctttaaaat

SEQ ID NO: 795877 - DNA, 22 bp, Artificial Sequence
  chemically synthesized
attgctttaaaatctcataatc

SEQ ID NO: 795878 - DNA, 22 bp, Artificial Sequence
  chemically synthesized
ttgctttaaaatctcataatca

SEQ ID NO: 795879 - DNA, 22 bp, Artificial Sequence
  chemically synthesized
ctttaaaatctcataatcaact

SEQ ID NO: 795880 - DNA, 22 bp, Artificial Sequence
  chemically synthesized
taaaatctcataatcaactatg

SEQ ID NO: 795881 - DNA, 22 bp, Artificial Sequence
  chemically synthesized
aaaatctcataatcaactatgg

SEQ ID NO: 795882 - DNA, 22 bp, Artificial Sequence
  chemically synthesized
aaatctcataatcaactatggt

SEQ ID NO: 795883 - DNA, 22 bp, Artificial Sequence
  chemically synthesized
gtgcagaaaaaaatgaccatag

SEQ ID NO: 795884 - DNA, 22 bp, Artificial Sequence
  chemically synthesized
tagtgcagaaaaaaatgaccat

SEQ ID NO: 795885 - DNA, 22 bp, Artificial Sequence
  chemically synthesized
ataatcaactatggtcattttt

SEQ ID NO: 795886 - DNA, 22 bp, Artificial Sequence
  chemically synthesized
cattctagtgcagaaaaaaatg

SEQ ID NO: 795887 - DNA, 22 bp, Artificial Sequence
  chemically synthesized
tggtcatttttttctgcactag

SEQ ID NO: 795888 - DNA, 22 bp, Artificial Sequence
  chemically synthesized
agtgacctacattctagtgcag

SEQ ID NO: 795889 - DNA, 22 bp, Artificial Sequence
  chemically synthesized
agctcagtgacctacattctag

SEQ ID NO: 795890 - DNA, 22 bp, Artificial Sequence
  chemically synthesized
gagctcagtgacctacattcta

SEQ ID NO: 795891 - DNA, 22 bp, Artificial Sequence
  chemically synthesized
ttttctgcactagaatgtaggt

SEQ ID NO: 795892 - DNA, 22 bp, Artificial Sequence
  chemically synthesized
tttctgcactagaatgtaggtc

SEQ ID NO: 795893 - DNA, 22 bp, Artificial Sequence
  chemically synthesized
ttctgcactagaatgtaggtca

SEQ ID NO: 795894 - DNA, 22 bp, Artificial Sequence
  chemically synthesized
tctgcactagaatgtaggtcac

SEQ ID NO: 795895 - DNA, 22 bp, Artificial Sequence
  chemically synthesized
ctgcactagaatgtaggtcact

SEQ ID NO: 795896 - DNA, 22 bp, Artificial Sequence
  chemically synthesized
tgcactagaatgtaggtcactg

SEQ ID NO: 795897 - DNA, 22 bp, Artificial Sequence
  chemically synthesized
cactagaatgtaggtcactgag

SEQ ID NO: 795898 - DNA, 22 bp, Artificial Sequence
  chemically synthesized
gaatgtaggtcactgagctcaa

SEQ ID NO: 795899 - DNA, 22 bp, Artificial Sequence
  chemically synthesized
tcaaaaaaaaataagaaataaa

SEQ ID NO: 795900 - DNA, 22 bp, Artificial Sequence
  chemically synthesized
agctcaaatttatttcttattt

SEQ ID NO: 795901 - DNA, 22 bp, Artificial Sequence
  chemically synthesized
aaatttatttcttatttttttt

SEQ ID NO: 795902 - DNA, 22 bp, Artificial Sequence
  chemically synthesized
atttcttatttttttttgatag

SEQ ID NO: 795903 - DNA, 22 bp, Artificial Sequence
  chemically synthesized
tttcttatttttttttgatagg

SEQ ID NO: 795904 - DNA, 22 bp, Artificial Sequence
  chemically synthesized
cttatttttttttgatagggtc

SEQ ID NO: 795905 - DNA, 22 bp, Artificial Sequence
  chemically synthesized
ttatttttttttgatagggtct

SEQ ID NO: 795906 - DNA, 22 bp, Artificial Sequence
  chemically synthesized
gatgacagagtgagaccctatc

SEQ ID NO: 795907 - DNA, 22 bp, Artificial Sequence
  chemically synthesized
atttttttttgatagggtctca

SEQ ID NO: 795908 - DNA, 22 bp, Artificial Sequence
  chemically synthesized
tttttttttgatagggtctcac

SEQ ID NO: 795909 - DNA, 22 bp, Artificial Sequence
  chemically synthesized
ttttttgatagggtctcactct

SEQ ID NO: 795910 - DNA, 22 bp, Artificial Sequence
  chemically synthesized
tttttgatagggtctcactctg

SEQ ID NO: 795911 - DNA, 22 bp, Artificial Sequence
  chemically synthesized
cagcctggatgacagagtgaga

SEQ ID NO: 795912 - DNA, 22 bp, Artificial Sequence
  chemically synthesized
ttttgatagggtctcactctgt

SEQ ID NO: 795913 - DNA, 22 bp, Artificial Sequence
  chemically synthesized
tttgatagggtctcactctgtc

SEQ ID NO: 795914 - DNA, 22 bp, Artificial Sequence
  chemically synthesized
ttgatagggtctcactctgtca

SEQ ID NO: 795915 - DNA, 22 bp, Artificial Sequence
  chemically synthesized
tgatagggtctcactctgtcat

SEQ ID NO: 795916 - DNA, 22 bp, Artificial Sequence
  chemically synthesized
gatagggtctcactctgtcatc

SEQ ID NO: 795917 - DNA, 22 bp, Artificial Sequence
  chemically synthesized
cactccagcctggatgacagag

SEQ ID NO: 795918 - DNA, 22 bp, Artificial Sequence
  chemically synthesized
atagggtctcactctgtcatcc

SEQ ID NO: 795919 - DNA, 22 bp, Artificial Sequence
  chemically synthesized
actctgtcatccaggctggagt

SEQ ID NO: 795920 - DNA, 22 bp, Artificial Sequence
  chemically synthesized
tgtcatccaggctggagtgcag

SEQ ID NO: 795921 - DNA, 22 bp, Artificial Sequence
  chemically synthesized
tcatccaggctggagtgcagtt

SEQ ID NO: 795922 - DNA, 22 bp, Artificial Sequence
  chemically synthesized
cagtgagccataatggcacaac

SEQ ID NO: 795923 - DNA, 22 bp, Artificial Sequence
  chemically synthesized
gagtgcagttgtgccattatgg

SEQ ID NO: 795924 - DNA, 22 bp, Artificial Sequence
  chemically synthesized
tgccattatggctcactgcagc

SEQ ID NO: 795925 - DNA, 22 bp, Artificial Sequence
  chemically synthesized
tggctcactgcagcctcgactt

SEQ ID NO: 795926 - DNA, 22 bp, Artificial Sequence
  chemically synthesized
actgcagcctcgacttcctggg

SEQ ID NO: 795927 - DNA, 22 bp, Artificial Sequence
  chemically synthesized
cagcctcgacttcctgggttca

SEQ ID NO: 795928 - DNA, 22 bp, Artificial Sequence
  chemically synthesized
aggtagaaggatcacgtgaacc

SEQ ID NO: 795929 - DNA, 22 bp, Artificial Sequence
  chemically synthesized
gacttcctgggttcacgtgatc

SEQ ID NO: 795930 - DNA, 22 bp, Artificial Sequence
  chemically synthesized
cctgggttcacgtgatccttct

SEQ ID NO: 795931 - DNA, 22 bp, Artificial Sequence
  chemically synthesized
ctgggttcacgtgatccttcta

SEQ ID NO: 795932 - DNA, 22 bp, Artificial Sequence
  chemically synthesized
gggagcctgaggtagaaggatc

SEQ ID NO: 795933 - DNA, 22 bp, Artificial Sequence
  chemically synthesized
ggttcacgtgatccttctacct

SEQ ID NO: 795934 - DNA, 22 bp, Artificial Sequence
  chemically synthesized
ctcgggagcctgaggtagaagg

SEQ ID NO: 795935 - DNA, 22 bp, Artificial Sequence
  chemically synthesized
acgtgatccttctacctcaggc

SEQ ID NO: 795936 - DNA, 22 bp, Artificial Sequence
  chemically synthesized
tagtcccagctactcgggagcc

SEQ ID NO: 795937 - DNA, 22 bp, Artificial Sequence
  chemically synthesized
ctacctcaggctcccgagtagc

SEQ ID NO: 795938 - DNA, 22 bp, Artificial Sequence
  chemically synthesized
tacctcaggctcccgagtagct

SEQ ID NO: 795939 - DNA, 22 bp, Artificial Sequence
  chemically synthesized
cctcaggctcccgagtagctgg

SEQ ID NO: 795940 - DNA, 22 bp, Artificial Sequence
  chemically synthesized
aggctcccgagtagctgggact

SEQ ID NO: 795941 - DNA, 22 bp, Artificial Sequence
  chemically synthesized
ccgagtagctgggactacaggc

SEQ ID NO: 795942 - DNA, 22 bp, Artificial Sequence
  chemically synthesized
cgcatggtggcatgtgcctgta

SEQ ID NO: 795943 - DNA, 22 bp, Artificial Sequence
  chemically synthesized
ggactacaggcacatgccacca

SEQ ID NO: 795944 - DNA, 22 bp, Artificial Sequence
  chemically synthesized
caggcacatgccaccatgcgca

SEQ ID NO: 795945 - DNA, 22 bp, Artificial Sequence
  chemically synthesized
caaaaaatgcaaaaagagtacc

SEQ ID NO: 795946 - DNA, 22 bp, Artificial Sequence
  chemically synthesized
tacaaaaaatgcaaaaagagta

SEQ ID NO: 795947 - DNA, 22 bp, Artificial Sequence
  chemically synthesized
tttttgcattttttgtagagat

SEQ ID NO: 795948 - DNA, 22 bp, Artificial Sequence
  chemically synthesized
tttgcattttttgtagagatgg

SEQ ID NO: 795949 - DNA, 22 bp, Artificial Sequence
  chemically synthesized
ttgcattttttgtagagatggg

SEQ ID NO: 795950 - DNA, 22 bp, Artificial Sequence
  chemically synthesized
tgcattttttgtagagatgggg

SEQ ID NO: 795951 - DNA, 22 bp, Artificial Sequence
  chemically synthesized
gcattttttgtagagatggggt

SEQ ID NO: 795952 - DNA, 22 bp, Artificial Sequence
  chemically synthesized
cattttttgtagagatggggtt

SEQ ID NO: 795953 - DNA, 22 bp, Artificial Sequence
  chemically synthesized
ggcaacatggtgaaaccccatc

SEQ ID NO: 795954 - DNA, 22 bp, Artificial Sequence
  chemically synthesized
tttgtagagatggggtttcacc

SEQ ID NO: 795955 - DNA, 22 bp, Artificial Sequence
  chemically synthesized
ttgtagagatggggtttcacca

SEQ ID NO: 795956 - DNA, 22 bp, Artificial Sequence
  chemically synthesized
tgtagagatggggtttcaccat

SEQ ID NO: 795957 - DNA, 22 bp, Artificial Sequence
  chemically synthesized
gtagagatggggtttcaccatg

SEQ ID NO: 795958 - DNA, 22 bp, Artificial Sequence
  chemically synthesized
tagagatggggtttcaccatgt

SEQ ID NO: 795959 - DNA, 22 bp, Artificial Sequence
  chemically synthesized
agatcagcctgggcaacatggt

SEQ ID NO: 795960 - DNA, 22 bp, Artificial Sequence
  chemically synthesized
gagatcagcctgggcaacatgg

SEQ ID NO: 795961 - DNA, 22 bp, Artificial Sequence
  chemically synthesized
caccatgttgcccaggctgatc

SEQ ID NO: 795962 - DNA, 22 bp, Artificial Sequence
  chemically synthesized
accatgttgcccaggctgatct

SEQ ID NO: 795963 - DNA, 22 bp, Artificial Sequence
  chemically synthesized
agtccaggagtttgagatcagc

SEQ ID NO: 795964 - DNA, 22 bp, Artificial Sequence
  chemically synthesized
gagtccaggagtttgagatcag

SEQ ID NO: 795965 - DNA, 22 bp, Artificial Sequence
  chemically synthesized
cccaggctgatctcaaactcct

SEQ ID NO: 795966 - DNA, 22 bp, Artificial Sequence
  chemically synthesized
atctcaaactcctggactcaag

SEQ ID NO: 795967 - DNA, 22 bp, Artificial Sequence
  chemically synthesized
aggcaggcagatcacttgagtc

SEQ ID NO: 795968 - DNA, 22 bp, Artificial Sequence
  chemically synthesized
aaactcctggactcaagtgatc

SEQ ID NO: 795969 - DNA, 22 bp, Artificial Sequence
  chemically synthesized
ggaagctgaggcaggcagatca

SEQ ID NO: 795970 - DNA, 22 bp, Artificial Sequence
  chemically synthesized
ctggactcaagtgatctgcctg

SEQ ID NO: 795971 - DNA, 22 bp, Artificial Sequence
  chemically synthesized
gggaagctgaggcaggcagatc

SEQ ID NO: 795972 - DNA, 22 bp, Artificial Sequence
  chemically synthesized
gactcaagtgatctgcctgcct

SEQ ID NO: 795973 - DNA, 22 bp, Artificial Sequence
  chemically synthesized
aagtgatctgcctgcctcagct

SEQ ID NO: 795974 - DNA, 22 bp, Artificial Sequence
  chemically synthesized
taatcccaaggatttgggaagc

SEQ ID NO: 795975 - DNA, 22 bp, Artificial Sequence
  chemically synthesized
cctgcctcagcttcccaaatcc

SEQ ID NO: 795976 - DNA, 22 bp, Artificial Sequence
  chemically synthesized
cctcagcttcccaaatccttgg

SEQ ID NO: 795977 - DNA, 22 bp, Artificial Sequence
  chemically synthesized
atgcctgtaatcccaaggattt

SEQ ID NO: 795978 - DNA, 22 bp, Artificial Sequence
  chemically synthesized
agcttcccaaatccttgggatt

SEQ ID NO: 795979 - DNA, 22 bp, Artificial Sequence
  chemically synthesized
cccaaatccttgggattacagg

SEQ ID NO: 795980 - DNA, 22 bp, Artificial Sequence
  chemically synthesized
ccaaatccttgggattacaggc

SEQ ID NO: 795981 - DNA, 22 bp, Artificial Sequence
  chemically synthesized
gggtgcgatggctcatgcctgt

SEQ ID NO: 795982 - DNA, 22 bp, Artificial Sequence
  chemically synthesized
ggggtgcgatggctcatgcctg

SEQ ID NO: 795983 - DNA, 22 bp, Artificial Sequence
  chemically synthesized
gggattacaggcatgagccatc

SEQ ID NO: 795984 - DNA, 22 bp, Artificial Sequence
  chemically synthesized
ggattacaggcatgagccatcg

SEQ ID NO: 795985 - DNA, 22 bp, Artificial Sequence
  chemically synthesized
caggcatgagccatcgcacccc

SEQ ID NO: 795986 - DNA, 22 bp, Artificial Sequence
  chemically synthesized
taaggtatagaaatacacttgg

SEQ ID NO: 795987 - DNA, 22 bp, Artificial Sequence
  chemically synthesized
gtaaggtatagaaatacacttg

SEQ ID NO: 795988 - DNA, 22 bp, Artificial Sequence
  chemically synthesized
tgtaaggtatagaaatacactt

SEQ ID NO: 795989 - DNA, 22 bp, Artificial Sequence
  chemically synthesized
tgtaaggtactttgtaaggtat

SEQ ID NO: 795990 - DNA, 22 bp, Artificial Sequence
  chemically synthesized
ctgtgtaaggtactttgtaagg

SEQ ID NO: 795991 - DNA, 22 bp, Artificial Sequence
  chemically synthesized
gttactgtgtaaggtactttgt

SEQ ID NO: 795992 - DNA, 22 bp, Artificial Sequence
  chemically synthesized
ctataccttacaaagtacctta

SEQ ID NO: 795993 - DNA, 22 bp, Artificial Sequence
  chemically synthesized
tataccttacaaagtaccttac

SEQ ID NO: 795994 - DNA, 22 bp, Artificial Sequence
  chemically synthesized
gttagttactgtgtaaggtact

SEQ ID NO: 795995 - DNA, 22 bp, Artificial Sequence
  chemically synthesized
taccttacaaagtaccttacac

SEQ ID NO: 795996 - DNA, 22 bp, Artificial Sequence
  chemically synthesized
ctggttagttactgtgtaaggt

SEQ ID NO: 795997 - DNA, 22 bp, Artificial Sequence
  chemically synthesized
gctggttagttactgtgtaagg

SEQ ID NO: 795998 - DNA, 22 bp, Artificial Sequence
  chemically synthesized
acaaagtaccttacacagtaac

SEQ ID NO: 795999 - DNA, 22 bp, Artificial Sequence
  chemically synthesized
caaagtaccttacacagtaact

SEQ ID NO: 796000 - DNA, 22 bp, Artificial Sequence
  chemically synthesized
ccatttgctggttagttactgt

SEQ ID NO: 796001 - DNA, 22 bp, Artificial Sequence
  chemically synthesized
gagtatctgccatttgctggtt

SEQ ID NO: 796002 - DNA, 22 bp, Artificial Sequence
  chemically synthesized
acacagtaactaaccagcaaat

SEQ ID NO: 796003 - DNA, 22 bp, Artificial Sequence
  chemically synthesized
cacagtaactaaccagcaaatg

SEQ ID NO: 796004 - DNA, 22 bp, Artificial Sequence
  chemically synthesized
tgactggagtatctgccatttg

SEQ ID NO: 796005 - DNA, 22 bp, Artificial Sequence
  chemically synthesized
atctatgactggagtatctgcc

SEQ ID NO: 796006 - DNA, 22 bp, Artificial Sequence
  chemically synthesized
accagcaaatggcagatactcc

SEQ ID NO: 796007 - DNA, 22 bp, Artificial Sequence
  chemically synthesized
atatccattcatctatgactgg

SEQ ID NO: 796008 - DNA, 22 bp, Artificial Sequence
  chemically synthesized
aacagtagattcatatccattc

SEQ ID NO: 796009 - DNA, 22 bp, Artificial Sequence
  chemically synthesized
cagtcatagatgaatggatatg

SEQ ID NO: 796010 - DNA, 22 bp, Artificial Sequence
  chemically synthesized
gtattcaacagtagattcatat

SEQ ID NO: 796011 - DNA, 22 bp, Artificial Sequence
  chemically synthesized
ttagtattcaacagtagattca

SEQ ID NO: 796012 - DNA, 22 bp, Artificial Sequence
  chemically synthesized
tattagtattcaacagtagatt

SEQ ID NO: 796013 - DNA, 22 bp, Artificial Sequence
  chemically synthesized
ctattagtattcaacagtagat

SEQ ID NO: 796014 - DNA, 22 bp, Artificial Sequence
  chemically synthesized
caatttctattagtattcaaca

SEQ ID NO: 796015 - DNA, 22 bp, Artificial Sequence
  chemically synthesized
tgccgttacaatttctattagt

SEQ ID NO: 796016 - DNA, 22 bp, Artificial Sequence
  chemically synthesized
ctgttgaatactaatagaaatt

SEQ ID NO: 796017 - DNA, 22 bp, Artificial Sequence
  chemically synthesized
ttgaatactaatagaaattgta

SEQ ID NO: 796018 - DNA, 22 bp, Artificial Sequence
  chemically synthesized
aatactaatagaaattgtaacg

SEQ ID NO: 796019 - DNA, 22 bp, Artificial Sequence
  chemically synthesized
agaaatgtaactgtgccgttac

SEQ ID NO: 796020 - DNA, 22 bp, Artificial Sequence
  chemically synthesized
atagaaattgtaacggcacagt

SEQ ID NO: 796021 - DNA, 22 bp, Artificial Sequence
  chemically synthesized
gttcagaaatgtaactgtgccg

SEQ ID NO: 796022 - DNA, 22 bp, Artificial Sequence
  chemically synthesized
gaattggttcagaaatgtaact

SEQ ID NO: 796023 - DNA, 22 bp, Artificial Sequence
  chemically synthesized
tagaattggttcagaaatgtaa

SEQ ID NO: 796024 - DNA, 22 bp, Artificial Sequence
  chemically synthesized
taacggcacagttacatttctg

SEQ ID NO: 796025 - DNA, 22 bp, Artificial Sequence
  chemically synthesized
aatgtataacctctagaattgg

SEQ ID NO: 796026 - DNA, 22 bp, Artificial Sequence
  chemically synthesized
gaatgtataacctctagaattg

SEQ ID NO: 796027 - DNA, 22 bp, Artificial Sequence
  chemically synthesized
catttctgaaccaattctagag

SEQ ID NO: 796028 - DNA, 22 bp, Artificial Sequence
  chemically synthesized
tgaatgtataacctctagaatt

SEQ ID NO: 796029 - DNA, 22 bp, Artificial Sequence
  chemically synthesized
tttgaatgtataacctctagaa

SEQ ID NO: 796030 - DNA, 22 bp, Artificial Sequence
  chemically synthesized
ctttgaatgtataacctctaga

SEQ ID NO: 796031 - DNA, 22 bp, Artificial Sequence
  chemically synthesized
ctgaaccaattctagaggttat

SEQ ID NO: 796032 - DNA, 22 bp, Artificial Sequence
  chemically synthesized
tgaaccaattctagaggttata

SEQ ID NO: 796033 - DNA, 22 bp, Artificial Sequence
  chemically synthesized
cttctttgaatgtataacctct

SEQ ID NO: 796034 - DNA, 22 bp, Artificial Sequence
  chemically synthesized
aaccaattctagaggttataca

SEQ ID NO: 796035 - DNA, 22 bp, Artificial Sequence
  chemically synthesized
tagaggttatacattcaaagaa

SEQ ID NO: 796036 - DNA, 22 bp, Artificial Sequence
  chemically synthesized
ataataatactccttctttgaa

SEQ ID NO: 796037 - DNA, 22 bp, Artificial Sequence
  chemically synthesized
gaggttatacattcaaagaagg

SEQ ID NO: 796038 - DNA, 22 bp, Artificial Sequence
  chemically synthesized
tacattcaaagaaggagtatta

SEQ ID NO: 796039 - DNA, 22 bp, Artificial Sequence
  chemically synthesized
ggcacctaataataatactcct

SEQ ID NO: 796040 - DNA, 22 bp, Artificial Sequence
  chemically synthesized
aggcacctaataataatactcc

SEQ ID NO: 796041 - DNA, 22 bp, Artificial Sequence
  chemically synthesized
taggcacctaataataatactc

SEQ ID NO: 796042 - DNA, 22 bp, Artificial Sequence
  chemically synthesized
aaagaaggagtattattattag

SEQ ID NO: 796043 - DNA, 22 bp, Artificial Sequence
  chemically synthesized
acaattttaggcacctaataat

SEQ ID NO: 796044 - DNA, 22 bp, Artificial Sequence
  chemically synthesized
ctaacaattttaggcacctaat

SEQ ID NO: 796045 - DNA, 22 bp, Artificial Sequence
  chemically synthesized
actaacaattttaggcacctaa

SEQ ID NO: 796046 - DNA, 22 bp, Artificial Sequence
  chemically synthesized
tactaacaattttaggcaccta

SEQ ID NO: 796047 - DNA, 22 bp, Artificial Sequence
  chemically synthesized
ttttactaacaattttaggcac

SEQ ID NO: 796048 - DNA, 22 bp, Artificial Sequence
  chemically synthesized
ttattaggtgcctaaaattgtt

SEQ ID NO: 796049 - DNA, 22 bp, Artificial Sequence
  chemically synthesized
ttaggtgcctaaaattgttagt

SEQ ID NO: 796050 - DNA, 22 bp, Artificial Sequence
  chemically synthesized
ggtgcctaaaattgttagtaaa

SEQ ID NO: 796051 - DNA, 22 bp, Artificial Sequence
  chemically synthesized
aaattgttagtaaaatagacct

SEQ ID NO: 796052 - DNA, 22 bp, Artificial Sequence
  chemically synthesized
ttagtaaaatagacctcttact

SEQ ID NO: 796053 - DNA, 22 bp, Artificial Sequence
  chemically synthesized
gtaaaatagacctcttactata

SEQ ID NO: 796054 - DNA, 22 bp, Artificial Sequence
  chemically synthesized
catgatataagaatccagataa

SEQ ID NO: 796055 - DNA, 22 bp, Artificial Sequence
  chemically synthesized
gcatgatataagaatccagata

SEQ ID NO: 796056 - DNA, 22 bp, Artificial Sequence
  chemically synthesized
ttactatatttatctggattct

SEQ ID NO: 796057 - DNA, 22 bp, Artificial Sequence
  chemically synthesized
ttgcatgatataagaatccaga

SEQ ID NO: 796058 - DNA, 22 bp, Artificial Sequence
  chemically synthesized
cttgcatgatataagaatccag

SEQ ID NO: 796059 - DNA, 22 bp, Artificial Sequence
  chemically synthesized
actatatttatctggattctta

SEQ ID NO: 796060 - DNA, 22 bp, Artificial Sequence
  chemically synthesized
tcttgcatgatataagaatcca

SEQ ID NO: 796061 - DNA, 22 bp, Artificial Sequence
  chemically synthesized
ctatatttatctggattcttat

SEQ ID NO: 796062 - DNA, 22 bp, Artificial Sequence
  chemically synthesized
tatttatctggattcttatatc

SEQ ID NO: 796063 - DNA, 22 bp, Artificial Sequence
  chemically synthesized
atattttcttgcatgatataag

SEQ ID NO: 796064 - DNA, 22 bp, Artificial Sequence
  chemically synthesized
atctggattcttatatcatgca

SEQ ID NO: 796065 - DNA, 22 bp, Artificial Sequence
  chemically synthesized
ttgatattttcttgcatgatat

SEQ ID NO: 796066 - DNA, 22 bp, Artificial Sequence
  chemically synthesized
tctggattcttatatcatgcaa

SEQ ID NO: 796067 - DNA, 22 bp, Artificial Sequence
  chemically synthesized
attgatattttcttgcatgata

SEQ ID NO: 796068 - DNA, 22 bp, Artificial Sequence
  chemically synthesized
tttattgatattttcttgcatg

SEQ ID NO: 796069 - DNA, 22 bp, Artificial Sequence
  chemically synthesized
gattcttatatcatgcaagaaa

SEQ ID NO: 796070 - DNA, 22 bp, Artificial Sequence
  chemically synthesized
gtttattgatattttcttgcat

SEQ ID NO: 796071 - DNA, 22 bp, Artificial Sequence
  chemically synthesized
ttatatcatgcaagaaaatatc

SEQ ID NO: 796072 - DNA, 22 bp, Artificial Sequence
  chemically synthesized
atatcatgcaagaaaatatcaa

SEQ ID NO: 796073 - DNA, 22 bp, Artificial Sequence
  chemically synthesized
tatcatgcaagaaaatatcaat

SEQ ID NO: 796074 - DNA, 22 bp, Artificial Sequence
  chemically synthesized
gcatgcttgtttattgatattt

SEQ ID NO: 796075 - DNA, 22 bp, Artificial Sequence
  chemically synthesized
tggttttttttttttttttttt

SEQ ID NO: 796076 - DNA, 22 bp, Artificial Sequence
  chemically synthesized
gagggataccaaaaaaaaaaaa

SEQ ID NO: 796077 - DNA, 22 bp, Artificial Sequence
  chemically synthesized
tttttttttttttttttttttg

SEQ ID NO: 796078 - DNA, 22 bp, Artificial Sequence
  chemically synthesized
ttttttttttttttttttttgg

SEQ ID NO: 796079 - DNA, 22 bp, Artificial Sequence
  chemically synthesized
tttttttttttttttttttggt

SEQ ID NO: 796080 - DNA, 22 bp, Artificial Sequence
  chemically synthesized
ttttttttttttttttttggta

SEQ ID NO: 796081 - DNA, 22 bp, Artificial Sequence
  chemically synthesized
gatctggagggataccaaaaaa

SEQ ID NO: 796082 - DNA, 22 bp, Artificial Sequence
  chemically synthesized
tttttttttttttttttggtat

SEQ ID NO: 796083 - DNA, 22 bp, Artificial Sequence
  chemically synthesized
ttttttttttttttttggtatc

SEQ ID NO: 796084 - DNA, 22 bp, Artificial Sequence
  chemically synthesized
tttttttttttttttggtatcc

SEQ ID NO: 796085 - DNA, 22 bp, Artificial Sequence
  chemically synthesized
ttttttttttttttggtatccc

SEQ ID NO: 796086 - DNA, 22 bp, Artificial Sequence
  chemically synthesized
tttttttttttttggtatccct

SEQ ID NO: 796087 - DNA, 22 bp, Artificial Sequence
  chemically synthesized
ttttttttttttggtatccctc

SEQ ID NO: 796088 - DNA, 22 bp, Artificial Sequence
  chemically synthesized
tttttttttttggtatccctcc

SEQ ID NO: 796089 - DNA, 22 bp, Artificial Sequence
  chemically synthesized
ttttttttttggtatccctcca

SEQ ID NO: 796090 - DNA, 22 bp, Artificial Sequence
  chemically synthesized
tttttttttggtatccctccag

SEQ ID NO: 796091 - DNA, 22 bp, Artificial Sequence
  chemically synthesized
ttttttttggtatccctccaga

SEQ ID NO: 796092 - DNA, 22 bp, Artificial Sequence
  chemically synthesized
tttttttggtatccctccagat

SEQ ID NO: 796093 - DNA, 22 bp, Artificial Sequence
  chemically synthesized
ttttttggtatccctccagatc

SEQ ID NO: 796094 - DNA, 22 bp, Artificial Sequence
  chemically synthesized
tttttggtatccctccagatcc

SEQ ID NO: 796095 - DNA, 22 bp, Artificial Sequence
  chemically synthesized
ttttggtatccctccagatcca

SEQ ID NO: 796096 - DNA, 22 bp, Artificial Sequence
  chemically synthesized
tttggtatccctccagatccag

SEQ ID NO: 796097 - DNA, 22 bp, Artificial Sequence
  chemically synthesized
ttggtatccctccagatccaga

SEQ ID NO: 796098 - DNA, 22 bp, Artificial Sequence
  chemically synthesized
tggtatccctccagatccagat

SEQ ID NO: 796099 - DNA, 22 bp, Artificial Sequence
  chemically synthesized
ggtatccctccagatccagatc

SEQ ID NO: 796100 - DNA, 22 bp, Artificial Sequence
  chemically synthesized
gtatccctccagatccagatcc

SEQ ID NO: 796101 - DNA, 22 bp, Artificial Sequence
  chemically synthesized
cagatccagatccattttccct

SEQ ID NO: 796102 - DNA, 22 bp, Artificial Sequence
  chemically synthesized
gaaggtggaaaaagaagggaaa

SEQ ID NO: 796103 - DNA, 22 bp, Artificial Sequence
  chemically synthesized
tcccttctttttccaccttcca

SEQ ID NO: 796104 - DNA, 22 bp, Artificial Sequence
  chemically synthesized
cccttctttttccaccttccag

SEQ ID NO: 796105 - DNA, 22 bp, Artificial Sequence
  chemically synthesized
ccttctttttccaccttccagg

SEQ ID NO: 796106 - DNA, 22 bp, Artificial Sequence
  chemically synthesized
ctttttccaccttccagggggc

SEQ ID NO: 796107 - DNA, 22 bp, Artificial Sequence
  chemically synthesized
tttttccaccttccagggggct

SEQ ID NO: 796108 - DNA, 22 bp, Artificial Sequence
  chemically synthesized
tttccaccttccagggggctga

SEQ ID NO: 796109 - DNA, 22 bp, Artificial Sequence
  chemically synthesized
ttccaccttccagggggctgac

SEQ ID NO: 796110 - DNA, 22 bp, Artificial Sequence
  chemically synthesized
tccaccttccagggggctgact

SEQ ID NO: 796111 - DNA, 22 bp, Artificial Sequence
  chemically synthesized
ccaccttccagggggctgactt

SEQ ID NO: 796112 - DNA, 22 bp, Artificial Sequence
  chemically synthesized
atgatgtaatccaagtcagccc

SEQ ID NO: 796113 - DNA, 22 bp, Artificial Sequence
  chemically synthesized
caccttccagggggctgacttg

SEQ ID NO: 796114 - DNA, 22 bp, Artificial Sequence
  chemically synthesized
ccagggggctgacttggattac

SEQ ID NO: 796115 - DNA, 22 bp, Artificial Sequence
  chemically synthesized
cagggggctgacttggattaca

SEQ ID NO: 796116 - DNA, 22 bp, Artificial Sequence
  chemically synthesized
acttggattacatcattagact

SEQ ID NO: 796117 - DNA, 22 bp, Artificial Sequence
  chemically synthesized
ggattacatcattagactccta

SEQ ID NO: 796118 - DNA, 22 bp, Artificial Sequence
  chemically synthesized
gattacatcattagactcctat

SEQ ID NO: 796119 - DNA, 22 bp, Artificial Sequence
  chemically synthesized
catcattagactcctatgccct

SEQ ID NO: 796120 - DNA, 22 bp, Artificial Sequence
  chemically synthesized
gactcctatgccctatggtttt

SEQ ID NO: 796121 - DNA, 22 bp, Artificial Sequence
  chemically synthesized
gtcaaacccaaacagaaaacca

SEQ ID NO: 796122 - DNA, 22 bp, Artificial Sequence
  chemically synthesized
ggtcaaacccaaacagaaaacc

SEQ ID NO: 796123 - DNA, 22 bp, Artificial Sequence
  chemically synthesized
ctatgccctatggttttctgtt

SEQ ID NO: 796124 - DNA, 22 bp, Artificial Sequence
  chemically synthesized
cttggtcaaacccaaacagaaa

SEQ ID NO: 796125 - DNA, 22 bp, Artificial Sequence
  chemically synthesized
tgccctatggttttctgtttgg

SEQ ID NO: 796126 - DNA, 22 bp, Artificial Sequence
  chemically synthesized
tccttggtcaaacccaaacaga

SEQ ID NO: 796127 - DNA, 22 bp, Artificial Sequence
  chemically synthesized
tggttttctgtttgggtttgac

SEQ ID NO: 796128 - DNA, 22 bp, Artificial Sequence
  chemically synthesized
gtcctctccttggtcaaaccca

SEQ ID NO: 796129 - DNA, 22 bp, Artificial Sequence
  chemically synthesized
ctagtcctctccttggtcaaac

SEQ ID NO: 796130 - DNA, 22 bp, Artificial Sequence
  chemically synthesized
gctagtcctctccttggtcaaa

SEQ ID NO: 796131 - DNA, 22 bp, Artificial Sequence
  chemically synthesized
tctgtttgggtttgaccaagga

SEQ ID NO: 796132 - DNA, 22 bp, Artificial Sequence
  chemically synthesized
ctgtttgggtttgaccaaggag

SEQ ID NO: 796133 - DNA, 22 bp, Artificial Sequence
  chemically synthesized
tgtttgggtttgaccaaggaga

SEQ ID NO: 796134 - DNA, 22 bp, Artificial Sequence
  chemically synthesized
tttgggtttgaccaaggagagg

SEQ ID NO: 796135 - DNA, 22 bp, Artificial Sequence
  chemically synthesized
gggtttgaccaaggagaggact

SEQ ID NO: 796136 - DNA, 22 bp, Artificial Sequence
  chemically synthesized
cagtggtttgctagtcctctcc

SEQ ID NO: 796137 - DNA, 22 bp, Artificial Sequence
  chemically synthesized
ggtttgaccaaggagaggacta

SEQ ID NO: 796138 - DNA, 22 bp, Artificial Sequence
  chemically synthesized
tgcagtggtttgctagtcctct

SEQ ID NO: 796139 - DNA, 22 bp, Artificial Sequence
  chemically synthesized
tctgcagtggtttgctagtcct

SEQ ID NO: 796140 - DNA, 22 bp, Artificial Sequence
  chemically synthesized
ctctgcagtggtttgctagtcc

SEQ ID NO: 796141 - DNA, 22 bp, Artificial Sequence
  chemically synthesized
gaccaaggagaggactagcaaa

SEQ ID NO: 796142 - DNA, 22 bp, Artificial Sequence
  chemically synthesized
accaaggagaggactagcaaac

SEQ ID NO: 796143 - DNA, 22 bp, Artificial Sequence
  chemically synthesized
ccttctctgcagtggtttgcta

SEQ ID NO: 796144 - DNA, 22 bp, Artificial Sequence
  chemically synthesized
tcccttctctgcagtggtttgc

SEQ ID NO: 796145 - DNA, 22 bp, Artificial Sequence
  chemically synthesized
acccaagactctcccttctctg

SEQ ID NO: 796146 - DNA, 22 bp, Artificial Sequence
  chemically synthesized
gcaaaccactgcagagaaggga

SEQ ID NO: 796147 - DNA, 22 bp, Artificial Sequence
  chemically synthesized
tgacccaagactctcccttctc

SEQ ID NO: 796148 - DNA, 22 bp, Artificial Sequence
  chemically synthesized
cagagaagggagagtcttgggt

SEQ ID NO: 796149 - DNA, 22 bp, Artificial Sequence
  chemically synthesized
gggtcagagtattgattccctt

SEQ ID NO: 796150 - DNA, 22 bp, Artificial Sequence
  chemically synthesized
ggtcagagtattgattcccttc

SEQ ID NO: 796151 - DNA, 22 bp, Artificial Sequence
  chemically synthesized
agggaaaaagagatgaagggaa

SEQ ID NO: 796152 - DNA, 22 bp, Artificial Sequence
  chemically synthesized
attcccttcatctctttttccc

SEQ ID NO: 796153 - DNA, 22 bp, Artificial Sequence
  chemically synthesized
gaaatgatactcagggaaaaag

SEQ ID NO: 796154 - DNA, 22 bp, Artificial Sequence
  chemically synthesized
ccttcatctctttttccctgag

SEQ ID NO: 796155 - DNA, 22 bp, Artificial Sequence
  chemically synthesized
cctcgaaatgatactcagggaa

SEQ ID NO: 796156 - DNA, 22 bp, Artificial Sequence
  chemically synthesized
gcctcgaaatgatactcaggga

SEQ ID NO: 796157 - DNA, 22 bp, Artificial Sequence
  chemically synthesized
catctctttttccctgagtatc

SEQ ID NO: 796158 - DNA, 22 bp, Artificial Sequence
  chemically synthesized
atctctttttccctgagtatca

SEQ ID NO: 796159 - DNA, 22 bp, Artificial Sequence
  chemically synthesized
tttttccctgagtatcatttcg

SEQ ID NO: 796160 - DNA, 22 bp, Artificial Sequence
  chemically synthesized
tttccctgagtatcatttcgag

SEQ ID NO: 796161 - DNA, 22 bp, Artificial Sequence
  chemically synthesized
ttccctgagtatcatttcgagg

SEQ ID NO: 796162 - DNA, 22 bp, Artificial Sequence
  chemically synthesized
tccctgagtatcatttcgaggc

SEQ ID NO: 796163 - DNA, 22 bp, Artificial Sequence
  chemically synthesized
aggacagaatttgcctcgaaat

SEQ ID NO: 796164 - DNA, 22 bp, Artificial Sequence
  chemically synthesized
ccctgagtatcatttcgaggca

SEQ ID NO: 796165 - DNA, 22 bp, Artificial Sequence
  chemically synthesized
aaggacagaatttgcctcgaaa

SEQ ID NO: 796166 - DNA, 22 bp, Artificial Sequence
  chemically synthesized
cctgagtatcatttcgaggcaa

SEQ ID NO: 796167 - DNA, 22 bp, Artificial Sequence
  chemically synthesized
ttaaggacagaatttgcctcga

SEQ ID NO: 796168 - DNA, 22 bp, Artificial Sequence
  chemically synthesized
tcttaaggacagaatttgcctc

SEQ ID NO: 796169 - DNA, 22 bp, Artificial Sequence
  chemically synthesized
agtatcatttcgaggcaaattc

SEQ ID NO: 796170 - DNA, 22 bp, Artificial Sequence
  chemically synthesized
ctcttaaggacagaatttgcct

SEQ ID NO: 796171 - DNA, 22 bp, Artificial Sequence
  chemically synthesized
tctcttaaggacagaatttgcc

SEQ ID NO: 796172 - DNA, 22 bp, Artificial Sequence
  chemically synthesized
cgaggcaaattctgtccttaag

SEQ ID NO: 796173 - DNA, 22 bp, Artificial Sequence
  chemically synthesized
gaggcaaattctgtccttaaga

SEQ ID NO: 796174 - DNA, 22 bp, Artificial Sequence
  chemically synthesized
ggaggagcagtggctttctctt

SEQ ID NO: 796175 - DNA, 22 bp, Artificial Sequence
  chemically synthesized
gggaggagcagtggctttctct

SEQ ID NO: 796176 - DNA, 22 bp, Artificial Sequence
  chemically synthesized
tgtccttaagagaaagccactg

SEQ ID NO: 796177 - DNA, 22 bp, Artificial Sequence
  chemically synthesized
tccttaagagaaagccactgct

SEQ ID NO: 796178 - DNA, 22 bp, Artificial Sequence
  chemically synthesized
atgccttgggaggagcagtggc

SEQ ID NO: 796179 - DNA, 22 bp, Artificial Sequence
  chemically synthesized
aatgccttgggaggagcagtgg

SEQ ID NO: 796180 - DNA, 22 bp, Artificial Sequence
  chemically synthesized
taatgccttgggaggagcagtg

SEQ ID NO: 796181 - DNA, 22 bp, Artificial Sequence
  chemically synthesized
aagagaaagccactgctcctcc

SEQ ID NO: 796182 - DNA, 22 bp, Artificial Sequence
  chemically synthesized
agagaaagccactgctcctccc

SEQ ID NO: 796183 - DNA, 22 bp, Artificial Sequence
  chemically synthesized
ctcctcccaaggcattaaaatc

SEQ ID NO: 796184 - DNA, 22 bp, Artificial Sequence
  chemically synthesized
ctcccaaggcattaaaatctgc

SEQ ID NO: 796185 - DNA, 22 bp, Artificial Sequence
  chemically synthesized
ccaaggcattaaaatctgcatg

SEQ ID NO: 796186 - DNA, 22 bp, Artificial Sequence
  chemically synthesized
aaatctgcatgatgtttttttt

SEQ ID NO: 796187 - DNA, 22 bp, Artificial Sequence
  chemically synthesized
catgatgttttttttttttttc

SEQ ID NO: 796188 - DNA, 22 bp, Artificial Sequence
  chemically synthesized
agagcccagaaaaaaagaaaaa

SEQ ID NO: 796189 - DNA, 22 bp, Artificial Sequence
  chemically synthesized
tcagagcccagaaaaaaagaaa

SEQ ID NO: 796190 - DNA, 22 bp, Artificial Sequence
  chemically synthesized
ctcagagcccagaaaaaaagaa

SEQ ID NO: 796191 - DNA, 22 bp, Artificial Sequence
  chemically synthesized
tttttttttttctttttttctg

SEQ ID NO: 796192 - DNA, 22 bp, Artificial Sequence
  chemically synthesized
ttttttttttctttttttctgg

SEQ ID NO: 796193 - DNA, 22 bp, Artificial Sequence
  chemically synthesized
tttttttttctttttttctggg

SEQ ID NO: 796194 - DNA, 22 bp, Artificial Sequence
  chemically synthesized
ttttttttctttttttctgggc

SEQ ID NO: 796195 - DNA, 22 bp, Artificial Sequence
  chemically synthesized
tttttttctttttttctgggct

SEQ ID NO: 796196 - DNA, 22 bp, Artificial Sequence
  chemically synthesized
ttttttctttttttctgggctc

SEQ ID NO: 796197 - DNA, 22 bp, Artificial Sequence
  chemically synthesized
tttttctttttttctgggctct

SEQ ID NO: 796198 - DNA, 22 bp, Artificial Sequence
  chemically synthesized
ttttctttttttctgggctctg

SEQ ID NO: 796199 - DNA, 22 bp, Artificial Sequence
  chemically synthesized
tttctttttttctgggctctga

SEQ ID NO: 796200 - DNA, 22 bp, Artificial Sequence
  chemically synthesized
ttctttttttctgggctctgag

SEQ ID NO: 796201 - DNA, 22 bp, Artificial Sequence
  chemically synthesized
tctttttttctgggctctgaga

SEQ ID NO: 796202 - DNA, 22 bp, Artificial Sequence
  chemically synthesized
gggagagaggtttctcagagcc

SEQ ID NO: 796203 - DNA, 22 bp, Artificial Sequence
  chemically synthesized
ctttttttctgggctctgagaa

SEQ ID NO: 796204 - DNA, 22 bp, Artificial Sequence
  chemically synthesized
tttttttctgggctctgagaaa

SEQ ID NO: 796205 - DNA, 22 bp, Artificial Sequence
  chemically synthesized
ttggggagagaggtttctcaga

SEQ ID NO: 796206 - DNA, 22 bp, Artificial Sequence
  chemically synthesized
tttttctgggctctgagaaacc

SEQ ID NO: 796207 - DNA, 22 bp, Artificial Sequence
  chemically synthesized
ttttctgggctctgagaaacct

SEQ ID NO: 796208 - DNA, 22 bp, Artificial Sequence
  chemically synthesized
tttctgggctctgagaaacctc

SEQ ID NO: 796209 - DNA, 22 bp, Artificial Sequence
  chemically synthesized
ttctgggctctgagaaacctct

SEQ ID NO: 796210 - DNA, 22 bp, Artificial Sequence
  chemically synthesized
tctgggctctgagaaacctctc

SEQ ID NO: 796211 - DNA, 22 bp, Artificial Sequence
  chemically synthesized
ctgggctctgagaaacctctct

SEQ ID NO: 796212 - DNA, 22 bp, Artificial Sequence
  chemically synthesized
tgggctctgagaaacctctctc

SEQ ID NO: 796213 - DNA, 22 bp, Artificial Sequence
  chemically synthesized
ggctctgagaaacctctctccc

SEQ ID NO: 796214 - DNA, 22 bp, Artificial Sequence
  chemically synthesized
aagccgttgttggggagagagg

SEQ ID NO: 796215 - DNA, 22 bp, Artificial Sequence
  chemically synthesized
tgagaaacctctctccccaaca

SEQ ID NO: 796216 - DNA, 22 bp, Artificial Sequence
  chemically synthesized
gacctgaagccgttgttgggga

SEQ ID NO: 796217 - DNA, 22 bp, Artificial Sequence
  chemically synthesized
agaaacctctctccccaacaac

SEQ ID NO: 796218 - DNA, 22 bp, Artificial Sequence
  chemically synthesized
ctagacctgaagccgttgttgg

SEQ ID NO: 796219 - DNA, 22 bp, Artificial Sequence
  chemically synthesized
tcctagacctgaagccgttgtt

SEQ ID NO: 796220 - DNA, 22 bp, Artificial Sequence
  chemically synthesized
tctccccaacaacggcttcagg

SEQ ID NO: 796221 - DNA, 22 bp, Artificial Sequence
  chemically synthesized
tccccaacaacggcttcaggtc

SEQ ID NO: 796222 - DNA, 22 bp, Artificial Sequence
  chemically synthesized
tcacctctcctagacctgaagc

SEQ ID NO: 796223 - DNA, 22 bp, Artificial Sequence
  chemically synthesized
cccaacaacggcttcaggtcta

SEQ ID NO: 796224 - DNA, 22 bp, Artificial Sequence
  chemically synthesized
gcagcagcagagctgtcacctc

SEQ ID NO: 796225 - DNA, 22 bp, Artificial Sequence
  chemically synthesized
caggtctaggagaggtgacagc

SEQ ID NO: 796226 - DNA, 22 bp, Artificial Sequence
  chemically synthesized
aggtctaggagaggtgacagct

SEQ ID NO: 796227 - DNA, 22 bp, Artificial Sequence
  chemically synthesized
ggactagcagcagcagagctgt

SEQ ID NO: 796228 - DNA, 22 bp, Artificial Sequence
  chemically synthesized
taggactagcagcagcagagct

SEQ ID NO: 796229 - DNA, 22 bp, Artificial Sequence
  chemically synthesized
ggagaggtgacagctctgctgc

SEQ ID NO: 796230 - DNA, 22 bp, Artificial Sequence
  chemically synthesized
tgctgctgctagtcctagagtc

SEQ ID NO: 796231 - DNA, 22 bp, Artificial Sequence
  chemically synthesized
ctgctgctagtcctagagtctt

SEQ ID NO: 796232 - DNA, 22 bp, Artificial Sequence
  chemically synthesized
acaagatagcacaagactctag

SEQ ID NO: 796233 - DNA, 22 bp, Artificial Sequence
  chemically synthesized
ctgctagtcctagagtcttgtg

SEQ ID NO: 796234 - DNA, 22 bp, Artificial Sequence
  chemically synthesized
ctagtcctagagtcttgtgcta

SEQ ID NO: 796235 - DNA, 22 bp, Artificial Sequence
  chemically synthesized
gtcctagagtcttgtgctatct

SEQ ID NO: 796236 - DNA, 22 bp, Artificial Sequence
  chemically synthesized
gagtcttgtgctatcttgtgag

SEQ ID NO: 796237 - DNA, 22 bp, Artificial Sequence
  chemically synthesized
ggcagggtgtagggaaatctca

SEQ ID NO: 796238 - DNA, 22 bp, Artificial Sequence
  chemically synthesized
gtgctatcttgtgagatttccc

SEQ ID NO: 796239 - DNA, 22 bp, Artificial Sequence
  chemically synthesized
tgctatcttgtgagatttccct

SEQ ID NO: 796240 - DNA, 22 bp, Artificial Sequence
  chemically synthesized
tcttgtgagatttccctacacc

SEQ ID NO: 796241 - DNA, 22 bp, Artificial Sequence
  chemically synthesized
aggattgggcagggtgtaggga

SEQ ID NO: 796242 - DNA, 22 bp, Artificial Sequence
  chemically synthesized
gtgagatttccctacaccctgc

SEQ ID NO: 796243 - DNA, 22 bp, Artificial Sequence
  chemically synthesized
tgagatttccctacaccctgcc

SEQ ID NO: 796244 - DNA, 22 bp, Artificial Sequence
  chemically synthesized
catactcaggattgggcagggt

SEQ ID NO: 796245 - DNA, 22 bp, Artificial Sequence
  chemically synthesized
ccctacaccctgcccaatcctg

SEQ ID NO: 796246 - DNA, 22 bp, Artificial Sequence
  chemically synthesized
cctacaccctgcccaatcctga

SEQ ID NO: 796247 - DNA, 22 bp, Artificial Sequence
  chemically synthesized
caaggcactacatactcaggat

SEQ ID NO: 796248 - DNA, 22 bp, Artificial Sequence
  chemically synthesized
caccctgcccaatcctgagtat

SEQ ID NO: 796249 - DNA, 22 bp, Artificial Sequence
  chemically synthesized
acaaggcactacatactcagga

SEQ ID NO: 796250 - DNA, 22 bp, Artificial Sequence
  chemically synthesized
tttacaaggcactacatactca

SEQ ID NO: 796251 - DNA, 22 bp, Artificial Sequence
  chemically synthesized
atttacaaggcactacatactc

SEQ ID NO: 796252 - DNA, 22 bp, Artificial Sequence
  chemically synthesized
tatttacaaggcactacatact

SEQ ID NO: 796253 - DNA, 22 bp, Artificial Sequence
  chemically synthesized
cccaatcctgagtatgtagtgc

SEQ ID NO: 796254 - DNA, 22 bp, Artificial Sequence
  chemically synthesized
aggagtctttatttacaaggca

SEQ ID NO: 796255 - DNA, 22 bp, Artificial Sequence
  chemically synthesized
agtatgtagtgccttgtaaata

SEQ ID NO: 796256 - DNA, 22 bp, Artificial Sequence
  chemically synthesized
gggtaagttgaggagtctttat

SEQ ID NO: 796257 - DNA, 22 bp, Artificial Sequence
  chemically synthesized
agattagggtaagttgaggagt

SEQ ID NO: 796258 - DNA, 22 bp, Artificial Sequence
  chemically synthesized
gtaaataaagactcctcaactt

SEQ ID NO: 796259 - DNA, 22 bp, Artificial Sequence
  chemically synthesized
taaataaagactcctcaactta

SEQ ID NO: 796260 - DNA, 22 bp, Artificial Sequence
  chemically synthesized
ctcaacttaccctaatctgaat

SEQ ID NO: 796261 - DNA, 22 bp, Artificial Sequence
  chemically synthesized
aacttaccctaatctgaatgtg

SEQ ID NO: 796262 - DNA, 22 bp, Artificial Sequence
  chemically synthesized
accctaatctgaatgtgccatc

SEQ ID NO: 796263 - DNA, 22 bp, Artificial Sequence
  chemically synthesized
ccctaatctgaatgtgccatct

SEQ ID NO: 796264 - DNA, 22 bp, Artificial Sequence
  chemically synthesized
atctgaatgtgccatctgtttc

SEQ ID NO: 796265 - DNA, 22 bp, Artificial Sequence
  chemically synthesized
aatgtgccatctgtttcttgtt

SEQ ID NO: 796266 - DNA, 22 bp, Artificial Sequence
  chemically synthesized
agtcagtcagagtcccaacaag

SEQ ID NO: 796267 - DNA, 22 bp, Artificial Sequence
  chemically synthesized
atatctcagtcagtcagagtcc

SEQ ID NO: 796268 - DNA, 22 bp, Artificial Sequence
  chemically synthesized
tttcttgttgggactctgactg

SEQ ID NO: 796269 - DNA, 22 bp, Artificial Sequence
  chemically synthesized
cttgttgggactctgactgact

SEQ ID NO: 796270 - DNA, 22 bp, Artificial Sequence
  chemically synthesized
tgttgatatctcagtcagtcag

SEQ ID NO: 796271 - DNA, 22 bp, Artificial Sequence
  chemically synthesized
ttgttgggactctgactgactg

SEQ ID NO: 796272 - DNA, 22 bp, Artificial Sequence
  chemically synthesized
gtgttgatatctcagtcagtca

SEQ ID NO: 796273 - DNA, 22 bp, Artificial Sequence
  chemically synthesized
gttgggactctgactgactgag

SEQ ID NO: 796274 - DNA, 22 bp, Artificial Sequence
  chemically synthesized
ttgggactctgactgactgaga

SEQ ID NO: 796275 - DNA, 22 bp, Artificial Sequence
  chemically synthesized
tatttgtgttgatatctcagtc

SEQ ID NO: 796276 - DNA, 22 bp, Artificial Sequence
  chemically synthesized
ggactctgactgactgagatat

SEQ ID NO: 796277 - DNA, 22 bp, Artificial Sequence
  chemically synthesized
tgactgactgagatatcaacac

SEQ ID NO: 796278 - DNA, 22 bp, Artificial Sequence
  chemically synthesized
atgattgtatttgtgttgatat

SEQ ID NO: 796279 - DNA, 22 bp, Artificial Sequence
  chemically synthesized
catgattgtatttgtgttgata

SEQ ID NO: 796280 - DNA, 22 bp, Artificial Sequence
  chemically synthesized
actgactgagatatcaacacaa

SEQ ID NO: 796281 - DNA, 22 bp, Artificial Sequence
  chemically synthesized
tttcatgattgtatttgtgttg

SEQ ID NO: 796282 - DNA, 22 bp, Artificial Sequence
  chemically synthesized
actgagatatcaacacaaatac

SEQ ID NO: 796283 - DNA, 22 bp, Artificial Sequence
  chemically synthesized
agatatcaacacaaatacaatc

SEQ ID NO: 796284 - DNA, 22 bp, Artificial Sequence
  chemically synthesized
tgtcctgtttcatgattgtatt

SEQ ID NO: 796285 - DNA, 22 bp, Artificial Sequence
  chemically synthesized
gtgtcctgtttcatgattgtat

SEQ ID NO: 796286 - DNA, 22 bp, Artificial Sequence
  chemically synthesized
aatttgtgtcctgtttcatgat

SEQ ID NO: 796287 - DNA, 22 bp, Artificial Sequence
  chemically synthesized
tgaagtgctgaatttgtgtcct

SEQ ID NO: 796288 - DNA, 22 bp, Artificial Sequence
  chemically synthesized
tgtgaagtgctgaatttgtgtc

SEQ ID NO: 796289 - DNA, 22 bp, Artificial Sequence
  chemically synthesized
acatagtaccgcaataactctg

SEQ ID NO: 796290 - DNA, 22 bp, Artificial Sequence
  chemically synthesized
agcacttcacagagttattgcg

SEQ ID NO: 796291 - DNA, 22 bp, Artificial Sequence
  chemically synthesized
cacagagttattgcggtactat

SEQ ID NO: 796292 - DNA, 22 bp, Artificial Sequence
  chemically synthesized
atgcccattaacatagtaccgc

SEQ ID NO: 796293 - DNA, 22 bp, Artificial Sequence
  chemically synthesized
acagagttattgcggtactatg

SEQ ID NO: 796294 - DNA, 22 bp, Artificial Sequence
  chemically synthesized
catgcccattaacatagtaccg

SEQ ID NO: 796295 - DNA, 22 bp, Artificial Sequence
  chemically synthesized
tcatgcccattaacatagtacc

SEQ ID NO: 796296 - DNA, 22 bp, Artificial Sequence
  chemically synthesized
ataactttcatgcccattaaca

SEQ ID NO: 796297 - DNA, 22 bp, Artificial Sequence
  chemically synthesized
ttgcggtactatgttaatgggc

SEQ ID NO: 796298 - DNA, 22 bp, Artificial Sequence
  chemically synthesized
ctgataactttcatgcccatta

SEQ ID NO: 796299 - DNA, 22 bp, Artificial Sequence
  chemically synthesized
cggtactatgttaatgggcatg

SEQ ID NO: 796300 - DNA, 22 bp, Artificial Sequence
  chemically synthesized
actgataactttcatgcccatt

SEQ ID NO: 796301 - DNA, 22 bp, Artificial Sequence
  chemically synthesized
cagtttactgataactttcatg

SEQ ID NO: 796302 - DNA, 22 bp, Artificial Sequence
  chemically synthesized
acagtttactgataactttcat

SEQ ID NO: 796303 - DNA, 22 bp, Artificial Sequence
  chemically synthesized
tgttaatgggcatgaaagttat

SEQ ID NO: 796304 - DNA, 22 bp, Artificial Sequence
  chemically synthesized
atgggcatgaaagttatcagta

SEQ ID NO: 796305 - DNA, 22 bp, Artificial Sequence
  chemically synthesized
tcagtaaactgtaagtgccata

SEQ ID NO: 796306 - DNA, 22 bp, Artificial Sequence
  chemically synthesized
aatgatagcaatcaacatcggt

SEQ ID NO: 796307 - DNA, 22 bp, Artificial Sequence
  chemically synthesized
taagtgccataccgatgttgat

SEQ ID NO: 796308 - DNA, 22 bp, Artificial Sequence
  chemically synthesized
tgctaaatgatagcaatcaaca

SEQ ID NO: 796309 - DNA, 22 bp, Artificial Sequence
  chemically synthesized
gtgctaaatgatagcaatcaac

SEQ ID NO: 796310 - DNA, 22 bp, Artificial Sequence
  chemically synthesized
atagtttgtgctaaatgatagc

SEQ ID NO: 796311 - DNA, 22 bp, Artificial Sequence
  chemically synthesized
catagtttgtgctaaatgatag

SEQ ID NO: 796312 - DNA, 22 bp, Artificial Sequence
  chemically synthesized
tcatagtttgtgctaaatgata

SEQ ID NO: 796313 - DNA, 22 bp, Artificial Sequence
  chemically synthesized
ttcatagtttgtgctaaatgat

SEQ ID NO: 796314 - DNA, 22 bp, Artificial Sequence
  chemically synthesized
aacttttcatagtttgtgctaa

SEQ ID NO: 796315 - DNA, 22 bp, Artificial Sequence
  chemically synthesized
attgctatcatttagcacaaac

SEQ ID NO: 796316 - DNA, 22 bp, Artificial Sequence
  chemically synthesized
ctatcatttagcacaaactatg

SEQ ID NO: 796317 - DNA, 22 bp, Artificial Sequence
  chemically synthesized
tcatttagcacaaactatgaaa

SEQ ID NO: 796318 - DNA, 22 bp, Artificial Sequence
  chemically synthesized
agcacaaactatgaaaagttca

SEQ ID NO: 796319 - DNA, 22 bp, Artificial Sequence
  chemically synthesized
gcacaaactatgaaaagttcag

SEQ ID NO: 796320 - DNA, 22 bp, Artificial Sequence
  chemically synthesized
tgtatggacatagtctgaactt

SEQ ID NO: 796321 - DNA, 22 bp, Artificial Sequence
  chemically synthesized
tgaaaagttcagactatgtcca

SEQ ID NO: 796322 - DNA, 22 bp, Artificial Sequence
  chemically synthesized
agacacctgtgtatggacatag

SEQ ID NO: 796323 - DNA, 22 bp, Artificial Sequence
  chemically synthesized
tgttgagacacctgtgtatgga

SEQ ID NO: 796324 - DNA, 22 bp, Artificial Sequence
  chemically synthesized
gtgttgagacacctgtgtatgg

SEQ ID NO: 796325 - DNA, 22 bp, Artificial Sequence
  chemically synthesized
tgtgttgagacacctgtgtatg

SEQ ID NO: 796326 - DNA, 22 bp, Artificial Sequence
  chemically synthesized
agactatgtccatacacaggtg

SEQ ID NO: 796327 - DNA, 22 bp, Artificial Sequence
  chemically synthesized
gttttgtgttgagacacctgtg

SEQ ID NO: 796328 - DNA, 22 bp, Artificial Sequence
  chemically synthesized
tgtccatacacaggtgtctcaa

SEQ ID NO: 796329 - DNA, 22 bp, Artificial Sequence
  chemically synthesized
gaccatgtcaactggttttgtg

SEQ ID NO: 796330 - DNA, 22 bp, Artificial Sequence
  chemically synthesized
aacacaaaaccagttgacatgg

SEQ ID NO: 796331 - DNA, 22 bp, Artificial Sequence
  chemically synthesized
tatcaagttagaccatgtcaac

SEQ ID NO: 796332 - DNA, 22 bp, Artificial Sequence
  chemically synthesized
acatggtctaacttgatatagg

SEQ ID NO: 796333 - DNA, 22 bp, Artificial Sequence
  chemically synthesized
cagtacagccacatcaatccta

SEQ ID NO: 796334 - DNA, 22 bp, Artificial Sequence
  chemically synthesized
ttacagtacagccacatcaatc

SEQ ID NO: 796335 - DNA, 22 bp, Artificial Sequence
  chemically synthesized
acttgatataggattgatgtgg

SEQ ID NO: 796336 - DNA, 22 bp, Artificial Sequence
  chemically synthesized
gatataggattgatgtggctgt

SEQ ID NO: 796337 - DNA, 22 bp, Artificial Sequence
  chemically synthesized
atataggattgatgtggctgta

SEQ ID NO: 796338 - DNA, 22 bp, Artificial Sequence
  chemically synthesized
gacaactgttacagtacagcca

SEQ ID NO: 796339 - DNA, 22 bp, Artificial Sequence
  chemically synthesized
ttggacaactgttacagtacag

SEQ ID NO: 796340 - DNA, 22 bp, Artificial Sequence
  chemically synthesized
atgtggctgtactgtaacagtt

SEQ ID NO: 796341 - DNA, 22 bp, Artificial Sequence
  chemically synthesized
caacatgattattggacaactg

SEQ ID NO: 796342 - DNA, 22 bp, Artificial Sequence
  chemically synthesized
acaacatgattattggacaact

SEQ ID NO: 796343 - DNA, 22 bp, Artificial Sequence
  chemically synthesized
tactgtaacagttgtccaataa

SEQ ID NO: 796344 - DNA, 22 bp, Artificial Sequence
  chemically synthesized
tttacaacatgattattggaca

SEQ ID NO: 796345 - DNA, 22 bp, Artificial Sequence
  chemically synthesized
atttacaacatgattattggac

SEQ ID NO: 796346 - DNA, 22 bp, Artificial Sequence
  chemically synthesized
taacagttgtccaataatcatg

SEQ ID NO: 796347 - DNA, 22 bp, Artificial Sequence
  chemically synthesized
aaaacttatttacaacatgatt

SEQ ID NO: 796348 - DNA, 22 bp, Artificial Sequence
  chemically synthesized
tccaataatcatgttgtaaata

SEQ ID NO: 796349 - DNA, 22 bp, Artificial Sequence
  chemically synthesized
atatattaaaaacttatttaca

SEQ ID NO: 796350 - DNA, 22 bp, Artificial Sequence
  chemically synthesized
ttaatatattaaaaacttattt

SEQ ID NO: 796351 - DNA, 22 bp, Artificial Sequence
  chemically synthesized
taaataagtttttaatatatta

SEQ ID NO: 796352 - DNA, 22 bp, Artificial Sequence
  chemically synthesized
ttaatatattaacagcatacta

SEQ ID NO: 796353 - DNA, 22 bp, Artificial Sequence
  chemically synthesized
taatatattaacagcatactat

SEQ ID NO: 796354 - DNA, 22 bp, Artificial Sequence
  chemically synthesized
aatatattaacagcatactata

SEQ ID NO: 796355 - DNA, 22 bp, Artificial Sequence
  chemically synthesized
catatgtatcaatatagtatgc

SEQ ID NO: 796356 - DNA, 22 bp, Artificial Sequence
  chemically synthesized
atatattaacagcatactatat

SEQ ID NO: 796357 - DNA, 22 bp, Artificial Sequence
  chemically synthesized
tgattacatatgtatcaatata

SEQ ID NO: 796358 - DNA, 22 bp, Artificial Sequence
  chemically synthesized
acagcatactatattgatacat

SEQ ID NO: 796359 - DNA, 22 bp, Artificial Sequence
  chemically synthesized
ataacactgtgattacatatgt

SEQ ID NO: 796360 - DNA, 22 bp, Artificial Sequence
  chemically synthesized
tattgatacatatgtaatcaca

SEQ ID NO: 796361 - DNA, 22 bp, Artificial Sequence
  chemically synthesized
atacatatgtaatcacagtgtt

SEQ ID NO: 796362 - DNA, 22 bp, Artificial Sequence
  chemically synthesized
gataagtctgataacactgtga

SEQ ID NO: 796363 - DNA, 22 bp, Artificial Sequence
  chemically synthesized
acactggataagtctgataaca

SEQ ID NO: 796364 - DNA, 22 bp, Artificial Sequence
  chemically synthesized
tggtcagccatattaacactgg

SEQ ID NO: 796365 - DNA, 22 bp, Artificial Sequence
  chemically synthesized
tcagacttatccagtgttaata

SEQ ID NO: 796366 - DNA, 22 bp, Artificial Sequence
  chemically synthesized
tctatggtcagccatattaaca

SEQ ID NO: 796367 - DNA, 22 bp, Artificial Sequence
  chemically synthesized
gtctatggtcagccatattaac

SEQ ID NO: 796368 - DNA, 22 bp, Artificial Sequence
  chemically synthesized
atccagtgttaatatggctgac

SEQ ID NO: 796369 - DNA, 22 bp, Artificial Sequence
  chemically synthesized
tccagtgttaatatggctgacc

SEQ ID NO: 796370 - DNA, 22 bp, Artificial Sequence
  chemically synthesized
agaccttgtctatggtcagcca

SEQ ID NO: 796371 - DNA, 22 bp, Artificial Sequence
  chemically synthesized
atatggctgaccatagacaagg

SEQ ID NO: 796372 - DNA, 22 bp, Artificial Sequence
  chemically synthesized
accatagacaaggtctcaatat

SEQ ID NO: 796373 - DNA, 22 bp, Artificial Sequence
  chemically synthesized
gcggataatggaatattgagac

SEQ ID NO: 796374 - DNA, 22 bp, Artificial Sequence
  chemically synthesized
gaacagactggcggataatgga

SEQ ID NO: 796375 - DNA, 22 bp, Artificial Sequence
  chemically synthesized
aatattccattatccgccagtc

SEQ ID NO: 796376 - DNA, 22 bp, Artificial Sequence
  chemically synthesized
cattatccgccagtctgttcca

SEQ ID NO: 796377 - DNA, 22 bp, Artificial Sequence
  chemically synthesized
tccgccagtctgttccagatcg

SEQ ID NO: 796378 - DNA, 22 bp, Artificial Sequence
  chemically synthesized
ggaacatgtacaagtggcccac

SEQ ID NO: 796379 - DNA, 22 bp, Artificial Sequence
  chemically synthesized
ttccagatcgtgggccacttgt

SEQ ID NO: 796380 - DNA, 22 bp, Artificial Sequence
  chemically synthesized
cagatcgtgggccacttgtaca

SEQ ID NO: 796381 - DNA, 22 bp, Artificial Sequence
  chemically synthesized
cgaactaggaacatgtacaagt

SEQ ID NO: 796382 - DNA, 22 bp, Artificial Sequence
  chemically synthesized
attccgaactaggaacatgtac

SEQ ID NO: 796383 - DNA, 22 bp, Artificial Sequence
  chemically synthesized
attgattccgaactaggaacat

SEQ ID NO: 796384 - DNA, 22 bp, Artificial Sequence
  chemically synthesized
aattgattccgaactaggaaca

SEQ ID NO: 796385 - DNA, 22 bp, Artificial Sequence
  chemically synthesized
ttaattgattccgaactaggaa

SEQ ID NO: 796386 - DNA, 22 bp, Artificial Sequence
  chemically synthesized
gtacatgttcctagttcggaat

SEQ ID NO: 796387 - DNA, 22 bp, Artificial Sequence
  chemically synthesized
gtctcttaattgattccgaact

SEQ ID NO: 796388 - DNA, 22 bp, Artificial Sequence
  chemically synthesized
tacatgttcctagttcggaatc

SEQ ID NO: 796389 - DNA, 22 bp, Artificial Sequence
  chemically synthesized
acagagctagtctcttaattga

SEQ ID NO: 796390 - DNA, 22 bp, Artificial Sequence
  chemically synthesized
ctagttcggaatcaattaagag

SEQ ID NO: 796391 - DNA, 22 bp, Artificial Sequence
  chemically synthesized
cacagagctagtctcttaattg

SEQ ID NO: 796392 - DNA, 22 bp, Artificial Sequence
  chemically synthesized
ttcacagagctagtctcttaat

SEQ ID NO: 796393 - DNA, 22 bp, Artificial Sequence
  chemically synthesized
gttcggaatcaattaagagact

SEQ ID NO: 796394 - DNA, 22 bp, Artificial Sequence
  chemically synthesized
ggaatcaattaagagactagct

SEQ ID NO: 796395 - DNA, 22 bp, Artificial Sequence
  chemically synthesized
ccgtctcttcacagagctagtc

SEQ ID NO: 796396 - DNA, 22 bp, Artificial Sequence
  chemically synthesized
cccgtctcttcacagagctagt

SEQ ID NO: 796397 - DNA, 22 bp, Artificial Sequence
  chemically synthesized
tgcttcccgtctcttcacagag

SEQ ID NO: 796398 - DNA, 22 bp, Artificial Sequence
  chemically synthesized
agagactagctctgtgaagaga

SEQ ID NO: 796399 - DNA, 22 bp, Artificial Sequence
  chemically synthesized
gctctgtgaagagacgggaagc

SEQ ID NO: 796400 - DNA, 22 bp, Artificial Sequence
  chemically synthesized
agaaaaaggttatgcttcccgt

SEQ ID NO: 796401 - DNA, 22 bp, Artificial Sequence
  chemically synthesized
tgtgaagagacgggaagcataa

SEQ ID NO: 796402 - DNA, 22 bp, Artificial Sequence
  chemically synthesized
tgaagagacgggaagcataacc

SEQ ID NO: 796403 - DNA, 22 bp, Artificial Sequence
  chemically synthesized
taactcagaaaaaggttatgct

SEQ ID NO: 796404 - DNA, 22 bp, Artificial Sequence
  chemically synthesized
ataactcagaaaaaggttatgc

SEQ ID NO: 796405 - DNA, 22 bp, Artificial Sequence
  chemically synthesized
tacttataactcagaaaaaggt

SEQ ID NO: 796406 - DNA, 22 bp, Artificial Sequence
  chemically synthesized
atacttataactcagaaaaagg

SEQ ID NO: 796407 - DNA, 22 bp, Artificial Sequence
  chemically synthesized
tatacttataactcagaaaaag

SEQ ID NO: 796408 - DNA, 22 bp, Artificial Sequence
  chemically synthesized
actttatacttataactcagaa

SEQ ID NO: 796409 - DNA, 22 bp, Artificial Sequence
  chemically synthesized
tttctgagttataagtataaag

SEQ ID NO: 796410 - DNA, 22 bp, Artificial Sequence
  chemically synthesized
ttctgagttataagtataaagt

SEQ ID NO: 796411 - DNA, 22 bp, Artificial Sequence
  chemically synthesized
tctgagttataagtataaagtc

SEQ ID NO: 796412 - DNA, 22 bp, Artificial Sequence
  chemically synthesized
ctgagttataagtataaagtca

SEQ ID NO: 796413 - DNA, 22 bp, Artificial Sequence
  chemically synthesized
tgagttataagtataaagtcag

SEQ ID NO: 796414 - DNA, 22 bp, Artificial Sequence
  chemically synthesized
agttataagtataaagtcagcc

SEQ ID NO: 796415 - DNA, 22 bp, Artificial Sequence
  chemically synthesized
taagtataaagtcagccctgca

SEQ ID NO: 796416 - DNA, 22 bp, Artificial Sequence
  chemically synthesized
agccccaatcagggtaaaagaa

SEQ ID NO: 796417 - DNA, 22 bp, Artificial Sequence
  chemically synthesized
cattcttttaccctgattgggg

SEQ ID NO: 796418 - DNA, 22 bp, Artificial Sequence
  chemically synthesized
taatgtagctcagccccaatca

SEQ ID NO: 796419 - DNA, 22 bp, Artificial Sequence
  chemically synthesized
gtaatgtagctcagccccaatc

SEQ ID NO: 796420 - DNA, 22 bp, Artificial Sequence
  chemically synthesized
ttttaccctgattggggctgag

SEQ ID NO: 796421 - DNA, 22 bp, Artificial Sequence
  chemically synthesized
ttaccctgattggggctgagct

SEQ ID NO: 796422 - DNA, 22 bp, Artificial Sequence
  chemically synthesized
taccctgattggggctgagcta

SEQ ID NO: 796423 - DNA, 22 bp, Artificial Sequence
  chemically synthesized
accctgattggggctgagctac

SEQ ID NO: 796424 - DNA, 22 bp, Artificial Sequence
  chemically synthesized
ccctgattggggctgagctaca

SEQ ID NO: 796425 - DNA, 22 bp, Artificial Sequence
  chemically synthesized
attggggctgagctacattaca

SEQ ID NO: 796426 - DNA, 22 bp, Artificial Sequence
  chemically synthesized
gggctgagctacattacaaatc

SEQ ID NO: 796427 - DNA, 22 bp, Artificial Sequence
  chemically synthesized
aagagacaaaggagatttgtaa

SEQ ID NO: 796428 - DNA, 22 bp, Artificial Sequence
  chemically synthesized
gaagagacaaaggagatttgta

SEQ ID NO: 796429 - DNA, 22 bp, Artificial Sequence
  chemically synthesized
agctacattacaaatctccttt

SEQ ID NO: 796430 - DNA, 22 bp, Artificial Sequence
  chemically synthesized
agcttgaagagacaaaggagat

SEQ ID NO: 796431 - DNA, 22 bp, Artificial Sequence
  chemically synthesized
cattacaaatctcctttgtctc

SEQ ID NO: 796432 - DNA, 22 bp, Artificial Sequence
  chemically synthesized
ccctaagcttgaagagacaaag

SEQ ID NO: 796433 - DNA, 22 bp, Artificial Sequence
  chemically synthesized
caaatctcctttgtctcttcaa

SEQ ID NO: 796434 - DNA, 22 bp, Artificial Sequence
  chemically synthesized
caagctcccctaagcttgaaga

SEQ ID NO: 796435 - DNA, 22 bp, Artificial Sequence
  chemically synthesized
ctgcaagctcccctaagcttga

SEQ ID NO: 796436 - DNA, 22 bp, Artificial Sequence
  chemically synthesized
cctgcaagctcccctaagcttg

SEQ ID NO: 796437 - DNA, 22 bp, Artificial Sequence
  chemically synthesized
ctttgtctcttcaagcttaggg

SEQ ID NO: 796438 - DNA, 22 bp, Artificial Sequence
  chemically synthesized
tgtctcttcaagcttaggggag

SEQ ID NO: 796439 - DNA, 22 bp, Artificial Sequence
  chemically synthesized
gtctcttcaagcttaggggagc

SEQ ID NO: 796440 - DNA, 22 bp, Artificial Sequence
  chemically synthesized
tctcttcaagcttaggggagct

SEQ ID NO: 796441 - DNA, 22 bp, Artificial Sequence
  chemically synthesized
ttcaagcttaggggagcttgca

SEQ ID NO: 796442 - DNA, 22 bp, Artificial Sequence
  chemically synthesized
acagaaaatttcctgcaagctc

SEQ ID NO: 796443 - DNA, 22 bp, Artificial Sequence
  chemically synthesized
caagcttaggggagcttgcagg

SEQ ID NO: 796444 - DNA, 22 bp, Artificial Sequence
  chemically synthesized
aacagaaaatttcctgcaagct

SEQ ID NO: 796445 - DNA, 22 bp, Artificial Sequence
  chemically synthesized
aagcttaggggagcttgcagga

SEQ ID NO: 796446 - DNA, 22 bp, Artificial Sequence
  chemically synthesized
ttaacagaaaatttcctgcaag

SEQ ID NO: 796447 - DNA, 22 bp, Artificial Sequence
  chemically synthesized
aggggagcttgcaggaaatttt

SEQ ID NO: 796448 - DNA, 22 bp, Artificial Sequence
  chemically synthesized
ggggagcttgcaggaaattttc

SEQ ID NO: 796449 - DNA, 22 bp, Artificial Sequence
  chemically synthesized
gcaggaaattttctgttaagaa

SEQ ID NO: 796450 - DNA, 22 bp, Artificial Sequence
  chemically synthesized
caggaaattttctgttaagaat

SEQ ID NO: 796451 - DNA, 22 bp, Artificial Sequence
  chemically synthesized
ataaaaacataaattcttaaca

SEQ ID NO: 796452 - DNA, 22 bp, Artificial Sequence
  chemically synthesized
cataaaaacataaattcttaac

SEQ ID NO: 796453 - DNA, 22 bp, Artificial Sequence
  chemically synthesized
tcataaaaacataaattcttaa

SEQ ID NO: 796454 - DNA, 22 bp, Artificial Sequence
  chemically synthesized
ttcataaaaacataaattctta

SEQ ID NO: 796455 - DNA, 22 bp, Artificial Sequence
  chemically synthesized
tttttcataaaaacataaattc

SEQ ID NO: 796456 - DNA, 22 bp, Artificial Sequence
  chemically synthesized
tctgttaagaatttatgttttt

SEQ ID NO: 796457 - DNA, 22 bp, Artificial Sequence
  chemically synthesized
ctgttaagaatttatgttttta

SEQ ID NO: 796458 - DNA, 22 bp, Artificial Sequence
  chemically synthesized
tgttaagaatttatgtttttat

SEQ ID NO: 796459 - DNA, 22 bp, Artificial Sequence
  chemically synthesized
ttaagaatttatgtttttatga

SEQ ID NO: 796460 - DNA, 22 bp, Artificial Sequence
  chemically synthesized
agtatcattgtttttcataaaa

SEQ ID NO: 796461 - DNA, 22 bp, Artificial Sequence
  chemically synthesized
agaatttatgtttttatgaaaa

SEQ ID NO: 796462 - DNA, 22 bp, Artificial Sequence
  chemically synthesized
tgtctcagtatcattgtttttc

SEQ ID NO: 796463 - DNA, 22 bp, Artificial Sequence
  chemically synthesized
atgtttttatgaaaaacaatga

SEQ ID NO: 796464 - DNA, 22 bp, Artificial Sequence
  chemically synthesized
tgtgtctcagtatcattgtttt

SEQ ID NO: 796465 - DNA, 22 bp, Artificial Sequence
  chemically synthesized
tgtttttatgaaaaacaatgat

SEQ ID NO: 796466 - DNA, 22 bp, Artificial Sequence
  chemically synthesized
ttatgaaaaacaatgatactga

SEQ ID NO: 796467 - DNA, 22 bp, Artificial Sequence
  chemically synthesized
tatgaaaaacaatgatactgag

SEQ ID NO: 796468 - DNA, 22 bp, Artificial Sequence
  chemically synthesized
atgaaaaacaatgatactgaga

SEQ ID NO: 796469 - DNA, 22 bp, Artificial Sequence
  chemically synthesized
tgaaaaacaatgatactgagac

SEQ ID NO: 796470 - DNA, 22 bp, Artificial Sequence
  chemically synthesized
gtagcatacactctgtgtctca

SEQ ID NO: 796471 - DNA, 22 bp, Artificial Sequence
  chemically synthesized
cgtagcatacactctgtgtctc

SEQ ID NO: 796472 - DNA, 22 bp, Artificial Sequence
  chemically synthesized
tcgtagcatacactctgtgtct

SEQ ID NO: 796473 - DNA, 22 bp, Artificial Sequence
  chemically synthesized
ttcgtagcatacactctgtgtc

SEQ ID NO: 796474 - DNA, 22 bp, Artificial Sequence
  chemically synthesized
tttcgtagcatacactctgtgt

SEQ ID NO: 796475 - DNA, 22 bp, Artificial Sequence
  chemically synthesized
ttttcgtagcatacactctgtg

SEQ ID NO: 796476 - DNA, 22 bp, Artificial Sequence
  chemically synthesized
tttttttcgtagcatacactct

SEQ ID NO: 796477 - DNA, 22 bp, Artificial Sequence
  chemically synthesized
atttttttcgtagcatacactc

SEQ ID NO: 796478 - DNA, 22 bp, Artificial Sequence
  chemically synthesized
agacacagagtgtatgctacga

SEQ ID NO: 796479 - DNA, 22 bp, Artificial Sequence
  chemically synthesized
aaagtatttatttttttcgtag

SEQ ID NO: 796480 - DNA, 22 bp, Artificial Sequence
  chemically synthesized
ccctaaaagtatttattttttt

SEQ ID NO: 796481 - DNA, 22 bp, Artificial Sequence
  chemically synthesized
accctaaaagtatttatttttt

SEQ ID NO: 796482 - DNA, 22 bp, Artificial Sequence
  chemically synthesized
taccctaaaagtatttattttt

SEQ ID NO: 796483 - DNA, 22 bp, Artificial Sequence
  chemically synthesized
ttaccctaaaagtatttatttt

SEQ ID NO: 796484 - DNA, 22 bp, Artificial Sequence
  chemically synthesized
tttaccctaaaagtatttattt

SEQ ID NO: 796485 - DNA, 22 bp, Artificial Sequence
  chemically synthesized
ttttaccctaaaagtatttatt

SEQ ID NO: 796486 - DNA, 22 bp, Artificial Sequence
  chemically synthesized
cttttttaccctaaaagtattt

SEQ ID NO: 796487 - DNA, 22 bp, Artificial Sequence
  chemically synthesized
ccttttttaccctaaaagtatt

SEQ ID NO: 796488 - DNA, 22 bp, Artificial Sequence
  chemically synthesized
cgaaaaaaataaatacttttag

SEQ ID NO: 796489 - DNA, 22 bp, Artificial Sequence
  chemically synthesized
tccttttttaccctaaaagtat

SEQ ID NO: 796490 - DNA, 22 bp, Artificial Sequence
  chemically synthesized
ttccttttttaccctaaaagta

SEQ ID NO: 796491 - DNA, 22 bp, Artificial Sequence
  chemically synthesized
tttccttttttaccctaaaagt

SEQ ID NO: 796492 - DNA, 22 bp, Artificial Sequence
  chemically synthesized
ataccacctttttcctttttta

SEQ ID NO: 796493 - DNA, 22 bp, Artificial Sequence
  chemically synthesized
aataccacctttttcctttttt

SEQ ID NO: 796494 - DNA, 22 bp, Artificial Sequence
  chemically synthesized
taataccacctttttccttttt

SEQ ID NO: 796495 - DNA, 22 bp, Artificial Sequence
  chemically synthesized
ttttaataccacctttttcctt

SEQ ID NO: 796496 - DNA, 22 bp, Artificial Sequence
  chemically synthesized
ttagggtaaaaaaggaaaaagg

SEQ ID NO: 796497 - DNA, 22 bp, Artificial Sequence
  chemically synthesized
attttaataccacctttttcct

SEQ ID NO: 796498 - DNA, 22 bp, Artificial Sequence
  chemically synthesized
tagggtaaaaaaggaaaaaggt

SEQ ID NO: 796499 - DNA, 22 bp, Artificial Sequence
  chemically synthesized
agggtaaaaaaggaaaaaggtg

SEQ ID NO: 796500 - DNA, 22 bp, Artificial Sequence
  chemically synthesized
gggtaaaaaaggaaaaaggtgg

SEQ ID NO: 796501 - DNA, 22 bp, Artificial Sequence
  chemically synthesized
ggaaaatttattttaataccac

SEQ ID NO: 796502 - DNA, 22 bp, Artificial Sequence
  chemically synthesized
gggaaaatttattttaatacca

SEQ ID NO: 796503 - DNA, 22 bp, Artificial Sequence
  chemically synthesized
aaataaattttcccaaatactg

SEQ ID NO: 796504 - DNA, 22 bp, Artificial Sequence
  chemically synthesized
acgaaatatataaagagcagta

SEQ ID NO: 796505 - DNA, 22 bp, Artificial Sequence
  chemically synthesized
tcccaaatactgctctttatat

SEQ ID NO: 796506 - DNA, 22 bp, Artificial Sequence
  chemically synthesized
cccaaatactgctctttatata

SEQ ID NO: 796507 - DNA, 22 bp, Artificial Sequence
  chemically synthesized
ccaaatactgctctttatatat

SEQ ID NO: 796508 - DNA, 22 bp, Artificial Sequence
  chemically synthesized
tgtagatgtcactaacgaaata

SEQ ID NO: 796509 - DNA, 22 bp, Artificial Sequence
  chemically synthesized
ctctttatatatttcgttagtg

SEQ ID NO: 796510 - DNA, 22 bp, Artificial Sequence
  chemically synthesized
ttgtgtagatgtcactaacgaa

SEQ ID NO: 796511 - DNA, 22 bp, Artificial Sequence
  chemically synthesized
tttatatatttcgttagtgaca

SEQ ID NO: 796512 - DNA, 22 bp, Artificial Sequence
  chemically synthesized
tatatatttcgttagtgacatc

SEQ ID NO: 796513 - DNA, 22 bp, Artificial Sequence
  chemically synthesized
atatatttcgttagtgacatct

SEQ ID NO: 796514 - DNA, 22 bp, Artificial Sequence
  chemically synthesized
tatatttcgttagtgacatcta

SEQ ID NO: 796515 - DNA, 22 bp, Artificial Sequence
  chemically synthesized
cgttagtgacatctacacaata

SEQ ID NO: 796516 - DNA, 22 bp, Artificial Sequence
  chemically synthesized
ccaaaatatggttattgtgtag

SEQ ID NO: 796517 - DNA, 22 bp, Artificial Sequence
  chemically synthesized
gttagtgacatctacacaataa

SEQ ID NO: 796518 - DNA, 22 bp, Artificial Sequence
  chemically synthesized
cccaaaatatggttattgtgta

SEQ ID NO: 796519 - DNA, 22 bp, Artificial Sequence
  chemically synthesized
cttcccaaaatatggttattgt

SEQ ID NO: 796520 - DNA, 22 bp, Artificial Sequence
  chemically synthesized
gtgacatctacacaataaccat

SEQ ID NO: 796521 - DNA, 22 bp, Artificial Sequence
  chemically synthesized
attgcttcccaaaatatggtta

SEQ ID NO: 796522 - DNA, 22 bp, Artificial Sequence
  chemically synthesized
aattgcttcccaaaatatggtt

SEQ ID NO: 796523 - DNA, 22 bp, Artificial Sequence
  chemically synthesized
cacaataaccatattttgggaa

SEQ ID NO: 796524 - DNA, 22 bp, Artificial Sequence
  chemically synthesized
tccatgtgaggtgtttaattgc

SEQ ID NO: 796525 - DNA, 22 bp, Artificial Sequence
  chemically synthesized
gtccatgtgaggtgtttaattg

SEQ ID NO: 796526 - DNA, 22 bp, Artificial Sequence
  chemically synthesized
tgtccatgtgaggtgtttaatt

SEQ ID NO: 796527 - DNA, 22 bp, Artificial Sequence
  chemically synthesized
ttgtccatgtgaggtgtttaat

SEQ ID NO: 796528 - DNA, 22 bp, Artificial Sequence
  chemically synthesized
tgggaagcaattaaacacctca

SEQ ID NO: 796529 - DNA, 22 bp, Artificial Sequence
  chemically synthesized
gggaagcaattaaacacctcac

SEQ ID NO: 796530 - DNA, 22 bp, Artificial Sequence
  chemically synthesized
ggaagcaattaaacacctcaca

SEQ ID NO: 796531 - DNA, 22 bp, Artificial Sequence
  chemically synthesized
aacacctcacatggacaaaaat

SEQ ID NO: 796532 - DNA, 22 bp, Artificial Sequence
  chemically synthesized
acatggacaaaaatcatatcgg

SEQ ID NO: 796533 - DNA, 22 bp, Artificial Sequence
  chemically synthesized
ccagcccaaatagtaagaaacc

SEQ ID NO: 796534 - DNA, 22 bp, Artificial Sequence
  chemically synthesized
taaggtactgccagcccaaata

SEQ ID NO: 796535 - DNA, 22 bp, Artificial Sequence
  chemically synthesized
ataaggtactgccagcccaaat

SEQ ID NO: 796536 - DNA, 22 bp, Artificial Sequence
  chemically synthesized
tataaggtactgccagcccaaa

SEQ ID NO: 796537 - DNA, 22 bp, Artificial Sequence
  chemically synthesized
ttataaggtactgccagcccaa

SEQ ID NO: 796538 - DNA, 22 bp, Artificial Sequence
  chemically synthesized
tttataaggtactgccagccca

SEQ ID NO: 796539 - DNA, 22 bp, Artificial Sequence
  chemically synthesized
tttttataaggtactgccagcc

SEQ ID NO: 796540 - DNA, 22 bp, Artificial Sequence
  chemically synthesized
cttactatttgggctggcagta

SEQ ID NO: 796541 - DNA, 22 bp, Artificial Sequence
  chemically synthesized
ctttttataaggtactgccagc

SEQ ID NO: 796542 - DNA, 22 bp, Artificial Sequence
  chemically synthesized
ttactatttgggctggcagtac

SEQ ID NO: 796543 - DNA, 22 bp, Artificial Sequence
  chemically synthesized
tctttttataaggtactgccag

SEQ ID NO: 796544 - DNA, 22 bp, Artificial Sequence
  chemically synthesized
ttctttttataaggtactgcca

SEQ ID NO: 796545 - DNA, 22 bp, Artificial Sequence
  chemically synthesized
actatttgggctggcagtacct

SEQ ID NO: 796546 - DNA, 22 bp, Artificial Sequence
  chemically synthesized
tttctttttataaggtactgcc

SEQ ID NO: 796547 - DNA, 22 bp, Artificial Sequence
  chemically synthesized
ctatttgggctggcagtacctt

SEQ ID NO: 796548 - DNA, 22 bp, Artificial Sequence
  chemically synthesized
ttttctttttataaggtactgc

SEQ ID NO: 796549 - DNA, 22 bp, Artificial Sequence
  chemically synthesized
tttgggctggcagtaccttata

SEQ ID NO: 796550 - DNA, 22 bp, Artificial Sequence
  chemically synthesized
gggctggcagtaccttataaaa

SEQ ID NO: 796551 - DNA, 22 bp, Artificial Sequence
  chemically synthesized
atgcttttttctttttataagg

SEQ ID NO: 796552 - DNA, 22 bp, Artificial Sequence
  chemically synthesized
ggctggcagtaccttataaaaa

SEQ ID NO: 796553 - DNA, 22 bp, Artificial Sequence
  chemically synthesized
gatgcttttttctttttataag

SEQ ID NO: 796554 - DNA, 22 bp, Artificial Sequence
  chemically synthesized
gcagtaccttataaaaagaaaa

SEQ ID NO: 796555 - DNA, 22 bp, Artificial Sequence
  chemically synthesized
cagtgccttgatgcttttttct

SEQ ID NO: 796556 - DNA, 22 bp, Artificial Sequence
  chemically synthesized
ataaaaagaaaaaagcatcaag

SEQ ID NO: 796557 - DNA, 22 bp, Artificial Sequence
  chemically synthesized
taaaaagaaaaaagcatcaagg

SEQ ID NO: 796558 - DNA, 22 bp, Artificial Sequence
  chemically synthesized
aaaaatatcatactacagtgcc

SEQ ID NO: 796559 - DNA, 22 bp, Artificial Sequence
  chemically synthesized
taggaaaaacatcctcaaaaat

SEQ ID NO: 796560 - DNA, 22 bp, Artificial Sequence
  chemically synthesized
ataggaaaaacatcctcaaaaa

SEQ ID NO: 796561 - DNA, 22 bp, Artificial Sequence
  chemically synthesized
tataggaaaaacatcctcaaaa

SEQ ID NO: 796562 - DNA, 22 bp, Artificial Sequence
  chemically synthesized
tagtatgatatttttgaggatg

SEQ ID NO: 796563 - DNA, 22 bp, Artificial Sequence
  chemically synthesized
ttataggaaaaacatcctcaaa

SEQ ID NO: 796564 - DNA, 22 bp, Artificial Sequence
  chemically synthesized
aagatttttataggaaaaacat

SEQ ID NO: 796565 - DNA, 22 bp, Artificial Sequence
  chemically synthesized
gaagatttttataggaaaaaca

SEQ ID NO: 796566 - DNA, 22 bp, Artificial Sequence
  chemically synthesized
atttgaagatttttataggaaa

SEQ ID NO: 796567 - DNA, 22 bp, Artificial Sequence
  chemically synthesized
ttgaggatgtttttcctataaa

SEQ ID NO: 796568 - DNA, 22 bp, Artificial Sequence
  chemically synthesized
tgaggatgtttttcctataaaa

SEQ ID NO: 796569 - DNA, 22 bp, Artificial Sequence
  chemically synthesized
gaggatgtttttcctataaaaa

SEQ ID NO: 796570 - DNA, 22 bp, Artificial Sequence
  chemically synthesized
aggatgtttttcctataaaaat

SEQ ID NO: 796571 - DNA, 22 bp, Artificial Sequence
  chemically synthesized
cagctcatttgaagatttttat

SEQ ID NO: 796572 - DNA, 22 bp, Artificial Sequence
  chemically synthesized
gcagctcatttgaagattttta

SEQ ID NO: 796573 - DNA, 22 bp, Artificial Sequence
  chemically synthesized
ttcctataaaaatcttcaaatg

SEQ ID NO: 796574 - DNA, 22 bp, Artificial Sequence
  chemically synthesized
tcctataaaaatcttcaaatga

SEQ ID NO: 796575 - DNA, 22 bp, Artificial Sequence
  chemically synthesized
cctataaaaatcttcaaatgag

SEQ ID NO: 796576 - DNA, 22 bp, Artificial Sequence
  chemically synthesized
ctataaaaatcttcaaatgagc

SEQ ID NO: 796577 - DNA, 22 bp, Artificial Sequence
  chemically synthesized
ggtccatttgcagctcatttga

SEQ ID NO: 796578 - DNA, 22 bp, Artificial Sequence
  chemically synthesized
gggtccatttgcagctcatttg

SEQ ID NO: 796579 - DNA, 22 bp, Artificial Sequence
  chemically synthesized
taaaaatcttcaaatgagctgc

SEQ ID NO: 796580 - DNA, 22 bp, Artificial Sequence
  chemically synthesized
tttgggtccatttgcagctcat

SEQ ID NO: 796581 - DNA, 22 bp, Artificial Sequence
  chemically synthesized
caaatgagctgcaaatggaccc

SEQ ID NO: 796582 - DNA, 22 bp, Artificial Sequence
  chemically synthesized
aaatgagctgcaaatggaccca

SEQ ID NO: 796583 - DNA, 22 bp, Artificial Sequence
  chemically synthesized
aaataagtctgtttgggtccat

SEQ ID NO: 796584 - DNA, 22 bp, Artificial Sequence
  chemically synthesized
caaatggacccaaacagactta

SEQ ID NO: 796585 - DNA, 22 bp, Artificial Sequence
  chemically synthesized
gagtatattaaaataagtctgt

SEQ ID NO: 796586 - DNA, 22 bp, Artificial Sequence
  chemically synthesized
tatatggtcctagagtatatta

SEQ ID NO: 796587 - DNA, 22 bp, Artificial Sequence
  chemically synthesized
ttatatatggtcctagagtata

SEQ ID NO: 796588 - DNA, 22 bp, Artificial Sequence
  chemically synthesized
attatatatggtcctagagtat

SEQ ID NO: 796589 - DNA, 22 bp, Artificial Sequence
  chemically synthesized
tattatatatggtcctagagta

SEQ ID NO: 796590 - DNA, 22 bp, Artificial Sequence
  chemically synthesized
ttattatatatggtcctagagt

SEQ ID NO: 796591 - DNA, 22 bp, Artificial Sequence
  chemically synthesized
attttaatatactctaggacca

SEQ ID NO: 796592 - DNA, 22 bp, Artificial Sequence
  chemically synthesized
ttttaatatactctaggaccat

SEQ ID NO: 796593 - DNA, 22 bp, Artificial Sequence
  chemically synthesized
taatatactctaggaccatata

SEQ ID NO: 796594 - DNA, 22 bp, Artificial Sequence
  chemically synthesized
aatatactctaggaccatatat

SEQ ID NO: 796595 - DNA, 22 bp, Artificial Sequence
  chemically synthesized
atatactctaggaccatatata

SEQ ID NO: 796596 - DNA, 22 bp, Artificial Sequence
  chemically synthesized
taggaccatatataataaaagg

SEQ ID NO: 796597 - DNA, 22 bp, Artificial Sequence
  chemically synthesized
ggaccatatataataaaaggtc

SEQ ID NO: 796598 - DNA, 22 bp, Artificial Sequence
  chemically synthesized
taaaatagtataggacctttta

SEQ ID NO: 796599 - DNA, 22 bp, Artificial Sequence
  chemically synthesized
tataaaatagtataggaccttt

SEQ ID NO: 796600 - DNA, 22 bp, Artificial Sequence
  chemically synthesized
ctataaaatagtataggacctt

SEQ ID NO: 796601 - DNA, 22 bp, Artificial Sequence
  chemically synthesized
aggcaacagaagccatttctat

SEQ ID NO: 796602 - DNA, 22 bp, Artificial Sequence
  chemically synthesized
tactattttatagaaatggctt

SEQ ID NO: 796603 - DNA, 22 bp, Artificial Sequence
  chemically synthesized
atctaaggcaacagaagccatt

SEQ ID NO: 796604 - DNA, 22 bp, Artificial Sequence
  chemically synthesized
ttttatagaaatggcttctgtt

SEQ ID NO: 796605 - DNA, 22 bp, Artificial Sequence
  chemically synthesized
tatagaaatggcttctgttgcc

SEQ ID NO: 796606 - DNA, 22 bp, Artificial Sequence
  chemically synthesized
atagaaatggcttctgttgcct

SEQ ID NO: 796607 - DNA, 22 bp, Artificial Sequence
  chemically synthesized
tagaaatggcttctgttgcctt

SEQ ID NO: 796608 - DNA, 22 bp, Artificial Sequence
  chemically synthesized
tgtgtaaacctcatctaaggca

SEQ ID NO: 796609 - DNA, 22 bp, Artificial Sequence
  chemically synthesized
atgtgtaaacctcatctaaggc

SEQ ID NO: 796610 - DNA, 22 bp, Artificial Sequence
  chemically synthesized
ctgttgccttagatgaggttta

SEQ ID NO: 796611 - DNA, 22 bp, Artificial Sequence
  chemically synthesized
tgttgccttagatgaggtttac

SEQ ID NO: 796612 - DNA, 22 bp, Artificial Sequence
  chemically synthesized
aaagatttatgtgtaaacctca

SEQ ID NO: 796613 - DNA, 22 bp, Artificial Sequence
  chemically synthesized
ttgccttagatgaggtttacac

SEQ ID NO: 796614 - DNA, 22 bp, Artificial Sequence
  chemically synthesized
ccttagatgaggtttacacata

SEQ ID NO: 796615 - DNA, 22 bp, Artificial Sequence
  chemically synthesized
aaagttaaaagatttatgtgta

SEQ ID NO: 796616 - DNA, 22 bp, Artificial Sequence
  chemically synthesized
agatgaggtttacacataaatc

SEQ ID NO: 796617 - DNA, 22 bp, Artificial Sequence
  chemically synthesized
gatgaggtttacacataaatct

SEQ ID NO: 796618 - DNA, 22 bp, Artificial Sequence
  chemically synthesized
acacataaatcttttaactttt

SEQ ID NO: 796619 - DNA, 22 bp, Artificial Sequence
  chemically synthesized
cacataaatcttttaactttta

SEQ ID NO: 796620 - DNA, 22 bp, Artificial Sequence
  chemically synthesized
ttaacttttagtgctgcttgtt

SEQ ID NO: 796621 - DNA, 22 bp, Artificial Sequence
  chemically synthesized
taacttttagtgctgcttgttt

SEQ ID NO: 796622 - DNA, 22 bp, Artificial Sequence
  chemically synthesized
aacttttagtgctgcttgtttc

SEQ ID NO: 796623 - DNA, 22 bp, Artificial Sequence
  chemically synthesized
acttttagtgctgcttgtttca

SEQ ID NO: 796624 - DNA, 22 bp, Artificial Sequence
  chemically synthesized
ttagtgctgcttgtttcacttc

SEQ ID NO: 796625 - DNA, 22 bp, Artificial Sequence
  chemically synthesized
tagtgctgcttgtttcacttct

SEQ ID NO: 796626 - DNA, 22 bp, Artificial Sequence
  chemically synthesized
agtgctgcttgtttcacttctg

SEQ ID NO: 796627 - DNA, 22 bp, Artificial Sequence
  chemically synthesized
gtgctgcttgtttcacttctgg

SEQ ID NO: 796628 - DNA, 22 bp, Artificial Sequence
  chemically synthesized
taaaaagaatccaccagaagtg

SEQ ID NO: 796629 - DNA, 22 bp, Artificial Sequence
  chemically synthesized
ttgtaaaaagaatccaccagaa

SEQ ID NO: 796630 - DNA, 22 bp, Artificial Sequence
  chemically synthesized
cttgtttcacttctggtggatt

SEQ ID NO: 796631 - DNA, 22 bp, Artificial Sequence
  chemically synthesized
gtttcacttctggtggattctt

SEQ ID NO: 796632 - DNA, 22 bp, Artificial Sequence
  chemically synthesized
tttcacttctggtggattcttt

SEQ ID NO: 796633 - DNA, 22 bp, Artificial Sequence
  chemically synthesized
cacttctggtggattcttttta

SEQ ID NO: 796634 - DNA, 22 bp, Artificial Sequence
  chemically synthesized
acttctggtggattctttttac

SEQ ID NO: 796635 - DNA, 22 bp, Artificial Sequence
  chemically synthesized
gcagggcattgttgtaaaaaga

SEQ ID NO: 796636 - DNA, 22 bp, Artificial Sequence
  chemically synthesized
ggcagggcattgttgtaaaaag

SEQ ID NO: 796637 - DNA, 22 bp, Artificial Sequence
  chemically synthesized
ctggtggattctttttacaaca

SEQ ID NO: 796638 - DNA, 22 bp, Artificial Sequence
  chemically synthesized
tggtggattctttttacaacaa

SEQ ID NO: 796639 - DNA, 22 bp, Artificial Sequence
  chemically synthesized
cttggcagggcattgttgtaaa

SEQ ID NO: 796640 - DNA, 22 bp, Artificial Sequence
  chemically synthesized
gtggattctttttacaacaatg

SEQ ID NO: 796641 - DNA, 22 bp, Artificial Sequence
  chemically synthesized
actgcttggcagggcattgttg

SEQ ID NO: 796642 - DNA, 22 bp, Artificial Sequence
  chemically synthesized
tttttacaacaatgccctgcca

SEQ ID NO: 796643 - DNA, 22 bp, Artificial Sequence
  chemically synthesized
tttacaacaatgccctgccaag

SEQ ID NO: 796644 - DNA, 22 bp, Artificial Sequence
  chemically synthesized
ttacaacaatgccctgccaagc

SEQ ID NO: 796645 - DNA, 22 bp, Artificial Sequence
  chemically synthesized
tacaacaatgccctgccaagca

SEQ ID NO: 796646 - DNA, 22 bp, Artificial Sequence
  chemically synthesized
acaacaatgccctgccaagcag

SEQ ID NO: 796647 - DNA, 22 bp, Artificial Sequence
  chemically synthesized
caacaatgccctgccaagcagt

SEQ ID NO: 796648 - DNA, 22 bp, Artificial Sequence
  chemically synthesized
tgaagtagtattaactgcttgg

SEQ ID NO: 796649 - DNA, 22 bp, Artificial Sequence
  chemically synthesized
atgaagtagtattaactgcttg

SEQ ID NO: 796650 - DNA, 22 bp, Artificial Sequence
  chemically synthesized
tatgaagtagtattaactgctt

SEQ ID NO: 796651 - DNA, 22 bp, Artificial Sequence
  chemically synthesized
ctttatgaagtagtattaactg

SEQ ID NO: 796652 - DNA, 22 bp, Artificial Sequence
  chemically synthesized
cctttatgaagtagtattaact

SEQ ID NO: 796653 - DNA, 22 bp, Artificial Sequence
  chemically synthesized
ccaagcagttaatactacttca

SEQ ID NO: 796654 - DNA, 22 bp, Artificial Sequence
  chemically synthesized
atactacttcataaaggaagac

SEQ ID NO: 796655 - DNA, 22 bp, Artificial Sequence
  chemically synthesized
cttcataaaggaagacgccacc

SEQ ID NO: 796656 - DNA, 22 bp, Artificial Sequence
  chemically synthesized
cataaaggaagacgccacccct

SEQ ID NO: 796657 - DNA, 22 bp, Artificial Sequence
  chemically synthesized
ataaaggaagacgccacccctt

SEQ ID NO: 796658 - DNA, 22 bp, Artificial Sequence
  chemically synthesized
tgggtcacaaacgtgaaggtca

SEQ ID NO: 796659 - DNA, 22 bp, Artificial Sequence
  chemically synthesized
cattatgggtcacaaacgtgaa

SEQ ID NO: 796660 - DNA, 22 bp, Artificial Sequence
  chemically synthesized
gcattatgggtcacaaacgtga

SEQ ID NO: 796661 - DNA, 22 bp, Artificial Sequence
  chemically synthesized
gaccttcacgtttgtgacccat

SEQ ID NO: 796662 - DNA, 22 bp, Artificial Sequence
  chemically synthesized
accttcacgtttgtgacccata

SEQ ID NO: 796663 - DNA, 22 bp, Artificial Sequence
  chemically synthesized
cacgtttgtgacccataatgca

SEQ ID NO: 796664 - DNA, 22 bp, Artificial Sequence
  chemically synthesized
acgtttgtgacccataatgcaa

SEQ ID NO: 796665 - DNA, 22 bp, Artificial Sequence
  chemically synthesized
gtgacccataatgcaaggtgct

SEQ ID NO: 796666 - DNA, 22 bp, Artificial Sequence
  chemically synthesized
tgacccataatgcaaggtgctt

SEQ ID NO: 796667 - DNA, 22 bp, Artificial Sequence
  chemically synthesized
gaaaagatagagatgatggaag

SEQ ID NO: 796668 - DNA, 22 bp, Artificial Sequence
  chemically synthesized
ccatcatctctatcttttctag

SEQ ID NO: 796669 - DNA, 22 bp, Artificial Sequence
  chemically synthesized
catcatctctatcttttctaga

SEQ ID NO: 796670 - DNA, 22 bp, Artificial Sequence
  chemically synthesized
caaggaagggtgatatctagaa

SEQ ID NO: 796671 - DNA, 22 bp, Artificial Sequence
  chemically synthesized
ccaaggaagggtgatatctaga

SEQ ID NO: 796672 - DNA, 22 bp, Artificial Sequence
  chemically synthesized
tatcttttctagatatcaccct

SEQ ID NO: 796673 - DNA, 22 bp, Artificial Sequence
  chemically synthesized
cacttccaaggaagggtgatat

SEQ ID NO: 796674 - DNA, 22 bp, Artificial Sequence
  chemically synthesized
tcttttctagatatcacccttc

SEQ ID NO: 796675 - DNA, 22 bp, Artificial Sequence
  chemically synthesized
tctgcacttccaaggaagggtg

SEQ ID NO: 796676 - DNA, 22 bp, Artificial Sequence
  chemically synthesized
gtctgcacttccaaggaagggt

SEQ ID NO: 796677 - DNA, 22 bp, Artificial Sequence
  chemically synthesized
ttctagatatcacccttccttg

SEQ ID NO: 796678 - DNA, 22 bp, Artificial Sequence
  chemically synthesized
tctagatatcacccttccttgg

SEQ ID NO: 796679 - DNA, 22 bp, Artificial Sequence
  chemically synthesized
ctagatatcacccttccttgga

SEQ ID NO: 796680 - DNA, 22 bp, Artificial Sequence
  chemically synthesized
tagatatcacccttccttggaa

SEQ ID NO: 796681 - DNA, 22 bp, Artificial Sequence
  chemically synthesized
gatatcacccttccttggaagt

SEQ ID NO: 796682 - DNA, 22 bp, Artificial Sequence
  chemically synthesized
ccttggaagtgcagacaagtgt

SEQ ID NO: 796683 - DNA, 22 bp, Artificial Sequence
  chemically synthesized
cttggaagtgcagacaagtgtt

SEQ ID NO: 796684 - DNA, 22 bp, Artificial Sequence
  chemically synthesized
ggaagtgcagacaagtgttttg

SEQ ID NO: 796685 - DNA, 22 bp, Artificial Sequence
  chemically synthesized
gaagtgcagacaagtgttttgt

SEQ ID NO: 796686 - DNA, 22 bp, Artificial Sequence
  chemically synthesized
aaacaaaacaagaacaaataaa

SEQ ID NO: 796687 - DNA, 22 bp, Artificial Sequence
  chemically synthesized
acctcaaacaaaacaagaacaa

SEQ ID NO: 796688 - DNA, 22 bp, Artificial Sequence
  chemically synthesized
tgtttatttgttcttgttttgt

SEQ ID NO: 796689 - DNA, 22 bp, Artificial Sequence
  chemically synthesized
gtttatttgttcttgttttgtt

SEQ ID NO: 796690 - DNA, 22 bp, Artificial Sequence
  chemically synthesized
tttatttgttcttgttttgttt

SEQ ID NO: 796691 - DNA, 22 bp, Artificial Sequence
  chemically synthesized
atttgttcttgttttgtttgag

SEQ ID NO: 796692 - DNA, 22 bp, Artificial Sequence
  chemically synthesized
tttgttcttgttttgtttgagg

SEQ ID NO: 796693 - DNA, 22 bp, Artificial Sequence
  chemically synthesized
gttcttgttttgtttgaggtca

SEQ ID NO: 796694 - DNA, 22 bp, Artificial Sequence
  chemically synthesized
ttcttgttttgtttgaggtcaa

SEQ ID NO: 796695 - DNA, 22 bp, Artificial Sequence
  chemically synthesized
ttgttttgtttgaggtcaattc

SEQ ID NO: 796696 - DNA, 22 bp, Artificial Sequence
  chemically synthesized
gttttgtttgaggtcaattcac

SEQ ID NO: 796697 - DNA, 22 bp, Artificial Sequence
  chemically synthesized
ttttgtttgaggtcaattcact

SEQ ID NO: 796698 - DNA, 22 bp, Artificial Sequence
  chemically synthesized
gagaaaggagccagtgaattga

SEQ ID NO: 796699 - DNA, 22 bp, Artificial Sequence
  chemically synthesized
tgtttgaggtcaattcactggc

SEQ ID NO: 796700 - DNA, 22 bp, Artificial Sequence
  chemically synthesized
gtttgaggtcaattcactggct

SEQ ID NO: 796701 - DNA, 22 bp, Artificial Sequence
  chemically synthesized
tttgaggtcaattcactggctc

SEQ ID NO: 796702 - DNA, 22 bp, Artificial Sequence
  chemically synthesized
gaggtcaattcactggctcctt

SEQ ID NO: 796703 - DNA, 22 bp, Artificial Sequence
  chemically synthesized
aggtcaattcactggctccttt

SEQ ID NO: 796704 - DNA, 22 bp, Artificial Sequence
  chemically synthesized
actggctcctttctccagtttt

SEQ ID NO: 796705 - DNA, 22 bp, Artificial Sequence
  chemically synthesized
aaaaaaaaaaaaaaaactggag

SEQ ID NO: 796706 - DNA, 22 bp, Artificial Sequence
  chemically synthesized
aaaaaaaaaaaaaaaaactgga

SEQ ID NO: 796707 - DNA, 22 bp, Artificial Sequence
  chemically synthesized
gctcctttctccagtttttttt

SEQ ID NO: 796708 - DNA, 22 bp, Artificial Sequence
  chemically synthesized
ctttctccagtttttttttttt

SEQ ID NO: 796709 - DNA, 22 bp, Artificial Sequence
  chemically synthesized
aaggtgtttaaaaaaaaaaaaa

SEQ ID NO: 796710 - DNA, 22 bp, Artificial Sequence
  chemically synthesized
tctccagttttttttttttttt

SEQ ID NO: 796711 - DNA, 22 bp, Artificial Sequence
  chemically synthesized
caaggtgtttaaaaaaaaaaaa

SEQ ID NO: 796712 - DNA, 22 bp, Artificial Sequence
  chemically synthesized
ctccagtttttttttttttttt

SEQ ID NO: 796713 - DNA, 22 bp, Artificial Sequence
  chemically synthesized
tcaaggtgtttaaaaaaaaaaa

SEQ ID NO: 796714 - DNA, 22 bp, Artificial Sequence
  chemically synthesized
tccagttttttttttttttttt

SEQ ID NO: 796715 - DNA, 22 bp, Artificial Sequence
  chemically synthesized
cagtttttttttttttttttaa

SEQ ID NO: 796716 - DNA, 22 bp, Artificial Sequence
  chemically synthesized
gaagctttcaaggtgtttaaaa

SEQ ID NO: 796717 - DNA, 22 bp, Artificial Sequence
  chemically synthesized
ttttttttttttttaaacacct

SEQ ID NO: 796718 - DNA, 22 bp, Artificial Sequence
  chemically synthesized
tttttttttttttaaacacctt

SEQ ID NO: 796719 - DNA, 22 bp, Artificial Sequence
  chemically synthesized
ttttttttttttaaacaccttg

SEQ ID NO: 796720 - DNA, 22 bp, Artificial Sequence
  chemically synthesized
tttttttttttaaacaccttga

SEQ ID NO: 796721 - DNA, 22 bp, Artificial Sequence
  chemically synthesized
ttttttttttaaacaccttgaa

SEQ ID NO: 796722 - DNA, 22 bp, Artificial Sequence
  chemically synthesized
tttttttttaaacaccttgaaa

SEQ ID NO: 796723 - DNA, 22 bp, Artificial Sequence
  chemically synthesized
ttttttttaaacaccttgaaag

SEQ ID NO: 796724 - DNA, 22 bp, Artificial Sequence
  chemically synthesized
tttttttaaacaccttgaaagc

SEQ ID NO: 796725 - DNA, 22 bp, Artificial Sequence
  chemically synthesized
ttttttaaacaccttgaaagct

SEQ ID NO: 796726 - DNA, 22 bp, Artificial Sequence
  chemically synthesized
tttttaaacaccttgaaagctt

SEQ ID NO: 796727 - DNA, 22 bp, Artificial Sequence
  chemically synthesized
ttttaaacaccttgaaagcttc

SEQ ID NO: 796728 - DNA, 22 bp, Artificial Sequence
  chemically synthesized
gcagatgtattagaagctttca

SEQ ID NO: 796729 - DNA, 22 bp, Artificial Sequence
  chemically synthesized
tttaaacaccttgaaagcttct

SEQ ID NO: 796730 - DNA, 22 bp, Artificial Sequence
  chemically synthesized
ttaaacaccttgaaagcttcta

SEQ ID NO: 796731 - DNA, 22 bp, Artificial Sequence
  chemically synthesized
taaacaccttgaaagcttctaa

SEQ ID NO: 796732 - DNA, 22 bp, Artificial Sequence
  chemically synthesized
aaacaccttgaaagcttctaat

SEQ ID NO: 796733 - DNA, 22 bp, Artificial Sequence
  chemically synthesized
gctagcagatgtattagaagct

SEQ ID NO: 796734 - DNA, 22 bp, Artificial Sequence
  chemically synthesized
aacaccttgaaagcttctaata

SEQ ID NO: 796735 - DNA, 22 bp, Artificial Sequence
  chemically synthesized
ggctagcagatgtattagaagc

SEQ ID NO: 796736 - DNA, 22 bp, Artificial Sequence
  chemically synthesized
tggctagcagatgtattagaag

SEQ ID NO: 796737 - DNA, 22 bp, Artificial Sequence
  chemically synthesized
ttttggctagcagatgtattag

SEQ ID NO: 796738 - DNA, 22 bp, Artificial Sequence
  chemically synthesized
gaaagcttctaatacatctgct

SEQ ID NO: 796739 - DNA, 22 bp, Artificial Sequence
  chemically synthesized
aaagcttctaatacatctgcta

SEQ ID NO: 796740 - DNA, 22 bp, Artificial Sequence
  chemically synthesized
ctaatacatctgctagccaaaa

SEQ ID NO: 796741 - DNA, 22 bp, Artificial Sequence
  chemically synthesized
taatacatctgctagccaaaac

SEQ ID NO: 796742 - DNA, 22 bp, Artificial Sequence
  chemically synthesized
atacatctgctagccaaaacag

SEQ ID NO: 796743 - DNA, 22 bp, Artificial Sequence
  chemically synthesized
ctagccaaaacagtcattttca

SEQ ID NO: 796744 - DNA, 22 bp, Artificial Sequence
  chemically synthesized
gccaaaacagtcattttcatta

SEQ ID NO: 796745 - DNA, 22 bp, Artificial Sequence
  chemically synthesized
accagccacaagcatgtaatga

SEQ ID NO: 796746 - DNA, 22 bp, Artificial Sequence
  chemically synthesized
gaccagccacaagcatgtaatg

SEQ ID NO: 796747 - DNA, 22 bp, Artificial Sequence
  chemically synthesized
tgaccagccacaagcatgtaat

SEQ ID NO: 796748 - DNA, 22 bp, Artificial Sequence
  chemically synthesized
ttgaccagccacaagcatgtaa

SEQ ID NO: 796749 - DNA, 22 bp, Artificial Sequence
  chemically synthesized
tttgaccagccacaagcatgta

SEQ ID NO: 796750 - DNA, 22 bp, Artificial Sequence
  chemically synthesized
tttttgaccagccacaagcatg

SEQ ID NO: 796751 - DNA, 22 bp, Artificial Sequence
  chemically synthesized
ttctttttgaccagccacaagc

SEQ ID NO: 796752 - DNA, 22 bp, Artificial Sequence
  chemically synthesized
tcattacatgcttgtggctggt

SEQ ID NO: 796753 - DNA, 22 bp, Artificial Sequence
  chemically synthesized
cattacatgcttgtggctggtc

SEQ ID NO: 796754 - DNA, 22 bp, Artificial Sequence
  chemically synthesized
attacatgcttgtggctggtca

SEQ ID NO: 796755 - DNA, 22 bp, Artificial Sequence
  chemically synthesized
tacaactgttctttttgaccag

SEQ ID NO: 796756 - DNA, 22 bp, Artificial Sequence
  chemically synthesized
catgcttgtggctggtcaaaaa

SEQ ID NO: 796757 - DNA, 22 bp, Artificial Sequence
  chemically synthesized
gtggctggtcaaaaagaacagt

SEQ ID NO: 796758 - DNA, 22 bp, Artificial Sequence
  chemically synthesized
tggctggtcaaaaagaacagtt

SEQ ID NO: 796759 - DNA, 22 bp, Artificial Sequence
  chemically synthesized
gtcaaaaagaacagttgtataa

SEQ ID NO: 796760 - DNA, 22 bp, Artificial Sequence
  chemically synthesized
ggtaagaaaataaaaattatac

SEQ ID NO: 796761 - DNA, 22 bp, Artificial Sequence
  chemically synthesized
tggtctgggtaagaaaataaaa

SEQ ID NO: 796762 - DNA, 22 bp, Artificial Sequence
  chemically synthesized
gtggtctgggtaagaaaataaa

SEQ ID NO: 796763 - DNA, 22 bp, Artificial Sequence
  chemically synthesized
tttgtggtctgggtaagaaaat

SEQ ID NO: 796764 - DNA, 22 bp, Artificial Sequence
  chemically synthesized
tataatttttattttcttaccc

SEQ ID NO: 796765 - DNA, 22 bp, Artificial Sequence
  chemically synthesized
taacctgtttgtggtctgggta

SEQ ID NO: 796766 - DNA, 22 bp, Artificial Sequence
  chemically synthesized
ataacctgtttgtggtctgggt

SEQ ID NO: 796767 - DNA, 22 bp, Artificial Sequence
  chemically synthesized
tataacctgtttgtggtctggg

SEQ ID NO: 796768 - DNA, 22 bp, Artificial Sequence
  chemically synthesized
ttattttcttacccagaccaca

SEQ ID NO: 796769 - DNA, 22 bp, Artificial Sequence
  chemically synthesized
ttataacctgtttgtggtctgg

SEQ ID NO: 796770 - DNA, 22 bp, Artificial Sequence
  chemically synthesized
tattttcttacccagaccacaa

SEQ ID NO: 796771 - DNA, 22 bp, Artificial Sequence
  chemically synthesized
tttataacctgtttgtggtctg

SEQ ID NO: 796772 - DNA, 22 bp, Artificial Sequence
  chemically synthesized
attttcttacccagaccacaaa

SEQ ID NO: 796773 - DNA, 22 bp, Artificial Sequence
  chemically synthesized
ttttcttacccagaccacaaac

SEQ ID NO: 796774 - DNA, 22 bp, Artificial Sequence
  chemically synthesized
tcttacccagaccacaaacagg

SEQ ID NO: 796775 - DNA, 22 bp, Artificial Sequence
  chemically synthesized
cttacccagaccacaaacaggt

SEQ ID NO: 796776 - DNA, 22 bp, Artificial Sequence
  chemically synthesized
ttacccagaccacaaacaggtt

SEQ ID NO: 796777 - DNA, 22 bp, Artificial Sequence
  chemically synthesized
acccagaccacaaacaggttat

SEQ ID NO: 796778 - DNA, 22 bp, Artificial Sequence
  chemically synthesized
cccagaccacaaacaggttata

SEQ ID NO: 796779 - DNA, 22 bp, Artificial Sequence
  chemically synthesized
agggccatgtactttttataac

SEQ ID NO: 796780 - DNA, 22 bp, Artificial Sequence
  chemically synthesized
aagggccatgtactttttataa

SEQ ID NO: 796781 - DNA, 22 bp, Artificial Sequence
  chemically synthesized
taaaaagtacatggcccttaaa

SEQ ID NO: 796782 - DNA, 22 bp, Artificial Sequence
  chemically synthesized
aaggaaccgccaaaatttaagg

SEQ ID NO: 796783 - DNA, 22 bp, Artificial Sequence
  chemically synthesized
aaaggaaccgccaaaatttaag

SEQ ID NO: 796784 - DNA, 22 bp, Artificial Sequence
  chemically synthesized
taaaggaaccgccaaaatttaa

SEQ ID NO: 796785 - DNA, 22 bp, Artificial Sequence
  chemically synthesized
aattttaaaggaaccgccaaaa

SEQ ID NO: 796786 - DNA, 22 bp, Artificial Sequence
  chemically synthesized
aactaaattttaaaggaaccgc

SEQ ID NO: 796787 - DNA, 22 bp, Artificial Sequence
  chemically synthesized
gaactaaattttaaaggaaccg

SEQ ID NO: 796788 - DNA, 22 bp, Artificial Sequence
  chemically synthesized
tgaactaaattttaaaggaacc

SEQ ID NO: 796789 - DNA, 22 bp, Artificial Sequence
  chemically synthesized
ttgaactaaattttaaaggaac

SEQ ID NO: 796790 - DNA, 22 bp, Artificial Sequence
  chemically synthesized
aaattttggcggttcctttaaa

SEQ ID NO: 796791 - DNA, 22 bp, Artificial Sequence
  chemically synthesized
aattttggcggttcctttaaaa

SEQ ID NO: 796792 - DNA, 22 bp, Artificial Sequence
  chemically synthesized
gcttttgaactaaattttaaag

SEQ ID NO: 796793 - DNA, 22 bp, Artificial Sequence
  chemically synthesized
tggcggttcctttaaaatttag

SEQ ID NO: 796794 - DNA, 22 bp, Artificial Sequence
  chemically synthesized
ggcggttcctttaaaatttagt

SEQ ID NO: 796795 - DNA, 22 bp, Artificial Sequence
  chemically synthesized
gcggttcctttaaaatttagtt

SEQ ID NO: 796796 - DNA, 22 bp, Artificial Sequence
  chemically synthesized
atgttggcttttgaactaaatt

SEQ ID NO: 796797 - DNA, 22 bp, Artificial Sequence
  chemically synthesized
catgttggcttttgaactaaat

SEQ ID NO: 796798 - DNA, 22 bp, Artificial Sequence
  chemically synthesized
ttcatgttggcttttgaactaa

SEQ ID NO: 796799 - DNA, 22 bp, Artificial Sequence
  chemically synthesized
ctttaaaatttagttcaaaagc

SEQ ID NO: 796800 - DNA, 22 bp, Artificial Sequence
  chemically synthesized
actcttcatgttggcttttgaa

SEQ ID NO: 796801 - DNA, 22 bp, Artificial Sequence
  chemically synthesized
taaaatttagttcaaaagccaa

SEQ ID NO: 796802 - DNA, 22 bp, Artificial Sequence
  chemically synthesized
aaaatttagttcaaaagccaac

SEQ ID NO: 796803 - DNA, 22 bp, Artificial Sequence
  chemically synthesized
aaatttagttcaaaagccaaca

SEQ ID NO: 796804 - DNA, 22 bp, Artificial Sequence
  chemically synthesized
catctgactcttcatgttggct

SEQ ID NO: 796805 - DNA, 22 bp, Artificial Sequence
  chemically synthesized
agttcaaaagccaacatgaaga

SEQ ID NO: 796806 - DNA, 22 bp, Artificial Sequence
  chemically synthesized
gttcaaaagccaacatgaagag

SEQ ID NO: 796807 - DNA, 22 bp, Artificial Sequence
  chemically synthesized
aaaagccaacatgaagagtcag

SEQ ID NO: 796808 - DNA, 22 bp, Artificial Sequence
  chemically synthesized
catgtgacagtcattccatctg

SEQ ID NO: 796809 - DNA, 22 bp, Artificial Sequence
  chemically synthesized
ccatgtgacagtcattccatct

SEQ ID NO: 796810 - DNA, 22 bp, Artificial Sequence
  chemically synthesized
ttccatgtgacagtcattccat

SEQ ID NO: 796811 - DNA, 22 bp, Artificial Sequence
  chemically synthesized
gtagctcttccatgtgacagtc

SEQ ID NO: 796812 - DNA, 22 bp, Artificial Sequence
  chemically synthesized
ggtagctcttccatgtgacagt

SEQ ID NO: 796813 - DNA, 22 bp, Artificial Sequence
  chemically synthesized
cttggtagctcttccatgtgac

SEQ ID NO: 796814 - DNA, 22 bp, Artificial Sequence
  chemically synthesized
tctgcttggtagctcttccatg

SEQ ID NO: 796815 - DNA, 22 bp, Artificial Sequence
  chemically synthesized
ttatctgcttggtagctcttcc

SEQ ID NO: 796816 - DNA, 22 bp, Artificial Sequence
  chemically synthesized
attatctgcttggtagctcttc

SEQ ID NO: 796817 - DNA, 22 bp, Artificial Sequence
  chemically synthesized
tcacatggaagagctaccaagc

SEQ ID NO: 796818 - DNA, 22 bp, Artificial Sequence
  chemically synthesized
aacttattatctgcttggtagc

SEQ ID NO: 796819 - DNA, 22 bp, Artificial Sequence
  chemically synthesized
taaacttattatctgcttggta

SEQ ID NO: 796820 - DNA, 22 bp, Artificial Sequence
  chemically synthesized
agagttctaaacttattatctg

SEQ ID NO: 796821 - DNA, 22 bp, Artificial Sequence
  chemically synthesized
aattaagagttctaaacttatt

SEQ ID NO: 796822 - DNA, 22 bp, Artificial Sequence
  chemically synthesized
caattaagagttctaaacttat

SEQ ID NO: 796823 - DNA, 22 bp, Artificial Sequence
  chemically synthesized
ccaagcagataataagtttaga

SEQ ID NO: 796824 - DNA, 22 bp, Artificial Sequence
  chemically synthesized
tcaattaagagttctaaactta

SEQ ID NO: 796825 - DNA, 22 bp, Artificial Sequence
  chemically synthesized
attttcaattaagagttctaaa

SEQ ID NO: 796826 - DNA, 22 bp, Artificial Sequence
  chemically synthesized
agaactcttaattgaaaattaa

SEQ ID NO: 796827 - DNA, 22 bp, Artificial Sequence
  chemically synthesized
gaactcttaattgaaaattaac

SEQ ID NO: 796828 - DNA, 22 bp, Artificial Sequence
  chemically synthesized
ttaattgaaaattaacacacct

SEQ ID NO: 796829 - DNA, 22 bp, Artificial Sequence
  chemically synthesized
ggaatacaatgtaggtgtgtta

SEQ ID NO: 796830 - DNA, 22 bp, Artificial Sequence
  chemically synthesized
gggaatacaatgtaggtgtgtt

SEQ ID NO: 796831 - DNA, 22 bp, Artificial Sequence
  chemically synthesized
aattgaaaattaacacacctac

SEQ ID NO: 796832 - DNA, 22 bp, Artificial Sequence
  chemically synthesized
attgaaaattaacacacctaca

SEQ ID NO: 796833 - DNA, 22 bp, Artificial Sequence
  chemically synthesized
aatttgggaatacaatgtaggt

SEQ ID NO: 796834 - DNA, 22 bp, Artificial Sequence
  chemically synthesized
aaaattaacacacctacattgt

SEQ ID NO: 796835 - DNA, 22 bp, Artificial Sequence
  chemically synthesized
caatttgggaatacaatgtagg

SEQ ID NO: 796836 - DNA, 22 bp, Artificial Sequence
  chemically synthesized
ttcaatttgggaatacaatgta

SEQ ID NO: 796837 - DNA, 22 bp, Artificial Sequence
  chemically synthesized
cttcaatttgggaatacaatgt

SEQ ID NO: 796838 - DNA, 22 bp, Artificial Sequence
  chemically synthesized
tcttcaatttgggaatacaatg

SEQ ID NO: 796839 - DNA, 22 bp, Artificial Sequence
  chemically synthesized
acacacctacattgtattccca

SEQ ID NO: 796840 - DNA, 22 bp, Artificial Sequence
  chemically synthesized
cattgtattcccaaattgaaga

SEQ ID NO: 796841 - DNA, 22 bp, Artificial Sequence
  chemically synthesized
tattcccaaattgaagaaaacg

SEQ ID NO: 796842 - DNA, 22 bp, Artificial Sequence
  chemically synthesized
ccaaattgaagaaaacggctgt

SEQ ID NO: 796843 - DNA, 22 bp, Artificial Sequence
  chemically synthesized
tagcagtagccaaaacagccgt

SEQ ID NO: 796844 - DNA, 22 bp, Artificial Sequence
  chemically synthesized
ttatagcagtagccaaaacagc

SEQ ID NO: 796845 - DNA, 22 bp, Artificial Sequence
  chemically synthesized
attatagcagtagccaaaacag

SEQ ID NO: 796846 - DNA, 22 bp, Artificial Sequence
  chemically synthesized
aagaaaacggctgttttggcta

SEQ ID NO: 796847 - DNA, 22 bp, Artificial Sequence
  chemically synthesized
ttttggctactgctataataag

SEQ ID NO: 796848 - DNA, 22 bp, Artificial Sequence
  chemically synthesized
tggctactgctataataagatg

SEQ ID NO: 796849 - DNA, 22 bp, Artificial Sequence
  chemically synthesized
ggctactgctataataagatgc

SEQ ID NO: 796850 - DNA, 22 bp, Artificial Sequence
  chemically synthesized
gctactgctataataagatgct

SEQ ID NO: 796851 - DNA, 22 bp, Artificial Sequence
  chemically synthesized
ctgctataataagatgctgcat

SEQ ID NO: 796852 - DNA, 22 bp, Artificial Sequence
  chemically synthesized
agcatgtgaagtatgcagcatc

SEQ ID NO: 796853 - DNA, 22 bp, Artificial Sequence
  chemically synthesized
ctataataagatgctgcatact

SEQ ID NO: 796854 - DNA, 22 bp, Artificial Sequence
  chemically synthesized
taataagatgctgcatacttca

SEQ ID NO: 796855 - DNA, 22 bp, Artificial Sequence
  chemically synthesized
cagattcagcatgtgaagtatg

SEQ ID NO: 796856 - DNA, 22 bp, Artificial Sequence
  chemically synthesized
ccagattcagcatgtgaagtat

SEQ ID NO: 796857 - DNA, 22 bp, Artificial Sequence
  chemically synthesized
ccccttccagattcagcatgtg

SEQ ID NO: 796858 - DNA, 22 bp, Artificial Sequence
  chemically synthesized
ctcccccttccagattcagcat

SEQ ID NO: 796859 - DNA, 22 bp, Artificial Sequence
  chemically synthesized
catacttcacatgctgaatctg

SEQ ID NO: 796860 - DNA, 22 bp, Artificial Sequence
  chemically synthesized
aattgctcccccttccagattc

SEQ ID NO: 796861 - DNA, 22 bp, Artificial Sequence
  chemically synthesized
cacatgctgaatctggaagggg

SEQ ID NO: 796862 - DNA, 22 bp, Artificial Sequence
  chemically synthesized
acatgctgaatctggaaggggg

SEQ ID NO: 796863 - DNA, 22 bp, Artificial Sequence
  chemically synthesized
aatctggaagggggagcaattc

SEQ ID NO: 796864 - DNA, 22 bp, Artificial Sequence
  chemically synthesized
gaagggggagcaattcagtcct

SEQ ID NO: 796865 - DNA, 22 bp, Artificial Sequence
  chemically synthesized
ggaacaaccgtcagataggact

SEQ ID NO: 796866 - DNA, 22 bp, Artificial Sequence
  chemically synthesized
aggaacaaccgtcagataggac

SEQ ID NO: 796867 - DNA, 22 bp, Artificial Sequence
  chemically synthesized
aagcttaggaacaaccgtcaga

SEQ ID NO: 796868 - DNA, 22 bp, Artificial Sequence
  chemically synthesized
agtcctatctgacggttgttcc

SEQ ID NO: 796869 - DNA, 22 bp, Artificial Sequence
  chemically synthesized
tactaaagcttaggaacaaccg

SEQ ID NO: 796870 - DNA, 22 bp, Artificial Sequence
  chemically synthesized
aagttatactaaagcttaggaa

SEQ ID NO: 796871 - DNA, 22 bp, Artificial Sequence
  chemically synthesized
tctgacggttgttcctaagctt

SEQ ID NO: 796872 - DNA, 22 bp, Artificial Sequence
  chemically synthesized
gaagttatactaaagcttagga

SEQ ID NO: 796873 - DNA, 22 bp, Artificial Sequence
  chemically synthesized
tgaagttatactaaagcttagg

SEQ ID NO: 796874 - DNA, 22 bp, Artificial Sequence
  chemically synthesized
acggttgttcctaagctttagt

SEQ ID NO: 796875 - DNA, 22 bp, Artificial Sequence
  chemically synthesized
atctttgaagttatactaaagc

SEQ ID NO: 796876 - DNA, 22 bp, Artificial Sequence
  chemically synthesized
ttcctaagctttagtataactt

SEQ ID NO: 796877 - DNA, 22 bp, Artificial Sequence
  chemically synthesized
ctaagctttagtataacttcaa

SEQ ID NO: 796878 - DNA, 22 bp, Artificial Sequence
  chemically synthesized
ataccctcatctttgaagttat

SEQ ID NO: 796879 - DNA, 22 bp, Artificial Sequence
  chemically synthesized
cataccctcatctttgaagtta

SEQ ID NO: 796880 - DNA, 22 bp, Artificial Sequence
  chemically synthesized
agctttagtataacttcaaaga

SEQ ID NO: 796881 - DNA, 22 bp, Artificial Sequence
  chemically synthesized
tagtataacttcaaagatgagg

SEQ ID NO: 796882 - DNA, 22 bp, Artificial Sequence
  chemically synthesized
agtataacttcaaagatgaggg

SEQ ID NO: 796883 - DNA, 22 bp, Artificial Sequence
  chemically synthesized
gtataacttcaaagatgagggt

SEQ ID NO: 796884 - DNA, 22 bp, Artificial Sequence
  chemically synthesized
acgatgacggaatttcataccc

SEQ ID NO: 796885 - DNA, 22 bp, Artificial Sequence
  chemically synthesized
tgacgatgacggaatttcatac

SEQ ID NO: 796886 - DNA, 22 bp, Artificial Sequence
  chemically synthesized
caaagatgagggtatgaaattc

SEQ ID NO: 796887 - DNA, 22 bp, Artificial Sequence
  chemically synthesized
aaagatgagggtatgaaattcc

SEQ ID NO: 796888 - DNA, 22 bp, Artificial Sequence
  chemically synthesized
tctgacgatgacggaatttcat

SEQ ID NO: 796889 - DNA, 22 bp, Artificial Sequence
  chemically synthesized
cgtcatcgtcagagagatcctg

SEQ ID NO: 796890 - DNA, 22 bp, Artificial Sequence
  chemically synthesized
caacccaaggaagagaaagcag

SEQ ID NO: 796891 - DNA, 22 bp, Artificial Sequence
  chemically synthesized
gcaacccaaggaagagaaagca

SEQ ID NO: 796892 - DNA, 22 bp, Artificial Sequence
  chemically synthesized
tgcaacccaaggaagagaaagc

SEQ ID NO: 796893 - DNA, 22 bp, Artificial Sequence
  chemically synthesized
actttgcaacccaaggaagaga

SEQ ID NO: 796894 - DNA, 22 bp, Artificial Sequence
  chemically synthesized
ctaactttgcaacccaaggaag

SEQ ID NO: 796895 - DNA, 22 bp, Artificial Sequence
  chemically synthesized
actaactttgcaacccaaggaa

SEQ ID NO: 796896 - DNA, 22 bp, Artificial Sequence
  chemically synthesized
ctttctcttccttgggttgcaa

SEQ ID NO: 796897 - DNA, 22 bp, Artificial Sequence
  chemically synthesized
atatttactaactttgcaaccc

SEQ ID NO: 796898 - DNA, 22 bp, Artificial Sequence
  chemically synthesized
tctcttccttgggttgcaaagt

SEQ ID NO: 796899 - DNA, 22 bp, Artificial Sequence
  chemically synthesized
ctcttccttgggttgcaaagtt

SEQ ID NO: 796900 - DNA, 22 bp, Artificial Sequence
  chemically synthesized
tcttccttgggttgcaaagtta

SEQ ID NO: 796901 - DNA, 22 bp, Artificial Sequence
  chemically synthesized
ttccttgggttgcaaagttagt

SEQ ID NO: 796902 - DNA, 22 bp, Artificial Sequence
  chemically synthesized
ccttgggttgcaaagttagtaa

SEQ ID NO: 796903 - DNA, 22 bp, Artificial Sequence
  chemically synthesized
cttgggttgcaaagttagtaaa

SEQ ID NO: 796904 - DNA, 22 bp, Artificial Sequence
  chemically synthesized
gggttgcaaagttagtaaatat

SEQ ID NO: 796905 - DNA, 22 bp, Artificial Sequence
  chemically synthesized
ggttgcaaagttagtaaatatt

SEQ ID NO: 796906 - DNA, 22 bp, Artificial Sequence
  chemically synthesized
aaatggaaggctaatatttact

SEQ ID NO: 796907 - DNA, 22 bp, Artificial Sequence
  chemically synthesized
gttaaaatggaaggctaatatt

SEQ ID NO: 796908 - DNA, 22 bp, Artificial Sequence
  chemically synthesized
caaagttagtaaatattagcct

SEQ ID NO: 796909 - DNA, 22 bp, Artificial Sequence
  chemically synthesized
gtaaatattagccttccatttt

SEQ ID NO: 796910 - DNA, 22 bp, Artificial Sequence
  chemically synthesized
aacgagttagttaaaatggaag

SEQ ID NO: 796911 - DNA, 22 bp, Artificial Sequence
  chemically synthesized
gccttccattttaactaactcg

SEQ ID NO: 796912 - DNA, 22 bp, Artificial Sequence
  chemically synthesized
gagacaagctcaacgagttagt

SEQ ID NO: 796913 - DNA, 22 bp, Artificial Sequence
  chemically synthesized
ttggagacaagctcaacgagtt

SEQ ID NO: 796914 - DNA, 22 bp, Artificial Sequence
  chemically synthesized
ccattttaactaactcgttgag

SEQ ID NO: 796915 - DNA, 22 bp, Artificial Sequence
  chemically synthesized
cattttaactaactcgttgagc

SEQ ID NO: 796916 - DNA, 22 bp, Artificial Sequence
  chemically synthesized
tattggagacaagctcaacgag

SEQ ID NO: 796917 - DNA, 22 bp, Artificial Sequence
  chemically synthesized
ctattggagacaagctcaacga

SEQ ID NO: 796918 - DNA, 22 bp, Artificial Sequence
  chemically synthesized
taactaactcgttgagcttgtc

SEQ ID NO: 796919 - DNA, 22 bp, Artificial Sequence
  chemically synthesized
aactaactcgttgagcttgtct

SEQ ID NO: 796920 - DNA, 22 bp, Artificial Sequence
  chemically synthesized
actaactcgttgagcttgtctc

SEQ ID NO: 796921 - DNA, 22 bp, Artificial Sequence
  chemically synthesized
aatcttctattggagacaagct

SEQ ID NO: 796922 - DNA, 22 bp, Artificial Sequence
  chemically synthesized
actcgttgagcttgtctccaat

SEQ ID NO: 796923 - DNA, 22 bp, Artificial Sequence
  chemically synthesized
gttgagcttgtctccaatagaa

SEQ ID NO: 796924 - DNA, 22 bp, Artificial Sequence
  chemically synthesized
agcttgtctccaatagaagatt

SEQ ID NO: 796925 - DNA, 22 bp, Artificial Sequence
  chemically synthesized
aggccaataattcaatcttcta

SEQ ID NO: 796926 - DNA, 22 bp, Artificial Sequence
  chemically synthesized
gtctccaatagaagattgaatt

SEQ ID NO: 796927 - DNA, 22 bp, Artificial Sequence
  chemically synthesized
tctccaatagaagattgaatta

SEQ ID NO: 796928 - DNA, 22 bp, Artificial Sequence
  chemically synthesized
caatagaagattgaattattgg

SEQ ID NO: 796929 - DNA, 22 bp, Artificial Sequence
  chemically synthesized
gggatgtgaaaggattgaggcc

SEQ ID NO: 796930 - DNA, 22 bp, Artificial Sequence
  chemically synthesized
ctagggatgtgaaaggattgag

SEQ ID NO: 796931 - DNA, 22 bp, Artificial Sequence
  chemically synthesized
aattattggcctcaatcctttc

SEQ ID NO: 796932 - DNA, 22 bp, Artificial Sequence
  chemically synthesized
ttggcctcaatcctttcacatc

SEQ ID NO: 796933 - DNA, 22 bp, Artificial Sequence
  chemically synthesized
gcctcaatcctttcacatccct

SEQ ID NO: 796934 - DNA, 22 bp, Artificial Sequence
  chemically synthesized
aatcctttcacatccctagtag

SEQ ID NO: 796935 - DNA, 22 bp, Artificial Sequence
  chemically synthesized
gagcgtgaatgtatgatactac

SEQ ID NO: 796936 - DNA, 22 bp, Artificial Sequence
  chemically synthesized
tcacatccctagtagtatcata

SEQ ID NO: 796937 - DNA, 22 bp, Artificial Sequence
  chemically synthesized
cacatccctagtagtatcatac

SEQ ID NO: 796938 - DNA, 22 bp, Artificial Sequence
  chemically synthesized
acatccctagtagtatcataca

SEQ ID NO: 796939 - DNA, 22 bp, Artificial Sequence
  chemically synthesized
gtagtatcatacattcacgctc

SEQ ID NO: 796940 - DNA, 22 bp, Artificial Sequence
  chemically synthesized
tgtgaggccatggctggagcgt

SEQ ID NO: 796941 - DNA, 22 bp, Artificial Sequence
  chemically synthesized
cacctatgtgaggccatggctg

SEQ ID NO: 796942 - DNA, 22 bp, Artificial Sequence
  chemically synthesized
ccacctatgtgaggccatggct

SEQ ID NO: 796943 - DNA, 22 bp, Artificial Sequence
  chemically synthesized
tccacctatgtgaggccatggc

SEQ ID NO: 796944 - DNA, 22 bp, Artificial Sequence
  chemically synthesized
acgctccagccatggcctcaca

SEQ ID NO: 796945 - DNA, 22 bp, Artificial Sequence
  chemically synthesized
cagccatggcctcacataggtg

SEQ ID NO: 796946 - DNA, 22 bp, Artificial Sequence
  chemically synthesized
acataggtggaaagtattttcc

SEQ ID NO: 796947 - DNA, 22 bp, Artificial Sequence
  chemically synthesized
tggccaagcccaaagtcaaggg

SEQ ID NO: 796948 - DNA, 22 bp, Artificial Sequence
  chemically synthesized
gtggccaagcccaaagtcaagg

SEQ ID NO: 796949 - DNA, 22 bp, Artificial Sequence
  chemically synthesized
tcctaccccttgactttgggct

SEQ ID NO: 796950 - DNA, 22 bp, Artificial Sequence
  chemically synthesized
cctaccccttgactttgggctt

SEQ ID NO: 796951 - DNA, 22 bp, Artificial Sequence
  chemically synthesized
ctaccccttgactttgggcttg

SEQ ID NO: 796952 - DNA, 22 bp, Artificial Sequence
  chemically synthesized
ccccttgactttgggcttggcc

SEQ ID NO: 796953 - DNA, 22 bp, Artificial Sequence
  chemically synthesized
gacaaaacatgtcttgtggcca

SEQ ID NO: 796954 - DNA, 22 bp, Artificial Sequence
  chemically synthesized
gactttgggcttggccacaaga

SEQ ID NO: 796955 - DNA, 22 bp, Artificial Sequence
  chemically synthesized
actttgggcttggccacaagac

SEQ ID NO: 796956 - DNA, 22 bp, Artificial Sequence
  chemically synthesized
tgggcttggccacaagacatgt

SEQ ID NO: 796957 - DNA, 22 bp, Artificial Sequence
  chemically synthesized
gggcttggccacaagacatgtt

SEQ ID NO: 796958 - DNA, 22 bp, Artificial Sequence
  chemically synthesized
ggcttggccacaagacatgttt

SEQ ID NO: 796959 - DNA, 22 bp, Artificial Sequence
  chemically synthesized
tagcccattagacaaaacatgt

SEQ ID NO: 796960 - DNA, 22 bp, Artificial Sequence
  chemically synthesized
atagcccattagacaaaacatg

SEQ ID NO: 796961 - DNA, 22 bp, Artificial Sequence
  chemically synthesized
ggccacaagacatgttttgtct

SEQ ID NO: 796962 - DNA, 22 bp, Artificial Sequence
  chemically synthesized
gccacaagacatgttttgtcta

SEQ ID NO: 796963 - DNA, 22 bp, Artificial Sequence
  chemically synthesized
tttatagcccattagacaaaac

SEQ ID NO: 796964 - DNA, 22 bp, Artificial Sequence
  chemically synthesized
gtttatagcccattagacaaaa

SEQ ID NO: 796965 - DNA, 22 bp, Artificial Sequence
  chemically synthesized
tcacatttgtttatagcccatt

SEQ ID NO: 796966 - DNA, 22 bp, Artificial Sequence
  chemically synthesized
gtcacatttgtttatagcccat

SEQ ID NO: 796967 - DNA, 22 bp, Artificial Sequence
  chemically synthesized
ttgtcacatttgtttatagccc

SEQ ID NO: 796968 - DNA, 22 bp, Artificial Sequence
  chemically synthesized
ctcttgtcacatttgtttatag

SEQ ID NO: 796969 - DNA, 22 bp, Artificial Sequence
  chemically synthesized
tgtctaatgggctataaacaaa

SEQ ID NO: 796970 - DNA, 22 bp, Artificial Sequence
  chemically synthesized
gtctaatgggctataaacaaat

SEQ ID NO: 796971 - DNA, 22 bp, Artificial Sequence
  chemically synthesized
tcctcttgtcacatttgtttat

SEQ ID NO: 796972 - DNA, 22 bp, Artificial Sequence
  chemically synthesized
tctaatgggctataaacaaatg

SEQ ID NO: 796973 - DNA, 22 bp, Artificial Sequence
  chemically synthesized
atgggctataaacaaatgtgac

SEQ ID NO: 796974 - DNA, 22 bp, Artificial Sequence
  chemically synthesized
aaaatctctcctcttgtcacat

SEQ ID NO: 796975 - DNA, 22 bp, Artificial Sequence
  chemically synthesized
caaaatctctcctcttgtcaca

SEQ ID NO: 796976 - DNA, 22 bp, Artificial Sequence
  chemically synthesized
tcaaaatctctcctcttgtcac

SEQ ID NO: 796977 - DNA, 22 bp, Artificial Sequence
  chemically synthesized
ttcaaaatctctcctcttgtca

SEQ ID NO: 796978 - DNA, 22 bp, Artificial Sequence
  chemically synthesized
taaacaaatgtgacaagaggag

SEQ ID NO: 796979 - DNA, 22 bp, Artificial Sequence
  chemically synthesized
tgaaaagtgttgtttgtgcttc

SEQ ID NO: 796980 - DNA, 22 bp, Artificial Sequence
  chemically synthesized
gaaaagtgttgtttgtgcttct

SEQ ID NO: 796981 - DNA, 22 bp, Artificial Sequence
  chemically synthesized
aaaagtgttgtttgtgcttctg

SEQ ID NO: 796982 - DNA, 22 bp, Artificial Sequence
  chemically synthesized
tttgtgcttctgtcattgcctt

SEQ ID NO: 796983 - DNA, 22 bp, Artificial Sequence
  chemically synthesized
gtgcttctgtcattgccttgtg

SEQ ID NO: 796984 - DNA, 22 bp, Artificial Sequence
  chemically synthesized
tgcttctgtcattgccttgtgc

SEQ ID NO: 796985 - DNA, 22 bp, Artificial Sequence
  chemically synthesized
ggggtatgacagagtagcacaa

SEQ ID NO: 796986 - DNA, 22 bp, Artificial Sequence
  chemically synthesized
ctgtcattgccttgtgctactc

SEQ ID NO: 796987 - DNA, 22 bp, Artificial Sequence
  chemically synthesized
tgtcattgccttgtgctactct

SEQ ID NO: 796988 - DNA, 22 bp, Artificial Sequence
  chemically synthesized
ctcggggtatgacagagtagca

SEQ ID NO: 796989 - DNA, 22 bp, Artificial Sequence
  chemically synthesized
tcattgccttgtgctactctgt

SEQ ID NO: 796990 - DNA, 22 bp, Artificial Sequence
  chemically synthesized
ccttgtgctactctgtcatacc

SEQ ID NO: 796991 - DNA, 22 bp, Artificial Sequence
  chemically synthesized
gtgctactctgtcataccccga

SEQ ID NO: 796992 - DNA, 22 bp, Artificial Sequence
  chemically synthesized
tgctactctgtcataccccgag

SEQ ID NO: 796993 - DNA, 22 bp, Artificial Sequence
  chemically synthesized
aagggacatcagctactcgggg

SEQ ID NO: 796994 - DNA, 22 bp, Artificial Sequence
  chemically synthesized
ctctgtcataccccgagtagct

SEQ ID NO: 796995 - DNA, 22 bp, Artificial Sequence
  chemically synthesized
tgtcataccccgagtagctgat

SEQ ID NO: 796996 - DNA, 22 bp, Artificial Sequence
  chemically synthesized
aagctgaagggacatcagctac

SEQ ID NO: 796997 - DNA, 22 bp, Artificial Sequence
  chemically synthesized
tcataccccgagtagctgatgt

SEQ ID NO: 796998 - DNA, 22 bp, Artificial Sequence
  chemically synthesized
agactcaagctgaagggacatc

SEQ ID NO: 796999 - DNA, 22 bp, Artificial Sequence
  chemically synthesized
tgagactcaagctgaagggaca

SEQ ID NO: 797000 - DNA, 22 bp, Artificial Sequence
  chemically synthesized
ctgagactcaagctgaagggac

SEQ ID NO: 797001 - DNA, 22 bp, Artificial Sequence
  chemically synthesized
ttctgagactcaagctgaaggg

SEQ ID NO: 797002 - DNA, 22 bp, Artificial Sequence
  chemically synthesized
cttctgagactcaagctgaagg

SEQ ID NO: 797003 - DNA, 22 bp, Artificial Sequence
  chemically synthesized
tcttctgagactcaagctgaag

SEQ ID NO: 797004 - DNA, 22 bp, Artificial Sequence
  chemically synthesized
atgtcccttcagcttgagtctc

SEQ ID NO: 797005 - DNA, 22 bp, Artificial Sequence
  chemically synthesized
taccacatattttcttctgaga

SEQ ID NO: 797006 - DNA, 22 bp, Artificial Sequence
  chemically synthesized
cagcttgagtctcagaagaaaa

SEQ ID NO: 797007 - DNA, 22 bp, Artificial Sequence
  chemically synthesized
agcttgagtctcagaagaaaat

SEQ ID NO: 797008 - DNA, 22 bp, Artificial Sequence
  chemically synthesized
gggtctataccacatattttct

SEQ ID NO: 797009 - DNA, 22 bp, Artificial Sequence
  chemically synthesized
gagtctcagaagaaaatatgtg

SEQ ID NO: 797010 - DNA, 22 bp, Artificial Sequence
  chemically synthesized
agtctcagaagaaaatatgtgg

SEQ ID NO: 797011 - DNA, 22 bp, Artificial Sequence
  chemically synthesized
ttcgggtctataccacatattt

SEQ ID NO: 797012 - DNA, 22 bp, Artificial Sequence
  chemically synthesized
tgttcgggtctataccacatat

SEQ ID NO: 797013 - DNA, 22 bp, Artificial Sequence
  chemically synthesized
agaagaaaatatgtggtataga

SEQ ID NO: 797014 - DNA, 22 bp, Artificial Sequence
  chemically synthesized
ggccgtcggttctgttcgggtc

SEQ ID NO: 797015 - DNA, 22 bp, Artificial Sequence
  chemically synthesized
taggccgtcggttctgttcggg

SEQ ID NO: 797016 - DNA, 22 bp, Artificial Sequence
  chemically synthesized
tctctaggccgtcggttctgtt

SEQ ID NO: 797017 - DNA, 22 bp, Artificial Sequence
  chemically synthesized
atctctaggccgtcggttctgt

SEQ ID NO: 797018 - DNA, 22 bp, Artificial Sequence
  chemically synthesized
tgcttatctctaggccgtcggt

SEQ ID NO: 797019 - DNA, 22 bp, Artificial Sequence
  chemically synthesized
gctatgcttatctctaggccgt

SEQ ID NO: 797020 - DNA, 22 bp, Artificial Sequence
  chemically synthesized
agctatgcttatctctaggccg

SEQ ID NO: 797021 - DNA, 22 bp, Artificial Sequence
  chemically synthesized
gaaatggtttagctatgcttat

SEQ ID NO: 797022 - DNA, 22 bp, Artificial Sequence
  chemically synthesized
gagataagcatagctaaaccat

SEQ ID NO: 797023 - DNA, 22 bp, Artificial Sequence
  chemically synthesized
gccaatcatggctggaaatggt

SEQ ID NO: 797024 - DNA, 22 bp, Artificial Sequence
  chemically synthesized
ggccaatcatggctggaaatgg

SEQ ID NO: 797025 - DNA, 22 bp, Artificial Sequence
  chemically synthesized
gtagggtttggccaatcatggc

SEQ ID NO: 797026 - DNA, 22 bp, Artificial Sequence
  chemically synthesized
aaccatttccagccatgattgg

SEQ ID NO: 797027 - DNA, 22 bp, Artificial Sequence
  chemically synthesized
ggtagggtttggccaatcatgg

SEQ ID NO: 797028 - DNA, 22 bp, Artificial Sequence
  chemically synthesized
cagtttggtagggtttggccaa

SEQ ID NO: 797029 - DNA, 22 bp, Artificial Sequence
  chemically synthesized
ccagccatgattggccaaaccc

SEQ ID NO: 797030 - DNA, 22 bp, Artificial Sequence
  chemically synthesized
cagccatgattggccaaaccct

SEQ ID NO: 797031 - DNA, 22 bp, Artificial Sequence
  chemically synthesized
atggagctgcagtttggtaggg

SEQ ID NO: 797032 - DNA, 22 bp, Artificial Sequence
  chemically synthesized
ttcatggagctgcagtttggta

SEQ ID NO: 797033 - DNA, 22 bp, Artificial Sequence
  chemically synthesized
attcatggagctgcagtttggt

SEQ ID NO: 797034 - DNA, 22 bp, Artificial Sequence
  chemically synthesized
gccaaaccctaccaaactgcag

SEQ ID NO: 797035 - DNA, 22 bp, Artificial Sequence
  chemically synthesized
atttattcatggagctgcagtt

SEQ ID NO: 797036 - DNA, 22 bp, Artificial Sequence
  chemically synthesized
ccaaactgcagctccatgaata

SEQ ID NO: 797037 - DNA, 22 bp, Artificial Sequence
  chemically synthesized
ataacaacaatattgatttatt

SEQ ID NO: 797038 - DNA, 22 bp, Artificial Sequence
  chemically synthesized
cagctccatgaataaatcaata

SEQ ID NO: 797039 - DNA, 22 bp, Artificial Sequence
  chemically synthesized
catgaataaatcaatattgttg

SEQ ID NO: 797040 - DNA, 22 bp, Artificial Sequence
  chemically synthesized
agtggctaataacaacaatatt

SEQ ID NO: 797041 - DNA, 22 bp, Artificial Sequence
  chemically synthesized
attcagtggctaataacaacaa

SEQ ID NO: 797042 - DNA, 22 bp, Artificial Sequence
  chemically synthesized
aattcagtggctaataacaaca

SEQ ID NO: 797043 - DNA, 22 bp, Artificial Sequence
  chemically synthesized
ttgttattagccactgaattaa

SEQ ID NO: 797044 - DNA, 22 bp, Artificial Sequence
  chemically synthesized
ttattagccactgaattaaatt

SEQ ID NO: 797045 - DNA, 22 bp, Artificial Sequence
  chemically synthesized
ttagccactgaattaaattttt

SEQ ID NO: 797046 - DNA, 22 bp, Artificial Sequence
  chemically synthesized
gccactgaattaaatttttttg

SEQ ID NO: 797047 - DNA, 22 bp, Artificial Sequence
  chemically synthesized
cacaataaacaaccaaaaaaat

SEQ ID NO: 797048 - DNA, 22 bp, Artificial Sequence
  chemically synthesized
ctgcacaataaacaaccaaaaa

SEQ ID NO: 797049 - DNA, 22 bp, Artificial Sequence
  chemically synthesized
gctgcacaataaacaaccaaaa

SEQ ID NO: 797050 - DNA, 22 bp, Artificial Sequence
  chemically synthesized
tgctgcacaataaacaaccaaa

SEQ ID NO: 797051 - DNA, 22 bp, Artificial Sequence
  chemically synthesized
aattaaatttttttggttgttt

SEQ ID NO: 797052 - DNA, 22 bp, Artificial Sequence
  chemically synthesized
aatttttttggttgtttattgt

SEQ ID NO: 797053 - DNA, 22 bp, Artificial Sequence
  chemically synthesized
ttttggttgtttattgtgcagc

SEQ ID NO: 797054 - DNA, 22 bp, Artificial Sequence
  chemically synthesized
tttggttgtttattgtgcagca

SEQ ID NO: 797055 - DNA, 22 bp, Artificial Sequence
  chemically synthesized
ttggttgtttattgtgcagcaa

SEQ ID NO: 797056 - DNA, 22 bp, Artificial Sequence
  chemically synthesized
tggttgtttattgtgcagcaaa

SEQ ID NO: 797057 - DNA, 22 bp, Artificial Sequence
  chemically synthesized
atatcagtccattttgctgcac

SEQ ID NO: 797058 - DNA, 22 bp, Artificial Sequence
  chemically synthesized
ggttgtttattgtgcagcaaaa

SEQ ID NO: 797059 - DNA, 22 bp, Artificial Sequence
  chemically synthesized
gttgtttattgtgcagcaaaat

SEQ ID NO: 797060 - DNA, 22 bp, Artificial Sequence
  chemically synthesized
agttcatatcagtccattttgc

SEQ ID NO: 797061 - DNA, 22 bp, Artificial Sequence
  chemically synthesized
tttattgtgcagcaaaatggac

SEQ ID NO: 797062 - DNA, 22 bp, Artificial Sequence
  chemically synthesized
cagttcatatcagtccattttg

SEQ ID NO: 797063 - DNA, 22 bp, Artificial Sequence
  chemically synthesized
attgtgcagcaaaatggactga

SEQ ID NO: 797064 - DNA, 22 bp, Artificial Sequence
  chemically synthesized
ttgtgcagcaaaatggactgat

SEQ ID NO: 797065 - DNA, 22 bp, Artificial Sequence
  chemically synthesized
tgcagcaaaatggactgatatg

SEQ ID NO: 797066 - DNA, 22 bp, Artificial Sequence
  chemically synthesized
taaaccacatttcagttcatat

SEQ ID NO: 797067 - DNA, 22 bp, Artificial Sequence
  chemically synthesized
attataaaccacatttcagttc

SEQ ID NO: 797068 - DNA, 22 bp, Artificial Sequence
  chemically synthesized
tattgattataaaccacatttc

SEQ ID NO: 797069 - DNA, 22 bp, Artificial Sequence
  chemically synthesized
atatgaactgaaatgtggttta

SEQ ID NO: 797070 - DNA, 22 bp, Artificial Sequence
  chemically synthesized
gattgtattgattataaaccac

SEQ ID NO: 797071 - DNA, 22 bp, Artificial Sequence
  chemically synthesized
ctggattgtattgattataaac

SEQ ID NO: 797072 - DNA, 22 bp, Artificial Sequence
  chemically synthesized
actggattgtattgattataaa

SEQ ID NO: 797073 - DNA, 22 bp, Artificial Sequence
  chemically synthesized
tactggattgtattgattataa

SEQ ID NO: 797074 - DNA, 22 bp, Artificial Sequence
  chemically synthesized
aaatgtggtttataatcaatac

SEQ ID NO: 797075 - DNA, 22 bp, Artificial Sequence
  chemically synthesized
gtagaactttactggattgtat

SEQ ID NO: 797076 - DNA, 22 bp, Artificial Sequence
  chemically synthesized
agtagaactttactggattgta

SEQ ID NO: 797077 - DNA, 22 bp, Artificial Sequence
  chemically synthesized
ataatcaatacaatccagtaaa

SEQ ID NO: 797078 - DNA, 22 bp, Artificial Sequence
  chemically synthesized
taatcaatacaatccagtaaag

SEQ ID NO: 797079 - DNA, 22 bp, Artificial Sequence
  chemically synthesized
atagacatacatttagtagaac

SEQ ID NO: 797080 - DNA, 22 bp, Artificial Sequence
  chemically synthesized
gatagacatacatttagtagaa

SEQ ID NO: 797081 - DNA, 22 bp, Artificial Sequence
  chemically synthesized
cttgatagacatacatttagta

SEQ ID NO: 797082 - DNA, 22 bp, Artificial Sequence
  chemically synthesized
gcttgatagacatacatttagt

SEQ ID NO: 797083 - DNA, 22 bp, Artificial Sequence
  chemically synthesized
tgcttgatagacatacatttag

SEQ ID NO: 797084 - DNA, 22 bp, Artificial Sequence
  chemically synthesized
ttgcttgatagacatacattta

SEQ ID NO: 797085 - DNA, 22 bp, Artificial Sequence
  chemically synthesized
ttttgcttgatagacatacatt

SEQ ID NO: 797086 - DNA, 22 bp, Artificial Sequence
  chemically synthesized
cttttgcttgatagacatacat

SEQ ID NO: 797087 - DNA, 22 bp, Artificial Sequence
  chemically synthesized
tcttttgcttgatagacataca

SEQ ID NO: 797088 - DNA, 22 bp, Artificial Sequence
  chemically synthesized
ttcttttgcttgatagacatac

SEQ ID NO: 797089 - DNA, 22 bp, Artificial Sequence
  chemically synthesized
tttcttttgcttgatagacata

SEQ ID NO: 797090 - DNA, 22 bp, Artificial Sequence
  chemically synthesized
ttttcttttgcttgatagacat

SEQ ID NO: 797091 - DNA, 22 bp, Artificial Sequence
  chemically synthesized
tttttcttttgcttgatagaca

SEQ ID NO: 797092 - DNA, 22 bp, Artificial Sequence
  chemically synthesized
tactaaatgtatgtctatcaag

SEQ ID NO: 797093 - DNA, 22 bp, Artificial Sequence
  chemically synthesized
ctaaatgtatgtctatcaagca

SEQ ID NO: 797094 - DNA, 22 bp, Artificial Sequence
  chemically synthesized
ttttttttcttttgcttgatag

SEQ ID NO: 797095 - DNA, 22 bp, Artificial Sequence
  chemically synthesized
aatgtatgtctatcaagcaaaa

SEQ ID NO: 797096 - DNA, 22 bp, Artificial Sequence
  chemically synthesized
atcatctgttttttttcttttg

SEQ ID NO: 797097 - DNA, 22 bp, Artificial Sequence
  chemically synthesized
taatcatctgttttttttcttt

SEQ ID NO: 797098 - DNA, 22 bp, Artificial Sequence
  chemically synthesized
ctaatcatctgttttttttctt

SEQ ID NO: 797099 - DNA, 22 bp, Artificial Sequence
  chemically synthesized
tctaatcatctgttttttttct

SEQ ID NO: 797100 - DNA, 22 bp, Artificial Sequence
  chemically synthesized
tcaagcaaaagaaaaaaaacag

SEQ ID NO: 797101 - DNA, 22 bp, Artificial Sequence
  chemically synthesized
acaactttctaatcatctgttt

SEQ ID NO: 797102 - DNA, 22 bp, Artificial Sequence
  chemically synthesized
gacaactttctaatcatctgtt

SEQ ID NO: 797103 - DNA, 22 bp, Artificial Sequence
  chemically synthesized
gaagaatttgacaactttctaa

SEQ ID NO: 797104 - DNA, 22 bp, Artificial Sequence
  chemically synthesized
ttagaagaatttgacaactttc

SEQ ID NO: 797105 - DNA, 22 bp, Artificial Sequence
  chemically synthesized
gttagaagaatttgacaacttt

SEQ ID NO: 797106 - DNA, 22 bp, Artificial Sequence
  chemically synthesized
tgttagaagaatttgacaactt

SEQ ID NO: 797107 - DNA, 22 bp, Artificial Sequence
  chemically synthesized
gaaagttgtcaaattcttctaa

SEQ ID NO: 797108 - DNA, 22 bp, Artificial Sequence
  chemically synthesized
gtatgtatatggactttgttag

SEQ ID NO: 797109 - DNA, 22 bp, Artificial Sequence
  chemically synthesized
tcaaattcttctaacaaagtcc

SEQ ID NO: 797110 - DNA, 22 bp, Artificial Sequence
  chemically synthesized
gtacctggtatgtatatggact

SEQ ID NO: 797111 - DNA, 22 bp, Artificial Sequence
  chemically synthesized
tggtacctggtatgtatatgga

SEQ ID NO: 797112 - DNA, 22 bp, Artificial Sequence
  chemically synthesized
ttctaacaaagtccatatacat

SEQ ID NO: 797113 - DNA, 22 bp, Artificial Sequence
  chemically synthesized
ctaacaaagtccatatacatac

SEQ ID NO: 797114 - DNA, 22 bp, Artificial Sequence
  chemically synthesized
taacaaagtccatatacatacc

SEQ ID NO: 797115 - DNA, 22 bp, Artificial Sequence
  chemically synthesized
attctggtacctggtatgtata

SEQ ID NO: 797116 - DNA, 22 bp, Artificial Sequence
  chemically synthesized
acaaagtccatatacataccag

SEQ ID NO: 797117 - DNA, 22 bp, Artificial Sequence
  chemically synthesized
ataactcattctggtacctggt

SEQ ID NO: 797118 - DNA, 22 bp, Artificial Sequence
  chemically synthesized
ttgataactcattctggtacct

SEQ ID NO: 797119 - DNA, 22 bp, Artificial Sequence
  chemically synthesized
ggcaattattgataactcattc

SEQ ID NO: 797120 - DNA, 22 bp, Artificial Sequence
  chemically synthesized
cccctaggcaattattgataac

SEQ ID NO: 797121 - DNA, 22 bp, Artificial Sequence
  chemically synthesized
acccctaggcaattattgataa

SEQ ID NO: 797122 - DNA, 22 bp, Artificial Sequence
  chemically synthesized
acccttacccctaggcaattat

SEQ ID NO: 797123 - DNA, 22 bp, Artificial Sequence
  chemically synthesized
taacccttacccctaggcaatt

SEQ ID NO: 797124 - DNA, 22 bp, Artificial Sequence
  chemically synthesized
ctaacccttacccctaggcaat

SEQ ID NO: 797125 - DNA, 22 bp, Artificial Sequence
  chemically synthesized
tttctaacccttacccctaggc

SEQ ID NO: 797126 - DNA, 22 bp, Artificial Sequence
  chemically synthesized
atttctaacccttacccctagg

SEQ ID NO: 797127 - DNA, 22 bp, Artificial Sequence
  chemically synthesized
tatttctaacccttacccctag

SEQ ID NO: 797128 - DNA, 22 bp, Artificial Sequence
  chemically synthesized
tcaataattgcctaggggtaag

SEQ ID NO: 797129 - DNA, 22 bp, Artificial Sequence
  chemically synthesized
ttatttctaacccttaccccta

SEQ ID NO: 797130 - DNA, 22 bp, Artificial Sequence
  chemically synthesized
tttatttctaacccttacccct

SEQ ID NO: 797131 - DNA, 22 bp, Artificial Sequence
  chemically synthesized
ttttatttctaacccttacccc

SEQ ID NO: 797132 - DNA, 22 bp, Artificial Sequence
  chemically synthesized
tttttatttctaacccttaccc

SEQ ID NO: 797133 - DNA, 22 bp, Artificial Sequence
  chemically synthesized
actttttttatttctaaccctt

SEQ ID NO: 797134 - DNA, 22 bp, Artificial Sequence
  chemically synthesized
gactttttttatttctaaccct

SEQ ID NO: 797135 - DNA, 22 bp, Artificial Sequence
  chemically synthesized
cctaggggtaagggttagaaat

SEQ ID NO: 797136 - DNA, 22 bp, Artificial Sequence
  chemically synthesized
aacttgactttttttatttcta

SEQ ID NO: 797137 - DNA, 22 bp, Artificial Sequence
  chemically synthesized
ggggtaagggttagaaataaaa

SEQ ID NO: 797138 - DNA, 22 bp, Artificial Sequence
  chemically synthesized
gtgggttcaacttgactttttt

SEQ ID NO: 797139 - DNA, 22 bp, Artificial Sequence
  chemically synthesized
gaaataaaaaaagtcaagttga

SEQ ID NO: 797140 - DNA, 22 bp, Artificial Sequence
  chemically synthesized
gaaatacgacctagtgggttca

SEQ ID NO: 797141 - DNA, 22 bp, Artificial Sequence
  chemically synthesized
aaaacctggaaatacgacctag

SEQ ID NO: 797142 - DNA, 22 bp, Artificial Sequence
  chemically synthesized
gaaaacctggaaatacgaccta

SEQ ID NO: 797143 - DNA, 22 bp, Artificial Sequence
  chemically synthesized
cttgaaaacctggaaatacgac

SEQ ID NO: 797144 - DNA, 22 bp, Artificial Sequence
  chemically synthesized
aacccactaggtcgtatttcca

SEQ ID NO: 797145 - DNA, 22 bp, Artificial Sequence
  chemically synthesized
ggtcgtatttccaggttttcaa

SEQ ID NO: 797146 - DNA, 22 bp, Artificial Sequence
  chemically synthesized
caaaccagaacagtctgcttga

SEQ ID NO: 797147 - DNA, 22 bp, Artificial Sequence
  chemically synthesized
ccaggttttcaagcagactgtt

SEQ ID NO: 797148 - DNA, 22 bp, Artificial Sequence
  chemically synthesized
caggttttcaagcagactgttc

SEQ ID NO: 797149 - DNA, 22 bp, Artificial Sequence
  chemically synthesized
aaatattgcaaaccagaacagt

SEQ ID NO: 797150 - DNA, 22 bp, Artificial Sequence
  chemically synthesized
caaatattgcaaaccagaacag

SEQ ID NO: 797151 - DNA, 22 bp, Artificial Sequence
  chemically synthesized
tcaaatattgcaaaccagaaca

SEQ ID NO: 797152 - DNA, 22 bp, Artificial Sequence
  chemically synthesized
ttcaaatattgcaaaccagaac

SEQ ID NO: 797153 - DNA, 22 bp, Artificial Sequence
  chemically synthesized
tcaagcagactgttctggtttg

SEQ ID NO: 797154 - DNA, 22 bp, Artificial Sequence
  chemically synthesized
caagcagactgttctggtttgc

SEQ ID NO: 797155 - DNA, 22 bp, Artificial Sequence
  chemically synthesized
ttttcaaatattgcaaaccaga

SEQ ID NO: 797156 - DNA, 22 bp, Artificial Sequence
  chemically synthesized
aagcagactgttctggtttgca

SEQ ID NO: 797157 - DNA, 22 bp, Artificial Sequence
  chemically synthesized
ttctggtttgcaatatttgaaa

SEQ ID NO: 797158 - DNA, 22 bp, Artificial Sequence
  chemically synthesized
tggtttgcaatatttgaaaaga

SEQ ID NO: 797159 - DNA, 22 bp, Artificial Sequence
  chemically synthesized
gtttgcaatatttgaaaagagt

SEQ ID NO: 797160 - DNA, 22 bp, Artificial Sequence
  chemically synthesized
gcataccacagcagactctttt

SEQ ID NO: 797161 - DNA, 22 bp, Artificial Sequence
  chemically synthesized
gcaatatttgaaaagagtctgc

SEQ ID NO: 797162 - DNA, 22 bp, Artificial Sequence
  chemically synthesized
caatatttgaaaagagtctgct

SEQ ID NO: 797163 - DNA, 22 bp, Artificial Sequence
  chemically synthesized
acagtcattagcataccacagc

SEQ ID NO: 797164 - DNA, 22 bp, Artificial Sequence
  chemically synthesized
gaaaagagtctgctgtggtatg

SEQ ID NO: 797165 - DNA, 22 bp, Artificial Sequence
  chemically synthesized
aaaagagtctgctgtggtatgc

SEQ ID NO: 797166 - DNA, 22 bp, Artificial Sequence
  chemically synthesized
ctgtggtatgctaatgactgtg

SEQ ID NO: 797167 - DNA, 22 bp, Artificial Sequence
  chemically synthesized
tggtatgctaatgactgtgaat

SEQ ID NO: 797168 - DNA, 22 bp, Artificial Sequence
  chemically synthesized
caaagaccacagaattcacagt

SEQ ID NO: 797169 - DNA, 22 bp, Artificial Sequence
  chemically synthesized
ttccaaagaccacagaattcac

SEQ ID NO: 797170 - DNA, 22 bp, Artificial Sequence
  chemically synthesized
atgactgtgaattctgtggtct

SEQ ID NO: 797171 - DNA, 22 bp, Artificial Sequence
  chemically synthesized
gaactattccaaagaccacaga

SEQ ID NO: 797172 - DNA, 22 bp, Artificial Sequence
  chemically synthesized
ggaactattccaaagaccacag

SEQ ID NO: 797173 - DNA, 22 bp, Artificial Sequence
  chemically synthesized
tggaactattccaaagaccaca

SEQ ID NO: 797174 - DNA, 22 bp, Artificial Sequence
  chemically synthesized
tgaattctgtggtctttggaat

SEQ ID NO: 797175 - DNA, 22 bp, Artificial Sequence
  chemically synthesized
gcattttggaactattccaaag

SEQ ID NO: 797176 - DNA, 22 bp, Artificial Sequence
  chemically synthesized
agcattttggaactattccaaa

SEQ ID NO: 797177 - DNA, 22 bp, Artificial Sequence
  chemically synthesized
tgtggtctttggaatagttcca

SEQ ID NO: 797178 - DNA, 22 bp, Artificial Sequence
  chemically synthesized
agcttagcattttggaactatt

SEQ ID NO: 797179 - DNA, 22 bp, Artificial Sequence
  chemically synthesized
gagcttagcattttggaactat

SEQ ID NO: 797180 - DNA, 22 bp, Artificial Sequence
  chemically synthesized
tggtctttggaatagttccaaa

SEQ ID NO: 797181 - DNA, 22 bp, Artificial Sequence
  chemically synthesized
aacttgagcttagcattttgga

SEQ ID NO: 797182 - DNA, 22 bp, Artificial Sequence
  chemically synthesized
aaacttgagcttagcattttgg

SEQ ID NO: 797183 - DNA, 22 bp, Artificial Sequence
  chemically synthesized
taaacttgagcttagcattttg

SEQ ID NO: 797184 - DNA, 22 bp, Artificial Sequence
  chemically synthesized
tggaatagttccaaaatgctaa

SEQ ID NO: 797185 - DNA, 22 bp, Artificial Sequence
  chemically synthesized
ggaatagttccaaaatgctaag

SEQ ID NO: 797186 - DNA, 22 bp, Artificial Sequence
  chemically synthesized
gaatagttccaaaatgctaagc

SEQ ID NO: 797187 - DNA, 22 bp, Artificial Sequence
  chemically synthesized
ttttaaacttgagcttagcatt

SEQ ID NO: 797188 - DNA, 22 bp, Artificial Sequence
  chemically synthesized
gttttaaacttgagcttagcat

SEQ ID NO: 797189 - DNA, 22 bp, Artificial Sequence
  chemically synthesized
tgttttaaacttgagcttagca

SEQ ID NO: 797190 - DNA, 22 bp, Artificial Sequence
  chemically synthesized
caaaatgctaagctcaagttta

SEQ ID NO: 797191 - DNA, 22 bp, Artificial Sequence
  chemically synthesized
agaatccaattttgttttaaac

SEQ ID NO: 797192 - DNA, 22 bp, Artificial Sequence
  chemically synthesized
gagaatccaattttgttttaaa

SEQ ID NO: 797193 - DNA, 22 bp, Artificial Sequence
  chemically synthesized
agctcaagtttaaaacaaaatt

SEQ ID NO: 797194 - DNA, 22 bp, Artificial Sequence
  chemically synthesized
aagtttaaaacaaaattggatt

SEQ ID NO: 797195 - DNA, 22 bp, Artificial Sequence
  chemically synthesized
aaaacaaaattggattctcaaa

SEQ ID NO: 797196 - DNA, 22 bp, Artificial Sequence
  chemically synthesized
aaacaaaattggattctcaaat

SEQ ID NO: 797197 - DNA, 22 bp, Artificial Sequence
  chemically synthesized
agcaagaaagatatttgagaat

SEQ ID NO: 797198 - DNA, 22 bp, Artificial Sequence
  chemically synthesized
tgagcaagaaagatatttgaga

SEQ ID NO: 797199 - DNA, 22 bp, Artificial Sequence
  chemically synthesized
ctgagcaagaaagatatttgag

SEQ ID NO: 797200 - DNA, 22 bp, Artificial Sequence
  chemically synthesized
tctgagcaagaaagatatttga

SEQ ID NO: 797201 - DNA, 22 bp, Artificial Sequence
  chemically synthesized
gattctcaaatatctttcttgc

SEQ ID NO: 797202 - DNA, 22 bp, Artificial Sequence
  chemically synthesized
aatcctttctgagcaagaaaga

SEQ ID NO: 797203 - DNA, 22 bp, Artificial Sequence
  chemically synthesized
aaatcctttctgagcaagaaag

SEQ ID NO: 797204 - DNA, 22 bp, Artificial Sequence
  chemically synthesized
tcaaatatctttcttgctcaga

SEQ ID NO: 797205 - DNA, 22 bp, Artificial Sequence
  chemically synthesized
aaatatctttcttgctcagaaa

SEQ ID NO: 797206 - DNA, 22 bp, Artificial Sequence
  chemically synthesized
tacaaaaggacttaaatccttt

SEQ ID NO: 797207 - DNA, 22 bp, Artificial Sequence
  chemically synthesized
tcttgctcagaaaggatttaag

SEQ ID NO: 797208 - DNA, 22 bp, Artificial Sequence
  chemically synthesized
tgtacaaaaggacttaaatcct

SEQ ID NO: 797209 - DNA, 22 bp, Artificial Sequence
  chemically synthesized
cttgctcagaaaggatttaagt

SEQ ID NO: 797210 - DNA, 22 bp, Artificial Sequence
  chemically synthesized
ctgtacaaaaggacttaaatcc

SEQ ID NO: 797211 - DNA, 22 bp, Artificial Sequence
  chemically synthesized
ttgctcagaaaggatttaagtc

SEQ ID NO: 797212 - DNA, 22 bp, Artificial Sequence
  chemically synthesized
tctgtacaaaaggacttaaatc

SEQ ID NO: 797213 - DNA, 22 bp, Artificial Sequence
  chemically synthesized
gctcagaaaggatttaagtcct

SEQ ID NO: 797214 - DNA, 22 bp, Artificial Sequence
  chemically synthesized
ctcagaaaggatttaagtcctt

SEQ ID NO: 797215 - DNA, 22 bp, Artificial Sequence
  chemically synthesized
ctttctgtacaaaaggacttaa

SEQ ID NO: 797216 - DNA, 22 bp, Artificial Sequence
  chemically synthesized
agaaaggatttaagtccttttg

SEQ ID NO: 797217 - DNA, 22 bp, Artificial Sequence
  chemically synthesized
ttcctttctgtacaaaaggact

SEQ ID NO: 797218 - DNA, 22 bp, Artificial Sequence
  chemically synthesized
gttcctttctgtacaaaaggac

SEQ ID NO: 797219 - DNA, 22 bp, Artificial Sequence
  chemically synthesized
tttgttcctttctgtacaaaag

SEQ ID NO: 797220 - DNA, 22 bp, Artificial Sequence
  chemically synthesized
gtttgttcctttctgtacaaaa

SEQ ID NO: 797221 - DNA, 22 bp, Artificial Sequence
  chemically synthesized
aagtccttttgtacagaaagga

SEQ ID NO: 797222 - DNA, 22 bp, Artificial Sequence
  chemically synthesized
tcacttgtttgttcctttctgt

SEQ ID NO: 797223 - DNA, 22 bp, Artificial Sequence
  chemically synthesized
agtccttttgtacagaaaggaa

SEQ ID NO: 797224 - DNA, 22 bp, Artificial Sequence
  chemically synthesized
atcacttgtttgttcctttctg

SEQ ID NO: 797225 - DNA, 22 bp, Artificial Sequence
  chemically synthesized
ttgtacagaaaggaacaaacaa

SEQ ID NO: 797226 - DNA, 22 bp, Artificial Sequence
  chemically synthesized
tgtacagaaaggaacaaacaag

SEQ ID NO: 797227 - DNA, 22 bp, Artificial Sequence
  chemically synthesized
gtacagaaaggaacaaacaagt

SEQ ID NO: 797228 - DNA, 22 bp, Artificial Sequence
  chemically synthesized
tacagaaaggaacaaacaagtg

SEQ ID NO: 797229 - DNA, 22 bp, Artificial Sequence
  chemically synthesized
gaaacataggtaatagaaagcc

SEQ ID NO: 797230 - DNA, 22 bp, Artificial Sequence
  chemically synthesized
tggaaacataggtaatagaaag

SEQ ID NO: 797231 - DNA, 22 bp, Artificial Sequence
  chemically synthesized
ccactctggaaacataggtaat

SEQ ID NO: 797232 - DNA, 22 bp, Artificial Sequence
  chemically synthesized
ttgggctttctattacctatgt

SEQ ID NO: 797233 - DNA, 22 bp, Artificial Sequence
  chemically synthesized
accactctggaaacataggtaa

SEQ ID NO: 797234 - DNA, 22 bp, Artificial Sequence
  chemically synthesized
tgggctttctattacctatgtt

SEQ ID NO: 797235 - DNA, 22 bp, Artificial Sequence
  chemically synthesized
taccactctggaaacataggta

SEQ ID NO: 797236 - DNA, 22 bp, Artificial Sequence
  chemically synthesized
gggctttctattacctatgttt

SEQ ID NO: 797237 - DNA, 22 bp, Artificial Sequence
  chemically synthesized
ggctttctattacctatgtttc

SEQ ID NO: 797238 - DNA, 22 bp, Artificial Sequence
  chemically synthesized
tctattacctatgtttccagag

SEQ ID NO: 797239 - DNA, 22 bp, Artificial Sequence
  chemically synthesized
ctattacctatgtttccagagt

SEQ ID NO: 797240 - DNA, 22 bp, Artificial Sequence
  chemically synthesized
tattacctatgtttccagagtg

SEQ ID NO: 797241 - DNA, 22 bp, Artificial Sequence
  chemically synthesized
ttacctatgtttccagagtggt

SEQ ID NO: 797242 - DNA, 22 bp, Artificial Sequence
  chemically synthesized
cctatgtttccagagtggtaaa

SEQ ID NO: 797243 - DNA, 22 bp, Artificial Sequence
  chemically synthesized
tgtttccagagtggtaaaactg

SEQ ID NO: 797244 - DNA, 22 bp, Artificial Sequence
  chemically synthesized
aaaacaagagagatccagtttt

SEQ ID NO: 797245 - DNA, 22 bp, Artificial Sequence
  chemically synthesized
ccagagtggtaaaactggatct

SEQ ID NO: 797246 - DNA, 22 bp, Artificial Sequence
  chemically synthesized
cagagtggtaaaactggatctc

SEQ ID NO: 797247 - DNA, 22 bp, Artificial Sequence
  chemically synthesized
tagatatgactgaaaacaagag

SEQ ID NO: 797248 - DNA, 22 bp, Artificial Sequence
  chemically synthesized
gatctctcttgttttcagtcat

SEQ ID NO: 797249 - DNA, 22 bp, Artificial Sequence
  chemically synthesized
ggagggaacctgtagatatgac

SEQ ID NO: 797250 - DNA, 22 bp, Artificial Sequence
  chemically synthesized
tcttgttttcagtcatatctac

SEQ ID NO: 797251 - DNA, 22 bp, Artificial Sequence
  chemically synthesized
aggagggaacctgtagatatga

SEQ ID NO: 797252 - DNA, 22 bp, Artificial Sequence
  chemically synthesized
ttgttttcagtcatatctacag

SEQ ID NO: 797253 - DNA, 22 bp, Artificial Sequence
  chemically synthesized
gttttcagtcatatctacaggt

SEQ ID NO: 797254 - DNA, 22 bp, Artificial Sequence
  chemically synthesized
ttttcagtcatatctacaggtt

SEQ ID NO: 797255 - DNA, 22 bp, Artificial Sequence
  chemically synthesized
tcagtcatatctacaggttccc

SEQ ID NO: 797256 - DNA, 22 bp, Artificial Sequence
  chemically synthesized
cagtcatatctacaggttccct

SEQ ID NO: 797257 - DNA, 22 bp, Artificial Sequence
  chemically synthesized
agtcatatctacaggttccctc

SEQ ID NO: 797258 - DNA, 22 bp, Artificial Sequence
  chemically synthesized
caggttccctcctaaggatgat

SEQ ID NO: 797259 - DNA, 22 bp, Artificial Sequence
  chemically synthesized
cctcctaaggatgatccttcct

SEQ ID NO: 797260 - DNA, 22 bp, Artificial Sequence
  chemically synthesized
taaacagaagccaccaggaagg

SEQ ID NO: 797261 - DNA, 22 bp, Artificial Sequence
  chemically synthesized
ctaaggatgatccttcctggtg

SEQ ID NO: 797262 - DNA, 22 bp, Artificial Sequence
  chemically synthesized
ttgtaaacagaagccaccagga

SEQ ID NO: 797263 - DNA, 22 bp, Artificial Sequence
  chemically synthesized
aggatgatccttcctggtggct

SEQ ID NO: 797264 - DNA, 22 bp, Artificial Sequence
  chemically synthesized
gcgtggcattgttgtaaacaga

SEQ ID NO: 797265 - DNA, 22 bp, Artificial Sequence
  chemically synthesized
ggcgtggcattgttgtaaacag

SEQ ID NO: 797266 - DNA, 22 bp, Artificial Sequence
  chemically synthesized
cctggtggcttctgtttacaac

SEQ ID NO: 797267 - DNA, 22 bp, Artificial Sequence
  chemically synthesized
ctggtggcttctgtttacaaca

SEQ ID NO: 797268 - DNA, 22 bp, Artificial Sequence
  chemically synthesized
cttggcgtggcattgttgtaaa

SEQ ID NO: 797269 - DNA, 22 bp, Artificial Sequence
  chemically synthesized
gtggcttctgtttacaacaatg

SEQ ID NO: 797270 - DNA, 22 bp, Artificial Sequence
  chemically synthesized
actgcttggcgtggcattgttg

SEQ ID NO: 797271 - DNA, 22 bp, Artificial Sequence
  chemically synthesized
ctgtttacaacaatgccacgcc

SEQ ID NO: 797272 - DNA, 22 bp, Artificial Sequence
  chemically synthesized
tgtttacaacaatgccacgcca

SEQ ID NO: 797273 - DNA, 22 bp, Artificial Sequence
  chemically synthesized
tttacaacaatgccacgccaag

SEQ ID NO: 797274 - DNA, 22 bp, Artificial Sequence
  chemically synthesized
acaacaatgccacgccaagcag

SEQ ID NO: 797275 - DNA, 22 bp, Artificial Sequence
  chemically synthesized
caacaatgccacgccaagcagt

SEQ ID NO: 797276 - DNA, 22 bp, Artificial Sequence
  chemically synthesized
cgaagtagtgttaactgcttgg

SEQ ID NO: 797277 - DNA, 22 bp, Artificial Sequence
  chemically synthesized
acgaagtagtgttaactgcttg

SEQ ID NO: 797278 - DNA, 22 bp, Artificial Sequence
  chemically synthesized
tacgaagtagtgttaactgctt

SEQ ID NO: 797279 - DNA, 22 bp, Artificial Sequence
  chemically synthesized
ctttacgaagtagtgttaactg

SEQ ID NO: 797280 - DNA, 22 bp, Artificial Sequence
  chemically synthesized
cctttacgaagtagtgttaact

SEQ ID NO: 797281 - DNA, 22 bp, Artificial Sequence
  chemically synthesized
acactacttcgtaaaggaagac

SEQ ID NO: 797282 - DNA, 22 bp, Artificial Sequence
  chemically synthesized
cttcgtaaaggaagactccact

SEQ ID NO: 797283 - DNA, 22 bp, Artificial Sequence
  chemically synthesized
cgtaaaggaagactccactcct

SEQ ID NO: 797284 - DNA, 22 bp, Artificial Sequence
  chemically synthesized
gtaaaggaagactccactcctt

SEQ ID NO: 797285 - DNA, 22 bp, Artificial Sequence
  chemically synthesized
tgggtcaagaatgcgaaggtca

SEQ ID NO: 797286 - DNA, 22 bp, Artificial Sequence
  chemically synthesized
cactccttgaccttcgcattct

SEQ ID NO: 797287 - DNA, 22 bp, Artificial Sequence
  chemically synthesized
cattatgggtcaagaatgcgaa

SEQ ID NO: 797288 - DNA, 22 bp, Artificial Sequence
  chemically synthesized
cttgaccttcgcattcttgacc

SEQ ID NO: 797289 - DNA, 22 bp, Artificial Sequence
  chemically synthesized
gaccttcgcattcttgacccat

SEQ ID NO: 797290 - DNA, 22 bp, Artificial Sequence
  chemically synthesized
accttcgcattcttgacccata

SEQ ID NO: 797291 - DNA, 22 bp, Artificial Sequence
  chemically synthesized
tggaagcacattgcattatggg

SEQ ID NO: 797292 - DNA, 22 bp, Artificial Sequence
  chemically synthesized
cgcattcttgacccataatgca

SEQ ID NO: 797293 - DNA, 22 bp, Artificial Sequence
  chemically synthesized
gcattcttgacccataatgcaa

SEQ ID NO: 797294 - DNA, 22 bp, Artificial Sequence
  chemically synthesized
ttgacccataatgcaatgtgct

SEQ ID NO: 797295 - DNA, 22 bp, Artificial Sequence
  chemically synthesized
gacccataatgcaatgtgcttc

SEQ ID NO: 797296 - DNA, 22 bp, Artificial Sequence
  chemically synthesized
acccataatgcaatgtgcttcc

SEQ ID NO: 797297 - DNA, 22 bp, Artificial Sequence
  chemically synthesized
gaaatgatagagattgtggaag

SEQ ID NO: 797298 - DNA, 22 bp, Artificial Sequence
  chemically synthesized
ccacaatctctatcatttccag

SEQ ID NO: 797299 - DNA, 22 bp, Artificial Sequence
  chemically synthesized
cacaatctctatcatttccaga

SEQ ID NO: 797300 - DNA, 22 bp, Artificial Sequence
  chemically synthesized
ccaggaagggtgatgtctggaa

SEQ ID NO: 797301 - DNA, 22 bp, Artificial Sequence
  chemically synthesized
cccaggaagggtgatgtctgga

SEQ ID NO: 797302 - DNA, 22 bp, Artificial Sequence
  chemically synthesized
tatcatttccagacatcaccct

SEQ ID NO: 797303 - DNA, 22 bp, Artificial Sequence
  chemically synthesized
tcatttccagacatcacccttc

SEQ ID NO: 797304 - DNA, 22 bp, Artificial Sequence
  chemically synthesized
tcagcatttcccaggaagggtg

SEQ ID NO: 797305 - DNA, 22 bp, Artificial Sequence
  chemically synthesized
gtcagcatttcccaggaagggt

SEQ ID NO: 797306 - DNA, 22 bp, Artificial Sequence
  chemically synthesized
ccagacatcacccttcctggga

SEQ ID NO: 797307 - DNA, 22 bp, Artificial Sequence
  chemically synthesized
cagacatcacccttcctgggaa

SEQ ID NO: 797308 - DNA, 22 bp, Artificial Sequence
  chemically synthesized
gcacagtccgtacttgtcagca

SEQ ID NO: 797309 - DNA, 22 bp, Artificial Sequence
  chemically synthesized
agcacagtccgtacttgtcagc

SEQ ID NO: 797310 - DNA, 22 bp, Artificial Sequence
  chemically synthesized
tagcacagtccgtacttgtcag

SEQ ID NO: 797311 - DNA, 22 bp, Artificial Sequence
  chemically synthesized
cctgggaaatgctgacaagtac

SEQ ID NO: 797312 - DNA, 22 bp, Artificial Sequence
  chemically synthesized
ctgggaaatgctgacaagtacg

SEQ ID NO: 797313 - DNA, 22 bp, Artificial Sequence
  chemically synthesized
ggaaatgctgacaagtacggac

SEQ ID NO: 797314 - DNA, 22 bp, Artificial Sequence
  chemically synthesized
caccctttagcacagtccgtac

SEQ ID NO: 797315 - DNA, 22 bp, Artificial Sequence
  chemically synthesized
acaagtacggactgtgctaaag

SEQ ID NO: 797316 - DNA, 22 bp, Artificial Sequence
  chemically synthesized
tgctaaagggtggaggctgtct

SEQ ID NO: 797317 - DNA, 22 bp, Artificial Sequence
  chemically synthesized
gtggcaggaggtgaaagacagc

SEQ ID NO: 797318 - DNA, 22 bp, Artificial Sequence
  chemically synthesized
aagggtggaggctgtctttcac

SEQ ID NO: 797319 - DNA, 22 bp, Artificial Sequence
  chemically synthesized
ttggtggcaggaggtgaaagac

SEQ ID NO: 797320 - DNA, 22 bp, Artificial Sequence
  chemically synthesized
aaataagctgttggtggcagga

SEQ ID NO: 797321 - DNA, 22 bp, Artificial Sequence
  chemically synthesized
tctttcacctcctgccaccaac

SEQ ID NO: 797322 - DNA, 22 bp, Artificial Sequence
  chemically synthesized
ctcaaataagctgttggtggca

SEQ ID NO: 797323 - DNA, 22 bp, Artificial Sequence
  chemically synthesized
tcctcaaataagctgttggtgg

SEQ ID NO: 797324 - DNA, 22 bp, Artificial Sequence
  chemically synthesized
tcacctcctgccaccaacagct

SEQ ID NO: 797325 - DNA, 22 bp, Artificial Sequence
  chemically synthesized
cacctcctgccaccaacagctt

SEQ ID NO: 797326 - DNA, 22 bp, Artificial Sequence
  chemically synthesized
acctcctgccaccaacagctta

SEQ ID NO: 797327 - DNA, 22 bp, Artificial Sequence
  chemically synthesized
aactctcctcaaataagctgtt

SEQ ID NO: 797328 - DNA, 22 bp, Artificial Sequence
  chemically synthesized
aaactctcctcaaataagctgt

SEQ ID NO: 797329 - DNA, 22 bp, Artificial Sequence
  chemically synthesized
ttaaactctcctcaaataagct

SEQ ID NO: 797330 - DNA, 22 bp, Artificial Sequence
  chemically synthesized
ctgccaccaacagcttatttga

SEQ ID NO: 797331 - DNA, 22 bp, Artificial Sequence
  chemically synthesized
cttaaactctcctcaaataagc

SEQ ID NO: 797332 - DNA, 22 bp, Artificial Sequence
  chemically synthesized
tcttaaactctcctcaaataag

SEQ ID NO: 797333 - DNA, 22 bp, Artificial Sequence
  chemically synthesized
ccaccaacagcttatttgagga

SEQ ID NO: 797334 - DNA, 22 bp, Artificial Sequence
  chemically synthesized
tttcttaaactctcctcaaata

SEQ ID NO: 797335 - DNA, 22 bp, Artificial Sequence
  chemically synthesized
ctttcttaaactctcctcaaat

SEQ ID NO: 797336 - DNA, 22 bp, Artificial Sequence
  chemically synthesized
gtaaaatcttctttcttaaact

SEQ ID NO: 797337 - DNA, 22 bp, Artificial Sequence
  chemically synthesized
atttgaggagagtttaagaaag

SEQ ID NO: 797338 - DNA, 22 bp, Artificial Sequence
  chemically synthesized
tggtaaaatcttctttcttaaa

SEQ ID NO: 797339 - DNA, 22 bp, Artificial Sequence
  chemically synthesized
tttgaggagagtttaagaaaga

SEQ ID NO: 797340 - DNA, 22 bp, Artificial Sequence
  chemically synthesized
ctggtaaaatcttctttcttaa

SEQ ID NO: 797341 - DNA, 22 bp, Artificial Sequence
  chemically synthesized
tctggtaaaatcttctttctta

SEQ ID NO: 797342 - DNA, 22 bp, Artificial Sequence
  chemically synthesized
ttctggtaaaatcttctttctt

SEQ ID NO: 797343 - DNA, 22 bp, Artificial Sequence
  chemically synthesized
gaggagagtttaagaaagaaga

SEQ ID NO: 797344 - DNA, 22 bp, Artificial Sequence
  chemically synthesized
aggagagtttaagaaagaagat

SEQ ID NO: 797345 - DNA, 22 bp, Artificial Sequence
  chemically synthesized
gaacttttctggtaaaatcttc

SEQ ID NO: 797346 - DNA, 22 bp, Artificial Sequence
  chemically synthesized
aagaaagaagattttaccagaa

SEQ ID NO: 797347 - DNA, 22 bp, Artificial Sequence
  chemically synthesized
agaaagaagattttaccagaaa

SEQ ID NO: 797348 - DNA, 22 bp, Artificial Sequence
  chemically synthesized
taccagaaaagttccaatttca

SEQ ID NO: 797349 - DNA, 22 bp, Artificial Sequence
  chemically synthesized
accagaaaagttccaatttcat

SEQ ID NO: 797350 - DNA, 22 bp, Artificial Sequence
  chemically synthesized
ccagaaaagttccaatttcatg

SEQ ID NO: 797351 - DNA, 22 bp, Artificial Sequence
  chemically synthesized
caatttcatgtgcctctttata

SEQ ID NO: 797352 - DNA, 22 bp, Artificial Sequence
  chemically synthesized
catgtgcctctttatatgcttt

SEQ ID NO: 797353 - DNA, 22 bp, Artificial Sequence
  chemically synthesized
atgtgcctctttatatgctttt

SEQ ID NO: 797354 - DNA, 22 bp, Artificial Sequence
  chemically synthesized
cataagaagcagaaaaagcata

SEQ ID NO: 797355 - DNA, 22 bp, Artificial Sequence
  chemically synthesized
gagactacataagaagcagaaa

SEQ ID NO: 797356 - DNA, 22 bp, Artificial Sequence
  chemically synthesized
tttatatgctttttctgcttct

SEQ ID NO: 797357 - DNA, 22 bp, Artificial Sequence
  chemically synthesized
ggagactacataagaagcagaa

SEQ ID NO: 797358 - DNA, 22 bp, Artificial Sequence
  chemically synthesized
tatatgctttttctgcttctta

SEQ ID NO: 797359 - DNA, 22 bp, Artificial Sequence
  chemically synthesized
atatgctttttctgcttcttat

SEQ ID NO: 797360 - DNA, 22 bp, Artificial Sequence
  chemically synthesized
tatgctttttctgcttcttatg

SEQ ID NO: 797361 - DNA, 22 bp, Artificial Sequence
  chemically synthesized
aaatttggagactacataagaa

SEQ ID NO: 797362 - DNA, 22 bp, Artificial Sequence
  chemically synthesized
tttctgcttcttatgtagtctc

SEQ ID NO: 797363 - DNA, 22 bp, Artificial Sequence
  chemically synthesized
ttctgcttcttatgtagtctcc

SEQ ID NO: 797364 - DNA, 22 bp, Artificial Sequence
  chemically synthesized
tcattcaaatttggagactaca

SEQ ID NO: 797365 - DNA, 22 bp, Artificial Sequence
  chemically synthesized
tctgcttcttatgtagtctcca

SEQ ID NO: 797366 - DNA, 22 bp, Artificial Sequence
  chemically synthesized
ctgcttcttatgtagtctccaa

SEQ ID NO: 797367 - DNA, 22 bp, Artificial Sequence
  chemically synthesized
tgcttcttatgtagtctccaaa

SEQ ID NO: 797368 - DNA, 22 bp, Artificial Sequence
  chemically synthesized
cttcttatgtagtctccaaatt

SEQ ID NO: 797369 - DNA, 22 bp, Artificial Sequence
  chemically synthesized
cttatgtagtctccaaatttga

SEQ ID NO: 797370 - DNA, 22 bp, Artificial Sequence
  chemically synthesized
ttatgtagtctccaaatttgaa

SEQ ID NO: 797371 - DNA, 22 bp, Artificial Sequence
  chemically synthesized
ggaagactgtcattcaaatttg

SEQ ID NO: 797372 - DNA, 22 bp, Artificial Sequence
  chemically synthesized
atgtagtctccaaatttgaatg

SEQ ID NO: 797373 - DNA, 22 bp, Artificial Sequence
  chemically synthesized
tgtagtctccaaatttgaatga

SEQ ID NO: 797374 - DNA, 22 bp, Artificial Sequence
  chemically synthesized
gttaggaagactgtcattcaaa

SEQ ID NO: 797375 - DNA, 22 bp, Artificial Sequence
  chemically synthesized
ctagttaggaagactgtcattc

SEQ ID NO: 797376 - DNA, 22 bp, Artificial Sequence
  chemically synthesized
caaatttgaatgacagtcttcc

SEQ ID NO: 797377 - DNA, 22 bp, Artificial Sequence
  chemically synthesized
caaggttactagttaggaagac

SEQ ID NO: 797378 - DNA, 22 bp, Artificial Sequence
  chemically synthesized
ctccaaggttactagttaggaa

SEQ ID NO: 797379 - DNA, 22 bp, Artificial Sequence
  chemically synthesized
gaatgacagtcttcctaactag

SEQ ID NO: 797380 - DNA, 22 bp, Artificial Sequence
  chemically synthesized
aatgacagtcttcctaactagt

SEQ ID NO: 797381 - DNA, 22 bp, Artificial Sequence
  chemically synthesized
tattcctccaaggttactagtt

SEQ ID NO: 797382 - DNA, 22 bp, Artificial Sequence
  chemically synthesized
ctatattcctccaaggttacta

SEQ ID NO: 797383 - DNA, 22 bp, Artificial Sequence
  chemically synthesized
gtctcctatattcctccaaggt

SEQ ID NO: 797384 - DNA, 22 bp, Artificial Sequence
  chemically synthesized
cctaactagtaaccttggagga

SEQ ID NO: 797385 - DNA, 22 bp, Artificial Sequence
  chemically synthesized
ggtctcctatattcctccaagg

SEQ ID NO: 797386 - DNA, 22 bp, Artificial Sequence
  chemically synthesized
ctaactagtaaccttggaggaa

SEQ ID NO: 797387 - DNA, 22 bp, Artificial Sequence
  chemically synthesized
actagtaaccttggaggaatat

SEQ ID NO: 797388 - DNA, 22 bp, Artificial Sequence
  chemically synthesized
acttggtctcctatattcctcc

SEQ ID NO: 797389 - DNA, 22 bp, Artificial Sequence
  chemically synthesized
ctcacttggtctcctatattcc

SEQ ID NO: 797390 - DNA, 22 bp, Artificial Sequence
  chemically synthesized
gtaaccttggaggaatatagga

SEQ ID NO: 797391 - DNA, 22 bp, Artificial Sequence
  chemically synthesized
cctcacttggtctcctatattc

SEQ ID NO: 797392 - DNA, 22 bp, Artificial Sequence
  chemically synthesized
atagcttcctcacttggtctcc

SEQ ID NO: 797393 - DNA, 22 bp, Artificial Sequence
  chemically synthesized
ggaggaatataggagaccaagt

SEQ ID NO: 797394 - DNA, 22 bp, Artificial Sequence
  chemically synthesized
gatagcttcctcacttggtctc

SEQ ID NO: 797395 - DNA, 22 bp, Artificial Sequence
  chemically synthesized
gaggaatataggagaccaagtg

SEQ ID NO: 797396 - DNA, 22 bp, Artificial Sequence
  chemically synthesized
tttgatagcttcctcacttggt

SEQ ID NO: 797397 - DNA, 22 bp, Artificial Sequence
  chemically synthesized
agaaattatttgatagcttcct

SEQ ID NO: 797398 - DNA, 22 bp, Artificial Sequence
  chemically synthesized
atgttaagaaattatttgatag

SEQ ID NO: 797399 - DNA, 22 bp, Artificial Sequence
  chemically synthesized
aataatgttgatgttaagaaat

SEQ ID NO: 797400 - DNA, 22 bp, Artificial Sequence
  chemically synthesized
caataatgttgatgttaagaaa

SEQ ID NO: 797401 - DNA, 22 bp, Artificial Sequence
  chemically synthesized
tcaaataatttcttaacatcaa

SEQ ID NO: 797402 - DNA, 22 bp, Artificial Sequence
  chemically synthesized
tgtttcaataatgttgatgtta

SEQ ID NO: 797403 - DNA, 22 bp, Artificial Sequence
  chemically synthesized
ctatgtttcaataatgttgatg

SEQ ID NO: 797404 - DNA, 22 bp, Artificial Sequence
  chemically synthesized
cttaacatcaacattattgaaa

SEQ ID NO: 797405 - DNA, 22 bp, Artificial Sequence
  chemically synthesized
ttaacatcaacattattgaaac

SEQ ID NO: 797406 - DNA, 22 bp, Artificial Sequence
  chemically synthesized
aacatcaacattattgaaacat

SEQ ID NO: 797407 - DNA, 22 bp, Artificial Sequence
  chemically synthesized
acatcaacattattgaaacata

SEQ ID NO: 797408 - DNA, 22 bp, Artificial Sequence
  chemically synthesized
caatgtaaaacaatgagttact

SEQ ID NO: 797409 - DNA, 22 bp, Artificial Sequence
  chemically synthesized
ttgaaacatagtaactcattgt

SEQ ID NO: 797410 - DNA, 22 bp, Artificial Sequence
  chemically synthesized
gcctccaatgtaaaacaatgag

SEQ ID NO: 797411 - DNA, 22 bp, Artificial Sequence
  chemically synthesized
aaacatagtaactcattgtttt

SEQ ID NO: 797412 - DNA, 22 bp, Artificial Sequence
  chemically synthesized
agcctccaatgtaaaacaatga

SEQ ID NO: 797413 - DNA, 22 bp, Artificial Sequence
  chemically synthesized
tttagcctccaatgtaaaacaa

SEQ ID NO: 797414 - DNA, 22 bp, Artificial Sequence
  chemically synthesized
tatttagcctccaatgtaaaac

SEQ ID NO: 797415 - DNA, 22 bp, Artificial Sequence
  chemically synthesized
attgttttacattggaggctaa

SEQ ID NO: 797416 - DNA, 22 bp, Artificial Sequence
  chemically synthesized
ttttacattggaggctaaatag

SEQ ID NO: 797417 - DNA, 22 bp, Artificial Sequence
  chemically synthesized
aaacatatcattctatttagcc

SEQ ID NO: 797418 - DNA, 22 bp, Artificial Sequence
  chemically synthesized
aaaacatatcattctatttagc

SEQ ID NO: 797419 - DNA, 22 bp, Artificial Sequence
  chemically synthesized
taaaacatatcattctatttag

SEQ ID NO: 797420 - DNA, 22 bp, Artificial Sequence
  chemically synthesized
tacattggaggctaaatagaat

SEQ ID NO: 797421 - DNA, 22 bp, Artificial Sequence
  chemically synthesized
acattggaggctaaatagaatg

SEQ ID NO: 797422 - DNA, 22 bp, Artificial Sequence
  chemically synthesized
cattggaggctaaatagaatga

SEQ ID NO: 797423 - DNA, 22 bp, Artificial Sequence
  chemically synthesized
gaggctaaatagaatgatatgt

SEQ ID NO: 797424 - DNA, 22 bp, Artificial Sequence
  chemically synthesized
aatagaatgatatgttttaaaa

SEQ ID NO: 797425 - DNA, 22 bp, Artificial Sequence
  chemically synthesized
taaaatggctatctccatgggc

SEQ ID NO: 797426 - DNA, 22 bp, Artificial Sequence
  chemically synthesized
aaaatggctatctccatgggct

SEQ ID NO: 797427 - DNA, 22 bp, Artificial Sequence
  chemically synthesized
aaatggctatctccatgggctt

SEQ ID NO: 797428 - DNA, 22 bp, Artificial Sequence
  chemically synthesized
tcagatgagaaaaaaaaaataa

SEQ ID NO: 797429 - DNA, 22 bp, Artificial Sequence
  chemically synthesized
tctccatgggcttatttttttt

SEQ ID NO: 797430 - DNA, 22 bp, Artificial Sequence
  chemically synthesized
atcagatgagaaaaaaaaaata

SEQ ID NO: 797431 - DNA, 22 bp, Artificial Sequence
  chemically synthesized
catgggcttattttttttttct

SEQ ID NO: 797432 - DNA, 22 bp, Artificial Sequence
  chemically synthesized
aatccacttatcagatgagaaa

SEQ ID NO: 797433 - DNA, 22 bp, Artificial Sequence
  chemically synthesized
attttttttttctcatctgata

SEQ ID NO: 797434 - DNA, 22 bp, Artificial Sequence
  chemically synthesized
ttttttttttctcatctgataa

SEQ ID NO: 797435 - DNA, 22 bp, Artificial Sequence
  chemically synthesized
tttttttctcatctgataagtg

SEQ ID NO: 797436 - DNA, 22 bp, Artificial Sequence
  chemically synthesized
ttttttctcatctgataagtgg

SEQ ID NO: 797437 - DNA, 22 bp, Artificial Sequence
  chemically synthesized
tttttctcatctgataagtgga

SEQ ID NO: 797438 - DNA, 22 bp, Artificial Sequence
  chemically synthesized
gaaatcattgaatccacttatc

SEQ ID NO: 797439 - DNA, 22 bp, Artificial Sequence
  chemically synthesized
ttttctcatctgataagtggat

SEQ ID NO: 797440 - DNA, 22 bp, Artificial Sequence
  chemically synthesized
ggaaatcattgaatccacttat

SEQ ID NO: 797441 - DNA, 22 bp, Artificial Sequence
  chemically synthesized
tttctcatctgataagtggatt

SEQ ID NO: 797442 - DNA, 22 bp, Artificial Sequence
  chemically synthesized
ttctcatctgataagtggattc

SEQ ID NO: 797443 - DNA, 22 bp, Artificial Sequence
  chemically synthesized
tctcatctgataagtggattca

SEQ ID NO: 797444 - DNA, 22 bp, Artificial Sequence
  chemically synthesized
ctcatctgataagtggattcaa

SEQ ID NO: 797445 - DNA, 22 bp, Artificial Sequence
  chemically synthesized
tcatctgataagtggattcaat

SEQ ID NO: 797446 - DNA, 22 bp, Artificial Sequence
  chemically synthesized
atctgataagtggattcaatga

SEQ ID NO: 797447 - DNA, 22 bp, Artificial Sequence
  chemically synthesized
ataagtggattcaatgatttcc

SEQ ID NO: 797448 - DNA, 22 bp, Artificial Sequence
  chemically synthesized
aaaacaaaatcttggaaatcat

SEQ ID NO: 797449 - DNA, 22 bp, Artificial Sequence
  chemically synthesized
aatgatttccaagattttgttt

SEQ ID NO: 797450 - DNA, 22 bp, Artificial Sequence
  chemically synthesized
ccaagattttgttttcaactct

SEQ ID NO: 797451 - DNA, 22 bp, Artificial Sequence
  chemically synthesized
caagattttgttttcaactctg

SEQ ID NO: 797452 - DNA, 22 bp, Artificial Sequence
  chemically synthesized
tgttttcaactctgtgattcta

SEQ ID NO: 797453 - DNA, 22 bp, Artificial Sequence
  chemically synthesized
gttttcaactctgtgattctat

SEQ ID NO: 797454 - DNA, 22 bp, Artificial Sequence
  chemically synthesized
ttttcaactctgtgattctatg

SEQ ID NO: 797455 - DNA, 22 bp, Artificial Sequence
  chemically synthesized
cagtatccagagaccatagaat

SEQ ID NO: 797456 - DNA, 22 bp, Artificial Sequence
  chemically synthesized
tcaactctgtgattctatggtc

SEQ ID NO: 797457 - DNA, 22 bp, Artificial Sequence
  chemically synthesized
caactctgtgattctatggtct

SEQ ID NO: 797458 - DNA, 22 bp, Artificial Sequence
  chemically synthesized
aactctgtgattctatggtctc

SEQ ID NO: 797459 - DNA, 22 bp, Artificial Sequence
  chemically synthesized
gaactacagtatccagagacca

SEQ ID NO: 797460 - DNA, 22 bp, Artificial Sequence
  chemically synthesized
tgtgattctatggtctctggat

SEQ ID NO: 797461 - DNA, 22 bp, Artificial Sequence
  chemically synthesized
tgattctatggtctctggatac

SEQ ID NO: 797462 - DNA, 22 bp, Artificial Sequence
  chemically synthesized
aaggttggaactacagtatcca

SEQ ID NO: 797463 - DNA, 22 bp, Artificial Sequence
  chemically synthesized
gaaggttggaactacagtatcc

SEQ ID NO: 797464 - DNA, 22 bp, Artificial Sequence
  chemically synthesized
tatggtctctggatactgtagt

SEQ ID NO: 797465 - DNA, 22 bp, Artificial Sequence
  chemically synthesized
ttgaaggttggaactacagtat

SEQ ID NO: 797466 - DNA, 22 bp, Artificial Sequence
  chemically synthesized
tggtctctggatactgtagttc

SEQ ID NO: 797467 - DNA, 22 bp, Artificial Sequence
  chemically synthesized
tcttgaaggttggaactacagt

SEQ ID NO: 797468 - DNA, 22 bp, Artificial Sequence
  chemically synthesized
ctcttgaaggttggaactacag

SEQ ID NO: 797469 - DNA, 22 bp, Artificial Sequence
  chemically synthesized
ttctcttgaaggttggaactac

SEQ ID NO: 797470 - DNA, 22 bp, Artificial Sequence
  chemically synthesized
tggatactgtagttccaacctt

SEQ ID NO: 797471 - DNA, 22 bp, Artificial Sequence
  chemically synthesized
gatactgtagttccaaccttca

SEQ ID NO: 797472 - DNA, 22 bp, Artificial Sequence
  chemically synthesized
gatgtgctcttctcttgaaggt

SEQ ID NO: 797473 - DNA, 22 bp, Artificial Sequence
  chemically synthesized
tagttccaaccttcaagagaag

SEQ ID NO: 797474 - DNA, 22 bp, Artificial Sequence
  chemically synthesized
attagatgtgctcttctcttga

SEQ ID NO: 797475 - DNA, 22 bp, Artificial Sequence
  chemically synthesized
aattagatgtgctcttctcttg

SEQ ID NO: 797476 - DNA, 22 bp, Artificial Sequence
  chemically synthesized
taattagatgtgctcttctctt

SEQ ID NO: 797477 - DNA, 22 bp, Artificial Sequence
  chemically synthesized
caaccttcaagagaagagcaca

SEQ ID NO: 797478 - DNA, 22 bp, Artificial Sequence
  chemically synthesized
gaactttaattagatgtgctct

SEQ ID NO: 797479 - DNA, 22 bp, Artificial Sequence
  chemically synthesized
tctcgaactttaattagatgtg

SEQ ID NO: 797480 - DNA, 22 bp, Artificial Sequence
  chemically synthesized
caagagaagagcacatctaatt

SEQ ID NO: 797481 - DNA, 22 bp, Artificial Sequence
  chemically synthesized
aagagaagagcacatctaatta

SEQ ID NO: 797482 - DNA, 22 bp, Artificial Sequence
  chemically synthesized
gcgctgtctcgaactttaatta

SEQ ID NO: 797483 - DNA, 22 bp, Artificial Sequence
  chemically synthesized
ggcgctgtctcgaactttaatt

SEQ ID NO: 797484 - DNA, 22 bp, Artificial Sequence
  chemically synthesized
tggcgctgtctcgaactttaat

SEQ ID NO: 797485 - DNA, 22 bp, Artificial Sequence
  chemically synthesized
ttggcgctgtctcgaactttaa

SEQ ID NO: 797486 - DNA, 22 bp, Artificial Sequence
  chemically synthesized
atcttttggcgctgtctcgaac

SEQ ID NO: 797487 - DNA, 22 bp, Artificial Sequence
  chemically synthesized
ctaatcttttggcgctgtctcg

SEQ ID NO: 797488 - DNA, 22 bp, Artificial Sequence
  chemically synthesized
attaaagttcgagacagcgcca

SEQ ID NO: 797489 - DNA, 22 bp, Artificial Sequence
  chemically synthesized
aagttcgagacagcgccaaaag

SEQ ID NO: 797490 - DNA, 22 bp, Artificial Sequence
  chemically synthesized
gagacagcgccaaaagattagc

SEQ ID NO: 797491 - DNA, 22 bp, Artificial Sequence
  chemically synthesized
aatgtgaccgtagctgctaatc

SEQ ID NO: 797492 - DNA, 22 bp, Artificial Sequence
  chemically synthesized
attaaatgtgaccgtagctgct

SEQ ID NO: 797493 - DNA, 22 bp, Artificial Sequence
  chemically synthesized
ctcattaaatgtgaccgtagct

SEQ ID NO: 797494 - DNA, 22 bp, Artificial Sequence
  chemically synthesized
gctcattaaatgtgaccgtagc

SEQ ID NO: 797495 - DNA, 22 bp, Artificial Sequence
  chemically synthesized
gacttgctcattaaatgtgacc

SEQ ID NO: 797496 - DNA, 22 bp, Artificial Sequence
  chemically synthesized
gcagctacggtcacatttaatg

SEQ ID NO: 797497 - DNA, 22 bp, Artificial Sequence
  chemically synthesized
actcgacttgctcattaaatgt

SEQ ID NO: 797498 - DNA, 22 bp, Artificial Sequence
  chemically synthesized
cactcgacttgctcattaaatg

SEQ ID NO: 797499 - DNA, 22 bp, Artificial Sequence
  chemically synthesized
cggtcacatttaatgagcaagt

SEQ ID NO: 797500 - DNA, 22 bp, Artificial Sequence
  chemically synthesized
aatgagcaagtcgagtgaaggc

SEQ ID NO: 797501 - DNA, 22 bp, Artificial Sequence
  chemically synthesized
atgagcaagtcgagtgaaggca

SEQ ID NO: 797502 - DNA, 22 bp, Artificial Sequence
  chemically synthesized
gacaatgggaaaaatgccttca

SEQ ID NO: 797503 - DNA, 22 bp, Artificial Sequence
  chemically synthesized
ctagacaatgggaaaaatgcct

SEQ ID NO: 797504 - DNA, 22 bp, Artificial Sequence
  chemically synthesized
aggtgactcctagacaatggga

SEQ ID NO: 797505 - DNA, 22 bp, Artificial Sequence
  chemically synthesized
ttgaggtgactcctagacaatg

SEQ ID NO: 797506 - DNA, 22 bp, Artificial Sequence
  chemically synthesized
catcctattgaggtgactccta

SEQ ID NO: 797507 - DNA, 22 bp, Artificial Sequence
  chemically synthesized
ttcccattgtctaggagtcacc

SEQ ID NO: 797508 - DNA, 22 bp, Artificial Sequence
  chemically synthesized
ccatcctattgaggtgactcct

SEQ ID NO: 797509 - DNA, 22 bp, Artificial Sequence
  chemically synthesized
tcccattgtctaggagtcacct

SEQ ID NO: 797510 - DNA, 22 bp, Artificial Sequence
  chemically synthesized
cccattgtctaggagtcacctc

SEQ ID NO: 797511 - DNA, 22 bp, Artificial Sequence
  chemically synthesized
ccattgtctaggagtcacctca

SEQ ID NO: 797512 - DNA, 22 bp, Artificial Sequence
  chemically synthesized
tctaggagtcacctcaatagga

SEQ ID NO: 797513 - DNA, 22 bp, Artificial Sequence
  chemically synthesized
ggagtcacctcaataggatgga

SEQ ID NO: 797514 - DNA, 22 bp, Artificial Sequence
  chemically synthesized
tatagaacgtgcatcttccatc

SEQ ID NO: 797515 - DNA, 22 bp, Artificial Sequence
  chemically synthesized
aataggatggaagatgcacgtt

SEQ ID NO: 797516 - DNA, 22 bp, Artificial Sequence
  chemically synthesized
gtcataagactgtatagaacgt

SEQ ID NO: 797517 - DNA, 22 bp, Artificial Sequence
  chemically synthesized
aggaacaggctggtcataagac

SEQ ID NO: 797518 - DNA, 22 bp, Artificial Sequence
  chemically synthesized
tatacagtcttatgaccagcct

SEQ ID NO: 797519 - DNA, 22 bp, Artificial Sequence
  chemically synthesized
tacagtcttatgaccagcctgt

SEQ ID NO: 797520 - DNA, 22 bp, Artificial Sequence
  chemically synthesized
aaggaaaaatatgctgaggaac

SEQ ID NO: 797521 - DNA, 22 bp, Artificial Sequence
  chemically synthesized
atgaccagcctgttcctcagca

SEQ ID NO: 797522 - DNA, 22 bp, Artificial Sequence
  chemically synthesized
aaaggaaaaatatgctgaggaa

SEQ ID NO: 797523 - DNA, 22 bp, Artificial Sequence
  chemically synthesized
tgaccagcctgttcctcagcat

SEQ ID NO: 797524 - DNA, 22 bp, Artificial Sequence
  chemically synthesized
gtacttaaaggaaaaatatgct

SEQ ID NO: 797525 - DNA, 22 bp, Artificial Sequence
  chemically synthesized
ggtacttaaaggaaaaatatgc

SEQ ID NO: 797526 - DNA, 22 bp, Artificial Sequence
  chemically synthesized
tttggtacttaaaggaaaaata

SEQ ID NO: 797527 - DNA, 22 bp, Artificial Sequence
  chemically synthesized
ttcctcagcatatttttccttt

SEQ ID NO: 797528 - DNA, 22 bp, Artificial Sequence
  chemically synthesized
ctcagcatatttttcctttaag

SEQ ID NO: 797529 - DNA, 22 bp, Artificial Sequence
  chemically synthesized
agcatatttttcctttaagtac

SEQ ID NO: 797530 - DNA, 22 bp, Artificial Sequence
  chemically synthesized
atatacctgtttggtacttaaa

SEQ ID NO: 797531 - DNA, 22 bp, Artificial Sequence
  chemically synthesized
aattcatatacctgtttggtac

SEQ ID NO: 797532 - DNA, 22 bp, Artificial Sequence
  chemically synthesized
taaattcatatacctgtttggt

SEQ ID NO: 797533 - DNA, 22 bp, Artificial Sequence
  chemically synthesized
ttcctttaagtaccaaacaggt

SEQ ID NO: 797534 - DNA, 22 bp, Artificial Sequence
  chemically synthesized
tcctttaagtaccaaacaggta

SEQ ID NO: 797535 - DNA, 22 bp, Artificial Sequence
  chemically synthesized
cctttaagtaccaaacaggtat

SEQ ID NO: 797536 - DNA, 22 bp, Artificial Sequence
  chemically synthesized
ctttaagtaccaaacaggtata

SEQ ID NO: 797537 - DNA, 22 bp, Artificial Sequence
  chemically synthesized
tattctaaattcatatacctgt

SEQ ID NO: 797538 - DNA, 22 bp, Artificial Sequence
  chemically synthesized
atattctaaattcatatacctg

SEQ ID NO: 797539 - DNA, 22 bp, Artificial Sequence
  chemically synthesized
taagtaccaaacaggtatatga

SEQ ID NO: 797540 - DNA, 22 bp, Artificial Sequence
  chemically synthesized
tatattctaaattcatatacct

SEQ ID NO: 797541 - DNA, 22 bp, Artificial Sequence
  chemically synthesized
aagtaccaaacaggtatatgaa

SEQ ID NO: 797542 - DNA, 22 bp, Artificial Sequence
  chemically synthesized
ttatattctaaattcatatacc

SEQ ID NO: 797543 - DNA, 22 bp, Artificial Sequence
  chemically synthesized
agtaccaaacaggtatatgaat

SEQ ID NO: 797544 - DNA, 22 bp, Artificial Sequence
  chemically synthesized
tttatattctaaattcatatac

SEQ ID NO: 797545 - DNA, 22 bp, Artificial Sequence
  chemically synthesized
tttttatattctaaattcatat

SEQ ID NO: 797546 - DNA, 22 bp, Artificial Sequence
  chemically synthesized
tcacaaccctctttttatattc

SEQ ID NO: 797547 - DNA, 22 bp, Artificial Sequence
  chemically synthesized
atcacaaccctctttttatatt

SEQ ID NO: 797548 - DNA, 22 bp, Artificial Sequence
  chemically synthesized
agaatataaaaagagggttgtg

SEQ ID NO: 797549 - DNA, 22 bp, Artificial Sequence
  chemically synthesized
gaatataaaaagagggttgtga

SEQ ID NO: 797550 - DNA, 22 bp, Artificial Sequence
  chemically synthesized
gagaagaaaatatcaacttatc

SEQ ID NO: 797551 - DNA, 22 bp, Artificial Sequence
  chemically synthesized
ggagaagaaaatatcaacttat

SEQ ID NO: 797552 - DNA, 22 bp, Artificial Sequence
  chemically synthesized
tggagaagaaaatatcaactta

SEQ ID NO: 797553 - DNA, 22 bp, Artificial Sequence
  chemically synthesized
aactttggagaagaaaatatca

SEQ ID NO: 797554 - DNA, 22 bp, Artificial Sequence
  chemically synthesized
aaactttggagaagaaaatatc

SEQ ID NO: 797555 - DNA, 22 bp, Artificial Sequence
  chemically synthesized
tgataagttgatattttcttct

SEQ ID NO: 797556 - DNA, 22 bp, Artificial Sequence
  chemically synthesized
aaatatttaaactttggagaag

SEQ ID NO: 797557 - DNA, 22 bp, Artificial Sequence
  chemically synthesized
ttcaaatatttaaactttggag

SEQ ID NO: 797558 - DNA, 22 bp, Artificial Sequence
  chemically synthesized
atattttcttctccaaagttta

SEQ ID NO: 797559 - DNA, 22 bp, Artificial Sequence
  chemically synthesized
tcttctccaaagtttaaatatt

SEQ ID NO: 797560 - DNA, 22 bp, Artificial Sequence
  chemically synthesized
gtgaactattcaaatatttaaa

SEQ ID NO: 797561 - DNA, 22 bp, Artificial Sequence
  chemically synthesized
cttctccaaagtttaaatattt

SEQ ID NO: 797562 - DNA, 22 bp, Artificial Sequence
  chemically synthesized
ttctccaaagtttaaatatttg

SEQ ID NO: 797563 - DNA, 22 bp, Artificial Sequence
  chemically synthesized
ctccaaagtttaaatatttgaa

SEQ ID NO: 797564 - DNA, 22 bp, Artificial Sequence
  chemically synthesized
tccaaagtttaaatatttgaat

SEQ ID NO: 797565 - DNA, 22 bp, Artificial Sequence
  chemically synthesized
cagctggtgaactattcaaata

SEQ ID NO: 797566 - DNA, 22 bp, Artificial Sequence
  chemically synthesized
caaagtttaaatatttgaatag

SEQ ID NO: 797567 - DNA, 22 bp, Artificial Sequence
  chemically synthesized
aagctacagctggtgaactatt

SEQ ID NO: 797568 - DNA, 22 bp, Artificial Sequence
  chemically synthesized
aaagctacagctggtgaactat

SEQ ID NO: 797569 - DNA, 22 bp, Artificial Sequence
  chemically synthesized
aaatatttgaatagttcaccag

SEQ ID NO: 797570 - DNA, 22 bp, Artificial Sequence
  chemically synthesized
aatatttgaatagttcaccagc

SEQ ID NO: 797571 - DNA, 22 bp, Artificial Sequence
  chemically synthesized
tttaaagctacagctggtgaac

SEQ ID NO: 797572 - DNA, 22 bp, Artificial Sequence
  chemically synthesized
ccactatttaaagctacagctg

SEQ ID NO: 797573 - DNA, 22 bp, Artificial Sequence
  chemically synthesized
gaatagttcaccagctgtagct

SEQ ID NO: 797574 - DNA, 22 bp, Artificial Sequence
  chemically synthesized
cccactatttaaagctacagct

SEQ ID NO: 797575 - DNA, 22 bp, Artificial Sequence
  chemically synthesized
aatagttcaccagctgtagctt

SEQ ID NO: 797576 - DNA, 22 bp, Artificial Sequence
  chemically synthesized
tttcccactatttaaagctaca

SEQ ID NO: 797577 - DNA, 22 bp, Artificial Sequence
  chemically synthesized
cattatttcccactatttaaag

SEQ ID NO: 797578 - DNA, 22 bp, Artificial Sequence
  chemically synthesized
accagctgtagctttaaatagt

SEQ ID NO: 797579 - DNA, 22 bp, Artificial Sequence
  chemically synthesized
gctgcattatttcccactattt

SEQ ID NO: 797580 - DNA, 22 bp, Artificial Sequence
  chemically synthesized
tagctgcattatttcccactat

SEQ ID NO: 797581 - DNA, 22 bp, Artificial Sequence
  chemically synthesized
ctagctgcattatttcccacta

SEQ ID NO: 797582 - DNA, 22 bp, Artificial Sequence
  chemically synthesized
tagctttaaatagtgggaaata

SEQ ID NO: 797583 - DNA, 22 bp, Artificial Sequence
  chemically synthesized
ttctagctgcattatttcccac

SEQ ID NO: 797584 - DNA, 22 bp, Artificial Sequence
  chemically synthesized
taaatagtgggaaataatgcag

SEQ ID NO: 797585 - DNA, 22 bp, Artificial Sequence
  chemically synthesized
aaatagtgggaaataatgcagc

SEQ ID NO: 797586 - DNA, 22 bp, Artificial Sequence
  chemically synthesized
aatagtgggaaataatgcagct

SEQ ID NO: 797587 - DNA, 22 bp, Artificial Sequence
  chemically synthesized
tatggttcttctagctgcatta

SEQ ID NO: 797588 - DNA, 22 bp, Artificial Sequence
  chemically synthesized
cctgtatggttcttctagctgc

SEQ ID NO: 797589 - DNA, 22 bp, Artificial Sequence
  chemically synthesized
ccctgtatggttcttctagctg

SEQ ID NO: 797590 - DNA, 22 bp, Artificial Sequence
  chemically synthesized
tccctgtatggttcttctagct

SEQ ID NO: 797591 - DNA, 22 bp, Artificial Sequence
  chemically synthesized
ttccctgtatggttcttctagc

SEQ ID NO: 797592 - DNA, 22 bp, Artificial Sequence
  chemically synthesized
tttccctgtatggttcttctag

SEQ ID NO: 797593 - DNA, 22 bp, Artificial Sequence
  chemically synthesized
tttttccctgtatggttcttct

SEQ ID NO: 797594 - DNA, 22 bp, Artificial Sequence
  chemically synthesized
actctttttccctgtatggttc

SEQ ID NO: 797595 - DNA, 22 bp, Artificial Sequence
  chemically synthesized
aactcactctttttccctgtat

SEQ ID NO: 797596 - DNA, 22 bp, Artificial Sequence
  chemically synthesized
caactcactctttttccctgta

SEQ ID NO: 797597 - DNA, 22 bp, Artificial Sequence
  chemically synthesized
tcaactcactctttttccctgt

SEQ ID NO: 797598 - DNA, 22 bp, Artificial Sequence
  chemically synthesized
gaagaaccatacagggaaaaag

SEQ ID NO: 797599 - DNA, 22 bp, Artificial Sequence
  chemically synthesized
agaattttcaactcactctttt

SEQ ID NO: 797600 - DNA, 22 bp, Artificial Sequence
  chemically synthesized
agctgagaattttcaactcact

SEQ ID NO: 797601 - DNA, 22 bp, Artificial Sequence
  chemically synthesized
atgataaccactgagctgagaa

SEQ ID NO: 797602 - DNA, 22 bp, Artificial Sequence
  chemically synthesized
gatgataaccactgagctgaga

SEQ ID NO: 797603 - DNA, 22 bp, Artificial Sequence
  chemically synthesized
aaaattctcagctcagtggtta

SEQ ID NO: 797604 - DNA, 22 bp, Artificial Sequence
  chemically synthesized
tcagctcagtggttatcatcaa

SEQ ID NO: 797605 - DNA, 22 bp, Artificial Sequence
  chemically synthesized
acaggaaccaaacttgatgata

SEQ ID NO: 797606 - DNA, 22 bp, Artificial Sequence
  chemically synthesized
agctcagtggttatcatcaagt

SEQ ID NO: 797607 - DNA, 22 bp, Artificial Sequence
  chemically synthesized
agtggttatcatcaagtttggt

SEQ ID NO: 797608 - DNA, 22 bp, Artificial Sequence
  chemically synthesized
gaggctgacaggaaccaaactt

SEQ ID NO: 797609 - DNA, 22 bp, Artificial Sequence
  chemically synthesized
tcatcaagtttggttcctgtca

SEQ ID NO: 797610 - DNA, 22 bp, Artificial Sequence
  chemically synthesized
cagtcgctggaggctgacagga

SEQ ID NO: 797611 - DNA, 22 bp, Artificial Sequence
  chemically synthesized
ggttcctgtcagcctccagcga

SEQ ID NO: 797612 - DNA, 22 bp, Artificial Sequence
  chemically synthesized
gttcctgtcagcctccagcgac

SEQ ID NO: 797613 - DNA, 22 bp, Artificial Sequence
  chemically synthesized
taagcaccacctacagtcgctg

SEQ ID NO: 797614 - DNA, 22 bp, Artificial Sequence
  chemically synthesized
ctgtcagcctccagcgactgta

SEQ ID NO: 797615 - DNA, 22 bp, Artificial Sequence
  chemically synthesized
tcagcctccagcgactgtaggt

SEQ ID NO: 797616 - DNA, 22 bp, Artificial Sequence
  chemically synthesized
atgaatacctataagcaccacc

SEQ ID NO: 797617 - DNA, 22 bp, Artificial Sequence
  chemically synthesized
cagcgactgtaggtggtgctta

SEQ ID NO: 797618 - DNA, 22 bp, Artificial Sequence
  chemically synthesized
ttgatgaatacctataagcacc

SEQ ID NO: 797619 - DNA, 22 bp, Artificial Sequence
  chemically synthesized
attgatgaatacctataagcac

SEQ ID NO: 797620 - DNA, 22 bp, Artificial Sequence
  chemically synthesized
tattgatgaatacctataagca

SEQ ID NO: 797621 - DNA, 22 bp, Artificial Sequence
  chemically synthesized
ttattgatgaatacctataagc

SEQ ID NO: 797622 - DNA, 22 bp, Artificial Sequence
  chemically synthesized
taggtggtgcttataggtattc

SEQ ID NO: 797623 - DNA, 22 bp, Artificial Sequence
  chemically synthesized
aaatgcaccttttattgatgaa

SEQ ID NO: 797624 - DNA, 22 bp, Artificial Sequence
  chemically synthesized
ataggtattcatcaataaaagg

SEQ ID NO: 797625 - DNA, 22 bp, Artificial Sequence
  chemically synthesized
taggtattcatcaataaaaggt

SEQ ID NO: 797626 - DNA, 22 bp, Artificial Sequence
  chemically synthesized
gaaatcccctcaaatgcacctt

SEQ ID NO: 797627 - DNA, 22 bp, Artificial Sequence
  chemically synthesized
atcaataaaaggtgcatttgag

SEQ ID NO: 797628 - DNA, 22 bp, Artificial Sequence
  chemically synthesized
cgaagcaaaatgctggaaatcc

SEQ ID NO: 797629 - DNA, 22 bp, Artificial Sequence
  chemically synthesized
ctccgaagcaaaatgctggaaa

SEQ ID NO: 797630 - DNA, 22 bp, Artificial Sequence
  chemically synthesized
cctccgaagcaaaatgctggaa

SEQ ID NO: 797631 - DNA, 22 bp, Artificial Sequence
  chemically synthesized
gaggggatttccagcattttgc

SEQ ID NO: 797632 - DNA, 22 bp, Artificial Sequence
  chemically synthesized
aggggatttccagcattttgct

SEQ ID NO: 797633 - DNA, 22 bp, Artificial Sequence
  chemically synthesized
acataaatgatttcctccgaag

SEQ ID NO: 797634 - DNA, 22 bp, Artificial Sequence
  chemically synthesized
ccagcattttgcttcggaggaa

SEQ ID NO: 797635 - DNA, 22 bp, Artificial Sequence
  chemically synthesized
gacataaatgatttcctccgaa

SEQ ID NO: 797636 - DNA, 22 bp, Artificial Sequence
  chemically synthesized
cagcattttgcttcggaggaaa

SEQ ID NO: 797637 - DNA, 22 bp, Artificial Sequence
  chemically synthesized
tgacataaatgatttcctccga

SEQ ID NO: 797638 - DNA, 22 bp, Artificial Sequence
  chemically synthesized
ttgacataaatgatttcctccg

SEQ ID NO: 797639 - DNA, 22 bp, Artificial Sequence
  chemically synthesized
atcttttgacataaatgatttc

SEQ ID NO: 797640 - DNA, 22 bp, Artificial Sequence
  chemically synthesized
aatcttttgacataaatgattt

SEQ ID NO: 797641 - DNA, 22 bp, Artificial Sequence
  chemically synthesized
tgcttcggaggaaatcatttat

SEQ ID NO: 797642 - DNA, 22 bp, Artificial Sequence
  chemically synthesized
taatcttttgacataaatgatt

SEQ ID NO: 797643 - DNA, 22 bp, Artificial Sequence
  chemically synthesized
gcttcggaggaaatcatttatg

SEQ ID NO: 797644 - DNA, 22 bp, Artificial Sequence
  chemically synthesized
cttcggaggaaatcatttatgt

SEQ ID NO: 797645 - DNA, 22 bp, Artificial Sequence
  chemically synthesized
cggaggaaatcatttatgtcaa

SEQ ID NO: 797646 - DNA, 22 bp, Artificial Sequence
  chemically synthesized
ggaggaaatcatttatgtcaaa

SEQ ID NO: 797647 - DNA, 22 bp, Artificial Sequence
  chemically synthesized
aaaacagcagttttaatctttt

SEQ ID NO: 797648 - DNA, 22 bp, Artificial Sequence
  chemically synthesized
atgtcaaaagattaaaactgct

SEQ ID NO: 797649 - DNA, 22 bp, Artificial Sequence
  chemically synthesized
tgtcaaaagattaaaactgctg

SEQ ID NO: 797650 - DNA, 22 bp, Artificial Sequence
  chemically synthesized
agcaattgaaaacagcagtttt

SEQ ID NO: 797651 - DNA, 22 bp, Artificial Sequence
  chemically synthesized
aattaagcaattgaaaacagca

SEQ ID NO: 797652 - DNA, 22 bp, Artificial Sequence
  chemically synthesized
aaactgctgttttcaattgctt

SEQ ID NO: 797653 - DNA, 22 bp, Artificial Sequence
  chemically synthesized
aatatatactcaattaagcaat

SEQ ID NO: 797654 - DNA, 22 bp, Artificial Sequence
  chemically synthesized
ctgttttcaattgcttaattga

SEQ ID NO: 797655 - DNA, 22 bp, Artificial Sequence
  chemically synthesized
acctcaatatatactcaattaa

SEQ ID NO: 797656 - DNA, 22 bp, Artificial Sequence
  chemically synthesized
ttttcaattgcttaattgagta

SEQ ID NO: 797657 - DNA, 22 bp, Artificial Sequence
  chemically synthesized
aacctcaatatatactcaatta

SEQ ID NO: 797658 - DNA, 22 bp, Artificial Sequence
  chemically synthesized
tcaattgcttaattgagtatat

SEQ ID NO: 797659 - DNA, 22 bp, Artificial Sequence
  chemically synthesized
caattgcttaattgagtatata

SEQ ID NO: 797660 - DNA, 22 bp, Artificial Sequence
  chemically synthesized
aattgcttaattgagtatatat

SEQ ID NO: 797661 - DNA, 22 bp, Artificial Sequence
  chemically synthesized
accttaacctcaatatatactc

SEQ ID NO: 797662 - DNA, 22 bp, Artificial Sequence
  chemically synthesized
actaaccttaacctcaatatat

SEQ ID NO: 797663 - DNA, 22 bp, Artificial Sequence
  chemically synthesized
cttaattgagtatatattgagg

SEQ ID NO: 797664 - DNA, 22 bp, Artificial Sequence
  chemically synthesized
cactaaccttaacctcaatata

SEQ ID NO: 797665 - DNA, 22 bp, Artificial Sequence
  chemically synthesized
tcactaaccttaacctcaatat

SEQ ID NO: 797666 - DNA, 22 bp, Artificial Sequence
  chemically synthesized
aattgagtatatattgaggtta

SEQ ID NO: 797667 - DNA, 22 bp, Artificial Sequence
  chemically synthesized
attgagtatatattgaggttaa

SEQ ID NO: 797668 - DNA, 22 bp, Artificial Sequence
  chemically synthesized
ccactttcactaaccttaacct

SEQ ID NO: 797669 - DNA, 22 bp, Artificial Sequence
  chemically synthesized
agtatatattgaggttaaggtt

SEQ ID NO: 797670 - DNA, 22 bp, Artificial Sequence
  chemically synthesized
accactttcactaaccttaacc

SEQ ID NO: 797671 - DNA, 22 bp, Artificial Sequence
  chemically synthesized
taccactttcactaaccttaac

SEQ ID NO: 797672 - DNA, 22 bp, Artificial Sequence
  chemically synthesized
ctttaccactttcactaacctt

SEQ ID NO: 797673 - DNA, 22 bp, Artificial Sequence
  chemically synthesized
tgctttaccactttcactaacc

SEQ ID NO: 797674 - DNA, 22 bp, Artificial Sequence
  chemically synthesized
attctgctttaccactttcact

SEQ ID NO: 797675 - DNA, 22 bp, Artificial Sequence
  chemically synthesized
aggttaaggttagtgaaagtgg

SEQ ID NO: 797676 - DNA, 22 bp, Artificial Sequence
  chemically synthesized
aggttagtgaaagtggtaaagc

SEQ ID NO: 797677 - DNA, 22 bp, Artificial Sequence
  chemically synthesized
gtgaaagtggtaaagcagaatg

SEQ ID NO: 797678 - DNA, 22 bp, Artificial Sequence
  chemically synthesized
taataagcaatgtattcattct

SEQ ID NO: 797679 - DNA, 22 bp, Artificial Sequence
  chemically synthesized
actgtaataagcaatgtattca

SEQ ID NO: 797680 - DNA, 22 bp, Artificial Sequence
  chemically synthesized
gactgtaataagcaatgtattc

SEQ ID NO: 797681 - DNA, 22 bp, Artificial Sequence
  chemically synthesized
ttgactgtaataagcaatgtat

SEQ ID NO: 797682 - DNA, 22 bp, Artificial Sequence
  chemically synthesized
cttgactgtaataagcaatgta

SEQ ID NO: 797683 - DNA, 22 bp, Artificial Sequence
  chemically synthesized
tataacatttcttgactgtaat

SEQ ID NO: 797684 - DNA, 22 bp, Artificial Sequence
  chemically synthesized
tgtataacatttcttgactgta

SEQ ID NO: 797685 - DNA, 22 bp, Artificial Sequence
  chemically synthesized
ctgtataacatttcttgactgt

SEQ ID NO: 797686 - DNA, 22 bp, Artificial Sequence
  chemically synthesized
atttctgtataacatttcttga

SEQ ID NO: 797687 - DNA, 22 bp, Artificial Sequence
  chemically synthesized
cttattacagtcaagaaatgtt

SEQ ID NO: 797688 - DNA, 22 bp, Artificial Sequence
  chemically synthesized
tcatttctgtataacatttctt

SEQ ID NO: 797689 - DNA, 22 bp, Artificial Sequence
  chemically synthesized
ctcatttctgtataacatttct

SEQ ID NO: 797690 - DNA, 22 bp, Artificial Sequence
  chemically synthesized
tctcatttctgtataacatttc

SEQ ID NO: 797691 - DNA, 22 bp, Artificial Sequence
  chemically synthesized
attacagtcaagaaatgttata

SEQ ID NO: 797692 - DNA, 22 bp, Artificial Sequence
  chemically synthesized
ttacagtcaagaaatgttatac

SEQ ID NO: 797693 - DNA, 22 bp, Artificial Sequence
  chemically synthesized
cagtcaagaaatgttatacaga

SEQ ID NO: 797694 - DNA, 22 bp, Artificial Sequence
  chemically synthesized
tacattttctcatttctgtata

SEQ ID NO: 797695 - DNA, 22 bp, Artificial Sequence
  chemically synthesized
gtacattttctcatttctgtat

SEQ ID NO: 797696 - DNA, 22 bp, Artificial Sequence
  chemically synthesized
gtggggtttgtacattttctca

SEQ ID NO: 797697 - DNA, 22 bp, Artificial Sequence
  chemically synthesized
tacagaaatgagaaaatgtaca

SEQ ID NO: 797698 - DNA, 22 bp, Artificial Sequence
  chemically synthesized
tggctggtggggtttgtacatt

SEQ ID NO: 797699 - DNA, 22 bp, Artificial Sequence
  chemically synthesized
atggctggtggggtttgtacat

SEQ ID NO: 797700 - DNA, 22 bp, Artificial Sequence
  chemically synthesized
tttatggctggtggggtttgta

SEQ ID NO: 797701 - DNA, 22 bp, Artificial Sequence
  chemically synthesized
atttatggctggtggggtttgt

SEQ ID NO: 797702 - DNA, 22 bp, Artificial Sequence
  chemically synthesized
cttatttatggctggtggggtt

SEQ ID NO: 797703 - DNA, 22 bp, Artificial Sequence
  chemically synthesized
ccttatttatggctggtggggt

SEQ ID NO: 797704 - DNA, 22 bp, Artificial Sequence
  chemically synthesized
accacttccttatttatggctg

SEQ ID NO: 797705 - DNA, 22 bp, Artificial Sequence
  chemically synthesized
taaccacttccttatttatggc

SEQ ID NO: 797706 - DNA, 22 bp, Artificial Sequence
  chemically synthesized
agagcgacattctaaccacttc

SEQ ID NO: 797707 - DNA, 22 bp, Artificial Sequence
  chemically synthesized
gctgagagcgacattctaacca

SEQ ID NO: 797708 - DNA, 22 bp, Artificial Sequence
  chemically synthesized
ggctgagagcgacattctaacc

SEQ ID NO: 797709 - DNA, 22 bp, Artificial Sequence
  chemically synthesized
gggcccttggctgagagcgaca

SEQ ID NO: 797710 - DNA, 22 bp, Artificial Sequence
  chemically synthesized
agggcccttggctgagagcgac

SEQ ID NO: 797711 - DNA, 22 bp, Artificial Sequence
  chemically synthesized
gaatgtcgctctcagccaaggg

SEQ ID NO: 797712 - DNA, 22 bp, Artificial Sequence
  chemically synthesized
cacaaagggacttagggccctt

SEQ ID NO: 797713 - DNA, 22 bp, Artificial Sequence
  chemically synthesized
tcagccaagggccctaagtccc

SEQ ID NO: 797714 - DNA, 22 bp, Artificial Sequence
  chemically synthesized
agccaagggccctaagtccctt

SEQ ID NO: 797715 - DNA, 22 bp, Artificial Sequence
  chemically synthesized
caaacctacacaaagggactta

SEQ ID NO: 797716 - DNA, 22 bp, Artificial Sequence
  chemically synthesized
ccaaacctacacaaagggactt

SEQ ID NO: 797717 - DNA, 22 bp, Artificial Sequence
  chemically synthesized
tccaaacctacacaaagggact

SEQ ID NO: 797718 - DNA, 22 bp, Artificial Sequence
  chemically synthesized
ttccaaacctacacaaagggac

SEQ ID NO: 797719 - DNA, 22 bp, Artificial Sequence
  chemically synthesized
agtccctttgtgtaggtttgga

SEQ ID NO: 797720 - DNA, 22 bp, Artificial Sequence
  chemically synthesized
gacaggcataaatttttccaaa

SEQ ID NO: 797721 - DNA, 22 bp, Artificial Sequence
  chemically synthesized
ctagacaggcataaatttttcc

SEQ ID NO: 797722 - DNA, 22 bp, Artificial Sequence
  chemically synthesized
tgtgtaggtttggaaaaattta

SEQ ID NO: 797723 - DNA, 22 bp, Artificial Sequence
  chemically synthesized
gtgtaggtttggaaaaatttat

SEQ ID NO: 797724 - DNA, 22 bp, Artificial Sequence
  chemically synthesized
tgtaggtttggaaaaatttatg

SEQ ID NO: 797725 - DNA, 22 bp, Artificial Sequence
  chemically synthesized
caagctgctagacaggcataaa

SEQ ID NO: 797726 - DNA, 22 bp, Artificial Sequence
  chemically synthesized
ggaaaaatttatgcctgtctag

SEQ ID NO: 797727 - DNA, 22 bp, Artificial Sequence
  chemically synthesized
gaaaaatttatgcctgtctagc

SEQ ID NO: 797728 - DNA, 22 bp, Artificial Sequence
  chemically synthesized
cacagctacaagctgctagaca

SEQ ID NO: 797729 - DNA, 22 bp, Artificial Sequence
  chemically synthesized
ctccacagctacaagctgctag

SEQ ID NO: 797730 - DNA, 22 bp, Artificial Sequence
  chemically synthesized
tgctccacagctacaagctgct

SEQ ID NO: 797731 - DNA, 22 bp, Artificial Sequence
  chemically synthesized
atgcctgtctagcagcttgtag

SEQ ID NO: 797732 - DNA, 22 bp, Artificial Sequence
  chemically synthesized
tgcctgtctagcagcttgtagc

SEQ ID NO: 797733 - DNA, 22 bp, Artificial Sequence
  chemically synthesized
tctagcagcttgtagctgtgga

SEQ ID NO: 797734 - DNA, 22 bp, Artificial Sequence
  chemically synthesized
gtcagccaactctgctccacag

SEQ ID NO: 797735 - DNA, 22 bp, Artificial Sequence
  chemically synthesized
gcagcttgtagctgtggagcag

SEQ ID NO: 797736 - DNA, 22 bp, Artificial Sequence
  chemically synthesized
ggtcagccaactctgctccaca

SEQ ID NO: 797737 - DNA, 22 bp, Artificial Sequence
  chemically synthesized
gtagctgtggagcagagttggc

SEQ ID NO: 797738 - DNA, 22 bp, Artificial Sequence
  chemically synthesized
tagctgtggagcagagttggct

SEQ ID NO: 797739 - DNA, 22 bp, Artificial Sequence
  chemically synthesized
tggagcagagttggctgaccaa

SEQ ID NO: 797740 - DNA, 22 bp, Artificial Sequence
  chemically synthesized
gctgaccaaactttgattcctt

SEQ ID NO: 797741 - DNA, 22 bp, Artificial Sequence
  chemically synthesized
accaaactttgattccttctct

SEQ ID NO: 797742 - DNA, 22 bp, Artificial Sequence
  chemically synthesized
gcagaacatggtcagagaagga

SEQ ID NO: 797743 - DNA, 22 bp, Artificial Sequence
  chemically synthesized
tgattccttctctgaccatgtt

SEQ ID NO: 797744 - DNA, 22 bp, Artificial Sequence
  chemically synthesized
gattccttctctgaccatgttc

SEQ ID NO: 797745 - DNA, 22 bp, Artificial Sequence
  chemically synthesized
attccttctctgaccatgttct

SEQ ID NO: 797746 - DNA, 22 bp, Artificial Sequence
  chemically synthesized
cttctctgaccatgttctgcta

SEQ ID NO: 797747 - DNA, 22 bp, Artificial Sequence
  chemically synthesized
aaggacataaggctagcagaac

SEQ ID NO: 797748 - DNA, 22 bp, Artificial Sequence
  chemically synthesized
ctctgaccatgttctgctagcc

SEQ ID NO: 797749 - DNA, 22 bp, Artificial Sequence
  chemically synthesized
tctgaccatgttctgctagcct

SEQ ID NO: 797750 - DNA, 22 bp, Artificial Sequence
  chemically synthesized
ctgaaggacataaggctagcag

SEQ ID NO: 797751 - DNA, 22 bp, Artificial Sequence
  chemically synthesized
actgaaggacataaggctagca

SEQ ID NO: 797752 - DNA, 22 bp, Artificial Sequence
  chemically synthesized
tgaccatgttctgctagcctta

SEQ ID NO: 797753 - DNA, 22 bp, Artificial Sequence
  chemically synthesized
accatgttctgctagccttatg

SEQ ID NO: 797754 - DNA, 22 bp, Artificial Sequence
  chemically synthesized
tcatttactgaaggacataagg

SEQ ID NO: 797755 - DNA, 22 bp, Artificial Sequence
  chemically synthesized
tgctagccttatgtccttcagt

SEQ ID NO: 797756 - DNA, 22 bp, Artificial Sequence
  chemically synthesized
ctagccttatgtccttcagtaa

SEQ ID NO: 797757 - DNA, 22 bp, Artificial Sequence
  chemically synthesized
tggcaactgtcatttactgaag

SEQ ID NO: 797758 - DNA, 22 bp, Artificial Sequence
  chemically synthesized
atggcaactgtcatttactgaa

SEQ ID NO: 797759 - DNA, 22 bp, Artificial Sequence
  chemically synthesized
gccttatgtccttcagtaaatg

SEQ ID NO: 797760 - DNA, 22 bp, Artificial Sequence
  chemically synthesized
tatggcaactgtcatttactga

SEQ ID NO: 797761 - DNA, 22 bp, Artificial Sequence
  chemically synthesized
ttatggcaactgtcatttactg

SEQ ID NO: 797762 - DNA, 22 bp, Artificial Sequence
  chemically synthesized
tttatggcaactgtcatttact

SEQ ID NO: 797763 - DNA, 22 bp, Artificial Sequence
  chemically synthesized
atgtccttcagtaaatgacagt

SEQ ID NO: 797764 - DNA, 22 bp, Artificial Sequence
  chemically synthesized
ttttttatggcaactgtcattt

SEQ ID NO: 797765 - DNA, 22 bp, Artificial Sequence
  chemically synthesized
tgtccttcagtaaatgacagtt

SEQ ID NO: 797766 - DNA, 22 bp, Artificial Sequence
  chemically synthesized
attgttttttatggcaactgtc

SEQ ID NO: 797767 - DNA, 22 bp, Artificial Sequence
  chemically synthesized
cagtaaatgacagttgccataa

SEQ ID NO: 797768 - DNA, 22 bp, Artificial Sequence
  chemically synthesized
agtaaatgacagttgccataaa

SEQ ID NO: 797769 - DNA, 22 bp, Artificial Sequence
  chemically synthesized
ccataaaaaacaatgaggttgt

SEQ ID NO: 797770 - DNA, 22 bp, Artificial Sequence
  chemically synthesized
aaagtagtgggaatgatggagt

SEQ ID NO: 797771 - DNA, 22 bp, Artificial Sequence
  chemically synthesized
ttgtatactccatcattcccac

SEQ ID NO: 797772 - DNA, 22 bp, Artificial Sequence
  chemically synthesized
agatctcaaagtagtgggaatg

SEQ ID NO: 797773 - DNA, 22 bp, Artificial Sequence
  chemically synthesized
tatactccatcattcccactac

SEQ ID NO: 797774 - DNA, 22 bp, Artificial Sequence
  chemically synthesized
ttaagatctcaaagtagtggga

SEQ ID NO: 797775 - DNA, 22 bp, Artificial Sequence
  chemically synthesized
gttaagatctcaaagtagtggg

SEQ ID NO: 797776 - DNA, 22 bp, Artificial Sequence
  chemically synthesized
catcattcccactactttgaga

SEQ ID NO: 797777 - DNA, 22 bp, Artificial Sequence
  chemically synthesized
tgtgatcttgttaagatctcaa

SEQ ID NO: 797778 - DNA, 22 bp, Artificial Sequence
  chemically synthesized
ccactactttgagatcttaaca

SEQ ID NO: 797779 - DNA, 22 bp, Artificial Sequence
  chemically synthesized
agatggttatgtgatcttgtta

SEQ ID NO: 797780 - DNA, 22 bp, Artificial Sequence
  chemically synthesized
ctttgagatcttaacaagatca

SEQ ID NO: 797781 - DNA, 22 bp, Artificial Sequence
  chemically synthesized
tgagatcttaacaagatcacat

SEQ ID NO: 797782 - DNA, 22 bp, Artificial Sequence
  chemically synthesized
gagatcttaacaagatcacata

SEQ ID NO: 797783 - DNA, 22 bp, Artificial Sequence
  chemically synthesized
agatcttaacaagatcacataa

SEQ ID NO: 797784 - DNA, 22 bp, Artificial Sequence
  chemically synthesized
aagttcagatggttatgtgatc

SEQ ID NO: 797785 - DNA, 22 bp, Artificial Sequence
  chemically synthesized
caagttcagatggttatgtgat

SEQ ID NO: 797786 - DNA, 22 bp, Artificial Sequence
  chemically synthesized
aacaagatcacataaccatctg

SEQ ID NO: 797787 - DNA, 22 bp, Artificial Sequence
  chemically synthesized
tgtcttcaagttcagatggtta

SEQ ID NO: 797788 - DNA, 22 bp, Artificial Sequence
  chemically synthesized
acaagatcacataaccatctga

SEQ ID NO: 797789 - DNA, 22 bp, Artificial Sequence
  chemically synthesized
agtctgtgtcttcaagttcaga

SEQ ID NO: 797790 - DNA, 22 bp, Artificial Sequence
  chemically synthesized
aattcagtctgtgtcttcaagt

SEQ ID NO: 797791 - DNA, 22 bp, Artificial Sequence
  chemically synthesized
gaattcagtctgtgtcttcaag

SEQ ID NO: 797792 - DNA, 22 bp, Artificial Sequence
  chemically synthesized
tttgaattcagtctgtgtcttc

SEQ ID NO: 797793 - DNA, 22 bp, Artificial Sequence
  chemically synthesized
aattatttgaattcagtctgtg

SEQ ID NO: 797794 - DNA, 22 bp, Artificial Sequence
  chemically synthesized
aacttgaagacacagactgaat

SEQ ID NO: 797795 - DNA, 22 bp, Artificial Sequence
  chemically synthesized
gcctgaattatttgaattcagt

SEQ ID NO: 797796 - DNA, 22 bp, Artificial Sequence
  chemically synthesized
agcctgaattatttgaattcag

SEQ ID NO: 797797 - DNA, 22 bp, Artificial Sequence
  chemically synthesized
gaagacacagactgaattcaaa

SEQ ID NO: 797798 - DNA, 22 bp, Artificial Sequence
  chemically synthesized
aagacacagactgaattcaaat

SEQ ID NO: 797799 - DNA, 22 bp, Artificial Sequence
  chemically synthesized
tcagcacatgtcttagcctgaa

SEQ ID NO: 797800 - DNA, 22 bp, Artificial Sequence
  chemically synthesized
aattcaaataattcaggctaag

SEQ ID NO: 797801 - DNA, 22 bp, Artificial Sequence
  chemically synthesized
ggttatcagcacatgtcttagc

SEQ ID NO: 797802 - DNA, 22 bp, Artificial Sequence
  chemically synthesized
aaataattcaggctaagacatg

SEQ ID NO: 797803 - DNA, 22 bp, Artificial Sequence
  chemically synthesized
aggttatcagcacatgtcttag

SEQ ID NO: 797804 - DNA, 22 bp, Artificial Sequence
  chemically synthesized
ttaggttatcagcacatgtctt

SEQ ID NO: 797805 - DNA, 22 bp, Artificial Sequence
  chemically synthesized
cttaggttatcagcacatgtct

SEQ ID NO: 797806 - DNA, 22 bp, Artificial Sequence
  chemically synthesized
tcttaggttatcagcacatgtc

SEQ ID NO: 797807 - DNA, 22 bp, Artificial Sequence
  chemically synthesized
ttcttaggttatcagcacatgt

SEQ ID NO: 797808 - DNA, 22 bp, Artificial Sequence
  chemically synthesized
aggctaagacatgtgctgataa

SEQ ID NO: 797809 - DNA, 22 bp, Artificial Sequence
  chemically synthesized
agacatgtgctgataacctaag

SEQ ID NO: 797810 - DNA, 22 bp, Artificial Sequence
  chemically synthesized
gcaataatttttcttaggttat

SEQ ID NO: 797811 - DNA, 22 bp, Artificial Sequence
  chemically synthesized
ggagtctagcaataatttttct

SEQ ID NO: 797812 - DNA, 22 bp, Artificial Sequence
  chemically synthesized
aggagtctagcaataatttttc

SEQ ID NO: 797813 - DNA, 22 bp, Artificial Sequence
  chemically synthesized
taggagtctagcaataattttt

SEQ ID NO: 797814 - DNA, 22 bp, Artificial Sequence
  chemically synthesized
ataacctaagaaaaattattgc

SEQ ID NO: 797815 - DNA, 22 bp, Artificial Sequence
  chemically synthesized
ttttaggagtctagcaataatt

SEQ ID NO: 797816 - DNA, 22 bp, Artificial Sequence
  chemically synthesized
attttaggagtctagcaataat

SEQ ID NO: 797817 - DNA, 22 bp, Artificial Sequence
  chemically synthesized
agaaaaattattgctagactcc

SEQ ID NO: 797818 - DNA, 22 bp, Artificial Sequence
  chemically synthesized
atagtatttattttaggagtct

SEQ ID NO: 797819 - DNA, 22 bp, Artificial Sequence
  chemically synthesized
tcatagtatttattttaggagt

SEQ ID NO: 797820 - DNA, 22 bp, Artificial Sequence
  chemically synthesized
ctcatagtatttattttaggag

SEQ ID NO: 797821 - DNA, 22 bp, Artificial Sequence
  chemically synthesized
tctcatagtatttattttagga

SEQ ID NO: 797822 - DNA, 22 bp, Artificial Sequence
  chemically synthesized
tttctcatagtatttattttag

SEQ ID NO: 797823 - DNA, 22 bp, Artificial Sequence
  chemically synthesized
ttgctagactcctaaaataaat

SEQ ID NO: 797824 - DNA, 22 bp, Artificial Sequence
  chemically synthesized
ctagactcctaaaataaatact

SEQ ID NO: 797825 - DNA, 22 bp, Artificial Sequence
  chemically synthesized
gactcctaaaataaatactatg

SEQ ID NO: 797826 - DNA, 22 bp, Artificial Sequence
  chemically synthesized
ctaaaataaatactatgagaaa

SEQ ID NO: 797827 - DNA, 22 bp, Artificial Sequence
  chemically synthesized
aaataaatactatgagaaagag

SEQ ID NO: 797828 - DNA, 22 bp, Artificial Sequence
  chemically synthesized
aaaatatgtgtgaaagtggcct

SEQ ID NO: 797829 - DNA, 22 bp, Artificial Sequence
  chemically synthesized
tgagaaagaggccactttcaca

SEQ ID NO: 797830 - DNA, 22 bp, Artificial Sequence
  chemically synthesized
aagctaaaaatatgtgtgaaag

SEQ ID NO: 797831 - DNA, 22 bp, Artificial Sequence
  chemically synthesized
caagctaaaaatatgtgtgaaa

SEQ ID NO: 797832 - DNA, 22 bp, Artificial Sequence
  chemically synthesized
tcaagctaaaaatatgtgtgaa

SEQ ID NO: 797833 - DNA, 22 bp, Artificial Sequence
  chemically synthesized
tcacacatatttttagcttgaa

SEQ ID NO: 797834 - DNA, 22 bp, Artificial Sequence
  chemically synthesized
cacacatatttttagcttgaaa

SEQ ID NO: 797835 - DNA, 22 bp, Artificial Sequence
  chemically synthesized
acacatatttttagcttgaaaa

SEQ ID NO: 797836 - DNA, 22 bp, Artificial Sequence
  chemically synthesized
atgcagatacacattttcaagc

SEQ ID NO: 797837 - DNA, 22 bp, Artificial Sequence
  chemically synthesized
acaattgatgcagatacacatt

SEQ ID NO: 797838 - DNA, 22 bp, Artificial Sequence
  chemically synthesized
aacaattgatgcagatacacat

SEQ ID NO: 797839 - DNA, 22 bp, Artificial Sequence
  chemically synthesized
ttagcttgaaaatgtgtatctg

SEQ ID NO: 797840 - DNA, 22 bp, Artificial Sequence
  chemically synthesized
taacaattgatgcagatacaca

SEQ ID NO: 797841 - DNA, 22 bp, Artificial Sequence
  chemically synthesized
tagcttgaaaatgtgtatctgc

SEQ ID NO: 797842 - DNA, 22 bp, Artificial Sequence
  chemically synthesized
ttaacaattgatgcagatacac

SEQ ID NO: 797843 - DNA, 22 bp, Artificial Sequence
  chemically synthesized
agcttgaaaatgtgtatctgca

SEQ ID NO: 797844 - DNA, 22 bp, Artificial Sequence
  chemically synthesized
tttaacaattgatgcagataca

SEQ ID NO: 797845 - DNA, 22 bp, Artificial Sequence
  chemically synthesized
gcttgaaaatgtgtatctgcat

SEQ ID NO: 797846 - DNA, 22 bp, Artificial Sequence
  chemically synthesized
ttttaacaattgatgcagatac

SEQ ID NO: 797847 - DNA, 22 bp, Artificial Sequence
  chemically synthesized
tttttaacaattgatgcagata

SEQ ID NO: 797848 - DNA, 22 bp, Artificial Sequence
  chemically synthesized
gaaaatgtgtatctgcatcaat

SEQ ID NO: 797849 - DNA, 22 bp, Artificial Sequence
  chemically synthesized
aaaatgtgtatctgcatcaatt

SEQ ID NO: 797850 - DNA, 22 bp, Artificial Sequence
  chemically synthesized
tccaaaaaaaaggtttttttta

SEQ ID NO: 797851 - DNA, 22 bp, Artificial Sequence
  chemically synthesized
atccaaaaaaaaggtttttttt

SEQ ID NO: 797852 - DNA, 22 bp, Artificial Sequence
  chemically synthesized
catcaattgttaaaaaaaacct

SEQ ID NO: 797853 - DNA, 22 bp, Artificial Sequence
  chemically synthesized
ccatttatccaaaaaaaaggtt

SEQ ID NO: 797854 - DNA, 22 bp, Artificial Sequence
  chemically synthesized
cccatttatccaaaaaaaaggt

SEQ ID NO: 797855 - DNA, 22 bp, Artificial Sequence
  chemically synthesized
tcccatttatccaaaaaaaagg

SEQ ID NO: 797856 - DNA, 22 bp, Artificial Sequence
  chemically synthesized
ttaaaaaaaaccttttttttgg

SEQ ID NO: 797857 - DNA, 22 bp, Artificial Sequence
  chemically synthesized
aaaaaaaccttttttttggata

SEQ ID NO: 797858 - DNA, 22 bp, Artificial Sequence
  chemically synthesized
tactttcccatttatccaaaaa

SEQ ID NO: 797859 - DNA, 22 bp, Artificial Sequence
  chemically synthesized
ttatactttcccatttatccaa

SEQ ID NO: 797860 - DNA, 22 bp, Artificial Sequence
  chemically synthesized
attatactttcccatttatcca

SEQ ID NO: 797861 - DNA, 22 bp, Artificial Sequence
  chemically synthesized
aatttattatactttcccattt

SEQ ID NO: 797862 - DNA, 22 bp, Artificial Sequence
  chemically synthesized
ttttttggataaatgggaaagt

SEQ ID NO: 797863 - DNA, 22 bp, Artificial Sequence
  chemically synthesized
tttttggataaatgggaaagta

SEQ ID NO: 797864 - DNA, 22 bp, Artificial Sequence
  chemically synthesized
ttttggataaatgggaaagtat

SEQ ID NO: 797865 - DNA, 22 bp, Artificial Sequence
  chemically synthesized
tttggataaatgggaaagtata

SEQ ID NO: 797866 - DNA, 22 bp, Artificial Sequence
  chemically synthesized
ttggataaatgggaaagtataa

SEQ ID NO: 797867 - DNA, 22 bp, Artificial Sequence
  chemically synthesized
tggataaatgggaaagtataat

SEQ ID NO: 797868 - DNA, 22 bp, Artificial Sequence
  chemically synthesized
ggataaatgggaaagtataata

SEQ ID NO: 797869 - DNA, 22 bp, Artificial Sequence
  chemically synthesized
gataaatgggaaagtataataa

SEQ ID NO: 797870 - DNA, 22 bp, Artificial Sequence
  chemically synthesized
aaaataaaattgaatttattat

SEQ ID NO: 797871 - DNA, 22 bp, Artificial Sequence
  chemically synthesized
atgtcctaaaaataaaattgaa

SEQ ID NO: 797872 - DNA, 22 bp, Artificial Sequence
  chemically synthesized
tcatccattcatgtcctaaaaa

SEQ ID NO: 797873 - DNA, 22 bp, Artificial Sequence
  chemically synthesized
aattttatttttaggacatgaa

SEQ ID NO: 797874 - DNA, 22 bp, Artificial Sequence
  chemically synthesized
tatttttaggacatgaatggat

SEQ ID NO: 797875 - DNA, 22 bp, Artificial Sequence
  chemically synthesized
atttttaggacatgaatggatg

SEQ ID NO: 797876 - DNA, 22 bp, Artificial Sequence
  chemically synthesized
tttttaggacatgaatggatga

SEQ ID NO: 797877 - DNA, 22 bp, Artificial Sequence
  chemically synthesized
tgcccacaaattatcatccatt

SEQ ID NO: 797878 - DNA, 22 bp, Artificial Sequence
  chemically synthesized
gtgcccacaaattatcatccat

SEQ ID NO: 797879 - DNA, 22 bp, Artificial Sequence
  chemically synthesized
ttaggacatgaatggatgataa

SEQ ID NO: 797880 - DNA, 22 bp, Artificial Sequence
  chemically synthesized
tgtgcccacaaattatcatcca

SEQ ID NO: 797881 - DNA, 22 bp, Artificial Sequence
  chemically synthesized
taggacatgaatggatgataat

SEQ ID NO: 797882 - DNA, 22 bp, Artificial Sequence
  chemically synthesized
ttgtgcccacaaattatcatcc

SEQ ID NO: 797883 - DNA, 22 bp, Artificial Sequence
  chemically synthesized
aggacatgaatggatgataatt

SEQ ID NO: 797884 - DNA, 22 bp, Artificial Sequence
  chemically synthesized
tttgtgcccacaaattatcatc

SEQ ID NO: 797885 - DNA, 22 bp, Artificial Sequence
  chemically synthesized
ggacatgaatggatgataattt

SEQ ID NO: 797886 - DNA, 22 bp, Artificial Sequence
  chemically synthesized
ttttgtgcccacaaattatcat

SEQ ID NO: 797887 - DNA, 22 bp, Artificial Sequence
  chemically synthesized
ttttttgtgcccacaaattatc

SEQ ID NO: 797888 - DNA, 22 bp, Artificial Sequence
  chemically synthesized
ttcttttttgtgcccacaaatt

SEQ ID NO: 797889 - DNA, 22 bp, Artificial Sequence
  chemically synthesized
gcaaattattcttttttgtgcc

SEQ ID NO: 797890 - DNA, 22 bp, Artificial Sequence
  chemically synthesized
agcaaattattcttttttgtgc

SEQ ID NO: 797891 - DNA, 22 bp, Artificial Sequence
  chemically synthesized
aagcttagcaaattattctttt

SEQ ID NO: 797892 - DNA, 22 bp, Artificial Sequence
  chemically synthesized
gtgggcacaaaaaagaataatt

SEQ ID NO: 797893 - DNA, 22 bp, Artificial Sequence
  chemically synthesized
tgggcacaaaaaagaataattt

SEQ ID NO: 797894 - DNA, 22 bp, Artificial Sequence
  chemically synthesized
ctaaagcttagcaaattattct

SEQ ID NO: 797895 - DNA, 22 bp, Artificial Sequence
  chemically synthesized
ctactaaagcttagcaaattat

SEQ ID NO: 797896 - DNA, 22 bp, Artificial Sequence
  chemically synthesized
cactgctactaaagcttagcaa

SEQ ID NO: 797897 - DNA, 22 bp, Artificial Sequence
  chemically synthesized
atgtattacactgctactaaag

SEQ ID NO: 797898 - DNA, 22 bp, Artificial Sequence
  chemically synthesized
aatgtattacactgctactaaa

SEQ ID NO: 797899 - DNA, 22 bp, Artificial Sequence
  chemically synthesized
taatgtattacactgctactaa

SEQ ID NO: 797900 - DNA, 22 bp, Artificial Sequence
  chemically synthesized
gctaagctttagtagcagtgta

SEQ ID NO: 797901 - DNA, 22 bp, Artificial Sequence
  chemically synthesized
ctaagctttagtagcagtgtaa

SEQ ID NO: 797902 - DNA, 22 bp, Artificial Sequence
  chemically synthesized
agctttagtagcagtgtaatac

SEQ ID NO: 797903 - DNA, 22 bp, Artificial Sequence
  chemically synthesized
tagtagcagtgtaatacattaa

SEQ ID NO: 797904 - DNA, 22 bp, Artificial Sequence
  chemically synthesized
agtagcagtgtaatacattaaa

SEQ ID NO: 797905 - DNA, 22 bp, Artificial Sequence
  chemically synthesized
gtagcagtgtaatacattaaaa

SEQ ID NO: 797906 - DNA, 22 bp, Artificial Sequence
  chemically synthesized
gagcaagagatacaggcatttt

SEQ ID NO: 797907 - DNA, 22 bp, Artificial Sequence
  chemically synthesized
agagcaagagatacaggcattt

SEQ ID NO: 797908 - DNA, 22 bp, Artificial Sequence
  chemically synthesized
atttagagcaagagatacaggc

SEQ ID NO: 797909 - DNA, 22 bp, Artificial Sequence
  chemically synthesized
attcatttagagcaagagatac

SEQ ID NO: 797910 - DNA, 22 bp, Artificial Sequence
  chemically synthesized
aaatgcctgtatctcttgctct

SEQ ID NO: 797911 - DNA, 22 bp, Artificial Sequence
  chemically synthesized
aaattgattcatttagagcaag

SEQ ID NO: 797912 - DNA, 22 bp, Artificial Sequence
  chemically synthesized
aaaattgattcatttagagcaa

SEQ ID NO: 797913 - DNA, 22 bp, Artificial Sequence
  chemically synthesized
tatctcttgctctaaatgaatc

SEQ ID NO: 797914 - DNA, 22 bp, Artificial Sequence
  chemically synthesized
atatatatttaaaattgattca

SEQ ID NO: 797915 - DNA, 22 bp, Artificial Sequence
  chemically synthesized
ttgctctaaatgaatcaatttt

SEQ ID NO: 797916 - DNA, 22 bp, Artificial Sequence
  chemically synthesized
gctctaaatgaatcaattttaa

SEQ ID NO: 797917 - DNA, 22 bp, Artificial Sequence
  chemically synthesized
ctctaaatgaatcaattttaaa

SEQ ID NO: 797918 - DNA, 22 bp, Artificial Sequence
  chemically synthesized
aattcatatatatttaaaattg

SEQ ID NO: 797919 - DNA, 22 bp, Artificial Sequence
  chemically synthesized
taaatgaatcaattttaaatat

SEQ ID NO: 797920 - DNA, 22 bp, Artificial Sequence
  chemically synthesized
aatgaatcaattttaaatatat

SEQ ID NO: 797921 - DNA, 22 bp, Artificial Sequence
  chemically synthesized
atacattcaattcatatatatt

SEQ ID NO: 797922 - DNA, 22 bp, Artificial Sequence
  chemically synthesized
aattgatacattcaattcatat

SEQ ID NO: 797923 - DNA, 22 bp, Artificial Sequence
  chemically synthesized
taaatatatatgaattgaatgt

SEQ ID NO: 797924 - DNA, 22 bp, Artificial Sequence
  chemically synthesized
aaatatatatgaattgaatgta

SEQ ID NO: 797925 - DNA, 22 bp, Artificial Sequence
  chemically synthesized
aatatatatgaattgaatgtat

SEQ ID NO: 797926 - DNA, 22 bp, Artificial Sequence
  chemically synthesized
agatctcaattgatacattcaa

SEQ ID NO: 797927 - DNA, 22 bp, Artificial Sequence
  chemically synthesized
aagatctcaattgatacattca

SEQ ID NO: 797928 - DNA, 22 bp, Artificial Sequence
  chemically synthesized
taagatctcaattgatacattc

SEQ ID NO: 797929 - DNA, 22 bp, Artificial Sequence
  chemically synthesized
attttaagatctcaattgatac

SEQ ID NO: 797930 - DNA, 22 bp, Artificial Sequence
  chemically synthesized
ctcattttaagatctcaattga

SEQ ID NO: 797931 - DNA, 22 bp, Artificial Sequence
  chemically synthesized
attgctcattttaagatctcaa

SEQ ID NO: 797932 - DNA, 22 bp, Artificial Sequence
  chemically synthesized
aatgtatcaattgagatcttaa

SEQ ID NO: 797933 - DNA, 22 bp, Artificial Sequence
  chemically synthesized
ccacattcattgctcattttaa

SEQ ID NO: 797934 - DNA, 22 bp, Artificial Sequence
  chemically synthesized
gtattaccacattcattgctca

SEQ ID NO: 797935 - DNA, 22 bp, Artificial Sequence
  chemically synthesized
agatcttaaaatgagcaatgaa

SEQ ID NO: 797936 - DNA, 22 bp, Artificial Sequence
  chemically synthesized
tacctggtattaccacattcat

SEQ ID NO: 797937 - DNA, 22 bp, Artificial Sequence
  chemically synthesized
aaaatgagcaatgaatgtggta

SEQ ID NO: 797938 - DNA, 22 bp, Artificial Sequence
  chemically synthesized
aaatgagcaatgaatgtggtaa

SEQ ID NO: 797939 - DNA, 22 bp, Artificial Sequence
  chemically synthesized
tctgtacctggtattaccacat

SEQ ID NO: 797940 - DNA, 22 bp, Artificial Sequence
  chemically synthesized
gaacacataaattatctgtacc

SEQ ID NO: 797941 - DNA, 22 bp, Artificial Sequence
  chemically synthesized
aataatattagaacacataaat

SEQ ID NO: 797942 - DNA, 22 bp, Artificial Sequence
  chemically synthesized
taaataatattagaacacataa

SEQ ID NO: 797943 - DNA, 22 bp, Artificial Sequence
  chemically synthesized
ctaaataatattagaacacata

SEQ ID NO: 797944 - DNA, 22 bp, Artificial Sequence
  chemically synthesized
tctaaataatattagaacacat

SEQ ID NO: 797945 - DNA, 22 bp, Artificial Sequence
  chemically synthesized
ttctaaataatattagaacaca

SEQ ID NO: 797946 - DNA, 22 bp, Artificial Sequence
  chemically synthesized
tggcatgcttttctaaataata

SEQ ID NO: 797947 - DNA, 22 bp, Artificial Sequence
  chemically synthesized
atgtgttctaatattatttaga

SEQ ID NO: 797948 - DNA, 22 bp, Artificial Sequence
  chemically synthesized
atggcatgcttttctaaataat

SEQ ID NO: 797949 - DNA, 22 bp, Artificial Sequence
  chemically synthesized
tgtgttctaatattatttagaa

SEQ ID NO: 797950 - DNA, 22 bp, Artificial Sequence
  chemically synthesized
taatattatttagaaaagcatg

SEQ ID NO: 797951 - DNA, 22 bp, Artificial Sequence
  chemically synthesized
atattatttagaaaagcatgcc

SEQ ID NO: 797952 - DNA, 22 bp, Artificial Sequence
  chemically synthesized
agaacagcttatggcatgcttt

SEQ ID NO: 797953 - DNA, 22 bp, Artificial Sequence
  chemically synthesized
gctaagaacagcttatggcatg

SEQ ID NO: 797954 - DNA, 22 bp, Artificial Sequence
  chemically synthesized
agctaagaacagcttatggcat

SEQ ID NO: 797955 - DNA, 22 bp, Artificial Sequence
  chemically synthesized
tttagaaaagcatgccataagc

SEQ ID NO: 797956 - DNA, 22 bp, Artificial Sequence
  chemically synthesized
tagctaagaacagcttatggca

SEQ ID NO: 797957 - DNA, 22 bp, Artificial Sequence
  chemically synthesized
agaaaagcatgccataagctgt

SEQ ID NO: 797958 - DNA, 22 bp, Artificial Sequence
  chemically synthesized
gaaaagcatgccataagctgtt

SEQ ID NO: 797959 - DNA, 22 bp, Artificial Sequence
  chemically synthesized
tggtggttttagctaagaacag

SEQ ID NO: 797960 - DNA, 22 bp, Artificial Sequence
  chemically synthesized
aattatggtggttttagctaag

SEQ ID NO: 797961 - DNA, 22 bp, Artificial Sequence
  chemically synthesized
tcaattatggtggttttagcta

SEQ ID NO: 797962 - DNA, 22 bp, Artificial Sequence
  chemically synthesized
ctcaattatggtggttttagct

SEQ ID NO: 797963 - DNA, 22 bp, Artificial Sequence
  chemically synthesized
tctcaattatggtggttttagc

SEQ ID NO: 797964 - DNA, 22 bp, Artificial Sequence
  chemically synthesized
tttctcaattatggtggtttta

SEQ ID NO: 797965 - DNA, 22 bp, Artificial Sequence
  chemically synthesized
ctttctcaattatggtggtttt

SEQ ID NO: 797966 - DNA, 22 bp, Artificial Sequence
  chemically synthesized
ttcttagctaaaaccaccataa

SEQ ID NO: 797967 - DNA, 22 bp, Artificial Sequence
  chemically synthesized
ttagctaaaaccaccataattg

SEQ ID NO: 797968 - DNA, 22 bp, Artificial Sequence
  chemically synthesized
agctaaaaccaccataattgag

SEQ ID NO: 797969 - DNA, 22 bp, Artificial Sequence
  chemically synthesized
aagtatttctttctcaattatg

SEQ ID NO: 797970 - DNA, 22 bp, Artificial Sequence
  chemically synthesized
gctaaaaccaccataattgaga

SEQ ID NO: 797971 - DNA, 22 bp, Artificial Sequence
  chemically synthesized
tcaagtatttctttctcaatta

SEQ ID NO: 797972 - DNA, 22 bp, Artificial Sequence
  chemically synthesized
ctcaagtatttctttctcaatt

SEQ ID NO: 797973 - DNA, 22 bp, Artificial Sequence
  chemically synthesized
aaaccaccataattgagaaaga

SEQ ID NO: 797974 - DNA, 22 bp, Artificial Sequence
  chemically synthesized
ttctcaagtatttctttctcaa

SEQ ID NO: 797975 - DNA, 22 bp, Artificial Sequence
  chemically synthesized
atctcttctcaagtatttcttt

SEQ ID NO: 797976 - DNA, 22 bp, Artificial Sequence
  chemically synthesized
agaaagaaatacttgagaagag

SEQ ID NO: 797977 - DNA, 22 bp, Artificial Sequence
  chemically synthesized
gtagagaatatctaatctcttc

SEQ ID NO: 797978 - DNA, 22 bp, Artificial Sequence
  chemically synthesized
aactagtagagaatatctaatc

SEQ ID NO: 797979 - DNA, 22 bp, Artificial Sequence
  chemically synthesized
gagaagagattagatattctct

SEQ ID NO: 797980 - DNA, 22 bp, Artificial Sequence
  chemically synthesized
cattcaactagtagagaatatc

SEQ ID NO: 797981 - DNA, 22 bp, Artificial Sequence
  chemically synthesized
agaagagattagatattctcta

SEQ ID NO: 797982 - DNA, 22 bp, Artificial Sequence
  chemically synthesized
ctccattcaactagtagagaat

SEQ ID NO: 797983 - DNA, 22 bp, Artificial Sequence
  chemically synthesized
actgctccattcaactagtaga

SEQ ID NO: 797984 - DNA, 22 bp, Artificial Sequence
  chemically synthesized
cactgctccattcaactagtag

SEQ ID NO: 797985 - DNA, 22 bp, Artificial Sequence
  chemically synthesized
tcactgctccattcaactagta

SEQ ID NO: 797986 - DNA, 22 bp, Artificial Sequence
  chemically synthesized
ttcactgctccattcaactagt

SEQ ID NO: 797987 - DNA, 22 bp, Artificial Sequence
  chemically synthesized
gatattctctactagttgaatg

SEQ ID NO: 797988 - DNA, 22 bp, Artificial Sequence
  chemically synthesized
cttttcactgctccattcaact

SEQ ID NO: 797989 - DNA, 22 bp, Artificial Sequence
  chemically synthesized
tctactagttgaatggagcagt

SEQ ID NO: 797990 - DNA, 22 bp, Artificial Sequence
  chemically synthesized
tactagttgaatggagcagtga

SEQ ID NO: 797991 - DNA, 22 bp, Artificial Sequence
  chemically synthesized
ctagttgaatggagcagtgaaa

SEQ ID NO: 797992 - DNA, 22 bp, Artificial Sequence
  chemically synthesized
gttgaatggagcagtgaaaagt

SEQ ID NO: 797993 - DNA, 22 bp, Artificial Sequence
  chemically synthesized
aatggagcagtgaaaagtagat

SEQ ID NO: 797994 - DNA, 22 bp, Artificial Sequence
  chemically synthesized
ataaaaccacgacaccaaaatc

SEQ ID NO: 797995 - DNA, 22 bp, Artificial Sequence
  chemically synthesized
cataaaaccacgacaccaaaat

SEQ ID NO: 797996 - DNA, 22 bp, Artificial Sequence
  chemically synthesized
tcataaaaccacgacaccaaaa

SEQ ID NO: 797997 - DNA, 22 bp, Artificial Sequence
  chemically synthesized
ttcataaaaccacgacaccaaa

SEQ ID NO: 797998 - DNA, 22 bp, Artificial Sequence
  chemically synthesized
tttcataaaaccacgacaccaa

SEQ ID NO: 797999 - DNA, 22 bp, Artificial Sequence
  chemically synthesized
tttttcataaaaccacgacacc

SEQ ID NO: 798000 - DNA, 22 bp, Artificial Sequence
  chemically synthesized
ctttttcataaaaccacgacac

SEQ ID NO: 798001 - DNA, 22 bp, Artificial Sequence
  chemically synthesized
atgtttctttttcataaaacca

SEQ ID NO: 798002 - DNA, 22 bp, Artificial Sequence
  chemically synthesized
tgatgtttctttttcataaaac

SEQ ID NO: 798003 - DNA, 22 bp, Artificial Sequence
  chemically synthesized
ctgatgtttctttttcataaaa

SEQ ID NO: 798004 - DNA, 22 bp, Artificial Sequence
  chemically synthesized
tggtgtcgtggttttatgaaaa

SEQ ID NO: 798005 - DNA, 22 bp, Artificial Sequence
  chemically synthesized
tctgatgtttctttttcataaa

SEQ ID NO: 798006 - DNA, 22 bp, Artificial Sequence
  chemically synthesized
ggtgtcgtggttttatgaaaaa

SEQ ID NO: 798007 - DNA, 22 bp, Artificial Sequence
  chemically synthesized
gtgtcgtggttttatgaaaaag

SEQ ID NO: 798008 - DNA, 22 bp, Artificial Sequence
  chemically synthesized
ttttctgatgtttctttttcat

SEQ ID NO: 798009 - DNA, 22 bp, Artificial Sequence
  chemically synthesized
attttctgatgtttctttttca

SEQ ID NO: 798010 - DNA, 22 bp, Artificial Sequence
  chemically synthesized
tattttctgatgtttctttttc

SEQ ID NO: 798011 - DNA, 22 bp, Artificial Sequence
  chemically synthesized
gaactttattttctgatgtttc

SEQ ID NO: 798012 - DNA, 22 bp, Artificial Sequence
  chemically synthesized
agaactttattttctgatgttt

SEQ ID NO: 798013 - DNA, 22 bp, Artificial Sequence
  chemically synthesized
tatgaaaaagaaacatcagaaa

SEQ ID NO: 798014 - DNA, 22 bp, Artificial Sequence
  chemically synthesized
atgaaaaagaaacatcagaaaa

SEQ ID NO: 798015 - DNA, 22 bp, Artificial Sequence
  chemically synthesized
tgaaaaagaaacatcagaaaat

SEQ ID NO: 798016 - DNA, 22 bp, Artificial Sequence
  chemically synthesized
atggaaatgatttagaacttta

SEQ ID NO: 798017 - DNA, 22 bp, Artificial Sequence
  chemically synthesized
aatggaaatgatttagaacttt

SEQ ID NO: 798018 - DNA, 22 bp, Artificial Sequence
  chemically synthesized
tttaatggaaatgatttagaac

SEQ ID NO: 798019 - DNA, 22 bp, Artificial Sequence
  chemically synthesized
gtttaatggaaatgatttagaa

SEQ ID NO: 798020 - DNA, 22 bp, Artificial Sequence
  chemically synthesized
tgtttaatggaaatgatttaga

SEQ ID NO: 798021 - DNA, 22 bp, Artificial Sequence
  chemically synthesized
ttgtttaatggaaatgatttag

SEQ ID NO: 798022 - DNA, 22 bp, Artificial Sequence
  chemically synthesized
tttttgtttaatggaaatgatt

SEQ ID NO: 798023 - DNA, 22 bp, Artificial Sequence
  chemically synthesized
gtttttgtttaatggaaatgat

SEQ ID NO: 798024 - DNA, 22 bp, Artificial Sequence
  chemically synthesized
tgtttttgtttaatggaaatga

SEQ ID NO: 798025 - DNA, 22 bp, Artificial Sequence
  chemically synthesized
ttgtttttgtttaatggaaatg

SEQ ID NO: 798026 - DNA, 22 bp, Artificial Sequence
  chemically synthesized
tttgtttttgtttaatggaaat

SEQ ID NO: 798027 - DNA, 22 bp, Artificial Sequence
  chemically synthesized
ttttttgtttttgtttaatgga

SEQ ID NO: 798028 - DNA, 22 bp, Artificial Sequence
  chemically synthesized
tgttttttgtttttgtttaatg

SEQ ID NO: 798029 - DNA, 22 bp, Artificial Sequence
  chemically synthesized
taaatcatttccattaaacaaa

SEQ ID NO: 798030 - DNA, 22 bp, Artificial Sequence
  chemically synthesized
aatcatttccattaaacaaaaa

SEQ ID NO: 798031 - DNA, 22 bp, Artificial Sequence
  chemically synthesized
ccattaaacaaaaacaaaaaac

SEQ ID NO: 798032 - DNA, 22 bp, Artificial Sequence
  chemically synthesized
cattaaacaaaaacaaaaaaca

SEQ ID NO: 798033 - DNA, 22 bp, Artificial Sequence
  chemically synthesized
aacaaaaacaaaaaacagagtt

SEQ ID NO: 798034 - DNA, 22 bp, Artificial Sequence
  chemically synthesized
tggggtggggacacagccaagc

SEQ ID NO: 798035 - DNA, 22 bp, Artificial Sequence
  chemically synthesized
ttggtatggcttggctgtgtcc

SEQ ID NO: 798036 - DNA, 22 bp, Artificial Sequence
  chemically synthesized
tggtatggcttggctgtgtccc

SEQ ID NO: 798037 - DNA, 22 bp, Artificial Sequence
  chemically synthesized
ggtatggcttggctgtgtcccc

SEQ ID NO: 798038 - DNA, 22 bp, Artificial Sequence
  chemically synthesized
gtatggcttggctgtgtcccca

SEQ ID NO: 798039 - DNA, 22 bp, Artificial Sequence
  chemically synthesized
agatgagattgtggggtgggga

SEQ ID NO: 798040 - DNA, 22 bp, Artificial Sequence
  chemically synthesized
aagatgagattgtggggtgggg

SEQ ID NO: 798041 - DNA, 22 bp, Artificial Sequence
  chemically synthesized
ggctgtgtccccaccccacaat

SEQ ID NO: 798042 - DNA, 22 bp, Artificial Sequence
  chemically synthesized
gctgtgtccccaccccacaatc

SEQ ID NO: 798043 - DNA, 22 bp, Artificial Sequence
  chemically synthesized
caatttaagatgagattgtggg

SEQ ID NO: 798044 - DNA, 22 bp, Artificial Sequence
  chemically synthesized
tgtccccaccccacaatctcat

SEQ ID NO: 798045 - DNA, 22 bp, Artificial Sequence
  chemically synthesized
tggggattacaatttaagatga

SEQ ID NO: 798046 - DNA, 22 bp, Artificial Sequence
  chemically synthesized
tggaggttatggggattacaat

SEQ ID NO: 798047 - DNA, 22 bp, Artificial Sequence
  chemically synthesized
atcttaaattgtaatccccata

SEQ ID NO: 798048 - DNA, 22 bp, Artificial Sequence
  chemically synthesized
aaattgtaatccccataacctc

SEQ ID NO: 798049 - DNA, 22 bp, Artificial Sequence
  chemically synthesized
aattgtaatccccataacctcc

SEQ ID NO: 798050 - DNA, 22 bp, Artificial Sequence
  chemically synthesized
acacgtggggattatggaggtt

SEQ ID NO: 798051 - DNA, 22 bp, Artificial Sequence
  chemically synthesized
gacacgtggggattatggaggt

SEQ ID NO: 798052 - DNA, 22 bp, Artificial Sequence
  chemically synthesized
taatccccataacctccataat

SEQ ID NO: 798053 - DNA, 22 bp, Artificial Sequence
  chemically synthesized
ccttgacacgtggggattatgg

SEQ ID NO: 798054 - DNA, 22 bp, Artificial Sequence
  chemically synthesized
tcccttgacacgtggggattat

SEQ ID NO: 798055 - DNA, 22 bp, Artificial Sequence
  chemically synthesized
gtctctcccttgacacgtgggg

SEQ ID NO: 798056 - DNA, 22 bp, Artificial Sequence
  chemically synthesized
cataatccccacgtgtcaaggg

SEQ ID NO: 798057 - DNA, 22 bp, Artificial Sequence
  chemically synthesized
cacctggtctctcccttgacac

SEQ ID NO: 798058 - DNA, 22 bp, Artificial Sequence
  chemically synthesized
cctccacctggtctctcccttg

SEQ ID NO: 798059 - DNA, 22 bp, Artificial Sequence
  chemically synthesized
cattacctccacctggtctctc

SEQ ID NO: 798060 - DNA, 22 bp, Artificial Sequence
  chemically synthesized
tgattccattacctccacctgg

SEQ ID NO: 798061 - DNA, 22 bp, Artificial Sequence
  chemically synthesized
atgattccattacctccacctg

SEQ ID NO: 798062 - DNA, 22 bp, Artificial Sequence
  chemically synthesized
cccttatgattccattacctcc

SEQ ID NO: 798063 - DNA, 22 bp, Artificial Sequence
  chemically synthesized
tcatgagaacagcatgggagaa

SEQ ID NO: 798064 - DNA, 22 bp, Artificial Sequence
  chemically synthesized
ctcccatgctgttctcatgata

SEQ ID NO: 798065 - DNA, 22 bp, Artificial Sequence
  chemically synthesized
tcccatgctgttctcatgatag

SEQ ID NO: 798066 - DNA, 22 bp, Artificial Sequence
  chemically synthesized
ccatgctgttctcatgatagcg

SEQ ID NO: 798067 - DNA, 22 bp, Artificial Sequence
  chemically synthesized
taaaaccatcagatcccgctat

SEQ ID NO: 798068 - DNA, 22 bp, Artificial Sequence
  chemically synthesized
ataaaaccatcagatcccgcta

SEQ ID NO: 798069 - DNA, 22 bp, Artificial Sequence
  chemically synthesized
ttctcatgatagcgggatctga

SEQ ID NO: 798070 - DNA, 22 bp, Artificial Sequence
  chemically synthesized
tcatgatagcgggatctgatgg

SEQ ID NO: 798071 - DNA, 22 bp, Artificial Sequence
  chemically synthesized
atgatagcgggatctgatggtt

SEQ ID NO: 798072 - DNA, 22 bp, Artificial Sequence
  chemically synthesized
atggttttataaggggctcttc

SEQ ID NO: 798073 - DNA, 22 bp, Artificial Sequence
  chemically synthesized
tataaggggctcttcctacttc

SEQ ID NO: 798074 - DNA, 22 bp, Artificial Sequence
  chemically synthesized
ataaggggctcttcctacttcg

SEQ ID NO: 798075 - DNA, 22 bp, Artificial Sequence
  chemically synthesized
taaggggctcttcctacttcgc

SEQ ID NO: 798076 - DNA, 22 bp, Artificial Sequence
  chemically synthesized
ttcctacttcgctgggcgcttc

SEQ ID NO: 798077 - DNA, 22 bp, Artificial Sequence
  chemically synthesized
cctacttcgctgggcgcttctc

SEQ ID NO: 798078 - DNA, 22 bp, Artificial Sequence
  chemically synthesized
ctacttcgctgggcgcttctcc

SEQ ID NO: 798079 - DNA, 22 bp, Artificial Sequence
  chemically synthesized
cttcgctgggcgcttctccttc

SEQ ID NO: 798080 - DNA, 22 bp, Artificial Sequence
  chemically synthesized
acaaggccgcaggaaggagaag

SEQ ID NO: 798081 - DNA, 22 bp, Artificial Sequence
  chemically synthesized
cacaaggccgcaggaaggagaa

SEQ ID NO: 798082 - DNA, 22 bp, Artificial Sequence
  chemically synthesized
cgctgggcgcttctccttcctg

SEQ ID NO: 798083 - DNA, 22 bp, Artificial Sequence
  chemically synthesized
ttcacaaggccgcaggaaggag

SEQ ID NO: 798084 - DNA, 22 bp, Artificial Sequence
  chemically synthesized
gctgggcgcttctccttcctgc

SEQ ID NO: 798085 - DNA, 22 bp, Artificial Sequence
  chemically synthesized
cttcacaaggccgcaggaagga

SEQ ID NO: 798086 - DNA, 22 bp, Artificial Sequence
  chemically synthesized
ggcgcttctccttcctgcggcc

SEQ ID NO: 798087 - DNA, 22 bp, Artificial Sequence
  chemically synthesized
ctccttcctgcggccttgtgaa

SEQ ID NO: 798088 - DNA, 22 bp, Artificial Sequence
  chemically synthesized
tccttcctgcggccttgtgaag

SEQ ID NO: 798089 - DNA, 22 bp, Artificial Sequence
  chemically synthesized
cttcctgcggccttgtgaagaa

SEQ ID NO: 798090 - DNA, 22 bp, Artificial Sequence
  chemically synthesized
cctgcggccttgtgaagaagat

SEQ ID NO: 798091 - DNA, 22 bp, Artificial Sequence
  chemically synthesized
ctgcggccttgtgaagaagatg

SEQ ID NO: 798092 - DNA, 22 bp, Artificial Sequence
  chemically synthesized
cggccttgtgaagaagatgctt

SEQ ID NO: 798093 - DNA, 22 bp, Artificial Sequence
  chemically synthesized
gtgaagaagatgcttgcttccc

SEQ ID NO: 798094 - DNA, 22 bp, Artificial Sequence
  chemically synthesized
tgaagaagatgcttgcttcccc

SEQ ID NO: 798095 - DNA, 22 bp, Artificial Sequence
  chemically synthesized
caatcatggcagaaggtgaagg

SEQ ID NO: 798096 - DNA, 22 bp, Artificial Sequence
  chemically synthesized
acaatcatggcagaaggtgaag

SEQ ID NO: 798097 - DNA, 22 bp, Artificial Sequence
  chemically synthesized
gcttccccttcaccttctgcca

SEQ ID NO: 798098 - DNA, 22 bp, Artificial Sequence
  chemically synthesized
cttccccttcaccttctgccat

SEQ ID NO: 798099 - DNA, 22 bp, Artificial Sequence
  chemically synthesized
ccccttcaccttctgccatgat

SEQ ID NO: 798100 - DNA, 22 bp, Artificial Sequence
  chemically synthesized
aggaaacttacaatcatggcag

SEQ ID NO: 798101 - DNA, 22 bp, Artificial Sequence
  chemically synthesized
cccttcaccttctgccatgatt

SEQ ID NO: 798102 - DNA, 22 bp, Artificial Sequence
  chemically synthesized
caccttctgccatgattgtaag

SEQ ID NO: 798103 - DNA, 22 bp, Artificial Sequence
  chemically synthesized
accttctgccatgattgtaagt

SEQ ID NO: 798104 - DNA, 22 bp, Artificial Sequence
  chemically synthesized
ggtaggcctcaggaaacttaca

SEQ ID NO: 798105 - DNA, 22 bp, Artificial Sequence
  chemically synthesized
ctgccatgattgtaagtttcct

SEQ ID NO: 798106 - DNA, 22 bp, Artificial Sequence
  chemically synthesized
tgccatgattgtaagtttcctg

SEQ ID NO: 798107 - DNA, 22 bp, Artificial Sequence
  chemically synthesized
ccatgattgtaagtttcctgag

SEQ ID NO: 798108 - DNA, 22 bp, Artificial Sequence
  chemically synthesized
cacatggctgggtaggcctcag

SEQ ID NO: 798109 - DNA, 22 bp, Artificial Sequence
  chemically synthesized
taagtttcctgaggcctaccca

SEQ ID NO: 798110 - DNA, 22 bp, Artificial Sequence
  chemically synthesized
acagttccacatggctgggtag

SEQ ID NO: 798111 - DNA, 22 bp, Artificial Sequence
  chemically synthesized
cctgaggcctacccagccatgt

SEQ ID NO: 798112 - DNA, 22 bp, Artificial Sequence
  chemically synthesized
actcacagttccacatggctgg

SEQ ID NO: 798113 - DNA, 22 bp, Artificial Sequence
  chemically synthesized
ctgaggcctacccagccatgtg

SEQ ID NO: 798114 - DNA, 22 bp, Artificial Sequence
  chemically synthesized
aggcctacccagccatgtggaa

SEQ ID NO: 798115 - DNA, 22 bp, Artificial Sequence
  chemically synthesized
attgactcacagttccacatgg

SEQ ID NO: 798116 - DNA, 22 bp, Artificial Sequence
  chemically synthesized
aattgactcacagttccacatg

SEQ ID NO: 798117 - DNA, 22 bp, Artificial Sequence
  chemically synthesized
cccagccatgtggaactgtgag

SEQ ID NO: 798118 - DNA, 22 bp, Artificial Sequence
  chemically synthesized
aaggaaagaggtttaattgact

SEQ ID NO: 798119 - DNA, 22 bp, Artificial Sequence
  chemically synthesized
taaaggaaagaggtttaattga

SEQ ID NO: 798120 - DNA, 22 bp, Artificial Sequence
  chemically synthesized
ctaaaggaaagaggtttaattg

SEQ ID NO: 798121 - DNA, 22 bp, Artificial Sequence
  chemically synthesized
tgagtcaattaaacctctttcc

SEQ ID NO: 798122 - DNA, 22 bp, Artificial Sequence
  chemically synthesized
ggtaatttctaaaggaaagagg

SEQ ID NO: 798123 - DNA, 22 bp, Artificial Sequence
  chemically synthesized
aacctctttcctttagaaatta

SEQ ID NO: 798124 - DNA, 22 bp, Artificial Sequence
  chemically synthesized
cccgagactgggtaatttctaa

SEQ ID NO: 798125 - DNA, 22 bp, Artificial Sequence
  chemically synthesized
tttcctttagaaattacccagt

SEQ ID NO: 798126 - DNA, 22 bp, Artificial Sequence
  chemically synthesized
tcctttagaaattacccagtct

SEQ ID NO: 798127 - DNA, 22 bp, Artificial Sequence
  chemically synthesized
cctttagaaattacccagtctc

SEQ ID NO: 798128 - DNA, 22 bp, Artificial Sequence
  chemically synthesized
ctttagaaattacccagtctcg

SEQ ID NO: 798129 - DNA, 22 bp, Artificial Sequence
  chemically synthesized
taaagaactgcccgagactggg

SEQ ID NO: 798130 - DNA, 22 bp, Artificial Sequence
  chemically synthesized
tagaaattacccagtctcgggc

SEQ ID NO: 798131 - DNA, 22 bp, Artificial Sequence
  chemically synthesized
ctataaagaactgcccgagact

SEQ ID NO: 798132 - DNA, 22 bp, Artificial Sequence
  chemically synthesized
agaaattacccagtctcgggca

SEQ ID NO: 798133 - DNA, 22 bp, Artificial Sequence
  chemically synthesized
gaaattacccagtctcgggcag

SEQ ID NO: 798134 - DNA, 22 bp, Artificial Sequence
  chemically synthesized
atactgctataaagaactgccc

SEQ ID NO: 798135 - DNA, 22 bp, Artificial Sequence
  chemically synthesized
catactgctataaagaactgcc

SEQ ID NO: 798136 - DNA, 22 bp, Artificial Sequence
  chemically synthesized
tcatactgctataaagaactgc

SEQ ID NO: 798137 - DNA, 22 bp, Artificial Sequence
  chemically synthesized
cccagtctcgggcagttcttta

SEQ ID NO: 798138 - DNA, 22 bp, Artificial Sequence
  chemically synthesized
gtccattttcatactgctataa

SEQ ID NO: 798139 - DNA, 22 bp, Artificial Sequence
  chemically synthesized
gggcagttctttatagcagtat

SEQ ID NO: 798140 - DNA, 22 bp, Artificial Sequence
  chemically synthesized
tattagtccattttcatactgc

SEQ ID NO: 798141 - DNA, 22 bp, Artificial Sequence
  chemically synthesized
ctgtattagtccattttcatac

SEQ ID NO: 798142 - DNA, 22 bp, Artificial Sequence
  chemically synthesized
tttatagcagtatgaaaatgga

SEQ ID NO: 798143 - DNA, 22 bp, Artificial Sequence
  chemically synthesized
tatagcagtatgaaaatggact

SEQ ID NO: 798144 - DNA, 22 bp, Artificial Sequence
  chemically synthesized
atagcagtatgaaaatggacta

SEQ ID NO: 798145 - DNA, 22 bp, Artificial Sequence
  chemically synthesized
tagcagtatgaaaatggactaa

SEQ ID NO: 798146 - DNA, 22 bp, Artificial Sequence
  chemically synthesized
aacaaagctactgtattagtcc

SEQ ID NO: 798147 - DNA, 22 bp, Artificial Sequence
  chemically synthesized
aaacaaagctactgtattagtc

SEQ ID NO: 798148 - DNA, 22 bp, Artificial Sequence
  chemically synthesized
cttaaacaaagctactgtatta

SEQ ID NO: 798149 - DNA, 22 bp, Artificial Sequence
  chemically synthesized
tgttgcttaaacaaagctactg

SEQ ID NO: 798150 - DNA, 22 bp, Artificial Sequence
  chemically synthesized
atgttgcttaaacaaagctact

SEQ ID NO: 798151 - DNA, 22 bp, Artificial Sequence
  chemically synthesized
agtacttatgttgcttaaacaa

SEQ ID NO: 798152 - DNA, 22 bp, Artificial Sequence
  chemically synthesized
atacagtagctttgtttaagca

SEQ ID NO: 798153 - DNA, 22 bp, Artificial Sequence
  chemically synthesized
cagtacttatgttgcttaaaca

SEQ ID NO: 798154 - DNA, 22 bp, Artificial Sequence
  chemically synthesized
atttcagtacttatgttgctta

SEQ ID NO: 798155 - DNA, 22 bp, Artificial Sequence
  chemically synthesized
aatattcatttcagtacttatg

SEQ ID NO: 798156 - DNA, 22 bp, Artificial Sequence
  chemically synthesized
tgtttaagcaacataagtactg

SEQ ID NO: 798157 - DNA, 22 bp, Artificial Sequence
  chemically synthesized
gaatattcatttcagtacttat

SEQ ID NO: 798158 - DNA, 22 bp, Artificial Sequence
  chemically synthesized
gtttaagcaacataagtactga

SEQ ID NO: 798159 - DNA, 22 bp, Artificial Sequence
  chemically synthesized
tttaagcaacataagtactgaa

SEQ ID NO: 798160 - DNA, 22 bp, Artificial Sequence
  chemically synthesized
aagcaacataagtactgaaatg

SEQ ID NO: 798161 - DNA, 22 bp, Artificial Sequence
  chemically synthesized
tatttgaatattcatttcagta

SEQ ID NO: 798162 - DNA, 22 bp, Artificial Sequence
  chemically synthesized
agcaacataagtactgaaatga

SEQ ID NO: 798163 - DNA, 22 bp, Artificial Sequence
  chemically synthesized
atatttgaatattcatttcagt

SEQ ID NO: 798164 - DNA, 22 bp, Artificial Sequence
  chemically synthesized
tatgatttatatttgaatattc

SEQ ID NO: 798165 - DNA, 22 bp, Artificial Sequence
  chemically synthesized
aaatgaatattcaaatataaat

SEQ ID NO: 798166 - DNA, 22 bp, Artificial Sequence
  chemically synthesized
tccacctatatgatttatattt

SEQ ID NO: 798167 - DNA, 22 bp, Artificial Sequence
  chemically synthesized
atccacctatatgatttatatt

SEQ ID NO: 798168 - DNA, 22 bp, Artificial Sequence
  chemically synthesized
aaatataaatcatataggtgga

SEQ ID NO: 798169 - DNA, 22 bp, Artificial Sequence
  chemically synthesized
ataagatcagtttatccaccta

SEQ ID NO: 798170 - DNA, 22 bp, Artificial Sequence
  chemically synthesized
cataagatcagtttatccacct

SEQ ID NO: 798171 - DNA, 22 bp, Artificial Sequence
  chemically synthesized
tgacagaaccccatttcataag

SEQ ID NO: 798172 - DNA, 22 bp, Artificial Sequence
  chemically synthesized
atcttatgaaatggggttctgt

SEQ ID NO: 798173 - DNA, 22 bp, Artificial Sequence
  chemically synthesized
taaccaaaaactatgacagaac

SEQ ID NO: 798174 - DNA, 22 bp, Artificial Sequence
  chemically synthesized
atgaaatggggttctgtcatag

SEQ ID NO: 798175 - DNA, 22 bp, Artificial Sequence
  chemically synthesized
tgaaatggggttctgtcatagt

SEQ ID NO: 798176 - DNA, 22 bp, Artificial Sequence
  chemically synthesized
ttgtaaccaaaaactatgacag

SEQ ID NO: 798177 - DNA, 22 bp, Artificial Sequence
  chemically synthesized
tgtgttattgtaaccaaaaact

SEQ ID NO: 798178 - DNA, 22 bp, Artificial Sequence
  chemically synthesized
tgtcatagtttttggttacaat

SEQ ID NO: 798179 - DNA, 22 bp, Artificial Sequence
  chemically synthesized
tacgttgtgtgttattgtaacc

SEQ ID NO: 798180 - DNA, 22 bp, Artificial Sequence
  chemically synthesized
tcatagtttttggttacaataa

SEQ ID NO: 798181 - DNA, 22 bp, Artificial Sequence
  chemically synthesized
ttggttacaataacacacaacg

SEQ ID NO: 798182 - DNA, 22 bp, Artificial Sequence
  chemically synthesized
tggttacaataacacacaacgt

SEQ ID NO: 798183 - DNA, 22 bp, Artificial Sequence
  chemically synthesized
ggttacaataacacacaacgta

SEQ ID NO: 798184 - DNA, 22 bp, Artificial Sequence
  chemically synthesized
gttacaataacacacaacgtac

SEQ ID NO: 798185 - DNA, 22 bp, Artificial Sequence
  chemically synthesized
caataacacacaacgtacaatg

SEQ ID NO: 798186 - DNA, 22 bp, Artificial Sequence
  chemically synthesized
agtaatcaataacattgtacgt

SEQ ID NO: 798187 - DNA, 22 bp, Artificial Sequence
  chemically synthesized
actcagtaatcaataacattgt

SEQ ID NO: 798188 - DNA, 22 bp, Artificial Sequence
  chemically synthesized
gctaactcagtaatcaataaca

SEQ ID NO: 798189 - DNA, 22 bp, Artificial Sequence
  chemically synthesized
agctaactcagtaatcaataac

SEQ ID NO: 798190 - DNA, 22 bp, Artificial Sequence
  chemically synthesized
ttagctaactcagtaatcaata

SEQ ID NO: 798191 - DNA, 22 bp, Artificial Sequence
  chemically synthesized
ttgattactgagttagctaaga

SEQ ID NO: 798192 - DNA, 22 bp, Artificial Sequence
  chemically synthesized
attactgagttagctaagagga

SEQ ID NO: 798193 - DNA, 22 bp, Artificial Sequence
  chemically synthesized
taacaggagaagtcctcttagc

SEQ ID NO: 798194 - DNA, 22 bp, Artificial Sequence
  chemically synthesized
ctgagttagctaagaggacttc

SEQ ID NO: 798195 - DNA, 22 bp, Artificial Sequence
  chemically synthesized
agttagctaagaggacttctcc

SEQ ID NO: 798196 - DNA, 22 bp, Artificial Sequence
  chemically synthesized
gctaagaggacttctcctgtta

SEQ ID NO: 798197 - DNA, 22 bp, Artificial Sequence
  chemically synthesized
tgtataatattataacaggaga

SEQ ID NO: 798198 - DNA, 22 bp, Artificial Sequence
  chemically synthesized
agaggacttctcctgttataat

SEQ ID NO: 798199 - DNA, 22 bp, Artificial Sequence
  chemically synthesized
tgatattatgtataatattata

SEQ ID NO: 798200 - DNA, 22 bp, Artificial Sequence
  chemically synthesized
ctcctgttataatattatacat

SEQ ID NO: 798201 - DNA, 22 bp, Artificial Sequence
  chemically synthesized
tgttgtgatattatgtataata

SEQ ID NO: 798202 - DNA, 22 bp, Artificial Sequence
  chemically synthesized
tcctgttataatattatacata

SEQ ID NO: 798203 - DNA, 22 bp, Artificial Sequence
  chemically synthesized
ctgttataatattatacataat

SEQ ID NO: 798204 - DNA, 22 bp, Artificial Sequence
  chemically synthesized
ttataatattatacataatatc

SEQ ID NO: 798205 - DNA, 22 bp, Artificial Sequence
  chemically synthesized
taatattatacataatatcaca

SEQ ID NO: 798206 - DNA, 22 bp, Artificial Sequence
  chemically synthesized
taacgaaagcaactgtgttgtg

SEQ ID NO: 798207 - DNA, 22 bp, Artificial Sequence
  chemically synthesized
ataacgaaagcaactgtgttgt

SEQ ID NO: 798208 - DNA, 22 bp, Artificial Sequence
  chemically synthesized
tacataatatcacaacacagtt

SEQ ID NO: 798209 - DNA, 22 bp, Artificial Sequence
  chemically synthesized
tataacgaaagcaactgtgttg

SEQ ID NO: 798210 - DNA, 22 bp, Artificial Sequence
  chemically synthesized
ttttataacgaaagcaactgtg

SEQ ID NO: 798211 - DNA, 22 bp, Artificial Sequence
  chemically synthesized
attttataacgaaagcaactgt

SEQ ID NO: 798212 - DNA, 22 bp, Artificial Sequence
  chemically synthesized
tattttataacgaaagcaactg

SEQ ID NO: 798213 - DNA, 22 bp, Artificial Sequence
  chemically synthesized
ctttattttataacgaaagcaa

SEQ ID NO: 798214 - DNA, 22 bp, Artificial Sequence
  chemically synthesized
ctttcgttataaaataaagtaa

SEQ ID NO: 798215 - DNA, 22 bp, Artificial Sequence
  chemically synthesized
tcgttataaaataaagtaacat

SEQ ID NO: 798216 - DNA, 22 bp, Artificial Sequence
  chemically synthesized
cgttataaaataaagtaacatg

SEQ ID NO: 798217 - DNA, 22 bp, Artificial Sequence
  chemically synthesized
agatagaatgtacatgttactt

SEQ ID NO: 798218 - DNA, 22 bp, Artificial Sequence
  chemically synthesized
gttataaaataaagtaacatgt

SEQ ID NO: 798219 - DNA, 22 bp, Artificial Sequence
  chemically synthesized
taaaataaagtaacatgtacat

SEQ ID NO: 798220 - DNA, 22 bp, Artificial Sequence
  chemically synthesized
atctcagatagaatgtacatgt

SEQ ID NO: 798221 - DNA, 22 bp, Artificial Sequence
  chemically synthesized
aatctcagatagaatgtacatg

SEQ ID NO: 798222 - DNA, 22 bp, Artificial Sequence
  chemically synthesized
ttaatctcagatagaatgtaca

SEQ ID NO: 798223 - DNA, 22 bp, Artificial Sequence
  chemically synthesized
gtctcttaatctcagatagaat

SEQ ID NO: 798224 - DNA, 22 bp, Artificial Sequence
  chemically synthesized
accattggtctcttaatctcag

SEQ ID NO: 798225 - DNA, 22 bp, Artificial Sequence
  chemically synthesized
tatctgagattaagagaccaat

SEQ ID NO: 798226 - DNA, 22 bp, Artificial Sequence
  chemically synthesized
tctgagattaagagaccaatgg

SEQ ID NO: 798227 - DNA, 22 bp, Artificial Sequence
  chemically synthesized
agattaagagaccaatggtgaa

SEQ ID NO: 798228 - DNA, 22 bp, Artificial Sequence
  chemically synthesized
agagaccaatggtgaatatatt

SEQ ID NO: 798229 - DNA, 22 bp, Artificial Sequence
  chemically synthesized
gtgcagtgatcccatgaagagg

SEQ ID NO: 798230 - DNA, 22 bp, Artificial Sequence
  chemically synthesized
agtgcagtgatcccatgaagag

SEQ ID NO: 798231 - DNA, 22 bp, Artificial Sequence
  chemically synthesized
tagtgcagtgatcccatgaaga

SEQ ID NO: 798232 - DNA, 22 bp, Artificial Sequence
  chemically synthesized
ctcttcatgggatcactgcact

SEQ ID NO: 798233 - DNA, 22 bp, Artificial Sequence
  chemically synthesized
ttcatgggatcactgcactaaa

SEQ ID NO: 798234 - DNA, 22 bp, Artificial Sequence
  chemically synthesized
catgggatcactgcactaaaac

SEQ ID NO: 798235 - DNA, 22 bp, Artificial Sequence
  chemically synthesized
atgggatcactgcactaaaacc

SEQ ID NO: 798236 - DNA, 22 bp, Artificial Sequence
  chemically synthesized
taaaataaataaaagccgtggg

SEQ ID NO: 798237 - DNA, 22 bp, Artificial Sequence
  chemically synthesized
gtaaaataaataaaagccgtgg

SEQ ID NO: 798238 - DNA, 22 bp, Artificial Sequence
  chemically synthesized
tgtaaaataaataaaagccgtg

SEQ ID NO: 798239 - DNA, 22 bp, Artificial Sequence
  chemically synthesized
ttgtaaaataaataaaagccgt

SEQ ID NO: 798240 - DNA, 22 bp, Artificial Sequence
  chemically synthesized
cactaaaacccacggcttttat

SEQ ID NO: 798241 - DNA, 22 bp, Artificial Sequence
  chemically synthesized
aaacccacggcttttatttatt

SEQ ID NO: 798242 - DNA, 22 bp, Artificial Sequence
  chemically synthesized
gaaatttttgtaaaataaataa

SEQ ID NO: 798243 - DNA, 22 bp, Artificial Sequence
  chemically synthesized
actagaaatttttgtaaaataa

SEQ ID NO: 798244 - DNA, 22 bp, Artificial Sequence
  chemically synthesized
ttatttattttacaaaaatttc

SEQ ID NO: 798245 - DNA, 22 bp, Artificial Sequence
  chemically synthesized
gatcattaactagaaatttttg

SEQ ID NO: 798246 - DNA, 22 bp, Artificial Sequence
  chemically synthesized
tatttattttacaaaaatttct

SEQ ID NO: 798247 - DNA, 22 bp, Artificial Sequence
  chemically synthesized
agatcattaactagaaattttt

SEQ ID NO: 798248 - DNA, 22 bp, Artificial Sequence
  chemically synthesized
atttattttacaaaaatttcta

SEQ ID NO: 798249 - DNA, 22 bp, Artificial Sequence
  chemically synthesized
tttattttacaaaaatttctag

SEQ ID NO: 798250 - DNA, 22 bp, Artificial Sequence
  chemically synthesized
attttacaaaaatttctagtta

SEQ ID NO: 798251 - DNA, 22 bp, Artificial Sequence
  chemically synthesized
ttttacaaaaatttctagttaa

SEQ ID NO: 798252 - DNA, 22 bp, Artificial Sequence
  chemically synthesized
aatccttagatcattaactaga

SEQ ID NO: 798253 - DNA, 22 bp, Artificial Sequence
  chemically synthesized
tacaaaaatttctagttaatga

SEQ ID NO: 798254 - DNA, 22 bp, Artificial Sequence
  chemically synthesized
acaaaaatttctagttaatgat

SEQ ID NO: 798255 - DNA, 22 bp, Artificial Sequence
  chemically synthesized
caaaaatttctagttaatgatc

SEQ ID NO: 798256 - DNA, 22 bp, Artificial Sequence
  chemically synthesized
ctagttaatgatctaaggattt

SEQ ID NO: 798257 - DNA, 22 bp, Artificial Sequence
  chemically synthesized
tagttaatgatctaaggattta

SEQ ID NO: 798258 - DNA, 22 bp, Artificial Sequence
  chemically synthesized
gttaatgatctaaggatttagc

SEQ ID NO: 798259 - DNA, 22 bp, Artificial Sequence
  chemically synthesized
gtgaaaaaataaaaagctaaat

SEQ ID NO: 798260 - DNA, 22 bp, Artificial Sequence
  chemically synthesized
atgatctaaggatttagctttt

SEQ ID NO: 798261 - DNA, 22 bp, Artificial Sequence
  chemically synthesized
ggtgaaaaaataaaaagctaaa

SEQ ID NO: 798262 - DNA, 22 bp, Artificial Sequence
  chemically synthesized
gtttggtgaaaaaataaaaagc

SEQ ID NO: 798263 - DNA, 22 bp, Artificial Sequence
  chemically synthesized
ggtttggtgaaaaaataaaaag

SEQ ID NO: 798264 - DNA, 22 bp, Artificial Sequence
  chemically synthesized
aggatttagctttttatttttt

SEQ ID NO: 798265 - DNA, 22 bp, Artificial Sequence
  chemically synthesized
agctttttattttttcaccaaa

SEQ ID NO: 798266 - DNA, 22 bp, Artificial Sequence
  chemically synthesized
gctttttattttttcaccaaac

SEQ ID NO: 798267 - DNA, 22 bp, Artificial Sequence
  chemically synthesized
tttattttttcaccaaaccaag

SEQ ID NO: 798268 - DNA, 22 bp, Artificial Sequence
  chemically synthesized
ttattttttcaccaaaccaagg

SEQ ID NO: 798269 - DNA, 22 bp, Artificial Sequence
  chemically synthesized
tattttttcaccaaaccaaggt

SEQ ID NO: 798270 - DNA, 22 bp, Artificial Sequence
  chemically synthesized
cagtcaatatataccttggttt

SEQ ID NO: 798271 - DNA, 22 bp, Artificial Sequence
  chemically synthesized
attttttcaccaaaccaaggta

SEQ ID NO: 798272 - DNA, 22 bp, Artificial Sequence
  chemically synthesized
ccagtcaatatataccttggtt

SEQ ID NO: 798273 - DNA, 22 bp, Artificial Sequence
  chemically synthesized
ttttttcaccaaaccaaggtat

SEQ ID NO: 798274 - DNA, 22 bp, Artificial Sequence
  chemically synthesized
tttcaccaaaccaaggtatata

SEQ ID NO: 798275 - DNA, 22 bp, Artificial Sequence
  chemically synthesized
ttcaccaaaccaaggtatatat

SEQ ID NO: 798276 - DNA, 22 bp, Artificial Sequence
  chemically synthesized
tcaccaaaccaaggtatatatt

SEQ ID NO: 798277 - DNA, 22 bp, Artificial Sequence
  chemically synthesized
caccaaaccaaggtatatattg

SEQ ID NO: 798278 - DNA, 22 bp, Artificial Sequence
  chemically synthesized
accaaaccaaggtatatattga

SEQ ID NO: 798279 - DNA, 22 bp, Artificial Sequence
  chemically synthesized
agaatacttccagtcaatatat

SEQ ID NO: 798280 - DNA, 22 bp, Artificial Sequence
  chemically synthesized
cagaatacttccagtcaatata

SEQ ID NO: 798281 - DNA, 22 bp, Artificial Sequence
  chemically synthesized
tataatagtttcagaatacttc

SEQ ID NO: 798282 - DNA, 22 bp, Artificial Sequence
  chemically synthesized
atataatagtttcagaatactt

SEQ ID NO: 798283 - DNA, 22 bp, Artificial Sequence
  chemically synthesized
tatataatagtttcagaatact

SEQ ID NO: 798284 - DNA, 22 bp, Artificial Sequence
  chemically synthesized
ttttatataatagtttcagaat

SEQ ID NO: 798285 - DNA, 22 bp, Artificial Sequence
  chemically synthesized
gttttatataatagtttcagaa

SEQ ID NO: 798286 - DNA, 22 bp, Artificial Sequence
  chemically synthesized
tgttttatataatagtttcaga

SEQ ID NO: 798287 - DNA, 22 bp, Artificial Sequence
  chemically synthesized
actggaagtattctgaaactat

SEQ ID NO: 798288 - DNA, 22 bp, Artificial Sequence
  chemically synthesized
ttttgttttatataatagtttc

SEQ ID NO: 798289 - DNA, 22 bp, Artificial Sequence
  chemically synthesized
gaagtattctgaaactattata

SEQ ID NO: 798290 - DNA, 22 bp, Artificial Sequence
  chemically synthesized
tgaaactattatataaaacaaa

SEQ ID NO: 798291 - DNA, 22 bp, Artificial Sequence
  chemically synthesized
aaactattatataaaacaaaac

SEQ ID NO: 798292 - DNA, 22 bp, Artificial Sequence
  chemically synthesized
ttatataaaacaaaacagcttt

SEQ ID NO: 798293 - DNA, 22 bp, Artificial Sequence
  chemically synthesized
atacaaaaaagtcaaaagctgt

SEQ ID NO: 798294 - DNA, 22 bp, Artificial Sequence
  chemically synthesized
tataaaacaaaacagcttttga

SEQ ID NO: 798295 - DNA, 22 bp, Artificial Sequence
  chemically synthesized
aaacaaacaactgatacaaaaa

SEQ ID NO: 798296 - DNA, 22 bp, Artificial Sequence
  chemically synthesized
caaacaaacaactgatacaaaa

SEQ ID NO: 798297 - DNA, 22 bp, Artificial Sequence
  chemically synthesized
tcaaacaaacaactgatacaaa

SEQ ID NO: 798298 - DNA, 22 bp, Artificial Sequence
  chemically synthesized
ttgacttttttgtatcagttgt

SEQ ID NO: 798299 - DNA, 22 bp, Artificial Sequence
  chemically synthesized
tgacttttttgtatcagttgtt

SEQ ID NO: 798300 - DNA, 22 bp, Artificial Sequence
  chemically synthesized
gacttttttgtatcagttgttt

SEQ ID NO: 798301 - DNA, 22 bp, Artificial Sequence
  chemically synthesized
acttttttgtatcagttgtttg

SEQ ID NO: 798302 - DNA, 22 bp, Artificial Sequence
  chemically synthesized
ttttgtatcagttgtttgtttg

SEQ ID NO: 798303 - DNA, 22 bp, Artificial Sequence
  chemically synthesized
aagaacaactttcaaacaaaca

SEQ ID NO: 798304 - DNA, 22 bp, Artificial Sequence
  chemically synthesized
tttgtatcagttgtttgtttga

SEQ ID NO: 798305 - DNA, 22 bp, Artificial Sequence
  chemically synthesized
gaagaacaactttcaaacaaac

SEQ ID NO: 798306 - DNA, 22 bp, Artificial Sequence
  chemically synthesized
ttgtatcagttgtttgtttgaa

SEQ ID NO: 798307 - DNA, 22 bp, Artificial Sequence
  chemically synthesized
tgtatcagttgtttgtttgaaa

SEQ ID NO: 798308 - DNA, 22 bp, Artificial Sequence
  chemically synthesized
gtatcagttgtttgtttgaaag

SEQ ID NO: 798309 - DNA, 22 bp, Artificial Sequence
  chemically synthesized
tatcagttgtttgtttgaaagt

SEQ ID NO: 798310 - DNA, 22 bp, Artificial Sequence
  chemically synthesized
ccacttgaagaacaactttcaa

SEQ ID NO: 798311 - DNA, 22 bp, Artificial Sequence
  chemically synthesized
tttgtttgaaagttgttcttca

SEQ ID NO: 798312 - DNA, 22 bp, Artificial Sequence
  chemically synthesized
gtttgaaagttgttcttcaagt

SEQ ID NO: 798313 - DNA, 22 bp, Artificial Sequence
  chemically synthesized
tttgaaagttgttcttcaagtg

SEQ ID NO: 798314 - DNA, 22 bp, Artificial Sequence
  chemically synthesized
gaaagttgttcttcaagtggga

SEQ ID NO: 798315 - DNA, 22 bp, Artificial Sequence
  chemically synthesized
aaagttgttcttcaagtgggaa

SEQ ID NO: 798316 - DNA, 22 bp, Artificial Sequence
  chemically synthesized
aaatggaagaaaacatgttccc

SEQ ID NO: 798317 - DNA, 22 bp, Artificial Sequence
  chemically synthesized
aaaatggaagaaaacatgttcc

SEQ ID NO: 798318 - DNA, 22 bp, Artificial Sequence
  chemically synthesized
ttcttcaagtgggaacatgttt

SEQ ID NO: 798319 - DNA, 22 bp, Artificial Sequence
  chemically synthesized
ttcaagtgggaacatgttttct

SEQ ID NO: 798320 - DNA, 22 bp, Artificial Sequence
  chemically synthesized
caagtgggaacatgttttcttc

SEQ ID NO: 798321 - DNA, 22 bp, Artificial Sequence
  chemically synthesized
caatttaaaatggaagaaaaca

SEQ ID NO: 798322 - DNA, 22 bp, Artificial Sequence
  chemically synthesized
aagtgggaacatgttttcttcc

SEQ ID NO: 798323 - DNA, 22 bp, Artificial Sequence
  chemically synthesized
taagactgcaatttaaaatgga

SEQ ID NO: 798324 - DNA, 22 bp, Artificial Sequence
  chemically synthesized
cagatctgtaagactgcaattt

SEQ ID NO: 798325 - DNA, 22 bp, Artificial Sequence
  chemically synthesized
tcttccattttaaattgcagtc

SEQ ID NO: 798326 - DNA, 22 bp, Artificial Sequence
  chemically synthesized
cttccattttaaattgcagtct

SEQ ID NO: 798327 - DNA, 22 bp, Artificial Sequence
  chemically synthesized
ttccattttaaattgcagtctt

SEQ ID NO: 798328 - DNA, 22 bp, Artificial Sequence
  chemically synthesized
ccattttaaattgcagtcttac

SEQ ID NO: 798329 - DNA, 22 bp, Artificial Sequence
  chemically synthesized
cattttaaattgcagtcttaca

SEQ ID NO: 798330 - DNA, 22 bp, Artificial Sequence
  chemically synthesized
taaattgcagtcttacagatct

SEQ ID NO: 798331 - DNA, 22 bp, Artificial Sequence
  chemically synthesized
aaattgcagtcttacagatctg

SEQ ID NO: 798332 - DNA, 22 bp, Artificial Sequence
  chemically synthesized
aattgcagtcttacagatctgt

SEQ ID NO: 798333 - DNA, 22 bp, Artificial Sequence
  chemically synthesized
cagtcttacagatctgtagttt

SEQ ID NO: 798334 - DNA, 22 bp, Artificial Sequence
  chemically synthesized
tccccatgaaaagaaaactaca

SEQ ID NO: 798335 - DNA, 22 bp, Artificial Sequence
  chemically synthesized
gtccccatgaaaagaaaactac

SEQ ID NO: 798336 - DNA, 22 bp, Artificial Sequence
  chemically synthesized
tgtccccatgaaaagaaaacta

SEQ ID NO: 798337 - DNA, 22 bp, Artificial Sequence
  chemically synthesized
acagatctgtagttttcttttc

SEQ ID NO: 798338 - DNA, 22 bp, Artificial Sequence
  chemically synthesized
cagatctgtagttttcttttca

SEQ ID NO: 798339 - DNA, 22 bp, Artificial Sequence
  chemically synthesized
aaacgaattttgtccccatgaa

SEQ ID NO: 798340 - DNA, 22 bp, Artificial Sequence
  chemically synthesized
aaaacgaattttgtccccatga

SEQ ID NO: 798341 - DNA, 22 bp, Artificial Sequence
  chemically synthesized
tagttttcttttcatggggaca

SEQ ID NO: 798342 - DNA, 22 bp, Artificial Sequence
  chemically synthesized
ttaaaacgaattttgtccccat

SEQ ID NO: 798343 - DNA, 22 bp, Artificial Sequence
  chemically synthesized
tcttttcatggggacaaaattc

SEQ ID NO: 798344 - DNA, 22 bp, Artificial Sequence
  chemically synthesized
cttttcatggggacaaaattcg

SEQ ID NO: 798345 - DNA, 22 bp, Artificial Sequence
  chemically synthesized
ttttcatggggacaaaattcgt

SEQ ID NO: 798346 - DNA, 22 bp, Artificial Sequence
  chemically synthesized
ttcatggggacaaaattcgttt

SEQ ID NO: 798347 - DNA, 22 bp, Artificial Sequence
  chemically synthesized
tcatggggacaaaattcgtttt

SEQ ID NO: 798348 - DNA, 22 bp, Artificial Sequence
  chemically synthesized
catggggacaaaattcgtttta

SEQ ID NO: 798349 - DNA, 22 bp, Artificial Sequence
  chemically synthesized
atggggacaaaattcgttttaa

SEQ ID NO: 798350 - DNA, 22 bp, Artificial Sequence
  chemically synthesized
tataccagagttcttaaaacga

SEQ ID NO: 798351 - DNA, 22 bp, Artificial Sequence
  chemically synthesized
atataccagagttcttaaaacg

SEQ ID NO: 798352 - DNA, 22 bp, Artificial Sequence
  chemically synthesized
cagagatttatataccagagtt

SEQ ID NO: 798353 - DNA, 22 bp, Artificial Sequence
  chemically synthesized
ccagagatttatataccagagt

SEQ ID NO: 798354 - DNA, 22 bp, Artificial Sequence
  chemically synthesized
ttccagagatttatataccaga

SEQ ID NO: 798355 - DNA, 22 bp, Artificial Sequence
  chemically synthesized
gttttaagaactctggtatata

SEQ ID NO: 798356 - DNA, 22 bp, Artificial Sequence
  chemically synthesized
tcttccagagatttatatacca

SEQ ID NO: 798357 - DNA, 22 bp, Artificial Sequence
  chemically synthesized
taagaactctggtatataaatc

SEQ ID NO: 798358 - DNA, 22 bp, Artificial Sequence
  chemically synthesized
aagaactctggtatataaatct

SEQ ID NO: 798359 - DNA, 22 bp, Artificial Sequence
  chemically synthesized
agaactctggtatataaatctc

SEQ ID NO: 798360 - DNA, 22 bp, Artificial Sequence
  chemically synthesized
tgaatgctctcttccagagatt

SEQ ID NO: 798361 - DNA, 22 bp, Artificial Sequence
  chemically synthesized
gtgaatgctctcttccagagat

SEQ ID NO: 798362 - DNA, 22 bp, Artificial Sequence
  chemically synthesized
tggtatataaatctctggaaga

SEQ ID NO: 798363 - DNA, 22 bp, Artificial Sequence
  chemically synthesized
tttgtgaatgctctcttccaga

SEQ ID NO: 798364 - DNA, 22 bp, Artificial Sequence
  chemically synthesized
gtatataaatctctggaagaga

SEQ ID NO: 798365 - DNA, 22 bp, Artificial Sequence
  chemically synthesized
atttgtgaatgctctcttccag

SEQ ID NO: 798366 - DNA, 22 bp, Artificial Sequence
  chemically synthesized
atcggaatttatttgtgaatgc

SEQ ID NO: 798367 - DNA, 22 bp, Artificial Sequence
  chemically synthesized
tggaagagagcattcacaaata

SEQ ID NO: 798368 - DNA, 22 bp, Artificial Sequence
  chemically synthesized
ttgatcggaatttatttgtgaa

SEQ ID NO: 798369 - DNA, 22 bp, Artificial Sequence
  chemically synthesized
gaagagagcattcacaaataaa

SEQ ID NO: 798370 - DNA, 22 bp, Artificial Sequence
  chemically synthesized
acaaataaattccgatcaacag

SEQ ID NO: 798371 - DNA, 22 bp, Artificial Sequence
  chemically synthesized
agaaatgtatgcaatctgttga

SEQ ID NO: 798372 - DNA, 22 bp, Artificial Sequence
  chemically synthesized
attgagaaatgtatgcaatctg

SEQ ID NO: 798373 - DNA, 22 bp, Artificial Sequence
  chemically synthesized
cgatcaacagattgcatacatt

SEQ ID NO: 798374 - DNA, 22 bp, Artificial Sequence
  chemically synthesized
cacagctgattgagaaatgtat

SEQ ID NO: 798375 - DNA, 22 bp, Artificial Sequence
  chemically synthesized
agtctgcacagctgattgagaa

SEQ ID NO: 798376 - DNA, 22 bp, Artificial Sequence
  chemically synthesized
catacatttctcaatcagctgt

SEQ ID NO: 798377 - DNA, 22 bp, Artificial Sequence
  chemically synthesized
ctcaatcagctgtgcagactga

SEQ ID NO: 798378 - DNA, 22 bp, Artificial Sequence
  chemically synthesized
tcaatcagctgtgcagactgag

SEQ ID NO: 798379 - DNA, 22 bp, Artificial Sequence
  chemically synthesized
aatcagctgtgcagactgagca

SEQ ID NO: 798380 - DNA, 22 bp, Artificial Sequence
  chemically synthesized
gagccgtgaaaatgctcagtct

SEQ ID NO: 798381 - DNA, 22 bp, Artificial Sequence
  chemically synthesized
tgcagactgagcattttcacgg

SEQ ID NO: 798382 - DNA, 22 bp, Artificial Sequence
  chemically synthesized
tgaaatgactggagccgtgaaa

SEQ ID NO: 798383 - DNA, 22 bp, Artificial Sequence
  chemically synthesized
atgaaatgactggagccgtgaa

SEQ ID NO: 798384 - DNA, 22 bp, Artificial Sequence
  chemically synthesized
tatgaaatgactggagccgtga

SEQ ID NO: 798385 - DNA, 22 bp, Artificial Sequence
  chemically synthesized
agcattttcacggctccagtca

SEQ ID NO: 798386 - DNA, 22 bp, Artificial Sequence
  chemically synthesized
aatcatctttatgaaatgactg

SEQ ID NO: 798387 - DNA, 22 bp, Artificial Sequence
  chemically synthesized
tgaatcatctttatgaaatgac

SEQ ID NO: 798388 - DNA, 22 bp, Artificial Sequence
  chemically synthesized
tcacggctccagtcatttcata

SEQ ID NO: 798389 - DNA, 22 bp, Artificial Sequence
  chemically synthesized
cacggctccagtcatttcataa

SEQ ID NO: 798390 - DNA, 22 bp, Artificial Sequence
  chemically synthesized
acggctccagtcatttcataaa

SEQ ID NO: 798391 - DNA, 22 bp, Artificial Sequence
  chemically synthesized
attctgaatcatctttatgaaa

SEQ ID NO: 798392 - DNA, 22 bp, Artificial Sequence
  chemically synthesized
attaattctgaatcatctttat

SEQ ID NO: 798393 - DNA, 22 bp, Artificial Sequence
  chemically synthesized
cagtcatttcataaagatgatt

SEQ ID NO: 798394 - DNA, 22 bp, Artificial Sequence
  chemically synthesized
cataaagatgattcagaattaa

SEQ ID NO: 798395 - DNA, 22 bp, Artificial Sequence
  chemically synthesized
ataaagatgattcagaattaat

SEQ ID NO: 798396 - DNA, 22 bp, Artificial Sequence
  chemically synthesized
agaattaatcagtcctactgct

SEQ ID NO: 798397 - DNA, 22 bp, Artificial Sequence
  chemically synthesized
atcagtcctactgctactttta

SEQ ID NO: 798398 - DNA, 22 bp, Artificial Sequence
  chemically synthesized
tgaatatataaataataaaagt

SEQ ID NO: 798399 - DNA, 22 bp, Artificial Sequence
  chemically synthesized
ctgctacttttattatttatat

SEQ ID NO: 798400 - DNA, 22 bp, Artificial Sequence
  chemically synthesized
tcaatactgtgaatatataaat

SEQ ID NO: 798401 - DNA, 22 bp, Artificial Sequence
  chemically synthesized
ctacttttattatttatatatt

SEQ ID NO: 798402 - DNA, 22 bp, Artificial Sequence
  chemically synthesized
cttttattatttatatattcac

SEQ ID NO: 798403 - DNA, 22 bp, Artificial Sequence
  chemically synthesized
ttattatttatatattcacagt

SEQ ID NO: 798404 - DNA, 22 bp, Artificial Sequence
  chemically synthesized
tattatttatatattcacagta

SEQ ID NO: 798405 - DNA, 22 bp, Artificial Sequence
  chemically synthesized
attatttatatattcacagtat

SEQ ID NO: 798406 - DNA, 22 bp, Artificial Sequence
  chemically synthesized
ttatttatatattcacagtatt

SEQ ID NO: 798407 - DNA, 22 bp, Artificial Sequence
  chemically synthesized
tttatatattcacagtattgac

SEQ ID NO: 798408 - DNA, 22 bp, Artificial Sequence
  chemically synthesized
atatattcacagtattgacaga

SEQ ID NO: 798409 - DNA, 22 bp, Artificial Sequence
  chemically synthesized
tatattcacagtattgacagat

SEQ ID NO: 798410 - DNA, 22 bp, Artificial Sequence
  chemically synthesized
acagtattgacagatttcattt

SEQ ID NO: 798411 - DNA, 22 bp, Artificial Sequence
  chemically synthesized
acagatttcattttcttcccac

SEQ ID NO: 798412 - DNA, 22 bp, Artificial Sequence
  chemically synthesized
tagaggaggagtaaagagtggg

SEQ ID NO: 798413 - DNA, 22 bp, Artificial Sequence
  chemically synthesized
cattttcttcccactctttact

SEQ ID NO: 798414 - DNA, 22 bp, Artificial Sequence
  chemically synthesized
ctatagaggaggagtaaagagt

SEQ ID NO: 798415 - DNA, 22 bp, Artificial Sequence
  chemically synthesized
attttcttcccactctttactc

SEQ ID NO: 798416 - DNA, 22 bp, Artificial Sequence
  chemically synthesized
ttcctatagaggaggagtaaag

SEQ ID NO: 798417 - DNA, 22 bp, Artificial Sequence
  chemically synthesized
tcttcccactctttactcctcc

SEQ ID NO: 798418 - DNA, 22 bp, Artificial Sequence
  chemically synthesized
cttcccactctttactcctcct

SEQ ID NO: 798419 - DNA, 22 bp, Artificial Sequence
  chemically synthesized
ttcccactctttactcctcctc

SEQ ID NO: 798420 - DNA, 22 bp, Artificial Sequence
  chemically synthesized
cccactctttactcctcctcta

SEQ ID NO: 798421 - DNA, 22 bp, Artificial Sequence
  chemically synthesized
ccactctttactcctcctctat

SEQ ID NO: 798422 - DNA, 22 bp, Artificial Sequence
  chemically synthesized
tttactcctcctctataggaat

SEQ ID NO: 798423 - DNA, 22 bp, Artificial Sequence
  chemically synthesized
tactcctcctctataggaataa

SEQ ID NO: 798424 - DNA, 22 bp, Artificial Sequence
  chemically synthesized
actcctcctctataggaataac

SEQ ID NO: 798425 - DNA, 22 bp, Artificial Sequence
  chemically synthesized
ctcctcctctataggaataaca

SEQ ID NO: 798426 - DNA, 22 bp, Artificial Sequence
  chemically synthesized
ctcctctataggaataacactc

SEQ ID NO: 798427 - DNA, 22 bp, Artificial Sequence
  chemically synthesized
ctctataggaataacactcatg

SEQ ID NO: 798428 - DNA, 22 bp, Artificial Sequence
  chemically synthesized
cccgcaccacatcatgagtgtt

SEQ ID NO: 798429 - DNA, 22 bp, Artificial Sequence
  chemically synthesized
tataggaataacactcatgatg

SEQ ID NO: 798430 - DNA, 22 bp, Artificial Sequence
  chemically synthesized
ctgcccgcaccacatcatgagt

SEQ ID NO: 798431 - DNA, 22 bp, Artificial Sequence
  chemically synthesized
taggaataacactcatgatgtg

SEQ ID NO: 798432 - DNA, 22 bp, Artificial Sequence
  chemically synthesized
ctgctgcccgcaccacatcatg

SEQ ID NO: 798433 - DNA, 22 bp, Artificial Sequence
  chemically synthesized
cctgctgcccgcaccacatcat

SEQ ID NO: 798434 - DNA, 22 bp, Artificial Sequence
  chemically synthesized
atgatgtggtgcgggcagcagg

SEQ ID NO: 798435 - DNA, 22 bp, Artificial Sequence
  chemically synthesized
aagaaagaaagtcagatgatag

SEQ ID NO: 798436 - DNA, 22 bp, Artificial Sequence
  chemically synthesized
aaagaaagaaagtcagatgata

SEQ ID NO: 798437 - DNA, 22 bp, Artificial Sequence
  chemically synthesized
agtgatgccttaaagaaagaaa

SEQ ID NO: 798438 - DNA, 22 bp, Artificial Sequence
  chemically synthesized
tcatctgactttctttctttaa

SEQ ID NO: 798439 - DNA, 22 bp, Artificial Sequence
  chemically synthesized
gttgagtgatgccttaaagaaa

SEQ ID NO: 798440 - DNA, 22 bp, Artificial Sequence
  chemically synthesized
actttctttctttaaggcatca

SEQ ID NO: 798441 - DNA, 22 bp, Artificial Sequence
  chemically synthesized
aggattagttgagtgatgcctt

SEQ ID NO: 798442 - DNA, 22 bp, Artificial Sequence
  chemically synthesized
tcaggattagttgagtgatgcc

SEQ ID NO: 798443 - DNA, 22 bp, Artificial Sequence
  chemically synthesized
tctttctttaaggcatcactca

SEQ ID NO: 798444 - DNA, 22 bp, Artificial Sequence
  chemically synthesized
ctttctttaaggcatcactcaa

SEQ ID NO: 798445 - DNA, 22 bp, Artificial Sequence
  chemically synthesized
tttctttaaggcatcactcaac

SEQ ID NO: 798446 - DNA, 22 bp, Artificial Sequence
  chemically synthesized
tctttaaggcatcactcaacta

SEQ ID NO: 798447 - DNA, 22 bp, Artificial Sequence
  chemically synthesized
ctttaaggcatcactcaactaa

SEQ ID NO: 798448 - DNA, 22 bp, Artificial Sequence
  chemically synthesized
tttaaggcatcactcaactaat

SEQ ID NO: 798449 - DNA, 22 bp, Artificial Sequence
  chemically synthesized
ataggttctcaggattagttga

SEQ ID NO: 798450 - DNA, 22 bp, Artificial Sequence
  chemically synthesized
taaggcatcactcaactaatcc

SEQ ID NO: 798451 - DNA, 22 bp, Artificial Sequence
  chemically synthesized
aaggcatcactcaactaatcct

SEQ ID NO: 798452 - DNA, 22 bp, Artificial Sequence
  chemically synthesized
aggcatcactcaactaatcctg

SEQ ID NO: 798453 - DNA, 22 bp, Artificial Sequence
  chemically synthesized
ttcataggttctcaggattagt

SEQ ID NO: 798454 - DNA, 22 bp, Artificial Sequence
  chemically synthesized
ttgttcataggttctcaggatt

SEQ ID NO: 798455 - DNA, 22 bp, Artificial Sequence
  chemically synthesized
aactaatcctgagaacctatga

SEQ ID NO: 798456 - DNA, 22 bp, Artificial Sequence
  chemically synthesized
atcctgagaacctatgaacaat

SEQ ID NO: 798457 - DNA, 22 bp, Artificial Sequence
  chemically synthesized
catatccaccattattgttcat

SEQ ID NO: 798458 - DNA, 22 bp, Artificial Sequence
  chemically synthesized
agaacctatgaacaataatggt

SEQ ID NO: 798459 - DNA, 22 bp, Artificial Sequence
  chemically synthesized
atgtgaatctgcatatccacca

SEQ ID NO: 798460 - DNA, 22 bp, Artificial Sequence
  chemically synthesized
gatgtgaatctgcatatccacc

SEQ ID NO: 798461 - DNA, 22 bp, Artificial Sequence
  chemically synthesized
tgaacaataatggtggatatgc

SEQ ID NO: 798462 - DNA, 22 bp, Artificial Sequence
  chemically synthesized
aagaaccaaacagaagtttgat

SEQ ID NO: 798463 - DNA, 22 bp, Artificial Sequence
  chemically synthesized
gaagaaccaaacagaagtttga

SEQ ID NO: 798464 - DNA, 22 bp, Artificial Sequence
  chemically synthesized
acatcaaacttctgtttggttc

SEQ ID NO: 798465 - DNA, 22 bp, Artificial Sequence
  chemically synthesized
gagagaacacttgaagaaccaa

SEQ ID NO: 798466 - DNA, 22 bp, Artificial Sequence
  chemically synthesized
tggagagaacacttgaagaacc

SEQ ID NO: 798467 - DNA, 22 bp, Artificial Sequence
  chemically synthesized
ctgtttggttcttcaagtgttc

SEQ ID NO: 798468 - DNA, 22 bp, Artificial Sequence
  chemically synthesized
atattctggagagaacacttga

SEQ ID NO: 798469 - DNA, 22 bp, Artificial Sequence
  chemically synthesized
tgtttggttcttcaagtgttct

SEQ ID NO: 798470 - DNA, 22 bp, Artificial Sequence
  chemically synthesized
catattctggagagaacacttg

SEQ ID NO: 798471 - DNA, 22 bp, Artificial Sequence
  chemically synthesized
tttggttcttcaagtgttctct

SEQ ID NO: 798472 - DNA, 22 bp, Artificial Sequence
  chemically synthesized
ggttcttcaagtgttctctcca

SEQ ID NO: 798473 - DNA, 22 bp, Artificial Sequence
  chemically synthesized
gttcttcaagtgttctctccag

SEQ ID NO: 798474 - DNA, 22 bp, Artificial Sequence
  chemically synthesized
gtggacttcatattctggagag

SEQ ID NO: 798475 - DNA, 22 bp, Artificial Sequence
  chemically synthesized
ttcaagtgttctctccagaata

SEQ ID NO: 798476 - DNA, 22 bp, Artificial Sequence
  chemically synthesized
caagtgttctctccagaatatg

SEQ ID NO: 798477 - DNA, 22 bp, Artificial Sequence
  chemically synthesized
aagtgttctctccagaatatga

SEQ ID NO: 798478 - DNA, 22 bp, Artificial Sequence
  chemically synthesized
aagaattagtggacttcatatt

SEQ ID NO: 798479 - DNA, 22 bp, Artificial Sequence
  chemically synthesized
tctccagaatatgaagtccact

SEQ ID NO: 798480 - DNA, 22 bp, Artificial Sequence
  chemically synthesized
tccagaatatgaagtccactaa

SEQ ID NO: 798481 - DNA, 22 bp, Artificial Sequence
  chemically synthesized
aggtctaaagaattagtggact

SEQ ID NO: 798482 - DNA, 22 bp, Artificial Sequence
  chemically synthesized
cagaatatgaagtccactaatt

SEQ ID NO: 798483 - DNA, 22 bp, Artificial Sequence
  chemically synthesized
ctgaggtctaaagaattagtgg

SEQ ID NO: 798484 - DNA, 22 bp, Artificial Sequence
  chemically synthesized
tactgaggtctaaagaattagt

SEQ ID NO: 798485 - DNA, 22 bp, Artificial Sequence
  chemically synthesized
acatacctctactgaggtctaa

SEQ ID NO: 798486 - DNA, 22 bp, Artificial Sequence
  chemically synthesized
cacatacctctactgaggtcta

SEQ ID NO: 798487 - DNA, 22 bp, Artificial Sequence
  chemically synthesized
attctttagacctcagtagagg

SEQ ID NO: 798488 - DNA, 22 bp, Artificial Sequence
  chemically synthesized
catgcttcacatacctctactg

SEQ ID NO: 798489 - DNA, 22 bp, Artificial Sequence
  chemically synthesized
tttagacctcagtagaggtatg

SEQ ID NO: 798490 - DNA, 22 bp, Artificial Sequence
  chemically synthesized
ctacatgcttcacatacctcta

SEQ ID NO: 798491 - DNA, 22 bp, Artificial Sequence
  chemically synthesized
tagacctcagtagaggtatgtg

SEQ ID NO: 798492 - DNA, 22 bp, Artificial Sequence
  chemically synthesized
agacctcagtagaggtatgtga

SEQ ID NO: 798493 - DNA, 22 bp, Artificial Sequence
  chemically synthesized
ttactacatgcttcacatacct

SEQ ID NO: 798494 - DNA, 22 bp, Artificial Sequence
  chemically synthesized
gacctcagtagaggtatgtgaa

SEQ ID NO: 798495 - DNA, 22 bp, Artificial Sequence
  chemically synthesized
ttattactacatgcttcacata

SEQ ID NO: 798496 - DNA, 22 bp, Artificial Sequence
  chemically synthesized
agtagaggtatgtgaagcatgt

SEQ ID NO: 798497 - DNA, 22 bp, Artificial Sequence
  chemically synthesized
tagccattgttattactacatg

SEQ ID NO: 798498 - DNA, 22 bp, Artificial Sequence
  chemically synthesized
tgtgtcattgtagccattgtta

SEQ ID NO: 798499 - DNA, 22 bp, Artificial Sequence
  chemically synthesized
atgtgtcattgtagccattgtt

SEQ ID NO: 798500 - DNA, 22 bp, Artificial Sequence
  chemically synthesized
tttatgtgtcattgtagccatt

SEQ ID NO: 798501 - DNA, 22 bp, Artificial Sequence
  chemically synthesized
cagccataactatttatgtgtc

SEQ ID NO: 798502 - DNA, 22 bp, Artificial Sequence
  chemically synthesized
caatgacacataaatagttatg

SEQ ID NO: 798503 - DNA, 22 bp, Artificial Sequence
  chemically synthesized
tagcgattgcagccataactat

SEQ ID NO: 798504 - DNA, 22 bp, Artificial Sequence
  chemically synthesized
cagtacctatagcgattgcagc

SEQ ID NO: 798505 - DNA, 22 bp, Artificial Sequence
  chemically synthesized
ttccagtacctatagcgattgc

SEQ ID NO: 798506 - DNA, 22 bp, Artificial Sequence
  chemically synthesized
tggctgcaatcgctataggtac

SEQ ID NO: 798507 - DNA, 22 bp, Artificial Sequence
  chemically synthesized
gaggaatgttgttccagtacct

SEQ ID NO: 798508 - DNA, 22 bp, Artificial Sequence
  chemically synthesized
caatcgctataggtactggaac

SEQ ID NO: 798509 - DNA, 22 bp, Artificial Sequence
  chemically synthesized
ctagaggaatgttgttccagta

SEQ ID NO: 798510 - DNA, 22 bp, Artificial Sequence
  chemically synthesized
ttcctagaggaatgttgttcca

SEQ ID NO: 798511 - DNA, 22 bp, Artificial Sequence
  chemically synthesized
taggtactggaacaacattcct

SEQ ID NO: 798512 - DNA, 22 bp, Artificial Sequence
  chemically synthesized
atgtcattgttcctagaggaat

SEQ ID NO: 798513 - DNA, 22 bp, Artificial Sequence
  chemically synthesized
gatgtcattgttcctagaggaa

SEQ ID NO: 798514 - DNA, 22 bp, Artificial Sequence
  chemically synthesized
ttgatgtcattgttcctagagg

SEQ ID NO: 798515 - DNA, 22 bp, Artificial Sequence
  chemically synthesized
cttgatgtcattgttcctagag

SEQ ID NO: 798516 - DNA, 22 bp, Artificial Sequence
  chemically synthesized
gaacaacattcctctaggaaca

SEQ ID NO: 798517 - DNA, 22 bp, Artificial Sequence
  chemically synthesized
caaggcttcttgatgtcattgt

SEQ ID NO: 798518 - DNA, 22 bp, Artificial Sequence
  chemically synthesized
tgcaaggcttcttgatgtcatt

SEQ ID NO: 798519 - DNA, 22 bp, Artificial Sequence
  chemically synthesized
ctctaggaacaatgacatcaag

SEQ ID NO: 798520 - DNA, 22 bp, Artificial Sequence
  chemically synthesized
tctgcaaggcttcttgatgtca

SEQ ID NO: 798521 - DNA, 22 bp, Artificial Sequence
  chemically synthesized
taggaacaatgacatcaagaag

SEQ ID NO: 798522 - DNA, 22 bp, Artificial Sequence
  chemically synthesized
gctctctgcaaggcttcttgat

SEQ ID NO: 798523 - DNA, 22 bp, Artificial Sequence
  chemically synthesized
ggaacaatgacatcaagaagcc

SEQ ID NO: 798524 - DNA, 22 bp, Artificial Sequence
  chemically synthesized
ggagattggctctctgcaaggc

SEQ ID NO: 798525 - DNA, 22 bp, Artificial Sequence
  chemically synthesized
tgggagattggctctctgcaag

SEQ ID NO: 798526 - DNA, 22 bp, Artificial Sequence
  chemically synthesized
aaaattctgggagattggctct

SEQ ID NO: 798527 - DNA, 22 bp, Artificial Sequence
  chemically synthesized
ctcaaaattctgggagattggc

SEQ ID NO: 798528 - DNA, 22 bp, Artificial Sequence
  chemically synthesized
attgctcaaaattctgggagat

SEQ ID NO: 798529 - DNA, 22 bp, Artificial Sequence
  chemically synthesized
gcagagagccaatctcccagaa

SEQ ID NO: 798530 - DNA, 22 bp, Artificial Sequence
  chemically synthesized
gattgctcaaaattctgggaga

SEQ ID NO: 798531 - DNA, 22 bp, Artificial Sequence
  chemically synthesized
cagagagccaatctcccagaat

SEQ ID NO: 798532 - DNA, 22 bp, Artificial Sequence
  chemically synthesized
ccagaattttgagcaatcaaac

SEQ ID NO: 798533 - DNA, 22 bp, Artificial Sequence
  chemically synthesized
aaatgtcacaaggagtttgatt

SEQ ID NO: 798534 - DNA, 22 bp, Artificial Sequence
  chemically synthesized
taaaatgtcacaaggagtttga

SEQ ID NO: 798535 - DNA, 22 bp, Artificial Sequence
  chemically synthesized
tgagcaatcaaactccttgtga

SEQ ID NO: 798536 - DNA, 22 bp, Artificial Sequence
  chemically synthesized
gagcaatcaaactccttgtgac

SEQ ID NO: 798537 - DNA, 22 bp, Artificial Sequence
  chemically synthesized
agcaatcaaactccttgtgaca

SEQ ID NO: 798538 - DNA, 22 bp, Artificial Sequence
  chemically synthesized
cttgtgacattttagaatgcac

SEQ ID NO: 798539 - DNA, 22 bp, Artificial Sequence
  chemically synthesized
agagaagatgcagtgcattcta

SEQ ID NO: 798540 - DNA, 22 bp, Artificial Sequence
  chemically synthesized
gtgacattttagaatgcactgc

SEQ ID NO: 798541 - DNA, 22 bp, Artificial Sequence
  chemically synthesized
tgacattttagaatgcactgca

SEQ ID NO: 798542 - DNA, 22 bp, Artificial Sequence
  chemically synthesized
gtaaccctaagagaagatgcag

SEQ ID NO: 798543 - DNA, 22 bp, Artificial Sequence
  chemically synthesized
agtaaccctaagagaagatgca

SEQ ID NO: 798544 - DNA, 22 bp, Artificial Sequence
  chemically synthesized
tagtaaccctaagagaagatgc

SEQ ID NO: 798545 - DNA, 22 bp, Artificial Sequence
  chemically synthesized
tagaatgcactgcatcttctct

SEQ ID NO: 798546 - DNA, 22 bp, Artificial Sequence
  chemically synthesized
ttagtaaccctaagagaagatg

SEQ ID NO: 798547 - DNA, 22 bp, Artificial Sequence
  chemically synthesized
agaatgcactgcatcttctctt

SEQ ID NO: 798548 - DNA, 22 bp, Artificial Sequence
  chemically synthesized
gaatgcactgcatcttctctta

SEQ ID NO: 798549 - DNA, 22 bp, Artificial Sequence
  chemically synthesized
tagtttttagtaaccctaagag

SEQ ID NO: 798550 - DNA, 22 bp, Artificial Sequence
  chemically synthesized
catcttctcttagggttactaa

SEQ ID NO: 798551 - DNA, 22 bp, Artificial Sequence
  chemically synthesized
ggtatagttgtagtttttagta

SEQ ID NO: 798552 - DNA, 22 bp, Artificial Sequence
  chemically synthesized
ctcttagggttactaaaaacta

SEQ ID NO: 798553 - DNA, 22 bp, Artificial Sequence
  chemically synthesized
tcttagggttactaaaaactac

SEQ ID NO: 798554 - DNA, 22 bp, Artificial Sequence
  chemically synthesized
ttagggttactaaaaactacaa

SEQ ID NO: 798555 - DNA, 22 bp, Artificial Sequence
  chemically synthesized
agggttactaaaaactacaact

SEQ ID NO: 798556 - DNA, 22 bp, Artificial Sequence
  chemically synthesized
gggttactaaaaactacaacta

SEQ ID NO: 798557 - DNA, 22 bp, Artificial Sequence
  chemically synthesized
ggtgagttaggtatagttgtag

SEQ ID NO: 798558 - DNA, 22 bp, Artificial Sequence
  chemically synthesized
ctaggtgagttaggtatagttg

SEQ ID NO: 798559 - DNA, 22 bp, Artificial Sequence
  chemically synthesized
ctaaaaactacaactataccta

SEQ ID NO: 798560 - DNA, 22 bp, Artificial Sequence
  chemically synthesized
ttgctaggtgagttaggtatag

SEQ ID NO: 798561 - DNA, 22 bp, Artificial Sequence
  chemically synthesized
aaaactacaactatacctaact

SEQ ID NO: 798562 - DNA, 22 bp, Artificial Sequence
  chemically synthesized
caactatacctaactcacctag

SEQ ID NO: 798563 - DNA, 22 bp, Artificial Sequence
  chemically synthesized
gcggcatgaactgttgctaggt

SEQ ID NO: 798564 - DNA, 22 bp, Artificial Sequence
  chemically synthesized
tacctaactcacctagcaacag

SEQ ID NO: 798565 - DNA, 22 bp, Artificial Sequence
  chemically synthesized
actcacctagcaacagttcatg

SEQ ID NO: 798566 - DNA, 22 bp, Artificial Sequence
  chemically synthesized
aaatgaattagcggcatgaact

SEQ ID NO: 798567 - DNA, 22 bp, Artificial Sequence
  chemically synthesized
aaaatgaattagcggcatgaac

SEQ ID NO: 798568 - DNA, 22 bp, Artificial Sequence
  chemically synthesized
acctagcaacagttcatgccgc

SEQ ID NO: 798569 - DNA, 22 bp, Artificial Sequence
  chemically synthesized
taaaatgaattagcggcatgaa

SEQ ID NO: 798570 - DNA, 22 bp, Artificial Sequence
  chemically synthesized
gcaacagttcatgccgctaatt

SEQ ID NO: 798571 - DNA, 22 bp, Artificial Sequence
  chemically synthesized
atgtatctttaaaatgaattag

SEQ ID NO: 798572 - DNA, 22 bp, Artificial Sequence
  chemically synthesized
ttaatgtatctttaaaatgaat

SEQ ID NO: 798573 - DNA, 22 bp, Artificial Sequence
  chemically synthesized
atgccgctaattcattttaaag

SEQ ID NO: 798574 - DNA, 22 bp, Artificial Sequence
  chemically synthesized
ctgttaatgtatctttaaaatg

SEQ ID NO: 798575 - DNA, 22 bp, Artificial Sequence
  chemically synthesized
attcattttaaagatacattaa

SEQ ID NO: 798576 - DNA, 22 bp, Artificial Sequence
  chemically synthesized
attttaaagatacattaacagt

SEQ ID NO: 798577 - DNA, 22 bp, Artificial Sequence
  chemically synthesized
taaagatacattaacagtagtc

SEQ ID NO: 798578 - DNA, 22 bp, Artificial Sequence
  chemically synthesized
aaagatacattaacagtagtct

SEQ ID NO: 798579 - DNA, 22 bp, Artificial Sequence
  chemically synthesized
aagatacattaacagtagtctt

SEQ ID NO: 798580 - DNA, 22 bp, Artificial Sequence
  chemically synthesized
aaagagacatatgaaaagacta

SEQ ID NO: 798581 - DNA, 22 bp, Artificial Sequence
  chemically synthesized
acagtagtcttttcatatgtct

SEQ ID NO: 798582 - DNA, 22 bp, Artificial Sequence
  chemically synthesized
ttcatatgtctctttgaattga

SEQ ID NO: 798583 - DNA, 22 bp, Artificial Sequence
  chemically synthesized
tcatatgtctctttgaattgac

SEQ ID NO: 798584 - DNA, 22 bp, Artificial Sequence
  chemically synthesized
catatgtctctttgaattgact

SEQ ID NO: 798585 - DNA, 22 bp, Artificial Sequence
  chemically synthesized
atatgtctctttgaattgactt

SEQ ID NO: 798586 - DNA, 22 bp, Artificial Sequence
  chemically synthesized
aagagacacagccaagtcaatt

SEQ ID NO: 798587 - DNA, 22 bp, Artificial Sequence
  chemically synthesized
caagagacacagccaagtcaat

SEQ ID NO: 798588 - DNA, 22 bp, Artificial Sequence
  chemically synthesized
tcaagagacacagccaagtcaa

SEQ ID NO: 798589 - DNA, 22 bp, Artificial Sequence
  chemically synthesized
tttgaattgacttggctgtgtc

SEQ ID NO: 798590 - DNA, 22 bp, Artificial Sequence
  chemically synthesized
agcctttcaagagacacagcca

SEQ ID NO: 798591 - DNA, 22 bp, Artificial Sequence
  chemically synthesized
gagcctttcaagagacacagcc

SEQ ID NO: 798592 - DNA, 22 bp, Artificial Sequence
  chemically synthesized
tgaattgacttggctgtgtctc

SEQ ID NO: 798593 - DNA, 22 bp, Artificial Sequence
  chemically synthesized
gaattgacttggctgtgtctct

SEQ ID NO: 798594 - DNA, 22 bp, Artificial Sequence
  chemically synthesized
aattgacttggctgtgtctctt

SEQ ID NO: 798595 - DNA, 22 bp, Artificial Sequence
  chemically synthesized
acttggctgtgtctcttgaaag

SEQ ID NO: 798596 - DNA, 22 bp, Artificial Sequence
  chemically synthesized
atcaaatttgagcctttcaaga

SEQ ID NO: 798597 - DNA, 22 bp, Artificial Sequence
  chemically synthesized
ggctgtgtctcttgaaaggctc

SEQ ID NO: 798598 - DNA, 22 bp, Artificial Sequence
  chemically synthesized
gctgtgtctcttgaaaggctca

SEQ ID NO: 798599 - DNA, 22 bp, Artificial Sequence
  chemically synthesized
gcctaatcaaatttgagccttt

SEQ ID NO: 798600 - DNA, 22 bp, Artificial Sequence
  chemically synthesized
ggcctaatcaaatttgagcctt

SEQ ID NO: 798601 - DNA, 22 bp, Artificial Sequence
  chemically synthesized
tggcctaatcaaatttgagcct

SEQ ID NO: 798602 - DNA, 22 bp, Artificial Sequence
  chemically synthesized
tgtctcttgaaaggctcaaatt

SEQ ID NO: 798603 - DNA, 22 bp, Artificial Sequence
  chemically synthesized
cattttggcctaatcaaatttg

SEQ ID NO: 798604 - DNA, 22 bp, Artificial Sequence
  chemically synthesized
ttgaaaggctcaaatttgatta

SEQ ID NO: 798605 - DNA, 22 bp, Artificial Sequence
  chemically synthesized
tgcattttggcctaatcaaatt

SEQ ID NO: 798606 - DNA, 22 bp, Artificial Sequence
  chemically synthesized
gaaaggctcaaatttgattagg

SEQ ID NO: 798607 - DNA, 22 bp, Artificial Sequence
  chemically synthesized
aaaggctcaaatttgattaggc

SEQ ID NO: 798608 - DNA, 22 bp, Artificial Sequence
  chemically synthesized
ctctgcattttggcctaatcaa

SEQ ID NO: 798609 - DNA, 22 bp, Artificial Sequence
  chemically synthesized
cctctgcattttggcctaatca

SEQ ID NO: 798610 - DNA, 22 bp, Artificial Sequence
  chemically synthesized
atttcctctgcattttggccta

SEQ ID NO: 798611 - DNA, 22 bp, Artificial Sequence
  chemically synthesized
aaatttgattaggccaaaatgc

SEQ ID NO: 798612 - DNA, 22 bp, Artificial Sequence
  chemically synthesized
gattaggccaaaatgcagagga

SEQ ID NO: 798613 - DNA, 22 bp, Artificial Sequence
  chemically synthesized
attaggccaaaatgcagaggaa

SEQ ID NO: 798614 - DNA, 22 bp, Artificial Sequence
  chemically synthesized
ggccaaaatgcagaggaaatta

SEQ ID NO: 798615 - DNA, 22 bp, Artificial Sequence
  chemically synthesized
gggaaatggcacaagagaataa

SEQ ID NO: 798616 - DNA, 22 bp, Artificial Sequence
  chemically synthesized
agggaaatggcacaagagaata

SEQ ID NO: 798617 - DNA, 22 bp, Artificial Sequence
  chemically synthesized
aatttagggaaatggcacaaga

SEQ ID NO: 798618 - DNA, 22 bp, Artificial Sequence
  chemically synthesized
tgaatttagggaaatggcacaa

SEQ ID NO: 798619 - DNA, 22 bp, Artificial Sequence
  chemically synthesized
atgttattctcttgtgccattt

SEQ ID NO: 798620 - DNA, 22 bp, Artificial Sequence
  chemically synthesized
ctgaatttagggaaatggcaca

SEQ ID NO: 798621 - DNA, 22 bp, Artificial Sequence
  chemically synthesized
catttctgaatttagggaaatg

SEQ ID NO: 798622 - DNA, 22 bp, Artificial Sequence
  chemically synthesized
ttctcttgtgccatttccctaa

SEQ ID NO: 798623 - DNA, 22 bp, Artificial Sequence
  chemically synthesized
acatttctgaatttagggaaat

SEQ ID NO: 798624 - DNA, 22 bp, Artificial Sequence
  chemically synthesized
tacatttctgaatttagggaaa

SEQ ID NO: 798625 - DNA, 22 bp, Artificial Sequence
  chemically synthesized
tcttgtgccatttccctaaatt

SEQ ID NO: 798626 - DNA, 22 bp, Artificial Sequence
  chemically synthesized
tttacatttctgaatttaggga

SEQ ID NO: 798627 - DNA, 22 bp, Artificial Sequence
  chemically synthesized
ctttacatttctgaatttaggg

SEQ ID NO: 798628 - DNA, 22 bp, Artificial Sequence
  chemically synthesized
ttgtgccatttccctaaattca

SEQ ID NO: 798629 - DNA, 22 bp, Artificial Sequence
  chemically synthesized
gtgccatttccctaaattcaga

SEQ ID NO: 798630 - DNA, 22 bp, Artificial Sequence
  chemically synthesized
tgccatttccctaaattcagaa

SEQ ID NO: 798631 - DNA, 22 bp, Artificial Sequence
  chemically synthesized
gtatttctttacatttctgaat

SEQ ID NO: 798632 - DNA, 22 bp, Artificial Sequence
  chemically synthesized
ccctaaattcagaaatgtaaag

SEQ ID NO: 798633 - DNA, 22 bp, Artificial Sequence
  chemically synthesized
aaattggtatttctttacattt

SEQ ID NO: 798634 - DNA, 22 bp, Artificial Sequence
  chemically synthesized
cctaaattcagaaatgtaaaga

SEQ ID NO: 798635 - DNA, 22 bp, Artificial Sequence
  chemically synthesized
gaaattggtatttctttacatt

SEQ ID NO: 798636 - DNA, 22 bp, Artificial Sequence
  chemically synthesized
aattcagaaatgtaaagaaata

SEQ ID NO: 798637 - DNA, 22 bp, Artificial Sequence
  chemically synthesized
tatttgaaattggtatttcttt

SEQ ID NO: 798638 - DNA, 22 bp, Artificial Sequence
  chemically synthesized
agaaatgtaaagaaataccaat

SEQ ID NO: 798639 - DNA, 22 bp, Artificial Sequence
  chemically synthesized
tctgtatttgaaattggtattt

SEQ ID NO: 798640 - DNA, 22 bp, Artificial Sequence
  chemically synthesized
gtctgtatttgaaattggtatt

SEQ ID NO: 798641 - DNA, 22 bp, Artificial Sequence
  chemically synthesized
gacttgtctgtatttgaaattg

SEQ ID NO: 798642 - DNA, 22 bp, Artificial Sequence
  chemically synthesized
acattagacttgtctgtatttg

SEQ ID NO: 798643 - DNA, 22 bp, Artificial Sequence
  chemically synthesized
aacattagacttgtctgtattt

SEQ ID NO: 798644 - DNA, 22 bp, Artificial Sequence
  chemically synthesized
atttaacattagacttgtctgt

SEQ ID NO: 798645 - DNA, 22 bp, Artificial Sequence
  chemically synthesized
catttaacattagacttgtctg

SEQ ID NO: 798646 - DNA, 22 bp, Artificial Sequence
  chemically synthesized
caaatacagacaagtctaatgt

SEQ ID NO: 798647 - DNA, 22 bp, Artificial Sequence
  chemically synthesized
agacttcatttaacattagact

SEQ ID NO: 798648 - DNA, 22 bp, Artificial Sequence
  chemically synthesized
aaatacagacaagtctaatgtt

SEQ ID NO: 798649 - DNA, 22 bp, Artificial Sequence
  chemically synthesized
tatgttcagacttcatttaaca

SEQ ID NO: 798650 - DNA, 22 bp, Artificial Sequence
  chemically synthesized
atatgttcagacttcatttaac

SEQ ID NO: 798651 - DNA, 22 bp, Artificial Sequence
  chemically synthesized
tatatgttcagacttcatttaa

SEQ ID NO: 798652 - DNA, 22 bp, Artificial Sequence
  chemically synthesized
ttatatgttcagacttcattta

SEQ ID NO: 798653 - DNA, 22 bp, Artificial Sequence
  chemically synthesized
tttatatgttcagacttcattt

SEQ ID NO: 798654 - DNA, 22 bp, Artificial Sequence
  chemically synthesized
atgttaaatgaagtctgaacat

SEQ ID NO: 798655 - DNA, 22 bp, Artificial Sequence
  chemically synthesized
acgacaatctttttatatgttc

SEQ ID NO: 798656 - DNA, 22 bp, Artificial Sequence
  chemically synthesized
gacgacaatctttttatatgtt

SEQ ID NO: 798657 - DNA, 22 bp, Artificial Sequence
  chemically synthesized
aatgaagtctgaacatataaaa

SEQ ID NO: 798658 - DNA, 22 bp, Artificial Sequence
  chemically synthesized
tcttgacgacaatctttttata

SEQ ID NO: 798659 - DNA, 22 bp, Artificial Sequence
  chemically synthesized
gtcttgacgacaatctttttat

SEQ ID NO: 798660 - DNA, 22 bp, Artificial Sequence
  chemically synthesized
aacatataaaaagattgtcgtc

SEQ ID NO: 798661 - DNA, 22 bp, Artificial Sequence
  chemically synthesized
aagaaaaccaggcaatggattt

SEQ ID NO: 798662 - DNA, 22 bp, Artificial Sequence
  chemically synthesized
tcgtcaagacaaatccattgcc

SEQ ID NO: 798663 - DNA, 22 bp, Artificial Sequence
  chemically synthesized
cataaaaatagatgtcagctga

SEQ ID NO: 798664 - DNA, 22 bp, Artificial Sequence
  chemically synthesized
cctggttttcttcagctgacat

SEQ ID NO: 798665 - DNA, 22 bp, Artificial Sequence
  chemically synthesized
gttttcttcagctgacatctat

SEQ ID NO: 798666 - DNA, 22 bp, Artificial Sequence
  chemically synthesized
tcttcagctgacatctattttt

SEQ ID NO: 798667 - DNA, 22 bp, Artificial Sequence
  chemically synthesized
cttcagctgacatctattttta

SEQ ID NO: 798668 - DNA, 22 bp, Artificial Sequence
  chemically synthesized
ttcagctgacatctatttttat

SEQ ID NO: 798669 - DNA, 22 bp, Artificial Sequence
  chemically synthesized
cagctgacatctatttttatgt

SEQ ID NO: 798670 - DNA, 22 bp, Artificial Sequence
  chemically synthesized
agctgacatctatttttatgta

SEQ ID NO: 798671 - DNA, 22 bp, Artificial Sequence
  chemically synthesized
agtcataccgtctacataaaaa

SEQ ID NO: 798672 - DNA, 22 bp, Artificial Sequence
  chemically synthesized
acatctatttttatgtagacgg

SEQ ID NO: 798673 - DNA, 22 bp, Artificial Sequence
  chemically synthesized
aatctaagtcataccgtctaca

SEQ ID NO: 798674 - DNA, 22 bp, Artificial Sequence
  chemically synthesized
tttttatgtagacggtatgact

SEQ ID NO: 798675 - DNA, 22 bp, Artificial Sequence
  chemically synthesized
gtccctgaatctaagtcatacc

SEQ ID NO: 798676 - DNA, 22 bp, Artificial Sequence
  chemically synthesized
agtccctgaatctaagtcatac

SEQ ID NO: 798677 - DNA, 22 bp, Artificial Sequence
  chemically synthesized
ttatgtagacggtatgacttag

SEQ ID NO: 798678 - DNA, 22 bp, Artificial Sequence
  chemically synthesized
tatgtagacggtatgacttaga

SEQ ID NO: 798679 - DNA, 22 bp, Artificial Sequence
  chemically synthesized
atgtagacggtatgacttagat

SEQ ID NO: 798680 - DNA, 22 bp, Artificial Sequence
  chemically synthesized
tgtagacggtatgacttagatt

SEQ ID NO: 798681 - DNA, 22 bp, Artificial Sequence
  chemically synthesized
atgtttagtccctgaatctaag

SEQ ID NO: 798682 - DNA, 22 bp, Artificial Sequence
  chemically synthesized
catgtttagtccctgaatctaa

SEQ ID NO: 798683 - DNA, 22 bp, Artificial Sequence
  chemically synthesized
ttcatgtttagtccctgaatct

SEQ ID NO: 798684 - DNA, 22 bp, Artificial Sequence
  chemically synthesized
cttcatgtttagtccctgaatc

SEQ ID NO: 798685 - DNA, 22 bp, Artificial Sequence
  chemically synthesized
aatttcttcatgtttagtccct

SEQ ID NO: 798686 - DNA, 22 bp, Artificial Sequence
  chemically synthesized
tgaatttcttcatgtttagtcc

SEQ ID NO: 798687 - DNA, 22 bp, Artificial Sequence
  chemically synthesized
ttctgaatttcttcatgtttag

SEQ ID NO: 798688 - DNA, 22 bp, Artificial Sequence
  chemically synthesized
agattcagggactaaacatgaa

SEQ ID NO: 798689 - DNA, 22 bp, Artificial Sequence
  chemically synthesized
gattcagggactaaacatgaag

SEQ ID NO: 798690 - DNA, 22 bp, Artificial Sequence
  chemically synthesized
gattattctgaatttcttcatg

SEQ ID NO: 798691 - DNA, 22 bp, Artificial Sequence
  chemically synthesized
agggactaaacatgaagaaatt

SEQ ID NO: 798692 - DNA, 22 bp, Artificial Sequence
  chemically synthesized
aataattggattattctgaatt

SEQ ID NO: 798693 - DNA, 22 bp, Artificial Sequence
  chemically synthesized
gaataattggattattctgaat

SEQ ID NO: 798694 - DNA, 22 bp, Artificial Sequence
  chemically synthesized
aacatgaagaaattcagaataa

SEQ ID NO: 798695 - DNA, 22 bp, Artificial Sequence
  chemically synthesized
tgaataattggattattctgaa

SEQ ID NO: 798696 - DNA, 22 bp, Artificial Sequence
  chemically synthesized
ttgaataattggattattctga

SEQ ID NO: 798697 - DNA, 22 bp, Artificial Sequence
  chemically synthesized
catgccttttgaataattggat

SEQ ID NO: 798698 - DNA, 22 bp, Artificial Sequence
  chemically synthesized
gcatgccttttgaataattgga

SEQ ID NO: 798699 - DNA, 22 bp, Artificial Sequence
  chemically synthesized
tgcatgccttttgaataattgg

SEQ ID NO: 798700 - DNA, 22 bp, Artificial Sequence
  chemically synthesized
ttgcatgccttttgaataattg

SEQ ID NO: 798701 - DNA, 22 bp, Artificial Sequence
  chemically synthesized
agaataatccaattattcaaaa

SEQ ID NO: 798702 - DNA, 22 bp, Artificial Sequence
  chemically synthesized
aataatagtttttgcatgcctt

SEQ ID NO: 798703 - DNA, 22 bp, Artificial Sequence
  chemically synthesized
aaataatagtttttgcatgcct

SEQ ID NO: 798704 - DNA, 22 bp, Artificial Sequence
  chemically synthesized
taaataatagtttttgcatgcc

SEQ ID NO: 798705 - DNA, 22 bp, Artificial Sequence
  chemically synthesized
ttaaataatagtttttgcatgc

SEQ ID NO: 798706 - DNA, 22 bp, Artificial Sequence
  chemically synthesized
tttaaataatagtttttgcatg

SEQ ID NO: 798707 - DNA, 22 bp, Artificial Sequence
  chemically synthesized
ttcaaaaggcatgcaaaaacta

SEQ ID NO: 798708 - DNA, 22 bp, Artificial Sequence
  chemically synthesized
aaaaggcatgcaaaaactatta

SEQ ID NO: 798709 - DNA, 22 bp, Artificial Sequence
  chemically synthesized
tgaaaagagattttttaaataa

SEQ ID NO: 798710 - DNA, 22 bp, Artificial Sequence
  chemically synthesized
ttatttaaaaaatctcttttca

SEQ ID NO: 798711 - DNA, 22 bp, Artificial Sequence
  chemically synthesized
tttaaaaaatctcttttcacag

SEQ ID NO: 798712 - DNA, 22 bp, Artificial Sequence
  chemically synthesized
aaaacaaaaacactgtgaaaag

SEQ ID NO: 798713 - DNA, 22 bp, Artificial Sequence
  chemically synthesized
aaaaaatctcttttcacagtgt

SEQ ID NO: 798714 - DNA, 22 bp, Artificial Sequence
  chemically synthesized
aaaaatctcttttcacagtgtt

SEQ ID NO: 798715 - DNA, 22 bp, Artificial Sequence
  chemically synthesized
tagtactcaaaacaaaaacact

SEQ ID NO: 798716 - DNA, 22 bp, Artificial Sequence
  chemically synthesized
ttttcacagtgtttttgttttg

SEQ ID NO: 798717 - DNA, 22 bp, Artificial Sequence
  chemically synthesized
ttcacagtgtttttgttttgag

SEQ ID NO: 798718 - DNA, 22 bp, Artificial Sequence
  chemically synthesized
tcacagtgtttttgttttgagt

SEQ ID NO: 798719 - DNA, 22 bp, Artificial Sequence
  chemically synthesized
caaagctatagtactcaaaaca

SEQ ID NO: 798720 - DNA, 22 bp, Artificial Sequence
  chemically synthesized
cacagtgtttttgttttgagta

SEQ ID NO: 798721 - DNA, 22 bp, Artificial Sequence
  chemically synthesized
acaaagctatagtactcaaaac

SEQ ID NO: 798722 - DNA, 22 bp, Artificial Sequence
  chemically synthesized
acagtgtttttgttttgagtac

SEQ ID NO: 798723 - DNA, 22 bp, Artificial Sequence
  chemically synthesized
aatgtttacaaagctatagtac

SEQ ID NO: 798724 - DNA, 22 bp, Artificial Sequence
  chemically synthesized
ttgttttgagtactatagcttt

SEQ ID NO: 798725 - DNA, 22 bp, Artificial Sequence
  chemically synthesized
tgttttgagtactatagctttg

SEQ ID NO: 798726 - DNA, 22 bp, Artificial Sequence
  chemically synthesized
gttttgagtactatagctttgt

SEQ ID NO: 798727 - DNA, 22 bp, Artificial Sequence
  chemically synthesized
ttttgagtactatagctttgta

SEQ ID NO: 798728 - DNA, 22 bp, Artificial Sequence
  chemically synthesized
gataattaaatgtttacaaagc

SEQ ID NO: 798729 - DNA, 22 bp, Artificial Sequence
  chemically synthesized
tgagtactatagctttgtaaac

SEQ ID NO: 798730 - DNA, 22 bp, Artificial Sequence
  chemically synthesized
gagtactatagctttgtaaaca

SEQ ID NO: 798731 - DNA, 22 bp, Artificial Sequence
  chemically synthesized
agtactatagctttgtaaacat

SEQ ID NO: 798732 - DNA, 22 bp, Artificial Sequence
  chemically synthesized
tagctttgtaaacatttaatta

SEQ ID NO: 798733 - DNA, 22 bp, Artificial Sequence
  chemically synthesized
tgtaaacatttaattatctagc

SEQ ID NO: 798734 - DNA, 22 bp, Artificial Sequence
  chemically synthesized
gtaaacatttaattatctagct

SEQ ID NO: 798735 - DNA, 22 bp, Artificial Sequence
  chemically synthesized
taaacatttaattatctagctt

SEQ ID NO: 798736 - DNA, 22 bp, Artificial Sequence
  chemically synthesized
aaacgaaacccataaagctaga

SEQ ID NO: 798737 - DNA, 22 bp, Artificial Sequence
  chemically synthesized
aattatctagctttatgggttt

SEQ ID NO: 798738 - DNA, 22 bp, Artificial Sequence
  chemically synthesized
attatctagctttatgggtttc

SEQ ID NO: 798739 - DNA, 22 bp, Artificial Sequence
  chemically synthesized
tctagctttatgggtttcgttt

SEQ ID NO: 798740 - DNA, 22 bp, Artificial Sequence
  chemically synthesized
gcacaatcattaaaacgaaacc

SEQ ID NO: 798741 - DNA, 22 bp, Artificial Sequence
  chemically synthesized
ttggcacaatcattaaaacgaa

SEQ ID NO: 798742 - DNA, 22 bp, Artificial Sequence
  chemically synthesized
gctttatgggtttcgttttaat

SEQ ID NO: 798743 - DNA, 22 bp, Artificial Sequence
  chemically synthesized
gttggcacaatcattaaaacga

SEQ ID NO: 798744 - DNA, 22 bp, Artificial Sequence
  chemically synthesized
tatgggtttcgttttaatgatt

SEQ ID NO: 798745 - DNA, 22 bp, Artificial Sequence
  chemically synthesized
atgggtttcgttttaatgattg

SEQ ID NO: 798746 - DNA, 22 bp, Artificial Sequence
  chemically synthesized
tgggtttcgttttaatgattgt

SEQ ID NO: 798747 - DNA, 22 bp, Artificial Sequence
  chemically synthesized
tcatttgttggcacaatcatta

SEQ ID NO: 798748 - DNA, 22 bp, Artificial Sequence
  chemically synthesized
ttatcatttgttggcacaatca

SEQ ID NO: 798749 - DNA, 22 bp, Artificial Sequence
  chemically synthesized
ttgttatcatttgttggcacaa

SEQ ID NO: 798750 - DNA, 22 bp, Artificial Sequence
  chemically synthesized
cgttttaatgattgtgccaaca

SEQ ID NO: 798751 - DNA, 22 bp, Artificial Sequence
  chemically synthesized
attgttatcatttgttggcaca

SEQ ID NO: 798752 - DNA, 22 bp, Artificial Sequence
  chemically synthesized
gttttaatgattgtgccaacaa

SEQ ID NO: 798753 - DNA, 22 bp, Artificial Sequence
  chemically synthesized
taatgattgtgccaacaaatga

SEQ ID NO: 798754 - DNA, 22 bp, Artificial Sequence
  chemically synthesized
aatgattgtgccaacaaatgat

SEQ ID NO: 798755 - DNA, 22 bp, Artificial Sequence
  chemically synthesized
atgattgtgccaacaaatgata

SEQ ID NO: 798756 - DNA, 22 bp, Artificial Sequence
  chemically synthesized
gcatggatttattgttatcatt

SEQ ID NO: 798757 - DNA, 22 bp, Artificial Sequence
  chemically synthesized
tgccaacaaatgataacaataa

SEQ ID NO: 798758 - DNA, 22 bp, Artificial Sequence
  chemically synthesized
caaaattggcatggatttattg

SEQ ID NO: 798759 - DNA, 22 bp, Artificial Sequence
  chemically synthesized
ccaaaattggcatggatttatt

SEQ ID NO: 798760 - DNA, 22 bp, Artificial Sequence
  chemically synthesized
gaaatacttccaaaattggcat

SEQ ID NO: 798761 - DNA, 22 bp, Artificial Sequence
  chemically synthesized
tataatattagaaatacttcca

SEQ ID NO: 798762 - DNA, 22 bp, Artificial Sequence
  chemically synthesized
ttatataatattagaaatactt

SEQ ID NO: 798763 - DNA, 22 bp, Artificial Sequence
  chemically synthesized
gttatataatattagaaatact

SEQ ID NO: 798764 - DNA, 22 bp, Artificial Sequence
  chemically synthesized
caatttgttatataatattaga

SEQ ID NO: 798765 - DNA, 22 bp, Artificial Sequence
  chemically synthesized
ccaatttgttatataatattag

SEQ ID NO: 798766 - DNA, 22 bp, Artificial Sequence
  chemically synthesized
tggaagtatttctaatattata

SEQ ID NO: 798767 - DNA, 22 bp, Artificial Sequence
  chemically synthesized
tccaatttgttatataatatta

SEQ ID NO: 798768 - DNA, 22 bp, Artificial Sequence
  chemically synthesized
ggaagtatttctaatattatat

SEQ ID NO: 798769 - DNA, 22 bp, Artificial Sequence
  chemically synthesized
gaagtatttctaatattatata

SEQ ID NO: 798770 - DNA, 22 bp, Artificial Sequence
  chemically synthesized
ctttccaatttgttatataata

SEQ ID NO: 798771 - DNA, 22 bp, Artificial Sequence
  chemically synthesized
ctaatattatataacaaattgg

SEQ ID NO: 798772 - DNA, 22 bp, Artificial Sequence
  chemically synthesized
taatattatataacaaattgga

SEQ ID NO: 798773 - DNA, 22 bp, Artificial Sequence
  chemically synthesized
atattatataacaaattggaaa

SEQ ID NO: 798774 - DNA, 22 bp, Artificial Sequence
  chemically synthesized
tataacaaattggaaaggaatt

SEQ ID NO: 798775 - DNA, 22 bp, Artificial Sequence
  chemically synthesized
gagataatcatgtacaaaattc

SEQ ID NO: 798776 - DNA, 22 bp, Artificial Sequence
  chemically synthesized
ctagagataatcatgtacaaaa

SEQ ID NO: 798777 - DNA, 22 bp, Artificial Sequence
  chemically synthesized
cctagagataatcatgtacaaa

SEQ ID NO: 798778 - DNA, 22 bp, Artificial Sequence
  chemically synthesized
gaaaggaattttgtacatgatt

SEQ ID NO: 798779 - DNA, 22 bp, Artificial Sequence
  chemically synthesized
tcttcctagagataatcatgta

SEQ ID NO: 798780 - DNA, 22 bp, Artificial Sequence
  chemically synthesized
gtcttcctagagataatcatgt

SEQ ID NO: 798781 - DNA, 22 bp, Artificial Sequence
  chemically synthesized
tggtttgtcttcctagagataa

SEQ ID NO: 798782 - DNA, 22 bp, Artificial Sequence
  chemically synthesized
gtggtttgtcttcctagagata

SEQ ID NO: 798783 - DNA, 22 bp, Artificial Sequence
  chemically synthesized
tgtacatgattatctctaggaa

SEQ ID NO: 798784 - DNA, 22 bp, Artificial Sequence
  chemically synthesized
ttgtggtttgtcttcctagaga

SEQ ID NO: 798785 - DNA, 22 bp, Artificial Sequence
  chemically synthesized
gtacatgattatctctaggaag

SEQ ID NO: 798786 - DNA, 22 bp, Artificial Sequence
  chemically synthesized
tacatgattatctctaggaaga

SEQ ID NO: 798787 - DNA, 22 bp, Artificial Sequence
  chemically synthesized
ctcttgtggtttgtcttcctag

SEQ ID NO: 798788 - DNA, 22 bp, Artificial Sequence
  chemically synthesized
attactcttgtggtttgtcttc

SEQ ID NO: 798789 - DNA, 22 bp, Artificial Sequence
  chemically synthesized
ttaattactcttgtggtttgtc

SEQ ID NO: 798790 - DNA, 22 bp, Artificial Sequence
  chemically synthesized
tctctaggaagacaaaccacaa

SEQ ID NO: 798791 - DNA, 22 bp, Artificial Sequence
  chemically synthesized
tgttaattactcttgtggtttg

SEQ ID NO: 798792 - DNA, 22 bp, Artificial Sequence
  chemically synthesized
taggaagacaaaccacaagagt

SEQ ID NO: 798793 - DNA, 22 bp, Artificial Sequence
  chemically synthesized
ggaagacaaaccacaagagtaa

SEQ ID NO: 798794 - DNA, 22 bp, Artificial Sequence
  chemically synthesized
tgatgataatggaatcatagct

SEQ ID NO: 798795 - DNA, 22 bp, Artificial Sequence
  chemically synthesized
gtgatgataatggaatcatagc

SEQ ID NO: 798796 - DNA, 22 bp, Artificial Sequence
  chemically synthesized
acccttgtgatgataatggaat

SEQ ID NO: 798797 - DNA, 22 bp, Artificial Sequence
  chemically synthesized
acagagctatgattccattatc

SEQ ID NO: 798798 - DNA, 22 bp, Artificial Sequence
  chemically synthesized
aacccttgtgatgataatggaa

SEQ ID NO: 798799 - DNA, 22 bp, Artificial Sequence
  chemically synthesized
gtttaacccttgtgatgataat

SEQ ID NO: 798800 - DNA, 22 bp, Artificial Sequence
  chemically synthesized
tggtttaacccttgtgatgata

SEQ ID NO: 798801 - DNA, 22 bp, Artificial Sequence
  chemically synthesized
ctggtttaacccttgtgatgat

SEQ ID NO: 798802 - DNA, 22 bp, Artificial Sequence
  chemically synthesized
tgattccattatcatcacaagg

SEQ ID NO: 798803 - DNA, 22 bp, Artificial Sequence
  chemically synthesized
cattatcatcacaagggttaaa

SEQ ID NO: 798804 - DNA, 22 bp, Artificial Sequence
  chemically synthesized
tcatcacaagggttaaaccaga

SEQ ID NO: 798805 - DNA, 22 bp, Artificial Sequence
  chemically synthesized
aaccagaagttcatgttcacta

SEQ ID NO: 798806 - DNA, 22 bp, Artificial Sequence
  chemically synthesized
tgagatatatgaaaatagtgaa

SEQ ID NO: 798807 - DNA, 22 bp, Artificial Sequence
  chemically synthesized
gtgagatatatgaaaatagtga

SEQ ID NO: 798808 - DNA, 22 bp, Artificial Sequence
  chemically synthesized
ggtttgtgagatatatgaaaat

SEQ ID NO: 798809 - DNA, 22 bp, Artificial Sequence
  chemically synthesized
gggtttgtgagatatatgaaaa

SEQ ID NO: 798810 - DNA, 22 bp, Artificial Sequence
  chemically synthesized
atgttcactattttcatatatc

SEQ ID NO: 798811 - DNA, 22 bp, Artificial Sequence
  chemically synthesized
atacttgggtttgtgagatata

SEQ ID NO: 798812 - DNA, 22 bp, Artificial Sequence
  chemically synthesized
actattttcatatatctcacaa

SEQ ID NO: 798813 - DNA, 22 bp, Artificial Sequence
  chemically synthesized
aactgatacttgggtttgtgag

SEQ ID NO: 798814 - DNA, 22 bp, Artificial Sequence
  chemically synthesized
ttttcatatatctcacaaaccc

SEQ ID NO: 798815 - DNA, 22 bp, Artificial Sequence
  chemically synthesized
tcatatatctcacaaacccaag

SEQ ID NO: 798816 - DNA, 22 bp, Artificial Sequence
  chemically synthesized
catatatctcacaaacccaagt

SEQ ID NO: 798817 - DNA, 22 bp, Artificial Sequence
  chemically synthesized
atatatctcacaaacccaagta

SEQ ID NO: 798818 - DNA, 22 bp, Artificial Sequence
  chemically synthesized
caggagaactgaactgatactt

SEQ ID NO: 798819 - DNA, 22 bp, Artificial Sequence
  chemically synthesized
ccaggagaactgaactgatact

SEQ ID NO: 798820 - DNA, 22 bp, Artificial Sequence
  chemically synthesized
acaaacccaagtatcagttcag

SEQ ID NO: 798821 - DNA, 22 bp, Artificial Sequence
  chemically synthesized
atgaatttccaggagaactgaa

SEQ ID NO: 798822 - DNA, 22 bp, Artificial Sequence
  chemically synthesized
catgaatttccaggagaactga

SEQ ID NO: 798823 - DNA, 22 bp, Artificial Sequence
  chemically synthesized
atccttcatgaatttccaggag

SEQ ID NO: 798824 - DNA, 22 bp, Artificial Sequence
  chemically synthesized
aatccttcatgaatttccagga

SEQ ID NO: 798825 - DNA, 22 bp, Artificial Sequence
  chemically synthesized
taatccttcatgaatttccagg

SEQ ID NO: 798826 - DNA, 22 bp, Artificial Sequence
  chemically synthesized
ttttaatccttcatgaatttcc

SEQ ID NO: 798827 - DNA, 22 bp, Artificial Sequence
  chemically synthesized
gttttaatccttcatgaatttc

SEQ ID NO: 798828 - DNA, 22 bp, Artificial Sequence
  chemically synthesized
tgttttaatccttcatgaattt

SEQ ID NO: 798829 - DNA, 22 bp, Artificial Sequence
  chemically synthesized
agttctcctggaaattcatgaa

SEQ ID NO: 798830 - DNA, 22 bp, Artificial Sequence
  chemically synthesized
tcctggaaattcatgaaggatt

SEQ ID NO: 798831 - DNA, 22 bp, Artificial Sequence
  chemically synthesized
ctggaaattcatgaaggattaa

SEQ ID NO: 798832 - DNA, 22 bp, Artificial Sequence
  chemically synthesized
gaaattcatgaaggattaaaac

SEQ ID NO: 798833 - DNA, 22 bp, Artificial Sequence
  chemically synthesized
ataatgtgttttgttttaatcc

SEQ ID NO: 798834 - DNA, 22 bp, Artificial Sequence
  chemically synthesized
cctaataatgtgttttgtttta

SEQ ID NO: 798835 - DNA, 22 bp, Artificial Sequence
  chemically synthesized
atgaaggattaaaacaaaacac

SEQ ID NO: 798836 - DNA, 22 bp, Artificial Sequence
  chemically synthesized
tatcaaaatattgcctaataat

SEQ ID NO: 798837 - DNA, 22 bp, Artificial Sequence
  chemically synthesized
aaacaaaacacattattaggca

SEQ ID NO: 798838 - DNA, 22 bp, Artificial Sequence
  chemically synthesized
atatcaaaatattgcctaataa

SEQ ID NO: 798839 - DNA, 22 bp, Artificial Sequence
  chemically synthesized
cttatatcaaaatattgcctaa

SEQ ID NO: 798840 - DNA, 22 bp, Artificial Sequence
  chemically synthesized
cccactccttatatcaaaatat

SEQ ID NO: 798841 - DNA, 22 bp, Artificial Sequence
  chemically synthesized
gctacccactccttatatcaaa

SEQ ID NO: 798842 - DNA, 22 bp, Artificial Sequence
  chemically synthesized
ttaggcaatattttgatataag

SEQ ID NO: 798843 - DNA, 22 bp, Artificial Sequence
  chemically synthesized
ggcaatattttgatataaggag

SEQ ID NO: 798844 - DNA, 22 bp, Artificial Sequence
  chemically synthesized
gaaaacatattagctacccact

SEQ ID NO: 798845 - DNA, 22 bp, Artificial Sequence
  chemically synthesized
ggaaaacatattagctacccac

SEQ ID NO: 798846 - DNA, 22 bp, Artificial Sequence
  chemically synthesized
tgatataaggagtgggtagcta

SEQ ID NO: 798847 - DNA, 22 bp, Artificial Sequence
  chemically synthesized
tggaaaacatattagctaccca

SEQ ID NO: 798848 - DNA, 22 bp, Artificial Sequence
  chemically synthesized
gatataaggagtgggtagctaa

SEQ ID NO: 798849 - DNA, 22 bp, Artificial Sequence
  chemically synthesized
atataaggagtgggtagctaat

SEQ ID NO: 798850 - DNA, 22 bp, Artificial Sequence
  chemically synthesized
aattttggaaaacatattagct

SEQ ID NO: 798851 - DNA, 22 bp, Artificial Sequence
  chemically synthesized
tactaaattttggaaaacatat

SEQ ID NO: 798852 - DNA, 22 bp, Artificial Sequence
  chemically synthesized
tgtactaaattttggaaaacat

SEQ ID NO: 798853 - DNA, 22 bp, Artificial Sequence
  chemically synthesized
ctgtactaaattttggaaaaca

SEQ ID NO: 798854 - DNA, 22 bp, Artificial Sequence
  chemically synthesized
atatgttttccaaaatttagta

SEQ ID NO: 798855 - DNA, 22 bp, Artificial Sequence
  chemically synthesized
tccaaaatttagtacagaagtg

SEQ ID NO: 798856 - DNA, 22 bp, Artificial Sequence
  chemically synthesized
agatgatacacacacttctgta

SEQ ID NO: 798857 - DNA, 22 bp, Artificial Sequence
  chemically synthesized
ccaaaatttagtacagaagtgt

SEQ ID NO: 798858 - DNA, 22 bp, Artificial Sequence
  chemically synthesized
gagatgatacacacacttctgt

SEQ ID NO: 798859 - DNA, 22 bp, Artificial Sequence
  chemically synthesized
caaaatttagtacagaagtgtg

SEQ ID NO: 798860 - DNA, 22 bp, Artificial Sequence
  chemically synthesized
agtacagaagtgtgtgtatcat

SEQ ID NO: 798861 - DNA, 22 bp, Artificial Sequence
  chemically synthesized
gtacagaagtgtgtgtatcatc

SEQ ID NO: 798862 - DNA, 22 bp, Artificial Sequence
  chemically synthesized
ccgccaatcttgagatgataca

SEQ ID NO: 798863 - DNA, 22 bp, Artificial Sequence
  chemically synthesized
taagtaacatgtgttaccgcca

SEQ ID NO: 798864 - DNA, 22 bp, Artificial Sequence
  chemically synthesized
gtaagtaacatgtgttaccgcc

SEQ ID NO: 798865 - DNA, 22 bp, Artificial Sequence
  chemically synthesized
tgtaagtaacatgtgttaccgc

SEQ ID NO: 798866 - DNA, 22 bp, Artificial Sequence
  chemically synthesized
ttgtaagtaacatgtgttaccg

SEQ ID NO: 798867 - DNA, 22 bp, Artificial Sequence
  chemically synthesized
tttgtaagtaacatgtgttacc

SEQ ID NO: 798868 - DNA, 22 bp, Artificial Sequence
  chemically synthesized
ttttgtaagtaacatgtgttac

SEQ ID NO: 798869 - DNA, 22 bp, Artificial Sequence
  chemically synthesized
aagattggcggtaacacatgtt

SEQ ID NO: 798870 - DNA, 22 bp, Artificial Sequence
  chemically synthesized
atttttttgtaagtaacatgtg

SEQ ID NO: 798871 - DNA, 22 bp, Artificial Sequence
  chemically synthesized
ctcatttttttgtaagtaacat

SEQ ID NO: 798872 - DNA, 22 bp, Artificial Sequence
  chemically synthesized
gcggtaacacatgttacttaca

SEQ ID NO: 798873 - DNA, 22 bp, Artificial Sequence
  chemically synthesized
tgctcatttttttgtaagtaac

SEQ ID NO: 798874 - DNA, 22 bp, Artificial Sequence
  chemically synthesized
ctgctcatttttttgtaagtaa

SEQ ID NO: 798875 - DNA, 22 bp, Artificial Sequence
  chemically synthesized
tttctgctcatttttttgtaag

SEQ ID NO: 798876 - DNA, 22 bp, Artificial Sequence
  chemically synthesized
atttctgctcatttttttgtaa

SEQ ID NO: 798877 - DNA, 22 bp, Artificial Sequence
  chemically synthesized
tttatttctgctcatttttttg

SEQ ID NO: 798878 - DNA, 22 bp, Artificial Sequence
  chemically synthesized
cttacaaaaaaatgagcagaaa

SEQ ID NO: 798879 - DNA, 22 bp, Artificial Sequence
  chemically synthesized
acaaaaaaatgagcagaaataa

SEQ ID NO: 798880 - DNA, 22 bp, Artificial Sequence
  chemically synthesized
caaaaaaatgagcagaaataaa

SEQ ID NO: 798881 - DNA, 22 bp, Artificial Sequence
  chemically synthesized
tacatcataaacacactgttta

SEQ ID NO: 798882 - DNA, 22 bp, Artificial Sequence
  chemically synthesized
atacatcataaacacactgttt

SEQ ID NO: 798883 - DNA, 22 bp, Artificial Sequence
  chemically synthesized
tttatacatcataaacacactg

SEQ ID NO: 798884 - DNA, 22 bp, Artificial Sequence
  chemically synthesized
atttatacatcataaacacact

SEQ ID NO: 798885 - DNA, 22 bp, Artificial Sequence
  chemically synthesized
tatttatacatcataaacacac

SEQ ID NO: 798886 - DNA, 22 bp, Artificial Sequence
  chemically synthesized
tattttatttatacatcataaa

SEQ ID NO: 798887 - DNA, 22 bp, Artificial Sequence
  chemically synthesized
gtgatgtcattatattttattt

SEQ ID NO: 798888 - DNA, 22 bp, Artificial Sequence
  chemically synthesized
atgatgtataaataaaatataa

SEQ ID NO: 798889 - DNA, 22 bp, Artificial Sequence
  chemically synthesized
tgatgtataaataaaatataat

SEQ ID NO: 798890 - DNA, 22 bp, Artificial Sequence
  chemically synthesized
tctagtgatgtcattatatttt

SEQ ID NO: 798891 - DNA, 22 bp, Artificial Sequence
  chemically synthesized
gtctagtgatgtcattatattt

SEQ ID NO: 798892 - DNA, 22 bp, Artificial Sequence
  chemically synthesized
ccttgtctagtgatgtcattat

SEQ ID NO: 798893 - DNA, 22 bp, Artificial Sequence
  chemically synthesized
caaaaagtagatgttcccttgt

SEQ ID NO: 798894 - DNA, 22 bp, Artificial Sequence
  chemically synthesized
ccaaaaagtagatgttcccttg

SEQ ID NO: 798895 - DNA, 22 bp, Artificial Sequence
  chemically synthesized
aataaatttccaaaaagtagat

SEQ ID NO: 798896 - DNA, 22 bp, Artificial Sequence
  chemically synthesized
gacaagggaacatctacttttt

SEQ ID NO: 798897 - DNA, 22 bp, Artificial Sequence
  chemically synthesized
ccctaaataaatttccaaaaag

SEQ ID NO: 798898 - DNA, 22 bp, Artificial Sequence
  chemically synthesized
actgccctaaataaatttccaa

SEQ ID NO: 798899 - DNA, 22 bp, Artificial Sequence
  chemically synthesized
atggttcactgccctaaataaa

SEQ ID NO: 798900 - DNA, 22 bp, Artificial Sequence
  chemically synthesized
ctttttggaaatttatttaggg

SEQ ID NO: 798901 - DNA, 22 bp, Artificial Sequence
  chemically synthesized
aatggttcactgccctaaataa

SEQ ID NO: 798902 - DNA, 22 bp, Artificial Sequence
  chemically synthesized
taatggttcactgccctaaata

SEQ ID NO: 798903 - DNA, 22 bp, Artificial Sequence
  chemically synthesized
ttaatggttcactgccctaaat

SEQ ID NO: 798904 - DNA, 22 bp, Artificial Sequence
  chemically synthesized
tttggaaatttatttagggcag

SEQ ID NO: 798905 - DNA, 22 bp, Artificial Sequence
  chemically synthesized
tttaatggttcactgccctaaa

SEQ ID NO: 798906 - DNA, 22 bp, Artificial Sequence
  chemically synthesized
ttggaaatttatttagggcagt

SEQ ID NO: 798907 - DNA, 22 bp, Artificial Sequence
  chemically synthesized
tggaaatttatttagggcagtg

SEQ ID NO: 798908 - DNA, 22 bp, Artificial Sequence
  chemically synthesized
ggaaatttatttagggcagtga

SEQ ID NO: 798909 - DNA, 22 bp, Artificial Sequence
  chemically synthesized
ttttttaatggttcactgccct

SEQ ID NO: 798910 - DNA, 22 bp, Artificial Sequence
  chemically synthesized
gaaatttatttagggcagtgaa

SEQ ID NO: 798911 - DNA, 22 bp, Artificial Sequence
  chemically synthesized
attttttaatggttcactgccc

SEQ ID NO: 798912 - DNA, 22 bp, Artificial Sequence
  chemically synthesized
tattttttaatggttcactgcc

SEQ ID NO: 798913 - DNA, 22 bp, Artificial Sequence
  chemically synthesized
tgttttattttttaatggttca

SEQ ID NO: 798914 - DNA, 22 bp, Artificial Sequence
  chemically synthesized
atttagggcagtgaaccattaa

SEQ ID NO: 798915 - DNA, 22 bp, Artificial Sequence
  chemically synthesized
tttagggcagtgaaccattaaa

SEQ ID NO: 798916 - DNA, 22 bp, Artificial Sequence
  chemically synthesized
agggcagtgaaccattaaaaaa

SEQ ID NO: 798917 - DNA, 22 bp, Artificial Sequence
  chemically synthesized
gggcagtgaaccattaaaaaat

SEQ ID NO: 798918 - DNA, 22 bp, Artificial Sequence
  chemically synthesized
aaaaataaaacataggctttat

SEQ ID NO: 798919 - DNA, 22 bp, Artificial Sequence
  chemically synthesized
tatgataaaaatataaagccta

SEQ ID NO: 798920 - DNA, 22 bp, Artificial Sequence
  chemically synthesized
gccatctgtatgataaaaatat

SEQ ID NO: 798921 - DNA, 22 bp, Artificial Sequence
  chemically synthesized
ataatattagccatctgtatga

SEQ ID NO: 798922 - DNA, 22 bp, Artificial Sequence
  chemically synthesized
tatatttttatcatacagatgg

SEQ ID NO: 798923 - DNA, 22 bp, Artificial Sequence
  chemically synthesized
atatttttatcatacagatggc

SEQ ID NO: 798924 - DNA, 22 bp, Artificial Sequence
  chemically synthesized
tatttttatcatacagatggct

SEQ ID NO: 798925 - DNA, 22 bp, Artificial Sequence
  chemically synthesized
aaaattaataatattagccatc

SEQ ID NO: 798926 - DNA, 22 bp, Artificial Sequence
  chemically synthesized
ttatcatacagatggctaatat

SEQ ID NO: 798927 - DNA, 22 bp, Artificial Sequence
  chemically synthesized
tatcatacagatggctaatatt

SEQ ID NO: 798928 - DNA, 22 bp, Artificial Sequence
  chemically synthesized
atcatacagatggctaatatta

SEQ ID NO: 798929 - DNA, 22 bp, Artificial Sequence
  chemically synthesized
tcatacagatggctaatattat

SEQ ID NO: 798930 - DNA, 22 bp, Artificial Sequence
  chemically synthesized
aatgcatattgaaaattaataa

SEQ ID NO: 798931 - DNA, 22 bp, Artificial Sequence
  chemically synthesized
ctaaatgcatattgaaaattaa

SEQ ID NO: 798932 - DNA, 22 bp, Artificial Sequence
  chemically synthesized
cctaaatgcatattgaaaatta

SEQ ID NO: 798933 - DNA, 22 bp, Artificial Sequence
  chemically synthesized
tcctaaatgcatattgaaaatt

SEQ ID NO: 798934 - DNA, 22 bp, Artificial Sequence
  chemically synthesized
ttcctaaatgcatattgaaaat

SEQ ID NO: 798935 - DNA, 22 bp, Artificial Sequence
  chemically synthesized
atattattaattttcaatatgc

SEQ ID NO: 798936 - DNA, 22 bp, Artificial Sequence
  chemically synthesized
gtttttcctaaatgcatattga

SEQ ID NO: 798937 - DNA, 22 bp, Artificial Sequence
  chemically synthesized
ggtttttcctaaatgcatattg

SEQ ID NO: 798938 - DNA, 22 bp, Artificial Sequence
  chemically synthesized
tggtttttcctaaatgcatatt

SEQ ID NO: 798939 - DNA, 22 bp, Artificial Sequence
  chemically synthesized
ttaattttcaatatgcatttag

SEQ ID NO: 798940 - DNA, 22 bp, Artificial Sequence
  chemically synthesized
attttcaatatgcatttaggaa

SEQ ID NO: 798941 - DNA, 22 bp, Artificial Sequence
  chemically synthesized
tcaatatgcatttaggaaaaac

SEQ ID NO: 798942 - DNA, 22 bp, Artificial Sequence
  chemically synthesized
caatatgcatttaggaaaaacc

SEQ ID NO: 798943 - DNA, 22 bp, Artificial Sequence
  chemically synthesized
aatatgcatttaggaaaaacca

SEQ ID NO: 798944 - DNA, 22 bp, Artificial Sequence
  chemically synthesized
aaatagtaaatatactttggtt

SEQ ID NO: 798945 - DNA, 22 bp, Artificial Sequence
  chemically synthesized
attgaaatagtaaatatacttt

SEQ ID NO: 798946 - DNA, 22 bp, Artificial Sequence
  chemically synthesized
aggaaaaaccaaagtatattta

SEQ ID NO: 798947 - DNA, 22 bp, Artificial Sequence
  chemically synthesized
ggaaaaaccaaagtatatttac

SEQ ID NO: 798948 - DNA, 22 bp, Artificial Sequence
  chemically synthesized
tgacaatagctaattgaaatag

SEQ ID NO: 798949 - DNA, 22 bp, Artificial Sequence
  chemically synthesized
ctgtgacaatagctaattgaaa

SEQ ID NO: 798950 - DNA, 22 bp, Artificial Sequence
  chemically synthesized
cattactgtgacaatagctaat

SEQ ID NO: 798951 - DNA, 22 bp, Artificial Sequence
  chemically synthesized
tacattactgtgacaatagcta

SEQ ID NO: 798952 - DNA, 22 bp, Artificial Sequence
  chemically synthesized
actatttcaattagctattgtc

SEQ ID NO: 798953 - DNA, 22 bp, Artificial Sequence
  chemically synthesized
ctatttcaattagctattgtca

SEQ ID NO: 798954 - DNA, 22 bp, Artificial Sequence
  chemically synthesized
ttctacattactgtgacaatag

SEQ ID NO: 798955 - DNA, 22 bp, Artificial Sequence
  chemically synthesized
attctacattactgtgacaata

SEQ ID NO: 798956 - DNA, 22 bp, Artificial Sequence
  chemically synthesized
tttcaattagctattgtcacag

SEQ ID NO: 798957 - DNA, 22 bp, Artificial Sequence
  chemically synthesized
tattctacattactgtgacaat

SEQ ID NO: 798958 - DNA, 22 bp, Artificial Sequence
  chemically synthesized
caattagctattgtcacagtaa

SEQ ID NO: 798959 - DNA, 22 bp, Artificial Sequence
  chemically synthesized
aattagctattgtcacagtaat

SEQ ID NO: 798960 - DNA, 22 bp, Artificial Sequence
  chemically synthesized
agctttattctacattactgtg

SEQ ID NO: 798961 - DNA, 22 bp, Artificial Sequence
  chemically synthesized
gctattgtcacagtaatgtaga

SEQ ID NO: 798962 - DNA, 22 bp, Artificial Sequence
  chemically synthesized
ttgtcacagtaatgtagaataa

SEQ ID NO: 798963 - DNA, 22 bp, Artificial Sequence
  chemically synthesized
tcacagtaatgtagaataaagc

SEQ ID NO: 798964 - DNA, 22 bp, Artificial Sequence
  chemically synthesized
cataaagccattgagctttatt

SEQ ID NO: 798965 - DNA, 22 bp, Artificial Sequence
  chemically synthesized
ttgcataaagccattgagcttt

SEQ ID NO: 798966 - DNA, 22 bp, Artificial Sequence
  chemically synthesized
aatggctttatgcaacaatcat

SEQ ID NO: 798967 - DNA, 22 bp, Artificial Sequence
  chemically synthesized
acatccaggaaaagaaatgatt

SEQ ID NO: 798968 - DNA, 22 bp, Artificial Sequence
  chemically synthesized
tatgcaacaatcatttcttttc

SEQ ID NO: 798969 - DNA, 22 bp, Artificial Sequence
  chemically synthesized
atgcaacaatcatttcttttcc

SEQ ID NO: 798970 - DNA, 22 bp, Artificial Sequence
  chemically synthesized
tgcaacaatcatttcttttcct

SEQ ID NO: 798971 - DNA, 22 bp, Artificial Sequence
  chemically synthesized
gccattcacatccaggaaaaga

SEQ ID NO: 798972 - DNA, 22 bp, Artificial Sequence
  chemically synthesized
cactagccattcacatccagga

SEQ ID NO: 798973 - DNA, 22 bp, Artificial Sequence
  chemically synthesized
cttttcctggatgtgaatggct

SEQ ID NO: 798974 - DNA, 22 bp, Artificial Sequence
  chemically synthesized
ttttcctggatgtgaatggcta

SEQ ID NO: 798975 - DNA, 22 bp, Artificial Sequence
  chemically synthesized
ttcctggatgtgaatggctagt

SEQ ID NO: 798976 - DNA, 22 bp, Artificial Sequence
  chemically synthesized
tcctggatgtgaatggctagtg

SEQ ID NO: 798977 - DNA, 22 bp, Artificial Sequence
  chemically synthesized
cctggatgtgaatggctagtgc

SEQ ID NO: 798978 - DNA, 22 bp, Artificial Sequence
  chemically synthesized
ctggatgtgaatggctagtgca

SEQ ID NO: 798979 - DNA, 22 bp, Artificial Sequence
  chemically synthesized
gatgtgaatggctagtgcagcc

SEQ ID NO: 798980 - DNA, 22 bp, Artificial Sequence
  chemically synthesized
gtgcagccctgctgttcatgtc

SEQ ID NO: 798981 - DNA, 22 bp, Artificial Sequence
  chemically synthesized
aggaaaacgataaaagacatga

SEQ ID NO: 798982 - DNA, 22 bp, Artificial Sequence
  chemically synthesized
gtctcaggaaaacgataaaaga

SEQ ID NO: 798983 - DNA, 22 bp, Artificial Sequence
  chemically synthesized
ctgttcatgtcttttatcgttt

SEQ ID NO: 798984 - DNA, 22 bp, Artificial Sequence
  chemically synthesized
ctggtctcaggaaaacgataaa

SEQ ID NO: 798985 - DNA, 22 bp, Artificial Sequence
  chemically synthesized
ttcatgtcttttatcgttttcc

SEQ ID NO: 798986 - DNA, 22 bp, Artificial Sequence
  chemically synthesized
ggctgctggtctcaggaaaacg

SEQ ID NO: 798987 - DNA, 22 bp, Artificial Sequence
  chemically synthesized
atgtcttttatcgttttcctga

SEQ ID NO: 798988 - DNA, 22 bp, Artificial Sequence
  chemically synthesized
ttatcgttttcctgagaccagc

SEQ ID NO: 798989 - DNA, 22 bp, Artificial Sequence
  chemically synthesized
tatcgttttcctgagaccagca

SEQ ID NO: 798990 - DNA, 22 bp, Artificial Sequence
  chemically synthesized
atcgttttcctgagaccagcag

SEQ ID NO: 798991 - DNA, 22 bp, Artificial Sequence
  chemically synthesized
tcgttttcctgagaccagcagc

SEQ ID NO: 798992 - DNA, 22 bp, Artificial Sequence
  chemically synthesized
agaacacgtccatctaggctgc

SEQ ID NO: 798993 - DNA, 22 bp, Artificial Sequence
  chemically synthesized
tcctgagaccagcagcctagat

SEQ ID NO: 798994 - DNA, 22 bp, Artificial Sequence
  chemically synthesized
cctgagaccagcagcctagatg

SEQ ID NO: 798995 - DNA, 22 bp, Artificial Sequence
  chemically synthesized
tgagaacacgtccatctaggct

SEQ ID NO: 798996 - DNA, 22 bp, Artificial Sequence
  chemically synthesized
ctgagaccagcagcctagatgg

SEQ ID NO: 798997 - DNA, 22 bp, Artificial Sequence
  chemically synthesized
agaccagcagcctagatggacg

SEQ ID NO: 798998 - DNA, 22 bp, Artificial Sequence
  chemically synthesized
tcattctgagaacacgtccatc

SEQ ID NO: 798999 - DNA, 22 bp, Artificial Sequence
  chemically synthesized
ctatcattctgagaacacgtcc

SEQ ID NO: 799000 - DNA, 22 bp, Artificial Sequence
  chemically synthesized
tgctatcattctgagaacacgt

SEQ ID NO: 799001 - DNA, 22 bp, Artificial Sequence
  chemically synthesized
ctgctatcattctgagaacacg

SEQ ID NO: 799002 - DNA, 22 bp, Artificial Sequence
  chemically synthesized
tgcttctgctatcattctgaga

SEQ ID NO: 799003 - DNA, 22 bp, Artificial Sequence
  chemically synthesized
gatggacgtgttctcagaatga

SEQ ID NO: 799004 - DNA, 22 bp, Artificial Sequence
  chemically synthesized
gtgcttctgctatcattctgag

SEQ ID NO: 799005 - DNA, 22 bp, Artificial Sequence
  chemically synthesized
tttgtgcttctgctatcattct

SEQ ID NO: 799006 - DNA, 22 bp, Artificial Sequence
  chemically synthesized
ctgtttgtgcttctgctatcat

SEQ ID NO: 799007 - DNA, 22 bp, Artificial Sequence
  chemically synthesized
tcagaatgatagcagaagcaca

SEQ ID NO: 799008 - DNA, 22 bp, Artificial Sequence
  chemically synthesized
tacattcctgtttgtgcttctg

SEQ ID NO: 799009 - DNA, 22 bp, Artificial Sequence
  chemically synthesized
agaatgatagcagaagcacaaa

SEQ ID NO: 799010 - DNA, 22 bp, Artificial Sequence
  chemically synthesized
agagatctatacattcctgttt

SEQ ID NO: 799011 - DNA, 22 bp, Artificial Sequence
  chemically synthesized
aagagatctatacattcctgtt

SEQ ID NO: 799012 - DNA, 22 bp, Artificial Sequence
  chemically synthesized
ggccttaagagatctatacatt

SEQ ID NO: 799013 - DNA, 22 bp, Artificial Sequence
  chemically synthesized
agcctaggccttaagagatcta

SEQ ID NO: 799014 - DNA, 22 bp, Artificial Sequence
  chemically synthesized
cagcctaggccttaagagatct

SEQ ID NO: 799015 - DNA, 22 bp, Artificial Sequence
  chemically synthesized
tcagcctaggccttaagagatc

SEQ ID NO: 799016 - DNA, 22 bp, Artificial Sequence
  chemically synthesized
ttaaggcctaggctgaaaactg

SEQ ID NO: 799017 - DNA, 22 bp, Artificial Sequence
  chemically synthesized
aaggcctaggctgaaaactgtc

SEQ ID NO: 799018 - DNA, 22 bp, Artificial Sequence
  chemically synthesized
aggcctaggctgaaaactgtca

SEQ ID NO: 799019 - DNA, 22 bp, Artificial Sequence
  chemically synthesized
ggctgaaaactgtcacctctca

SEQ ID NO: 799020 - DNA, 22 bp, Artificial Sequence
  chemically synthesized
aaaactgtcacctctcactcct

SEQ ID NO: 799021 - DNA, 22 bp, Artificial Sequence
  chemically synthesized
gcaaatggtaaatgagcaggag

SEQ ID NO: 799022 - DNA, 22 bp, Artificial Sequence
  chemically synthesized
agcaaatggtaaatgagcagga

SEQ ID NO: 799023 - DNA, 22 bp, Artificial Sequence
  chemically synthesized
tcacctctcactcctgctcatt

SEQ ID NO: 799024 - DNA, 22 bp, Artificial Sequence
  chemically synthesized
tagcaaatggtaaatgagcagg

SEQ ID NO: 799025 - DNA, 22 bp, Artificial Sequence
  chemically synthesized
ctttagcaaatggtaaatgagc

SEQ ID NO: 799026 - DNA, 22 bp, Artificial Sequence
  chemically synthesized
gctttagcaaatggtaaatgag

SEQ ID NO: 799027 - DNA, 22 bp, Artificial Sequence
  chemically synthesized
tcactcctgctcatttaccatt

SEQ ID NO: 799028 - DNA, 22 bp, Artificial Sequence
  chemically synthesized
actcctgctcatttaccatttg

SEQ ID NO: 799029 - DNA, 22 bp, Artificial Sequence
  chemically synthesized
ctgctcatttaccatttgctaa

SEQ ID NO: 799030 - DNA, 22 bp, Artificial Sequence
  chemically synthesized
ctcatttaccatttgctaaagc

SEQ ID NO: 799031 - DNA, 22 bp, Artificial Sequence
  chemically synthesized
gccatgtgatttgctttagcaa

SEQ ID NO: 799032 - DNA, 22 bp, Artificial Sequence
  chemically synthesized
atttaccatttgctaaagcaaa

SEQ ID NO: 799033 - DNA, 22 bp, Artificial Sequence
  chemically synthesized
accatttgctaaagcaaatcac

SEQ ID NO: 799034 - DNA, 22 bp, Artificial Sequence
  chemically synthesized
ggggttggccatgtgatttgct

SEQ ID NO: 799035 - DNA, 22 bp, Artificial Sequence
  chemically synthesized
ccatttgctaaagcaaatcaca

SEQ ID NO: 799036 - DNA, 22 bp, Artificial Sequence
  chemically synthesized
aggggttggccatgtgatttgc

SEQ ID NO: 799037 - DNA, 22 bp, Artificial Sequence
  chemically synthesized
gtcttaggggttggccatgtga

SEQ ID NO: 799038 - DNA, 22 bp, Artificial Sequence
  chemically synthesized
gctaaagcaaatcacatggcca

SEQ ID NO: 799039 - DNA, 22 bp, Artificial Sequence
  chemically synthesized
ctaaagcaaatcacatggccaa

SEQ ID NO: 799040 - DNA, 22 bp, Artificial Sequence
  chemically synthesized
aagcaaatcacatggccaaccc

SEQ ID NO: 799041 - DNA, 22 bp, Artificial Sequence
  chemically synthesized
ccaacccctagtcttaggggtt

SEQ ID NO: 799042 - DNA, 22 bp, Artificial Sequence
  chemically synthesized
cccaacccctagtcttaggggt

SEQ ID NO: 799043 - DNA, 22 bp, Artificial Sequence
  chemically synthesized
tgagtggaatgtacttcccaac

SEQ ID NO: 799044 - DNA, 22 bp, Artificial Sequence
  chemically synthesized
atgagtggaatgtacttcccaa

SEQ ID NO: 799045 - DNA, 22 bp, Artificial Sequence
  chemically synthesized
agactaggggttgggaagtaca

SEQ ID NO: 799046 - DNA, 22 bp, Artificial Sequence
  chemically synthesized
cttatgagtggaatgtacttcc

SEQ ID NO: 799047 - DNA, 22 bp, Artificial Sequence
  chemically synthesized
ggggttgggaagtacattccac

SEQ ID NO: 799048 - DNA, 22 bp, Artificial Sequence
  chemically synthesized
acaatgcctccttatgagtgga

SEQ ID NO: 799049 - DNA, 22 bp, Artificial Sequence
  chemically synthesized
aacaatgcctccttatgagtgg

SEQ ID NO: 799050 - DNA, 22 bp, Artificial Sequence
  chemically synthesized
ggaagtacattccactcataag

SEQ ID NO: 799051 - DNA, 22 bp, Artificial Sequence
  chemically synthesized
cactcataaggaggcattgtta

SEQ ID NO: 799052 - DNA, 22 bp, Artificial Sequence
  chemically synthesized
caatcacaaccttaacaatgcc

SEQ ID NO: 799053 - DNA, 22 bp, Artificial Sequence
  chemically synthesized
tgcaatcacaaccttaacaatg

SEQ ID NO: 799054 - DNA, 22 bp, Artificial Sequence
  chemically synthesized
ctgcaatcacaaccttaacaat

SEQ ID NO: 799055 - DNA, 22 bp, Artificial Sequence
  chemically synthesized
ataaggaggcattgttaaggtt

SEQ ID NO: 799056 - DNA, 22 bp, Artificial Sequence
  chemically synthesized
caccttctgcaatcacaacctt

SEQ ID NO: 799057 - DNA, 22 bp, Artificial Sequence
  chemically synthesized
tccaccttctgcaatcacaacc

SEQ ID NO: 799058 - DNA, 22 bp, Artificial Sequence
  chemically synthesized
ctccaccttctgcaatcacaac

SEQ ID NO: 799059 - DNA, 22 bp, Artificial Sequence
  chemically synthesized
ttctccaccttctgcaatcaca

SEQ ID NO: 799060 - DNA, 22 bp, Artificial Sequence
  chemically synthesized
cttctccaccttctgcaatcac

SEQ ID NO: 799061 - DNA, 22 bp, Artificial Sequence
  chemically synthesized
ttaaggttgtgattgcagaagg

SEQ ID NO: 799062 - DNA, 22 bp, Artificial Sequence
  chemically synthesized
aggttgtgattgcagaaggtgg

SEQ ID NO: 799063 - DNA, 22 bp, Artificial Sequence
  chemically synthesized
atcccatttcttctccaccttc

SEQ ID NO: 799064 - DNA, 22 bp, Artificial Sequence
  chemically synthesized
tgattgcagaaggtggagaaga

SEQ ID NO: 799065 - DNA, 22 bp, Artificial Sequence
  chemically synthesized
atcattaatcccatttcttctc

SEQ ID NO: 799066 - DNA, 22 bp, Artificial Sequence
  chemically synthesized
aatcattaatcccatttcttct

SEQ ID NO: 799067 - DNA, 22 bp, Artificial Sequence
  chemically synthesized
cagaaggtggagaagaaatggg

SEQ ID NO: 799068 - DNA, 22 bp, Artificial Sequence
  chemically synthesized
tagtagatttaatcattaatcc

SEQ ID NO: 799069 - DNA, 22 bp, Artificial Sequence
  chemically synthesized
tgtagctgtagtagatttaatc

SEQ ID NO: 799070 - DNA, 22 bp, Artificial Sequence
  chemically synthesized
ttatgtagctgtagtagattta

SEQ ID NO: 799071 - DNA, 22 bp, Artificial Sequence
  chemically synthesized
atgattaaatctactacagcta

SEQ ID NO: 799072 - DNA, 22 bp, Artificial Sequence
  chemically synthesized
aagaaactgttatgtagctgta

SEQ ID NO: 799073 - DNA, 22 bp, Artificial Sequence
  chemically synthesized
aaagaaactgttatgtagctgt

SEQ ID NO: 799074 - DNA, 22 bp, Artificial Sequence
  chemically synthesized
taaagaaactgttatgtagctg

SEQ ID NO: 799075 - DNA, 22 bp, Artificial Sequence
  chemically synthesized
aatctactacagctacataaca

SEQ ID NO: 799076 - DNA, 22 bp, Artificial Sequence
  chemically synthesized
ctttaaagaaactgttatgtag

SEQ ID NO: 799077 - DNA, 22 bp, Artificial Sequence
  chemically synthesized
ctacagctacataacagtttct

SEQ ID NO: 799078 - DNA, 22 bp, Artificial Sequence
  chemically synthesized
cagctacataacagtttcttta

SEQ ID NO: 799079 - DNA, 22 bp, Artificial Sequence
  chemically synthesized
cataacagtttctttaaagcag

SEQ ID NO: 799080 - DNA, 22 bp, Artificial Sequence
  chemically synthesized
cacaatatatcatctgctttaa

SEQ ID NO: 799081 - DNA, 22 bp, Artificial Sequence
  chemically synthesized
tcatgttccacaatatatcatc

SEQ ID NO: 799082 - DNA, 22 bp, Artificial Sequence
  chemically synthesized
ctttaaagcagatgatatattg

SEQ ID NO: 799083 - DNA, 22 bp, Artificial Sequence
  chemically synthesized
tttaaagcagatgatatattgt

SEQ ID NO: 799084 - DNA, 22 bp, Artificial Sequence
  chemically synthesized
taaagcagatgatatattgtgg

SEQ ID NO: 799085 - DNA, 22 bp, Artificial Sequence
  chemically synthesized
aaagcagatgatatattgtgga

SEQ ID NO: 799086 - DNA, 22 bp, Artificial Sequence
  chemically synthesized
aagcagatgatatattgtggaa

SEQ ID NO: 799087 - DNA, 22 bp, Artificial Sequence
  chemically synthesized
tggaacatgacaatgatgtgta

SEQ ID NO: 799088 - DNA, 22 bp, Artificial Sequence
  chemically synthesized
agtcaaagatataagtaagtac

SEQ ID NO: 799089 - DNA, 22 bp, Artificial Sequence
  chemically synthesized
aagaattcagtcaaagatataa

SEQ ID NO: 799090 - DNA, 22 bp, Artificial Sequence
  chemically synthesized
caccctgaagaattcagtcaaa

SEQ ID NO: 799091 - DNA, 22 bp, Artificial Sequence
  chemically synthesized
acttatatctttgactgaattc

SEQ ID NO: 799092 - DNA, 22 bp, Artificial Sequence
  chemically synthesized
cttatatctttgactgaattct

SEQ ID NO: 799093 - DNA, 22 bp, Artificial Sequence
  chemically synthesized
atatctttgactgaattcttca

SEQ ID NO: 799094 - DNA, 22 bp, Artificial Sequence
  chemically synthesized
tatctttgactgaattcttcag

SEQ ID NO: 799095 - DNA, 22 bp, Artificial Sequence
  chemically synthesized
tggcaaaaattacaccctgaag

SEQ ID NO: 799096 - DNA, 22 bp, Artificial Sequence
  chemically synthesized
tgactgaattcttcagggtgta

SEQ ID NO: 799097 - DNA, 22 bp, Artificial Sequence
  chemically synthesized
gactgaattcttcagggtgtaa

SEQ ID NO: 799098 - DNA, 22 bp, Artificial Sequence
  chemically synthesized
actgaattcttcagggtgtaat

SEQ ID NO: 799099 - DNA, 22 bp, Artificial Sequence
  chemically synthesized
aattcttcagggtgtaattttt

SEQ ID NO: 799100 - DNA, 22 bp, Artificial Sequence
  chemically synthesized
ttcagggtgtaatttttgccac

SEQ ID NO: 799101 - DNA, 22 bp, Artificial Sequence
  chemically synthesized
cagggtgtaatttttgccacaa

SEQ ID NO: 799102 - DNA, 22 bp, Artificial Sequence
  chemically synthesized
agggtgtaatttttgccacaat

SEQ ID NO: 799103 - DNA, 22 bp, Artificial Sequence
  chemically synthesized
gcacgggtaaatattgtggcaa

SEQ ID NO: 799104 - DNA, 22 bp, Artificial Sequence
  chemically synthesized
ttgccacaatatttacccgtgc

SEQ ID NO: 799105 - DNA, 22 bp, Artificial Sequence
  chemically synthesized
tgccacaatatttacccgtgct

SEQ ID NO: 799106 - DNA, 22 bp, Artificial Sequence
  chemically synthesized
gccacaatatttacccgtgcta

SEQ ID NO: 799107 - DNA, 22 bp, Artificial Sequence
  chemically synthesized
ccacaatatttacccgtgctag

SEQ ID NO: 799108 - DNA, 22 bp, Artificial Sequence
  chemically synthesized
acccgtgctagatgattgttat

SEQ ID NO: 799109 - DNA, 22 bp, Artificial Sequence
  chemically synthesized
cccgtgctagatgattgttatg

SEQ ID NO: 799110 - DNA, 22 bp, Artificial Sequence
  chemically synthesized
ataacaataaaaatacataaca

SEQ ID NO: 799111 - DNA, 22 bp, Artificial Sequence
  chemically synthesized
gatgattgttatgtatttttat

SEQ ID NO: 799112 - DNA, 22 bp, Artificial Sequence
  chemically synthesized
atcactgataacaataaaaata

SEQ ID NO: 799113 - DNA, 22 bp, Artificial Sequence
  chemically synthesized
ttatgtatttttattgttatca

SEQ ID NO: 799114 - DNA, 22 bp, Artificial Sequence
  chemically synthesized
tgtatttttattgttatcagtg

SEQ ID NO: 799115 - DNA, 22 bp, Artificial Sequence
  chemically synthesized
gcagcaggttaatcactgataa

SEQ ID NO: 799116 - DNA, 22 bp, Artificial Sequence
  chemically synthesized
agcagcaggttaatcactgata

SEQ ID NO: 799117 - DNA, 22 bp, Artificial Sequence
  chemically synthesized
ttattgttatcagtgattaacc

SEQ ID NO: 799118 - DNA, 22 bp, Artificial Sequence
  chemically synthesized
aatttagcagcaggttaatcac

SEQ ID NO: 799119 - DNA, 22 bp, Artificial Sequence
  chemically synthesized
tattgttatcagtgattaacct

SEQ ID NO: 799120 - DNA, 22 bp, Artificial Sequence
  chemically synthesized
aaatttagcagcaggttaatca

SEQ ID NO: 799121 - DNA, 22 bp, Artificial Sequence
  chemically synthesized
attgttatcagtgattaacctg

SEQ ID NO: 799122 - DNA, 22 bp, Artificial Sequence
  chemically synthesized
ttgttatcagtgattaacctgc

SEQ ID NO: 799123 - DNA, 22 bp, Artificial Sequence
  chemically synthesized
ttaaatttagcagcaggttaat

SEQ ID NO: 799124 - DNA, 22 bp, Artificial Sequence
  chemically synthesized
cttaaatttagcagcaggttaa

SEQ ID NO: 799125 - DNA, 22 bp, Artificial Sequence
  chemically synthesized
ttatcagtgattaacctgctgc

SEQ ID NO: 799126 - DNA, 22 bp, Artificial Sequence
  chemically synthesized
tttcttaaatttagcagcaggt

SEQ ID NO: 799127 - DNA, 22 bp, Artificial Sequence
  chemically synthesized
tcagtgattaacctgctgctaa

SEQ ID NO: 799128 - DNA, 22 bp, Artificial Sequence
  chemically synthesized
tatttcttaaatttagcagcag

SEQ ID NO: 799129 - DNA, 22 bp, Artificial Sequence
  chemically synthesized
tctatttcttaaatttagcagc

SEQ ID NO: 799130 - DNA, 22 bp, Artificial Sequence
  chemically synthesized
acctgctgctaaatttaagaaa

SEQ ID NO: 799131 - DNA, 22 bp, Artificial Sequence
  chemically synthesized
ctgctaaatttaagaaatagag

SEQ ID NO: 799132 - DNA, 22 bp, Artificial Sequence
  chemically synthesized
ctaaatttaagaaatagagaat

SEQ ID NO: 799133 - DNA, 22 bp, Artificial Sequence
  chemically synthesized
aatttaagaaatagagaatctt

SEQ ID NO: 799134 - DNA, 22 bp, Artificial Sequence
  chemically synthesized
gaaaaaaaaagtaagattctct

SEQ ID NO: 799135 - DNA, 22 bp, Artificial Sequence
  chemically synthesized
aagaaatagagaatcttacttt

SEQ ID NO: 799136 - DNA, 22 bp, Artificial Sequence
  chemically synthesized
agaaatagagaatcttactttt

SEQ ID NO: 799137 - DNA, 22 bp, Artificial Sequence
  chemically synthesized
tacaagaatctggaaaaaaaaa

SEQ ID NO: 799138 - DNA, 22 bp, Artificial Sequence
  chemically synthesized
atacaagaatctggaaaaaaaa

SEQ ID NO: 799139 - DNA, 22 bp, Artificial Sequence
  chemically synthesized
cttatacaagaatctggaaaaa

SEQ ID NO: 799140 - DNA, 22 bp, Artificial Sequence
  chemically synthesized
attccttatacaagaatctgga

SEQ ID NO: 799141 - DNA, 22 bp, Artificial Sequence
  chemically synthesized
aattccttatacaagaatctgg

SEQ ID NO: 799142 - DNA, 22 bp, Artificial Sequence
  chemically synthesized
actttttttttccagattcttg

SEQ ID NO: 799143 - DNA, 22 bp, Artificial Sequence
  chemically synthesized
taattccttatacaagaatctg

SEQ ID NO: 799144 - DNA, 22 bp, Artificial Sequence
  chemically synthesized
ctttttttttccagattcttgt

SEQ ID NO: 799145 - DNA, 22 bp, Artificial Sequence
  chemically synthesized
ttaattccttatacaagaatct

SEQ ID NO: 799146 - DNA, 22 bp, Artificial Sequence
  chemically synthesized
tttttttccagattcttgtata

SEQ ID NO: 799147 - DNA, 22 bp, Artificial Sequence
  chemically synthesized
ttttttccagattcttgtataa

SEQ ID NO: 799148 - DNA, 22 bp, Artificial Sequence
  chemically synthesized
tttttccagattcttgtataag

SEQ ID NO: 799149 - DNA, 22 bp, Artificial Sequence
  chemically synthesized
ttttccagattcttgtataagg

SEQ ID NO: 799150 - DNA, 22 bp, Artificial Sequence
  chemically synthesized
tttccagattcttgtataagga

SEQ ID NO: 799151 - DNA, 22 bp, Artificial Sequence
  chemically synthesized
ttccagattcttgtataaggaa

SEQ ID NO: 799152 - DNA, 22 bp, Artificial Sequence
  chemically synthesized
tccagattcttgtataaggaat

SEQ ID NO: 799153 - DNA, 22 bp, Artificial Sequence
  chemically synthesized
ccagattcttgtataaggaatt

SEQ ID NO: 799154 - DNA, 22 bp, Artificial Sequence
  chemically synthesized
cagattcttgtataaggaatta

SEQ ID NO: 799155 - DNA, 22 bp, Artificial Sequence
  chemically synthesized
cagtaaaatatgtcttttaatt

SEQ ID NO: 799156 - DNA, 22 bp, Artificial Sequence
  chemically synthesized
ttgtataaggaattaaaagaca

SEQ ID NO: 799157 - DNA, 22 bp, Artificial Sequence
  chemically synthesized
gtataaggaattaaaagacata

SEQ ID NO: 799158 - DNA, 22 bp, Artificial Sequence
  chemically synthesized
cctccagtaaaatatgtctttt

SEQ ID NO: 799159 - DNA, 22 bp, Artificial Sequence
  chemically synthesized
tataaggaattaaaagacatat

SEQ ID NO: 799160 - DNA, 22 bp, Artificial Sequence
  chemically synthesized
aaggattgcctccagtaaaata

SEQ ID NO: 799161 - DNA, 22 bp, Artificial Sequence
  chemically synthesized
ttaaaggattgcctccagtaaa

SEQ ID NO: 799162 - DNA, 22 bp, Artificial Sequence
  chemically synthesized
aaagacatattttactggaggc

SEQ ID NO: 799163 - DNA, 22 bp, Artificial Sequence
  chemically synthesized
acatccgctgttaaaggattgc

SEQ ID NO: 799164 - DNA, 22 bp, Artificial Sequence
  chemically synthesized
tactggaggcaatcctttaaca

SEQ ID NO: 799165 - DNA, 22 bp, Artificial Sequence
  chemically synthesized
actggaggcaatcctttaacag

SEQ ID NO: 799166 - DNA, 22 bp, Artificial Sequence
  chemically synthesized
tactcacatccgctgttaaagg

SEQ ID NO: 799167 - DNA, 22 bp, Artificial Sequence
  chemically synthesized
ctggaggcaatcctttaacagc

SEQ ID NO: 799168 - DNA, 22 bp, Artificial Sequence
  chemically synthesized
gaggcaatcctttaacagcgga

SEQ ID NO: 799169 - DNA, 22 bp, Artificial Sequence
  chemically synthesized
cctatactcacatccgctgtta

SEQ ID NO: 799170 - DNA, 22 bp, Artificial Sequence
  chemically synthesized
catcagtctgcctatactcaca

SEQ ID NO: 799171 - DNA, 22 bp, Artificial Sequence
  chemically synthesized
taacagcggatgtgagtatagg

SEQ ID NO: 799172 - DNA, 22 bp, Artificial Sequence
  chemically synthesized
aacagcggatgtgagtataggc

SEQ ID NO: 799173 - DNA, 22 bp, Artificial Sequence
  chemically synthesized
acagcggatgtgagtataggca

SEQ ID NO: 799174 - DNA, 22 bp, Artificial Sequence
  chemically synthesized
gacattgcatcagtctgcctat

SEQ ID NO: 799175 - DNA, 22 bp, Artificial Sequence
  chemically synthesized
gactagacattgcatcagtctg

SEQ ID NO: 799176 - DNA, 22 bp, Artificial Sequence
  chemically synthesized
cctagactagacattgcatcag

SEQ ID NO: 799177 - DNA, 22 bp, Artificial Sequence
  chemically synthesized
ctccctagactagacattgcat

SEQ ID NO: 799178 - DNA, 22 bp, Artificial Sequence
  chemically synthesized
tgctccctagactagacattgc

SEQ ID NO: 799179 - DNA, 22 bp, Artificial Sequence
  chemically synthesized
atgcaatgtctagtctagggag

SEQ ID NO: 799180 - DNA, 22 bp, Artificial Sequence
  chemically synthesized
agatggcatgctctgctcccta

SEQ ID NO: 799181 - DNA, 22 bp, Artificial Sequence
  chemically synthesized
gtgactcagatggcatgctctg

SEQ ID NO: 799182 - DNA, 22 bp, Artificial Sequence
  chemically synthesized
gtctagggagcagagcatgcca

SEQ ID NO: 799183 - DNA, 22 bp, Artificial Sequence
  chemically synthesized
gggagcagagcatgccatctga

SEQ ID NO: 799184 - DNA, 22 bp, Artificial Sequence
  chemically synthesized
agtaagacaagactcgtgactc

SEQ ID NO: 799185 - DNA, 22 bp, Artificial Sequence
  chemically synthesized
cagagttgagtaagacaagact

SEQ ID NO: 799186 - DNA, 22 bp, Artificial Sequence
  chemically synthesized
agtcacgagtcttgtcttactc

SEQ ID NO: 799187 - DNA, 22 bp, Artificial Sequence
  chemically synthesized
aagtaagtaactccagagttga

SEQ ID NO: 799188 - DNA, 22 bp, Artificial Sequence
  chemically synthesized
caagtaagtaactccagagttg

SEQ ID NO: 799189 - DNA, 22 bp, Artificial Sequence
  chemically synthesized
ttcaagtaagtaactccagagt

SEQ ID NO: 799190 - DNA, 22 bp, Artificial Sequence
  chemically synthesized
gtcttactcaactctggagtta

SEQ ID NO: 799191 - DNA, 22 bp, Artificial Sequence
  chemically synthesized
tcttactcaactctggagttac

SEQ ID NO: 799192 - DNA, 22 bp, Artificial Sequence
  chemically synthesized
actcaactctggagttacttac

SEQ ID NO: 799193 - DNA, 22 bp, Artificial Sequence
  chemically synthesized
ctcaactctggagttacttact

SEQ ID NO: 799194 - DNA, 22 bp, Artificial Sequence
  chemically synthesized
aactctggagttacttacttga

SEQ ID NO: 799195 - DNA, 22 bp, Artificial Sequence
  chemically synthesized
tggagttacttacttgaagagc

SEQ ID NO: 799196 - DNA, 22 bp, Artificial Sequence
  chemically synthesized
ccatatagtatatgctcttcaa

SEQ ID NO: 799197 - DNA, 22 bp, Artificial Sequence
  chemically synthesized
gagttacttacttgaagagcat

SEQ ID NO: 799198 - DNA, 22 bp, Artificial Sequence
  chemically synthesized
taattcccatatagtatatgct

SEQ ID NO: 799199 - DNA, 22 bp, Artificial Sequence
  chemically synthesized
cttacttgaagagcatatacta

SEQ ID NO: 799200 - DNA, 22 bp, Artificial Sequence
  chemically synthesized
ataattcccatatagtatatgc

SEQ ID NO: 799201 - DNA, 22 bp, Artificial Sequence
  chemically synthesized
acttgaagagcatatactatat

SEQ ID NO: 799202 - DNA, 22 bp, Artificial Sequence
  chemically synthesized
cttgaagagcatatactatatg

SEQ ID NO: 799203 - DNA, 22 bp, Artificial Sequence
  chemically synthesized
tcttataattcccatatagtat

SEQ ID NO: 799204 - DNA, 22 bp, Artificial Sequence
  chemically synthesized
gaagagcatatactatatggga

SEQ ID NO: 799205 - DNA, 22 bp, Artificial Sequence
  chemically synthesized
aagagcatatactatatgggaa

SEQ ID NO: 799206 - DNA, 22 bp, Artificial Sequence
  chemically synthesized
ggggcagtgttgtcttataatt

SEQ ID NO: 799207 - DNA, 22 bp, Artificial Sequence
  chemically synthesized
aggggcagtgttgtcttataat

SEQ ID NO: 799208 - DNA, 22 bp, Artificial Sequence
  chemically synthesized
cttaggggcagtgttgtcttat

SEQ ID NO: 799209 - DNA, 22 bp, Artificial Sequence
  chemically synthesized
tatgggaattataagacaacac

SEQ ID NO: 799210 - DNA, 22 bp, Artificial Sequence
  chemically synthesized
ccaaactccttaggggcagtgt

SEQ ID NO: 799211 - DNA, 22 bp, Artificial Sequence
  chemically synthesized
cccaaactccttaggggcagtg

SEQ ID NO: 799212 - DNA, 22 bp, Artificial Sequence
  chemically synthesized
tcccaaactccttaggggcagt

SEQ ID NO: 799213 - DNA, 22 bp, Artificial Sequence
  chemically synthesized
taagacaacactgcccctaagg

SEQ ID NO: 799214 - DNA, 22 bp, Artificial Sequence
  chemically synthesized
cccctaaggagtttgggaaaat

SEQ ID NO: 799215 - DNA, 22 bp, Artificial Sequence
  chemically synthesized
gaaaagaaaataattttcccaa

SEQ ID NO: 799216 - DNA, 22 bp, Artificial Sequence
  chemically synthesized
tattggaaaagaaaataatttt

SEQ ID NO: 799217 - DNA, 22 bp, Artificial Sequence
  chemically synthesized
aggagtttgggaaaattatttt

SEQ ID NO: 799218 - DNA, 22 bp, Artificial Sequence
  chemically synthesized
catattgtattggaaaagaaaa

SEQ ID NO: 799219 - DNA, 22 bp, Artificial Sequence
  chemically synthesized
gcatattgtattggaaaagaaa

SEQ ID NO: 799220 - DNA, 22 bp, Artificial Sequence
  chemically synthesized
gggaaaattattttcttttcca

SEQ ID NO: 799221 - DNA, 22 bp, Artificial Sequence
  chemically synthesized
ggaaaattattttcttttccaa

SEQ ID NO: 799222 - DNA, 22 bp, Artificial Sequence
  chemically synthesized
ttgcatattgtattggaaaaga

SEQ ID NO: 799223 - DNA, 22 bp, Artificial Sequence
  chemically synthesized
cttgcatattgtattggaaaag

SEQ ID NO: 799224 - DNA, 22 bp, Artificial Sequence
  chemically synthesized
tcttgcatattgtattggaaaa

SEQ ID NO: 799225 - DNA, 22 bp, Artificial Sequence
  chemically synthesized
ttttcttttccaatacaatatg

SEQ ID NO: 799226 - DNA, 22 bp, Artificial Sequence
  chemically synthesized
tcttttccaatacaatatgcaa

SEQ ID NO: 799227 - DNA, 22 bp, Artificial Sequence
  chemically synthesized
cttttccaatacaatatgcaag

SEQ ID NO: 799228 - DNA, 22 bp, Artificial Sequence
  chemically synthesized
ttttccaatacaatatgcaaga

SEQ ID NO: 799229 - DNA, 22 bp, Artificial Sequence
  chemically synthesized
ttccaatacaatatgcaagaaa

SEQ ID NO: 799230 - DNA, 22 bp, Artificial Sequence
  chemically synthesized
tccaatacaatatgcaagaaaa

SEQ ID NO: 799231 - DNA, 22 bp, Artificial Sequence
  chemically synthesized
ccaatacaatatgcaagaaaat

SEQ ID NO: 799232 - DNA, 22 bp, Artificial Sequence
  chemically synthesized
atgatgtgaaatattttcttgc

SEQ ID NO: 799233 - DNA, 22 bp, Artificial Sequence
  chemically synthesized
caatacaatatgcaagaaaata

SEQ ID NO: 799234 - DNA, 22 bp, Artificial Sequence
  chemically synthesized
aatctcatgatgtgaaatattt

SEQ ID NO: 799235 - DNA, 22 bp, Artificial Sequence
  chemically synthesized
caggaagtgactaaatctcatg

SEQ ID NO: 799236 - DNA, 22 bp, Artificial Sequence
  chemically synthesized
acaggaagtgactaaatctcat

SEQ ID NO: 799237 - DNA, 22 bp, Artificial Sequence
  chemically synthesized
tcttacaggaagtgactaaatc

SEQ ID NO: 799238 - DNA, 22 bp, Artificial Sequence
  chemically synthesized
cacatcatgagatttagtcact

SEQ ID NO: 799239 - DNA, 22 bp, Artificial Sequence
  chemically synthesized
acatcatgagatttagtcactt

SEQ ID NO: 799240 - DNA, 22 bp, Artificial Sequence
  chemically synthesized
gttgtcttacaggaagtgacta

SEQ ID NO: 799241 - DNA, 22 bp, Artificial Sequence
  chemically synthesized
tggttgtcttacaggaagtgac

SEQ ID NO: 799242 - DNA, 22 bp, Artificial Sequence
  chemically synthesized
ctctggttgtcttacaggaagt

SEQ ID NO: 799243 - DNA, 22 bp, Artificial Sequence
  chemically synthesized
gctctggttgtcttacaggaag

SEQ ID NO: 799244 - DNA, 22 bp, Artificial Sequence
  chemically synthesized
tgctctggttgtcttacaggaa

SEQ ID NO: 799245 - DNA, 22 bp, Artificial Sequence
  chemically synthesized
ttgctctggttgtcttacagga

SEQ ID NO: 799246 - DNA, 22 bp, Artificial Sequence
  chemically synthesized
tttgctctggttgtcttacagg

SEQ ID NO: 799247 - DNA, 22 bp, Artificial Sequence
  chemically synthesized
agtcacttcctgtaagacaacc

SEQ ID NO: 799248 - DNA, 22 bp, Artificial Sequence
  chemically synthesized
gtcacttcctgtaagacaacca

SEQ ID NO: 799249 - DNA, 22 bp, Artificial Sequence
  chemically synthesized
agaagactttttgctctggttg

SEQ ID NO: 799250 - DNA, 22 bp, Artificial Sequence
  chemically synthesized
cctgtaagacaaccagagcaaa

SEQ ID NO: 799251 - DNA, 22 bp, Artificial Sequence
  chemically synthesized
ctgtaagacaaccagagcaaaa

SEQ ID NO: 799252 - DNA, 22 bp, Artificial Sequence
  chemically synthesized
actaagaagactttttgctctg

SEQ ID NO: 799253 - DNA, 22 bp, Artificial Sequence
  chemically synthesized
taagacaaccagagcaaaaagt

SEQ ID NO: 799254 - DNA, 22 bp, Artificial Sequence
  chemically synthesized
catggtgtatctgactaagaag

SEQ ID NO: 799255 - DNA, 22 bp, Artificial Sequence
  chemically synthesized
cctacatggtgtatctgactaa

SEQ ID NO: 799256 - DNA, 22 bp, Artificial Sequence
  chemically synthesized
gcctacatggtgtatctgacta

SEQ ID NO: 799257 - DNA, 22 bp, Artificial Sequence
  chemically synthesized
cttagtcagatacaccatgtag

SEQ ID NO: 799258 - DNA, 22 bp, Artificial Sequence
  chemically synthesized
ttagtcagatacaccatgtagg

SEQ ID NO: 799259 - DNA, 22 bp, Artificial Sequence
  chemically synthesized
agtcagatacaccatgtaggca

SEQ ID NO: 799260 - DNA, 22 bp, Artificial Sequence
  chemically synthesized
gtcagatacaccatgtaggcaa

SEQ ID NO: 799261 - DNA, 22 bp, Artificial Sequence
  chemically synthesized
ctctctcatcacctgtgcatgc

SEQ ID NO: 799262 - DNA, 22 bp, Artificial Sequence
  chemically synthesized
tctcatcacctgtgcatgcacg

SEQ ID NO: 799263 - DNA, 22 bp, Artificial Sequence
  chemically synthesized
tcatcacctgtgcatgcacgtg

SEQ ID NO: 799264 - DNA, 22 bp, Artificial Sequence
  chemically synthesized
atcacctgtgcatgcacgtgtg

SEQ ID NO: 799265 - DNA, 22 bp, Artificial Sequence
  chemically synthesized
tgcatgcacgtgtgtgtgcgtg

SEQ ID NO: 799266 - DNA, 22 bp, Artificial Sequence
  chemically synthesized
gaaacagacagaatgtgtacac

SEQ ID NO: 799267 - DNA, 22 bp, Artificial Sequence
  chemically synthesized
taattggaaacagacagaatgt

SEQ ID NO: 799268 - DNA, 22 bp, Artificial Sequence
  chemically synthesized
gtgtacacattctgtctgtttc

SEQ ID NO: 799269 - DNA, 22 bp, Artificial Sequence
  chemically synthesized
tgtacacattctgtctgtttcc

SEQ ID NO: 799270 - DNA, 22 bp, Artificial Sequence
  chemically synthesized
tgtctgtttccaattacaactt

SEQ ID NO: 799271 - DNA, 22 bp, Artificial Sequence
  chemically synthesized
tctgtttccaattacaacttac

SEQ ID NO: 799272 - DNA, 22 bp, Artificial Sequence
  chemically synthesized
tttccaattacaacttactttt

SEQ ID NO: 799273 - DNA, 22 bp, Artificial Sequence
  chemically synthesized
aaagacgagatgagaaaagtaa

SEQ ID NO: 799274 - DNA, 22 bp, Artificial Sequence
  chemically synthesized
ccaattacaacttacttttctc

SEQ ID NO: 799275 - DNA, 22 bp, Artificial Sequence
  chemically synthesized
gaaagacgagatgagaaaagta

SEQ ID NO: 799276 - DNA, 22 bp, Artificial Sequence
  chemically synthesized
caattacaacttacttttctca

SEQ ID NO: 799277 - DNA, 22 bp, Artificial Sequence
  chemically synthesized
caacttacttttctcatctcgt

SEQ ID NO: 799278 - DNA, 22 bp, Artificial Sequence
  chemically synthesized
acttttctcatctcgtctttca

SEQ ID NO: 799279 - DNA, 22 bp, Artificial Sequence
  chemically synthesized
cttttctcatctcgtctttcaa

SEQ ID NO: 799280 - DNA, 22 bp, Artificial Sequence
  chemically synthesized
ttctcatctcgtctttcaaatt

SEQ ID NO: 799281 - DNA, 22 bp, Artificial Sequence
  chemically synthesized
tctcatctcgtctttcaaattc

SEQ ID NO: 799282 - DNA, 22 bp, Artificial Sequence
  chemically synthesized
ctcatctcgtctttcaaattct

SEQ ID NO: 799283 - DNA, 22 bp, Artificial Sequence
  chemically synthesized
tcatctcgtctttcaaattctt

SEQ ID NO: 799284 - DNA, 22 bp, Artificial Sequence
  chemically synthesized
atctcgtctttcaaattcttgt

SEQ ID NO: 799285 - DNA, 22 bp, Artificial Sequence
  chemically synthesized
gtctttcaaattcttgtttttc

SEQ ID NO: 799286 - DNA, 22 bp, Artificial Sequence
  chemically synthesized
tcaaattcttgtttttctggtg

SEQ ID NO: 799287 - DNA, 22 bp, Artificial Sequence
  chemically synthesized
caaattcttgtttttctggtgg

SEQ ID NO: 799288 - DNA, 22 bp, Artificial Sequence
  chemically synthesized
aaattcttgtttttctggtggt

SEQ ID NO: 799289 - DNA, 22 bp, Artificial Sequence
  chemically synthesized
caaaaatggaacaccaccagaa

SEQ ID NO: 799290 - DNA, 22 bp, Artificial Sequence
  chemically synthesized
acaaaaatggaacaccaccaga

SEQ ID NO: 799291 - DNA, 22 bp, Artificial Sequence
  chemically synthesized
tttacaaaaatggaacaccacc

SEQ ID NO: 799292 - DNA, 22 bp, Artificial Sequence
  chemically synthesized
ttgtttttctggtggtgttcca

SEQ ID NO: 799293 - DNA, 22 bp, Artificial Sequence
  chemically synthesized
tatttacaaaaatggaacacca

SEQ ID NO: 799294 - DNA, 22 bp, Artificial Sequence
  chemically synthesized
ctatttacaaaaatggaacacc

SEQ ID NO: 799295 - DNA, 22 bp, Artificial Sequence
  chemically synthesized
gtttttctggtggtgttccatt

SEQ ID NO: 799296 - DNA, 22 bp, Artificial Sequence
  chemically synthesized
tctatttacaaaaatggaacac

SEQ ID NO: 799297 - DNA, 22 bp, Artificial Sequence
  chemically synthesized
tttttctggtggtgttccattt

SEQ ID NO: 799298 - DNA, 22 bp, Artificial Sequence
  chemically synthesized
ttctatttacaaaaatggaaca

SEQ ID NO: 799299 - DNA, 22 bp, Artificial Sequence
  chemically synthesized
ttctggtggtgttccatttttg

SEQ ID NO: 799300 - DNA, 22 bp, Artificial Sequence
  chemically synthesized
cttttctatttacaaaaatgga

SEQ ID NO: 799301 - DNA, 22 bp, Artificial Sequence
  chemically synthesized
tctggtggtgttccatttttgt

SEQ ID NO: 799302 - DNA, 22 bp, Artificial Sequence
  chemically synthesized
acttttctatttacaaaaatgg

SEQ ID NO: 799303 - DNA, 22 bp, Artificial Sequence
  chemically synthesized
ctggtggtgttccatttttgta

SEQ ID NO: 799304 - DNA, 22 bp, Artificial Sequence
  chemically synthesized
tacttttctatttacaaaaatg

SEQ ID NO: 799305 - DNA, 22 bp, Artificial Sequence
  chemically synthesized
tggtggtgttccatttttgtaa

SEQ ID NO: 799306 - DNA, 22 bp, Artificial Sequence
  chemically synthesized
ttacttttctatttacaaaaat

SEQ ID NO: 799307 - DNA, 22 bp, Artificial Sequence
  chemically synthesized
gtggtgttccatttttgtaaat

SEQ ID NO: 799308 - DNA, 22 bp, Artificial Sequence
  chemically synthesized
ttttacttttctatttacaaaa

SEQ ID NO: 799309 - DNA, 22 bp, Artificial Sequence
  chemically synthesized
cttttacttttctatttacaaa

SEQ ID NO: 799310 - DNA, 22 bp, Artificial Sequence
  chemically synthesized
ttcttttacttttctatttaca

SEQ ID NO: 799311 - DNA, 22 bp, Artificial Sequence
  chemically synthesized
catttttgtaaatagaaaagta

SEQ ID NO: 799312 - DNA, 22 bp, Artificial Sequence
  chemically synthesized
agcacactcttcttttactttt

SEQ ID NO: 799313 - DNA, 22 bp, Artificial Sequence
  chemically synthesized
aagcacactcttcttttacttt

SEQ ID NO: 799314 - DNA, 22 bp, Artificial Sequence
  chemically synthesized
ttgtaaatagaaaagtaaaaga

SEQ ID NO: 799315 - DNA, 22 bp, Artificial Sequence
  chemically synthesized
taagcacactcttcttttactt

SEQ ID NO: 799316 - DNA, 22 bp, Artificial Sequence
  chemically synthesized
tgtaaatagaaaagtaaaagaa

SEQ ID NO: 799317 - DNA, 22 bp, Artificial Sequence
  chemically synthesized
ttaagcacactcttcttttact

SEQ ID NO: 799318 - DNA, 22 bp, Artificial Sequence
  chemically synthesized
gtaaatagaaaagtaaaagaag

SEQ ID NO: 799319 - DNA, 22 bp, Artificial Sequence
  chemically synthesized
taaatagaaaagtaaaagaaga

SEQ ID NO: 799320 - DNA, 22 bp, Artificial Sequence
  chemically synthesized
agcaggtttttaagcacactct

SEQ ID NO: 799321 - DNA, 22 bp, Artificial Sequence
  chemically synthesized
tgagcaggtttttaagcacact

SEQ ID NO: 799322 - DNA, 22 bp, Artificial Sequence
  chemically synthesized
accctctgagcaggtttttaag

SEQ ID NO: 799323 - DNA, 22 bp, Artificial Sequence
  chemically synthesized
aaattcaccctctgagcaggtt

SEQ ID NO: 799324 - DNA, 22 bp, Artificial Sequence
  chemically synthesized
gaaattcaccctctgagcaggt

SEQ ID NO: 799325 - DNA, 22 bp, Artificial Sequence
  chemically synthesized
aaaaacctgctcagagggtgaa

SEQ ID NO: 799326 - DNA, 22 bp, Artificial Sequence
  chemically synthesized
aaaacctgctcagagggtgaat

SEQ ID NO: 799327 - DNA, 22 bp, Artificial Sequence
  chemically synthesized
atagagacgccaatttgaaatt

SEQ ID NO: 799328 - DNA, 22 bp, Artificial Sequence
  chemically synthesized
ctcagagggtgaatttcaaatt

SEQ ID NO: 799329 - DNA, 22 bp, Artificial Sequence
  chemically synthesized
taatagagacgccaatttgaaa

SEQ ID NO: 799330 - DNA, 22 bp, Artificial Sequence
  chemically synthesized
agagggtgaatttcaaattggc

SEQ ID NO: 799331 - DNA, 22 bp, Artificial Sequence
  chemically synthesized
gtcctctaatagagacgccaat

SEQ ID NO: 799332 - DNA, 22 bp, Artificial Sequence
  chemically synthesized
caaattggcgtctctattagag

SEQ ID NO: 799333 - DNA, 22 bp, Artificial Sequence
  chemically synthesized
aaattggcgtctctattagagg

SEQ ID NO: 799334 - DNA, 22 bp, Artificial Sequence
  chemically synthesized
gcgtctctattagaggactaat

SEQ ID NO: 799335 - DNA, 22 bp, Artificial Sequence
  chemically synthesized
cacatagaaagcaaattagtcc

SEQ ID NO: 799336 - DNA, 22 bp, Artificial Sequence
  chemically synthesized
tattagaggactaatttgcttt

SEQ ID NO: 799337 - DNA, 22 bp, Artificial Sequence
  chemically synthesized
ttagaggactaatttgctttct

SEQ ID NO: 799338 - DNA, 22 bp, Artificial Sequence
  chemically synthesized
gaggactaatttgctttctatg

SEQ ID NO: 799339 - DNA, 22 bp, Artificial Sequence
  chemically synthesized
atttgctttctatgtgcaatcc

SEQ ID NO: 799340 - DNA, 22 bp, Artificial Sequence
  chemically synthesized
gctttctatgtgcaatcctggt

SEQ ID NO: 799341 - DNA, 22 bp, Artificial Sequence
  chemically synthesized
ctttctatgtgcaatcctggtg

SEQ ID NO: 799342 - DNA, 22 bp, Artificial Sequence
  chemically synthesized
tctatgtgcaatcctggtgtga

SEQ ID NO: 799343 - DNA, 22 bp, Artificial Sequence
  chemically synthesized
ctatgtgcaatcctggtgtgat

SEQ ID NO: 799344 - DNA, 22 bp, Artificial Sequence
  chemically synthesized
tatgtgcaatcctggtgtgatc

SEQ ID NO: 799345 - DNA, 22 bp, Artificial Sequence
  chemically synthesized
tgtgcaatcctggtgtgatcac

SEQ ID NO: 799346 - DNA, 22 bp, Artificial Sequence
  chemically synthesized
aaatccagtaacatatgcaaca

SEQ ID NO: 799347 - DNA, 22 bp, Artificial Sequence
  chemically synthesized
gtgtgatcactgttgcatatgt

SEQ ID NO: 799348 - DNA, 22 bp, Artificial Sequence
  chemically synthesized
ttgcatatgttactggatttca

SEQ ID NO: 799349 - DNA, 22 bp, Artificial Sequence
  chemically synthesized
catatgttactggatttcaact

SEQ ID NO: 799350 - DNA, 22 bp, Artificial Sequence
  chemically synthesized
ggtaggggcagaggagttgaaa

SEQ ID NO: 799351 - DNA, 22 bp, Artificial Sequence
  chemically synthesized
aggtaggggcagaggagttgaa

SEQ ID NO: 799352 - DNA, 22 bp, Artificial Sequence
  chemically synthesized
ctggatttcaactcctctgccc

SEQ ID NO: 799353 - DNA, 22 bp, Artificial Sequence
  chemically synthesized
gatttcaactcctctgccccta

SEQ ID NO: 799354 - DNA, 22 bp, Artificial Sequence
  chemically synthesized
aaaatgagtttaggtaggggca

SEQ ID NO: 799355 - DNA, 22 bp, Artificial Sequence
  chemically synthesized
caactcctctgcccctacctaa

SEQ ID NO: 799356 - DNA, 22 bp, Artificial Sequence
  chemically synthesized
aactcctctgcccctacctaaa

SEQ ID NO: 799357 - DNA, 22 bp, Artificial Sequence
  chemically synthesized
ctctgcccctacctaaactcat

SEQ ID NO: 799358 - DNA, 22 bp, Artificial Sequence
  chemically synthesized
tgcccctacctaaactcatttt

SEQ ID NO: 799359 - DNA, 22 bp, Artificial Sequence
  chemically synthesized
cccctacctaaactcattttga

SEQ ID NO: 799360 - DNA, 22 bp, Artificial Sequence
  chemically synthesized
ccatgtgagagtctcaaaatga

SEQ ID NO: 799361 - DNA, 22 bp, Artificial Sequence
  chemically synthesized
cctaaactcattttgagactct

SEQ ID NO: 799362 - DNA, 22 bp, Artificial Sequence
  chemically synthesized
tcgacctaccatgtgagagtct

SEQ ID NO: 799363 - DNA, 22 bp, Artificial Sequence
  chemically synthesized
aactcattttgagactctcaca

SEQ ID NO: 799364 - DNA, 22 bp, Artificial Sequence
  chemically synthesized
attttgagactctcacatggta

SEQ ID NO: 799365 - DNA, 22 bp, Artificial Sequence
  chemically synthesized
aggctatcgacctaccatgtga

SEQ ID NO: 799366 - DNA, 22 bp, Artificial Sequence
  chemically synthesized
tgagactctcacatggtaggtc

SEQ ID NO: 799367 - DNA, 22 bp, Artificial Sequence
  chemically synthesized
gagactctcacatggtaggtcg

SEQ ID NO: 799368 - DNA, 22 bp, Artificial Sequence
  chemically synthesized
agactctcacatggtaggtcga

SEQ ID NO: 799369 - DNA, 22 bp, Artificial Sequence
  chemically synthesized
cataaaactcaggctatcgacc

SEQ ID NO: 799370 - DNA, 22 bp, Artificial Sequence
  chemically synthesized
tcacatggtaggtcgatagcct

SEQ ID NO: 799371 - DNA, 22 bp, Artificial Sequence
  chemically synthesized
acatggtaggtcgatagcctga

SEQ ID NO: 799372 - DNA, 22 bp, Artificial Sequence
  chemically synthesized
agctccataaaactcaggctat

SEQ ID NO: 799373 - DNA, 22 bp, Artificial Sequence
  chemically synthesized
gagctccataaaactcaggcta

SEQ ID NO: 799374 - DNA, 22 bp, Artificial Sequence
  chemically synthesized
agttttatggagctcaaatgct

SEQ ID NO: 799375 - DNA, 22 bp, Artificial Sequence
  chemically synthesized
acagaagtcatgtcagcatttg

SEQ ID NO: 799376 - DNA, 22 bp, Artificial Sequence
  chemically synthesized
tatggagctcaaatgctgacat

SEQ ID NO: 799377 - DNA, 22 bp, Artificial Sequence
  chemically synthesized
atggagctcaaatgctgacatg

SEQ ID NO: 799378 - DNA, 22 bp, Artificial Sequence
  chemically synthesized
tggagctcaaatgctgacatga

SEQ ID NO: 799379 - DNA, 22 bp, Artificial Sequence
  chemically synthesized
aaatgctgacatgacttctgtc

SEQ ID NO: 799380 - DNA, 22 bp, Artificial Sequence
  chemically synthesized
acatgacttctgtcagacttct

SEQ ID NO: 799381 - DNA, 22 bp, Artificial Sequence
  chemically synthesized
accaaatgtgacaccagaagtc

SEQ ID NO: 799382 - DNA, 22 bp, Artificial Sequence
  chemically synthesized
caccaaatgtgacaccagaagt

SEQ ID NO: 799383 - DNA, 22 bp, Artificial Sequence
  chemically synthesized
ctgtcagacttctggtgtcaca

SEQ ID NO: 799384 - DNA, 22 bp, Artificial Sequence
  chemically synthesized
tgtcagacttctggtgtcacat

SEQ ID NO: 799385 - DNA, 22 bp, Artificial Sequence
  chemically synthesized
gtgcttcaccaaatgtgacacc

SEQ ID NO: 799386 - DNA, 22 bp, Artificial Sequence
  chemically synthesized
tcagacttctggtgtcacattt

SEQ ID NO: 799387 - DNA, 22 bp, Artificial Sequence
  chemically synthesized
ctggtgcttcaccaaatgtgac

SEQ ID NO: 799388 - DNA, 22 bp, Artificial Sequence
  chemically synthesized
tcctggtgcttcaccaaatgtg

SEQ ID NO: 799389 - DNA, 22 bp, Artificial Sequence
  chemically synthesized
ctggtgtcacatttggtgaagc

SEQ ID NO: 799390 - DNA, 22 bp, Artificial Sequence
  chemically synthesized
tggtgtcacatttggtgaagca

SEQ ID NO: 799391 - DNA, 22 bp, Artificial Sequence
  chemically synthesized
gtgtcacatttggtgaagcacc

SEQ ID NO: 799392 - DNA, 22 bp, Artificial Sequence
  chemically synthesized
ggtgaagcaccaggagaatatt

SEQ ID NO: 799393 - DNA, 22 bp, Artificial Sequence
  chemically synthesized
gtgaagcaccaggagaatattc

SEQ ID NO: 799394 - DNA, 22 bp, Artificial Sequence
  chemically synthesized
gtgaaacaaaggaaagagaaat

SEQ ID NO: 799395 - DNA, 22 bp, Artificial Sequence
  chemically synthesized
gcctagtgaaacaaaggaaaga

SEQ ID NO: 799396 - DNA, 22 bp, Artificial Sequence
  chemically synthesized
taccatatttctctttcctttg

SEQ ID NO: 799397 - DNA, 22 bp, Artificial Sequence
  chemically synthesized
tggcctagtgaaacaaaggaaa

SEQ ID NO: 799398 - DNA, 22 bp, Artificial Sequence
  chemically synthesized
ccatatttctctttcctttgtt

SEQ ID NO: 799399 - DNA, 22 bp, Artificial Sequence
  chemically synthesized
ctctggcctagtgaaacaaagg

SEQ ID NO: 799400 - DNA, 22 bp, Artificial Sequence
  chemically synthesized
ctctttcctttgtttcactagg

SEQ ID NO: 799401 - DNA, 22 bp, Artificial Sequence
  chemically synthesized
tctttcctttgtttcactaggc

SEQ ID NO: 799402 - DNA, 22 bp, Artificial Sequence
  chemically synthesized
tttcctttgtttcactaggcca

SEQ ID NO: 799403 - DNA, 22 bp, Artificial Sequence
  chemically synthesized
tcctttgtttcactaggccaga

SEQ ID NO: 799404 - DNA, 22 bp, Artificial Sequence
  chemically synthesized
cctttgtttcactaggccagag

SEQ ID NO: 799405 - DNA, 22 bp, Artificial Sequence
  chemically synthesized
ctttgtttcactaggccagagt

SEQ ID NO: 799406 - DNA, 22 bp, Artificial Sequence
  chemically synthesized
tgtttcactaggccagagtagt

SEQ ID NO: 799407 - DNA, 22 bp, Artificial Sequence
  chemically synthesized
gtttcactaggccagagtagtc

SEQ ID NO: 799408 - DNA, 22 bp, Artificial Sequence
  chemically synthesized
tttcactaggccagagtagtcc

SEQ ID NO: 799409 - DNA, 22 bp, Artificial Sequence
  chemically synthesized
cactaggccagagtagtcctct

SEQ ID NO: 799410 - DNA, 22 bp, Artificial Sequence
  chemically synthesized
actaggccagagtagtcctctc

SEQ ID NO: 799411 - DNA, 22 bp, Artificial Sequence
  chemically synthesized
ataacccaagggagagaggact

SEQ ID NO: 799412 - DNA, 22 bp, Artificial Sequence
  chemically synthesized
ggccagagtagtcctctctccc

SEQ ID NO: 799413 - DNA, 22 bp, Artificial Sequence
  chemically synthesized
gtgtgtaaagtctgataaccca

SEQ ID NO: 799414 - DNA, 22 bp, Artificial Sequence
  chemically synthesized
ctagtgtgtaaagtctgataac

SEQ ID NO: 799415 - DNA, 22 bp, Artificial Sequence
  chemically synthesized
gctagtgtgtaaagtctgataa

SEQ ID NO: 799416 - DNA, 22 bp, Artificial Sequence
  chemically synthesized
tctcccttgggttatcagactt

SEQ ID NO: 799417 - DNA, 22 bp, Artificial Sequence
  chemically synthesized
tgctagtgtgtaaagtctgata

SEQ ID NO: 799418 - DNA, 22 bp, Artificial Sequence
  chemically synthesized
tcccttgggttatcagacttta

SEQ ID NO: 799419 - DNA, 22 bp, Artificial Sequence
  chemically synthesized
ccttgggttatcagactttaca

SEQ ID NO: 799420 - DNA, 22 bp, Artificial Sequence
  chemically synthesized
gggttatcagactttacacact

SEQ ID NO: 799421 - DNA, 22 bp, Artificial Sequence
  chemically synthesized
ggttatcagactttacacacta

SEQ ID NO: 799422 - DNA, 22 bp, Artificial Sequence
  chemically synthesized
tcagactttacacactagcaaa

SEQ ID NO: 799423 - DNA, 22 bp, Artificial Sequence
  chemically synthesized
tacacactagcaaagcatatga

SEQ ID NO: 799424 - DNA, 22 bp, Artificial Sequence
  chemically synthesized
acacactagcaaagcatatgat

SEQ ID NO: 799425 - DNA, 22 bp, Artificial Sequence
  chemically synthesized
cacactagcaaagcatatgatt

SEQ ID NO: 799426 - DNA, 22 bp, Artificial Sequence
  chemically synthesized
gcaaagcatatgattggcattt

SEQ ID NO: 799427 - DNA, 22 bp, Artificial Sequence
  chemically synthesized
gcatttttctcttgcttattac

SEQ ID NO: 799428 - DNA, 22 bp, Artificial Sequence
  chemically synthesized
ttctcttgcttattacccactc

SEQ ID NO: 799429 - DNA, 22 bp, Artificial Sequence
  chemically synthesized
tctcttgcttattacccactcc

SEQ ID NO: 799430 - DNA, 22 bp, Artificial Sequence
  chemically synthesized
ctcttgcttattacccactcca

SEQ ID NO: 799431 - DNA, 22 bp, Artificial Sequence
  chemically synthesized
tcttgcttattacccactccat

SEQ ID NO: 799432 - DNA, 22 bp, Artificial Sequence
  chemically synthesized
ttgcttattacccactccattc

SEQ ID NO: 799433 - DNA, 22 bp, Artificial Sequence
  chemically synthesized
gcttattacccactccattcct

SEQ ID NO: 799434 - DNA, 22 bp, Artificial Sequence
  chemically synthesized
cttattacccactccattcctc

SEQ ID NO: 799435 - DNA, 22 bp, Artificial Sequence
  chemically synthesized
attacccactccattcctctct

SEQ ID NO: 799436 - DNA, 22 bp, Artificial Sequence
  chemically synthesized
ttacccactccattcctctctc

SEQ ID NO: 799437 - DNA, 22 bp, Artificial Sequence
  chemically synthesized
cccactccattcctctctctct

SEQ ID NO: 799438 - DNA, 22 bp, Artificial Sequence
  chemically synthesized
cattcctctctctctgtctctc

SEQ ID NO: 799439 - DNA, 22 bp, Artificial Sequence
  chemically synthesized
ctctctctctgtctctctctct

SEQ ID NO: 799440 - DNA, 22 bp, Artificial Sequence
  chemically synthesized
tctctctgtctctctctctccc

SEQ ID NO: 799441 - DNA, 22 bp, Artificial Sequence
  chemically synthesized
tctctgtctctctctctccctc

SEQ ID NO: 799442 - DNA, 22 bp, Artificial Sequence
  chemically synthesized
tctgtctctctctctccctctc

SEQ ID NO: 799443 - DNA, 22 bp, Artificial Sequence
  chemically synthesized
tgtctctctctctccctctcct

SEQ ID NO: 799444 - DNA, 22 bp, Artificial Sequence
  chemically synthesized
tctctctctctccctctccttc

SEQ ID NO: 799445 - DNA, 22 bp, Artificial Sequence
  chemically synthesized
tctctctccctctccttcccat

SEQ ID NO: 799446 - DNA, 22 bp, Artificial Sequence
  chemically synthesized
tctctccctctccttcccattc

SEQ ID NO: 799447 - DNA, 22 bp, Artificial Sequence
  chemically synthesized
tctccctctccttcccattctc

SEQ ID NO: 799448 - DNA, 22 bp, Artificial Sequence
  chemically synthesized
tccctctccttcccattctccc

SEQ ID NO: 799449 - DNA, 22 bp, Artificial Sequence
  chemically synthesized
cctctccttcccattctccctc

SEQ ID NO: 799450 - DNA, 22 bp, Artificial Sequence
  chemically synthesized
tccttcccattctccctctgtc

SEQ ID NO: 799451 - DNA, 22 bp, Artificial Sequence
  chemically synthesized
cttcccattctccctctgtcct

SEQ ID NO: 799452 - DNA, 22 bp, Artificial Sequence
  chemically synthesized
cccattctccctctgtccttcc

SEQ ID NO: 799453 - DNA, 22 bp, Artificial Sequence
  chemically synthesized
ccattctccctctgtccttcct

SEQ ID NO: 799454 - DNA, 22 bp, Artificial Sequence
  chemically synthesized
tccctctgtccttcctgttctc

SEQ ID NO: 799455 - DNA, 22 bp, Artificial Sequence
  chemically synthesized
cctctgtccttcctgttctccc

SEQ ID NO: 799456 - DNA, 22 bp, Artificial Sequence
  chemically synthesized
tgtccttcctgttctccctctc

SEQ ID NO: 799457 - DNA, 22 bp, Artificial Sequence
  chemically synthesized
tccttcctgttctccctctctc

SEQ ID NO: 799458 - DNA, 22 bp, Artificial Sequence
  chemically synthesized
cctgttctccctctctcctttc

SEQ ID NO: 799459 - DNA, 22 bp, Artificial Sequence
  chemically synthesized
ctgttctccctctctcctttct

SEQ ID NO: 799460 - DNA, 22 bp, Artificial Sequence
  chemically synthesized
ttctccctctctcctttctatc

SEQ ID NO: 799461 - DNA, 22 bp, Artificial Sequence
  chemically synthesized
tccctctctcctttctatcctc

SEQ ID NO: 799462 - DNA, 22 bp, Artificial Sequence
  chemically synthesized
cctctctcctttctatcctccc

SEQ ID NO: 799463 - DNA, 22 bp, Artificial Sequence
  chemically synthesized
tctcctttctatcctccctctc

SEQ ID NO: 799464 - DNA, 22 bp, Artificial Sequence
  chemically synthesized
tcctttctatcctccctctctc

SEQ ID NO: 799465 - DNA, 22 bp, Artificial Sequence
  chemically synthesized
ctttctatcctccctctctcct

SEQ ID NO: 799466 - DNA, 22 bp, Artificial Sequence
  chemically synthesized
tctatcctccctctctccttca

SEQ ID NO: 799467 - DNA, 22 bp, Artificial Sequence
  chemically synthesized
ctatcctccctctctccttcac

SEQ ID NO: 799468 - DNA, 22 bp, Artificial Sequence
  chemically synthesized
tatcctccctctctccttcaca

SEQ ID NO: 799469 - DNA, 22 bp, Artificial Sequence
  chemically synthesized
tcctccctctctccttcacact

SEQ ID NO: 799470 - DNA, 22 bp, Artificial Sequence
  chemically synthesized
cctctctccttcacacttctct

SEQ ID NO: 799471 - DNA, 22 bp, Artificial Sequence
  chemically synthesized
tctccttcacacttctcttctc

SEQ ID NO: 799472 - DNA, 22 bp, Artificial Sequence
  chemically synthesized
tccttcacacttctcttctcct

SEQ ID NO: 799473 - DNA, 22 bp, Artificial Sequence
  chemically synthesized
gagagacagagagaggagaaga

SEQ ID NO: 799474 - DNA, 22 bp, Artificial Sequence
  chemically synthesized
cttcacacttctcttctcctct

SEQ ID NO: 799475 - DNA, 22 bp, Artificial Sequence
  chemically synthesized
agagagacagagagaggagaag

SEQ ID NO: 799476 - DNA, 22 bp, Artificial Sequence
  chemically synthesized
tagagagacagagagaggagaa

SEQ ID NO: 799477 - DNA, 22 bp, Artificial Sequence
  chemically synthesized
cacacttctcttctcctctctc

SEQ ID NO: 799478 - DNA, 22 bp, Artificial Sequence
  chemically synthesized
acacttctcttctcctctctct

SEQ ID NO: 799479 - DNA, 22 bp, Artificial Sequence
  chemically synthesized
attttagagagacagagagagg

SEQ ID NO: 799480 - DNA, 22 bp, Artificial Sequence
  chemically synthesized
gttgattttagagagacagaga

SEQ ID NO: 799481 - DNA, 22 bp, Artificial Sequence
  chemically synthesized
ctcttctcctctctctgtctct

SEQ ID NO: 799482 - DNA, 22 bp, Artificial Sequence
  chemically synthesized
tcttctcctctctctgtctctc

SEQ ID NO: 799483 - DNA, 22 bp, Artificial Sequence
  chemically synthesized
ttctcctctctctgtctctcta

SEQ ID NO: 799484 - DNA, 22 bp, Artificial Sequence
  chemically synthesized
ctcctctctctgtctctctaaa

SEQ ID NO: 799485 - DNA, 22 bp, Artificial Sequence
  chemically synthesized
tcctctctctgtctctctaaaa

SEQ ID NO: 799486 - DNA, 22 bp, Artificial Sequence
  chemically synthesized
ctctctctgtctctctaaaatc

SEQ ID NO: 799487 - DNA, 22 bp, Artificial Sequence
  chemically synthesized
tctctgtctctctaaaatcaac

SEQ ID NO: 799488 - DNA, 22 bp, Artificial Sequence
  chemically synthesized
tctgtctctctaaaatcaacta

SEQ ID NO: 799489 - DNA, 22 bp, Artificial Sequence
  chemically synthesized
tgtctctctaaaatcaactaat

SEQ ID NO: 799490 - DNA, 22 bp, Artificial Sequence
  chemically synthesized
aaatggaaaataattagttgat

SEQ ID NO: 799491 - DNA, 22 bp, Artificial Sequence
  chemically synthesized
tctctctaaaatcaactaatta

SEQ ID NO: 799492 - DNA, 22 bp, Artificial Sequence
  chemically synthesized
tctaaaatcaactaattatttt

SEQ ID NO: 799493 - DNA, 22 bp, Artificial Sequence
  chemically synthesized
taaaatcaactaattattttcc

SEQ ID NO: 799494 - DNA, 22 bp, Artificial Sequence
  chemically synthesized
aaatcaactaattattttccat

SEQ ID NO: 799495 - DNA, 22 bp, Artificial Sequence
  chemically synthesized
tgaatgtgattaaaatggaaaa

SEQ ID NO: 799496 - DNA, 22 bp, Artificial Sequence
  chemically synthesized
atgaatgtgattaaaatggaaa

SEQ ID NO: 799497 - DNA, 22 bp, Artificial Sequence
  chemically synthesized
acttatgaatgtgattaaaatg

SEQ ID NO: 799498 - DNA, 22 bp, Artificial Sequence
  chemically synthesized
attattttccattttaatcaca

SEQ ID NO: 799499 - DNA, 22 bp, Artificial Sequence
  chemically synthesized
ttttccattttaatcacattca

SEQ ID NO: 799500 - DNA, 22 bp, Artificial Sequence
  chemically synthesized
tccattttaatcacattcataa

SEQ ID NO: 799501 - DNA, 22 bp, Artificial Sequence
  chemically synthesized
ccattttaatcacattcataag

SEQ ID NO: 799502 - DNA, 22 bp, Artificial Sequence
  chemically synthesized
cattttaatcacattcataagt

SEQ ID NO: 799503 - DNA, 22 bp, Artificial Sequence
  chemically synthesized
cacataaaatatattgacttat

SEQ ID NO: 799504 - DNA, 22 bp, Artificial Sequence
  chemically synthesized
taatcacattcataagtcaata

SEQ ID NO: 799505 - DNA, 22 bp, Artificial Sequence
  chemically synthesized
gcacataaaatatattgactta

SEQ ID NO: 799506 - DNA, 22 bp, Artificial Sequence
  chemically synthesized
aatcacattcataagtcaatat

SEQ ID NO: 799507 - DNA, 22 bp, Artificial Sequence
  chemically synthesized
tgcacataaaatatattgactt

SEQ ID NO: 799508 - DNA, 22 bp, Artificial Sequence
  chemically synthesized
atcacattcataagtcaatata

SEQ ID NO: 799509 - DNA, 22 bp, Artificial Sequence
  chemically synthesized
tttgcacataaaatatattgac

SEQ ID NO: 799510 - DNA, 22 bp, Artificial Sequence
  chemically synthesized
ctttgcacataaaatatattga

SEQ ID NO: 799511 - DNA, 22 bp, Artificial Sequence
  chemically synthesized
ataagtcaatatattttatgtg

SEQ ID NO: 799512 - DNA, 22 bp, Artificial Sequence
  chemically synthesized
aatatgtatttctttgcacata

SEQ ID NO: 799513 - DNA, 22 bp, Artificial Sequence
  chemically synthesized
gaatatgtatttctttgcacat

SEQ ID NO: 799514 - DNA, 22 bp, Artificial Sequence
  chemically synthesized
ttgaatatgtatttctttgcac

SEQ ID NO: 799515 - DNA, 22 bp, Artificial Sequence
  chemically synthesized
cttgaatatgtatttctttgca

SEQ ID NO: 799516 - DNA, 22 bp, Artificial Sequence
  chemically synthesized
tcttgaatatgtatttctttgc

SEQ ID NO: 799517 - DNA, 22 bp, Artificial Sequence
  chemically synthesized
ttcttgaatatgtatttctttg

SEQ ID NO: 799518 - DNA, 22 bp, Artificial Sequence
  chemically synthesized
tttcttgaatatgtatttcttt

SEQ ID NO: 799519 - DNA, 22 bp, Artificial Sequence
  chemically synthesized
ttttcttgaatatgtatttctt

SEQ ID NO: 799520 - DNA, 22 bp, Artificial Sequence
  chemically synthesized
tatgtgcaaagaaatacatatt

SEQ ID NO: 799521 - DNA, 22 bp, Artificial Sequence
  chemically synthesized
atgtgcaaagaaatacatattc

SEQ ID NO: 799522 - DNA, 22 bp, Artificial Sequence
  chemically synthesized
aacttttttcttgaatatgtat

SEQ ID NO: 799523 - DNA, 22 bp, Artificial Sequence
  chemically synthesized
tgtgcaaagaaatacatattca

SEQ ID NO: 799524 - DNA, 22 bp, Artificial Sequence
  chemically synthesized
gaacttttttcttgaatatgta

SEQ ID NO: 799525 - DNA, 22 bp, Artificial Sequence
  chemically synthesized
tttgaacttttttcttgaatat

SEQ ID NO: 799526 - DNA, 22 bp, Artificial Sequence
  chemically synthesized
atttgaacttttttcttgaata

SEQ ID NO: 799527 - DNA, 22 bp, Artificial Sequence
  chemically synthesized
cttatttgaacttttttcttga

SEQ ID NO: 799528 - DNA, 22 bp, Artificial Sequence
  chemically synthesized
acttatttgaacttttttcttg

SEQ ID NO: 799529 - DNA, 22 bp, Artificial Sequence
  chemically synthesized
tacttatttgaacttttttctt

SEQ ID NO: 799530 - DNA, 22 bp, Artificial Sequence
  chemically synthesized
tcgttttacttatttgaacttt

SEQ ID NO: 799531 - DNA, 22 bp, Artificial Sequence
  chemically synthesized
ttgtcgttttacttatttgaac

SEQ ID NO: 799532 - DNA, 22 bp, Artificial Sequence
  chemically synthesized
gttgtcgttttacttatttgaa

SEQ ID NO: 799533 - DNA, 22 bp, Artificial Sequence
  chemically synthesized
tgttgtcgttttacttatttga

SEQ ID NO: 799534 - DNA, 22 bp, Artificial Sequence
  chemically synthesized
aagaaaaaagttcaaataagta

SEQ ID NO: 799535 - DNA, 22 bp, Artificial Sequence
  chemically synthesized
ttgttgtcgttttacttatttg

SEQ ID NO: 799536 - DNA, 22 bp, Artificial Sequence
  chemically synthesized
aaacaggtttttgttgtcgttt

SEQ ID NO: 799537 - DNA, 22 bp, Artificial Sequence
  chemically synthesized
tgaaacaggtttttgttgtcgt

SEQ ID NO: 799538 - DNA, 22 bp, Artificial Sequence
  chemically synthesized
aaataagtaaaacgacaacaaa

SEQ ID NO: 799539 - DNA, 22 bp, Artificial Sequence
  chemically synthesized
ttctgaaacaggtttttgttgt

SEQ ID NO: 799540 - DNA, 22 bp, Artificial Sequence
  chemically synthesized
attctgaaacaggtttttgttg

SEQ ID NO: 799541 - DNA, 22 bp, Artificial Sequence
  chemically synthesized
tattctgaaacaggtttttgtt

SEQ ID NO: 799542 - DNA, 22 bp, Artificial Sequence
  chemically synthesized
ttttattctgaaacaggttttt

SEQ ID NO: 799543 - DNA, 22 bp, Artificial Sequence
  chemically synthesized
gcaaagaagattattttattct

SEQ ID NO: 799544 - DNA, 22 bp, Artificial Sequence
  chemically synthesized
tagcaaagaagattattttatt

SEQ ID NO: 799545 - DNA, 22 bp, Artificial Sequence
  chemically synthesized
gttctagcaaagaagattattt

SEQ ID NO: 799546 - DNA, 22 bp, Artificial Sequence
  chemically synthesized
tttcagaataaaataatcttct

SEQ ID NO: 799547 - DNA, 22 bp, Artificial Sequence
  chemically synthesized
gttagttctagcaaagaagatt

SEQ ID NO: 799548 - DNA, 22 bp, Artificial Sequence
  chemically synthesized
cagaataaaataatcttctttg

SEQ ID NO: 799549 - DNA, 22 bp, Artificial Sequence
  chemically synthesized
ggttagttctagcaaagaagat

SEQ ID NO: 799550 - DNA, 22 bp, Artificial Sequence
  chemically synthesized
agaataaaataatcttctttgc

SEQ ID NO: 799551 - DNA, 22 bp, Artificial Sequence
  chemically synthesized
gaacttggttagttctagcaaa

SEQ ID NO: 799552 - DNA, 22 bp, Artificial Sequence
  chemically synthesized
ctttgctagaactaaccaagtt

SEQ ID NO: 799553 - DNA, 22 bp, Artificial Sequence
  chemically synthesized
tttgctagaactaaccaagttc

SEQ ID NO: 799554 - DNA, 22 bp, Artificial Sequence
  chemically synthesized
aagacaccagctagaacttggt

SEQ ID NO: 799555 - DNA, 22 bp, Artificial Sequence
  chemically synthesized
tgctagaactaaccaagttcta

SEQ ID NO: 799556 - DNA, 22 bp, Artificial Sequence
  chemically synthesized
aaagacaccagctagaacttgg

SEQ ID NO: 799557 - DNA, 22 bp, Artificial Sequence
  chemically synthesized
gctagaactaaccaagttctag

SEQ ID NO: 799558 - DNA, 22 bp, Artificial Sequence
  chemically synthesized
ctagaactaaccaagttctagc

SEQ ID NO: 799559 - DNA, 22 bp, Artificial Sequence
  chemically synthesized
gaactaaccaagttctagctgg

SEQ ID NO: 799560 - DNA, 22 bp, Artificial Sequence
  chemically synthesized
tgtcttaaagacaccagctaga

SEQ ID NO: 799561 - DNA, 22 bp, Artificial Sequence
  chemically synthesized
gtgtcttaaagacaccagctag

SEQ ID NO: 799562 - DNA, 22 bp, Artificial Sequence
  chemically synthesized
accaagttctagctggtgtctt

SEQ ID NO: 799563 - DNA, 22 bp, Artificial Sequence
  chemically synthesized
gccaaatttgtgtcttaaagac

SEQ ID NO: 799564 - DNA, 22 bp, Artificial Sequence
  chemically synthesized
tagccaaatttgtgtcttaaag

SEQ ID NO: 799565 - DNA, 22 bp, Artificial Sequence
  chemically synthesized
ctagccaaatttgtgtcttaaa

SEQ ID NO: 799566 - DNA, 22 bp, Artificial Sequence
  chemically synthesized
tagctggtgtctttaagacaca

SEQ ID NO: 799567 - DNA, 22 bp, Artificial Sequence
  chemically synthesized
tctagccaaatttgtgtcttaa

SEQ ID NO: 799568 - DNA, 22 bp, Artificial Sequence
  chemically synthesized
gctggtgtctttaagacacaaa

SEQ ID NO: 799569 - DNA, 22 bp, Artificial Sequence
  chemically synthesized
gtgtctttaagacacaaatttg

SEQ ID NO: 799570 - DNA, 22 bp, Artificial Sequence
  chemically synthesized
gtaactttctagccaaatttgt

SEQ ID NO: 799571 - DNA, 22 bp, Artificial Sequence
  chemically synthesized
attagtaactttctagccaaat

SEQ ID NO: 799572 - DNA, 22 bp, Artificial Sequence
  chemically synthesized
taagacacaaatttggctagaa

SEQ ID NO: 799573 - DNA, 22 bp, Artificial Sequence
  chemically synthesized
aagacacaaatttggctagaaa

SEQ ID NO: 799574 - DNA, 22 bp, Artificial Sequence
  chemically synthesized
agacacaaatttggctagaaag

SEQ ID NO: 799575 - DNA, 22 bp, Artificial Sequence
  chemically synthesized
caaattaattagtaactttcta

SEQ ID NO: 799576 - DNA, 22 bp, Artificial Sequence
  chemically synthesized
acaaattaattagtaactttct

SEQ ID NO: 799577 - DNA, 22 bp, Artificial Sequence
  chemically synthesized
tacaaattaattagtaactttc

SEQ ID NO: 799578 - DNA, 22 bp, Artificial Sequence
  chemically synthesized
ggctagaaagttactaattaat

SEQ ID NO: 799579 - DNA, 22 bp, Artificial Sequence
  chemically synthesized
gctagaaagttactaattaatt

SEQ ID NO: 799580 - DNA, 22 bp, Artificial Sequence
  chemically synthesized
aggtatattttacaaattaatt

SEQ ID NO: 799581 - DNA, 22 bp, Artificial Sequence
  chemically synthesized
caggtatattttacaaattaat

SEQ ID NO: 799582 - DNA, 22 bp, Artificial Sequence
  chemically synthesized
gaaagttactaattaatttgta

SEQ ID NO: 799583 - DNA, 22 bp, Artificial Sequence
  chemically synthesized
cttcaggtatattttacaaatt

SEQ ID NO: 799584 - DNA, 22 bp, Artificial Sequence
  chemically synthesized
ctaattaatttgtaaaatatac

SEQ ID NO: 799585 - DNA, 22 bp, Artificial Sequence
  chemically synthesized
attaatttgtaaaatatacctg

SEQ ID NO: 799586 - DNA, 22 bp, Artificial Sequence
  chemically synthesized
atttgtaaaatatacctgaagg

SEQ ID NO: 799587 - DNA, 22 bp, Artificial Sequence
  chemically synthesized
gtaaaatatacctgaaggagtt

SEQ ID NO: 799588 - DNA, 22 bp, Artificial Sequence
  chemically synthesized
taaaatatacctgaaggagttg

SEQ ID NO: 799589 - DNA, 22 bp, Artificial Sequence
  chemically synthesized
agtatcccgtaaaaggcacaac

SEQ ID NO: 799590 - DNA, 22 bp, Artificial Sequence
  chemically synthesized
tctaagtatcccgtaaaaggca

SEQ ID NO: 799591 - DNA, 22 bp, Artificial Sequence
  chemically synthesized
aaggagttgtgccttttacggg

SEQ ID NO: 799592 - DNA, 22 bp, Artificial Sequence
  chemically synthesized
tgccttttacgggatacttaga

SEQ ID NO: 799593 - DNA, 22 bp, Artificial Sequence
  chemically synthesized
atggtgaatagattatctaagt

SEQ ID NO: 799594 - DNA, 22 bp, Artificial Sequence
  chemically synthesized
ttacgggatacttagataatct

SEQ ID NO: 799595 - DNA, 22 bp, Artificial Sequence
  chemically synthesized
tacgggatacttagataatcta

SEQ ID NO: 799596 - DNA, 22 bp, Artificial Sequence
  chemically synthesized
actgatggtgaatagattatct

SEQ ID NO: 799597 - DNA, 22 bp, Artificial Sequence
  chemically synthesized
acgggatacttagataatctat

SEQ ID NO: 799598 - DNA, 22 bp, Artificial Sequence
  chemically synthesized
cgggatacttagataatctatt

SEQ ID NO: 799599 - DNA, 22 bp, Artificial Sequence
  chemically synthesized
cccacccctgactgatggtgaa

SEQ ID NO: 799600 - DNA, 22 bp, Artificial Sequence
  chemically synthesized
agataatctattcaccatcagt

SEQ ID NO: 799601 - DNA, 22 bp, Artificial Sequence
  chemically synthesized
gataatctattcaccatcagtc

SEQ ID NO: 799602 - DNA, 22 bp, Artificial Sequence
  chemically synthesized
ttacccacccctgactgatggt

SEQ ID NO: 799603 - DNA, 22 bp, Artificial Sequence
  chemically synthesized
ttcaccatcagtcaggggtggg

SEQ ID NO: 799604 - DNA, 22 bp, Artificial Sequence
  chemically synthesized
accatcagtcaggggtgggtaa

SEQ ID NO: 799605 - DNA, 22 bp, Artificial Sequence
  chemically synthesized
tctgactactcttctgtacttt

SEQ ID NO: 799606 - DNA, 22 bp, Artificial Sequence
  chemically synthesized
tatataagataaaaagtacaga

SEQ ID NO: 799607 - DNA, 22 bp, Artificial Sequence
  chemically synthesized
tgactactcttctgtacttttt

SEQ ID NO: 799608 - DNA, 22 bp, Artificial Sequence
  chemically synthesized
actactcttctgtactttttat

SEQ ID NO: 799609 - DNA, 22 bp, Artificial Sequence
  chemically synthesized
ctcttctgtactttttatctta

SEQ ID NO: 799610 - DNA, 22 bp, Artificial Sequence
  chemically synthesized
aaagactgtatataagataaaa

SEQ ID NO: 799611 - DNA, 22 bp, Artificial Sequence
  chemically synthesized
ttctgtactttttatcttatat

SEQ ID NO: 799612 - DNA, 22 bp, Artificial Sequence
  chemically synthesized
tctgaaagactgtatataagat

SEQ ID NO: 799613 - DNA, 22 bp, Artificial Sequence
  chemically synthesized
ctgtactttttatcttatatac

SEQ ID NO: 799614 - DNA, 22 bp, Artificial Sequence
  chemically synthesized
tgtactttttatcttatataca

SEQ ID NO: 799615 - DNA, 22 bp, Artificial Sequence
  chemically synthesized
tgtctgaaagactgtatataag

SEQ ID NO: 799616 - DNA, 22 bp, Artificial Sequence
  chemically synthesized
tactttttatcttatatacagt

SEQ ID NO: 799617 - DNA, 22 bp, Artificial Sequence
  chemically synthesized
tttatcttatatacagtctttc

SEQ ID NO: 799618 - DNA, 22 bp, Artificial Sequence
  chemically synthesized
ttatcttatatacagtctttca

SEQ ID NO: 799619 - DNA, 22 bp, Artificial Sequence
  chemically synthesized
tatcttatatacagtctttcag

SEQ ID NO: 799620 - DNA, 22 bp, Artificial Sequence
  chemically synthesized
atcttatatacagtctttcaga

SEQ ID NO: 799621 - DNA, 22 bp, Artificial Sequence
  chemically synthesized
aaatagattctgtctgaaagac

SEQ ID NO: 799622 - DNA, 22 bp, Artificial Sequence
  chemically synthesized
tcttatatacagtctttcagac

SEQ ID NO: 799623 - DNA, 22 bp, Artificial Sequence
  chemically synthesized
atatacagtctttcagacagaa

SEQ ID NO: 799624 - DNA, 22 bp, Artificial Sequence
  chemically synthesized
tattgaaatagattctgtctga

SEQ ID NO: 799625 - DNA, 22 bp, Artificial Sequence
  chemically synthesized
tatacagtctttcagacagaat

SEQ ID NO: 799626 - DNA, 22 bp, Artificial Sequence
  chemically synthesized
ctgtattgaaatagattctgtc

SEQ ID NO: 799627 - DNA, 22 bp, Artificial Sequence
  chemically synthesized
actgtattgaaatagattctgt

SEQ ID NO: 799628 - DNA, 22 bp, Artificial Sequence
  chemically synthesized
tcagacagaatctatttcaata

SEQ ID NO: 799629 - DNA, 22 bp, Artificial Sequence
  chemically synthesized
cagacagaatctatttcaatac

SEQ ID NO: 799630 - DNA, 22 bp, Artificial Sequence
  chemically synthesized
agacagaatctatttcaataca

SEQ ID NO: 799631 - DNA, 22 bp, Artificial Sequence
  chemically synthesized
gaatgtgtatgtgtgtttactg

SEQ ID NO: 799632 - DNA, 22 bp, Artificial Sequence
  chemically synthesized
ggaatgtgtatgtgtgtttact

SEQ ID NO: 799633 - DNA, 22 bp, Artificial Sequence
  chemically synthesized
tttcaatacagtaaacacacat

SEQ ID NO: 799634 - DNA, 22 bp, Artificial Sequence
  chemically synthesized
atttggaatgtgtatgtgtgtt

SEQ ID NO: 799635 - DNA, 22 bp, Artificial Sequence
  chemically synthesized
gatttggaatgtgtatgtgtgt

SEQ ID NO: 799636 - DNA, 22 bp, Artificial Sequence
  chemically synthesized
caatacagtaaacacacataca

SEQ ID NO: 799637 - DNA, 22 bp, Artificial Sequence
  chemically synthesized
aatacagtaaacacacatacac

SEQ ID NO: 799638 - DNA, 22 bp, Artificial Sequence
  chemically synthesized
atttgatttggaatgtgtatgt

SEQ ID NO: 799639 - DNA, 22 bp, Artificial Sequence
  chemically synthesized
gatttgatttggaatgtgtatg

SEQ ID NO: 799640 - DNA, 22 bp, Artificial Sequence
  chemically synthesized
tgatttgatttggaatgtgtat

SEQ ID NO: 799641 - DNA, 22 bp, Artificial Sequence
  chemically synthesized
ttttgatttgatttggaatgtg

SEQ ID NO: 799642 - DNA, 22 bp, Artificial Sequence
  chemically synthesized
gttttgatttgatttggaatgt

SEQ ID NO: 799643 - DNA, 22 bp, Artificial Sequence
  chemically synthesized
tgttttgatttgatttggaatg

SEQ ID NO: 799644 - DNA, 22 bp, Artificial Sequence
  chemically synthesized
caaatcaaatcaaaacaaaacc

SEQ ID NO: 799645 - DNA, 22 bp, Artificial Sequence
  chemically synthesized
atcaagagaaggaaaaaaggtt

SEQ ID NO: 799646 - DNA, 22 bp, Artificial Sequence
  chemically synthesized
aaaagtaaagttaatcaagaga

SEQ ID NO: 799647 - DNA, 22 bp, Artificial Sequence
  chemically synthesized
tcaaaagtaaagttaatcaaga

SEQ ID NO: 799648 - DNA, 22 bp, Artificial Sequence
  chemically synthesized
ctcaaaagtaaagttaatcaag

SEQ ID NO: 799649 - DNA, 22 bp, Artificial Sequence
  chemically synthesized
ttttccttctcttgattaactt

SEQ ID NO: 799650 - DNA, 22 bp, Artificial Sequence
  chemically synthesized
tttccttctcttgattaacttt

SEQ ID NO: 799651 - DNA, 22 bp, Artificial Sequence
  chemically synthesized
ttccttctcttgattaacttta

SEQ ID NO: 799652 - DNA, 22 bp, Artificial Sequence
  chemically synthesized
tccttctcttgattaactttac

SEQ ID NO: 799653 - DNA, 22 bp, Artificial Sequence
  chemically synthesized
ccttctcttgattaactttact

SEQ ID NO: 799654 - DNA, 22 bp, Artificial Sequence
  chemically synthesized
cttctcttgattaactttactt

SEQ ID NO: 799655 - DNA, 22 bp, Artificial Sequence
  chemically synthesized
ctcttgattaactttacttttg

SEQ ID NO: 799656 - DNA, 22 bp, Artificial Sequence
  chemically synthesized
taatcaatttctcaaaagtaaa

SEQ ID NO: 799657 - DNA, 22 bp, Artificial Sequence
  chemically synthesized
tcttgattaactttacttttga

SEQ ID NO: 799658 - DNA, 22 bp, Artificial Sequence
  chemically synthesized
ttgattaactttacttttgaga

SEQ ID NO: 799659 - DNA, 22 bp, Artificial Sequence
  chemically synthesized
attataatcaatttctcaaaag

SEQ ID NO: 799660 - DNA, 22 bp, Artificial Sequence
  chemically synthesized
gattaactttacttttgagaaa

SEQ ID NO: 799661 - DNA, 22 bp, Artificial Sequence
  chemically synthesized
cattataatcaatttctcaaaa

SEQ ID NO: 799662 - DNA, 22 bp, Artificial Sequence
  chemically synthesized
attaactttacttttgagaaat

SEQ ID NO: 799663 - DNA, 22 bp, Artificial Sequence
  chemically synthesized
actttacttttgagaaattgat

SEQ ID NO: 799664 - DNA, 22 bp, Artificial Sequence
  chemically synthesized
tacttttgagaaattgattata

SEQ ID NO: 799665 - DNA, 22 bp, Artificial Sequence
  chemically synthesized
aacatgtttcattataatcaat

SEQ ID NO: 799666 - DNA, 22 bp, Artificial Sequence
  chemically synthesized
acttttgagaaattgattataa

SEQ ID NO: 799667 - DNA, 22 bp, Artificial Sequence
  chemically synthesized
cttttgagaaattgattataat

SEQ ID NO: 799668 - DNA, 22 bp, Artificial Sequence
  chemically synthesized
ttaaacatgtttcattataatc

SEQ ID NO: 799669 - DNA, 22 bp, Artificial Sequence
  chemically synthesized
gttaaacatgtttcattataat

SEQ ID NO: 799670 - DNA, 22 bp, Artificial Sequence
  chemically synthesized
ttgagaaattgattataatgaa

SEQ ID NO: 799671 - DNA, 22 bp, Artificial Sequence
  chemically synthesized
tgttaaacatgtttcattataa

SEQ ID NO: 799672 - DNA, 22 bp, Artificial Sequence
  chemically synthesized
tgagaaattgattataatgaaa

SEQ ID NO: 799673 - DNA, 22 bp, Artificial Sequence
  chemically synthesized
gagaaattgattataatgaaac

SEQ ID NO: 799674 - DNA, 22 bp, Artificial Sequence
  chemically synthesized
agaaattgattataatgaaaca

SEQ ID NO: 799675 - DNA, 22 bp, Artificial Sequence
  chemically synthesized
attataatgaaacatgtttaac

SEQ ID NO: 799676 - DNA, 22 bp, Artificial Sequence
  chemically synthesized
taatgaaacatgtttaacaaaa

SEQ ID NO: 799677 - DNA, 22 bp, Artificial Sequence
  chemically synthesized
tcataaaaatgcattttgttaa

SEQ ID NO: 799678 - DNA, 22 bp, Artificial Sequence
  chemically synthesized
atcataaaaatgcattttgtta

SEQ ID NO: 799679 - DNA, 22 bp, Artificial Sequence
  chemically synthesized
tatcataaaaatgcattttgtt

SEQ ID NO: 799680 - DNA, 22 bp, Artificial Sequence
  chemically synthesized
tttatcataaaaatgcattttg

SEQ ID NO: 799681 - DNA, 22 bp, Artificial Sequence
  chemically synthesized
tctttatcataaaaatgcattt

SEQ ID NO: 799682 - DNA, 22 bp, Artificial Sequence
  chemically synthesized
ctctttatcataaaaatgcatt

SEQ ID NO: 799683 - DNA, 22 bp, Artificial Sequence
  chemically synthesized
aacaaaatgcatttttatgata

SEQ ID NO: 799684 - DNA, 22 bp, Artificial Sequence
  chemically synthesized
acaaaatgcatttttatgataa

SEQ ID NO: 799685 - DNA, 22 bp, Artificial Sequence
  chemically synthesized
gggaatcttctctttatcataa

SEQ ID NO: 799686 - DNA, 22 bp, Artificial Sequence
  chemically synthesized
agggaatcttctctttatcata

SEQ ID NO: 799687 - DNA, 22 bp, Artificial Sequence
  chemically synthesized
atttagggaatcttctctttat

SEQ ID NO: 799688 - DNA, 22 bp, Artificial Sequence
  chemically synthesized
gatttagggaatcttctcttta

SEQ ID NO: 799689 - DNA, 22 bp, Artificial Sequence
  chemically synthesized
ttatgataaagagaagattccc

SEQ ID NO: 799690 - DNA, 22 bp, Artificial Sequence
  chemically synthesized
agtcttgatttagggaatcttc

SEQ ID NO: 799691 - DNA, 22 bp, Artificial Sequence
  chemically synthesized
tatgataaagagaagattccct

SEQ ID NO: 799692 - DNA, 22 bp, Artificial Sequence
  chemically synthesized
atgataaagagaagattcccta

SEQ ID NO: 799693 - DNA, 22 bp, Artificial Sequence
  chemically synthesized
tgataaagagaagattccctaa

SEQ ID NO: 799694 - DNA, 22 bp, Artificial Sequence
  chemically synthesized
tgtctcagtcttgatttaggga

SEQ ID NO: 799695 - DNA, 22 bp, Artificial Sequence
  chemically synthesized
acaattatgtctcagtcttgat

SEQ ID NO: 799696 - DNA, 22 bp, Artificial Sequence
  chemically synthesized
cacaattatgtctcagtcttga

SEQ ID NO: 799697 - DNA, 22 bp, Artificial Sequence
  chemically synthesized
tcacaattatgtctcagtcttg

SEQ ID NO: 799698 - DNA, 22 bp, Artificial Sequence
  chemically synthesized
ttcacaattatgtctcagtctt

SEQ ID NO: 799699 - DNA, 22 bp, Artificial Sequence
  chemically synthesized
cctaaatcaagactgagacata

SEQ ID NO: 799700 - DNA, 22 bp, Artificial Sequence
  chemically synthesized
aatttttcacaattatgtctca

SEQ ID NO: 799701 - DNA, 22 bp, Artificial Sequence
  chemically synthesized
aatcaagactgagacataattg

SEQ ID NO: 799702 - DNA, 22 bp, Artificial Sequence
  chemically synthesized
gctgaatttttcacaattatgt

SEQ ID NO: 799703 - DNA, 22 bp, Artificial Sequence
  chemically synthesized
taatactggctgaatttttcac

SEQ ID NO: 799704 - DNA, 22 bp, Artificial Sequence
  chemically synthesized
agacataattgtgaaaaattca

SEQ ID NO: 799705 - DNA, 22 bp, Artificial Sequence
  chemically synthesized
atccaattataatactggctga

SEQ ID NO: 799706 - DNA, 22 bp, Artificial Sequence
  chemically synthesized
aatccaattataatactggctg

SEQ ID NO: 799707 - DNA, 22 bp, Artificial Sequence
  chemically synthesized
tgaaaaattcagccagtattat

SEQ ID NO: 799708 - DNA, 22 bp, Artificial Sequence
  chemically synthesized
agccagtattataattggatta

SEQ ID NO: 799709 - DNA, 22 bp, Artificial Sequence
  chemically synthesized
aatcccataacttaatccaatt

SEQ ID NO: 799710 - DNA, 22 bp, Artificial Sequence
  chemically synthesized
aggttgaatcccataacttaat

SEQ ID NO: 799711 - DNA, 22 bp, Artificial Sequence
  chemically synthesized
caggttgaatcccataacttaa

SEQ ID NO: 799712 - DNA, 22 bp, Artificial Sequence
  chemically synthesized
tcaggttgaatcccataactta

SEQ ID NO: 799713 - DNA, 22 bp, Artificial Sequence
  chemically synthesized
ttcaggttgaatcccataactt

SEQ ID NO: 799714 - DNA, 22 bp, Artificial Sequence
  chemically synthesized
tttcaggttgaatcccataact

SEQ ID NO: 799715 - DNA, 22 bp, Artificial Sequence
  chemically synthesized
taattggattaagttatgggat

SEQ ID NO: 799716 - DNA, 22 bp, Artificial Sequence
  chemically synthesized
ttttcaggttgaatcccataac

SEQ ID NO: 799717 - DNA, 22 bp, Artificial Sequence
  chemically synthesized
ttttttcaggttgaatcccata

SEQ ID NO: 799718 - DNA, 22 bp, Artificial Sequence
  chemically synthesized
cttttttcaggttgaatcccat

SEQ ID NO: 799719 - DNA, 22 bp, Artificial Sequence
  chemically synthesized
gattaagttatgggattcaacc

SEQ ID NO: 799720 - DNA, 22 bp, Artificial Sequence
  chemically synthesized
agttatgggattcaacctgaaa

SEQ ID NO: 799721 - DNA, 22 bp, Artificial Sequence
  chemically synthesized
tgggattcaacctgaaaaaaga

SEQ ID NO: 799722 - DNA, 22 bp, Artificial Sequence
  chemically synthesized
caatatcagaataaaaatttct

SEQ ID NO: 799723 - DNA, 22 bp, Artificial Sequence
  chemically synthesized
aacctgaaaaaagaaattttta

SEQ ID NO: 799724 - DNA, 22 bp, Artificial Sequence
  chemically synthesized
aaaaaagaaatttttattctga

SEQ ID NO: 799725 - DNA, 22 bp, Artificial Sequence
  chemically synthesized
atatgaccaaattacaatatca

SEQ ID NO: 799726 - DNA, 22 bp, Artificial Sequence
  chemically synthesized
gcctaatatgaccaaattacaa

SEQ ID NO: 799727 - DNA, 22 bp, Artificial Sequence
  chemically synthesized
ttattctgatattgtaatttgg

SEQ ID NO: 799728 - DNA, 22 bp, Artificial Sequence
  chemically synthesized
agcctaatatgaccaaattaca

SEQ ID NO: 799729 - DNA, 22 bp, Artificial Sequence
  chemically synthesized
tattctgatattgtaatttggt

SEQ ID NO: 799730 - DNA, 22 bp, Artificial Sequence
  chemically synthesized
attctgatattgtaatttggtc

SEQ ID NO: 799731 - DNA, 22 bp, Artificial Sequence
  chemically synthesized
ttctgatattgtaatttggtca

SEQ ID NO: 799732 - DNA, 22 bp, Artificial Sequence
  chemically synthesized
tgatattgtaatttggtcatat

SEQ ID NO: 799733 - DNA, 22 bp, Artificial Sequence
  chemically synthesized
tatcttagcctaatatgaccaa

SEQ ID NO: 799734 - DNA, 22 bp, Artificial Sequence
  chemically synthesized
atattgtaatttggtcatatta

SEQ ID NO: 799735 - DNA, 22 bp, Artificial Sequence
  chemically synthesized
aattatatcttagcctaatatg

SEQ ID NO: 799736 - DNA, 22 bp, Artificial Sequence
  chemically synthesized
taatttggtcatattaggctaa

SEQ ID NO: 799737 - DNA, 22 bp, Artificial Sequence
  chemically synthesized
ggtcatattaggctaagatata

SEQ ID NO: 799738 - DNA, 22 bp, Artificial Sequence
  chemically synthesized
atgacattaaattatatcttag

SEQ ID NO: 799739 - DNA, 22 bp, Artificial Sequence
  chemically synthesized
gtcatattaggctaagatataa

SEQ ID NO: 799740 - DNA, 22 bp, Artificial Sequence
  chemically synthesized
atgactcatgacattaaattat

SEQ ID NO: 799741 - DNA, 22 bp, Artificial Sequence
  chemically synthesized
taatgactcatgacattaaatt

SEQ ID NO: 799742 - DNA, 22 bp, Artificial Sequence
  chemically synthesized
ggctaagatataatttaatgtc

SEQ ID NO: 799743 - DNA, 22 bp, Artificial Sequence
  chemically synthesized
cactctaatgactcatgacatt

SEQ ID NO: 799744 - DNA, 22 bp, Artificial Sequence
  chemically synthesized
agatataatttaatgtcatgag

SEQ ID NO: 799745 - DNA, 22 bp, Artificial Sequence
  chemically synthesized
gtacaatgttacactctaatga

SEQ ID NO: 799746 - DNA, 22 bp, Artificial Sequence
  chemically synthesized
aatgtcatgagtcattagagtg

SEQ ID NO: 799747 - DNA, 22 bp, Artificial Sequence
  chemically synthesized
atgtcatgagtcattagagtgt

SEQ ID NO: 799748 - DNA, 22 bp, Artificial Sequence
  chemically synthesized
gagtgtaacattgtactagtga

SEQ ID NO: 799749 - DNA, 22 bp, Artificial Sequence
  chemically synthesized
catcagagccatgatcactagt

SEQ ID NO: 799750 - DNA, 22 bp, Artificial Sequence
  chemically synthesized
tccatgcctccatcagagccat

SEQ ID NO: 799751 - DNA, 22 bp, Artificial Sequence
  chemically synthesized
tactagtgatcatggctctgat

SEQ ID NO: 799752 - DNA, 22 bp, Artificial Sequence
  chemically synthesized
gtgatcatggctctgatggagg

SEQ ID NO: 799753 - DNA, 22 bp, Artificial Sequence
  chemically synthesized
cataaaaactgtccatgcctcc

SEQ ID NO: 799754 - DNA, 22 bp, Artificial Sequence
  chemically synthesized
gcataaaaactgtccatgcctc

SEQ ID NO: 799755 - DNA, 22 bp, Artificial Sequence
  chemically synthesized
tgcataaaaactgtccatgcct

SEQ ID NO: 799756 - DNA, 22 bp, Artificial Sequence
  chemically synthesized
cctttgcataaaaactgtccat

SEQ ID NO: 799757 - DNA, 22 bp, Artificial Sequence
  chemically synthesized
ccctttgcataaaaactgtcca

SEQ ID NO: 799758 - DNA, 22 bp, Artificial Sequence
  chemically synthesized
tgatggaggcatggacagtttt

SEQ ID NO: 799759 - DNA, 22 bp, Artificial Sequence
  chemically synthesized
tccctttgcataaaaactgtcc

SEQ ID NO: 799760 - DNA, 22 bp, Artificial Sequence
  chemically synthesized
ttccctttgcataaaaactgtc

SEQ ID NO: 799761 - DNA, 22 bp, Artificial Sequence
  chemically synthesized
atggaggcatggacagttttta

SEQ ID NO: 799762 - DNA, 22 bp, Artificial Sequence
  chemically synthesized
atgtttttccctttgcataaaa

SEQ ID NO: 799763 - DNA, 22 bp, Artificial Sequence
  chemically synthesized
catgtttttccctttgcataaa

SEQ ID NO: 799764 - DNA, 22 bp, Artificial Sequence
  chemically synthesized
tcatgtttttccctttgcataa

SEQ ID NO: 799765 - DNA, 22 bp, Artificial Sequence
  chemically synthesized
ccattttcatgtttttcccttt

SEQ ID NO: 799766 - DNA, 22 bp, Artificial Sequence
  chemically synthesized
cattaccattttcatgtttttc

SEQ ID NO: 799767 - DNA, 22 bp, Artificial Sequence
  chemically synthesized
ttatgcaaagggaaaaacatga

SEQ ID NO: 799768 - DNA, 22 bp, Artificial Sequence
  chemically synthesized
ccattaccattttcatgttttt

SEQ ID NO: 799769 - DNA, 22 bp, Artificial Sequence
  chemically synthesized
tatgcaaagggaaaaacatgaa

SEQ ID NO: 799770 - DNA, 22 bp, Artificial Sequence
  chemically synthesized
atgcaaagggaaaaacatgaaa

SEQ ID NO: 799771 - DNA, 22 bp, Artificial Sequence
  chemically synthesized
tgcaaagggaaaaacatgaaaa

SEQ ID NO: 799772 - DNA, 22 bp, Artificial Sequence
  chemically synthesized
aaggcttccattaccattttca

SEQ ID NO: 799773 - DNA, 22 bp, Artificial Sequence
  chemically synthesized
agccagatgacacctaaaggct

SEQ ID NO: 799774 - DNA, 22 bp, Artificial Sequence
  chemically synthesized
taggtgtcatctggcttagctt

SEQ ID NO: 799775 - DNA, 22 bp, Artificial Sequence
  chemically synthesized
aggtgtcatctggcttagcttt

SEQ ID NO: 799776 - DNA, 22 bp, Artificial Sequence
  chemically synthesized
ggtgtcatctggcttagctttt

SEQ ID NO: 799777 - DNA, 22 bp, Artificial Sequence
  chemically synthesized
aagatacaaaaggaaaagctaa

SEQ ID NO: 799778 - DNA, 22 bp, Artificial Sequence
  chemically synthesized
gaagatacaaaaggaaaagcta

SEQ ID NO: 799779 - DNA, 22 bp, Artificial Sequence
  chemically synthesized
tgaagatacaaaaggaaaagct

SEQ ID NO: 799780 - DNA, 22 bp, Artificial Sequence
  chemically synthesized
ttttgaagatacaaaaggaaaa

SEQ ID NO: 799781 - DNA, 22 bp, Artificial Sequence
  chemically synthesized
gcttagcttttccttttgtatc

SEQ ID NO: 799782 - DNA, 22 bp, Artificial Sequence
  chemically synthesized
ccactgttttgaagatacaaaa

SEQ ID NO: 799783 - DNA, 22 bp, Artificial Sequence
  chemically synthesized
cccactgttttgaagatacaaa

SEQ ID NO: 799784 - DNA, 22 bp, Artificial Sequence
  chemically synthesized
agcttttccttttgtatcttca

SEQ ID NO: 799785 - DNA, 22 bp, Artificial Sequence
  chemically synthesized
ttcccactgttttgaagataca

SEQ ID NO: 799786 - DNA, 22 bp, Artificial Sequence
  chemically synthesized
gcttttccttttgtatcttcaa

SEQ ID NO: 799787 - DNA, 22 bp, Artificial Sequence
  chemically synthesized
ttcttcccactgttttgaagat

SEQ ID NO: 799788 - DNA, 22 bp, Artificial Sequence
  chemically synthesized
attcttcccactgttttgaaga

SEQ ID NO: 799789 - DNA, 22 bp, Artificial Sequence
  chemically synthesized
ttccttttgtatcttcaaaaca

SEQ ID NO: 799790 - DNA, 22 bp, Artificial Sequence
  chemically synthesized
tccttttgtatcttcaaaacag

SEQ ID NO: 799791 - DNA, 22 bp, Artificial Sequence
  chemically synthesized
ccttttgtatcttcaaaacagt

SEQ ID NO: 799792 - DNA, 22 bp, Artificial Sequence
  chemically synthesized
tttattcttcccactgttttga

SEQ ID NO: 799793 - DNA, 22 bp, Artificial Sequence
  chemically synthesized
cttttgtatcttcaaaacagtg

SEQ ID NO: 799794 - DNA, 22 bp, Artificial Sequence
  chemically synthesized
ttgtatcttcaaaacagtggga

SEQ ID NO: 799795 - DNA, 22 bp, Artificial Sequence
  chemically synthesized
tgtatcttcaaaacagtgggaa

SEQ ID NO: 799796 - DNA, 22 bp, Artificial Sequence
  chemically synthesized
gtatcttcaaaacagtgggaag

SEQ ID NO: 799797 - DNA, 22 bp, Artificial Sequence
  chemically synthesized
tatcttcaaaacagtgggaaga

SEQ ID NO: 799798 - DNA, 22 bp, Artificial Sequence
  chemically synthesized
caaaacagtgggaagaataaac

SEQ ID NO: 799799 - DNA, 22 bp, Artificial Sequence
  chemically synthesized
aaaacagtgggaagaataaaca

SEQ ID NO: 799800 - DNA, 22 bp, Artificial Sequence
  chemically synthesized
gccaatcaagaatagtattgtt

SEQ ID NO: 799801 - DNA, 22 bp, Artificial Sequence
  chemically synthesized
cagtggctagccaatcaagaat

SEQ ID NO: 799802 - DNA, 22 bp, Artificial Sequence
  chemically synthesized
ttcttgattggctagccactgg

SEQ ID NO: 799803 - DNA, 22 bp, Artificial Sequence
  chemically synthesized
gtatccccatctccagtggcta

SEQ ID NO: 799804 - DNA, 22 bp, Artificial Sequence
  chemically synthesized
ggtatccccatctccagtggct

SEQ ID NO: 799805 - DNA, 22 bp, Artificial Sequence
  chemically synthesized
ttgattggctagccactggaga

SEQ ID NO: 799806 - DNA, 22 bp, Artificial Sequence
  chemically synthesized
gattggctagccactggagatg

SEQ ID NO: 799807 - DNA, 22 bp, Artificial Sequence
  chemically synthesized
atttggtatccccatctccagt

SEQ ID NO: 799808 - DNA, 22 bp, Artificial Sequence
  chemically synthesized
attggctagccactggagatgg

SEQ ID NO: 799809 - DNA, 22 bp, Artificial Sequence
  chemically synthesized
catttggtatccccatctccag

SEQ ID NO: 799810 - DNA, 22 bp, Artificial Sequence
  chemically synthesized
tcatttggtatccccatctcca

SEQ ID NO: 799811 - DNA, 22 bp, Artificial Sequence
  chemically synthesized
ttcatttggtatccccatctcc

SEQ ID NO: 799812 - DNA, 22 bp, Artificial Sequence
  chemically synthesized
tttcatttggtatccccatctc

SEQ ID NO: 799813 - DNA, 22 bp, Artificial Sequence
  chemically synthesized
gctagccactggagatggggat

SEQ ID NO: 799814 - DNA, 22 bp, Artificial Sequence
  chemically synthesized
ttttcatttggtatccccatct

SEQ ID NO: 799815 - DNA, 22 bp, Artificial Sequence
  chemically synthesized
gccactggagatggggatacca

SEQ ID NO: 799816 - DNA, 22 bp, Artificial Sequence
  chemically synthesized
gagcatttttttcatttggtat

SEQ ID NO: 799817 - DNA, 22 bp, Artificial Sequence
  chemically synthesized
gagatggggataccaaatgaaa

SEQ ID NO: 799818 - DNA, 22 bp, Artificial Sequence
  chemically synthesized
tgttggagcatttttttcattt

SEQ ID NO: 799819 - DNA, 22 bp, Artificial Sequence
  chemically synthesized
gtgttggagcatttttttcatt

SEQ ID NO: 799820 - DNA, 22 bp, Artificial Sequence
  chemically synthesized
cttgtgttggagcatttttttc

SEQ ID NO: 799821 - DNA, 22 bp, Artificial Sequence
  chemically synthesized
ctgcttgtgttggagcattttt

SEQ ID NO: 799822 - DNA, 22 bp, Artificial Sequence
  chemically synthesized
cctgcttgtgttggagcatttt

SEQ ID NO: 799823 - DNA, 22 bp, Artificial Sequence
  chemically synthesized
caacacaagcaggaagtattat

SEQ ID NO: 799824 - DNA, 22 bp, Artificial Sequence
  chemically synthesized
caggataaagaaatgaagaaaa

SEQ ID NO: 799825 - DNA, 22 bp, Artificial Sequence
  chemically synthesized
gcaggataaagaaatgaagaaa

SEQ ID NO: 799826 - DNA, 22 bp, Artificial Sequence
  chemically synthesized
tgcaggataaagaaatgaagaa

SEQ ID NO: 799827 - DNA, 22 bp, Artificial Sequence
  chemically synthesized
ttgcaggataaagaaatgaaga

SEQ ID NO: 799828 - DNA, 22 bp, Artificial Sequence
  chemically synthesized
tgcttttgcaggataaagaaat

SEQ ID NO: 799829 - DNA, 22 bp, Artificial Sequence
  chemically synthesized
tgtgcttttgcaggataaagaa

SEQ ID NO: 799830 - DNA, 22 bp, Artificial Sequence
  chemically synthesized
ttttcttcatttctttatcctg

SEQ ID NO: 799831 - DNA, 22 bp, Artificial Sequence
  chemically synthesized
tcttcatttctttatcctgcaa

SEQ ID NO: 799832 - DNA, 22 bp, Artificial Sequence
  chemically synthesized
cttcatttctttatcctgcaaa

SEQ ID NO: 799833 - DNA, 22 bp, Artificial Sequence
  chemically synthesized
ttcatttctttatcctgcaaaa

SEQ ID NO: 799834 - DNA, 22 bp, Artificial Sequence
  chemically synthesized
catttctttatcctgcaaaagc

SEQ ID NO: 799835 - DNA, 22 bp, Artificial Sequence
  chemically synthesized
atttctttatcctgcaaaagca

SEQ ID NO: 799836 - DNA, 22 bp, Artificial Sequence
  chemically synthesized
ctttatcctgcaaaagcacaga

SEQ ID NO: 799837 - DNA, 22 bp, Artificial Sequence
  chemically synthesized
caagacagagtctctgtgcttt

SEQ ID NO: 799838 - DNA, 22 bp, Artificial Sequence
  chemically synthesized
tttatcctgcaaaagcacagag

SEQ ID NO: 799839 - DNA, 22 bp, Artificial Sequence
  chemically synthesized
tgcaagacagagtctctgtgct

SEQ ID NO: 799840 - DNA, 22 bp, Artificial Sequence
  chemically synthesized
tatcctgcaaaagcacagagac

SEQ ID NO: 799841 - DNA, 22 bp, Artificial Sequence
  chemically synthesized
atcctgcaaaagcacagagact

SEQ ID NO: 799842 - DNA, 22 bp, Artificial Sequence
  chemically synthesized
tcctgcaaaagcacagagactc

SEQ ID NO: 799843 - DNA, 22 bp, Artificial Sequence
  chemically synthesized
caaaagcacagagactctgtct

SEQ ID NO: 799844 - DNA, 22 bp, Artificial Sequence
  chemically synthesized
aaaaaaaaaaaaatgattctgc

SEQ ID NO: 799845 - DNA, 22 bp, Artificial Sequence
  chemically synthesized
gaaaaaaaaaaaaatgattctg

SEQ ID NO: 799846 - DNA, 22 bp, Artificial Sequence
  chemically synthesized
tgtcttgcagaatcattttttt

SEQ ID NO: 799847 - DNA, 22 bp, Artificial Sequence
  chemically synthesized
aaatttgaaaaaaaaaaaaatg

SEQ ID NO: 799848 - DNA, 22 bp, Artificial Sequence
  chemically synthesized
tcttgcagaatcattttttttt

SEQ ID NO: 799849 - DNA, 22 bp, Artificial Sequence
  chemically synthesized
tgaaatttgaaaaaaaaaaaaa

SEQ ID NO: 799850 - DNA, 22 bp, Artificial Sequence
  chemically synthesized
gcagaatcattttttttttttt

SEQ ID NO: 799851 - DNA, 22 bp, Artificial Sequence
  chemically synthesized
cagaatcatttttttttttttc

SEQ ID NO: 799852 - DNA, 22 bp, Artificial Sequence
  chemically synthesized
agctctgaaatttgaaaaaaaa

SEQ ID NO: 799853 - DNA, 22 bp, Artificial Sequence
  chemically synthesized
cagctctgaaatttgaaaaaaa

SEQ ID NO: 799854 - DNA, 22 bp, Artificial Sequence
  chemically synthesized
tcagctctgaaatttgaaaaaa

SEQ ID NO: 799855 - DNA, 22 bp, Artificial Sequence
  chemically synthesized
ttttttttttcaaatttcagag

SEQ ID NO: 799856 - DNA, 22 bp, Artificial Sequence
  chemically synthesized
tggccctttcagctctgaaatt

SEQ ID NO: 799857 - DNA, 22 bp, Artificial Sequence
  chemically synthesized
tttttttttcaaatttcagagc

SEQ ID NO: 799858 - DNA, 22 bp, Artificial Sequence
  chemically synthesized
atggccctttcagctctgaaat

SEQ ID NO: 799859 - DNA, 22 bp, Artificial Sequence
  chemically synthesized
ttttttttcaaatttcagagct

SEQ ID NO: 799860 - DNA, 22 bp, Artificial Sequence
  chemically synthesized
tttttttcaaatttcagagctg

SEQ ID NO: 799861 - DNA, 22 bp, Artificial Sequence
  chemically synthesized
ttttttcaaatttcagagctga

SEQ ID NO: 799862 - DNA, 22 bp, Artificial Sequence
  chemically synthesized
cttatggccctttcagctctga

SEQ ID NO: 799863 - DNA, 22 bp, Artificial Sequence
  chemically synthesized
tttttcaaatttcagagctgaa

SEQ ID NO: 799864 - DNA, 22 bp, Artificial Sequence
  chemically synthesized
gcttatggccctttcagctctg

SEQ ID NO: 799865 - DNA, 22 bp, Artificial Sequence
  chemically synthesized
ttttcaaatttcagagctgaaa

SEQ ID NO: 799866 - DNA, 22 bp, Artificial Sequence
  chemically synthesized
tgcttatggccctttcagctct

SEQ ID NO: 799867 - DNA, 22 bp, Artificial Sequence
  chemically synthesized
tttcaaatttcagagctgaaag

SEQ ID NO: 799868 - DNA, 22 bp, Artificial Sequence
  chemically synthesized
ttcaaatttcagagctgaaagg

SEQ ID NO: 799869 - DNA, 22 bp, Artificial Sequence
  chemically synthesized
tcaaatttcagagctgaaaggg

SEQ ID NO: 799870 - DNA, 22 bp, Artificial Sequence
  chemically synthesized
caaatttcagagctgaaagggc

SEQ ID NO: 799871 - DNA, 22 bp, Artificial Sequence
  chemically synthesized
aaatttcagagctgaaagggcc

SEQ ID NO: 799872 - DNA, 22 bp, Artificial Sequence
  chemically synthesized
cagagctgaaagggccataagc

SEQ ID NO: 799873 - DNA, 22 bp, Artificial Sequence
  chemically synthesized
agagctgaaagggccataagca

SEQ ID NO: 799874 - DNA, 22 bp, Artificial Sequence
  chemically synthesized
gaccagatgttttgcttatggc

SEQ ID NO: 799875 - DNA, 22 bp, Artificial Sequence
  chemically synthesized
aaagggccataagcaaaacatc

SEQ ID NO: 799876 - DNA, 22 bp, Artificial Sequence
  chemically synthesized
agaaccactagaccagatgttt

SEQ ID NO: 799877 - DNA, 22 bp, Artificial Sequence
  chemically synthesized
gagaaccactagaccagatgtt

SEQ ID NO: 799878 - DNA, 22 bp, Artificial Sequence
  chemically synthesized
aatttgagaaccactagaccag

SEQ ID NO: 799879 - DNA, 22 bp, Artificial Sequence
  chemically synthesized
aaatttgagaaccactagacca

SEQ ID NO: 799880 - DNA, 22 bp, Artificial Sequence
  chemically synthesized
tgcccacttaaatttgagaacc

SEQ ID NO: 799881 - DNA, 22 bp, Artificial Sequence
  chemically synthesized
gtgcccacttaaatttgagaac

SEQ ID NO: 799882 - DNA, 22 bp, Artificial Sequence
  chemically synthesized
ttgtgcccacttaaatttgaga

SEQ ID NO: 799883 - DNA, 22 bp, Artificial Sequence
  chemically synthesized
gtctagtggttctcaaatttaa

SEQ ID NO: 799884 - DNA, 22 bp, Artificial Sequence
  chemically synthesized
gtggttctcaaatttaagtggg

SEQ ID NO: 799885 - DNA, 22 bp, Artificial Sequence
  chemically synthesized
ggtagttcttgtgcccacttaa

SEQ ID NO: 799886 - DNA, 22 bp, Artificial Sequence
  chemically synthesized
tcaaatttaagtgggcacaaga

SEQ ID NO: 799887 - DNA, 22 bp, Artificial Sequence
  chemically synthesized
aaatttaagtgggcacaagaac

SEQ ID NO: 799888 - DNA, 22 bp, Artificial Sequence
  chemically synthesized
aagtgggcacaagaactaccta

SEQ ID NO: 799889 - DNA, 22 bp, Artificial Sequence
  chemically synthesized
agtgggcacaagaactacctag

SEQ ID NO: 799890 - DNA, 22 bp, Artificial Sequence
  chemically synthesized
catatgtaaagagcccctaggt

SEQ ID NO: 799891 - DNA, 22 bp, Artificial Sequence
  chemically synthesized
cctaggggctctttacatatgc

SEQ ID NO: 799892 - DNA, 22 bp, Artificial Sequence
  chemically synthesized
ggggctctttacatatgcagat

SEQ ID NO: 799893 - DNA, 22 bp, Artificial Sequence
  chemically synthesized
gggatgggtcgtggaatctgca

SEQ ID NO: 799894 - DNA, 22 bp, Artificial Sequence
  chemically synthesized
tggggatgggtcgtggaatctg

SEQ ID NO: 799895 - DNA, 22 bp, Artificial Sequence
  chemically synthesized
tttacatatgcagattccacga

SEQ ID NO: 799896 - DNA, 22 bp, Artificial Sequence
  chemically synthesized
tctggggatgggtcgtggaatc

SEQ ID NO: 799897 - DNA, 22 bp, Artificial Sequence
  chemically synthesized
tacatatgcagattccacgacc

SEQ ID NO: 799898 - DNA, 22 bp, Artificial Sequence
  chemically synthesized
acatatgcagattccacgaccc

SEQ ID NO: 799899 - DNA, 22 bp, Artificial Sequence
  chemically synthesized
catatgcagattccacgaccca

SEQ ID NO: 799900 - DNA, 22 bp, Artificial Sequence
  chemically synthesized
tgtcagaagctctctggggatg

SEQ ID NO: 799901 - DNA, 22 bp, Artificial Sequence
  chemically synthesized
cacgacccatccccagagagct

SEQ ID NO: 799902 - DNA, 22 bp, Artificial Sequence
  chemically synthesized
aaaatgcattgtgtcagaagct

SEQ ID NO: 799903 - DNA, 22 bp, Artificial Sequence
  chemically synthesized
ttaaaaatgcattgtgtcagaa

SEQ ID NO: 799904 - DNA, 22 bp, Artificial Sequence
  chemically synthesized
attaaaaatgcattgtgtcaga

SEQ ID NO: 799905 - DNA, 22 bp, Artificial Sequence
  chemically synthesized
tattaaaaatgcattgtgtcag

SEQ ID NO: 799906 - DNA, 22 bp, Artificial Sequence
  chemically synthesized
gaaactttattaaaaatgcatt

SEQ ID NO: 799907 - DNA, 22 bp, Artificial Sequence
  chemically synthesized
ggaaactttattaaaaatgcat

SEQ ID NO: 799908 - DNA, 22 bp, Artificial Sequence
  chemically synthesized
cttggaaactttattaaaaatg

SEQ ID NO: 799909 - DNA, 22 bp, Artificial Sequence
  chemically synthesized
ctgacacaatgcatttttaata

SEQ ID NO: 799910 - DNA, 22 bp, Artificial Sequence
  chemically synthesized
acttggaaactttattaaaaat

SEQ ID NO: 799911 - DNA, 22 bp, Artificial Sequence
  chemically synthesized
tgacacaatgcatttttaataa

SEQ ID NO: 799912 - DNA, 22 bp, Artificial Sequence
  chemically synthesized
tacttggaaactttattaaaaa

SEQ ID NO: 799913 - DNA, 22 bp, Artificial Sequence
  chemically synthesized
acacaatgcatttttaataaag

SEQ ID NO: 799914 - DNA, 22 bp, Artificial Sequence
  chemically synthesized
ttaataaagtttccaagtaaag

SEQ ID NO: 799915 - DNA, 22 bp, Artificial Sequence
  chemically synthesized
taataaagtttccaagtaaaga

SEQ ID NO: 799916 - DNA, 22 bp, Artificial Sequence
  chemically synthesized
aataaagtttccaagtaaagat

SEQ ID NO: 799917 - DNA, 22 bp, Artificial Sequence
  chemically synthesized
ataaagtttccaagtaaagatg

SEQ ID NO: 799918 - DNA, 22 bp, Artificial Sequence
  chemically synthesized
cataccacggacaccatcttta

SEQ ID NO: 799919 - DNA, 22 bp, Artificial Sequence
  chemically synthesized
acataccacggacaccatcttt

SEQ ID NO: 799920 - DNA, 22 bp, Artificial Sequence
  chemically synthesized
ccaagtaaagatggtgtccgtg

SEQ ID NO: 799921 - DNA, 22 bp, Artificial Sequence
  chemically synthesized
caagtaaagatggtgtccgtgg

SEQ ID NO: 799922 - DNA, 22 bp, Artificial Sequence
  chemically synthesized
caggtttacataccacggacac

SEQ ID NO: 799923 - DNA, 22 bp, Artificial Sequence
  chemically synthesized
tccaggtttacataccacggac

SEQ ID NO: 799924 - DNA, 22 bp, Artificial Sequence
  chemically synthesized
ctccaggtttacataccacgga

SEQ ID NO: 799925 - DNA, 22 bp, Artificial Sequence
  chemically synthesized
ggtaaaagatatgtttctccag

SEQ ID NO: 799926 - DNA, 22 bp, Artificial Sequence
  chemically synthesized
gagaaacatatcttttacctag

SEQ ID NO: 799927 - DNA, 22 bp, Artificial Sequence
  chemically synthesized
aaaaatgatggatctaggtaaa

SEQ ID NO: 799928 - DNA, 22 bp, Artificial Sequence
  chemically synthesized
tgaaaaatgatggatctaggta

SEQ ID NO: 799929 - DNA, 22 bp, Artificial Sequence
  chemically synthesized
ctgaaaaatgatggatctaggt

SEQ ID NO: 799930 - DNA, 22 bp, Artificial Sequence
  chemically synthesized
atcttctgaaaaatgatggatc

SEQ ID NO: 799931 - DNA, 22 bp, Artificial Sequence
  chemically synthesized
ttacctagatccatcatttttc

SEQ ID NO: 799932 - DNA, 22 bp, Artificial Sequence
  chemically synthesized
tacctagatccatcatttttca

SEQ ID NO: 799933 - DNA, 22 bp, Artificial Sequence
  chemically synthesized
aggttgatcttctgaaaaatga

SEQ ID NO: 799934 - DNA, 22 bp, Artificial Sequence
  chemically synthesized
acctagatccatcatttttcag

SEQ ID NO: 799935 - DNA, 22 bp, Artificial Sequence
  chemically synthesized
cctagatccatcatttttcaga

SEQ ID NO: 799936 - DNA, 22 bp, Artificial Sequence
  chemically synthesized
gatccatcatttttcagaagat

SEQ ID NO: 799937 - DNA, 22 bp, Artificial Sequence
  chemically synthesized
gagatctcaggttgatcttctg

SEQ ID NO: 799938 - DNA, 22 bp, Artificial Sequence
  chemically synthesized
ttggagatctcaggttgatctt

SEQ ID NO: 799939 - DNA, 22 bp, Artificial Sequence
  chemically synthesized
ttcagaagatcaacctgagatc

SEQ ID NO: 799940 - DNA, 22 bp, Artificial Sequence
  chemically synthesized
tcagaagatcaacctgagatct

SEQ ID NO: 799941 - DNA, 22 bp, Artificial Sequence
  chemically synthesized
cagaagatcaacctgagatctc

SEQ ID NO: 799942 - DNA, 22 bp, Artificial Sequence
  chemically synthesized
agaagatcaacctgagatctcc

SEQ ID NO: 799943 - DNA, 22 bp, Artificial Sequence
  chemically synthesized
gggaagtcagtgctgttggaga

SEQ ID NO: 799944 - DNA, 22 bp, Artificial Sequence
  chemically synthesized
taatcctggggaagtcagtgct

SEQ ID NO: 799945 - DNA, 22 bp, Artificial Sequence
  chemically synthesized
agatctccaacagcactgactt

SEQ ID NO: 799946 - DNA, 22 bp, Artificial Sequence
  chemically synthesized
tgtaatcctggggaagtcagtg

SEQ ID NO: 799947 - DNA, 22 bp, Artificial Sequence
  chemically synthesized
gcctctgtaatcctggggaagt

SEQ ID NO: 799948 - DNA, 22 bp, Artificial Sequence
  chemically synthesized
caacagcactgacttccccagg

SEQ ID NO: 799949 - DNA, 22 bp, Artificial Sequence
  chemically synthesized
aacactagcctctgtaatcctg

SEQ ID NO: 799950 - DNA, 22 bp, Artificial Sequence
  chemically synthesized
ctaaacactagcctctgtaatc

SEQ ID NO: 799951 - DNA, 22 bp, Artificial Sequence
  chemically synthesized
acttccccaggattacagaggc

SEQ ID NO: 799952 - DNA, 22 bp, Artificial Sequence
  chemically synthesized
ttcctaaacactagcctctgta

SEQ ID NO: 799953 - DNA, 22 bp, Artificial Sequence
  chemically synthesized
ccccaggattacagaggctagt

SEQ ID NO: 799954 - DNA, 22 bp, Artificial Sequence
  chemically synthesized
cccaggattacagaggctagtg

SEQ ID NO: 799955 - DNA, 22 bp, Artificial Sequence
  chemically synthesized
gggtcctgttcctaaacactag

SEQ ID NO: 799956 - DNA, 22 bp, Artificial Sequence
  chemically synthesized
cagaggctagtgtttaggaaca

SEQ ID NO: 799957 - DNA, 22 bp, Artificial Sequence
  chemically synthesized
agtcaagaagttagggtcctgt

SEQ ID NO: 799958 - DNA, 22 bp, Artificial Sequence
  chemically synthesized
aagtcaagaagttagggtcctg

SEQ ID NO: 799959 - DNA, 22 bp, Artificial Sequence
  chemically synthesized
gtgtttaggaacaggaccctaa

SEQ ID NO: 799960 - DNA, 22 bp, Artificial Sequence
  chemically synthesized
taagtcaagaagttagggtcct

SEQ ID NO: 799961 - DNA, 22 bp, Artificial Sequence
  chemically synthesized
ttttaagtcaagaagttagggt

SEQ ID NO: 799962 - DNA, 22 bp, Artificial Sequence
  chemically synthesized
attttaagtcaagaagttaggg

SEQ ID NO: 799963 - DNA, 22 bp, Artificial Sequence
  chemically synthesized
aggaacaggaccctaacttctt

SEQ ID NO: 799964 - DNA, 22 bp, Artificial Sequence
  chemically synthesized
ggaacaggaccctaacttcttg

SEQ ID NO: 799965 - DNA, 22 bp, Artificial Sequence
  chemically synthesized
acttcttgacttaaaataagat

SEQ ID NO: 799966 - DNA, 22 bp, Artificial Sequence
  chemically synthesized
gagagtgcaaaatatcttattt

SEQ ID NO: 799967 - DNA, 22 bp, Artificial Sequence
  chemically synthesized
agagagtgcaaaatatcttatt

SEQ ID NO: 799968 - DNA, 22 bp, Artificial Sequence
  chemically synthesized
cttgacttaaaataagatattt

SEQ ID NO: 799969 - DNA, 22 bp, Artificial Sequence
  chemically synthesized
ttgacttaaaataagatatttt

SEQ ID NO: 799970 - DNA, 22 bp, Artificial Sequence
  chemically synthesized
gacttaaaataagatattttgc

SEQ ID NO: 799971 - DNA, 22 bp, Artificial Sequence
  chemically synthesized
acttaaaataagatattttgca

SEQ ID NO: 799972 - DNA, 22 bp, Artificial Sequence
  chemically synthesized
aggtatttagagagtgcaaaat

SEQ ID NO: 799973 - DNA, 22 bp, Artificial Sequence
  chemically synthesized
aaaataagatattttgcactct

SEQ ID NO: 799974 - DNA, 22 bp, Artificial Sequence
  chemically synthesized
aaataagatattttgcactctc

SEQ ID NO: 799975 - DNA, 22 bp, Artificial Sequence
  chemically synthesized
atagaagtattaaggtatttag

SEQ ID NO: 799976 - DNA, 22 bp, Artificial Sequence
  chemically synthesized
aatagaagtattaaggtattta

SEQ ID NO: 799977 - DNA, 22 bp, Artificial Sequence
  chemically synthesized
taatagaagtattaaggtattt

SEQ ID NO: 799978 - DNA, 22 bp, Artificial Sequence
  chemically synthesized
ttaatagaagtattaaggtatt

SEQ ID NO: 799979 - DNA, 22 bp, Artificial Sequence
  chemically synthesized
tgcactctctaaataccttaat

SEQ ID NO: 799980 - DNA, 22 bp, Artificial Sequence
  chemically synthesized
tttaatagaagtattaaggtat

SEQ ID NO: 799981 - DNA, 22 bp, Artificial Sequence
  chemically synthesized
gcactctctaaataccttaata

SEQ ID NO: 799982 - DNA, 22 bp, Artificial Sequence
  chemically synthesized
ttttaatagaagtattaaggta

SEQ ID NO: 799983 - DNA, 22 bp, Artificial Sequence
  chemically synthesized
cactctctaaataccttaatac

SEQ ID NO: 799984 - DNA, 22 bp, Artificial Sequence
  chemically synthesized
tttttaatagaagtattaaggt

SEQ ID NO: 799985 - DNA, 22 bp, Artificial Sequence
  chemically synthesized
tctaaataccttaatacttcta

SEQ ID NO: 799986 - DNA, 22 bp, Artificial Sequence
  chemically synthesized
aaactttttttaatagaagtat

SEQ ID NO: 799987 - DNA, 22 bp, Artificial Sequence
  chemically synthesized
taaataccttaatacttctatt

SEQ ID NO: 799988 - DNA, 22 bp, Artificial Sequence
  chemically synthesized
taaaactttttttaatagaagt

SEQ ID NO: 799989 - DNA, 22 bp, Artificial Sequence
  chemically synthesized
aataccttaatacttctattaa

SEQ ID NO: 799990 - DNA, 22 bp, Artificial Sequence
  chemically synthesized
acagactctaaaacttttttta

SEQ ID NO: 799991 - DNA, 22 bp, Artificial Sequence
  chemically synthesized
aatacttctattaaaaaaagtt

SEQ ID NO: 799992 - DNA, 22 bp, Artificial Sequence
  chemically synthesized
atacttctattaaaaaaagttt

SEQ ID NO: 799993 - DNA, 22 bp, Artificial Sequence
  chemically synthesized
agctaacagactctaaaacttt

SEQ ID NO: 799994 - DNA, 22 bp, Artificial Sequence
  chemically synthesized
cagctaacagactctaaaactt

SEQ ID NO: 799995 - DNA, 22 bp, Artificial Sequence
  chemically synthesized
ctattaaaaaaagttttagagt

SEQ ID NO: 799996 - DNA, 22 bp, Artificial Sequence
  chemically synthesized
ttcagctaacagactctaaaac

SEQ ID NO: 799997 - DNA, 22 bp, Artificial Sequence
  chemically synthesized
tattaaaaaaagttttagagtc

SEQ ID NO: 799998 - DNA, 22 bp, Artificial Sequence
  chemically synthesized
cttcagctaacagactctaaaa

SEQ ID NO: 799999 - DNA, 22 bp, Artificial Sequence
  chemically synthesized
ttaaaaaaagttttagagtctg

SEQ ID NO: 800000 - DNA, 22 bp, Artificial Sequence
  chemically synthesized
aaaaaagttttagagtctgtta

SEQ ID NO: 800001 - DNA, 22 bp, Artificial Sequence
  chemically synthesized
aaaaggcacagcttcttcagct

SEQ ID NO: 800002 - DNA, 22 bp, Artificial Sequence
  chemically synthesized
tagagtctgttagctgaagaag

SEQ ID NO: 800003 - DNA, 22 bp, Artificial Sequence
  chemically synthesized
aaaaaggcacagcttcttcagc

SEQ ID NO: 800004 - DNA, 22 bp, Artificial Sequence
  chemically synthesized
agagtctgttagctgaagaagc

SEQ ID NO: 800005 - DNA, 22 bp, Artificial Sequence
  chemically synthesized
gagtctgttagctgaagaagct

SEQ ID NO: 800006 - DNA, 22 bp, Artificial Sequence
  chemically synthesized
ttagctgaagaagctgtgcctt

SEQ ID NO: 800007 - DNA, 22 bp, Artificial Sequence
  chemically synthesized
agtatccttaaaaaggcacagc

SEQ ID NO: 800008 - DNA, 22 bp, Artificial Sequence
  chemically synthesized
aagtatccttaaaaaggcacag

SEQ ID NO: 800009 - DNA, 22 bp, Artificial Sequence
  chemically synthesized
taagtatccttaaaaaggcaca

SEQ ID NO: 800010 - DNA, 22 bp, Artificial Sequence
  chemically synthesized
gctgaagaagctgtgccttttt

SEQ ID NO: 800011 - DNA, 22 bp, Artificial Sequence
  chemically synthesized
ttaagtatccttaaaaaggcac

SEQ ID NO: 800012 - DNA, 22 bp, Artificial Sequence
  chemically synthesized
aagaagctgtgcctttttaagg

SEQ ID NO: 800013 - DNA, 22 bp, Artificial Sequence
  chemically synthesized
gcttttaagtatccttaaaaag

SEQ ID NO: 800014 - DNA, 22 bp, Artificial Sequence
  chemically synthesized
ttcgcttttaagtatccttaaa

SEQ ID NO: 800015 - DNA, 22 bp, Artificial Sequence
  chemically synthesized
tgcctttttaaggatacttaaa

SEQ ID NO: 800016 - DNA, 22 bp, Artificial Sequence
  chemically synthesized
tttaaggatacttaaaagcgaa

SEQ ID NO: 800017 - DNA, 22 bp, Artificial Sequence
  chemically synthesized
ttaaggatacttaaaagcgaat

SEQ ID NO: 800018 - DNA, 22 bp, Artificial Sequence
  chemically synthesized
taaggatacttaaaagcgaata

SEQ ID NO: 800019 - DNA, 22 bp, Artificial Sequence
  chemically synthesized
aaggatacttaaaagcgaatag

SEQ ID NO: 800020 - DNA, 22 bp, Artificial Sequence
  chemically synthesized
aggatacttaaaagcgaatagg

SEQ ID NO: 800021 - DNA, 22 bp, Artificial Sequence
  chemically synthesized
aaaagcgaataggcttttcccc

SEQ ID NO: 800022 - DNA, 22 bp, Artificial Sequence
  chemically synthesized
aaagcgaataggcttttcccca

SEQ ID NO: 800023 - DNA, 22 bp, Artificial Sequence
  chemically synthesized
ccacaatacaaaaatggggaaa

SEQ ID NO: 800024 - DNA, 22 bp, Artificial Sequence
  chemically synthesized
gccacaatacaaaaatggggaa

SEQ ID NO: 800025 - DNA, 22 bp, Artificial Sequence
  chemically synthesized
tgccacaatacaaaaatgggga

SEQ ID NO: 800026 - DNA, 22 bp, Artificial Sequence
  chemically synthesized
tgtatattttgccacaatacaa

SEQ ID NO: 800027 - DNA, 22 bp, Artificial Sequence
  chemically synthesized
ttccccatttttgtattgtggc

SEQ ID NO: 800028 - DNA, 22 bp, Artificial Sequence
  chemically synthesized
tccccatttttgtattgtggca

SEQ ID NO: 800029 - DNA, 22 bp, Artificial Sequence
  chemically synthesized
ccccatttttgtattgtggcaa

SEQ ID NO: 800030 - DNA, 22 bp, Artificial Sequence
  chemically synthesized
cccatttttgtattgtggcaaa

SEQ ID NO: 800031 - DNA, 22 bp, Artificial Sequence
  chemically synthesized
tgttgtgtatattttgccacaa

SEQ ID NO: 800032 - DNA, 22 bp, Artificial Sequence
  chemically synthesized
atgttgtgtatattttgccaca

SEQ ID NO: 800033 - DNA, 22 bp, Artificial Sequence
  chemically synthesized
tatgttgtgtatattttgccac

SEQ ID NO: 800034 - DNA, 22 bp, Artificial Sequence
  chemically synthesized
ttgtattgtggcaaaatataca

SEQ ID NO: 800035 - DNA, 22 bp, Artificial Sequence
  chemically synthesized
tgtattgtggcaaaatatacac

SEQ ID NO: 800036 - DNA, 22 bp, Artificial Sequence
  chemically synthesized
gtattgtggcaaaatatacaca

SEQ ID NO: 800037 - DNA, 22 bp, Artificial Sequence
  chemically synthesized
tattgtggcaaaatatacacaa

SEQ ID NO: 800038 - DNA, 22 bp, Artificial Sequence
  chemically synthesized
tggcaaaatatacacaacataa

SEQ ID NO: 800039 - DNA, 22 bp, Artificial Sequence
  chemically synthesized
aaatgatcaattttatgttgtg

SEQ ID NO: 800040 - DNA, 22 bp, Artificial Sequence
  chemically synthesized
atcattttaatcatttcttttt

SEQ ID NO: 800041 - DNA, 22 bp, Artificial Sequence
  chemically synthesized
taatcatttctttttgatttgg

SEQ ID NO: 800042 - DNA, 22 bp, Artificial Sequence
  chemically synthesized
aatcatttctttttgatttggg

SEQ ID NO: 800043 - DNA, 22 bp, Artificial Sequence
  chemically synthesized
atcatttctttttgatttggga

SEQ ID NO: 800044 - DNA, 22 bp, Artificial Sequence
  chemically synthesized
ctttttgatttgggatcttgac

SEQ ID NO: 800045 - DNA, 22 bp, Artificial Sequence
  chemically synthesized
taccccagcatggtcaagatcc

SEQ ID NO: 800046 - DNA, 22 bp, Artificial Sequence
  chemically synthesized
tttttgatttgggatcttgacc

SEQ ID NO: 800047 - DNA, 22 bp, Artificial Sequence
  chemically synthesized
tttgatttgggatcttgaccat

SEQ ID NO: 800048 - DNA, 22 bp, Artificial Sequence
  chemically synthesized
ttgatttgggatcttgaccatg

SEQ ID NO: 800049 - DNA, 22 bp, Artificial Sequence
  chemically synthesized
tgatttgggatcttgaccatgc

SEQ ID NO: 800050 - DNA, 22 bp, Artificial Sequence
  chemically synthesized
gatttgggatcttgaccatgct

SEQ ID NO: 800051 - DNA, 22 bp, Artificial Sequence
  chemically synthesized
atttgggatcttgaccatgctg

SEQ ID NO: 800052 - DNA, 22 bp, Artificial Sequence
  chemically synthesized
gggatcttgaccatgctggggt

SEQ ID NO: 800053 - DNA, 22 bp, Artificial Sequence
  chemically synthesized
ggatcttgaccatgctggggta

SEQ ID NO: 800054 - DNA, 22 bp, Artificial Sequence
  chemically synthesized
gaccatgctggggtacagtgtc

SEQ ID NO: 800055 - DNA, 22 bp, Artificial Sequence
  chemically synthesized
accatgctggggtacagtgtca

SEQ ID NO: 800056 - DNA, 22 bp, Artificial Sequence
  chemically synthesized
gaggaagcagtgaatgacactg

SEQ ID NO: 800057 - DNA, 22 bp, Artificial Sequence
  chemically synthesized
gggtacagtgtcattcactgct

SEQ ID NO: 800058 - DNA, 22 bp, Artificial Sequence
  chemically synthesized
aacccaggaactggaggaagca

SEQ ID NO: 800059 - DNA, 22 bp, Artificial Sequence
  chemically synthesized
gaacccaggaactggaggaagc

SEQ ID NO: 800060 - DNA, 22 bp, Artificial Sequence
  chemically synthesized
cttgaacccaggaactggagga

SEQ ID NO: 800061 - DNA, 22 bp, Artificial Sequence
  chemically synthesized
actgcttcctccagttcctggg

SEQ ID NO: 800062 - DNA, 22 bp, Artificial Sequence
  chemically synthesized
cttcctccagttcctgggttca

SEQ ID NO: 800063 - DNA, 22 bp, Artificial Sequence
  chemically synthesized
cctccagttcctgggttcaagg

SEQ ID NO: 800064 - DNA, 22 bp, Artificial Sequence
  chemically synthesized
ctccagttcctgggttcaagga

SEQ ID NO: 800065 - DNA, 22 bp, Artificial Sequence
  chemically synthesized
aggcaggaggattccttgaacc

SEQ ID NO: 800066 - DNA, 22 bp, Artificial Sequence
  chemically synthesized
cagttcctgggttcaaggaatc

SEQ ID NO: 800067 - DNA, 22 bp, Artificial Sequence
  chemically synthesized
gaggctgaggcaggaggattcc

SEQ ID NO: 800068 - DNA, 22 bp, Artificial Sequence
  chemically synthesized
ctgggttcaaggaatcctcctg

SEQ ID NO: 800069 - DNA, 22 bp, Artificial Sequence
  chemically synthesized
ggttcaaggaatcctcctgcct

SEQ ID NO: 800070 - DNA, 22 bp, Artificial Sequence
  chemically synthesized
aaggaatcctcctgcctcagcc

SEQ ID NO: 800071 - DNA, 22 bp, Artificial Sequence
  chemically synthesized
tagtcccagacacactggaggc

SEQ ID NO: 800072 - DNA, 22 bp, Artificial Sequence
  chemically synthesized
gtagtcccagacacactggagg

SEQ ID NO: 800073 - DNA, 22 bp, Artificial Sequence
  chemically synthesized
ctgcctcagcctccagtgtgtc

SEQ ID NO: 800074 - DNA, 22 bp, Artificial Sequence
  chemically synthesized
cctcagcctccagtgtgtctgg

SEQ ID NO: 800075 - DNA, 22 bp, Artificial Sequence
  chemically synthesized
atgcttgtagtcccagacacac

SEQ ID NO: 800076 - DNA, 22 bp, Artificial Sequence
  chemically synthesized
agcctccagtgtgtctgggact

SEQ ID NO: 800077 - DNA, 22 bp, Artificial Sequence
  chemically synthesized
cagtgtgtctgggactacaagc

SEQ ID NO: 800078 - DNA, 22 bp, Artificial Sequence
  chemically synthesized
ggtgtgggagctcatgcttgta

SEQ ID NO: 800079 - DNA, 22 bp, Artificial Sequence
  chemically synthesized
actgggtgtgggagctcatgct

SEQ ID NO: 800080 - DNA, 22 bp, Artificial Sequence
  chemically synthesized
ggactacaagcatgagctccca

SEQ ID NO: 800081 - DNA, 22 bp, Artificial Sequence
  chemically synthesized
aaaaattaactgggtgtgggag

SEQ ID NO: 800082 - DNA, 22 bp, Artificial Sequence
  chemically synthesized
caagcatgagctcccacaccca

SEQ ID NO: 800083 - DNA, 22 bp, Artificial Sequence
  chemically synthesized
caaagaattcaaaaattaactg

SEQ ID NO: 800084 - DNA, 22 bp, Artificial Sequence
  chemically synthesized
tacaaagaattcaaaaattaac

SEQ ID NO: 800085 - DNA, 22 bp, Artificial Sequence
  chemically synthesized
ccacacccagttaatttttgaa

SEQ ID NO: 800086 - DNA, 22 bp, Artificial Sequence
  chemically synthesized
atttttgaattctttgtagaga

SEQ ID NO: 800087 - DNA, 22 bp, Artificial Sequence
  chemically synthesized
ttgaattctttgtagagatggg

SEQ ID NO: 800088 - DNA, 22 bp, Artificial Sequence
  chemically synthesized
tgaattctttgtagagatgggg

SEQ ID NO: 800089 - DNA, 22 bp, Artificial Sequence
  chemically synthesized
gaattctttgtagagatggggc

SEQ ID NO: 800090 - DNA, 22 bp, Artificial Sequence
  chemically synthesized
aattctttgtagagatggggcc

SEQ ID NO: 800091 - DNA, 22 bp, Artificial Sequence
  chemically synthesized
ggcaacatggcaaggccccatc

SEQ ID NO: 800092 - DNA, 22 bp, Artificial Sequence
  chemically synthesized
tttgtagagatggggccttgcc

SEQ ID NO: 800093 - DNA, 22 bp, Artificial Sequence
  chemically synthesized
tgtagagatggggccttgccat

SEQ ID NO: 800094 - DNA, 22 bp, Artificial Sequence
  chemically synthesized
gtagagatggggccttgccatg

SEQ ID NO: 800095 - DNA, 22 bp, Artificial Sequence
  chemically synthesized
tagagatggggccttgccatgt

SEQ ID NO: 800096 - DNA, 22 bp, Artificial Sequence
  chemically synthesized
aagaccagcctgggcaacatgg

SEQ ID NO: 800097 - DNA, 22 bp, Artificial Sequence
  chemically synthesized
aggagttcaagaccagcctggg

SEQ ID NO: 800098 - DNA, 22 bp, Artificial Sequence
  chemically synthesized
gccatgttgcccaggctggtct

SEQ ID NO: 800099 - DNA, 22 bp, Artificial Sequence
  chemically synthesized
ccatgttgcccaggctggtctt

SEQ ID NO: 800100 - DNA, 22 bp, Artificial Sequence
  chemically synthesized
agctcaggagttcaagaccagc

SEQ ID NO: 800101 - DNA, 22 bp, Artificial Sequence
  chemically synthesized
gagctcaggagttcaagaccag

SEQ ID NO: 800102 - DNA, 22 bp, Artificial Sequence
  chemically synthesized
cccaggctggtcttgaactcct

SEQ ID NO: 800103 - DNA, 22 bp, Artificial Sequence
  chemically synthesized
gtcttgaactcctgagctcaag

SEQ ID NO: 800104 - DNA, 22 bp, Artificial Sequence
  chemically synthesized
aagcaggaggatcacttgagct

SEQ ID NO: 800105 - DNA, 22 bp, Artificial Sequence
  chemically synthesized
gaactcctgagctcaagtgatc

SEQ ID NO: 800106 - DNA, 22 bp, Artificial Sequence
  chemically synthesized
aactcctgagctcaagtgatcc

SEQ ID NO: 800107 - DNA, 22 bp, Artificial Sequence
  chemically synthesized
ctgagctcaagtgatcctcctg

SEQ ID NO: 800108 - DNA, 22 bp, Artificial Sequence
  chemically synthesized
tgggaggctaaagcaggaggat

SEQ ID NO: 800109 - DNA, 22 bp, Artificial Sequence
  chemically synthesized
agctcaagtgatcctcctgctt

SEQ ID NO: 800110 - DNA, 22 bp, Artificial Sequence
  chemically synthesized
aagtgatcctcctgctttagcc

SEQ ID NO: 800111 - DNA, 22 bp, Artificial Sequence
  chemically synthesized
taatcccagaactgtgggaggc

SEQ ID NO: 800112 - DNA, 22 bp, Artificial Sequence
  chemically synthesized
tgtaatcccagaactgtgggag

SEQ ID NO: 800113 - DNA, 22 bp, Artificial Sequence
  chemically synthesized
ctgtaatcccagaactgtggga

SEQ ID NO: 800114 - DNA, 22 bp, Artificial Sequence
  chemically synthesized
ctgctttagcctcccacagttc

SEQ ID NO: 800115 - DNA, 22 bp, Artificial Sequence
  chemically synthesized
ctttagcctcccacagttctgg

SEQ ID NO: 800116 - DNA, 22 bp, Artificial Sequence
  chemically synthesized
tagcctcccacagttctgggat

SEQ ID NO: 800117 - DNA, 22 bp, Artificial Sequence
  chemically synthesized
agcctcccacagttctgggatt

SEQ ID NO: 800118 - DNA, 22 bp, Artificial Sequence
  chemically synthesized
gcctcccacagttctgggatta

SEQ ID NO: 800119 - DNA, 22 bp, Artificial Sequence
  chemically synthesized
tgggtcacttctgtaatcccag

SEQ ID NO: 800120 - DNA, 22 bp, Artificial Sequence
  chemically synthesized
ccacagttctgggattacagaa

SEQ ID NO: 800121 - DNA, 22 bp, Artificial Sequence
  chemically synthesized
tgggattacagaagtgacccac

SEQ ID NO: 800122 - DNA, 22 bp, Artificial Sequence
  chemically synthesized
ggattacagaagtgacccacaa

SEQ ID NO: 800123 - DNA, 22 bp, Artificial Sequence
  chemically synthesized
aatggccaggcattgtgggtca

SEQ ID NO: 800124 - DNA, 22 bp, Artificial Sequence
  chemically synthesized
cagaagtgacccacaatgcctg

SEQ ID NO: 800125 - DNA, 22 bp, Artificial Sequence
  chemically synthesized
aaggctaaatggccaggcattg

SEQ ID NO: 800126 - DNA, 22 bp, Artificial Sequence
  chemically synthesized
aaaggctaaatggccaggcatt

SEQ ID NO: 800127 - DNA, 22 bp, Artificial Sequence
  chemically synthesized
gccatttagcctttaaattttt

SEQ ID NO: 800128 - DNA, 22 bp, Artificial Sequence
  chemically synthesized
tgtacccataaaaaaaatttaa

SEQ ID NO: 800129 - DNA, 22 bp, Artificial Sequence
  chemically synthesized
ctatgtacccataaaaaaaatt

SEQ ID NO: 800130 - DNA, 22 bp, Artificial Sequence
  chemically synthesized
agcctttaaattttttttatgg

SEQ ID NO: 800131 - DNA, 22 bp, Artificial Sequence
  chemically synthesized
gcctttaaattttttttatggg

SEQ ID NO: 800132 - DNA, 22 bp, Artificial Sequence
  chemically synthesized
taaattttttttatgggtacat

SEQ ID NO: 800133 - DNA, 22 bp, Artificial Sequence
  chemically synthesized
aaattttttttatgggtacata

SEQ ID NO: 800134 - DNA, 22 bp, Artificial Sequence
  chemically synthesized
aattttttttatgggtacatag

SEQ ID NO: 800135 - DNA, 22 bp, Artificial Sequence
  chemically synthesized
tttttatgggtacatagtaggt

SEQ ID NO: 800136 - DNA, 22 bp, Artificial Sequence
  chemically synthesized
ttttatgggtacatagtaggtg

SEQ ID NO: 800137 - DNA, 22 bp, Artificial Sequence
  chemically synthesized
tttatgggtacatagtaggtgc

SEQ ID NO: 800138 - DNA, 22 bp, Artificial Sequence
  chemically synthesized
ttatgggtacatagtaggtgca

SEQ ID NO: 800139 - DNA, 22 bp, Artificial Sequence
  chemically synthesized
tatgggtacatagtaggtgcat

SEQ ID NO: 800140 - DNA, 22 bp, Artificial Sequence
  chemically synthesized
atgggtacatagtaggtgcata

SEQ ID NO: 800141 - DNA, 22 bp, Artificial Sequence
  chemically synthesized
tgggtacatagtaggtgcatat

SEQ ID NO: 800142 - DNA, 22 bp, Artificial Sequence
  chemically synthesized
atgtaccccgtaaatatatgca

SEQ ID NO: 800143 - DNA, 22 bp, Artificial Sequence
  chemically synthesized
tatcaaaatatctcatgtaccc

SEQ ID NO: 800144 - DNA, 22 bp, Artificial Sequence
  chemically synthesized
taggcctatatcaaaatatctc

SEQ ID NO: 800145 - DNA, 22 bp, Artificial Sequence
  chemically synthesized
acggggtacatgagatattttg

SEQ ID NO: 800146 - DNA, 22 bp, Artificial Sequence
  chemically synthesized
cggggtacatgagatattttga

SEQ ID NO: 800147 - DNA, 22 bp, Artificial Sequence
  chemically synthesized
cacattgtaggcctatatcaaa

SEQ ID NO: 800148 - DNA, 22 bp, Artificial Sequence
  chemically synthesized
ttacacattgtaggcctatatc

SEQ ID NO: 800149 - DNA, 22 bp, Artificial Sequence
  chemically synthesized
atgtgattattacacattgtag

SEQ ID NO: 800150 - DNA, 22 bp, Artificial Sequence
  chemically synthesized
tgatataggcctacaatgtgta

SEQ ID NO: 800151 - DNA, 22 bp, Artificial Sequence
  chemically synthesized
gatataggcctacaatgtgtaa

SEQ ID NO: 800152 - DNA, 22 bp, Artificial Sequence
  chemically synthesized
atataggcctacaatgtgtaat

SEQ ID NO: 800153 - DNA, 22 bp, Artificial Sequence
  chemically synthesized
tcctgatgtgattattacacat

SEQ ID NO: 800154 - DNA, 22 bp, Artificial Sequence
  chemically synthesized
caatgtgtaataatcacatcag

SEQ ID NO: 800155 - DNA, 22 bp, Artificial Sequence
  chemically synthesized
aaaatggtcaagaaaatggtac

SEQ ID NO: 800156 - DNA, 22 bp, Artificial Sequence
  chemically synthesized
aaaaatggtcaagaaaatggta

SEQ ID NO: 800157 - DNA, 22 bp, Artificial Sequence
  chemically synthesized
tatacttaaaaatggtcaagaa

SEQ ID NO: 800158 - DNA, 22 bp, Artificial Sequence
  chemically synthesized
aactgtatacttaaaaatggtc

SEQ ID NO: 800159 - DNA, 22 bp, Artificial Sequence
  chemically synthesized
tcttgaccatttttaagtatac

SEQ ID NO: 800160 - DNA, 22 bp, Artificial Sequence
  chemically synthesized
cttgaccatttttaagtataca

SEQ ID NO: 800161 - DNA, 22 bp, Artificial Sequence
  chemically synthesized
atagtactcaactgtatactta

SEQ ID NO: 800162 - DNA, 22 bp, Artificial Sequence
  chemically synthesized
ttgaccatttttaagtatacag

SEQ ID NO: 800163 - DNA, 22 bp, Artificial Sequence
  chemically synthesized
aatagtactcaactgtatactt

SEQ ID NO: 800164 - DNA, 22 bp, Artificial Sequence
  chemically synthesized
gaccatttttaagtatacagtt

SEQ ID NO: 800165 - DNA, 22 bp, Artificial Sequence
  chemically synthesized
accatttttaagtatacagttg

SEQ ID NO: 800166 - DNA, 22 bp, Artificial Sequence
  chemically synthesized
atgtacttaatagtactcaact

SEQ ID NO: 800167 - DNA, 22 bp, Artificial Sequence
  chemically synthesized
ttaagtatacagttgagtacta

SEQ ID NO: 800168 - DNA, 22 bp, Artificial Sequence
  chemically synthesized
taagtatacagttgagtactat

SEQ ID NO: 800169 - DNA, 22 bp, Artificial Sequence
  chemically synthesized
aagtatacagttgagtactatt

SEQ ID NO: 800170 - DNA, 22 bp, Artificial Sequence
  chemically synthesized
agtatacagttgagtactatta

SEQ ID NO: 800171 - DNA, 22 bp, Artificial Sequence
  chemically synthesized
agtactattaagtacattaata

SEQ ID NO: 800172 - DNA, 22 bp, Artificial Sequence
  chemically synthesized
ttaagtacattaatattatatt

SEQ ID NO: 800173 - DNA, 22 bp, Artificial Sequence
  chemically synthesized
aacgataataataatataatat

SEQ ID NO: 800174 - DNA, 22 bp, Artificial Sequence
  chemically synthesized
agtacattaatattatattatt

SEQ ID NO: 800175 - DNA, 22 bp, Artificial Sequence
  chemically synthesized
atattatattattattatcgtt

SEQ ID NO: 800176 - DNA, 22 bp, Artificial Sequence
  chemically synthesized
tattattattatcgttgaacca

SEQ ID NO: 800177 - DNA, 22 bp, Artificial Sequence
  chemically synthesized
ttattatcgttgaaccatcacc

SEQ ID NO: 800178 - DNA, 22 bp, Artificial Sequence
  chemically synthesized
gagatggatagtggtgatggtt

SEQ ID NO: 800179 - DNA, 22 bp, Artificial Sequence
  chemically synthesized
tagagatggatagtggtgatgg

SEQ ID NO: 800180 - DNA, 22 bp, Artificial Sequence
  chemically synthesized
ttatcgttgaaccatcaccact

SEQ ID NO: 800181 - DNA, 22 bp, Artificial Sequence
  chemically synthesized
tcgttgaaccatcaccactatc

SEQ ID NO: 800182 - DNA, 22 bp, Artificial Sequence
  chemically synthesized
aaccatcaccactatccatctc

SEQ ID NO: 800183 - DNA, 22 bp, Artificial Sequence
  chemically synthesized
ggatgatgaaaacattctagag

SEQ ID NO: 800184 - DNA, 22 bp, Artificial Sequence
  chemically synthesized
gggatgatgaaaacattctaga

SEQ ID NO: 800185 - DNA, 22 bp, Artificial Sequence
  chemically synthesized
agtttgggatgatgaaaacatt

SEQ ID NO: 800186 - DNA, 22 bp, Artificial Sequence
  chemically synthesized
tccatctctagaatgttttcat

SEQ ID NO: 800187 - DNA, 22 bp, Artificial Sequence
  chemically synthesized
cagtttgggatgatgaaaacat

SEQ ID NO: 800188 - DNA, 22 bp, Artificial Sequence
  chemically synthesized
agtttcagtttgggatgatgaa

SEQ ID NO: 800189 - DNA, 22 bp, Artificial Sequence
  chemically synthesized
tagaatgttttcatcatcccaa

SEQ ID NO: 800190 - DNA, 22 bp, Artificial Sequence
  chemically synthesized
gaatgttttcatcatcccaaac

SEQ ID NO: 800191 - DNA, 22 bp, Artificial Sequence
  chemically synthesized
atgagtacctgagtttcagttt

SEQ ID NO: 800192 - DNA, 22 bp, Artificial Sequence
  chemically synthesized
aatgagtacctgagtttcagtt

SEQ ID NO: 800193 - DNA, 22 bp, Artificial Sequence
  chemically synthesized
tcatcatcccaaactgaaactc

SEQ ID NO: 800194 - DNA, 22 bp, Artificial Sequence
  chemically synthesized
catcatcccaaactgaaactca

SEQ ID NO: 800195 - DNA, 22 bp, Artificial Sequence
  chemically synthesized
atcatcccaaactgaaactcag

SEQ ID NO: 800196 - DNA, 22 bp, Artificial Sequence
  chemically synthesized
tttaatgagtacctgagtttca

SEQ ID NO: 800197 - DNA, 22 bp, Artificial Sequence
  chemically synthesized
ttgtttaatgagtacctgagtt

SEQ ID NO: 800198 - DNA, 22 bp, Artificial Sequence
  chemically synthesized
attgtttaatgagtacctgagt

SEQ ID NO: 800199 - DNA, 22 bp, Artificial Sequence
  chemically synthesized
aaactcaggtactcattaaaca

SEQ ID NO: 800200 - DNA, 22 bp, Artificial Sequence
  chemically synthesized
aggtactcattaaacaataagc

SEQ ID NO: 800201 - DNA, 22 bp, Artificial Sequence
  chemically synthesized
gaggaagaagagaatgagggct

SEQ ID NO: 800202 - DNA, 22 bp, Artificial Sequence
  chemically synthesized
attaaacaataagccctcattc

SEQ ID NO: 800203 - DNA, 22 bp, Artificial Sequence
  chemically synthesized
aacaataagccctcattctctt

SEQ ID NO: 800204 - DNA, 22 bp, Artificial Sequence
  chemically synthesized
ccaggagctggaggaagaagag

SEQ ID NO: 800205 - DNA, 22 bp, Artificial Sequence
  chemically synthesized
attctcttcttcctccagctcc

SEQ ID NO: 800206 - DNA, 22 bp, Artificial Sequence
  chemically synthesized
aaggatgttaccaggagctgga

SEQ ID NO: 800207 - DNA, 22 bp, Artificial Sequence
  chemically synthesized
tcttcttcctccagctcctggt

SEQ ID NO: 800208 - DNA, 22 bp, Artificial Sequence
  chemically synthesized
ttcttcctccagctcctggtaa

SEQ ID NO: 800209 - DNA, 22 bp, Artificial Sequence
  chemically synthesized
cttcctccagctcctggtaaca

SEQ ID NO: 800210 - DNA, 22 bp, Artificial Sequence
  chemically synthesized
ttcctccagctcctggtaacat

SEQ ID NO: 800211 - DNA, 22 bp, Artificial Sequence
  chemically synthesized
cctccagctcctggtaacatcc

SEQ ID NO: 800212 - DNA, 22 bp, Artificial Sequence
  chemically synthesized
ctccagctcctggtaacatcct

SEQ ID NO: 800213 - DNA, 22 bp, Artificial Sequence
  chemically synthesized
cagctcctggtaacatccttca

SEQ ID NO: 800214 - DNA, 22 bp, Artificial Sequence
  chemically synthesized
tacagacgtaaagttgaaggat

SEQ ID NO: 800215 - DNA, 22 bp, Artificial Sequence
  chemically synthesized
atacagacgtaaagttgaagga

SEQ ID NO: 800216 - DNA, 22 bp, Artificial Sequence
  chemically synthesized
ctggtaacatccttcaacttta

SEQ ID NO: 800217 - DNA, 22 bp, Artificial Sequence
  chemically synthesized
gtaacatccttcaactttacgt

SEQ ID NO: 800218 - DNA, 22 bp, Artificial Sequence
  chemically synthesized
caacagtcaaatttatacagac

SEQ ID NO: 800219 - DNA, 22 bp, Artificial Sequence
  chemically synthesized
caactttacgtctgtataaatt

SEQ ID NO: 800220 - DNA, 22 bp, Artificial Sequence
  chemically synthesized
aactttacgtctgtataaattt

SEQ ID NO: 800221 - DNA, 22 bp, Artificial Sequence
  chemically synthesized
cctacaacagtcaaatttatac

SEQ ID NO: 800222 - DNA, 22 bp, Artificial Sequence
  chemically synthesized
tacgtctgtataaatttgactg

SEQ ID NO: 800223 - DNA, 22 bp, Artificial Sequence
  chemically synthesized
acgtctgtataaatttgactgt

SEQ ID NO: 800224 - DNA, 22 bp, Artificial Sequence
  chemically synthesized
cgtctgtataaatttgactgtt

SEQ ID NO: 800225 - DNA, 22 bp, Artificial Sequence
  chemically synthesized
gtatgagctacctacaacagtc

SEQ ID NO: 800226 - DNA, 22 bp, Artificial Sequence
  chemically synthesized
tataaatttgactgttgtaggt

SEQ ID NO: 800227 - DNA, 22 bp, Artificial Sequence
  chemically synthesized
cactggtatgagctacctacaa

SEQ ID NO: 800228 - DNA, 22 bp, Artificial Sequence
  chemically synthesized
gactgttgtaggtagctcatac

SEQ ID NO: 800229 - DNA, 22 bp, Artificial Sequence
  chemically synthesized
actgttgtaggtagctcatacc

SEQ ID NO: 800230 - DNA, 22 bp, Artificial Sequence
  chemically synthesized
tatgattccactggtatgagct

SEQ ID NO: 800231 - DNA, 22 bp, Artificial Sequence
  chemically synthesized
ttgtaggtagctcataccagtg

SEQ ID NO: 800232 - DNA, 22 bp, Artificial Sequence
  chemically synthesized
taggtagctcataccagtggaa

SEQ ID NO: 800233 - DNA, 22 bp, Artificial Sequence
  chemically synthesized
ataccagtggaatcatacaata

SEQ ID NO: 800234 - DNA, 22 bp, Artificial Sequence
  chemically synthesized
agtgaaataaaccagacacaaa

SEQ ID NO: 800235 - DNA, 22 bp, Artificial Sequence
  chemically synthesized
tgctaagtgaaataaaccagac

SEQ ID NO: 800236 - DNA, 22 bp, Artificial Sequence
  chemically synthesized
ttcattttgtgtctggtttatt

SEQ ID NO: 800237 - DNA, 22 bp, Artificial Sequence
  chemically synthesized
tcattttgtgtctggtttattt

SEQ ID NO: 800238 - DNA, 22 bp, Artificial Sequence
  chemically synthesized
cattttgtgtctggtttatttc

SEQ ID NO: 800239 - DNA, 22 bp, Artificial Sequence
  chemically synthesized
attttgtgtctggtttatttca

SEQ ID NO: 800240 - DNA, 22 bp, Artificial Sequence
  chemically synthesized
tgtgtctggtttatttcactta

SEQ ID NO: 800241 - DNA, 22 bp, Artificial Sequence
  chemically synthesized
gaggcattatgctaagtgaaat

SEQ ID NO: 800242 - DNA, 22 bp, Artificial Sequence
  chemically synthesized
gtgtctggtttatttcacttag

SEQ ID NO: 800243 - DNA, 22 bp, Artificial Sequence
  chemically synthesized
agaggcattatgctaagtgaaa

SEQ ID NO: 800244 - DNA, 22 bp, Artificial Sequence
  chemically synthesized
tgtctggtttatttcacttagc

SEQ ID NO: 800245 - DNA, 22 bp, Artificial Sequence
  chemically synthesized
gtttatttcacttagcataatg

SEQ ID NO: 800246 - DNA, 22 bp, Artificial Sequence
  chemically synthesized
atttcacttagcataatgcctc

SEQ ID NO: 800247 - DNA, 22 bp, Artificial Sequence
  chemically synthesized
tttcacttagcataatgcctct

SEQ ID NO: 800248 - DNA, 22 bp, Artificial Sequence
  chemically synthesized
cacttagcataatgcctctaag

SEQ ID NO: 800249 - DNA, 22 bp, Artificial Sequence
  chemically synthesized
atatgggtgaatcttagaggca

SEQ ID NO: 800250 - DNA, 22 bp, Artificial Sequence
  chemically synthesized
acttagcataatgcctctaaga

SEQ ID NO: 800251 - DNA, 22 bp, Artificial Sequence
  chemically synthesized
agcataatgcctctaagattca

SEQ ID NO: 800252 - DNA, 22 bp, Artificial Sequence
  chemically synthesized
gcataatgcctctaagattcac

SEQ ID NO: 800253 - DNA, 22 bp, Artificial Sequence
  chemically synthesized
taagattcacccatattagctc

SEQ ID NO: 800254 - DNA, 22 bp, Artificial Sequence
  chemically synthesized
agattcacccatattagctcat

SEQ ID NO: 800255 - DNA, 22 bp, Artificial Sequence
  chemically synthesized
agcaaatcaaaagatgagctaa

SEQ ID NO: 800256 - DNA, 22 bp, Artificial Sequence
  chemically synthesized
acccatattagctcatcttttg

SEQ ID NO: 800257 - DNA, 22 bp, Artificial Sequence
  chemically synthesized
aaagaattcagcaaatcaaaag

SEQ ID NO: 800258 - DNA, 22 bp, Artificial Sequence
  chemically synthesized
gctcatcttttgatttgctgaa

SEQ ID NO: 800259 - DNA, 22 bp, Artificial Sequence
  chemically synthesized
atcttttgatttgctgaattct

SEQ ID NO: 800260 - DNA, 22 bp, Artificial Sequence
  chemically synthesized
aacaagaagttaaaagaattca

SEQ ID NO: 800261 - DNA, 22 bp, Artificial Sequence
  chemically synthesized
gaacaagaagttaaaagaattc

SEQ ID NO: 800262 - DNA, 22 bp, Artificial Sequence
  chemically synthesized
ttgatttgctgaattcttttaa

SEQ ID NO: 800263 - DNA, 22 bp, Artificial Sequence
  chemically synthesized
tgatttgctgaattcttttaac

SEQ ID NO: 800264 - DNA, 22 bp, Artificial Sequence
  chemically synthesized
gatttgctgaattcttttaact

SEQ ID NO: 800265 - DNA, 22 bp, Artificial Sequence
  chemically synthesized
atttgctgaattcttttaactt

SEQ ID NO: 800266 - DNA, 22 bp, Artificial Sequence
  chemically synthesized
gctgaattcttttaacttcttg

SEQ ID NO: 800267 - DNA, 22 bp, Artificial Sequence
  chemically synthesized
ctgaattcttttaacttcttgt

SEQ ID NO: 800268 - DNA, 22 bp, Artificial Sequence
  chemically synthesized
aattcttttaacttcttgttca

SEQ ID NO: 800269 - DNA, 22 bp, Artificial Sequence
  chemically synthesized
ttttaacttcttgttcaagatg

SEQ ID NO: 800270 - DNA, 22 bp, Artificial Sequence
  chemically synthesized
ttaacttcttgttcaagatgat

SEQ ID NO: 800271 - DNA, 22 bp, Artificial Sequence
  chemically synthesized
aagagccagaacatcatcttga

SEQ ID NO: 800272 - DNA, 22 bp, Artificial Sequence
  chemically synthesized
taacttcttgttcaagatgatg

SEQ ID NO: 800273 - DNA, 22 bp, Artificial Sequence
  chemically synthesized
aaagagccagaacatcatcttg

SEQ ID NO: 800274 - DNA, 22 bp, Artificial Sequence
  chemically synthesized
aacttcttgttcaagatgatgt

SEQ ID NO: 800275 - DNA, 22 bp, Artificial Sequence
  chemically synthesized
acttcttgttcaagatgatgtt

SEQ ID NO: 800276 - DNA, 22 bp, Artificial Sequence
  chemically synthesized
ttaaagagccagaacatcatct

SEQ ID NO: 800277 - DNA, 22 bp, Artificial Sequence
  chemically synthesized
cttaaagagccagaacatcatc

SEQ ID NO: 800278 - DNA, 22 bp, Artificial Sequence
  chemically synthesized
cttgttcaagatgatgttctgg

SEQ ID NO: 800279 - DNA, 22 bp, Artificial Sequence
  chemically synthesized
ttgttcaagatgatgttctggc

SEQ ID NO: 800280 - DNA, 22 bp, Artificial Sequence
  chemically synthesized
atttcttaaagagccagaacat

SEQ ID NO: 800281 - DNA, 22 bp, Artificial Sequence
  chemically synthesized
gttcaagatgatgttctggctc

SEQ ID NO: 800282 - DNA, 22 bp, Artificial Sequence
  chemically synthesized
ttcaagatgatgttctggctct

SEQ ID NO: 800283 - DNA, 22 bp, Artificial Sequence
  chemically synthesized
aagatgatgttctggctcttta

SEQ ID NO: 800284 - DNA, 22 bp, Artificial Sequence
  chemically synthesized
tggctctttaagaaatgaattt

SEQ ID NO: 800285 - DNA, 22 bp, Artificial Sequence
  chemically synthesized
gacaaatgatagaaattcattt

SEQ ID NO: 800286 - DNA, 22 bp, Artificial Sequence
  chemically synthesized
gctctttaagaaatgaatttct

SEQ ID NO: 800287 - DNA, 22 bp, Artificial Sequence
  chemically synthesized
tttaagaaatgaatttctatca

SEQ ID NO: 800288 - DNA, 22 bp, Artificial Sequence
  chemically synthesized
aagttggacaaatgatagaaat

SEQ ID NO: 800289 - DNA, 22 bp, Artificial Sequence
  chemically synthesized
taagaaatgaatttctatcatt

SEQ ID NO: 800290 - DNA, 22 bp, Artificial Sequence
  chemically synthesized
aagaaatgaatttctatcattt

SEQ ID NO: 800291 - DNA, 22 bp, Artificial Sequence
  chemically synthesized
ttgaagttggacaaatgataga

SEQ ID NO: 800292 - DNA, 22 bp, Artificial Sequence
  chemically synthesized
agaaatgaatttctatcatttg

SEQ ID NO: 800293 - DNA, 22 bp, Artificial Sequence
  chemically synthesized
tctattgaagttggacaaatga

SEQ ID NO: 800294 - DNA, 22 bp, Artificial Sequence
  chemically synthesized
gcagctatctattgaagttgga

SEQ ID NO: 800295 - DNA, 22 bp, Artificial Sequence
  chemically synthesized
agcagctatctattgaagttgg

SEQ ID NO: 800296 - DNA, 22 bp, Artificial Sequence
  chemically synthesized
ctatcatttgtccaacttcaat

SEQ ID NO: 800297 - DNA, 22 bp, Artificial Sequence
  chemically synthesized
tatcatttgtccaacttcaata

SEQ ID NO: 800298 - DNA, 22 bp, Artificial Sequence
  chemically synthesized
tcatttgtccaacttcaataga

SEQ ID NO: 800299 - DNA, 22 bp, Artificial Sequence
  chemically synthesized
atttagcagctatctattgaag

SEQ ID NO: 800300 - DNA, 22 bp, Artificial Sequence
  chemically synthesized
tcatttagcagctatctattga

SEQ ID NO: 800301 - DNA, 22 bp, Artificial Sequence
  chemically synthesized
tctcatttagcagctatctatt

SEQ ID NO: 800302 - DNA, 22 bp, Artificial Sequence
  chemically synthesized
ctctcatttagcagctatctat

SEQ ID NO: 800303 - DNA, 22 bp, Artificial Sequence
  chemically synthesized
gtccaacttcaatagatagctg

SEQ ID NO: 800304 - DNA, 22 bp, Artificial Sequence
  chemically synthesized
tctctcatttagcagctatcta

SEQ ID NO: 800305 - DNA, 22 bp, Artificial Sequence
  chemically synthesized
tccaacttcaatagatagctgc

SEQ ID NO: 800306 - DNA, 22 bp, Artificial Sequence
  chemically synthesized
aatgctttctctcatttagcag

SEQ ID NO: 800307 - DNA, 22 bp, Artificial Sequence
  chemically synthesized
caatagatagctgctaaatgag

SEQ ID NO: 800308 - DNA, 22 bp, Artificial Sequence
  chemically synthesized
tgaatgctttctctcatttagc

SEQ ID NO: 800309 - DNA, 22 bp, Artificial Sequence
  chemically synthesized
aatagatagctgctaaatgaga

SEQ ID NO: 800310 - DNA, 22 bp, Artificial Sequence
  chemically synthesized
ctgaatgctttctctcatttag

SEQ ID NO: 800311 - DNA, 22 bp, Artificial Sequence
  chemically synthesized
tctgaatgctttctctcattta

SEQ ID NO: 800312 - DNA, 22 bp, Artificial Sequence
  chemically synthesized
ctaaatgagagaaagcattcag

SEQ ID NO: 800313 - DNA, 22 bp, Artificial Sequence
  chemically synthesized
aatgagagaaagcattcagaaa

SEQ ID NO: 800314 - DNA, 22 bp, Artificial Sequence
  chemically synthesized
acccaggaatgccctttctgaa

SEQ ID NO: 800315 - DNA, 22 bp, Artificial Sequence
  chemically synthesized
attcacccaggaatgccctttc

SEQ ID NO: 800316 - DNA, 22 bp, Artificial Sequence
  chemically synthesized
cattcacccaggaatgcccttt

SEQ ID NO: 800317 - DNA, 22 bp, Artificial Sequence
  chemically synthesized
tttcattcacccaggaatgccc

SEQ ID NO: 800318 - DNA, 22 bp, Artificial Sequence
  chemically synthesized
tctatttcattcacccaggaat

SEQ ID NO: 800319 - DNA, 22 bp, Artificial Sequence
  chemically synthesized
tgtctatttcattcacccagga

SEQ ID NO: 800320 - DNA, 22 bp, Artificial Sequence
  chemically synthesized
agaaagggcattcctgggtgaa

SEQ ID NO: 800321 - DNA, 22 bp, Artificial Sequence
  chemically synthesized
caggctctgtctatttcattca

SEQ ID NO: 800322 - DNA, 22 bp, Artificial Sequence
  chemically synthesized
ctgggtgaatgaaatagacaga

SEQ ID NO: 800323 - DNA, 22 bp, Artificial Sequence
  chemically synthesized
ggtgaatgaaatagacagagcc

SEQ ID NO: 800324 - DNA, 22 bp, Artificial Sequence
  chemically synthesized
tgccggcctccaggctctgtct

SEQ ID NO: 800325 - DNA, 22 bp, Artificial Sequence
  chemically synthesized
acatcactatgccggcctccag

SEQ ID NO: 800326 - DNA, 22 bp, Artificial Sequence
  chemically synthesized
cacatcactatgccggcctcca

SEQ ID NO: 800327 - DNA, 22 bp, Artificial Sequence
  chemically synthesized
gaggccggcatagtgatgtgaa

SEQ ID NO: 800328 - DNA, 22 bp, Artificial Sequence
  chemically synthesized
agtagaaaatgcatttcacatc

SEQ ID NO: 800329 - DNA, 22 bp, Artificial Sequence
  chemically synthesized
aactaagtagaaaatgcatttc

SEQ ID NO: 800330 - DNA, 22 bp, Artificial Sequence
  chemically synthesized
caactaagtagaaaatgcattt

SEQ ID NO: 800331 - DNA, 22 bp, Artificial Sequence
  chemically synthesized
tcaactaagtagaaaatgcatt

SEQ ID NO: 800332 - DNA, 22 bp, Artificial Sequence
  chemically synthesized
aagtgactttcaactaagtaga

SEQ ID NO: 800333 - DNA, 22 bp, Artificial Sequence
  chemically synthesized
caagtgactttcaactaagtag

SEQ ID NO: 800334 - DNA, 22 bp, Artificial Sequence
  chemically synthesized
tcaagtgactttcaactaagta

SEQ ID NO: 800335 - DNA, 22 bp, Artificial Sequence
  chemically synthesized
ttcaagtgactttcaactaagt

SEQ ID NO: 800336 - DNA, 22 bp, Artificial Sequence
  chemically synthesized
ttttcaagtgactttcaactaa

SEQ ID NO: 800337 - DNA, 22 bp, Artificial Sequence
  chemically synthesized
cttttcaagtgactttcaacta

SEQ ID NO: 800338 - DNA, 22 bp, Artificial Sequence
  chemically synthesized
tcttttcaagtgactttcaact

SEQ ID NO: 800339 - DNA, 22 bp, Artificial Sequence
  chemically synthesized
ttcttttcaagtgactttcaac

SEQ ID NO: 800340 - DNA, 22 bp, Artificial Sequence
  chemically synthesized
tttcttttcaagtgactttcaa

SEQ ID NO: 800341 - DNA, 22 bp, Artificial Sequence
  chemically synthesized
tttttcttttcaagtgactttc

SEQ ID NO: 800342 - DNA, 22 bp, Artificial Sequence
  chemically synthesized
tctacttagttgaaagtcactt

SEQ ID NO: 800343 - DNA, 22 bp, Artificial Sequence
  chemically synthesized
ctttttcttttcaagtgacttt

SEQ ID NO: 800344 - DNA, 22 bp, Artificial Sequence
  chemically synthesized
ctacttagttgaaagtcacttg

SEQ ID NO: 800345 - DNA, 22 bp, Artificial Sequence
  chemically synthesized
tacttagttgaaagtcacttga

SEQ ID NO: 800346 - DNA, 22 bp, Artificial Sequence
  chemically synthesized
tttctttttcttttcaagtgac

SEQ ID NO: 800347 - DNA, 22 bp, Artificial Sequence
  chemically synthesized
cttagttgaaagtcacttgaaa

SEQ ID NO: 800348 - DNA, 22 bp, Artificial Sequence
  chemically synthesized
ctatttctttttcttttcaagt

SEQ ID NO: 800349 - DNA, 22 bp, Artificial Sequence
  chemically synthesized
agttgaaagtcacttgaaaaga

SEQ ID NO: 800350 - DNA, 22 bp, Artificial Sequence
  chemically synthesized
cctatttctttttcttttcaag

SEQ ID NO: 800351 - DNA, 22 bp, Artificial Sequence
  chemically synthesized
gttgaaagtcacttgaaaagaa

SEQ ID NO: 800352 - DNA, 22 bp, Artificial Sequence
  chemically synthesized
tttcctatttctttttcttttc

SEQ ID NO: 800353 - DNA, 22 bp, Artificial Sequence
  chemically synthesized
atttcctatttctttttctttt

SEQ ID NO: 800354 - DNA, 22 bp, Artificial Sequence
  chemically synthesized
aaagtcacttgaaaagaaaaag

SEQ ID NO: 800355 - DNA, 22 bp, Artificial Sequence
  chemically synthesized
ttatttcctatttctttttctt

SEQ ID NO: 800356 - DNA, 22 bp, Artificial Sequence
  chemically synthesized
tcttatttcctatttctttttc

SEQ ID NO: 800357 - DNA, 22 bp, Artificial Sequence
  chemically synthesized
tctctcttatttcctatttctt

SEQ ID NO: 800358 - DNA, 22 bp, Artificial Sequence
  chemically synthesized
gaaaagaaaaagaaataggaaa

SEQ ID NO: 800359 - DNA, 22 bp, Artificial Sequence
  chemically synthesized
ctgtctctcttatttcctattt

SEQ ID NO: 800360 - DNA, 22 bp, Artificial Sequence
  chemically synthesized
aaaagaaaaagaaataggaaat

SEQ ID NO: 800361 - DNA, 22 bp, Artificial Sequence
  chemically synthesized
ctcctgtctctcttatttccta

SEQ ID NO: 800362 - DNA, 22 bp, Artificial Sequence
  chemically synthesized
tcctcctgtctctcttatttcc

SEQ ID NO: 800363 - DNA, 22 bp, Artificial Sequence
  chemically synthesized
ctcctcctgtctctcttatttc

SEQ ID NO: 800364 - DNA, 22 bp, Artificial Sequence
  chemically synthesized
ttctcctcctgtctctcttatt

SEQ ID NO: 800365 - DNA, 22 bp, Artificial Sequence
  chemically synthesized
tcttctcctcctgtctctctta

SEQ ID NO: 800366 - DNA, 22 bp, Artificial Sequence
  chemically synthesized
ctcttctcctcctgtctctctt

SEQ ID NO: 800367 - DNA, 22 bp, Artificial Sequence
  chemically synthesized
ttctcttctcctcctgtctctc

SEQ ID NO: 800368 - DNA, 22 bp, Artificial Sequence
  chemically synthesized
tcttctcttctcctcctgtctc

SEQ ID NO: 800369 - DNA, 22 bp, Artificial Sequence
  chemically synthesized
atctctcttctcttctcctcct

SEQ ID NO: 800370 - DNA, 22 bp, Artificial Sequence
  chemically synthesized
gttcatctctcttctcttctcc

SEQ ID NO: 800371 - DNA, 22 bp, Artificial Sequence
  chemically synthesized
agttcatctctcttctcttctc

SEQ ID NO: 800372 - DNA, 22 bp, Artificial Sequence
  chemically synthesized
agtttagttcatctctcttctc

SEQ ID NO: 800373 - DNA, 22 bp, Artificial Sequence
  chemically synthesized
tcagtttagttcatctctcttc

SEQ ID NO: 800374 - DNA, 22 bp, Artificial Sequence
  chemically synthesized
ctcagtttagttcatctctctt

SEQ ID NO: 800375 - DNA, 22 bp, Artificial Sequence
  chemically synthesized
tctcagtttagttcatctctct

SEQ ID NO: 800376 - DNA, 22 bp, Artificial Sequence
  chemically synthesized
ttctcagtttagttcatctctc

SEQ ID NO: 800377 - DNA, 22 bp, Artificial Sequence
  chemically synthesized
gtttttctcagtttagttcatc

SEQ ID NO: 800378 - DNA, 22 bp, Artificial Sequence
  chemically synthesized
agtttttctcagtttagttcat

SEQ ID NO: 800379 - DNA, 22 bp, Artificial Sequence
  chemically synthesized
agaaagtcttagtttttctcag

SEQ ID NO: 800380 - DNA, 22 bp, Artificial Sequence
  chemically synthesized
aagaaagtcttagtttttctca

SEQ ID NO: 800381 - DNA, 22 bp, Artificial Sequence
  chemically synthesized
aactgagaaaaactaagacttt

SEQ ID NO: 800382 - DNA, 22 bp, Artificial Sequence
  chemically synthesized
agaaaaactaagactttcttaa

SEQ ID NO: 800383 - DNA, 22 bp, Artificial Sequence
  chemically synthesized
agcacagcgcagccttaagaaa

SEQ ID NO: 800384 - DNA, 22 bp, Artificial Sequence
  chemically synthesized
atctgagcacagcgcagcctta

SEQ ID NO: 800385 - DNA, 22 bp, Artificial Sequence
  chemically synthesized
agactttcttaaggctgcgctg

SEQ ID NO: 800386 - DNA, 22 bp, Artificial Sequence
  chemically synthesized
ctaatctgagcacagcgcagcc

SEQ ID NO: 800387 - DNA, 22 bp, Artificial Sequence
  chemically synthesized
tcttaaggctgcgctgtgctca

SEQ ID NO: 800388 - DNA, 22 bp, Artificial Sequence
  chemically synthesized
cttaaggctgcgctgtgctcag

SEQ ID NO: 800389 - DNA, 22 bp, Artificial Sequence
  chemically synthesized
ttaaggctgcgctgtgctcaga

SEQ ID NO: 800390 - DNA, 22 bp, Artificial Sequence
  chemically synthesized
aaggctgcgctgtgctcagatt

SEQ ID NO: 800391 - DNA, 22 bp, Artificial Sequence
  chemically synthesized
catagccctactaatctgagca

SEQ ID NO: 800392 - DNA, 22 bp, Artificial Sequence
  chemically synthesized
aggctgcgctgtgctcagatta

SEQ ID NO: 800393 - DNA, 22 bp, Artificial Sequence
  chemically synthesized
gcatagccctactaatctgagc

SEQ ID NO: 800394 - DNA, 22 bp, Artificial Sequence
  chemically synthesized
atttgcatagccctactaatct

SEQ ID NO: 800395 - DNA, 22 bp, Artificial Sequence
  chemically synthesized
cgctgtgctcagattagtaggg

SEQ ID NO: 800396 - DNA, 22 bp, Artificial Sequence
  chemically synthesized
tgctcagattagtagggctatg

SEQ ID NO: 800397 - DNA, 22 bp, Artificial Sequence
  chemically synthesized
ataacctcatttgcatagccct

SEQ ID NO: 800398 - DNA, 22 bp, Artificial Sequence
  chemically synthesized
ttaataacctcatttgcatagc

SEQ ID NO: 800399 - DNA, 22 bp, Artificial Sequence
  chemically synthesized
agattagtagggctatgcaaat

SEQ ID NO: 800400 - DNA, 22 bp, Artificial Sequence
  chemically synthesized
gtagggctatgcaaatgaggtt

SEQ ID NO: 800401 - DNA, 22 bp, Artificial Sequence
  chemically synthesized
gaatatacctgttaataacctc

SEQ ID NO: 800402 - DNA, 22 bp, Artificial Sequence
  chemically synthesized
agaatatacctgttaataacct

SEQ ID NO: 800403 - DNA, 22 bp, Artificial Sequence
  chemically synthesized
tgcaaatgaggttattaacagg

SEQ ID NO: 800404 - DNA, 22 bp, Artificial Sequence
  chemically synthesized
atatttagaatatacctgttaa

SEQ ID NO: 800405 - DNA, 22 bp, Artificial Sequence
  chemically synthesized
ttaacaggtatattctaaatat

SEQ ID NO: 800406 - DNA, 22 bp, Artificial Sequence
  chemically synthesized
acaggtatattctaaatattaa

SEQ ID NO: 800407 - DNA, 22 bp, Artificial Sequence
  chemically synthesized
catgtataccagtgtgtaccaa

SEQ ID NO: 800408 - DNA, 22 bp, Artificial Sequence
  chemically synthesized
taaatattaattggtacacact

SEQ ID NO: 800409 - DNA, 22 bp, Artificial Sequence
  chemically synthesized
aatattaattggtacacactgg

SEQ ID NO: 800410 - DNA, 22 bp, Artificial Sequence
  chemically synthesized
attggtacacactggtatacat

SEQ ID NO: 800411 - DNA, 22 bp, Artificial Sequence
  chemically synthesized
ataatatcgggttccatgtata

SEQ ID NO: 800412 - DNA, 22 bp, Artificial Sequence
  chemically synthesized
gtacacactggtatacatggaa

SEQ ID NO: 800413 - DNA, 22 bp, Artificial Sequence
  chemically synthesized
aataatatcgggttccatgtat

SEQ ID NO: 800414 - DNA, 22 bp, Artificial Sequence
  chemically synthesized
taataatatcgggttccatgta

SEQ ID NO: 800415 - DNA, 22 bp, Artificial Sequence
  chemically synthesized
gtatacatggaacccgatatta

SEQ ID NO: 800416 - DNA, 22 bp, Artificial Sequence
  chemically synthesized
ccccaaaggtattttaataata

SEQ ID NO: 800417 - DNA, 22 bp, Artificial Sequence
  chemically synthesized
gccccaaaggtattttaataat

SEQ ID NO: 800418 - DNA, 22 bp, Artificial Sequence
  chemically synthesized
tagtttgccccaaaggtatttt

SEQ ID NO: 800419 - DNA, 22 bp, Artificial Sequence
  chemically synthesized
tctatagtttgccccaaaggta

SEQ ID NO: 800420 - DNA, 22 bp, Artificial Sequence
  chemically synthesized
gtctatagtttgccccaaaggt

SEQ ID NO: 800421 - DNA, 22 bp, Artificial Sequence
  chemically synthesized
tgtctatagtttgccccaaagg

SEQ ID NO: 800422 - DNA, 22 bp, Artificial Sequence
  chemically synthesized
tttgtctatagtttgccccaaa

SEQ ID NO: 800423 - DNA, 22 bp, Artificial Sequence
  chemically synthesized
ctttgtctatagtttgccccaa

SEQ ID NO: 800424 - DNA, 22 bp, Artificial Sequence
  chemically synthesized
ttaaaatacctttggggcaaac

SEQ ID NO: 800425 - DNA, 22 bp, Artificial Sequence
  chemically synthesized
tctttgtctatagtttgcccca

SEQ ID NO: 800426 - DNA, 22 bp, Artificial Sequence
  chemically synthesized
ttctttgtctatagtttgcccc

SEQ ID NO: 800427 - DNA, 22 bp, Artificial Sequence
  chemically synthesized
aaatacctttggggcaaactat

SEQ ID NO: 800428 - DNA, 22 bp, Artificial Sequence
  chemically synthesized
cttttctttgtctatagtttgc

SEQ ID NO: 800429 - DNA, 22 bp, Artificial Sequence
  chemically synthesized
gcttttctttgtctatagtttg

SEQ ID NO: 800430 - DNA, 22 bp, Artificial Sequence
  chemically synthesized
tttgcttttctttgtctatagt

SEQ ID NO: 800431 - DNA, 22 bp, Artificial Sequence
  chemically synthesized
atttgcttttctttgtctatag

SEQ ID NO: 800432 - DNA, 22 bp, Artificial Sequence
  chemically synthesized
tatttgcttttctttgtctata

SEQ ID NO: 800433 - DNA, 22 bp, Artificial Sequence
  chemically synthesized
tggggcaaactatagacaaaga

SEQ ID NO: 800434 - DNA, 22 bp, Artificial Sequence
  chemically synthesized
tttatttgcttttctttgtcta

SEQ ID NO: 800435 - DNA, 22 bp, Artificial Sequence
  chemically synthesized
ggggcaaactatagacaaagaa

SEQ ID NO: 800436 - DNA, 22 bp, Artificial Sequence
  chemically synthesized
ctttatttgcttttctttgtct

SEQ ID NO: 800437 - DNA, 22 bp, Artificial Sequence
  chemically synthesized
gggcaaactatagacaaagaaa

SEQ ID NO: 800438 - DNA, 22 bp, Artificial Sequence
  chemically synthesized
acttctttatttgcttttcttt

SEQ ID NO: 800439 - DNA, 22 bp, Artificial Sequence
  chemically synthesized
cacttctttatttgcttttctt

SEQ ID NO: 800440 - DNA, 22 bp, Artificial Sequence
  chemically synthesized
tttcacttctttatttgctttt

SEQ ID NO: 800441 - DNA, 22 bp, Artificial Sequence
  chemically synthesized
atttcacttctttatttgcttt

SEQ ID NO: 800442 - DNA, 22 bp, Artificial Sequence
  chemically synthesized
tatttcacttctttatttgctt

SEQ ID NO: 800443 - DNA, 22 bp, Artificial Sequence
  chemically synthesized
tagacaaagaaaagcaaataaa

SEQ ID NO: 800444 - DNA, 22 bp, Artificial Sequence
  chemically synthesized
tttatttcacttctttatttgc

SEQ ID NO: 800445 - DNA, 22 bp, Artificial Sequence
  chemically synthesized
ctttatttcacttctttatttg

SEQ ID NO: 800446 - DNA, 22 bp, Artificial Sequence
  chemically synthesized
cttctttatttcacttctttat

SEQ ID NO: 800447 - DNA, 22 bp, Artificial Sequence
  chemically synthesized
acttctttatttcacttcttta

SEQ ID NO: 800448 - DNA, 22 bp, Artificial Sequence
  chemically synthesized
gaatagcaacatagatgcttac

SEQ ID NO: 800449 - DNA, 22 bp, Artificial Sequence
  chemically synthesized
tcgaatagcaacatagatgctt

SEQ ID NO: 800450 - DNA, 22 bp, Artificial Sequence
  chemically synthesized
agcacgataaatacctctcgaa

SEQ ID NO: 800451 - DNA, 22 bp, Artificial Sequence
  chemically synthesized
aagcacgataaatacctctcga

SEQ ID NO: 800452 - DNA, 22 bp, Artificial Sequence
  chemically synthesized
tgttgctattcgagaggtattt

SEQ ID NO: 800453 - DNA, 22 bp, Artificial Sequence
  chemically synthesized
aatcttaagcacgataaatacc

SEQ ID NO: 800454 - DNA, 22 bp, Artificial Sequence
  chemically synthesized
ctattcgagaggtatttatcgt

SEQ ID NO: 800455 - DNA, 22 bp, Artificial Sequence
  chemically synthesized
ttcgagaggtatttatcgtgct

SEQ ID NO: 800456 - DNA, 22 bp, Artificial Sequence
  chemically synthesized
aaattaaatcttaagcacgata

SEQ ID NO: 800457 - DNA, 22 bp, Artificial Sequence
  chemically synthesized
gagaggtatttatcgtgcttaa

SEQ ID NO: 800458 - DNA, 22 bp, Artificial Sequence
  chemically synthesized
tataaattaaaattaaatctta

SEQ ID NO: 800459 - DNA, 22 bp, Artificial Sequence
  chemically synthesized
atcgtgcttaagatttaatttt

SEQ ID NO: 800460 - DNA, 22 bp, Artificial Sequence
  chemically synthesized
tcgtgcttaagatttaatttta

SEQ ID NO: 800461 - DNA, 22 bp, Artificial Sequence
  chemically synthesized
aagatttaattttaatttatat

SEQ ID NO: 800462 - DNA, 22 bp, Artificial Sequence
  chemically synthesized
atgacagtaactatataaatta

SEQ ID NO: 800463 - DNA, 22 bp, Artificial Sequence
  chemically synthesized
agatttaattttaatttatata

SEQ ID NO: 800464 - DNA, 22 bp, Artificial Sequence
  chemically synthesized
aattttaatttatatagttact

SEQ ID NO: 800465 - DNA, 22 bp, Artificial Sequence
  chemically synthesized
attttaatttatatagttactg

SEQ ID NO: 800466 - DNA, 22 bp, Artificial Sequence
  chemically synthesized
caaaatgctcatgacagtaact

SEQ ID NO: 800467 - DNA, 22 bp, Artificial Sequence
  chemically synthesized
taatttatatagttactgtcat

SEQ ID NO: 800468 - DNA, 22 bp, Artificial Sequence
  chemically synthesized
aatttatatagttactgtcatg

SEQ ID NO: 800469 - DNA, 22 bp, Artificial Sequence
  chemically synthesized
atttatatagttactgtcatga

SEQ ID NO: 800470 - DNA, 22 bp, Artificial Sequence
  chemically synthesized
aaagctgcaaaatgctcatgac

SEQ ID NO: 800471 - DNA, 22 bp, Artificial Sequence
  chemically synthesized
atatagttactgtcatgagcat

SEQ ID NO: 800472 - DNA, 22 bp, Artificial Sequence
  chemically synthesized
aaaagctgcaaaatgctcatga

SEQ ID NO: 800473 - DNA, 22 bp, Artificial Sequence
  chemically synthesized
tatagttactgtcatgagcatt

SEQ ID NO: 800474 - DNA, 22 bp, Artificial Sequence
  chemically synthesized
acttaaaagctgcaaaatgctc

SEQ ID NO: 800475 - DNA, 22 bp, Artificial Sequence
  chemically synthesized
tgacttaaaagctgcaaaatgc

SEQ ID NO: 800476 - DNA, 22 bp, Artificial Sequence
  chemically synthesized
ctgacttaaaagctgcaaaatg

SEQ ID NO: 800477 - DNA, 22 bp, Artificial Sequence
  chemically synthesized
ctgtcatgagcattttgcagct

SEQ ID NO: 800478 - DNA, 22 bp, Artificial Sequence
  chemically synthesized
ccttctgacttaaaagctgcaa

SEQ ID NO: 800479 - DNA, 22 bp, Artificial Sequence
  chemically synthesized
tcatgagcattttgcagctttt

SEQ ID NO: 800480 - DNA, 22 bp, Artificial Sequence
  chemically synthesized
cccttctgacttaaaagctgca

SEQ ID NO: 800481 - DNA, 22 bp, Artificial Sequence
  chemically synthesized
aataacttcccttctgacttaa

SEQ ID NO: 800482 - DNA, 22 bp, Artificial Sequence
  chemically synthesized
tgcagcttttaagtcagaaggg

SEQ ID NO: 800483 - DNA, 22 bp, Artificial Sequence
  chemically synthesized
gcagcttttaagtcagaaggga

SEQ ID NO: 800484 - DNA, 22 bp, Artificial Sequence
  chemically synthesized
cagcttttaagtcagaagggaa

SEQ ID NO: 800485 - DNA, 22 bp, Artificial Sequence
  chemically synthesized
ttaagtcagaagggaagttatt

SEQ ID NO: 800486 - DNA, 22 bp, Artificial Sequence
  chemically synthesized
taagtcagaagggaagttattt

SEQ ID NO: 800487 - DNA, 22 bp, Artificial Sequence
  chemically synthesized
aagtcagaagggaagttattta

SEQ ID NO: 800488 - DNA, 22 bp, Artificial Sequence
  chemically synthesized
agtcagaagggaagttatttaa

SEQ ID NO: 800489 - DNA, 22 bp, Artificial Sequence
  chemically synthesized
caataaaacataaattaaataa

SEQ ID NO: 800490 - DNA, 22 bp, Artificial Sequence
  chemically synthesized
tacaataaaacataaattaaat

SEQ ID NO: 800491 - DNA, 22 bp, Artificial Sequence
  chemically synthesized
ctacaataaaacataaattaaa

SEQ ID NO: 800492 - DNA, 22 bp, Artificial Sequence
  chemically synthesized
tctacaataaaacataaattaa

SEQ ID NO: 800493 - DNA, 22 bp, Artificial Sequence
  chemically synthesized
ttctacaataaaacataaatta

SEQ ID NO: 800494 - DNA, 22 bp, Artificial Sequence
  chemically synthesized
tttctacaataaaacataaatt

SEQ ID NO: 800495 - DNA, 22 bp, Artificial Sequence
  chemically synthesized
ttttctacaataaaacataaat

SEQ ID NO: 800496 - DNA, 22 bp, Artificial Sequence
  chemically synthesized
aacttttttctacaataaaaca

SEQ ID NO: 800497 - DNA, 22 bp, Artificial Sequence
  chemically synthesized
aaacttttttctacaataaaac

SEQ ID NO: 800498 - DNA, 22 bp, Artificial Sequence
  chemically synthesized
taaacttttttctacaataaaa

SEQ ID NO: 800499 - DNA, 22 bp, Artificial Sequence
  chemically synthesized
tttaatttatgttttattgtag

SEQ ID NO: 800500 - DNA, 22 bp, Artificial Sequence
  chemically synthesized
aatttatgttttattgtagaaa

SEQ ID NO: 800501 - DNA, 22 bp, Artificial Sequence
  chemically synthesized
atttatgttttattgtagaaaa

SEQ ID NO: 800502 - DNA, 22 bp, Artificial Sequence
  chemically synthesized
aaactttaaacttttttctaca

SEQ ID NO: 800503 - DNA, 22 bp, Artificial Sequence
  chemically synthesized
aaaactttaaacttttttctac

SEQ ID NO: 800504 - DNA, 22 bp, Artificial Sequence
  chemically synthesized
taaaactttaaacttttttcta

SEQ ID NO: 800505 - DNA, 22 bp, Artificial Sequence
  chemically synthesized
atgttttattgtagaaaaaagt

SEQ ID NO: 800506 - DNA, 22 bp, Artificial Sequence
  chemically synthesized
ttaaaactttaaacttttttct

SEQ ID NO: 800507 - DNA, 22 bp, Artificial Sequence
  chemically synthesized
tgttttattgtagaaaaaagtt

SEQ ID NO: 800508 - DNA, 22 bp, Artificial Sequence
  chemically synthesized
tattgtagaaaaaagtttaaag

SEQ ID NO: 800509 - DNA, 22 bp, Artificial Sequence
  chemically synthesized
atgtttttaaaactttaaactt

SEQ ID NO: 800510 - DNA, 22 bp, Artificial Sequence
  chemically synthesized
attgtagaaaaaagtttaaagt

SEQ ID NO: 800511 - DNA, 22 bp, Artificial Sequence
  chemically synthesized
ttgtagaaaaaagtttaaagtt

SEQ ID NO: 800512 - DNA, 22 bp, Artificial Sequence
  chemically synthesized
tagaaaaaagtttaaagtttta

SEQ ID NO: 800513 - DNA, 22 bp, Artificial Sequence
  chemically synthesized
aaagttttaaaaacatcagtat

SEQ ID NO: 800514 - DNA, 22 bp, Artificial Sequence
  chemically synthesized
aagttttaaaaacatcagtata

SEQ ID NO: 800515 - DNA, 22 bp, Artificial Sequence
  chemically synthesized
gagatacaccagtatactgatg

SEQ ID NO: 800516 - DNA, 22 bp, Artificial Sequence
  chemically synthesized
taaaaacatcagtatactggtg

SEQ ID NO: 800517 - DNA, 22 bp, Artificial Sequence
  chemically synthesized
aaaaacatcagtatactggtgt

SEQ ID NO: 800518 - DNA, 22 bp, Artificial Sequence
  chemically synthesized
aaaacatcagtatactggtgta

SEQ ID NO: 800519 - DNA, 22 bp, Artificial Sequence
  chemically synthesized
agtgtacaattggagatacacc

SEQ ID NO: 800520 - DNA, 22 bp, Artificial Sequence
  chemically synthesized
taagtgtacaattggagataca

SEQ ID NO: 800521 - DNA, 22 bp, Artificial Sequence
  chemically synthesized
cctctaagtgtacaattggaga

SEQ ID NO: 800522 - DNA, 22 bp, Artificial Sequence
  chemically synthesized
gcctctaagtgtacaattggag

SEQ ID NO: 800523 - DNA, 22 bp, Artificial Sequence
  chemically synthesized
gtgtatctccaattgtacactt

SEQ ID NO: 800524 - DNA, 22 bp, Artificial Sequence
  chemically synthesized
ccaggccttgcctctaagtgta

SEQ ID NO: 800525 - DNA, 22 bp, Artificial Sequence
  chemically synthesized
caattgtacacttagaggcaag

SEQ ID NO: 800526 - DNA, 22 bp, Artificial Sequence
  chemically synthesized
gaaagcattaccaggccttgcc

SEQ ID NO: 800527 - DNA, 22 bp, Artificial Sequence
  chemically synthesized
tacacttagaggcaaggcctgg

SEQ ID NO: 800528 - DNA, 22 bp, Artificial Sequence
  chemically synthesized
tcgaaagcattaccaggccttg

SEQ ID NO: 800529 - DNA, 22 bp, Artificial Sequence
  chemically synthesized
ctcgaaagcattaccaggcctt

SEQ ID NO: 800530 - DNA, 22 bp, Artificial Sequence
  chemically synthesized
ttctcgaaagcattaccaggcc

SEQ ID NO: 800531 - DNA, 22 bp, Artificial Sequence
  chemically synthesized
agaggcaaggcctggtaatgct

SEQ ID NO: 800532 - DNA, 22 bp, Artificial Sequence
  chemically synthesized
cctcttctcgaaagcattacca

SEQ ID NO: 800533 - DNA, 22 bp, Artificial Sequence
  chemically synthesized
gaggcaaggcctggtaatgctt

SEQ ID NO: 800534 - DNA, 22 bp, Artificial Sequence
  chemically synthesized
gccaaagccctacctcttctcg

SEQ ID NO: 800535 - DNA, 22 bp, Artificial Sequence
  chemically synthesized
ggccaaagccctacctcttctc

SEQ ID NO: 800536 - DNA, 22 bp, Artificial Sequence
  chemically synthesized
gtaatgctttcgagaagaggta

SEQ ID NO: 800537 - DNA, 22 bp, Artificial Sequence
  chemically synthesized
ttggccaaagccctacctcttc

SEQ ID NO: 800538 - DNA, 22 bp, Artificial Sequence
  chemically synthesized
aactcttggccaaagccctacc

SEQ ID NO: 800539 - DNA, 22 bp, Artificial Sequence
  chemically synthesized
tcgagaagaggtagggctttgg

SEQ ID NO: 800540 - DNA, 22 bp, Artificial Sequence
  chemically synthesized
cgagaagaggtagggctttggc

SEQ ID NO: 800541 - DNA, 22 bp, Artificial Sequence
  chemically synthesized
gagaagaggtagggctttggcc

SEQ ID NO: 800542 - DNA, 22 bp, Artificial Sequence
  chemically synthesized
gaaaattcaactcttggccaaa

SEQ ID NO: 800543 - DNA, 22 bp, Artificial Sequence
  chemically synthesized
cctggaaaattcaactcttggc

SEQ ID NO: 800544 - DNA, 22 bp, Artificial Sequence
  chemically synthesized
tctacctggaaaattcaactct

SEQ ID NO: 800545 - DNA, 22 bp, Artificial Sequence
  chemically synthesized
gtctacctggaaaattcaactc

SEQ ID NO: 800546 - DNA, 22 bp, Artificial Sequence
  chemically synthesized
cttgtctacctggaaaattcaa

SEQ ID NO: 800547 - DNA, 22 bp, Artificial Sequence
  chemically synthesized
tggccaagagttgaattttcca

SEQ ID NO: 800548 - DNA, 22 bp, Artificial Sequence
  chemically synthesized
tccttgtctacctggaaaattc

SEQ ID NO: 800549 - DNA, 22 bp, Artificial Sequence
  chemically synthesized
ggccaagagttgaattttccag

SEQ ID NO: 800550 - DNA, 22 bp, Artificial Sequence
  chemically synthesized
gccaagagttgaattttccagg

SEQ ID NO: 800551 - DNA, 22 bp, Artificial Sequence
  chemically synthesized
tctccttgtctacctggaaaat

SEQ ID NO: 800552 - DNA, 22 bp, Artificial Sequence
  chemically synthesized
ctctccttgtctacctggaaaa

SEQ ID NO: 800553 - DNA, 22 bp, Artificial Sequence
  chemically synthesized
tctctccttgtctacctggaaa

SEQ ID NO: 800554 - DNA, 22 bp, Artificial Sequence
  chemically synthesized
aattttccaggtagacaaggag

SEQ ID NO: 800555 - DNA, 22 bp, Artificial Sequence
  chemically synthesized
agaataccctttctctccttgt

SEQ ID NO: 800556 - DNA, 22 bp, Artificial Sequence
  chemically synthesized
tccaggtagacaaggagagaaa

SEQ ID NO: 800557 - DNA, 22 bp, Artificial Sequence
  chemically synthesized
ctcagaataccctttctctcct

SEQ ID NO: 800558 - DNA, 22 bp, Artificial Sequence
  chemically synthesized
ccaggtagacaaggagagaaag

SEQ ID NO: 800559 - DNA, 22 bp, Artificial Sequence
  chemically synthesized
gctcagaataccctttctctcc

SEQ ID NO: 800560 - DNA, 22 bp, Artificial Sequence
  chemically synthesized
caggtagacaaggagagaaagg

SEQ ID NO: 800561 - DNA, 22 bp, Artificial Sequence
  chemically synthesized
tgctcagaataccctttctctc

SEQ ID NO: 800562 - DNA, 22 bp, Artificial Sequence
  chemically synthesized
tctttgctcagaataccctttc

SEQ ID NO: 800563 - DNA, 22 bp, Artificial Sequence
  chemically synthesized
tcccagtcaagagaagttatct

SEQ ID NO: 800564 - DNA, 22 bp, Artificial Sequence
  chemically synthesized
tgagcaaagataacttctcttg

SEQ ID NO: 800565 - DNA, 22 bp, Artificial Sequence
  chemically synthesized
agcaaagataacttctcttgac

SEQ ID NO: 800566 - DNA, 22 bp, Artificial Sequence
  chemically synthesized
aacagcaagtagtcattatccc

SEQ ID NO: 800567 - DNA, 22 bp, Artificial Sequence
  chemically synthesized
ctcttgactgggataatgacta

SEQ ID NO: 800568 - DNA, 22 bp, Artificial Sequence
  chemically synthesized
tcttgactgggataatgactac

SEQ ID NO: 800569 - DNA, 22 bp, Artificial Sequence
  chemically synthesized
ttgactgggataatgactactt

SEQ ID NO: 800570 - DNA, 22 bp, Artificial Sequence
  chemically synthesized
gactgggataatgactacttgc

SEQ ID NO: 800571 - DNA, 22 bp, Artificial Sequence
  chemically synthesized
actgggataatgactacttgct

SEQ ID NO: 800572 - DNA, 22 bp, Artificial Sequence
  chemically synthesized
aatgaatactaaacagcaagta

SEQ ID NO: 800573 - DNA, 22 bp, Artificial Sequence
  chemically synthesized
ggataatgactacttgctgttt

SEQ ID NO: 800574 - DNA, 22 bp, Artificial Sequence
  chemically synthesized
agctgaatgaatactaaacagc

SEQ ID NO: 800575 - DNA, 22 bp, Artificial Sequence
  chemically synthesized
cttgctgtttagtattcattca

SEQ ID NO: 800576 - DNA, 22 bp, Artificial Sequence
  chemically synthesized
gctgtttagtattcattcagct

SEQ ID NO: 800577 - DNA, 22 bp, Artificial Sequence
  chemically synthesized
taaatgacactgagctgaatga

SEQ ID NO: 800578 - DNA, 22 bp, Artificial Sequence
  chemically synthesized
ctgtttagtattcattcagctc

SEQ ID NO: 800579 - DNA, 22 bp, Artificial Sequence
  chemically synthesized
ataaatgacactgagctgaatg

SEQ ID NO: 800580 - DNA, 22 bp, Artificial Sequence
  chemically synthesized
ttataaatgacactgagctgaa

SEQ ID NO: 800581 - DNA, 22 bp, Artificial Sequence
  chemically synthesized
tttagtattcattcagctcagt

SEQ ID NO: 800582 - DNA, 22 bp, Artificial Sequence
  chemically synthesized
cttataaatgacactgagctga

SEQ ID NO: 800583 - DNA, 22 bp, Artificial Sequence
  chemically synthesized
agtattcattcagctcagtgtc

SEQ ID NO: 800584 - DNA, 22 bp, Artificial Sequence
  chemically synthesized
gtattcattcagctcagtgtca

SEQ ID NO: 800585 - DNA, 22 bp, Artificial Sequence
  chemically synthesized
attcagctcagtgtcatttata

SEQ ID NO: 800586 - DNA, 22 bp, Artificial Sequence
  chemically synthesized
ccatacaaagtttcttataaat

SEQ ID NO: 800587 - DNA, 22 bp, Artificial Sequence
  chemically synthesized
agctcagtgtcatttataagaa

SEQ ID NO: 800588 - DNA, 22 bp, Artificial Sequence
  chemically synthesized
agtgtcatttataagaaacttt

SEQ ID NO: 800589 - DNA, 22 bp, Artificial Sequence
  chemically synthesized
aagctgccatacaaagtttctt

SEQ ID NO: 800590 - DNA, 22 bp, Artificial Sequence
  chemically synthesized
attaaagctgccatacaaagtt

SEQ ID NO: 800591 - DNA, 22 bp, Artificial Sequence
  chemically synthesized
aattaaagctgccatacaaagt

SEQ ID NO: 800592 - DNA, 22 bp, Artificial Sequence
  chemically synthesized
ataagaaactttgtatggcagc

SEQ ID NO: 800593 - DNA, 22 bp, Artificial Sequence
  chemically synthesized
taagaaactttgtatggcagct

SEQ ID NO: 800594 - DNA, 22 bp, Artificial Sequence
  chemically synthesized
atgccatttaattaaagctgcc

SEQ ID NO: 800595 - DNA, 22 bp, Artificial Sequence
  chemically synthesized
gatgccatttaattaaagctgc

SEQ ID NO: 800596 - DNA, 22 bp, Artificial Sequence
  chemically synthesized
tgatgccatttaattaaagctg

SEQ ID NO: 800597 - DNA, 22 bp, Artificial Sequence
  chemically synthesized
tgtatggcagctttaattaaat

SEQ ID NO: 800598 - DNA, 22 bp, Artificial Sequence
  chemically synthesized
gtatggcagctttaattaaatg

SEQ ID NO: 800599 - DNA, 22 bp, Artificial Sequence
  chemically synthesized
tatggcagctttaattaaatgg

SEQ ID NO: 800600 - DNA, 22 bp, Artificial Sequence
  chemically synthesized
taattaaatggcatcaaaactt

SEQ ID NO: 800601 - DNA, 22 bp, Artificial Sequence
  chemically synthesized
aattaaatggcatcaaaacttt

SEQ ID NO: 800602 - DNA, 22 bp, Artificial Sequence
  chemically synthesized
attaaatggcatcaaaactttt

SEQ ID NO: 800603 - DNA, 22 bp, Artificial Sequence
  chemically synthesized
catggagaagtatcaaaaagtt

SEQ ID NO: 800604 - DNA, 22 bp, Artificial Sequence
  chemically synthesized
aatggcatcaaaactttttgat

SEQ ID NO: 800605 - DNA, 22 bp, Artificial Sequence
  chemically synthesized
ccatggagaagtatcaaaaagt

SEQ ID NO: 800606 - DNA, 22 bp, Artificial Sequence
  chemically synthesized
tccatggagaagtatcaaaaag

SEQ ID NO: 800607 - DNA, 22 bp, Artificial Sequence
  chemically synthesized
cacctttccatggagaagtatc

SEQ ID NO: 800608 - DNA, 22 bp, Artificial Sequence
  chemically synthesized
tttgatacttctccatggaaag

SEQ ID NO: 800609 - DNA, 22 bp, Artificial Sequence
  chemically synthesized
ttgatacttctccatggaaagg

SEQ ID NO: 800610 - DNA, 22 bp, Artificial Sequence
  chemically synthesized
tgatacttctccatggaaaggt

SEQ ID NO: 800611 - DNA, 22 bp, Artificial Sequence
  chemically synthesized
gatacttctccatggaaaggtg

SEQ ID NO: 800612 - DNA, 22 bp, Artificial Sequence
  chemically synthesized
atacttctccatggaaaggtgg

SEQ ID NO: 800613 - DNA, 22 bp, Artificial Sequence
  chemically synthesized
ctccatggaaaggtggagttta

SEQ ID NO: 800614 - DNA, 22 bp, Artificial Sequence
  chemically synthesized
tccatggaaaggtggagtttat

SEQ ID NO: 800615 - DNA, 22 bp, Artificial Sequence
  chemically synthesized
catggaaaggtggagtttatgt

SEQ ID NO: 800616 - DNA, 22 bp, Artificial Sequence
  chemically synthesized
aaggggatgagaacataaactc

SEQ ID NO: 800617 - DNA, 22 bp, Artificial Sequence
  chemically synthesized
attcaaggggatgagaacataa

SEQ ID NO: 800618 - DNA, 22 bp, Artificial Sequence
  chemically synthesized
tgattcaaggggatgagaacat

SEQ ID NO: 800619 - DNA, 22 bp, Artificial Sequence
  chemically synthesized
atgttctcatccccttgaatca

SEQ ID NO: 800620 - DNA, 22 bp, Artificial Sequence
  chemically synthesized
tgttctcatccccttgaatcag

SEQ ID NO: 800621 - DNA, 22 bp, Artificial Sequence
  chemically synthesized
tcatccccttgaatcagagctc

SEQ ID NO: 800622 - DNA, 22 bp, Artificial Sequence
  chemically synthesized
tcaatcagtgacagagctctga

SEQ ID NO: 800623 - DNA, 22 bp, Artificial Sequence
  chemically synthesized
atccccttgaatcagagctctg

SEQ ID NO: 800624 - DNA, 22 bp, Artificial Sequence
  chemically synthesized
gtcaatcagtgacagagctctg

SEQ ID NO: 800625 - DNA, 22 bp, Artificial Sequence
  chemically synthesized
tttgtcaatcagtgacagagct

SEQ ID NO: 800626 - DNA, 22 bp, Artificial Sequence
  chemically synthesized
tatttgtcaatcagtgacagag

SEQ ID NO: 800627 - DNA, 22 bp, Artificial Sequence
  chemically synthesized
gaatcagagctctgtcactgat

SEQ ID NO: 800628 - DNA, 22 bp, Artificial Sequence
  chemically synthesized
aatcagagctctgtcactgatt

SEQ ID NO: 800629 - DNA, 22 bp, Artificial Sequence
  chemically synthesized
ccatattctatttgtcaatcag

SEQ ID NO: 800630 - DNA, 22 bp, Artificial Sequence
  chemically synthesized
tcccatattctatttgtcaatc

SEQ ID NO: 800631 - DNA, 22 bp, Artificial Sequence
  chemically synthesized
ctcccatattctatttgtcaat

SEQ ID NO: 800632 - DNA, 22 bp, Artificial Sequence
  chemically synthesized
cttctcccatattctatttgtc

SEQ ID NO: 800633 - DNA, 22 bp, Artificial Sequence
  chemically synthesized
tgtcactgattgacaaatagaa

SEQ ID NO: 800634 - DNA, 22 bp, Artificial Sequence
  chemically synthesized
gcttctcccatattctatttgt

SEQ ID NO: 800635 - DNA, 22 bp, Artificial Sequence
  chemically synthesized
tgcttctcccatattctatttg

SEQ ID NO: 800636 - DNA, 22 bp, Artificial Sequence
  chemically synthesized
tcactgattgacaaatagaata

SEQ ID NO: 800637 - DNA, 22 bp, Artificial Sequence
  chemically synthesized
attgacaaatagaatatgggag

SEQ ID NO: 800638 - DNA, 22 bp, Artificial Sequence
  chemically synthesized
acaaatagaatatgggagaagc

SEQ ID NO: 800639 - DNA, 22 bp, Artificial Sequence
  chemically synthesized
aaagcaagaatggttttgcttc

SEQ ID NO: 800640 - DNA, 22 bp, Artificial Sequence
  chemically synthesized
ccctaaaagcaagaatggtttt

SEQ ID NO: 800641 - DNA, 22 bp, Artificial Sequence
  chemically synthesized
aaggcctgccctaaaagcaaga

SEQ ID NO: 800642 - DNA, 22 bp, Artificial Sequence
  chemically synthesized
tcaaggcctgccctaaaagcaa

SEQ ID NO: 800643 - DNA, 22 bp, Artificial Sequence
  chemically synthesized
ctcaaggcctgccctaaaagca

SEQ ID NO: 800644 - DNA, 22 bp, Artificial Sequence
  chemically synthesized
caagcttctcaaggcctgccct

SEQ ID NO: 800645 - DNA, 22 bp, Artificial Sequence
  chemically synthesized
ttgcttttagggcaggccttga

SEQ ID NO: 800646 - DNA, 22 bp, Artificial Sequence
  chemically synthesized
gcttttagggcaggccttgaga

SEQ ID NO: 800647 - DNA, 22 bp, Artificial Sequence
  chemically synthesized
aagctgcaagcttctcaaggcc

SEQ ID NO: 800648 - DNA, 22 bp, Artificial Sequence
  chemically synthesized
cttttagggcaggccttgagaa

SEQ ID NO: 800649 - DNA, 22 bp, Artificial Sequence
  chemically synthesized
ttagggcaggccttgagaagct

SEQ ID NO: 800650 - DNA, 22 bp, Artificial Sequence
  chemically synthesized
tagggcaggccttgagaagctt

SEQ ID NO: 800651 - DNA, 22 bp, Artificial Sequence
  chemically synthesized
agggcaggccttgagaagcttg

SEQ ID NO: 800652 - DNA, 22 bp, Artificial Sequence
  chemically synthesized
gggcaggccttgagaagcttgc

SEQ ID NO: 800653 - DNA, 22 bp, Artificial Sequence
  chemically synthesized
agggacaagaaattaaagctgc

SEQ ID NO: 800654 - DNA, 22 bp, Artificial Sequence
  chemically synthesized
gagaagcttgcagctttaattt

SEQ ID NO: 800655 - DNA, 22 bp, Artificial Sequence
  chemically synthesized
agaagcttgcagctttaatttc

SEQ ID NO: 800656 - DNA, 22 bp, Artificial Sequence
  chemically synthesized
tcctaagggacaagaaattaaa

SEQ ID NO: 800657 - DNA, 22 bp, Artificial Sequence
  chemically synthesized
gcagctttaatttcttgtccct

SEQ ID NO: 800658 - DNA, 22 bp, Artificial Sequence
  chemically synthesized
cagctttaatttcttgtccctt

SEQ ID NO: 800659 - DNA, 22 bp, Artificial Sequence
  chemically synthesized
taatttcttgtcccttaggata

SEQ ID NO: 800660 - DNA, 22 bp, Artificial Sequence
  chemically synthesized
aatttcttgtcccttaggataa

SEQ ID NO: 800661 - DNA, 22 bp, Artificial Sequence
  chemically synthesized
atttcttgtcccttaggataat

SEQ ID NO: 800662 - DNA, 22 bp, Artificial Sequence
  chemically synthesized
ggtcccaagagcaattatccta

SEQ ID NO: 800663 - DNA, 22 bp, Artificial Sequence
  chemically synthesized
cttgtcccttaggataattgct

SEQ ID NO: 800664 - DNA, 22 bp, Artificial Sequence
  chemically synthesized
ttgtcccttaggataattgctc

SEQ ID NO: 800665 - DNA, 22 bp, Artificial Sequence
  chemically synthesized
gtcccttaggataattgctctt

SEQ ID NO: 800666 - DNA, 22 bp, Artificial Sequence
  chemically synthesized
tcccttaggataattgctcttg

SEQ ID NO: 800667 - DNA, 22 bp, Artificial Sequence
  chemically synthesized
aggataattgctcttgggaccc

SEQ ID NO: 800668 - DNA, 22 bp, Artificial Sequence
  chemically synthesized
ggataattgctcttgggaccca

SEQ ID NO: 800669 - DNA, 22 bp, Artificial Sequence
  chemically synthesized
acagtgtaagagttgggtccca

SEQ ID NO: 800670 - DNA, 22 bp, Artificial Sequence
  chemically synthesized
cacagtgtaagagttgggtccc

SEQ ID NO: 800671 - DNA, 22 bp, Artificial Sequence
  chemically synthesized
tcacagtgtaagagttgggtcc

SEQ ID NO: 800672 - DNA, 22 bp, Artificial Sequence
  chemically synthesized
ttcacagtgtaagagttgggtc

SEQ ID NO: 800673 - DNA, 22 bp, Artificial Sequence
  chemically synthesized
tttcacagtgtaagagttgggt

SEQ ID NO: 800674 - DNA, 22 bp, Artificial Sequence
  chemically synthesized
ctcttgggacccaactcttaca

SEQ ID NO: 800675 - DNA, 22 bp, Artificial Sequence
  chemically synthesized
ggctttttcacagtgtaagagt

SEQ ID NO: 800676 - DNA, 22 bp, Artificial Sequence
  chemically synthesized
gggctttttcacagtgtaagag

SEQ ID NO: 800677 - DNA, 22 bp, Artificial Sequence
  chemically synthesized
ttgggacccaactcttacactg

SEQ ID NO: 800678 - DNA, 22 bp, Artificial Sequence
  chemically synthesized
gggacccaactcttacactgtg

SEQ ID NO: 800679 - DNA, 22 bp, Artificial Sequence
  chemically synthesized
ggacccaactcttacactgtga

SEQ ID NO: 800680 - DNA, 22 bp, Artificial Sequence
  chemically synthesized
catggagcagtttgggcttttt

SEQ ID NO: 800681 - DNA, 22 bp, Artificial Sequence
  chemically synthesized
ttacactgtgaaaaagcccaaa

SEQ ID NO: 800682 - DNA, 22 bp, Artificial Sequence
  chemically synthesized
tccatggagcagtttgggcttt

SEQ ID NO: 800683 - DNA, 22 bp, Artificial Sequence
  chemically synthesized
acactgtgaaaaagcccaaact

SEQ ID NO: 800684 - DNA, 22 bp, Artificial Sequence
  chemically synthesized
cactgtgaaaaagcccaaactg

SEQ ID NO: 800685 - DNA, 22 bp, Artificial Sequence
  chemically synthesized
tgaaaaagcccaaactgctcca

SEQ ID NO: 800686 - DNA, 22 bp, Artificial Sequence
  chemically synthesized
atgtggacctctccatggagca

SEQ ID NO: 800687 - DNA, 22 bp, Artificial Sequence
  chemically synthesized
catgtggacctctccatggagc

SEQ ID NO: 800688 - DNA, 22 bp, Artificial Sequence
  chemically synthesized
ttcatgtggacctctccatgga

SEQ ID NO: 800689 - DNA, 22 bp, Artificial Sequence
  chemically synthesized
cttcatgtggacctctccatgg

SEQ ID NO: 800690 - DNA, 22 bp, Artificial Sequence
  chemically synthesized
tcttcatgtggacctctccatg

SEQ ID NO: 800691 - DNA, 22 bp, Artificial Sequence
  chemically synthesized
ttcttcatgtggacctctccat

SEQ ID NO: 800692 - DNA, 22 bp, Artificial Sequence
  chemically synthesized
tcagtttttcttcatgtggacc

SEQ ID NO: 800693 - DNA, 22 bp, Artificial Sequence
  chemically synthesized
ctccatggagaggtccacatga

SEQ ID NO: 800694 - DNA, 22 bp, Artificial Sequence
  chemically synthesized
catggagaggtccacatgaaga

SEQ ID NO: 800695 - DNA, 22 bp, Artificial Sequence
  chemically synthesized
actgtcagtttttcttcatgtg

SEQ ID NO: 800696 - DNA, 22 bp, Artificial Sequence
  chemically synthesized
gaaaataggtgctgactgtcag

SEQ ID NO: 800697 - DNA, 22 bp, Artificial Sequence
  chemically synthesized
acatgcctggaaaataggtgct

SEQ ID NO: 800698 - DNA, 22 bp, Artificial Sequence
  chemically synthesized
actcacatgcctggaaaatagg

SEQ ID NO: 800699 - DNA, 22 bp, Artificial Sequence
  chemically synthesized
acagtcagcacctattttccag

SEQ ID NO: 800700 - DNA, 22 bp, Artificial Sequence
  chemically synthesized
caagagggctcactcacatgcc

SEQ ID NO: 800701 - DNA, 22 bp, Artificial Sequence
  chemically synthesized
ccaagagggctcactcacatgc

SEQ ID NO: 800702 - DNA, 22 bp, Artificial Sequence
  chemically synthesized
ttttccaggcatgtgagtgagc

SEQ ID NO: 800703 - DNA, 22 bp, Artificial Sequence
  chemically synthesized
acttccaagagggctcactcac

SEQ ID NO: 800704 - DNA, 22 bp, Artificial Sequence
  chemically synthesized
tccaggcatgtgagtgagccct

SEQ ID NO: 800705 - DNA, 22 bp, Artificial Sequence
  chemically synthesized
ccaggcatgtgagtgagccctc

SEQ ID NO: 800706 - DNA, 22 bp, Artificial Sequence
  chemically synthesized
caggcatgtgagtgagccctct

SEQ ID NO: 800707 - DNA, 22 bp, Artificial Sequence
  chemically synthesized
gaggattcacttccaagagggc

SEQ ID NO: 800708 - DNA, 22 bp, Artificial Sequence
  chemically synthesized
atgctggaggattcacttccaa

SEQ ID NO: 800709 - DNA, 22 bp, Artificial Sequence
  chemically synthesized
cctgatgctggaggattcactt

SEQ ID NO: 800710 - DNA, 22 bp, Artificial Sequence
  chemically synthesized
ttggaagtgaatcctccagcat

SEQ ID NO: 800711 - DNA, 22 bp, Artificial Sequence
  chemically synthesized
ggaagtgaatcctccagcatca

SEQ ID NO: 800712 - DNA, 22 bp, Artificial Sequence
  chemically synthesized
gggtagattgcctgatgctgga

SEQ ID NO: 800713 - DNA, 22 bp, Artificial Sequence
  chemically synthesized
gaagtgaatcctccagcatcag

SEQ ID NO: 800714 - DNA, 22 bp, Artificial Sequence
  chemically synthesized
atatcagttggggtagattgcc

SEQ ID NO: 800715 - DNA, 22 bp, Artificial Sequence
  chemically synthesized
cagcatcaggcaatctacccca

SEQ ID NO: 800716 - DNA, 22 bp, Artificial Sequence
  chemically synthesized
agttgatatcagttggggtaga

SEQ ID NO: 800717 - DNA, 22 bp, Artificial Sequence
  chemically synthesized
cagttgatatcagttggggtag

SEQ ID NO: 800718 - DNA, 22 bp, Artificial Sequence
  chemically synthesized
tttcagttgatatcagttgggg

SEQ ID NO: 800719 - DNA, 22 bp, Artificial Sequence
  chemically synthesized
tccctgtttcagttgatatcag

SEQ ID NO: 800720 - DNA, 22 bp, Artificial Sequence
  chemically synthesized
atccctgtttcagttgatatca

SEQ ID NO: 800721 - DNA, 22 bp, Artificial Sequence
  chemically synthesized
cttatccctgtttcagttgata

SEQ ID NO: 800722 - DNA, 22 bp, Artificial Sequence
  chemically synthesized
gcttatccctgtttcagttgat

SEQ ID NO: 800723 - DNA, 22 bp, Artificial Sequence
  chemically synthesized
ccccaactgatatcaactgaaa

SEQ ID NO: 800724 - DNA, 22 bp, Artificial Sequence
  chemically synthesized
atatcaactgaaacagggataa

SEQ ID NO: 800725 - DNA, 22 bp, Artificial Sequence
  chemically synthesized
aatggggcttgcttatccctgt

SEQ ID NO: 800726 - DNA, 22 bp, Artificial Sequence
  chemically synthesized
aaggttcaatggggcttgctta

SEQ ID NO: 800727 - DNA, 22 bp, Artificial Sequence
  chemically synthesized
aaacagggataagcaagcccca

SEQ ID NO: 800728 - DNA, 22 bp, Artificial Sequence
  chemically synthesized
ctcaaggttcaatggggcttgc

SEQ ID NO: 800729 - DNA, 22 bp, Artificial Sequence
  chemically synthesized
gctcaaggttcaatggggcttg

SEQ ID NO: 800730 - DNA, 22 bp, Artificial Sequence
  chemically synthesized
cagtttgctcaaggttcaatgg

SEQ ID NO: 800731 - DNA, 22 bp, Artificial Sequence
  chemically synthesized
atgaatctacagtttgctcaag

SEQ ID NO: 800732 - DNA, 22 bp, Artificial Sequence
  chemically synthesized
ttcatgaatctacagtttgctc

SEQ ID NO: 800733 - DNA, 22 bp, Artificial Sequence
  chemically synthesized
gttcatgaatctacagtttgct

SEQ ID NO: 800734 - DNA, 22 bp, Artificial Sequence
  chemically synthesized
tgttcatgaatctacagtttgc

SEQ ID NO: 800735 - DNA, 22 bp, Artificial Sequence
  chemically synthesized
ttttgttcatgaatctacagtt

SEQ ID NO: 800736 - DNA, 22 bp, Artificial Sequence
  chemically synthesized
aaccttgagcaaactgtagatt

SEQ ID NO: 800737 - DNA, 22 bp, Artificial Sequence
  chemically synthesized
gttttgttcatgaatctacagt

SEQ ID NO: 800738 - DNA, 22 bp, Artificial Sequence
  chemically synthesized
cttgttttgttcatgaatctac

SEQ ID NO: 800739 - DNA, 22 bp, Artificial Sequence
  chemically synthesized
gagcaaactgtagattcatgaa

SEQ ID NO: 800740 - DNA, 22 bp, Artificial Sequence
  chemically synthesized
agcaaactgtagattcatgaac

SEQ ID NO: 800741 - DNA, 22 bp, Artificial Sequence
  chemically synthesized
agtaaaaattacttgttttgtt

SEQ ID NO: 800742 - DNA, 22 bp, Artificial Sequence
  chemically synthesized
cagtaaaaattacttgttttgt

SEQ ID NO: 800743 - DNA, 22 bp, Artificial Sequence
  chemically synthesized
tagattcatgaacaaaacaagt

SEQ ID NO: 800744 - DNA, 22 bp, Artificial Sequence
  chemically synthesized
atggcttcagtaaaaattactt

SEQ ID NO: 800745 - DNA, 22 bp, Artificial Sequence
  chemically synthesized
atgaacaaaacaagtaattttt

SEQ ID NO: 800746 - DNA, 22 bp, Artificial Sequence
  chemically synthesized
catggcttcagtaaaaattact

SEQ ID NO: 800747 - DNA, 22 bp, Artificial Sequence
  chemically synthesized
ttactgaagccatgaagttttg

SEQ ID NO: 800748 - DNA, 22 bp, Artificial Sequence
  chemically synthesized
tactgaagccatgaagttttgg

SEQ ID NO: 800749 - DNA, 22 bp, Artificial Sequence
  chemically synthesized
actgaagccatgaagttttggg

SEQ ID NO: 800750 - DNA, 22 bp, Artificial Sequence
  chemically synthesized
ctgaagccatgaagttttgggc

SEQ ID NO: 800751 - DNA, 22 bp, Artificial Sequence
  chemically synthesized
cataacaagccagcccaaaact

SEQ ID NO: 800752 - DNA, 22 bp, Artificial Sequence
  chemically synthesized
aagccatgaagttttgggctgg

SEQ ID NO: 800753 - DNA, 22 bp, Artificial Sequence
  chemically synthesized
ctacataacaagccagcccaaa

SEQ ID NO: 800754 - DNA, 22 bp, Artificial Sequence
  chemically synthesized
gctacataacaagccagcccaa

SEQ ID NO: 800755 - DNA, 22 bp, Artificial Sequence
  chemically synthesized
tgctacataacaagccagccca

SEQ ID NO: 800756 - DNA, 22 bp, Artificial Sequence
  chemically synthesized
ttgctacataacaagccagccc

SEQ ID NO: 800757 - DNA, 22 bp, Artificial Sequence
  chemically synthesized
acttttgctacataacaagcca

SEQ ID NO: 800758 - DNA, 22 bp, Artificial Sequence
  chemically synthesized
gttaacttttgctacataacaa

SEQ ID NO: 800759 - DNA, 22 bp, Artificial Sequence
  chemically synthesized
tagttaacttttgctacataac

SEQ ID NO: 800760 - DNA, 22 bp, Artificial Sequence
  chemically synthesized
tgggctggcttgttatgtagca

SEQ ID NO: 800761 - DNA, 22 bp, Artificial Sequence
  chemically synthesized
gggctggcttgttatgtagcaa

SEQ ID NO: 800762 - DNA, 22 bp, Artificial Sequence
  chemically synthesized
ggctggcttgttatgtagcaaa

SEQ ID NO: 800763 - DNA, 22 bp, Artificial Sequence
  chemically synthesized
gcttgttatgtagcaaaagtta

SEQ ID NO: 800764 - DNA, 22 bp, Artificial Sequence
  chemically synthesized
gttatgtagcaaaagttaacta

SEQ ID NO: 800765 - DNA, 22 bp, Artificial Sequence
  chemically synthesized
ttatgtagcaaaagttaactag

SEQ ID NO: 800766 - DNA, 22 bp, Artificial Sequence
  chemically synthesized
tgtagcaaaagttaactagaat

SEQ ID NO: 800767 - DNA, 22 bp, Artificial Sequence
  chemically synthesized
tgagtaagatcagagaaggtat

SEQ ID NO: 800768 - DNA, 22 bp, Artificial Sequence
  chemically synthesized
atgagtaagatcagagaaggta

SEQ ID NO: 800769 - DNA, 22 bp, Artificial Sequence
  chemically synthesized
actagaataccttctctgatct

SEQ ID NO: 800770 - DNA, 22 bp, Artificial Sequence
  chemically synthesized
catcccttatgagtaagatcag

SEQ ID NO: 800771 - DNA, 22 bp, Artificial Sequence
  chemically synthesized
gaataccttctctgatcttact

SEQ ID NO: 800772 - DNA, 22 bp, Artificial Sequence
  chemically synthesized
tgcatcccttatgagtaagatc

SEQ ID NO: 800773 - DNA, 22 bp, Artificial Sequence
  chemically synthesized
ctgcatcccttatgagtaagat

SEQ ID NO: 800774 - DNA, 22 bp, Artificial Sequence
  chemically synthesized
ctctgatcttactcataaggga

SEQ ID NO: 800775 - DNA, 22 bp, Artificial Sequence
  chemically synthesized
tctgatcttactcataagggat

SEQ ID NO: 800776 - DNA, 22 bp, Artificial Sequence
  chemically synthesized
tgatcttactcataagggatgc

SEQ ID NO: 800777 - DNA, 22 bp, Artificial Sequence
  chemically synthesized
atcttactcataagggatgcag

SEQ ID NO: 800778 - DNA, 22 bp, Artificial Sequence
  chemically synthesized
actcataagggatgcagaaggt

SEQ ID NO: 800779 - DNA, 22 bp, Artificial Sequence
  chemically synthesized
ctcataagggatgcagaaggtg

SEQ ID NO: 800780 - DNA, 22 bp, Artificial Sequence
  chemically synthesized
ataagggatgcagaaggtgccc

SEQ ID NO: 800781 - DNA, 22 bp, Artificial Sequence
  chemically synthesized
gtcatccaagagaaggggcacc

SEQ ID NO: 800782 - DNA, 22 bp, Artificial Sequence
  chemically synthesized
agtcatccaagagaaggggcac

SEQ ID NO: 800783 - DNA, 22 bp, Artificial Sequence
  chemically synthesized
tagtcatccaagagaaggggca

SEQ ID NO: 800784 - DNA, 22 bp, Artificial Sequence
  chemically synthesized
ctcttggatgactaaaggactt

SEQ ID NO: 800785 - DNA, 22 bp, Artificial Sequence
  chemically synthesized
taatagagtacaaagtccttta

SEQ ID NO: 800786 - DNA, 22 bp, Artificial Sequence
  chemically synthesized
tcttggatgactaaaggacttt

SEQ ID NO: 800787 - DNA, 22 bp, Artificial Sequence
  chemically synthesized
ttggatgactaaaggactttgt

SEQ ID NO: 800788 - DNA, 22 bp, Artificial Sequence
  chemically synthesized
ggatgactaaaggactttgtac

SEQ ID NO: 800789 - DNA, 22 bp, Artificial Sequence
  chemically synthesized
tattataatagagtacaaagtc

SEQ ID NO: 800790 - DNA, 22 bp, Artificial Sequence
  chemically synthesized
gatgactaaaggactttgtact

SEQ ID NO: 800791 - DNA, 22 bp, Artificial Sequence
  chemically synthesized
aaggactttgtactctattata

SEQ ID NO: 800792 - DNA, 22 bp, Artificial Sequence
  chemically synthesized
tgtactctattataatatagcc

SEQ ID NO: 800793 - DNA, 22 bp, Artificial Sequence
  chemically synthesized
gtactctattataatatagccc

SEQ ID NO: 800794 - DNA, 22 bp, Artificial Sequence
  chemically synthesized
tactctattataatatagccct

SEQ ID NO: 800795 - DNA, 22 bp, Artificial Sequence
  chemically synthesized
gccaaggaaggaagggctatat

SEQ ID NO: 800796 - DNA, 22 bp, Artificial Sequence
  chemically synthesized
tattataatatagcccttcctt

SEQ ID NO: 800797 - DNA, 22 bp, Artificial Sequence
  chemically synthesized
ttataatatagcccttccttcc

SEQ ID NO: 800798 - DNA, 22 bp, Artificial Sequence
  chemically synthesized
taatatagcccttccttccttg

SEQ ID NO: 800799 - DNA, 22 bp, Artificial Sequence
  chemically synthesized
ccttccttggctaggtctctct

SEQ ID NO: 800800 - DNA, 22 bp, Artificial Sequence
  chemically synthesized
gggcaggaggacagagagacct

SEQ ID NO: 800801 - DNA, 22 bp, Artificial Sequence
  chemically synthesized
cttccttggctaggtctctctg

SEQ ID NO: 800802 - DNA, 22 bp, Artificial Sequence
  chemically synthesized
ggggcaggaggacagagagacc

SEQ ID NO: 800803 - DNA, 22 bp, Artificial Sequence
  chemically synthesized
ccttggctaggtctctctgtcc

SEQ ID NO: 800804 - DNA, 22 bp, Artificial Sequence
  chemically synthesized
cttggctaggtctctctgtcct

SEQ ID NO: 800805 - DNA, 22 bp, Artificial Sequence
  chemically synthesized
ggctaggtctctctgtcctcct

SEQ ID NO: 800806 - DNA, 22 bp, Artificial Sequence
  chemically synthesized
gctaggtctctctgtcctcctg

SEQ ID NO: 800807 - DNA, 22 bp, Artificial Sequence
  chemically synthesized
ggtctctctgtcctcctgcccc

SEQ ID NO: 800808 - DNA, 22 bp, Artificial Sequence
  chemically synthesized
atagtggtggggcttggggcag

SEQ ID NO: 800809 - DNA, 22 bp, Artificial Sequence
  chemically synthesized
tctgtcctcctgccccaagccc

SEQ ID NO: 800810 - DNA, 22 bp, Artificial Sequence
  chemically synthesized
tgtcctcctgccccaagcccca

SEQ ID NO: 800811 - DNA, 22 bp, Artificial Sequence
  chemically synthesized
tcctcctgccccaagccccacc

SEQ ID NO: 800812 - DNA, 22 bp, Artificial Sequence
  chemically synthesized
ctgccccaagccccaccactat

SEQ ID NO: 800813 - DNA, 22 bp, Artificial Sequence
  chemically synthesized
ccccaagccccaccactattaa

SEQ ID NO: 800814 - DNA, 22 bp, Artificial Sequence
  chemically synthesized
ccccaaaagaggaattaatagt

SEQ ID NO: 800815 - DNA, 22 bp, Artificial Sequence
  chemically synthesized
ttaattcctcttttggggtagt

SEQ ID NO: 800816 - DNA, 22 bp, Artificial Sequence
  chemically synthesized
ataagatatggaactaccccaa

SEQ ID NO: 800817 - DNA, 22 bp, Artificial Sequence
  chemically synthesized
attcctcttttggggtagttcc

SEQ ID NO: 800818 - DNA, 22 bp, Artificial Sequence
  chemically synthesized
ctcttttggggtagttccatat

SEQ ID NO: 800819 - DNA, 22 bp, Artificial Sequence
  chemically synthesized
ttttggggtagttccatatctt

SEQ ID NO: 800820 - DNA, 22 bp, Artificial Sequence
  chemically synthesized
ttggggtagttccatatcttat

SEQ ID NO: 800821 - DNA, 22 bp, Artificial Sequence
  chemically synthesized
tggggtagttccatatcttatc

SEQ ID NO: 800822 - DNA, 22 bp, Artificial Sequence
  chemically synthesized
ggggtagttccatatcttatca

SEQ ID NO: 800823 - DNA, 22 bp, Artificial Sequence
  chemically synthesized
gggtagttccatatcttatcaa

SEQ ID NO: 800824 - DNA, 22 bp, Artificial Sequence
  chemically synthesized
catatcttatcaacttgtatat

SEQ ID NO: 800825 - DNA, 22 bp, Artificial Sequence
  chemically synthesized
atcaacttgtatattttcatgc

SEQ ID NO: 800826 - DNA, 22 bp, Artificial Sequence
  chemically synthesized
tcaacttgtatattttcatgcc

SEQ ID NO: 800827 - DNA, 22 bp, Artificial Sequence
  chemically synthesized
cagaacagtaaacaggcatgaa

SEQ ID NO: 800828 - DNA, 22 bp, Artificial Sequence
  chemically synthesized
tacagaacagtaaacaggcatg

SEQ ID NO: 800829 - DNA, 22 bp, Artificial Sequence
  chemically synthesized
ctacagaacagtaaacaggcat

SEQ ID NO: 800830 - DNA, 22 bp, Artificial Sequence
  chemically synthesized
gtatattttcatgcctgtttac

SEQ ID NO: 800831 - DNA, 22 bp, Artificial Sequence
  chemically synthesized
tatattttcatgcctgtttact

SEQ ID NO: 800832 - DNA, 22 bp, Artificial Sequence
  chemically synthesized
tcatgcctgtttactgttctgt

SEQ ID NO: 800833 - DNA, 22 bp, Artificial Sequence
  chemically synthesized
catgcctgtttactgttctgta

SEQ ID NO: 800834 - DNA, 22 bp, Artificial Sequence
  chemically synthesized
atgcctgtttactgttctgtag

SEQ ID NO: 800835 - DNA, 22 bp, Artificial Sequence
  chemically synthesized
agaagtgggatcttctacagaa

SEQ ID NO: 800836 - DNA, 22 bp, Artificial Sequence
  chemically synthesized
ttaagaagtgggatcttctaca

SEQ ID NO: 800837 - DNA, 22 bp, Artificial Sequence
  chemically synthesized
tttactgttctgtagaagatcc

SEQ ID NO: 800838 - DNA, 22 bp, Artificial Sequence
  chemically synthesized
actgttctgtagaagatcccac

SEQ ID NO: 800839 - DNA, 22 bp, Artificial Sequence
  chemically synthesized
ctgttctgtagaagatcccact

SEQ ID NO: 800840 - DNA, 22 bp, Artificial Sequence
  chemically synthesized
ttctgtagaagatcccacttct

SEQ ID NO: 800841 - DNA, 22 bp, Artificial Sequence
  chemically synthesized
agaagagctattaagaagtggg

SEQ ID NO: 800842 - DNA, 22 bp, Artificial Sequence
  chemically synthesized
aagaagagctattaagaagtgg

SEQ ID NO: 800843 - DNA, 22 bp, Artificial Sequence
  chemically synthesized
tgtagaagatcccacttcttaa

SEQ ID NO: 800844 - DNA, 22 bp, Artificial Sequence
  chemically synthesized
taagaagagctattaagaagtg

SEQ ID NO: 800845 - DNA, 22 bp, Artificial Sequence
  chemically synthesized
ttaagaagagctattaagaagt

SEQ ID NO: 800846 - DNA, 22 bp, Artificial Sequence
  chemically synthesized
tagaagatcccacttcttaata

SEQ ID NO: 800847 - DNA, 22 bp, Artificial Sequence
  chemically synthesized
aatgtgacttttaagaagagct

SEQ ID NO: 800848 - DNA, 22 bp, Artificial Sequence
  chemically synthesized
ctgaatgtgacttttaagaaga

SEQ ID NO: 800849 - DNA, 22 bp, Artificial Sequence
  chemically synthesized
cttaatagctcttcttaaaagt

SEQ ID NO: 800850 - DNA, 22 bp, Artificial Sequence
  chemically synthesized
ttaatagctcttcttaaaagtc

SEQ ID NO: 800851 - DNA, 22 bp, Artificial Sequence
  chemically synthesized
aatagctcttcttaaaagtcac

SEQ ID NO: 800852 - DNA, 22 bp, Artificial Sequence
  chemically synthesized
atagctcttcttaaaagtcaca

SEQ ID NO: 800853 - DNA, 22 bp, Artificial Sequence
  chemically synthesized
aatggattcctgaatgtgactt

SEQ ID NO: 800854 - DNA, 22 bp, Artificial Sequence
  chemically synthesized
gaatggattcctgaatgtgact

SEQ ID NO: 800855 - DNA, 22 bp, Artificial Sequence
  chemically synthesized
tgaatggattcctgaatgtgac

SEQ ID NO: 800856 - DNA, 22 bp, Artificial Sequence
  chemically synthesized
ttgaatggattcctgaatgtga

SEQ ID NO: 800857 - DNA, 22 bp, Artificial Sequence
  chemically synthesized
tttgaatggattcctgaatgtg

SEQ ID NO: 800858 - DNA, 22 bp, Artificial Sequence
  chemically synthesized
ttcttaaaagtcacattcagga

SEQ ID NO: 800859 - DNA, 22 bp, Artificial Sequence
  chemically synthesized
cttaaaagtcacattcaggaat

SEQ ID NO: 800860 - DNA, 22 bp, Artificial Sequence
  chemically synthesized
ttaaaagtcacattcaggaatc

SEQ ID NO: 800861 - DNA, 22 bp, Artificial Sequence
  chemically synthesized
aaaagtcacattcaggaatcca

SEQ ID NO: 800862 - DNA, 22 bp, Artificial Sequence
  chemically synthesized
aaagtcacattcaggaatccat

SEQ ID NO: 800863 - DNA, 22 bp, Artificial Sequence
  chemically synthesized
aggaatccattcaaaaagtaca

SEQ ID NO: 800864 - DNA, 22 bp, Artificial Sequence
  chemically synthesized
aaaaagtacattttccactacg

SEQ ID NO: 800865 - DNA, 22 bp, Artificial Sequence
  chemically synthesized
atgcaatatatacccgtagtgg

SEQ ID NO: 800866 - DNA, 22 bp, Artificial Sequence
  chemically synthesized
aaattcatgcaatatatacccg

SEQ ID NO: 800867 - DNA, 22 bp, Artificial Sequence
  chemically synthesized
gaaattcatgcaatatataccc

SEQ ID NO: 800868 - DNA, 22 bp, Artificial Sequence
  chemically synthesized
tgaaattcatgcaatatatacc

SEQ ID NO: 800869 - DNA, 22 bp, Artificial Sequence
  chemically synthesized
tccactacgggtatatattgca

SEQ ID NO: 800870 - DNA, 22 bp, Artificial Sequence
  chemically synthesized
ccactacgggtatatattgcat

SEQ ID NO: 800871 - DNA, 22 bp, Artificial Sequence
  chemically synthesized
cactacgggtatatattgcatg

SEQ ID NO: 800872 - DNA, 22 bp, Artificial Sequence
  chemically synthesized
cgggtatatattgcatgaattt

SEQ ID NO: 800873 - DNA, 22 bp, Artificial Sequence
  chemically synthesized
aaagaaattttgaaattcatgc

SEQ ID NO: 800874 - DNA, 22 bp, Artificial Sequence
  chemically synthesized
atccatgacctgaaagaaattt

SEQ ID NO: 800875 - DNA, 22 bp, Artificial Sequence
  chemically synthesized
catgaatttcaaaatttctttc

SEQ ID NO: 800876 - DNA, 22 bp, Artificial Sequence
  chemically synthesized
catccatgacctgaaagaaatt

SEQ ID NO: 800877 - DNA, 22 bp, Artificial Sequence
  chemically synthesized
tcatccatgacctgaaagaaat

SEQ ID NO: 800878 - DNA, 22 bp, Artificial Sequence
  chemically synthesized
atctttcatccatgacctgaaa

SEQ ID NO: 800879 - DNA, 22 bp, Artificial Sequence
  chemically synthesized
caaaatttctttcaggtcatgg

SEQ ID NO: 800880 - DNA, 22 bp, Artificial Sequence
  chemically synthesized
aaaatttctttcaggtcatgga

SEQ ID NO: 800881 - DNA, 22 bp, Artificial Sequence
  chemically synthesized
aattcatctttcatccatgacc

SEQ ID NO: 800882 - DNA, 22 bp, Artificial Sequence
  chemically synthesized
ctttcaggtcatggatgaaaga

SEQ ID NO: 800883 - DNA, 22 bp, Artificial Sequence
  chemically synthesized
tttcaggtcatggatgaaagat

SEQ ID NO: 800884 - DNA, 22 bp, Artificial Sequence
  chemically synthesized
tcaggtcatggatgaaagatga

SEQ ID NO: 800885 - DNA, 22 bp, Artificial Sequence
  chemically synthesized
caggtcatggatgaaagatgaa

SEQ ID NO: 800886 - DNA, 22 bp, Artificial Sequence
  chemically synthesized
gacaaccctaaattcatctttc

SEQ ID NO: 800887 - DNA, 22 bp, Artificial Sequence
  chemically synthesized
aggtcatggatgaaagatgaat

SEQ ID NO: 800888 - DNA, 22 bp, Artificial Sequence
  chemically synthesized
attagacaaccctaaattcatc

SEQ ID NO: 800889 - DNA, 22 bp, Artificial Sequence
  chemically synthesized
cattgattagacaaccctaaat

SEQ ID NO: 800890 - DNA, 22 bp, Artificial Sequence
  chemically synthesized
gatgcaaccattgcattgatta

SEQ ID NO: 800891 - DNA, 22 bp, Artificial Sequence
  chemically synthesized
ggatgcaaccattgcattgatt

SEQ ID NO: 800892 - DNA, 22 bp, Artificial Sequence
  chemically synthesized
agggttgtctaatcaatgcaat

SEQ ID NO: 800893 - DNA, 22 bp, Artificial Sequence
  chemically synthesized
gggttgtctaatcaatgcaatg

SEQ ID NO: 800894 - DNA, 22 bp, Artificial Sequence
  chemically synthesized
tttggatgcaaccattgcattg

SEQ ID NO: 800895 - DNA, 22 bp, Artificial Sequence
  chemically synthesized
atttggatgcaaccattgcatt

SEQ ID NO: 800896 - DNA, 22 bp, Artificial Sequence
  chemically synthesized
ttatttggatgcaaccattgca

SEQ ID NO: 800897 - DNA, 22 bp, Artificial Sequence
  chemically synthesized
tctaatcaatgcaatggttgca

SEQ ID NO: 800898 - DNA, 22 bp, Artificial Sequence
  chemically synthesized
atcaatgcaatggttgcatcca

SEQ ID NO: 800899 - DNA, 22 bp, Artificial Sequence
  chemically synthesized
gagtggaaaacaagtgttctta

SEQ ID NO: 800900 - DNA, 22 bp, Artificial Sequence
  chemically synthesized
ggagtggaaaacaagtgttctt

SEQ ID NO: 800901 - DNA, 22 bp, Artificial Sequence
  chemically synthesized
tggagtggaaaacaagtgttct

SEQ ID NO: 800902 - DNA, 22 bp, Artificial Sequence
  chemically synthesized
ttggagtggaaaacaagtgttc

SEQ ID NO: 800903 - DNA, 22 bp, Artificial Sequence
  chemically synthesized
catccaaataagaacacttgtt

SEQ ID NO: 800904 - DNA, 22 bp, Artificial Sequence
  chemically synthesized
ttttggagtggaaaacaagtgt

SEQ ID NO: 800905 - DNA, 22 bp, Artificial Sequence
  chemically synthesized
tcttttggagtggaaaacaagt

SEQ ID NO: 800906 - DNA, 22 bp, Artificial Sequence
  chemically synthesized
attctcttttggagtggaaaac

SEQ ID NO: 800907 - DNA, 22 bp, Artificial Sequence
  chemically synthesized
ttgattctcttttggagtggaa

SEQ ID NO: 800908 - DNA, 22 bp, Artificial Sequence
  chemically synthesized
gttttccactccaaaagagaat

SEQ ID NO: 800909 - DNA, 22 bp, Artificial Sequence
  chemically synthesized
ttttccactccaaaagagaatc

SEQ ID NO: 800910 - DNA, 22 bp, Artificial Sequence
  chemically synthesized
tccactccaaaagagaatcaac

SEQ ID NO: 800911 - DNA, 22 bp, Artificial Sequence
  chemically synthesized
gtatggtaaattgttgattctc

SEQ ID NO: 800912 - DNA, 22 bp, Artificial Sequence
  chemically synthesized
ccactccaaaagagaatcaaca

SEQ ID NO: 800913 - DNA, 22 bp, Artificial Sequence
  chemically synthesized
cactccaaaagagaatcaacaa

SEQ ID NO: 800914 - DNA, 22 bp, Artificial Sequence
  chemically synthesized
acctggtatggtaaattgttga

SEQ ID NO: 800915 - DNA, 22 bp, Artificial Sequence
  chemically synthesized
cacctggtatggtaaattgttg

SEQ ID NO: 800916 - DNA, 22 bp, Artificial Sequence
  chemically synthesized
caaaagagaatcaacaatttac

SEQ ID NO: 800917 - DNA, 22 bp, Artificial Sequence
  chemically synthesized
ttcacctggtatggtaaattgt

SEQ ID NO: 800918 - DNA, 22 bp, Artificial Sequence
  chemically synthesized
cttcacctggtatggtaaattg

SEQ ID NO: 800919 - DNA, 22 bp, Artificial Sequence
  chemically synthesized
accataccaggtgaagaagcta

SEQ ID NO: 800920 - DNA, 22 bp, Artificial Sequence
  chemically synthesized
ccataccaggtgaagaagctac

SEQ ID NO: 800921 - DNA, 22 bp, Artificial Sequence
  chemically synthesized
aaaagtgcaatgagtagaggta

SEQ ID NO: 800922 - DNA, 22 bp, Artificial Sequence
  chemically synthesized
aaaaagtgcaatgagtagaggt

SEQ ID NO: 800923 - DNA, 22 bp, Artificial Sequence
  chemically synthesized
taaaaagtgcaatgagtagagg

SEQ ID NO: 800924 - DNA, 22 bp, Artificial Sequence
  chemically synthesized
cctctactcattgcacttttta

SEQ ID NO: 800925 - DNA, 22 bp, Artificial Sequence
  chemically synthesized
tgcaatgcagttttaaaaagtg

SEQ ID NO: 800926 - DNA, 22 bp, Artificial Sequence
  chemically synthesized
tactcattgcactttttaaaac

SEQ ID NO: 800927 - DNA, 22 bp, Artificial Sequence
  chemically synthesized
ctcattgcactttttaaaactg

SEQ ID NO: 800928 - DNA, 22 bp, Artificial Sequence
  chemically synthesized
attgcactttttaaaactgcat

SEQ ID NO: 800929 - DNA, 22 bp, Artificial Sequence
  chemically synthesized
gaaaatggctgtgcaatgcagt

SEQ ID NO: 800930 - DNA, 22 bp, Artificial Sequence
  chemically synthesized
cactttttaaaactgcattgca

SEQ ID NO: 800931 - DNA, 22 bp, Artificial Sequence
  chemically synthesized
ggaaaatggctgtgcaatgcag

SEQ ID NO: 800932 - DNA, 22 bp, Artificial Sequence
  chemically synthesized
tttaaaactgcattgcacagcc

SEQ ID NO: 800933 - DNA, 22 bp, Artificial Sequence
  chemically synthesized
ttaaaactgcattgcacagcca

SEQ ID NO: 800934 - DNA, 22 bp, Artificial Sequence
  chemically synthesized
taaaactgcattgcacagccat

SEQ ID NO: 800935 - DNA, 22 bp, Artificial Sequence
  chemically synthesized
aaaactgcattgcacagccatt

SEQ ID NO: 800936 - DNA, 22 bp, Artificial Sequence
  chemically synthesized
aaactgcattgcacagccattt

SEQ ID NO: 800937 - DNA, 22 bp, Artificial Sequence
  chemically synthesized
caaatatttggaaaatggctgt

SEQ ID NO: 800938 - DNA, 22 bp, Artificial Sequence
  chemically synthesized
acaaatatttggaaaatggctg

SEQ ID NO: 800939 - DNA, 22 bp, Artificial Sequence
  chemically synthesized
tacaaatatttggaaaatggct

SEQ ID NO: 800940 - DNA, 22 bp, Artificial Sequence
  chemically synthesized
cattgcacagccattttccaaa

SEQ ID NO: 800941 - DNA, 22 bp, Artificial Sequence
  chemically synthesized
cacagccattttccaaatattt

SEQ ID NO: 800942 - DNA, 22 bp, Artificial Sequence
  chemically synthesized
cagtagctttacaaatatttgg

SEQ ID NO: 800943 - DNA, 22 bp, Artificial Sequence
  chemically synthesized
gcagtagctttacaaatatttg

SEQ ID NO: 800944 - DNA, 22 bp, Artificial Sequence
  chemically synthesized
tgcagtagctttacaaatattt

SEQ ID NO: 800945 - DNA, 22 bp, Artificial Sequence
  chemically synthesized
ttgcagtagctttacaaatatt

SEQ ID NO: 800946 - DNA, 22 bp, Artificial Sequence
  chemically synthesized
gtttttgcagtagctttacaaa

SEQ ID NO: 800947 - DNA, 22 bp, Artificial Sequence
  chemically synthesized
agtttttgcagtagctttacaa

SEQ ID NO: 800948 - DNA, 22 bp, Artificial Sequence
  chemically synthesized
tagtttttgcagtagctttaca

SEQ ID NO: 800949 - DNA, 22 bp, Artificial Sequence
  chemically synthesized
ttagtttttgcagtagctttac

SEQ ID NO: 800950 - DNA, 22 bp, Artificial Sequence
  chemically synthesized
tccaaatatttgtaaagctact

SEQ ID NO: 800951 - DNA, 22 bp, Artificial Sequence
  chemically synthesized
tttagtttttgcagtagcttta

SEQ ID NO: 800952 - DNA, 22 bp, Artificial Sequence
  chemically synthesized
ccaaatatttgtaaagctactg

SEQ ID NO: 800953 - DNA, 22 bp, Artificial Sequence
  chemically synthesized
caaatatttgtaaagctactgc

SEQ ID NO: 800954 - DNA, 22 bp, Artificial Sequence
  chemically synthesized
gtaaagctactgcaaaaactaa

SEQ ID NO: 800955 - DNA, 22 bp, Artificial Sequence
  chemically synthesized
cataaatcctttttagtttttg

SEQ ID NO: 800956 - DNA, 22 bp, Artificial Sequence
  chemically synthesized
taaagctactgcaaaaactaaa

SEQ ID NO: 800957 - DNA, 22 bp, Artificial Sequence
  chemically synthesized
ctccataaatcctttttagttt

SEQ ID NO: 800958 - DNA, 22 bp, Artificial Sequence
  chemically synthesized
actccataaatcctttttagtt

SEQ ID NO: 800959 - DNA, 22 bp, Artificial Sequence
  chemically synthesized
ctgcaaaaactaaaaaggattt

SEQ ID NO: 800960 - DNA, 22 bp, Artificial Sequence
  chemically synthesized
caaaaactaaaaaggatttatg

SEQ ID NO: 800961 - DNA, 22 bp, Artificial Sequence
  chemically synthesized
ccatgatttactccataaatcc

SEQ ID NO: 800962 - DNA, 22 bp, Artificial Sequence
  chemically synthesized
cccatgatttactccataaatc

SEQ ID NO: 800963 - DNA, 22 bp, Artificial Sequence
  chemically synthesized
ttcccatgatttactccataaa

SEQ ID NO: 800964 - DNA, 22 bp, Artificial Sequence
  chemically synthesized
aaaaggatttatggagtaaatc

SEQ ID NO: 800965 - DNA, 22 bp, Artificial Sequence
  chemically synthesized
accaggcattcttcccatgatt

SEQ ID NO: 800966 - DNA, 22 bp, Artificial Sequence
  chemically synthesized
gaccaggcattcttcccatgat

SEQ ID NO: 800967 - DNA, 22 bp, Artificial Sequence
  chemically synthesized
atggagtaaatcatgggaagaa

SEQ ID NO: 800968 - DNA, 22 bp, Artificial Sequence
  chemically synthesized
tggagtaaatcatgggaagaat

SEQ ID NO: 800969 - DNA, 22 bp, Artificial Sequence
  chemically synthesized
tgaaccacttgaccaggcattc

SEQ ID NO: 800970 - DNA, 22 bp, Artificial Sequence
  chemically synthesized
atgaaccacttgaccaggcatt

SEQ ID NO: 800971 - DNA, 22 bp, Artificial Sequence
  chemically synthesized
gatatttatgaaccacttgacc

SEQ ID NO: 800972 - DNA, 22 bp, Artificial Sequence
  chemically synthesized
gtcaagtggttcataaatatcc

SEQ ID NO: 800973 - DNA, 22 bp, Artificial Sequence
  chemically synthesized
tgaccccaaatagaatgagacc

SEQ ID NO: 800974 - DNA, 22 bp, Artificial Sequence
  chemically synthesized
ataaatatccaggtctcattct

SEQ ID NO: 800975 - DNA, 22 bp, Artificial Sequence
  chemically synthesized
aaggctgtgaccccaaatagaa

SEQ ID NO: 800976 - DNA, 22 bp, Artificial Sequence
  chemically synthesized
aattcaaggctgtgaccccaaa

SEQ ID NO: 800977 - DNA, 22 bp, Artificial Sequence
  chemically synthesized
gattaaattcaaggctgtgacc

SEQ ID NO: 800978 - DNA, 22 bp, Artificial Sequence
  chemically synthesized
attctatttggggtcacagcct

SEQ ID NO: 800979 - DNA, 22 bp, Artificial Sequence
  chemically synthesized
tatttggggtcacagccttgaa

SEQ ID NO: 800980 - DNA, 22 bp, Artificial Sequence
  chemically synthesized
tttggggtcacagccttgaatt

SEQ ID NO: 800981 - DNA, 22 bp, Artificial Sequence
  chemically synthesized
aatattggattaaattcaaggc

SEQ ID NO: 800982 - DNA, 22 bp, Artificial Sequence
  chemically synthesized
ggggtcacagccttgaatttaa

SEQ ID NO: 800983 - DNA, 22 bp, Artificial Sequence
  chemically synthesized
gggtcacagccttgaatttaat

SEQ ID NO: 800984 - DNA, 22 bp, Artificial Sequence
  chemically synthesized
aacaattcaatattggattaaa

SEQ ID NO: 800985 - DNA, 22 bp, Artificial Sequence
  chemically synthesized
ccaattcaacaattcaatattg

SEQ ID NO: 800986 - DNA, 22 bp, Artificial Sequence
  chemically synthesized
gaatttaatccaatattgaatt

SEQ ID NO: 800987 - DNA, 22 bp, Artificial Sequence
  chemically synthesized
aatttaatccaatattgaattg

SEQ ID NO: 800988 - DNA, 22 bp, Artificial Sequence
  chemically synthesized
ctcccaattcaacaattcaata

SEQ ID NO: 800989 - DNA, 22 bp, Artificial Sequence
  chemically synthesized
gctcccaattcaacaattcaat

SEQ ID NO: 800990 - DNA, 22 bp, Artificial Sequence
  chemically synthesized
tgctcccaattcaacaattcaa

SEQ ID NO: 800991 - DNA, 22 bp, Artificial Sequence
  chemically synthesized
tttgctcccaattcaacaattc

SEQ ID NO: 800992 - DNA, 22 bp, Artificial Sequence
  chemically synthesized
aatccaatattgaattgttgaa

SEQ ID NO: 800993 - DNA, 22 bp, Artificial Sequence
  chemically synthesized
atccaatattgaattgttgaat

SEQ ID NO: 800994 - DNA, 22 bp, Artificial Sequence
  chemically synthesized
aattctttgctcccaattcaac

SEQ ID NO: 800995 - DNA, 22 bp, Artificial Sequence
  chemically synthesized
acctcaattctttgctcccaat

SEQ ID NO: 800996 - DNA, 22 bp, Artificial Sequence
  chemically synthesized
cacctcaattctttgctcccaa

SEQ ID NO: 800997 - DNA, 22 bp, Artificial Sequence
  chemically synthesized
aattgttgaattgggagcaaag

SEQ ID NO: 800998 - DNA, 22 bp, Artificial Sequence
  chemically synthesized
ttgaattgggagcaaagaattg

SEQ ID NO: 800999 - DNA, 22 bp, Artificial Sequence
  chemically synthesized
aattgggagcaaagaattgagg

SEQ ID NO: 801000 - DNA, 22 bp, Artificial Sequence
  chemically synthesized
ggagcaaagaattgaggtgaaa

SEQ ID NO: 801001 - DNA, 22 bp, Artificial Sequence
  chemically synthesized
aggagccaaccacatttcacct

SEQ ID NO: 801002 - DNA, 22 bp, Artificial Sequence
  chemically synthesized
tcaggagccaaccacatttcac

SEQ ID NO: 801003 - DNA, 22 bp, Artificial Sequence
  chemically synthesized
ctctcaggagccaaccacattt

SEQ ID NO: 801004 - DNA, 22 bp, Artificial Sequence
  chemically synthesized
agttgctctcaggagccaacca

SEQ ID NO: 801005 - DNA, 22 bp, Artificial Sequence
  chemically synthesized
cagttgctctcaggagccaacc

SEQ ID NO: 801006 - DNA, 22 bp, Artificial Sequence
  chemically synthesized
aggtgaaatgtggttggctcct

SEQ ID NO: 801007 - DNA, 22 bp, Artificial Sequence
  chemically synthesized
caggaagcagcatttcagttgc

SEQ ID NO: 801008 - DNA, 22 bp, Artificial Sequence
  chemically synthesized
gctcctgagagcaactgaaatg

SEQ ID NO: 801009 - DNA, 22 bp, Artificial Sequence
  chemically synthesized
tgcaggaagcagcatttcagtt

SEQ ID NO: 801010 - DNA, 22 bp, Artificial Sequence
  chemically synthesized
tctgcaggaagcagcatttcag

SEQ ID NO: 801011 - DNA, 22 bp, Artificial Sequence
  chemically synthesized
ctgagagcaactgaaatgctgc

SEQ ID NO: 801012 - DNA, 22 bp, Artificial Sequence
  chemically synthesized
ttctctgcaggaagcagcattt

SEQ ID NO: 801013 - DNA, 22 bp, Artificial Sequence
  chemically synthesized
agagcaactgaaatgctgcttc

SEQ ID NO: 801014 - DNA, 22 bp, Artificial Sequence
  chemically synthesized
aaatgctgcttcctgcagagaa

SEQ ID NO: 801015 - DNA, 22 bp, Artificial Sequence
  chemically synthesized
caaagaaagttattctctgcag

SEQ ID NO: 801016 - DNA, 22 bp, Artificial Sequence
  chemically synthesized
ggagttacaaagaaagttattc

SEQ ID NO: 801017 - DNA, 22 bp, Artificial Sequence
  chemically synthesized
cttcctgcagagaataactttc

SEQ ID NO: 801018 - DNA, 22 bp, Artificial Sequence
  chemically synthesized
tgggagttacaaagaaagttat

SEQ ID NO: 801019 - DNA, 22 bp, Artificial Sequence
  chemically synthesized
cctgcagagaataactttcttt

SEQ ID NO: 801020 - DNA, 22 bp, Artificial Sequence
  chemically synthesized
tctgggagttacaaagaaagtt

SEQ ID NO: 801021 - DNA, 22 bp, Artificial Sequence
  chemically synthesized
ctgcagagaataactttctttg

SEQ ID NO: 801022 - DNA, 22 bp, Artificial Sequence
  chemically synthesized
ttctctgggagttacaaagaaa

SEQ ID NO: 801023 - DNA, 22 bp, Artificial Sequence
  chemically synthesized
cagagaataactttctttgtaa

SEQ ID NO: 801024 - DNA, 22 bp, Artificial Sequence
  chemically synthesized
caaatatattattctctgggag

SEQ ID NO: 801025 - DNA, 22 bp, Artificial Sequence
  chemically synthesized
gcaaatatattattctctggga

SEQ ID NO: 801026 - DNA, 22 bp, Artificial Sequence
  chemically synthesized
tgcaaatatattattctctggg

SEQ ID NO: 801027 - DNA, 22 bp, Artificial Sequence
  chemically synthesized
tctttgtaactcccagagaata

SEQ ID NO: 801028 - DNA, 22 bp, Artificial Sequence
  chemically synthesized
ctttgtaactcccagagaataa

SEQ ID NO: 801029 - DNA, 22 bp, Artificial Sequence
  chemically synthesized
tttgtaactcccagagaataat

SEQ ID NO: 801030 - DNA, 22 bp, Artificial Sequence
  chemically synthesized
tgtaactcccagagaataatat

SEQ ID NO: 801031 - DNA, 22 bp, Artificial Sequence
  chemically synthesized
gtaactcccagagaataatata

SEQ ID NO: 801032 - DNA, 22 bp, Artificial Sequence
  chemically synthesized
taactcccagagaataatatat

SEQ ID NO: 801033 - DNA, 22 bp, Artificial Sequence
  chemically synthesized
caacacctttgcaaatatatta

SEQ ID NO: 801034 - DNA, 22 bp, Artificial Sequence
  chemically synthesized
ccagagaataatatatttgcaa

SEQ ID NO: 801035 - DNA, 22 bp, Artificial Sequence
  chemically synthesized
acctccaacacctttgcaaata

SEQ ID NO: 801036 - DNA, 22 bp, Artificial Sequence
  chemically synthesized
ttcacctccaacacctttgcaa

SEQ ID NO: 801037 - DNA, 22 bp, Artificial Sequence
  chemically synthesized
atatctattcacctccaacacc

SEQ ID NO: 801038 - DNA, 22 bp, Artificial Sequence
  chemically synthesized
taatatctattcacctccaaca

SEQ ID NO: 801039 - DNA, 22 bp, Artificial Sequence
  chemically synthesized
tctaatatctattcacctccaa

SEQ ID NO: 801040 - DNA, 22 bp, Artificial Sequence
  chemically synthesized
gcaaaggtgttggaggtgaata

SEQ ID NO: 801041 - DNA, 22 bp, Artificial Sequence
  chemically synthesized
ctctctaatatctattcacctc

SEQ ID NO: 801042 - DNA, 22 bp, Artificial Sequence
  chemically synthesized
caaaggtgttggaggtgaatag

SEQ ID NO: 801043 - DNA, 22 bp, Artificial Sequence
  chemically synthesized
cctctctaatatctattcacct

SEQ ID NO: 801044 - DNA, 22 bp, Artificial Sequence
  chemically synthesized
tcctctctaatatctattcacc

SEQ ID NO: 801045 - DNA, 22 bp, Artificial Sequence
  chemically synthesized
ttcctctctaatatctattcac

SEQ ID NO: 801046 - DNA, 22 bp, Artificial Sequence
  chemically synthesized
tttcctctctaatatctattca

SEQ ID NO: 801047 - DNA, 22 bp, Artificial Sequence
  chemically synthesized
ctttttcctctctaatatctat

SEQ ID NO: 801048 - DNA, 22 bp, Artificial Sequence
  chemically synthesized
actttttcctctctaatatcta

SEQ ID NO: 801049 - DNA, 22 bp, Artificial Sequence
  chemically synthesized
tactttttcctctctaatatct

SEQ ID NO: 801050 - DNA, 22 bp, Artificial Sequence
  chemically synthesized
gaggtgaatagatattagagag

SEQ ID NO: 801051 - DNA, 22 bp, Artificial Sequence
  chemically synthesized
aagattttactttttcctctct

SEQ ID NO: 801052 - DNA, 22 bp, Artificial Sequence
  chemically synthesized
taaagattttactttttcctct

SEQ ID NO: 801053 - DNA, 22 bp, Artificial Sequence
  chemically synthesized
tctaaagattttactttttcct

SEQ ID NO: 801054 - DNA, 22 bp, Artificial Sequence
  chemically synthesized
agttctctaaagattttacttt

SEQ ID NO: 801055 - DNA, 22 bp, Artificial Sequence
  chemically synthesized
cagttctctaaagattttactt

SEQ ID NO: 801056 - DNA, 22 bp, Artificial Sequence
  chemically synthesized
tcagttctctaaagattttact

SEQ ID NO: 801057 - DNA, 22 bp, Artificial Sequence
  chemically synthesized
gagaggaaaaagtaaaatcttt

SEQ ID NO: 801058 - DNA, 22 bp, Artificial Sequence
  chemically synthesized
agtcacataaatataatctttc

SEQ ID NO: 801059 - DNA, 22 bp, Artificial Sequence
  chemically synthesized
tagagaactgaaagattatatt

SEQ ID NO: 801060 - DNA, 22 bp, Artificial Sequence
  chemically synthesized
agagaactgaaagattatattt

SEQ ID NO: 801061 - DNA, 22 bp, Artificial Sequence
  chemically synthesized
gagaactgaaagattatattta

SEQ ID NO: 801062 - DNA, 22 bp, Artificial Sequence
  chemically synthesized
caatgatctgagtcacataaat

SEQ ID NO: 801063 - DNA, 22 bp, Artificial Sequence
  chemically synthesized
acaatgatctgagtcacataaa

SEQ ID NO: 801064 - DNA, 22 bp, Artificial Sequence
  chemically synthesized
aaagattatatttatgtgactc

SEQ ID NO: 801065 - DNA, 22 bp, Artificial Sequence
  chemically synthesized
taataacttacaatgatctgag

SEQ ID NO: 801066 - DNA, 22 bp, Artificial Sequence
  chemically synthesized
tatttatgtgactcagatcatt

SEQ ID NO: 801067 - DNA, 22 bp, Artificial Sequence
  chemically synthesized
atgtgactcagatcattgtaag

SEQ ID NO: 801068 - DNA, 22 bp, Artificial Sequence
  chemically synthesized
gcattataataacttacaatga

SEQ ID NO: 801069 - DNA, 22 bp, Artificial Sequence
  chemically synthesized
tgtgactcagatcattgtaagt

SEQ ID NO: 801070 - DNA, 22 bp, Artificial Sequence
  chemically synthesized
aatattagcattataataactt

SEQ ID NO: 801071 - DNA, 22 bp, Artificial Sequence
  chemically synthesized
agatcattgtaagttattataa

SEQ ID NO: 801072 - DNA, 22 bp, Artificial Sequence
  chemically synthesized
ttcaatattagcattataataa

SEQ ID NO: 801073 - DNA, 22 bp, Artificial Sequence
  chemically synthesized
actattcaatattagcattata

SEQ ID NO: 801074 - DNA, 22 bp, Artificial Sequence
  chemically synthesized
ttgactattcaatattagcatt

SEQ ID NO: 801075 - DNA, 22 bp, Artificial Sequence
  chemically synthesized
taagttattataatgctaatat

SEQ ID NO: 801076 - DNA, 22 bp, Artificial Sequence
  chemically synthesized
actattgactattcaatattag

SEQ ID NO: 801077 - DNA, 22 bp, Artificial Sequence
  chemically synthesized
ttataatgctaatattgaatag

SEQ ID NO: 801078 - DNA, 22 bp, Artificial Sequence
  chemically synthesized
taatgctaatattgaatagtca

SEQ ID NO: 801079 - DNA, 22 bp, Artificial Sequence
  chemically synthesized
gcatgttgactattgactattc

SEQ ID NO: 801080 - DNA, 22 bp, Artificial Sequence
  chemically synthesized
ttagcatgttgactattgacta

SEQ ID NO: 801081 - DNA, 22 bp, Artificial Sequence
  chemically synthesized
atattgaatagtcaatagtcaa

SEQ ID NO: 801082 - DNA, 22 bp, Artificial Sequence
  chemically synthesized
agaggtctgttagcatgttgac

SEQ ID NO: 801083 - DNA, 22 bp, Artificial Sequence
  chemically synthesized
aatagtcaatagtcaacatgct

SEQ ID NO: 801084 - DNA, 22 bp, Artificial Sequence
  chemically synthesized
gagaggtctgttagcatgttga

SEQ ID NO: 801085 - DNA, 22 bp, Artificial Sequence
  chemically synthesized
tccttgagaggtctgttagcat

SEQ ID NO: 801086 - DNA, 22 bp, Artificial Sequence
  chemically synthesized
tggttgtccttgagaggtctgt

SEQ ID NO: 801087 - DNA, 22 bp, Artificial Sequence
  chemically synthesized
agtctgtggttgtccttgagag

SEQ ID NO: 801088 - DNA, 22 bp, Artificial Sequence
  chemically synthesized
ctgagtctgtggttgtccttga

SEQ ID NO: 801089 - DNA, 22 bp, Artificial Sequence
  chemically synthesized
acagacctctcaaggacaacca

SEQ ID NO: 801090 - DNA, 22 bp, Artificial Sequence
  chemically synthesized
ctcctgagtctgtggttgtcct

SEQ ID NO: 801091 - DNA, 22 bp, Artificial Sequence
  chemically synthesized
gctcctgagtctgtggttgtcc

SEQ ID NO: 801092 - DNA, 22 bp, Artificial Sequence
  chemically synthesized
tttgctcctgagtctgtggttg

SEQ ID NO: 801093 - DNA, 22 bp, Artificial Sequence
  chemically synthesized
gtttgctcctgagtctgtggtt

SEQ ID NO: 801094 - DNA, 22 bp, Artificial Sequence
  chemically synthesized
tgtttgctcctgagtctgtggt

SEQ ID NO: 801095 - DNA, 22 bp, Artificial Sequence
  chemically synthesized
ttgtttgctcctgagtctgtgg

SEQ ID NO: 801096 - DNA, 22 bp, Artificial Sequence
  chemically synthesized
tcaaggacaaccacagactcag

SEQ ID NO: 801097 - DNA, 22 bp, Artificial Sequence
  chemically synthesized
cttttgtttgctcctgagtctg

SEQ ID NO: 801098 - DNA, 22 bp, Artificial Sequence
  chemically synthesized
aaggacaaccacagactcagga

SEQ ID NO: 801099 - DNA, 22 bp, Artificial Sequence
  chemically synthesized
aggagcaaacaaaagtaatttg

SEQ ID NO: 801100 - DNA, 22 bp, Artificial Sequence
  chemically synthesized
atagtgagaaagcaacaaatta

SEQ ID NO: 801101 - DNA, 22 bp, Artificial Sequence
  chemically synthesized
gatagtgagaaagcaacaaatt

SEQ ID NO: 801102 - DNA, 22 bp, Artificial Sequence
  chemically synthesized
ttgatagtgagaaagcaacaaa

SEQ ID NO: 801103 - DNA, 22 bp, Artificial Sequence
  chemically synthesized
cttgatagtgagaaagcaacaa

SEQ ID NO: 801104 - DNA, 22 bp, Artificial Sequence
  chemically synthesized
tttcttgatagtgagaaagcaa

SEQ ID NO: 801105 - DNA, 22 bp, Artificial Sequence
  chemically synthesized
gttgctttctcactatcaagaa

SEQ ID NO: 801106 - DNA, 22 bp, Artificial Sequence
  chemically synthesized
ttgctttctcactatcaagaaa

SEQ ID NO: 801107 - DNA, 22 bp, Artificial Sequence
  chemically synthesized
ctttctcactatcaagaaacag

SEQ ID NO: 801108 - DNA, 22 bp, Artificial Sequence
  chemically synthesized
gatggaagaatgtctgtttctt

SEQ ID NO: 801109 - DNA, 22 bp, Artificial Sequence
  chemically synthesized
tctcactatcaagaaacagaca

SEQ ID NO: 801110 - DNA, 22 bp, Artificial Sequence
  chemically synthesized
ctcactatcaagaaacagacat

SEQ ID NO: 801111 - DNA, 22 bp, Artificial Sequence
  chemically synthesized
tcactatcaagaaacagacatt

SEQ ID NO: 801112 - DNA, 22 bp, Artificial Sequence
  chemically synthesized
gtctagatggaagaatgtctgt

SEQ ID NO: 801113 - DNA, 22 bp, Artificial Sequence
  chemically synthesized
actatcaagaaacagacattct

SEQ ID NO: 801114 - DNA, 22 bp, Artificial Sequence
  chemically synthesized
tcaagaaacagacattcttcca

SEQ ID NO: 801115 - DNA, 22 bp, Artificial Sequence
  chemically synthesized
gagatcatattagtctagatgg

SEQ ID NO: 801116 - DNA, 22 bp, Artificial Sequence
  chemically synthesized
ccactggagatcatattagtct

SEQ ID NO: 801117 - DNA, 22 bp, Artificial Sequence
  chemically synthesized
cccactggagatcatattagtc

SEQ ID NO: 801118 - DNA, 22 bp, Artificial Sequence
  chemically synthesized
ttccatctagactaatatgatc

SEQ ID NO: 801119 - DNA, 22 bp, Artificial Sequence
  chemically synthesized
ccatctagactaatatgatctc

SEQ ID NO: 801120 - DNA, 22 bp, Artificial Sequence
  chemically synthesized
catctagactaatatgatctcc

SEQ ID NO: 801121 - DNA, 22 bp, Artificial Sequence
  chemically synthesized
gactaatatgatctccagtggg

SEQ ID NO: 801122 - DNA, 22 bp, Artificial Sequence
  chemically synthesized
atatgatctccagtgggaaatg

SEQ ID NO: 801123 - DNA, 22 bp, Artificial Sequence
  chemically synthesized
atgaatgtaagagacataaatc

SEQ ID NO: 801124 - DNA, 22 bp, Artificial Sequence
  chemically synthesized
cagtgggaaatgatttatgtct

SEQ ID NO: 801125 - DNA, 22 bp, Artificial Sequence
  chemically synthesized
catgaatgtaagagacataaat

SEQ ID NO: 801126 - DNA, 22 bp, Artificial Sequence
  chemically synthesized
tgagagagagtttcatgaatgt

SEQ ID NO: 801127 - DNA, 22 bp, Artificial Sequence
  chemically synthesized
atgtctcttacattcatgaaac

SEQ ID NO: 801128 - DNA, 22 bp, Artificial Sequence
  chemically synthesized
tgtctcttacattcatgaaact

SEQ ID NO: 801129 - DNA, 22 bp, Artificial Sequence
  chemically synthesized
gttatgagagagagtttcatga

SEQ ID NO: 801130 - DNA, 22 bp, Artificial Sequence
  chemically synthesized
ttacattcatgaaactctctct

SEQ ID NO: 801131 - DNA, 22 bp, Artificial Sequence
  chemically synthesized
cgcctggttatgagagagagtt

SEQ ID NO: 801132 - DNA, 22 bp, Artificial Sequence
  chemically synthesized
acattcatgaaactctctctca

SEQ ID NO: 801133 - DNA, 22 bp, Artificial Sequence
  chemically synthesized
cattcatgaaactctctctcat

SEQ ID NO: 801134 - DNA, 22 bp, Artificial Sequence
  chemically synthesized
atgaaactctctctcataacca

SEQ ID NO: 801135 - DNA, 22 bp, Artificial Sequence
  chemically synthesized
tctctcataaccaggcgtaatg

SEQ ID NO: 801136 - DNA, 22 bp, Artificial Sequence
  chemically synthesized
tctcataaccaggcgtaatgac

SEQ ID NO: 801137 - DNA, 22 bp, Artificial Sequence
  chemically synthesized
tcataaccaggcgtaatgactt

SEQ ID NO: 801138 - DNA, 22 bp, Artificial Sequence
  chemically synthesized
ataaccaggcgtaatgacttct

SEQ ID NO: 801139 - DNA, 22 bp, Artificial Sequence
  chemically synthesized
cgaagaggtaaaagaagtcatt

SEQ ID NO: 801140 - DNA, 22 bp, Artificial Sequence
  chemically synthesized
tccgaagaggtaaaagaagtca

SEQ ID NO: 801141 - DNA, 22 bp, Artificial Sequence
  chemically synthesized
cttttacctcttcggagaatgg

SEQ ID NO: 801142 - DNA, 22 bp, Artificial Sequence
  chemically synthesized
tgcataaatcagccattctccg

SEQ ID NO: 801143 - DNA, 22 bp, Artificial Sequence
  chemically synthesized
ttttacctcttcggagaatggc

SEQ ID NO: 801144 - DNA, 22 bp, Artificial Sequence
  chemically synthesized
ttacctcttcggagaatggctg

SEQ ID NO: 801145 - DNA, 22 bp, Artificial Sequence
  chemically synthesized
tacctcttcggagaatggctga

SEQ ID NO: 801146 - DNA, 22 bp, Artificial Sequence
  chemically synthesized
acctcttcggagaatggctgat

SEQ ID NO: 801147 - DNA, 22 bp, Artificial Sequence
  chemically synthesized
cctcttcggagaatggctgatt

SEQ ID NO: 801148 - DNA, 22 bp, Artificial Sequence
  chemically synthesized
ttcggagaatggctgatttatg

SEQ ID NO: 801149 - DNA, 22 bp, Artificial Sequence
  chemically synthesized
cggagaatggctgatttatgca

SEQ ID NO: 801150 - DNA, 22 bp, Artificial Sequence
  chemically synthesized
cacaaaggtctgtgcataaatc

SEQ ID NO: 801151 - DNA, 22 bp, Artificial Sequence
  chemically synthesized
ggagaatggctgatttatgcac

SEQ ID NO: 801152 - DNA, 22 bp, Artificial Sequence
  chemically synthesized
ttgcacaaaggtctgtgcataa

SEQ ID NO: 801153 - DNA, 22 bp, Artificial Sequence
  chemically synthesized
atttatgcacagacctttgtgc

SEQ ID NO: 801154 - DNA, 22 bp, Artificial Sequence
  chemically synthesized
aagaaaagttattgcacaaagg

SEQ ID NO: 801155 - DNA, 22 bp, Artificial Sequence
  chemically synthesized
aaagaaaagttattgcacaaag

SEQ ID NO: 801156 - DNA, 22 bp, Artificial Sequence
  chemically synthesized
taaagaaaagttattgcacaaa

SEQ ID NO: 801157 - DNA, 22 bp, Artificial Sequence
  chemically synthesized
atgcacagacctttgtgcaata

SEQ ID NO: 801158 - DNA, 22 bp, Artificial Sequence
  chemically synthesized
tgcacagacctttgtgcaataa

SEQ ID NO: 801159 - DNA, 22 bp, Artificial Sequence
  chemically synthesized
tgtgcaataacttttctttaaa

SEQ ID NO: 801160 - DNA, 22 bp, Artificial Sequence
  chemically synthesized
acagcatcaatctttaaagaaa

SEQ ID NO: 801161 - DNA, 22 bp, Artificial Sequence
  chemically synthesized
gtgcaataacttttctttaaag

SEQ ID NO: 801162 - DNA, 22 bp, Artificial Sequence
  chemically synthesized
aacagcatcaatctttaaagaa

SEQ ID NO: 801163 - DNA, 22 bp, Artificial Sequence
  chemically synthesized
tgcaataacttttctttaaaga

SEQ ID NO: 801164 - DNA, 22 bp, Artificial Sequence
  chemically synthesized
atgtttaacagcatcaatcttt

SEQ ID NO: 801165 - DNA, 22 bp, Artificial Sequence
  chemically synthesized
catgtttaacagcatcaatctt

SEQ ID NO: 801166 - DNA, 22 bp, Artificial Sequence
  chemically synthesized
tcatgtttaacagcatcaatct

SEQ ID NO: 801167 - DNA, 22 bp, Artificial Sequence
  chemically synthesized
ttcatgtttaacagcatcaatc

SEQ ID NO: 801168 - DNA, 22 bp, Artificial Sequence
  chemically synthesized
tttcatgtttaacagcatcaat

SEQ ID NO: 801169 - DNA, 22 bp, Artificial Sequence
  chemically synthesized
ttttcatgtttaacagcatcaa

SEQ ID NO: 801170 - DNA, 22 bp, Artificial Sequence
  chemically synthesized
ttctttaaagattgatgctgtt

SEQ ID NO: 801171 - DNA, 22 bp, Artificial Sequence
  chemically synthesized
tctttaaagattgatgctgtta

SEQ ID NO: 801172 - DNA, 22 bp, Artificial Sequence
  chemically synthesized
ctttaaagattgatgctgttaa

SEQ ID NO: 801173 - DNA, 22 bp, Artificial Sequence
  chemically synthesized
tttaaagattgatgctgttaaa

SEQ ID NO: 801174 - DNA, 22 bp, Artificial Sequence
  chemically synthesized
taaagattgatgctgttaaaca

SEQ ID NO: 801175 - DNA, 22 bp, Artificial Sequence
  chemically synthesized
acatttttttcatgtttaacag

SEQ ID NO: 801176 - DNA, 22 bp, Artificial Sequence
  chemically synthesized
aaagattgatgctgttaaacat

SEQ ID NO: 801177 - DNA, 22 bp, Artificial Sequence
  chemically synthesized
aagattgatgctgttaaacatg

SEQ ID NO: 801178 - DNA, 22 bp, Artificial Sequence
  chemically synthesized
atgctgttaaacatgaaaaaaa

SEQ ID NO: 801179 - DNA, 22 bp, Artificial Sequence
  chemically synthesized
ttaaacatgaaaaaaatgtgaa

SEQ ID NO: 801180 - DNA, 22 bp, Artificial Sequence
  chemically synthesized
aacatgaaaaaaatgtgaactt

SEQ ID NO: 801181 - DNA, 22 bp, Artificial Sequence
  chemically synthesized
aaataaaatgtcagaaagttca

SEQ ID NO: 801182 - DNA, 22 bp, Artificial Sequence
  chemically synthesized
tattaaaataaaatgtcagaaa

SEQ ID NO: 801183 - DNA, 22 bp, Artificial Sequence
  chemically synthesized
aattatattaaaataaaatgtc

SEQ ID NO: 801184 - DNA, 22 bp, Artificial Sequence
  chemically synthesized
taaattatattaaaataaaatg

SEQ ID NO: 801185 - DNA, 22 bp, Artificial Sequence
  chemically synthesized
ctaaattatattaaaataaaat

SEQ ID NO: 801186 - DNA, 22 bp, Artificial Sequence
  chemically synthesized
tctaaattatattaaaataaaa

SEQ ID NO: 801187 - DNA, 22 bp, Artificial Sequence
  chemically synthesized
tctgacattttattttaatata

SEQ ID NO: 801188 - DNA, 22 bp, Artificial Sequence
  chemically synthesized
ctgacattttattttaatataa

SEQ ID NO: 801189 - DNA, 22 bp, Artificial Sequence
  chemically synthesized
tgacattttattttaatataat

SEQ ID NO: 801190 - DNA, 22 bp, Artificial Sequence
  chemically synthesized
catggttttctaaattatatta

SEQ ID NO: 801191 - DNA, 22 bp, Artificial Sequence
  chemically synthesized
acattttattttaatataattt

SEQ ID NO: 801192 - DNA, 22 bp, Artificial Sequence
  chemically synthesized
acatggttttctaaattatatt

SEQ ID NO: 801193 - DNA, 22 bp, Artificial Sequence
  chemically synthesized
tattttaatataatttagaaaa

SEQ ID NO: 801194 - DNA, 22 bp, Artificial Sequence
  chemically synthesized
cagtttacatggttttctaaat

SEQ ID NO: 801195 - DNA, 22 bp, Artificial Sequence
  chemically synthesized
attttaatataatttagaaaac

SEQ ID NO: 801196 - DNA, 22 bp, Artificial Sequence
  chemically synthesized
gcagtttacatggttttctaaa

SEQ ID NO: 801197 - DNA, 22 bp, Artificial Sequence
  chemically synthesized
ttttaatataatttagaaaacc

SEQ ID NO: 801198 - DNA, 22 bp, Artificial Sequence
  chemically synthesized
tgcagtttacatggttttctaa

SEQ ID NO: 801199 - DNA, 22 bp, Artificial Sequence
  chemically synthesized
ttgcagtttacatggttttcta

SEQ ID NO: 801200 - DNA, 22 bp, Artificial Sequence
  chemically synthesized
taatataatttagaaaaccatg

SEQ ID NO: 801201 - DNA, 22 bp, Artificial Sequence
  chemically synthesized
aatataatttagaaaaccatgt

SEQ ID NO: 801202 - DNA, 22 bp, Artificial Sequence
  chemically synthesized
atataatttagaaaaccatgta

SEQ ID NO: 801203 - DNA, 22 bp, Artificial Sequence
  chemically synthesized
agaaaaccatgtaaactgcaaa

SEQ ID NO: 801204 - DNA, 22 bp, Artificial Sequence
  chemically synthesized
gaaaaccatgtaaactgcaaaa

SEQ ID NO: 801205 - DNA, 22 bp, Artificial Sequence
  chemically synthesized
cacatgaggtccttttgcagtt

SEQ ID NO: 801206 - DNA, 22 bp, Artificial Sequence
  chemically synthesized
attccacatgaggtccttttgc

SEQ ID NO: 801207 - DNA, 22 bp, Artificial Sequence
  chemically synthesized
cattccacatgaggtccttttg

SEQ ID NO: 801208 - DNA, 22 bp, Artificial Sequence
  chemically synthesized
tcattccacatgaggtcctttt

SEQ ID NO: 801209 - DNA, 22 bp, Artificial Sequence
  chemically synthesized
caaaaggacctcatgtggaatg

SEQ ID NO: 801210 - DNA, 22 bp, Artificial Sequence
  chemically synthesized
tcagcatgtgattttcattcca

SEQ ID NO: 801211 - DNA, 22 bp, Artificial Sequence
  chemically synthesized
ggttatcagcatgtgattttca

SEQ ID NO: 801212 - DNA, 22 bp, Artificial Sequence
  chemically synthesized
aggttatcagcatgtgattttc

SEQ ID NO: 801213 - DNA, 22 bp, Artificial Sequence
  chemically synthesized
atgtggaatgaaaatcacatgc

SEQ ID NO: 801214 - DNA, 22 bp, Artificial Sequence
  chemically synthesized
aaaataatttaggttatcagca

SEQ ID NO: 801215 - DNA, 22 bp, Artificial Sequence
  chemically synthesized
atggtattgaaaataatttagg

SEQ ID NO: 801216 - DNA, 22 bp, Artificial Sequence
  chemically synthesized
ataacctaaattattttcaata

SEQ ID NO: 801217 - DNA, 22 bp, Artificial Sequence
  chemically synthesized
gtcaaagattaatggtattgaa

SEQ ID NO: 801218 - DNA, 22 bp, Artificial Sequence
  chemically synthesized
aattattttcaataccattaat

SEQ ID NO: 801219 - DNA, 22 bp, Artificial Sequence
  chemically synthesized
caggtattagtcaaagattaat

SEQ ID NO: 801220 - DNA, 22 bp, Artificial Sequence
  chemically synthesized
ttttcaataccattaatctttg

SEQ ID NO: 801221 - DNA, 22 bp, Artificial Sequence
  chemically synthesized
tcaataccattaatctttgact

SEQ ID NO: 801222 - DNA, 22 bp, Artificial Sequence
  chemically synthesized
caataccattaatctttgacta

SEQ ID NO: 801223 - DNA, 22 bp, Artificial Sequence
  chemically synthesized
aataccattaatctttgactaa

SEQ ID NO: 801224 - DNA, 22 bp, Artificial Sequence
  chemically synthesized
ataataaaacattccaggtatt

SEQ ID NO: 801225 - DNA, 22 bp, Artificial Sequence
  chemically synthesized
atctttgactaatacctggaat

SEQ ID NO: 801226 - DNA, 22 bp, Artificial Sequence
  chemically synthesized
tgataataaaacattccaggta

SEQ ID NO: 801227 - DNA, 22 bp, Artificial Sequence
  chemically synthesized
tgactaatacctggaatgtttt

SEQ ID NO: 801228 - DNA, 22 bp, Artificial Sequence
  chemically synthesized
gactaatacctggaatgtttta

SEQ ID NO: 801229 - DNA, 22 bp, Artificial Sequence
  chemically synthesized
actaatacctggaatgttttat

SEQ ID NO: 801230 - DNA, 22 bp, Artificial Sequence
  chemically synthesized
ataattctgataataaaacatt

SEQ ID NO: 801231 - DNA, 22 bp, Artificial Sequence
  chemically synthesized
cataattctgataataaaacat

SEQ ID NO: 801232 - DNA, 22 bp, Artificial Sequence
  chemically synthesized
tcataattctgataataaaaca

SEQ ID NO: 801233 - DNA, 22 bp, Artificial Sequence
  chemically synthesized
atacctggaatgttttattatc

SEQ ID NO: 801234 - DNA, 22 bp, Artificial Sequence
  chemically synthesized
tgcctttcataattctgataat

SEQ ID NO: 801235 - DNA, 22 bp, Artificial Sequence
  chemically synthesized
gtgcctttcataattctgataa

SEQ ID NO: 801236 - DNA, 22 bp, Artificial Sequence
  chemically synthesized
gaatgttttattatcagaatta

SEQ ID NO: 801237 - DNA, 22 bp, Artificial Sequence
  chemically synthesized
ttgtgcctttcataattctgat

SEQ ID NO: 801238 - DNA, 22 bp, Artificial Sequence
  chemically synthesized
tcttgtgcctttcataattctg

SEQ ID NO: 801239 - DNA, 22 bp, Artificial Sequence
  chemically synthesized
tattatcagaattatgaaaggc

SEQ ID NO: 801240 - DNA, 22 bp, Artificial Sequence
  chemically synthesized
attatcagaattatgaaaggca

SEQ ID NO: 801241 - DNA, 22 bp, Artificial Sequence
  chemically synthesized
gtgcctctcttgtgcctttcat

SEQ ID NO: 801242 - DNA, 22 bp, Artificial Sequence
  chemically synthesized
ttatcagaattatgaaaggcac

SEQ ID NO: 801243 - DNA, 22 bp, Artificial Sequence
  chemically synthesized
tcagaattatgaaaggcacaag

SEQ ID NO: 801244 - DNA, 22 bp, Artificial Sequence
  chemically synthesized
cattagtgcctctcttgtgcct

SEQ ID NO: 801245 - DNA, 22 bp, Artificial Sequence
  chemically synthesized
tgaaaggcacaagagaggcact

SEQ ID NO: 801246 - DNA, 22 bp, Artificial Sequence
  chemically synthesized
agatgaactacattagtgcctc

SEQ ID NO: 801247 - DNA, 22 bp, Artificial Sequence
  chemically synthesized
aagatgaactacattagtgcct

SEQ ID NO: 801248 - DNA, 22 bp, Artificial Sequence
  chemically synthesized
taagatgaactacattagtgcc

SEQ ID NO: 801249 - DNA, 22 bp, Artificial Sequence
  chemically synthesized
ttaagatgaactacattagtgc

SEQ ID NO: 801250 - DNA, 22 bp, Artificial Sequence
  chemically synthesized
tttttaagatgaactacattag

SEQ ID NO: 801251 - DNA, 22 bp, Artificial Sequence
  chemically synthesized
aattatttttaagatgaactac

SEQ ID NO: 801252 - DNA, 22 bp, Artificial Sequence
  chemically synthesized
aaattatttttaagatgaacta

SEQ ID NO: 801253 - DNA, 22 bp, Artificial Sequence
  chemically synthesized
taaattatttttaagatgaact

SEQ ID NO: 801254 - DNA, 22 bp, Artificial Sequence
  chemically synthesized
agtcctttaaattatttttaag

SEQ ID NO: 801255 - DNA, 22 bp, Artificial Sequence
  chemically synthesized
atgtagttcatcttaaaaataa

SEQ ID NO: 801256 - DNA, 22 bp, Artificial Sequence
  chemically synthesized
aagtcctttaaattatttttaa

SEQ ID NO: 801257 - DNA, 22 bp, Artificial Sequence
  chemically synthesized
atcttaaaaataatttaaagga

SEQ ID NO: 801258 - DNA, 22 bp, Artificial Sequence
  chemically synthesized
aaaaataatttaaaggacttaa

SEQ ID NO: 801259 - DNA, 22 bp, Artificial Sequence
  chemically synthesized
aaaataatttaaaggacttaag

SEQ ID NO: 801260 - DNA, 22 bp, Artificial Sequence
  chemically synthesized
aggggataaaaaaagaatctta

SEQ ID NO: 801261 - DNA, 22 bp, Artificial Sequence
  chemically synthesized
aaaggacttaagattctttttt

SEQ ID NO: 801262 - DNA, 22 bp, Artificial Sequence
  chemically synthesized
aaggacttaagattcttttttt

SEQ ID NO: 801263 - DNA, 22 bp, Artificial Sequence
  chemically synthesized
aagattctttttttatcccctc

SEQ ID NO: 801264 - DNA, 22 bp, Artificial Sequence
  chemically synthesized
aaagtgtaaattgaggggataa

SEQ ID NO: 801265 - DNA, 22 bp, Artificial Sequence
  chemically synthesized
agattctttttttatcccctca

SEQ ID NO: 801266 - DNA, 22 bp, Artificial Sequence
  chemically synthesized
tcaaagtgtaaattgaggggat

SEQ ID NO: 801267 - DNA, 22 bp, Artificial Sequence
  chemically synthesized
tttttttatcccctcaatttac

SEQ ID NO: 801268 - DNA, 22 bp, Artificial Sequence
  chemically synthesized
tttttatcccctcaatttacac

SEQ ID NO: 801269 - DNA, 22 bp, Artificial Sequence
  chemically synthesized
ttttatcccctcaatttacact

SEQ ID NO: 801270 - DNA, 22 bp, Artificial Sequence
  chemically synthesized
gaaaattctcaaagtgtaaatt

SEQ ID NO: 801271 - DNA, 22 bp, Artificial Sequence
  chemically synthesized
tttatcccctcaatttacactt

SEQ ID NO: 801272 - DNA, 22 bp, Artificial Sequence
  chemically synthesized
ttatcccctcaatttacacttt

SEQ ID NO: 801273 - DNA, 22 bp, Artificial Sequence
  chemically synthesized
tatcccctcaatttacactttg

SEQ ID NO: 801274 - DNA, 22 bp, Artificial Sequence
  chemically synthesized
ctggaaaattctcaaagtgtaa

SEQ ID NO: 801275 - DNA, 22 bp, Artificial Sequence
  chemically synthesized
atcccctcaatttacactttga

SEQ ID NO: 801276 - DNA, 22 bp, Artificial Sequence
  chemically synthesized
tcccctcaatttacactttgag

SEQ ID NO: 801277 - DNA, 22 bp, Artificial Sequence
  chemically synthesized
aatttacactttgagaattttc

SEQ ID NO: 801278 - DNA, 22 bp, Artificial Sequence
  chemically synthesized
cccatcctactggaaaattctc

SEQ ID NO: 801279 - DNA, 22 bp, Artificial Sequence
  chemically synthesized
acactttgagaattttccagta

SEQ ID NO: 801280 - DNA, 22 bp, Artificial Sequence
  chemically synthesized
cactttgagaattttccagtag

SEQ ID NO: 801281 - DNA, 22 bp, Artificial Sequence
  chemically synthesized
tgagaattttccagtaggatgg

SEQ ID NO: 801282 - DNA, 22 bp, Artificial Sequence
  chemically synthesized
gagaattttccagtaggatggg

SEQ ID NO: 801283 - DNA, 22 bp, Artificial Sequence
  chemically synthesized
agaattttccagtaggatgggt

SEQ ID NO: 801284 - DNA, 22 bp, Artificial Sequence
  chemically synthesized
tccagtaggatgggtagtgatt

SEQ ID NO: 801285 - DNA, 22 bp, Artificial Sequence
  chemically synthesized
ccagtaggatgggtagtgattg

SEQ ID NO: 801286 - DNA, 22 bp, Artificial Sequence
  chemically synthesized
tgtgataggtaacaatcactac

SEQ ID NO: 801287 - DNA, 22 bp, Artificial Sequence
  chemically synthesized
cagtaggatgggtagtgattgt

SEQ ID NO: 801288 - DNA, 22 bp, Artificial Sequence
  chemically synthesized
tatgtgataggtaacaatcact

SEQ ID NO: 801289 - DNA, 22 bp, Artificial Sequence
  chemically synthesized
ctctatgtgataggtaacaatc

SEQ ID NO: 801290 - DNA, 22 bp, Artificial Sequence
  chemically synthesized
ttacctatcacatagaggaata

SEQ ID NO: 801291 - DNA, 22 bp, Artificial Sequence
  chemically synthesized
cctatcacatagaggaatatca

SEQ ID NO: 801292 - DNA, 22 bp, Artificial Sequence
  chemically synthesized
tcacatagaggaatatcatttt

SEQ ID NO: 801293 - DNA, 22 bp, Artificial Sequence
  chemically synthesized
gaccaaaacaaaaaaaatgata

SEQ ID NO: 801294 - DNA, 22 bp, Artificial Sequence
  chemically synthesized
tagaccaaaacaaaaaaaatga

SEQ ID NO: 801295 - DNA, 22 bp, Artificial Sequence
  chemically synthesized
ctagaccaaaacaaaaaaaatg

SEQ ID NO: 801296 - DNA, 22 bp, Artificial Sequence
  chemically synthesized
tctagaccaaaacaaaaaaaat

SEQ ID NO: 801297 - DNA, 22 bp, Artificial Sequence
  chemically synthesized
ggagcagactttctagaccaaa

SEQ ID NO: 801298 - DNA, 22 bp, Artificial Sequence
  chemically synthesized
gggagcagactttctagaccaa

SEQ ID NO: 801299 - DNA, 22 bp, Artificial Sequence
  chemically synthesized
tgggagcagactttctagacca

SEQ ID NO: 801300 - DNA, 22 bp, Artificial Sequence
  chemically synthesized
tttttgttttggtctagaaagt

SEQ ID NO: 801301 - DNA, 22 bp, Artificial Sequence
  chemically synthesized
ttttgttttggtctagaaagtc

SEQ ID NO: 801302 - DNA, 22 bp, Artificial Sequence
  chemically synthesized
tttgttttggtctagaaagtct

SEQ ID NO: 801303 - DNA, 22 bp, Artificial Sequence
  chemically synthesized
gtctttgggagcagactttcta

SEQ ID NO: 801304 - DNA, 22 bp, Artificial Sequence
  chemically synthesized
ttgttttggtctagaaagtctg

SEQ ID NO: 801305 - DNA, 22 bp, Artificial Sequence
  chemically synthesized
tgttttggtctagaaagtctgc

SEQ ID NO: 801306 - DNA, 22 bp, Artificial Sequence
  chemically synthesized
gttttggtctagaaagtctgct

SEQ ID NO: 801307 - DNA, 22 bp, Artificial Sequence
  chemically synthesized
ttggtctttgggagcagacttt

SEQ ID NO: 801308 - DNA, 22 bp, Artificial Sequence
  chemically synthesized
ttttggtctagaaagtctgctc

SEQ ID NO: 801309 - DNA, 22 bp, Artificial Sequence
  chemically synthesized
tggtctagaaagtctgctccca

SEQ ID NO: 801310 - DNA, 22 bp, Artificial Sequence
  chemically synthesized
ggtctagaaagtctgctcccaa

SEQ ID NO: 801311 - DNA, 22 bp, Artificial Sequence
  chemically synthesized
gtctagaaagtctgctcccaaa

SEQ ID NO: 801312 - DNA, 22 bp, Artificial Sequence
  chemically synthesized
gggttattggtctttgggagca

SEQ ID NO: 801313 - DNA, 22 bp, Artificial Sequence
  chemically synthesized
agggttattggtctttgggagc

SEQ ID NO: 801314 - DNA, 22 bp, Artificial Sequence
  chemically synthesized
tagggttattggtctttgggag

SEQ ID NO: 801315 - DNA, 22 bp, Artificial Sequence
  chemically synthesized
ttagggttattggtctttggga

SEQ ID NO: 801316 - DNA, 22 bp, Artificial Sequence
  chemically synthesized
tttagggttattggtctttggg

SEQ ID NO: 801317 - DNA, 22 bp, Artificial Sequence
  chemically synthesized
gaaagtctgctcccaaagacca

SEQ ID NO: 801318 - DNA, 22 bp, Artificial Sequence
  chemically synthesized
aataattttttagggttattgg

SEQ ID NO: 801319 - DNA, 22 bp, Artificial Sequence
  chemically synthesized
gaataattttttagggttattg

SEQ ID NO: 801320 - DNA, 22 bp, Artificial Sequence
  chemically synthesized
ctcccaaagaccaataacccta

SEQ ID NO: 801321 - DNA, 22 bp, Artificial Sequence
  chemically synthesized
ccaaagaccaataaccctaaaa

SEQ ID NO: 801322 - DNA, 22 bp, Artificial Sequence
  chemically synthesized
accttgaataattttttagggt

SEQ ID NO: 801323 - DNA, 22 bp, Artificial Sequence
  chemically synthesized
taaccttgaataattttttagg

SEQ ID NO: 801324 - DNA, 22 bp, Artificial Sequence
  chemically synthesized
ctctaaccttgaataatttttt

SEQ ID NO: 801325 - DNA, 22 bp, Artificial Sequence
  chemically synthesized
cctctaaccttgaataattttt

SEQ ID NO: 801326 - DNA, 22 bp, Artificial Sequence
  chemically synthesized
ccttcctctaaccttgaataat

SEQ ID NO: 801327 - DNA, 22 bp, Artificial Sequence
  chemically synthesized
ctcccttcctctaaccttgaat

SEQ ID NO: 801328 - DNA, 22 bp, Artificial Sequence
  chemically synthesized
ctcctcccttcctctaaccttg

SEQ ID NO: 801329 - DNA, 22 bp, Artificial Sequence
  chemically synthesized
aaaaattattcaaggttagagg

SEQ ID NO: 801330 - DNA, 22 bp, Artificial Sequence
  chemically synthesized
tcctcctcccttcctctaacct

SEQ ID NO: 801331 - DNA, 22 bp, Artificial Sequence
  chemically synthesized
ctcctcctcccttcctctaacc

SEQ ID NO: 801332 - DNA, 22 bp, Artificial Sequence
  chemically synthesized
tctcctcctcccttcctctaac

SEQ ID NO: 801333 - DNA, 22 bp, Artificial Sequence
  chemically synthesized
ttcaaggttagaggaagggagg

SEQ ID NO: 801334 - DNA, 22 bp, Artificial Sequence
  chemically synthesized
tgtcactttctcctcctccctt

SEQ ID NO: 801335 - DNA, 22 bp, Artificial Sequence
  chemically synthesized
aaggttagaggaagggaggagg

SEQ ID NO: 801336 - DNA, 22 bp, Artificial Sequence
  chemically synthesized
gtgtcactttctcctcctccct

SEQ ID NO: 801337 - DNA, 22 bp, Artificial Sequence
  chemically synthesized
tgtgtcactttctcctcctccc

SEQ ID NO: 801338 - DNA, 22 bp, Artificial Sequence
  chemically synthesized
gaggaagggaggaggagaaagt

SEQ ID NO: 801339 - DNA, 22 bp, Artificial Sequence
  chemically synthesized
accacagaaaaatgtcaaagaa

SEQ ID NO: 801340 - DNA, 22 bp, Artificial Sequence
  chemically synthesized
gaccacagaaaaatgtcaaaga

SEQ ID NO: 801341 - DNA, 22 bp, Artificial Sequence
  chemically synthesized
tttgacatttttctgtggtcaa

SEQ ID NO: 801342 - DNA, 22 bp, Artificial Sequence
  chemically synthesized
tgacatttttctgtggtcaaac

SEQ ID NO: 801343 - DNA, 22 bp, Artificial Sequence
  chemically synthesized
gacatttttctgtggtcaaact

SEQ ID NO: 801344 - DNA, 22 bp, Artificial Sequence
  chemically synthesized
acatttttctgtggtcaaactt

SEQ ID NO: 801345 - DNA, 22 bp, Artificial Sequence
  chemically synthesized
aaaaggtcaggaaaagtttgac

SEQ ID NO: 801346 - DNA, 22 bp, Artificial Sequence
  chemically synthesized
ttctgtggtcaaacttttcctg

SEQ ID NO: 801347 - DNA, 22 bp, Artificial Sequence
  chemically synthesized
tctgtggtcaaacttttcctga

SEQ ID NO: 801348 - DNA, 22 bp, Artificial Sequence
  chemically synthesized
ctgtggtcaaacttttcctgac

SEQ ID NO: 801349 - DNA, 22 bp, Artificial Sequence
  chemically synthesized
tgtggtcaaacttttcctgacc

SEQ ID NO: 801350 - DNA, 22 bp, Artificial Sequence
  chemically synthesized
tggtcaaacttttcctgacctt

SEQ ID NO: 801351 - DNA, 22 bp, Artificial Sequence
  chemically synthesized
caaacaagaattgaaaaggtca

SEQ ID NO: 801352 - DNA, 22 bp, Artificial Sequence
  chemically synthesized
tccaaacaagaattgaaaaggt

SEQ ID NO: 801353 - DNA, 22 bp, Artificial Sequence
  chemically synthesized
ctccaaacaagaattgaaaagg

SEQ ID NO: 801354 - DNA, 22 bp, Artificial Sequence
  chemically synthesized
ttctccaaacaagaattgaaaa

SEQ ID NO: 801355 - DNA, 22 bp, Artificial Sequence
  chemically synthesized
cttctccaaacaagaattgaaa

SEQ ID NO: 801356 - DNA, 22 bp, Artificial Sequence
  chemically synthesized
ttcctgaccttttcaattcttg

SEQ ID NO: 801357 - DNA, 22 bp, Artificial Sequence
  chemically synthesized
tcctgaccttttcaattcttgt

SEQ ID NO: 801358 - DNA, 22 bp, Artificial Sequence
  chemically synthesized
cctgaccttttcaattcttgtt

SEQ ID NO: 801359 - DNA, 22 bp, Artificial Sequence
  chemically synthesized
ctgaccttttcaattcttgttt

SEQ ID NO: 801360 - DNA, 22 bp, Artificial Sequence
  chemically synthesized
agaacttcttctccaaacaaga

SEQ ID NO: 801361 - DNA, 22 bp, Artificial Sequence
  chemically synthesized
accttttcaattcttgtttgga

SEQ ID NO: 801362 - DNA, 22 bp, Artificial Sequence
  chemically synthesized
cagaacttcttctccaaacaag

SEQ ID NO: 801363 - DNA, 22 bp, Artificial Sequence
  chemically synthesized
ttcaattcttgtttggagaaga

SEQ ID NO: 801364 - DNA, 22 bp, Artificial Sequence
  chemically synthesized
tcaattcttgtttggagaagaa

SEQ ID NO: 801365 - DNA, 22 bp, Artificial Sequence
  chemically synthesized
caattcttgtttggagaagaag

SEQ ID NO: 801366 - DNA, 22 bp, Artificial Sequence
  chemically synthesized
aattcttgtttggagaagaagt

SEQ ID NO: 801367 - DNA, 22 bp, Artificial Sequence
  chemically synthesized
ttgtttggagaagaagttctga

SEQ ID NO: 801368 - DNA, 22 bp, Artificial Sequence
  chemically synthesized
gtttggagaagaagttctgaaa

SEQ ID NO: 801369 - DNA, 22 bp, Artificial Sequence
  chemically synthesized
tttggagaagaagttctgaaat

SEQ ID NO: 801370 - DNA, 22 bp, Artificial Sequence
  chemically synthesized
ggagaagaagttctgaaattat

SEQ ID NO: 801371 - DNA, 22 bp, Artificial Sequence
  chemically synthesized
gacaagatccacataatttcag

SEQ ID NO: 801372 - DNA, 22 bp, Artificial Sequence
  chemically synthesized
gagaagaagttctgaaattatg

SEQ ID NO: 801373 - DNA, 22 bp, Artificial Sequence
  chemically synthesized
gaacctggacaagatccacata

SEQ ID NO: 801374 - DNA, 22 bp, Artificial Sequence
  chemically synthesized
cattagaacctggacaagatcc

SEQ ID NO: 801375 - DNA, 22 bp, Artificial Sequence
  chemically synthesized
tgaaattatgtggatcttgtcc

SEQ ID NO: 801376 - DNA, 22 bp, Artificial Sequence
  chemically synthesized
aaattatgtggatcttgtccag

SEQ ID NO: 801377 - DNA, 22 bp, Artificial Sequence
  chemically synthesized
atctccattagaacctggacaa

SEQ ID NO: 801378 - DNA, 22 bp, Artificial Sequence
  chemically synthesized
gatctccattagaacctggaca

SEQ ID NO: 801379 - DNA, 22 bp, Artificial Sequence
  chemically synthesized
tgatctccattagaacctggac

SEQ ID NO: 801380 - DNA, 22 bp, Artificial Sequence
  chemically synthesized
tgtggatcttgtccaggttcta

SEQ ID NO: 801381 - DNA, 22 bp, Artificial Sequence
  chemically synthesized
tttgatctccattagaacctgg

SEQ ID NO: 801382 - DNA, 22 bp, Artificial Sequence
  chemically synthesized
ctttgatctccattagaacctg

SEQ ID NO: 801383 - DNA, 22 bp, Artificial Sequence
  chemically synthesized
tctttgatctccattagaacct

SEQ ID NO: 801384 - DNA, 22 bp, Artificial Sequence
  chemically synthesized
ccaactttctttgatctccatt

SEQ ID NO: 801385 - DNA, 22 bp, Artificial Sequence
  chemically synthesized
gtccaggttctaatggagatca

SEQ ID NO: 801386 - DNA, 22 bp, Artificial Sequence
  chemically synthesized
gccaactttctttgatctccat

SEQ ID NO: 801387 - DNA, 22 bp, Artificial Sequence
  chemically synthesized
tccaggttctaatggagatcaa

SEQ ID NO: 801388 - DNA, 22 bp, Artificial Sequence
  chemically synthesized
tttgccaactttctttgatctc

SEQ ID NO: 801389 - DNA, 22 bp, Artificial Sequence
  chemically synthesized
ggactatttgccaactttcttt

SEQ ID NO: 801390 - DNA, 22 bp, Artificial Sequence
  chemically synthesized
taatggagatcaaagaaagttg

SEQ ID NO: 801391 - DNA, 22 bp, Artificial Sequence
  chemically synthesized
atggagatcaaagaaagttggc

SEQ ID NO: 801392 - DNA, 22 bp, Artificial Sequence
  chemically synthesized
agaaggctgggactatttgcca

SEQ ID NO: 801393 - DNA, 22 bp, Artificial Sequence
  chemically synthesized
gcaaatagtcccagccttctca

SEQ ID NO: 801394 - DNA, 22 bp, Artificial Sequence
  chemically synthesized
ctcaatgttttcattgccactg

SEQ ID NO: 801395 - DNA, 22 bp, Artificial Sequence
  chemically synthesized
tcaatgttttcattgccactgc

SEQ ID NO: 801396 - DNA, 22 bp, Artificial Sequence
  chemically synthesized
aatgttttcattgccactgccc

SEQ ID NO: 801397 - DNA, 22 bp, Artificial Sequence
  chemically synthesized
aatgcataccatggggcagtgg

SEQ ID NO: 801398 - DNA, 22 bp, Artificial Sequence
  chemically synthesized
aaatgcataccatggggcagtg

SEQ ID NO: 801399 - DNA, 22 bp, Artificial Sequence
  chemically synthesized
taaatgcataccatggggcagt

SEQ ID NO: 801400 - DNA, 22 bp, Artificial Sequence
  chemically synthesized
ttttaaatgcataccatggggc

SEQ ID NO: 801401 - DNA, 22 bp, Artificial Sequence
  chemically synthesized
tcattgccactgccccatggta

SEQ ID NO: 801402 - DNA, 22 bp, Artificial Sequence
  chemically synthesized
cattgccactgccccatggtat

SEQ ID NO: 801403 - DNA, 22 bp, Artificial Sequence
  chemically synthesized
attgccactgccccatggtatg

SEQ ID NO: 801404 - DNA, 22 bp, Artificial Sequence
  chemically synthesized
ccactgccccatggtatgcatt

SEQ ID NO: 801405 - DNA, 22 bp, Artificial Sequence
  chemically synthesized
ataaagttgttttaaatgcata

SEQ ID NO: 801406 - DNA, 22 bp, Artificial Sequence
  chemically synthesized
ccccatggtatgcatttaaaac

SEQ ID NO: 801407 - DNA, 22 bp, Artificial Sequence
  chemically synthesized
ataaaattaataaagttgtttt

SEQ ID NO: 801408 - DNA, 22 bp, Artificial Sequence
  chemically synthesized
aaaacaactttattaattttat

SEQ ID NO: 801409 - DNA, 22 bp, Artificial Sequence
  chemically synthesized
aaacaactttattaattttatt

SEQ ID NO: 801410 - DNA, 22 bp, Artificial Sequence
  chemically synthesized
atagataacgttaataaaatta

SEQ ID NO: 801411 - DNA, 22 bp, Artificial Sequence
  chemically synthesized
tattaattttattaacgttatc

SEQ ID NO: 801412 - DNA, 22 bp, Artificial Sequence
  chemically synthesized
attaattttattaacgttatct

SEQ ID NO: 801413 - DNA, 22 bp, Artificial Sequence
  chemically synthesized
ttaattttattaacgttatcta

SEQ ID NO: 801414 - DNA, 22 bp, Artificial Sequence
  chemically synthesized
attttattaacgttatctatca

SEQ ID NO: 801415 - DNA, 22 bp, Artificial Sequence
  chemically synthesized
tattaacgttatctatcagtca

SEQ ID NO: 801416 - DNA, 22 bp, Artificial Sequence
  chemically synthesized
attaacgttatctatcagtcat

SEQ ID NO: 801417 - DNA, 22 bp, Artificial Sequence
  chemically synthesized
ttaacgttatctatcagtcatt

SEQ ID NO: 801418 - DNA, 22 bp, Artificial Sequence
  chemically synthesized
acgttatctatcagtcattggt

SEQ ID NO: 801419 - DNA, 22 bp, Artificial Sequence
  chemically synthesized
tctatcagtcattggtgtgatt

SEQ ID NO: 801420 - DNA, 22 bp, Artificial Sequence
  chemically synthesized
agtaacacaggaaatcacacca

SEQ ID NO: 801421 - DNA, 22 bp, Artificial Sequence
  chemically synthesized
tcagtcattggtgtgatttcct

SEQ ID NO: 801422 - DNA, 22 bp, Artificial Sequence
  chemically synthesized
ccaaacatcctgagtaacacag

SEQ ID NO: 801423 - DNA, 22 bp, Artificial Sequence
  chemically synthesized
cccaaacatcctgagtaacaca

SEQ ID NO: 801424 - DNA, 22 bp, Artificial Sequence
  chemically synthesized
gtgtgatttcctgtgttactca

SEQ ID NO: 801425 - DNA, 22 bp, Artificial Sequence
  chemically synthesized
tcccaaacatcctgagtaacac

SEQ ID NO: 801426 - DNA, 22 bp, Artificial Sequence
  chemically synthesized
ttcccaaacatcctgagtaaca

SEQ ID NO: 801427 - DNA, 22 bp, Artificial Sequence
  chemically synthesized
tttcccaaacatcctgagtaac

SEQ ID NO: 801428 - DNA, 22 bp, Artificial Sequence
  chemically synthesized
tttttcccaaacatcctgagta

SEQ ID NO: 801429 - DNA, 22 bp, Artificial Sequence
  chemically synthesized
ctttttcccaaacatcctgagt

SEQ ID NO: 801430 - DNA, 22 bp, Artificial Sequence
  chemically synthesized
cctgtgttactcaggatgtttg

SEQ ID NO: 801431 - DNA, 22 bp, Artificial Sequence
  chemically synthesized
ctgtgttactcaggatgtttgg

SEQ ID NO: 801432 - DNA, 22 bp, Artificial Sequence
  chemically synthesized
tgttactcaggatgtttgggaa

SEQ ID NO: 801433 - DNA, 22 bp, Artificial Sequence
  chemically synthesized
ctcaggatgtttgggaaaaaga

SEQ ID NO: 801434 - DNA, 22 bp, Artificial Sequence
  chemically synthesized
gtaaaaggagtttctttttccc

SEQ ID NO: 801435 - DNA, 22 bp, Artificial Sequence
  chemically synthesized
ggtaaaaggagtttctttttcc

SEQ ID NO: 801436 - DNA, 22 bp, Artificial Sequence
  chemically synthesized
aggatgtttgggaaaaagaaac

SEQ ID NO: 801437 - DNA, 22 bp, Artificial Sequence
  chemically synthesized
gggaaaaagaaactccttttac

SEQ ID NO: 801438 - DNA, 22 bp, Artificial Sequence
  chemically synthesized
aaacacagtttggtaaaaggag

SEQ ID NO: 801439 - DNA, 22 bp, Artificial Sequence
  chemically synthesized
ggaaaaagaaactccttttacc

SEQ ID NO: 801440 - DNA, 22 bp, Artificial Sequence
  chemically synthesized
cctgaaacacagtttggtaaaa

SEQ ID NO: 801441 - DNA, 22 bp, Artificial Sequence
  chemically synthesized
agattgcctgaaacacagtttg

SEQ ID NO: 801442 - DNA, 22 bp, Artificial Sequence
  chemically synthesized
cttttaccaaactgtgtttcag

SEQ ID NO: 801443 - DNA, 22 bp, Artificial Sequence
  chemically synthesized
ttaccaaactgtgtttcaggca

SEQ ID NO: 801444 - DNA, 22 bp, Artificial Sequence
  chemically synthesized
taccaaactgtgtttcaggcaa

SEQ ID NO: 801445 - DNA, 22 bp, Artificial Sequence
  chemically synthesized
accaaactgtgtttcaggcaat

SEQ ID NO: 801446 - DNA, 22 bp, Artificial Sequence
  chemically synthesized
ccaaactgtgtttcaggcaatc

SEQ ID NO: 801447 - DNA, 22 bp, Artificial Sequence
  chemically synthesized
aatcagacaccaaagttgagat

SEQ ID NO: 801448 - DNA, 22 bp, Artificial Sequence
  chemically synthesized
tgtttcaggcaatctcaacttt

SEQ ID NO: 801449 - DNA, 22 bp, Artificial Sequence
  chemically synthesized
caatcagacaccaaagttgaga

SEQ ID NO: 801450 - DNA, 22 bp, Artificial Sequence
  chemically synthesized
tcaatcagacaccaaagttgag

SEQ ID NO: 801451 - DNA, 22 bp, Artificial Sequence
  chemically synthesized
tttcaatcagacaccaaagttg

SEQ ID NO: 801452 - DNA, 22 bp, Artificial Sequence
  chemically synthesized
caggcaatctcaactttggtgt

SEQ ID NO: 801453 - DNA, 22 bp, Artificial Sequence
  chemically synthesized
tctttcaatcagacaccaaagt

SEQ ID NO: 801454 - DNA, 22 bp, Artificial Sequence
  chemically synthesized
aggcaatctcaactttggtgtc

SEQ ID NO: 801455 - DNA, 22 bp, Artificial Sequence
  chemically synthesized
ctctttcaatcagacaccaaag

SEQ ID NO: 801456 - DNA, 22 bp, Artificial Sequence
  chemically synthesized
gcccttctctttcaatcagaca

SEQ ID NO: 801457 - DNA, 22 bp, Artificial Sequence
  chemically synthesized
ggcccttctctttcaatcagac

SEQ ID NO: 801458 - DNA, 22 bp, Artificial Sequence
  chemically synthesized
aactttggtgtctgattgaaag

SEQ ID NO: 801459 - DNA, 22 bp, Artificial Sequence
  chemically synthesized
acttggcccttctctttcaatc

SEQ ID NO: 801460 - DNA, 22 bp, Artificial Sequence
  chemically synthesized
tggtgtctgattgaaagagaag

SEQ ID NO: 801461 - DNA, 22 bp, Artificial Sequence
  chemically synthesized
ggtgtctgattgaaagagaagg

SEQ ID NO: 801462 - DNA, 22 bp, Artificial Sequence
  chemically synthesized
gtgtctgattgaaagagaaggg

SEQ ID NO: 801463 - DNA, 22 bp, Artificial Sequence
  chemically synthesized
attgaaagagaagggccaagtc

SEQ ID NO: 801464 - DNA, 22 bp, Artificial Sequence
  chemically synthesized
ggaaaatacattgacttggccc

SEQ ID NO: 801465 - DNA, 22 bp, Artificial Sequence
  chemically synthesized
gggaaaatacattgacttggcc

SEQ ID NO: 801466 - DNA, 22 bp, Artificial Sequence
  chemically synthesized
aaagagaagggccaagtcaatg

SEQ ID NO: 801467 - DNA, 22 bp, Artificial Sequence
  chemically synthesized
cttgggaaaatacattgacttg

SEQ ID NO: 801468 - DNA, 22 bp, Artificial Sequence
  chemically synthesized
ataatgccctccttgggaaaat

SEQ ID NO: 801469 - DNA, 22 bp, Artificial Sequence
  chemically synthesized
cataatgccctccttgggaaaa

SEQ ID NO: 801470 - DNA, 22 bp, Artificial Sequence
  chemically synthesized
tcataatgccctccttgggaaa

SEQ ID NO: 801471 - DNA, 22 bp, Artificial Sequence
  chemically synthesized
tctttcataatgccctccttgg

SEQ ID NO: 801472 - DNA, 22 bp, Artificial Sequence
  chemically synthesized
atctttcataatgccctccttg

SEQ ID NO: 801473 - DNA, 22 bp, Artificial Sequence
  chemically synthesized
tatctttcataatgccctcctt

SEQ ID NO: 801474 - DNA, 22 bp, Artificial Sequence
  chemically synthesized
tcccaaggagggcattatgaaa

SEQ ID NO: 801475 - DNA, 22 bp, Artificial Sequence
  chemically synthesized
cccaaggagggcattatgaaag

SEQ ID NO: 801476 - DNA, 22 bp, Artificial Sequence
  chemically synthesized
ccaaggagggcattatgaaaga

SEQ ID NO: 801477 - DNA, 22 bp, Artificial Sequence
  chemically synthesized
taagagagatattttatctttc

SEQ ID NO: 801478 - DNA, 22 bp, Artificial Sequence
  chemically synthesized
aaaattgtaagagagatatttt

SEQ ID NO: 801479 - DNA, 22 bp, Artificial Sequence
  chemically synthesized
tgaaagataaaatatctctctt

SEQ ID NO: 801480 - DNA, 22 bp, Artificial Sequence
  chemically synthesized
tactgaaaattgtaagagagat

SEQ ID NO: 801481 - DNA, 22 bp, Artificial Sequence
  chemically synthesized
tcttacaattttcagtataata

SEQ ID NO: 801482 - DNA, 22 bp, Artificial Sequence
  chemically synthesized
atgataacaaacatattatact

SEQ ID NO: 801483 - DNA, 22 bp, Artificial Sequence
  chemically synthesized
ttacaattttcagtataatatg

SEQ ID NO: 801484 - DNA, 22 bp, Artificial Sequence
  chemically synthesized
acaattttcagtataatatgtt

SEQ ID NO: 801485 - DNA, 22 bp, Artificial Sequence
  chemically synthesized
caattttcagtataatatgttt

SEQ ID NO: 801486 - DNA, 22 bp, Artificial Sequence
  chemically synthesized
attcatgataacaaacatatta

SEQ ID NO: 801487 - DNA, 22 bp, Artificial Sequence
  chemically synthesized
tcagtataatatgtttgttatc

SEQ ID NO: 801488 - DNA, 22 bp, Artificial Sequence
  chemically synthesized
cagtataatatgtttgttatca

SEQ ID NO: 801489 - DNA, 22 bp, Artificial Sequence
  chemically synthesized
agtataatatgtttgttatcat

SEQ ID NO: 801490 - DNA, 22 bp, Artificial Sequence
  chemically synthesized
aataccctcattcatgataaca

SEQ ID NO: 801491 - DNA, 22 bp, Artificial Sequence
  chemically synthesized
gttatcatgaatgagggtattc

SEQ ID NO: 801492 - DNA, 22 bp, Artificial Sequence
  chemically synthesized
ttatcatgaatgagggtattca

SEQ ID NO: 801493 - DNA, 22 bp, Artificial Sequence
  chemically synthesized
tcatgaatgagggtattcagcc

SEQ ID NO: 801494 - DNA, 22 bp, Artificial Sequence
  chemically synthesized
ggatataaacaaggctgaatac

SEQ ID NO: 801495 - DNA, 22 bp, Artificial Sequence
  chemically synthesized
gggatataaacaaggctgaata

SEQ ID NO: 801496 - DNA, 22 bp, Artificial Sequence
  chemically synthesized
aagtcttgggatataaacaagg

SEQ ID NO: 801497 - DNA, 22 bp, Artificial Sequence
  chemically synthesized
aaagtcttgggatataaacaag

SEQ ID NO: 801498 - DNA, 22 bp, Artificial Sequence
  chemically synthesized
taaagtcttgggatataaacaa

SEQ ID NO: 801499 - DNA, 22 bp, Artificial Sequence
  chemically synthesized
tttaaagtcttgggatataaac

SEQ ID NO: 801500 - DNA, 22 bp, Artificial Sequence
  chemically synthesized
agccttgtttatatcccaagac

SEQ ID NO: 801501 - DNA, 22 bp, Artificial Sequence
  chemically synthesized
gaaaagctctttaaagtcttgg

SEQ ID NO: 801502 - DNA, 22 bp, Artificial Sequence
  chemically synthesized
ggaaaagctctttaaagtcttg

SEQ ID NO: 801503 - DNA, 22 bp, Artificial Sequence
  chemically synthesized
tggaaaagctctttaaagtctt

SEQ ID NO: 801504 - DNA, 22 bp, Artificial Sequence
  chemically synthesized
gtttatatcccaagactttaaa

SEQ ID NO: 801505 - DNA, 22 bp, Artificial Sequence
  chemically synthesized
tttatatcccaagactttaaag

SEQ ID NO: 801506 - DNA, 22 bp, Artificial Sequence
  chemically synthesized
gttttggaaaagctctttaaag

SEQ ID NO: 801507 - DNA, 22 bp, Artificial Sequence
  chemically synthesized
atatcccaagactttaaagagc

SEQ ID NO: 801508 - DNA, 22 bp, Artificial Sequence
  chemically synthesized
tatcccaagactttaaagagct

SEQ ID NO: 801509 - DNA, 22 bp, Artificial Sequence
  chemically synthesized
actcgttttggaaaagctcttt

SEQ ID NO: 801510 - DNA, 22 bp, Artificial Sequence
  chemically synthesized
atattgactcgttttggaaaag

SEQ ID NO: 801511 - DNA, 22 bp, Artificial Sequence
  chemically synthesized
taaagagcttttccaaaacgag

SEQ ID NO: 801512 - DNA, 22 bp, Artificial Sequence
  chemically synthesized
aaagagcttttccaaaacgagt

SEQ ID NO: 801513 - DNA, 22 bp, Artificial Sequence
  chemically synthesized
aagagcttttccaaaacgagtc

SEQ ID NO: 801514 - DNA, 22 bp, Artificial Sequence
  chemically synthesized
agcgttcatattgactcgtttt

SEQ ID NO: 801515 - DNA, 22 bp, Artificial Sequence
  chemically synthesized
aagcgttcatattgactcgttt

SEQ ID NO: 801516 - DNA, 22 bp, Artificial Sequence
  chemically synthesized
ttaagcgttcatattgactcgt

SEQ ID NO: 801517 - DNA, 22 bp, Artificial Sequence
  chemically synthesized
gttcttaagcgttcatattgac

SEQ ID NO: 801518 - DNA, 22 bp, Artificial Sequence
  chemically synthesized
ttccaaaacgagtcaatatgaa

SEQ ID NO: 801519 - DNA, 22 bp, Artificial Sequence
  chemically synthesized
agttcttaagcgttcatattga

SEQ ID NO: 801520 - DNA, 22 bp, Artificial Sequence
  chemically synthesized
tccaaaacgagtcaatatgaac

SEQ ID NO: 801521 - DNA, 22 bp, Artificial Sequence
  chemically synthesized
tagttcttaagcgttcatattg

SEQ ID NO: 801522 - DNA, 22 bp, Artificial Sequence
  chemically synthesized
ccaaaacgagtcaatatgaacg

SEQ ID NO: 801523 - DNA, 22 bp, Artificial Sequence
  chemically synthesized
caaaacgagtcaatatgaacgc

SEQ ID NO: 801524 - DNA, 22 bp, Artificial Sequence
  chemically synthesized
cataaattttagttcttaagcg

SEQ ID NO: 801525 - DNA, 22 bp, Artificial Sequence
  chemically synthesized
ccataaattttagttcttaagc

SEQ ID NO: 801526 - DNA, 22 bp, Artificial Sequence
  chemically synthesized
atcttccataaattttagttct

SEQ ID NO: 801527 - DNA, 22 bp, Artificial Sequence
  chemically synthesized
ttaatcttccataaattttagt

SEQ ID NO: 801528 - DNA, 22 bp, Artificial Sequence
  chemically synthesized
aattgttaatcttccataaatt

SEQ ID NO: 801529 - DNA, 22 bp, Artificial Sequence
  chemically synthesized
caattgttaatcttccataaat

SEQ ID NO: 801530 - DNA, 22 bp, Artificial Sequence
  chemically synthesized
aagaactaaaatttatggaaga

SEQ ID NO: 801531 - DNA, 22 bp, Artificial Sequence
  chemically synthesized
agaactaaaatttatggaagat

SEQ ID NO: 801532 - DNA, 22 bp, Artificial Sequence
  chemically synthesized
aaatttatggaagattaacaat

SEQ ID NO: 801533 - DNA, 22 bp, Artificial Sequence
  chemically synthesized
aagaaagcttcaattgttaatc

SEQ ID NO: 801534 - DNA, 22 bp, Artificial Sequence
  chemically synthesized
aaagaaagcttcaattgttaat

SEQ ID NO: 801535 - DNA, 22 bp, Artificial Sequence
  chemically synthesized
tttaaagaaagcttcaattgtt

SEQ ID NO: 801536 - DNA, 22 bp, Artificial Sequence
  chemically synthesized
gtttaaagaaagcttcaattgt

SEQ ID NO: 801537 - DNA, 22 bp, Artificial Sequence
  chemically synthesized
atggaagattaacaattgaagc

SEQ ID NO: 801538 - DNA, 22 bp, Artificial Sequence
  chemically synthesized
tgtttaaagaaagcttcaattg

SEQ ID NO: 801539 - DNA, 22 bp, Artificial Sequence
  chemically synthesized
tggaagattaacaattgaagct

SEQ ID NO: 801540 - DNA, 22 bp, Artificial Sequence
  chemically synthesized
acaattgaagctttctttaaac

SEQ ID NO: 801541 - DNA, 22 bp, Artificial Sequence
  chemically synthesized
aaaatccattttgtttaaagaa

SEQ ID NO: 801542 - DNA, 22 bp, Artificial Sequence
  chemically synthesized
aagctttctttaaacaaaatgg

SEQ ID NO: 801543 - DNA, 22 bp, Artificial Sequence
  chemically synthesized
tgagtgttgaaaatccattttg

SEQ ID NO: 801544 - DNA, 22 bp, Artificial Sequence
  chemically synthesized
ctgtgagtgttgaaaatccatt

SEQ ID NO: 801545 - DNA, 22 bp, Artificial Sequence
  chemically synthesized
tctttaaacaaaatggattttc

SEQ ID NO: 801546 - DNA, 22 bp, Artificial Sequence
  chemically synthesized
ctttaaacaaaatggattttca

SEQ ID NO: 801547 - DNA, 22 bp, Artificial Sequence
  chemically synthesized
tttaaacaaaatggattttcaa

SEQ ID NO: 801548 - DNA, 22 bp, Artificial Sequence
  chemically synthesized
gttactgtgagtgttgaaaatc

SEQ ID NO: 801549 - DNA, 22 bp, Artificial Sequence
  chemically synthesized
taaacaaaatggattttcaaca

SEQ ID NO: 801550 - DNA, 22 bp, Artificial Sequence
  chemically synthesized
aaacaaaatggattttcaacac

SEQ ID NO: 801551 - DNA, 22 bp, Artificial Sequence
  chemically synthesized
aacaaaatggattttcaacact

SEQ ID NO: 801552 - DNA, 22 bp, Artificial Sequence
  chemically synthesized
aaatattggttactgtgagtgt

SEQ ID NO: 801553 - DNA, 22 bp, Artificial Sequence
  chemically synthesized
gaaatattggttactgtgagtg

SEQ ID NO: 801554 - DNA, 22 bp, Artificial Sequence
  chemically synthesized
tgcttgaaatattggttactgt

SEQ ID NO: 801555 - DNA, 22 bp, Artificial Sequence
  chemically synthesized
tcaacactcacagtaaccaata

SEQ ID NO: 801556 - DNA, 22 bp, Artificial Sequence
  chemically synthesized
caacactcacagtaaccaatat

SEQ ID NO: 801557 - DNA, 22 bp, Artificial Sequence
  chemically synthesized
aacactcacagtaaccaatatt

SEQ ID NO: 801558 - DNA, 22 bp, Artificial Sequence
  chemically synthesized
acagtaaccaatatttcaagca

SEQ ID NO: 801559 - DNA, 22 bp, Artificial Sequence
  chemically synthesized
caagcatagtttcattcacacg

SEQ ID NO: 801560 - DNA, 22 bp, Artificial Sequence
  chemically synthesized
gaaagaaatagacgtgtgaatg

SEQ ID NO: 801561 - DNA, 22 bp, Artificial Sequence
  chemically synthesized
aagcatagtttcattcacacgt

SEQ ID NO: 801562 - DNA, 22 bp, Artificial Sequence
  chemically synthesized
agaaagaaatagacgtgtgaat

SEQ ID NO: 801563 - DNA, 22 bp, Artificial Sequence
  chemically synthesized
cttagaaagaaatagacgtgtg

SEQ ID NO: 801564 - DNA, 22 bp, Artificial Sequence
  chemically synthesized
cattcacacgtctatttctttc

SEQ ID NO: 801565 - DNA, 22 bp, Artificial Sequence
  chemically synthesized
attcacacgtctatttctttct

SEQ ID NO: 801566 - DNA, 22 bp, Artificial Sequence
  chemically synthesized
tgtgagaaactacttagaaaga

SEQ ID NO: 801567 - DNA, 22 bp, Artificial Sequence
  chemically synthesized
acacgtctatttctttctaagt

SEQ ID NO: 801568 - DNA, 22 bp, Artificial Sequence
  chemically synthesized
gtgtgagaaactacttagaaag

SEQ ID NO: 801569 - DNA, 22 bp, Artificial Sequence
  chemically synthesized
atttgtgtgagaaactacttag

SEQ ID NO: 801570 - DNA, 22 bp, Artificial Sequence
  chemically synthesized
gatttgtgtgagaaactactta

SEQ ID NO: 801571 - DNA, 22 bp, Artificial Sequence
  chemically synthesized
tttctttctaagtagtttctca

SEQ ID NO: 801572 - DNA, 22 bp, Artificial Sequence
  chemically synthesized
atttgatttgtgtgagaaacta

SEQ ID NO: 801573 - DNA, 22 bp, Artificial Sequence
  chemically synthesized
tcatttgatttgtgtgagaaac

SEQ ID NO: 801574 - DNA, 22 bp, Artificial Sequence
  chemically synthesized
ctttctaagtagtttctcacac

SEQ ID NO: 801575 - DNA, 22 bp, Artificial Sequence
  chemically synthesized
tttctaagtagtttctcacaca

SEQ ID NO: 801576 - DNA, 22 bp, Artificial Sequence
  chemically synthesized
tctaagtagtttctcacacaaa

SEQ ID NO: 801577 - DNA, 22 bp, Artificial Sequence
  chemically synthesized
ctaagtagtttctcacacaaat

SEQ ID NO: 801578 - DNA, 22 bp, Artificial Sequence
  chemically synthesized
taagtagtttctcacacaaatc

SEQ ID NO: 801579 - DNA, 22 bp, Artificial Sequence
  chemically synthesized
agtagtttctcacacaaatcaa

SEQ ID NO: 801580 - DNA, 22 bp, Artificial Sequence
  chemically synthesized
agagcacaattctcatttgatt

SEQ ID NO: 801581 - DNA, 22 bp, Artificial Sequence
  chemically synthesized
gagagcacaattctcatttgat

SEQ ID NO: 801582 - DNA, 22 bp, Artificial Sequence
  chemically synthesized
ctcacacaaatcaaatgagaat

SEQ ID NO: 801583 - DNA, 22 bp, Artificial Sequence
  chemically synthesized
tcacacaaatcaaatgagaatt

SEQ ID NO: 801584 - DNA, 22 bp, Artificial Sequence
  chemically synthesized
acacaaatcaaatgagaattgt

SEQ ID NO: 801585 - DNA, 22 bp, Artificial Sequence
  chemically synthesized
tcaccttgagagcacaattctc

SEQ ID NO: 801586 - DNA, 22 bp, Artificial Sequence
  chemically synthesized
actatcaccttgagagcacaat

SEQ ID NO: 801587 - DNA, 22 bp, Artificial Sequence
  chemically synthesized
cactatcaccttgagagcacaa

SEQ ID NO: 801588 - DNA, 22 bp, Artificial Sequence
  chemically synthesized
tttcactatcaccttgagagca

SEQ ID NO: 801589 - DNA, 22 bp, Artificial Sequence
  chemically synthesized
atttcactatcaccttgagagc

SEQ ID NO: 801590 - DNA, 22 bp, Artificial Sequence
  chemically synthesized
tttatttcactatcaccttgag

SEQ ID NO: 801591 - DNA, 22 bp, Artificial Sequence
  chemically synthesized
gtattgtttatttcactatcac

SEQ ID NO: 801592 - DNA, 22 bp, Artificial Sequence
  chemically synthesized
ggtattgtttatttcactatca

SEQ ID NO: 801593 - DNA, 22 bp, Artificial Sequence
  chemically synthesized
tgctctcaaggtgatagtgaaa

SEQ ID NO: 801594 - DNA, 22 bp, Artificial Sequence
  chemically synthesized
tggtattgtttatttcactatc

SEQ ID NO: 801595 - DNA, 22 bp, Artificial Sequence
  chemically synthesized
tcaaggtgatagtgaaataaac

SEQ ID NO: 801596 - DNA, 22 bp, Artificial Sequence
  chemically synthesized
aaggtgatagtgaaataaacaa

SEQ ID NO: 801597 - DNA, 22 bp, Artificial Sequence
  chemically synthesized
tgtcaatatgtataaatagact

SEQ ID NO: 801598 - DNA, 22 bp, Artificial Sequence
  chemically synthesized
atgtcaatatgtataaatagac

SEQ ID NO: 801599 - DNA, 22 bp, Artificial Sequence
  chemically synthesized
tatgtcaatatgtataaataga

SEQ ID NO: 801600 - DNA, 22 bp, Artificial Sequence
  chemically synthesized
tttatacatattgacataaaat

SEQ ID NO: 801601 - DNA, 22 bp, Artificial Sequence
  chemically synthesized
atacatattgacataaaattac

SEQ ID NO: 801602 - DNA, 22 bp, Artificial Sequence
  chemically synthesized
tacatattgacataaaattaca

SEQ ID NO: 801603 - DNA, 22 bp, Artificial Sequence
  chemically synthesized
tgtatacatatagtatgtaatt

SEQ ID NO: 801604 - DNA, 22 bp, Artificial Sequence
  chemically synthesized
atgtatacatatagtatgtaat

SEQ ID NO: 801605 - DNA, 22 bp, Artificial Sequence
  chemically synthesized
tatgtatacatatagtatgtaa

SEQ ID NO: 801606 - DNA, 22 bp, Artificial Sequence
  chemically synthesized
ttatgtatacatatagtatgta

SEQ ID NO: 801607 - DNA, 22 bp, Artificial Sequence
  chemically synthesized
acataaaattacatactatatg

SEQ ID NO: 801608 - DNA, 22 bp, Artificial Sequence
  chemically synthesized
tttttatgtatacatatagtat

SEQ ID NO: 801609 - DNA, 22 bp, Artificial Sequence
  chemically synthesized
atttttatgtatacatatagta

SEQ ID NO: 801610 - DNA, 22 bp, Artificial Sequence
  chemically synthesized
aggcttatttttatgtatacat

SEQ ID NO: 801611 - DNA, 22 bp, Artificial Sequence
  chemically synthesized
caggcttatttttatgtataca

SEQ ID NO: 801612 - DNA, 22 bp, Artificial Sequence
  chemically synthesized
tcaggcttatttttatgtatac

SEQ ID NO: 801613 - DNA, 22 bp, Artificial Sequence
  chemically synthesized
catactatatgtatacataaaa

SEQ ID NO: 801614 - DNA, 22 bp, Artificial Sequence
  chemically synthesized
ttttcaggcttatttttatgta

SEQ ID NO: 801615 - DNA, 22 bp, Artificial Sequence
  chemically synthesized
ctattttcaggcttatttttat

SEQ ID NO: 801616 - DNA, 22 bp, Artificial Sequence
  chemically synthesized
tatgtatacataaaaataagcc

SEQ ID NO: 801617 - DNA, 22 bp, Artificial Sequence
  chemically synthesized
ttactattttcaggcttatttt

SEQ ID NO: 801618 - DNA, 22 bp, Artificial Sequence
  chemically synthesized
tgttattactattttcaggctt

SEQ ID NO: 801619 - DNA, 22 bp, Artificial Sequence
  chemically synthesized
atattatgttattactattttc

SEQ ID NO: 801620 - DNA, 22 bp, Artificial Sequence
  chemically synthesized
aaaatagtaataacataatatt

SEQ ID NO: 801621 - DNA, 22 bp, Artificial Sequence
  chemically synthesized
gcacacggtaagcacccaataa

SEQ ID NO: 801622 - DNA, 22 bp, Artificial Sequence
  chemically synthesized
tggcacacggtaagcacccaat

SEQ ID NO: 801623 - DNA, 22 bp, Artificial Sequence
  chemically synthesized
ctggcacacggtaagcacccaa

SEQ ID NO: 801624 - DNA, 22 bp, Artificial Sequence
  chemically synthesized
gctatgtttattgggtgcttac

SEQ ID NO: 801625 - DNA, 22 bp, Artificial Sequence
  chemically synthesized
tgtttattgggtgcttaccgtg

SEQ ID NO: 801626 - DNA, 22 bp, Artificial Sequence
  chemically synthesized
attgggtgcttaccgtgtgcca

SEQ ID NO: 801627 - DNA, 22 bp, Artificial Sequence
  chemically synthesized
ttgggtgcttaccgtgtgccag

SEQ ID NO: 801628 - DNA, 22 bp, Artificial Sequence
  chemically synthesized
ggtgcttaccgtgtgccagaaa

SEQ ID NO: 801629 - DNA, 22 bp, Artificial Sequence
  chemically synthesized
aagtgcatggaacagtttctgg

SEQ ID NO: 801630 - DNA, 22 bp, Artificial Sequence
  chemically synthesized
accgtgtgccagaaactgttcc

SEQ ID NO: 801631 - DNA, 22 bp, Artificial Sequence
  chemically synthesized
ccgtgtgccagaaactgttcca

SEQ ID NO: 801632 - DNA, 22 bp, Artificial Sequence
  chemically synthesized
atgtactgaagtgcatggaaca

SEQ ID NO: 801633 - DNA, 22 bp, Artificial Sequence
  chemically synthesized
ttccatgcacttcagtacatta

SEQ ID NO: 801634 - DNA, 22 bp, Artificial Sequence
  chemically synthesized
catgcacttcagtacattaatt

SEQ ID NO: 801635 - DNA, 22 bp, Artificial Sequence
  chemically synthesized
tgagggtgatgcgaattaatgt

SEQ ID NO: 801636 - DNA, 22 bp, Artificial Sequence
  chemically synthesized
ttgtgagggtgatgcgaattaa

SEQ ID NO: 801637 - DNA, 22 bp, Artificial Sequence
  chemically synthesized
cagtacattaattcgcatcacc

SEQ ID NO: 801638 - DNA, 22 bp, Artificial Sequence
  chemically synthesized
agtacattaattcgcatcaccc

SEQ ID NO: 801639 - DNA, 22 bp, Artificial Sequence
  chemically synthesized
aggttgttgtgagggtgatgcg

SEQ ID NO: 801640 - DNA, 22 bp, Artificial Sequence
  chemically synthesized
caggttgttgtgagggtgatgc

SEQ ID NO: 801641 - DNA, 22 bp, Artificial Sequence
  chemically synthesized
ttcaggttgttgtgagggtgat

SEQ ID NO: 801642 - DNA, 22 bp, Artificial Sequence
  chemically synthesized
cctcttcaggttgttgtgaggg

SEQ ID NO: 801643 - DNA, 22 bp, Artificial Sequence
  chemically synthesized
attcgcatcaccctcacaacaa

SEQ ID NO: 801644 - DNA, 22 bp, Artificial Sequence
  chemically synthesized
gcatcaccctcacaacaacctg

SEQ ID NO: 801645 - DNA, 22 bp, Artificial Sequence
  chemically synthesized
acaacaacctgaagaggtagct

SEQ ID NO: 801646 - DNA, 22 bp, Artificial Sequence
  chemically synthesized
aagaggtagctgtcattacttt

SEQ ID NO: 801647 - DNA, 22 bp, Artificial Sequence
  chemically synthesized
tggagcataaatcaaaagtaat

SEQ ID NO: 801648 - DNA, 22 bp, Artificial Sequence
  chemically synthesized
agattatggagcataaatcaaa

SEQ ID NO: 801649 - DNA, 22 bp, Artificial Sequence
  chemically synthesized
tcagattatggagcataaatca

SEQ ID NO: 801650 - DNA, 22 bp, Artificial Sequence
  chemically synthesized
tcattacttttgatttatgctc

SEQ ID NO: 801651 - DNA, 22 bp, Artificial Sequence
  chemically synthesized
ctctcagattatggagcataaa

SEQ ID NO: 801652 - DNA, 22 bp, Artificial Sequence
  chemically synthesized
cttttgatttatgctccataat

SEQ ID NO: 801653 - DNA, 22 bp, Artificial Sequence
  chemically synthesized
aattgctctcagattatggagc

SEQ ID NO: 801654 - DNA, 22 bp, Artificial Sequence
  chemically synthesized
tgaattgctctcagattatgga

SEQ ID NO: 801655 - DNA, 22 bp, Artificial Sequence
  chemically synthesized
ttgatttatgctccataatctg

SEQ ID NO: 801656 - DNA, 22 bp, Artificial Sequence
  chemically synthesized
ctgaattgctctcagattatgg

SEQ ID NO: 801657 - DNA, 22 bp, Artificial Sequence
  chemically synthesized
tgatttatgctccataatctga

SEQ ID NO: 801658 - DNA, 22 bp, Artificial Sequence
  chemically synthesized
gatttatgctccataatctgag

SEQ ID NO: 801659 - DNA, 22 bp, Artificial Sequence
  chemically synthesized
atttatgctccataatctgaga

SEQ ID NO: 801660 - DNA, 22 bp, Artificial Sequence
  chemically synthesized
atgctccataatctgagagcaa

SEQ ID NO: 801661 - DNA, 22 bp, Artificial Sequence
  chemically synthesized
tgctccataatctgagagcaat

SEQ ID NO: 801662 - DNA, 22 bp, Artificial Sequence
  chemically synthesized
cataatctgagagcaattcaga

SEQ ID NO: 801663 - DNA, 22 bp, Artificial Sequence
  chemically synthesized
accatagacgcatttctgaatt

SEQ ID NO: 801664 - DNA, 22 bp, Artificial Sequence
  chemically synthesized
ctgaccatagacgcatttctga

SEQ ID NO: 801665 - DNA, 22 bp, Artificial Sequence
  chemically synthesized
actgaccatagacgcatttctg

SEQ ID NO: 801666 - DNA, 22 bp, Artificial Sequence
  chemically synthesized
agagcaattcagaaatgcgtct

SEQ ID NO: 801667 - DNA, 22 bp, Artificial Sequence
  chemically synthesized
gggcttactgaccatagacgca

SEQ ID NO: 801668 - DNA, 22 bp, Artificial Sequence
  chemically synthesized
tggggcttactgaccatagacg

SEQ ID NO: 801669 - DNA, 22 bp, Artificial Sequence
  chemically synthesized
agaaatgcgtctatggtcagta

SEQ ID NO: 801670 - DNA, 22 bp, Artificial Sequence
  chemically synthesized
aatcgtgattctggggcttact

SEQ ID NO: 801671 - DNA, 22 bp, Artificial Sequence
  chemically synthesized
aaatcgtgattctggggcttac

SEQ ID NO: 801672 - DNA, 22 bp, Artificial Sequence
  chemically synthesized
agtttaaatcgtgattctgggg

SEQ ID NO: 801673 - DNA, 22 bp, Artificial Sequence
  chemically synthesized
tggtcagtaagccccagaatca

SEQ ID NO: 801674 - DNA, 22 bp, Artificial Sequence
  chemically synthesized
cctgagtttaaatcgtgattct

SEQ ID NO: 801675 - DNA, 22 bp, Artificial Sequence
  chemically synthesized
aagcccgactgcctgagtttaa

SEQ ID NO: 801676 - DNA, 22 bp, Artificial Sequence
  chemically synthesized
gaagcccgactgcctgagttta

SEQ ID NO: 801677 - DNA, 22 bp, Artificial Sequence
  chemically synthesized
tgaagcccgactgcctgagttt

SEQ ID NO: 801678 - DNA, 22 bp, Artificial Sequence
  chemically synthesized
aaactcaggcagtcgggcttca

SEQ ID NO: 801679 - DNA, 22 bp, Artificial Sequence
  chemically synthesized
aactcaggcagtcgggcttcaa

SEQ ID NO: 801680 - DNA, 22 bp, Artificial Sequence
  chemically synthesized
atagtgtgaactttgaagcccg

SEQ ID NO: 801681 - DNA, 22 bp, Artificial Sequence
  chemically synthesized
catagtgtgaactttgaagccc

SEQ ID NO: 801682 - DNA, 22 bp, Artificial Sequence
  chemically synthesized
aggcagtcgggcttcaaagttc

SEQ ID NO: 801683 - DNA, 22 bp, Artificial Sequence
  chemically synthesized
gggtggatagtgtttcatagtg

SEQ ID NO: 801684 - DNA, 22 bp, Artificial Sequence
  chemically synthesized
caaagttcacactatgaaacac

SEQ ID NO: 801685 - DNA, 22 bp, Artificial Sequence
  chemically synthesized
aaagttcacactatgaaacact

SEQ ID NO: 801686 - DNA, 22 bp, Artificial Sequence
  chemically synthesized
acactatgaaacactatccacc

SEQ ID NO: 801687 - DNA, 22 bp, Artificial Sequence
  chemically synthesized
gagagaggctggggtggatagt

SEQ ID NO: 801688 - DNA, 22 bp, Artificial Sequence
  chemically synthesized
cattagagagaggctggggtgg

SEQ ID NO: 801689 - DNA, 22 bp, Artificial Sequence
  chemically synthesized
tgaaacactatccaccccagcc

SEQ ID NO: 801690 - DNA, 22 bp, Artificial Sequence
  chemically synthesized
acattgcattagagagaggctg

SEQ ID NO: 801691 - DNA, 22 bp, Artificial Sequence
  chemically synthesized
tgacattgcattagagagaggc

SEQ ID NO: 801692 - DNA, 22 bp, Artificial Sequence
  chemically synthesized
ctgacattgcattagagagagg

SEQ ID NO: 801693 - DNA, 22 bp, Artificial Sequence
  chemically synthesized
tccaccccagcctctctctaat

SEQ ID NO: 801694 - DNA, 22 bp, Artificial Sequence
  chemically synthesized
gtacttctgacattgcattaga

SEQ ID NO: 801695 - DNA, 22 bp, Artificial Sequence
  chemically synthesized
agtacttctgacattgcattag

SEQ ID NO: 801696 - DNA, 22 bp, Artificial Sequence
  chemically synthesized
tctctaatgcaatgtcagaagt

SEQ ID NO: 801697 - DNA, 22 bp, Artificial Sequence
  chemically synthesized
aatgacgtttagtacttctgac

SEQ ID NO: 801698 - DNA, 22 bp, Artificial Sequence
  chemically synthesized
tctaatgcaatgtcagaagtac

SEQ ID NO: 801699 - DNA, 22 bp, Artificial Sequence
  chemically synthesized
aaatgacgtttagtacttctga

SEQ ID NO: 801700 - DNA, 22 bp, Artificial Sequence
  chemically synthesized
taaatgacgtttagtacttctg

SEQ ID NO: 801701 - DNA, 22 bp, Artificial Sequence
  chemically synthesized
taatgcaatgtcagaagtacta

SEQ ID NO: 801702 - DNA, 22 bp, Artificial Sequence
  chemically synthesized
atgcaatgtcagaagtactaaa

SEQ ID NO: 801703 - DNA, 22 bp, Artificial Sequence
  chemically synthesized
cactttaaatgacgtttagtac

SEQ ID NO: 801704 - DNA, 22 bp, Artificial Sequence
  chemically synthesized
tgcactttaaatgacgtttagt

SEQ ID NO: 801705 - DNA, 22 bp, Artificial Sequence
  chemically synthesized
tctgcactttaaatgacgttta

SEQ ID NO: 801706 - DNA, 22 bp, Artificial Sequence
  chemically synthesized
ctctgcactttaaatgacgttt

SEQ ID NO: 801707 - DNA, 22 bp, Artificial Sequence
  chemically synthesized
taggcatttctctgcactttaa

SEQ ID NO: 801708 - DNA, 22 bp, Artificial Sequence
  chemically synthesized
ctataggcatttctctgcactt

SEQ ID NO: 801709 - DNA, 22 bp, Artificial Sequence
  chemically synthesized
aacgtcatttaaagtgcagaga

SEQ ID NO: 801710 - DNA, 22 bp, Artificial Sequence
  chemically synthesized
aattcctataggcatttctctg

SEQ ID NO: 801711 - DNA, 22 bp, Artificial Sequence
  chemically synthesized
aaagtgcagagaaatgcctata

SEQ ID NO: 801712 - DNA, 22 bp, Artificial Sequence
  chemically synthesized
catctcaattcctataggcatt

SEQ ID NO: 801713 - DNA, 22 bp, Artificial Sequence
  chemically synthesized
aagtgcagagaaatgcctatag

SEQ ID NO: 801714 - DNA, 22 bp, Artificial Sequence
  chemically synthesized
tctccatctcaattcctatagg

SEQ ID NO: 801715 - DNA, 22 bp, Artificial Sequence
  chemically synthesized
gtctccatctcaattcctatag

SEQ ID NO: 801716 - DNA, 22 bp, Artificial Sequence
  chemically synthesized
gaagacatcttgtctccatctc

SEQ ID NO: 801717 - DNA, 22 bp, Artificial Sequence
  chemically synthesized
taggaattgagatggagacaag

SEQ ID NO: 801718 - DNA, 22 bp, Artificial Sequence
  chemically synthesized
agatggagacaagatgtcttcc

SEQ ID NO: 801719 - DNA, 22 bp, Artificial Sequence
  chemically synthesized
agcccccaagctggaagacatc

SEQ ID NO: 801720 - DNA, 22 bp, Artificial Sequence
  chemically synthesized
cctgagcccccaagctggaaga

SEQ ID NO: 801721 - DNA, 22 bp, Artificial Sequence
  chemically synthesized
ccctgagcccccaagctggaag

SEQ ID NO: 801722 - DNA, 22 bp, Artificial Sequence
  chemically synthesized
tccctgagcccccaagctggaa

SEQ ID NO: 801723 - DNA, 22 bp, Artificial Sequence
  chemically synthesized
ttccctgagcccccaagctgga

SEQ ID NO: 801724 - DNA, 22 bp, Artificial Sequence
  chemically synthesized
tttccctgagcccccaagctgg

SEQ ID NO: 801725 - DNA, 22 bp, Artificial Sequence
  chemically synthesized
cctttttccctgagcccccaag

SEQ ID NO: 801726 - DNA, 22 bp, Artificial Sequence
  chemically synthesized
ccctttttccctgagcccccaa

SEQ ID NO: 801727 - DNA, 22 bp, Artificial Sequence
  chemically synthesized
ccagcttgggggctcagggaaa

SEQ ID NO: 801728 - DNA, 22 bp, Artificial Sequence
  chemically synthesized
gaatcttccctttttccctgag

SEQ ID NO: 801729 - DNA, 22 bp, Artificial Sequence
  chemically synthesized
cagcttgggggctcagggaaaa

SEQ ID NO: 801730 - DNA, 22 bp, Artificial Sequence
  chemically synthesized
cgaatcttccctttttccctga

SEQ ID NO: 801731 - DNA, 22 bp, Artificial Sequence
  chemically synthesized
tcgaatcttccctttttccctg

SEQ ID NO: 801732 - DNA, 22 bp, Artificial Sequence
  chemically synthesized
gggggctcagggaaaaagggaa

SEQ ID NO: 801733 - DNA, 22 bp, Artificial Sequence
  chemically synthesized
ggggctcagggaaaaagggaag

SEQ ID NO: 801734 - DNA, 22 bp, Artificial Sequence
  chemically synthesized
agggaaaaagggaagattcgaa

SEQ ID NO: 801735 - DNA, 22 bp, Artificial Sequence
  chemically synthesized
aaggaaagccattttcgaatct

SEQ ID NO: 801736 - DNA, 22 bp, Artificial Sequence
  chemically synthesized
caaggaaagccattttcgaatc

SEQ ID NO: 801737 - DNA, 22 bp, Artificial Sequence
  chemically synthesized
tcaaggaaagccattttcgaat

SEQ ID NO: 801738 - DNA, 22 bp, Artificial Sequence
  chemically synthesized
ttcaaggaaagccattttcgaa

SEQ ID NO: 801739 - DNA, 22 bp, Artificial Sequence
  chemically synthesized
cttttcaaggaaagccattttc

SEQ ID NO: 801740 - DNA, 22 bp, Artificial Sequence
  chemically synthesized
cctacttttcaaggaaagccat

SEQ ID NO: 801741 - DNA, 22 bp, Artificial Sequence
  chemically synthesized
gaaaatggctttccttgaaaag

SEQ ID NO: 801742 - DNA, 22 bp, Artificial Sequence
  chemically synthesized
cccaaacattacctacttttca

SEQ ID NO: 801743 - DNA, 22 bp, Artificial Sequence
  chemically synthesized
acccaaacattacctacttttc

SEQ ID NO: 801744 - DNA, 22 bp, Artificial Sequence
  chemically synthesized
agcttacccaaacattacctac

SEQ ID NO: 801745 - DNA, 22 bp, Artificial Sequence
  chemically synthesized
tccttgaaaagtaggtaatgtt

SEQ ID NO: 801746 - DNA, 22 bp, Artificial Sequence
  chemically synthesized
ccttgaaaagtaggtaatgttt

SEQ ID NO: 801747 - DNA, 22 bp, Artificial Sequence
  chemically synthesized
cttgaaaagtaggtaatgtttg

SEQ ID NO: 801748 - DNA, 22 bp, Artificial Sequence
  chemically synthesized
atctaagcttacccaaacatta

SEQ ID NO: 801749 - DNA, 22 bp, Artificial Sequence
  chemically synthesized
catctaagcttacccaaacatt

SEQ ID NO: 801750 - DNA, 22 bp, Artificial Sequence
  chemically synthesized
gaaaagtaggtaatgtttgggt

SEQ ID NO: 801751 - DNA, 22 bp, Artificial Sequence
  chemically synthesized
tcatctaagcttacccaaacat

SEQ ID NO: 801752 - DNA, 22 bp, Artificial Sequence
  chemically synthesized
aaaagtaggtaatgtttgggta

SEQ ID NO: 801753 - DNA, 22 bp, Artificial Sequence
  chemically synthesized
ttcatctaagcttacccaaaca

SEQ ID NO: 801754 - DNA, 22 bp, Artificial Sequence
  chemically synthesized
tttcatctaagcttacccaaac

SEQ ID NO: 801755 - DNA, 22 bp, Artificial Sequence
  chemically synthesized
ttttcatctaagcttacccaaa

SEQ ID NO: 801756 - DNA, 22 bp, Artificial Sequence
  chemically synthesized
tttttcatctaagcttacccaa

SEQ ID NO: 801757 - DNA, 22 bp, Artificial Sequence
  chemically synthesized
ctttttttcatctaagcttacc

SEQ ID NO: 801758 - DNA, 22 bp, Artificial Sequence
  chemically synthesized
agattcctttttttcatctaag

SEQ ID NO: 801759 - DNA, 22 bp, Artificial Sequence
  chemically synthesized
gagattcctttttttcatctaa

SEQ ID NO: 801760 - DNA, 22 bp, Artificial Sequence
  chemically synthesized
gggtaagcttagatgaaaaaaa

SEQ ID NO: 801761 - DNA, 22 bp, Artificial Sequence
  chemically synthesized
tcttgagattcctttttttcat

SEQ ID NO: 801762 - DNA, 22 bp, Artificial Sequence
  chemically synthesized
ggtaagcttagatgaaaaaaag

SEQ ID NO: 801763 - DNA, 22 bp, Artificial Sequence
  chemically synthesized
gtcttgagattcctttttttca

SEQ ID NO: 801764 - DNA, 22 bp, Artificial Sequence
  chemically synthesized
tgtcttgagattcctttttttc

SEQ ID NO: 801765 - DNA, 22 bp, Artificial Sequence
  chemically synthesized
ttgtcttgagattccttttttt

SEQ ID NO: 801766 - DNA, 22 bp, Artificial Sequence
  chemically synthesized
tttgtcttgagattcctttttt

SEQ ID NO: 801767 - DNA, 22 bp, Artificial Sequence
  chemically synthesized
ttttttgtcttgagattccttt

SEQ ID NO: 801768 - DNA, 22 bp, Artificial Sequence
  chemically synthesized
gttttttgtcttgagattcctt

SEQ ID NO: 801769 - DNA, 22 bp, Artificial Sequence
  chemically synthesized
agatgaaaaaaaggaatctcaa

SEQ ID NO: 801770 - DNA, 22 bp, Artificial Sequence
  chemically synthesized
gatgaaaaaaaggaatctcaag

SEQ ID NO: 801771 - DNA, 22 bp, Artificial Sequence
  chemically synthesized
gatgatcttgttttttgtcttg

SEQ ID NO: 801772 - DNA, 22 bp, Artificial Sequence
  chemically synthesized
cgatgatcttgttttttgtctt

SEQ ID NO: 801773 - DNA, 22 bp, Artificial Sequence
  chemically synthesized
tcgatgatcttgttttttgtct

SEQ ID NO: 801774 - DNA, 22 bp, Artificial Sequence
  chemically synthesized
tgtctttcgatgatcttgtttt

SEQ ID NO: 801775 - DNA, 22 bp, Artificial Sequence
  chemically synthesized
tgtgtctttcgatgatcttgtt

SEQ ID NO: 801776 - DNA, 22 bp, Artificial Sequence
  chemically synthesized
ctgtgtctttcgatgatcttgt

SEQ ID NO: 801777 - DNA, 22 bp, Artificial Sequence
  chemically synthesized
aagacaaaaaacaagatcatcg

SEQ ID NO: 801778 - DNA, 22 bp, Artificial Sequence
  chemically synthesized
cttctgtgtctttcgatgatct

SEQ ID NO: 801779 - DNA, 22 bp, Artificial Sequence
  chemically synthesized
acttctgtgtctttcgatgatc

SEQ ID NO: 801780 - DNA, 22 bp, Artificial Sequence
  chemically synthesized
gccagcttacttctgtgtcttt

SEQ ID NO: 801781 - DNA, 22 bp, Artificial Sequence
  chemically synthesized
aaatgaacagctagccagctta

SEQ ID NO: 801782 - DNA, 22 bp, Artificial Sequence
  chemically synthesized
ctaaaatgaacagctagccagc

SEQ ID NO: 801783 - DNA, 22 bp, Artificial Sequence
  chemically synthesized
ctactaaaatgaacagctagcc

SEQ ID NO: 801784 - DNA, 22 bp, Artificial Sequence
  chemically synthesized
aactcctactaaaatgaacagc

SEQ ID NO: 801785 - DNA, 22 bp, Artificial Sequence
  chemically synthesized
caactcctactaaaatgaacag

SEQ ID NO: 801786 - DNA, 22 bp, Artificial Sequence
  chemically synthesized
gctagctgttcattttagtagg

SEQ ID NO: 801787 - DNA, 22 bp, Artificial Sequence
  chemically synthesized
aatgcaccttcaactcctacta

SEQ ID NO: 801788 - DNA, 22 bp, Artificial Sequence
  chemically synthesized
gctgttcattttagtaggagtt

SEQ ID NO: 801789 - DNA, 22 bp, Artificial Sequence
  chemically synthesized
tcaatgcaccttcaactcctac

SEQ ID NO: 801790 - DNA, 22 bp, Artificial Sequence
  chemically synthesized
ttcattttagtaggagttgaag

SEQ ID NO: 801791 - DNA, 22 bp, Artificial Sequence
  chemically synthesized
cctctcaatgcaccttcaactc

SEQ ID NO: 801792 - DNA, 22 bp, Artificial Sequence
  chemically synthesized
acctctcaatgcaccttcaact

SEQ ID NO: 801793 - DNA, 22 bp, Artificial Sequence
  chemically synthesized
attttagtaggagttgaaggtg

SEQ ID NO: 801794 - DNA, 22 bp, Artificial Sequence
  chemically synthesized
tacctctcaatgcaccttcaac

SEQ ID NO: 801795 - DNA, 22 bp, Artificial Sequence
  chemically synthesized
ttttacctctcaatgcaccttc

SEQ ID NO: 801796 - DNA, 22 bp, Artificial Sequence
  chemically synthesized
tagtaggagttgaaggtgcatt

SEQ ID NO: 801797 - DNA, 22 bp, Artificial Sequence
  chemically synthesized
attttacctctcaatgcacctt

SEQ ID NO: 801798 - DNA, 22 bp, Artificial Sequence
  chemically synthesized
agtaggagttgaaggtgcattg

SEQ ID NO: 801799 - DNA, 22 bp, Artificial Sequence
  chemically synthesized
gtaggagttgaaggtgcattga

SEQ ID NO: 801800 - DNA, 22 bp, Artificial Sequence
  chemically synthesized
ttattttacctctcaatgcacc

SEQ ID NO: 801801 - DNA, 22 bp, Artificial Sequence
  chemically synthesized
cttattttacctctcaatgcac

SEQ ID NO: 801802 - DNA, 22 bp, Artificial Sequence
  chemically synthesized
tttcttattttacctctcaatg

SEQ ID NO: 801803 - DNA, 22 bp, Artificial Sequence
  chemically synthesized
atttcttattttacctctcaat

SEQ ID NO: 801804 - DNA, 22 bp, Artificial Sequence
  chemically synthesized
aaggtgcattgagaggtaaaat

SEQ ID NO: 801805 - DNA, 22 bp, Artificial Sequence
  chemically synthesized
caatcttatttcttattttacc

SEQ ID NO: 801806 - DNA, 22 bp, Artificial Sequence
  chemically synthesized
ccaatcttatttcttattttac

SEQ ID NO: 801807 - DNA, 22 bp, Artificial Sequence
  chemically synthesized
gtttccaatcttatttcttatt

SEQ ID NO: 801808 - DNA, 22 bp, Artificial Sequence
  chemically synthesized
agaggtaaaataagaaataaga

SEQ ID NO: 801809 - DNA, 22 bp, Artificial Sequence
  chemically synthesized
agtctcgtttccaatcttattt

SEQ ID NO: 801810 - DNA, 22 bp, Artificial Sequence
  chemically synthesized
cccctgagtctcgtttccaatc

SEQ ID NO: 801811 - DNA, 22 bp, Artificial Sequence
  chemically synthesized
cacaattgcccctgagtctcgt

SEQ ID NO: 801812 - DNA, 22 bp, Artificial Sequence
  chemically synthesized
tccacaattgcccctgagtctc

SEQ ID NO: 801813 - DNA, 22 bp, Artificial Sequence
  chemically synthesized
gctctccacaattgcccctgag

SEQ ID NO: 801814 - DNA, 22 bp, Artificial Sequence
  chemically synthesized
gaaacgagactcaggggcaatt

SEQ ID NO: 801815 - DNA, 22 bp, Artificial Sequence
  chemically synthesized
acctggctctccacaattgccc

SEQ ID NO: 801816 - DNA, 22 bp, Artificial Sequence
  chemically synthesized
cacctggctctccacaattgcc

SEQ ID NO: 801817 - DNA, 22 bp, Artificial Sequence
  chemically synthesized
cttcacctggctctccacaatt

SEQ ID NO: 801818 - DNA, 22 bp, Artificial Sequence
  chemically synthesized
aggggcaattgtggagagccag

SEQ ID NO: 801819 - DNA, 22 bp, Artificial Sequence
  chemically synthesized
cagactccttcacctggctctc

SEQ ID NO: 801820 - DNA, 22 bp, Artificial Sequence
  chemically synthesized
tacagactccttcacctggctc

SEQ ID NO: 801821 - DNA, 22 bp, Artificial Sequence
  chemically synthesized
tggagagccaggtgaaggagtc

SEQ ID NO: 801822 - DNA, 22 bp, Artificial Sequence
  chemically synthesized
agaatattctacagactccttc

SEQ ID NO: 801823 - DNA, 22 bp, Artificial Sequence
  chemically synthesized
cagaatattctacagactcctt

SEQ ID NO: 801824 - DNA, 22 bp, Artificial Sequence
  chemically synthesized
aaagcccttcagaatattctac

SEQ ID NO: 801825 - DNA, 22 bp, Artificial Sequence
  chemically synthesized
caaagcccttcagaatattcta

SEQ ID NO: 801826 - DNA, 22 bp, Artificial Sequence
  chemically synthesized
acttcaaagcccttcagaatat

SEQ ID NO: 801827 - DNA, 22 bp, Artificial Sequence
  chemically synthesized
gacttcaaagcccttcagaata

SEQ ID NO: 801828 - DNA, 22 bp, Artificial Sequence
  chemically synthesized
tgacttcaaagcccttcagaat

SEQ ID NO: 801829 - DNA, 22 bp, Artificial Sequence
  chemically synthesized
ttgacttcaaagcccttcagaa

SEQ ID NO: 801830 - DNA, 22 bp, Artificial Sequence
  chemically synthesized
tttgacttcaaagcccttcaga

SEQ ID NO: 801831 - DNA, 22 bp, Artificial Sequence
  chemically synthesized
ttttgacttcaaagcccttcag

SEQ ID NO: 801832 - DNA, 22 bp, Artificial Sequence
  chemically synthesized
tagaatattctgaagggctttg

SEQ ID NO: 801833 - DNA, 22 bp, Artificial Sequence
  chemically synthesized
aaacaccttttttgacttcaaa

SEQ ID NO: 801834 - DNA, 22 bp, Artificial Sequence
  chemically synthesized
caaacaccttttttgacttcaa

SEQ ID NO: 801835 - DNA, 22 bp, Artificial Sequence
  chemically synthesized
ttcaaacaccttttttgacttc

SEQ ID NO: 801836 - DNA, 22 bp, Artificial Sequence
  chemically synthesized
tgaagggctttgaagtcaaaaa

SEQ ID NO: 801837 - DNA, 22 bp, Artificial Sequence
  chemically synthesized
aagggctttgaagtcaaaaaag

SEQ ID NO: 801838 - DNA, 22 bp, Artificial Sequence
  chemically synthesized
ccctcttcaaacaccttttttg

SEQ ID NO: 801839 - DNA, 22 bp, Artificial Sequence
  chemically synthesized
tgaagtcaaaaaaggtgtttga

SEQ ID NO: 801840 - DNA, 22 bp, Artificial Sequence
  chemically synthesized
gaagtcaaaaaaggtgtttgaa

SEQ ID NO: 801841 - DNA, 22 bp, Artificial Sequence
  chemically synthesized
aagtcaaaaaaggtgtttgaag

SEQ ID NO: 801842 - DNA, 22 bp, Artificial Sequence
  chemically synthesized
gaagaggggagtcatatattat

SEQ ID NO: 801843 - DNA, 22 bp, Artificial Sequence
  chemically synthesized
aagaggggagtcatatattatt

SEQ ID NO: 801844 - DNA, 22 bp, Artificial Sequence
  chemically synthesized
tcagtgaacgaaaataatatat

SEQ ID NO: 801845 - DNA, 22 bp, Artificial Sequence
  chemically synthesized
gtcagtgaacgaaaataatata

SEQ ID NO: 801846 - DNA, 22 bp, Artificial Sequence
  chemically synthesized
aataagtatttgtcagtgaacg

SEQ ID NO: 801847 - DNA, 22 bp, Artificial Sequence
  chemically synthesized
ttttcgttcactgacaaatact

SEQ ID NO: 801848 - DNA, 22 bp, Artificial Sequence
  chemically synthesized
tcgttcactgacaaatacttat

SEQ ID NO: 801849 - DNA, 22 bp, Artificial Sequence
  chemically synthesized
cgttcactgacaaatacttatt

SEQ ID NO: 801850 - DNA, 22 bp, Artificial Sequence
  chemically synthesized
gttcactgacaaatacttattg

SEQ ID NO: 801851 - DNA, 22 bp, Artificial Sequence
  chemically synthesized
actgacaaatacttattgaaca

SEQ ID NO: 801852 - DNA, 22 bp, Artificial Sequence
  chemically synthesized
acaaatacttattgaacacttt

SEQ ID NO: 801853 - DNA, 22 bp, Artificial Sequence
  chemically synthesized
tgtgtgtcacatgaaaagtgtt

SEQ ID NO: 801854 - DNA, 22 bp, Artificial Sequence
  chemically synthesized
attgaacacttttcatgtgaca

SEQ ID NO: 801855 - DNA, 22 bp, Artificial Sequence
  chemically synthesized
ttgaacacttttcatgtgacac

SEQ ID NO: 801856 - DNA, 22 bp, Artificial Sequence
  chemically synthesized
tccaagactgtgtgtgtcacat

SEQ ID NO: 801857 - DNA, 22 bp, Artificial Sequence
  chemically synthesized
aacacttttcatgtgacacaca

SEQ ID NO: 801858 - DNA, 22 bp, Artificial Sequence
  chemically synthesized
ttcatgtgacacacacagtctt

SEQ ID NO: 801859 - DNA, 22 bp, Artificial Sequence
  chemically synthesized
tcatgtgacacacacagtcttg

SEQ ID NO: 801860 - DNA, 22 bp, Artificial Sequence
  chemically synthesized
catgtgacacacacagtcttgg

SEQ ID NO: 801861 - DNA, 22 bp, Artificial Sequence
  chemically synthesized
atgtgacacacacagtcttgga

SEQ ID NO: 801862 - DNA, 22 bp, Artificial Sequence
  chemically synthesized
tatatatccattgtccaagact

SEQ ID NO: 801863 - DNA, 22 bp, Artificial Sequence
  chemically synthesized
gtatatatccattgtccaagac

SEQ ID NO: 801864 - DNA, 22 bp, Artificial Sequence
  chemically synthesized
acttgtatatatccattgtcca

SEQ ID NO: 801865 - DNA, 22 bp, Artificial Sequence
  chemically synthesized
ttcacttgtatatatccattgt

SEQ ID NO: 801866 - DNA, 22 bp, Artificial Sequence
  chemically synthesized
attcacttgtatatatccattg

SEQ ID NO: 801867 - DNA, 22 bp, Artificial Sequence
  chemically synthesized
tattcacttgtatatatccatt

SEQ ID NO: 801868 - DNA, 22 bp, Artificial Sequence
  chemically synthesized
ctttattcacttgtatatatcc

SEQ ID NO: 801869 - DNA, 22 bp, Artificial Sequence
  chemically synthesized
ggacaatggatatatacaagtg

SEQ ID NO: 801870 - DNA, 22 bp, Artificial Sequence
  chemically synthesized
atctgctttattcacttgtata

SEQ ID NO: 801871 - DNA, 22 bp, Artificial Sequence
  chemically synthesized
gacaatggatatatacaagtga

SEQ ID NO: 801872 - DNA, 22 bp, Artificial Sequence
  chemically synthesized
catctgctttattcacttgtat

SEQ ID NO: 801873 - DNA, 22 bp, Artificial Sequence
  chemically synthesized
catgagagcaaagatttcatct

SEQ ID NO: 801874 - DNA, 22 bp, Artificial Sequence
  chemically synthesized
caatgcaaattccatgagagca

SEQ ID NO: 801875 - DNA, 22 bp, Artificial Sequence
  chemically synthesized
taactacaatgcaaattccatg

SEQ ID NO: 801876 - DNA, 22 bp, Artificial Sequence
  chemically synthesized
ggttgtaactacaatgcaaatt

SEQ ID NO: 801877 - DNA, 22 bp, Artificial Sequence
  chemically synthesized
tgctctcatggaatttgcattg

SEQ ID NO: 801878 - DNA, 22 bp, Artificial Sequence
  chemically synthesized
aggttgtaactacaatgcaaat

SEQ ID NO: 801879 - DNA, 22 bp, Artificial Sequence
  chemically synthesized
gctctcatggaatttgcattgt

SEQ ID NO: 801880 - DNA, 22 bp, Artificial Sequence
  chemically synthesized
ctctcatggaatttgcattgta

SEQ ID NO: 801881 - DNA, 22 bp, Artificial Sequence
  chemically synthesized
tcatggaatttgcattgtagtt

SEQ ID NO: 801882 - DNA, 22 bp, Artificial Sequence
  chemically synthesized
atggaatttgcattgtagttac

SEQ ID NO: 801883 - DNA, 22 bp, Artificial Sequence
  chemically synthesized
aaacatagcttaggttgtaact

SEQ ID NO: 801884 - DNA, 22 bp, Artificial Sequence
  chemically synthesized
ctaaaacatagcttaggttgta

SEQ ID NO: 801885 - DNA, 22 bp, Artificial Sequence
  chemically synthesized
cctaaaacatagcttaggttgt

SEQ ID NO: 801886 - DNA, 22 bp, Artificial Sequence
  chemically synthesized
gcattgtagttacaacctaagc

SEQ ID NO: 801887 - DNA, 22 bp, Artificial Sequence
  chemically synthesized
cattgtagttacaacctaagct

SEQ ID NO: 801888 - DNA, 22 bp, Artificial Sequence
  chemically synthesized
agcttcctaaaacatagcttag

SEQ ID NO: 801889 - DNA, 22 bp, Artificial Sequence
  chemically synthesized
tagttacaacctaagctatgtt

SEQ ID NO: 801890 - DNA, 22 bp, Artificial Sequence
  chemically synthesized
aattaagcttcctaaaacatag

SEQ ID NO: 801891 - DNA, 22 bp, Artificial Sequence
  chemically synthesized
aaattaagcttcctaaaacata

SEQ ID NO: 801892 - DNA, 22 bp, Artificial Sequence
  chemically synthesized
caacctaagctatgttttagga

SEQ ID NO: 801893 - DNA, 22 bp, Artificial Sequence
  chemically synthesized
catttaaattaagcttcctaaa

SEQ ID NO: 801894 - DNA, 22 bp, Artificial Sequence
  chemically synthesized
ccatttaaattaagcttcctaa

SEQ ID NO: 801895 - DNA, 22 bp, Artificial Sequence
  chemically synthesized
agctatgttttaggaagcttaa

SEQ ID NO: 801896 - DNA, 22 bp, Artificial Sequence
  chemically synthesized
cagatttccatttaaattaagc

SEQ ID NO: 801897 - DNA, 22 bp, Artificial Sequence
  chemically synthesized
tgttttaggaagcttaatttaa

SEQ ID NO: 801898 - DNA, 22 bp, Artificial Sequence
  chemically synthesized
gcagatttccatttaaattaag

SEQ ID NO: 801899 - DNA, 22 bp, Artificial Sequence
  chemically synthesized
taggaagcttaatttaaatgga

SEQ ID NO: 801900 - DNA, 22 bp, Artificial Sequence
  chemically synthesized
aggaagcttaatttaaatggaa

SEQ ID NO: 801901 - DNA, 22 bp, Artificial Sequence
  chemically synthesized
ggaagcttaatttaaatggaaa

SEQ ID NO: 801902 - DNA, 22 bp, Artificial Sequence
  chemically synthesized
caatccaacttgcagatttcca

SEQ ID NO: 801903 - DNA, 22 bp, Artificial Sequence
  chemically synthesized
aatttaaatggaaatctgcaag

SEQ ID NO: 801904 - DNA, 22 bp, Artificial Sequence
  chemically synthesized
atttaaatggaaatctgcaagt

SEQ ID NO: 801905 - DNA, 22 bp, Artificial Sequence
  chemically synthesized
aaatggaaatctgcaagttgga

SEQ ID NO: 801906 - DNA, 22 bp, Artificial Sequence
  chemically synthesized
aatggaaatctgcaagttggat

SEQ ID NO: 801907 - DNA, 22 bp, Artificial Sequence
  chemically synthesized
cccaccagtggctccaatccaa

SEQ ID NO: 801908 - DNA, 22 bp, Artificial Sequence
  chemically synthesized
ctgcccaccagtggctccaatc

SEQ ID NO: 801909 - DNA, 22 bp, Artificial Sequence
  chemically synthesized
attcctgcccaccagtggctcc

SEQ ID NO: 801910 - DNA, 22 bp, Artificial Sequence
  chemically synthesized
caagttggattggagccactgg

SEQ ID NO: 801911 - DNA, 22 bp, Artificial Sequence
  chemically synthesized
cactcattcctgcccaccagtg

SEQ ID NO: 801912 - DNA, 22 bp, Artificial Sequence
  chemically synthesized
gattggagccactggtgggcag

SEQ ID NO: 801913 - DNA, 22 bp, Artificial Sequence
  chemically synthesized
ctccactcattcctgcccacca

SEQ ID NO: 801914 - DNA, 22 bp, Artificial Sequence
  chemically synthesized
gagccactggtgggcaggaatg

SEQ ID NO: 801915 - DNA, 22 bp, Artificial Sequence
  chemically synthesized
ccctcctccactcattcctgcc

SEQ ID NO: 801916 - DNA, 22 bp, Artificial Sequence
  chemically synthesized
accctcctccactcattcctgc

SEQ ID NO: 801917 - DNA, 22 bp, Artificial Sequence
  chemically synthesized
taccctcctccactcattcctg

SEQ ID NO: 801918 - DNA, 22 bp, Artificial Sequence
  chemically synthesized
ttaccctcctccactcattcct

SEQ ID NO: 801919 - DNA, 22 bp, Artificial Sequence
  chemically synthesized
tttaccctcctccactcattcc

SEQ ID NO: 801920 - DNA, 22 bp, Artificial Sequence
  chemically synthesized
ttttttaccctcctccactcat

SEQ ID NO: 801921 - DNA, 22 bp, Artificial Sequence
  chemically synthesized
gtgggcaggaatgagtggagga

SEQ ID NO: 801922 - DNA, 22 bp, Artificial Sequence
  chemically synthesized
ctattttttaccctcctccact

SEQ ID NO: 801923 - DNA, 22 bp, Artificial Sequence
  chemically synthesized
actattttttaccctcctccac

SEQ ID NO: 801924 - DNA, 22 bp, Artificial Sequence
  chemically synthesized
ttactattttttaccctcctcc

SEQ ID NO: 801925 - DNA, 22 bp, Artificial Sequence
  chemically synthesized
acactcttactattttttaccc

SEQ ID NO: 801926 - DNA, 22 bp, Artificial Sequence
  chemically synthesized
attcacactcttactatttttt

SEQ ID NO: 801927 - DNA, 22 bp, Artificial Sequence
  chemically synthesized
tcattcacactcttactatttt

SEQ ID NO: 801928 - DNA, 22 bp, Artificial Sequence
  chemically synthesized
cactctcattcacactcttact

SEQ ID NO: 801929 - DNA, 22 bp, Artificial Sequence
  chemically synthesized
cctccactctcattcacactct

SEQ ID NO: 801930 - DNA, 22 bp, Artificial Sequence
  chemically synthesized
acctccactctcattcacactc

SEQ ID NO: 801931 - DNA, 22 bp, Artificial Sequence
  chemically synthesized
gccccttacctccactctcatt

SEQ ID NO: 801932 - DNA, 22 bp, Artificial Sequence
  chemically synthesized
actagccccttacctccactct

SEQ ID NO: 801933 - DNA, 22 bp, Artificial Sequence
  chemically synthesized
tcactagccccttacctccact

SEQ ID NO: 801934 - DNA, 22 bp, Artificial Sequence
  chemically synthesized
ctcactagccccttacctccac

SEQ ID NO: 801935 - DNA, 22 bp, Artificial Sequence
  chemically synthesized
tctcactagccccttacctcca

SEQ ID NO: 801936 - DNA, 22 bp, Artificial Sequence
  chemically synthesized
ctttctcactagccccttacct

SEQ ID NO: 801937 - DNA, 22 bp, Artificial Sequence
  chemically synthesized
tgaccattcctttctcactagc

SEQ ID NO: 801938 - DNA, 22 bp, Artificial Sequence
  chemically synthesized
atgaccattcctttctcactag

SEQ ID NO: 801939 - DNA, 22 bp, Artificial Sequence
  chemically synthesized
tatgaccattcctttctcacta

SEQ ID NO: 801940 - DNA, 22 bp, Artificial Sequence
  chemically synthesized
tttatgaccattcctttctcac

SEQ ID NO: 801941 - DNA, 22 bp, Artificial Sequence
  chemically synthesized
attctttatgaccattcctttc

SEQ ID NO: 801942 - DNA, 22 bp, Artificial Sequence
  chemically synthesized
cctaattctttatgaccattcc

SEQ ID NO: 801943 - DNA, 22 bp, Artificial Sequence
  chemically synthesized
gtgagaaaggaatggtcataaa

SEQ ID NO: 801944 - DNA, 22 bp, Artificial Sequence
  chemically synthesized
cctccctaattctttatgacca

SEQ ID NO: 801945 - DNA, 22 bp, Artificial Sequence
  chemically synthesized
tgcctccctaattctttatgac

SEQ ID NO: 801946 - DNA, 22 bp, Artificial Sequence
  chemically synthesized
tagattctgcctccctaattct

SEQ ID NO: 801947 - DNA, 22 bp, Artificial Sequence
  chemically synthesized
aggtctgtagattctgcctccc

SEQ ID NO: 801948 - DNA, 22 bp, Artificial Sequence
  chemically synthesized
aaggtctgtagattctgcctcc

SEQ ID NO: 801949 - DNA, 22 bp, Artificial Sequence
  chemically synthesized
taaggtctgtagattctgcctc

SEQ ID NO: 801950 - DNA, 22 bp, Artificial Sequence
  chemically synthesized
ttaaggtctgtagattctgcct

SEQ ID NO: 801951 - DNA, 22 bp, Artificial Sequence
  chemically synthesized
atttttaaggtctgtagattct

SEQ ID NO: 801952 - DNA, 22 bp, Artificial Sequence
  chemically synthesized
gggaggcagaatctacagacct

SEQ ID NO: 801953 - DNA, 22 bp, Artificial Sequence
  chemically synthesized
aagttcatttttaaggtctgta

SEQ ID NO: 801954 - DNA, 22 bp, Artificial Sequence
  chemically synthesized
caagttcatttttaaggtctgt

SEQ ID NO: 801955 - DNA, 22 bp, Artificial Sequence
  chemically synthesized
tcaagttcatttttaaggtctg

SEQ ID NO: 801956 - DNA, 22 bp, Artificial Sequence
  chemically synthesized
actttcaagttcatttttaagg

SEQ ID NO: 801957 - DNA, 22 bp, Artificial Sequence
  chemically synthesized
cctcactttcaagttcattttt

SEQ ID NO: 801958 - DNA, 22 bp, Artificial Sequence
  chemically synthesized
gcctcactttcaagttcatttt

SEQ ID NO: 801959 - DNA, 22 bp, Artificial Sequence
  chemically synthesized
cagaccttaaaaatgaacttga

SEQ ID NO: 801960 - DNA, 22 bp, Artificial Sequence
  chemically synthesized
cttgcctcactttcaagttcat

SEQ ID NO: 801961 - DNA, 22 bp, Artificial Sequence
  chemically synthesized
acttgcctcactttcaagttca

SEQ ID NO: 801962 - DNA, 22 bp, Artificial Sequence
  chemically synthesized
ccacttacttgcctcactttca

SEQ ID NO: 801963 - DNA, 22 bp, Artificial Sequence
  chemically synthesized
aaaaatgaacttgaaagtgagg

SEQ ID NO: 801964 - DNA, 22 bp, Artificial Sequence
  chemically synthesized
aaaatgaacttgaaagtgaggc

SEQ ID NO: 801965 - DNA, 22 bp, Artificial Sequence
  chemically synthesized
aatctcccacttacttgcctca

SEQ ID NO: 801966 - DNA, 22 bp, Artificial Sequence
  chemically synthesized
taaatctcccacttacttgcct

SEQ ID NO: 801967 - DNA, 22 bp, Artificial Sequence
  chemically synthesized
ctaaatctcccacttacttgcc

SEQ ID NO: 801968 - DNA, 22 bp, Artificial Sequence
  chemically synthesized
gaaagtgaggcaagtaagtggg

SEQ ID NO: 801969 - DNA, 22 bp, Artificial Sequence
  chemically synthesized
aaagtgaggcaagtaagtggga

SEQ ID NO: 801970 - DNA, 22 bp, Artificial Sequence
  chemically synthesized
agatcatatagtcatttctaaa

SEQ ID NO: 801971 - DNA, 22 bp, Artificial Sequence
  chemically synthesized
agtcagagagttcagatcatat

SEQ ID NO: 801972 - DNA, 22 bp, Artificial Sequence
  chemically synthesized
cagtcagagagttcagatcata

SEQ ID NO: 801973 - DNA, 22 bp, Artificial Sequence
  chemically synthesized
agaaatgactatatgatctgaa

SEQ ID NO: 801974 - DNA, 22 bp, Artificial Sequence
  chemically synthesized
tcagtcagagagttcagatcat

SEQ ID NO: 801975 - DNA, 22 bp, Artificial Sequence
  chemically synthesized
gaaatgactatatgatctgaac

SEQ ID NO: 801976 - DNA, 22 bp, Artificial Sequence
  chemically synthesized
ttcagtcagagagttcagatca

SEQ ID NO: 801977 - DNA, 22 bp, Artificial Sequence
  chemically synthesized
tatgatctgaactctctgactg

SEQ ID NO: 801978 - DNA, 22 bp, Artificial Sequence
  chemically synthesized
atcccggtaccatcttttcagt

SEQ ID NO: 801979 - DNA, 22 bp, Artificial Sequence
  chemically synthesized
aactctctgactgaaaagatgg

SEQ ID NO: 801980 - DNA, 22 bp, Artificial Sequence
  chemically synthesized
ttcatcccggtaccatcttttc

SEQ ID NO: 801981 - DNA, 22 bp, Artificial Sequence
  chemically synthesized
ctgttcatcccggtaccatctt

SEQ ID NO: 801982 - DNA, 22 bp, Artificial Sequence
  chemically synthesized
tctgactgaaaagatggtaccg

SEQ ID NO: 801983 - DNA, 22 bp, Artificial Sequence
  chemically synthesized
tgactgaaaagatggtaccggg

SEQ ID NO: 801984 - DNA, 22 bp, Artificial Sequence
  chemically synthesized
tcctgctgttcatcccggtacc

SEQ ID NO: 801985 - DNA, 22 bp, Artificial Sequence
  chemically synthesized
actgaaaagatggtaccgggat

SEQ ID NO: 801986 - DNA, 22 bp, Artificial Sequence
  chemically synthesized
ctatcctgctgttcatcccggt

SEQ ID NO: 801987 - DNA, 22 bp, Artificial Sequence
  chemically synthesized
cctatcctgctgttcatcccgg

SEQ ID NO: 801988 - DNA, 22 bp, Artificial Sequence
  chemically synthesized
aaaagatggtaccgggatgaac

SEQ ID NO: 801989 - DNA, 22 bp, Artificial Sequence
  chemically synthesized
tttcctatcctgctgttcatcc

SEQ ID NO: 801990 - DNA, 22 bp, Artificial Sequence
  chemically synthesized
atttcctatcctgctgttcatc

SEQ ID NO: 801991 - DNA, 22 bp, Artificial Sequence
  chemically synthesized
taccaagtcttatttcctatcc

SEQ ID NO: 801992 - DNA, 22 bp, Artificial Sequence
  chemically synthesized
ataccaagtcttatttcctatc

SEQ ID NO: 801993 - DNA, 22 bp, Artificial Sequence
  chemically synthesized
tataccaagtcttatttcctat

SEQ ID NO: 801994 - DNA, 22 bp, Artificial Sequence
  chemically synthesized
ttataccaagtcttatttccta

SEQ ID NO: 801995 - DNA, 22 bp, Artificial Sequence
  chemically synthesized
tttataccaagtcttatttcct

SEQ ID NO: 801996 - DNA, 22 bp, Artificial Sequence
  chemically synthesized
agtatgacccaaataggccatt

SEQ ID NO: 801997 - DNA, 22 bp, Artificial Sequence
  chemically synthesized
ggtataaaaaatggcctatttg

SEQ ID NO: 801998 - DNA, 22 bp, Artificial Sequence
  chemically synthesized
gtataaaaaatggcctatttgg

SEQ ID NO: 801999 - DNA, 22 bp, Artificial Sequence
  chemically synthesized
acaaatgacataaattcagtat

SEQ ID NO: 802000 - DNA, 22 bp, Artificial Sequence
  chemically synthesized
tttgggtcatactgaatttatg

SEQ ID NO: 802001 - DNA, 22 bp, Artificial Sequence
  chemically synthesized
gggtcatactgaatttatgtca

SEQ ID NO: 802002 - DNA, 22 bp, Artificial Sequence
  chemically synthesized
ggtcatactgaatttatgtcat

SEQ ID NO: 802003 - DNA, 22 bp, Artificial Sequence
  chemically synthesized
aaatgtctcacaaatgacataa

SEQ ID NO: 802004 - DNA, 22 bp, Artificial Sequence
  chemically synthesized
ctcaaatgtctcacaaatgaca

SEQ ID NO: 802005 - DNA, 22 bp, Artificial Sequence
  chemically synthesized
actcaaatgtctcacaaatgac

SEQ ID NO: 802006 - DNA, 22 bp, Artificial Sequence
  chemically synthesized
ttactcaaatgtctcacaaatg

SEQ ID NO: 802007 - DNA, 22 bp, Artificial Sequence
  chemically synthesized
cttactcaaatgtctcacaaat

SEQ ID NO: 802008 - DNA, 22 bp, Artificial Sequence
  chemically synthesized
aatttatgtcatttgtgagaca

SEQ ID NO: 802009 - DNA, 22 bp, Artificial Sequence
  chemically synthesized
atgtcatttgtgagacatttga

SEQ ID NO: 802010 - DNA, 22 bp, Artificial Sequence
  chemically synthesized
tgtcatttgtgagacatttgag

SEQ ID NO: 802011 - DNA, 22 bp, Artificial Sequence
  chemically synthesized
tatgtaggacatttcttactca

SEQ ID NO: 802012 - DNA, 22 bp, Artificial Sequence
  chemically synthesized
gtgagacatttgagtaagaaat

SEQ ID NO: 802013 - DNA, 22 bp, Artificial Sequence
  chemically synthesized
tgagacatttgagtaagaaatg

SEQ ID NO: 802014 - DNA, 22 bp, Artificial Sequence
  chemically synthesized
ctgtatgtaggacatttcttac

SEQ ID NO: 802015 - DNA, 22 bp, Artificial Sequence
  chemically synthesized
actgtatgtaggacatttctta

SEQ ID NO: 802016 - DNA, 22 bp, Artificial Sequence
  chemically synthesized
ttactgtatgtaggacatttct

SEQ ID NO: 802017 - DNA, 22 bp, Artificial Sequence
  chemically synthesized
cttactgtatgtaggacatttc

SEQ ID NO: 802018 - DNA, 22 bp, Artificial Sequence
  chemically synthesized
gagtaagaaatgtcctacatac

SEQ ID NO: 802019 - DNA, 22 bp, Artificial Sequence
  chemically synthesized
agtaagaaatgtcctacataca

SEQ ID NO: 802020 - DNA, 22 bp, Artificial Sequence
  chemically synthesized
tcccacatttcttactgtatgt

SEQ ID NO: 802021 - DNA, 22 bp, Artificial Sequence
  chemically synthesized
caatgtctgtcccacatttctt

SEQ ID NO: 802022 - DNA, 22 bp, Artificial Sequence
  chemically synthesized
ccaatgtctgtcccacatttct

SEQ ID NO: 802023 - DNA, 22 bp, Artificial Sequence
  chemically synthesized
tccaatgtctgtcccacatttc

SEQ ID NO: 802024 - DNA, 22 bp, Artificial Sequence
  chemically synthesized
catacagtaagaaatgtgggac

SEQ ID NO: 802025 - DNA, 22 bp, Artificial Sequence
  chemically synthesized
ctttccaatgtctgtcccacat

SEQ ID NO: 802026 - DNA, 22 bp, Artificial Sequence
  chemically synthesized
ttcctttccaatgtctgtccca

SEQ ID NO: 802027 - DNA, 22 bp, Artificial Sequence
  chemically synthesized
attcctttccaatgtctgtccc

SEQ ID NO: 802028 - DNA, 22 bp, Artificial Sequence
  chemically synthesized
tattcctttccaatgtctgtcc

SEQ ID NO: 802029 - DNA, 22 bp, Artificial Sequence
  chemically synthesized
ttattcctttccaatgtctgtc

SEQ ID NO: 802030 - DNA, 22 bp, Artificial Sequence
  chemically synthesized
aacatttttattcctttccaat

SEQ ID NO: 802031 - DNA, 22 bp, Artificial Sequence
  chemically synthesized
gaacatttttattcctttccaa

SEQ ID NO: 802032 - DNA, 22 bp, Artificial Sequence
  chemically synthesized
atccaatgatttgaacattttt

SEQ ID NO: 802033 - DNA, 22 bp, Artificial Sequence
  chemically synthesized
aatccaatgatttgaacatttt

SEQ ID NO: 802034 - DNA, 22 bp, Artificial Sequence
  chemically synthesized
taatccaatgatttgaacattt

SEQ ID NO: 802035 - DNA, 22 bp, Artificial Sequence
  chemically synthesized
gaaaggaataaaaatgttcaaa

SEQ ID NO: 802036 - DNA, 22 bp, Artificial Sequence
  chemically synthesized
ctttaatccaatgatttgaaca

SEQ ID NO: 802037 - DNA, 22 bp, Artificial Sequence
  chemically synthesized
catctcctttaatccaatgatt

SEQ ID NO: 802038 - DNA, 22 bp, Artificial Sequence
  chemically synthesized
tccatctcctttaatccaatga

SEQ ID NO: 802039 - DNA, 22 bp, Artificial Sequence
  chemically synthesized
ctccatctcctttaatccaatg

SEQ ID NO: 802040 - DNA, 22 bp, Artificial Sequence
  chemically synthesized
tctccatctcctttaatccaat

SEQ ID NO: 802041 - DNA, 22 bp, Artificial Sequence
  chemically synthesized
ttctccatctcctttaatccaa

SEQ ID NO: 802042 - DNA, 22 bp, Artificial Sequence
  chemically synthesized
aaatcattggattaaaggagat

SEQ ID NO: 802043 - DNA, 22 bp, Artificial Sequence
  chemically synthesized
gaaacagtcttttctccatctc

SEQ ID NO: 802044 - DNA, 22 bp, Artificial Sequence
  chemically synthesized
gattaaaggagatggagaaaag

SEQ ID NO: 802045 - DNA, 22 bp, Artificial Sequence
  chemically synthesized
tactagaaacagtcttttctcc

SEQ ID NO: 802046 - DNA, 22 bp, Artificial Sequence
  chemically synthesized
ttatactagaaacagtcttttc

SEQ ID NO: 802047 - DNA, 22 bp, Artificial Sequence
  chemically synthesized
aaggagatggagaaaagactgt

SEQ ID NO: 802048 - DNA, 22 bp, Artificial Sequence
  chemically synthesized
gttattatactagaaacagtct

SEQ ID NO: 802049 - DNA, 22 bp, Artificial Sequence
  chemically synthesized
tgtgttagttattatactagaa

SEQ ID NO: 802050 - DNA, 22 bp, Artificial Sequence
  chemically synthesized
tcagttatgtgttagttattat

SEQ ID NO: 802051 - DNA, 22 bp, Artificial Sequence
  chemically synthesized
ctgtcagttatgtgttagttat

SEQ ID NO: 802052 - DNA, 22 bp, Artificial Sequence
  chemically synthesized
tttctagtataataactaacac

SEQ ID NO: 802053 - DNA, 22 bp, Artificial Sequence
  chemically synthesized
ctagtataataactaacacata

SEQ ID NO: 802054 - DNA, 22 bp, Artificial Sequence
  chemically synthesized
tagtataataactaacacataa

SEQ ID NO: 802055 - DNA, 22 bp, Artificial Sequence
  chemically synthesized
gtataataactaacacataact

SEQ ID NO: 802056 - DNA, 22 bp, Artificial Sequence
  chemically synthesized
gtcaatagttactgtcagttat

SEQ ID NO: 802057 - DNA, 22 bp, Artificial Sequence
  chemically synthesized
agtcaatagttactgtcagtta

SEQ ID NO: 802058 - DNA, 22 bp, Artificial Sequence
  chemically synthesized
atatttagtcaatagttactgt

SEQ ID NO: 802059 - DNA, 22 bp, Artificial Sequence
  chemically synthesized
acacataactgacagtaactat

SEQ ID NO: 802060 - DNA, 22 bp, Artificial Sequence
  chemically synthesized
gatatttagtcaatagttactg

SEQ ID NO: 802061 - DNA, 22 bp, Artificial Sequence
  chemically synthesized
atttgatatttagtcaatagtt

SEQ ID NO: 802062 - DNA, 22 bp, Artificial Sequence
  chemically synthesized
catttgatatttagtcaatagt

SEQ ID NO: 802063 - DNA, 22 bp, Artificial Sequence
  chemically synthesized
tcttcatttgatatttagtcaa

SEQ ID NO: 802064 - DNA, 22 bp, Artificial Sequence
  chemically synthesized
acagtaactattgactaaatat

SEQ ID NO: 802065 - DNA, 22 bp, Artificial Sequence
  chemically synthesized
attatcttcatttgatatttag

SEQ ID NO: 802066 - DNA, 22 bp, Artificial Sequence
  chemically synthesized
atctcattatcttcatttgata

SEQ ID NO: 802067 - DNA, 22 bp, Artificial Sequence
  chemically synthesized
ttgactaaatatcaaatgaaga

SEQ ID NO: 802068 - DNA, 22 bp, Artificial Sequence
  chemically synthesized
attaatctcattatcttcattt

SEQ ID NO: 802069 - DNA, 22 bp, Artificial Sequence
  chemically synthesized
cattaatctcattatcttcatt

SEQ ID NO: 802070 - DNA, 22 bp, Artificial Sequence
  chemically synthesized
actaaatatcaaatgaagataa

SEQ ID NO: 802071 - DNA, 22 bp, Artificial Sequence
  chemically synthesized
atttcattaatctcattatctt

SEQ ID NO: 802072 - DNA, 22 bp, Artificial Sequence
  chemically synthesized
aatatcaaatgaagataatgag

SEQ ID NO: 802073 - DNA, 22 bp, Artificial Sequence
  chemically synthesized
tgatttcattaatctcattatc

SEQ ID NO: 802074 - DNA, 22 bp, Artificial Sequence
  chemically synthesized
ctgatttcattaatctcattat

SEQ ID NO: 802075 - DNA, 22 bp, Artificial Sequence
  chemically synthesized
tctgatttcattaatctcatta

SEQ ID NO: 802076 - DNA, 22 bp, Artificial Sequence
  chemically synthesized
ttctgatttcattaatctcatt

SEQ ID NO: 802077 - DNA, 22 bp, Artificial Sequence
  chemically synthesized
ttttctgatttcattaatctca

SEQ ID NO: 802078 - DNA, 22 bp, Artificial Sequence
  chemically synthesized
tgcattcttttctgatttcatt

SEQ ID NO: 802079 - DNA, 22 bp, Artificial Sequence
  chemically synthesized
tatgcattcttttctgatttca

SEQ ID NO: 802080 - DNA, 22 bp, Artificial Sequence
  chemically synthesized
atgaaatcagaaaagaatgcat

SEQ ID NO: 802081 - DNA, 22 bp, Artificial Sequence
  chemically synthesized
caggtgtgagccaccacaccaa

SEQ ID NO: 802082 - DNA, 22 bp, Artificial Sequence
  chemically synthesized
atactgtgggcttggtgtggtg

SEQ ID NO: 802083 - DNA, 22 bp, Artificial Sequence
  chemically synthesized
agattacaggtgtgagccacca

SEQ ID NO: 802084 - DNA, 22 bp, Artificial Sequence
  chemically synthesized
tgggcttggtgtggtggctcac

SEQ ID NO: 802085 - DNA, 22 bp, Artificial Sequence
  chemically synthesized
ggtgtggtggctcacacctgta

SEQ ID NO: 802086 - DNA, 22 bp, Artificial Sequence
  chemically synthesized
gtgtggtggctcacacctgtaa

SEQ ID NO: 802087 - DNA, 22 bp, Artificial Sequence
  chemically synthesized
ccaaaacgctgagattacaggt

SEQ ID NO: 802088 - DNA, 22 bp, Artificial Sequence
  chemically synthesized
acacctgtaatctcagcgtttt

SEQ ID NO: 802089 - DNA, 22 bp, Artificial Sequence
  chemically synthesized
taatctcagcgttttgggaggc

SEQ ID NO: 802090 - DNA, 22 bp, Artificial Sequence
  chemically synthesized
agcgttttgggaggccggggcg

SEQ ID NO: 802091 - DNA, 22 bp, Artificial Sequence
  chemically synthesized
aggtgatgcgcccgccccggcc

SEQ ID NO: 802092 - DNA, 22 bp, Artificial Sequence
  chemically synthesized
acctcaggtgatgcgcccgccc

SEQ ID NO: 802093 - DNA, 22 bp, Artificial Sequence
  chemically synthesized
tgggaggccggggcgggcgcat

SEQ ID NO: 802094 - DNA, 22 bp, Artificial Sequence
  chemically synthesized
gggaggccggggcgggcgcatc

SEQ ID NO: 802095 - DNA, 22 bp, Artificial Sequence
  chemically synthesized
ctgacctcaggtgatgcgcccg

SEQ ID NO: 802096 - DNA, 22 bp, Artificial Sequence
  chemically synthesized
ggaggccggggcgggcgcatca

SEQ ID NO: 802097 - DNA, 22 bp, Artificial Sequence
  chemically synthesized
gtcgcaaactcctgacctcagg

SEQ ID NO: 802098 - DNA, 22 bp, Artificial Sequence
  chemically synthesized
gccaggctggtcgcaaactcct

SEQ ID NO: 802099 - DNA, 22 bp, Artificial Sequence
  chemically synthesized
aggtcaggagtttgcgaccagc

SEQ ID NO: 802100 - DNA, 22 bp, Artificial Sequence
  chemically synthesized
accaggttggccaggctggtcg

SEQ ID NO: 802101 - DNA, 22 bp, Artificial Sequence
  chemically synthesized
caccaggttggccaggctggtc

SEQ ID NO: 802102 - DNA, 22 bp, Artificial Sequence
  chemically synthesized
gcgaccagcctggccaacctgg

SEQ ID NO: 802103 - DNA, 22 bp, Artificial Sequence
  chemically synthesized
cgaccagcctggccaacctggt

SEQ ID NO: 802104 - DNA, 22 bp, Artificial Sequence
  chemically synthesized
gtacagacagggtttcaccagg

SEQ ID NO: 802105 - DNA, 22 bp, Artificial Sequence
  chemically synthesized
agtacagacagggtttcaccag

SEQ ID NO: 802106 - DNA, 22 bp, Artificial Sequence
  chemically synthesized
tagtacagacagggtttcacca

SEQ ID NO: 802107 - DNA, 22 bp, Artificial Sequence
  chemically synthesized
ttagtacagacagggtttcacc

SEQ ID NO: 802108 - DNA, 22 bp, Artificial Sequence
  chemically synthesized
tttttagtacagacagggtttc

SEQ ID NO: 802109 - DNA, 22 bp, Artificial Sequence
  chemically synthesized
gccaacctggtgaaaccctgtc

SEQ ID NO: 802110 - DNA, 22 bp, Artificial Sequence
  chemically synthesized
atttttagtacagacagggttt

SEQ ID NO: 802111 - DNA, 22 bp, Artificial Sequence
  chemically synthesized
tatttttagtacagacagggtt

SEQ ID NO: 802112 - DNA, 22 bp, Artificial Sequence
  chemically synthesized
ttatttttagtacagacagggt

SEQ ID NO: 802113 - DNA, 22 bp, Artificial Sequence
  chemically synthesized
tttatttttagtacagacaggg

SEQ ID NO: 802114 - DNA, 22 bp, Artificial Sequence
  chemically synthesized
attttttatttttagtacagac

SEQ ID NO: 802115 - DNA, 22 bp, Artificial Sequence
  chemically synthesized
gtgaaaccctgtctgtactaaa

SEQ ID NO: 802116 - DNA, 22 bp, Artificial Sequence
  chemically synthesized
gctaattttttatttttagtac

SEQ ID NO: 802117 - DNA, 22 bp, Artificial Sequence
  chemically synthesized
tctgtactaaaaataaaaaatt

SEQ ID NO: 802118 - DNA, 22 bp, Artificial Sequence
  chemically synthesized
caccatgcctggctaatttttt

SEQ ID NO: 802119 - DNA, 22 bp, Artificial Sequence
  chemically synthesized
ccaccatgcctggctaattttt

SEQ ID NO: 802120 - DNA, 22 bp, Artificial Sequence
  chemically synthesized
tactaaaaataaaaaattagcc

SEQ ID NO: 802121 - DNA, 22 bp, Artificial Sequence
  chemically synthesized
aaaataaaaaattagccaggca

SEQ ID NO: 802122 - DNA, 22 bp, Artificial Sequence
  chemically synthesized
gaggcgccttccaccatgcctg

SEQ ID NO: 802123 - DNA, 22 bp, Artificial Sequence
  chemically synthesized
ggattagaggcgccttccacca

SEQ ID NO: 802124 - DNA, 22 bp, Artificial Sequence
  chemically synthesized
gccaggcatggtggaaggcgcc

SEQ ID NO: 802125 - DNA, 22 bp, Artificial Sequence
  chemically synthesized
ccaagtagctgggattagaggc

SEQ ID NO: 802126 - DNA, 22 bp, Artificial Sequence
  chemically synthesized
agcctcccaagtagctgggatt

SEQ ID NO: 802127 - DNA, 22 bp, Artificial Sequence
  chemically synthesized
cctcagcctcccaagtagctgg

SEQ ID NO: 802128 - DNA, 22 bp, Artificial Sequence
  chemically synthesized
ctgcctcagcctcccaagtagc

SEQ ID NO: 802129 - DNA, 22 bp, Artificial Sequence
  chemically synthesized
tcctgcctcagcctcccaagta

SEQ ID NO: 802130 - DNA, 22 bp, Artificial Sequence
  chemically synthesized
taatcccagctacttgggaggc

SEQ ID NO: 802131 - DNA, 22 bp, Artificial Sequence
  chemically synthesized
atcccagctacttgggaggctg

SEQ ID NO: 802132 - DNA, 22 bp, Artificial Sequence
  chemically synthesized
aagtgattctcctgcctcagcc

SEQ ID NO: 802133 - DNA, 22 bp, Artificial Sequence
  chemically synthesized
cttgggaggctgaggcaggaga

SEQ ID NO: 802134 - DNA, 22 bp, Artificial Sequence
  chemically synthesized
gggaggctgaggcaggagaatc

SEQ ID NO: 802135 - DNA, 22 bp, Artificial Sequence
  chemically synthesized
ccgggttcaagtgattctcctg

SEQ ID NO: 802136 - DNA, 22 bp, Artificial Sequence
  chemically synthesized
ggaggctgaggcaggagaatca

SEQ ID NO: 802137 - DNA, 22 bp, Artificial Sequence
  chemically synthesized
cacctcccgggttcaagtgatt

SEQ ID NO: 802138 - DNA, 22 bp, Artificial Sequence
  chemically synthesized
aggcaggagaatcacttgaacc

SEQ ID NO: 802139 - DNA, 22 bp, Artificial Sequence
  chemically synthesized
caacctccacctcccgggttca

SEQ ID NO: 802140 - DNA, 22 bp, Artificial Sequence
  chemically synthesized
actgcaacctccacctcccggg

SEQ ID NO: 802141 - DNA, 22 bp, Artificial Sequence
  chemically synthesized
gctcactgcaacctccacctcc

SEQ ID NO: 802142 - DNA, 22 bp, Artificial Sequence
  chemically synthesized
ggctcactgcaacctccacctc

SEQ ID NO: 802143 - DNA, 22 bp, Artificial Sequence
  chemically synthesized
gaacccgggaggtggaggttgc

SEQ ID NO: 802144 - DNA, 22 bp, Artificial Sequence
  chemically synthesized
aacccgggaggtggaggttgca

SEQ ID NO: 802145 - DNA, 22 bp, Artificial Sequence
  chemically synthesized
gagtgcaatggcgcaatcttgg

SEQ ID NO: 802146 - DNA, 22 bp, Artificial Sequence
  chemically synthesized
cagtgagccaagattgcgccat

SEQ ID NO: 802147 - DNA, 22 bp, Artificial Sequence
  chemically synthesized
tcccccaggctggagtgcaatg

SEQ ID NO: 802148 - DNA, 22 bp, Artificial Sequence
  chemically synthesized
gtcccccaggctggagtgcaat

SEQ ID NO: 802149 - DNA, 22 bp, Artificial Sequence
  chemically synthesized
ttgtcccccaggctggagtgca

SEQ ID NO: 802150 - DNA, 22 bp, Artificial Sequence
  chemically synthesized
gctcttgtcccccaggctggag

SEQ ID NO: 802151 - DNA, 22 bp, Artificial Sequence
  chemically synthesized
cgccattgcactccagcctggg

SEQ ID NO: 802152 - DNA, 22 bp, Artificial Sequence
  chemically synthesized
cactccagcctgggggacaaga

SEQ ID NO: 802153 - DNA, 22 bp, Artificial Sequence
  chemically synthesized
agacgaagtctcgctcttgtcc

SEQ ID NO: 802154 - DNA, 22 bp, Artificial Sequence
  chemically synthesized
gagacgaagtctcgctcttgtc

SEQ ID NO: 802155 - DNA, 22 bp, Artificial Sequence
  chemically synthesized
tgagacgaagtctcgctcttgt

SEQ ID NO: 802156 - DNA, 22 bp, Artificial Sequence
  chemically synthesized
cagcctgggggacaagagcgag

SEQ ID NO: 802157 - DNA, 22 bp, Artificial Sequence
  chemically synthesized
ttgagacgaagtctcgctcttg

SEQ ID NO: 802158 - DNA, 22 bp, Artificial Sequence
  chemically synthesized
tttgagacgaagtctcgctctt

SEQ ID NO: 802159 - DNA, 22 bp, Artificial Sequence
  chemically synthesized
ttttgagacgaagtctcgctct

SEQ ID NO: 802160 - DNA, 22 bp, Artificial Sequence
  chemically synthesized
tttttgagacgaagtctcgctc

SEQ ID NO: 802161 - DNA, 22 bp, Artificial Sequence
  chemically synthesized
ttttttgagacgaagtctcgct

SEQ ID NO: 802162 - DNA, 22 bp, Artificial Sequence
  chemically synthesized
tttttttgagacgaagtctcgc

SEQ ID NO: 802163 - DNA, 22 bp, Artificial Sequence
  chemically synthesized
ttttttttgagacgaagtctcg

SEQ ID NO: 802164 - DNA, 22 bp, Artificial Sequence
  chemically synthesized
ggggacaagagcgagacttcgt

SEQ ID NO: 802165 - DNA, 22 bp, Artificial Sequence
  chemically synthesized
tttttttttgagacgaagtctc

SEQ ID NO: 802166 - DNA, 22 bp, Artificial Sequence
  chemically synthesized
ttttttttttgagacgaagtct

SEQ ID NO: 802167 - DNA, 22 bp, Artificial Sequence
  chemically synthesized
tttttttttttgagacgaagtc

SEQ ID NO: 802168 - DNA, 22 bp, Artificial Sequence
  chemically synthesized
ttttttttttttgagacgaagt

SEQ ID NO: 802169 - DNA, 22 bp, Artificial Sequence
  chemically synthesized
tttttttttttttgagacgaag

SEQ ID NO: 802170 - DNA, 22 bp, Artificial Sequence
  chemically synthesized
ttttttttttttttgagacgaa

SEQ ID NO: 802171 - DNA, 22 bp, Artificial Sequence
  chemically synthesized
tttttttttttttttgagacga

SEQ ID NO: 802172 - DNA, 22 bp, Artificial Sequence
  chemically synthesized
ttttttttttttttttgagacg

SEQ ID NO: 802173 - DNA, 22 bp, Artificial Sequence
  chemically synthesized
tttttttttttttttttgagac

SEQ ID NO: 802174 - DNA, 22 bp, Artificial Sequence
  chemically synthesized
ttttttttttttttttttgaga

SEQ ID NO: 802175 - DNA, 22 bp, Artificial Sequence
  chemically synthesized
tttttttttttttttttttgag

SEQ ID NO: 802176 - DNA, 22 bp, Artificial Sequence
  chemically synthesized
ttttttttttttttttttttga

SEQ ID NO: 802177 - DNA, 22 bp, Artificial Sequence
  chemically synthesized
tttttttttttttttttttttg

SEQ ID NO: 802178 - DNA, 22 bp, Artificial Sequence
  chemically synthesized
tttttttttttttttttttttt

SEQ ID NO: 802179 - DNA, 22 bp, Artificial Sequence
  chemically synthesized
tttttttttttttttttttttt

SEQ ID NO: 802180 - DNA, 22 bp, Artificial Sequence
  chemically synthesized
tttttttttttttttttttttt

SEQ ID NO: 802181 - DNA, 22 bp, Artificial Sequence
  chemically synthesized
tttttttttttttttttttttt

SEQ ID NO: 802182 - DNA, 22 bp, Artificial Sequence
  chemically synthesized
cgtctcaaaaaaaaaaaaaaaa

SEQ ID NO: 802183 - DNA, 22 bp, Artificial Sequence
  chemically synthesized
gtctcaaaaaaaaaaaaaaaaa

SEQ ID NO: 802184 - DNA, 22 bp, Artificial Sequence
  chemically synthesized
actttttttttttttttttttt

SEQ ID NO: 802185 - DNA, 22 bp, Artificial Sequence
  chemically synthesized
gacttttttttttttttttttt

SEQ ID NO: 802186 - DNA, 22 bp, Artificial Sequence
  chemically synthesized
tgactttttttttttttttttt

SEQ ID NO: 802187 - DNA, 22 bp, Artificial Sequence
  chemically synthesized
ttgacttttttttttttttttt

SEQ ID NO: 802188 - DNA, 22 bp, Artificial Sequence
  chemically synthesized
tttgactttttttttttttttt

SEQ ID NO: 802189 - DNA, 22 bp, Artificial Sequence
  chemically synthesized
aaaaaaaaaaaaaaaaaaaaaa

SEQ ID NO: 802190 - DNA, 22 bp, Artificial Sequence
  chemically synthesized
gtattttttgactttttttttt

SEQ ID NO: 802191 - DNA, 22 bp, Artificial Sequence
  chemically synthesized
accagcatctggtattttttga

SEQ ID NO: 802192 - DNA, 22 bp, Artificial Sequence
  chemically synthesized
acaacctcaccagcatctggta

SEQ ID NO: 802193 - DNA, 22 bp, Artificial Sequence
  chemically synthesized
cacaacctcaccagcatctggt

SEQ ID NO: 802194 - DNA, 22 bp, Artificial Sequence
  chemically synthesized
ttcacaacctcaccagcatctg

SEQ ID NO: 802195 - DNA, 22 bp, Artificial Sequence
  chemically synthesized
cttcacaacctcaccagcatct

SEQ ID NO: 802196 - DNA, 22 bp, Artificial Sequence
  chemically synthesized
tcttcacaacctcaccagcatc

SEQ ID NO: 802197 - DNA, 22 bp, Artificial Sequence
  chemically synthesized
ccctttcttcacaacctcacca

SEQ ID NO: 802198 - DNA, 22 bp, Artificial Sequence
  chemically synthesized
gtgaggttgtgaagaaagggga

SEQ ID NO: 802199 - DNA, 22 bp, Artificial Sequence
  chemically synthesized
tgaagaaaggggaatgcttata

SEQ ID NO: 802200 - DNA, 22 bp, Artificial Sequence
  chemically synthesized
ccaccaacagggtataagcatt

SEQ ID NO: 802201 - DNA, 22 bp, Artificial Sequence
  chemically synthesized
cattcccaccaacagggtataa

SEQ ID NO: 802202 - DNA, 22 bp, Artificial Sequence
  chemically synthesized
acattcccaccaacagggtata

SEQ ID NO: 802203 - DNA, 22 bp, Artificial Sequence
  chemically synthesized
atttacattcccaccaacaggg

SEQ ID NO: 802204 - DNA, 22 bp, Artificial Sequence
  chemically synthesized
aactaatttacattcccaccaa

SEQ ID NO: 802205 - DNA, 22 bp, Artificial Sequence
  chemically synthesized
ataccctgttggtgggaatgta

SEQ ID NO: 802206 - DNA, 22 bp, Artificial Sequence
  chemically synthesized
taccctgttggtgggaatgtaa

SEQ ID NO: 802207 - DNA, 22 bp, Artificial Sequence
  chemically synthesized
cacagtggctgaactaatttac

SEQ ID NO: 802208 - DNA, 22 bp, Artificial Sequence
  chemically synthesized
ttggtgggaatgtaaattagtt

SEQ ID NO: 802209 - DNA, 22 bp, Artificial Sequence
  chemically synthesized
ccacagtggctgaactaattta

SEQ ID NO: 802210 - DNA, 22 bp, Artificial Sequence
  chemically synthesized
tccacagtggctgaactaattt

SEQ ID NO: 802211 - DNA, 22 bp, Artificial Sequence
  chemically synthesized
gtgggaatgtaaattagttcag

SEQ ID NO: 802212 - DNA, 22 bp, Artificial Sequence
  chemically synthesized
ctttccacagtggctgaactaa

SEQ ID NO: 802213 - DNA, 22 bp, Artificial Sequence
  chemically synthesized
caaactgctttccacagtggct

SEQ ID NO: 802214 - DNA, 22 bp, Artificial Sequence
  chemically synthesized
ccaaactgctttccacagtggc

SEQ ID NO: 802215 - DNA, 22 bp, Artificial Sequence
  chemically synthesized
gttcagccactgtggaaagcag

SEQ ID NO: 802216 - DNA, 22 bp, Artificial Sequence
  chemically synthesized
gaggtatttccaaactgctttc

SEQ ID NO: 802217 - DNA, 22 bp, Artificial Sequence
  chemically synthesized
agaggtatttccaaactgcttt

SEQ ID NO: 802218 - DNA, 22 bp, Artificial Sequence
  chemically synthesized
agccactgtggaaagcagtttg

SEQ ID NO: 802219 - DNA, 22 bp, Artificial Sequence
  chemically synthesized
ttagaggtatttccaaactgct

SEQ ID NO: 802220 - DNA, 22 bp, Artificial Sequence
  chemically synthesized
agttcttagaggtatttccaaa

SEQ ID NO: 802221 - DNA, 22 bp, Artificial Sequence
  chemically synthesized
gagttcttagaggtatttccaa

SEQ ID NO: 802222 - DNA, 22 bp, Artificial Sequence
  chemically synthesized
tggaaagcagtttggaaatacc

SEQ ID NO: 802223 - DNA, 22 bp, Artificial Sequence
  chemically synthesized
tgagttcttagaggtatttcca

SEQ ID NO: 802224 - DNA, 22 bp, Artificial Sequence
  chemically synthesized
agttttgagttcttagaggtat

SEQ ID NO: 802225 - DNA, 22 bp, Artificial Sequence
  chemically synthesized
ggaaatacctctaagaactcaa

SEQ ID NO: 802226 - DNA, 22 bp, Artificial Sequence
  chemically synthesized
gaaatacctctaagaactcaaa

SEQ ID NO: 802227 - DNA, 22 bp, Artificial Sequence
  chemically synthesized
aacggtagttcagttttgagtt

SEQ ID NO: 802228 - DNA, 22 bp, Artificial Sequence
  chemically synthesized
ggttgaacggtagttcagtttt

SEQ ID NO: 802229 - DNA, 22 bp, Artificial Sequence
  chemically synthesized
taagaactcaaaactgaactac

SEQ ID NO: 802230 - DNA, 22 bp, Artificial Sequence
  chemically synthesized
ctgggttgaacggtagttcagt

SEQ ID NO: 802231 - DNA, 22 bp, Artificial Sequence
  chemically synthesized
agaactcaaaactgaactaccg

SEQ ID NO: 802232 - DNA, 22 bp, Artificial Sequence
  chemically synthesized
aaaactgaactaccgttcaacc

SEQ ID NO: 802233 - DNA, 22 bp, Artificial Sequence
  chemically synthesized
aactaccgttcaacccagcaat

SEQ ID NO: 802234 - DNA, 22 bp, Artificial Sequence
  chemically synthesized
ccgttcaacccagcaatgccat

SEQ ID NO: 802235 - DNA, 22 bp, Artificial Sequence
  chemically synthesized
ggtatatacccagtaatggcat

SEQ ID NO: 802236 - DNA, 22 bp, Artificial Sequence
  chemically synthesized
gggtatatacccagtaatggca

SEQ ID NO: 802237 - DNA, 22 bp, Artificial Sequence
  chemically synthesized
tgggtatatacccagtaatggc

SEQ ID NO: 802238 - DNA, 22 bp, Artificial Sequence
  chemically synthesized
aacccagcaatgccattactgg

SEQ ID NO: 802239 - DNA, 22 bp, Artificial Sequence
  chemically synthesized
ctttgggtatatacccagtaat

SEQ ID NO: 802240 - DNA, 22 bp, Artificial Sequence
  chemically synthesized
tattcctttgggtatataccca

SEQ ID NO: 802241 - DNA, 22 bp, Artificial Sequence
  chemically synthesized
atattcctttgggtatataccc

SEQ ID NO: 802242 - DNA, 22 bp, Artificial Sequence
  chemically synthesized
ctgggtatatacccaaaggaat

SEQ ID NO: 802243 - DNA, 22 bp, Artificial Sequence
  chemically synthesized
ggtatatacccaaaggaatata

SEQ ID NO: 802244 - DNA, 22 bp, Artificial Sequence
  chemically synthesized
tggtagaatgatttatattcct

SEQ ID NO: 802245 - DNA, 22 bp, Artificial Sequence
  chemically synthesized
atggtagaatgatttatattcc

SEQ ID NO: 802246 - DNA, 22 bp, Artificial Sequence
  chemically synthesized
tatggtagaatgatttatattc

SEQ ID NO: 802247 - DNA, 22 bp, Artificial Sequence
  chemically synthesized
catgtgtctttatggtagaatg

SEQ ID NO: 802248 - DNA, 22 bp, Artificial Sequence
  chemically synthesized
taccataaagacacatgcagct

SEQ ID NO: 802249 - DNA, 22 bp, Artificial Sequence
  chemically synthesized
ccataaagacacatgcagctgt

SEQ ID NO: 802250 - DNA, 22 bp, Artificial Sequence
  chemically synthesized
ggaatagtgcagcaatgaacat

SEQ ID NO: 802251 - DNA, 22 bp, Artificial Sequence
  chemically synthesized
gtattgggaatagtgcagcaat

SEQ ID NO: 802252 - DNA, 22 bp, Artificial Sequence
  chemically synthesized
ggtattgggaatagtgcagcaa

SEQ ID NO: 802253 - DNA, 22 bp, Artificial Sequence
  chemically synthesized
tggtattgggaatagtgcagca

SEQ ID NO: 802254 - DNA, 22 bp, Artificial Sequence
  chemically synthesized
tatgttcattgctgcactattc

SEQ ID NO: 802255 - DNA, 22 bp, Artificial Sequence
  chemically synthesized
catgtctttggtattgggaata

SEQ ID NO: 802256 - DNA, 22 bp, Artificial Sequence
  chemically synthesized
attgctgcactattcccaatac

SEQ ID NO: 802257 - DNA, 22 bp, Artificial Sequence
  chemically synthesized
attccatgtctttggtattggg

SEQ ID NO: 802258 - DNA, 22 bp, Artificial Sequence
  chemically synthesized
ctgcactattcccaataccaaa

SEQ ID NO: 802259 - DNA, 22 bp, Artificial Sequence
  chemically synthesized
cactattcccaataccaaagac

SEQ ID NO: 802260 - DNA, 22 bp, Artificial Sequence
  chemically synthesized
ggttgattccatgtctttggta

SEQ ID NO: 802261 - DNA, 22 bp, Artificial Sequence
  chemically synthesized
aggttgattccatgtctttggt

SEQ ID NO: 802262 - DNA, 22 bp, Artificial Sequence
  chemically synthesized
ttcccaataccaaagacatgga

SEQ ID NO: 802263 - DNA, 22 bp, Artificial Sequence
  chemically synthesized
ccaataccaaagacatggaatc

SEQ ID NO: 802264 - DNA, 22 bp, Artificial Sequence
  chemically synthesized
atgggcatttaggttgattcca

SEQ ID NO: 802265 - DNA, 22 bp, Artificial Sequence
  chemically synthesized
ccattgatgggcatttaggttg

SEQ ID NO: 802266 - DNA, 22 bp, Artificial Sequence
  chemically synthesized
atctaccattgatgggcattta

SEQ ID NO: 802267 - DNA, 22 bp, Artificial Sequence
  chemically synthesized
tatctgatctaccattgatggg

SEQ ID NO: 802268 - DNA, 22 bp, Artificial Sequence
  chemically synthesized
tatatctgatctaccattgatg

SEQ ID NO: 802269 - DNA, 22 bp, Artificial Sequence
  chemically synthesized
ctatatctgatctaccattgat

SEQ ID NO: 802270 - DNA, 22 bp, Artificial Sequence
  chemically synthesized
tctatatctgatctaccattga

SEQ ID NO: 802271 - DNA, 22 bp, Artificial Sequence
  chemically synthesized
aatgcccatcaatggtagatca

SEQ ID NO: 802272 - DNA, 22 bp, Artificial Sequence
  chemically synthesized
gtgtatatgtaccacattttct

SEQ ID NO: 802273 - DNA, 22 bp, Artificial Sequence
  chemically synthesized
cctggtgtatatgtaccacatt

SEQ ID NO: 802274 - DNA, 22 bp, Artificial Sequence
  chemically synthesized
cacagtattccctggtgtatat

SEQ ID NO: 802275 - DNA, 22 bp, Artificial Sequence
  chemically synthesized
gctgcacagtattccctggtgt

SEQ ID NO: 802276 - DNA, 22 bp, Artificial Sequence
  chemically synthesized
tggctgcacagtattccctggt

SEQ ID NO: 802277 - DNA, 22 bp, Artificial Sequence
  chemically synthesized
ctggctgcacagtattccctgg

SEQ ID NO: 802278 - DNA, 22 bp, Artificial Sequence
  chemically synthesized
tctggctgcacagtattccctg

SEQ ID NO: 802279 - DNA, 22 bp, Artificial Sequence
  chemically synthesized
ttctggctgcacagtattccct

SEQ ID NO: 802280 - DNA, 22 bp, Artificial Sequence
  chemically synthesized
tttctggctgcacagtattccc

SEQ ID NO: 802281 - DNA, 22 bp, Artificial Sequence
  chemically synthesized
ttttctggctgcacagtattcc

SEQ ID NO: 802282 - DNA, 22 bp, Artificial Sequence
  chemically synthesized
ttttttctggctgcacagtatt

SEQ ID NO: 802283 - DNA, 22 bp, Artificial Sequence
  chemically synthesized
attcttttttctggctgcacag

SEQ ID NO: 802284 - DNA, 22 bp, Artificial Sequence
  chemically synthesized
tgcagccagaaaaaagaatgag

SEQ ID NO: 802285 - DNA, 22 bp, Artificial Sequence
  chemically synthesized
caaagaacataatctcattctt

SEQ ID NO: 802286 - DNA, 22 bp, Artificial Sequence
  chemically synthesized
ctgcaaagaacataatctcatt

SEQ ID NO: 802287 - DNA, 22 bp, Artificial Sequence
  chemically synthesized
catccatgttgctgcaaagaac

SEQ ID NO: 802288 - DNA, 22 bp, Artificial Sequence
  chemically synthesized
cagctccatccatgttgctgca

SEQ ID NO: 802289 - DNA, 22 bp, Artificial Sequence
  chemically synthesized
tgttctttgcagcaacatggat

SEQ ID NO: 802290 - DNA, 22 bp, Artificial Sequence
  chemically synthesized
tttgcagcaacatggatggagc

SEQ ID NO: 802291 - DNA, 22 bp, Artificial Sequence
  chemically synthesized
tgcagcaacatggatggagctg

SEQ ID NO: 802292 - DNA, 22 bp, Artificial Sequence
  chemically synthesized
gcagcaacatggatggagctgg

SEQ ID NO: 802293 - DNA, 22 bp, Artificial Sequence
  chemically synthesized
ggataatggcctccagctccat

SEQ ID NO: 802294 - DNA, 22 bp, Artificial Sequence
  chemically synthesized
cagcaacatggatggagctgga

SEQ ID NO: 802295 - DNA, 22 bp, Artificial Sequence
  chemically synthesized
acctaggataatggcctccagc

SEQ ID NO: 802296 - DNA, 22 bp, Artificial Sequence
  chemically synthesized
cacctaggataatggcctccag

SEQ ID NO: 802297 - DNA, 22 bp, Artificial Sequence
  chemically synthesized
tttcacctaggataatggcctc

SEQ ID NO: 802298 - DNA, 22 bp, Artificial Sequence
  chemically synthesized
tgttatttcacctaggataatg

SEQ ID NO: 802299 - DNA, 22 bp, Artificial Sequence
  chemically synthesized
ctatgttatttcacctaggata

SEQ ID NO: 802300 - DNA, 22 bp, Artificial Sequence
  chemically synthesized
ttcctatgttatttcacctagg

SEQ ID NO: 802301 - DNA, 22 bp, Artificial Sequence
  chemically synthesized
gaggccattatcctaggtgaaa

SEQ ID NO: 802302 - DNA, 22 bp, Artificial Sequence
  chemically synthesized
tgttcctatgttatttcaccta

SEQ ID NO: 802303 - DNA, 22 bp, Artificial Sequence
  chemically synthesized
ctgttcctatgttatttcacct

SEQ ID NO: 802304 - DNA, 22 bp, Artificial Sequence
  chemically synthesized
tctgttcctatgttatttcacc

SEQ ID NO: 802305 - DNA, 22 bp, Artificial Sequence
  chemically synthesized
gttttctgttcctatgttattt

SEQ ID NO: 802306 - DNA, 22 bp, Artificial Sequence
  chemically synthesized
ggttttctgttcctatgttatt

SEQ ID NO: 802307 - DNA, 22 bp, Artificial Sequence
  chemically synthesized
tcctaggtgaaataacatagga

SEQ ID NO: 802308 - DNA, 22 bp, Artificial Sequence
  chemically synthesized
ggtgaaataacataggaacaga

SEQ ID NO: 802309 - DNA, 22 bp, Artificial Sequence
  chemically synthesized
taagtgagaatatatggtattt

SEQ ID NO: 802310 - DNA, 22 bp, Artificial Sequence
  chemically synthesized
ataagtgagaatatatggtatt

SEQ ID NO: 802311 - DNA, 22 bp, Artificial Sequence
  chemically synthesized
cacttataagtgagaatatatg

SEQ ID NO: 802312 - DNA, 22 bp, Artificial Sequence
  chemically synthesized
gctccacttataagtgagaata

SEQ ID NO: 802313 - DNA, 22 bp, Artificial Sequence
  chemically synthesized
agctccacttataagtgagaat

SEQ ID NO: 802314 - DNA, 22 bp, Artificial Sequence
  chemically synthesized
agtgtttagctccacttataag

SEQ ID NO: 802315 - DNA, 22 bp, Artificial Sequence
  chemically synthesized
tcacttataagtggagctaaac

SEQ ID NO: 802316 - DNA, 22 bp, Artificial Sequence
  chemically synthesized
atatgtactcagtgtttagctc

SEQ ID NO: 802317 - DNA, 22 bp, Artificial Sequence
  chemically synthesized
acttataagtggagctaaacac

SEQ ID NO: 802318 - DNA, 22 bp, Artificial Sequence
  chemically synthesized
ataagtggagctaaacactgag

SEQ ID NO: 802319 - DNA, 22 bp, Artificial Sequence
  chemically synthesized
tgttcatatgtactcagtgttt

SEQ ID NO: 802320 - DNA, 22 bp, Artificial Sequence
  chemically synthesized
taagtggagctaaacactgagt

SEQ ID NO: 802321 - DNA, 22 bp, Artificial Sequence
  chemically synthesized
gtgttcatatgtactcagtgtt

SEQ ID NO: 802322 - DNA, 22 bp, Artificial Sequence
  chemically synthesized
tgtgttcatatgtactcagtgt

SEQ ID NO: 802323 - DNA, 22 bp, Artificial Sequence
  chemically synthesized
tttgtgttcatatgtactcagt

SEQ ID NO: 802324 - DNA, 22 bp, Artificial Sequence
  chemically synthesized
ctttgtgttcatatgtactcag

SEQ ID NO: 802325 - DNA, 22 bp, Artificial Sequence
  chemically synthesized
ccttctttgtgttcatatgtac

SEQ ID NO: 802326 - DNA, 22 bp, Artificial Sequence
  chemically synthesized
ttcccttctttgtgttcatatg

SEQ ID NO: 802327 - DNA, 22 bp, Artificial Sequence
  chemically synthesized
aacactgagtacatatgaacac

SEQ ID NO: 802328 - DNA, 22 bp, Artificial Sequence
  chemically synthesized
ttgttcccttctttgtgttcat

SEQ ID NO: 802329 - DNA, 22 bp, Artificial Sequence
  chemically synthesized
tgttgttcccttctttgtgttc

SEQ ID NO: 802330 - DNA, 22 bp, Artificial Sequence
  chemically synthesized
ctgttgttcccttctttgtgtt

SEQ ID NO: 802331 - DNA, 22 bp, Artificial Sequence
  chemically synthesized
agtacatatgaacacaaagaag

SEQ ID NO: 802332 - DNA, 22 bp, Artificial Sequence
  chemically synthesized
gtttctgttgttcccttctttg

SEQ ID NO: 802333 - DNA, 22 bp, Artificial Sequence
  chemically synthesized
gagtagatcctggtttctgttg

SEQ ID NO: 802334 - DNA, 22 bp, Artificial Sequence
  chemically synthesized
caccctagagtagatcctggtt

SEQ ID NO: 802335 - DNA, 22 bp, Artificial Sequence
  chemically synthesized
ccaccctccaccctagagtaga

SEQ ID NO: 802336 - DNA, 22 bp, Artificial Sequence
  chemically synthesized
accatcctcccaccctccaccc

SEQ ID NO: 802337 - DNA, 22 bp, Artificial Sequence
  chemically synthesized
caccatcctcccaccctccacc

SEQ ID NO: 802338 - DNA, 22 bp, Artificial Sequence
  chemically synthesized
ctctagggtggagggtgggagg

SEQ ID NO: 802339 - DNA, 22 bp, Artificial Sequence
  chemically synthesized
agtcttcaccatcctcccaccc

SEQ ID NO: 802340 - DNA, 22 bp, Artificial Sequence
  chemically synthesized
tcagtcttcaccatcctcccac

SEQ ID NO: 802341 - DNA, 22 bp, Artificial Sequence
  chemically synthesized
tagggtggagggtgggaggatg

SEQ ID NO: 802342 - DNA, 22 bp, Artificial Sequence
  chemically synthesized
ctcagtcttcaccatcctccca

SEQ ID NO: 802343 - DNA, 22 bp, Artificial Sequence
  chemically synthesized
gggtggagggtgggaggatggt

SEQ ID NO: 802344 - DNA, 22 bp, Artificial Sequence
  chemically synthesized
ataggtagtttctcagtcttca

SEQ ID NO: 802345 - DNA, 22 bp, Artificial Sequence
  chemically synthesized
agaaactacctatcaggtacca

SEQ ID NO: 802346 - DNA, 22 bp, Artificial Sequence
  chemically synthesized
tcacccagataataagcatggt

SEQ ID NO: 802347 - DNA, 22 bp, Artificial Sequence
  chemically synthesized
gtcacccagataataagcatgg

SEQ ID NO: 802348 - DNA, 22 bp, Artificial Sequence
  chemically synthesized
cctatcaggtaccatgcttatt

SEQ ID NO: 802349 - DNA, 22 bp, Artificial Sequence
  chemically synthesized
tgtcacccagataataagcatg

SEQ ID NO: 802350 - DNA, 22 bp, Artificial Sequence
  chemically synthesized
ttttgtcacccagataataagc

SEQ ID NO: 802351 - DNA, 22 bp, Artificial Sequence
  chemically synthesized
tcaggtaccatgcttattatct

SEQ ID NO: 802352 - DNA, 22 bp, Artificial Sequence
  chemically synthesized
gtgaacagattattttgtcacc

SEQ ID NO: 802353 - DNA, 22 bp, Artificial Sequence
  chemically synthesized
ggtgaacagattattttgtcac

SEQ ID NO: 802354 - DNA, 22 bp, Artificial Sequence
  chemically synthesized
attatctgggtgacaaaataat

SEQ ID NO: 802355 - DNA, 22 bp, Artificial Sequence
  chemically synthesized
ttatctgggtgacaaaataatc

SEQ ID NO: 802356 - DNA, 22 bp, Artificial Sequence
  chemically synthesized
tctgggtgacaaaataatctgt

SEQ ID NO: 802357 - DNA, 22 bp, Artificial Sequence
  chemically synthesized
ggtgacaaaataatctgttcac

SEQ ID NO: 802358 - DNA, 22 bp, Artificial Sequence
  chemically synthesized
catgtcatgggagtttggtgaa

SEQ ID NO: 802359 - DNA, 22 bp, Artificial Sequence
  chemically synthesized
ttcaccaaactcccatgacatg

SEQ ID NO: 802360 - DNA, 22 bp, Artificial Sequence
  chemically synthesized
catgggtaaattgcatgtcatg

SEQ ID NO: 802361 - DNA, 22 bp, Artificial Sequence
  chemically synthesized
accaaactcccatgacatgcaa

SEQ ID NO: 802362 - DNA, 22 bp, Artificial Sequence
  chemically synthesized
ttacatgggtaaattgcatgtc

SEQ ID NO: 802363 - DNA, 22 bp, Artificial Sequence
  chemically synthesized
gttacatgggtaaattgcatgt

SEQ ID NO: 802364 - DNA, 22 bp, Artificial Sequence
  chemically synthesized
ccatgacatgcaatttacccat

SEQ ID NO: 802365 - DNA, 22 bp, Artificial Sequence
  chemically synthesized
ggggcacatgtgcaggtttgtt

SEQ ID NO: 802366 - DNA, 22 bp, Artificial Sequence
  chemically synthesized
taggggcacatgtgcaggtttg

SEQ ID NO: 802367 - DNA, 22 bp, Artificial Sequence
  chemically synthesized
acccatgtaacaaacctgcaca

SEQ ID NO: 802368 - DNA, 22 bp, Artificial Sequence
  chemically synthesized
cccatgtaacaaacctgcacat

SEQ ID NO: 802369 - DNA, 22 bp, Artificial Sequence
  chemically synthesized
agctctaggggcacatgtgcag

SEQ ID NO: 802370 - DNA, 22 bp, Artificial Sequence
  chemically synthesized
aagctctaggggcacatgtgca

SEQ ID NO: 802371 - DNA, 22 bp, Artificial Sequence
  chemically synthesized
taagctctaggggcacatgtgc

SEQ ID NO: 802372 - DNA, 22 bp, Artificial Sequence
  chemically synthesized
ttttaagctctaggggcacatg

SEQ ID NO: 802373 - DNA, 22 bp, Artificial Sequence
  chemically synthesized
attttaagctctaggggcacat

SEQ ID NO: 802374 - DNA, 22 bp, Artificial Sequence
  chemically synthesized
tattttaagctctaggggcaca

SEQ ID NO: 802375 - DNA, 22 bp, Artificial Sequence
  chemically synthesized
ttattttaagctctaggggcac

SEQ ID NO: 802376 - DNA, 22 bp, Artificial Sequence
  chemically synthesized
acttttattttaagctctaggg

SEQ ID NO: 802377 - DNA, 22 bp, Artificial Sequence
  chemically synthesized
cacttttattttaagctctagg

SEQ ID NO: 802378 - DNA, 22 bp, Artificial Sequence
  chemically synthesized
tcacttttattttaagctctag

SEQ ID NO: 802379 - DNA, 22 bp, Artificial Sequence
  chemically synthesized
cacatgtgcccctagagcttaa

SEQ ID NO: 802380 - DNA, 22 bp, Artificial Sequence
  chemically synthesized
ttcacttttattttaagctcta

SEQ ID NO: 802381 - DNA, 22 bp, Artificial Sequence
  chemically synthesized
tttcacttttattttaagctct

SEQ ID NO: 802382 - DNA, 22 bp, Artificial Sequence
  chemically synthesized
ttttcacttttattttaagctc

SEQ ID NO: 802383 - DNA, 22 bp, Artificial Sequence
  chemically synthesized
tttttcacttttattttaagct

SEQ ID NO: 802384 - DNA, 22 bp, Artificial Sequence
  chemically synthesized
ttttttcacttttattttaagc

SEQ ID NO: 802385 - DNA, 22 bp, Artificial Sequence
  chemically synthesized
tttttttcacttttattttaag

SEQ ID NO: 802386 - DNA, 22 bp, Artificial Sequence
  chemically synthesized
ttttttttcacttttattttaa

SEQ ID NO: 802387 - DNA, 22 bp, Artificial Sequence
  chemically synthesized
tttttttttcacttttatttta

SEQ ID NO: 802388 - DNA, 22 bp, Artificial Sequence
  chemically synthesized
ttttttttttcacttttatttt

SEQ ID NO: 802389 - DNA, 22 bp, Artificial Sequence
  chemically synthesized
tttttttttttcacttttattt

SEQ ID NO: 802390 - DNA, 22 bp, Artificial Sequence
  chemically synthesized
tttttttttttttcacttttat

SEQ ID NO: 802391 - DNA, 22 bp, Artificial Sequence
  chemically synthesized
ctttttttttttttcactttta

SEQ ID NO: 802392 - DNA, 22 bp, Artificial Sequence
  chemically synthesized
gagcttaaaataaaagtgaaaa

SEQ ID NO: 802393 - DNA, 22 bp, Artificial Sequence
  chemically synthesized
ttctttttttttttttcacttt

SEQ ID NO: 802394 - DNA, 22 bp, Artificial Sequence
  chemically synthesized
cttctttttttttttttcactt

SEQ ID NO: 802395 - DNA, 22 bp, Artificial Sequence
  chemically synthesized
tcttctttttttttttttcact

SEQ ID NO: 802396 - DNA, 22 bp, Artificial Sequence
  chemically synthesized
tttcttctttttttttttttca

SEQ ID NO: 802397 - DNA, 22 bp, Artificial Sequence
  chemically synthesized
ctttcttctttttttttttttc

SEQ ID NO: 802398 - DNA, 22 bp, Artificial Sequence
  chemically synthesized
aaaataaaagtgaaaaaaaaaa

SEQ ID NO: 802399 - DNA, 22 bp, Artificial Sequence
  chemically synthesized
tctttcttcttttttttttttt

SEQ ID NO: 802400 - DNA, 22 bp, Artificial Sequence
  chemically synthesized
aaataaaagtgaaaaaaaaaaa

SEQ ID NO: 802401 - DNA, 22 bp, Artificial Sequence
  chemically synthesized
tttctttcttcttttttttttt

SEQ ID NO: 802402 - DNA, 22 bp, Artificial Sequence
  chemically synthesized
ctctttctttcttctttttttt

SEQ ID NO: 802403 - DNA, 22 bp, Artificial Sequence
  chemically synthesized
cctctttctttcttcttttttt

SEQ ID NO: 802404 - DNA, 22 bp, Artificial Sequence
  chemically synthesized
cttcctctttctttcttctttt

SEQ ID NO: 802405 - DNA, 22 bp, Artificial Sequence
  chemically synthesized
attccttcctctttctttcttc

SEQ ID NO: 802406 - DNA, 22 bp, Artificial Sequence
  chemically synthesized
agcactcattccttcctctttc

SEQ ID NO: 802407 - DNA, 22 bp, Artificial Sequence
  chemically synthesized
taagcactcattccttcctctt

SEQ ID NO: 802408 - DNA, 22 bp, Artificial Sequence
  chemically synthesized
tctaagcactcattccttcctc

SEQ ID NO: 802409 - DNA, 22 bp, Artificial Sequence
  chemically synthesized
tctctctaagcactcattcctt

SEQ ID NO: 802410 - DNA, 22 bp, Artificial Sequence
  chemically synthesized
gtctctctaagcactcattcct

SEQ ID NO: 802411 - DNA, 22 bp, Artificial Sequence
  chemically synthesized
cttgtctctctaagcactcatt

SEQ ID NO: 802412 - DNA, 22 bp, Artificial Sequence
  chemically synthesized
tctccttgtctctctaagcact

SEQ ID NO: 802413 - DNA, 22 bp, Artificial Sequence
  chemically synthesized
attgtctccttgtctctctaag

SEQ ID NO: 802414 - DNA, 22 bp, Artificial Sequence
  chemically synthesized
tactaattgtctccttgtctct

SEQ ID NO: 802415 - DNA, 22 bp, Artificial Sequence
  chemically synthesized
agagagacaaggagacaattag

SEQ ID NO: 802416 - DNA, 22 bp, Artificial Sequence
  chemically synthesized
gagagacaaggagacaattagt

SEQ ID NO: 802417 - DNA, 22 bp, Artificial Sequence
  chemically synthesized
ccagggtgatatattatactaa

SEQ ID NO: 802418 - DNA, 22 bp, Artificial Sequence
  chemically synthesized
gccagggtgatatattatacta

SEQ ID NO: 802419 - DNA, 22 bp, Artificial Sequence
  chemically synthesized
acttgccagggtgatatattat

SEQ ID NO: 802420 - DNA, 22 bp, Artificial Sequence
  chemically synthesized
gacttgccagggtgatatatta

SEQ ID NO: 802421 - DNA, 22 bp, Artificial Sequence
  chemically synthesized
tgacttgccagggtgatatatt

SEQ ID NO: 802422 - DNA, 22 bp, Artificial Sequence
  chemically synthesized
ttgacttgccagggtgatatat

SEQ ID NO: 802423 - DNA, 22 bp, Artificial Sequence
  chemically synthesized
accttttgacttgccagggtga

SEQ ID NO: 802424 - DNA, 22 bp, Artificial Sequence
  chemically synthesized
gtataatatatcaccctggcaa

SEQ ID NO: 802425 - DNA, 22 bp, Artificial Sequence
  chemically synthesized
aaaaatgtctcaccttttgact

SEQ ID NO: 802426 - DNA, 22 bp, Artificial Sequence
  chemically synthesized
ctgaaaaatgtctcaccttttg

SEQ ID NO: 802427 - DNA, 22 bp, Artificial Sequence
  chemically synthesized
gcaagtcaaaaggtgagacatt

SEQ ID NO: 802428 - DNA, 22 bp, Artificial Sequence
  chemically synthesized
cagcctactgaaaaatgtctca

SEQ ID NO: 802429 - DNA, 22 bp, Artificial Sequence
  chemically synthesized
actacagcctactgaaaaatgt

SEQ ID NO: 802430 - DNA, 22 bp, Artificial Sequence
  chemically synthesized
ctcactacagcctactgaaaaa

SEQ ID NO: 802431 - DNA, 22 bp, Artificial Sequence
  chemically synthesized
ctgctcactacagcctactgaa

SEQ ID NO: 802432 - DNA, 22 bp, Artificial Sequence
  chemically synthesized
ttactgctcactacagcctact

SEQ ID NO: 802433 - DNA, 22 bp, Artificial Sequence
  chemically synthesized
ttattactgctcactacagcct

SEQ ID NO: 802434 - DNA, 22 bp, Artificial Sequence
  chemically synthesized
gttattactgctcactacagcc

SEQ ID NO: 802435 - DNA, 22 bp, Artificial Sequence
  chemically synthesized
tgttattactgctcactacagc

SEQ ID NO: 802436 - DNA, 22 bp, Artificial Sequence
  chemically synthesized
ttcagtaggctgtagtgagcag

SEQ ID NO: 802437 - DNA, 22 bp, Artificial Sequence
  chemically synthesized
tcagtaggctgtagtgagcagt

SEQ ID NO: 802438 - DNA, 22 bp, Artificial Sequence
  chemically synthesized
cagtaggctgtagtgagcagta

SEQ ID NO: 802439 - DNA, 22 bp, Artificial Sequence
  chemically synthesized
atattttgttattactgctcac

SEQ ID NO: 802440 - DNA, 22 bp, Artificial Sequence
  chemically synthesized
agtaggctgtagtgagcagtaa

SEQ ID NO: 802441 - DNA, 22 bp, Artificial Sequence
  chemically synthesized
ctcatattttgttattactgct

SEQ ID NO: 802442 - DNA, 22 bp, Artificial Sequence
  chemically synthesized
tagtgagcagtaataacaaaat

SEQ ID NO: 802443 - DNA, 22 bp, Artificial Sequence
  chemically synthesized
gaaatctactcatattttgtta

SEQ ID NO: 802444 - DNA, 22 bp, Artificial Sequence
  chemically synthesized
ccctagaaatctactcatattt

SEQ ID NO: 802445 - DNA, 22 bp, Artificial Sequence
  chemically synthesized
attgccctagaaatctactcat

SEQ ID NO: 802446 - DNA, 22 bp, Artificial Sequence
  chemically synthesized
tcaagtcctcattgccctagaa

SEQ ID NO: 802447 - DNA, 22 bp, Artificial Sequence
  chemically synthesized
atcaagtcctcattgccctaga

SEQ ID NO: 802448 - DNA, 22 bp, Artificial Sequence
  chemically synthesized
tatcaagtcctcattgccctag

SEQ ID NO: 802449 - DNA, 22 bp, Artificial Sequence
  chemically synthesized
ttatcaagtcctcattgcccta

SEQ ID NO: 802450 - DNA, 22 bp, Artificial Sequence
  chemically synthesized
ctagggcaatgaggacttgata

SEQ ID NO: 802451 - DNA, 22 bp, Artificial Sequence
  chemically synthesized
tagggcaatgaggacttgataa

SEQ ID NO: 802452 - DNA, 22 bp, Artificial Sequence
  chemically synthesized
gggcaatgaggacttgataaaa

SEQ ID NO: 802453 - DNA, 22 bp, Artificial Sequence
  chemically synthesized
ccaaatgcaaatatttttatca

SEQ ID NO: 802454 - DNA, 22 bp, Artificial Sequence
  chemically synthesized
gataaaaatatttgcatttggt

SEQ ID NO: 802455 - DNA, 22 bp, Artificial Sequence
  chemically synthesized
ataaaaatatttgcatttggta

SEQ ID NO: 802456 - DNA, 22 bp, Artificial Sequence
  chemically synthesized
tgaaatcaccataactaccaaa

SEQ ID NO: 802457 - DNA, 22 bp, Artificial Sequence
  chemically synthesized
tatgaaatcaccataactacca

SEQ ID NO: 802458 - DNA, 22 bp, Artificial Sequence
  chemically synthesized
tctatgaaatcaccataactac

SEQ ID NO: 802459 - DNA, 22 bp, Artificial Sequence
  chemically synthesized
ctctatgaaatcaccataacta

SEQ ID NO: 802460 - DNA, 22 bp, Artificial Sequence
  chemically synthesized
gcatttggtagttatggtgatt

SEQ ID NO: 802461 - DNA, 22 bp, Artificial Sequence
  chemically synthesized
catttggtagttatggtgattt

SEQ ID NO: 802462 - DNA, 22 bp, Artificial Sequence
  chemically synthesized
aaacacttctctatgaaatcac

SEQ ID NO: 802463 - DNA, 22 bp, Artificial Sequence
  chemically synthesized
ggtagttatggtgatttcatag

SEQ ID NO: 802464 - DNA, 22 bp, Artificial Sequence
  chemically synthesized
gtagttatggtgatttcataga

SEQ ID NO: 802465 - DNA, 22 bp, Artificial Sequence
  chemically synthesized
ccaactgaaacacttctctatg

SEQ ID NO: 802466 - DNA, 22 bp, Artificial Sequence
  chemically synthesized
tggtgatttcatagagaagtgt

SEQ ID NO: 802467 - DNA, 22 bp, Artificial Sequence
  chemically synthesized
cctcccaactgaaacacttctc

SEQ ID NO: 802468 - DNA, 22 bp, Artificial Sequence
  chemically synthesized
catctgcctcccaactgaaaca

SEQ ID NO: 802469 - DNA, 22 bp, Artificial Sequence
  chemically synthesized
catagagaagtgtttcagttgg

SEQ ID NO: 802470 - DNA, 22 bp, Artificial Sequence
  chemically synthesized
tacatctgcctcccaactgaaa

SEQ ID NO: 802471 - DNA, 22 bp, Artificial Sequence
  chemically synthesized
atagagaagtgtttcagttggg

SEQ ID NO: 802472 - DNA, 22 bp, Artificial Sequence
  chemically synthesized
ctacatctgcctcccaactgaa

SEQ ID NO: 802473 - DNA, 22 bp, Artificial Sequence
  chemically synthesized
aagtcaagtttctacatctgcc

SEQ ID NO: 802474 - DNA, 22 bp, Artificial Sequence
  chemically synthesized
aaagtcaagtttctacatctgc

SEQ ID NO: 802475 - DNA, 22 bp, Artificial Sequence
  chemically synthesized
taaagtcaagtttctacatctg

SEQ ID NO: 802476 - DNA, 22 bp, Artificial Sequence
  chemically synthesized
cagttgggaggcagatgtagaa

SEQ ID NO: 802477 - DNA, 22 bp, Artificial Sequence
  chemically synthesized
agttgggaggcagatgtagaaa

SEQ ID NO: 802478 - DNA, 22 bp, Artificial Sequence
  chemically synthesized
cattttaaagtcaagtttctac

SEQ ID NO: 802479 - DNA, 22 bp, Artificial Sequence
  chemically synthesized
acattttaaagtcaagtttcta

SEQ ID NO: 802480 - DNA, 22 bp, Artificial Sequence
  chemically synthesized
ggaggcagatgtagaaacttga

SEQ ID NO: 802481 - DNA, 22 bp, Artificial Sequence
  chemically synthesized
tacattttaaagtcaagtttct

SEQ ID NO: 802482 - DNA, 22 bp, Artificial Sequence
  chemically synthesized
ctttacattttaaagtcaagtt

SEQ ID NO: 802483 - DNA, 22 bp, Artificial Sequence
  chemically synthesized
cctttacattttaaagtcaagt

SEQ ID NO: 802484 - DNA, 22 bp, Artificial Sequence
  chemically synthesized
tcctttacattttaaagtcaag

SEQ ID NO: 802485 - DNA, 22 bp, Artificial Sequence
  chemically synthesized
aacatccatctttcctttacat

SEQ ID NO: 802486 - DNA, 22 bp, Artificial Sequence
  chemically synthesized
gactttaaaatgtaaaggaaag

SEQ ID NO: 802487 - DNA, 22 bp, Artificial Sequence
  chemically synthesized
ctaaacatccatctttccttta

SEQ ID NO: 802488 - DNA, 22 bp, Artificial Sequence
  chemically synthesized
actttaaaatgtaaaggaaaga

SEQ ID NO: 802489 - DNA, 22 bp, Artificial Sequence
  chemically synthesized
cctaaacatccatctttccttt

SEQ ID NO: 802490 - DNA, 22 bp, Artificial Sequence
  chemically synthesized
cttcctaaacatccatctttcc

SEQ ID NO: 802491 - DNA, 22 bp, Artificial Sequence
  chemically synthesized
taaaatgtaaaggaaagatgga

SEQ ID NO: 802492 - DNA, 22 bp, Artificial Sequence
  chemically synthesized
aaaatgtaaaggaaagatggat

SEQ ID NO: 802493 - DNA, 22 bp, Artificial Sequence
  chemically synthesized
tacttcctaaacatccatcttt

SEQ ID NO: 802494 - DNA, 22 bp, Artificial Sequence
  chemically synthesized
aaatgtaaaggaaagatggatg

SEQ ID NO: 802495 - DNA, 22 bp, Artificial Sequence
  chemically synthesized
ctacttcctaaacatccatctt

SEQ ID NO: 802496 - DNA, 22 bp, Artificial Sequence
  chemically synthesized
gtggaaatatttctacttccta

SEQ ID NO: 802497 - DNA, 22 bp, Artificial Sequence
  chemically synthesized
atagaaattagtggaaatattt

SEQ ID NO: 802498 - DNA, 22 bp, Artificial Sequence
  chemically synthesized
aggaagtagaaatatttccact

SEQ ID NO: 802499 - DNA, 22 bp, Artificial Sequence
  chemically synthesized
ggaagtagaaatatttccacta

SEQ ID NO: 802500 - DNA, 22 bp, Artificial Sequence
  chemically synthesized
atctaatagaaattagtggaaa

SEQ ID NO: 802501 - DNA, 22 bp, Artificial Sequence
  chemically synthesized
aaatcactcatctaatagaaat

SEQ ID NO: 802502 - DNA, 22 bp, Artificial Sequence
  chemically synthesized
caaatcactcatctaatagaaa

SEQ ID NO: 802503 - DNA, 22 bp, Artificial Sequence
  chemically synthesized
ccactaatttctattagatgag

SEQ ID NO: 802504 - DNA, 22 bp, Artificial Sequence
  chemically synthesized
cactaatttctattagatgagt

SEQ ID NO: 802505 - DNA, 22 bp, Artificial Sequence
  chemically synthesized
atttctattagatgagtgattt

SEQ ID NO: 802506 - DNA, 22 bp, Artificial Sequence
  chemically synthesized
ctattagatgagtgatttgaag

SEQ ID NO: 802507 - DNA, 22 bp, Artificial Sequence
  chemically synthesized
tattagatgagtgatttgaagc

SEQ ID NO: 802508 - DNA, 22 bp, Artificial Sequence
  chemically synthesized
ttagatgagtgatttgaagctt

SEQ ID NO: 802509 - DNA, 22 bp, Artificial Sequence
  chemically synthesized
gatgagtgatttgaagcttgct

SEQ ID NO: 802510 - DNA, 22 bp, Artificial Sequence
  chemically synthesized
gaagcttgcttttggtgatctt

SEQ ID NO: 802511 - DNA, 22 bp, Artificial Sequence
  chemically synthesized
aagcttgcttttggtgatcttg

SEQ ID NO: 802512 - DNA, 22 bp, Artificial Sequence
  chemically synthesized
cagggaaagacccaagatcacc

SEQ ID NO: 802513 - DNA, 22 bp, Artificial Sequence
  chemically synthesized
gcttttggtgatcttgggtctt

SEQ ID NO: 802514 - DNA, 22 bp, Artificial Sequence
  chemically synthesized
cttttggtgatcttgggtcttt

SEQ ID NO: 802515 - DNA, 22 bp, Artificial Sequence
  chemically synthesized
agcattacagggaaagacccaa

SEQ ID NO: 802516 - DNA, 22 bp, Artificial Sequence
  chemically synthesized
ttggtgatcttgggtctttccc

SEQ ID NO: 802517 - DNA, 22 bp, Artificial Sequence
  chemically synthesized
tggtgatcttgggtctttccct

SEQ ID NO: 802518 - DNA, 22 bp, Artificial Sequence
  chemically synthesized
actcagcattacagggaaagac

SEQ ID NO: 802519 - DNA, 22 bp, Artificial Sequence
  chemically synthesized
ggtgatcttgggtctttccctg

SEQ ID NO: 802520 - DNA, 22 bp, Artificial Sequence
  chemically synthesized
gtgatcttgggtctttccctgt

SEQ ID NO: 802521 - DNA, 22 bp, Artificial Sequence
  chemically synthesized
cattgactcagcattacaggga

SEQ ID NO: 802522 - DNA, 22 bp, Artificial Sequence
  chemically synthesized
tacattgactcagcattacagg

SEQ ID NO: 802523 - DNA, 22 bp, Artificial Sequence
  chemically synthesized
gggtctttccctgtaatgctga

SEQ ID NO: 802524 - DNA, 22 bp, Artificial Sequence
  chemically synthesized
ctctacattgactcagcattac

SEQ ID NO: 802525 - DNA, 22 bp, Artificial Sequence
  chemically synthesized
ggtctttccctgtaatgctgag

SEQ ID NO: 802526 - DNA, 22 bp, Artificial Sequence
  chemically synthesized
tccctgtaatgctgagtcaatg

SEQ ID NO: 802527 - DNA, 22 bp, Artificial Sequence
  chemically synthesized
cccattactctacattgactca

SEQ ID NO: 802528 - DNA, 22 bp, Artificial Sequence
  chemically synthesized
ccctgtaatgctgagtcaatgt

SEQ ID NO: 802529 - DNA, 22 bp, Artificial Sequence
  chemically synthesized
cctgtaatgctgagtcaatgta

SEQ ID NO: 802530 - DNA, 22 bp, Artificial Sequence
  chemically synthesized
tcctacccattactctacattg

SEQ ID NO: 802531 - DNA, 22 bp, Artificial Sequence
  chemically synthesized
taatgctgagtcaatgtagagt

SEQ ID NO: 802532 - DNA, 22 bp, Artificial Sequence
  chemically synthesized
ctgtcctacccattactctaca

SEQ ID NO: 802533 - DNA, 22 bp, Artificial Sequence
  chemically synthesized
tactgtcctacccattactcta

SEQ ID NO: 802534 - DNA, 22 bp, Artificial Sequence
  chemically synthesized
agtcaatgtagagtaatgggta

SEQ ID NO: 802535 - DNA, 22 bp, Artificial Sequence
  chemically synthesized
ccaactctactgtcctacccat

SEQ ID NO: 802536 - DNA, 22 bp, Artificial Sequence
  chemically synthesized
taccaactctactgtcctaccc

SEQ ID NO: 802537 - DNA, 22 bp, Artificial Sequence
  chemically synthesized
ctaccaactctactgtcctacc

SEQ ID NO: 802538 - DNA, 22 bp, Artificial Sequence
  chemically synthesized
atcttctaccaactctactgtc

SEQ ID NO: 802539 - DNA, 22 bp, Artificial Sequence
  chemically synthesized
tgatcttctaccaactctactg

SEQ ID NO: 802540 - DNA, 22 bp, Artificial Sequence
  chemically synthesized
ctgatcttctaccaactctact

SEQ ID NO: 802541 - DNA, 22 bp, Artificial Sequence
  chemically synthesized
tctgatcttctaccaactctac

SEQ ID NO: 802542 - DNA, 22 bp, Artificial Sequence
  chemically synthesized
actttctgatcttctaccaact

SEQ ID NO: 802543 - DNA, 22 bp, Artificial Sequence
  chemically synthesized
gactttctgatcttctaccaac

SEQ ID NO: 802544 - DNA, 22 bp, Artificial Sequence
  chemically synthesized
agtttgactttctgatcttcta

SEQ ID NO: 802545 - DNA, 22 bp, Artificial Sequence
  chemically synthesized
aacctaagtttgactttctgat

SEQ ID NO: 802546 - DNA, 22 bp, Artificial Sequence
  chemically synthesized
gaacctaagtttgactttctga

SEQ ID NO: 802547 - DNA, 22 bp, Artificial Sequence
  chemically synthesized
gtagaagatcagaaagtcaaac

SEQ ID NO: 802548 - DNA, 22 bp, Artificial Sequence
  chemically synthesized
aggttcaaatgctgacttttct

SEQ ID NO: 802549 - DNA, 22 bp, Artificial Sequence
  chemically synthesized
ggttcaaatgctgacttttcta

SEQ ID NO: 802550 - DNA, 22 bp, Artificial Sequence
  chemically synthesized
aacccgaatatatagaaaagtc

SEQ ID NO: 802551 - DNA, 22 bp, Artificial Sequence
  chemically synthesized
aaatgctgacttttctatatat

SEQ ID NO: 802552 - DNA, 22 bp, Artificial Sequence
  chemically synthesized
ggatgctcaacccgaatatata

SEQ ID NO: 802553 - DNA, 22 bp, Artificial Sequence
  chemically synthesized
gggatgctcaacccgaatatat

SEQ ID NO: 802554 - DNA, 22 bp, Artificial Sequence
  chemically synthesized
acttttctatatattcgggttg

SEQ ID NO: 802555 - DNA, 22 bp, Artificial Sequence
  chemically synthesized
agatttgggatgctcaacccga

SEQ ID NO: 802556 - DNA, 22 bp, Artificial Sequence
  chemically synthesized
cagatttgggatgctcaacccg

SEQ ID NO: 802557 - DNA, 22 bp, Artificial Sequence
  chemically synthesized
ttctatatattcgggttgagca

SEQ ID NO: 802558 - DNA, 22 bp, Artificial Sequence
  chemically synthesized
tcagatttgggatgctcaaccc

SEQ ID NO: 802559 - DNA, 22 bp, Artificial Sequence
  chemically synthesized
tctatatattcgggttgagcat

SEQ ID NO: 802560 - DNA, 22 bp, Artificial Sequence
  chemically synthesized
ctatatattcgggttgagcatc

SEQ ID NO: 802561 - DNA, 22 bp, Artificial Sequence
  chemically synthesized
tatatattcgggttgagcatcc

SEQ ID NO: 802562 - DNA, 22 bp, Artificial Sequence
  chemically synthesized
tatattcgggttgagcatccca

SEQ ID NO: 802563 - DNA, 22 bp, Artificial Sequence
  chemically synthesized
gattttcagatttgggatgctc

SEQ ID NO: 802564 - DNA, 22 bp, Artificial Sequence
  chemically synthesized
ggattttcagatttgggatgct

SEQ ID NO: 802565 - DNA, 22 bp, Artificial Sequence
  chemically synthesized
tggattttcagatttgggatgc

SEQ ID NO: 802566 - DNA, 22 bp, Artificial Sequence
  chemically synthesized
gggttgagcatcccaaatctga

SEQ ID NO: 802567 - DNA, 22 bp, Artificial Sequence
  chemically synthesized
gattttggattttcagatttgg

SEQ ID NO: 802568 - DNA, 22 bp, Artificial Sequence
  chemically synthesized
ggattttggattttcagatttg

SEQ ID NO: 802569 - DNA, 22 bp, Artificial Sequence
  chemically synthesized
tggattttggattttcagattt

SEQ ID NO: 802570 - DNA, 22 bp, Artificial Sequence
  chemically synthesized
ttggattttggattttcagatt

SEQ ID NO: 802571 - DNA, 22 bp, Artificial Sequence
  chemically synthesized
tttggattttggattttcagat

SEQ ID NO: 802572 - DNA, 22 bp, Artificial Sequence
  chemically synthesized
agcatcccaaatctgaaaatcc

SEQ ID NO: 802573 - DNA, 22 bp, Artificial Sequence
  chemically synthesized
gagttttttggattttggattt

SEQ ID NO: 802574 - DNA, 22 bp, Artificial Sequence
  chemically synthesized
agagttttttggattttggatt

SEQ ID NO: 802575 - DNA, 22 bp, Artificial Sequence
  chemically synthesized
tagagttttttggattttggat

SEQ ID NO: 802576 - DNA, 22 bp, Artificial Sequence
  chemically synthesized
ttagagttttttggattttgga

SEQ ID NO: 802577 - DNA, 22 bp, Artificial Sequence
  chemically synthesized
agcttttagagttttttggatt

SEQ ID NO: 802578 - DNA, 22 bp, Artificial Sequence
  chemically synthesized
cagcttttagagttttttggat

SEQ ID NO: 802579 - DNA, 22 bp, Artificial Sequence
  chemically synthesized
tcagcttttagagttttttgga

SEQ ID NO: 802580 - DNA, 22 bp, Artificial Sequence
  chemically synthesized
aaaatccaaaatccaaaaaact

SEQ ID NO: 802581 - DNA, 22 bp, Artificial Sequence
  chemically synthesized
aaaaattttcagcttttagagt

SEQ ID NO: 802582 - DNA, 22 bp, Artificial Sequence
  chemically synthesized
taaaagctgaaaatttttgagc

SEQ ID NO: 802583 - DNA, 22 bp, Artificial Sequence
  chemically synthesized
aaagctgaaaatttttgagcgc

SEQ ID NO: 802584 - DNA, 22 bp, Artificial Sequence
  chemically synthesized
agaatcatgtcggcgctcaaaa

SEQ ID NO: 802585 - DNA, 22 bp, Artificial Sequence
  chemically synthesized
gagaatcatgtcggcgctcaaa

SEQ ID NO: 802586 - DNA, 22 bp, Artificial Sequence
  chemically synthesized
tgagaatcatgtcggcgctcaa

SEQ ID NO: 802587 - DNA, 22 bp, Artificial Sequence
  chemically synthesized
ctttgagaatcatgtcggcgct

SEQ ID NO: 802588 - DNA, 22 bp, Artificial Sequence
  chemically synthesized
actttgagaatcatgtcggcgc

SEQ ID NO: 802589 - DNA, 22 bp, Artificial Sequence
  chemically synthesized
aaaatttttgagcgccgacatg

SEQ ID NO: 802590 - DNA, 22 bp, Artificial Sequence
  chemically synthesized
ttgagcgccgacatgattctca

SEQ ID NO: 802591 - DNA, 22 bp, Artificial Sequence
  chemically synthesized
tgagcgccgacatgattctcaa

SEQ ID NO: 802592 - DNA, 22 bp, Artificial Sequence
  chemically synthesized
gagcgccgacatgattctcaaa

SEQ ID NO: 802593 - DNA, 22 bp, Artificial Sequence
  chemically synthesized
agcgccgacatgattctcaaag

SEQ ID NO: 802594 - DNA, 22 bp, Artificial Sequence
  chemically synthesized
caatgagcatttactttgagaa

SEQ ID NO: 802595 - DNA, 22 bp, Artificial Sequence
  chemically synthesized
gaaatactccaatgagcattta

SEQ ID NO: 802596 - DNA, 22 bp, Artificial Sequence
  chemically synthesized
tcaaagtaaatgctcattggag

SEQ ID NO: 802597 - DNA, 22 bp, Artificial Sequence
  chemically synthesized
aaaattggaaatactccaatga

SEQ ID NO: 802598 - DNA, 22 bp, Artificial Sequence
  chemically synthesized
aaagtaaatgctcattggagta

SEQ ID NO: 802599 - DNA, 22 bp, Artificial Sequence
  chemically synthesized
attggagtatttccaattttga

SEQ ID NO: 802600 - DNA, 22 bp, Artificial Sequence
  chemically synthesized
gagtatttccaattttgaattt

SEQ ID NO: 802601 - DNA, 22 bp, Artificial Sequence
  chemically synthesized
agcatcccaaaccccaaaattc

SEQ ID NO: 802602 - DNA, 22 bp, Artificial Sequence
  chemically synthesized
ccaattttgaattttggggttt

SEQ ID NO: 802603 - DNA, 22 bp, Artificial Sequence
  chemically synthesized
caattttgaattttggggtttg

SEQ ID NO: 802604 - DNA, 22 bp, Artificial Sequence
  chemically synthesized
tgggttaagcatcccaaacccc

SEQ ID NO: 802605 - DNA, 22 bp, Artificial Sequence
  chemically synthesized
tgaattttggggtttgggatgc

SEQ ID NO: 802606 - DNA, 22 bp, Artificial Sequence
  chemically synthesized
gaattttggggtttgggatgct

SEQ ID NO: 802607 - DNA, 22 bp, Artificial Sequence
  chemically synthesized
aattttggggtttgggatgctt

SEQ ID NO: 802608 - DNA, 22 bp, Artificial Sequence
  chemically synthesized
taattatgggttaagcatccca

SEQ ID NO: 802609 - DNA, 22 bp, Artificial Sequence
  chemically synthesized
ataattatgggttaagcatccc

SEQ ID NO: 802610 - DNA, 22 bp, Artificial Sequence
  chemically synthesized
tataattatgggttaagcatcc

SEQ ID NO: 802611 - DNA, 22 bp, Artificial Sequence
  chemically synthesized
tggggtttgggatgcttaaccc

SEQ ID NO: 802612 - DNA, 22 bp, Artificial Sequence
  chemically synthesized
ctttataattatgggttaagca

SEQ ID NO: 802613 - DNA, 22 bp, Artificial Sequence
  chemically synthesized
ggggtttgggatgcttaaccca

SEQ ID NO: 802614 - DNA, 22 bp, Artificial Sequence
  chemically synthesized
gctttataattatgggttaagc

SEQ ID NO: 802615 - DNA, 22 bp, Artificial Sequence
  chemically synthesized
gggtttgggatgcttaacccat

SEQ ID NO: 802616 - DNA, 22 bp, Artificial Sequence
  chemically synthesized
cttgctttataattatgggtta

SEQ ID NO: 802617 - DNA, 22 bp, Artificial Sequence
  chemically synthesized
gggatgcttaacccataattat

SEQ ID NO: 802618 - DNA, 22 bp, Artificial Sequence
  chemically synthesized
ggatgcttaacccataattata

SEQ ID NO: 802619 - DNA, 22 bp, Artificial Sequence
  chemically synthesized
gattacttgctttataattatg

SEQ ID NO: 802620 - DNA, 22 bp, Artificial Sequence
  chemically synthesized
ggattacttgctttataattat

SEQ ID NO: 802621 - DNA, 22 bp, Artificial Sequence
  chemically synthesized
tggattacttgctttataatta

SEQ ID NO: 802622 - DNA, 22 bp, Artificial Sequence
  chemically synthesized
aacccataattataaagcaagt

SEQ ID NO: 802623 - DNA, 22 bp, Artificial Sequence
  chemically synthesized
agattttggattacttgcttta

SEQ ID NO: 802624 - DNA, 22 bp, Artificial Sequence
  chemically synthesized
acccataattataaagcaagta

SEQ ID NO: 802625 - DNA, 22 bp, Artificial Sequence
  chemically synthesized
cagattttggattacttgcttt

SEQ ID NO: 802626 - DNA, 22 bp, Artificial Sequence
  chemically synthesized
tcagattttggattacttgctt

SEQ ID NO: 802627 - DNA, 22 bp, Artificial Sequence
  chemically synthesized
ttcagattttggattacttgct

SEQ ID NO: 802628 - DNA, 22 bp, Artificial Sequence
  chemically synthesized
tttcagattttggattacttgc

SEQ ID NO: 802629 - DNA, 22 bp, Artificial Sequence
  chemically synthesized
agattttttcagattttggatt

SEQ ID NO: 802630 - DNA, 22 bp, Artificial Sequence
  chemically synthesized
cagattttttcagattttggat

SEQ ID NO: 802631 - DNA, 22 bp, Artificial Sequence
  chemically synthesized
taaagcaagtaatccaaaatct

SEQ ID NO: 802632 - DNA, 22 bp, Artificial Sequence
  chemically synthesized
gatttcagattttttcagattt

SEQ ID NO: 802633 - DNA, 22 bp, Artificial Sequence
  chemically synthesized
ggatttcagattttttcagatt

SEQ ID NO: 802634 - DNA, 22 bp, Artificial Sequence
  chemically synthesized
tggatttcagattttttcagat

SEQ ID NO: 802635 - DNA, 22 bp, Artificial Sequence
  chemically synthesized
ttggatttcagattttttcaga

SEQ ID NO: 802636 - DNA, 22 bp, Artificial Sequence
  chemically synthesized
tttggatttcagattttttcag

SEQ ID NO: 802637 - DNA, 22 bp, Artificial Sequence
  chemically synthesized
ttttggatttcagattttttca

SEQ ID NO: 802638 - DNA, 22 bp, Artificial Sequence
  chemically synthesized
tttttggatttcagattttttc

SEQ ID NO: 802639 - DNA, 22 bp, Artificial Sequence
  chemically synthesized
tttttttggatttcagattttt

SEQ ID NO: 802640 - DNA, 22 bp, Artificial Sequence
  chemically synthesized
attctttttttggatttcagat

SEQ ID NO: 802641 - DNA, 22 bp, Artificial Sequence
  chemically synthesized
tgattctttttttggatttcag

SEQ ID NO: 802642 - DNA, 22 bp, Artificial Sequence
  chemically synthesized
ctgattctttttttggatttca

SEQ ID NO: 802643 - DNA, 22 bp, Artificial Sequence
  chemically synthesized
tctgattctttttttggatttc

SEQ ID NO: 802644 - DNA, 22 bp, Artificial Sequence
  chemically synthesized
ttctgattctttttttggattt

SEQ ID NO: 802645 - DNA, 22 bp, Artificial Sequence
  chemically synthesized
tttctgattctttttttggatt

SEQ ID NO: 802646 - DNA, 22 bp, Artificial Sequence
  chemically synthesized
aaaaaatctgaaatccaaaaaa

SEQ ID NO: 802647 - DNA, 22 bp, Artificial Sequence
  chemically synthesized
ttttctgattctttttttggat

SEQ ID NO: 802648 - DNA, 22 bp, Artificial Sequence
  chemically synthesized
aaatccaaaaaaagaatcagaa

SEQ ID NO: 802649 - DNA, 22 bp, Artificial Sequence
  chemically synthesized
tggatatcaatttttttctgat

SEQ ID NO: 802650 - DNA, 22 bp, Artificial Sequence
  chemically synthesized
ggaccacaagtgttatggatat

SEQ ID NO: 802651 - DNA, 22 bp, Artificial Sequence
  chemically synthesized
gggaccacaagtgttatggata

SEQ ID NO: 802652 - DNA, 22 bp, Artificial Sequence
  chemically synthesized
atatccataacacttgtggtcc

SEQ ID NO: 802653 - DNA, 22 bp, Artificial Sequence
  chemically synthesized
tccaaaacacttgggaccacaa

SEQ ID NO: 802654 - DNA, 22 bp, Artificial Sequence
  chemically synthesized
atccaaaacacttgggaccaca

SEQ ID NO: 802655 - DNA, 22 bp, Artificial Sequence
  chemically synthesized
agtatcccttatccaaaacact

SEQ ID NO: 802656 - DNA, 22 bp, Artificial Sequence
  chemically synthesized
gtggtcccaagtgttttggata

SEQ ID NO: 802657 - DNA, 22 bp, Artificial Sequence
  chemically synthesized
tggtcccaagtgttttggataa

SEQ ID NO: 802658 - DNA, 22 bp, Artificial Sequence
  chemically synthesized
gttgagtatcccttatccaaaa

SEQ ID NO: 802659 - DNA, 22 bp, Artificial Sequence
  chemically synthesized
tggataagggatactcaaccag

SEQ ID NO: 802660 - DNA, 22 bp, Artificial Sequence
  chemically synthesized
ggataagggatactcaaccagt

SEQ ID NO: 802661 - DNA, 22 bp, Artificial Sequence
  chemically synthesized
gataagggatactcaaccagta

SEQ ID NO: 802662 - DNA, 22 bp, Artificial Sequence
  chemically synthesized
aggtaacacacaagtactggtt

SEQ ID NO: 802663 - DNA, 22 bp, Artificial Sequence
  chemically synthesized
ctaaggtaacacacaagtactg

SEQ ID NO: 802664 - DNA, 22 bp, Artificial Sequence
  chemically synthesized
tactaaggtaacacacaagtac

SEQ ID NO: 802665 - DNA, 22 bp, Artificial Sequence
  chemically synthesized
ctactaaggtaacacacaagta

SEQ ID NO: 802666 - DNA, 22 bp, Artificial Sequence
  chemically synthesized
aaccagtacttgtgtgttacct

SEQ ID NO: 802667 - DNA, 22 bp, Artificial Sequence
  chemically synthesized
ggtaacttctactaaggtaaca

SEQ ID NO: 802668 - DNA, 22 bp, Artificial Sequence
  chemically synthesized
agaggctgggtaacttctacta

SEQ ID NO: 802669 - DNA, 22 bp, Artificial Sequence
  chemically synthesized
gtgtgttaccttagtagaagtt

SEQ ID NO: 802670 - DNA, 22 bp, Artificial Sequence
  chemically synthesized
tgtgttaccttagtagaagtta

SEQ ID NO: 802671 - DNA, 22 bp, Artificial Sequence
  chemically synthesized
ccttagtagaagttacccagcc

SEQ ID NO: 802672 - DNA, 22 bp, Artificial Sequence
  chemically synthesized
agtagaagttacccagcctctc

SEQ ID NO: 802673 - DNA, 22 bp, Artificial Sequence
  chemically synthesized
gtagaagttacccagcctctca

SEQ ID NO: 802674 - DNA, 22 bp, Artificial Sequence
  chemically synthesized
gtacagaggaaaaactgagagg

SEQ ID NO: 802675 - DNA, 22 bp, Artificial Sequence
  chemically synthesized
agtacagaggaaaaactgagag

SEQ ID NO: 802676 - DNA, 22 bp, Artificial Sequence
  chemically synthesized
cccagcctctcagtttttcctc

SEQ ID NO: 802677 - DNA, 22 bp, Artificial Sequence
  chemically synthesized
tcagtttttcctctgtactaaa

SEQ ID NO: 802678 - DNA, 22 bp, Artificial Sequence
  chemically synthesized
agtttttcctctgtactaaata

SEQ ID NO: 802679 - DNA, 22 bp, Artificial Sequence
  chemically synthesized
ttcctctgtactaaatatacga

SEQ ID NO: 802680 - DNA, 22 bp, Artificial Sequence
  chemically synthesized
tcctctgtactaaatatacgat

SEQ ID NO: 802681 - DNA, 22 bp, Artificial Sequence
  chemically synthesized
cctctgtactaaatatacgatg

SEQ ID NO: 802682 - DNA, 22 bp, Artificial Sequence
  chemically synthesized
ctctgtactaaatatacgatgg

SEQ ID NO: 802683 - DNA, 22 bp, Artificial Sequence
  chemically synthesized
catgatgtaataccatcgtata

SEQ ID NO: 802684 - DNA, 22 bp, Artificial Sequence
  chemically synthesized
gcatgatgtaataccatcgtat

SEQ ID NO: 802685 - DNA, 22 bp, Artificial Sequence
  chemically synthesized
tgtactaaatatacgatggtat

SEQ ID NO: 802686 - DNA, 22 bp, Artificial Sequence
  chemically synthesized
cttgcatgatgtaataccatcg

SEQ ID NO: 802687 - DNA, 22 bp, Artificial Sequence
  chemically synthesized
tactaaatatacgatggtatta

SEQ ID NO: 802688 - DNA, 22 bp, Artificial Sequence
  chemically synthesized
gcttgcatgatgtaataccatc

SEQ ID NO: 802689 - DNA, 22 bp, Artificial Sequence
  chemically synthesized
tgcttgcatgatgtaataccat

SEQ ID NO: 802690 - DNA, 22 bp, Artificial Sequence
  chemically synthesized
aatatacgatggtattacatca

SEQ ID NO: 802691 - DNA, 22 bp, Artificial Sequence
  chemically synthesized
agtgctttgcttgcatgatgta

SEQ ID NO: 802692 - DNA, 22 bp, Artificial Sequence
  chemically synthesized
catcatgcaagcaaagcactta

SEQ ID NO: 802693 - DNA, 22 bp, Artificial Sequence
  chemically synthesized
tgtgccaaggtgtgtactaagt

SEQ ID NO: 802694 - DNA, 22 bp, Artificial Sequence
  chemically synthesized
ctatgtgccaaggtgtgtacta

SEQ ID NO: 802695 - DNA, 22 bp, Artificial Sequence
  chemically synthesized
aaatagttactatgtgccaagg

SEQ ID NO: 802696 - DNA, 22 bp, Artificial Sequence
  chemically synthesized
aaaatagttactatgtgccaag

SEQ ID NO: 802697 - DNA, 22 bp, Artificial Sequence
  chemically synthesized
taaaatagttactatgtgccaa

SEQ ID NO: 802698 - DNA, 22 bp, Artificial Sequence
  chemically synthesized
ttaaaatagttactatgtgcca

SEQ ID NO: 802699 - DNA, 22 bp, Artificial Sequence
  chemically synthesized
agtacacaccttggcacatagt

SEQ ID NO: 802700 - DNA, 22 bp, Artificial Sequence
  chemically synthesized
tttaaaatagttactatgtgcc

SEQ ID NO: 802701 - DNA, 22 bp, Artificial Sequence
  chemically synthesized
gtacacaccttggcacatagta

SEQ ID NO: 802702 - DNA, 22 bp, Artificial Sequence
  chemically synthesized
cctttttaaaatagttactatg

SEQ ID NO: 802703 - DNA, 22 bp, Artificial Sequence
  chemically synthesized
ggcacatagtaactattttaaa

SEQ ID NO: 802704 - DNA, 22 bp, Artificial Sequence
  chemically synthesized
gcacatagtaactattttaaaa

SEQ ID NO: 802705 - DNA, 22 bp, Artificial Sequence
  chemically synthesized
ttttaaaaaggtagctattatt

SEQ ID NO: 802706 - DNA, 22 bp, Artificial Sequence
  chemically synthesized
aggggggtaataataataatag

SEQ ID NO: 802707 - DNA, 22 bp, Artificial Sequence
  chemically synthesized
taaaaaggtagctattattatt

SEQ ID NO: 802708 - DNA, 22 bp, Artificial Sequence
  chemically synthesized
aaaaaggtagctattattatta

SEQ ID NO: 802709 - DNA, 22 bp, Artificial Sequence
  chemically synthesized
aaaaggtagctattattattat

SEQ ID NO: 802710 - DNA, 22 bp, Artificial Sequence
  chemically synthesized
ttaaggggggtaataataataa

SEQ ID NO: 802711 - DNA, 22 bp, Artificial Sequence
  chemically synthesized
aattattaaggggggtaataat

SEQ ID NO: 802712 - DNA, 22 bp, Artificial Sequence
  chemically synthesized
caattattaaggggggtaataa

SEQ ID NO: 802713 - DNA, 22 bp, Artificial Sequence
  chemically synthesized
tcaattattaaggggggtaata

SEQ ID NO: 802714 - DNA, 22 bp, Artificial Sequence
  chemically synthesized
ttcaattattaaggggggtaat

SEQ ID NO: 802715 - DNA, 22 bp, Artificial Sequence
  chemically synthesized
ttattattattaccccccttaa

SEQ ID NO: 802716 - DNA, 22 bp, Artificial Sequence
  chemically synthesized
ttattattaccccccttaataa

SEQ ID NO: 802717 - DNA, 22 bp, Artificial Sequence
  chemically synthesized
ttattaccccccttaataattg

SEQ ID NO: 802718 - DNA, 22 bp, Artificial Sequence
  chemically synthesized
ttaccccccttaataattgaaa

SEQ ID NO: 802719 - DNA, 22 bp, Artificial Sequence
  chemically synthesized
ccccccttaataattgaaaaat

SEQ ID NO: 802720 - DNA, 22 bp, Artificial Sequence
  chemically synthesized
aagtcatcatgtatttttcaat

SEQ ID NO: 802721 - DNA, 22 bp, Artificial Sequence
  chemically synthesized
ggattaaagtcatcatgtattt

SEQ ID NO: 802722 - DNA, 22 bp, Artificial Sequence
  chemically synthesized
aataattgaaaaatacatgatg

SEQ ID NO: 802723 - DNA, 22 bp, Artificial Sequence
  chemically synthesized
tgggattaaagtcatcatgtat

SEQ ID NO: 802724 - DNA, 22 bp, Artificial Sequence
  chemically synthesized
ataattgaaaaatacatgatga

SEQ ID NO: 802725 - DNA, 22 bp, Artificial Sequence
  chemically synthesized
ctgggattaaagtcatcatgta

SEQ ID NO: 802726 - DNA, 22 bp, Artificial Sequence
  chemically synthesized
tctgggattaaagtcatcatgt

SEQ ID NO: 802727 - DNA, 22 bp, Artificial Sequence
  chemically synthesized
ttctgggattaaagtcatcatg

SEQ ID NO: 802728 - DNA, 22 bp, Artificial Sequence
  chemically synthesized
cttttctgggattaaagtcatc

SEQ ID NO: 802729 - DNA, 22 bp, Artificial Sequence
  chemically synthesized
acttttctgggattaaagtcat

SEQ ID NO: 802730 - DNA, 22 bp, Artificial Sequence
  chemically synthesized
aaaaatacatgatgactttaat

SEQ ID NO: 802731 - DNA, 22 bp, Artificial Sequence
  chemically synthesized
tcacaataaatgtttacttttc

SEQ ID NO: 802732 - DNA, 22 bp, Artificial Sequence
  chemically synthesized
gtcacaataaatgtttactttt

SEQ ID NO: 802733 - DNA, 22 bp, Artificial Sequence
  chemically synthesized
taatcccagaaaagtaaacatt

SEQ ID NO: 802734 - DNA, 22 bp, Artificial Sequence
  chemically synthesized
aatcccagaaaagtaaacattt

SEQ ID NO: 802735 - DNA, 22 bp, Artificial Sequence
  chemically synthesized
atcccagaaaagtaaacattta

SEQ ID NO: 802736 - DNA, 22 bp, Artificial Sequence
  chemically synthesized
aaagcttgtcacaataaatgtt

SEQ ID NO: 802737 - DNA, 22 bp, Artificial Sequence
  chemically synthesized
tataaactaaaagcttgtcaca

SEQ ID NO: 802738 - DNA, 22 bp, Artificial Sequence
  chemically synthesized
attgtgacaagcttttagttta

SEQ ID NO: 802739 - DNA, 22 bp, Artificial Sequence
  chemically synthesized
ttgtgacaagcttttagtttat

SEQ ID NO: 802740 - DNA, 22 bp, Artificial Sequence
  chemically synthesized
ggagggcaattatataaactaa

SEQ ID NO: 802741 - DNA, 22 bp, Artificial Sequence
  chemically synthesized
tgacaagcttttagtttatata

SEQ ID NO: 802742 - DNA, 22 bp, Artificial Sequence
  chemically synthesized
ccagttaggagggcaattatat

SEQ ID NO: 802743 - DNA, 22 bp, Artificial Sequence
  chemically synthesized
ctcccagttaggagggcaatta

SEQ ID NO: 802744 - DNA, 22 bp, Artificial Sequence
  chemically synthesized
ttagtttatataattgccctcc

SEQ ID NO: 802745 - DNA, 22 bp, Artificial Sequence
  chemically synthesized
tagtttatataattgccctcct

SEQ ID NO: 802746 - DNA, 22 bp, Artificial Sequence
  chemically synthesized
ttactcccagttaggagggcaa

SEQ ID NO: 802747 - DNA, 22 bp, Artificial Sequence
  chemically synthesized
agtttatataattgccctccta

SEQ ID NO: 802748 - DNA, 22 bp, Artificial Sequence
  chemically synthesized
attactcccagttaggagggca

SEQ ID NO: 802749 - DNA, 22 bp, Artificial Sequence
  chemically synthesized
gtttatataattgccctcctaa

SEQ ID NO: 802750 - DNA, 22 bp, Artificial Sequence
  chemically synthesized
tattactcccagttaggagggc

SEQ ID NO: 802751 - DNA, 22 bp, Artificial Sequence
  chemically synthesized
atataattgccctcctaactgg

SEQ ID NO: 802752 - DNA, 22 bp, Artificial Sequence
  chemically synthesized
tataattgccctcctaactggg

SEQ ID NO: 802753 - DNA, 22 bp, Artificial Sequence
  chemically synthesized
aattttattactcccagttagg

SEQ ID NO: 802754 - DNA, 22 bp, Artificial Sequence
  chemically synthesized
ctaaattttattactcccagtt

SEQ ID NO: 802755 - DNA, 22 bp, Artificial Sequence
  chemically synthesized
ccctcctaactgggagtaataa

SEQ ID NO: 802756 - DNA, 22 bp, Artificial Sequence
  chemically synthesized
aaataactactaaattttatta

SEQ ID NO: 802757 - DNA, 22 bp, Artificial Sequence
  chemically synthesized
ctaactgggagtaataaaattt

SEQ ID NO: 802758 - DNA, 22 bp, Artificial Sequence
  chemically synthesized
ttaaaataactactaaatttta

SEQ ID NO: 802759 - DNA, 22 bp, Artificial Sequence
  chemically synthesized
actgggagtaataaaatttagt

SEQ ID NO: 802760 - DNA, 22 bp, Artificial Sequence
  chemically synthesized
gttaaaataactactaaatttt

SEQ ID NO: 802761 - DNA, 22 bp, Artificial Sequence
  chemically synthesized
cttgttaaaataactactaaat

SEQ ID NO: 802762 - DNA, 22 bp, Artificial Sequence
  chemically synthesized
ggagtaataaaatttagtagtt

SEQ ID NO: 802763 - DNA, 22 bp, Artificial Sequence
  chemically synthesized
ctacttgttaaaataactacta

SEQ ID NO: 802764 - DNA, 22 bp, Artificial Sequence
  chemically synthesized
ttgctacttgttaaaataacta

SEQ ID NO: 802765 - DNA, 22 bp, Artificial Sequence
  chemically synthesized
tctattgctacttgttaaaata

SEQ ID NO: 802766 - DNA, 22 bp, Artificial Sequence
  chemically synthesized
atctattgctacttgttaaaat

SEQ ID NO: 802767 - DNA, 22 bp, Artificial Sequence
  chemically synthesized
agtagttattttaacaagtagc

SEQ ID NO: 802768 - DNA, 22 bp, Artificial Sequence
  chemically synthesized
gtagttattttaacaagtagca

SEQ ID NO: 802769 - DNA, 22 bp, Artificial Sequence
  chemically synthesized
agtaatttatctattgctactt

SEQ ID NO: 802770 - DNA, 22 bp, Artificial Sequence
  chemically synthesized
ttttaacaagtagcaatagata

SEQ ID NO: 802771 - DNA, 22 bp, Artificial Sequence
  chemically synthesized
taacaagtagcaatagataaat

SEQ ID NO: 802772 - DNA, 22 bp, Artificial Sequence
  chemically synthesized
aacaagtagcaatagataaatt

SEQ ID NO: 802773 - DNA, 22 bp, Artificial Sequence
  chemically synthesized
gagaggttaagtaatttatcta

SEQ ID NO: 802774 - DNA, 22 bp, Artificial Sequence
  chemically synthesized
acaagtagcaatagataaatta

SEQ ID NO: 802775 - DNA, 22 bp, Artificial Sequence
  chemically synthesized
agaagaataaaattggagaggt

SEQ ID NO: 802776 - DNA, 22 bp, Artificial Sequence
  chemically synthesized
gagaagaataaaattggagagg

SEQ ID NO: 802777 - DNA, 22 bp, Artificial Sequence
  chemically synthesized
atttgagaagaataaaattgga

SEQ ID NO: 802778 - DNA, 22 bp, Artificial Sequence
  chemically synthesized
catttgagaagaataaaattgg

SEQ ID NO: 802779 - DNA, 22 bp, Artificial Sequence
  chemically synthesized
tcatttgagaagaataaaattg

SEQ ID NO: 802780 - DNA, 22 bp, Artificial Sequence
  chemically synthesized
cttaacctctccaattttattc

SEQ ID NO: 802781 - DNA, 22 bp, Artificial Sequence
  chemically synthesized
aacctctccaattttattcttc

SEQ ID NO: 802782 - DNA, 22 bp, Artificial Sequence
  chemically synthesized
acctctccaattttattcttct

SEQ ID NO: 802783 - DNA, 22 bp, Artificial Sequence
  chemically synthesized
cattttcatttgagaagaataa

SEQ ID NO: 802784 - DNA, 22 bp, Artificial Sequence
  chemically synthesized
ccattttcatttgagaagaata

SEQ ID NO: 802785 - DNA, 22 bp, Artificial Sequence
  chemically synthesized
tttccattttcatttgagaaga

SEQ ID NO: 802786 - DNA, 22 bp, Artificial Sequence
  chemically synthesized
tccaattttattcttctcaaat

SEQ ID NO: 802787 - DNA, 22 bp, Artificial Sequence
  chemically synthesized
caattttattcttctcaaatga

SEQ ID NO: 802788 - DNA, 22 bp, Artificial Sequence
  chemically synthesized
ttatttccattttcatttgaga

SEQ ID NO: 802789 - DNA, 22 bp, Artificial Sequence
  chemically synthesized
ctattatttccattttcatttg

SEQ ID NO: 802790 - DNA, 22 bp, Artificial Sequence
  chemically synthesized
tattcttctcaaatgaaaatgg

SEQ ID NO: 802791 - DNA, 22 bp, Artificial Sequence
  chemically synthesized
attcttctcaaatgaaaatgga

SEQ ID NO: 802792 - DNA, 22 bp, Artificial Sequence
  chemically synthesized
ttcttctcaaatgaaaatggaa

SEQ ID NO: 802793 - DNA, 22 bp, Artificial Sequence
  chemically synthesized
gtactcctattatttccatttt

SEQ ID NO: 802794 - DNA, 22 bp, Artificial Sequence
  chemically synthesized
ttctcaaatgaaaatggaaata

SEQ ID NO: 802795 - DNA, 22 bp, Artificial Sequence
  chemically synthesized
ctcaaatgaaaatggaaataat

SEQ ID NO: 802796 - DNA, 22 bp, Artificial Sequence
  chemically synthesized
tcaaatgaaaatggaaataata

SEQ ID NO: 802797 - DNA, 22 bp, Artificial Sequence
  chemically synthesized
aaatgaaaatggaaataatagg

SEQ ID NO: 802798 - DNA, 22 bp, Artificial Sequence
  chemically synthesized
tgatgttggtactcctattatt

SEQ ID NO: 802799 - DNA, 22 bp, Artificial Sequence
  chemically synthesized
gtgaaaacctgtgatgttggta

SEQ ID NO: 802800 - DNA, 22 bp, Artificial Sequence
  chemically synthesized
agtgaaaacctgtgatgttggt

SEQ ID NO: 802801 - DNA, 22 bp, Artificial Sequence
  chemically synthesized
atccttagtgaaaacctgtgat

SEQ ID NO: 802802 - DNA, 22 bp, Artificial Sequence
  chemically synthesized
gatccttagtgaaaacctgtga

SEQ ID NO: 802803 - DNA, 22 bp, Artificial Sequence
  chemically synthesized
atttgatccttagtgaaaacct

SEQ ID NO: 802804 - DNA, 22 bp, Artificial Sequence
  chemically synthesized
taatttgatccttagtgaaaac

SEQ ID NO: 802805 - DNA, 22 bp, Artificial Sequence
  chemically synthesized
ctaatttgatccttagtgaaaa

SEQ ID NO: 802806 - DNA, 22 bp, Artificial Sequence
  chemically synthesized
tctaatttgatccttagtgaaa

SEQ ID NO: 802807 - DNA, 22 bp, Artificial Sequence
  chemically synthesized
tcattttctaatttgatcctta

SEQ ID NO: 802808 - DNA, 22 bp, Artificial Sequence
  chemically synthesized
ctgtcattttctaatttgatcc

SEQ ID NO: 802809 - DNA, 22 bp, Artificial Sequence
  chemically synthesized
actgtcattttctaatttgatc

SEQ ID NO: 802810 - DNA, 22 bp, Artificial Sequence
  chemically synthesized
tactgtcattttctaatttgat

SEQ ID NO: 802811 - DNA, 22 bp, Artificial Sequence
  chemically synthesized
tcactaaggatcaaattagaaa

SEQ ID NO: 802812 - DNA, 22 bp, Artificial Sequence
  chemically synthesized
cactaaggatcaaattagaaaa

SEQ ID NO: 802813 - DNA, 22 bp, Artificial Sequence
  chemically synthesized
actaaggatcaaattagaaaat

SEQ ID NO: 802814 - DNA, 22 bp, Artificial Sequence
  chemically synthesized
aggatcaaattagaaaatgaca

SEQ ID NO: 802815 - DNA, 22 bp, Artificial Sequence
  chemically synthesized
gcaaagtatctttactgtcatt

SEQ ID NO: 802816 - DNA, 22 bp, Artificial Sequence
  chemically synthesized
ataattggcaaagtatctttac

SEQ ID NO: 802817 - DNA, 22 bp, Artificial Sequence
  chemically synthesized
cataattggcaaagtatcttta

SEQ ID NO: 802818 - DNA, 22 bp, Artificial Sequence
  chemically synthesized
gaaaatgacagtaaagatactt

SEQ ID NO: 802819 - DNA, 22 bp, Artificial Sequence
  chemically synthesized
tgtttcataattggcaaagtat

SEQ ID NO: 802820 - DNA, 22 bp, Artificial Sequence
  chemically synthesized
atgtttcataattggcaaagta

SEQ ID NO: 802821 - DNA, 22 bp, Artificial Sequence
  chemically synthesized
tatgtttcataattggcaaagt

SEQ ID NO: 802822 - DNA, 22 bp, Artificial Sequence
  chemically synthesized
aatattttatgtttcataattg

SEQ ID NO: 802823 - DNA, 22 bp, Artificial Sequence
  chemically synthesized
tgccaattatgaaacataaaat

SEQ ID NO: 802824 - DNA, 22 bp, Artificial Sequence
  chemically synthesized
gccaattatgaaacataaaata

SEQ ID NO: 802825 - DNA, 22 bp, Artificial Sequence
  chemically synthesized
ccaattatgaaacataaaatat

SEQ ID NO: 802826 - DNA, 22 bp, Artificial Sequence
  chemically synthesized
ataaagaataataactaaatat

SEQ ID NO: 802827 - DNA, 22 bp, Artificial Sequence
  chemically synthesized
tgaaacataaaatatttagtta

SEQ ID NO: 802828 - DNA, 22 bp, Artificial Sequence
  chemically synthesized
attaataaagaataataactaa

SEQ ID NO: 802829 - DNA, 22 bp, Artificial Sequence
  chemically synthesized
tattaattaataaagaataata

SEQ ID NO: 802830 - DNA, 22 bp, Artificial Sequence
  chemically synthesized
agttattattctttattaatta

SEQ ID NO: 802831 - DNA, 22 bp, Artificial Sequence
  chemically synthesized
gttattattctttattaattaa

SEQ ID NO: 802832 - DNA, 22 bp, Artificial Sequence
  chemically synthesized
ttattctttattaattaatata

SEQ ID NO: 802833 - DNA, 22 bp, Artificial Sequence
  chemically synthesized
ttctttattaattaatataact

SEQ ID NO: 802834 - DNA, 22 bp, Artificial Sequence
  chemically synthesized
tttattaattaatataactttg

SEQ ID NO: 802835 - DNA, 22 bp, Artificial Sequence
  chemically synthesized
aaagtcaatggatcaaagttat

SEQ ID NO: 802836 - DNA, 22 bp, Artificial Sequence
  chemically synthesized
tattaattaatataactttgat

SEQ ID NO: 802837 - DNA, 22 bp, Artificial Sequence
  chemically synthesized
aaaagtcaatggatcaaagtta

SEQ ID NO: 802838 - DNA, 22 bp, Artificial Sequence
  chemically synthesized
attaattaatataactttgatc

SEQ ID NO: 802839 - DNA, 22 bp, Artificial Sequence
  chemically synthesized
ttaattaatataactttgatcc

SEQ ID NO: 802840 - DNA, 22 bp, Artificial Sequence
  chemically synthesized
ttaaaagtcaatggatcaaagt

SEQ ID NO: 802841 - DNA, 22 bp, Artificial Sequence
  chemically synthesized
attaatataactttgatccatt

SEQ ID NO: 802842 - DNA, 22 bp, Artificial Sequence
  chemically synthesized
atataactttgatccattgact

SEQ ID NO: 802843 - DNA, 22 bp, Artificial Sequence
  chemically synthesized
ataggatgctcttaaaagtcaa

SEQ ID NO: 802844 - DNA, 22 bp, Artificial Sequence
  chemically synthesized
tgatccattgacttttaagagc

SEQ ID NO: 802845 - DNA, 22 bp, Artificial Sequence
  chemically synthesized
gatccattgacttttaagagca

SEQ ID NO: 802846 - DNA, 22 bp, Artificial Sequence
  chemically synthesized
atccattgacttttaagagcat

SEQ ID NO: 802847 - DNA, 22 bp, Artificial Sequence
  chemically synthesized
aagatgtaaatctaataggatg

SEQ ID NO: 802848 - DNA, 22 bp, Artificial Sequence
  chemically synthesized
acttttaagagcatcctattag

SEQ ID NO: 802849 - DNA, 22 bp, Artificial Sequence
  chemically synthesized
ttaagagcatcctattagattt

SEQ ID NO: 802850 - DNA, 22 bp, Artificial Sequence
  chemically synthesized
taagagcatcctattagattta

SEQ ID NO: 802851 - DNA, 22 bp, Artificial Sequence
  chemically synthesized
aagagcatcctattagatttac

SEQ ID NO: 802852 - DNA, 22 bp, Artificial Sequence
  chemically synthesized
agagcatcctattagatttaca

SEQ ID NO: 802853 - DNA, 22 bp, Artificial Sequence
  chemically synthesized
aacaaaagtcaaactgaagatg

SEQ ID NO: 802854 - DNA, 22 bp, Artificial Sequence
  chemically synthesized
ttagatttacatcttcagtttg

SEQ ID NO: 802855 - DNA, 22 bp, Artificial Sequence
  chemically synthesized
gatttacatcttcagtttgact

SEQ ID NO: 802856 - DNA, 22 bp, Artificial Sequence
  chemically synthesized
ccattaaacaaaagtcaaactg

SEQ ID NO: 802857 - DNA, 22 bp, Artificial Sequence
  chemically synthesized
acatcttcagtttgacttttgt

SEQ ID NO: 802858 - DNA, 22 bp, Artificial Sequence
  chemically synthesized
catcttcagtttgacttttgtt

SEQ ID NO: 802859 - DNA, 22 bp, Artificial Sequence
  chemically synthesized
tgaattaccattaaacaaaagt

SEQ ID NO: 802860 - DNA, 22 bp, Artificial Sequence
  chemically synthesized
atgaattaccattaaacaaaag

SEQ ID NO: 802861 - DNA, 22 bp, Artificial Sequence
  chemically synthesized
tatgaattaccattaaacaaaa

SEQ ID NO: 802862 - DNA, 22 bp, Artificial Sequence
  chemically synthesized
cagtttgacttttgtttaatgg

SEQ ID NO: 802863 - DNA, 22 bp, Artificial Sequence
  chemically synthesized
agtttgacttttgtttaatggt

SEQ ID NO: 802864 - DNA, 22 bp, Artificial Sequence
  chemically synthesized
attttatgaattaccattaaac

SEQ ID NO: 802865 - DNA, 22 bp, Artificial Sequence
  chemically synthesized
ttaattttatgaattaccatta

SEQ ID NO: 802866 - DNA, 22 bp, Artificial Sequence
  chemically synthesized
attaattttatgaattaccatt

SEQ ID NO: 802867 - DNA, 22 bp, Artificial Sequence
  chemically synthesized
gacttttgtttaatggtaattc

SEQ ID NO: 802868 - DNA, 22 bp, Artificial Sequence
  chemically synthesized
acttttgtttaatggtaattca

SEQ ID NO: 802869 - DNA, 22 bp, Artificial Sequence
  chemically synthesized
ttgtttaatggtaattcataaa

SEQ ID NO: 802870 - DNA, 22 bp, Artificial Sequence
  chemically synthesized
tgtttaatggtaattcataaaa

SEQ ID NO: 802871 - DNA, 22 bp, Artificial Sequence
  chemically synthesized
gtttaatggtaattcataaaat

SEQ ID NO: 802872 - DNA, 22 bp, Artificial Sequence
  chemically synthesized
tttaatggtaattcataaaatt

SEQ ID NO: 802873 - DNA, 22 bp, Artificial Sequence
  chemically synthesized
aatggtaattcataaaattaat

SEQ ID NO: 802874 - DNA, 22 bp, Artificial Sequence
  chemically synthesized
atggtaattcataaaattaata

SEQ ID NO: 802875 - DNA, 22 bp, Artificial Sequence
  chemically synthesized
aagtgaaaggtccttattaatt

SEQ ID NO: 802876 - DNA, 22 bp, Artificial Sequence
  chemically synthesized
caagtgaaaggtccttattaat

SEQ ID NO: 802877 - DNA, 22 bp, Artificial Sequence
  chemically synthesized
tcaagtgaaaggtccttattaa

SEQ ID NO: 802878 - DNA, 22 bp, Artificial Sequence
  chemically synthesized
ataaaattaataaggacctttc

SEQ ID NO: 802879 - DNA, 22 bp, Artificial Sequence
  chemically synthesized
aaaaagctttcaagtgaaaggt

SEQ ID NO: 802880 - DNA, 22 bp, Artificial Sequence
  chemically synthesized
gaaaaagctttcaagtgaaagg

SEQ ID NO: 802881 - DNA, 22 bp, Artificial Sequence
  chemically synthesized
tgaaaaagctttcaagtgaaag

SEQ ID NO: 802882 - DNA, 22 bp, Artificial Sequence
  chemically synthesized
ataaggacctttcacttgaaag

SEQ ID NO: 802883 - DNA, 22 bp, Artificial Sequence
  chemically synthesized
tcacttgaaagctttttcaaag

SEQ ID NO: 802884 - DNA, 22 bp, Artificial Sequence
  chemically synthesized
cacttgaaagctttttcaaagt

SEQ ID NO: 802885 - DNA, 22 bp, Artificial Sequence
  chemically synthesized
acttgaaagctttttcaaagtg

SEQ ID NO: 802886 - DNA, 22 bp, Artificial Sequence
  chemically synthesized
gaaagctttttcaaagtgcttt

SEQ ID NO: 802887 - DNA, 22 bp, Artificial Sequence
  chemically synthesized
aaagctttttcaaagtgctttc

SEQ ID NO: 802888 - DNA, 22 bp, Artificial Sequence
  chemically synthesized
taagggaataaatatgaaagca

SEQ ID NO: 802889 - DNA, 22 bp, Artificial Sequence
  chemically synthesized
ataagggaataaatatgaaagc

SEQ ID NO: 802890 - DNA, 22 bp, Artificial Sequence
  chemically synthesized
tttcaaagtgctttcatattta

SEQ ID NO: 802891 - DNA, 22 bp, Artificial Sequence
  chemically synthesized
ttcaaagtgctttcatatttat

SEQ ID NO: 802892 - DNA, 22 bp, Artificial Sequence
  chemically synthesized
tcaaagtgctttcatatttatt

SEQ ID NO: 802893 - DNA, 22 bp, Artificial Sequence
  chemically synthesized
caaagtgctttcatatttattc

SEQ ID NO: 802894 - DNA, 22 bp, Artificial Sequence
  chemically synthesized
aaagtgctttcatatttattcc

SEQ ID NO: 802895 - DNA, 22 bp, Artificial Sequence
  chemically synthesized
tgaggatcttataagggaataa

SEQ ID NO: 802896 - DNA, 22 bp, Artificial Sequence
  chemically synthesized
gtgaggatcttataagggaata

SEQ ID NO: 802897 - DNA, 22 bp, Artificial Sequence
  chemically synthesized
tgtgaggatcttataagggaat

SEQ ID NO: 802898 - DNA, 22 bp, Artificial Sequence
  chemically synthesized
ttgtgaggatcttataagggaa

SEQ ID NO: 802899 - DNA, 22 bp, Artificial Sequence
  chemically synthesized
tcatatttattcccttataaga

SEQ ID NO: 802900 - DNA, 22 bp, Artificial Sequence
  chemically synthesized
catatttattcccttataagat

SEQ ID NO: 802901 - DNA, 22 bp, Artificial Sequence
  chemically synthesized
atatttattcccttataagatc

SEQ ID NO: 802902 - DNA, 22 bp, Artificial Sequence
  chemically synthesized
gcagagcttttgtgaggatctt

SEQ ID NO: 802903 - DNA, 22 bp, Artificial Sequence
  chemically synthesized
attcccttataagatcctcaca

SEQ ID NO: 802904 - DNA, 22 bp, Artificial Sequence
  chemically synthesized
ttcccttataagatcctcacaa

SEQ ID NO: 802905 - DNA, 22 bp, Artificial Sequence
  chemically synthesized
ctcgcagagcttttgtgaggat

SEQ ID NO: 802906 - DNA, 22 bp, Artificial Sequence
  chemically synthesized
ccttataagatcctcacaaaag

SEQ ID NO: 802907 - DNA, 22 bp, Artificial Sequence
  chemically synthesized
ttcctcgcagagcttttgtgag

SEQ ID NO: 802908 - DNA, 22 bp, Artificial Sequence
  chemically synthesized
attcctcgcagagcttttgtga

SEQ ID NO: 802909 - DNA, 22 bp, Artificial Sequence
  chemically synthesized
tattcctcgcagagcttttgtg

SEQ ID NO: 802910 - DNA, 22 bp, Artificial Sequence
  chemically synthesized
ataagatcctcacaaaagctct

SEQ ID NO: 802911 - DNA, 22 bp, Artificial Sequence
  chemically synthesized
taagatcctcacaaaagctctg

SEQ ID NO: 802912 - DNA, 22 bp, Artificial Sequence
  chemically synthesized
tgttttattcctcgcagagctt

SEQ ID NO: 802913 - DNA, 22 bp, Artificial Sequence
  chemically synthesized
acaaaagctctgcgaggaataa

SEQ ID NO: 802914 - DNA, 22 bp, Artificial Sequence
  chemically synthesized
caataaccattgtgttttattc

SEQ ID NO: 802915 - DNA, 22 bp, Artificial Sequence
  chemically synthesized
gcctccaataaccattgtgttt

SEQ ID NO: 802916 - DNA, 22 bp, Artificial Sequence
  chemically synthesized
tgcgaggaataaaacacaatgg

SEQ ID NO: 802917 - DNA, 22 bp, Artificial Sequence
  chemically synthesized
cgaggaataaaacacaatggtt

SEQ ID NO: 802918 - DNA, 22 bp, Artificial Sequence
  chemically synthesized
ttagcctccaataaccattgtg

SEQ ID NO: 802919 - DNA, 22 bp, Artificial Sequence
  chemically synthesized
gttagcctccaataaccattgt

SEQ ID NO: 802920 - DNA, 22 bp, Artificial Sequence
  chemically synthesized
tgttagcctccaataaccattg

SEQ ID NO: 802921 - DNA, 22 bp, Artificial Sequence
  chemically synthesized
aaaagtcaattttgttagcctc

SEQ ID NO: 802922 - DNA, 22 bp, Artificial Sequence
  chemically synthesized
ttggaggctaacaaaattgact

SEQ ID NO: 802923 - DNA, 22 bp, Artificial Sequence
  chemically synthesized
tgcatactgaaaagtcaatttt

SEQ ID NO: 802924 - DNA, 22 bp, Artificial Sequence
  chemically synthesized
gaggctaacaaaattgactttt

SEQ ID NO: 802925 - DNA, 22 bp, Artificial Sequence
  chemically synthesized
acaaaattgacttttcagtatg

SEQ ID NO: 802926 - DNA, 22 bp, Artificial Sequence
  chemically synthesized
gtaagaagacactgtgcatact

SEQ ID NO: 802927 - DNA, 22 bp, Artificial Sequence
  chemically synthesized
acttttcagtatgcacagtgtc

SEQ ID NO: 802928 - DNA, 22 bp, Artificial Sequence
  chemically synthesized
ttcagtatgcacagtgtcttct

SEQ ID NO: 802929 - DNA, 22 bp, Artificial Sequence
  chemically synthesized
tcagtatgcacagtgtcttctt

SEQ ID NO: 802930 - DNA, 22 bp, Artificial Sequence
  chemically synthesized
cagtatgcacagtgtcttctta

SEQ ID NO: 802931 - DNA, 22 bp, Artificial Sequence
  chemically synthesized
agtatgcacagtgtcttcttac

SEQ ID NO: 802932 - DNA, 22 bp, Artificial Sequence
  chemically synthesized
taaaccaaaagaaaagcccaca

SEQ ID NO: 802933 - DNA, 22 bp, Artificial Sequence
  chemically synthesized
cttaccaatgtgggcttttctt

SEQ ID NO: 802934 - DNA, 22 bp, Artificial Sequence
  chemically synthesized
ttaccaatgtgggcttttcttt

SEQ ID NO: 802935 - DNA, 22 bp, Artificial Sequence
  chemically synthesized
tatctataaaccaaaagaaaag

SEQ ID NO: 802936 - DNA, 22 bp, Artificial Sequence
  chemically synthesized
accaatgtgggcttttcttttg

SEQ ID NO: 802937 - DNA, 22 bp, Artificial Sequence
  chemically synthesized
atatctataaaccaaaagaaaa

SEQ ID NO: 802938 - DNA, 22 bp, Artificial Sequence
  chemically synthesized
ccaatgtgggcttttcttttgg

SEQ ID NO: 802939 - DNA, 22 bp, Artificial Sequence
  chemically synthesized
tatatctataaaccaaaagaaa

SEQ ID NO: 802940 - DNA, 22 bp, Artificial Sequence
  chemically synthesized
taattttatatctataaaccaa

SEQ ID NO: 802941 - DNA, 22 bp, Artificial Sequence
  chemically synthesized
gtaattttatatctataaacca

SEQ ID NO: 802942 - DNA, 22 bp, Artificial Sequence
  chemically synthesized
tgtaattttatatctataaacc

SEQ ID NO: 802943 - DNA, 22 bp, Artificial Sequence
  chemically synthesized
ttcttttggtttatagatataa

SEQ ID NO: 802944 - DNA, 22 bp, Artificial Sequence
  chemically synthesized
gattttgtaattttatatctat

SEQ ID NO: 802945 - DNA, 22 bp, Artificial Sequence
  chemically synthesized
tcttttggtttatagatataaa

SEQ ID NO: 802946 - DNA, 22 bp, Artificial Sequence
  chemically synthesized
cttttggtttatagatataaaa

SEQ ID NO: 802947 - DNA, 22 bp, Artificial Sequence
  chemically synthesized
ttttggtttatagatataaaat

SEQ ID NO: 802948 - DNA, 22 bp, Artificial Sequence
  chemically synthesized
ttggattttgtaattttatatc

SEQ ID NO: 802949 - DNA, 22 bp, Artificial Sequence
  chemically synthesized
ttggtttatagatataaaatta

SEQ ID NO: 802950 - DNA, 22 bp, Artificial Sequence
  chemically synthesized
tggtttatagatataaaattac

SEQ ID NO: 802951 - DNA, 22 bp, Artificial Sequence
  chemically synthesized
ggtttatagatataaaattaca

SEQ ID NO: 802952 - DNA, 22 bp, Artificial Sequence
  chemically synthesized
actattggattttgtaatttta

SEQ ID NO: 802953 - DNA, 22 bp, Artificial Sequence
  chemically synthesized
gtttatagatataaaattacaa

SEQ ID NO: 802954 - DNA, 22 bp, Artificial Sequence
  chemically synthesized
atagatataaaattacaaaatc

SEQ ID NO: 802955 - DNA, 22 bp, Artificial Sequence
  chemically synthesized
tagatataaaattacaaaatcc

SEQ ID NO: 802956 - DNA, 22 bp, Artificial Sequence
  chemically synthesized
taaattaactattggattttgt

SEQ ID NO: 802957 - DNA, 22 bp, Artificial Sequence
  chemically synthesized
gtaaattaactattggattttg

SEQ ID NO: 802958 - DNA, 22 bp, Artificial Sequence
  chemically synthesized
tgtaaattaactattggatttt

SEQ ID NO: 802959 - DNA, 22 bp, Artificial Sequence
  chemically synthesized
aataactttgtaaattaactat

SEQ ID NO: 802960 - DNA, 22 bp, Artificial Sequence
  chemically synthesized
caaaatccaatagttaatttac

SEQ ID NO: 802961 - DNA, 22 bp, Artificial Sequence
  chemically synthesized
aattgaataactttgtaaatta

SEQ ID NO: 802962 - DNA, 22 bp, Artificial Sequence
  chemically synthesized
atttacaaagttattcaattta

SEQ ID NO: 802963 - DNA, 22 bp, Artificial Sequence
  chemically synthesized
acaaagttattcaatttagtca

SEQ ID NO: 802964 - DNA, 22 bp, Artificial Sequence
  chemically synthesized
caaagttattcaatttagtcat

SEQ ID NO: 802965 - DNA, 22 bp, Artificial Sequence
  chemically synthesized
gaatgatacaaagtaatgacta

SEQ ID NO: 802966 - DNA, 22 bp, Artificial Sequence
  chemically synthesized
tctagaatgatacaaagtaatg

SEQ ID NO: 802967 - DNA, 22 bp, Artificial Sequence
  chemically synthesized
ttcaatttagtcattactttgt

SEQ ID NO: 802968 - DNA, 22 bp, Artificial Sequence
  chemically synthesized
aatttagtcattactttgtatc

SEQ ID NO: 802969 - DNA, 22 bp, Artificial Sequence
  chemically synthesized
aacaattatctagaatgataca

SEQ ID NO: 802970 - DNA, 22 bp, Artificial Sequence
  chemically synthesized
agtcattactttgtatcattct

SEQ ID NO: 802971 - DNA, 22 bp, Artificial Sequence
  chemically synthesized
gtcattactttgtatcattcta

SEQ ID NO: 802972 - DNA, 22 bp, Artificial Sequence
  chemically synthesized
cattaaacaattatctagaatg

SEQ ID NO: 802973 - DNA, 22 bp, Artificial Sequence
  chemically synthesized
ctttgtatcattctagataatt

SEQ ID NO: 802974 - DNA, 22 bp, Artificial Sequence
  chemically synthesized
ccattacattaaacaattatct

SEQ ID NO: 802975 - DNA, 22 bp, Artificial Sequence
  chemically synthesized
tgtatcattctagataattgtt

SEQ ID NO: 802976 - DNA, 22 bp, Artificial Sequence
  chemically synthesized
gtatcattctagataattgttt

SEQ ID NO: 802977 - DNA, 22 bp, Artificial Sequence
  chemically synthesized
tatcattctagataattgttta

SEQ ID NO: 802978 - DNA, 22 bp, Artificial Sequence
  chemically synthesized
gatgttgccattacattaaaca

SEQ ID NO: 802979 - DNA, 22 bp, Artificial Sequence
  chemically synthesized
tggatgttgccattacattaaa

SEQ ID NO: 802980 - DNA, 22 bp, Artificial Sequence
  chemically synthesized
ctggatgttgccattacattaa

SEQ ID NO: 802981 - DNA, 22 bp, Artificial Sequence
  chemically synthesized
tagataattgtttaatgtaatg

SEQ ID NO: 802982 - DNA, 22 bp, Artificial Sequence
  chemically synthesized
gataattgtttaatgtaatggc

SEQ ID NO: 802983 - DNA, 22 bp, Artificial Sequence
  chemically synthesized
cttctggatgttgccattacat

SEQ ID NO: 802984 - DNA, 22 bp, Artificial Sequence
  chemically synthesized
aaacctacttctggatgttgcc

SEQ ID NO: 802985 - DNA, 22 bp, Artificial Sequence
  chemically synthesized
tttaatgtaatggcaacatcca

SEQ ID NO: 802986 - DNA, 22 bp, Artificial Sequence
  chemically synthesized
aaaacctacttctggatgttgc

SEQ ID NO: 802987 - DNA, 22 bp, Artificial Sequence
  chemically synthesized
taaaacctacttctggatgttg

SEQ ID NO: 802988 - DNA, 22 bp, Artificial Sequence
  chemically synthesized
aatgtaatggcaacatccagaa

SEQ ID NO: 802989 - DNA, 22 bp, Artificial Sequence
  chemically synthesized
atgtaatggcaacatccagaag

SEQ ID NO: 802990 - DNA, 22 bp, Artificial Sequence
  chemically synthesized
aaacctttaaaacctacttctg

SEQ ID NO: 802991 - DNA, 22 bp, Artificial Sequence
  chemically synthesized
tattaaaacctttaaaacctac

SEQ ID NO: 802992 - DNA, 22 bp, Artificial Sequence
  chemically synthesized
attgtattaaaacctttaaaac

SEQ ID NO: 802993 - DNA, 22 bp, Artificial Sequence
  chemically synthesized
taaaggttttaatacaattaac

SEQ ID NO: 802994 - DNA, 22 bp, Artificial Sequence
  chemically synthesized
atacgtaaacatgttaattgta

SEQ ID NO: 802995 - DNA, 22 bp, Artificial Sequence
  chemically synthesized
aaaggttttaatacaattaaca

SEQ ID NO: 802996 - DNA, 22 bp, Artificial Sequence
  chemically synthesized
aaggttttaatacaattaacat

SEQ ID NO: 802997 - DNA, 22 bp, Artificial Sequence
  chemically synthesized
attcatacgtaaacatgttaat

SEQ ID NO: 802998 - DNA, 22 bp, Artificial Sequence
  chemically synthesized
taatacaattaacatgtttacg

SEQ ID NO: 802999 - DNA, 22 bp, Artificial Sequence
  chemically synthesized
aatacaattaacatgtttacgt

SEQ ID NO: 803000 - DNA, 22 bp, Artificial Sequence
  chemically synthesized
atacaattaacatgtttacgta

SEQ ID NO: 803001 - DNA, 22 bp, Artificial Sequence
  chemically synthesized
acatgtttacgtatgaatgaga

SEQ ID NO: 803002 - DNA, 22 bp, Artificial Sequence
  chemically synthesized
acgtatgaatgagacatggttc

SEQ ID NO: 803003 - DNA, 22 bp, Artificial Sequence
  chemically synthesized
ccatggtaacatgaaccatgtc

SEQ ID NO: 803004 - DNA, 22 bp, Artificial Sequence
  chemically synthesized
cgtatgaatgagacatggttca

SEQ ID NO: 803005 - DNA, 22 bp, Artificial Sequence
  chemically synthesized
gaccatgttaccatggtaacat

SEQ ID NO: 803006 - DNA, 22 bp, Artificial Sequence
  chemically synthesized
ggaccatgttaccatggtaaca

SEQ ID NO: 803007 - DNA, 22 bp, Artificial Sequence
  chemically synthesized
tggaccatgttaccatggtaac

SEQ ID NO: 803008 - DNA, 22 bp, Artificial Sequence
  chemically synthesized
taccgttttggaccatgttacc

SEQ ID NO: 803009 - DNA, 22 bp, Artificial Sequence
  chemically synthesized
atgttaccatggtaacatggtc

SEQ ID NO: 803010 - DNA, 22 bp, Artificial Sequence
  chemically synthesized
agtgttgtaccgttttggacca

SEQ ID NO: 803011 - DNA, 22 bp, Artificial Sequence
  chemically synthesized
ccatggtaacatggtccaaaac

SEQ ID NO: 803012 - DNA, 22 bp, Artificial Sequence
  chemically synthesized
aagtgttgtaccgttttggacc

SEQ ID NO: 803013 - DNA, 22 bp, Artificial Sequence
  chemically synthesized
taagtgttgtaccgttttggac

SEQ ID NO: 803014 - DNA, 22 bp, Artificial Sequence
  chemically synthesized
attttaagtgttgtaccgtttt

SEQ ID NO: 803015 - DNA, 22 bp, Artificial Sequence
  chemically synthesized
gattttaagtgttgtaccgttt

SEQ ID NO: 803016 - DNA, 22 bp, Artificial Sequence
  chemically synthesized
tttgattttaagtgttgtaccg

SEQ ID NO: 803017 - DNA, 22 bp, Artificial Sequence
  chemically synthesized
gctatttgattttaagtgttgt

SEQ ID NO: 803018 - DNA, 22 bp, Artificial Sequence
  chemically synthesized
agctatttgattttaagtgttg

SEQ ID NO: 803019 - DNA, 22 bp, Artificial Sequence
  chemically synthesized
atgcaatatgagtttagctatt

SEQ ID NO: 803020 - DNA, 22 bp, Artificial Sequence
  chemically synthesized
aatgcaatatgagtttagctat

SEQ ID NO: 803021 - DNA, 22 bp, Artificial Sequence
  chemically synthesized
aaaatcaaatagctaaactcat

SEQ ID NO: 803022 - DNA, 22 bp, Artificial Sequence
  chemically synthesized
aaatcaaatagctaaactcata

SEQ ID NO: 803023 - DNA, 22 bp, Artificial Sequence
  chemically synthesized
atccagtcaccccaatttaatg

SEQ ID NO: 803024 - DNA, 22 bp, Artificial Sequence
  chemically synthesized
aactcatattgcattaaattgg

SEQ ID NO: 803025 - DNA, 22 bp, Artificial Sequence
  chemically synthesized
catccagtcaccccaatttaat

SEQ ID NO: 803026 - DNA, 22 bp, Artificial Sequence
  chemically synthesized
tcatccagtcaccccaatttaa

SEQ ID NO: 803027 - DNA, 22 bp, Artificial Sequence
  chemically synthesized
ttcatccagtcaccccaattta

SEQ ID NO: 803028 - DNA, 22 bp, Artificial Sequence
  chemically synthesized
atattgcattaaattggggtga

SEQ ID NO: 803029 - DNA, 22 bp, Artificial Sequence
  chemically synthesized
cattaaattggggtgactggat

SEQ ID NO: 803030 - DNA, 22 bp, Artificial Sequence
  chemically synthesized
gaatccatttttcatccagtca

SEQ ID NO: 803031 - DNA, 22 bp, Artificial Sequence
  chemically synthesized
aattggggtgactggatgaaaa

SEQ ID NO: 803032 - DNA, 22 bp, Artificial Sequence
  chemically synthesized
gggtgactggatgaaaaatgga

SEQ ID NO: 803033 - DNA, 22 bp, Artificial Sequence
  chemically synthesized
aatgcagaaaattagaatccat

SEQ ID NO: 803034 - DNA, 22 bp, Artificial Sequence
  chemically synthesized
gatgaaaaatggattctaattt

SEQ ID NO: 803035 - DNA, 22 bp, Artificial Sequence
  chemically synthesized
caggaagaaagactgaatgcag

SEQ ID NO: 803036 - DNA, 22 bp, Artificial Sequence
  chemically synthesized
ctgcaggaagaaagactgaatg

SEQ ID NO: 803037 - DNA, 22 bp, Artificial Sequence
  chemically synthesized
taattttctgcattcagtcttt

SEQ ID NO: 803038 - DNA, 22 bp, Artificial Sequence
  chemically synthesized
attttctgcattcagtctttct

SEQ ID NO: 803039 - DNA, 22 bp, Artificial Sequence
  chemically synthesized
tctcctgcaggaagaaagactg

SEQ ID NO: 803040 - DNA, 22 bp, Artificial Sequence
  chemically synthesized
atctcctgcaggaagaaagact

SEQ ID NO: 803041 - DNA, 22 bp, Artificial Sequence
  chemically synthesized
tatctcctgcaggaagaaagac

SEQ ID NO: 803042 - DNA, 22 bp, Artificial Sequence
  chemically synthesized
ttatctcctgcaggaagaaaga

SEQ ID NO: 803043 - DNA, 22 bp, Artificial Sequence
  chemically synthesized
tctgcattcagtctttcttcct

SEQ ID NO: 803044 - DNA, 22 bp, Artificial Sequence
  chemically synthesized
ctgcattcagtctttcttcctg

SEQ ID NO: 803045 - DNA, 22 bp, Artificial Sequence
  chemically synthesized
tgcattcagtctttcttcctgc

SEQ ID NO: 803046 - DNA, 22 bp, Artificial Sequence
  chemically synthesized
cattcagtctttcttcctgcag

SEQ ID NO: 803047 - DNA, 22 bp, Artificial Sequence
  chemically synthesized
gtcttttatctcctgcaggaag

SEQ ID NO: 803048 - DNA, 22 bp, Artificial Sequence
  chemically synthesized
agtctttcttcctgcaggagat

SEQ ID NO: 803049 - DNA, 22 bp, Artificial Sequence
  chemically synthesized
aggactggtcttttatctcctg

SEQ ID NO: 803050 - DNA, 22 bp, Artificial Sequence
  chemically synthesized
tcttcctgcaggagataaaaga

SEQ ID NO: 803051 - DNA, 22 bp, Artificial Sequence
  chemically synthesized
cttcctgcaggagataaaagac

SEQ ID NO: 803052 - DNA, 22 bp, Artificial Sequence
  chemically synthesized
ttcctgcaggagataaaagacc

SEQ ID NO: 803053 - DNA, 22 bp, Artificial Sequence
  chemically synthesized
cctgcaggagataaaagaccag

SEQ ID NO: 803054 - DNA, 22 bp, Artificial Sequence
  chemically synthesized
ctgcaggagataaaagaccagt

SEQ ID NO: 803055 - DNA, 22 bp, Artificial Sequence
  chemically synthesized
caggagataaaagaccagtcct

SEQ ID NO: 803056 - DNA, 22 bp, Artificial Sequence
  chemically synthesized
gaaaagggagtcaatggggaca

SEQ ID NO: 803057 - DNA, 22 bp, Artificial Sequence
  chemically synthesized
agaaaagggagtcaatggggac

SEQ ID NO: 803058 - DNA, 22 bp, Artificial Sequence
  chemically synthesized
aacatttgtccccattgactcc

SEQ ID NO: 803059 - DNA, 22 bp, Artificial Sequence
  chemically synthesized
aaagtttagaaaagggagtcaa

SEQ ID NO: 803060 - DNA, 22 bp, Artificial Sequence
  chemically synthesized
gtccccattgactcccttttct

SEQ ID NO: 803061 - DNA, 22 bp, Artificial Sequence
  chemically synthesized
tccccattgactcccttttcta

SEQ ID NO: 803062 - DNA, 22 bp, Artificial Sequence
  chemically synthesized
actcccttttctaaacttttaa

SEQ ID NO: 803063 - DNA, 22 bp, Artificial Sequence
  chemically synthesized
ccttttctaaacttttaattat

SEQ ID NO: 803064 - DNA, 22 bp, Artificial Sequence
  chemically synthesized
ttctaaacttttaattattttc

SEQ ID NO: 803065 - DNA, 22 bp, Artificial Sequence
  chemically synthesized
tctaaacttttaattattttca

SEQ ID NO: 803066 - DNA, 22 bp, Artificial Sequence
  chemically synthesized
ctaaacttttaattattttcat

SEQ ID NO: 803067 - DNA, 22 bp, Artificial Sequence
  chemically synthesized
taaacttttaattattttcatt

SEQ ID NO: 803068 - DNA, 22 bp, Artificial Sequence
  chemically synthesized
aacttttaattattttcattat

SEQ ID NO: 803069 - DNA, 22 bp, Artificial Sequence
  chemically synthesized
ttaattattttcattatttcat

SEQ ID NO: 803070 - DNA, 22 bp, Artificial Sequence
  chemically synthesized
taattattttcattatttcatt

SEQ ID NO: 803071 - DNA, 22 bp, Artificial Sequence
  chemically synthesized
aattattttcattatttcattt

SEQ ID NO: 803072 - DNA, 22 bp, Artificial Sequence
  chemically synthesized
agagaaaatccgaaatgaaata

SEQ ID NO: 803073 - DNA, 22 bp, Artificial Sequence
  chemically synthesized
attattttcattatttcatttc

SEQ ID NO: 803074 - DNA, 22 bp, Artificial Sequence
  chemically synthesized
ttttcattatttcatttcggat

SEQ ID NO: 803075 - DNA, 22 bp, Artificial Sequence
  chemically synthesized
tcattatttcatttcggatttt

SEQ ID NO: 803076 - DNA, 22 bp, Artificial Sequence
  chemically synthesized
tagatctcagagaaaatccgaa

SEQ ID NO: 803077 - DNA, 22 bp, Artificial Sequence
  chemically synthesized
cattatttcatttcggattttc

SEQ ID NO: 803078 - DNA, 22 bp, Artificial Sequence
  chemically synthesized
attatttcatttcggattttct

SEQ ID NO: 803079 - DNA, 22 bp, Artificial Sequence
  chemically synthesized
ctgtagatctcagagaaaatcc

SEQ ID NO: 803080 - DNA, 22 bp, Artificial Sequence
  chemically synthesized
tttcatttcggattttctctga

SEQ ID NO: 803081 - DNA, 22 bp, Artificial Sequence
  chemically synthesized
aattcctgtagatctcagagaa

SEQ ID NO: 803082 - DNA, 22 bp, Artificial Sequence
  chemically synthesized
catttcggattttctctgagat

SEQ ID NO: 803083 - DNA, 22 bp, Artificial Sequence
  chemically synthesized
atttcggattttctctgagatc

SEQ ID NO: 803084 - DNA, 22 bp, Artificial Sequence
  chemically synthesized
cggattttctctgagatctaca

SEQ ID NO: 803085 - DNA, 22 bp, Artificial Sequence
  chemically synthesized
ggattttctctgagatctacag

SEQ ID NO: 803086 - DNA, 22 bp, Artificial Sequence
  chemically synthesized
ggaccctgaattcctgtagatc

SEQ ID NO: 803087 - DNA, 22 bp, Artificial Sequence
  chemically synthesized
gggaccctgaattcctgtagat

SEQ ID NO: 803088 - DNA, 22 bp, Artificial Sequence
  chemically synthesized
tgggaccctgaattcctgtaga

SEQ ID NO: 803089 - DNA, 22 bp, Artificial Sequence
  chemically synthesized
tctctgagatctacaggaattc

SEQ ID NO: 803090 - DNA, 22 bp, Artificial Sequence
  chemically synthesized
ctctgagatctacaggaattca

SEQ ID NO: 803091 - DNA, 22 bp, Artificial Sequence
  chemically synthesized
tctgagatctacaggaattcag

SEQ ID NO: 803092 - DNA, 22 bp, Artificial Sequence
  chemically synthesized
cattttgggaccctgaattcct

SEQ ID NO: 803093 - DNA, 22 bp, Artificial Sequence
  chemically synthesized
ccattttgggaccctgaattcc

SEQ ID NO: 803094 - DNA, 22 bp, Artificial Sequence
  chemically synthesized
tgagatctacaggaattcaggg

SEQ ID NO: 803095 - DNA, 22 bp, Artificial Sequence
  chemically synthesized
tccattttgggaccctgaattc

SEQ ID NO: 803096 - DNA, 22 bp, Artificial Sequence
  chemically synthesized
agatctacaggaattcagggtc

SEQ ID NO: 803097 - DNA, 22 bp, Artificial Sequence
  chemically synthesized
ttttccattttgggaccctgaa

SEQ ID NO: 803098 - DNA, 22 bp, Artificial Sequence
  chemically synthesized
ttattttccattttgggaccct

SEQ ID NO: 803099 - DNA, 22 bp, Artificial Sequence
  chemically synthesized
attattttccattttgggaccc

SEQ ID NO: 803100 - DNA, 22 bp, Artificial Sequence
  chemically synthesized
tattattttccattttgggacc

SEQ ID NO: 803101 - DNA, 22 bp, Artificial Sequence
  chemically synthesized
caggaattcagggtcccaaaat

SEQ ID NO: 803102 - DNA, 22 bp, Artificial Sequence
  chemically synthesized
ctttattattttccattttggg

SEQ ID NO: 803103 - DNA, 22 bp, Artificial Sequence
  chemically synthesized
gttactttattattttccattt

SEQ ID NO: 803104 - DNA, 22 bp, Artificial Sequence
  chemically synthesized
agttactttattattttccatt

SEQ ID NO: 803105 - DNA, 22 bp, Artificial Sequence
  chemically synthesized
agggtcccaaaatggaaaataa

SEQ ID NO: 803106 - DNA, 22 bp, Artificial Sequence
  chemically synthesized
tatttagttactttattatttt

SEQ ID NO: 803107 - DNA, 22 bp, Artificial Sequence
  chemically synthesized
ctatatttagttactttattat

SEQ ID NO: 803108 - DNA, 22 bp, Artificial Sequence
  chemically synthesized
gctatatttagttactttatta

SEQ ID NO: 803109 - DNA, 22 bp, Artificial Sequence
  chemically synthesized
ttgctatatttagttactttat

SEQ ID NO: 803110 - DNA, 22 bp, Artificial Sequence
  chemically synthesized
cttgctatatttagttacttta

SEQ ID NO: 803111 - DNA, 22 bp, Artificial Sequence
  chemically synthesized
tcttcttgctatatttagttac

SEQ ID NO: 803112 - DNA, 22 bp, Artificial Sequence
  chemically synthesized
acatgattgtcttcttgctata

SEQ ID NO: 803113 - DNA, 22 bp, Artificial Sequence
  chemically synthesized
aagactcacatgattgtcttct

SEQ ID NO: 803114 - DNA, 22 bp, Artificial Sequence
  chemically synthesized
aatatagcaagaagacaatcat

SEQ ID NO: 803115 - DNA, 22 bp, Artificial Sequence
  chemically synthesized
aggaatactcaagactcacatg

SEQ ID NO: 803116 - DNA, 22 bp, Artificial Sequence
  chemically synthesized
taatgctcaggaatactcaaga

SEQ ID NO: 803117 - DNA, 22 bp, Artificial Sequence
  chemically synthesized
actataatgctcaggaatactc

SEQ ID NO: 803118 - DNA, 22 bp, Artificial Sequence
  chemically synthesized
tgactataatgctcaggaatac

SEQ ID NO: 803119 - DNA, 22 bp, Artificial Sequence
  chemically synthesized
gagtattcctgagcattatagt

SEQ ID NO: 803120 - DNA, 22 bp, Artificial Sequence
  chemically synthesized
agtattcctgagcattatagtc

SEQ ID NO: 803121 - DNA, 22 bp, Artificial Sequence
  chemically synthesized
agtgagaacctctgactataat

SEQ ID NO: 803122 - DNA, 22 bp, Artificial Sequence
  chemically synthesized
ttcagtgagaacctctgactat

SEQ ID NO: 803123 - DNA, 22 bp, Artificial Sequence
  chemically synthesized
ctgagcattatagtcagaggtt

SEQ ID NO: 803124 - DNA, 22 bp, Artificial Sequence
  chemically synthesized
ttgttcagtgagaacctctgac

SEQ ID NO: 803125 - DNA, 22 bp, Artificial Sequence
  chemically synthesized
agcattatagtcagaggttctc

SEQ ID NO: 803126 - DNA, 22 bp, Artificial Sequence
  chemically synthesized
tagtcagaggttctcactgaac

SEQ ID NO: 803127 - DNA, 22 bp, Artificial Sequence
  chemically synthesized
cccatgaatctattgttcagtg

SEQ ID NO: 803128 - DNA, 22 bp, Artificial Sequence
  chemically synthesized
tacccatgaatctattgttcag

SEQ ID NO: 803129 - DNA, 22 bp, Artificial Sequence
  chemically synthesized
tcactgaacaatagattcatgg

SEQ ID NO: 803130 - DNA, 22 bp, Artificial Sequence
  chemically synthesized
actgaacaatagattcatgggt

SEQ ID NO: 803131 - DNA, 22 bp, Artificial Sequence
  chemically synthesized
aacgtagcatgttctacccatg

SEQ ID NO: 803132 - DNA, 22 bp, Artificial Sequence
  chemically synthesized
aacaatagattcatgggtagaa

SEQ ID NO: 803133 - DNA, 22 bp, Artificial Sequence
  chemically synthesized
aattgaacgtagcatgttctac

SEQ ID NO: 803134 - DNA, 22 bp, Artificial Sequence
  chemically synthesized
atgggtagaacatgctacgttc

SEQ ID NO: 803135 - DNA, 22 bp, Artificial Sequence
  chemically synthesized
gatagataccagttcaattgaa

SEQ ID NO: 803136 - DNA, 22 bp, Artificial Sequence
  chemically synthesized
ccctcgatagataccagttcaa

SEQ ID NO: 803137 - DNA, 22 bp, Artificial Sequence
  chemically synthesized
taccctcgatagataccagttc

SEQ ID NO: 803138 - DNA, 22 bp, Artificial Sequence
  chemically synthesized
cgttcaattgaactggtatcta

SEQ ID NO: 803139 - DNA, 22 bp, Artificial Sequence
  chemically synthesized
tctctaccctcgatagatacca

SEQ ID NO: 803140 - DNA, 22 bp, Artificial Sequence
  chemically synthesized
ctgtctctaccctcgatagata

SEQ ID NO: 803141 - DNA, 22 bp, Artificial Sequence
  chemically synthesized
aattgaactggtatctatcgag

SEQ ID NO: 803142 - DNA, 22 bp, Artificial Sequence
  chemically synthesized
aactggtatctatcgagggtag

SEQ ID NO: 803143 - DNA, 22 bp, Artificial Sequence
  chemically synthesized
acaatactactgtctctaccct

SEQ ID NO: 803144 - DNA, 22 bp, Artificial Sequence
  chemically synthesized
gtatctatcgagggtagagaca

SEQ ID NO: 803145 - DNA, 22 bp, Artificial Sequence
  chemically synthesized
attcacaatactactgtctcta

SEQ ID NO: 803146 - DNA, 22 bp, Artificial Sequence
  chemically synthesized
tcgagggtagagacagtagtat

SEQ ID NO: 803147 - DNA, 22 bp, Artificial Sequence
  chemically synthesized
taaaaaccccatcctcattcac

SEQ ID NO: 803148 - DNA, 22 bp, Artificial Sequence
  chemically synthesized
atactataaaaaccccatcctc

SEQ ID NO: 803149 - DNA, 22 bp, Artificial Sequence
  chemically synthesized
atattgatactataaaaacccc

SEQ ID NO: 803150 - DNA, 22 bp, Artificial Sequence
  chemically synthesized
tgaatgaggatggggtttttat

SEQ ID NO: 803151 - DNA, 22 bp, Artificial Sequence
  chemically synthesized
tcatattgatactataaaaacc

SEQ ID NO: 803152 - DNA, 22 bp, Artificial Sequence
  chemically synthesized
ttctcatattgatactataaaa

SEQ ID NO: 803153 - DNA, 22 bp, Artificial Sequence
  chemically synthesized
attctcatattgatactataaa

SEQ ID NO: 803154 - DNA, 22 bp, Artificial Sequence
  chemically synthesized
tattctcatattgatactataa

SEQ ID NO: 803155 - DNA, 22 bp, Artificial Sequence
  chemically synthesized
ttattctcatattgatactata

SEQ ID NO: 803156 - DNA, 22 bp, Artificial Sequence
  chemically synthesized
cttttattctcatattgatact

SEQ ID NO: 803157 - DNA, 22 bp, Artificial Sequence
  chemically synthesized
ccttttattctcatattgatac

SEQ ID NO: 803158 - DNA, 22 bp, Artificial Sequence
  chemically synthesized
tccttttattctcatattgata

SEQ ID NO: 803159 - DNA, 22 bp, Artificial Sequence
  chemically synthesized
ttccttttattctcatattgat

SEQ ID NO: 803160 - DNA, 22 bp, Artificial Sequence
  chemically synthesized
atttttccttttattctcatat

SEQ ID NO: 803161 - DNA, 22 bp, Artificial Sequence
  chemically synthesized
ttatagtatcaatatgagaata

SEQ ID NO: 803162 - DNA, 22 bp, Artificial Sequence
  chemically synthesized
catttttccttttattctcata

SEQ ID NO: 803163 - DNA, 22 bp, Artificial Sequence
  chemically synthesized
tatagtatcaatatgagaataa

SEQ ID NO: 803164 - DNA, 22 bp, Artificial Sequence
  chemically synthesized
tcatttttccttttattctcat

SEQ ID NO: 803165 - DNA, 22 bp, Artificial Sequence
  chemically synthesized
atagtatcaatatgagaataaa

SEQ ID NO: 803166 - DNA, 22 bp, Artificial Sequence
  chemically synthesized
tagtatcaatatgagaataaaa

SEQ ID NO: 803167 - DNA, 22 bp, Artificial Sequence
  chemically synthesized
tataaacatggaaattttcatt

SEQ ID NO: 803168 - DNA, 22 bp, Artificial Sequence
  chemically synthesized
atataaacatggaaattttcat

SEQ ID NO: 803169 - DNA, 22 bp, Artificial Sequence
  chemically synthesized
ttatataaacatggaaattttc

SEQ ID NO: 803170 - DNA, 22 bp, Artificial Sequence
  chemically synthesized
cttatataaacatggaaatttt

SEQ ID NO: 803171 - DNA, 22 bp, Artificial Sequence
  chemically synthesized
tcttatataaacatggaaattt

SEQ ID NO: 803172 - DNA, 22 bp, Artificial Sequence
  chemically synthesized
ttcttatataaacatggaaatt

SEQ ID NO: 803173 - DNA, 22 bp, Artificial Sequence
  chemically synthesized
cttttcttatataaacatggaa

SEQ ID NO: 803174 - DNA, 22 bp, Artificial Sequence
  chemically synthesized
gttccttttcttatataaacat

SEQ ID NO: 803175 - DNA, 22 bp, Artificial Sequence
  chemically synthesized
ccatgtttatataagaaaagga

SEQ ID NO: 803176 - DNA, 22 bp, Artificial Sequence
  chemically synthesized
catgtttatataagaaaaggaa

SEQ ID NO: 803177 - DNA, 22 bp, Artificial Sequence
  chemically synthesized
aataagataattagttcctttt

SEQ ID NO: 803178 - DNA, 22 bp, Artificial Sequence
  chemically synthesized
caataagataattagttccttt

SEQ ID NO: 803179 - DNA, 22 bp, Artificial Sequence
  chemically synthesized
tcaataagataattagttcctt

SEQ ID NO: 803180 - DNA, 22 bp, Artificial Sequence
  chemically synthesized
ttcaataagataattagttcct

SEQ ID NO: 803181 - DNA, 22 bp, Artificial Sequence
  chemically synthesized
atataagaaaaggaactaatta

SEQ ID NO: 803182 - DNA, 22 bp, Artificial Sequence
  chemically synthesized
ttttcaataagataattagttc

SEQ ID NO: 803183 - DNA, 22 bp, Artificial Sequence
  chemically synthesized
tataagaaaaggaactaattat

SEQ ID NO: 803184 - DNA, 22 bp, Artificial Sequence
  chemically synthesized
attatcttattgaaaagagttt

SEQ ID NO: 803185 - DNA, 22 bp, Artificial Sequence
  chemically synthesized
tcttattgaaaagagtttttca

SEQ ID NO: 803186 - DNA, 22 bp, Artificial Sequence
  chemically synthesized
attgaaaagagtttttcatgat

SEQ ID NO: 803187 - DNA, 22 bp, Artificial Sequence
  chemically synthesized
ttgaaaagagtttttcatgatc

SEQ ID NO: 803188 - DNA, 22 bp, Artificial Sequence
  chemically synthesized
cataatgtatccaagatcatga

SEQ ID NO: 803189 - DNA, 22 bp, Artificial Sequence
  chemically synthesized
aaaagagtttttcatgatcttg

SEQ ID NO: 803190 - DNA, 22 bp, Artificial Sequence
  chemically synthesized
gcataatgtatccaagatcatg

SEQ ID NO: 803191 - DNA, 22 bp, Artificial Sequence
  chemically synthesized
tgcataatgtatccaagatcat

SEQ ID NO: 803192 - DNA, 22 bp, Artificial Sequence
  chemically synthesized
ttcatgatcttggatacattat

SEQ ID NO: 803193 - DNA, 22 bp, Artificial Sequence
  chemically synthesized
tcatgatcttggatacattatg

SEQ ID NO: 803194 - DNA, 22 bp, Artificial Sequence
  chemically synthesized
catgatcttggatacattatgc

SEQ ID NO: 803195 - DNA, 22 bp, Artificial Sequence
  chemically synthesized
atgatcttggatacattatgca

SEQ ID NO: 803196 - DNA, 22 bp, Artificial Sequence
  chemically synthesized
ggatacattatgcaaagacttt

SEQ ID NO: 803197 - DNA, 22 bp, Artificial Sequence
  chemically synthesized
gatacattatgcaaagactttt

SEQ ID NO: 803198 - DNA, 22 bp, Artificial Sequence
  chemically synthesized
tgtcatggaaaaagtaaaagtc

SEQ ID NO: 803199 - DNA, 22 bp, Artificial Sequence
  chemically synthesized
tgcaaagacttttactttttcc

SEQ ID NO: 803200 - DNA, 22 bp, Artificial Sequence
  chemically synthesized
ttactttttccatgacataatt

SEQ ID NO: 803201 - DNA, 22 bp, Artificial Sequence
  chemically synthesized
tactttttccatgacataattt

SEQ ID NO: 803202 - DNA, 22 bp, Artificial Sequence
  chemically synthesized
actttttccatgacataatttt

SEQ ID NO: 803203 - DNA, 22 bp, Artificial Sequence
  chemically synthesized
ctttttccatgacataattttt

SEQ ID NO: 803204 - DNA, 22 bp, Artificial Sequence
  chemically synthesized
aaaaaaaaaaaaaaaaaattat

SEQ ID NO: 803205 - DNA, 22 bp, Artificial Sequence
  chemically synthesized
tttccatgacataatttttttt

SEQ ID NO: 803206 - DNA, 22 bp, Artificial Sequence
  chemically synthesized
ttccatgacataattttttttt

SEQ ID NO: 803207 - DNA, 22 bp, Artificial Sequence
  chemically synthesized
tccatgacataatttttttttt

SEQ ID NO: 803208 - DNA, 22 bp, Artificial Sequence
  chemically synthesized
ccatgacataattttttttttt

SEQ ID NO: 803209 - DNA, 22 bp, Artificial Sequence
  chemically synthesized
catgacataatttttttttttt

SEQ ID NO: 803210 - DNA, 22 bp, Artificial Sequence
  chemically synthesized
catctcaaaaaaaaaaaaaaaa

SEQ ID NO: 803211 - DNA, 22 bp, Artificial Sequence
  chemically synthesized
tttttttttttttttgagatgg

SEQ ID NO: 803212 - DNA, 22 bp, Artificial Sequence
  chemically synthesized
ttttttttttttttgagatgga

SEQ ID NO: 803213 - DNA, 22 bp, Artificial Sequence
  chemically synthesized
tttttttttttttgagatggag

SEQ ID NO: 803214 - DNA, 22 bp, Artificial Sequence
  chemically synthesized
ttttttttttttgagatggagt

SEQ ID NO: 803215 - DNA, 22 bp, Artificial Sequence
  chemically synthesized
tttttttttttgagatggagtc

SEQ ID NO: 803216 - DNA, 22 bp, Artificial Sequence
  chemically synthesized
ttttttttttgagatggagtct

SEQ ID NO: 803217 - DNA, 22 bp, Artificial Sequence
  chemically synthesized
ggtgacacagtgagactccatc

SEQ ID NO: 803218 - DNA, 22 bp, Artificial Sequence
  chemically synthesized
tttttttttgagatggagtctc

SEQ ID NO: 803219 - DNA, 22 bp, Artificial Sequence
  chemically synthesized
ttttttttgagatggagtctca

SEQ ID NO: 803220 - DNA, 22 bp, Artificial Sequence
  chemically synthesized
tttttttgagatggagtctcac

SEQ ID NO: 803221 - DNA, 22 bp, Artificial Sequence
  chemically synthesized
ttttttgagatggagtctcact

SEQ ID NO: 803222 - DNA, 22 bp, Artificial Sequence
  chemically synthesized
tttttgagatggagtctcactg

SEQ ID NO: 803223 - DNA, 22 bp, Artificial Sequence
  chemically synthesized
ttttgagatggagtctcactgt

SEQ ID NO: 803224 - DNA, 22 bp, Artificial Sequence
  chemically synthesized
tttgagatggagtctcactgtg

SEQ ID NO: 803225 - DNA, 22 bp, Artificial Sequence
  chemically synthesized
cagcctgggtgacacagtgaga

SEQ ID NO: 803226 - DNA, 22 bp, Artificial Sequence
  chemically synthesized
ttgagatggagtctcactgtgt

SEQ ID NO: 803227 - DNA, 22 bp, Artificial Sequence
  chemically synthesized
tgagatggagtctcactgtgtc

SEQ ID NO: 803228 - DNA, 22 bp, Artificial Sequence
  chemically synthesized
gagatggagtctcactgtgtca

SEQ ID NO: 803229 - DNA, 22 bp, Artificial Sequence
  chemically synthesized
agatggagtctcactgtgtcac

SEQ ID NO: 803230 - DNA, 22 bp, Artificial Sequence
  chemically synthesized
cactccagcctgggtgacacag

SEQ ID NO: 803231 - DNA, 22 bp, Artificial Sequence
  chemically synthesized
actgtgtcacccaggctggagt

SEQ ID NO: 803232 - DNA, 22 bp, Artificial Sequence
  chemically synthesized
agatcgtgccattgcactccag

SEQ ID NO: 803233 - DNA, 22 bp, Artificial Sequence
  chemically synthesized
tgtcacccaggctggagtgcaa

SEQ ID NO: 803234 - DNA, 22 bp, Artificial Sequence
  chemically synthesized
gagtgcaatggcacgatctcag

SEQ ID NO: 803235 - DNA, 22 bp, Artificial Sequence
  chemically synthesized
aacgtaggaggcagaggatgca

SEQ ID NO: 803236 - DNA, 22 bp, Artificial Sequence
  chemically synthesized
gaacgtaggaggcagaggatgc

SEQ ID NO: 803237 - DNA, 22 bp, Artificial Sequence
  chemically synthesized
agctcactgcatcctctgcctc

SEQ ID NO: 803238 - DNA, 22 bp, Artificial Sequence
  chemically synthesized
actgcatcctctgcctcctacg

SEQ ID NO: 803239 - DNA, 22 bp, Artificial Sequence
  chemically synthesized
catcctctgcctcctacgttca

SEQ ID NO: 803240 - DNA, 22 bp, Artificial Sequence
  chemically synthesized
tgcctcctacgttcaagcgatt

SEQ ID NO: 803241 - DNA, 22 bp, Artificial Sequence
  chemically synthesized
cctcctacgttcaagcgattct

SEQ ID NO: 803242 - DNA, 22 bp, Artificial Sequence
  chemically synthesized
ctacgttcaagcgattctcctg

SEQ ID NO: 803243 - DNA, 22 bp, Artificial Sequence
  chemically synthesized
gggaggcagaggcaggagaatc

SEQ ID NO: 803244 - DNA, 22 bp, Artificial Sequence
  chemically synthesized
cgttcaagcgattctcctgcct

SEQ ID NO: 803245 - DNA, 22 bp, Artificial Sequence
  chemically synthesized
ctcgggaggcagaggcaggaga

SEQ ID NO: 803246 - DNA, 22 bp, Artificial Sequence
  chemically synthesized
aagcgattctcctgcctctgcc

SEQ ID NO: 803247 - DNA, 22 bp, Artificial Sequence
  chemically synthesized
taatcccaactactcgggaggc

SEQ ID NO: 803248 - DNA, 22 bp, Artificial Sequence
  chemically synthesized
tcctgcctctgcctcccgagta

SEQ ID NO: 803249 - DNA, 22 bp, Artificial Sequence
  chemically synthesized
ctgcctctgcctcccgagtagt

SEQ ID NO: 803250 - DNA, 22 bp, Artificial Sequence
  chemically synthesized
cctctgcctcccgagtagttgg

SEQ ID NO: 803251 - DNA, 22 bp, Artificial Sequence
  chemically synthesized
tgcctcccgagtagttgggatt

SEQ ID NO: 803252 - DNA, 22 bp, Artificial Sequence
  chemically synthesized
cctcccgagtagttgggattac

SEQ ID NO: 803253 - DNA, 22 bp, Artificial Sequence
  chemically synthesized
ccgagtagttgggattacaggc

SEQ ID NO: 803254 - DNA, 22 bp, Artificial Sequence
  chemically synthesized
gccaggtgtggtggcacacgcc

SEQ ID NO: 803255 - DNA, 22 bp, Artificial Sequence
  chemically synthesized
ggattacaggcgtgtgccacca

SEQ ID NO: 803256 - DNA, 22 bp, Artificial Sequence
  chemically synthesized
caggcgtgtgccaccacacctg

SEQ ID NO: 803257 - DNA, 22 bp, Artificial Sequence
  chemically synthesized
aaaatacaaaaattagccaggt

SEQ ID NO: 803258 - DNA, 22 bp, Artificial Sequence
  chemically synthesized
ctaaaaatacaaaaattagcca

SEQ ID NO: 803259 - DNA, 22 bp, Artificial Sequence
  chemically synthesized
tactaaaaatacaaaaattagc

SEQ ID NO: 803260 - DNA, 22 bp, Artificial Sequence
  chemically synthesized
gctaatttttgtatttttagta

SEQ ID NO: 803261 - DNA, 22 bp, Artificial Sequence
  chemically synthesized
atttttgtatttttagtagaga

SEQ ID NO: 803262 - DNA, 22 bp, Artificial Sequence
  chemically synthesized
ttgtatttttagtagagacggg

SEQ ID NO: 803263 - DNA, 22 bp, Artificial Sequence
  chemically synthesized
tgtatttttagtagagacgggg

SEQ ID NO: 803264 - DNA, 22 bp, Artificial Sequence
  chemically synthesized
gtatttttagtagagacggggt

SEQ ID NO: 803265 - DNA, 22 bp, Artificial Sequence
  chemically synthesized
tatttttagtagagacggggtt

SEQ ID NO: 803266 - DNA, 22 bp, Artificial Sequence
  chemically synthesized
accaacatggcgaaaccccgtc

SEQ ID NO: 803267 - DNA, 22 bp, Artificial Sequence
  chemically synthesized
ttagtagagacggggtttcgcc

SEQ ID NO: 803268 - DNA, 22 bp, Artificial Sequence
  chemically synthesized
tagtagagacggggtttcgcca

SEQ ID NO: 803269 - DNA, 22 bp, Artificial Sequence
  chemically synthesized
agtagagacggggtttcgccat

SEQ ID NO: 803270 - DNA, 22 bp, Artificial Sequence
  chemically synthesized
gtagagacggggtttcgccatg

SEQ ID NO: 803271 - DNA, 22 bp, Artificial Sequence
  chemically synthesized
gagaccagcctgaccaacatgg

SEQ ID NO: 803272 - DNA, 22 bp, Artificial Sequence
  chemically synthesized
cgccatgttggtcaggctggtc

SEQ ID NO: 803273 - DNA, 22 bp, Artificial Sequence
  chemically synthesized
gccatgttggtcaggctggtct

SEQ ID NO: 803274 - DNA, 22 bp, Artificial Sequence
  chemically synthesized
aggtcgggagttcgagaccagc

SEQ ID NO: 803275 - DNA, 22 bp, Artificial Sequence
  chemically synthesized
gtcaggctggtctcgaactccc

SEQ ID NO: 803276 - DNA, 22 bp, Artificial Sequence
  chemically synthesized
gtctcgaactcccgacctcagg

SEQ ID NO: 803277 - DNA, 22 bp, Artificial Sequence
  chemically synthesized
aggtgggcagatcacctgaggt

SEQ ID NO: 803278 - DNA, 22 bp, Artificial Sequence
  chemically synthesized
gaactcccgacctcaggtgatc

SEQ ID NO: 803279 - DNA, 22 bp, Artificial Sequence
  chemically synthesized
ggaggctgaggtgggcagatca

SEQ ID NO: 803280 - DNA, 22 bp, Artificial Sequence
  chemically synthesized
ccgacctcaggtgatctgccca

SEQ ID NO: 803281 - DNA, 22 bp, Artificial Sequence
  chemically synthesized
gggaggctgaggtgggcagatc

SEQ ID NO: 803282 - DNA, 22 bp, Artificial Sequence
  chemically synthesized
tgggaggctgaggtgggcagat

SEQ ID NO: 803283 - DNA, 22 bp, Artificial Sequence
  chemically synthesized
aggtgatctgcccacctcagcc

SEQ ID NO: 803284 - DNA, 22 bp, Artificial Sequence
  chemically synthesized
cccacctcagcctcccaaagtg

SEQ ID NO: 803285 - DNA, 22 bp, Artificial Sequence
  chemically synthesized
atgcatataatcccagcacttt

SEQ ID NO: 803286 - DNA, 22 bp, Artificial Sequence
  chemically synthesized
agcctcccaaagtgctgggatt

SEQ ID NO: 803287 - DNA, 22 bp, Artificial Sequence
  chemically synthesized
ccaaagtgctgggattatatgc

SEQ ID NO: 803288 - DNA, 22 bp, Artificial Sequence
  chemically synthesized
ggattatatgcatgagccacca

SEQ ID NO: 803289 - DNA, 22 bp, Artificial Sequence
  chemically synthesized
atatcatgggccaggcgtggtg

SEQ ID NO: 803290 - DNA, 22 bp, Artificial Sequence
  chemically synthesized
tatgcatgagccaccacgcctg

SEQ ID NO: 803291 - DNA, 22 bp, Artificial Sequence
  chemically synthesized
gcataaaattcatatcatgggc

SEQ ID NO: 803292 - DNA, 22 bp, Artificial Sequence
  chemically synthesized
ggcataaaattcatatcatggg

SEQ ID NO: 803293 - DNA, 22 bp, Artificial Sequence
  chemically synthesized
tggcataaaattcatatcatgg

SEQ ID NO: 803294 - DNA, 22 bp, Artificial Sequence
  chemically synthesized
gcaaagctttggcataaaattc

SEQ ID NO: 803295 - DNA, 22 bp, Artificial Sequence
  chemically synthesized
gcccatgatatgaattttatgc

SEQ ID NO: 803296 - DNA, 22 bp, Artificial Sequence
  chemically synthesized
tatgccaaagctttgctaattc

SEQ ID NO: 803297 - DNA, 22 bp, Artificial Sequence
  chemically synthesized
atgccaaagctttgctaattct

SEQ ID NO: 803298 - DNA, 22 bp, Artificial Sequence
  chemically synthesized
tgaaaaaggcaaagaattagca

SEQ ID NO: 803299 - DNA, 22 bp, Artificial Sequence
  chemically synthesized
tgccaaagctttgctaattctt

SEQ ID NO: 803300 - DNA, 22 bp, Artificial Sequence
  chemically synthesized
attgtgaaaaaggcaaagaatt

SEQ ID NO: 803301 - DNA, 22 bp, Artificial Sequence
  chemically synthesized
tgctaattctttgcctttttca

SEQ ID NO: 803302 - DNA, 22 bp, Artificial Sequence
  chemically synthesized
ataaactaattgtgaaaaaggc

SEQ ID NO: 803303 - DNA, 22 bp, Artificial Sequence
  chemically synthesized
gctaattctttgcctttttcac

SEQ ID NO: 803304 - DNA, 22 bp, Artificial Sequence
  chemically synthesized
aataaactaattgtgaaaaagg

SEQ ID NO: 803305 - DNA, 22 bp, Artificial Sequence
  chemically synthesized
ctaattctttgcctttttcaca

SEQ ID NO: 803306 - DNA, 22 bp, Artificial Sequence
  chemically synthesized
ttaataaactaattgtgaaaaa

SEQ ID NO: 803307 - DNA, 22 bp, Artificial Sequence
  chemically synthesized
attctttgcctttttcacaatt

SEQ ID NO: 803308 - DNA, 22 bp, Artificial Sequence
  chemically synthesized
tttgcctttttcacaattagtt

SEQ ID NO: 803309 - DNA, 22 bp, Artificial Sequence
  chemically synthesized
tgcctttttcacaattagttta

SEQ ID NO: 803310 - DNA, 22 bp, Artificial Sequence
  chemically synthesized
gcctttttcacaattagtttat

SEQ ID NO: 803311 - DNA, 22 bp, Artificial Sequence
  chemically synthesized
cctttttcacaattagtttatt

SEQ ID NO: 803312 - DNA, 22 bp, Artificial Sequence
  chemically synthesized
tagggaccctcttaataaacta

SEQ ID NO: 803313 - DNA, 22 bp, Artificial Sequence
  chemically synthesized
tttcacaattagtttattaaga

SEQ ID NO: 803314 - DNA, 22 bp, Artificial Sequence
  chemically synthesized
ttcacaattagtttattaagag

SEQ ID NO: 803315 - DNA, 22 bp, Artificial Sequence
  chemically synthesized
tcacaattagtttattaagagg

SEQ ID NO: 803316 - DNA, 22 bp, Artificial Sequence
  chemically synthesized
cacaattagtttattaagaggg

SEQ ID NO: 803317 - DNA, 22 bp, Artificial Sequence
  chemically synthesized
acaattagtttattaagagggt

SEQ ID NO: 803318 - DNA, 22 bp, Artificial Sequence
  chemically synthesized
aaaaagacagttatagggaccc

SEQ ID NO: 803319 - DNA, 22 bp, Artificial Sequence
  chemically synthesized
gtttattaagagggtccctata

SEQ ID NO: 803320 - DNA, 22 bp, Artificial Sequence
  chemically synthesized
ttcaaaaagacagttataggga

SEQ ID NO: 803321 - DNA, 22 bp, Artificial Sequence
  chemically synthesized
attaagagggtccctataactg

SEQ ID NO: 803322 - DNA, 22 bp, Artificial Sequence
  chemically synthesized
ttaagagggtccctataactgt

SEQ ID NO: 803323 - DNA, 22 bp, Artificial Sequence
  chemically synthesized
agagggtccctataactgtctt

SEQ ID NO: 803324 - DNA, 22 bp, Artificial Sequence
  chemically synthesized
tccatgttattcaaaaagacag

SEQ ID NO: 803325 - DNA, 22 bp, Artificial Sequence
  chemically synthesized
ttgtccatgttattcaaaaaga

SEQ ID NO: 803326 - DNA, 22 bp, Artificial Sequence
  chemically synthesized
taactgtctttttgaataacat

SEQ ID NO: 803327 - DNA, 22 bp, Artificial Sequence
  chemically synthesized
agtgatactattgtccatgtta

SEQ ID NO: 803328 - DNA, 22 bp, Artificial Sequence
  chemically synthesized
tctttttgaataacatggacaa

SEQ ID NO: 803329 - DNA, 22 bp, Artificial Sequence
  chemically synthesized
tttgaataacatggacaatagt

SEQ ID NO: 803330 - DNA, 22 bp, Artificial Sequence
  chemically synthesized
gtattaagtgatactattgtcc

SEQ ID NO: 803331 - DNA, 22 bp, Artificial Sequence
  chemically synthesized
ttgaataacatggacaatagta

SEQ ID NO: 803332 - DNA, 22 bp, Artificial Sequence
  chemically synthesized
tgaataacatggacaatagtat

SEQ ID NO: 803333 - DNA, 22 bp, Artificial Sequence
  chemically synthesized
gaataacatggacaatagtatc

SEQ ID NO: 803334 - DNA, 22 bp, Artificial Sequence
  chemically synthesized
aataacatggacaatagtatca

SEQ ID NO: 803335 - DNA, 22 bp, Artificial Sequence
  chemically synthesized
tagtacagaattggtattaagt

SEQ ID NO: 803336 - DNA, 22 bp, Artificial Sequence
  chemically synthesized
ctgtagtacagaattggtatta

SEQ ID NO: 803337 - DNA, 22 bp, Artificial Sequence
  chemically synthesized
actgtagtacagaattggtatt

SEQ ID NO: 803338 - DNA, 22 bp, Artificial Sequence
  chemically synthesized
cttactgtagtacagaattggt

SEQ ID NO: 803339 - DNA, 22 bp, Artificial Sequence
  chemically synthesized
aataccaattctgtactacagt

SEQ ID NO: 803340 - DNA, 22 bp, Artificial Sequence
  chemically synthesized
ataccaattctgtactacagta

SEQ ID NO: 803341 - DNA, 22 bp, Artificial Sequence
  chemically synthesized
aatgtcaccaaaatgttactta

SEQ ID NO: 803342 - DNA, 22 bp, Artificial Sequence
  chemically synthesized
tgtactacagtaagtaacattt

SEQ ID NO: 803343 - DNA, 22 bp, Artificial Sequence
  chemically synthesized
tactacagtaagtaacattttg

SEQ ID NO: 803344 - DNA, 22 bp, Artificial Sequence
  chemically synthesized
cagtaagtaacattttggtgac

SEQ ID NO: 803345 - DNA, 22 bp, Artificial Sequence
  chemically synthesized
agaaatatatctaaatgtcacc

SEQ ID NO: 803346 - DNA, 22 bp, Artificial Sequence
  chemically synthesized
tggtgacatttagatatatttc

SEQ ID NO: 803347 - DNA, 22 bp, Artificial Sequence
  chemically synthesized
ggtgacatttagatatatttct

SEQ ID NO: 803348 - DNA, 22 bp, Artificial Sequence
  chemically synthesized
catggtccactcagaaatatat

SEQ ID NO: 803349 - DNA, 22 bp, Artificial Sequence
  chemically synthesized
gtgacatttagatatatttctg

SEQ ID NO: 803350 - DNA, 22 bp, Artificial Sequence
  chemically synthesized
tccatggtccactcagaaatat

SEQ ID NO: 803351 - DNA, 22 bp, Artificial Sequence
  chemically synthesized
ctccatggtccactcagaaata

SEQ ID NO: 803352 - DNA, 22 bp, Artificial Sequence
  chemically synthesized
aatttctccatggtccactcag

SEQ ID NO: 803353 - DNA, 22 bp, Artificial Sequence
  chemically synthesized
gaatttctccatggtccactca

SEQ ID NO: 803354 - DNA, 22 bp, Artificial Sequence
  chemically synthesized
agatatatttctgagtggacca

SEQ ID NO: 803355 - DNA, 22 bp, Artificial Sequence
  chemically synthesized
gatatatttctgagtggaccat

SEQ ID NO: 803356 - DNA, 22 bp, Artificial Sequence
  chemically synthesized
tttgaatttctccatggtccac

SEQ ID NO: 803357 - DNA, 22 bp, Artificial Sequence
  chemically synthesized
ctgagtggaccatggagaaatt

SEQ ID NO: 803358 - DNA, 22 bp, Artificial Sequence
  chemically synthesized
tgtcgttatttgaatttctcca

SEQ ID NO: 803359 - DNA, 22 bp, Artificial Sequence
  chemically synthesized
tgagtggaccatggagaaattc

SEQ ID NO: 803360 - DNA, 22 bp, Artificial Sequence
  chemically synthesized
atgtcgttatttgaatttctcc

SEQ ID NO: 803361 - DNA, 22 bp, Artificial Sequence
  chemically synthesized
agtggaccatggagaaattcaa

SEQ ID NO: 803362 - DNA, 22 bp, Artificial Sequence
  chemically synthesized
cacacaaatttatgtcgttatt

SEQ ID NO: 803363 - DNA, 22 bp, Artificial Sequence
  chemically synthesized
tattacacacaaatttatgtcg

SEQ ID NO: 803364 - DNA, 22 bp, Artificial Sequence
  chemically synthesized
aaataacgacataaatttgtgt

SEQ ID NO: 803365 - DNA, 22 bp, Artificial Sequence
  chemically synthesized
gtgtgtaatataatttatttct

SEQ ID NO: 803366 - DNA, 22 bp, Artificial Sequence
  chemically synthesized
tgtgtaatataatttatttcta

SEQ ID NO: 803367 - DNA, 22 bp, Artificial Sequence
  chemically synthesized
aaggacatcaacatggaagcca

SEQ ID NO: 803368 - DNA, 22 bp, Artificial Sequence
  chemically synthesized
atttctatggcttccatgttga

SEQ ID NO: 803369 - DNA, 22 bp, Artificial Sequence
  chemically synthesized
tttctatggcttccatgttgat

SEQ ID NO: 803370 - DNA, 22 bp, Artificial Sequence
  chemically synthesized
aaattgaaggacatcaacatgg

SEQ ID NO: 803371 - DNA, 22 bp, Artificial Sequence
  chemically synthesized
aaaattgaaggacatcaacatg

SEQ ID NO: 803372 - DNA, 22 bp, Artificial Sequence
  chemically synthesized
ctatggcttccatgttgatgtc

SEQ ID NO: 803373 - DNA, 22 bp, Artificial Sequence
  chemically synthesized
tatggcttccatgttgatgtcc

SEQ ID NO: 803374 - DNA, 22 bp, Artificial Sequence
  chemically synthesized
tggcttccatgttgatgtcctt

SEQ ID NO: 803375 - DNA, 22 bp, Artificial Sequence
  chemically synthesized
aagatttaaaattgaaggacat

SEQ ID NO: 803376 - DNA, 22 bp, Artificial Sequence
  chemically synthesized
ccatgttgatgtccttcaattt

SEQ ID NO: 803377 - DNA, 22 bp, Artificial Sequence
  chemically synthesized
catgttgatgtccttcaatttt

SEQ ID NO: 803378 - DNA, 22 bp, Artificial Sequence
  chemically synthesized
ggttaaagatttaaaattgaag

SEQ ID NO: 803379 - DNA, 22 bp, Artificial Sequence
  chemically synthesized
atgtccttcaattttaaatctt

SEQ ID NO: 803380 - DNA, 22 bp, Artificial Sequence
  chemically synthesized
gaaaaagatctgggttaaagat

SEQ ID NO: 803381 - DNA, 22 bp, Artificial Sequence
  chemically synthesized
ggaaaaagatctgggttaaaga

SEQ ID NO: 803382 - DNA, 22 bp, Artificial Sequence
  chemically synthesized
caattttaaatctttaacccag

SEQ ID NO: 803383 - DNA, 22 bp, Artificial Sequence
  chemically synthesized
aattttaaatctttaacccaga

SEQ ID NO: 803384 - DNA, 22 bp, Artificial Sequence
  chemically synthesized
aggtttggaaaaagatctgggt

SEQ ID NO: 803385 - DNA, 22 bp, Artificial Sequence
  chemically synthesized
taaatctttaacccagatcttt

SEQ ID NO: 803386 - DNA, 22 bp, Artificial Sequence
  chemically synthesized
aaatctttaacccagatctttt

SEQ ID NO: 803387 - DNA, 22 bp, Artificial Sequence
  chemically synthesized
aatctttaacccagatcttttt

SEQ ID NO: 803388 - DNA, 22 bp, Artificial Sequence
  chemically synthesized
taacccagatctttttccaaac

SEQ ID NO: 803389 - DNA, 22 bp, Artificial Sequence
  chemically synthesized
aacccagatctttttccaaacc

SEQ ID NO: 803390 - DNA, 22 bp, Artificial Sequence
  chemically synthesized
acccagatctttttccaaacct

SEQ ID NO: 803391 - DNA, 22 bp, Artificial Sequence
  chemically synthesized
tgaatgtaaatctaaggtttgg

SEQ ID NO: 803392 - DNA, 22 bp, Artificial Sequence
  chemically synthesized
tttccaaaccttagatttacat

SEQ ID NO: 803393 - DNA, 22 bp, Artificial Sequence
  chemically synthesized
aagcagttgtgaatgtaaatct

SEQ ID NO: 803394 - DNA, 22 bp, Artificial Sequence
  chemically synthesized
ttccaaaccttagatttacatt

SEQ ID NO: 803395 - DNA, 22 bp, Artificial Sequence
  chemically synthesized
gaagcagttgtgaatgtaaatc

SEQ ID NO: 803396 - DNA, 22 bp, Artificial Sequence
  chemically synthesized
tccaaaccttagatttacattc

SEQ ID NO: 803397 - DNA, 22 bp, Artificial Sequence
  chemically synthesized
ccaaaccttagatttacattca

SEQ ID NO: 803398 - DNA, 22 bp, Artificial Sequence
  chemically synthesized
ttgaagcagttgtgaatgtaaa

SEQ ID NO: 803399 - DNA, 22 bp, Artificial Sequence
  chemically synthesized
caaaccttagatttacattcac

SEQ ID NO: 803400 - DNA, 22 bp, Artificial Sequence
  chemically synthesized
tcttgaagcagttgtgaatgta

SEQ ID NO: 803401 - DNA, 22 bp, Artificial Sequence
  chemically synthesized
cctctcttgaagcagttgtgaa

SEQ ID NO: 803402 - DNA, 22 bp, Artificial Sequence
  chemically synthesized
acctctcttgaagcagttgtga

SEQ ID NO: 803403 - DNA, 22 bp, Artificial Sequence
  chemically synthesized
agatttacattcacaactgctt

SEQ ID NO: 803404 - DNA, 22 bp, Artificial Sequence
  chemically synthesized
gatttacattcacaactgcttc

SEQ ID NO: 803405 - DNA, 22 bp, Artificial Sequence
  chemically synthesized
acattcacaactgcttcaagag

SEQ ID NO: 803406 - DNA, 22 bp, Artificial Sequence
  chemically synthesized
cattcacaactgcttcaagaga

SEQ ID NO: 803407 - DNA, 22 bp, Artificial Sequence
  chemically synthesized
acaactgcttcaagagaggtaa

SEQ ID NO: 803408 - DNA, 22 bp, Artificial Sequence
  chemically synthesized
cttcaagagaggtaaggttttc

SEQ ID NO: 803409 - DNA, 22 bp, Artificial Sequence
  chemically synthesized
caagagaggtaaggttttcacc

SEQ ID NO: 803410 - DNA, 22 bp, Artificial Sequence
  chemically synthesized
aagagaggtaaggttttcacct

SEQ ID NO: 803411 - DNA, 22 bp, Artificial Sequence
  chemically synthesized
taagtgaaaaatcagaggtgaa

SEQ ID NO: 803412 - DNA, 22 bp, Artificial Sequence
  chemically synthesized
aggtatctgtaagtgaaaaatc

SEQ ID NO: 803413 - DNA, 22 bp, Artificial Sequence
  chemically synthesized
gaggtatctgtaagtgaaaaat

SEQ ID NO: 803414 - DNA, 22 bp, Artificial Sequence
  chemically synthesized
tgaggtatctgtaagtgaaaaa

SEQ ID NO: 803415 - DNA, 22 bp, Artificial Sequence
  chemically synthesized
tcacctctgatttttcacttac

SEQ ID NO: 803416 - DNA, 22 bp, Artificial Sequence
  chemically synthesized
cacctctgatttttcacttaca

SEQ ID NO: 803417 - DNA, 22 bp, Artificial Sequence
  chemically synthesized
acctctgatttttcacttacag

SEQ ID NO: 803418 - DNA, 22 bp, Artificial Sequence
  chemically synthesized
attttgaggtatctgtaagtga

SEQ ID NO: 803419 - DNA, 22 bp, Artificial Sequence
  chemically synthesized
gattttgaggtatctgtaagtg

SEQ ID NO: 803420 - DNA, 22 bp, Artificial Sequence
  chemically synthesized
tgatttttcacttacagatacc

SEQ ID NO: 803421 - DNA, 22 bp, Artificial Sequence
  chemically synthesized
atttttcacttacagatacctc

SEQ ID NO: 803422 - DNA, 22 bp, Artificial Sequence
  chemically synthesized
ttcacttacagatacctcaaaa

SEQ ID NO: 803423 - DNA, 22 bp, Artificial Sequence
  chemically synthesized
tcacttacagatacctcaaaat

SEQ ID NO: 803424 - DNA, 22 bp, Artificial Sequence
  chemically synthesized
cacttacagatacctcaaaatc

SEQ ID NO: 803425 - DNA, 22 bp, Artificial Sequence
  chemically synthesized
acttacagatacctcaaaatca

SEQ ID NO: 803426 - DNA, 22 bp, Artificial Sequence
  chemically synthesized
acagatacctcaaaatcaaaca

SEQ ID NO: 803427 - DNA, 22 bp, Artificial Sequence
  chemically synthesized
cagatacctcaaaatcaaacac

SEQ ID NO: 803428 - DNA, 22 bp, Artificial Sequence
  chemically synthesized
tgaggagcaaagtcaagaacgt

SEQ ID NO: 803429 - DNA, 22 bp, Artificial Sequence
  chemically synthesized
aaaatcaaacacgttcttgact

SEQ ID NO: 803430 - DNA, 22 bp, Artificial Sequence
  chemically synthesized
aagatggcaaacagttgtgagg

SEQ ID NO: 803431 - DNA, 22 bp, Artificial Sequence
  chemically synthesized
ttgactttgctcctcacaactg

SEQ ID NO: 803432 - DNA, 22 bp, Artificial Sequence
  chemically synthesized
gactttgctcctcacaactgtt

SEQ ID NO: 803433 - DNA, 22 bp, Artificial Sequence
  chemically synthesized
actttgctcctcacaactgttt

SEQ ID NO: 803434 - DNA, 22 bp, Artificial Sequence
  chemically synthesized
tgctcctcacaactgtttgcca

SEQ ID NO: 803435 - DNA, 22 bp, Artificial Sequence
  chemically synthesized
cagaattcaagatggcaaacag

SEQ ID NO: 803436 - DNA, 22 bp, Artificial Sequence
  chemically synthesized
gctcctcacaactgtttgccat

SEQ ID NO: 803437 - DNA, 22 bp, Artificial Sequence
  chemically synthesized
ctcctcacaactgtttgccatc

SEQ ID NO: 803438 - DNA, 22 bp, Artificial Sequence
  chemically synthesized
ctcacaactgtttgccatcttg

SEQ ID NO: 803439 - DNA, 22 bp, Artificial Sequence
  chemically synthesized
acaactgtttgccatcttgaat

SEQ ID NO: 803440 - DNA, 22 bp, Artificial Sequence
  chemically synthesized
aatcatgagttgcagaattcaa

SEQ ID NO: 803441 - DNA, 22 bp, Artificial Sequence
  chemically synthesized
tttgccatcttgaattctgcaa

SEQ ID NO: 803442 - DNA, 22 bp, Artificial Sequence
  chemically synthesized
actcaatcatgagttgcagaat

SEQ ID NO: 803443 - DNA, 22 bp, Artificial Sequence
  chemically synthesized
cactcaatcatgagttgcagaa

SEQ ID NO: 803444 - DNA, 22 bp, Artificial Sequence
  chemically synthesized
gccatcttgaattctgcaactc

SEQ ID NO: 803445 - DNA, 22 bp, Artificial Sequence
  chemically synthesized
ccatcttgaattctgcaactca

SEQ ID NO: 803446 - DNA, 22 bp, Artificial Sequence
  chemically synthesized
gaattctgcaactcatgattga

SEQ ID NO: 803447 - DNA, 22 bp, Artificial Sequence
  chemically synthesized
aattctgcaactcatgattgag

SEQ ID NO: 803448 - DNA, 22 bp, Artificial Sequence
  chemically synthesized
aaggtagtgtcttcactcaatc

SEQ ID NO: 803449 - DNA, 22 bp, Artificial Sequence
  chemically synthesized
tgcaactcatgattgagtgaag

SEQ ID NO: 803450 - DNA, 22 bp, Artificial Sequence
  chemically synthesized
caactcatgattgagtgaagac

SEQ ID NO: 803451 - DNA, 22 bp, Artificial Sequence
  chemically synthesized
actgaaggtagtgtcttcactc

SEQ ID NO: 803452 - DNA, 22 bp, Artificial Sequence
  chemically synthesized
atgattgagtgaagacactacc

SEQ ID NO: 803453 - DNA, 22 bp, Artificial Sequence
  chemically synthesized
gcatgattgactgaaggtagtg

SEQ ID NO: 803454 - DNA, 22 bp, Artificial Sequence
  chemically synthesized
ggcatgattgactgaaggtagt

SEQ ID NO: 803455 - DNA, 22 bp, Artificial Sequence
  chemically synthesized
agtgaagacactaccttcagtc

SEQ ID NO: 803456 - DNA, 22 bp, Artificial Sequence
  chemically synthesized
ccacttggcatgattgactgaa

SEQ ID NO: 803457 - DNA, 22 bp, Artificial Sequence
  chemically synthesized
accacttggcatgattgactga

SEQ ID NO: 803458 - DNA, 22 bp, Artificial Sequence
  chemically synthesized
cttaccacttggcatgattgac

SEQ ID NO: 803459 - DNA, 22 bp, Artificial Sequence
  chemically synthesized
ccttcagtcaatcatgccaagt

SEQ ID NO: 803460 - DNA, 22 bp, Artificial Sequence
  chemically synthesized
cagtcaatcatgccaagtggta

SEQ ID NO: 803461 - DNA, 22 bp, Artificial Sequence
  chemically synthesized
agtcaatcatgccaagtggtaa

SEQ ID NO: 803462 - DNA, 22 bp, Artificial Sequence
  chemically synthesized
atttctcattttacctcacatt

SEQ ID NO: 803463 - DNA, 22 bp, Artificial Sequence
  chemically synthesized
ctcattttacctcacattttct

SEQ ID NO: 803464 - DNA, 22 bp, Artificial Sequence
  chemically synthesized
tcattttacctcacattttctg

SEQ ID NO: 803465 - DNA, 22 bp, Artificial Sequence
  chemically synthesized
attttacctcacattttctgct

SEQ ID NO: 803466 - DNA, 22 bp, Artificial Sequence
  chemically synthesized
tgggaggtggaggtgagcagaa

SEQ ID NO: 803467 - DNA, 22 bp, Artificial Sequence
  chemically synthesized
tacctcacattttctgctcacc

SEQ ID NO: 803468 - DNA, 22 bp, Artificial Sequence
  chemically synthesized
gtgggaggtggaggtgagcaga

SEQ ID NO: 803469 - DNA, 22 bp, Artificial Sequence
  chemically synthesized
acctcacattttctgctcacct

SEQ ID NO: 803470 - DNA, 22 bp, Artificial Sequence
  chemically synthesized
tgtgggaggtggaggtgagcag

SEQ ID NO: 803471 - DNA, 22 bp, Artificial Sequence
  chemically synthesized
cctcacattttctgctcacctc

SEQ ID NO: 803472 - DNA, 22 bp, Artificial Sequence
  chemically synthesized
acattttctgctcacctccacc

SEQ ID NO: 803473 - DNA, 22 bp, Artificial Sequence
  chemically synthesized
tcatatgttttgtgggaggtgg

SEQ ID NO: 803474 - DNA, 22 bp, Artificial Sequence
  chemically synthesized
tctgctcacctccacctcccac

SEQ ID NO: 803475 - DNA, 22 bp, Artificial Sequence
  chemically synthesized
ctgctcacctccacctcccaca

SEQ ID NO: 803476 - DNA, 22 bp, Artificial Sequence
  chemically synthesized
tgctcacctccacctcccacaa

SEQ ID NO: 803477 - DNA, 22 bp, Artificial Sequence
  chemically synthesized
ctcacctccacctcccacaaaa

SEQ ID NO: 803478 - DNA, 22 bp, Artificial Sequence
  chemically synthesized
acctccacctcccacaaaacat

SEQ ID NO: 803479 - DNA, 22 bp, Artificial Sequence
  chemically synthesized
cacctcccacaaaacatatgac

SEQ ID NO: 803480 - DNA, 22 bp, Artificial Sequence
  chemically synthesized
gagataaaatcaacactgtcat

SEQ ID NO: 803481 - DNA, 22 bp, Artificial Sequence
  chemically synthesized
ccacaaaacatatgacagtgtt

SEQ ID NO: 803482 - DNA, 22 bp, Artificial Sequence
  chemically synthesized
ggagataaaatcaacactgtca

SEQ ID NO: 803483 - DNA, 22 bp, Artificial Sequence
  chemically synthesized
tttggagataaaatcaacactg

SEQ ID NO: 803484 - DNA, 22 bp, Artificial Sequence
  chemically synthesized
attttatctccaaatagctcac

SEQ ID NO: 803485 - DNA, 22 bp, Artificial Sequence
  chemically synthesized
tatctccaaatagctcacgtat

SEQ ID NO: 803486 - DNA, 22 bp, Artificial Sequence
  chemically synthesized
atctccaaatagctcacgtatc

SEQ ID NO: 803487 - DNA, 22 bp, Artificial Sequence
  chemically synthesized
tctccaaatagctcacgtatct

SEQ ID NO: 803488 - DNA, 22 bp, Artificial Sequence
  chemically synthesized
aacaaacaaaacagatacgtga

SEQ ID NO: 803489 - DNA, 22 bp, Artificial Sequence
  chemically synthesized
caaatagctcacgtatctgttt

SEQ ID NO: 803490 - DNA, 22 bp, Artificial Sequence
  chemically synthesized
acgtatctgttttgtttgttca

SEQ ID NO: 803491 - DNA, 22 bp, Artificial Sequence
  chemically synthesized
atgatcaaagtggtgaggttga

SEQ ID NO: 803492 - DNA, 22 bp, Artificial Sequence
  chemically synthesized
ttttgtttgttcaacctcacca

SEQ ID NO: 803493 - DNA, 22 bp, Artificial Sequence
  chemically synthesized
tgtttgttcaacctcaccactt

SEQ ID NO: 803494 - DNA, 22 bp, Artificial Sequence
  chemically synthesized
gtttgttcaacctcaccacttt

SEQ ID NO: 803495 - DNA, 22 bp, Artificial Sequence
  chemically synthesized
tttgttcaacctcaccactttg

SEQ ID NO: 803496 - DNA, 22 bp, Artificial Sequence
  chemically synthesized
gttcaacctcaccactttgatc

SEQ ID NO: 803497 - DNA, 22 bp, Artificial Sequence
  chemically synthesized
ttcaacctcaccactttgatca

SEQ ID NO: 803498 - DNA, 22 bp, Artificial Sequence
  chemically synthesized
aacctcaccactttgatcatca

SEQ ID NO: 803499 - DNA, 22 bp, Artificial Sequence
  chemically synthesized
accactttgatcatcaattctt

SEQ ID NO: 803500 - DNA, 22 bp, Artificial Sequence
  chemically synthesized
taataagccaagcaagaattga

SEQ ID NO: 803501 - DNA, 22 bp, Artificial Sequence
  chemically synthesized
tgtaataagccaagcaagaatt

SEQ ID NO: 803502 - DNA, 22 bp, Artificial Sequence
  chemically synthesized
ctgtaataagccaagcaagaat

SEQ ID NO: 803503 - DNA, 22 bp, Artificial Sequence
  chemically synthesized
tgatcatcaattcttgcttggc

SEQ ID NO: 803504 - DNA, 22 bp, Artificial Sequence
  chemically synthesized
tttctgtaataagccaagcaag

SEQ ID NO: 803505 - DNA, 22 bp, Artificial Sequence
  chemically synthesized
gatcatcaattcttgcttggct

SEQ ID NO: 803506 - DNA, 22 bp, Artificial Sequence
  chemically synthesized
atcatcaattcttgcttggctt

SEQ ID NO: 803507 - DNA, 22 bp, Artificial Sequence
  chemically synthesized
ggacattatttctgtaataagc

SEQ ID NO: 803508 - DNA, 22 bp, Artificial Sequence
  chemically synthesized
ttgcttggcttattacagaaat

SEQ ID NO: 803509 - DNA, 22 bp, Artificial Sequence
  chemically synthesized
gcttggcttattacagaaataa

SEQ ID NO: 803510 - DNA, 22 bp, Artificial Sequence
  chemically synthesized
cttggcttattacagaaataat

SEQ ID NO: 803511 - DNA, 22 bp, Artificial Sequence
  chemically synthesized
ggcttattacagaaataatgtc

SEQ ID NO: 803512 - DNA, 22 bp, Artificial Sequence
  chemically synthesized
gcttattacagaaataatgtcc

SEQ ID NO: 803513 - DNA, 22 bp, Artificial Sequence
  chemically synthesized
attacagaaataatgtcctaac

SEQ ID NO: 803514 - DNA, 22 bp, Artificial Sequence
  chemically synthesized
ttacagaaataatgtcctaact

SEQ ID NO: 803515 - DNA, 22 bp, Artificial Sequence
  chemically synthesized
cagaaataatgtcctaactgtt

SEQ ID NO: 803516 - DNA, 22 bp, Artificial Sequence
  chemically synthesized
gaaagatatgagacccatgcag

SEQ ID NO: 803517 - DNA, 22 bp, Artificial Sequence
  chemically synthesized
actgttgtccctgcatgggtct

SEQ ID NO: 803518 - DNA, 22 bp, Artificial Sequence
  chemically synthesized
ttgtccctgcatgggtctcata

SEQ ID NO: 803519 - DNA, 22 bp, Artificial Sequence
  chemically synthesized
tccctgcatgggtctcatatct

SEQ ID NO: 803520 - DNA, 22 bp, Artificial Sequence
  chemically synthesized
ggagaatgaattggaaagatat

SEQ ID NO: 803521 - DNA, 22 bp, Artificial Sequence
  chemically synthesized
catgggtctcatatctttccaa

SEQ ID NO: 803522 - DNA, 22 bp, Artificial Sequence
  chemically synthesized
gtagtggttaggagaatgaatt

SEQ ID NO: 803523 - DNA, 22 bp, Artificial Sequence
  chemically synthesized
atatctttccaattcattctcc

SEQ ID NO: 803524 - DNA, 22 bp, Artificial Sequence
  chemically synthesized
tggtagtggttaggagaatgaa

SEQ ID NO: 803525 - DNA, 22 bp, Artificial Sequence
  chemically synthesized
tccaattcattctcctaaccac

SEQ ID NO: 803526 - DNA, 22 bp, Artificial Sequence
  chemically synthesized
ccaattcattctcctaaccact

SEQ ID NO: 803527 - DNA, 22 bp, Artificial Sequence
  chemically synthesized
caattcattctcctaaccacta

SEQ ID NO: 803528 - DNA, 22 bp, Artificial Sequence
  chemically synthesized
aaagatcattctggtagtggtt

SEQ ID NO: 803529 - DNA, 22 bp, Artificial Sequence
  chemically synthesized
aaaagatcattctggtagtggt

SEQ ID NO: 803530 - DNA, 22 bp, Artificial Sequence
  chemically synthesized
taaaagatcattctggtagtgg

SEQ ID NO: 803531 - DNA, 22 bp, Artificial Sequence
  chemically synthesized
ttaaaagatcattctggtagtg

SEQ ID NO: 803532 - DNA, 22 bp, Artificial Sequence
  chemically synthesized
attctcctaaccactaccagaa

SEQ ID NO: 803533 - DNA, 22 bp, Artificial Sequence
  chemically synthesized
tcctaaccactaccagaatgat

SEQ ID NO: 803534 - DNA, 22 bp, Artificial Sequence
  chemically synthesized
ctaaccactaccagaatgatct

SEQ ID NO: 803535 - DNA, 22 bp, Artificial Sequence
  chemically synthesized
accactaccagaatgatctttt

SEQ ID NO: 803536 - DNA, 22 bp, Artificial Sequence
  chemically synthesized
atcagacatgtttttaaaagat

SEQ ID NO: 803537 - DNA, 22 bp, Artificial Sequence
  chemically synthesized
ccagaatgatcttttaaaaaca

SEQ ID NO: 803538 - DNA, 22 bp, Artificial Sequence
  chemically synthesized
ttaaaaacatgtctgattagtc

SEQ ID NO: 803539 - DNA, 22 bp, Artificial Sequence
  chemically synthesized
agcaaggaaatggactaatcag

SEQ ID NO: 803540 - DNA, 22 bp, Artificial Sequence
  chemically synthesized
taaaaacatgtctgattagtcc

SEQ ID NO: 803541 - DNA, 22 bp, Artificial Sequence
  chemically synthesized
aaaaacatgtctgattagtcca

SEQ ID NO: 803542 - DNA, 22 bp, Artificial Sequence
  chemically synthesized
taagcaaggaaatggactaatc

SEQ ID NO: 803543 - DNA, 22 bp, Artificial Sequence
  chemically synthesized
aaaacatgtctgattagtccat

SEQ ID NO: 803544 - DNA, 22 bp, Artificial Sequence
  chemically synthesized
gttctaagcaaggaaatggact

SEQ ID NO: 803545 - DNA, 22 bp, Artificial Sequence
  chemically synthesized
attagtccatttccttgcttag

SEQ ID NO: 803546 - DNA, 22 bp, Artificial Sequence
  chemically synthesized
agtcatagcctagttctaagca

SEQ ID NO: 803547 - DNA, 22 bp, Artificial Sequence
  chemically synthesized
gtccatttccttgcttagaact

SEQ ID NO: 803548 - DNA, 22 bp, Artificial Sequence
  chemically synthesized
aagtcatagcctagttctaagc

SEQ ID NO: 803549 - DNA, 22 bp, Artificial Sequence
  chemically synthesized
taagtcatagcctagttctaag

SEQ ID NO: 803550 - DNA, 22 bp, Artificial Sequence
  chemically synthesized
tcactttaagtcatagcctagt

SEQ ID NO: 803551 - DNA, 22 bp, Artificial Sequence
  chemically synthesized
ccttgcttagaactaggctatg

SEQ ID NO: 803552 - DNA, 22 bp, Artificial Sequence
  chemically synthesized
atcactttaagtcatagcctag

SEQ ID NO: 803553 - DNA, 22 bp, Artificial Sequence
  chemically synthesized
cttgcttagaactaggctatga

SEQ ID NO: 803554 - DNA, 22 bp, Artificial Sequence
  chemically synthesized
tatcactttaagtcatagccta

SEQ ID NO: 803555 - DNA, 22 bp, Artificial Sequence
  chemically synthesized
ttatcactttaagtcatagcct

SEQ ID NO: 803556 - DNA, 22 bp, Artificial Sequence
  chemically synthesized
gcttagaactaggctatgactt

SEQ ID NO: 803557 - DNA, 22 bp, Artificial Sequence
  chemically synthesized
cttagaactaggctatgactta

SEQ ID NO: 803558 - DNA, 22 bp, Artificial Sequence
  chemically synthesized
gacttttatcactttaagtcat

SEQ ID NO: 803559 - DNA, 22 bp, Artificial Sequence
  chemically synthesized
agaactaggctatgacttaaag

SEQ ID NO: 803560 - DNA, 22 bp, Artificial Sequence
  chemically synthesized
gaactaggctatgacttaaagt

SEQ ID NO: 803561 - DNA, 22 bp, Artificial Sequence
  chemically synthesized
tggacttttatcactttaagtc

SEQ ID NO: 803562 - DNA, 22 bp, Artificial Sequence
  chemically synthesized
ggctatgacttaaagtgataaa

SEQ ID NO: 803563 - DNA, 22 bp, Artificial Sequence
  chemically synthesized
agactctggacttttatcactt

SEQ ID NO: 803564 - DNA, 22 bp, Artificial Sequence
  chemically synthesized
cagactctggacttttatcact

SEQ ID NO: 803565 - DNA, 22 bp, Artificial Sequence
  chemically synthesized
tcagactctggacttttatcac

SEQ ID NO: 803566 - DNA, 22 bp, Artificial Sequence
  chemically synthesized
ttcagactctggacttttatca

SEQ ID NO: 803567 - DNA, 22 bp, Artificial Sequence
  chemically synthesized
tgacttaaagtgataaaagtcc

SEQ ID NO: 803568 - DNA, 22 bp, Artificial Sequence
  chemically synthesized
tttttcagactctggactttta

SEQ ID NO: 803569 - DNA, 22 bp, Artificial Sequence
  chemically synthesized
aaagtgataaaagtccagagtc

SEQ ID NO: 803570 - DNA, 22 bp, Artificial Sequence
  chemically synthesized
aagtgataaaagtccagagtct

SEQ ID NO: 803571 - DNA, 22 bp, Artificial Sequence
  chemically synthesized
ccacctatttttcagactctgg

SEQ ID NO: 803572 - DNA, 22 bp, Artificial Sequence
  chemically synthesized
gccacctatttttcagactctg

SEQ ID NO: 803573 - DNA, 22 bp, Artificial Sequence
  chemically synthesized
ccccttgccacctatttttcag

SEQ ID NO: 803574 - DNA, 22 bp, Artificial Sequence
  chemically synthesized
tgccccttgccacctatttttc

SEQ ID NO: 803575 - DNA, 22 bp, Artificial Sequence
  chemically synthesized
tctgccccttgccacctatttt

SEQ ID NO: 803576 - DNA, 22 bp, Artificial Sequence
  chemically synthesized
tctctgccccttgccacctatt

SEQ ID NO: 803577 - DNA, 22 bp, Artificial Sequence
  chemically synthesized
gctctctctgccccttgccacc

SEQ ID NO: 803578 - DNA, 22 bp, Artificial Sequence
  chemically synthesized
aaaaataggtggcaaggggcag

SEQ ID NO: 803579 - DNA, 22 bp, Artificial Sequence
  chemically synthesized
agtaagtgtaagctggctctct

SEQ ID NO: 803580 - DNA, 22 bp, Artificial Sequence
  chemically synthesized
gaagggctcagtaagtgtaagc

SEQ ID NO: 803581 - DNA, 22 bp, Artificial Sequence
  chemically synthesized
gactcgaagggctcagtaagtg

SEQ ID NO: 803582 - DNA, 22 bp, Artificial Sequence
  chemically synthesized
ttggactcgaagggctcagtaa

SEQ ID NO: 803583 - DNA, 22 bp, Artificial Sequence
  chemically synthesized
acacttactgagcccttcgagt

SEQ ID NO: 803584 - DNA, 22 bp, Artificial Sequence
  chemically synthesized
cacttactgagcccttcgagtc

SEQ ID NO: 803585 - DNA, 22 bp, Artificial Sequence
  chemically synthesized
actgagcccttcgagtccaata

SEQ ID NO: 803586 - DNA, 22 bp, Artificial Sequence
  chemically synthesized
ctgagcccttcgagtccaatag

SEQ ID NO: 803587 - DNA, 22 bp, Artificial Sequence
  chemically synthesized
agcccttcgagtccaatagtct

SEQ ID NO: 803588 - DNA, 22 bp, Artificial Sequence
  chemically synthesized
cgagtccaatagtctgcctctc

SEQ ID NO: 803589 - DNA, 22 bp, Artificial Sequence
  chemically synthesized
gagtccaatagtctgcctctct

SEQ ID NO: 803590 - DNA, 22 bp, Artificial Sequence
  chemically synthesized
cctctctggtatgcattttaca

SEQ ID NO: 803591 - DNA, 22 bp, Artificial Sequence
  chemically synthesized
aatgataagatatatgtaaaat

SEQ ID NO: 803592 - DNA, 22 bp, Artificial Sequence
  chemically synthesized
aaatgataagatatatgtaaaa

SEQ ID NO: 803593 - DNA, 22 bp, Artificial Sequence
  chemically synthesized
tctggtatgcattttacatata

SEQ ID NO: 803594 - DNA, 22 bp, Artificial Sequence
  chemically synthesized
tggtatgcattttacatatatc

SEQ ID NO: 803595 - DNA, 22 bp, Artificial Sequence
  chemically synthesized
gtatgcattttacatatatctt

SEQ ID NO: 803596 - DNA, 22 bp, Artificial Sequence
  chemically synthesized
tcaggtttaaatgataagatat

SEQ ID NO: 803597 - DNA, 22 bp, Artificial Sequence
  chemically synthesized
atcaggtttaaatgataagata

SEQ ID NO: 803598 - DNA, 22 bp, Artificial Sequence
  chemically synthesized
tatcaggtttaaatgataagat

SEQ ID NO: 803599 - DNA, 22 bp, Artificial Sequence
  chemically synthesized
tacatatatcttatcatttaaa

SEQ ID NO: 803600 - DNA, 22 bp, Artificial Sequence
  chemically synthesized
acatatatcttatcatttaaac

SEQ ID NO: 803601 - DNA, 22 bp, Artificial Sequence
  chemically synthesized
catatatcttatcatttaaacc

SEQ ID NO: 803602 - DNA, 22 bp, Artificial Sequence
  chemically synthesized
atcatttaaacctgataaaatc

SEQ ID NO: 803603 - DNA, 22 bp, Artificial Sequence
  chemically synthesized
tcatttaaacctgataaaatcc

SEQ ID NO: 803604 - DNA, 22 bp, Artificial Sequence
  chemically synthesized
aaacctgataaaatcctgtgat

SEQ ID NO: 803605 - DNA, 22 bp, Artificial Sequence
  chemically synthesized
tacaatgagtacatcacaggat

SEQ ID NO: 803606 - DNA, 22 bp, Artificial Sequence
  chemically synthesized
aacctgataaaatcctgtgatg

SEQ ID NO: 803607 - DNA, 22 bp, Artificial Sequence
  chemically synthesized
tatacaatgagtacatcacagg

SEQ ID NO: 803608 - DNA, 22 bp, Artificial Sequence
  chemically synthesized
ctatacaatgagtacatcacag

SEQ ID NO: 803609 - DNA, 22 bp, Artificial Sequence
  chemically synthesized
ttctatacaatgagtacatcac

SEQ ID NO: 803610 - DNA, 22 bp, Artificial Sequence
  chemically synthesized
ataaaatcctgtgatgtactca

SEQ ID NO: 803611 - DNA, 22 bp, Artificial Sequence
  chemically synthesized
ctcttctatacaatgagtacat

SEQ ID NO: 803612 - DNA, 22 bp, Artificial Sequence
  chemically synthesized
actcttctatacaatgagtaca

SEQ ID NO: 803613 - DNA, 22 bp, Artificial Sequence
  chemically synthesized
tactcttctatacaatgagtac

SEQ ID NO: 803614 - DNA, 22 bp, Artificial Sequence
  chemically synthesized
tgatgtactcattgtatagaag

SEQ ID NO: 803615 - DNA, 22 bp, Artificial Sequence
  chemically synthesized
agtcccaattttactcttctat

SEQ ID NO: 803616 - DNA, 22 bp, Artificial Sequence
  chemically synthesized
tgagtcccaattttactcttct

SEQ ID NO: 803617 - DNA, 22 bp, Artificial Sequence
  chemically synthesized
attgtatagaagagtaaaattg

SEQ ID NO: 803618 - DNA, 22 bp, Artificial Sequence
  chemically synthesized
acctctgagtcccaattttact

SEQ ID NO: 803619 - DNA, 22 bp, Artificial Sequence
  chemically synthesized
tatagaagagtaaaattgggac

SEQ ID NO: 803620 - DNA, 22 bp, Artificial Sequence
  chemically synthesized
tctgacctctgagtcccaattt

SEQ ID NO: 803621 - DNA, 22 bp, Artificial Sequence
  chemically synthesized
ttgtctgacctctgagtcccaa

SEQ ID NO: 803622 - DNA, 22 bp, Artificial Sequence
  chemically synthesized
attgtctgacctctgagtccca

SEQ ID NO: 803623 - DNA, 22 bp, Artificial Sequence
  chemically synthesized
gcttattgtctgacctctgagt

SEQ ID NO: 803624 - DNA, 22 bp, Artificial Sequence
  chemically synthesized
ctagcttattgtctgacctctg

SEQ ID NO: 803625 - DNA, 22 bp, Artificial Sequence
  chemically synthesized
actagcttattgtctgacctct

SEQ ID NO: 803626 - DNA, 22 bp, Artificial Sequence
  chemically synthesized
ggactcagaggtcagacaataa

SEQ ID NO: 803627 - DNA, 22 bp, Artificial Sequence
  chemically synthesized
gcacttactagcttattgtctg

SEQ ID NO: 803628 - DNA, 22 bp, Artificial Sequence
  chemically synthesized
agcacttactagcttattgtct

SEQ ID NO: 803629 - DNA, 22 bp, Artificial Sequence
  chemically synthesized
tttagcacttactagcttattg

SEQ ID NO: 803630 - DNA, 22 bp, Artificial Sequence
  chemically synthesized
atttagcacttactagcttatt

SEQ ID NO: 803631 - DNA, 22 bp, Artificial Sequence
  chemically synthesized
agaggtcagacaataagctagt

SEQ ID NO: 803632 - DNA, 22 bp, Artificial Sequence
  chemically synthesized
taagcaggaagaccccttattt

SEQ ID NO: 803633 - DNA, 22 bp, Artificial Sequence
  chemically synthesized
gtaagcaggaagaccccttatt

SEQ ID NO: 803634 - DNA, 22 bp, Artificial Sequence
  chemically synthesized
gtaagtgctaaataaggggtct

SEQ ID NO: 803635 - DNA, 22 bp, Artificial Sequence
  chemically synthesized
aataaggggtcttcctgcttac

SEQ ID NO: 803636 - DNA, 22 bp, Artificial Sequence
  chemically synthesized
gagtatggaccttgtaagcagg

SEQ ID NO: 803637 - DNA, 22 bp, Artificial Sequence
  chemically synthesized
cctgcttacaaggtccatactc

SEQ ID NO: 803638 - DNA, 22 bp, Artificial Sequence
  chemically synthesized
ctgcttacaaggtccatactct

SEQ ID NO: 803639 - DNA, 22 bp, Artificial Sequence
  chemically synthesized
cttacaaggtccatactctagc

SEQ ID NO: 803640 - DNA, 22 bp, Artificial Sequence
  chemically synthesized
acaaggtccatactctagctgc

SEQ ID NO: 803641 - DNA, 22 bp, Artificial Sequence
  chemically synthesized
caaggtccatactctagctgct

SEQ ID NO: 803642 - DNA, 22 bp, Artificial Sequence
  chemically synthesized
tgtggaaagacagcatgatgta

SEQ ID NO: 803643 - DNA, 22 bp, Artificial Sequence
  chemically synthesized
tagctgctacatcatgctgtct

SEQ ID NO: 803644 - DNA, 22 bp, Artificial Sequence
  chemically synthesized
aattatgtggaaagacagcatg

SEQ ID NO: 803645 - DNA, 22 bp, Artificial Sequence
  chemically synthesized
gctgctacatcatgctgtcttt

SEQ ID NO: 803646 - DNA, 22 bp, Artificial Sequence
  chemically synthesized
ctacatcatgctgtctttccac

SEQ ID NO: 803647 - DNA, 22 bp, Artificial Sequence
  chemically synthesized
gggctaaattatgtggaaagac

SEQ ID NO: 803648 - DNA, 22 bp, Artificial Sequence
  chemically synthesized
catcatgctgtctttccacata

SEQ ID NO: 803649 - DNA, 22 bp, Artificial Sequence
  chemically synthesized
gatcaactggggctaaattatg

SEQ ID NO: 803650 - DNA, 22 bp, Artificial Sequence
  chemically synthesized
tctttccacataatttagcccc

SEQ ID NO: 803651 - DNA, 22 bp, Artificial Sequence
  chemically synthesized
tccacataatttagccccagtt

SEQ ID NO: 803652 - DNA, 22 bp, Artificial Sequence
  chemically synthesized
ccacataatttagccccagttg

SEQ ID NO: 803653 - DNA, 22 bp, Artificial Sequence
  chemically synthesized
cacataatttagccccagttga

SEQ ID NO: 803654 - DNA, 22 bp, Artificial Sequence
  chemically synthesized
caagaaatgaaattagatcaac

SEQ ID NO: 803655 - DNA, 22 bp, Artificial Sequence
  chemically synthesized
ctacaagaaatgaaattagatc

SEQ ID NO: 803656 - DNA, 22 bp, Artificial Sequence
  chemically synthesized
agccccagttgatctaatttca

SEQ ID NO: 803657 - DNA, 22 bp, Artificial Sequence
  chemically synthesized
gccccagttgatctaatttcat

SEQ ID NO: 803658 - DNA, 22 bp, Artificial Sequence
  chemically synthesized
gggtatggttgctacaagaaat

SEQ ID NO: 803659 - DNA, 22 bp, Artificial Sequence
  chemically synthesized
atctaatttcatttcttgtagc

SEQ ID NO: 803660 - DNA, 22 bp, Artificial Sequence
  chemically synthesized
gctggggtatggttgctacaag

SEQ ID NO: 803661 - DNA, 22 bp, Artificial Sequence
  chemically synthesized
ggctggggtatggttgctacaa

SEQ ID NO: 803662 - DNA, 22 bp, Artificial Sequence
  chemically synthesized
atttcatttcttgtagcaacca

SEQ ID NO: 803663 - DNA, 22 bp, Artificial Sequence
  chemically synthesized
catttcttgtagcaaccatacc

SEQ ID NO: 803664 - DNA, 22 bp, Artificial Sequence
  chemically synthesized
atttcttgtagcaaccataccc

SEQ ID NO: 803665 - DNA, 22 bp, Artificial Sequence
  chemically synthesized
aaggaacttggctggggtatgg

SEQ ID NO: 803666 - DNA, 22 bp, Artificial Sequence
  chemically synthesized
cttgtagcaaccataccccagc

SEQ ID NO: 803667 - DNA, 22 bp, Artificial Sequence
  chemically synthesized
ttgtagcaaccataccccagcc

SEQ ID NO: 803668 - DNA, 22 bp, Artificial Sequence
  chemically synthesized
gtagcaaccataccccagccaa

SEQ ID NO: 803669 - DNA, 22 bp, Artificial Sequence
  chemically synthesized
tagcaaccataccccagccaag

SEQ ID NO: 803670 - DNA, 22 bp, Artificial Sequence
  chemically synthesized
gtcagtgtggtagtgtgagaat

SEQ ID NO: 803671 - DNA, 22 bp, Artificial Sequence
  chemically synthesized
agtcagtgtggtagtgtgagaa

SEQ ID NO: 803672 - DNA, 22 bp, Artificial Sequence
  chemically synthesized
cttcagattctcacactaccac

SEQ ID NO: 803673 - DNA, 22 bp, Artificial Sequence
  chemically synthesized
cagattctcacactaccacact

SEQ ID NO: 803674 - DNA, 22 bp, Artificial Sequence
  chemically synthesized
agattctcacactaccacactg

SEQ ID NO: 803675 - DNA, 22 bp, Artificial Sequence
  chemically synthesized
tcacactaccacactgactaag

SEQ ID NO: 803676 - DNA, 22 bp, Artificial Sequence
  chemically synthesized
acactaccacactgactaagcc

SEQ ID NO: 803677 - DNA, 22 bp, Artificial Sequence
  chemically synthesized
ccacactgactaagcctttgga

SEQ ID NO: 803678 - DNA, 22 bp, Artificial Sequence
  chemically synthesized
actaagcctttggatatggtgt

SEQ ID NO: 803679 - DNA, 22 bp, Artificial Sequence
  chemically synthesized
gtgatagaggaaacaccatatc

SEQ ID NO: 803680 - DNA, 22 bp, Artificial Sequence
  chemically synthesized
agcctttggatatggtgtttcc

SEQ ID NO: 803681 - DNA, 22 bp, Artificial Sequence
  chemically synthesized
tggatatggtgtttcctctatc

SEQ ID NO: 803682 - DNA, 22 bp, Artificial Sequence
  chemically synthesized
ggatatggtgtttcctctatca

SEQ ID NO: 803683 - DNA, 22 bp, Artificial Sequence
  chemically synthesized
gatatggtgtttcctctatcac

SEQ ID NO: 803684 - DNA, 22 bp, Artificial Sequence
  chemically synthesized
aaaagagcattcgtgatagagg

SEQ ID NO: 803685 - DNA, 22 bp, Artificial Sequence
  chemically synthesized
atggggttgaaaagagcattcg

SEQ ID NO: 803686 - DNA, 22 bp, Artificial Sequence
  chemically synthesized
cctctatcacgaatgctctttt

SEQ ID NO: 803687 - DNA, 22 bp, Artificial Sequence
  chemically synthesized
ctctatcacgaatgctcttttc

SEQ ID NO: 803688 - DNA, 22 bp, Artificial Sequence
  chemically synthesized
ggttcatggggttgaaaagagc

SEQ ID NO: 803689 - DNA, 22 bp, Artificial Sequence
  chemically synthesized
aggttcatggggttgaaaagag

SEQ ID NO: 803690 - DNA, 22 bp, Artificial Sequence
  chemically synthesized
tatcacgaatgctcttttcaac

SEQ ID NO: 803691 - DNA, 22 bp, Artificial Sequence
  chemically synthesized
tcacgaatgctcttttcaaccc

SEQ ID NO: 803692 - DNA, 22 bp, Artificial Sequence
  chemically synthesized
tttaggttcatggggttgaaaa

SEQ ID NO: 803693 - DNA, 22 bp, Artificial Sequence
  chemically synthesized
ggagttatttaggttcatgggg

SEQ ID NO: 803694 - DNA, 22 bp, Artificial Sequence
  chemically synthesized
ttaggagttatttaggttcatg

SEQ ID NO: 803695 - DNA, 22 bp, Artificial Sequence
  chemically synthesized
ttttcaaccccatgaacctaaa

SEQ ID NO: 803696 - DNA, 22 bp, Artificial Sequence
  chemically synthesized
ttcaaccccatgaacctaaata

SEQ ID NO: 803697 - DNA, 22 bp, Artificial Sequence
  chemically synthesized
tcaaccccatgaacctaaataa

SEQ ID NO: 803698 - DNA, 22 bp, Artificial Sequence
  chemically synthesized
caaccccatgaacctaaataac

SEQ ID NO: 803699 - DNA, 22 bp, Artificial Sequence
  chemically synthesized
aaccccatgaacctaaataact

SEQ ID NO: 803700 - DNA, 22 bp, Artificial Sequence
  chemically synthesized
gaagaattgttaggagttattt

SEQ ID NO: 803701 - DNA, 22 bp, Artificial Sequence
  chemically synthesized
agaagaattgttaggagttatt

SEQ ID NO: 803702 - DNA, 22 bp, Artificial Sequence
  chemically synthesized
aataactcctaacaattcttct

SEQ ID NO: 803703 - DNA, 22 bp, Artificial Sequence
  chemically synthesized
gagaaagtcaccttagaagaat

SEQ ID NO: 803704 - DNA, 22 bp, Artificial Sequence
  chemically synthesized
agagaaagtcaccttagaagaa

SEQ ID NO: 803705 - DNA, 22 bp, Artificial Sequence
  chemically synthesized
tttagagaaagtcaccttagaa

SEQ ID NO: 803706 - DNA, 22 bp, Artificial Sequence
  chemically synthesized
ctaacaattcttctaaggtgac

SEQ ID NO: 803707 - DNA, 22 bp, Artificial Sequence
  chemically synthesized
tgtttagagaaagtcaccttag

SEQ ID NO: 803708 - DNA, 22 bp, Artificial Sequence
  chemically synthesized
acaattcttctaaggtgacttt

SEQ ID NO: 803709 - DNA, 22 bp, Artificial Sequence
  chemically synthesized
ttctaaggtgactttctctaaa

SEQ ID NO: 803710 - DNA, 22 bp, Artificial Sequence
  chemically synthesized
ctaaggtgactttctctaaaca

SEQ ID NO: 803711 - DNA, 22 bp, Artificial Sequence
  chemically synthesized
taaggtgactttctctaaacag

SEQ ID NO: 803712 - DNA, 22 bp, Artificial Sequence
  chemically synthesized
aggtgactttctctaaacagag

SEQ ID NO: 803713 - DNA, 22 bp, Artificial Sequence
  chemically synthesized
tccagtgagaacctctgtttag

SEQ ID NO: 803714 - DNA, 22 bp, Artificial Sequence
  chemically synthesized
ttgtccagtgagaacctctgtt

SEQ ID NO: 803715 - DNA, 22 bp, Artificial Sequence
  chemically synthesized
tctctaaacagaggttctcact

SEQ ID NO: 803716 - DNA, 22 bp, Artificial Sequence
  chemically synthesized
ctctaaacagaggttctcactg

SEQ ID NO: 803717 - DNA, 22 bp, Artificial Sequence
  chemically synthesized
tctaaacagaggttctcactgg

SEQ ID NO: 803718 - DNA, 22 bp, Artificial Sequence
  chemically synthesized
taaacagaggttctcactggac

SEQ ID NO: 803719 - DNA, 22 bp, Artificial Sequence
  chemically synthesized
aacagaggttctcactggacaa

SEQ ID NO: 803720 - DNA, 22 bp, Artificial Sequence
  chemically synthesized
cccatgaatctattgtccagtg

SEQ ID NO: 803721 - DNA, 22 bp, Artificial Sequence
  chemically synthesized
tcactggacaatagattcatgg

SEQ ID NO: 803722 - DNA, 22 bp, Artificial Sequence
  chemically synthesized
actggacaatagattcatgggt

SEQ ID NO: 803723 - DNA, 22 bp, Artificial Sequence
  chemically synthesized
agcatagcatgtcctacccatg

SEQ ID NO: 803724 - DNA, 22 bp, Artificial Sequence
  chemically synthesized
gacaatagattcatgggtagga

SEQ ID NO: 803725 - DNA, 22 bp, Artificial Sequence
  chemically synthesized
aattgagcatagcatgtcctac

SEQ ID NO: 803726 - DNA, 22 bp, Artificial Sequence
  chemically synthesized
atgggtaggacatgctatgctc

SEQ ID NO: 803727 - DNA, 22 bp, Artificial Sequence
  chemically synthesized
cccacaatagataccaactgaa

SEQ ID NO: 803728 - DNA, 22 bp, Artificial Sequence
  chemically synthesized
tgcccacaatagataccaactg

SEQ ID NO: 803729 - DNA, 22 bp, Artificial Sequence
  chemically synthesized
tgctcaattcagttggtatcta

SEQ ID NO: 803730 - DNA, 22 bp, Artificial Sequence
  chemically synthesized
aattcagttggtatctattgtg

SEQ ID NO: 803731 - DNA, 22 bp, Artificial Sequence
  chemically synthesized
aaaatatctctgcccacaatag

SEQ ID NO: 803732 - DNA, 22 bp, Artificial Sequence
  chemically synthesized
aaaaatatctctgcccacaata

SEQ ID NO: 803733 - DNA, 22 bp, Artificial Sequence
  chemically synthesized
taaaaatatctctgcccacaat

SEQ ID NO: 803734 - DNA, 22 bp, Artificial Sequence
  chemically synthesized
agttggtatctattgtgggcag

SEQ ID NO: 803735 - DNA, 22 bp, Artificial Sequence
  chemically synthesized
gtatctattgtgggcagagata

SEQ ID NO: 803736 - DNA, 22 bp, Artificial Sequence
  chemically synthesized
ggggagattttaaaaatatctc

SEQ ID NO: 803737 - DNA, 22 bp, Artificial Sequence
  chemically synthesized
ttgtgggcagagatatttttaa

SEQ ID NO: 803738 - DNA, 22 bp, Artificial Sequence
  chemically synthesized
tgggcagagatatttttaaaat

SEQ ID NO: 803739 - DNA, 22 bp, Artificial Sequence
  chemically synthesized
tgcactgggggagattttaaaa

SEQ ID NO: 803740 - DNA, 22 bp, Artificial Sequence
  chemically synthesized
atgcactgggggagattttaaa

SEQ ID NO: 803741 - DNA, 22 bp, Artificial Sequence
  chemically synthesized
cttatgcactgggggagatttt

SEQ ID NO: 803742 - DNA, 22 bp, Artificial Sequence
  chemically synthesized
gcttatgcactgggggagattt

SEQ ID NO: 803743 - DNA, 22 bp, Artificial Sequence
  chemically synthesized
accttgcttatgcactggggga

SEQ ID NO: 803744 - DNA, 22 bp, Artificial Sequence
  chemically synthesized
aaccttgcttatgcactggggg

SEQ ID NO: 803745 - DNA, 22 bp, Artificial Sequence
  chemically synthesized
taaccttgcttatgcactgggg

SEQ ID NO: 803746 - DNA, 22 bp, Artificial Sequence
  chemically synthesized
ttaaaatctcccccagtgcata

SEQ ID NO: 803747 - DNA, 22 bp, Artificial Sequence
  chemically synthesized
taaaatctcccccagtgcataa

SEQ ID NO: 803748 - DNA, 22 bp, Artificial Sequence
  chemically synthesized
aaaatctcccccagtgcataag

SEQ ID NO: 803749 - DNA, 22 bp, Artificial Sequence
  chemically synthesized
aaatctcccccagtgcataagc

SEQ ID NO: 803750 - DNA, 22 bp, Artificial Sequence
  chemically synthesized
ccccagtgcataagcaaggtta

SEQ ID NO: 803751 - DNA, 22 bp, Artificial Sequence
  chemically synthesized
gaacggtggattttaaccttgc

SEQ ID NO: 803752 - DNA, 22 bp, Artificial Sequence
  chemically synthesized
acctagaacggtggattttaac

SEQ ID NO: 803753 - DNA, 22 bp, Artificial Sequence
  chemically synthesized
aaatccaccgttctaggtgagt

SEQ ID NO: 803754 - DNA, 22 bp, Artificial Sequence
  chemically synthesized
caaagaggccaggaaactcacc

SEQ ID NO: 803755 - DNA, 22 bp, Artificial Sequence
  chemically synthesized
ccaaagaggccaggaaactcac

SEQ ID NO: 803756 - DNA, 22 bp, Artificial Sequence
  chemically synthesized
aaccttccaaagaggccaggaa

SEQ ID NO: 803757 - DNA, 22 bp, Artificial Sequence
  chemically synthesized
taggtgagtttcctggcctctt

SEQ ID NO: 803758 - DNA, 22 bp, Artificial Sequence
  chemically synthesized
ggtgagtttcctggcctctttg

SEQ ID NO: 803759 - DNA, 22 bp, Artificial Sequence
  chemically synthesized
ggctaaaccttccaaagaggcc

SEQ ID NO: 803760 - DNA, 22 bp, Artificial Sequence
  chemically synthesized
cctggcctctttggaaggttta

SEQ ID NO: 803761 - DNA, 22 bp, Artificial Sequence
  chemically synthesized
ctggcctctttggaaggtttag

SEQ ID NO: 803762 - DNA, 22 bp, Artificial Sequence
  chemically synthesized
gcctctttggaaggtttagcct

SEQ ID NO: 803763 - DNA, 22 bp, Artificial Sequence
  chemically synthesized
gcaaaaacagaagactaggcta

SEQ ID NO: 803764 - DNA, 22 bp, Artificial Sequence
  chemically synthesized
tttggaaggtttagcctagtct

SEQ ID NO: 803765 - DNA, 22 bp, Artificial Sequence
  chemically synthesized
tggaaggtttagcctagtcttc

SEQ ID NO: 803766 - DNA, 22 bp, Artificial Sequence
  chemically synthesized
ggaaggtttagcctagtcttct

SEQ ID NO: 803767 - DNA, 22 bp, Artificial Sequence
  chemically synthesized
gaaggtttagcctagtcttctg

SEQ ID NO: 803768 - DNA, 22 bp, Artificial Sequence
  chemically synthesized
gacagggtctagcaaaaacaga

SEQ ID NO: 803769 - DNA, 22 bp, Artificial Sequence
  chemically synthesized
agcctagtcttctgtttttgct

SEQ ID NO: 803770 - DNA, 22 bp, Artificial Sequence
  chemically synthesized
gcctagtcttctgtttttgcta

SEQ ID NO: 803771 - DNA, 22 bp, Artificial Sequence
  chemically synthesized
gtcttctgtttttgctagaccc

SEQ ID NO: 803772 - DNA, 22 bp, Artificial Sequence
  chemically synthesized
ctgtttttgctagaccctgtcc

SEQ ID NO: 803773 - DNA, 22 bp, Artificial Sequence
  chemically synthesized
cagtagagagctggacagggtc

SEQ ID NO: 803774 - DNA, 22 bp, Artificial Sequence
  chemically synthesized
tgtttttgctagaccctgtcca

SEQ ID NO: 803775 - DNA, 22 bp, Artificial Sequence
  chemically synthesized
tttttgctagaccctgtccagc

SEQ ID NO: 803776 - DNA, 22 bp, Artificial Sequence
  chemically synthesized
ttgctagaccctgtccagctct

SEQ ID NO: 803777 - DNA, 22 bp, Artificial Sequence
  chemically synthesized
tgctagaccctgtccagctctc

SEQ ID NO: 803778 - DNA, 22 bp, Artificial Sequence
  chemically synthesized
gctagaccctgtccagctctct

SEQ ID NO: 803779 - DNA, 22 bp, Artificial Sequence
  chemically synthesized
ctagaccctgtccagctctcta

SEQ ID NO: 803780 - DNA, 22 bp, Artificial Sequence
  chemically synthesized
tgagaattacagtagagagctg

SEQ ID NO: 803781 - DNA, 22 bp, Artificial Sequence
  chemically synthesized
gaccctgtccagctctctactg

SEQ ID NO: 803782 - DNA, 22 bp, Artificial Sequence
  chemically synthesized
tccagctctctactgtaattct

SEQ ID NO: 803783 - DNA, 22 bp, Artificial Sequence
  chemically synthesized
taatagcattatgagaattaca

SEQ ID NO: 803784 - DNA, 22 bp, Artificial Sequence
  chemically synthesized
tctactgtaattctcataatgc

SEQ ID NO: 803785 - DNA, 22 bp, Artificial Sequence
  chemically synthesized
tactgtaattctcataatgcta

SEQ ID NO: 803786 - DNA, 22 bp, Artificial Sequence
  chemically synthesized
ctgtaattctcataatgctatt

SEQ ID NO: 803787 - DNA, 22 bp, Artificial Sequence
  chemically synthesized
agacaaaattataatagcatta

SEQ ID NO: 803788 - DNA, 22 bp, Artificial Sequence
  chemically synthesized
taattctcataatgctattata

SEQ ID NO: 803789 - DNA, 22 bp, Artificial Sequence
  chemically synthesized
tcataatgctattataattttg

SEQ ID NO: 803790 - DNA, 22 bp, Artificial Sequence
  chemically synthesized
ataatgctattataattttgtc

SEQ ID NO: 803791 - DNA, 22 bp, Artificial Sequence
  chemically synthesized
ttataattttgtcttaggatgt

SEQ ID NO: 803792 - DNA, 22 bp, Artificial Sequence
  chemically synthesized
taattttgtcttaggatgtatg

SEQ ID NO: 803793 - DNA, 22 bp, Artificial Sequence
  chemically synthesized
cagaggtgaagacatacatcct

SEQ ID NO: 803794 - DNA, 22 bp, Artificial Sequence
  chemically synthesized
tgtcttaggatgtatgtcttca

SEQ ID NO: 803795 - DNA, 22 bp, Artificial Sequence
  chemically synthesized
acattccagaggtgaagacata

SEQ ID NO: 803796 - DNA, 22 bp, Artificial Sequence
  chemically synthesized
gtcttaggatgtatgtcttcac

SEQ ID NO: 803797 - DNA, 22 bp, Artificial Sequence
  chemically synthesized
tcttaggatgtatgtcttcacc

SEQ ID NO: 803798 - DNA, 22 bp, Artificial Sequence
  chemically synthesized
aggatgtatgtcttcacctctg

SEQ ID NO: 803799 - DNA, 22 bp, Artificial Sequence
  chemically synthesized
ggatgtatgtcttcacctctgg

SEQ ID NO: 803800 - DNA, 22 bp, Artificial Sequence
  chemically synthesized
agaggttcacattccagaggtg

SEQ ID NO: 803801 - DNA, 22 bp, Artificial Sequence
  chemically synthesized
gagaggttcacattccagaggt

SEQ ID NO: 803802 - DNA, 22 bp, Artificial Sequence
  chemically synthesized
tgagaggttcacattccagagg

SEQ ID NO: 803803 - DNA, 22 bp, Artificial Sequence
  chemically synthesized
cctttgagaggttcacattcca

SEQ ID NO: 803804 - DNA, 22 bp, Artificial Sequence
  chemically synthesized
tgcctttgagaggttcacattc

SEQ ID NO: 803805 - DNA, 22 bp, Artificial Sequence
  chemically synthesized
ctgcctttgagaggttcacatt

SEQ ID NO: 803806 - DNA, 22 bp, Artificial Sequence
  chemically synthesized
cacctctggaatgtgaacctct

SEQ ID NO: 803807 - DNA, 22 bp, Artificial Sequence
  chemically synthesized
tttctgcctttgagaggttcac

SEQ ID NO: 803808 - DNA, 22 bp, Artificial Sequence
  chemically synthesized
acctctggaatgtgaacctctc

SEQ ID NO: 803809 - DNA, 22 bp, Artificial Sequence
  chemically synthesized
tggaatgtgaacctctcaaagg

SEQ ID NO: 803810 - DNA, 22 bp, Artificial Sequence
  chemically synthesized
acattatttctgcctttgagag

SEQ ID NO: 803811 - DNA, 22 bp, Artificial Sequence
  chemically synthesized
aacattatttctgcctttgaga

SEQ ID NO: 803812 - DNA, 22 bp, Artificial Sequence
  chemically synthesized
gaatgtgaacctctcaaaggca

SEQ ID NO: 803813 - DNA, 22 bp, Artificial Sequence
  chemically synthesized
taacattatttctgcctttgag

SEQ ID NO: 803814 - DNA, 22 bp, Artificial Sequence
  chemically synthesized
tattttaacattatttctgcct

SEQ ID NO: 803815 - DNA, 22 bp, Artificial Sequence
  chemically synthesized
tgtattttaacattatttctgc

SEQ ID NO: 803816 - DNA, 22 bp, Artificial Sequence
  chemically synthesized
tcaaaggcagaaataatgttaa

SEQ ID NO: 803817 - DNA, 22 bp, Artificial Sequence
  chemically synthesized
aaaggcagaaataatgttaaaa

SEQ ID NO: 803818 - DNA, 22 bp, Artificial Sequence
  chemically synthesized
aaaagcctctgtattttaacat

SEQ ID NO: 803819 - DNA, 22 bp, Artificial Sequence
  chemically synthesized
taacatatattcaaaagcctct

SEQ ID NO: 803820 - DNA, 22 bp, Artificial Sequence
  chemically synthesized
gtaacatatattcaaaagcctc

SEQ ID NO: 803821 - DNA, 22 bp, Artificial Sequence
  chemically synthesized
tgtaacatatattcaaaagcct

SEQ ID NO: 803822 - DNA, 22 bp, Artificial Sequence
  chemically synthesized
aaatacagaggcttttgaatat

SEQ ID NO: 803823 - DNA, 22 bp, Artificial Sequence
  chemically synthesized
gatcactttgtaacatatattc

SEQ ID NO: 803824 - DNA, 22 bp, Artificial Sequence
  chemically synthesized
ttgaatatatgttacaaagtga

SEQ ID NO: 803825 - DNA, 22 bp, Artificial Sequence
  chemically synthesized
tgaatatatgttacaaagtgat

SEQ ID NO: 803826 - DNA, 22 bp, Artificial Sequence
  chemically synthesized
gaatatatgttacaaagtgatc

SEQ ID NO: 803827 - DNA, 22 bp, Artificial Sequence
  chemically synthesized
aatatatgttacaaagtgatcc

SEQ ID NO: 803828 - DNA, 22 bp, Artificial Sequence
  chemically synthesized
tcggtgtggaaatactggatca

SEQ ID NO: 803829 - DNA, 22 bp, Artificial Sequence
  chemically synthesized
caaagtgatccagtatttccac

SEQ ID NO: 803830 - DNA, 22 bp, Artificial Sequence
  chemically synthesized
tgtgtgtgtgtgtgtgtgtctg

SEQ ID NO: 803831 - DNA, 22 bp, Artificial Sequence
  chemically synthesized
gtgtgtgtgtgtgtgtgtgtct

SEQ ID NO: 803832 - DNA, 22 bp, Artificial Sequence
  chemically synthesized
ccacaccgacagacacacacac

SEQ ID NO: 803833 - DNA, 22 bp, Artificial Sequence
  chemically synthesized
cacaccgacagacacacacaca

SEQ ID NO: 803834 - DNA, 22 bp, Artificial Sequence
  chemically synthesized
tgtgtgtgtgtatttgtgtgtg

SEQ ID NO: 803835 - DNA, 22 bp, Artificial Sequence
  chemically synthesized
gtgtgtgtgtgtatttgtgtgt

SEQ ID NO: 803836 - DNA, 22 bp, Artificial Sequence
  chemically synthesized
ggtggtttgtgtgtgtgtgtat

SEQ ID NO: 803837 - DNA, 22 bp, Artificial Sequence
  chemically synthesized
gttcggtggtttgtgtgtgtgt

SEQ ID NO: 803838 - DNA, 22 bp, Artificial Sequence
  chemically synthesized
ggttcggtggtttgtgtgtgtg

SEQ ID NO: 803839 - DNA, 22 bp, Artificial Sequence
  chemically synthesized
tggttcggtggtttgtgtgtgt

SEQ ID NO: 803840 - DNA, 22 bp, Artificial Sequence
  chemically synthesized
gtaaaactttggttcggtggtt

SEQ ID NO: 803841 - DNA, 22 bp, Artificial Sequence
  chemically synthesized
ttcgtaaaactttggttcggtg

SEQ ID NO: 803842 - DNA, 22 bp, Artificial Sequence
  chemically synthesized
aatattgttcgtaaaactttgg

SEQ ID NO: 803843 - DNA, 22 bp, Artificial Sequence
  chemically synthesized
caatattgttcgtaaaactttg

SEQ ID NO: 803844 - DNA, 22 bp, Artificial Sequence
  chemically synthesized
agtaagtttcaatattgttcgt

SEQ ID NO: 803845 - DNA, 22 bp, Artificial Sequence
  chemically synthesized
aagtaagtttcaatattgttcg

SEQ ID NO: 803846 - DNA, 22 bp, Artificial Sequence
  chemically synthesized
taagtaagtttcaatattgttc

SEQ ID NO: 803847 - DNA, 22 bp, Artificial Sequence
  chemically synthesized
ttaagtaagtttcaatattgtt

SEQ ID NO: 803848 - DNA, 22 bp, Artificial Sequence
  chemically synthesized
tacgaacaatattgaaacttac

SEQ ID NO: 803849 - DNA, 22 bp, Artificial Sequence
  chemically synthesized
acgaacaatattgaaacttact

SEQ ID NO: 803850 - DNA, 22 bp, Artificial Sequence
  chemically synthesized
cgaacaatattgaaacttactt

SEQ ID NO: 803851 - DNA, 22 bp, Artificial Sequence
  chemically synthesized
aaacttacttaaaagtgatgga

SEQ ID NO: 803852 - DNA, 22 bp, Artificial Sequence
  chemically synthesized
acttaaaagtgatggactcctt

SEQ ID NO: 803853 - DNA, 22 bp, Artificial Sequence
  chemically synthesized
cttaaaagtgatggactcctta

SEQ ID NO: 803854 - DNA, 22 bp, Artificial Sequence
  chemically synthesized
aaaagtgatggactccttattt

SEQ ID NO: 803855 - DNA, 22 bp, Artificial Sequence
  chemically synthesized
aaagtgatggactccttatttc

SEQ ID NO: 803856 - DNA, 22 bp, Artificial Sequence
  chemically synthesized
gtaaaatagaatagaaataagg

SEQ ID NO: 803857 - DNA, 22 bp, Artificial Sequence
  chemically synthesized
cttatttctattctattttact

SEQ ID NO: 803858 - DNA, 22 bp, Artificial Sequence
  chemically synthesized
atttctattctattttactaat

SEQ ID NO: 803859 - DNA, 22 bp, Artificial Sequence
  chemically synthesized
tttctattctattttactaatt

SEQ ID NO: 803860 - DNA, 22 bp, Artificial Sequence
  chemically synthesized
ctattctattttactaatttca

SEQ ID NO: 803861 - DNA, 22 bp, Artificial Sequence
  chemically synthesized
tattctattttactaatttcat

SEQ ID NO: 803862 - DNA, 22 bp, Artificial Sequence
  chemically synthesized
agatagaaatgaatgaaattag

SEQ ID NO: 803863 - DNA, 22 bp, Artificial Sequence
  chemically synthesized
aagatagaaatgaatgaaatta

SEQ ID NO: 803864 - DNA, 22 bp, Artificial Sequence
  chemically synthesized
ttctattttactaatttcattc

SEQ ID NO: 803865 - DNA, 22 bp, Artificial Sequence
  chemically synthesized
taagatagaaatgaatgaaatt

SEQ ID NO: 803866 - DNA, 22 bp, Artificial Sequence
  chemically synthesized
ttaagatagaaatgaatgaaat

SEQ ID NO: 803867 - DNA, 22 bp, Artificial Sequence
  chemically synthesized
tattttactaatttcattcatt

SEQ ID NO: 803868 - DNA, 22 bp, Artificial Sequence
  chemically synthesized
ttttactaatttcattcatttc

SEQ ID NO: 803869 - DNA, 22 bp, Artificial Sequence
  chemically synthesized
tactaatttcattcatttctat

SEQ ID NO: 803870 - DNA, 22 bp, Artificial Sequence
  chemically synthesized
actaatttcattcatttctatc

SEQ ID NO: 803871 - DNA, 22 bp, Artificial Sequence
  chemically synthesized
ctaatttcattcatttctatct

SEQ ID NO: 803872 - DNA, 22 bp, Artificial Sequence
  chemically synthesized
atttcattcatttctatcttaa

SEQ ID NO: 803873 - DNA, 22 bp, Artificial Sequence
  chemically synthesized
cattcatttctatcttaaaaat

SEQ ID NO: 803874 - DNA, 22 bp, Artificial Sequence
  chemically synthesized
attcatttctatcttaaaaata

SEQ ID NO: 803875 - DNA, 22 bp, Artificial Sequence
  chemically synthesized
atgagtatcaatccatattttt

SEQ ID NO: 803876 - DNA, 22 bp, Artificial Sequence
  chemically synthesized
atttctatcttaaaaatatgga

SEQ ID NO: 803877 - DNA, 22 bp, Artificial Sequence
  chemically synthesized
aatgagtatcaatccatatttt

SEQ ID NO: 803878 - DNA, 22 bp, Artificial Sequence
  chemically synthesized
taatgagtatcaatccatattt

SEQ ID NO: 803879 - DNA, 22 bp, Artificial Sequence
  chemically synthesized
ctatcttaaaaatatggattga

SEQ ID NO: 803880 - DNA, 22 bp, Artificial Sequence
  chemically synthesized
tatcttaaaaatatggattgat

SEQ ID NO: 803881 - DNA, 22 bp, Artificial Sequence
  chemically synthesized
tcttaaaaatatggattgatac

SEQ ID NO: 803882 - DNA, 22 bp, Artificial Sequence
  chemically synthesized
aaaaatatggattgatactcat

SEQ ID NO: 803883 - DNA, 22 bp, Artificial Sequence
  chemically synthesized
aaaatatggattgatactcatt

SEQ ID NO: 803884 - DNA, 22 bp, Artificial Sequence
  chemically synthesized
tataatcactttaatgagtatc

SEQ ID NO: 803885 - DNA, 22 bp, Artificial Sequence
  chemically synthesized
ggttgtataatcactttaatga

SEQ ID NO: 803886 - DNA, 22 bp, Artificial Sequence
  chemically synthesized
atactcattaaagtgattatac

SEQ ID NO: 803887 - DNA, 22 bp, Artificial Sequence
  chemically synthesized
agtaaaagtactgggttgtata

SEQ ID NO: 803888 - DNA, 22 bp, Artificial Sequence
  chemically synthesized
attaaagtgattatacaaccca

SEQ ID NO: 803889 - DNA, 22 bp, Artificial Sequence
  chemically synthesized
aagtgattatacaacccagtac

SEQ ID NO: 803890 - DNA, 22 bp, Artificial Sequence
  chemically synthesized
aaaaacagttcagtaaaagtac

SEQ ID NO: 803891 - DNA, 22 bp, Artificial Sequence
  chemically synthesized
caaaaacagttcagtaaaagta

SEQ ID NO: 803892 - DNA, 22 bp, Artificial Sequence
  chemically synthesized
tcaaaaacagttcagtaaaagt

SEQ ID NO: 803893 - DNA, 22 bp, Artificial Sequence
  chemically synthesized
tacaacccagtacttttactga

SEQ ID NO: 803894 - DNA, 22 bp, Artificial Sequence
  chemically synthesized
ttcaaaaacagttcagtaaaag

SEQ ID NO: 803895 - DNA, 22 bp, Artificial Sequence
  chemically synthesized
ttactgaactgtttttgaaaag

SEQ ID NO: 803896 - DNA, 22 bp, Artificial Sequence
  chemically synthesized
tactgaactgtttttgaaaagc

SEQ ID NO: 803897 - DNA, 22 bp, Artificial Sequence
  chemically synthesized
actgaactgtttttgaaaagca

SEQ ID NO: 803898 - DNA, 22 bp, Artificial Sequence
  chemically synthesized
ctgaactgtttttgaaaagcac

SEQ ID NO: 803899 - DNA, 22 bp, Artificial Sequence
  chemically synthesized
aactgtttttgaaaagcacctt

SEQ ID NO: 803900 - DNA, 22 bp, Artificial Sequence
  chemically synthesized
tttttgaaaagcacctttcttg

SEQ ID NO: 803901 - DNA, 22 bp, Artificial Sequence
  chemically synthesized
catcataagggccccaagaaag

SEQ ID NO: 803902 - DNA, 22 bp, Artificial Sequence
  chemically synthesized
ttgaaaagcacctttcttgggg

SEQ ID NO: 803903 - DNA, 22 bp, Artificial Sequence
  chemically synthesized
tgaaaagcacctttcttggggc

SEQ ID NO: 803904 - DNA, 22 bp, Artificial Sequence
  chemically synthesized
gaaaagcacctttcttggggcc

SEQ ID NO: 803905 - DNA, 22 bp, Artificial Sequence
  chemically synthesized
aaaagcacctttcttggggccc

SEQ ID NO: 803906 - DNA, 22 bp, Artificial Sequence
  chemically synthesized
attccatcataagggccccaag

SEQ ID NO: 803907 - DNA, 22 bp, Artificial Sequence
  chemically synthesized
tcttggggcccttatgatggaa

SEQ ID NO: 803908 - DNA, 22 bp, Artificial Sequence
  chemically synthesized
taagggaactaattccatcata

SEQ ID NO: 803909 - DNA, 22 bp, Artificial Sequence
  chemically synthesized
cttggggcccttatgatggaat

SEQ ID NO: 803910 - DNA, 22 bp, Artificial Sequence
  chemically synthesized
ttggggcccttatgatggaatt

SEQ ID NO: 803911 - DNA, 22 bp, Artificial Sequence
  chemically synthesized
ttataagggaactaattccatc

SEQ ID NO: 803912 - DNA, 22 bp, Artificial Sequence
  chemically synthesized
ggggcccttatgatggaattag

SEQ ID NO: 803913 - DNA, 22 bp, Artificial Sequence
  chemically synthesized
gttataagggaactaattccat

SEQ ID NO: 803914 - DNA, 22 bp, Artificial Sequence
  chemically synthesized
gggcccttatgatggaattagt

SEQ ID NO: 803915 - DNA, 22 bp, Artificial Sequence
  chemically synthesized
ttgttataagggaactaattcc

SEQ ID NO: 803916 - DNA, 22 bp, Artificial Sequence
  chemically synthesized
ctcttgttataagggaactaat

SEQ ID NO: 803917 - DNA, 22 bp, Artificial Sequence
  chemically synthesized
cctcttgttataagggaactaa

SEQ ID NO: 803918 - DNA, 22 bp, Artificial Sequence
  chemically synthesized
atgatggaattagttcccttat

SEQ ID NO: 803919 - DNA, 22 bp, Artificial Sequence
  chemically synthesized
tgatggaattagttcccttata

SEQ ID NO: 803920 - DNA, 22 bp, Artificial Sequence
  chemically synthesized
atgacacttcctcttgttataa

SEQ ID NO: 803921 - DNA, 22 bp, Artificial Sequence
  chemically synthesized
tgatgacacttcctcttgttat

SEQ ID NO: 803922 - DNA, 22 bp, Artificial Sequence
  chemically synthesized
gttcccttataacaagaggaag

SEQ ID NO: 803923 - DNA, 22 bp, Artificial Sequence
  chemically synthesized
ccttataacaagaggaagtgtc

SEQ ID NO: 803924 - DNA, 22 bp, Artificial Sequence
  chemically synthesized
ataacaagaggaagtgtcatca

SEQ ID NO: 803925 - DNA, 22 bp, Artificial Sequence
  chemically synthesized
taacaagaggaagtgtcatcag

SEQ ID NO: 803926 - DNA, 22 bp, Artificial Sequence
  chemically synthesized
acatagcaaagagagacagagc

SEQ ID NO: 803927 - DNA, 22 bp, Artificial Sequence
  chemically synthesized
tgtcctaacatagcaaagagag

SEQ ID NO: 803928 - DNA, 22 bp, Artificial Sequence
  chemically synthesized
tgtgtcctaacatagcaaagag

SEQ ID NO: 803929 - DNA, 22 bp, Artificial Sequence
  chemically synthesized
tctgtgtcctaacatagcaaag

SEQ ID NO: 803930 - DNA, 22 bp, Artificial Sequence
  chemically synthesized
tctctgtgtcctaacatagcaa

SEQ ID NO: 803931 - DNA, 22 bp, Artificial Sequence
  chemically synthesized
ctctctgtgtcctaacatagca

SEQ ID NO: 803932 - DNA, 22 bp, Artificial Sequence
  chemically synthesized
tgtctctctttgctatgttagg

SEQ ID NO: 803933 - DNA, 22 bp, Artificial Sequence
  chemically synthesized
cttctctctgtgtcctaacata

SEQ ID NO: 803934 - DNA, 22 bp, Artificial Sequence
  chemically synthesized
tctctctttgctatgttaggac

SEQ ID NO: 803935 - DNA, 22 bp, Artificial Sequence
  chemically synthesized
ccttctctctgtgtcctaacat

SEQ ID NO: 803936 - DNA, 22 bp, Artificial Sequence
  chemically synthesized
tctttgctatgttaggacacag

SEQ ID NO: 803937 - DNA, 22 bp, Artificial Sequence
  chemically synthesized
tttgctatgttaggacacagag

SEQ ID NO: 803938 - DNA, 22 bp, Artificial Sequence
  chemically synthesized
tgctatgttaggacacagagag

SEQ ID NO: 803939 - DNA, 22 bp, Artificial Sequence
  chemically synthesized
gctatgttaggacacagagaga

SEQ ID NO: 803940 - DNA, 22 bp, Artificial Sequence
  chemically synthesized
ctatgttaggacacagagagaa

SEQ ID NO: 803941 - DNA, 22 bp, Artificial Sequence
  chemically synthesized
cagatggcttccttctctctgt

SEQ ID NO: 803942 - DNA, 22 bp, Artificial Sequence
  chemically synthesized
gcagatggcttccttctctctg

SEQ ID NO: 803943 - DNA, 22 bp, Artificial Sequence
  chemically synthesized
tgttaggacacagagagaagga

SEQ ID NO: 803944 - DNA, 22 bp, Artificial Sequence
  chemically synthesized
gtttgcagatggcttccttctc

SEQ ID NO: 803945 - DNA, 22 bp, Artificial Sequence
  chemically synthesized
ggacacagagagaaggaagcca

SEQ ID NO: 803946 - DNA, 22 bp, Artificial Sequence
  chemically synthesized
ctggtttgcagatggcttcctt

SEQ ID NO: 803947 - DNA, 22 bp, Artificial Sequence
  chemically synthesized
cctggtttgcagatggcttcct

SEQ ID NO: 803948 - DNA, 22 bp, Artificial Sequence
  chemically synthesized
ttcctggtttgcagatggcttc

SEQ ID NO: 803949 - DNA, 22 bp, Artificial Sequence
  chemically synthesized
gtgagggcccctcttcctggtt

SEQ ID NO: 803950 - DNA, 22 bp, Artificial Sequence
  chemically synthesized
caaaccaggaagaggggccctc

SEQ ID NO: 803951 - DNA, 22 bp, Artificial Sequence
  chemically synthesized
caagatcagggcctggtgaggg

SEQ ID NO: 803952 - DNA, 22 bp, Artificial Sequence
  chemically synthesized
ggattccaagatcagggcctgg

SEQ ID NO: 803953 - DNA, 22 bp, Artificial Sequence
  chemically synthesized
gaggctgggattccaagatcag

SEQ ID NO: 803954 - DNA, 22 bp, Artificial Sequence
  chemically synthesized
tggaggctgggattccaagatc

SEQ ID NO: 803955 - DNA, 22 bp, Artificial Sequence
  chemically synthesized
accaggccctgatcttggaatc

SEQ ID NO: 803956 - DNA, 22 bp, Artificial Sequence
  chemically synthesized
acagttctggaggctgggattc

SEQ ID NO: 803957 - DNA, 22 bp, Artificial Sequence
  chemically synthesized
tcacagttctggaggctgggat

SEQ ID NO: 803958 - DNA, 22 bp, Artificial Sequence
  chemically synthesized
ctcacagttctggaggctggga

SEQ ID NO: 803959 - DNA, 22 bp, Artificial Sequence
  chemically synthesized
atcttggaatcccagcctccag

SEQ ID NO: 803960 - DNA, 22 bp, Artificial Sequence
  chemically synthesized
tttctcacagttctggaggctg

SEQ ID NO: 803961 - DNA, 22 bp, Artificial Sequence
  chemically synthesized
atttctcacagttctggaggct

SEQ ID NO: 803962 - DNA, 22 bp, Artificial Sequence
  chemically synthesized
ggaatcccagcctccagaactg

SEQ ID NO: 803963 - DNA, 22 bp, Artificial Sequence
  chemically synthesized
gaatcccagcctccagaactgt

SEQ ID NO: 803964 - DNA, 22 bp, Artificial Sequence
  chemically synthesized
tacaacagaatcttatttctca

SEQ ID NO: 803965 - DNA, 22 bp, Artificial Sequence
  chemically synthesized
atacaacagaatcttatttctc

SEQ ID NO: 803966 - DNA, 22 bp, Artificial Sequence
  chemically synthesized
cagaactgtgagaaataagatt

SEQ ID NO: 803967 - DNA, 22 bp, Artificial Sequence
  chemically synthesized
tgagaaataagattctgttgta

SEQ ID NO: 803968 - DNA, 22 bp, Artificial Sequence
  chemically synthesized
tgttgtataagccttctttccc

SEQ ID NO: 803969 - DNA, 22 bp, Artificial Sequence
  chemically synthesized
gggggtgggtaagggaaagaag

SEQ ID NO: 803970 - DNA, 22 bp, Artificial Sequence
  chemically synthesized
ggggggtgggtaagggaaagaa

SEQ ID NO: 803971 - DNA, 22 bp, Artificial Sequence
  chemically synthesized
ttgtataagccttctttccctt

SEQ ID NO: 803972 - DNA, 22 bp, Artificial Sequence
  chemically synthesized
tggggggtgggtaagggaaaga

SEQ ID NO: 803973 - DNA, 22 bp, Artificial Sequence
  chemically synthesized
ttggggggtgggtaagggaaag

SEQ ID NO: 803974 - DNA, 22 bp, Artificial Sequence
  chemically synthesized
tttggggggtgggtaagggaaa

SEQ ID NO: 803975 - DNA, 22 bp, Artificial Sequence
  chemically synthesized
tataagccttctttcccttacc

SEQ ID NO: 803976 - DNA, 22 bp, Artificial Sequence
  chemically synthesized
ttttggggggtgggtaagggaa

SEQ ID NO: 803977 - DNA, 22 bp, Artificial Sequence
  chemically synthesized
ttttttggggggtgggtaaggg

SEQ ID NO: 803978 - DNA, 22 bp, Artificial Sequence
  chemically synthesized
cttttttggggggtgggtaagg

SEQ ID NO: 803979 - DNA, 22 bp, Artificial Sequence
  chemically synthesized
tcttttttggggggtgggtaag

SEQ ID NO: 803980 - DNA, 22 bp, Artificial Sequence
  chemically synthesized
tttcttttttggggggtgggta

SEQ ID NO: 803981 - DNA, 22 bp, Artificial Sequence
  chemically synthesized
ctttcttttttggggggtgggt

SEQ ID NO: 803982 - DNA, 22 bp, Artificial Sequence
  chemically synthesized
tctttcttttttggggggtggg

SEQ ID NO: 803983 - DNA, 22 bp, Artificial Sequence
  chemically synthesized
ctttcccttacccaccccccaa

SEQ ID NO: 803984 - DNA, 22 bp, Artificial Sequence
  chemically synthesized
tttcccttacccaccccccaaa

SEQ ID NO: 803985 - DNA, 22 bp, Artificial Sequence
  chemically synthesized
tcccttacccaccccccaaaaa

SEQ ID NO: 803986 - DNA, 22 bp, Artificial Sequence
  chemically synthesized
cccttacccaccccccaaaaaa

SEQ ID NO: 803987 - DNA, 22 bp, Artificial Sequence
  chemically synthesized
ccttacccaccccccaaaaaag

SEQ ID NO: 803988 - DNA, 22 bp, Artificial Sequence
  chemically synthesized
acccaccccccaaaaaagaaag

SEQ ID NO: 803989 - DNA, 22 bp, Artificial Sequence
  chemically synthesized
cccaccccccaaaaaagaaaga

SEQ ID NO: 803990 - DNA, 22 bp, Artificial Sequence
  chemically synthesized
agagagatgattttctttcttt

SEQ ID NO: 803991 - DNA, 22 bp, Artificial Sequence
  chemically synthesized
gtgatacaaacatgttcagaga

SEQ ID NO: 803992 - DNA, 22 bp, Artificial Sequence
  chemically synthesized
ggtctggtgatacaaacatgtt

SEQ ID NO: 803993 - DNA, 22 bp, Artificial Sequence
  chemically synthesized
tctgaacatgtttgtatcacca

SEQ ID NO: 803994 - DNA, 22 bp, Artificial Sequence
  chemically synthesized
tgaacatgtttgtatcaccaga

SEQ ID NO: 803995 - DNA, 22 bp, Artificial Sequence
  chemically synthesized
aacatgtttgtatcaccagacc

SEQ ID NO: 803996 - DNA, 22 bp, Artificial Sequence
  chemically synthesized
ccatgtgtcgtggtgttaggtc

SEQ ID NO: 803997 - DNA, 22 bp, Artificial Sequence
  chemically synthesized
gtatcaccagacctaacaccac

SEQ ID NO: 803998 - DNA, 22 bp, Artificial Sequence
  chemically synthesized
tatcaccagacctaacaccacg

SEQ ID NO: 803999 - DNA, 22 bp, Artificial Sequence
  chemically synthesized
aacacctgccatgtgtcgtggt

SEQ ID NO: 804000 - DNA, 22 bp, Artificial Sequence
  chemically synthesized
ctaaacacctgccatgtgtcgt

SEQ ID NO: 804001 - DNA, 22 bp, Artificial Sequence
  chemically synthesized
gctaaacacctgccatgtgtcg

SEQ ID NO: 804002 - DNA, 22 bp, Artificial Sequence
  chemically synthesized
tgctaaacacctgccatgtgtc

SEQ ID NO: 804003 - DNA, 22 bp, Artificial Sequence
  chemically synthesized
acaccacgacacatggcaggtg

SEQ ID NO: 804004 - DNA, 22 bp, Artificial Sequence
  chemically synthesized
agcgtatctttgctaaacacct

SEQ ID NO: 804005 - DNA, 22 bp, Artificial Sequence
  chemically synthesized
attcagcgtatctttgctaaac

SEQ ID NO: 804006 - DNA, 22 bp, Artificial Sequence
  chemically synthesized
ttaattcagcgtatctttgcta

SEQ ID NO: 804007 - DNA, 22 bp, Artificial Sequence
  chemically synthesized
attaattcagcgtatctttgct

SEQ ID NO: 804008 - DNA, 22 bp, Artificial Sequence
  chemically synthesized
tattaattcagcgtatctttgc

SEQ ID NO: 804009 - DNA, 22 bp, Artificial Sequence
  chemically synthesized
ttattaattcagcgtatctttg

SEQ ID NO: 804010 - DNA, 22 bp, Artificial Sequence
  chemically synthesized
agaacttttattaattcagcgt

SEQ ID NO: 804011 - DNA, 22 bp, Artificial Sequence
  chemically synthesized
tgagaacttttattaattcagc

SEQ ID NO: 804012 - DNA, 22 bp, Artificial Sequence
  chemically synthesized
agcaaagatacgctgaattaat

SEQ ID NO: 804013 - DNA, 22 bp, Artificial Sequence
  chemically synthesized
ctgagaacttttattaattcag

SEQ ID NO: 804014 - DNA, 22 bp, Artificial Sequence
  chemically synthesized
gcaaagatacgctgaattaata

SEQ ID NO: 804015 - DNA, 22 bp, Artificial Sequence
  chemically synthesized
tctgagaacttttattaattca

SEQ ID NO: 804016 - DNA, 22 bp, Artificial Sequence
  chemically synthesized
ttctgagaacttttattaattc

SEQ ID NO: 804017 - DNA, 22 bp, Artificial Sequence
  chemically synthesized
aattaataaaagttctcagaaa

SEQ ID NO: 804018 - DNA, 22 bp, Artificial Sequence
  chemically synthesized
ataaaagttctcagaaaaattt

SEQ ID NO: 804019 - DNA, 22 bp, Artificial Sequence
  chemically synthesized
tcagaaaaattttatatatata

SEQ ID NO: 804020 - DNA, 22 bp, Artificial Sequence
  chemically synthesized
agaaaaattttatatatatata

SEQ ID NO: 804021 - DNA, 22 bp, Artificial Sequence
  chemically synthesized
tatatatatatatatatatata

SEQ ID NO: 804022 - DNA, 22 bp, Artificial Sequence
  chemically synthesized
atatatatatatatatatatat

SEQ ID NO: 804023 - DNA, 22 bp, Artificial Sequence
  chemically synthesized
tatatatatatatatatatata

SEQ ID NO: 804024 - DNA, 22 bp, Artificial Sequence
  chemically synthesized
tatacacatatatgtgtgtgtg

SEQ ID NO: 804025 - DNA, 22 bp, Artificial Sequence
  chemically synthesized
aaaattatatacacatatatgt

SEQ ID NO: 804026 - DNA, 22 bp, Artificial Sequence
  chemically synthesized
aaaaattatatacacatatatg

SEQ ID NO: 804027 - DNA, 22 bp, Artificial Sequence
  chemically synthesized
gatatttaaaaattatatacac

SEQ ID NO: 804028 - DNA, 22 bp, Artificial Sequence
  chemically synthesized
tggatatttaaaaattatatac

SEQ ID NO: 804029 - DNA, 22 bp, Artificial Sequence
  chemically synthesized
ctctggatatttaaaaattata

SEQ ID NO: 804030 - DNA, 22 bp, Artificial Sequence
  chemically synthesized
tgctctggatatttaaaaatta

SEQ ID NO: 804031 - DNA, 22 bp, Artificial Sequence
  chemically synthesized
ctgctctggatatttaaaaatt

SEQ ID NO: 804032 - DNA, 22 bp, Artificial Sequence
  chemically synthesized
gcgatgaatgccttctgctctg

SEQ ID NO: 804033 - DNA, 22 bp, Artificial Sequence
  chemically synthesized
ttaaatatccagagcagaaggc

SEQ ID NO: 804034 - DNA, 22 bp, Artificial Sequence
  chemically synthesized
taaatatccagagcagaaggca

SEQ ID NO: 804035 - DNA, 22 bp, Artificial Sequence
  chemically synthesized
cctggcgatgaatgccttctgc

SEQ ID NO: 804036 - DNA, 22 bp, Artificial Sequence
  chemically synthesized
aaatatccagagcagaaggcat

SEQ ID NO: 804037 - DNA, 22 bp, Artificial Sequence
  chemically synthesized
gcctggcgatgaatgccttctg

SEQ ID NO: 804038 - DNA, 22 bp, Artificial Sequence
  chemically synthesized
aatatccagagcagaaggcatt

SEQ ID NO: 804039 - DNA, 22 bp, Artificial Sequence
  chemically synthesized
tgcctggcgatgaatgccttct

SEQ ID NO: 804040 - DNA, 22 bp, Artificial Sequence
  chemically synthesized
ttttgcctggcgatgaatgcct

SEQ ID NO: 804041 - DNA, 22 bp, Artificial Sequence
  chemically synthesized
attttgcctggcgatgaatgcc

SEQ ID NO: 804042 - DNA, 22 bp, Artificial Sequence
  chemically synthesized
tattttgcctggcgatgaatgc

SEQ ID NO: 804043 - DNA, 22 bp, Artificial Sequence
  chemically synthesized
ttattttgcctggcgatgaatg

SEQ ID NO: 804044 - DNA, 22 bp, Artificial Sequence
  chemically synthesized
atatttttattttgcctggcga

SEQ ID NO: 804045 - DNA, 22 bp, Artificial Sequence
  chemically synthesized
gatatttttattttgcctggcg

SEQ ID NO: 804046 - DNA, 22 bp, Artificial Sequence
  chemically synthesized
tgatatttttattttgcctggc

SEQ ID NO: 804047 - DNA, 22 bp, Artificial Sequence
  chemically synthesized
atcgccaggcaaaataaaaata

SEQ ID NO: 804048 - DNA, 22 bp, Artificial Sequence
  chemically synthesized
aagagtgtgaaagtgaattttg

SEQ ID NO: 804049 - DNA, 22 bp, Artificial Sequence
  chemically synthesized
tctaaagagtgtgaaagtgaat

SEQ ID NO: 804050 - DNA, 22 bp, Artificial Sequence
  chemically synthesized
ttgtctaaagagtgtgaaagtg

SEQ ID NO: 804051 - DNA, 22 bp, Artificial Sequence
  chemically synthesized
attgttgtctaaagagtgtgaa

SEQ ID NO: 804052 - DNA, 22 bp, Artificial Sequence
  chemically synthesized
gattgttgtctaaagagtgtga

SEQ ID NO: 804053 - DNA, 22 bp, Artificial Sequence
  chemically synthesized
tgattgttgtctaaagagtgtg

SEQ ID NO: 804054 - DNA, 22 bp, Artificial Sequence
  chemically synthesized
ttttgattgttgtctaaagagt

SEQ ID NO: 804055 - DNA, 22 bp, Artificial Sequence
  chemically synthesized
tattttgattgttgtctaaaga

SEQ ID NO: 804056 - DNA, 22 bp, Artificial Sequence
  chemically synthesized
ctattttgattgttgtctaaag

SEQ ID NO: 804057 - DNA, 22 bp, Artificial Sequence
  chemically synthesized
actttcacactctttagacaac

SEQ ID NO: 804058 - DNA, 22 bp, Artificial Sequence
  chemically synthesized
tctattttgattgttgtctaaa

SEQ ID NO: 804059 - DNA, 22 bp, Artificial Sequence
  chemically synthesized
tcacactctttagacaacaatc

SEQ ID NO: 804060 - DNA, 22 bp, Artificial Sequence
  chemically synthesized
cacactctttagacaacaatca

SEQ ID NO: 804061 - DNA, 22 bp, Artificial Sequence
  chemically synthesized
atctttctattttgattgttgt

SEQ ID NO: 804062 - DNA, 22 bp, Artificial Sequence
  chemically synthesized
acactctttagacaacaatcaa

SEQ ID NO: 804063 - DNA, 22 bp, Artificial Sequence
  chemically synthesized
aatctttctattttgattgttg

SEQ ID NO: 804064 - DNA, 22 bp, Artificial Sequence
  chemically synthesized
taatctttctattttgattgtt

SEQ ID NO: 804065 - DNA, 22 bp, Artificial Sequence
  chemically synthesized
ttaatctttctattttgattgt

SEQ ID NO: 804066 - DNA, 22 bp, Artificial Sequence
  chemically synthesized
tttaatctttctattttgattg

SEQ ID NO: 804067 - DNA, 22 bp, Artificial Sequence
  chemically synthesized
tttagacaacaatcaaaataga

SEQ ID NO: 804068 - DNA, 22 bp, Artificial Sequence
  chemically synthesized
tagacaacaatcaaaatagaaa

SEQ ID NO: 804069 - DNA, 22 bp, Artificial Sequence
  chemically synthesized
agacaacaatcaaaatagaaag

SEQ ID NO: 804070 - DNA, 22 bp, Artificial Sequence
  chemically synthesized
gacaacaatcaaaatagaaaga

SEQ ID NO: 804071 - DNA, 22 bp, Artificial Sequence
  chemically synthesized
tatgtattttttaatctttcta

SEQ ID NO: 804072 - DNA, 22 bp, Artificial Sequence
  chemically synthesized
atatgtattttttaatctttct

SEQ ID NO: 804073 - DNA, 22 bp, Artificial Sequence
  chemically synthesized
tatatgtattttttaatctttc

SEQ ID NO: 804074 - DNA, 22 bp, Artificial Sequence
  chemically synthesized
agttttatatgtattttttaat

SEQ ID NO: 804075 - DNA, 22 bp, Artificial Sequence
  chemically synthesized
aattgagttttatatgtatttt

SEQ ID NO: 804076 - DNA, 22 bp, Artificial Sequence
  chemically synthesized
gaattgagttttatatgtattt

SEQ ID NO: 804077 - DNA, 22 bp, Artificial Sequence
  chemically synthesized
gtttgaattgagttttatatgt

SEQ ID NO: 804078 - DNA, 22 bp, Artificial Sequence
  chemically synthesized
agtttgaattgagttttatatg

SEQ ID NO: 804079 - DNA, 22 bp, Artificial Sequence
  chemically synthesized
tagtttgaattgagttttatat

SEQ ID NO: 804080 - DNA, 22 bp, Artificial Sequence
  chemically synthesized
ctttagtttgaattgagtttta

SEQ ID NO: 804081 - DNA, 22 bp, Artificial Sequence
  chemically synthesized
aaaaatacatataaaactcaat

SEQ ID NO: 804082 - DNA, 22 bp, Artificial Sequence
  chemically synthesized
ttgctttagtttgaattgagtt

SEQ ID NO: 804083 - DNA, 22 bp, Artificial Sequence
  chemically synthesized
ctgttgctttagtttgaattga

SEQ ID NO: 804084 - DNA, 22 bp, Artificial Sequence
  chemically synthesized
cctgttgctttagtttgaattg

SEQ ID NO: 804085 - DNA, 22 bp, Artificial Sequence
  chemically synthesized
cttcctgttgctttagtttgaa

SEQ ID NO: 804086 - DNA, 22 bp, Artificial Sequence
  chemically synthesized
gtgtattccttcctgttgcttt

SEQ ID NO: 804087 - DNA, 22 bp, Artificial Sequence
  chemically synthesized
agtgtattccttcctgttgctt

SEQ ID NO: 804088 - DNA, 22 bp, Artificial Sequence
  chemically synthesized
aattcaaactaaagcaacagga

SEQ ID NO: 804089 - DNA, 22 bp, Artificial Sequence
  chemically synthesized
tagtgtattccttcctgttgct

SEQ ID NO: 804090 - DNA, 22 bp, Artificial Sequence
  chemically synthesized
aaactaaagcaacaggaaggaa

SEQ ID NO: 804091 - DNA, 22 bp, Artificial Sequence
  chemically synthesized
aagcaacaggaaggaatacact

SEQ ID NO: 804092 - DNA, 22 bp, Artificial Sequence
  chemically synthesized
aggagaagaaacctttagtgta

SEQ ID NO: 804093 - DNA, 22 bp, Artificial Sequence
  chemically synthesized
taaggagaagaaacctttagtg

SEQ ID NO: 804094 - DNA, 22 bp, Artificial Sequence
  chemically synthesized
attctaaggagaagaaaccttt

SEQ ID NO: 804095 - DNA, 22 bp, Artificial Sequence
  chemically synthesized
aggatccctaattctaaggaga

SEQ ID NO: 804096 - DNA, 22 bp, Artificial Sequence
  chemically synthesized
aaggatccctaattctaaggag

SEQ ID NO: 804097 - DNA, 22 bp, Artificial Sequence
  chemically synthesized
aaggtttcttctccttagaatt

SEQ ID NO: 804098 - DNA, 22 bp, Artificial Sequence
  chemically synthesized
cttctccttagaattagggatc

SEQ ID NO: 804099 - DNA, 22 bp, Artificial Sequence
  chemically synthesized
ttctccttagaattagggatcc

SEQ ID NO: 804100 - DNA, 22 bp, Artificial Sequence
  chemically synthesized
ctccttagaattagggatcctt

SEQ ID NO: 804101 - DNA, 22 bp, Artificial Sequence
  chemically synthesized
tccttagaattagggatcctta

SEQ ID NO: 804102 - DNA, 22 bp, Artificial Sequence
  chemically synthesized
cttagaattagggatccttaaa

SEQ ID NO: 804103 - DNA, 22 bp, Artificial Sequence
  chemically synthesized
agaattagggatccttaaattg

SEQ ID NO: 804104 - DNA, 22 bp, Artificial Sequence
  chemically synthesized
agaatgcagaggcaatttaagg

SEQ ID NO: 804105 - DNA, 22 bp, Artificial Sequence
  chemically synthesized
gaattagggatccttaaattgc

SEQ ID NO: 804106 - DNA, 22 bp, Artificial Sequence
  chemically synthesized
tctgagaatgcagaggcaattt

SEQ ID NO: 804107 - DNA, 22 bp, Artificial Sequence
  chemically synthesized
gggatccttaaattgcctctgc

SEQ ID NO: 804108 - DNA, 22 bp, Artificial Sequence
  chemically synthesized
gactatctgagaatgcagaggc

SEQ ID NO: 804109 - DNA, 22 bp, Artificial Sequence
  chemically synthesized
ggactatctgagaatgcagagg

SEQ ID NO: 804110 - DNA, 22 bp, Artificial Sequence
  chemically synthesized
ttggactatctgagaatgcaga

SEQ ID NO: 804111 - DNA, 22 bp, Artificial Sequence
  chemically synthesized
cttggactatctgagaatgcag

SEQ ID NO: 804112 - DNA, 22 bp, Artificial Sequence
  chemically synthesized
aaattgcctctgcattctcaga

SEQ ID NO: 804113 - DNA, 22 bp, Artificial Sequence
  chemically synthesized
aattgcctctgcattctcagat

SEQ ID NO: 804114 - DNA, 22 bp, Artificial Sequence
  chemically synthesized
cctctgcattctcagatagtcc

SEQ ID NO: 804115 - DNA, 22 bp, Artificial Sequence
  chemically synthesized
tgcattctcagatagtccaaga

SEQ ID NO: 804116 - DNA, 22 bp, Artificial Sequence
  chemically synthesized
gagtatcgtatttcttggacta

SEQ ID NO: 804117 - DNA, 22 bp, Artificial Sequence
  chemically synthesized
cattctcagatagtccaagaaa

SEQ ID NO: 804118 - DNA, 22 bp, Artificial Sequence
  chemically synthesized
tcagatagtccaagaaatacga

SEQ ID NO: 804119 - DNA, 22 bp, Artificial Sequence
  chemically synthesized
agatagtccaagaaatacgata

SEQ ID NO: 804120 - DNA, 22 bp, Artificial Sequence
  chemically synthesized
aataaattggagtatcgtattt

SEQ ID NO: 804121 - DNA, 22 bp, Artificial Sequence
  chemically synthesized
gaataaattggagtatcgtatt

SEQ ID NO: 804122 - DNA, 22 bp, Artificial Sequence
  chemically synthesized
gtaccttgaataaattggagta

SEQ ID NO: 804123 - DNA, 22 bp, Artificial Sequence
  chemically synthesized
gtagcacaattagtaccttgaa

SEQ ID NO: 804124 - DNA, 22 bp, Artificial Sequence
  chemically synthesized
agtagcacaattagtaccttga

SEQ ID NO: 804125 - DNA, 22 bp, Artificial Sequence
  chemically synthesized
caatttattcaaggtactaatt

SEQ ID NO: 804126 - DNA, 22 bp, Artificial Sequence
  chemically synthesized
attcaaggtactaattgtgcta

SEQ ID NO: 804127 - DNA, 22 bp, Artificial Sequence
  chemically synthesized
ttcaaggtactaattgtgctac

SEQ ID NO: 804128 - DNA, 22 bp, Artificial Sequence
  chemically synthesized
aaggtactaattgtgctactaa

SEQ ID NO: 804129 - DNA, 22 bp, Artificial Sequence
  chemically synthesized
attgtgctactaagattgcatt

SEQ ID NO: 804130 - DNA, 22 bp, Artificial Sequence
  chemically synthesized
aagaaagaagaaagaatgcaat

SEQ ID NO: 804131 - DNA, 22 bp, Artificial Sequence
  chemically synthesized
tgctactaagattgcattcttt

SEQ ID NO: 804132 - DNA, 22 bp, Artificial Sequence
  chemically synthesized
tgaagaaagaagaaagaatgca

SEQ ID NO: 804133 - DNA, 22 bp, Artificial Sequence
  chemically synthesized
attctgaagaaagaagaaagaa

SEQ ID NO: 804134 - DNA, 22 bp, Artificial Sequence
  chemically synthesized
ctaagattgcattctttcttct

SEQ ID NO: 804135 - DNA, 22 bp, Artificial Sequence
  chemically synthesized
agattgcattctttcttctttc

SEQ ID NO: 804136 - DNA, 22 bp, Artificial Sequence
  chemically synthesized
cattctttcttctttcttcaga

SEQ ID NO: 804137 - DNA, 22 bp, Artificial Sequence
  chemically synthesized
gcgcacggattaattctgaaga

SEQ ID NO: 804138 - DNA, 22 bp, Artificial Sequence
  chemically synthesized
ggcgcacggattaattctgaag

SEQ ID NO: 804139 - DNA, 22 bp, Artificial Sequence
  chemically synthesized
tggcgcacggattaattctgaa

SEQ ID NO: 804140 - DNA, 22 bp, Artificial Sequence
  chemically synthesized
tttcttctttcttcagaattaa

SEQ ID NO: 804141 - DNA, 22 bp, Artificial Sequence
  chemically synthesized
tcttctttcttcagaattaatc

SEQ ID NO: 804142 - DNA, 22 bp, Artificial Sequence
  chemically synthesized
cttctttcttcagaattaatcc

SEQ ID NO: 804143 - DNA, 22 bp, Artificial Sequence
  chemically synthesized
ttctttcttcagaattaatccg

SEQ ID NO: 804144 - DNA, 22 bp, Artificial Sequence
  chemically synthesized
ctttcttcagaattaatccgtg

SEQ ID NO: 804145 - DNA, 22 bp, Artificial Sequence
  chemically synthesized
tttcttcagaattaatccgtgc

SEQ ID NO: 804146 - DNA, 22 bp, Artificial Sequence
  chemically synthesized
tcttcagaattaatccgtgcgc

SEQ ID NO: 804147 - DNA, 22 bp, Artificial Sequence
  chemically synthesized
accaaaattttggcgcacggat

SEQ ID NO: 804148 - DNA, 22 bp, Artificial Sequence
  chemically synthesized
cttcagaattaatccgtgcgcc

SEQ ID NO: 804149 - DNA, 22 bp, Artificial Sequence
  chemically synthesized
ttcagaattaatccgtgcgcca

SEQ ID NO: 804150 - DNA, 22 bp, Artificial Sequence
  chemically synthesized
tcaccaaaattttggcgcacgg

SEQ ID NO: 804151 - DNA, 22 bp, Artificial Sequence
  chemically synthesized
ctcaccaaaattttggcgcacg

SEQ ID NO: 804152 - DNA, 22 bp, Artificial Sequence
  chemically synthesized
cagaattaatccgtgcgccaaa

SEQ ID NO: 804153 - DNA, 22 bp, Artificial Sequence
  chemically synthesized
agaattaatccgtgcgccaaaa

SEQ ID NO: 804154 - DNA, 22 bp, Artificial Sequence
  chemically synthesized
atccgtgcgccaaaattttggt

SEQ ID NO: 804155 - DNA, 22 bp, Artificial Sequence
  chemically synthesized
gagaagtttctcaccaaaattt

SEQ ID NO: 804156 - DNA, 22 bp, Artificial Sequence
  chemically synthesized
tggtgagaaacttctccaattt

SEQ ID NO: 804157 - DNA, 22 bp, Artificial Sequence
  chemically synthesized
ggtgagaaacttctccaatttt

SEQ ID NO: 804158 - DNA, 22 bp, Artificial Sequence
  chemically synthesized
gtgagaaacttctccaatttta

SEQ ID NO: 804159 - DNA, 22 bp, Artificial Sequence
  chemically synthesized
aaataaaataaaataaaattgg

SEQ ID NO: 804160 - DNA, 22 bp, Artificial Sequence
  chemically synthesized
ctccaattttattttattttat

SEQ ID NO: 804161 - DNA, 22 bp, Artificial Sequence
  chemically synthesized
tccaattttattttattttatt

SEQ ID NO: 804162 - DNA, 22 bp, Artificial Sequence
  chemically synthesized
caattttattttattttatttt

SEQ ID NO: 804163 - DNA, 22 bp, Artificial Sequence
  chemically synthesized
aaaaaaataaattaaaataaaa

SEQ ID NO: 804164 - DNA, 22 bp, Artificial Sequence
  chemically synthesized
tctcaaaaaaataaattaaaat

SEQ ID NO: 804165 - DNA, 22 bp, Artificial Sequence
  chemically synthesized
tattttattttattttaattta

SEQ ID NO: 804166 - DNA, 22 bp, Artificial Sequence
  chemically synthesized
attttattttattttaatttat

SEQ ID NO: 804167 - DNA, 22 bp, Artificial Sequence
  chemically synthesized
tgtctcaaaaaaataaattaaa

SEQ ID NO: 804168 - DNA, 22 bp, Artificial Sequence
  chemically synthesized
ttttattttattttaatttatt

SEQ ID NO: 804169 - DNA, 22 bp, Artificial Sequence
  chemically synthesized
tattttattttaatttattttt

SEQ ID NO: 804170 - DNA, 22 bp, Artificial Sequence
  chemically synthesized
attttattttaatttatttttt

SEQ ID NO: 804171 - DNA, 22 bp, Artificial Sequence
  chemically synthesized
ttttattttaatttattttttt

SEQ ID NO: 804172 - DNA, 22 bp, Artificial Sequence
  chemically synthesized
tattttaatttatttttttgag

SEQ ID NO: 804173 - DNA, 22 bp, Artificial Sequence
  chemically synthesized
attttaatttatttttttgaga

SEQ ID NO: 804174 - DNA, 22 bp, Artificial Sequence
  chemically synthesized
ttttaatttatttttttgagac

SEQ ID NO: 804175 - DNA, 22 bp, Artificial Sequence
  chemically synthesized
taatttatttttttgagacaga

SEQ ID NO: 804176 - DNA, 22 bp, Artificial Sequence
  chemically synthesized
aatttatttttttgagacagag

SEQ ID NO: 804177 - DNA, 22 bp, Artificial Sequence
  chemically synthesized
atttatttttttgagacagagt

SEQ ID NO: 804178 - DNA, 22 bp, Artificial Sequence
  chemically synthesized
gtgaaagagcagactctgtctc

SEQ ID NO: 804179 - DNA, 22 bp, Artificial Sequence
  chemically synthesized
atttttttgagacagagtctgc

SEQ ID NO: 804180 - DNA, 22 bp, Artificial Sequence
  chemically synthesized
tttttttgagacagagtctgct

SEQ ID NO: 804181 - DNA, 22 bp, Artificial Sequence
  chemically synthesized
cagcctggtgaaagagcagact

SEQ ID NO: 804182 - DNA, 22 bp, Artificial Sequence
  chemically synthesized
ttttgagacagagtctgctctt

SEQ ID NO: 804183 - DNA, 22 bp, Artificial Sequence
  chemically synthesized
tttgagacagagtctgctcttt

SEQ ID NO: 804184 - DNA, 22 bp, Artificial Sequence
  chemically synthesized
ttgagacagagtctgctctttc

SEQ ID NO: 804185 - DNA, 22 bp, Artificial Sequence
  chemically synthesized
tgagacagagtctgctctttca

SEQ ID NO: 804186 - DNA, 22 bp, Artificial Sequence
  chemically synthesized
gagacagagtctgctctttcac

SEQ ID NO: 804187 - DNA, 22 bp, Artificial Sequence
  chemically synthesized
cactccagcctggtgaaagagc

SEQ ID NO: 804188 - DNA, 22 bp, Artificial Sequence
  chemically synthesized
agacagagtctgctctttcacc

SEQ ID NO: 804189 - DNA, 22 bp, Artificial Sequence
  chemically synthesized
ctctttcaccaggctggagtgc

SEQ ID NO: 804190 - DNA, 22 bp, Artificial Sequence
  chemically synthesized
tttcaccaggctggagtgcagt

SEQ ID NO: 804191 - DNA, 22 bp, Artificial Sequence
  chemically synthesized
tcaccaggctggagtgcagtgg

SEQ ID NO: 804192 - DNA, 22 bp, Artificial Sequence
  chemically synthesized
caccaggctggagtgcagtggc

SEQ ID NO: 804193 - DNA, 22 bp, Artificial Sequence
  chemically synthesized
accaggctggagtgcagtggcg

SEQ ID NO: 804194 - DNA, 22 bp, Artificial Sequence
  chemically synthesized
cagtgagccgagatggcgccac

SEQ ID NO: 804195 - DNA, 22 bp, Artificial Sequence
  chemically synthesized
gagtgcagtggcgccatctcgg

SEQ ID NO: 804196 - DNA, 22 bp, Artificial Sequence
  chemically synthesized
aacccaggaggtggaggttgca

SEQ ID NO: 804197 - DNA, 22 bp, Artificial Sequence
  chemically synthesized
gaacccaggaggtggaggttgc

SEQ ID NO: 804198 - DNA, 22 bp, Artificial Sequence
  chemically synthesized
cttgaacccaggaggtggaggt

SEQ ID NO: 804199 - DNA, 22 bp, Artificial Sequence
  chemically synthesized
ggctcactgcaacctccacctc

SEQ ID NO: 804200 - DNA, 22 bp, Artificial Sequence
  chemically synthesized
actgcaacctccacctcctggg

SEQ ID NO: 804201 - DNA, 22 bp, Artificial Sequence
  chemically synthesized
caacctccacctcctgggttca

SEQ ID NO: 804202 - DNA, 22 bp, Artificial Sequence
  chemically synthesized
aggcaggagaattgcttgaacc

SEQ ID NO: 804203 - DNA, 22 bp, Artificial Sequence
  chemically synthesized
cacctcctgggttcaagcaatt

SEQ ID NO: 804204 - DNA, 22 bp, Artificial Sequence
  chemically synthesized
ctgggttcaagcaattctcctg

SEQ ID NO: 804205 - DNA, 22 bp, Artificial Sequence
  chemically synthesized
aggaggctgaggcaggagaatt

SEQ ID NO: 804206 - DNA, 22 bp, Artificial Sequence
  chemically synthesized
ggttcaagcaattctcctgcct

SEQ ID NO: 804207 - DNA, 22 bp, Artificial Sequence
  chemically synthesized
ctcaggaggctgaggcaggaga

SEQ ID NO: 804208 - DNA, 22 bp, Artificial Sequence
  chemically synthesized
aagcaattctcctgcctcagcc

SEQ ID NO: 804209 - DNA, 22 bp, Artificial Sequence
  chemically synthesized
tagtcccagctactcaggaggc

SEQ ID NO: 804210 - DNA, 22 bp, Artificial Sequence
  chemically synthesized
tcctgcctcagcctcctgagta

SEQ ID NO: 804211 - DNA, 22 bp, Artificial Sequence
  chemically synthesized
ctgcctcagcctcctgagtagc

SEQ ID NO: 804212 - DNA, 22 bp, Artificial Sequence
  chemically synthesized
cctcagcctcctgagtagctgg

SEQ ID NO: 804213 - DNA, 22 bp, Artificial Sequence
  chemically synthesized
agcctcctgagtagctgggact

SEQ ID NO: 804214 - DNA, 22 bp, Artificial Sequence
  chemically synthesized
ctgagtagctgggactacaggc

SEQ ID NO: 804215 - DNA, 22 bp, Artificial Sequence
  chemically synthesized
agtagctgggactacaggcgta

SEQ ID NO: 804216 - DNA, 22 bp, Artificial Sequence
  chemically synthesized
gccgggtgtggtggagtacgcc

SEQ ID NO: 804217 - DNA, 22 bp, Artificial Sequence
  chemically synthesized
ggactacaggcgtactccacca

SEQ ID NO: 804218 - DNA, 22 bp, Artificial Sequence
  chemically synthesized
caggcgtactccaccacacccg

SEQ ID NO: 804219 - DNA, 22 bp, Artificial Sequence
  chemically synthesized
aaaatacaaaaattagccgggt

SEQ ID NO: 804220 - DNA, 22 bp, Artificial Sequence
  chemically synthesized
ctaaaaatacaaaaattagccg

SEQ ID NO: 804221 - DNA, 22 bp, Artificial Sequence
  chemically synthesized
tactaaaaatacaaaaattagc

SEQ ID NO: 804222 - DNA, 22 bp, Artificial Sequence
  chemically synthesized
caccacacccggctaatttttg

SEQ ID NO: 804223 - DNA, 22 bp, Artificial Sequence
  chemically synthesized
atttttgtatttttagtagaga

SEQ ID NO: 804224 - DNA, 22 bp, Artificial Sequence
  chemically synthesized
ttgtatttttagtagagacggg

SEQ ID NO: 804225 - DNA, 22 bp, Artificial Sequence
  chemically synthesized
tgtatttttagtagagacgggg

SEQ ID NO: 804226 - DNA, 22 bp, Artificial Sequence
  chemically synthesized
gtatttttagtagagacggggg

SEQ ID NO: 804227 - DNA, 22 bp, Artificial Sequence
  chemically synthesized
tatttttagtagagacgggggt

SEQ ID NO: 804228 - DNA, 22 bp, Artificial Sequence
  chemically synthesized
gccacaaggtgaaacccccgtc

SEQ ID NO: 804229 - DNA, 22 bp, Artificial Sequence
  chemically synthesized
ttagtagagacgggggtttcac

SEQ ID NO: 804230 - DNA, 22 bp, Artificial Sequence
  chemically synthesized
tagtagagacgggggtttcacc

SEQ ID NO: 804231 - DNA, 22 bp, Artificial Sequence
  chemically synthesized
agtagagacgggggtttcacct

SEQ ID NO: 804232 - DNA, 22 bp, Artificial Sequence
  chemically synthesized
gtagagacgggggtttcacctt

SEQ ID NO: 804233 - DNA, 22 bp, Artificial Sequence
  chemically synthesized
caccttgtggccaggatggtct

SEQ ID NO: 804234 - DNA, 22 bp, Artificial Sequence
  chemically synthesized
accttgtggccaggatggtctc

SEQ ID NO: 804235 - DNA, 22 bp, Artificial Sequence
  chemically synthesized
gtggccaggatggtctcgatct

SEQ ID NO: 804236 - DNA, 22 bp, Artificial Sequence
  chemically synthesized
tggccaggatggtctcgatctc

SEQ ID NO: 804237 - DNA, 22 bp, Artificial Sequence
  chemically synthesized
gatctcttgacctcgtgatccg

SEQ ID NO: 804238 - DNA, 22 bp, Artificial Sequence
  chemically synthesized
ggaggcagaggcgggcggatca

SEQ ID NO: 804239 - DNA, 22 bp, Artificial Sequence
  chemically synthesized
gggaggcagaggcgggcggatc

SEQ ID NO: 804240 - DNA, 22 bp, Artificial Sequence
  chemically synthesized
tgggaggcagaggcgggcggat

SEQ ID NO: 804241 - DNA, 22 bp, Artificial Sequence
  chemically synthesized
ttgacctcgtgatccgcccgcc

SEQ ID NO: 804242 - DNA, 22 bp, Artificial Sequence
  chemically synthesized
gacctcgtgatccgcccgcctc

SEQ ID NO: 804243 - DNA, 22 bp, Artificial Sequence
  chemically synthesized
acctcgtgatccgcccgcctct

SEQ ID NO: 804244 - DNA, 22 bp, Artificial Sequence
  chemically synthesized
gtgatccgcccgcctctgcctc

SEQ ID NO: 804245 - DNA, 22 bp, Artificial Sequence
  chemically synthesized
taatcccagcactttgggaggc

SEQ ID NO: 804246 - DNA, 22 bp, Artificial Sequence
  chemically synthesized
acgcctgtaatcccagcacttt

SEQ ID NO: 804247 - DNA, 22 bp, Artificial Sequence
  chemically synthesized
tgcctcccaaagtgctgggatt

SEQ ID NO: 804248 - DNA, 22 bp, Artificial Sequence
  chemically synthesized
cctcccaaagtgctgggattac

SEQ ID NO: 804249 - DNA, 22 bp, Artificial Sequence
  chemically synthesized
ccaaagtgctgggattacaggc

SEQ ID NO: 804250 - DNA, 22 bp, Artificial Sequence
  chemically synthesized
ggtgtggtggctcacgcctgta

SEQ ID NO: 804251 - DNA, 22 bp, Artificial Sequence
  chemically synthesized
aaattgggtgtggtggctcacg

SEQ ID NO: 804252 - DNA, 22 bp, Artificial Sequence
  chemically synthesized
ggattacaggcgtgagccacca

SEQ ID NO: 804253 - DNA, 22 bp, Artificial Sequence
  chemically synthesized
ttaaaattgggtgtggtggctc

SEQ ID NO: 804254 - DNA, 22 bp, Artificial Sequence
  chemically synthesized
caggcgtgagccaccacaccca

SEQ ID NO: 804255 - DNA, 22 bp, Artificial Sequence
  chemically synthesized
atatgttattaaaattgggtgt

SEQ ID NO: 804256 - DNA, 22 bp, Artificial Sequence
  chemically synthesized
taatatgttattaaaattgggt

SEQ ID NO: 804257 - DNA, 22 bp, Artificial Sequence
  chemically synthesized
ctaatatgttattaaaattggg

SEQ ID NO: 804258 - DNA, 22 bp, Artificial Sequence
  chemically synthesized
atttctaatatgttattaaaat

SEQ ID NO: 804259 - DNA, 22 bp, Artificial Sequence
  chemically synthesized
gatttctaatatgttattaaaa

SEQ ID NO: 804260 - DNA, 22 bp, Artificial Sequence
  chemically synthesized
tgatttctaatatgttattaaa

SEQ ID NO: 804261 - DNA, 22 bp, Artificial Sequence
  chemically synthesized
agatatctttgatttctaatat

SEQ ID NO: 804262 - DNA, 22 bp, Artificial Sequence
  chemically synthesized
taataacatattagaaatcaaa

SEQ ID NO: 804263 - DNA, 22 bp, Artificial Sequence
  chemically synthesized
aataacatattagaaatcaaag

SEQ ID NO: 804264 - DNA, 22 bp, Artificial Sequence
  chemically synthesized
ataacatattagaaatcaaaga

SEQ ID NO: 804265 - DNA, 22 bp, Artificial Sequence
  chemically synthesized
tgaattaagatatctttgattt

SEQ ID NO: 804266 - DNA, 22 bp, Artificial Sequence
  chemically synthesized
agtacacctatgaattaagata

SEQ ID NO: 804267 - DNA, 22 bp, Artificial Sequence
  chemically synthesized
gaaatcaaagatatcttaattc

SEQ ID NO: 804268 - DNA, 22 bp, Artificial Sequence
  chemically synthesized
tacatctgagtacacctatgaa

SEQ ID NO: 804269 - DNA, 22 bp, Artificial Sequence
  chemically synthesized
aattgtacatctgagtacacct

SEQ ID NO: 804270 - DNA, 22 bp, Artificial Sequence
  chemically synthesized
gaattgtacatctgagtacacc

SEQ ID NO: 804271 - DNA, 22 bp, Artificial Sequence
  chemically synthesized
aattcataggtgtactcagatg

SEQ ID NO: 804272 - DNA, 22 bp, Artificial Sequence
  chemically synthesized
attcataggtgtactcagatgt

SEQ ID NO: 804273 - DNA, 22 bp, Artificial Sequence
  chemically synthesized
ataggtgtactcagatgtacaa

SEQ ID NO: 804274 - DNA, 22 bp, Artificial Sequence
  chemically synthesized
ataaagtttgaattgtacatct

SEQ ID NO: 804275 - DNA, 22 bp, Artificial Sequence
  chemically synthesized
cataaagtttgaattgtacatc

SEQ ID NO: 804276 - DNA, 22 bp, Artificial Sequence
  chemically synthesized
agatgtacaattcaaactttat

SEQ ID NO: 804277 - DNA, 22 bp, Artificial Sequence
  chemically synthesized
cagagagacaagtttcataaag

SEQ ID NO: 804278 - DNA, 22 bp, Artificial Sequence
  chemically synthesized
ccagagagacaagtttcataaa

SEQ ID NO: 804279 - DNA, 22 bp, Artificial Sequence
  chemically synthesized
aaactttatgaaacttgtctct

SEQ ID NO: 804280 - DNA, 22 bp, Artificial Sequence
  chemically synthesized
tatgaaacttgtctctctggaa

SEQ ID NO: 804281 - DNA, 22 bp, Artificial Sequence
  chemically synthesized
atgaaacttgtctctctggaaa

SEQ ID NO: 804282 - DNA, 22 bp, Artificial Sequence
  chemically synthesized
atgaataaaacatttccagaga

SEQ ID NO: 804283 - DNA, 22 bp, Artificial Sequence
  chemically synthesized
tgaaacttgtctctctggaaat

SEQ ID NO: 804284 - DNA, 22 bp, Artificial Sequence
  chemically synthesized
tgatgaataaaacatttccaga

SEQ ID NO: 804285 - DNA, 22 bp, Artificial Sequence
  chemically synthesized
ctgatgaataaaacatttccag

SEQ ID NO: 804286 - DNA, 22 bp, Artificial Sequence
  chemically synthesized
tcttctgatgaataaaacattt

SEQ ID NO: 804287 - DNA, 22 bp, Artificial Sequence
  chemically synthesized
gtctctctggaaatgttttatt

SEQ ID NO: 804288 - DNA, 22 bp, Artificial Sequence
  chemically synthesized
tctctctggaaatgttttattc

SEQ ID NO: 804289 - DNA, 22 bp, Artificial Sequence
  chemically synthesized
tctggaaatgttttattcatca

SEQ ID NO: 804290 - DNA, 22 bp, Artificial Sequence
  chemically synthesized
tggaaatgttttattcatcaga

SEQ ID NO: 804291 - DNA, 22 bp, Artificial Sequence
  chemically synthesized
taaaaattgtcttctgatgaat

SEQ ID NO: 804292 - DNA, 22 bp, Artificial Sequence
  chemically synthesized
gaaatgttttattcatcagaag

SEQ ID NO: 804293 - DNA, 22 bp, Artificial Sequence
  chemically synthesized
tattcatcagaagacaattttt

SEQ ID NO: 804294 - DNA, 22 bp, Artificial Sequence
  chemically synthesized
attcatcagaagacaattttta

SEQ ID NO: 804295 - DNA, 22 bp, Artificial Sequence
  chemically synthesized
ttcatcagaagacaatttttat

SEQ ID NO: 804296 - DNA, 22 bp, Artificial Sequence
  chemically synthesized
aatccccccattataaaaattg

SEQ ID NO: 804297 - DNA, 22 bp, Artificial Sequence
  chemically synthesized
tcaatccccccattataaaaat

SEQ ID NO: 804298 - DNA, 22 bp, Artificial Sequence
  chemically synthesized
atcagaagacaatttttataat

SEQ ID NO: 804299 - DNA, 22 bp, Artificial Sequence
  chemically synthesized
ctctcaatccccccattataaa

SEQ ID NO: 804300 - DNA, 22 bp, Artificial Sequence
  chemically synthesized
cgtctcctctcaatccccccat

SEQ ID NO: 804301 - DNA, 22 bp, Artificial Sequence
  chemically synthesized
cctacgtctcctctcaatcccc

SEQ ID NO: 804302 - DNA, 22 bp, Artificial Sequence
  chemically synthesized
acctacgtctcctctcaatccc

SEQ ID NO: 804303 - DNA, 22 bp, Artificial Sequence
  chemically synthesized
tacctacgtctcctctcaatcc

SEQ ID NO: 804304 - DNA, 22 bp, Artificial Sequence
  chemically synthesized
ttataatggggggattgagagg

SEQ ID NO: 804305 - DNA, 22 bp, Artificial Sequence
  chemically synthesized
tataatggggggattgagagga

SEQ ID NO: 804306 - DNA, 22 bp, Artificial Sequence
  chemically synthesized
ataatggggggattgagaggag

SEQ ID NO: 804307 - DNA, 22 bp, Artificial Sequence
  chemically synthesized
taatggggggattgagaggaga

SEQ ID NO: 804308 - DNA, 22 bp, Artificial Sequence
  chemically synthesized
gtgttttacctacgtctcctct

SEQ ID NO: 804309 - DNA, 22 bp, Artificial Sequence
  chemically synthesized
atctcgtgttttacctacgtct

SEQ ID NO: 804310 - DNA, 22 bp, Artificial Sequence
  chemically synthesized
cctaatctcgtgttttacctac

SEQ ID NO: 804311 - DNA, 22 bp, Artificial Sequence
  chemically synthesized
ccctaatctcgtgttttaccta

SEQ ID NO: 804312 - DNA, 22 bp, Artificial Sequence
  chemically synthesized
agaggagacgtaggtaaaacac

SEQ ID NO: 804313 - DNA, 22 bp, Artificial Sequence
  chemically synthesized
ccttccctaatctcgtgtttta

SEQ ID NO: 804314 - DNA, 22 bp, Artificial Sequence
  chemically synthesized
aaatcactcccttccctaatct

SEQ ID NO: 804315 - DNA, 22 bp, Artificial Sequence
  chemically synthesized
caaatcactcccttccctaatc

SEQ ID NO: 804316 - DNA, 22 bp, Artificial Sequence
  chemically synthesized
tcaaatcactcccttccctaat

SEQ ID NO: 804317 - DNA, 22 bp, Artificial Sequence
  chemically synthesized
aggccatatctttcaaatcact

SEQ ID NO: 804318 - DNA, 22 bp, Artificial Sequence
  chemically synthesized
gggaagggagtgatttgaaaga

SEQ ID NO: 804319 - DNA, 22 bp, Artificial Sequence
  chemically synthesized
ggtcatgtctcaggccatatct

SEQ ID NO: 804320 - DNA, 22 bp, Artificial Sequence
  chemically synthesized
tgatctgggtcatgtctcaggc

SEQ ID NO: 804321 - DNA, 22 bp, Artificial Sequence
  chemically synthesized
gaaagatatggcctgagacatg

SEQ ID NO: 804322 - DNA, 22 bp, Artificial Sequence
  chemically synthesized
aaagatatggcctgagacatga

SEQ ID NO: 804323 - DNA, 22 bp, Artificial Sequence
  chemically synthesized
atctgtgatctgggtcatgtct

SEQ ID NO: 804324 - DNA, 22 bp, Artificial Sequence
  chemically synthesized
catctgtgatctgggtcatgtc

SEQ ID NO: 804325 - DNA, 22 bp, Artificial Sequence
  chemically synthesized
agacatgacccagatcacagat

SEQ ID NO: 804326 - DNA, 22 bp, Artificial Sequence
  chemically synthesized
aggagcaataaatatatgagat

SEQ ID NO: 804327 - DNA, 22 bp, Artificial Sequence
  chemically synthesized
agcaagacaaactaaggagcaa

SEQ ID NO: 804328 - DNA, 22 bp, Artificial Sequence
  chemically synthesized
tcagcaagacaaactaaggagc

SEQ ID NO: 804329 - DNA, 22 bp, Artificial Sequence
  chemically synthesized
atatatttattgctccttagtt

SEQ ID NO: 804330 - DNA, 22 bp, Artificial Sequence
  chemically synthesized
ctcagcaagacaaactaaggag

SEQ ID NO: 804331 - DNA, 22 bp, Artificial Sequence
  chemically synthesized
tctcagcaagacaaactaagga

SEQ ID NO: 804332 - DNA, 22 bp, Artificial Sequence
  chemically synthesized
ttctcagcaagacaaactaagg

SEQ ID NO: 804333 - DNA, 22 bp, Artificial Sequence
  chemically synthesized
attgctccttagtttgtcttgc

SEQ ID NO: 804334 - DNA, 22 bp, Artificial Sequence
  chemically synthesized
ttgctccttagtttgtcttgct

SEQ ID NO: 804335 - DNA, 22 bp, Artificial Sequence
  chemically synthesized
acatatttttctcagcaagaca

SEQ ID NO: 804336 - DNA, 22 bp, Artificial Sequence
  chemically synthesized
ctccttagtttgtcttgctgag

SEQ ID NO: 804337 - DNA, 22 bp, Artificial Sequence
  chemically synthesized
cttagtttgtcttgctgagaaa

SEQ ID NO: 804338 - DNA, 22 bp, Artificial Sequence
  chemically synthesized
agtttgtcttgctgagaaaaat

SEQ ID NO: 804339 - DNA, 22 bp, Artificial Sequence
  chemically synthesized
gtttgtcttgctgagaaaaata

SEQ ID NO: 804340 - DNA, 22 bp, Artificial Sequence
  chemically synthesized
gtcttgctgagaaaaatatgtt

SEQ ID NO: 804341 - DNA, 22 bp, Artificial Sequence
  chemically synthesized
tcttgctgagaaaaatatgtta

SEQ ID NO: 804342 - DNA, 22 bp, Artificial Sequence
  chemically synthesized
gctgagaaaaatatgttaatta

SEQ ID NO: 804343 - DNA, 22 bp, Artificial Sequence
  chemically synthesized
ataaaggtggtgtaattaacat

SEQ ID NO: 804344 - DNA, 22 bp, Artificial Sequence
  chemically synthesized
ctgagaaaaatatgttaattac

SEQ ID NO: 804345 - DNA, 22 bp, Artificial Sequence
  chemically synthesized
agaaaaatatgttaattacacc

SEQ ID NO: 804346 - DNA, 22 bp, Artificial Sequence
  chemically synthesized
tgatgttcataaaggtggtgta

SEQ ID NO: 804347 - DNA, 22 bp, Artificial Sequence
  chemically synthesized
atgatgttcataaaggtggtgt

SEQ ID NO: 804348 - DNA, 22 bp, Artificial Sequence
  chemically synthesized
tatgatgttcataaaggtggtg

SEQ ID NO: 804349 - DNA, 22 bp, Artificial Sequence
  chemically synthesized
attacaccacctttatgaacat

SEQ ID NO: 804350 - DNA, 22 bp, Artificial Sequence
  chemically synthesized
caccacctttatgaacatcata

SEQ ID NO: 804351 - DNA, 22 bp, Artificial Sequence
  chemically synthesized
tatgaacatcataaaggtcacc

SEQ ID NO: 804352 - DNA, 22 bp, Artificial Sequence
  chemically synthesized
atgaacatcataaaggtcacca

SEQ ID NO: 804353 - DNA, 22 bp, Artificial Sequence
  chemically synthesized
tgaacatcataaaggtcaccac

SEQ ID NO: 804354 - DNA, 22 bp, Artificial Sequence
  chemically synthesized
taaagacaatgtgggggtgtgg

SEQ ID NO: 804355 - DNA, 22 bp, Artificial Sequence
  chemically synthesized
gtaaagacaatgtgggggtgtg

SEQ ID NO: 804356 - DNA, 22 bp, Artificial Sequence
  chemically synthesized
gcttgtaaagacaatgtggggg

SEQ ID NO: 804357 - DNA, 22 bp, Artificial Sequence
  chemically synthesized
taatattagcttgtaaagacaa

SEQ ID NO: 804358 - DNA, 22 bp, Artificial Sequence
  chemically synthesized
agagatcattgtaatattagct

SEQ ID NO: 804359 - DNA, 22 bp, Artificial Sequence
  chemically synthesized
tctttacaagctaatattacaa

SEQ ID NO: 804360 - DNA, 22 bp, Artificial Sequence
  chemically synthesized
tacaagctaatattacaatgat

SEQ ID NO: 804361 - DNA, 22 bp, Artificial Sequence
  chemically synthesized
acaagctaatattacaatgatc

SEQ ID NO: 804362 - DNA, 22 bp, Artificial Sequence
  chemically synthesized
caagctaatattacaatgatct

SEQ ID NO: 804363 - DNA, 22 bp, Artificial Sequence
  chemically synthesized
agtacccctgagagatcattgt

SEQ ID NO: 804364 - DNA, 22 bp, Artificial Sequence
  chemically synthesized
taagtacccctgagagatcatt

SEQ ID NO: 804365 - DNA, 22 bp, Artificial Sequence
  chemically synthesized
tctaagtacccctgagagatca

SEQ ID NO: 804366 - DNA, 22 bp, Artificial Sequence
  chemically synthesized
atattacaatgatctctcaggg

SEQ ID NO: 804367 - DNA, 22 bp, Artificial Sequence
  chemically synthesized
agtggttctctaagtacccctg

SEQ ID NO: 804368 - DNA, 22 bp, Artificial Sequence
  chemically synthesized
caatgatctctcaggggtactt

SEQ ID NO: 804369 - DNA, 22 bp, Artificial Sequence
  chemically synthesized
acaaatattaagtggttctcta

SEQ ID NO: 804370 - DNA, 22 bp, Artificial Sequence
  chemically synthesized
tcaggggtacttagagaaccac

SEQ ID NO: 804371 - DNA, 22 bp, Artificial Sequence
  chemically synthesized
cacaaatattaagtggttctct

SEQ ID NO: 804372 - DNA, 22 bp, Artificial Sequence
  chemically synthesized
aggggtacttagagaaccactt

SEQ ID NO: 804373 - DNA, 22 bp, Artificial Sequence
  chemically synthesized
acaagagtttcacaaatattaa

SEQ ID NO: 804374 - DNA, 22 bp, Artificial Sequence
  chemically synthesized
cacaagagtttcacaaatatta

SEQ ID NO: 804375 - DNA, 22 bp, Artificial Sequence
  chemically synthesized
agagaaccacttaatatttgtg

SEQ ID NO: 804376 - DNA, 22 bp, Artificial Sequence
  chemically synthesized
gagaaccacttaatatttgtga

SEQ ID NO: 804377 - DNA, 22 bp, Artificial Sequence
  chemically synthesized
aatatttcacaagagtttcaca

SEQ ID NO: 804378 - DNA, 22 bp, Artificial Sequence
  chemically synthesized
tgaatatttcacaagagtttca

SEQ ID NO: 804379 - DNA, 22 bp, Artificial Sequence
  chemically synthesized
ctgaatatttcacaagagtttc

SEQ ID NO: 804380 - DNA, 22 bp, Artificial Sequence
  chemically synthesized
tctgaatatttcacaagagttt

SEQ ID NO: 804381 - DNA, 22 bp, Artificial Sequence
  chemically synthesized
aatatttgtgaaactcttgtga

SEQ ID NO: 804382 - DNA, 22 bp, Artificial Sequence
  chemically synthesized
atatttgtgaaactcttgtgaa

SEQ ID NO: 804383 - DNA, 22 bp, Artificial Sequence
  chemically synthesized
tctttctgaatatttcacaaga

SEQ ID NO: 804384 - DNA, 22 bp, Artificial Sequence
  chemically synthesized
tgtctttctgaatatttcacaa

SEQ ID NO: 804385 - DNA, 22 bp, Artificial Sequence
  chemically synthesized
gtgaaactcttgtgaaatattc

SEQ ID NO: 804386 - DNA, 22 bp, Artificial Sequence
  chemically synthesized
tgaaactcttgtgaaatattca

SEQ ID NO: 804387 - DNA, 22 bp, Artificial Sequence
  chemically synthesized
ttgtgaaatattcagaaagaca

SEQ ID NO: 804388 - DNA, 22 bp, Artificial Sequence
  chemically synthesized
gtgaaatattcagaaagacaga

SEQ ID NO: 804389 - DNA, 22 bp, Artificial Sequence
  chemically synthesized
tgaaatattcagaaagacagag

SEQ ID NO: 804390 - DNA, 22 bp, Artificial Sequence
  chemically synthesized
aaaatggaaagactctgtcttt

SEQ ID NO: 804391 - DNA, 22 bp, Artificial Sequence
  chemically synthesized
actgaaaatggaaagactctgt

SEQ ID NO: 804392 - DNA, 22 bp, Artificial Sequence
  chemically synthesized
agaaagacagagtctttccatt

SEQ ID NO: 804393 - DNA, 22 bp, Artificial Sequence
  chemically synthesized
ggtaactaactgaaaatggaaa

SEQ ID NO: 804394 - DNA, 22 bp, Artificial Sequence
  chemically synthesized
ccataaaaccctgggtaactaa

SEQ ID NO: 804395 - DNA, 22 bp, Artificial Sequence
  chemically synthesized
tccattttcagttagttaccca

SEQ ID NO: 804396 - DNA, 22 bp, Artificial Sequence
  chemically synthesized
ccattttcagttagttacccag

SEQ ID NO: 804397 - DNA, 22 bp, Artificial Sequence
  chemically synthesized
cattttcagttagttacccagg

SEQ ID NO: 804398 - DNA, 22 bp, Artificial Sequence
  chemically synthesized
tcagttagttacccagggtttt

SEQ ID NO: 804399 - DNA, 22 bp, Artificial Sequence
  chemically synthesized
cagttagttacccagggtttta

SEQ ID NO: 804400 - DNA, 22 bp, Artificial Sequence
  chemically synthesized
aaagtactaccataaaaccctg

SEQ ID NO: 804401 - DNA, 22 bp, Artificial Sequence
  chemically synthesized
agttagttacccagggttttat

SEQ ID NO: 804402 - DNA, 22 bp, Artificial Sequence
  chemically synthesized
gttacccagggttttatggtag

SEQ ID NO: 804403 - DNA, 22 bp, Artificial Sequence
  chemically synthesized
atggttcaaagtactaccataa

SEQ ID NO: 804404 - DNA, 22 bp, Artificial Sequence
  chemically synthesized
cccagggttttatggtagtact

SEQ ID NO: 804405 - DNA, 22 bp, Artificial Sequence
  chemically synthesized
ttcatggttcaaagtactacca

SEQ ID NO: 804406 - DNA, 22 bp, Artificial Sequence
  chemically synthesized
acaaagctgttcatggttcaaa

SEQ ID NO: 804407 - DNA, 22 bp, Artificial Sequence
  chemically synthesized
tatggtagtactttgaaccatg

SEQ ID NO: 804408 - DNA, 22 bp, Artificial Sequence
  chemically synthesized
atggtagtactttgaaccatga

SEQ ID NO: 804409 - DNA, 22 bp, Artificial Sequence
  chemically synthesized
tggtagtactttgaaccatgaa

SEQ ID NO: 804410 - DNA, 22 bp, Artificial Sequence
  chemically synthesized
agaagagttgacaaagctgttc

SEQ ID NO: 804411 - DNA, 22 bp, Artificial Sequence
  chemically synthesized
tgaaccatgaacagctttgtca

SEQ ID NO: 804412 - DNA, 22 bp, Artificial Sequence
  chemically synthesized
gaaccatgaacagctttgtcaa

SEQ ID NO: 804413 - DNA, 22 bp, Artificial Sequence
  chemically synthesized
aaccatgaacagctttgtcaac

SEQ ID NO: 804414 - DNA, 22 bp, Artificial Sequence
  chemically synthesized
ggcctaagaagagttgacaaag

SEQ ID NO: 804415 - DNA, 22 bp, Artificial Sequence
  chemically synthesized
gggcctaagaagagttgacaaa

SEQ ID NO: 804416 - DNA, 22 bp, Artificial Sequence
  chemically synthesized
tgggcctaagaagagttgacaa

SEQ ID NO: 804417 - DNA, 22 bp, Artificial Sequence
  chemically synthesized
ctttgggcctaagaagagttga

SEQ ID NO: 804418 - DNA, 22 bp, Artificial Sequence
  chemically synthesized
tgctttgggcctaagaagagtt

SEQ ID NO: 804419 - DNA, 22 bp, Artificial Sequence
  chemically synthesized
ctgctttgggcctaagaagagt

SEQ ID NO: 804420 - DNA, 22 bp, Artificial Sequence
  chemically synthesized
tctgctttgggcctaagaagag

SEQ ID NO: 804421 - DNA, 22 bp, Artificial Sequence
  chemically synthesized
tgtcaactcttcttaggcccaa

SEQ ID NO: 804422 - DNA, 22 bp, Artificial Sequence
  chemically synthesized
gtcaactcttcttaggcccaaa

SEQ ID NO: 804423 - DNA, 22 bp, Artificial Sequence
  chemically synthesized
tcaactcttcttaggcccaaag

SEQ ID NO: 804424 - DNA, 22 bp, Artificial Sequence
  chemically synthesized
tccaaaacattttctgctttgg

SEQ ID NO: 804425 - DNA, 22 bp, Artificial Sequence
  chemically synthesized
tatccaaaacattttctgcttt

SEQ ID NO: 804426 - DNA, 22 bp, Artificial Sequence
  chemically synthesized
ttcttaggcccaaagcagaaaa

SEQ ID NO: 804427 - DNA, 22 bp, Artificial Sequence
  chemically synthesized
tctatccaaaacattttctgct

SEQ ID NO: 804428 - DNA, 22 bp, Artificial Sequence
  chemically synthesized
cttaggcccaaagcagaaaatg

SEQ ID NO: 804429 - DNA, 22 bp, Artificial Sequence
  chemically synthesized
ctctatccaaaacattttctgc

SEQ ID NO: 804430 - DNA, 22 bp, Artificial Sequence
  chemically synthesized
ttaggcccaaagcagaaaatgt

SEQ ID NO: 804431 - DNA, 22 bp, Artificial Sequence
  chemically synthesized
aggcccaaagcagaaaatgttt

SEQ ID NO: 804432 - DNA, 22 bp, Artificial Sequence
  chemically synthesized
tttctctatccaaaacattttc

SEQ ID NO: 804433 - DNA, 22 bp, Artificial Sequence
  chemically synthesized
ggcccaaagcagaaaatgtttt

SEQ ID NO: 804434 - DNA, 22 bp, Artificial Sequence
  chemically synthesized
aatcggattatttctctatcca

SEQ ID NO: 804435 - DNA, 22 bp, Artificial Sequence
  chemically synthesized
gtaattgaatcggattatttct

SEQ ID NO: 804436 - DNA, 22 bp, Artificial Sequence
  chemically synthesized
tggatagagaaataatccgatt

SEQ ID NO: 804437 - DNA, 22 bp, Artificial Sequence
  chemically synthesized
tattcgtaattgaatcggatta

SEQ ID NO: 804438 - DNA, 22 bp, Artificial Sequence
  chemically synthesized
ggatagagaaataatccgattc

SEQ ID NO: 804439 - DNA, 22 bp, Artificial Sequence
  chemically synthesized
gatagagaaataatccgattca

SEQ ID NO: 804440 - DNA, 22 bp, Artificial Sequence
  chemically synthesized
aataaaaaaactatattcgtaa

SEQ ID NO: 804441 - DNA, 22 bp, Artificial Sequence
  chemically synthesized
aaataaaaaaactatattcgta

SEQ ID NO: 804442 - DNA, 22 bp, Artificial Sequence
  chemically synthesized
taaataaaaaaactatattcgt

SEQ ID NO: 804443 - DNA, 22 bp, Artificial Sequence
  chemically synthesized
tcctttaaataaaaaaactata

SEQ ID NO: 804444 - DNA, 22 bp, Artificial Sequence
  chemically synthesized
atcctttaaataaaaaaactat

SEQ ID NO: 804445 - DNA, 22 bp, Artificial Sequence
  chemically synthesized
aattacgaatatagttttttta

SEQ ID NO: 804446 - DNA, 22 bp, Artificial Sequence
  chemically synthesized
cgaatatagtttttttatttaa

SEQ ID NO: 804447 - DNA, 22 bp, Artificial Sequence
  chemically synthesized
cagatttatcctttaaataaaa

SEQ ID NO: 804448 - DNA, 22 bp, Artificial Sequence
  chemically synthesized
aattgcagatttatcctttaaa

SEQ ID NO: 804449 - DNA, 22 bp, Artificial Sequence
  chemically synthesized
aaattgcagatttatcctttaa

SEQ ID NO: 804450 - DNA, 22 bp, Artificial Sequence
  chemically synthesized
taaattgcagatttatccttta

SEQ ID NO: 804451 - DNA, 22 bp, Artificial Sequence
  chemically synthesized
ttaaattgcagatttatccttt

SEQ ID NO: 804452 - DNA, 22 bp, Artificial Sequence
  chemically synthesized
ttttatttaaaggataaatctg

SEQ ID NO: 804453 - DNA, 22 bp, Artificial Sequence
  chemically synthesized
tttatttaaaggataaatctgc

SEQ ID NO: 804454 - DNA, 22 bp, Artificial Sequence
  chemically synthesized
ttatttaaaggataaatctgca

SEQ ID NO: 804455 - DNA, 22 bp, Artificial Sequence
  chemically synthesized
tatttaaaggataaatctgcaa

SEQ ID NO: 804456 - DNA, 22 bp, Artificial Sequence
  chemically synthesized
aggatttttaaattgcagattt

SEQ ID NO: 804457 - DNA, 22 bp, Artificial Sequence
  chemically synthesized
atttaaaggataaatctgcaat

SEQ ID NO: 804458 - DNA, 22 bp, Artificial Sequence
  chemically synthesized
caggatttttaaattgcagatt

SEQ ID NO: 804459 - DNA, 22 bp, Artificial Sequence
  chemically synthesized
tttaaaggataaatctgcaatt

SEQ ID NO: 804460 - DNA, 22 bp, Artificial Sequence
  chemically synthesized
aaaggataaatctgcaatttaa

SEQ ID NO: 804461 - DNA, 22 bp, Artificial Sequence
  chemically synthesized
aaggataaatctgcaatttaaa

SEQ ID NO: 804462 - DNA, 22 bp, Artificial Sequence
  chemically synthesized
ggggtgaaagtttcaggatttt

SEQ ID NO: 804463 - DNA, 22 bp, Artificial Sequence
  chemically synthesized
aggggtgaaagtttcaggattt

SEQ ID NO: 804464 - DNA, 22 bp, Artificial Sequence
  chemically synthesized
taggggtgaaagtttcaggatt

SEQ ID NO: 804465 - DNA, 22 bp, Artificial Sequence
  chemically synthesized
caatttaaaaatcctgaaactt

SEQ ID NO: 804466 - DNA, 22 bp, Artificial Sequence
  chemically synthesized
aaaaatcctgaaactttcaccc

SEQ ID NO: 804467 - DNA, 22 bp, Artificial Sequence
  chemically synthesized
aaaatcctgaaactttcacccc

SEQ ID NO: 804468 - DNA, 22 bp, Artificial Sequence
  chemically synthesized
aaactttcacccctaaaggctt

SEQ ID NO: 804469 - DNA, 22 bp, Artificial Sequence
  chemically synthesized
tagaacgccatacaaagccttt

SEQ ID NO: 804470 - DNA, 22 bp, Artificial Sequence
  chemically synthesized
atagaacgccatacaaagcctt

SEQ ID NO: 804471 - DNA, 22 bp, Artificial Sequence
  chemically synthesized
tatagaacgccatacaaagcct

SEQ ID NO: 804472 - DNA, 22 bp, Artificial Sequence
  chemically synthesized
ttatagaacgccatacaaagcc

SEQ ID NO: 804473 - DNA, 22 bp, Artificial Sequence
  chemically synthesized
tcacccctaaaggctttgtatg

SEQ ID NO: 804474 - DNA, 22 bp, Artificial Sequence
  chemically synthesized
cacccctaaaggctttgtatgg

SEQ ID NO: 804475 - DNA, 22 bp, Artificial Sequence
  chemically synthesized
acccctaaaggctttgtatggc

SEQ ID NO: 804476 - DNA, 22 bp, Artificial Sequence
  chemically synthesized
aaggctttgtatggcgttctat

SEQ ID NO: 804477 - DNA, 22 bp, Artificial Sequence
  chemically synthesized
agcaaatgtatttttatagaac

SEQ ID NO: 804478 - DNA, 22 bp, Artificial Sequence
  chemically synthesized
aagcaaatgtatttttatagaa

SEQ ID NO: 804479 - DNA, 22 bp, Artificial Sequence
  chemically synthesized
taagcaaatgtatttttataga

SEQ ID NO: 804480 - DNA, 22 bp, Artificial Sequence
  chemically synthesized
ttaagcaaatgtatttttatag

SEQ ID NO: 804481 - DNA, 22 bp, Artificial Sequence
  chemically synthesized
tgtatggcgttctataaaaata

SEQ ID NO: 804482 - DNA, 22 bp, Artificial Sequence
  chemically synthesized
gtatggcgttctataaaaatac

SEQ ID NO: 804483 - DNA, 22 bp, Artificial Sequence
  chemically synthesized
tatggcgttctataaaaataca

SEQ ID NO: 804484 - DNA, 22 bp, Artificial Sequence
  chemically synthesized
gaatttttaagcaaatgtattt

SEQ ID NO: 804485 - DNA, 22 bp, Artificial Sequence
  chemically synthesized
actggaatttttaagcaaatgt

SEQ ID NO: 804486 - DNA, 22 bp, Artificial Sequence
  chemically synthesized
tataaaaatacatttgcttaaa

SEQ ID NO: 804487 - DNA, 22 bp, Artificial Sequence
  chemically synthesized
taaaaatacatttgcttaaaaa

SEQ ID NO: 804488 - DNA, 22 bp, Artificial Sequence
  chemically synthesized
atatgctaactggaatttttaa

SEQ ID NO: 804489 - DNA, 22 bp, Artificial Sequence
  chemically synthesized
tgatatgctaactggaattttt

SEQ ID NO: 804490 - DNA, 22 bp, Artificial Sequence
  chemically synthesized
ctgatatgctaactggaatttt

SEQ ID NO: 804491 - DNA, 22 bp, Artificial Sequence
  chemically synthesized
tttctgatatgctaactggaat

SEQ ID NO: 804492 - DNA, 22 bp, Artificial Sequence
  chemically synthesized
ttatttctgatatgctaactgg

SEQ ID NO: 804493 - DNA, 22 bp, Artificial Sequence
  chemically synthesized
gcttaaaaattccagttagcat

SEQ ID NO: 804494 - DNA, 22 bp, Artificial Sequence
  chemically synthesized
cttaaaaattccagttagcata

SEQ ID NO: 804495 - DNA, 22 bp, Artificial Sequence
  chemically synthesized
aaaaattccagttagcatatca

SEQ ID NO: 804496 - DNA, 22 bp, Artificial Sequence
  chemically synthesized
aaaattccagttagcatatcag

SEQ ID NO: 804497 - DNA, 22 bp, Artificial Sequence
  chemically synthesized
taaatattgttatttctgatat

SEQ ID NO: 804498 - DNA, 22 bp, Artificial Sequence
  chemically synthesized
ataaatattgttatttctgata

SEQ ID NO: 804499 - DNA, 22 bp, Artificial Sequence
  chemically synthesized
ttataaatattgttatttctga

SEQ ID NO: 804500 - DNA, 22 bp, Artificial Sequence
  chemically synthesized
cagttagcatatcagaaataac

SEQ ID NO: 804501 - DNA, 22 bp, Artificial Sequence
  chemically synthesized
cttataaatattgttatttctg

SEQ ID NO: 804502 - DNA, 22 bp, Artificial Sequence
  chemically synthesized
gcatatcagaaataacaatatt

SEQ ID NO: 804503 - DNA, 22 bp, Artificial Sequence
  chemically synthesized
aggataagggggtgtttcttat

SEQ ID NO: 804504 - DNA, 22 bp, Artificial Sequence
  chemically synthesized
caggataagggggtgtttctta

SEQ ID NO: 804505 - DNA, 22 bp, Artificial Sequence
  chemically synthesized
tacttcaggataagggggtgtt

SEQ ID NO: 804506 - DNA, 22 bp, Artificial Sequence
  chemically synthesized
gtacttcaggataagggggtgt

SEQ ID NO: 804507 - DNA, 22 bp, Artificial Sequence
  chemically synthesized
ataagaaacacccccttatcct

SEQ ID NO: 804508 - DNA, 22 bp, Artificial Sequence
  chemically synthesized
taagaaacacccccttatcctg

SEQ ID NO: 804509 - DNA, 22 bp, Artificial Sequence
  chemically synthesized
ccgtcgtccttgtacttcagga

SEQ ID NO: 804510 - DNA, 22 bp, Artificial Sequence
  chemically synthesized
accgtcgtccttgtacttcagg

SEQ ID NO: 804511 - DNA, 22 bp, Artificial Sequence
  chemically synthesized
taccgtcgtccttgtacttcag

SEQ ID NO: 804512 - DNA, 22 bp, Artificial Sequence
  chemically synthesized
atcctgaagtacaaggacgacg

SEQ ID NO: 804513 - DNA, 22 bp, Artificial Sequence
  chemically synthesized
tcctgaagtacaaggacgacgg

SEQ ID NO: 804514 - DNA, 22 bp, Artificial Sequence
  chemically synthesized
aaatcaagaactttaccgtcgt

SEQ ID NO: 804515 - DNA, 22 bp, Artificial Sequence
  chemically synthesized
aagtacaaggacgacggtaaag

SEQ ID NO: 804516 - DNA, 22 bp, Artificial Sequence
  chemically synthesized
ctaaaatcaagaactttaccgt

SEQ ID NO: 804517 - DNA, 22 bp, Artificial Sequence
  chemically synthesized
actaaaatcaagaactttaccg

SEQ ID NO: 804518 - DNA, 22 bp, Artificial Sequence
  chemically synthesized
cttactaaaatcaagaacttta

SEQ ID NO: 804519 - DNA, 22 bp, Artificial Sequence
  chemically synthesized
ccttactaaaatcaagaacttt

SEQ ID NO: 804520 - DNA, 22 bp, Artificial Sequence
  chemically synthesized
tccttactaaaatcaagaactt

SEQ ID NO: 804521 - DNA, 22 bp, Artificial Sequence
  chemically synthesized
actttccttactaaaatcaaga

SEQ ID NO: 804522 - DNA, 22 bp, Artificial Sequence
  chemically synthesized
ttgattttagtaaggaaagtga

SEQ ID NO: 804523 - DNA, 22 bp, Artificial Sequence
  chemically synthesized
gattttagtaaggaaagtgagt

SEQ ID NO: 804524 - DNA, 22 bp, Artificial Sequence
  chemically synthesized
taaaaaggtgtaactcactttc

SEQ ID NO: 804525 - DNA, 22 bp, Artificial Sequence
  chemically synthesized
attttagtaaggaaagtgagtt

SEQ ID NO: 804526 - DNA, 22 bp, Artificial Sequence
  chemically synthesized
tagtaaggaaagtgagttacac

SEQ ID NO: 804527 - DNA, 22 bp, Artificial Sequence
  chemically synthesized
agtaaggaaagtgagttacacc

SEQ ID NO: 804528 - DNA, 22 bp, Artificial Sequence
  chemically synthesized
gtaaggaaagtgagttacacct

SEQ ID NO: 804529 - DNA, 22 bp, Artificial Sequence
  chemically synthesized
ccgtattataaaaaggtgtaac

SEQ ID NO: 804530 - DNA, 22 bp, Artificial Sequence
  chemically synthesized
ctcccgtattataaaaaggtgt

SEQ ID NO: 804531 - DNA, 22 bp, Artificial Sequence
  chemically synthesized
cctcccgtattataaaaaggtg

SEQ ID NO: 804532 - DNA, 22 bp, Artificial Sequence
  chemically synthesized
gaatttcctcccgtattataaa

SEQ ID NO: 804533 - DNA, 22 bp, Artificial Sequence
  chemically synthesized
cacctttttataatacgggagg

SEQ ID NO: 804534 - DNA, 22 bp, Artificial Sequence
  chemically synthesized
aaagacattagaatttcctccc

SEQ ID NO: 804535 - DNA, 22 bp, Artificial Sequence
  chemically synthesized
tttataatacgggaggaaattc

SEQ ID NO: 804536 - DNA, 22 bp, Artificial Sequence
  chemically synthesized
tgaaagacattagaatttcctc

SEQ ID NO: 804537 - DNA, 22 bp, Artificial Sequence
  chemically synthesized
ttataatacgggaggaaattct

SEQ ID NO: 804538 - DNA, 22 bp, Artificial Sequence
  chemically synthesized
tataatacgggaggaaattcta

SEQ ID NO: 804539 - DNA, 22 bp, Artificial Sequence
  chemically synthesized
tctgaaagacattagaatttcc

SEQ ID NO: 804540 - DNA, 22 bp, Artificial Sequence
  chemically synthesized
ataatacgggaggaaattctaa

SEQ ID NO: 804541 - DNA, 22 bp, Artificial Sequence
  chemically synthesized
ctctgaaagacattagaatttc

SEQ ID NO: 804542 - DNA, 22 bp, Artificial Sequence
  chemically synthesized
taatacgggaggaaattctaat

SEQ ID NO: 804543 - DNA, 22 bp, Artificial Sequence
  chemically synthesized
ttctctgaaagacattagaatt

SEQ ID NO: 804544 - DNA, 22 bp, Artificial Sequence
  chemically synthesized
attcttctctgaaagacattag

SEQ ID NO: 804545 - DNA, 22 bp, Artificial Sequence
  chemically synthesized
acatgattaattcttctctgaa

SEQ ID NO: 804546 - DNA, 22 bp, Artificial Sequence
  chemically synthesized
taatgtctttcagagaagaatt

SEQ ID NO: 804547 - DNA, 22 bp, Artificial Sequence
  chemically synthesized
atgtctttcagagaagaattaa

SEQ ID NO: 804548 - DNA, 22 bp, Artificial Sequence
  chemically synthesized
aatggaattaacatgattaatt

SEQ ID NO: 804549 - DNA, 22 bp, Artificial Sequence
  chemically synthesized
tgaatggaattaacatgattaa

SEQ ID NO: 804550 - DNA, 22 bp, Artificial Sequence
  chemically synthesized
tcagagaagaattaatcatgtt

SEQ ID NO: 804551 - DNA, 22 bp, Artificial Sequence
  chemically synthesized
cagagaagaattaatcatgtta

SEQ ID NO: 804552 - DNA, 22 bp, Artificial Sequence
  chemically synthesized
agagaagaattaatcatgttaa

SEQ ID NO: 804553 - DNA, 22 bp, Artificial Sequence
  chemically synthesized
atcatgttaattccattcagaa

SEQ ID NO: 804554 - DNA, 22 bp, Artificial Sequence
  chemically synthesized
attccattcagaatgtatatgc

SEQ ID NO: 804555 - DNA, 22 bp, Artificial Sequence
  chemically synthesized
cattcagaatgtatatgcttta

SEQ ID NO: 804556 - DNA, 22 bp, Artificial Sequence
  chemically synthesized
aacatacatgtaatataaagca

SEQ ID NO: 804557 - DNA, 22 bp, Artificial Sequence
  chemically synthesized
aaacatacatgtaatataaagc

SEQ ID NO: 804558 - DNA, 22 bp, Artificial Sequence
  chemically synthesized
agaatgtatatgctttatatta

SEQ ID NO: 804559 - DNA, 22 bp, Artificial Sequence
  chemically synthesized
taaacatacatgtaatataaag

SEQ ID NO: 804560 - DNA, 22 bp, Artificial Sequence
  chemically synthesized
tttaaacatacatgtaatataa

SEQ ID NO: 804561 - DNA, 22 bp, Artificial Sequence
  chemically synthesized
atagattctttaaacatacatg

SEQ ID NO: 804562 - DNA, 22 bp, Artificial Sequence
  chemically synthesized
tatattacatgtatgtttaaag

SEQ ID NO: 804563 - DNA, 22 bp, Artificial Sequence
  chemically synthesized
atattacatgtatgtttaaaga

SEQ ID NO: 804564 - DNA, 22 bp, Artificial Sequence
  chemically synthesized
tattacatgtatgtttaaagaa

SEQ ID NO: 804565 - DNA, 22 bp, Artificial Sequence
  chemically synthesized
catgtatgtttaaagaatctat

SEQ ID NO: 804566 - DNA, 22 bp, Artificial Sequence
  chemically synthesized
agcaataatcataattcataga

SEQ ID NO: 804567 - DNA, 22 bp, Artificial Sequence
  chemically synthesized
tcagcaataatcataattcata

SEQ ID NO: 804568 - DNA, 22 bp, Artificial Sequence
  chemically synthesized
tctcagcaataatcataattca

SEQ ID NO: 804569 - DNA, 22 bp, Artificial Sequence
  chemically synthesized
aaagaatctatgaattatgatt

SEQ ID NO: 804570 - DNA, 22 bp, Artificial Sequence
  chemically synthesized
aagaatctatgaattatgatta

SEQ ID NO: 804571 - DNA, 22 bp, Artificial Sequence
  chemically synthesized
ttctctcagcaataatcataat

SEQ ID NO: 804572 - DNA, 22 bp, Artificial Sequence
  chemically synthesized
attctctcagcaataatcataa

SEQ ID NO: 804573 - DNA, 22 bp, Artificial Sequence
  chemically synthesized
tgaattatgattattgctgaga

SEQ ID NO: 804574 - DNA, 22 bp, Artificial Sequence
  chemically synthesized
gtaagatatttattctctcagc

SEQ ID NO: 804575 - DNA, 22 bp, Artificial Sequence
  chemically synthesized
cgtaagatatttattctctcag

SEQ ID NO: 804576 - DNA, 22 bp, Artificial Sequence
  chemically synthesized
tgattattgctgagagaataaa

SEQ ID NO: 804577 - DNA, 22 bp, Artificial Sequence
  chemically synthesized
ttgctgagagaataaatatctt

SEQ ID NO: 804578 - DNA, 22 bp, Artificial Sequence
  chemically synthesized
tcagccacttcgtaagatattt

SEQ ID NO: 804579 - DNA, 22 bp, Artificial Sequence
  chemically synthesized
ctgagagaataaatatcttacg

SEQ ID NO: 804580 - DNA, 22 bp, Artificial Sequence
  chemically synthesized
agagaataaatatcttacgaag

SEQ ID NO: 804581 - DNA, 22 bp, Artificial Sequence
  chemically synthesized
gtctatcagccacttcgtaaga

SEQ ID NO: 804582 - DNA, 22 bp, Artificial Sequence
  chemically synthesized
cgtctatcagccacttcgtaag

SEQ ID NO: 804583 - DNA, 22 bp, Artificial Sequence
  chemically synthesized
tcgtctatcagccacttcgtaa

SEQ ID NO: 804584 - DNA, 22 bp, Artificial Sequence
  chemically synthesized
tcactttcgtctatcagccact

SEQ ID NO: 804585 - DNA, 22 bp, Artificial Sequence
  chemically synthesized
cctatcactttcgtctatcagc

SEQ ID NO: 804586 - DNA, 22 bp, Artificial Sequence
  chemically synthesized
acgaagtggctgatagacgaaa

SEQ ID NO: 804587 - DNA, 22 bp, Artificial Sequence
  chemically synthesized
cgaagtggctgatagacgaaag

SEQ ID NO: 804588 - DNA, 22 bp, Artificial Sequence
  chemically synthesized
gactacctatcactttcgtcta

SEQ ID NO: 804589 - DNA, 22 bp, Artificial Sequence
  chemically synthesized
ctagactacctatcactttcgt

SEQ ID NO: 804590 - DNA, 22 bp, Artificial Sequence
  chemically synthesized
gctagactacctatcactttcg

SEQ ID NO: 804591 - DNA, 22 bp, Artificial Sequence
  chemically synthesized
ttgctagactacctatcacttt

SEQ ID NO: 804592 - DNA, 22 bp, Artificial Sequence
  chemically synthesized
atagacgaaagtgataggtagt

SEQ ID NO: 804593 - DNA, 22 bp, Artificial Sequence
  chemically synthesized
cagctcttgctagactacctat

SEQ ID NO: 804594 - DNA, 22 bp, Artificial Sequence
  chemically synthesized
tatatggagactccagctcttg

SEQ ID NO: 804595 - DNA, 22 bp, Artificial Sequence
  chemically synthesized
tatatatggagactccagctct

SEQ ID NO: 804596 - DNA, 22 bp, Artificial Sequence
  chemically synthesized
ctatatatggagactccagctc

SEQ ID NO: 804597 - DNA, 22 bp, Artificial Sequence
  chemically synthesized
tctatatatggagactccagct

SEQ ID NO: 804598 - DNA, 22 bp, Artificial Sequence
  chemically synthesized
ttctatatatggagactccagc

SEQ ID NO: 804599 - DNA, 22 bp, Artificial Sequence
  chemically synthesized
gcaagagctggagtctccatat

SEQ ID NO: 804600 - DNA, 22 bp, Artificial Sequence
  chemically synthesized
tcaatccgtttttctatatatg

SEQ ID NO: 804601 - DNA, 22 bp, Artificial Sequence
  chemically synthesized
gagtctccatatatagaaaaac

SEQ ID NO: 804602 - DNA, 22 bp, Artificial Sequence
  chemically synthesized
agactgtcaatccgtttttcta

SEQ ID NO: 804603 - DNA, 22 bp, Artificial Sequence
  chemically synthesized
taagactgtcaatccgtttttc

SEQ ID NO: 804604 - DNA, 22 bp, Artificial Sequence
  chemically synthesized
tctaagactgtcaatccgtttt

SEQ ID NO: 804605 - DNA, 22 bp, Artificial Sequence
  chemically synthesized
ctctaagactgtcaatccgttt

SEQ ID NO: 804606 - DNA, 22 bp, Artificial Sequence
  chemically synthesized
catatatagaaaaacggattga

SEQ ID NO: 804607 - DNA, 22 bp, Artificial Sequence
  chemically synthesized
tctctaagactgtcaatccgtt

SEQ ID NO: 804608 - DNA, 22 bp, Artificial Sequence
  chemically synthesized
ttctctaagactgtcaatccgt

SEQ ID NO: 804609 - DNA, 22 bp, Artificial Sequence
  chemically synthesized
acaaaatgtgtttttctctaag

SEQ ID NO: 804610 - DNA, 22 bp, Artificial Sequence
  chemically synthesized
cacaaaatgtgtttttctctaa

SEQ ID NO: 804611 - DNA, 22 bp, Artificial Sequence
  chemically synthesized
acagtcttagagaaaaacacat

SEQ ID NO: 804612 - DNA, 22 bp, Artificial Sequence
  chemically synthesized
agagaaaaacacattttgtgaa

SEQ ID NO: 804613 - DNA, 22 bp, Artificial Sequence
  chemically synthesized
gagaaaaacacattttgtgaag

SEQ ID NO: 804614 - DNA, 22 bp, Artificial Sequence
  chemically synthesized
gtgaatgaagagagagggtgaa

SEQ ID NO: 804615 - DNA, 22 bp, Artificial Sequence
  chemically synthesized
tgtgaaggttttcaccctctct

SEQ ID NO: 804616 - DNA, 22 bp, Artificial Sequence
  chemically synthesized
gtgaaggttttcaccctctctc

SEQ ID NO: 804617 - DNA, 22 bp, Artificial Sequence
  chemically synthesized
tgaaggttttcaccctctctct

SEQ ID NO: 804618 - DNA, 22 bp, Artificial Sequence
  chemically synthesized
atacaaatgctagtgaatgaag

SEQ ID NO: 804619 - DNA, 22 bp, Artificial Sequence
  chemically synthesized
tcaccctctctcttcattcact

SEQ ID NO: 804620 - DNA, 22 bp, Artificial Sequence
  chemically synthesized
catacaaatgctagtgaatgaa

SEQ ID NO: 804621 - DNA, 22 bp, Artificial Sequence
  chemically synthesized
caccctctctcttcattcacta

SEQ ID NO: 804622 - DNA, 22 bp, Artificial Sequence
  chemically synthesized
accctctctcttcattcactag

SEQ ID NO: 804623 - DNA, 22 bp, Artificial Sequence
  chemically synthesized
cttcatacaaatgctagtgaat

SEQ ID NO: 804624 - DNA, 22 bp, Artificial Sequence
  chemically synthesized
acttcatacaaatgctagtgaa

SEQ ID NO: 804625 - DNA, 22 bp, Artificial Sequence
  chemically synthesized
tctcttcattcactagcatttg

SEQ ID NO: 804626 - DNA, 22 bp, Artificial Sequence
  chemically synthesized
tcttcattcactagcatttgta

SEQ ID NO: 804627 - DNA, 22 bp, Artificial Sequence
  chemically synthesized
ttcattcactagcatttgtatg

SEQ ID NO: 804628 - DNA, 22 bp, Artificial Sequence
  chemically synthesized
cattcactagcatttgtatgaa

SEQ ID NO: 804629 - DNA, 22 bp, Artificial Sequence
  chemically synthesized
attcactagcatttgtatgaag

SEQ ID NO: 804630 - DNA, 22 bp, Artificial Sequence
  chemically synthesized
actagcatttgtatgaagtaaa

SEQ ID NO: 804631 - DNA, 22 bp, Artificial Sequence
  chemically synthesized
gcatttgtatgaagtaaatcat

SEQ ID NO: 804632 - DNA, 22 bp, Artificial Sequence
  chemically synthesized
ccccaaaagtagtgatgattta

SEQ ID NO: 804633 - DNA, 22 bp, Artificial Sequence
  chemically synthesized
gtatgaagtaaatcatcactac

SEQ ID NO: 804634 - DNA, 22 bp, Artificial Sequence
  chemically synthesized
tctaccccaaaagtagtgatga

SEQ ID NO: 804635 - DNA, 22 bp, Artificial Sequence
  chemically synthesized
tatgaagtaaatcatcactact

SEQ ID NO: 804636 - DNA, 22 bp, Artificial Sequence
  chemically synthesized
atatatctgtctaccccaaaag

SEQ ID NO: 804637 - DNA, 22 bp, Artificial Sequence
  chemically synthesized
gatatatctgtctaccccaaaa

SEQ ID NO: 804638 - DNA, 22 bp, Artificial Sequence
  chemically synthesized
tgatatatctgtctaccccaaa

SEQ ID NO: 804639 - DNA, 22 bp, Artificial Sequence
  chemically synthesized
cttttggggtagacagatatat

SEQ ID NO: 804640 - DNA, 22 bp, Artificial Sequence
  chemically synthesized
ccaacagattttgatatatctg

SEQ ID NO: 804641 - DNA, 22 bp, Artificial Sequence
  chemically synthesized
ttggggtagacagatatatcaa

SEQ ID NO: 804642 - DNA, 22 bp, Artificial Sequence
  chemically synthesized
tgccaacagattttgatatatc

SEQ ID NO: 804643 - DNA, 22 bp, Artificial Sequence
  chemically synthesized
tggggtagacagatatatcaaa

SEQ ID NO: 804644 - DNA, 22 bp, Artificial Sequence
  chemically synthesized
ggggtagacagatatatcaaaa

SEQ ID NO: 804645 - DNA, 22 bp, Artificial Sequence
  chemically synthesized
gggtagacagatatatcaaaat

SEQ ID NO: 804646 - DNA, 22 bp, Artificial Sequence
  chemically synthesized
gccaaagcaacagctctgccaa

SEQ ID NO: 804647 - DNA, 22 bp, Artificial Sequence
  chemically synthesized
aaatgcctagccaaagcaacag

SEQ ID NO: 804648 - DNA, 22 bp, Artificial Sequence
  chemically synthesized
gaaatgcctagccaaagcaaca

SEQ ID NO: 804649 - DNA, 22 bp, Artificial Sequence
  chemically synthesized
ttggcagagctgttgctttggc

SEQ ID NO: 804650 - DNA, 22 bp, Artificial Sequence
  chemically synthesized
gcagagctgttgctttggctag

SEQ ID NO: 804651 - DNA, 22 bp, Artificial Sequence
  chemically synthesized
ttgctttggctaggcatttcaa

SEQ ID NO: 804652 - DNA, 22 bp, Artificial Sequence
  chemically synthesized
aaaaaaaaggaaatttgaaatg

SEQ ID NO: 804653 - DNA, 22 bp, Artificial Sequence
  chemically synthesized
ctttggctaggcatttcaaatt

SEQ ID NO: 804654 - DNA, 22 bp, Artificial Sequence
  chemically synthesized
tggctaggcatttcaaatttcc

SEQ ID NO: 804655 - DNA, 22 bp, Artificial Sequence
  chemically synthesized
ggctaggcatttcaaatttcct

SEQ ID NO: 804656 - DNA, 22 bp, Artificial Sequence
  chemically synthesized
gctaggcatttcaaatttcctt

SEQ ID NO: 804657 - DNA, 22 bp, Artificial Sequence
  chemically synthesized
atatattaaaaaaaaaggaaat

SEQ ID NO: 804658 - DNA, 22 bp, Artificial Sequence
  chemically synthesized
ggcatttcaaatttcctttttt

SEQ ID NO: 804659 - DNA, 22 bp, Artificial Sequence
  chemically synthesized
tcatatattaaaaaaaaaggaa

SEQ ID NO: 804660 - DNA, 22 bp, Artificial Sequence
  chemically synthesized
caaatttcctttttttttaata

SEQ ID NO: 804661 - DNA, 22 bp, Artificial Sequence
  chemically synthesized
aaatttcctttttttttaatat

SEQ ID NO: 804662 - DNA, 22 bp, Artificial Sequence
  chemically synthesized
cctttttttttaatatatgaga

SEQ ID NO: 804663 - DNA, 22 bp, Artificial Sequence
  chemically synthesized
ctttttttttaatatatgagaa

SEQ ID NO: 804664 - DNA, 22 bp, Artificial Sequence
  chemically synthesized
tatagcaatcatagttctcata

SEQ ID NO: 804665 - DNA, 22 bp, Artificial Sequence
  chemically synthesized
tttttttaatatatgagaacta

SEQ ID NO: 804666 - DNA, 22 bp, Artificial Sequence
  chemically synthesized
ttttttaatatatgagaactat

SEQ ID NO: 804667 - DNA, 22 bp, Artificial Sequence
  chemically synthesized
tttttaatatatgagaactatg

SEQ ID NO: 804668 - DNA, 22 bp, Artificial Sequence
  chemically synthesized
ttttaatatatgagaactatga

SEQ ID NO: 804669 - DNA, 22 bp, Artificial Sequence
  chemically synthesized
tttaatatatgagaactatgat

SEQ ID NO: 804670 - DNA, 22 bp, Artificial Sequence
  chemically synthesized
ttaatatatgagaactatgatt

SEQ ID NO: 804671 - DNA, 22 bp, Artificial Sequence
  chemically synthesized
atgctgtatagcaatcatagtt

SEQ ID NO: 804672 - DNA, 22 bp, Artificial Sequence
  chemically synthesized
taatatatgagaactatgattg

SEQ ID NO: 804673 - DNA, 22 bp, Artificial Sequence
  chemically synthesized
aatatatgagaactatgattgc

SEQ ID NO: 804674 - DNA, 22 bp, Artificial Sequence
  chemically synthesized
atatatgagaactatgattgct

SEQ ID NO: 804675 - DNA, 22 bp, Artificial Sequence
  chemically synthesized
atagattcatgctgtatagcaa

SEQ ID NO: 804676 - DNA, 22 bp, Artificial Sequence
  chemically synthesized
tattcatagattcatgctgtat

SEQ ID NO: 804677 - DNA, 22 bp, Artificial Sequence
  chemically synthesized
tgattgctatacagcatgaatc

SEQ ID NO: 804678 - DNA, 22 bp, Artificial Sequence
  chemically synthesized
gtagcattgtattcatagattc

SEQ ID NO: 804679 - DNA, 22 bp, Artificial Sequence
  chemically synthesized
ctatacagcatgaatctatgaa

SEQ ID NO: 804680 - DNA, 22 bp, Artificial Sequence
  chemically synthesized
tacagcatgaatctatgaatac

SEQ ID NO: 804681 - DNA, 22 bp, Artificial Sequence
  chemically synthesized
aagaagctggtagcattgtatt

SEQ ID NO: 804682 - DNA, 22 bp, Artificial Sequence
  chemically synthesized
gaagaagctggtagcattgtat

SEQ ID NO: 804683 - DNA, 22 bp, Artificial Sequence
  chemically synthesized
atttgaagaagctggtagcatt

SEQ ID NO: 804684 - DNA, 22 bp, Artificial Sequence
  chemically synthesized
catttgaagaagctggtagcat

SEQ ID NO: 804685 - DNA, 22 bp, Artificial Sequence
  chemically synthesized
tgaatacaatgctaccagcttc

SEQ ID NO: 804686 - DNA, 22 bp, Artificial Sequence
  chemically synthesized
acttcatttgaagaagctggta

SEQ ID NO: 804687 - DNA, 22 bp, Artificial Sequence
  chemically synthesized
cacttcatttgaagaagctggt

SEQ ID NO: 804688 - DNA, 22 bp, Artificial Sequence
  chemically synthesized
tcacttcatttgaagaagctgg

SEQ ID NO: 804689 - DNA, 22 bp, Artificial Sequence
  chemically synthesized
ttcacttcatttgaagaagctg

SEQ ID NO: 804690 - DNA, 22 bp, Artificial Sequence
  chemically synthesized
tttcacttcatttgaagaagct

SEQ ID NO: 804691 - DNA, 22 bp, Artificial Sequence
  chemically synthesized
ccagcttcttcaaatgaagtga

SEQ ID NO: 804692 - DNA, 22 bp, Artificial Sequence
  chemically synthesized
cttcaaatgaagtgaaaaagca

SEQ ID NO: 804693 - DNA, 22 bp, Artificial Sequence
  chemically synthesized
ttcaaatgaagtgaaaaagcat

SEQ ID NO: 804694 - DNA, 22 bp, Artificial Sequence
  chemically synthesized
caaatgaagtgaaaaagcatgc

SEQ ID NO: 804695 - DNA, 22 bp, Artificial Sequence
  chemically synthesized
aaatgaagtgaaaaagcatgcc

SEQ ID NO: 804696 - DNA, 22 bp, Artificial Sequence
  chemically synthesized
taatatgtaggtaggagaaaag

SEQ ID NO: 804697 - DNA, 22 bp, Artificial Sequence
  chemically synthesized
tataatatgtaggtaggagaaa

SEQ ID NO: 804698 - DNA, 22 bp, Artificial Sequence
  chemically synthesized
ctataatatgtaggtaggagaa

SEQ ID NO: 804699 - DNA, 22 bp, Artificial Sequence
  chemically synthesized
tctataatatgtaggtaggaga

SEQ ID NO: 804700 - DNA, 22 bp, Artificial Sequence
  chemically synthesized
cacttttctcctacctacatat

SEQ ID NO: 804701 - DNA, 22 bp, Artificial Sequence
  chemically synthesized
acttttctcctacctacatatt

SEQ ID NO: 804702 - DNA, 22 bp, Artificial Sequence
  chemically synthesized
ttctcctacctacatattatag

SEQ ID NO: 804703 - DNA, 22 bp, Artificial Sequence
  chemically synthesized
tctcctacctacatattataga

SEQ ID NO: 804704 - DNA, 22 bp, Artificial Sequence
  chemically synthesized
ctcctacctacatattatagaa

SEQ ID NO: 804705 - DNA, 22 bp, Artificial Sequence
  chemically synthesized
tcctacctacatattatagaaa

SEQ ID NO: 804706 - DNA, 22 bp, Artificial Sequence
  chemically synthesized
aacaaaaggaattttctataat

SEQ ID NO: 804707 - DNA, 22 bp, Artificial Sequence
  chemically synthesized
gaacaaaaggaattttctataa

SEQ ID NO: 804708 - DNA, 22 bp, Artificial Sequence
  chemically synthesized
ctacctacatattatagaaaat

SEQ ID NO: 804709 - DNA, 22 bp, Artificial Sequence
  chemically synthesized
tgaacaaaaggaattttctata

SEQ ID NO: 804710 - DNA, 22 bp, Artificial Sequence
  chemically synthesized
cctacatattatagaaaattcc

SEQ ID NO: 804711 - DNA, 22 bp, Artificial Sequence
  chemically synthesized
ttttgaacaaaaggaattttct

SEQ ID NO: 804712 - DNA, 22 bp, Artificial Sequence
  chemically synthesized
attttgaacaaaaggaattttc

SEQ ID NO: 804713 - DNA, 22 bp, Artificial Sequence
  chemically synthesized
tattttgaacaaaaggaatttt

SEQ ID NO: 804714 - DNA, 22 bp, Artificial Sequence
  chemically synthesized
ttattttgaacaaaaggaattt

SEQ ID NO: 804715 - DNA, 22 bp, Artificial Sequence
  chemically synthesized
catattatagaaaattcctttt

SEQ ID NO: 804716 - DNA, 22 bp, Artificial Sequence
  chemically synthesized
tgaatttttattttgaacaaaa

SEQ ID NO: 804717 - DNA, 22 bp, Artificial Sequence
  chemically synthesized
tagaaaattccttttgttcaaa

SEQ ID NO: 804718 - DNA, 22 bp, Artificial Sequence
  chemically synthesized
tatgaatttttattttgaacaa

SEQ ID NO: 804719 - DNA, 22 bp, Artificial Sequence
  chemically synthesized
ctctatgaatttttattttgaa

SEQ ID NO: 804720 - DNA, 22 bp, Artificial Sequence
  chemically synthesized
cctctatgaatttttattttga

SEQ ID NO: 804721 - DNA, 22 bp, Artificial Sequence
  chemically synthesized
tcctctatgaatttttattttg

SEQ ID NO: 804722 - DNA, 22 bp, Artificial Sequence
  chemically synthesized
ttcctctatgaatttttatttt

SEQ ID NO: 804723 - DNA, 22 bp, Artificial Sequence
  chemically synthesized
tttcctctatgaatttttattt

SEQ ID NO: 804724 - DNA, 22 bp, Artificial Sequence
  chemically synthesized
ttttcctctatgaatttttatt

SEQ ID NO: 804725 - DNA, 22 bp, Artificial Sequence
  chemically synthesized
cttttgttcaaaataaaaattc

SEQ ID NO: 804726 - DNA, 22 bp, Artificial Sequence
  chemically synthesized
tttttcctctatgaatttttat

SEQ ID NO: 804727 - DNA, 22 bp, Artificial Sequence
  chemically synthesized
ttgttcaaaataaaaattcata

SEQ ID NO: 804728 - DNA, 22 bp, Artificial Sequence
  chemically synthesized
ctttttttcctctatgaatttt

SEQ ID NO: 804729 - DNA, 22 bp, Artificial Sequence
  chemically synthesized
tgttcaaaataaaaattcatag

SEQ ID NO: 804730 - DNA, 22 bp, Artificial Sequence
  chemically synthesized
gctttttttcctctatgaattt

SEQ ID NO: 804731 - DNA, 22 bp, Artificial Sequence
  chemically synthesized
gttcaaaataaaaattcataga

SEQ ID NO: 804732 - DNA, 22 bp, Artificial Sequence
  chemically synthesized
ttcaaaataaaaattcatagag

SEQ ID NO: 804733 - DNA, 22 bp, Artificial Sequence
  chemically synthesized
aaaataaaaattcatagaggaa

SEQ ID NO: 804734 - DNA, 22 bp, Artificial Sequence
  chemically synthesized
aatggaagtgtttgcttttttt

SEQ ID NO: 804735 - DNA, 22 bp, Artificial Sequence
  chemically synthesized
atagaggaaaaaaagcaaacac

SEQ ID NO: 804736 - DNA, 22 bp, Artificial Sequence
  chemically synthesized
agctaaatggaagtgtttgctt

SEQ ID NO: 804737 - DNA, 22 bp, Artificial Sequence
  chemically synthesized
cagctaaatggaagtgtttgct

SEQ ID NO: 804738 - DNA, 22 bp, Artificial Sequence
  chemically synthesized
agtatttcagctaaatggaagt

SEQ ID NO: 804739 - DNA, 22 bp, Artificial Sequence
  chemically synthesized
cagtatttcagctaaatggaag

SEQ ID NO: 804740 - DNA, 22 bp, Artificial Sequence
  chemically synthesized
catgcaatttcagtatttcagc

SEQ ID NO: 804741 - DNA, 22 bp, Artificial Sequence
  chemically synthesized
ccatttagctgaaatactgaaa

SEQ ID NO: 804742 - DNA, 22 bp, Artificial Sequence
  chemically synthesized
catttagctgaaatactgaaat

SEQ ID NO: 804743 - DNA, 22 bp, Artificial Sequence
  chemically synthesized
agagattacatgcaatttcagt

SEQ ID NO: 804744 - DNA, 22 bp, Artificial Sequence
  chemically synthesized
aagagattacatgcaatttcag

SEQ ID NO: 804745 - DNA, 22 bp, Artificial Sequence
  chemically synthesized
agctgaaatactgaaattgcat

SEQ ID NO: 804746 - DNA, 22 bp, Artificial Sequence
  chemically synthesized
gctgaaatactgaaattgcatg

SEQ ID NO: 804747 - DNA, 22 bp, Artificial Sequence
  chemically synthesized
aaatactgaaattgcatgtaat

SEQ ID NO: 804748 - DNA, 22 bp, Artificial Sequence
  chemically synthesized
aaattgcatgtaatctcttaag

SEQ ID NO: 804749 - DNA, 22 bp, Artificial Sequence
  chemically synthesized
catgtaatctcttaaggtatgc

SEQ ID NO: 804750 - DNA, 22 bp, Artificial Sequence
  chemically synthesized
aaaataaataaagcagcatacc

SEQ ID NO: 804751 - DNA, 22 bp, Artificial Sequence
  chemically synthesized
gaaaataaataaagcagcatac

SEQ ID NO: 804752 - DNA, 22 bp, Artificial Sequence
  chemically synthesized
ttaaggtatgctgctttattta

SEQ ID NO: 804753 - DNA, 22 bp, Artificial Sequence
  chemically synthesized
aaggtatgctgctttatttatt

SEQ ID NO: 804754 - DNA, 22 bp, Artificial Sequence
  chemically synthesized
aggtatgctgctttatttattt

SEQ ID NO: 804755 - DNA, 22 bp, Artificial Sequence
  chemically synthesized
ctttatttattttcaagctcgg

SEQ ID NO: 804756 - DNA, 22 bp, Artificial Sequence
  chemically synthesized
tatttattttcaagctcggcat

SEQ ID NO: 804757 - DNA, 22 bp, Artificial Sequence
  chemically synthesized
atttattttcaagctcggcatt

SEQ ID NO: 804758 - DNA, 22 bp, Artificial Sequence
  chemically synthesized
tttattttcaagctcggcattt

SEQ ID NO: 804759 - DNA, 22 bp, Artificial Sequence
  chemically synthesized
attttcaagctcggcatttcca

SEQ ID NO: 804760 - DNA, 22 bp, Artificial Sequence
  chemically synthesized
aagagcaacaaatggaaatgcc

SEQ ID NO: 804761 - DNA, 22 bp, Artificial Sequence
  chemically synthesized
ttttcaagctcggcatttccat

SEQ ID NO: 804762 - DNA, 22 bp, Artificial Sequence
  chemically synthesized
tcaagctcggcatttccatttg

SEQ ID NO: 804763 - DNA, 22 bp, Artificial Sequence
  chemically synthesized
caagctcggcatttccatttgt

SEQ ID NO: 804764 - DNA, 22 bp, Artificial Sequence
  chemically synthesized
aagctcggcatttccatttgtt

SEQ ID NO: 804765 - DNA, 22 bp, Artificial Sequence
  chemically synthesized
gtgttgaagagcaacaaatgga

SEQ ID NO: 804766 - DNA, 22 bp, Artificial Sequence
  chemically synthesized
ggcatttccatttgttgctctt

SEQ ID NO: 804767 - DNA, 22 bp, Artificial Sequence
  chemically synthesized
ccatttgttgctcttcaacacc

SEQ ID NO: 804768 - DNA, 22 bp, Artificial Sequence
  chemically synthesized
agtcaagaaactggtgttgaag

SEQ ID NO: 804769 - DNA, 22 bp, Artificial Sequence
  chemically synthesized
catttgttgctcttcaacacca

SEQ ID NO: 804770 - DNA, 22 bp, Artificial Sequence
  chemically synthesized
aattgagtcaagaaactggtgt

SEQ ID NO: 804771 - DNA, 22 bp, Artificial Sequence
  chemically synthesized
gttgctcttcaacaccagtttc

SEQ ID NO: 804772 - DNA, 22 bp, Artificial Sequence
  chemically synthesized
ttgctcttcaacaccagtttct

SEQ ID NO: 804773 - DNA, 22 bp, Artificial Sequence
  chemically synthesized
attgaattgagtcaagaaactg

SEQ ID NO: 804774 - DNA, 22 bp, Artificial Sequence
  chemically synthesized
ctcttcaacaccagtttcttga

SEQ ID NO: 804775 - DNA, 22 bp, Artificial Sequence
  chemically synthesized
ttcaacaccagtttcttgactc

SEQ ID NO: 804776 - DNA, 22 bp, Artificial Sequence
  chemically synthesized
agctgattgaattgagtcaaga

SEQ ID NO: 804777 - DNA, 22 bp, Artificial Sequence
  chemically synthesized
caacaccagtttcttgactcaa

SEQ ID NO: 804778 - DNA, 22 bp, Artificial Sequence
  chemically synthesized
cagctgattgaattgagtcaag

SEQ ID NO: 804779 - DNA, 22 bp, Artificial Sequence
  chemically synthesized
aacaccagtttcttgactcaat

SEQ ID NO: 804780 - DNA, 22 bp, Artificial Sequence
  chemically synthesized
atggcacatttcagctgattga

SEQ ID NO: 804781 - DNA, 22 bp, Artificial Sequence
  chemically synthesized
cttgactcaattcaatcagctg

SEQ ID NO: 804782 - DNA, 22 bp, Artificial Sequence
  chemically synthesized
ttgactcaattcaatcagctga

SEQ ID NO: 804783 - DNA, 22 bp, Artificial Sequence
  chemically synthesized
ttaatggcacatttcagctgat

SEQ ID NO: 804784 - DNA, 22 bp, Artificial Sequence
  chemically synthesized
gactcaattcaatcagctgaaa

SEQ ID NO: 804785 - DNA, 22 bp, Artificial Sequence
  chemically synthesized
actcaattcaatcagctgaaat

SEQ ID NO: 804786 - DNA, 22 bp, Artificial Sequence
  chemically synthesized
ttgttaatggcacatttcagct

SEQ ID NO: 804787 - DNA, 22 bp, Artificial Sequence
  chemically synthesized
aattcaatcagctgaaatgtgc

SEQ ID NO: 804788 - DNA, 22 bp, Artificial Sequence
  chemically synthesized
attattgttaatggcacatttc

SEQ ID NO: 804789 - DNA, 22 bp, Artificial Sequence
  chemically synthesized
ttgattattgttaatggcacat

SEQ ID NO: 804790 - DNA, 22 bp, Artificial Sequence
  chemically synthesized
aatcagctgaaatgtgccatta

SEQ ID NO: 804791 - DNA, 22 bp, Artificial Sequence
  chemically synthesized
aaactattgattattgttaatg

SEQ ID NO: 804792 - DNA, 22 bp, Artificial Sequence
  chemically synthesized
ctgaaactattgattattgtta

SEQ ID NO: 804793 - DNA, 22 bp, Artificial Sequence
  chemically synthesized
aaatgtgccattaacaataatc

SEQ ID NO: 804794 - DNA, 22 bp, Artificial Sequence
  chemically synthesized
acaataatcaatagtttcagta

SEQ ID NO: 804795 - DNA, 22 bp, Artificial Sequence
  chemically synthesized
ggagatgtcatggtaaaacggt

SEQ ID NO: 804796 - DNA, 22 bp, Artificial Sequence
  chemically synthesized
cagtagttcaccgttttaccat

SEQ ID NO: 804797 - DNA, 22 bp, Artificial Sequence
  chemically synthesized
agtagttcaccgttttaccatg

SEQ ID NO: 804798 - DNA, 22 bp, Artificial Sequence
  chemically synthesized
atgaaagactcggagatgtcat

SEQ ID NO: 804799 - DNA, 22 bp, Artificial Sequence
  chemically synthesized
accgttttaccatgacatctcc

SEQ ID NO: 804800 - DNA, 22 bp, Artificial Sequence
  chemically synthesized
gatgaaagactcggagatgtca

SEQ ID NO: 804801 - DNA, 22 bp, Artificial Sequence
  chemically synthesized
tgatgaaagactcggagatgtc

SEQ ID NO: 804802 - DNA, 22 bp, Artificial Sequence
  chemically synthesized
ttgatgaaagactcggagatgt

SEQ ID NO: 804803 - DNA, 22 bp, Artificial Sequence
  chemically synthesized
taccatgacatctccgagtctt

SEQ ID NO: 804804 - DNA, 22 bp, Artificial Sequence
  chemically synthesized
accatgacatctccgagtcttt

SEQ ID NO: 804805 - DNA, 22 bp, Artificial Sequence
  chemically synthesized
ccatgacatctccgagtctttc

SEQ ID NO: 804806 - DNA, 22 bp, Artificial Sequence
  chemically synthesized
gataatgatcttttgatgaaag

SEQ ID NO: 804807 - DNA, 22 bp, Artificial Sequence
  chemically synthesized
cgagtctttcatcaaaagatca

SEQ ID NO: 804808 - DNA, 22 bp, Artificial Sequence
  chemically synthesized
gatggttggataatgatctttt

SEQ ID NO: 804809 - DNA, 22 bp, Artificial Sequence
  chemically synthesized
gttagatggttggataatgatc

SEQ ID NO: 804810 - DNA, 22 bp, Artificial Sequence
  chemically synthesized
agttagatggttggataatgat

SEQ ID NO: 804811 - DNA, 22 bp, Artificial Sequence
  chemically synthesized
tagttagatggttggataatga

SEQ ID NO: 804812 - DNA, 22 bp, Artificial Sequence
  chemically synthesized
tcatcaaaagatcattatccaa

SEQ ID NO: 804813 - DNA, 22 bp, Artificial Sequence
  chemically synthesized
ttagttagatggttggataatg

SEQ ID NO: 804814 - DNA, 22 bp, Artificial Sequence
  chemically synthesized
catcaaaagatcattatccaac

SEQ ID NO: 804815 - DNA, 22 bp, Artificial Sequence
  chemically synthesized
atcaaaagatcattatccaacc

SEQ ID NO: 804816 - DNA, 22 bp, Artificial Sequence
  chemically synthesized
atttttagttagatggttggat

SEQ ID NO: 804817 - DNA, 22 bp, Artificial Sequence
  chemically synthesized
ctgatttttagttagatggttg

SEQ ID NO: 804818 - DNA, 22 bp, Artificial Sequence
  chemically synthesized
tccaaccatctaactaaaaatc

SEQ ID NO: 804819 - DNA, 22 bp, Artificial Sequence
  chemically synthesized
tagccaactcctgatttttagt

SEQ ID NO: 804820 - DNA, 22 bp, Artificial Sequence
  chemically synthesized
atagccaactcctgatttttag

SEQ ID NO: 804821 - DNA, 22 bp, Artificial Sequence
  chemically synthesized
actaaaaatcaggagttggcta

SEQ ID NO: 804822 - DNA, 22 bp, Artificial Sequence
  chemically synthesized
aaatgacatttatagccaactc

SEQ ID NO: 804823 - DNA, 22 bp, Artificial Sequence
  chemically synthesized
aaaatcaggagttggctataaa

SEQ ID NO: 804824 - DNA, 22 bp, Artificial Sequence
  chemically synthesized
tggattgaaatgacatttatag

SEQ ID NO: 804825 - DNA, 22 bp, Artificial Sequence
  chemically synthesized
atggattgaaatgacatttata

SEQ ID NO: 804826 - DNA, 22 bp, Artificial Sequence
  chemically synthesized
tatggattgaaatgacatttat

SEQ ID NO: 804827 - DNA, 22 bp, Artificial Sequence
  chemically synthesized
cattttatggattgaaatgaca

SEQ ID NO: 804828 - DNA, 22 bp, Artificial Sequence
  chemically synthesized
gctataaatgtcatttcaatcc

SEQ ID NO: 804829 - DNA, 22 bp, Artificial Sequence
  chemically synthesized
aactacattttatggattgaaa

SEQ ID NO: 804830 - DNA, 22 bp, Artificial Sequence
  chemically synthesized
aaactacattttatggattgaa

SEQ ID NO: 804831 - DNA, 22 bp, Artificial Sequence
  chemically synthesized
taaatgtcatttcaatccataa

SEQ ID NO: 804832 - DNA, 22 bp, Artificial Sequence
  chemically synthesized
cccaaggtttaaactacatttt

SEQ ID NO: 804833 - DNA, 22 bp, Artificial Sequence
  chemically synthesized
gcccaaggtttaaactacattt

SEQ ID NO: 804834 - DNA, 22 bp, Artificial Sequence
  chemically synthesized
caatccataaaatgtagtttaa

SEQ ID NO: 804835 - DNA, 22 bp, Artificial Sequence
  chemically synthesized
aatccataaaatgtagtttaaa

SEQ ID NO: 804836 - DNA, 22 bp, Artificial Sequence
  chemically synthesized
taaatccacttgcccaaggttt

SEQ ID NO: 804837 - DNA, 22 bp, Artificial Sequence
  chemically synthesized
tataaatccacttgcccaaggt

SEQ ID NO: 804838 - DNA, 22 bp, Artificial Sequence
  chemically synthesized
ctataaatccacttgcccaagg

SEQ ID NO: 804839 - DNA, 22 bp, Artificial Sequence
  chemically synthesized
tctataaatccacttgcccaag

SEQ ID NO: 804840 - DNA, 22 bp, Artificial Sequence
  chemically synthesized
tattttctataaatccacttgc

SEQ ID NO: 804841 - DNA, 22 bp, Artificial Sequence
  chemically synthesized
aaaccttgggcaagtggattta

SEQ ID NO: 804842 - DNA, 22 bp, Artificial Sequence
  chemically synthesized
aaccttgggcaagtggatttat

SEQ ID NO: 804843 - DNA, 22 bp, Artificial Sequence
  chemically synthesized
atattgtattttctataaatcc

SEQ ID NO: 804844 - DNA, 22 bp, Artificial Sequence
  chemically synthesized
gggcaagtggatttatagaaaa

SEQ ID NO: 804845 - DNA, 22 bp, Artificial Sequence
  chemically synthesized
ggcaagtggatttatagaaaat

SEQ ID NO: 804846 - DNA, 22 bp, Artificial Sequence
  chemically synthesized
gcagctaatattgtattttcta

SEQ ID NO: 804847 - DNA, 22 bp, Artificial Sequence
  chemically synthesized
cctggcagctaatattgtattt

SEQ ID NO: 804848 - DNA, 22 bp, Artificial Sequence
  chemically synthesized
ccctggcagctaatattgtatt

SEQ ID NO: 804849 - DNA, 22 bp, Artificial Sequence
  chemically synthesized
ttccctggcagctaatattgta

SEQ ID NO: 804850 - DNA, 22 bp, Artificial Sequence
  chemically synthesized
atagaaaatacaatattagctg

SEQ ID NO: 804851 - DNA, 22 bp, Artificial Sequence
  chemically synthesized
cctcttccctggcagctaatat

SEQ ID NO: 804852 - DNA, 22 bp, Artificial Sequence
  chemically synthesized
tagaaaatacaatattagctgc

SEQ ID NO: 804853 - DNA, 22 bp, Artificial Sequence
  chemically synthesized
ccctcttccctggcagctaata

SEQ ID NO: 804854 - DNA, 22 bp, Artificial Sequence
  chemically synthesized
aaacagagacagtttccctctt

SEQ ID NO: 804855 - DNA, 22 bp, Artificial Sequence
  chemically synthesized
aaaacagagacagtttccctct

SEQ ID NO: 804856 - DNA, 22 bp, Artificial Sequence
  chemically synthesized
gctgccagggaagagggaaact

SEQ ID NO: 804857 - DNA, 22 bp, Artificial Sequence
  chemically synthesized
taaaacagagacagtttccctc

SEQ ID NO: 804858 - DNA, 22 bp, Artificial Sequence
  chemically synthesized
ttttaaaacagagacagtttcc

SEQ ID NO: 804859 - DNA, 22 bp, Artificial Sequence
  chemically synthesized
ccagggaagagggaaactgtct

SEQ ID NO: 804860 - DNA, 22 bp, Artificial Sequence
  chemically synthesized
caaaattattttaaaacagaga

SEQ ID NO: 804861 - DNA, 22 bp, Artificial Sequence
  chemically synthesized
agattccaaaattattttaaaa

SEQ ID NO: 804862 - DNA, 22 bp, Artificial Sequence
  chemically synthesized
actaagattccaaaattatttt

SEQ ID NO: 804863 - DNA, 22 bp, Artificial Sequence
  chemically synthesized
tctctgttttaaaataattttg

SEQ ID NO: 804864 - DNA, 22 bp, Artificial Sequence
  chemically synthesized
tgttttaaaataattttggaat

SEQ ID NO: 804865 - DNA, 22 bp, Artificial Sequence
  chemically synthesized
ttttaaaataattttggaatct

SEQ ID NO: 804866 - DNA, 22 bp, Artificial Sequence
  chemically synthesized
taaaataattttggaatcttag

SEQ ID NO: 804867 - DNA, 22 bp, Artificial Sequence
  chemically synthesized
taataaggttaactaagattcc

SEQ ID NO: 804868 - DNA, 22 bp, Artificial Sequence
  chemically synthesized
aaaataattttggaatcttagt

SEQ ID NO: 804869 - DNA, 22 bp, Artificial Sequence
  chemically synthesized
aaataattttggaatcttagtt

SEQ ID NO: 804870 - DNA, 22 bp, Artificial Sequence
  chemically synthesized
actataataaggttaactaaga

SEQ ID NO: 804871 - DNA, 22 bp, Artificial Sequence
  chemically synthesized
aactataataaggttaactaag

SEQ ID NO: 804872 - DNA, 22 bp, Artificial Sequence
  chemically synthesized
tggaatcttagttaaccttatt

SEQ ID NO: 804873 - DNA, 22 bp, Artificial Sequence
  chemically synthesized
cgtcttaactataataaggtta

SEQ ID NO: 804874 - DNA, 22 bp, Artificial Sequence
  chemically synthesized
ggaatcttagttaaccttatta

SEQ ID NO: 804875 - DNA, 22 bp, Artificial Sequence
  chemically synthesized
gcgtcttaactataataaggtt

SEQ ID NO: 804876 - DNA, 22 bp, Artificial Sequence
  chemically synthesized
gaatcttagttaaccttattat

SEQ ID NO: 804877 - DNA, 22 bp, Artificial Sequence
  chemically synthesized
aacatttgcgtcttaactataa

SEQ ID NO: 804878 - DNA, 22 bp, Artificial Sequence
  chemically synthesized
agttaaccttattatagttaag

SEQ ID NO: 804879 - DNA, 22 bp, Artificial Sequence
  chemically synthesized
gttaaccttattatagttaaga

SEQ ID NO: 804880 - DNA, 22 bp, Artificial Sequence
  chemically synthesized
accttattatagttaagacgca

SEQ ID NO: 804881 - DNA, 22 bp, Artificial Sequence
  chemically synthesized
aaaacctcaacatttgcgtctt

SEQ ID NO: 804882 - DNA, 22 bp, Artificial Sequence
  chemically synthesized
tgaaaacctcaacatttgcgtc

SEQ ID NO: 804883 - DNA, 22 bp, Artificial Sequence
  chemically synthesized
attatagttaagacgcaaatgt

SEQ ID NO: 804884 - DNA, 22 bp, Artificial Sequence
  chemically synthesized
ttatagttaagacgcaaatgtt

SEQ ID NO: 804885 - DNA, 22 bp, Artificial Sequence
  chemically synthesized
tagttaagacgcaaatgttgag

SEQ ID NO: 804886 - DNA, 22 bp, Artificial Sequence
  chemically synthesized
agacgcaaatgttgaggttttc

SEQ ID NO: 804887 - DNA, 22 bp, Artificial Sequence
  chemically synthesized
ccatagagcctctgaaaacctc

SEQ ID NO: 804888 - DNA, 22 bp, Artificial Sequence
  chemically synthesized
aggttttcagaggctctatggg

SEQ ID NO: 804889 - DNA, 22 bp, Artificial Sequence
  chemically synthesized
aaaatccagataaaactcccat

SEQ ID NO: 804890 - DNA, 22 bp, Artificial Sequence
  chemically synthesized
tcagaggctctatgggagtttt

SEQ ID NO: 804891 - DNA, 22 bp, Artificial Sequence
  chemically synthesized
cagaggctctatgggagtttta

SEQ ID NO: 804892 - DNA, 22 bp, Artificial Sequence
  chemically synthesized
tcaaaatccagataaaactccc

SEQ ID NO: 804893 - DNA, 22 bp, Artificial Sequence
  chemically synthesized
agaggctctatgggagttttat

SEQ ID NO: 804894 - DNA, 22 bp, Artificial Sequence
  chemically synthesized
ttctcaaaatccagataaaact

SEQ ID NO: 804895 - DNA, 22 bp, Artificial Sequence
  chemically synthesized
attctcaaaatccagataaaac

SEQ ID NO: 804896 - DNA, 22 bp, Artificial Sequence
  chemically synthesized
tatgggagttttatctggattt

SEQ ID NO: 804897 - DNA, 22 bp, Artificial Sequence
  chemically synthesized
catttattctcaaaatccagat

SEQ ID NO: 804898 - DNA, 22 bp, Artificial Sequence
  chemically synthesized
tgggagttttatctggattttg

SEQ ID NO: 804899 - DNA, 22 bp, Artificial Sequence
  chemically synthesized
tatctggattttgagaataaat

SEQ ID NO: 804900 - DNA, 22 bp, Artificial Sequence
  chemically synthesized
atctggattttgagaataaatg

SEQ ID NO: 804901 - DNA, 22 bp, Artificial Sequence
  chemically synthesized
tctggattttgagaataaatgt

SEQ ID NO: 804902 - DNA, 22 bp, Artificial Sequence
  chemically synthesized
gattttgagaataaatgtagtt

SEQ ID NO: 804903 - DNA, 22 bp, Artificial Sequence
  chemically synthesized
aaccccaaagtgataaactaca

SEQ ID NO: 804904 - DNA, 22 bp, Artificial Sequence
  chemically synthesized
tgagaataaatgtagtttatca

SEQ ID NO: 804905 - DNA, 22 bp, Artificial Sequence
  chemically synthesized
gagaataaatgtagtttatcac

SEQ ID NO: 804906 - DNA, 22 bp, Artificial Sequence
  chemically synthesized
agaataaatgtagtttatcact

SEQ ID NO: 804907 - DNA, 22 bp, Artificial Sequence
  chemically synthesized
tctcaaccccaaagtgataaac

SEQ ID NO: 804908 - DNA, 22 bp, Artificial Sequence
  chemically synthesized
ctgtctcaaccccaaagtgata

SEQ ID NO: 804909 - DNA, 22 bp, Artificial Sequence
  chemically synthesized
actgtctcaaccccaaagtgat

SEQ ID NO: 804910 - DNA, 22 bp, Artificial Sequence
  chemically synthesized
tactgtctcaaccccaaagtga

SEQ ID NO: 804911 - DNA, 22 bp, Artificial Sequence
  chemically synthesized
ttactgtctcaaccccaaagtg

SEQ ID NO: 804912 - DNA, 22 bp, Artificial Sequence
  chemically synthesized
tttactgtctcaaccccaaagt

SEQ ID NO: 804913 - DNA, 22 bp, Artificial Sequence
  chemically synthesized
atcactttggggttgagacagt

SEQ ID NO: 804914 - DNA, 22 bp, Artificial Sequence
  chemically synthesized
tcactttggggttgagacagta

SEQ ID NO: 804915 - DNA, 22 bp, Artificial Sequence
  chemically synthesized
tggggttgagacagtaaaaagc

SEQ ID NO: 804916 - DNA, 22 bp, Artificial Sequence
  chemically synthesized
ggggttgagacagtaaaaagcc

SEQ ID NO: 804917 - DNA, 22 bp, Artificial Sequence
  chemically synthesized
gggttgagacagtaaaaagccc

SEQ ID NO: 804918 - DNA, 22 bp, Artificial Sequence
  chemically synthesized
ggaataaggcaggggcttttta

SEQ ID NO: 804919 - DNA, 22 bp, Artificial Sequence
  chemically synthesized
gggaataaggcaggggcttttt

SEQ ID NO: 804920 - DNA, 22 bp, Artificial Sequence
  chemically synthesized
agacagtaaaaagcccctgcct

SEQ ID NO: 804921 - DNA, 22 bp, Artificial Sequence
  chemically synthesized
ccttattcccaagctctctctt

SEQ ID NO: 804922 - DNA, 22 bp, Artificial Sequence
  chemically synthesized
attcccaagctctctctttttc

SEQ ID NO: 804923 - DNA, 22 bp, Artificial Sequence
  chemically synthesized
ttcccaagctctctctttttct

SEQ ID NO: 804924 - DNA, 22 bp, Artificial Sequence
  chemically synthesized
agtgtacccgaggtagaaaaag

SEQ ID NO: 804925 - DNA, 22 bp, Artificial Sequence
  chemically synthesized
ccaagctctctctttttctacc

SEQ ID NO: 804926 - DNA, 22 bp, Artificial Sequence
  chemically synthesized
cagtgtacccgaggtagaaaaa

SEQ ID NO: 804927 - DNA, 22 bp, Artificial Sequence
  chemically synthesized
tcagtgtacccgaggtagaaaa

SEQ ID NO: 804928 - DNA, 22 bp, Artificial Sequence
  chemically synthesized
tctctttttctacctcgggtac

SEQ ID NO: 804929 - DNA, 22 bp, Artificial Sequence
  chemically synthesized
tctttttctacctcgggtacac

SEQ ID NO: 804930 - DNA, 22 bp, Artificial Sequence
  chemically synthesized
cacataactttcagtgtacccg

SEQ ID NO: 804931 - DNA, 22 bp, Artificial Sequence
  chemically synthesized
tttttctacctcgggtacactg

SEQ ID NO: 804932 - DNA, 22 bp, Artificial Sequence
  chemically synthesized
tttctacctcgggtacactgaa

SEQ ID NO: 804933 - DNA, 22 bp, Artificial Sequence
  chemically synthesized
ttctacctcgggtacactgaaa

SEQ ID NO: 804934 - DNA, 22 bp, Artificial Sequence
  chemically synthesized
tctacctcgggtacactgaaag

SEQ ID NO: 804935 - DNA, 22 bp, Artificial Sequence
  chemically synthesized
ctacctcgggtacactgaaagt

SEQ ID NO: 804936 - DNA, 22 bp, Artificial Sequence
  chemically synthesized
tacctcgggtacactgaaagtt

SEQ ID NO: 804937 - DNA, 22 bp, Artificial Sequence
  chemically synthesized
cctcgggtacactgaaagttat

SEQ ID NO: 804938 - DNA, 22 bp, Artificial Sequence
  chemically synthesized
aggcacatattacacataactt

SEQ ID NO: 804939 - DNA, 22 bp, Artificial Sequence
  chemically synthesized
gggtacactgaaagttatgtgt

SEQ ID NO: 804940 - DNA, 22 bp, Artificial Sequence
  chemically synthesized
agctaaggcacatattacacat

SEQ ID NO: 804941 - DNA, 22 bp, Artificial Sequence
  chemically synthesized
gagctaaggcacatattacaca

SEQ ID NO: 804942 - DNA, 22 bp, Artificial Sequence
  chemically synthesized
tgagctaaggcacatattacac

SEQ ID NO: 804943 - DNA, 22 bp, Artificial Sequence
  chemically synthesized
aaagttatgtgtaatatgtgcc

SEQ ID NO: 804944 - DNA, 22 bp, Artificial Sequence
  chemically synthesized
catctttgagctaaggcacata

SEQ ID NO: 804945 - DNA, 22 bp, Artificial Sequence
  chemically synthesized
ccatctttgagctaaggcacat

SEQ ID NO: 804946 - DNA, 22 bp, Artificial Sequence
  chemically synthesized
tccatctttgagctaaggcaca

SEQ ID NO: 804947 - DNA, 22 bp, Artificial Sequence
  chemically synthesized
ttccatctttgagctaaggcac

SEQ ID NO: 804948 - DNA, 22 bp, Artificial Sequence
  chemically synthesized
tgtgtaatatgtgccttagctc

SEQ ID NO: 804949 - DNA, 22 bp, Artificial Sequence
  chemically synthesized
ttttccatctttgagctaaggc

SEQ ID NO: 804950 - DNA, 22 bp, Artificial Sequence
  chemically synthesized
ctcttttccatctttgagctaa

SEQ ID NO: 804951 - DNA, 22 bp, Artificial Sequence
  chemically synthesized
agctcaaagatggaaaagagta

SEQ ID NO: 804952 - DNA, 22 bp, Artificial Sequence
  chemically synthesized
gctcaaagatggaaaagagtag

SEQ ID NO: 804953 - DNA, 22 bp, Artificial Sequence
  chemically synthesized
aaagatggaaaagagtagcctg

SEQ ID NO: 804954 - DNA, 22 bp, Artificial Sequence
  chemically synthesized
acataaagtccagtgtcgatca

SEQ ID NO: 804955 - DNA, 22 bp, Artificial Sequence
  chemically synthesized
ctcacataaagtccagtgtcga

SEQ ID NO: 804956 - DNA, 22 bp, Artificial Sequence
  chemically synthesized
ttgctcacataaagtccagtgt

SEQ ID NO: 804957 - DNA, 22 bp, Artificial Sequence
  chemically synthesized
gttgctcacataaagtccagtg

SEQ ID NO: 804958 - DNA, 22 bp, Artificial Sequence
  chemically synthesized
tttgttgctcacataaagtcca

SEQ ID NO: 804959 - DNA, 22 bp, Artificial Sequence
  chemically synthesized
atttgttgctcacataaagtcc

SEQ ID NO: 804960 - DNA, 22 bp, Artificial Sequence
  chemically synthesized
atcgacactggactttatgtga

SEQ ID NO: 804961 - DNA, 22 bp, Artificial Sequence
  chemically synthesized
gactttatgtgagcaacaaata

SEQ ID NO: 804962 - DNA, 22 bp, Artificial Sequence
  chemically synthesized
accaaaccacagtttatttgtt

SEQ ID NO: 804963 - DNA, 22 bp, Artificial Sequence
  chemically synthesized
aaccaaaccacagtttatttgt

SEQ ID NO: 804964 - DNA, 22 bp, Artificial Sequence
  chemically synthesized
tatgtgagcaacaaataaactg

SEQ ID NO: 804965 - DNA, 22 bp, Artificial Sequence
  chemically synthesized
atgtgagcaacaaataaactgt

SEQ ID NO: 804966 - DNA, 22 bp, Artificial Sequence
  chemically synthesized
tgtgagcaacaaataaactgtg

SEQ ID NO: 804967 - DNA, 22 bp, Artificial Sequence
  chemically synthesized
tccagtggcttaaccaaaccac

SEQ ID NO: 804968 - DNA, 22 bp, Artificial Sequence
  chemically synthesized
gtccagtggcttaaccaaacca

SEQ ID NO: 804969 - DNA, 22 bp, Artificial Sequence
  chemically synthesized
tgtccagtggcttaaccaaacc

SEQ ID NO: 804970 - DNA, 22 bp, Artificial Sequence
  chemically synthesized
ttgtccagtggcttaaccaaac

SEQ ID NO: 804971 - DNA, 22 bp, Artificial Sequence
  chemically synthesized
gtttttgtccagtggcttaacc

SEQ ID NO: 804972 - DNA, 22 bp, Artificial Sequence
  chemically synthesized
ttcgtttttgtccagtggctta

SEQ ID NO: 804973 - DNA, 22 bp, Artificial Sequence
  chemically synthesized
attcgtttttgtccagtggctt

SEQ ID NO: 804974 - DNA, 22 bp, Artificial Sequence
  chemically synthesized
tggtttggttaagccactggac

SEQ ID NO: 804975 - DNA, 22 bp, Artificial Sequence
  chemically synthesized
ggttaagccactggacaaaaac

SEQ ID NO: 804976 - DNA, 22 bp, Artificial Sequence
  chemically synthesized
gttaagccactggacaaaaacg

SEQ ID NO: 804977 - DNA, 22 bp, Artificial Sequence
  chemically synthesized
agccactggacaaaaacgaata

SEQ ID NO: 804978 - DNA, 22 bp, Artificial Sequence
  chemically synthesized
aagaaaatgtatttattcgttt

SEQ ID NO: 804979 - DNA, 22 bp, Artificial Sequence
  chemically synthesized
ctcaagaaaatgtatttattcg

SEQ ID NO: 804980 - DNA, 22 bp, Artificial Sequence
  chemically synthesized
gacaaaaacgaataaatacatt

SEQ ID NO: 804981 - DNA, 22 bp, Artificial Sequence
  chemically synthesized
tcccatgttactcaagaaaatg

SEQ ID NO: 804982 - DNA, 22 bp, Artificial Sequence
  chemically synthesized
atcccatgttactcaagaaaat

SEQ ID NO: 804983 - DNA, 22 bp, Artificial Sequence
  chemically synthesized
gcttatcccatgttactcaaga

SEQ ID NO: 804984 - DNA, 22 bp, Artificial Sequence
  chemically synthesized
agcttatcccatgttactcaag

SEQ ID NO: 804985 - DNA, 22 bp, Artificial Sequence
  chemically synthesized
tcttgagtaacatgggataagc

SEQ ID NO: 804986 - DNA, 22 bp, Artificial Sequence
  chemically synthesized
cttgagtaacatgggataagct

SEQ ID NO: 804987 - DNA, 22 bp, Artificial Sequence
  chemically synthesized
agaaaatgtcttagcttatccc

SEQ ID NO: 804988 - DNA, 22 bp, Artificial Sequence
  chemically synthesized
ttgagtaacatgggataagcta

SEQ ID NO: 804989 - DNA, 22 bp, Artificial Sequence
  chemically synthesized
gagtaacatgggataagctaag

SEQ ID NO: 804990 - DNA, 22 bp, Artificial Sequence
  chemically synthesized
agtaacatgggataagctaaga

SEQ ID NO: 804991 - DNA, 22 bp, Artificial Sequence
  chemically synthesized
tgctgagaaaatgtcttagctt

SEQ ID NO: 804992 - DNA, 22 bp, Artificial Sequence
  chemically synthesized
gaaattatgctgagaaaatgtc

SEQ ID NO: 804993 - DNA, 22 bp, Artificial Sequence
  chemically synthesized
agacattttctcagcataattt

SEQ ID NO: 804994 - DNA, 22 bp, Artificial Sequence
  chemically synthesized
aaaagcagttggaaattatgct

SEQ ID NO: 804995 - DNA, 22 bp, Artificial Sequence
  chemically synthesized
caaaagcagttggaaattatgc

SEQ ID NO: 804996 - DNA, 22 bp, Artificial Sequence
  chemically synthesized
tcaaaagcagttggaaattatg

SEQ ID NO: 804997 - DNA, 22 bp, Artificial Sequence
  chemically synthesized
tttcaaaagcagttggaaatta

SEQ ID NO: 804998 - DNA, 22 bp, Artificial Sequence
  chemically synthesized
tctttcaaaagcagttggaaat

SEQ ID NO: 804999 - DNA, 22 bp, Artificial Sequence
  chemically synthesized
tctcagcataatttccaactgc

SEQ ID NO: 805000 - DNA, 22 bp, Artificial Sequence
  chemically synthesized
ctcagcataatttccaactgct

SEQ ID NO: 805001 - DNA, 22 bp, Artificial Sequence
  chemically synthesized
tcagcataatttccaactgctt

SEQ ID NO: 805002 - DNA, 22 bp, Artificial Sequence
  chemically synthesized
atctctctttcaaaagcagttg

SEQ ID NO: 805003 - DNA, 22 bp, Artificial Sequence
  chemically synthesized
agcataatttccaactgctttt

SEQ ID NO: 805004 - DNA, 22 bp, Artificial Sequence
  chemically synthesized
tgatctctctttcaaaagcagt

SEQ ID NO: 805005 - DNA, 22 bp, Artificial Sequence
  chemically synthesized
ctgatctctctttcaaaagcag

SEQ ID NO: 805006 - DNA, 22 bp, Artificial Sequence
  chemically synthesized
gatttctgatctctctttcaaa

SEQ ID NO: 805007 - DNA, 22 bp, Artificial Sequence
  chemically synthesized
agatttctgatctctctttcaa

SEQ ID NO: 805008 - DNA, 22 bp, Artificial Sequence
  chemically synthesized
ccaactgcttttgaaagagaga

SEQ ID NO: 805009 - DNA, 22 bp, Artificial Sequence
  chemically synthesized
caactgcttttgaaagagagat

SEQ ID NO: 805010 - DNA, 22 bp, Artificial Sequence
  chemically synthesized
tgtttagatttctgatctctct

SEQ ID NO: 805011 - DNA, 22 bp, Artificial Sequence
  chemically synthesized
atgtttagatttctgatctctc

SEQ ID NO: 805012 - DNA, 22 bp, Artificial Sequence
  chemically synthesized
tatgtttagatttctgatctct

SEQ ID NO: 805013 - DNA, 22 bp, Artificial Sequence
  chemically synthesized
cttttgaaagagagatcagaaa

SEQ ID NO: 805014 - DNA, 22 bp, Artificial Sequence
  chemically synthesized
ttgaaagagagatcagaaatct

SEQ ID NO: 805015 - DNA, 22 bp, Artificial Sequence
  chemically synthesized
tgaaagagagatcagaaatcta

SEQ ID NO: 805016 - DNA, 22 bp, Artificial Sequence
  chemically synthesized
gaaagagagatcagaaatctaa

SEQ ID NO: 805017 - DNA, 22 bp, Artificial Sequence
  chemically synthesized
aaagagagatcagaaatctaaa

SEQ ID NO: 805018 - DNA, 22 bp, Artificial Sequence
  chemically synthesized
tggaagcatggaaaataaatat

SEQ ID NO: 805019 - DNA, 22 bp, Artificial Sequence
  chemically synthesized
ctatggaagcatggaaaataaa

SEQ ID NO: 805020 - DNA, 22 bp, Artificial Sequence
  chemically synthesized
aacataaaatatttattttcca

SEQ ID NO: 805021 - DNA, 22 bp, Artificial Sequence
  chemically synthesized
actatggaagcatggaaaataa

SEQ ID NO: 805022 - DNA, 22 bp, Artificial Sequence
  chemically synthesized
tatttactatggaagcatggaa

SEQ ID NO: 805023 - DNA, 22 bp, Artificial Sequence
  chemically synthesized
actatatttactatggaagcat

SEQ ID NO: 805024 - DNA, 22 bp, Artificial Sequence
  chemically synthesized
attttccatgcttccatagtaa

SEQ ID NO: 805025 - DNA, 22 bp, Artificial Sequence
  chemically synthesized
ttttccatgcttccatagtaaa

SEQ ID NO: 805026 - DNA, 22 bp, Artificial Sequence
  chemically synthesized
tccatgcttccatagtaaatat

SEQ ID NO: 805027 - DNA, 22 bp, Artificial Sequence
  chemically synthesized
ccatgcttccatagtaaatata

SEQ ID NO: 805028 - DNA, 22 bp, Artificial Sequence
  chemically synthesized
catgcttccatagtaaatatag

SEQ ID NO: 805029 - DNA, 22 bp, Artificial Sequence
  chemically synthesized
accatgtgtcctaactatattt

SEQ ID NO: 805030 - DNA, 22 bp, Artificial Sequence
  chemically synthesized
ccatagtaaatatagttaggac

SEQ ID NO: 805031 - DNA, 22 bp, Artificial Sequence
  chemically synthesized
catagtaaatatagttaggaca

SEQ ID NO: 805032 - DNA, 22 bp, Artificial Sequence
  chemically synthesized
aagggaagattcaccatgtgtc

SEQ ID NO: 805033 - DNA, 22 bp, Artificial Sequence
  chemically synthesized
aatcattaaagggaagattcac

SEQ ID NO: 805034 - DNA, 22 bp, Artificial Sequence
  chemically synthesized
tgaatcattaaagggaagattc

SEQ ID NO: 805035 - DNA, 22 bp, Artificial Sequence
  chemically synthesized
ggacacatggtgaatcttccct

SEQ ID NO: 805036 - DNA, 22 bp, Artificial Sequence
  chemically synthesized
ctgaatcattaaagggaagatt

SEQ ID NO: 805037 - DNA, 22 bp, Artificial Sequence
  chemically synthesized
caagcttctgaatcattaaagg

SEQ ID NO: 805038 - DNA, 22 bp, Artificial Sequence
  chemically synthesized
aagaaactgcaagcttctgaat

SEQ ID NO: 805039 - DNA, 22 bp, Artificial Sequence
  chemically synthesized
ccctttaatgattcagaagctt

SEQ ID NO: 805040 - DNA, 22 bp, Artificial Sequence
  chemically synthesized
cctttaatgattcagaagcttg

SEQ ID NO: 805041 - DNA, 22 bp, Artificial Sequence
  chemically synthesized
atctcaagaaactgcaagcttc

SEQ ID NO: 805042 - DNA, 22 bp, Artificial Sequence
  chemically synthesized
taatgattcagaagcttgcagt

SEQ ID NO: 805043 - DNA, 22 bp, Artificial Sequence
  chemically synthesized
taatctcaagaaactgcaagct

SEQ ID NO: 805044 - DNA, 22 bp, Artificial Sequence
  chemically synthesized
aatgattcagaagcttgcagtt

SEQ ID NO: 805045 - DNA, 22 bp, Artificial Sequence
  chemically synthesized
ctaatctcaagaaactgcaagc

SEQ ID NO: 805046 - DNA, 22 bp, Artificial Sequence
  chemically synthesized
atgattcagaagcttgcagttt

SEQ ID NO: 805047 - DNA, 22 bp, Artificial Sequence
  chemically synthesized
tttctaatctcaagaaactgca

SEQ ID NO: 805048 - DNA, 22 bp, Artificial Sequence
  chemically synthesized
tatttctaatctcaagaaactg

SEQ ID NO: 805049 - DNA, 22 bp, Artificial Sequence
  chemically synthesized
agaagcttgcagtttcttgaga

SEQ ID NO: 805050 - DNA, 22 bp, Artificial Sequence
  chemically synthesized
tctctatttctaatctcaagaa

SEQ ID NO: 805051 - DNA, 22 bp, Artificial Sequence
  chemically synthesized
atctctatttctaatctcaaga

SEQ ID NO: 805052 - DNA, 22 bp, Artificial Sequence
  chemically synthesized
gcagtttcttgagattagaaat

SEQ ID NO: 805053 - DNA, 22 bp, Artificial Sequence
  chemically synthesized
cagtttcttgagattagaaata

SEQ ID NO: 805054 - DNA, 22 bp, Artificial Sequence
  chemically synthesized
cttgagattagaaatagagata

SEQ ID NO: 805055 - DNA, 22 bp, Artificial Sequence
  chemically synthesized
ttgagattagaaatagagataa

SEQ ID NO: 805056 - DNA, 22 bp, Artificial Sequence
  chemically synthesized
tataatgaaaatttatctctat

SEQ ID NO: 805057 - DNA, 22 bp, Artificial Sequence
  chemically synthesized
gagattagaaatagagataaat

SEQ ID NO: 805058 - DNA, 22 bp, Artificial Sequence
  chemically synthesized
agattagaaatagagataaatt

SEQ ID NO: 805059 - DNA, 22 bp, Artificial Sequence
  chemically synthesized
tattatataatgaaaatttatc

SEQ ID NO: 805060 - DNA, 22 bp, Artificial Sequence
  chemically synthesized
ctgtattatataatgaaaattt

SEQ ID NO: 805061 - DNA, 22 bp, Artificial Sequence
  chemically synthesized
gaaatagagataaattttcatt

SEQ ID NO: 805062 - DNA, 22 bp, Artificial Sequence
  chemically synthesized
tatctgctgtattatataatga

SEQ ID NO: 805063 - DNA, 22 bp, Artificial Sequence
  chemically synthesized
atatctgctgtattatataatg

SEQ ID NO: 805064 - DNA, 22 bp, Artificial Sequence
  chemically synthesized
tatttatatctgctgtattata

SEQ ID NO: 805065 - DNA, 22 bp, Artificial Sequence
  chemically synthesized
gtatttatatctgctgtattat

SEQ ID NO: 805066 - DNA, 22 bp, Artificial Sequence
  chemically synthesized
tcattatataatacagcagata

SEQ ID NO: 805067 - DNA, 22 bp, Artificial Sequence
  chemically synthesized
cattatataatacagcagatat

SEQ ID NO: 805068 - DNA, 22 bp, Artificial Sequence
  chemically synthesized
attatataatacagcagatata

SEQ ID NO: 805069 - DNA, 22 bp, Artificial Sequence
  chemically synthesized
tacaatttgtatttatatctgc

SEQ ID NO: 805070 - DNA, 22 bp, Artificial Sequence
  chemically synthesized
tataatacagcagatataaata

SEQ ID NO: 805071 - DNA, 22 bp, Artificial Sequence
  chemically synthesized
ctatacaatttgtatttatatc

SEQ ID NO: 805072 - DNA, 22 bp, Artificial Sequence
  chemically synthesized
tactatacaatttgtatttata

SEQ ID NO: 805073 - DNA, 22 bp, Artificial Sequence
  chemically synthesized
ctactatacaatttgtatttat

SEQ ID NO: 805074 - DNA, 22 bp, Artificial Sequence
  chemically synthesized
tctactatacaatttgtattta

SEQ ID NO: 805075 - DNA, 22 bp, Artificial Sequence
  chemically synthesized
ttttctactatacaatttgtat

SEQ ID NO: 805076 - DNA, 22 bp, Artificial Sequence
  chemically synthesized
agggcaaaaatacgtctatttt

SEQ ID NO: 805077 - DNA, 22 bp, Artificial Sequence
  chemically synthesized
tatagtagaaaatagacgtatt

SEQ ID NO: 805078 - DNA, 22 bp, Artificial Sequence
  chemically synthesized
gttgagggcaaaaatacgtcta

SEQ ID NO: 805079 - DNA, 22 bp, Artificial Sequence
  chemically synthesized
aatctagttgagggcaaaaata

SEQ ID NO: 805080 - DNA, 22 bp, Artificial Sequence
  chemically synthesized
aaatctagttgagggcaaaaat

SEQ ID NO: 805081 - DNA, 22 bp, Artificial Sequence
  chemically synthesized
taaatctagttgagggcaaaaa

SEQ ID NO: 805082 - DNA, 22 bp, Artificial Sequence
  chemically synthesized
ataaaacatatctttaaatcta

SEQ ID NO: 805083 - DNA, 22 bp, Artificial Sequence
  chemically synthesized
ttgccctcaactagatttaaag

SEQ ID NO: 805084 - DNA, 22 bp, Artificial Sequence
  chemically synthesized
aataaaacatatctttaaatct

SEQ ID NO: 805085 - DNA, 22 bp, Artificial Sequence
  chemically synthesized
tgccctcaactagatttaaaga

SEQ ID NO: 805086 - DNA, 22 bp, Artificial Sequence
  chemically synthesized
gccctcaactagatttaaagat

SEQ ID NO: 805087 - DNA, 22 bp, Artificial Sequence
  chemically synthesized
ccctcaactagatttaaagata

SEQ ID NO: 805088 - DNA, 22 bp, Artificial Sequence
  chemically synthesized
aactagatttaaagatatgttt

SEQ ID NO: 805089 - DNA, 22 bp, Artificial Sequence
  chemically synthesized
tgtcagggatttaataaaacat

SEQ ID NO: 805090 - DNA, 22 bp, Artificial Sequence
  chemically synthesized
gatttaaagatatgttttatta

SEQ ID NO: 805091 - DNA, 22 bp, Artificial Sequence
  chemically synthesized
atgtcagggatttaataaaaca

SEQ ID NO: 805092 - DNA, 22 bp, Artificial Sequence
  chemically synthesized
tatgtcagggatttaataaaac

SEQ ID NO: 805093 - DNA, 22 bp, Artificial Sequence
  chemically synthesized
ttttatgtcagggatttaataa

SEQ ID NO: 805094 - DNA, 22 bp, Artificial Sequence
  chemically synthesized
aaagatatgttttattaaatcc

SEQ ID NO: 805095 - DNA, 22 bp, Artificial Sequence
  chemically synthesized
aagatatgttttattaaatccc

SEQ ID NO: 805096 - DNA, 22 bp, Artificial Sequence
  chemically synthesized
aaaaattattttatgtcaggga

SEQ ID NO: 805097 - DNA, 22 bp, Artificial Sequence
  chemically synthesized
tattaaatccctgacataaaat

SEQ ID NO: 805098 - DNA, 22 bp, Artificial Sequence
  chemically synthesized
attaaatccctgacataaaata

SEQ ID NO: 805099 - DNA, 22 bp, Artificial Sequence
  chemically synthesized
ttaaatccctgacataaaataa

SEQ ID NO: 805100 - DNA, 22 bp, Artificial Sequence
  chemically synthesized
aatccctgacataaaataattt

SEQ ID NO: 805101 - DNA, 22 bp, Artificial Sequence
  chemically synthesized
acataaaataattttttagtca

SEQ ID NO: 805102 - DNA, 22 bp, Artificial Sequence
  chemically synthesized
aaaaataaagaataacccaatg

SEQ ID NO: 805103 - DNA, 22 bp, Artificial Sequence
  chemically synthesized
gaaaaataaagaataacccaat

SEQ ID NO: 805104 - DNA, 22 bp, Artificial Sequence
  chemically synthesized
tgaaaaataaagaataacccaa

SEQ ID NO: 805105 - DNA, 22 bp, Artificial Sequence
  chemically synthesized
ctttgaaaaataaagaataacc

SEQ ID NO: 805106 - DNA, 22 bp, Artificial Sequence
  chemically synthesized
tttagtcattgggttattcttt

SEQ ID NO: 805107 - DNA, 22 bp, Artificial Sequence
  chemically synthesized
ttagtcattgggttattcttta

SEQ ID NO: 805108 - DNA, 22 bp, Artificial Sequence
  chemically synthesized
tagtcattgggttattctttat

SEQ ID NO: 805109 - DNA, 22 bp, Artificial Sequence
  chemically synthesized
agtcattgggttattctttatt

SEQ ID NO: 805110 - DNA, 22 bp, Artificial Sequence
  chemically synthesized
gtcattgggttattctttattt

SEQ ID NO: 805111 - DNA, 22 bp, Artificial Sequence
  chemically synthesized
gcagattactttgaaaaataaa

SEQ ID NO: 805112 - DNA, 22 bp, Artificial Sequence
  chemically synthesized
agcagattactttgaaaaataa

SEQ ID NO: 805113 - DNA, 22 bp, Artificial Sequence
  chemically synthesized
tagcagattactttgaaaaata

SEQ ID NO: 805114 - DNA, 22 bp, Artificial Sequence
  chemically synthesized
ttagcagattactttgaaaaat

SEQ ID NO: 805115 - DNA, 22 bp, Artificial Sequence
  chemically synthesized
ggttattctttatttttcaaag

SEQ ID NO: 805116 - DNA, 22 bp, Artificial Sequence
  chemically synthesized
tttttagcagattactttgaaa

SEQ ID NO: 805117 - DNA, 22 bp, Artificial Sequence
  chemically synthesized
ttctttatttttcaaagtaatc

SEQ ID NO: 805118 - DNA, 22 bp, Artificial Sequence
  chemically synthesized
gtctatttttagcagattactt

SEQ ID NO: 805119 - DNA, 22 bp, Artificial Sequence
  chemically synthesized
tttatttttcaaagtaatctgc

SEQ ID NO: 805120 - DNA, 22 bp, Artificial Sequence
  chemically synthesized
agtctatttttagcagattact

SEQ ID NO: 805121 - DNA, 22 bp, Artificial Sequence
  chemically synthesized
tagtctatttttagcagattac

SEQ ID NO: 805122 - DNA, 22 bp, Artificial Sequence
  chemically synthesized
tatttttcaaagtaatctgcta

SEQ ID NO: 805123 - DNA, 22 bp, Artificial Sequence
  chemically synthesized
atttttcaaagtaatctgctaa

SEQ ID NO: 805124 - DNA, 22 bp, Artificial Sequence
  chemically synthesized
tttttcaaagtaatctgctaaa

SEQ ID NO: 805125 - DNA, 22 bp, Artificial Sequence
  chemically synthesized
ttttagtctatttttagcagat

SEQ ID NO: 805126 - DNA, 22 bp, Artificial Sequence
  chemically synthesized
ttcaaagtaatctgctaaaaat

SEQ ID NO: 805127 - DNA, 22 bp, Artificial Sequence
  chemically synthesized
tcaaagtaatctgctaaaaata

SEQ ID NO: 805128 - DNA, 22 bp, Artificial Sequence
  chemically synthesized
caaagtaatctgctaaaaatag

SEQ ID NO: 805129 - DNA, 22 bp, Artificial Sequence
  chemically synthesized
aaagtaatctgctaaaaataga

SEQ ID NO: 805130 - DNA, 22 bp, Artificial Sequence
  chemically synthesized
agtctattttagtctattttta

SEQ ID NO: 805131 - DNA, 22 bp, Artificial Sequence
  chemically synthesized
attaagtctattttagtctatt

SEQ ID NO: 805132 - DNA, 22 bp, Artificial Sequence
  chemically synthesized
gattaagtctattttagtctat

SEQ ID NO: 805133 - DNA, 22 bp, Artificial Sequence
  chemically synthesized
tgattaagtctattttagtcta

SEQ ID NO: 805134 - DNA, 22 bp, Artificial Sequence
  chemically synthesized
ctaaaaatagactaaaatagac

SEQ ID NO: 805135 - DNA, 22 bp, Artificial Sequence
  chemically synthesized
aaaatagactaaaatagactta

SEQ ID NO: 805136 - DNA, 22 bp, Artificial Sequence
  chemically synthesized
aaatagacttaatcaaagctta

SEQ ID NO: 805137 - DNA, 22 bp, Artificial Sequence
  chemically synthesized
tggtaggtaaataataagcttt

SEQ ID NO: 805138 - DNA, 22 bp, Artificial Sequence
  chemically synthesized
aatcaaagcttattatttacct

SEQ ID NO: 805139 - DNA, 22 bp, Artificial Sequence
  chemically synthesized
atcaaagcttattatttaccta

SEQ ID NO: 805140 - DNA, 22 bp, Artificial Sequence
  chemically synthesized
cccatcagctatggtaggtaaa

SEQ ID NO: 805141 - DNA, 22 bp, Artificial Sequence
  chemically synthesized
acccatcagctatggtaggtaa

SEQ ID NO: 805142 - DNA, 22 bp, Artificial Sequence
  chemically synthesized
tacccatcagctatggtaggta

SEQ ID NO: 805143 - DNA, 22 bp, Artificial Sequence
  chemically synthesized
cattttacccatcagctatggt

SEQ ID NO: 805144 - DNA, 22 bp, Artificial Sequence
  chemically synthesized
attatttacctaccatagctga

SEQ ID NO: 805145 - DNA, 22 bp, Artificial Sequence
  chemically synthesized
acattttacccatcagctatgg

SEQ ID NO: 805146 - DNA, 22 bp, Artificial Sequence
  chemically synthesized
ttatttacctaccatagctgat

SEQ ID NO: 805147 - DNA, 22 bp, Artificial Sequence
  chemically synthesized
tttacctaccatagctgatggg

SEQ ID NO: 805148 - DNA, 22 bp, Artificial Sequence
  chemically synthesized
acctaccatagctgatgggtaa

SEQ ID NO: 805149 - DNA, 22 bp, Artificial Sequence
  chemically synthesized
cctaccatagctgatgggtaaa

SEQ ID NO: 805150 - DNA, 22 bp, Artificial Sequence
  chemically synthesized
ccatagctgatgggtaaaatgt

SEQ ID NO: 805151 - DNA, 22 bp, Artificial Sequence
  chemically synthesized
atgggtaaaatgtaaacccatg

SEQ ID NO: 805152 - DNA, 22 bp, Artificial Sequence
  chemically synthesized
aaaacaaataaataaataaata

SEQ ID NO: 805153 - DNA, 22 bp, Artificial Sequence
  chemically synthesized
atctcaaaacaaataaataaat

SEQ ID NO: 805154 - DNA, 22 bp, Artificial Sequence
  chemically synthesized
catctcaaaacaaataaataaa

SEQ ID NO: 805155 - DNA, 22 bp, Artificial Sequence
  chemically synthesized
ttatttatttatttatttgttt

SEQ ID NO: 805156 - DNA, 22 bp, Artificial Sequence
  chemically synthesized
tatttatttatttatttgtttt

SEQ ID NO: 805157 - DNA, 22 bp, Artificial Sequence
  chemically synthesized
atttatttatttatttgttttg

SEQ ID NO: 805158 - DNA, 22 bp, Artificial Sequence
  chemically synthesized
tttatttatttatttgttttga

SEQ ID NO: 805159 - DNA, 22 bp, Artificial Sequence
  chemically synthesized
atttatttatttgttttgagat

SEQ ID NO: 805160 - DNA, 22 bp, Artificial Sequence
  chemically synthesized
tttatttatttgttttgagatg

SEQ ID NO: 805161 - DNA, 22 bp, Artificial Sequence
  chemically synthesized
atttatttgttttgagatgaag

SEQ ID NO: 805162 - DNA, 22 bp, Artificial Sequence
  chemically synthesized
tttatttgttttgagatgaagt

SEQ ID NO: 805163 - DNA, 22 bp, Artificial Sequence
  chemically synthesized
ggtgacaaagtgagacttcatc

SEQ ID NO: 805164 - DNA, 22 bp, Artificial Sequence
  chemically synthesized
atttgttttgagatgaagtctc

SEQ ID NO: 805165 - DNA, 22 bp, Artificial Sequence
  chemically synthesized
tttgttttgagatgaagtctca

SEQ ID NO: 805166 - DNA, 22 bp, Artificial Sequence
  chemically synthesized
gttttgagatgaagtctcactt

SEQ ID NO: 805167 - DNA, 22 bp, Artificial Sequence
  chemically synthesized
ttttgagatgaagtctcacttt

SEQ ID NO: 805168 - DNA, 22 bp, Artificial Sequence
  chemically synthesized
cagcctgggtgacaaagtgaga

SEQ ID NO: 805169 - DNA, 22 bp, Artificial Sequence
  chemically synthesized
tgagatgaagtctcactttgtc

SEQ ID NO: 805170 - DNA, 22 bp, Artificial Sequence
  chemically synthesized
gagatgaagtctcactttgtca

SEQ ID NO: 805171 - DNA, 22 bp, Artificial Sequence
  chemically synthesized
agatgaagtctcactttgtcac

SEQ ID NO: 805172 - DNA, 22 bp, Artificial Sequence
  chemically synthesized
cactccagcctgggtgacaaag

SEQ ID NO: 805173 - DNA, 22 bp, Artificial Sequence
  chemically synthesized
actttgtcacccaggctggagt

SEQ ID NO: 805174 - DNA, 22 bp, Artificial Sequence
  chemically synthesized
tgtcacccaggctggagtgcag

SEQ ID NO: 805175 - DNA, 22 bp, Artificial Sequence
  chemically synthesized
gtcacccaggctggagtgcagt

SEQ ID NO: 805176 - DNA, 22 bp, Artificial Sequence
  chemically synthesized
tcacccaggctggagtgcagtg

SEQ ID NO: 805177 - DNA, 22 bp, Artificial Sequence
  chemically synthesized
cagtgagccgaggtggcgccac

SEQ ID NO: 805178 - DNA, 22 bp, Artificial Sequence
  chemically synthesized
gagtgcagtggcgccacctcgg

SEQ ID NO: 805179 - DNA, 22 bp, Artificial Sequence
  chemically synthesized
aacccaggaggcagaggttgca

SEQ ID NO: 805180 - DNA, 22 bp, Artificial Sequence
  chemically synthesized
gaacccaggaggcagaggttgc

SEQ ID NO: 805181 - DNA, 22 bp, Artificial Sequence
  chemically synthesized
ggctcactgcaacctctgcctc

SEQ ID NO: 805182 - DNA, 22 bp, Artificial Sequence
  chemically synthesized
actgcaacctctgcctcctggg

SEQ ID NO: 805183 - DNA, 22 bp, Artificial Sequence
  chemically synthesized
caacctctgcctcctgggttca

SEQ ID NO: 805184 - DNA, 22 bp, Artificial Sequence
  chemically synthesized
aggtgggagaatcgcttgaacc

SEQ ID NO: 805185 - DNA, 22 bp, Artificial Sequence
  chemically synthesized
tgcctcctgggttcaagcgatt

SEQ ID NO: 805186 - DNA, 22 bp, Artificial Sequence
  chemically synthesized
cctcctgggttcaagcgattct

SEQ ID NO: 805187 - DNA, 22 bp, Artificial Sequence
  chemically synthesized
ggaggctgaggtgggagaatcg

SEQ ID NO: 805188 - DNA, 22 bp, Artificial Sequence
  chemically synthesized
ctgggttcaagcgattctccca

SEQ ID NO: 805189 - DNA, 22 bp, Artificial Sequence
  chemically synthesized
gggaggctgaggtgggagaatc

SEQ ID NO: 805190 - DNA, 22 bp, Artificial Sequence
  chemically synthesized
ggttcaagcgattctcccacct

SEQ ID NO: 805191 - DNA, 22 bp, Artificial Sequence
  chemically synthesized
cttgggaggctgaggtgggaga

SEQ ID NO: 805192 - DNA, 22 bp, Artificial Sequence
  chemically synthesized
gctacttgggaggctgaggtgg

SEQ ID NO: 805193 - DNA, 22 bp, Artificial Sequence
  chemically synthesized
aagcgattctcccacctcagcc

SEQ ID NO: 805194 - DNA, 22 bp, Artificial Sequence
  chemically synthesized
taatcctagctacttgggaggc

SEQ ID NO: 805195 - DNA, 22 bp, Artificial Sequence
  chemically synthesized
tcccacctcagcctcccaagta

SEQ ID NO: 805196 - DNA, 22 bp, Artificial Sequence
  chemically synthesized
ccacctcagcctcccaagtagc

SEQ ID NO: 805197 - DNA, 22 bp, Artificial Sequence
  chemically synthesized
cgcctgtaatcctagctacttg

SEQ ID NO: 805198 - DNA, 22 bp, Artificial Sequence
  chemically synthesized
agcctcccaagtagctaggatt

SEQ ID NO: 805199 - DNA, 22 bp, Artificial Sequence
  chemically synthesized
ccaagtagctaggattacaggc

SEQ ID NO: 805200 - DNA, 22 bp, Artificial Sequence
  chemically synthesized
ggtatggtgacctgcgcctgta

SEQ ID NO: 805201 - DNA, 22 bp, Artificial Sequence
  chemically synthesized
gctgggtatggtgacctgcgcc

SEQ ID NO: 805202 - DNA, 22 bp, Artificial Sequence
  chemically synthesized
ggattacaggcgcaggtcacca

SEQ ID NO: 805203 - DNA, 22 bp, Artificial Sequence
  chemically synthesized
caggcgcaggtcaccataccca

SEQ ID NO: 805204 - DNA, 22 bp, Artificial Sequence
  chemically synthesized
aaaatacaaaaattagctgggt

SEQ ID NO: 805205 - DNA, 22 bp, Artificial Sequence
  chemically synthesized
ctaaaaatacaaaaattagctg

SEQ ID NO: 805206 - DNA, 22 bp, Artificial Sequence
  chemically synthesized
tactaaaaatacaaaaattagc

SEQ ID NO: 805207 - DNA, 22 bp, Artificial Sequence
  chemically synthesized
atttttgtatttttagtagaga

SEQ ID NO: 805208 - DNA, 22 bp, Artificial Sequence
  chemically synthesized
ttgtatttttagtagagatggg

SEQ ID NO: 805209 - DNA, 22 bp, Artificial Sequence
  chemically synthesized
tgtatttttagtagagatgggg

SEQ ID NO: 805210 - DNA, 22 bp, Artificial Sequence
  chemically synthesized
gtatttttagtagagatggggt

SEQ ID NO: 805211 - DNA, 22 bp, Artificial Sequence
  chemically synthesized
tatttttagtagagatggggtt

SEQ ID NO: 805212 - DNA, 22 bp, Artificial Sequence
  chemically synthesized
gccaacatggcgaaaccccatc

SEQ ID NO: 805213 - DNA, 22 bp, Artificial Sequence
  chemically synthesized
ttagtagagatggggtttcgcc

SEQ ID NO: 805214 - DNA, 22 bp, Artificial Sequence
  chemically synthesized
tagtagagatggggtttcgcca

SEQ ID NO: 805215 - DNA, 22 bp, Artificial Sequence
  chemically synthesized
agtagagatggggtttcgccat

SEQ ID NO: 805216 - DNA, 22 bp, Artificial Sequence
  chemically synthesized
gtagagatggggtttcgccatg

SEQ ID NO: 805217 - DNA, 22 bp, Artificial Sequence
  chemically synthesized
gagaccagcctggccaacatgg

SEQ ID NO: 805218 - DNA, 22 bp, Artificial Sequence
  chemically synthesized
cgccatgttggccaggctggtc

SEQ ID NO: 805219 - DNA, 22 bp, Artificial Sequence
  chemically synthesized
gccatgttggccaggctggtct

SEQ ID NO: 805220 - DNA, 22 bp, Artificial Sequence
  chemically synthesized
aagtcaggagttcgagaccagc

SEQ ID NO: 805221 - DNA, 22 bp, Artificial Sequence
  chemically synthesized
gccaggctggtctcgaactcct

SEQ ID NO: 805222 - DNA, 22 bp, Artificial Sequence
  chemically synthesized
gtctcgaactcctgacttcagg

SEQ ID NO: 805223 - DNA, 22 bp, Artificial Sequence
  chemically synthesized
gaactcctgacttcaggtgatc

SEQ ID NO: 805224 - DNA, 22 bp, Artificial Sequence
  chemically synthesized
ggaggccgaggtgggtggatca

SEQ ID NO: 805225 - DNA, 22 bp, Artificial Sequence
  chemically synthesized
ctgacttcaggtgatccaccca

SEQ ID NO: 805226 - DNA, 22 bp, Artificial Sequence
  chemically synthesized
gggaggccgaggtgggtggatc

SEQ ID NO: 805227 - DNA, 22 bp, Artificial Sequence
  chemically synthesized
tgggaggccgaggtgggtggat

SEQ ID NO: 805228 - DNA, 22 bp, Artificial Sequence
  chemically synthesized
acttcaggtgatccacccacct

SEQ ID NO: 805229 - DNA, 22 bp, Artificial Sequence
  chemically synthesized
caggtgatccacccacctcggc

SEQ ID NO: 805230 - DNA, 22 bp, Artificial Sequence
  chemically synthesized
aggtgatccacccacctcggcc

SEQ ID NO: 805231 - DNA, 22 bp, Artificial Sequence
  chemically synthesized
taaccccagcactttgggaggc

SEQ ID NO: 805232 - DNA, 22 bp, Artificial Sequence
  chemically synthesized
atgcctgtaaccccagcacttt

SEQ ID NO: 805233 - DNA, 22 bp, Artificial Sequence
  chemically synthesized
ggcctcccaaagtgctggggtt

SEQ ID NO: 805234 - DNA, 22 bp, Artificial Sequence
  chemically synthesized
ccaaagtgctggggttacaggc

SEQ ID NO: 805235 - DNA, 22 bp, Artificial Sequence
  chemically synthesized
ccggccagatgcggtggctcat

SEQ ID NO: 805236 - DNA, 22 bp, Artificial Sequence
  chemically synthesized
gggttacaggcatgagccaccg

SEQ ID NO: 805237 - DNA, 22 bp, Artificial Sequence
  chemically synthesized
cccggccagatgcggtggctca

SEQ ID NO: 805238 - DNA, 22 bp, Artificial Sequence
  chemically synthesized
caggcatgagccaccgcatctg

SEQ ID NO: 805239 - DNA, 22 bp, Artificial Sequence
  chemically synthesized
atagatatgtgggtttcccggc

SEQ ID NO: 805240 - DNA, 22 bp, Artificial Sequence
  chemically synthesized
aatagatatgtgggtttcccgg

SEQ ID NO: 805241 - DNA, 22 bp, Artificial Sequence
  chemically synthesized
taatagatatgtgggtttcccg

SEQ ID NO: 805242 - DNA, 22 bp, Artificial Sequence
  chemically synthesized
cagaattttaatagatatgtgg

SEQ ID NO: 805243 - DNA, 22 bp, Artificial Sequence
  chemically synthesized
gccgggaaacccacatatctat

SEQ ID NO: 805244 - DNA, 22 bp, Artificial Sequence
  chemically synthesized
ctccagaattttaatagatatg

SEQ ID NO: 805245 - DNA, 22 bp, Artificial Sequence
  chemically synthesized
ataaagctactccagaatttta

SEQ ID NO: 805246 - DNA, 22 bp, Artificial Sequence
  chemically synthesized
taaatgctgataaagctactcc

SEQ ID NO: 805247 - DNA, 22 bp, Artificial Sequence
  chemically synthesized
ttaaaattctggagtagcttta

SEQ ID NO: 805248 - DNA, 22 bp, Artificial Sequence
  chemically synthesized
aaattctggagtagctttatca

SEQ ID NO: 805249 - DNA, 22 bp, Artificial Sequence
  chemically synthesized
taaaatattataaatgctgata

SEQ ID NO: 805250 - DNA, 22 bp, Artificial Sequence
  chemically synthesized
tggagtagctttatcagcattt

SEQ ID NO: 805251 - DNA, 22 bp, Artificial Sequence
  chemically synthesized
gagtagctttatcagcatttat

SEQ ID NO: 805252 - DNA, 22 bp, Artificial Sequence
  chemically synthesized
ttataaaatattataaatgctg

SEQ ID NO: 805253 - DNA, 22 bp, Artificial Sequence
  chemically synthesized
attataaaatattataaatgct

SEQ ID NO: 805254 - DNA, 22 bp, Artificial Sequence
  chemically synthesized
tattataaaatattataaatgc

SEQ ID NO: 805255 - DNA, 22 bp, Artificial Sequence
  chemically synthesized
tatcagcatttataatatttta

SEQ ID NO: 805256 - DNA, 22 bp, Artificial Sequence
  chemically synthesized
atcagcatttataatattttat

SEQ ID NO: 805257 - DNA, 22 bp, Artificial Sequence
  chemically synthesized
tcagcatttataatattttata

SEQ ID NO: 805258 - DNA, 22 bp, Artificial Sequence
  chemically synthesized
ataaataaaattttattataaa

SEQ ID NO: 805259 - DNA, 22 bp, Artificial Sequence
  chemically synthesized
cataaataaaattttattataa

SEQ ID NO: 805260 - DNA, 22 bp, Artificial Sequence
  chemically synthesized
tttcataaataaaattttatta

SEQ ID NO: 805261 - DNA, 22 bp, Artificial Sequence
  chemically synthesized
ataatattttataataaaattt

SEQ ID NO: 805262 - DNA, 22 bp, Artificial Sequence
  chemically synthesized
taatattttataataaaatttt

SEQ ID NO: 805263 - DNA, 22 bp, Artificial Sequence
  chemically synthesized
ggctatttcataaataaaattt

SEQ ID NO: 805264 - DNA, 22 bp, Artificial Sequence
  chemically synthesized
aggctatttcataaataaaatt

SEQ ID NO: 805265 - DNA, 22 bp, Artificial Sequence
  chemically synthesized
tataataaaattttatttatga

SEQ ID NO: 805266 - DNA, 22 bp, Artificial Sequence
  chemically synthesized
gcttaggctatttcataaataa

SEQ ID NO: 805267 - DNA, 22 bp, Artificial Sequence
  chemically synthesized
ataataaaattttatttatgaa

SEQ ID NO: 805268 - DNA, 22 bp, Artificial Sequence
  chemically synthesized
ggcttaggctatttcataaata

SEQ ID NO: 805269 - DNA, 22 bp, Artificial Sequence
  chemically synthesized
taataaaattttatttatgaaa

SEQ ID NO: 805270 - DNA, 22 bp, Artificial Sequence
  chemically synthesized
taatatatttggcttaggctat

SEQ ID NO: 805271 - DNA, 22 bp, Artificial Sequence
  chemically synthesized
tatttatgaaatagcctaagcc

SEQ ID NO: 805272 - DNA, 22 bp, Artificial Sequence
  chemically synthesized
atttatgaaatagcctaagcca

SEQ ID NO: 805273 - DNA, 22 bp, Artificial Sequence
  chemically synthesized
tttatgaaatagcctaagccaa

SEQ ID NO: 805274 - DNA, 22 bp, Artificial Sequence
  chemically synthesized
atgaaatagcctaagccaaata

SEQ ID NO: 805275 - DNA, 22 bp, Artificial Sequence
  chemically synthesized
tgaaatagcctaagccaaatat

SEQ ID NO: 805276 - DNA, 22 bp, Artificial Sequence
  chemically synthesized
gacaatgtaccactgtaatata

SEQ ID NO: 805277 - DNA, 22 bp, Artificial Sequence
  chemically synthesized
agccaaatatattacagtggta

SEQ ID NO: 805278 - DNA, 22 bp, Artificial Sequence
  chemically synthesized
gatgtatggttagacaatgtac

SEQ ID NO: 805279 - DNA, 22 bp, Artificial Sequence
  chemically synthesized
cgatgtatggttagacaatgta

SEQ ID NO: 805280 - DNA, 22 bp, Artificial Sequence
  chemically synthesized
ttcgatgtatggttagacaatg

SEQ ID NO: 805281 - DNA, 22 bp, Artificial Sequence
  chemically synthesized
cagtggtacattgtctaaccat

SEQ ID NO: 805282 - DNA, 22 bp, Artificial Sequence
  chemically synthesized
actcttcgatgtatggttagac

SEQ ID NO: 805283 - DNA, 22 bp, Artificial Sequence
  chemically synthesized
ctcactcttcgatgtatggtta

SEQ ID NO: 805284 - DNA, 22 bp, Artificial Sequence
  chemically synthesized
gctcactcttcgatgtatggtt

SEQ ID NO: 805285 - DNA, 22 bp, Artificial Sequence
  chemically synthesized
tgctcactcttcgatgtatggt

SEQ ID NO: 805286 - DNA, 22 bp, Artificial Sequence
  chemically synthesized
ttgctcactcttcgatgtatgg

SEQ ID NO: 805287 - DNA, 22 bp, Artificial Sequence
  chemically synthesized
tttgctcactcttcgatgtatg

SEQ ID NO: 805288 - DNA, 22 bp, Artificial Sequence
  chemically synthesized
tctaaccatacatcgaagagtg

SEQ ID NO: 805289 - DNA, 22 bp, Artificial Sequence
  chemically synthesized
accatacatcgaagagtgagca

SEQ ID NO: 805290 - DNA, 22 bp, Artificial Sequence
  chemically synthesized
tgatagaatataagggcaatgc

SEQ ID NO: 805291 - DNA, 22 bp, Artificial Sequence
  chemically synthesized
gtgatagaatataagggcaatg

SEQ ID NO: 805292 - DNA, 22 bp, Artificial Sequence
  chemically synthesized
tacatttgcattgcccttatat

SEQ ID NO: 805293 - DNA, 22 bp, Artificial Sequence
  chemically synthesized
catttgcattgcccttatattc

SEQ ID NO: 805294 - DNA, 22 bp, Artificial Sequence
  chemically synthesized
ccatggcttgtgatagaatata

SEQ ID NO: 805295 - DNA, 22 bp, Artificial Sequence
  chemically synthesized
gcattgcccttatattctatca

SEQ ID NO: 805296 - DNA, 22 bp, Artificial Sequence
  chemically synthesized
cattgcccttatattctatcac

SEQ ID NO: 805297 - DNA, 22 bp, Artificial Sequence
  chemically synthesized
cccttatattctatcacaagcc

SEQ ID NO: 805298 - DNA, 22 bp, Artificial Sequence
  chemically synthesized
tagatatctcccatggcttgtg

SEQ ID NO: 805299 - DNA, 22 bp, Artificial Sequence
  chemically synthesized
atagatatctcccatggcttgt

SEQ ID NO: 805300 - DNA, 22 bp, Artificial Sequence
  chemically synthesized
tatagatatctcccatggcttg

SEQ ID NO: 805301 - DNA, 22 bp, Artificial Sequence
  chemically synthesized
atattctatcacaagccatggg

SEQ ID NO: 805302 - DNA, 22 bp, Artificial Sequence
  chemically synthesized
tattctatcacaagccatggga

SEQ ID NO: 805303 - DNA, 22 bp, Artificial Sequence
  chemically synthesized
tatcacaagccatgggagatat

SEQ ID NO: 805304 - DNA, 22 bp, Artificial Sequence
  chemically synthesized
tcacaagccatgggagatatct

SEQ ID NO: 805305 - DNA, 22 bp, Artificial Sequence
  chemically synthesized
gaacagtatcagactttataga

SEQ ID NO: 805306 - DNA, 22 bp, Artificial Sequence
  chemically synthesized
ggaacagtatcagactttatag

SEQ ID NO: 805307 - DNA, 22 bp, Artificial Sequence
  chemically synthesized
tttggaacagtatcagacttta

SEQ ID NO: 805308 - DNA, 22 bp, Artificial Sequence
  chemically synthesized
gtttggaacagtatcagacttt

SEQ ID NO: 805309 - DNA, 22 bp, Artificial Sequence
  chemically synthesized
gaggtaatttgtttggaacagt

SEQ ID NO: 805310 - DNA, 22 bp, Artificial Sequence
  chemically synthesized
taaagtctgatactgttccaaa

SEQ ID NO: 805311 - DNA, 22 bp, Artificial Sequence
  chemically synthesized
ggaggtaatttgtttggaacag

SEQ ID NO: 805312 - DNA, 22 bp, Artificial Sequence
  chemically synthesized
atcatttggaggtaatttgttt

SEQ ID NO: 805313 - DNA, 22 bp, Artificial Sequence
  chemically synthesized
gatcatttggaggtaatttgtt

SEQ ID NO: 805314 - DNA, 22 bp, Artificial Sequence
  chemically synthesized
atactgttccaaacaaattacc

SEQ ID NO: 805315 - DNA, 22 bp, Artificial Sequence
  chemically synthesized
gtttgatcatttggaggtaatt

SEQ ID NO: 805316 - DNA, 22 bp, Artificial Sequence
  chemically synthesized
ttccaaacaaattacctccaaa

SEQ ID NO: 805317 - DNA, 22 bp, Artificial Sequence
  chemically synthesized
agttagtttgatcatttggagg

SEQ ID NO: 805318 - DNA, 22 bp, Artificial Sequence
  chemically synthesized
caaacaaattacctccaaatga

SEQ ID NO: 805319 - DNA, 22 bp, Artificial Sequence
  chemically synthesized
cctccaaatgatcaaactaact

SEQ ID NO: 805320 - DNA, 22 bp, Artificial Sequence
  chemically synthesized
caaaatgcgtgttgagttagtt

SEQ ID NO: 805321 - DNA, 22 bp, Artificial Sequence
  chemically synthesized
caaatgatcaaactaactcaac

SEQ ID NO: 805322 - DNA, 22 bp, Artificial Sequence
  chemically synthesized
ctccaaaatgcgtgttgagtta

SEQ ID NO: 805323 - DNA, 22 bp, Artificial Sequence
  chemically synthesized
tcctccaaaatgcgtgttgagt

SEQ ID NO: 805324 - DNA, 22 bp, Artificial Sequence
  chemically synthesized
ctcctccaaaatgcgtgttgag

SEQ ID NO: 805325 - DNA, 22 bp, Artificial Sequence
  chemically synthesized
tctcctccaaaatgcgtgttga

SEQ ID NO: 805326 - DNA, 22 bp, Artificial Sequence
  chemically synthesized
accccactttctcctccaaaat

SEQ ID NO: 805327 - DNA, 22 bp, Artificial Sequence
  chemically synthesized
actcaacacgcattttggagga

SEQ ID NO: 805328 - DNA, 22 bp, Artificial Sequence
  chemically synthesized
gaccccactttctcctccaaaa

SEQ ID NO: 805329 - DNA, 22 bp, Artificial Sequence
  chemically synthesized
tgaccccactttctcctccaaa

SEQ ID NO: 805330 - DNA, 22 bp, Artificial Sequence
  chemically synthesized
aacacgcattttggaggagaaa

SEQ ID NO: 805331 - DNA, 22 bp, Artificial Sequence
  chemically synthesized
ctttgaccccactttctcctcc

SEQ ID NO: 805332 - DNA, 22 bp, Artificial Sequence
  chemically synthesized
atcatcctgctttgaccccact

SEQ ID NO: 805333 - DNA, 22 bp, Artificial Sequence
  chemically synthesized
catcatcctgctttgaccccac

SEQ ID NO: 805334 - DNA, 22 bp, Artificial Sequence
  chemically synthesized
tggaggagaaagtggggtcaaa

SEQ ID NO: 805335 - DNA, 22 bp, Artificial Sequence
  chemically synthesized
ggaggagaaagtggggtcaaag

SEQ ID NO: 805336 - DNA, 22 bp, Artificial Sequence
  chemically synthesized
gaggagaaagtggggtcaaagc

SEQ ID NO: 805337 - DNA, 22 bp, Artificial Sequence
  chemically synthesized
cttcatcatcctgctttgaccc

SEQ ID NO: 805338 - DNA, 22 bp, Artificial Sequence
  chemically synthesized
gcttcatcatcctgctttgacc

SEQ ID NO: 805339 - DNA, 22 bp, Artificial Sequence
  chemically synthesized
ttgcttcatcatcctgctttga

SEQ ID NO: 805340 - DNA, 22 bp, Artificial Sequence
  chemically synthesized
tcgttcttgcttcatcatcctg

SEQ ID NO: 805341 - DNA, 22 bp, Artificial Sequence
  chemically synthesized
atcgttcttgcttcatcatcct

SEQ ID NO: 805342 - DNA, 22 bp, Artificial Sequence
  chemically synthesized
aatttatcgttcttgcttcatc

SEQ ID NO: 805343 - DNA, 22 bp, Artificial Sequence
  chemically synthesized
ctgaatttatcgttcttgcttc

SEQ ID NO: 805344 - DNA, 22 bp, Artificial Sequence
  chemically synthesized
aggagccatacattgccactgt

SEQ ID NO: 805345 - DNA, 22 bp, Artificial Sequence
  chemically synthesized
catagagtacgtaacagtggca

SEQ ID NO: 805346 - DNA, 22 bp, Artificial Sequence
  chemically synthesized
ttgcatagagtacgtaacagtg

SEQ ID NO: 805347 - DNA, 22 bp, Artificial Sequence
  chemically synthesized
tgttgcatagagtacgtaacag

SEQ ID NO: 805348 - DNA, 22 bp, Artificial Sequence
  chemically synthesized
ctctgttgcatagagtacgtaa

SEQ ID NO: 805349 - DNA, 22 bp, Artificial Sequence
  chemically synthesized
ctgctctgttgcatagagtacg

SEQ ID NO: 805350 - DNA, 22 bp, Artificial Sequence
  chemically synthesized
gctgctctgttgcatagagtac

SEQ ID NO: 805351 - DNA, 22 bp, Artificial Sequence
  chemically synthesized
tgctgctctgttgcatagagta

SEQ ID NO: 805352 - DNA, 22 bp, Artificial Sequence
  chemically synthesized
ccactgttacgtactctatgca

SEQ ID NO: 805353 - DNA, 22 bp, Artificial Sequence
  chemically synthesized
ctttgctgctctgttgcataga

SEQ ID NO: 805354 - DNA, 22 bp, Artificial Sequence
  chemically synthesized
ttacgtactctatgcaacagag

SEQ ID NO: 805355 - DNA, 22 bp, Artificial Sequence
  chemically synthesized
atctactttgctgctctgttgc

SEQ ID NO: 805356 - DNA, 22 bp, Artificial Sequence
  chemically synthesized
cgtactctatgcaacagagcag

SEQ ID NO: 805357 - DNA, 22 bp, Artificial Sequence
  chemically synthesized
tatgcaacagagcagcaaagta

SEQ ID NO: 805358 - DNA, 22 bp, Artificial Sequence
  chemically synthesized
tgcaacagagcagcaaagtaga

SEQ ID NO: 805359 - DNA, 22 bp, Artificial Sequence
  chemically synthesized
atatgatagttgatctactttg

SEQ ID NO: 805360 - DNA, 22 bp, Artificial Sequence
  chemically synthesized
gatatgatagttgatctacttt

SEQ ID NO: 805361 - DNA, 22 bp, Artificial Sequence
  chemically synthesized
tgatatgatagttgatctactt

SEQ ID NO: 805362 - DNA, 22 bp, Artificial Sequence
  chemically synthesized
ttgatatgatagttgatctact

SEQ ID NO: 805363 - DNA, 22 bp, Artificial Sequence
  chemically synthesized
tttgatatgatagttgatctac

SEQ ID NO: 805364 - DNA, 22 bp, Artificial Sequence
  chemically synthesized
ttttgatatgatagttgatcta

SEQ ID NO: 805365 - DNA, 22 bp, Artificial Sequence
  chemically synthesized
ttttttgatatgatagttgatc

SEQ ID NO: 805366 - DNA, 22 bp, Artificial Sequence
  chemically synthesized
cttttttgatatgatagttgat

SEQ ID NO: 805367 - DNA, 22 bp, Artificial Sequence
  chemically synthesized
tcttttttgatatgatagttga

SEQ ID NO: 805368 - DNA, 22 bp, Artificial Sequence
  chemically synthesized
ttcttttttgatatgatagttg

SEQ ID NO: 805369 - DNA, 22 bp, Artificial Sequence
  chemically synthesized
tttttcttttttgatatgatag

SEQ ID NO: 805370 - DNA, 22 bp, Artificial Sequence
  chemically synthesized
ctgtttttcttttttgatatga

SEQ ID NO: 805371 - DNA, 22 bp, Artificial Sequence
  chemically synthesized
tcctgtttttcttttttgatat

SEQ ID NO: 805372 - DNA, 22 bp, Artificial Sequence
  chemically synthesized
ctcctgtttttcttttttgata

SEQ ID NO: 805373 - DNA, 22 bp, Artificial Sequence
  chemically synthesized
cttctcctgtttttcttttttg

SEQ ID NO: 805374 - DNA, 22 bp, Artificial Sequence
  chemically synthesized
tccttctcctgtttttcttttt

SEQ ID NO: 805375 - DNA, 22 bp, Artificial Sequence
  chemically synthesized
tcatatcaaaaaagaaaaacag

SEQ ID NO: 805376 - DNA, 22 bp, Artificial Sequence
  chemically synthesized
tcgttctccttctcctgttttt

SEQ ID NO: 805377 - DNA, 22 bp, Artificial Sequence
  chemically synthesized
ctatcgttctccttctcctgtt

SEQ ID NO: 805378 - DNA, 22 bp, Artificial Sequence
  chemically synthesized
cctcctatcgttctccttctcc

SEQ ID NO: 805379 - DNA, 22 bp, Artificial Sequence
  chemically synthesized
tccctcctatcgttctccttct

SEQ ID NO: 805380 - DNA, 22 bp, Artificial Sequence
  chemically synthesized
ctctccctcctatcgttctcct

SEQ ID NO: 805381 - DNA, 22 bp, Artificial Sequence
  chemically synthesized
tcctctccctcctatcgttctc

SEQ ID NO: 805382 - DNA, 22 bp, Artificial Sequence
  chemically synthesized
ctcctctccctcctatcgttct

SEQ ID NO: 805383 - DNA, 22 bp, Artificial Sequence
  chemically synthesized
ttctcctctccctcctatcgtt

SEQ ID NO: 805384 - DNA, 22 bp, Artificial Sequence
  chemically synthesized
cagaatcaaatcataataagca

SEQ ID NO: 805385 - DNA, 22 bp, Artificial Sequence
  chemically synthesized
aataattccagaatcaaatcat

SEQ ID NO: 805386 - DNA, 22 bp, Artificial Sequence
  chemically synthesized
gaataattccagaatcaaatca

SEQ ID NO: 805387 - DNA, 22 bp, Artificial Sequence
  chemically synthesized
ctgcttattatgatttgattct

SEQ ID NO: 805388 - DNA, 22 bp, Artificial Sequence
  chemically synthesized
tgcttattatgatttgattctg

SEQ ID NO: 805389 - DNA, 22 bp, Artificial Sequence
  chemically synthesized
gtttgaataattccagaatcaa

SEQ ID NO: 805390 - DNA, 22 bp, Artificial Sequence
  chemically synthesized
cttattatgatttgattctgga

SEQ ID NO: 805391 - DNA, 22 bp, Artificial Sequence
  chemically synthesized
tagtttgaataattccagaatc

SEQ ID NO: 805392 - DNA, 22 bp, Artificial Sequence
  chemically synthesized
attatgatttgattctggaatt

SEQ ID NO: 805393 - DNA, 22 bp, Artificial Sequence
  chemically synthesized
ttatgatttgattctggaatta

SEQ ID NO: 805394 - DNA, 22 bp, Artificial Sequence
  chemically synthesized
tgatttgattctggaattattc

SEQ ID NO: 805395 - DNA, 22 bp, Artificial Sequence
  chemically synthesized
gattctggaattattcaaacta

SEQ ID NO: 805396 - DNA, 22 bp, Artificial Sequence
  chemically synthesized
attctggaattattcaaactag

SEQ ID NO: 805397 - DNA, 22 bp, Artificial Sequence
  chemically synthesized
tgaaaagtatattctagtttga

SEQ ID NO: 805398 - DNA, 22 bp, Artificial Sequence
  chemically synthesized
tggaattattcaaactagaata

SEQ ID NO: 805399 - DNA, 22 bp, Artificial Sequence
  chemically synthesized
ttatgaaaagtatattctagtt

SEQ ID NO: 805400 - DNA, 22 bp, Artificial Sequence
  chemically synthesized
gaattattcaaactagaatata

SEQ ID NO: 805401 - DNA, 22 bp, Artificial Sequence
  chemically synthesized
aactattatgaaaagtatattc

SEQ ID NO: 805402 - DNA, 22 bp, Artificial Sequence
  chemically synthesized
aaactattatgaaaagtatatt

SEQ ID NO: 805403 - DNA, 22 bp, Artificial Sequence
  chemically synthesized
taaactattatgaaaagtatat

SEQ ID NO: 805404 - DNA, 22 bp, Artificial Sequence
  chemically synthesized
ttcaaactagaatatacttttc

SEQ ID NO: 805405 - DNA, 22 bp, Artificial Sequence
  chemically synthesized
ttaaactattatgaaaagtata

SEQ ID NO: 805406 - DNA, 22 bp, Artificial Sequence
  chemically synthesized
aaactagaatatacttttcata

SEQ ID NO: 805407 - DNA, 22 bp, Artificial Sequence
  chemically synthesized
tgatatttttaaactattatga

SEQ ID NO: 805408 - DNA, 22 bp, Artificial Sequence
  chemically synthesized
gaatatacttttcataatagtt

SEQ ID NO: 805409 - DNA, 22 bp, Artificial Sequence
  chemically synthesized
ttatgatatttttaaactatta

SEQ ID NO: 805410 - DNA, 22 bp, Artificial Sequence
  chemically synthesized
ttcataatagtttaaaaatatc

SEQ ID NO: 805411 - DNA, 22 bp, Artificial Sequence
  chemically synthesized
tgaaactattatgatattttta

SEQ ID NO: 805412 - DNA, 22 bp, Artificial Sequence
  chemically synthesized
tcataatagtttaaaaatatca

SEQ ID NO: 805413 - DNA, 22 bp, Artificial Sequence
  chemically synthesized
cataatagtttaaaaatatcat

SEQ ID NO: 805414 - DNA, 22 bp, Artificial Sequence
  chemically synthesized
ataatagtttaaaaatatcata

SEQ ID NO: 805415 - DNA, 22 bp, Artificial Sequence
  chemically synthesized
ttatgaaactattatgatattt

SEQ ID NO: 805416 - DNA, 22 bp, Artificial Sequence
  chemically synthesized
aaaaatatcataatagtttcat

SEQ ID NO: 805417 - DNA, 22 bp, Artificial Sequence
  chemically synthesized
tgaaaaactattatgaaactat

SEQ ID NO: 805418 - DNA, 22 bp, Artificial Sequence
  chemically synthesized
aaaatatcataatagtttcata

SEQ ID NO: 805419 - DNA, 22 bp, Artificial Sequence
  chemically synthesized
ttatgaaaaactattatgaaac

SEQ ID NO: 805420 - DNA, 22 bp, Artificial Sequence
  chemically synthesized
aactattatgaaaaactattat

SEQ ID NO: 805421 - DNA, 22 bp, Artificial Sequence
  chemically synthesized
aaactattatgaaaaactatta

SEQ ID NO: 805422 - DNA, 22 bp, Artificial Sequence
  chemically synthesized
taaactattatgaaaaactatt

SEQ ID NO: 805423 - DNA, 22 bp, Artificial Sequence
  chemically synthesized
ttaaactattatgaaaaactat

SEQ ID NO: 805424 - DNA, 22 bp, Artificial Sequence
  chemically synthesized
atatttttaaactattatgaaa

SEQ ID NO: 805425 - DNA, 22 bp, Artificial Sequence
  chemically synthesized
gatatttttaaactattatgaa

SEQ ID NO: 805426 - DNA, 22 bp, Artificial Sequence
  chemically synthesized
cataatagtttttcataatagt

SEQ ID NO: 805427 - DNA, 22 bp, Artificial Sequence
  chemically synthesized
tgatatttttaaactattatga

SEQ ID NO: 805428 - DNA, 22 bp, Artificial Sequence
  chemically synthesized
ataatagtttttcataatagtt

SEQ ID NO: 805429 - DNA, 22 bp, Artificial Sequence
  chemically synthesized
ttgatatttttaaactattatg

SEQ ID NO: 805430 - DNA, 22 bp, Artificial Sequence
  chemically synthesized
tttgatatttttaaactattat

SEQ ID NO: 805431 - DNA, 22 bp, Artificial Sequence
  chemically synthesized
ttttttgatatttttaaactat

SEQ ID NO: 805432 - DNA, 22 bp, Artificial Sequence
  chemically synthesized
attttttgatatttttaaacta

SEQ ID NO: 805433 - DNA, 22 bp, Artificial Sequence
  chemically synthesized
tattttttgatatttttaaact

SEQ ID NO: 805434 - DNA, 22 bp, Artificial Sequence
  chemically synthesized
ttcataatagtttaaaaatatc

SEQ ID NO: 805435 - DNA, 22 bp, Artificial Sequence
  chemically synthesized
actttattttttgatattttta

SEQ ID NO: 805436 - DNA, 22 bp, Artificial Sequence
  chemically synthesized
tcataatagtttaaaaatatca

SEQ ID NO: 805437 - DNA, 22 bp, Artificial Sequence
  chemically synthesized
cataatagtttaaaaatatcaa

SEQ ID NO: 805438 - DNA, 22 bp, Artificial Sequence
  chemically synthesized
ataatagtttaaaaatatcaaa

SEQ ID NO: 805439 - DNA, 22 bp, Artificial Sequence
  chemically synthesized
gactaactttattttttgatat

SEQ ID NO: 805440 - DNA, 22 bp, Artificial Sequence
  chemically synthesized
agactaactttattttttgata

SEQ ID NO: 805441 - DNA, 22 bp, Artificial Sequence
  chemically synthesized
tagactaactttattttttgat

SEQ ID NO: 805442 - DNA, 22 bp, Artificial Sequence
  chemically synthesized
ttagactaactttattttttga

SEQ ID NO: 805443 - DNA, 22 bp, Artificial Sequence
  chemically synthesized
tttagactaactttattttttg

SEQ ID NO: 805444 - DNA, 22 bp, Artificial Sequence
  chemically synthesized
aaaaatatcaaaaaataaagtt

SEQ ID NO: 805445 - DNA, 22 bp, Artificial Sequence
  chemically synthesized
attttttagactaactttattt

SEQ ID NO: 805446 - DNA, 22 bp, Artificial Sequence
  chemically synthesized
aaaatatcaaaaaataaagtta

SEQ ID NO: 805447 - DNA, 22 bp, Artificial Sequence
  chemically synthesized
taataagatgattgatttttta

SEQ ID NO: 805448 - DNA, 22 bp, Artificial Sequence
  chemically synthesized
gtctaaaaaatcaatcatctta

SEQ ID NO: 805449 - DNA, 22 bp, Artificial Sequence
  chemically synthesized
aaaaatcaatcatcttattata

SEQ ID NO: 805450 - DNA, 22 bp, Artificial Sequence
  chemically synthesized
gatataaatcattataataaga

SEQ ID NO: 805451 - DNA, 22 bp, Artificial Sequence
  chemically synthesized
ggatataaatcattataataag

SEQ ID NO: 805452 - DNA, 22 bp, Artificial Sequence
  chemically synthesized
aaatacaatttggatataaatc

SEQ ID NO: 805453 - DNA, 22 bp, Artificial Sequence
  chemically synthesized
tcaaatacaatttggatataaa

SEQ ID NO: 805454 - DNA, 22 bp, Artificial Sequence
  chemically synthesized
attataatgatttatatccaaa

SEQ ID NO: 805455 - DNA, 22 bp, Artificial Sequence
  chemically synthesized
ttataatgatttatatccaaat

SEQ ID NO: 805456 - DNA, 22 bp, Artificial Sequence
  chemically synthesized
gtctctcaaatacaatttggat

SEQ ID NO: 805457 - DNA, 22 bp, Artificial Sequence
  chemically synthesized
taatgatttatatccaaattgt

SEQ ID NO: 805458 - DNA, 22 bp, Artificial Sequence
  chemically synthesized
ctagtctctcaaatacaatttg

SEQ ID NO: 805459 - DNA, 22 bp, Artificial Sequence
  chemically synthesized
actagtctctcaaatacaattt

SEQ ID NO: 805460 - DNA, 22 bp, Artificial Sequence
  chemically synthesized
tactagtctctcaaatacaatt

SEQ ID NO: 805461 - DNA, 22 bp, Artificial Sequence
  chemically synthesized
atatccaaattgtatttgagag

SEQ ID NO: 805462 - DNA, 22 bp, Artificial Sequence
  chemically synthesized
tatccaaattgtatttgagaga

SEQ ID NO: 805463 - DNA, 22 bp, Artificial Sequence
  chemically synthesized
atataataactttactagtctc

SEQ ID NO: 805464 - DNA, 22 bp, Artificial Sequence
  chemically synthesized
gatataataactttactagtct

SEQ ID NO: 805465 - DNA, 22 bp, Artificial Sequence
  chemically synthesized
tatttgagagactagtaaagtt

SEQ ID NO: 805466 - DNA, 22 bp, Artificial Sequence
  chemically synthesized
acttgatataataactttacta

SEQ ID NO: 805467 - DNA, 22 bp, Artificial Sequence
  chemically synthesized
tgacttgatataataactttac

SEQ ID NO: 805468 - DNA, 22 bp, Artificial Sequence
  chemically synthesized
ctgacttgatataataacttta

SEQ ID NO: 805469 - DNA, 22 bp, Artificial Sequence
  chemically synthesized
tctgacttgatataataacttt

SEQ ID NO: 805470 - DNA, 22 bp, Artificial Sequence
  chemically synthesized
gagagactagtaaagttattat

SEQ ID NO: 805471 - DNA, 22 bp, Artificial Sequence
  chemically synthesized
ttctgacttgatataataactt

SEQ ID NO: 805472 - DNA, 22 bp, Artificial Sequence
  chemically synthesized
agagactagtaaagttattata

SEQ ID NO: 805473 - DNA, 22 bp, Artificial Sequence
  chemically synthesized
gtttttctgacttgatataata

SEQ ID NO: 805474 - DNA, 22 bp, Artificial Sequence
  chemically synthesized
gtaaagttattatatcaagtca

SEQ ID NO: 805475 - DNA, 22 bp, Artificial Sequence
  chemically synthesized
tgtatagttggtttttctgact

SEQ ID NO: 805476 - DNA, 22 bp, Artificial Sequence
  chemically synthesized
ttatgtatagttggtttttctg

SEQ ID NO: 805477 - DNA, 22 bp, Artificial Sequence
  chemically synthesized
ttatatcaagtcagaaaaacca

SEQ ID NO: 805478 - DNA, 22 bp, Artificial Sequence
  chemically synthesized
gttatgtatagttggtttttct

SEQ ID NO: 805479 - DNA, 22 bp, Artificial Sequence
  chemically synthesized
tgttatgtatagttggtttttc

SEQ ID NO: 805480 - DNA, 22 bp, Artificial Sequence
  chemically synthesized
tatcaagtcagaaaaaccaact

SEQ ID NO: 805481 - DNA, 22 bp, Artificial Sequence
  chemically synthesized
tggagttttgttatgtatagtt

SEQ ID NO: 805482 - DNA, 22 bp, Artificial Sequence
  chemically synthesized
ttatggagttttgttatgtata

SEQ ID NO: 805483 - DNA, 22 bp, Artificial Sequence
  chemically synthesized
aactattatggagttttgttat

SEQ ID NO: 805484 - DNA, 22 bp, Artificial Sequence
  chemically synthesized
ctgaactattatggagttttgt

SEQ ID NO: 805485 - DNA, 22 bp, Artificial Sequence
  chemically synthesized
cctgaactattatggagttttg

SEQ ID NO: 805486 - DNA, 22 bp, Artificial Sequence
  chemically synthesized
tcctgaactattatggagtttt

SEQ ID NO: 805487 - DNA, 22 bp, Artificial Sequence
  chemically synthesized
tacataacaaaactccataata

SEQ ID NO: 805488 - DNA, 22 bp, Artificial Sequence
  chemically synthesized
atataattttcctgaactatta

SEQ ID NO: 805489 - DNA, 22 bp, Artificial Sequence
  chemically synthesized
aatacctgatataattttcctg

SEQ ID NO: 805490 - DNA, 22 bp, Artificial Sequence
  chemically synthesized
cataatagttcaggaaaattat

SEQ ID NO: 805491 - DNA, 22 bp, Artificial Sequence
  chemically synthesized
tcaatacctgatataattttcc

SEQ ID NO: 805492 - DNA, 22 bp, Artificial Sequence
  chemically synthesized
ttctcaatacctgatataattt

SEQ ID NO: 805493 - DNA, 22 bp, Artificial Sequence
  chemically synthesized
attctcaatacctgatataatt

SEQ ID NO: 805494 - DNA, 22 bp, Artificial Sequence
  chemically synthesized
aagtttattctcaatacctgat

SEQ ID NO: 805495 - DNA, 22 bp, Artificial Sequence
  chemically synthesized
aggaaaattatatcaggtattg

SEQ ID NO: 805496 - DNA, 22 bp, Artificial Sequence
  chemically synthesized
aaagtttattctcaatacctga

SEQ ID NO: 805497 - DNA, 22 bp, Artificial Sequence
  chemically synthesized
ttaaagtttattctcaatacct

SEQ ID NO: 805498 - DNA, 22 bp, Artificial Sequence
  chemically synthesized
tatcaggtattgagaataaact

SEQ ID NO: 805499 - DNA, 22 bp, Artificial Sequence
  chemically synthesized
tagtacaaggaggctcttaaag

SEQ ID NO: 805500 - DNA, 22 bp, Artificial Sequence
  chemically synthesized
tgtagtacaaggaggctcttaa

SEQ ID NO: 805501 - DNA, 22 bp, Artificial Sequence
  chemically synthesized
agaataaactttaagagcctcc

SEQ ID NO: 805502 - DNA, 22 bp, Artificial Sequence
  chemically synthesized
taagagcctccttgtactacag

SEQ ID NO: 805503 - DNA, 22 bp, Artificial Sequence
  chemically synthesized
aagagcctccttgtactacaga

SEQ ID NO: 805504 - DNA, 22 bp, Artificial Sequence
  chemically synthesized
agagcctccttgtactacagaa

SEQ ID NO: 805505 - DNA, 22 bp, Artificial Sequence
  chemically synthesized
gtgagaatcatattctgtagta

SEQ ID NO: 805506 - DNA, 22 bp, Artificial Sequence
  chemically synthesized
ggtgagaatcatattctgtagt

SEQ ID NO: 805507 - DNA, 22 bp, Artificial Sequence
  chemically synthesized
cttgtactacagaatatgattc

SEQ ID NO: 805508 - DNA, 22 bp, Artificial Sequence
  chemically synthesized
gtactacagaatatgattctca

SEQ ID NO: 805509 - DNA, 22 bp, Artificial Sequence
  chemically synthesized
tactacagaatatgattctcac

SEQ ID NO: 805510 - DNA, 22 bp, Artificial Sequence
  chemically synthesized
aatgaagtcttggtgagaatca

SEQ ID NO: 805511 - DNA, 22 bp, Artificial Sequence
  chemically synthesized
aaatgaagtcttggtgagaatc

SEQ ID NO: 805512 - DNA, 22 bp, Artificial Sequence
  chemically synthesized
tttaaatgaagtcttggtgaga

SEQ ID NO: 805513 - DNA, 22 bp, Artificial Sequence
  chemically synthesized
cagaatatgattctcaccaaga

SEQ ID NO: 805514 - DNA, 22 bp, Artificial Sequence
  chemically synthesized
gtttaaatgaagtcttggtgag

SEQ ID NO: 805515 - DNA, 22 bp, Artificial Sequence
  chemically synthesized
tgtttaaatgaagtcttggtga

SEQ ID NO: 805516 - DNA, 22 bp, Artificial Sequence
  chemically synthesized
tcaccaagacttcatttaaaca

SEQ ID NO: 805517 - DNA, 22 bp, Artificial Sequence
  chemically synthesized
accaagacttcatttaaacaaa

SEQ ID NO: 805518 - DNA, 22 bp, Artificial Sequence
  chemically synthesized
catttaaacaaaactaccccac

SEQ ID NO: 805519 - DNA, 22 bp, Artificial Sequence
  chemically synthesized
atttaaacaaaactaccccacg

SEQ ID NO: 805520 - DNA, 22 bp, Artificial Sequence
  chemically synthesized
aaacaaaactaccccacgttct

SEQ ID NO: 805521 - DNA, 22 bp, Artificial Sequence
  chemically synthesized
aacaaaactaccccacgttctg

SEQ ID NO: 805522 - DNA, 22 bp, Artificial Sequence
  chemically synthesized
catatgcataaacagtgaaaac

SEQ ID NO: 805523 - DNA, 22 bp, Artificial Sequence
  chemically synthesized
ccccacgttctgttttcactgt

SEQ ID NO: 805524 - DNA, 22 bp, Artificial Sequence
  chemically synthesized
cataaagttccatatgcataaa

SEQ ID NO: 805525 - DNA, 22 bp, Artificial Sequence
  chemically synthesized
tgttttcactgtttatgcatat

SEQ ID NO: 805526 - DNA, 22 bp, Artificial Sequence
  chemically synthesized
ccataaagttccatatgcataa

SEQ ID NO: 805527 - DNA, 22 bp, Artificial Sequence
  chemically synthesized
ttttcactgtttatgcatatgg

SEQ ID NO: 805528 - DNA, 22 bp, Artificial Sequence
  chemically synthesized
tttccataaagttccatatgca

SEQ ID NO: 805529 - DNA, 22 bp, Artificial Sequence
  chemically synthesized
tcactgtttatgcatatggaac

SEQ ID NO: 805530 - DNA, 22 bp, Artificial Sequence
  chemically synthesized
cactgtttatgcatatggaact

SEQ ID NO: 805531 - DNA, 22 bp, Artificial Sequence
  chemically synthesized
actgtttatgcatatggaactt

SEQ ID NO: 805532 - DNA, 22 bp, Artificial Sequence
  chemically synthesized
tttatgcatatggaactttatg

SEQ ID NO: 805533 - DNA, 22 bp, Artificial Sequence
  chemically synthesized
atgcatatggaactttatggaa

SEQ ID NO: 805534 - DNA, 22 bp, Artificial Sequence
  chemically synthesized
tgcatatggaactttatggaaa

SEQ ID NO: 805535 - DNA, 22 bp, Artificial Sequence
  chemically synthesized
gaaacaaaaattatttccataa

SEQ ID NO: 805536 - DNA, 22 bp, Artificial Sequence
  chemically synthesized
ctagaaacaaaaattatttcca

SEQ ID NO: 805537 - DNA, 22 bp, Artificial Sequence
  chemically synthesized
cctagaaacaaaaattatttcc

SEQ ID NO: 805538 - DNA, 22 bp, Artificial Sequence
  chemically synthesized
tcctagaaacaaaaattatttc

SEQ ID NO: 805539 - DNA, 22 bp, Artificial Sequence
  chemically synthesized
ttcctagaaacaaaaattattt

SEQ ID NO: 805540 - DNA, 22 bp, Artificial Sequence
  chemically synthesized
tttttcctagaaacaaaaatta

SEQ ID NO: 805541 - DNA, 22 bp, Artificial Sequence
  chemically synthesized
tatggaaataatttttgtttct

SEQ ID NO: 805542 - DNA, 22 bp, Artificial Sequence
  chemically synthesized
atggaaataatttttgtttcta

SEQ ID NO: 805543 - DNA, 22 bp, Artificial Sequence
  chemically synthesized
tggaaataatttttgtttctag

SEQ ID NO: 805544 - DNA, 22 bp, Artificial Sequence
  chemically synthesized
agacaattgtttttcctagaaa

SEQ ID NO: 805545 - DNA, 22 bp, Artificial Sequence
  chemically synthesized
cagacaattgtttttcctagaa

SEQ ID NO: 805546 - DNA, 22 bp, Artificial Sequence
  chemically synthesized
tcagacaattgtttttcctaga

SEQ ID NO: 805547 - DNA, 22 bp, Artificial Sequence
  chemically synthesized
ttgtttctaggaaaaacaattg

SEQ ID NO: 805548 - DNA, 22 bp, Artificial Sequence
  chemically synthesized
tgtttctaggaaaaacaattgt

SEQ ID NO: 805549 - DNA, 22 bp, Artificial Sequence
  chemically synthesized
gtttctaggaaaaacaattgtc

SEQ ID NO: 805550 - DNA, 22 bp, Artificial Sequence
  chemically synthesized
tttctaggaaaaacaattgtct

SEQ ID NO: 805551 - DNA, 22 bp, Artificial Sequence
  chemically synthesized
ctaggaaaaacaattgtctgaa

SEQ ID NO: 805552 - DNA, 22 bp, Artificial Sequence
  chemically synthesized
taggaaaaacaattgtctgaaa

SEQ ID NO: 805553 - DNA, 22 bp, Artificial Sequence
  chemically synthesized
atgatcaaacaattttcagaca

SEQ ID NO: 805554 - DNA, 22 bp, Artificial Sequence
  chemically synthesized
ggaaaaacaattgtctgaaaat

SEQ ID NO: 805555 - DNA, 22 bp, Artificial Sequence
  chemically synthesized
tcgtagttaatgatcaaacaat

SEQ ID NO: 805556 - DNA, 22 bp, Artificial Sequence
  chemically synthesized
gtcgtagttaatgatcaaacaa

SEQ ID NO: 805557 - DNA, 22 bp, Artificial Sequence
  chemically synthesized
tctgaaaattgtttgatcatta

SEQ ID NO: 805558 - DNA, 22 bp, Artificial Sequence
  chemically synthesized
aatttgtcgtagttaatgatca

SEQ ID NO: 805559 - DNA, 22 bp, Artificial Sequence
  chemically synthesized
aaaattgtttgatcattaacta

SEQ ID NO: 805560 - DNA, 22 bp, Artificial Sequence
  chemically synthesized
tttgatcattaactacgacaaa

SEQ ID NO: 805561 - DNA, 22 bp, Artificial Sequence
  chemically synthesized
gatcattaactacgacaaattc

SEQ ID NO: 805562 - DNA, 22 bp, Artificial Sequence
  chemically synthesized
atcattaactacgacaaattca

SEQ ID NO: 805563 - DNA, 22 bp, Artificial Sequence
  chemically synthesized
actacgacaaattcagccatct

SEQ ID NO: 805564 - DNA, 22 bp, Artificial Sequence
  chemically synthesized
tgaaaataagaatgagatggct

SEQ ID NO: 805565 - DNA, 22 bp, Artificial Sequence
  chemically synthesized
cgacaaattcagccatctcatt

SEQ ID NO: 805566 - DNA, 22 bp, Artificial Sequence
  chemically synthesized
acatgatctgtgaaaataagaa

SEQ ID NO: 805567 - DNA, 22 bp, Artificial Sequence
  chemically synthesized
agccatctcattcttattttca

SEQ ID NO: 805568 - DNA, 22 bp, Artificial Sequence
  chemically synthesized
ctaacatgatctgtgaaaataa

SEQ ID NO: 805569 - DNA, 22 bp, Artificial Sequence
  chemically synthesized
cctaacatgatctgtgaaaata

SEQ ID NO: 805570 - DNA, 22 bp, Artificial Sequence
  chemically synthesized
ttcctaacatgatctgtgaaaa

SEQ ID NO: 805571 - DNA, 22 bp, Artificial Sequence
  chemically synthesized
cttcctaacatgatctgtgaaa

SEQ ID NO: 805572 - DNA, 22 bp, Artificial Sequence
  chemically synthesized
tcttcctaacatgatctgtgaa

SEQ ID NO: 805573 - DNA, 22 bp, Artificial Sequence
  chemically synthesized
attcttattttcacagatcatg

SEQ ID NO: 805574 - DNA, 22 bp, Artificial Sequence
  chemically synthesized
tagctttcttcctaacatgatc

SEQ ID NO: 805575 - DNA, 22 bp, Artificial Sequence
  chemically synthesized
ttattttcacagatcatgttag

SEQ ID NO: 805576 - DNA, 22 bp, Artificial Sequence
  chemically synthesized
gtagctttcttcctaacatgat

SEQ ID NO: 805577 - DNA, 22 bp, Artificial Sequence
  chemically synthesized
tgtagctttcttcctaacatga

SEQ ID NO: 805578 - DNA, 22 bp, Artificial Sequence
  chemically synthesized
attttcacagatcatgttagga

SEQ ID NO: 805579 - DNA, 22 bp, Artificial Sequence
  chemically synthesized
ttttcacagatcatgttaggaa

SEQ ID NO: 805580 - DNA, 22 bp, Artificial Sequence
  chemically synthesized
tcacagatcatgttaggaagaa

SEQ ID NO: 805581 - DNA, 22 bp, Artificial Sequence
  chemically synthesized
cacagatcatgttaggaagaaa

SEQ ID NO: 805582 - DNA, 22 bp, Artificial Sequence
  chemically synthesized
gcattttgtagctttcttccta

SEQ ID NO: 805583 - DNA, 22 bp, Artificial Sequence
  chemically synthesized
acagatcatgttaggaagaaag

SEQ ID NO: 805584 - DNA, 22 bp, Artificial Sequence
  chemically synthesized
atctggcattttgtagctttct

SEQ ID NO: 805585 - DNA, 22 bp, Artificial Sequence
  chemically synthesized
aaatgttaatctggcattttgt

SEQ ID NO: 805586 - DNA, 22 bp, Artificial Sequence
  chemically synthesized
ggaagaaagctacaaaatgcca

SEQ ID NO: 805587 - DNA, 22 bp, Artificial Sequence
  chemically synthesized
gaaatgttaatctggcattttg

SEQ ID NO: 805588 - DNA, 22 bp, Artificial Sequence
  chemically synthesized
tgaaatgttaatctggcatttt

SEQ ID NO: 805589 - DNA, 22 bp, Artificial Sequence
  chemically synthesized
aaatatgttttgaaatgttaat

SEQ ID NO: 805590 - DNA, 22 bp, Artificial Sequence
  chemically synthesized
caaaatgccagattaacatttc

SEQ ID NO: 805591 - DNA, 22 bp, Artificial Sequence
  chemically synthesized
caaatatgttttgaaatgttaa

SEQ ID NO: 805592 - DNA, 22 bp, Artificial Sequence
  chemically synthesized
tcaaatatgttttgaaatgtta

SEQ ID NO: 805593 - DNA, 22 bp, Artificial Sequence
  chemically synthesized
ctttcaaatatgttttgaaatg

SEQ ID NO: 805594 - DNA, 22 bp, Artificial Sequence
  chemically synthesized
attactttcaaatatgttttga

SEQ ID NO: 805595 - DNA, 22 bp, Artificial Sequence
  chemically synthesized
cattactttcaaatatgttttg

SEQ ID NO: 805596 - DNA, 22 bp, Artificial Sequence
  chemically synthesized
ccttcattactttcaaatatgt

SEQ ID NO: 805597 - DNA, 22 bp, Artificial Sequence
  chemically synthesized
cccttcattactttcaaatatg

SEQ ID NO: 805598 - DNA, 22 bp, Artificial Sequence
  chemically synthesized
acatttcaaaacatatttgaaa

SEQ ID NO: 805599 - DNA, 22 bp, Artificial Sequence
  chemically synthesized
caaaacatatttgaaagtaatg

SEQ ID NO: 805600 - DNA, 22 bp, Artificial Sequence
  chemically synthesized
aaaacatatttgaaagtaatga

SEQ ID NO: 805601 - DNA, 22 bp, Artificial Sequence
  chemically synthesized
aatcagtttcccttcattactt

SEQ ID NO: 805602 - DNA, 22 bp, Artificial Sequence
  chemically synthesized
actgaatcagtttcccttcatt

SEQ ID NO: 805603 - DNA, 22 bp, Artificial Sequence
  chemically synthesized
ctaactgaatcagtttcccttc

SEQ ID NO: 805604 - DNA, 22 bp, Artificial Sequence
  chemically synthesized
gaaagtaatgaagggaaactga

SEQ ID NO: 805605 - DNA, 22 bp, Artificial Sequence
  chemically synthesized
aaagtaatgaagggaaactgat

SEQ ID NO: 805606 - DNA, 22 bp, Artificial Sequence
  chemically synthesized
gcgttgctaactgaatcagttt

SEQ ID NO: 805607 - DNA, 22 bp, Artificial Sequence
  chemically synthesized
agcgttgctaactgaatcagtt

SEQ ID NO: 805608 - DNA, 22 bp, Artificial Sequence
  chemically synthesized
tttagcgttgctaactgaatca

SEQ ID NO: 805609 - DNA, 22 bp, Artificial Sequence
  chemically synthesized
atttagcgttgctaactgaatc

SEQ ID NO: 805610 - DNA, 22 bp, Artificial Sequence
  chemically synthesized
tatttagcgttgctaactgaat

SEQ ID NO: 805611 - DNA, 22 bp, Artificial Sequence
  chemically synthesized
ttttatttagcgttgctaactg

SEQ ID NO: 805612 - DNA, 22 bp, Artificial Sequence
  chemically synthesized
tctgttttatttagcgttgcta

SEQ ID NO: 805613 - DNA, 22 bp, Artificial Sequence
  chemically synthesized
attcagttagcaacgctaaata

SEQ ID NO: 805614 - DNA, 22 bp, Artificial Sequence
  chemically synthesized
agttagcaacgctaaataaaac

SEQ ID NO: 805615 - DNA, 22 bp, Artificial Sequence
  chemically synthesized
tatgaattgtctgttttattta

SEQ ID NO: 805616 - DNA, 22 bp, Artificial Sequence
  chemically synthesized
gcaacgctaaataaaacagaca

SEQ ID NO: 805617 - DNA, 22 bp, Artificial Sequence
  chemically synthesized
aataaaacagacaattcataca

SEQ ID NO: 805618 - DNA, 22 bp, Artificial Sequence
  chemically synthesized
cagggaaagcatctgtatgaat

SEQ ID NO: 805619 - DNA, 22 bp, Artificial Sequence
  chemically synthesized
acagggaaagcatctgtatgaa

SEQ ID NO: 805620 - DNA, 22 bp, Artificial Sequence
  chemically synthesized
tacagggaaagcatctgtatga

SEQ ID NO: 805621 - DNA, 22 bp, Artificial Sequence
  chemically synthesized
atattttacagggaaagcatct

SEQ ID NO: 805622 - DNA, 22 bp, Artificial Sequence
  chemically synthesized
aatattttacagggaaagcatc

SEQ ID NO: 805623 - DNA, 22 bp, Artificial Sequence
  chemically synthesized
tttaatattttacagggaaagc

SEQ ID NO: 805624 - DNA, 22 bp, Artificial Sequence
  chemically synthesized
atttaatattttacagggaaag

SEQ ID NO: 805625 - DNA, 22 bp, Artificial Sequence
  chemically synthesized
atacagatgctttccctgtaaa

SEQ ID NO: 805626 - DNA, 22 bp, Artificial Sequence
  chemically synthesized
agtgtttatttaatattttaca

SEQ ID NO: 805627 - DNA, 22 bp, Artificial Sequence
  chemically synthesized
gagtgtttatttaatattttac

SEQ ID NO: 805628 - DNA, 22 bp, Artificial Sequence
  chemically synthesized
tgagtgtttatttaatatttta

SEQ ID NO: 805629 - DNA, 22 bp, Artificial Sequence
  chemically synthesized
ttgagtgtttatttaatatttt

SEQ ID NO: 805630 - DNA, 22 bp, Artificial Sequence
  chemically synthesized
tccctgtaaaatattaaataaa

SEQ ID NO: 805631 - DNA, 22 bp, Artificial Sequence
  chemically synthesized
ccctgtaaaatattaaataaac

SEQ ID NO: 805632 - DNA, 22 bp, Artificial Sequence
  chemically synthesized
acatttttgagtgtttatttaa

SEQ ID NO: 805633 - DNA, 22 bp, Artificial Sequence
  chemically synthesized
cctgtaaaatattaaataaaca

SEQ ID NO: 805634 - DNA, 22 bp, Artificial Sequence
  chemically synthesized
taaaatattaaataaacactca

SEQ ID NO: 805635 - DNA, 22 bp, Artificial Sequence
  chemically synthesized
aaagttgacatttttgagtgtt

SEQ ID NO: 805636 - DNA, 22 bp, Artificial Sequence
  chemically synthesized
aaaagttgacatttttgagtgt

SEQ ID NO: 805637 - DNA, 22 bp, Artificial Sequence
  chemically synthesized
taaaagttgacatttttgagtg

SEQ ID NO: 805638 - DNA, 22 bp, Artificial Sequence
  chemically synthesized
aattttaaaagttgacattttt

SEQ ID NO: 805639 - DNA, 22 bp, Artificial Sequence
  chemically synthesized
aataaacactcaaaaatgtcaa

SEQ ID NO: 805640 - DNA, 22 bp, Artificial Sequence
  chemically synthesized
ttaaattttaaaagttgacatt

SEQ ID NO: 805641 - DNA, 22 bp, Artificial Sequence
  chemically synthesized
attaaattttaaaagttgacat

SEQ ID NO: 805642 - DNA, 22 bp, Artificial Sequence
  chemically synthesized
gtttattaaattttaaaagttg

SEQ ID NO: 805643 - DNA, 22 bp, Artificial Sequence
  chemically synthesized
aaaaatgtcaacttttaaaatt

SEQ ID NO: 805644 - DNA, 22 bp, Artificial Sequence
  chemically synthesized
gggattggtttattaaatttta

SEQ ID NO: 805645 - DNA, 22 bp, Artificial Sequence
  chemically synthesized
agggattggtttattaaatttt

SEQ ID NO: 805646 - DNA, 22 bp, Artificial Sequence
  chemically synthesized
ttaaaatttaataaaccaatcc

SEQ ID NO: 805647 - DNA, 22 bp, Artificial Sequence
  chemically synthesized
taaaatttaataaaccaatccc

SEQ ID NO: 805648 - DNA, 22 bp, Artificial Sequence
  chemically synthesized
aaaatttaataaaccaatccct

SEQ ID NO: 805649 - DNA, 22 bp, Artificial Sequence
  chemically synthesized
aaatttaataaaccaatcccta

SEQ ID NO: 805650 - DNA, 22 bp, Artificial Sequence
  chemically synthesized
agagaaataacttagggattgg

SEQ ID NO: 805651 - DNA, 22 bp, Artificial Sequence
  chemically synthesized
ctcagagaaataacttagggat

SEQ ID NO: 805652 - DNA, 22 bp, Artificial Sequence
  chemically synthesized
gctcagagaaataacttaggga

SEQ ID NO: 805653 - DNA, 22 bp, Artificial Sequence
  chemically synthesized
tgctcagagaaataacttaggg

SEQ ID NO: 805654 - DNA, 22 bp, Artificial Sequence
  chemically synthesized
aataaaccaatccctaagttat

SEQ ID NO: 805655 - DNA, 22 bp, Artificial Sequence
  chemically synthesized
ataaaccaatccctaagttatt

SEQ ID NO: 805656 - DNA, 22 bp, Artificial Sequence
  chemically synthesized
ggtcaaggagaaactttgctca

SEQ ID NO: 805657 - DNA, 22 bp, Artificial Sequence
  chemically synthesized
agttatttctctgagcaaagtt

SEQ ID NO: 805658 - DNA, 22 bp, Artificial Sequence
  chemically synthesized
cggtcaaggagaaactttgctc

SEQ ID NO: 805659 - DNA, 22 bp, Artificial Sequence
  chemically synthesized
tttctctgagcaaagtttctcc

SEQ ID NO: 805660 - DNA, 22 bp, Artificial Sequence
  chemically synthesized
ctctgagcaaagtttctccttg

SEQ ID NO: 805661 - DNA, 22 bp, Artificial Sequence
  chemically synthesized
tctgagcaaagtttctccttga

SEQ ID NO: 805662 - DNA, 22 bp, Artificial Sequence
  chemically synthesized
tgagcaaagtttctccttgacc

SEQ ID NO: 805663 - DNA, 22 bp, Artificial Sequence
  chemically synthesized
agcaaagtttctccttgaccga

SEQ ID NO: 805664 - DNA, 22 bp, Artificial Sequence
  chemically synthesized
catataaaaccagagcttcggt

SEQ ID NO: 805665 - DNA, 22 bp, Artificial Sequence
  chemically synthesized
gcatataaaaccagagcttcgg

SEQ ID NO: 805666 - DNA, 22 bp, Artificial Sequence
  chemically synthesized
ctccttgaccgaagctctggtt

SEQ ID NO: 805667 - DNA, 22 bp, Artificial Sequence
  chemically synthesized
tccttgaccgaagctctggttt

SEQ ID NO: 805668 - DNA, 22 bp, Artificial Sequence
  chemically synthesized
cttgaccgaagctctggtttta

SEQ ID NO: 805669 - DNA, 22 bp, Artificial Sequence
  chemically synthesized
gaccgaagctctggttttatat

SEQ ID NO: 805670 - DNA, 22 bp, Artificial Sequence
  chemically synthesized
accgaagctctggttttatatg

SEQ ID NO: 805671 - DNA, 22 bp, Artificial Sequence
  chemically synthesized
accaggaaaacatttgcatata

SEQ ID NO: 805672 - DNA, 22 bp, Artificial Sequence
  chemically synthesized
tgaccaggaaaacatttgcata

SEQ ID NO: 805673 - DNA, 22 bp, Artificial Sequence
  chemically synthesized
tggttttatatgcaaatgtttt

SEQ ID NO: 805674 - DNA, 22 bp, Artificial Sequence
  chemically synthesized
gttttatatgcaaatgttttcc

SEQ ID NO: 805675 - DNA, 22 bp, Artificial Sequence
  chemically synthesized
tatatgcaaatgttttcctggt

SEQ ID NO: 805676 - DNA, 22 bp, Artificial Sequence
  chemically synthesized
atatgcaaatgttttcctggtc

SEQ ID NO: 805677 - DNA, 22 bp, Artificial Sequence
  chemically synthesized
tatgcaaatgttttcctggtca

SEQ ID NO: 805678 - DNA, 22 bp, Artificial Sequence
  chemically synthesized
gaaaaagtacatgctctgacca

SEQ ID NO: 805679 - DNA, 22 bp, Artificial Sequence
  chemically synthesized
agaaaaagtacatgctctgacc

SEQ ID NO: 805680 - DNA, 22 bp, Artificial Sequence
  chemically synthesized
gtcttagaaaaagtacatgctc

SEQ ID NO: 805681 - DNA, 22 bp, Artificial Sequence
  chemically synthesized
tcctggtcagagcatgtacttt

SEQ ID NO: 805682 - DNA, 22 bp, Artificial Sequence
  chemically synthesized
cctggtcagagcatgtactttt

SEQ ID NO: 805683 - DNA, 22 bp, Artificial Sequence
  chemically synthesized
ctggtcagagcatgtacttttt

SEQ ID NO: 805684 - DNA, 22 bp, Artificial Sequence
  chemically synthesized
gtcagagcatgtactttttcta

SEQ ID NO: 805685 - DNA, 22 bp, Artificial Sequence
  chemically synthesized
acaccctcgtcttagaaaaagt

SEQ ID NO: 805686 - DNA, 22 bp, Artificial Sequence
  chemically synthesized
aacaccctcgtcttagaaaaag

SEQ ID NO: 805687 - DNA, 22 bp, Artificial Sequence
  chemically synthesized
cacttaacaccctcgtcttaga

SEQ ID NO: 805688 - DNA, 22 bp, Artificial Sequence
  chemically synthesized
taattccacttaacaccctcgt

SEQ ID NO: 805689 - DNA, 22 bp, Artificial Sequence
  chemically synthesized
ataattccacttaacaccctcg

SEQ ID NO: 805690 - DNA, 22 bp, Artificial Sequence
  chemically synthesized
tttctaagacgagggtgttaag

SEQ ID NO: 805691 - DNA, 22 bp, Artificial Sequence
  chemically synthesized
ttctaagacgagggtgttaagt

SEQ ID NO: 805692 - DNA, 22 bp, Artificial Sequence
  chemically synthesized
tctaagacgagggtgttaagtg

SEQ ID NO: 805693 - DNA, 22 bp, Artificial Sequence
  chemically synthesized
ctaagacgagggtgttaagtgg

SEQ ID NO: 805694 - DNA, 22 bp, Artificial Sequence
  chemically synthesized
taagacgagggtgttaagtgga

SEQ ID NO: 805695 - DNA, 22 bp, Artificial Sequence
  chemically synthesized
agacgagggtgttaagtggaat

SEQ ID NO: 805696 - DNA, 22 bp, Artificial Sequence
  chemically synthesized
agtggaattataaatgatgttt

SEQ ID NO: 805697 - DNA, 22 bp, Artificial Sequence
  chemically synthesized
taaatgatgtttccttctccct

SEQ ID NO: 805698 - DNA, 22 bp, Artificial Sequence
  chemically synthesized
gacaaggaggagagaggcagag

SEQ ID NO: 805699 - DNA, 22 bp, Artificial Sequence
  chemically synthesized
ggacaaggaggagagaggcaga

SEQ ID NO: 805700 - DNA, 22 bp, Artificial Sequence
  chemically synthesized
ccttctccctctgcctctctcc

SEQ ID NO: 805701 - DNA, 22 bp, Artificial Sequence
  chemically synthesized
cttctccctctgcctctctcct

SEQ ID NO: 805702 - DNA, 22 bp, Artificial Sequence
  chemically synthesized
ctccctctgcctctctcctcct

SEQ ID NO: 805703 - DNA, 22 bp, Artificial Sequence
  chemically synthesized
ggtatttggacaaggaggagag

SEQ ID NO: 805704 - DNA, 22 bp, Artificial Sequence
  chemically synthesized
tccctctgcctctctcctcctt

SEQ ID NO: 805705 - DNA, 22 bp, Artificial Sequence
  chemically synthesized
cggtatttggacaaggaggaga

SEQ ID NO: 805706 - DNA, 22 bp, Artificial Sequence
  chemically synthesized
cctctgcctctctcctccttgt

SEQ ID NO: 805707 - DNA, 22 bp, Artificial Sequence
  chemically synthesized
tgcctctctcctccttgtccaa

SEQ ID NO: 805708 - DNA, 22 bp, Artificial Sequence
  chemically synthesized
cctctctcctccttgtccaaat

SEQ ID NO: 805709 - DNA, 22 bp, Artificial Sequence
  chemically synthesized
atgtatttcggtatttggacaa

SEQ ID NO: 805710 - DNA, 22 bp, Artificial Sequence
  chemically synthesized
tctcctccttgtccaaataccg

SEQ ID NO: 805711 - DNA, 22 bp, Artificial Sequence
  chemically synthesized
tcctccttgtccaaataccgaa

SEQ ID NO: 805712 - DNA, 22 bp, Artificial Sequence
  chemically synthesized
ctccttgtccaaataccgaaat

SEQ ID NO: 805713 - DNA, 22 bp, Artificial Sequence
  chemically synthesized
tacagcctgatgtatttcggta

SEQ ID NO: 805714 - DNA, 22 bp, Artificial Sequence
  chemically synthesized
atacagcctgatgtatttcggt

SEQ ID NO: 805715 - DNA, 22 bp, Artificial Sequence
  chemically synthesized
cttgtccaaataccgaaataca

SEQ ID NO: 805716 - DNA, 22 bp, Artificial Sequence
  chemically synthesized
tatacagcctgatgtatttcgg

SEQ ID NO: 805717 - DNA, 22 bp, Artificial Sequence
  chemically synthesized
ttatacagcctgatgtatttcg

SEQ ID NO: 805718 - DNA, 22 bp, Artificial Sequence
  chemically synthesized
gtccaaataccgaaatacatca

SEQ ID NO: 805719 - DNA, 22 bp, Artificial Sequence
  chemically synthesized
tccaaataccgaaatacatcag

SEQ ID NO: 805720 - DNA, 22 bp, Artificial Sequence
  chemically synthesized
cttttatacagcctgatgtatt

SEQ ID NO: 805721 - DNA, 22 bp, Artificial Sequence
  chemically synthesized
tataaaagcaactattttgttt

SEQ ID NO: 805722 - DNA, 22 bp, Artificial Sequence
  chemically synthesized
acaagccagggacaaaacaaaa

SEQ ID NO: 805723 - DNA, 22 bp, Artificial Sequence
  chemically synthesized
taactgacaagccagggacaaa

SEQ ID NO: 805724 - DNA, 22 bp, Artificial Sequence
  chemically synthesized
gtaactgacaagccagggacaa

SEQ ID NO: 805725 - DNA, 22 bp, Artificial Sequence
  chemically synthesized
ttttgttttgtccctggcttgt

SEQ ID NO: 805726 - DNA, 22 bp, Artificial Sequence
  chemically synthesized
tacttgtaactgacaagccagg

SEQ ID NO: 805727 - DNA, 22 bp, Artificial Sequence
  chemically synthesized
gtacttgtaactgacaagccag

SEQ ID NO: 805728 - DNA, 22 bp, Artificial Sequence
  chemically synthesized
tgttttgtccctggcttgtcag

SEQ ID NO: 805729 - DNA, 22 bp, Artificial Sequence
  chemically synthesized
gttttgtccctggcttgtcagt

SEQ ID NO: 805730 - DNA, 22 bp, Artificial Sequence
  chemically synthesized
ttttgtccctggcttgtcagtt

SEQ ID NO: 805731 - DNA, 22 bp, Artificial Sequence
  chemically synthesized
tgtccctggcttgtcagttaca

SEQ ID NO: 805732 - DNA, 22 bp, Artificial Sequence
  chemically synthesized
agcatttgtacttgtaactgac

SEQ ID NO: 805733 - DNA, 22 bp, Artificial Sequence
  chemically synthesized
gtccctggcttgtcagttacaa

SEQ ID NO: 805734 - DNA, 22 bp, Artificial Sequence
  chemically synthesized
tccctggcttgtcagttacaag

SEQ ID NO: 805735 - DNA, 22 bp, Artificial Sequence
  chemically synthesized
tcagcatttgtacttgtaactg

SEQ ID NO: 805736 - DNA, 22 bp, Artificial Sequence
  chemically synthesized
gcttgtcagttacaagtacaaa

SEQ ID NO: 805737 - DNA, 22 bp, Artificial Sequence
  chemically synthesized
aacaattctcagcatttgtact

SEQ ID NO: 805738 - DNA, 22 bp, Artificial Sequence
  chemically synthesized
gtcagttacaagtacaaatgct

SEQ ID NO: 805739 - DNA, 22 bp, Artificial Sequence
  chemically synthesized
tcagttacaagtacaaatgctg

SEQ ID NO: 805740 - DNA, 22 bp, Artificial Sequence
  chemically synthesized
caagtacaaatgctgagaattg

SEQ ID NO: 805741 - DNA, 22 bp, Artificial Sequence
  chemically synthesized
tggatccaattgaacaattctc

SEQ ID NO: 805742 - DNA, 22 bp, Artificial Sequence
  chemically synthesized
gtggatccaattgaacaattct

SEQ ID NO: 805743 - DNA, 22 bp, Artificial Sequence
  chemically synthesized
ttgtggatccaattgaacaatt

SEQ ID NO: 805744 - DNA, 22 bp, Artificial Sequence
  chemically synthesized
gcactcttgtggatccaattga

SEQ ID NO: 805745 - DNA, 22 bp, Artificial Sequence
  chemically synthesized
agcactcttgtggatccaattg

SEQ ID NO: 805746 - DNA, 22 bp, Artificial Sequence
  chemically synthesized
tagcactcttgtggatccaatt

SEQ ID NO: 805747 - DNA, 22 bp, Artificial Sequence
  chemically synthesized
agaattgttcaattggatccac

SEQ ID NO: 805748 - DNA, 22 bp, Artificial Sequence
  chemically synthesized
cgctttagcactcttgtggatc

SEQ ID NO: 805749 - DNA, 22 bp, Artificial Sequence
  chemically synthesized
ccgctttagcactcttgtggat

SEQ ID NO: 805750 - DNA, 22 bp, Artificial Sequence
  chemically synthesized
ttcaattggatccacaagagtg

SEQ ID NO: 805751 - DNA, 22 bp, Artificial Sequence
  chemically synthesized
aattggatccacaagagtgcta

SEQ ID NO: 805752 - DNA, 22 bp, Artificial Sequence
  chemically synthesized
gatccacaagagtgctaaagcg

SEQ ID NO: 805753 - DNA, 22 bp, Artificial Sequence
  chemically synthesized
aagcggaaatgcctgacttact

SEQ ID NO: 805754 - DNA, 22 bp, Artificial Sequence
  chemically synthesized
atgaaacaatggcaagtaagtc

SEQ ID NO: 805755 - DNA, 22 bp, Artificial Sequence
  chemically synthesized
acttacttgccattgtttcatc

SEQ ID NO: 805756 - DNA, 22 bp, Artificial Sequence
  chemically synthesized
acttgccattgtttcatcagct

SEQ ID NO: 805757 - DNA, 22 bp, Artificial Sequence
  chemically synthesized
cttgccattgtttcatcagctc

SEQ ID NO: 805758 - DNA, 22 bp, Artificial Sequence
  chemically synthesized
caagggagtaaaagagctgatg

SEQ ID NO: 805759 - DNA, 22 bp, Artificial Sequence
  chemically synthesized
gccattgtttcatcagctcttt

SEQ ID NO: 805760 - DNA, 22 bp, Artificial Sequence
  chemically synthesized
ccattgtttcatcagctctttt

SEQ ID NO: 805761 - DNA, 22 bp, Artificial Sequence
  chemically synthesized
gaagactccaagggagtaaaag

SEQ ID NO: 805762 - DNA, 22 bp, Artificial Sequence
  chemically synthesized
tttcatcagctcttttactccc

SEQ ID NO: 805763 - DNA, 22 bp, Artificial Sequence
  chemically synthesized
ctagaagactccaagggagtaa

SEQ ID NO: 805764 - DNA, 22 bp, Artificial Sequence
  chemically synthesized
catcagctcttttactcccttg

SEQ ID NO: 805765 - DNA, 22 bp, Artificial Sequence
  chemically synthesized
atcagctcttttactcccttgg

SEQ ID NO: 805766 - DNA, 22 bp, Artificial Sequence
  chemically synthesized
ttttactcccttggagtcttct

SEQ ID NO: 805767 - DNA, 22 bp, Artificial Sequence
  chemically synthesized
ttactcccttggagtcttctag

SEQ ID NO: 805768 - DNA, 22 bp, Artificial Sequence
  chemically synthesized
tactcccttggagtcttctagg

SEQ ID NO: 805769 - DNA, 22 bp, Artificial Sequence
  chemically synthesized
actcccttggagtcttctagga

SEQ ID NO: 805770 - DNA, 22 bp, Artificial Sequence
  chemically synthesized
ctcccttggagtcttctaggag

SEQ ID NO: 805771 - DNA, 22 bp, Artificial Sequence
  chemically synthesized
cccgtaaggaaaggctcctaga

SEQ ID NO: 805772 - DNA, 22 bp, Artificial Sequence
  chemically synthesized
ccttggagtcttctaggagcct

SEQ ID NO: 805773 - DNA, 22 bp, Artificial Sequence
  chemically synthesized
ggagtcttctaggagcctttcc

SEQ ID NO: 805774 - DNA, 22 bp, Artificial Sequence
  chemically synthesized
gagtcttctaggagcctttcct

SEQ ID NO: 805775 - DNA, 22 bp, Artificial Sequence
  chemically synthesized
caggatgctacccgtaaggaaa

SEQ ID NO: 805776 - DNA, 22 bp, Artificial Sequence
  chemically synthesized
ctaggagcctttccttacgggt

SEQ ID NO: 805777 - DNA, 22 bp, Artificial Sequence
  chemically synthesized
taggagcctttccttacgggta

SEQ ID NO: 805778 - DNA, 22 bp, Artificial Sequence
  chemically synthesized
ggagcctttccttacgggtagc

SEQ ID NO: 805779 - DNA, 22 bp, Artificial Sequence
  chemically synthesized
ccaatgtcctacaggatgctac

SEQ ID NO: 805780 - DNA, 22 bp, Artificial Sequence
  chemically synthesized
tccttacgggtagcatcctgta

SEQ ID NO: 805781 - DNA, 22 bp, Artificial Sequence
  chemically synthesized
ccttacgggtagcatcctgtag

SEQ ID NO: 805782 - DNA, 22 bp, Artificial Sequence
  chemically synthesized
cttacgggtagcatcctgtagg

SEQ ID NO: 805783 - DNA, 22 bp, Artificial Sequence
  chemically synthesized
acgggtagcatcctgtaggaca

SEQ ID NO: 805784 - DNA, 22 bp, Artificial Sequence
  chemically synthesized
cgggtagcatcctgtaggacat

SEQ ID NO: 805785 - DNA, 22 bp, Artificial Sequence
  chemically synthesized
aaacaactgccaatgtcctaca

SEQ ID NO: 805786 - DNA, 22 bp, Artificial Sequence
  chemically synthesized
cagaagctgaaacaactgccaa

SEQ ID NO: 805787 - DNA, 22 bp, Artificial Sequence
  chemically synthesized
acagaagctgaaacaactgcca

SEQ ID NO: 805788 - DNA, 22 bp, Artificial Sequence
  chemically synthesized
taggacattggcagttgtttca

SEQ ID NO: 805789 - DNA, 22 bp, Artificial Sequence
  chemically synthesized
gcttacagaagctgaaacaact

SEQ ID NO: 805790 - DNA, 22 bp, Artificial Sequence
  chemically synthesized
cctggcttacagaagctgaaac

SEQ ID NO: 805791 - DNA, 22 bp, Artificial Sequence
  chemically synthesized
gcctggcttacagaagctgaaa

SEQ ID NO: 805792 - DNA, 22 bp, Artificial Sequence
  chemically synthesized
ttgcctggcttacagaagctga

SEQ ID NO: 805793 - DNA, 22 bp, Artificial Sequence
  chemically synthesized
cttgcctggcttacagaagctg

SEQ ID NO: 805794 - DNA, 22 bp, Artificial Sequence
  chemically synthesized
gcagttgtttcagcttctgtaa

SEQ ID NO: 805795 - DNA, 22 bp, Artificial Sequence
  chemically synthesized
tttcagcttctgtaagccaggc

SEQ ID NO: 805796 - DNA, 22 bp, Artificial Sequence
  chemically synthesized
gaaaagtttcttgcctggctta

SEQ ID NO: 805797 - DNA, 22 bp, Artificial Sequence
  chemically synthesized
cagcttctgtaagccaggcaag

SEQ ID NO: 805798 - DNA, 22 bp, Artificial Sequence
  chemically synthesized
agcttctgtaagccaggcaaga

SEQ ID NO: 805799 - DNA, 22 bp, Artificial Sequence
  chemically synthesized
gacctggaaaagtttcttgcct

SEQ ID NO: 805800 - DNA, 22 bp, Artificial Sequence
  chemically synthesized
ctgtaagccaggcaagaaactt

SEQ ID NO: 805801 - DNA, 22 bp, Artificial Sequence
  chemically synthesized
tgtaagccaggcaagaaacttt

SEQ ID NO: 805802 - DNA, 22 bp, Artificial Sequence
  chemically synthesized
taagccaggcaagaaacttttc

SEQ ID NO: 805803 - DNA, 22 bp, Artificial Sequence
  chemically synthesized
cccctggacctggaaaagtttc

SEQ ID NO: 805804 - DNA, 22 bp, Artificial Sequence
  chemically synthesized
caacagttccccctggacctgg

SEQ ID NO: 805805 - DNA, 22 bp, Artificial Sequence
  chemically synthesized
ctgcaacagttccccctggacc

SEQ ID NO: 805806 - DNA, 22 bp, Artificial Sequence
  chemically synthesized
ttccaggtccagggggaactgt

SEQ ID NO: 805807 - DNA, 22 bp, Artificial Sequence
  chemically synthesized
tccaggtccagggggaactgtt

SEQ ID NO: 805808 - DNA, 22 bp, Artificial Sequence
  chemically synthesized
atagattactgcaacagttccc

SEQ ID NO: 805809 - DNA, 22 bp, Artificial Sequence
  chemically synthesized
ccaggtccagggggaactgttg

SEQ ID NO: 805810 - DNA, 22 bp, Artificial Sequence
  chemically synthesized
caggtccagggggaactgttgc

SEQ ID NO: 805811 - DNA, 22 bp, Artificial Sequence
  chemically synthesized
gaagaaactcatagattactgc

SEQ ID NO: 805812 - DNA, 22 bp, Artificial Sequence
  chemically synthesized
ggaagaaactcatagattactg

SEQ ID NO: 805813 - DNA, 22 bp, Artificial Sequence
  chemically synthesized
tggaagaaactcatagattact

SEQ ID NO: 805814 - DNA, 22 bp, Artificial Sequence
  chemically synthesized
ctttggaagaaactcatagatt

SEQ ID NO: 805815 - DNA, 22 bp, Artificial Sequence
  chemically synthesized
ttgcagtaatctatgagtttct

SEQ ID NO: 805816 - DNA, 22 bp, Artificial Sequence
  chemically synthesized
cagtaatctatgagtttcttcc

SEQ ID NO: 805817 - DNA, 22 bp, Artificial Sequence
  chemically synthesized
tgagtttcttccaaagcagcct

SEQ ID NO: 805818 - DNA, 22 bp, Artificial Sequence
  chemically synthesized
cagggtgagtgagcgagaggct

SEQ ID NO: 805819 - DNA, 22 bp, Artificial Sequence
  chemically synthesized
gcagggtgagtgagcgagaggc

SEQ ID NO: 805820 - DNA, 22 bp, Artificial Sequence
  chemically synthesized
cttccaaagcagcctctcgctc

SEQ ID NO: 805821 - DNA, 22 bp, Artificial Sequence
  chemically synthesized
tgcagggtgagtgagcgagagg

SEQ ID NO: 805822 - DNA, 22 bp, Artificial Sequence
  chemically synthesized
ttccaaagcagcctctcgctca

SEQ ID NO: 805823 - DNA, 22 bp, Artificial Sequence
  chemically synthesized
ccaaagcagcctctcgctcact

SEQ ID NO: 805824 - DNA, 22 bp, Artificial Sequence
  chemically synthesized
caaagcagcctctcgctcactc

SEQ ID NO: 805825 - DNA, 22 bp, Artificial Sequence
  chemically synthesized
gtcctttgcagggtgagtgagc

SEQ ID NO: 805826 - DNA, 22 bp, Artificial Sequence
  chemically synthesized
ggtcctttgcagggtgagtgag

SEQ ID NO: 805827 - DNA, 22 bp, Artificial Sequence
  chemically synthesized
aacatttggtcctttgcagggt

SEQ ID NO: 805828 - DNA, 22 bp, Artificial Sequence
  chemically synthesized
tcgctcactcaccctgcaaagg

SEQ ID NO: 805829 - DNA, 22 bp, Artificial Sequence
  chemically synthesized
gctcactcaccctgcaaaggac

SEQ ID NO: 805830 - DNA, 22 bp, Artificial Sequence
  chemically synthesized
catctgaacatttggtcctttg

SEQ ID NO: 805831 - DNA, 22 bp, Artificial Sequence
  chemically synthesized
actcaccctgcaaaggaccaaa

SEQ ID NO: 805832 - DNA, 22 bp, Artificial Sequence
  chemically synthesized
accctgcaaaggaccaaatgtt

SEQ ID NO: 805833 - DNA, 22 bp, Artificial Sequence
  chemically synthesized
ataattgcatctgaacatttgg

SEQ ID NO: 805834 - DNA, 22 bp, Artificial Sequence
  chemically synthesized
aataattgcatctgaacatttg

SEQ ID NO: 805835 - DNA, 22 bp, Artificial Sequence
  chemically synthesized
caaaggaccaaatgttcagatg

SEQ ID NO: 805836 - DNA, 22 bp, Artificial Sequence
  chemically synthesized
atatttaataattgcatctgaa

SEQ ID NO: 805837 - DNA, 22 bp, Artificial Sequence
  chemically synthesized
tgatatttaataattgcatctg

SEQ ID NO: 805838 - DNA, 22 bp, Artificial Sequence
  chemically synthesized
ggtgcaccattctgatatttaa

SEQ ID NO: 805839 - DNA, 22 bp, Artificial Sequence
  chemically synthesized
agatgcaattattaaatatcag

SEQ ID NO: 805840 - DNA, 22 bp, Artificial Sequence
  chemically synthesized
actaggtgcaccattctgatat

SEQ ID NO: 805841 - DNA, 22 bp, Artificial Sequence
  chemically synthesized
ttaaatatcagaatggtgcacc

SEQ ID NO: 805842 - DNA, 22 bp, Artificial Sequence
  chemically synthesized
tggagttcactaggtgcaccat

SEQ ID NO: 805843 - DNA, 22 bp, Artificial Sequence
  chemically synthesized
atggagttcactaggtgcacca

SEQ ID NO: 805844 - DNA, 22 bp, Artificial Sequence
  chemically synthesized
tatggagttcactaggtgcacc

SEQ ID NO: 805845 - DNA, 22 bp, Artificial Sequence
  chemically synthesized
aatatcagaatggtgcacctag

SEQ ID NO: 805846 - DNA, 22 bp, Artificial Sequence
  chemically synthesized
ttatggagttcactaggtgcac

SEQ ID NO: 805847 - DNA, 22 bp, Artificial Sequence
  chemically synthesized
tttatggagttcactaggtgca

SEQ ID NO: 805848 - DNA, 22 bp, Artificial Sequence
  chemically synthesized
tttttatggagttcactaggtg

SEQ ID NO: 805849 - DNA, 22 bp, Artificial Sequence
  chemically synthesized
tctttttatggagttcactagg

SEQ ID NO: 805850 - DNA, 22 bp, Artificial Sequence
  chemically synthesized
ctctttttatggagttcactag

SEQ ID NO: 805851 - DNA, 22 bp, Artificial Sequence
  chemically synthesized
tctctttttatggagttcacta

SEQ ID NO: 805852 - DNA, 22 bp, Artificial Sequence
  chemically synthesized
catctttctctttttatggagt

SEQ ID NO: 805853 - DNA, 22 bp, Artificial Sequence
  chemically synthesized
ctccatctttctctttttatgg

SEQ ID NO: 805854 - DNA, 22 bp, Artificial Sequence
  chemically synthesized
gttcctccatctttctcttttt

SEQ ID NO: 805855 - DNA, 22 bp, Artificial Sequence
  chemically synthesized
gtgaactccataaaaagagaaa

SEQ ID NO: 805856 - DNA, 22 bp, Artificial Sequence
  chemically synthesized
agttcctccatctttctctttt

SEQ ID NO: 805857 - DNA, 22 bp, Artificial Sequence
  chemically synthesized
caatttagttcctccatctttc

SEQ ID NO: 805858 - DNA, 22 bp, Artificial Sequence
  chemically synthesized
cataaaaagagaaagatggagg

SEQ ID NO: 805859 - DNA, 22 bp, Artificial Sequence
  chemically synthesized
gtatattacaatttagttcctc

SEQ ID NO: 805860 - DNA, 22 bp, Artificial Sequence
  chemically synthesized
ttggtatattacaatttagttc

SEQ ID NO: 805861 - DNA, 22 bp, Artificial Sequence
  chemically synthesized
accccattgttggtatattaca

SEQ ID NO: 805862 - DNA, 22 bp, Artificial Sequence
  chemically synthesized
aattgtaatataccaacaatgg

SEQ ID NO: 805863 - DNA, 22 bp, Artificial Sequence
  chemically synthesized
tagcaacaactcaccccattgt

SEQ ID NO: 805864 - DNA, 22 bp, Artificial Sequence
  chemically synthesized
taatataccaacaatggggtga

SEQ ID NO: 805865 - DNA, 22 bp, Artificial Sequence
  chemically synthesized
aaggaagagctgtagcaacaac

SEQ ID NO: 805866 - DNA, 22 bp, Artificial Sequence
  chemically synthesized
aaaggaagagctgtagcaacaa

SEQ ID NO: 805867 - DNA, 22 bp, Artificial Sequence
  chemically synthesized
cttaaaggaagagctgtagcaa

SEQ ID NO: 805868 - DNA, 22 bp, Artificial Sequence
  chemically synthesized
ttgcttaaaggaagagctgtag

SEQ ID NO: 805869 - DNA, 22 bp, Artificial Sequence
  chemically synthesized
tagttgttgcttaaaggaagag

SEQ ID NO: 805870 - DNA, 22 bp, Artificial Sequence
  chemically synthesized
ttgctacagctcttcctttaag

SEQ ID NO: 805871 - DNA, 22 bp, Artificial Sequence
  chemically synthesized
ctacagctcttcctttaagcaa

SEQ ID NO: 805872 - DNA, 22 bp, Artificial Sequence
  chemically synthesized
cagctcttcctttaagcaacaa

SEQ ID NO: 805873 - DNA, 22 bp, Artificial Sequence
  chemically synthesized
cacaatattatagttgttgctt

SEQ ID NO: 805874 - DNA, 22 bp, Artificial Sequence
  chemically synthesized
ttcctttaagcaacaactataa

SEQ ID NO: 805875 - DNA, 22 bp, Artificial Sequence
  chemically synthesized
cctttaagcaacaactataata

SEQ ID NO: 805876 - DNA, 22 bp, Artificial Sequence
  chemically synthesized
ctttaagcaacaactataatat

SEQ ID NO: 805877 - DNA, 22 bp, Artificial Sequence
  chemically synthesized
taagcaacaactataatattgt

SEQ ID NO: 805878 - DNA, 22 bp, Artificial Sequence
  chemically synthesized
aagcaacaactataatattgtg

SEQ ID NO: 805879 - DNA, 22 bp, Artificial Sequence
  chemically synthesized
agcaacaactataatattgtgc

SEQ ID NO: 805880 - DNA, 22 bp, Artificial Sequence
  chemically synthesized
taatattgtgcagtctatttac

SEQ ID NO: 805881 - DNA, 22 bp, Artificial Sequence
  chemically synthesized
aataaaaatgaaagtaaataga

SEQ ID NO: 805882 - DNA, 22 bp, Artificial Sequence
  chemically synthesized
agttaaataaaaatgaaagtaa

SEQ ID NO: 805883 - DNA, 22 bp, Artificial Sequence
  chemically synthesized
aagttaaataaaaatgaaagta

SEQ ID NO: 805884 - DNA, 22 bp, Artificial Sequence
  chemically synthesized
tgcagtctatttactttcattt

SEQ ID NO: 805885 - DNA, 22 bp, Artificial Sequence
  chemically synthesized
taagttaaataaaaatgaaagt

SEQ ID NO: 805886 - DNA, 22 bp, Artificial Sequence
  chemically synthesized
tttactttcatttttatttaac

SEQ ID NO: 805887 - DNA, 22 bp, Artificial Sequence
  chemically synthesized
actttcatttttatttaactta

SEQ ID NO: 805888 - DNA, 22 bp, Artificial Sequence
  chemically synthesized
ctttcatttttatttaacttaa

SEQ ID NO: 805889 - DNA, 22 bp, Artificial Sequence
  chemically synthesized
tcatttttatttaacttaaagg

SEQ ID NO: 805890 - DNA, 22 bp, Artificial Sequence
  chemically synthesized
catttttatttaacttaaaggc

SEQ ID NO: 805891 - DNA, 22 bp, Artificial Sequence
  chemically synthesized
ccccatacaaacgcctttaagt

SEQ ID NO: 805892 - DNA, 22 bp, Artificial Sequence
  chemically synthesized
atttttatttaacttaaaggcg

SEQ ID NO: 805893 - DNA, 22 bp, Artificial Sequence
  chemically synthesized
cccccatacaaacgcctttaag

SEQ ID NO: 805894 - DNA, 22 bp, Artificial Sequence
  chemically synthesized
ttatttaacttaaaggcgtttg

SEQ ID NO: 805895 - DNA, 22 bp, Artificial Sequence
  chemically synthesized
tatttaacttaaaggcgtttgt

SEQ ID NO: 805896 - DNA, 22 bp, Artificial Sequence
  chemically synthesized
atttaacttaaaggcgtttgta

SEQ ID NO: 805897 - DNA, 22 bp, Artificial Sequence
  chemically synthesized
tttaacttaaaggcgtttgtat

SEQ ID NO: 805898 - DNA, 22 bp, Artificial Sequence
  chemically synthesized
catgccttcccccatacaaacg

SEQ ID NO: 805899 - DNA, 22 bp, Artificial Sequence
  chemically synthesized
gcatgccttcccccatacaaac

SEQ ID NO: 805900 - DNA, 22 bp, Artificial Sequence
  chemically synthesized
aacttaaaggcgtttgtatggg

SEQ ID NO: 805901 - DNA, 22 bp, Artificial Sequence
  chemically synthesized
acttaaaggcgtttgtatgggg

SEQ ID NO: 805902 - DNA, 22 bp, Artificial Sequence
  chemically synthesized
ttgcatgccttcccccatacaa

SEQ ID NO: 805903 - DNA, 22 bp, Artificial Sequence
  chemically synthesized
aaaggcgtttgtatgggggaag

SEQ ID NO: 805904 - DNA, 22 bp, Artificial Sequence
  chemically synthesized
aaggcgtttgtatgggggaagg

SEQ ID NO: 805905 - DNA, 22 bp, Artificial Sequence
  chemically synthesized
tcattcttgcatgccttccccc

SEQ ID NO: 805906 - DNA, 22 bp, Artificial Sequence
  chemically synthesized
taattgtcattcttgcatgcct

SEQ ID NO: 805907 - DNA, 22 bp, Artificial Sequence
  chemically synthesized
gtatgggggaaggcatgcaaga

SEQ ID NO: 805908 - DNA, 22 bp, Artificial Sequence
  chemically synthesized
tatgggggaaggcatgcaagaa

SEQ ID NO: 805909 - DNA, 22 bp, Artificial Sequence
  chemically synthesized
tagaaatctgtaattgtcattc

SEQ ID NO: 805910 - DNA, 22 bp, Artificial Sequence
  chemically synthesized
atagaaatctgtaattgtcatt

SEQ ID NO: 805911 - DNA, 22 bp, Artificial Sequence
  chemically synthesized
tggagaggggtttatagaaatc

SEQ ID NO: 805912 - DNA, 22 bp, Artificial Sequence
  chemically synthesized
tgtggagaggggtttatagaaa

SEQ ID NO: 805913 - DNA, 22 bp, Artificial Sequence
  chemically synthesized
ctctgtggagaggggtttatag

SEQ ID NO: 805914 - DNA, 22 bp, Artificial Sequence
  chemically synthesized
cagatttctataaacccctctc

SEQ ID NO: 805915 - DNA, 22 bp, Artificial Sequence
  chemically synthesized
ctataaacccctctccacagag

SEQ ID NO: 805916 - DNA, 22 bp, Artificial Sequence
  chemically synthesized
tataaacccctctccacagagg

SEQ ID NO: 805917 - DNA, 22 bp, Artificial Sequence
  chemically synthesized
taaacccctctccacagaggag

SEQ ID NO: 805918 - DNA, 22 bp, Artificial Sequence
  chemically synthesized
acatatatatatgaaacctcct

SEQ ID NO: 805919 - DNA, 22 bp, Artificial Sequence
  chemically synthesized
cacatatatatatgaaacctcc

SEQ ID NO: 805920 - DNA, 22 bp, Artificial Sequence
  chemically synthesized
tccacagaggaggtttcatata

SEQ ID NO: 805921 - DNA, 22 bp, Artificial Sequence
  chemically synthesized
cacagaggaggtttcatatata

SEQ ID NO: 805922 - DNA, 22 bp, Artificial Sequence
  chemically synthesized
catatatatatgtgaaatatat

SEQ ID NO: 805923 - DNA, 22 bp, Artificial Sequence
  chemically synthesized
aaatatatgtatatatatttca

SEQ ID NO: 805924 - DNA, 22 bp, Artificial Sequence
  chemically synthesized
atatatatatgtgaaatatata

SEQ ID NO: 805925 - DNA, 22 bp, Artificial Sequence
  chemically synthesized
acatgttcaaatatatgtatat

SEQ ID NO: 805926 - DNA, 22 bp, Artificial Sequence
  chemically synthesized
cacatgttcaaatatatgtata

SEQ ID NO: 805927 - DNA, 22 bp, Artificial Sequence
  chemically synthesized
tcacatgttcaaatatatgtat

SEQ ID NO: 805928 - DNA, 22 bp, Artificial Sequence
  chemically synthesized
aactttcacatgttcaaatata

SEQ ID NO: 805929 - DNA, 22 bp, Artificial Sequence
  chemically synthesized
gaactttcacatgttcaaatat

SEQ ID NO: 805930 - DNA, 22 bp, Artificial Sequence
  chemically synthesized
tgaactttcacatgttcaaata

SEQ ID NO: 805931 - DNA, 22 bp, Artificial Sequence
  chemically synthesized
aaaaaaaggtactttgaacttt

SEQ ID NO: 805932 - DNA, 22 bp, Artificial Sequence
  chemically synthesized
gaacatgtgaaagttcaaagta

SEQ ID NO: 805933 - DNA, 22 bp, Artificial Sequence
  chemically synthesized
aacatgtgaaagttcaaagtac

SEQ ID NO: 805934 - DNA, 22 bp, Artificial Sequence
  chemically synthesized
caaaattgaaaaaaaggtactt

SEQ ID NO: 805935 - DNA, 22 bp, Artificial Sequence
  chemically synthesized
aaagtacctttttttcaatttt

SEQ ID NO: 805936 - DNA, 22 bp, Artificial Sequence
  chemically synthesized
accaacaaaaactacaaaattg

SEQ ID NO: 805937 - DNA, 22 bp, Artificial Sequence
  chemically synthesized
tttttcaattttgtagtttttg

SEQ ID NO: 805938 - DNA, 22 bp, Artificial Sequence
  chemically synthesized
aaaattgaccaacaaaaactac

SEQ ID NO: 805939 - DNA, 22 bp, Artificial Sequence
  chemically synthesized
ttttcaattttgtagtttttgt

SEQ ID NO: 805940 - DNA, 22 bp, Artificial Sequence
  chemically synthesized
caaaattgaccaacaaaaacta

SEQ ID NO: 805941 - DNA, 22 bp, Artificial Sequence
  chemically synthesized
tttcaattttgtagtttttgtt

SEQ ID NO: 805942 - DNA, 22 bp, Artificial Sequence
  chemically synthesized
tcaaaattgaccaacaaaaact

SEQ ID NO: 805943 - DNA, 22 bp, Artificial Sequence
  chemically synthesized
ttcaattttgtagtttttgttg

SEQ ID NO: 805944 - DNA, 22 bp, Artificial Sequence
  chemically synthesized
tcaattttgtagtttttgttgg

SEQ ID NO: 805945 - DNA, 22 bp, Artificial Sequence
  chemically synthesized
caattttgtagtttttgttggt

SEQ ID NO: 805946 - DNA, 22 bp, Artificial Sequence
  chemically synthesized
aattttgtagtttttgttggtc

SEQ ID NO: 805947 - DNA, 22 bp, Artificial Sequence
  chemically synthesized
tgtagtttttgttggtcaattt

SEQ ID NO: 805948 - DNA, 22 bp, Artificial Sequence
  chemically synthesized
gtagtttttgttggtcaatttt

SEQ ID NO: 805949 - DNA, 22 bp, Artificial Sequence
  chemically synthesized
tagtttttgttggtcaattttg

SEQ ID NO: 805950 - DNA, 22 bp, Artificial Sequence
  chemically synthesized
aaaataagctttcaaaattgac

SEQ ID NO: 805951 - DNA, 22 bp, Artificial Sequence
  chemically synthesized
ttgttggtcaattttgaaagct

SEQ ID NO: 805952 - DNA, 22 bp, Artificial Sequence
  chemically synthesized
tgttggtcaattttgaaagctt

SEQ ID NO: 805953 - DNA, 22 bp, Artificial Sequence
  chemically synthesized
gttggtcaattttgaaagctta

SEQ ID NO: 805954 - DNA, 22 bp, Artificial Sequence
  chemically synthesized
ttggtcaattttgaaagcttat

SEQ ID NO: 805955 - DNA, 22 bp, Artificial Sequence
  chemically synthesized
gcagtatattaaaaataagctt

SEQ ID NO: 805956 - DNA, 22 bp, Artificial Sequence
  chemically synthesized
gtcaattttgaaagcttatttt

SEQ ID NO: 805957 - DNA, 22 bp, Artificial Sequence
  chemically synthesized
ggcagtatattaaaaataagct

SEQ ID NO: 805958 - DNA, 22 bp, Artificial Sequence
  chemically synthesized
aaatttggcagtatattaaaaa

SEQ ID NO: 805959 - DNA, 22 bp, Artificial Sequence
  chemically synthesized
tgaaagcttatttttaatatac

SEQ ID NO: 805960 - DNA, 22 bp, Artificial Sequence
  chemically synthesized
gaaagcttatttttaatatact

SEQ ID NO: 805961 - DNA, 22 bp, Artificial Sequence
  chemically synthesized
aaagcttatttttaatatactg

SEQ ID NO: 805962 - DNA, 22 bp, Artificial Sequence
  chemically synthesized
tctcaaatttggcagtatatta

SEQ ID NO: 805963 - DNA, 22 bp, Artificial Sequence
  chemically synthesized
gtctcaaatttggcagtatatt

SEQ ID NO: 805964 - DNA, 22 bp, Artificial Sequence
  chemically synthesized
atttttaatatactgccaaatt

SEQ ID NO: 805965 - DNA, 22 bp, Artificial Sequence
  chemically synthesized
tttttaatatactgccaaattt

SEQ ID NO: 805966 - DNA, 22 bp, Artificial Sequence
  chemically synthesized
taaaggtttgtctcaaatttgg

SEQ ID NO: 805967 - DNA, 22 bp, Artificial Sequence
  chemically synthesized
ttaatatactgccaaatttgag

SEQ ID NO: 805968 - DNA, 22 bp, Artificial Sequence
  chemically synthesized
taatatactgccaaatttgaga

SEQ ID NO: 805969 - DNA, 22 bp, Artificial Sequence
  chemically synthesized
aatatactgccaaatttgagac

SEQ ID NO: 805970 - DNA, 22 bp, Artificial Sequence
  chemically synthesized
atatactgccaaatttgagaca

SEQ ID NO: 805971 - DNA, 22 bp, Artificial Sequence
  chemically synthesized
actataaaggtttgtctcaaat

SEQ ID NO: 805972 - DNA, 22 bp, Artificial Sequence
  chemically synthesized
aactataaaggtttgtctcaaa

SEQ ID NO: 805973 - DNA, 22 bp, Artificial Sequence
  chemically synthesized
taactataaaggtttgtctcaa

SEQ ID NO: 805974 - DNA, 22 bp, Artificial Sequence
  chemically synthesized
ccaaatttgagacaaaccttta

SEQ ID NO: 805975 - DNA, 22 bp, Artificial Sequence
  chemically synthesized
gggttttaactataaaggtttg

SEQ ID NO: 805976 - DNA, 22 bp, Artificial Sequence
  chemically synthesized
agggttttaactataaaggttt

SEQ ID NO: 805977 - DNA, 22 bp, Artificial Sequence
  chemically synthesized
tagggttttaactataaaggtt

SEQ ID NO: 805978 - DNA, 22 bp, Artificial Sequence
  chemically synthesized
gagacaaacctttatagttaaa

SEQ ID NO: 805979 - DNA, 22 bp, Artificial Sequence
  chemically synthesized
agacaaacctttatagttaaaa

SEQ ID NO: 805980 - DNA, 22 bp, Artificial Sequence
  chemically synthesized
tatagttaaaaccctaaaatcc

SEQ ID NO: 805981 - DNA, 22 bp, Artificial Sequence
  chemically synthesized
atagttaaaaccctaaaatccc

SEQ ID NO: 805982 - DNA, 22 bp, Artificial Sequence
  chemically synthesized
tagttaaaaccctaaaatccct

SEQ ID NO: 805983 - DNA, 22 bp, Artificial Sequence
  chemically synthesized
aaaccctaaaatccctgtacca

SEQ ID NO: 805984 - DNA, 22 bp, Artificial Sequence
  chemically synthesized
aaatccctgtaccatgcttgtc

SEQ ID NO: 805985 - DNA, 22 bp, Artificial Sequence
  chemically synthesized
agagcagcatcaaagacaagca

SEQ ID NO: 805986 - DNA, 22 bp, Artificial Sequence
  chemically synthesized
cctcagagcagcatcaaagaca

SEQ ID NO: 805987 - DNA, 22 bp, Artificial Sequence
  chemically synthesized
tgcctcagagcagcatcaaaga

SEQ ID NO: 805988 - DNA, 22 bp, Artificial Sequence
  chemically synthesized
taccatgcttgtctttgatgct

SEQ ID NO: 805989 - DNA, 22 bp, Artificial Sequence
  chemically synthesized
ctgcctcagagcagcatcaaag

SEQ ID NO: 805990 - DNA, 22 bp, Artificial Sequence
  chemically synthesized
tctgcctcagagcagcatcaaa

SEQ ID NO: 805991 - DNA, 22 bp, Artificial Sequence
  chemically synthesized
ttttctgcctcagagcagcatc

SEQ ID NO: 805992 - DNA, 22 bp, Artificial Sequence
  chemically synthesized
gttttctgcctcagagcagcat

SEQ ID NO: 805993 - DNA, 22 bp, Artificial Sequence
  chemically synthesized
gtctttgatgctgctctgaggc

SEQ ID NO: 805994 - DNA, 22 bp, Artificial Sequence
  chemically synthesized
tctttgatgctgctctgaggca

SEQ ID NO: 805995 - DNA, 22 bp, Artificial Sequence
  chemically synthesized
tgatgctgctctgaggcagaaa

SEQ ID NO: 805996 - DNA, 22 bp, Artificial Sequence
  chemically synthesized
gatgctgctctgaggcagaaaa

SEQ ID NO: 805997 - DNA, 22 bp, Artificial Sequence
  chemically synthesized
atgctgctctgaggcagaaaac

SEQ ID NO: 805998 - DNA, 22 bp, Artificial Sequence
  chemically synthesized
catatcaaatccttgttttctg

SEQ ID NO: 805999 - DNA, 22 bp, Artificial Sequence
  chemically synthesized
gcatatcaaatccttgttttct

SEQ ID NO: 806000 - DNA, 22 bp, Artificial Sequence
  chemically synthesized
ctctgaggcagaaaacaaggat

SEQ ID NO: 806001 - DNA, 22 bp, Artificial Sequence
  chemically synthesized
cttgcatatcaaatccttgttt

SEQ ID NO: 806002 - DNA, 22 bp, Artificial Sequence
  chemically synthesized
tccttgcatatcaaatccttgt

SEQ ID NO: 806003 - DNA, 22 bp, Artificial Sequence
  chemically synthesized
tgaggcagaaaacaaggatttg

SEQ ID NO: 806004 - DNA, 22 bp, Artificial Sequence
  chemically synthesized
ctccttgcatatcaaatccttg

SEQ ID NO: 806005 - DNA, 22 bp, Artificial Sequence
  chemically synthesized
tctccttgcatatcaaatcctt

SEQ ID NO: 806006 - DNA, 22 bp, Artificial Sequence
  chemically synthesized
aggcagaaaacaaggatttgat

SEQ ID NO: 806007 - DNA, 22 bp, Artificial Sequence
  chemically synthesized
ttctccttgcatatcaaatcct

SEQ ID NO: 806008 - DNA, 22 bp, Artificial Sequence
  chemically synthesized
acttttctccttgcatatcaaa

SEQ ID NO: 806009 - DNA, 22 bp, Artificial Sequence
  chemically synthesized
gacttttctccttgcatatcaa

SEQ ID NO: 806010 - DNA, 22 bp, Artificial Sequence
  chemically synthesized
ttgacttttctccttgcatatc

SEQ ID NO: 806011 - DNA, 22 bp, Artificial Sequence
  chemically synthesized
cttgacttttctccttgcatat

SEQ ID NO: 806012 - DNA, 22 bp, Artificial Sequence
  chemically synthesized
tcttgacttttctccttgcata

SEQ ID NO: 806013 - DNA, 22 bp, Artificial Sequence
  chemically synthesized
tattttcttgacttttctcctt

SEQ ID NO: 806014 - DNA, 22 bp, Artificial Sequence
  chemically synthesized
gtattttcttgacttttctcct

SEQ ID NO: 806015 - DNA, 22 bp, Artificial Sequence
  chemically synthesized
gatatgcaaggagaaaagtcaa

SEQ ID NO: 806016 - DNA, 22 bp, Artificial Sequence
  chemically synthesized
atatgcaaggagaaaagtcaag

SEQ ID NO: 806017 - DNA, 22 bp, Artificial Sequence
  chemically synthesized
ggtttgtattttcttgactttt

SEQ ID NO: 806018 - DNA, 22 bp, Artificial Sequence
  chemically synthesized
taggtttgtattttcttgactt

SEQ ID NO: 806019 - DNA, 22 bp, Artificial Sequence
  chemically synthesized
attctaggtttgtattttcttg

SEQ ID NO: 806020 - DNA, 22 bp, Artificial Sequence
  chemically synthesized
gattctaggtttgtattttctt

SEQ ID NO: 806021 - DNA, 22 bp, Artificial Sequence
  chemically synthesized
tgattctaggtttgtattttct

SEQ ID NO: 806022 - DNA, 22 bp, Artificial Sequence
  chemically synthesized
ttgattctaggtttgtattttc

SEQ ID NO: 806023 - DNA, 22 bp, Artificial Sequence
  chemically synthesized
cttttgattctaggtttgtatt

SEQ ID NO: 806024 - DNA, 22 bp, Artificial Sequence
  chemically synthesized
ccttttgattctaggtttgtat

SEQ ID NO: 806025 - DNA, 22 bp, Artificial Sequence
  chemically synthesized
tccttttgattctaggtttgta

SEQ ID NO: 806026 - DNA, 22 bp, Artificial Sequence
  chemically synthesized
ttccttttgattctaggtttgt

SEQ ID NO: 806027 - DNA, 22 bp, Artificial Sequence
  chemically synthesized
gtcttttccttttgattctagg

SEQ ID NO: 806028 - DNA, 22 bp, Artificial Sequence
  chemically synthesized
tagtcttttccttttgattcta

SEQ ID NO: 806029 - DNA, 22 bp, Artificial Sequence
  chemically synthesized
ctctagtcttttccttttgatt

SEQ ID NO: 806030 - DNA, 22 bp, Artificial Sequence
  chemically synthesized
cctctagtcttttccttttgat

SEQ ID NO: 806031 - DNA, 22 bp, Artificial Sequence
  chemically synthesized
tcctctagtcttttccttttga

SEQ ID NO: 806032 - DNA, 22 bp, Artificial Sequence
  chemically synthesized
ttcctctagtcttttccttttg

SEQ ID NO: 806033 - DNA, 22 bp, Artificial Sequence
  chemically synthesized
tcttttcctctagtcttttcct

SEQ ID NO: 806034 - DNA, 22 bp, Artificial Sequence
  chemically synthesized
gtcttttcctctagtcttttcc

SEQ ID NO: 806035 - DNA, 22 bp, Artificial Sequence
  chemically synthesized
tgtcttttcctctagtcttttc

SEQ ID NO: 806036 - DNA, 22 bp, Artificial Sequence
  chemically synthesized
ttgtcttttcctctagtctttt

SEQ ID NO: 806037 - DNA, 22 bp, Artificial Sequence
  chemically synthesized
gaatcaaaaggaaaagactaga

SEQ ID NO: 806038 - DNA, 22 bp, Artificial Sequence
  chemically synthesized
tttgtcttttcctctagtcttt

SEQ ID NO: 806039 - DNA, 22 bp, Artificial Sequence
  chemically synthesized
tttttgtcttttcctctagtct

SEQ ID NO: 806040 - DNA, 22 bp, Artificial Sequence
  chemically synthesized
ctttttgtcttttcctctagtc

SEQ ID NO: 806041 - DNA, 22 bp, Artificial Sequence
  chemically synthesized
caatccccttctttttgtcttt

SEQ ID NO: 806042 - DNA, 22 bp, Artificial Sequence
  chemically synthesized
ccctccaatccccttctttttg

SEQ ID NO: 806043 - DNA, 22 bp, Artificial Sequence
  chemically synthesized
gccctccaatccccttcttttt

SEQ ID NO: 806044 - DNA, 22 bp, Artificial Sequence
  chemically synthesized
gaggaaaagacaaaaagaaggg

SEQ ID NO: 806045 - DNA, 22 bp, Artificial Sequence
  chemically synthesized
tgccctccaatccccttctttt

SEQ ID NO: 806046 - DNA, 22 bp, Artificial Sequence
  chemically synthesized
ctttgccctccaatccccttct

SEQ ID NO: 806047 - DNA, 22 bp, Artificial Sequence
  chemically synthesized
cctttgccctccaatccccttc

SEQ ID NO: 806048 - DNA, 22 bp, Artificial Sequence
  chemically synthesized
ttcctttgccctccaatcccct

SEQ ID NO: 806049 - DNA, 22 bp, Artificial Sequence
  chemically synthesized
cttcctttgccctccaatcccc

SEQ ID NO: 806050 - DNA, 22 bp, Artificial Sequence
  chemically synthesized
tcttcctttgccctccaatccc

SEQ ID NO: 806051 - DNA, 22 bp, Artificial Sequence
  chemically synthesized
agtctttcttcctttgccctcc

SEQ ID NO: 806052 - DNA, 22 bp, Artificial Sequence
  chemically synthesized
ttaagtctttcttcctttgccc

SEQ ID NO: 806053 - DNA, 22 bp, Artificial Sequence
  chemically synthesized
gttaagtctttcttcctttgcc

SEQ ID NO: 806054 - DNA, 22 bp, Artificial Sequence
  chemically synthesized
cttgttaagtctttcttccttt

SEQ ID NO: 806055 - DNA, 22 bp, Artificial Sequence
  chemically synthesized
acttgttaagtctttcttcctt

SEQ ID NO: 806056 - DNA, 22 bp, Artificial Sequence
  chemically synthesized
tacttgttaagtctttcttcct

SEQ ID NO: 806057 - DNA, 22 bp, Artificial Sequence
  chemically synthesized
tttacttgttaagtctttcttc

SEQ ID NO: 806058 - DNA, 22 bp, Artificial Sequence
  chemically synthesized
ctttacttgttaagtctttctt

SEQ ID NO: 806059 - DNA, 22 bp, Artificial Sequence
  chemically synthesized
gagggcaaaggaagaaagactt

SEQ ID NO: 806060 - DNA, 22 bp, Artificial Sequence
  chemically synthesized
tttctttacttgttaagtcttt

SEQ ID NO: 806061 - DNA, 22 bp, Artificial Sequence
  chemically synthesized
tgaaatgttatttctttacttg

SEQ ID NO: 806062 - DNA, 22 bp, Artificial Sequence
  chemically synthesized
tatgaaatgttatttctttact

SEQ ID NO: 806063 - DNA, 22 bp, Artificial Sequence
  chemically synthesized
ctatgaaatgttatttctttac

SEQ ID NO: 806064 - DNA, 22 bp, Artificial Sequence
  chemically synthesized
aacaagtaaagaaataacattt

SEQ ID NO: 806065 - DNA, 22 bp, Artificial Sequence
  chemically synthesized
acaagtaaagaaataacatttc

SEQ ID NO: 806066 - DNA, 22 bp, Artificial Sequence
  chemically synthesized
cacaaaatgatagtttctatga

SEQ ID NO: 806067 - DNA, 22 bp, Artificial Sequence
  chemically synthesized
gcacaaaatgatagtttctatg

SEQ ID NO: 806068 - DNA, 22 bp, Artificial Sequence
  chemically synthesized
catagaaactatcattttgtgc

SEQ ID NO: 806069 - DNA, 22 bp, Artificial Sequence
  chemically synthesized
atagaaactatcattttgtgca

SEQ ID NO: 806070 - DNA, 22 bp, Artificial Sequence
  chemically synthesized
atgtcatgcaaaatgatagttt

SEQ ID NO: 806071 - DNA, 22 bp, Artificial Sequence
  chemically synthesized
tcattttgtgcaaactatcatt

SEQ ID NO: 806072 - DNA, 22 bp, Artificial Sequence
  chemically synthesized
taactgatgtcatgcaaaatga

SEQ ID NO: 806073 - DNA, 22 bp, Artificial Sequence
  chemically synthesized
tgtgcaaactatcattttgcat

SEQ ID NO: 806074 - DNA, 22 bp, Artificial Sequence
  chemically synthesized
gtgcaaactatcattttgcatg

SEQ ID NO: 806075 - DNA, 22 bp, Artificial Sequence
  chemically synthesized
tgcaaactatcattttgcatga

SEQ ID NO: 806076 - DNA, 22 bp, Artificial Sequence
  chemically synthesized
tcattttgcatgacatcagtta

SEQ ID NO: 806077 - DNA, 22 bp, Artificial Sequence
  chemically synthesized
acacaataattataactgatgt

SEQ ID NO: 806078 - DNA, 22 bp, Artificial Sequence
  chemically synthesized
tgcatgacatcagttataatta

SEQ ID NO: 806079 - DNA, 22 bp, Artificial Sequence
  chemically synthesized
gcatgacatcagttataattat

SEQ ID NO: 806080 - DNA, 22 bp, Artificial Sequence
  chemically synthesized
catgacatcagttataattatt

SEQ ID NO: 806081 - DNA, 22 bp, Artificial Sequence
  chemically synthesized
aatatgaaactaacacaataat

SEQ ID NO: 806082 - DNA, 22 bp, Artificial Sequence
  chemically synthesized
taattattgtgttagtttcata

SEQ ID NO: 806083 - DNA, 22 bp, Artificial Sequence
  chemically synthesized
ttgtgttagtttcatatttaac

SEQ ID NO: 806084 - DNA, 22 bp, Artificial Sequence
  chemically synthesized
tatgatcaagtagttaaatatg

SEQ ID NO: 806085 - DNA, 22 bp, Artificial Sequence
  chemically synthesized
tgttagtttcatatttaactac

SEQ ID NO: 806086 - DNA, 22 bp, Artificial Sequence
  chemically synthesized
agttgtatgatcaagtagttaa

SEQ ID NO: 806087 - DNA, 22 bp, Artificial Sequence
  chemically synthesized
tcagttgtatgatcaagtagtt

SEQ ID NO: 806088 - DNA, 22 bp, Artificial Sequence
  chemically synthesized
gtttcatatttaactacttgat

SEQ ID NO: 806089 - DNA, 22 bp, Artificial Sequence
  chemically synthesized
catatttaactacttgatcata

SEQ ID NO: 806090 - DNA, 22 bp, Artificial Sequence
  chemically synthesized
atatttaactacttgatcatac

SEQ ID NO: 806091 - DNA, 22 bp, Artificial Sequence
  chemically synthesized
gaaaatgttctcagttgtatga

SEQ ID NO: 806092 - DNA, 22 bp, Artificial Sequence
  chemically synthesized
ggaaaatgttctcagttgtatg

SEQ ID NO: 806093 - DNA, 22 bp, Artificial Sequence
  chemically synthesized
aactacttgatcatacaactga

SEQ ID NO: 806094 - DNA, 22 bp, Artificial Sequence
  chemically synthesized
tggaaaatgttctcagttgtat

SEQ ID NO: 806095 - DNA, 22 bp, Artificial Sequence
  chemically synthesized
actacttgatcatacaactgag

SEQ ID NO: 806096 - DNA, 22 bp, Artificial Sequence
  chemically synthesized
ttttggaaaatgttctcagttg

SEQ ID NO: 806097 - DNA, 22 bp, Artificial Sequence
  chemically synthesized
attttggaaaatgttctcagtt

SEQ ID NO: 806098 - DNA, 22 bp, Artificial Sequence
  chemically synthesized
cttgatcatacaactgagaaca

SEQ ID NO: 806099 - DNA, 22 bp, Artificial Sequence
  chemically synthesized
tattttggaaaatgttctcagt

SEQ ID NO: 806100 - DNA, 22 bp, Artificial Sequence
  chemically synthesized
ttattttggaaaatgttctcag

SEQ ID NO: 806101 - DNA, 22 bp, Artificial Sequence
  chemically synthesized
gatcatacaactgagaacattt

SEQ ID NO: 806102 - DNA, 22 bp, Artificial Sequence
  chemically synthesized
atcatacaactgagaacatttt

SEQ ID NO: 806103 - DNA, 22 bp, Artificial Sequence
  chemically synthesized
cacataacatttttattttgga

SEQ ID NO: 806104 - DNA, 22 bp, Artificial Sequence
  chemically synthesized
agaacattttccaaaataaaaa

SEQ ID NO: 806105 - DNA, 22 bp, Artificial Sequence
  chemically synthesized
attacacataacatttttattt

SEQ ID NO: 806106 - DNA, 22 bp, Artificial Sequence
  chemically synthesized
cattacacataacatttttatt

SEQ ID NO: 806107 - DNA, 22 bp, Artificial Sequence
  chemically synthesized
tcattacacataacatttttat

SEQ ID NO: 806108 - DNA, 22 bp, Artificial Sequence
  chemically synthesized
ttcattacacataacattttta

SEQ ID NO: 806109 - DNA, 22 bp, Artificial Sequence
  chemically synthesized
tttcattacacataacattttt

SEQ ID NO: 806110 - DNA, 22 bp, Artificial Sequence
  chemically synthesized
tttttcattacacataacattt

SEQ ID NO: 806111 - DNA, 22 bp, Artificial Sequence
  chemically synthesized
tccaaaataaaaatgttatgtg

SEQ ID NO: 806112 - DNA, 22 bp, Artificial Sequence
  chemically synthesized
ccaaaataaaaatgttatgtgt

SEQ ID NO: 806113 - DNA, 22 bp, Artificial Sequence
  chemically synthesized
ctctttttcattacacataaca

SEQ ID NO: 806114 - DNA, 22 bp, Artificial Sequence
  chemically synthesized
caaaataaaaatgttatgtgta

SEQ ID NO: 806115 - DNA, 22 bp, Artificial Sequence
  chemically synthesized
tactctttttcattacacataa

SEQ ID NO: 806116 - DNA, 22 bp, Artificial Sequence
  chemically synthesized
aaactctactctttttcattac

SEQ ID NO: 806117 - DNA, 22 bp, Artificial Sequence
  chemically synthesized
aaaactctactctttttcatta

SEQ ID NO: 806118 - DNA, 22 bp, Artificial Sequence
  chemically synthesized
taaaactctactctttttcatt

SEQ ID NO: 806119 - DNA, 22 bp, Artificial Sequence
  chemically synthesized
ttaaaactctactctttttcat

SEQ ID NO: 806120 - DNA, 22 bp, Artificial Sequence
  chemically synthesized
gtttttaaaactctactctttt

SEQ ID NO: 806121 - DNA, 22 bp, Artificial Sequence
  chemically synthesized
tgtgtaatgaaaaagagtagag

SEQ ID NO: 806122 - DNA, 22 bp, Artificial Sequence
  chemically synthesized
cctagtttttaaaactctactc

SEQ ID NO: 806123 - DNA, 22 bp, Artificial Sequence
  chemically synthesized
agatctgcctagtttttaaaac

SEQ ID NO: 806124 - DNA, 22 bp, Artificial Sequence
  chemically synthesized
aactcagatctgcctagttttt

SEQ ID NO: 806125 - DNA, 22 bp, Artificial Sequence
  chemically synthesized
ggaattgaactcagatctgcct

SEQ ID NO: 806126 - DNA, 22 bp, Artificial Sequence
  chemically synthesized
taaaaactaggcagatctgagt

SEQ ID NO: 806127 - DNA, 22 bp, Artificial Sequence
  chemically synthesized
aaaaactaggcagatctgagtt

SEQ ID NO: 806128 - DNA, 22 bp, Artificial Sequence
  chemically synthesized
aaaactaggcagatctgagttc

SEQ ID NO: 806129 - DNA, 22 bp, Artificial Sequence
  chemically synthesized
ggcagatctgagttcaattccc

SEQ ID NO: 806130 - DNA, 22 bp, Artificial Sequence
  chemically synthesized
agttcaattcccagtgttcttt

SEQ ID NO: 806131 - DNA, 22 bp, Artificial Sequence
  chemically synthesized
aattcccagtgttctttaccac

SEQ ID NO: 806132 - DNA, 22 bp, Artificial Sequence
  chemically synthesized
ccatatcacgtaagtggtaaag

SEQ ID NO: 806133 - DNA, 22 bp, Artificial Sequence
  chemically synthesized
gccatatcacgtaagtggtaaa

SEQ ID NO: 806134 - DNA, 22 bp, Artificial Sequence
  chemically synthesized
ccagtgttctttaccacttacg

SEQ ID NO: 806135 - DNA, 22 bp, Artificial Sequence
  chemically synthesized
tttaccacttacgtgatatggc

SEQ ID NO: 806136 - DNA, 22 bp, Artificial Sequence
  chemically synthesized
taccacttacgtgatatggcaa

SEQ ID NO: 806137 - DNA, 22 bp, Artificial Sequence
  chemically synthesized
accacttacgtgatatggcaag

SEQ ID NO: 806138 - DNA, 22 bp, Artificial Sequence
  chemically synthesized
ccacttacgtgatatggcaagt

SEQ ID NO: 806139 - DNA, 22 bp, Artificial Sequence
  chemically synthesized
agaatcagagagggaacttgcc

SEQ ID NO: 806140 - DNA, 22 bp, Artificial Sequence
  chemically synthesized
acgtgatatggcaagttccctc

SEQ ID NO: 806141 - DNA, 22 bp, Artificial Sequence
  chemically synthesized
cgtgatatggcaagttccctct

SEQ ID NO: 806142 - DNA, 22 bp, Artificial Sequence
  chemically synthesized
cagatgagaaactgagaatcag

SEQ ID NO: 806143 - DNA, 22 bp, Artificial Sequence
  chemically synthesized
cctctctgattctcagtttctc

SEQ ID NO: 806144 - DNA, 22 bp, Artificial Sequence
  chemically synthesized
tctgattctcagtttctcatct

SEQ ID NO: 806145 - DNA, 22 bp, Artificial Sequence
  chemically synthesized
tgattctcagtttctcatctgc

SEQ ID NO: 806146 - DNA, 22 bp, Artificial Sequence
  chemically synthesized
attctcagtttctcatctgcaa

SEQ ID NO: 806147 - DNA, 22 bp, Artificial Sequence
  chemically synthesized
tcagtttctcatctgcaatatc

SEQ ID NO: 806148 - DNA, 22 bp, Artificial Sequence
  chemically synthesized
atcacagcaatagatattgcag

SEQ ID NO: 806149 - DNA, 22 bp, Artificial Sequence
  chemically synthesized
agtttctcatctgcaatatcta

SEQ ID NO: 806150 - DNA, 22 bp, Artificial Sequence
  chemically synthesized
tcatcacagcaatagatattgc

SEQ ID NO: 806151 - DNA, 22 bp, Artificial Sequence
  chemically synthesized
attctcatcacagcaatagata

SEQ ID NO: 806152 - DNA, 22 bp, Artificial Sequence
  chemically synthesized
ctcatctgcaatatctattgct

SEQ ID NO: 806153 - DNA, 22 bp, Artificial Sequence
  chemically synthesized
aattctcatcacagcaatagat

SEQ ID NO: 806154 - DNA, 22 bp, Artificial Sequence
  chemically synthesized
tcatctgcaatatctattgctg

SEQ ID NO: 806155 - DNA, 22 bp, Artificial Sequence
  chemically synthesized
taattctcatcacagcaataga

SEQ ID NO: 806156 - DNA, 22 bp, Artificial Sequence
  chemically synthesized
atctgcaatatctattgctgtg

SEQ ID NO: 806157 - DNA, 22 bp, Artificial Sequence
  chemically synthesized
ttttaattctcatcacagcaat

SEQ ID NO: 806158 - DNA, 22 bp, Artificial Sequence
  chemically synthesized
attttaattctcatcacagcaa

SEQ ID NO: 806159 - DNA, 22 bp, Artificial Sequence
  chemically synthesized
tattttaattctcatcacagca

SEQ ID NO: 806160 - DNA, 22 bp, Artificial Sequence
  chemically synthesized
ttattttaattctcatcacagc

SEQ ID NO: 806161 - DNA, 22 bp, Artificial Sequence
  chemically synthesized
caatatctattgctgtgatgag

SEQ ID NO: 806162 - DNA, 22 bp, Artificial Sequence
  chemically synthesized
tttattttaattctcatcacag

SEQ ID NO: 806163 - DNA, 22 bp, Artificial Sequence
  chemically synthesized
ttgctgtgatgagaattaaaat

SEQ ID NO: 806164 - DNA, 22 bp, Artificial Sequence
  chemically synthesized
acaggaattttttattttaatt

SEQ ID NO: 806165 - DNA, 22 bp, Artificial Sequence
  chemically synthesized
cacaggaattttttattttaat

SEQ ID NO: 806166 - DNA, 22 bp, Artificial Sequence
  chemically synthesized
ctgtgatgagaattaaaataaa

SEQ ID NO: 806167 - DNA, 22 bp, Artificial Sequence
  chemically synthesized
tgatgagaattaaaataaaaaa

SEQ ID NO: 806168 - DNA, 22 bp, Artificial Sequence
  chemically synthesized
aacttcacaggaattttttatt

SEQ ID NO: 806169 - DNA, 22 bp, Artificial Sequence
  chemically synthesized
aaataaaaaattcctgtgaagt

SEQ ID NO: 806170 - DNA, 22 bp, Artificial Sequence
  chemically synthesized
tataacgtggggcactcaactt

SEQ ID NO: 806171 - DNA, 22 bp, Artificial Sequence
  chemically synthesized
ctgtgaagttgagtgccccacg

SEQ ID NO: 806172 - DNA, 22 bp, Artificial Sequence
  chemically synthesized
tgaagttgagtgccccacgtta

SEQ ID NO: 806173 - DNA, 22 bp, Artificial Sequence
  chemically synthesized
taatgtataactgtataacgtg

SEQ ID NO: 806174 - DNA, 22 bp, Artificial Sequence
  chemically synthesized
agtgccccacgttatacagtta

SEQ ID NO: 806175 - DNA, 22 bp, Artificial Sequence
  chemically synthesized
agtaactgtaatgtataactgt

SEQ ID NO: 806176 - DNA, 22 bp, Artificial Sequence
  chemically synthesized
gagtaactgtaatgtataactg

SEQ ID NO: 806177 - DNA, 22 bp, Artificial Sequence
  chemically synthesized
tgagtaactgtaatgtataact

SEQ ID NO: 806178 - DNA, 22 bp, Artificial Sequence
  chemically synthesized
ttgagtaactgtaatgtataac

SEQ ID NO: 806179 - DNA, 22 bp, Artificial Sequence
  chemically synthesized
atgtttttgagtaactgtaatg

SEQ ID NO: 806180 - DNA, 22 bp, Artificial Sequence
  chemically synthesized
tacagttatacattacagttac

SEQ ID NO: 806181 - DNA, 22 bp, Artificial Sequence
  chemically synthesized
tacattacagttactcaaaaac

SEQ ID NO: 806182 - DNA, 22 bp, Artificial Sequence
  chemically synthesized
cagttactcaaaaacattagtt

SEQ ID NO: 806183 - DNA, 22 bp, Artificial Sequence
  chemically synthesized
ctcaaaaacattagttccttct

SEQ ID NO: 806184 - DNA, 22 bp, Artificial Sequence
  chemically synthesized
aaaaacattagttccttctacc

SEQ ID NO: 806185 - DNA, 22 bp, Artificial Sequence
  chemically synthesized
gttccttctacccatatcccat

SEQ ID NO: 806186 - DNA, 22 bp, Artificial Sequence
  chemically synthesized
caggaatggggaaatgggatat

SEQ ID NO: 806187 - DNA, 22 bp, Artificial Sequence
  chemically synthesized
cttctacccatatcccatttcc

SEQ ID NO: 806188 - DNA, 22 bp, Artificial Sequence
  chemically synthesized
ctacccatatcccatttcccca

SEQ ID NO: 806189 - DNA, 22 bp, Artificial Sequence
  chemically synthesized
tacccatatcccatttccccat

SEQ ID NO: 806190 - DNA, 22 bp, Artificial Sequence
  chemically synthesized
aaatattacaggaatggggaaa

SEQ ID NO: 806191 - DNA, 22 bp, Artificial Sequence
  chemically synthesized
cccatatcccatttccccattc

SEQ ID NO: 806192 - DNA, 22 bp, Artificial Sequence
  chemically synthesized
aaaatattacaggaatggggaa

SEQ ID NO: 806193 - DNA, 22 bp, Artificial Sequence
  chemically synthesized
taaaatattacaggaatgggga

SEQ ID NO: 806194 - DNA, 22 bp, Artificial Sequence
  chemically synthesized
ttaaaatattacaggaatgggg

SEQ ID NO: 806195 - DNA, 22 bp, Artificial Sequence
  chemically synthesized
tttaaaatattacaggaatggg

SEQ ID NO: 806196 - DNA, 22 bp, Artificial Sequence
  chemically synthesized
atctttttaaaatattacagga

SEQ ID NO: 806197 - DNA, 22 bp, Artificial Sequence
  chemically synthesized
catctttttaaaatattacagg

SEQ ID NO: 806198 - DNA, 22 bp, Artificial Sequence
  chemically synthesized
tttcatctttttaaaatattac

SEQ ID NO: 806199 - DNA, 22 bp, Artificial Sequence
  chemically synthesized
gtttcatctttttaaaatatta

SEQ ID NO: 806200 - DNA, 22 bp, Artificial Sequence
  chemically synthesized
ccccattcctgtaatattttaa

SEQ ID NO: 806201 - DNA, 22 bp, Artificial Sequence
  chemically synthesized
cccattcctgtaatattttaaa

SEQ ID NO: 806202 - DNA, 22 bp, Artificial Sequence
  chemically synthesized
ctgtaatattttaaaaagatga

SEQ ID NO: 806203 - DNA, 22 bp, Artificial Sequence
  chemically synthesized
taatattttaaaaagatgaaac

SEQ ID NO: 806204 - DNA, 22 bp, Artificial Sequence
  chemically synthesized
tcatgaaagagtttgtttcatc

SEQ ID NO: 806205 - DNA, 22 bp, Artificial Sequence
  chemically synthesized
gtcatgaaagagtttgtttcat

SEQ ID NO: 806206 - DNA, 22 bp, Artificial Sequence
  chemically synthesized
tgtcatgaaagagtttgtttca

SEQ ID NO: 806207 - DNA, 22 bp, Artificial Sequence
  chemically synthesized
ttgtcatgaaagagtttgtttc

SEQ ID NO: 806208 - DNA, 22 bp, Artificial Sequence
  chemically synthesized
taaaaagatgaaacaaactctt

SEQ ID NO: 806209 - DNA, 22 bp, Artificial Sequence
  chemically synthesized
aaaaagatgaaacaaactcttt

SEQ ID NO: 806210 - DNA, 22 bp, Artificial Sequence
  chemically synthesized
aaaagatgaaacaaactctttc

SEQ ID NO: 806211 - DNA, 22 bp, Artificial Sequence
  chemically synthesized
gagtttttgtcatgaaagagtt

SEQ ID NO: 806212 - DNA, 22 bp, Artificial Sequence
  chemically synthesized
agagtttttgtcatgaaagagt

SEQ ID NO: 806213 - DNA, 22 bp, Artificial Sequence
  chemically synthesized
tagagtttttgtcatgaaagag

SEQ ID NO: 806214 - DNA, 22 bp, Artificial Sequence
  chemically synthesized
ttagagtttttgtcatgaaaga

SEQ ID NO: 806215 - DNA, 22 bp, Artificial Sequence
  chemically synthesized
tttcatgacaaaaactctaaaa

SEQ ID NO: 806216 - DNA, 22 bp, Artificial Sequence
  chemically synthesized
tcatgacaaaaactctaaaaat

SEQ ID NO: 806217 - DNA, 22 bp, Artificial Sequence
  chemically synthesized
catgacaaaaactctaaaaatg

SEQ ID NO: 806218 - DNA, 22 bp, Artificial Sequence
  chemically synthesized
atgacaaaaactctaaaaatgt

SEQ ID NO: 806219 - DNA, 22 bp, Artificial Sequence
  chemically synthesized
taaaaatgtattcatatttttg

SEQ ID NO: 806220 - DNA, 22 bp, Artificial Sequence
  chemically synthesized
aaaatgtattcatatttttgat

SEQ ID NO: 806221 - DNA, 22 bp, Artificial Sequence
  chemically synthesized
atatttttgatcatatatatat

SEQ ID NO: 806222 - DNA, 22 bp, Artificial Sequence
  chemically synthesized
tatatatatatatatatatata

SEQ ID NO: 806223 - DNA, 22 bp, Artificial Sequence
  chemically synthesized
atatatatatatatatatatat

SEQ ID NO: 806224 - DNA, 22 bp, Artificial Sequence
  chemically synthesized
tatatatatatatatatatata

SEQ ID NO: 806225 - DNA, 22 bp, Artificial Sequence
  chemically synthesized
ttgatcatatatatatatatat

SEQ ID NO: 806226 - DNA, 22 bp, Artificial Sequence
  chemically synthesized
tgatcatatatatatatatata

SEQ ID NO: 806227 - DNA, 22 bp, Artificial Sequence
  chemically synthesized
gatcatatatatatatatatat

SEQ ID NO: 806228 - DNA, 22 bp, Artificial Sequence
  chemically synthesized
atcatatatatatatatatata

SEQ ID NO: 806229 - DNA, 22 bp, Artificial Sequence
  chemically synthesized
agggcatatgtgtgtgtatcca

SEQ ID NO: 806230 - DNA, 22 bp, Artificial Sequence
  chemically synthesized
ctgagggcatatgtgtgtgtat

SEQ ID NO: 806231 - DNA, 22 bp, Artificial Sequence
  chemically synthesized
gctgagggcatatgtgtgtgta

SEQ ID NO: 806232 - DNA, 22 bp, Artificial Sequence
  chemically synthesized
tggatacacacacatatgccct

SEQ ID NO: 806233 - DNA, 22 bp, Artificial Sequence
  chemically synthesized
tatagatatttgctgagggcat

SEQ ID NO: 806234 - DNA, 22 bp, Artificial Sequence
  chemically synthesized
ttatatagatatttgctgaggg

SEQ ID NO: 806235 - DNA, 22 bp, Artificial Sequence
  chemically synthesized
ttattatatagatatttgctga

SEQ ID NO: 806236 - DNA, 22 bp, Artificial Sequence
  chemically synthesized
agctattattatatagatattt

SEQ ID NO: 806237 - DNA, 22 bp, Artificial Sequence
  chemically synthesized
taagctattattatatagatat

SEQ ID NO: 806238 - DNA, 22 bp, Artificial Sequence
  chemically synthesized
ctaagctattattatatagata

SEQ ID NO: 806239 - DNA, 22 bp, Artificial Sequence
  chemically synthesized
tctaagctattattatatagat

SEQ ID NO: 806240 - DNA, 22 bp, Artificial Sequence
  chemically synthesized
ctttctaagctattattatata

SEQ ID NO: 806241 - DNA, 22 bp, Artificial Sequence
  chemically synthesized
cctttctaagctattattatat

SEQ ID NO: 806242 - DNA, 22 bp, Artificial Sequence
  chemically synthesized
agcaaatatctatataataata

SEQ ID NO: 806243 - DNA, 22 bp, Artificial Sequence
  chemically synthesized
tcctttctaagctattattata

SEQ ID NO: 806244 - DNA, 22 bp, Artificial Sequence
  chemically synthesized
aggcaattttcctttctaagct

SEQ ID NO: 806245 - DNA, 22 bp, Artificial Sequence
  chemically synthesized
tataataatagcttagaaagga

SEQ ID NO: 806246 - DNA, 22 bp, Artificial Sequence
  chemically synthesized
cctaaggcaattttcctttcta

SEQ ID NO: 806247 - DNA, 22 bp, Artificial Sequence
  chemically synthesized
ctgcctaaggcaattttccttt

SEQ ID NO: 806248 - DNA, 22 bp, Artificial Sequence
  chemically synthesized
ttactgcctaaggcaattttcc

SEQ ID NO: 806249 - DNA, 22 bp, Artificial Sequence
  chemically synthesized
agaaaggaaaattgccttaggc

SEQ ID NO: 806250 - DNA, 22 bp, Artificial Sequence
  chemically synthesized
gaaaggaaaattgccttaggca

SEQ ID NO: 806251 - DNA, 22 bp, Artificial Sequence
  chemically synthesized
cataggactgttactgcctaag

SEQ ID NO: 806252 - DNA, 22 bp, Artificial Sequence
  chemically synthesized
ccataggactgttactgcctaa

SEQ ID NO: 806253 - DNA, 22 bp, Artificial Sequence
  chemically synthesized
tccataggactgttactgccta

SEQ ID NO: 806254 - DNA, 22 bp, Artificial Sequence
  chemically synthesized
ttccataggactgttactgcct

SEQ ID NO: 806255 - DNA, 22 bp, Artificial Sequence
  chemically synthesized
tttccataggactgttactgcc

SEQ ID NO: 806256 - DNA, 22 bp, Artificial Sequence
  chemically synthesized
aatctttttccataggactgtt

SEQ ID NO: 806257 - DNA, 22 bp, Artificial Sequence
  chemically synthesized
ccttaggcagtaacagtcctat

SEQ ID NO: 806258 - DNA, 22 bp, Artificial Sequence
  chemically synthesized
cctgaatctttttccataggac

SEQ ID NO: 806259 - DNA, 22 bp, Artificial Sequence
  chemically synthesized
aggcagtaacagtcctatggaa

SEQ ID NO: 806260 - DNA, 22 bp, Artificial Sequence
  chemically synthesized
acctgaatctttttccatagga

SEQ ID NO: 806261 - DNA, 22 bp, Artificial Sequence
  chemically synthesized
ggcagtaacagtcctatggaaa

SEQ ID NO: 806262 - DNA, 22 bp, Artificial Sequence
  chemically synthesized
cagacaaagtttacctgaatct

SEQ ID NO: 806263 - DNA, 22 bp, Artificial Sequence
  chemically synthesized
attgcagacaaagtttacctga

SEQ ID NO: 806264 - DNA, 22 bp, Artificial Sequence
  chemically synthesized
tggaaaaagattcaggtaaact

SEQ ID NO: 806265 - DNA, 22 bp, Artificial Sequence
  chemically synthesized
ctcattgcagacaaagtttacc

SEQ ID NO: 806266 - DNA, 22 bp, Artificial Sequence
  chemically synthesized
cctcattgcagacaaagtttac

SEQ ID NO: 806267 - DNA, 22 bp, Artificial Sequence
  chemically synthesized
atttcctcattgcagacaaagt

SEQ ID NO: 806268 - DNA, 22 bp, Artificial Sequence
  chemically synthesized
aggtaaactttgtctgcaatga

SEQ ID NO: 806269 - DNA, 22 bp, Artificial Sequence
  chemically synthesized
aatagagtactaatttcctcat

SEQ ID NO: 806270 - DNA, 22 bp, Artificial Sequence
  chemically synthesized
aaatagagtactaatttcctca

SEQ ID NO: 806271 - DNA, 22 bp, Artificial Sequence
  chemically synthesized
tgtctgcaatgaggaaattagt

SEQ ID NO: 806272 - DNA, 22 bp, Artificial Sequence
  chemically synthesized
gtctgcaatgaggaaattagta

SEQ ID NO: 806273 - DNA, 22 bp, Artificial Sequence
  chemically synthesized
tctgcaatgaggaaattagtac

SEQ ID NO: 806274 - DNA, 22 bp, Artificial Sequence
  chemically synthesized
caatgaggaaattagtactcta

SEQ ID NO: 806275 - DNA, 22 bp, Artificial Sequence
  chemically synthesized
gtactctatttaaatgtcttat

SEQ ID NO: 806276 - DNA, 22 bp, Artificial Sequence
  chemically synthesized
tatttaaatgtcttatttgcct

SEQ ID NO: 806277 - DNA, 22 bp, Artificial Sequence
  chemically synthesized
tgtagtaatagaaggcaaataa

SEQ ID NO: 806278 - DNA, 22 bp, Artificial Sequence
  chemically synthesized
gtgtagtaatagaaggcaaata

SEQ ID NO: 806279 - DNA, 22 bp, Artificial Sequence
  chemically synthesized
tttaaatgtcttatttgccttc

SEQ ID NO: 806280 - DNA, 22 bp, Artificial Sequence
  chemically synthesized
aaatgtcttatttgccttctat

SEQ ID NO: 806281 - DNA, 22 bp, Artificial Sequence
  chemically synthesized
aatgtcttatttgccttctatt

SEQ ID NO: 806282 - DNA, 22 bp, Artificial Sequence
  chemically synthesized
atttgccttctattactacaca

SEQ ID NO: 806283 - DNA, 22 bp, Artificial Sequence
  chemically synthesized
tttgccttctattactacacaa

SEQ ID NO: 806284 - DNA, 22 bp, Artificial Sequence
  chemically synthesized
atcccagaaagtgtttgtgtag

SEQ ID NO: 806285 - DNA, 22 bp, Artificial Sequence
  chemically synthesized
gccttctattactacacaaaca

SEQ ID NO: 806286 - DNA, 22 bp, Artificial Sequence
  chemically synthesized
aatcccagaaagtgtttgtgta

SEQ ID NO: 806287 - DNA, 22 bp, Artificial Sequence
  chemically synthesized
ccttctattactacacaaacac

SEQ ID NO: 806288 - DNA, 22 bp, Artificial Sequence
  chemically synthesized
ctattactacacaaacactttc

SEQ ID NO: 806289 - DNA, 22 bp, Artificial Sequence
  chemically synthesized
tgtttaatcccagaaagtgttt

SEQ ID NO: 806290 - DNA, 22 bp, Artificial Sequence
  chemically synthesized
tattactacacaaacactttct

SEQ ID NO: 806291 - DNA, 22 bp, Artificial Sequence
  chemically synthesized
atgtttaatcccagaaagtgtt

SEQ ID NO: 806292 - DNA, 22 bp, Artificial Sequence
  chemically synthesized
ttactacacaaacactttctgg

SEQ ID NO: 806293 - DNA, 22 bp, Artificial Sequence
  chemically synthesized
gcttatgtttaatcccagaaag

SEQ ID NO: 806294 - DNA, 22 bp, Artificial Sequence
  chemically synthesized
ctacacaaacactttctgggat

SEQ ID NO: 806295 - DNA, 22 bp, Artificial Sequence
  chemically synthesized
agcttatgtttaatcccagaaa

SEQ ID NO: 806296 - DNA, 22 bp, Artificial Sequence
  chemically synthesized
tagcttatgtttaatcccagaa

SEQ ID NO: 806297 - DNA, 22 bp, Artificial Sequence
  chemically synthesized
ttagcttatgtttaatcccaga

SEQ ID NO: 806298 - DNA, 22 bp, Artificial Sequence
  chemically synthesized
cacaaacactttctgggattaa

SEQ ID NO: 806299 - DNA, 22 bp, Artificial Sequence
  chemically synthesized
aaatccatttttagcttatgtt

SEQ ID NO: 806300 - DNA, 22 bp, Artificial Sequence
  chemically synthesized
aaaatccatttttagcttatgt

SEQ ID NO: 806301 - DNA, 22 bp, Artificial Sequence
  chemically synthesized
tctgggattaaacataagctaa

SEQ ID NO: 806302 - DNA, 22 bp, Artificial Sequence
  chemically synthesized
taaaatccatttttagcttatg

SEQ ID NO: 806303 - DNA, 22 bp, Artificial Sequence
  chemically synthesized
ctgggattaaacataagctaaa

SEQ ID NO: 806304 - DNA, 22 bp, Artificial Sequence
  chemically synthesized
ttaaaatccatttttagcttat

SEQ ID NO: 806305 - DNA, 22 bp, Artificial Sequence
  chemically synthesized
tgggattaaacataagctaaaa

SEQ ID NO: 806306 - DNA, 22 bp, Artificial Sequence
  chemically synthesized
tttaaaatccatttttagctta

SEQ ID NO: 806307 - DNA, 22 bp, Artificial Sequence
  chemically synthesized
ggattaaacataagctaaaaat

SEQ ID NO: 806308 - DNA, 22 bp, Artificial Sequence
  chemically synthesized
aattttttaaaatccattttta

SEQ ID NO: 806309 - DNA, 22 bp, Artificial Sequence
  chemically synthesized
aacataagctaaaaatggattt

SEQ ID NO: 806310 - DNA, 22 bp, Artificial Sequence
  chemically synthesized
aagtgttcaattttttaaaatc

SEQ ID NO: 806311 - DNA, 22 bp, Artificial Sequence
  chemically synthesized
aaaatggattttaaaaaattga

SEQ ID NO: 806312 - DNA, 22 bp, Artificial Sequence
  chemically synthesized
taaaaaattgaacacttgaata

SEQ ID NO: 806313 - DNA, 22 bp, Artificial Sequence
  chemically synthesized
aaaaaattgaacacttgaatat

SEQ ID NO: 806314 - DNA, 22 bp, Artificial Sequence
  chemically synthesized
aaaaattgaacacttgaatatg

SEQ ID NO: 806315 - DNA, 22 bp, Artificial Sequence
  chemically synthesized
acaagcaatgtgtatcatattc

SEQ ID NO: 806316 - DNA, 22 bp, Artificial Sequence
  chemically synthesized
aacaagcaatgtgtatcatatt

SEQ ID NO: 806317 - DNA, 22 bp, Artificial Sequence
  chemically synthesized
aacacttgaatatgatacacat

SEQ ID NO: 806318 - DNA, 22 bp, Artificial Sequence
  chemically synthesized
gaatatgatacacattgcttgt

SEQ ID NO: 806319 - DNA, 22 bp, Artificial Sequence
  chemically synthesized
aatatgatacacattgcttgtt

SEQ ID NO: 806320 - DNA, 22 bp, Artificial Sequence
  chemically synthesized
acaatcacatcttaacaagcaa

SEQ ID NO: 806321 - DNA, 22 bp, Artificial Sequence
  chemically synthesized
ttgacaatcacatcttaacaag

SEQ ID NO: 806322 - DNA, 22 bp, Artificial Sequence
  chemically synthesized
cataattattgacaatcacatc

SEQ ID NO: 806323 - DNA, 22 bp, Artificial Sequence
  chemically synthesized
gcataattattgacaatcacat

SEQ ID NO: 806324 - DNA, 22 bp, Artificial Sequence
  chemically synthesized
tgcataattattgacaatcaca

SEQ ID NO: 806325 - DNA, 22 bp, Artificial Sequence
  chemically synthesized
cttgttaagatgtgattgtcaa

SEQ ID NO: 806326 - DNA, 22 bp, Artificial Sequence
  chemically synthesized
gttaagatgtgattgtcaataa

SEQ ID NO: 806327 - DNA, 22 bp, Artificial Sequence
  chemically synthesized
ttaagatgtgattgtcaataat

SEQ ID NO: 806328 - DNA, 22 bp, Artificial Sequence
  chemically synthesized
cagttttgcataattattgaca

SEQ ID NO: 806329 - DNA, 22 bp, Artificial Sequence
  chemically synthesized
agatgtgattgtcaataattat

SEQ ID NO: 806330 - DNA, 22 bp, Artificial Sequence
  chemically synthesized
aaataaattgcagttttgcata

SEQ ID NO: 806331 - DNA, 22 bp, Artificial Sequence
  chemically synthesized
ctgaaataaattgcagttttgc

SEQ ID NO: 806332 - DNA, 22 bp, Artificial Sequence
  chemically synthesized
tcaataattatgcaaaactgca

SEQ ID NO: 806333 - DNA, 22 bp, Artificial Sequence
  chemically synthesized
ctgctgaaataaattgcagttt

SEQ ID NO: 806334 - DNA, 22 bp, Artificial Sequence
  chemically synthesized
tgcaaaactgcaatttatttca

SEQ ID NO: 806335 - DNA, 22 bp, Artificial Sequence
  chemically synthesized
caatttatttcagcagcaactt

SEQ ID NO: 806336 - DNA, 22 bp, Artificial Sequence
  chemically synthesized
cacatcccatgataaagttgct

SEQ ID NO: 806337 - DNA, 22 bp, Artificial Sequence
  chemically synthesized
gcacatcccatgataaagttgc

SEQ ID NO: 806338 - DNA, 22 bp, Artificial Sequence
  chemically synthesized
atttcagcagcaactttatcat

SEQ ID NO: 806339 - DNA, 22 bp, Artificial Sequence
  chemically synthesized
tttcagcagcaactttatcatg

SEQ ID NO: 806340 - DNA, 22 bp, Artificial Sequence
  chemically synthesized
gtttgcacatcccatgataaag

SEQ ID NO: 806341 - DNA, 22 bp, Artificial Sequence
  chemically synthesized
cagcagcaactttatcatggga

SEQ ID NO: 806342 - DNA, 22 bp, Artificial Sequence
  chemically synthesized
agcagcaactttatcatgggat

SEQ ID NO: 806343 - DNA, 22 bp, Artificial Sequence
  chemically synthesized
cctggtttgcacatcccatgat

SEQ ID NO: 806344 - DNA, 22 bp, Artificial Sequence
  chemically synthesized
ttgcctggtttgcacatcccat

SEQ ID NO: 806345 - DNA, 22 bp, Artificial Sequence
  chemically synthesized
attgcctggtttgcacatccca

SEQ ID NO: 806346 - DNA, 22 bp, Artificial Sequence
  chemically synthesized
tttattgcctggtttgcacatc

SEQ ID NO: 806347 - DNA, 22 bp, Artificial Sequence
  chemically synthesized
tatcatgggatgtgcaaaccag

SEQ ID NO: 806348 - DNA, 22 bp, Artificial Sequence
  chemically synthesized
atcatgggatgtgcaaaccagg

SEQ ID NO: 806349 - DNA, 22 bp, Artificial Sequence
  chemically synthesized
tcatgggatgtgcaaaccaggc

SEQ ID NO: 806350 - DNA, 22 bp, Artificial Sequence
  chemically synthesized
ggcaggagttgtttattgcctg

SEQ ID NO: 806351 - DNA, 22 bp, Artificial Sequence
  chemically synthesized
gctcggcaggagttgtttattg

SEQ ID NO: 806352 - DNA, 22 bp, Artificial Sequence
  chemically synthesized
ccgctggctcggcaggagttgt

SEQ ID NO: 806353 - DNA, 22 bp, Artificial Sequence
  chemically synthesized
ctgccgctggctcggcaggagt

SEQ ID NO: 806354 - DNA, 22 bp, Artificial Sequence
  chemically synthesized
gctgccgctggctcggcaggag

SEQ ID NO: 806355 - DNA, 22 bp, Artificial Sequence
  chemically synthesized
tgctgccgctggctcggcagga

SEQ ID NO: 806356 - DNA, 22 bp, Artificial Sequence
  chemically synthesized
cgggggctttgctgccgctggc

SEQ ID NO: 806357 - DNA, 22 bp, Artificial Sequence
  chemically synthesized
ccgggggctttgctgccgctgg

SEQ ID NO: 806358 - DNA, 22 bp, Artificial Sequence
  chemically synthesized
ttccgggggctttgctgccgct

SEQ ID NO: 806359 - DNA, 22 bp, Artificial Sequence
  chemically synthesized
ctgccgagccagcggcagcaaa

SEQ ID NO: 806360 - DNA, 22 bp, Artificial Sequence
  chemically synthesized
ccgagccagcggcagcaaagcc

SEQ ID NO: 806361 - DNA, 22 bp, Artificial Sequence
  chemically synthesized
acccatgatgaataaacagctc

SEQ ID NO: 806362 - DNA, 22 bp, Artificial Sequence
  chemically synthesized
agcaaaaacctcacccatgatg

SEQ ID NO: 806363 - DNA, 22 bp, Artificial Sequence
  chemically synthesized
tttattcatcatgggtgaggtt

SEQ ID NO: 806364 - DNA, 22 bp, Artificial Sequence
  chemically synthesized
tgtgctcagcaaaaacctcacc

SEQ ID NO: 806365 - DNA, 22 bp, Artificial Sequence
  chemically synthesized
attcatcatgggtgaggttttt

SEQ ID NO: 806366 - DNA, 22 bp, Artificial Sequence
  chemically synthesized
ttcatcatgggtgaggtttttg

SEQ ID NO: 806367 - DNA, 22 bp, Artificial Sequence
  chemically synthesized
atcatgggtgaggtttttgctg

SEQ ID NO: 806368 - DNA, 22 bp, Artificial Sequence
  chemically synthesized
tggaagactgtgtgctcagcaa

SEQ ID NO: 806369 - DNA, 22 bp, Artificial Sequence
  chemically synthesized
cactgtggaagactgtgtgctc

SEQ ID NO: 806370 - DNA, 22 bp, Artificial Sequence
  chemically synthesized
aaactccactgtggaagactgt

SEQ ID NO: 806371 - DNA, 22 bp, Artificial Sequence
  chemically synthesized
ttgctgagcacacagtcttcca

SEQ ID NO: 806372 - DNA, 22 bp, Artificial Sequence
  chemically synthesized
tgctgagcacacagtcttccac

SEQ ID NO: 806373 - DNA, 22 bp, Artificial Sequence
  chemically synthesized
gctgagcacacagtcttccaca

SEQ ID NO: 806374 - DNA, 22 bp, Artificial Sequence
  chemically synthesized
ctgagcacacagtcttccacag

SEQ ID NO: 806375 - DNA, 22 bp, Artificial Sequence
  chemically synthesized
agcacacagtcttccacagtgg

SEQ ID NO: 806376 - DNA, 22 bp, Artificial Sequence
  chemically synthesized
tccagtatgagcactgaaactc

SEQ ID NO: 806377 - DNA, 22 bp, Artificial Sequence
  chemically synthesized
atccagtatgagcactgaaact

SEQ ID NO: 806378 - DNA, 22 bp, Artificial Sequence
  chemically synthesized
tatccagtatgagcactgaaac

SEQ ID NO: 806379 - DNA, 22 bp, Artificial Sequence
  chemically synthesized
ttatccagtatgagcactgaaa

SEQ ID NO: 806380 - DNA, 22 bp, Artificial Sequence
  chemically synthesized
ccacagtggagtttcagtgctc

SEQ ID NO: 806381 - DNA, 22 bp, Artificial Sequence
  chemically synthesized
cacagtggagtttcagtgctca

SEQ ID NO: 806382 - DNA, 22 bp, Artificial Sequence
  chemically synthesized
cagtgctcatactggataaaaa

SEQ ID NO: 806383 - DNA, 22 bp, Artificial Sequence
  chemically synthesized
agtgctcatactggataaaaat

SEQ ID NO: 806384 - DNA, 22 bp, Artificial Sequence
  chemically synthesized
atgcagacagaagatttttatc

SEQ ID NO: 806385 - DNA, 22 bp, Artificial Sequence
  chemically synthesized
atactggataaaaatcttctgt

SEQ ID NO: 806386 - DNA, 22 bp, Artificial Sequence
  chemically synthesized
caccagttaatgcagacagaag

SEQ ID NO: 806387 - DNA, 22 bp, Artificial Sequence
  chemically synthesized
gataaaaatcttctgtctgcat

SEQ ID NO: 806388 - DNA, 22 bp, Artificial Sequence
  chemically synthesized
ccctccaccagttaatgcagac

SEQ ID NO: 806389 - DNA, 22 bp, Artificial Sequence
  chemically synthesized
taccctccaccagttaatgcag

SEQ ID NO: 806390 - DNA, 22 bp, Artificial Sequence
  chemically synthesized
ttctaccctccaccagttaatg

SEQ ID NO: 806391 - DNA, 22 bp, Artificial Sequence
  chemically synthesized
ctgtctgcattaactggtggag

SEQ ID NO: 806392 - DNA, 22 bp, Artificial Sequence
  chemically synthesized
tgtctgcattaactggtggagg

SEQ ID NO: 806393 - DNA, 22 bp, Artificial Sequence
  chemically synthesized
tctgcattaactggtggagggt

SEQ ID NO: 806394 - DNA, 22 bp, Artificial Sequence
  chemically synthesized
ataaacctattctaccctccac

SEQ ID NO: 806395 - DNA, 22 bp, Artificial Sequence
  chemically synthesized
cattaactggtggagggtagaa

SEQ ID NO: 806396 - DNA, 22 bp, Artificial Sequence
  chemically synthesized
catcctcataaacctattctac

SEQ ID NO: 806397 - DNA, 22 bp, Artificial Sequence
  chemically synthesized
actggtggagggtagaataggt

SEQ ID NO: 806398 - DNA, 22 bp, Artificial Sequence
  chemically synthesized
gtggagggtagaataggtttat

SEQ ID NO: 806399 - DNA, 22 bp, Artificial Sequence
  chemically synthesized
cagtagctacatcctcataaac

SEQ ID NO: 806400 - DNA, 22 bp, Artificial Sequence
  chemically synthesized
ccagtagctacatcctcataaa

SEQ ID NO: 806401 - DNA, 22 bp, Artificial Sequence
  chemically synthesized
tccagtagctacatcctcataa

SEQ ID NO: 806402 - DNA, 22 bp, Artificial Sequence
  chemically synthesized
ttccagtagctacatcctcata

SEQ ID NO: 806403 - DNA, 22 bp, Artificial Sequence
  chemically synthesized
tttccagtagctacatcctcat

SEQ ID NO: 806404 - DNA, 22 bp, Artificial Sequence
  chemically synthesized
ttttccagtagctacatcctca

SEQ ID NO: 806405 - DNA, 22 bp, Artificial Sequence
  chemically synthesized
cttttttccagtagctacatcc

SEQ ID NO: 806406 - DNA, 22 bp, Artificial Sequence
  chemically synthesized
ccttttttccagtagctacatc

SEQ ID NO: 806407 - DNA, 22 bp, Artificial Sequence
  chemically synthesized
atgaggatgtagctactggaaa

SEQ ID NO: 806408 - DNA, 22 bp, Artificial Sequence
  chemically synthesized
tgaggatgtagctactggaaaa

SEQ ID NO: 806409 - DNA, 22 bp, Artificial Sequence
  chemically synthesized
gtgcaatgcttccttttttcca

SEQ ID NO: 806410 - DNA, 22 bp, Artificial Sequence
  chemically synthesized
agtgcaatgcttccttttttcc

SEQ ID NO: 806411 - DNA, 22 bp, Artificial Sequence
  chemically synthesized
ctggaaaaaaggaagcattgca

SEQ ID NO: 806412 - DNA, 22 bp, Artificial Sequence
  chemically synthesized
ataaatagcttagtgcaatgct

SEQ ID NO: 806413 - DNA, 22 bp, Artificial Sequence
  chemically synthesized
gaaaaaaggaagcattgcacta

SEQ ID NO: 806414 - DNA, 22 bp, Artificial Sequence
  chemically synthesized
ggagttgataaatagcttagtg

SEQ ID NO: 806415 - DNA, 22 bp, Artificial Sequence
  chemically synthesized
aggagttgataaatagcttagt

SEQ ID NO: 806416 - DNA, 22 bp, Artificial Sequence
  chemically synthesized
tttaggagttgataaatagctt

SEQ ID NO: 806417 - DNA, 22 bp, Artificial Sequence
  chemically synthesized
atttaggagttgataaatagct

SEQ ID NO: 806418 - DNA, 22 bp, Artificial Sequence
  chemically synthesized
aagtttatttaggagttgataa

SEQ ID NO: 806419 - DNA, 22 bp, Artificial Sequence
  chemically synthesized
cactaagctatttatcaactcc

SEQ ID NO: 806420 - DNA, 22 bp, Artificial Sequence
  chemically synthesized
agctatttatcaactcctaaat

SEQ ID NO: 806421 - DNA, 22 bp, Artificial Sequence
  chemically synthesized
tgcagtattaaagtttatttag

SEQ ID NO: 806422 - DNA, 22 bp, Artificial Sequence
  chemically synthesized
tttatcaactcctaaataaact

SEQ ID NO: 806423 - DNA, 22 bp, Artificial Sequence
  chemically synthesized
atcaactcctaaataaacttta

SEQ ID NO: 806424 - DNA, 22 bp, Artificial Sequence
  chemically synthesized
tcaactcctaaataaactttaa

SEQ ID NO: 806425 - DNA, 22 bp, Artificial Sequence
  chemically synthesized
agctgtgcagtattaaagttta

SEQ ID NO: 806426 - DNA, 22 bp, Artificial Sequence
  chemically synthesized
cagctgtgcagtattaaagttt

SEQ ID NO: 806427 - DNA, 22 bp, Artificial Sequence
  chemically synthesized
tcagctgtgcagtattaaagtt

SEQ ID NO: 806428 - DNA, 22 bp, Artificial Sequence
  chemically synthesized
cctttcagctgtgcagtattaa

SEQ ID NO: 806429 - DNA, 22 bp, Artificial Sequence
  chemically synthesized
ctaaataaactttaatactgca

SEQ ID NO: 806430 - DNA, 22 bp, Artificial Sequence
  chemically synthesized
aataaactttaatactgcacag

SEQ ID NO: 806431 - DNA, 22 bp, Artificial Sequence
  chemically synthesized
cactacctttcagctgtgcagt

SEQ ID NO: 806432 - DNA, 22 bp, Artificial Sequence
  chemically synthesized
taatactgcacagctgaaaggt

SEQ ID NO: 806433 - DNA, 22 bp, Artificial Sequence
  chemically synthesized
aatactgcacagctgaaaggta

SEQ ID NO: 806434 - DNA, 22 bp, Artificial Sequence
  chemically synthesized
atactgcacagctgaaaggtag

SEQ ID NO: 806435 - DNA, 22 bp, Artificial Sequence
  chemically synthesized
cacagctgaaaggtagtgtagg

SEQ ID NO: 806436 - DNA, 22 bp, Artificial Sequence
  chemically synthesized
cccaaccagaaccctacactac

SEQ ID NO: 806437 - DNA, 22 bp, Artificial Sequence
  chemically synthesized
gcccaaccagaaccctacacta

SEQ ID NO: 806438 - DNA, 22 bp, Artificial Sequence
  chemically synthesized
tttgcccaaccagaaccctaca

SEQ ID NO: 806439 - DNA, 22 bp, Artificial Sequence
  chemically synthesized
atttgcccaaccagaaccctac

SEQ ID NO: 806440 - DNA, 22 bp, Artificial Sequence
  chemically synthesized
aaaggtagtgtagggttctggt

SEQ ID NO: 806441 - DNA, 22 bp, Artificial Sequence
  chemically synthesized
atttatttgcccaaccagaacc

SEQ ID NO: 806442 - DNA, 22 bp, Artificial Sequence
  chemically synthesized
aatttatttgcccaaccagaac

SEQ ID NO: 806443 - DNA, 22 bp, Artificial Sequence
  chemically synthesized
catgaggtttaatttatttgcc

SEQ ID NO: 806444 - DNA, 22 bp, Artificial Sequence
  chemically synthesized
aactacatgaggtttaatttat

SEQ ID NO: 806445 - DNA, 22 bp, Artificial Sequence
  chemically synthesized
tggttgggcaaataaattaaac

SEQ ID NO: 806446 - DNA, 22 bp, Artificial Sequence
  chemically synthesized
gaactacatgaggtttaattta

SEQ ID NO: 806447 - DNA, 22 bp, Artificial Sequence
  chemically synthesized
gttgggcaaataaattaaacct

SEQ ID NO: 806448 - DNA, 22 bp, Artificial Sequence
  chemically synthesized
ggcaaataaattaaacctcatg

SEQ ID NO: 806449 - DNA, 22 bp, Artificial Sequence
  chemically synthesized
gcccttgaactacatgaggttt

SEQ ID NO: 806450 - DNA, 22 bp, Artificial Sequence
  chemically synthesized
aacctcatgtagttcaagggct

SEQ ID NO: 806451 - DNA, 22 bp, Artificial Sequence
  chemically synthesized
atgtagttcaagggctaacgtg

SEQ ID NO: 806452 - DNA, 22 bp, Artificial Sequence
  chemically synthesized
aagggctaacgtggactgccgg

SEQ ID NO: 806453 - DNA, 22 bp, Artificial Sequence
  chemically synthesized
gataagcagggagccggcagtc

SEQ ID NO: 806454 - DNA, 22 bp, Artificial Sequence
  chemically synthesized
acgtggactgccggctccctgc

SEQ ID NO: 806455 - DNA, 22 bp, Artificial Sequence
  chemically synthesized
aaaactagataagcagggagcc

SEQ ID NO: 806456 - DNA, 22 bp, Artificial Sequence
  chemically synthesized
cctgaaaactagataagcaggg

SEQ ID NO: 806457 - DNA, 22 bp, Artificial Sequence
  chemically synthesized
gcctgaaaactagataagcagg

SEQ ID NO: 806458 - DNA, 22 bp, Artificial Sequence
  chemically synthesized
ccggctccctgcttatctagtt

SEQ ID NO: 806459 - DNA, 22 bp, Artificial Sequence
  chemically synthesized
atagtttgcctgaaaactagat

SEQ ID NO: 806460 - DNA, 22 bp, Artificial Sequence
  chemically synthesized
cctgcttatctagttttcaggc

SEQ ID NO: 806461 - DNA, 22 bp, Artificial Sequence
  chemically synthesized
cattgatagtttgcctgaaaac

SEQ ID NO: 806462 - DNA, 22 bp, Artificial Sequence
  chemically synthesized
gcattgatagtttgcctgaaaa

SEQ ID NO: 806463 - DNA, 22 bp, Artificial Sequence
  chemically synthesized
cttatctagttttcaggcaaac

SEQ ID NO: 806464 - DNA, 22 bp, Artificial Sequence
  chemically synthesized
cttgcattgatagtttgcctga

SEQ ID NO: 806465 - DNA, 22 bp, Artificial Sequence
  chemically synthesized
tccttgcattgatagtttgcct

SEQ ID NO: 806466 - DNA, 22 bp, Artificial Sequence
  chemically synthesized
atctagttttcaggcaaactat

SEQ ID NO: 806467 - DNA, 22 bp, Artificial Sequence
  chemically synthesized
ctccttgcattgatagtttgcc

SEQ ID NO: 806468 - DNA, 22 bp, Artificial Sequence
  chemically synthesized
tctagttttcaggcaaactatc

SEQ ID NO: 806469 - DNA, 22 bp, Artificial Sequence
  chemically synthesized
gttttcaggcaaactatcaatg

SEQ ID NO: 806470 - DNA, 22 bp, Artificial Sequence
  chemically synthesized
atatttctccttgcattgatag

SEQ ID NO: 806471 - DNA, 22 bp, Artificial Sequence
  chemically synthesized
gatatttctccttgcattgata

SEQ ID NO: 806472 - DNA, 22 bp, Artificial Sequence
  chemically synthesized
tgatatttctccttgcattgat

SEQ ID NO: 806473 - DNA, 22 bp, Artificial Sequence
  chemically synthesized
tcaggcaaactatcaatgcaag

SEQ ID NO: 806474 - DNA, 22 bp, Artificial Sequence
  chemically synthesized
ttgatatttctccttgcattga

SEQ ID NO: 806475 - DNA, 22 bp, Artificial Sequence
  chemically synthesized
caggcaaactatcaatgcaagg

SEQ ID NO: 806476 - DNA, 22 bp, Artificial Sequence
  chemically synthesized
aggcaaactatcaatgcaagga

SEQ ID NO: 806477 - DNA, 22 bp, Artificial Sequence
  chemically synthesized
ttttgatatttctccttgcatt

SEQ ID NO: 806478 - DNA, 22 bp, Artificial Sequence
  chemically synthesized
tcaatgcaaggagaaatatcaa

SEQ ID NO: 806479 - DNA, 22 bp, Artificial Sequence
  chemically synthesized
aagcatgatacataaaaagata

SEQ ID NO: 806480 - DNA, 22 bp, Artificial Sequence
  chemically synthesized
caagcatgatacataaaaagat

SEQ ID NO: 806481 - DNA, 22 bp, Artificial Sequence
  chemically synthesized
tcaagcatgatacataaaaaga

SEQ ID NO: 806482 - DNA, 22 bp, Artificial Sequence
  chemically synthesized
ttcaagcatgatacataaaaag

SEQ ID NO: 806483 - DNA, 22 bp, Artificial Sequence
  chemically synthesized
aatttttcaagcatgatacata

SEQ ID NO: 806484 - DNA, 22 bp, Artificial Sequence
  chemically synthesized
tgaatttttcaagcatgataca

SEQ ID NO: 806485 - DNA, 22 bp, Artificial Sequence
  chemically synthesized
atctttttatgtatcatgcttg

SEQ ID NO: 806486 - DNA, 22 bp, Artificial Sequence
  chemically synthesized
tctttttatgtatcatgcttga

SEQ ID NO: 806487 - DNA, 22 bp, Artificial Sequence
  chemically synthesized
tttatgtatcatgcttgaaaaa

SEQ ID NO: 806488 - DNA, 22 bp, Artificial Sequence
  chemically synthesized
ttatgtatcatgcttgaaaaat

SEQ ID NO: 806489 - DNA, 22 bp, Artificial Sequence
  chemically synthesized
cagtggttctgaatttttcaag

SEQ ID NO: 806490 - DNA, 22 bp, Artificial Sequence
  chemically synthesized
tatgtatcatgcttgaaaaatt

SEQ ID NO: 806491 - DNA, 22 bp, Artificial Sequence
  chemically synthesized
atgtatcatgcttgaaaaattc

SEQ ID NO: 806492 - DNA, 22 bp, Artificial Sequence
  chemically synthesized
tgtatcatgcttgaaaaattca

SEQ ID NO: 806493 - DNA, 22 bp, Artificial Sequence
  chemically synthesized
ttgcagtggttctgaatttttc

SEQ ID NO: 806494 - DNA, 22 bp, Artificial Sequence
  chemically synthesized
gtggagttgttgcagtggttct

SEQ ID NO: 806495 - DNA, 22 bp, Artificial Sequence
  chemically synthesized
gaaaaattcagaaccactgcaa

SEQ ID NO: 806496 - DNA, 22 bp, Artificial Sequence
  chemically synthesized
aaaaattcagaaccactgcaac

SEQ ID NO: 806497 - DNA, 22 bp, Artificial Sequence
  chemically synthesized
agattcgtggagttgttgcagt

SEQ ID NO: 806498 - DNA, 22 bp, Artificial Sequence
  chemically synthesized
agaaccactgcaacaactccac

SEQ ID NO: 806499 - DNA, 22 bp, Artificial Sequence
  chemically synthesized
tagcattgagattcgtggagtt

SEQ ID NO: 806500 - DNA, 22 bp, Artificial Sequence
  chemically synthesized
caacaactccacgaatctcaat

SEQ ID NO: 806501 - DNA, 22 bp, Artificial Sequence
  chemically synthesized
cacgaatctcaatgctacaatt

SEQ ID NO: 806502 - DNA, 22 bp, Artificial Sequence
  chemically synthesized
taaggtgtatgcccaattgtag

SEQ ID NO: 806503 - DNA, 22 bp, Artificial Sequence
  chemically synthesized
aaactgtaaggtgtatgcccaa

SEQ ID NO: 806504 - DNA, 22 bp, Artificial Sequence
  chemically synthesized
aatgctacaattgggcatacac

SEQ ID NO: 806505 - DNA, 22 bp, Artificial Sequence
  chemically synthesized
caattgggcatacaccttacag

SEQ ID NO: 806506 - DNA, 22 bp, Artificial Sequence
  chemically synthesized
cacatggttcaaactgtaaggt

SEQ ID NO: 806507 - DNA, 22 bp, Artificial Sequence
  chemically synthesized
ggcatacaccttacagtttgaa

SEQ ID NO: 806508 - DNA, 22 bp, Artificial Sequence
  chemically synthesized
tcagcagttacacatggttcaa

SEQ ID NO: 806509 - DNA, 22 bp, Artificial Sequence
  chemically synthesized
acagtttgaaccatgtgtaact

SEQ ID NO: 806510 - DNA, 22 bp, Artificial Sequence
  chemically synthesized
cagtttgaaccatgtgtaactg

SEQ ID NO: 806511 - DNA, 22 bp, Artificial Sequence
  chemically synthesized
gaaccatgtgtaactgctgaca

SEQ ID NO: 806512 - DNA, 22 bp, Artificial Sequence
  chemically synthesized
aaccatgtgtaactgctgacaa

SEQ ID NO: 806513 - DNA, 22 bp, Artificial Sequence
  chemically synthesized
taggtcacacccagtcaattgt

SEQ ID NO: 806514 - DNA, 22 bp, Artificial Sequence
  chemically synthesized
ataggtcacacccagtcaattg

SEQ ID NO: 806515 - DNA, 22 bp, Artificial Sequence
  chemically synthesized
tataggtcacacccagtcaatt

SEQ ID NO: 806516 - DNA, 22 bp, Artificial Sequence
  chemically synthesized
ttataggtcacacccagtcaat

SEQ ID NO: 806517 - DNA, 22 bp, Artificial Sequence
  chemically synthesized
ctgacaattgactgggtgtgac

SEQ ID NO: 806518 - DNA, 22 bp, Artificial Sequence
  chemically synthesized
ccacttttataggtcacaccca

SEQ ID NO: 806519 - DNA, 22 bp, Artificial Sequence
  chemically synthesized
acaattgactgggtgtgaccta

SEQ ID NO: 806520 - DNA, 22 bp, Artificial Sequence
  chemically synthesized
actgggtgtgacctataaaagt

SEQ ID NO: 806521 - DNA, 22 bp, Artificial Sequence
  chemically synthesized
catgaaactgccacttttatag

SEQ ID NO: 806522 - DNA, 22 bp, Artificial Sequence
  chemically synthesized
ggtgtgacctataaaagtggca

SEQ ID NO: 806523 - DNA, 22 bp, Artificial Sequence
  chemically synthesized
atgcaaactgcatgaaactgcc

SEQ ID NO: 806524 - DNA, 22 bp, Artificial Sequence
  chemically synthesized
aatgcaaactgcatgaaactgc

SEQ ID NO: 806525 - DNA, 22 bp, Artificial Sequence
  chemically synthesized
taaaagtggcagtttcatgcag

SEQ ID NO: 806526 - DNA, 22 bp, Artificial Sequence
  chemically synthesized
gagatggagtaagtcttaatgc

SEQ ID NO: 806527 - DNA, 22 bp, Artificial Sequence
  chemically synthesized
catgcagtttgcattaagactt

SEQ ID NO: 806528 - DNA, 22 bp, Artificial Sequence
  chemically synthesized
atgcagtttgcattaagactta

SEQ ID NO: 806529 - DNA, 22 bp, Artificial Sequence
  chemically synthesized
cactggagatggagtaagtctt

SEQ ID NO: 806530 - DNA, 22 bp, Artificial Sequence
  chemically synthesized
gcactggagatggagtaagtct

SEQ ID NO: 806531 - DNA, 22 bp, Artificial Sequence
  chemically synthesized
tgcactggagatggagtaagtc

SEQ ID NO: 806532 - DNA, 22 bp, Artificial Sequence
  chemically synthesized
gcattaagacttactccatctc

SEQ ID NO: 806533 - DNA, 22 bp, Artificial Sequence
  chemically synthesized
cattaagacttactccatctcc

SEQ ID NO: 806534 - DNA, 22 bp, Artificial Sequence
  chemically synthesized
caaattttgcactggagatgga

SEQ ID NO: 806535 - DNA, 22 bp, Artificial Sequence
  chemically synthesized
ttccaaattttgcactggagat

SEQ ID NO: 806536 - DNA, 22 bp, Artificial Sequence
  chemically synthesized
agacttactccatctccagtgc

SEQ ID NO: 806537 - DNA, 22 bp, Artificial Sequence
  chemically synthesized
tgttccaaattttgcactggag

SEQ ID NO: 806538 - DNA, 22 bp, Artificial Sequence
  chemically synthesized
ctgttccaaattttgcactgga

SEQ ID NO: 806539 - DNA, 22 bp, Artificial Sequence
  chemically synthesized
tttctgttccaaattttgcact

SEQ ID NO: 806540 - DNA, 22 bp, Artificial Sequence
  chemically synthesized
actccatctccagtgcaaaatt

SEQ ID NO: 806541 - DNA, 22 bp, Artificial Sequence
  chemically synthesized
atttctgttccaaattttgcac

SEQ ID NO: 806542 - DNA, 22 bp, Artificial Sequence
  chemically synthesized
ctccatctccagtgcaaaattt

SEQ ID NO: 806543 - DNA, 22 bp, Artificial Sequence
  chemically synthesized
catctccagtgcaaaatttgga

SEQ ID NO: 806544 - DNA, 22 bp, Artificial Sequence
  chemically synthesized
cagtgcaaaatttggaacagaa

SEQ ID NO: 806545 - DNA, 22 bp, Artificial Sequence
  chemically synthesized
gaatgtgacagcttatttctgt

SEQ ID NO: 806546 - DNA, 22 bp, Artificial Sequence
  chemically synthesized
tggaatgtgacagcttatttct

SEQ ID NO: 806547 - DNA, 22 bp, Artificial Sequence
  chemically synthesized
tattctggaatgtgacagctta

SEQ ID NO: 806548 - DNA, 22 bp, Artificial Sequence
  chemically synthesized
atattctggaatgtgacagctt

SEQ ID NO: 806549 - DNA, 22 bp, Artificial Sequence
  chemically synthesized
ggaacagaaataagctgtcaca

SEQ ID NO: 806550 - DNA, 22 bp, Artificial Sequence
  chemically synthesized
gaacagaaataagctgtcacat

SEQ ID NO: 806551 - DNA, 22 bp, Artificial Sequence
  chemically synthesized
catttatattctggaatgtgac

SEQ ID NO: 806552 - DNA, 22 bp, Artificial Sequence
  chemically synthesized
accctgcatttatattctggaa

SEQ ID NO: 806553 - DNA, 22 bp, Artificial Sequence
  chemically synthesized
tcacattccagaatataaatgc

SEQ ID NO: 806554 - DNA, 22 bp, Artificial Sequence
  chemically synthesized
cagaatataaatgcagggttag

SEQ ID NO: 806555 - DNA, 22 bp, Artificial Sequence
  chemically synthesized
gaaaatatgtcaaatgtctaac

SEQ ID NO: 806556 - DNA, 22 bp, Artificial Sequence
  chemically synthesized
cattagaaaatatgtcaaatgt

SEQ ID NO: 806557 - DNA, 22 bp, Artificial Sequence
  chemically synthesized
gactacattagaaaatatgtca

SEQ ID NO: 806558 - DNA, 22 bp, Artificial Sequence
  chemically synthesized
gacatttgacatattttctaat

SEQ ID NO: 806559 - DNA, 22 bp, Artificial Sequence
  chemically synthesized
aaattggactacattagaaaat

SEQ ID NO: 806560 - DNA, 22 bp, Artificial Sequence
  chemically synthesized
gaaattggactacattagaaaa

SEQ ID NO: 806561 - DNA, 22 bp, Artificial Sequence
  chemically synthesized
tttgaaattggactacattaga

SEQ ID NO: 806562 - DNA, 22 bp, Artificial Sequence
  chemically synthesized
gtttgaaattggactacattag

SEQ ID NO: 806563 - DNA, 22 bp, Artificial Sequence
  chemically synthesized
tgtttgaaattggactacatta

SEQ ID NO: 806564 - DNA, 22 bp, Artificial Sequence
  chemically synthesized
gacatattttctaatgtagtcc

SEQ ID NO: 806565 - DNA, 22 bp, Artificial Sequence
  chemically synthesized
acatattttctaatgtagtcca

SEQ ID NO: 806566 - DNA, 22 bp, Artificial Sequence
  chemically synthesized
aattttgtttgaaattggacta

SEQ ID NO: 806567 - DNA, 22 bp, Artificial Sequence
  chemically synthesized
aaattttgtttgaaattggact

SEQ ID NO: 806568 - DNA, 22 bp, Artificial Sequence
  chemically synthesized
taaattttgtttgaaattggac

SEQ ID NO: 806569 - DNA, 22 bp, Artificial Sequence
  chemically synthesized
ttaaattttgtttgaaattgga

SEQ ID NO: 806570 - DNA, 22 bp, Artificial Sequence
  chemically synthesized
tctaatgtagtccaatttcaaa

SEQ ID NO: 806571 - DNA, 22 bp, Artificial Sequence
  chemically synthesized
ctaatgtagtccaatttcaaac

SEQ ID NO: 806572 - DNA, 22 bp, Artificial Sequence
  chemically synthesized
taatgtagtccaatttcaaaca

SEQ ID NO: 806573 - DNA, 22 bp, Artificial Sequence
  chemically synthesized
atgtagtccaatttcaaacaaa

SEQ ID NO: 806574 - DNA, 22 bp, Artificial Sequence
  chemically synthesized
atatttttaaattttgtttgaa

SEQ ID NO: 806575 - DNA, 22 bp, Artificial Sequence
  chemically synthesized
catatttttaaattttgtttga

SEQ ID NO: 806576 - DNA, 22 bp, Artificial Sequence
  chemically synthesized
caaacaaaatttaaaaatatga

SEQ ID NO: 806577 - DNA, 22 bp, Artificial Sequence
  chemically synthesized
aaacaaaatttaaaaatatgaa

SEQ ID NO: 806578 - DNA, 22 bp, Artificial Sequence
  chemically synthesized
ccatgggagaatttcatatttt

SEQ ID NO: 806579 - DNA, 22 bp, Artificial Sequence
  chemically synthesized
tgccatgggagaatttcatatt

SEQ ID NO: 806580 - DNA, 22 bp, Artificial Sequence
  chemically synthesized
actctgccatgggagaatttca

SEQ ID NO: 806581 - DNA, 22 bp, Artificial Sequence
  chemically synthesized
cactctgccatgggagaatttc

SEQ ID NO: 806582 - DNA, 22 bp, Artificial Sequence
  chemically synthesized
aaaaatatgaaattctcccatg

SEQ ID NO: 806583 - DNA, 22 bp, Artificial Sequence
  chemically synthesized
aaaatatgaaattctcccatgg

SEQ ID NO: 806584 - DNA, 22 bp, Artificial Sequence
  chemically synthesized
agtttcactctgccatgggaga

SEQ ID NO: 806585 - DNA, 22 bp, Artificial Sequence
  chemically synthesized
taagtttcactctgccatggga

SEQ ID NO: 806586 - DNA, 22 bp, Artificial Sequence
  chemically synthesized
tctaagtttcactctgccatgg

SEQ ID NO: 806587 - DNA, 22 bp, Artificial Sequence
  chemically synthesized
cattctctaagtttcactctgc

SEQ ID NO: 806588 - DNA, 22 bp, Artificial Sequence
  chemically synthesized
tcccatggcagagtgaaactta

SEQ ID NO: 806589 - DNA, 22 bp, Artificial Sequence
  chemically synthesized
ccatggcagagtgaaacttaga

SEQ ID NO: 806590 - DNA, 22 bp, Artificial Sequence
  chemically synthesized
ataaaatgcacaatattacatt

SEQ ID NO: 806591 - DNA, 22 bp, Artificial Sequence
  chemically synthesized
atgctgataaaatgcacaatat

SEQ ID NO: 806592 - DNA, 22 bp, Artificial Sequence
  chemically synthesized
agagaatgtaatattgtgcatt

SEQ ID NO: 806593 - DNA, 22 bp, Artificial Sequence
  chemically synthesized
gagaatgtaatattgtgcattt

SEQ ID NO: 806594 - DNA, 22 bp, Artificial Sequence
  chemically synthesized
atcatgaagctgatgctgataa

SEQ ID NO: 806595 - DNA, 22 bp, Artificial Sequence
  chemically synthesized
tgcattttatcagcatcagctt

SEQ ID NO: 806596 - DNA, 22 bp, Artificial Sequence
  chemically synthesized
tatcagcatcagcttcatgatg

SEQ ID NO: 806597 - DNA, 22 bp, Artificial Sequence
  chemically synthesized
atcagcatcagcttcatgatga

SEQ ID NO: 806598 - DNA, 22 bp, Artificial Sequence
  chemically synthesized
tcagcatcagcttcatgatgag

SEQ ID NO: 806599 - DNA, 22 bp, Artificial Sequence
  chemically synthesized
agatgcatcaagcgcagctcat

SEQ ID NO: 806600 - DNA, 22 bp, Artificial Sequence
  chemically synthesized
catgatgagctgcgcttgatgc

SEQ ID NO: 806601 - DNA, 22 bp, Artificial Sequence
  chemically synthesized
atgatgagctgcgcttgatgca

SEQ ID NO: 806602 - DNA, 22 bp, Artificial Sequence
  chemically synthesized
aggatagaggagctaagatgca

SEQ ID NO: 806603 - DNA, 22 bp, Artificial Sequence
  chemically synthesized
aaggatagaggagctaagatgc

SEQ ID NO: 806604 - DNA, 22 bp, Artificial Sequence
  chemically synthesized
cgcttgatgcatcttagctcct

SEQ ID NO: 806605 - DNA, 22 bp, Artificial Sequence
  chemically synthesized
gtttaaggatagaggagctaag

SEQ ID NO: 806606 - DNA, 22 bp, Artificial Sequence
  chemically synthesized
tagtttaaggatagaggagcta

SEQ ID NO: 806607 - DNA, 22 bp, Artificial Sequence
  chemically synthesized
ctagtttaaggatagaggagct

SEQ ID NO: 806608 - DNA, 22 bp, Artificial Sequence
  chemically synthesized
gatgcatcttagctcctctatc

SEQ ID NO: 806609 - DNA, 22 bp, Artificial Sequence
  chemically synthesized
atgcatcttagctcctctatcc

SEQ ID NO: 806610 - DNA, 22 bp, Artificial Sequence
  chemically synthesized
agctcctctatccttaaactag

SEQ ID NO: 806611 - DNA, 22 bp, Artificial Sequence
  chemically synthesized
gctcctctatccttaaactaga

SEQ ID NO: 806612 - DNA, 22 bp, Artificial Sequence
  chemically synthesized
ctctatccttaaactagaaatg

SEQ ID NO: 806613 - DNA, 22 bp, Artificial Sequence
  chemically synthesized
tatccttaaactagaaatgccg

SEQ ID NO: 806614 - DNA, 22 bp, Artificial Sequence
  chemically synthesized
tccttaaactagaaatgccgct

SEQ ID NO: 806615 - DNA, 22 bp, Artificial Sequence
  chemically synthesized
gaagcagagggtaagcggcatt

SEQ ID NO: 806616 - DNA, 22 bp, Artificial Sequence
  chemically synthesized
tggaagcagagggtaagcggca

SEQ ID NO: 806617 - DNA, 22 bp, Artificial Sequence
  chemically synthesized
aaactagaaatgccgcttaccc

SEQ ID NO: 806618 - DNA, 22 bp, Artificial Sequence
  chemically synthesized
tctggaagcagagggtaagcgg

SEQ ID NO: 806619 - DNA, 22 bp, Artificial Sequence
  chemically synthesized
aactagaaatgccgcttaccct

SEQ ID NO: 806620 - DNA, 22 bp, Artificial Sequence
  chemically synthesized
ctctggaagcagagggtaagcg

SEQ ID NO: 806621 - DNA, 22 bp, Artificial Sequence
  chemically synthesized
tctctggaagcagagggtaagc

SEQ ID NO: 806622 - DNA, 22 bp, Artificial Sequence
  chemically synthesized
ctttctctggaagcagagggta

SEQ ID NO: 806623 - DNA, 22 bp, Artificial Sequence
  chemically synthesized
gaaatgccgcttaccctctgct

SEQ ID NO: 806624 - DNA, 22 bp, Artificial Sequence
  chemically synthesized
gttactttctctggaagcagag

SEQ ID NO: 806625 - DNA, 22 bp, Artificial Sequence
  chemically synthesized
ctagttactttctctggaagca

SEQ ID NO: 806626 - DNA, 22 bp, Artificial Sequence
  chemically synthesized
actagttactttctctggaagc

SEQ ID NO: 806627 - DNA, 22 bp, Artificial Sequence
  chemically synthesized
tttactagttactttctctgga

SEQ ID NO: 806628 - DNA, 22 bp, Artificial Sequence
  chemically synthesized
accctctgcttccagagaaagt

SEQ ID NO: 806629 - DNA, 22 bp, Artificial Sequence
  chemically synthesized
ccctctgcttccagagaaagta

SEQ ID NO: 806630 - DNA, 22 bp, Artificial Sequence
  chemically synthesized
tgcttccagagaaagtaactag

SEQ ID NO: 806631 - DNA, 22 bp, Artificial Sequence
  chemically synthesized
gaaagttatttactagttactt

SEQ ID NO: 806632 - DNA, 22 bp, Artificial Sequence
  chemically synthesized
ggaaagttatttactagttact

SEQ ID NO: 806633 - DNA, 22 bp, Artificial Sequence
  chemically synthesized
cttccagagaaagtaactagta

SEQ ID NO: 806634 - DNA, 22 bp, Artificial Sequence
  chemically synthesized
ttggaaagttatttactagtta

SEQ ID NO: 806635 - DNA, 22 bp, Artificial Sequence
  chemically synthesized
ccagagaaagtaactagtaaat

SEQ ID NO: 806636 - DNA, 22 bp, Artificial Sequence
  chemically synthesized
cagagaaagtaactagtaaata

SEQ ID NO: 806637 - DNA, 22 bp, Artificial Sequence
  chemically synthesized
caaataactcttggaaagttat

SEQ ID NO: 806638 - DNA, 22 bp, Artificial Sequence
  chemically synthesized
gcaaataactcttggaaagtta

SEQ ID NO: 806639 - DNA, 22 bp, Artificial Sequence
  chemically synthesized
tgcaaataactcttggaaagtt

SEQ ID NO: 806640 - DNA, 22 bp, Artificial Sequence
  chemically synthesized
cattttgcaaataactcttgga

SEQ ID NO: 806641 - DNA, 22 bp, Artificial Sequence
  chemically synthesized
gtaaataactttccaagagtta

SEQ ID NO: 806642 - DNA, 22 bp, Artificial Sequence
  chemically synthesized
tgtgcattgcattttgcaaata

SEQ ID NO: 806643 - DNA, 22 bp, Artificial Sequence
  chemically synthesized
atgtgcattgcattttgcaaat

SEQ ID NO: 806644 - DNA, 22 bp, Artificial Sequence
  chemically synthesized
tccaagagttatttgcaaaatg

SEQ ID NO: 806645 - DNA, 22 bp, Artificial Sequence
  chemically synthesized
ccaagagttatttgcaaaatgc

SEQ ID NO: 806646 - DNA, 22 bp, Artificial Sequence
  chemically synthesized
caagagttatttgcaaaatgca

SEQ ID NO: 806647 - DNA, 22 bp, Artificial Sequence
  chemically synthesized
atttatgtgcattgcattttgc

SEQ ID NO: 806648 - DNA, 22 bp, Artificial Sequence
  chemically synthesized
atctgatttatgtgcattgcat

SEQ ID NO: 806649 - DNA, 22 bp, Artificial Sequence
  chemically synthesized
catctgatttatgtgcattgca

SEQ ID NO: 806650 - DNA, 22 bp, Artificial Sequence
  chemically synthesized
tcatctgatttatgtgcattgc

SEQ ID NO: 806651 - DNA, 22 bp, Artificial Sequence
  chemically synthesized
tttgcaaaatgcaatgcacata

SEQ ID NO: 806652 - DNA, 22 bp, Artificial Sequence
  chemically synthesized
tttcatctgatttatgtgcatt

SEQ ID NO: 806653 - DNA, 22 bp, Artificial Sequence
  chemically synthesized
gcaaaatgcaatgcacataaat

SEQ ID NO: 806654 - DNA, 22 bp, Artificial Sequence
  chemically synthesized
caaaatgcaatgcacataaatc

SEQ ID NO: 806655 - DNA, 22 bp, Artificial Sequence
  chemically synthesized
ggtagaactctttcatctgatt

SEQ ID NO: 806656 - DNA, 22 bp, Artificial Sequence
  chemically synthesized
tctcggtagaactctttcatct

SEQ ID NO: 806657 - DNA, 22 bp, Artificial Sequence
  chemically synthesized
aaaatcacattgtctcggtaga

SEQ ID NO: 806658 - DNA, 22 bp, Artificial Sequence
  chemically synthesized
gctgaaaatcacattgtctcgg

SEQ ID NO: 806659 - DNA, 22 bp, Artificial Sequence
  chemically synthesized
ggctgaaaatcacattgtctcg

SEQ ID NO: 806660 - DNA, 22 bp, Artificial Sequence
  chemically synthesized
taccgagacaatgtgattttca

SEQ ID NO: 806661 - DNA, 22 bp, Artificial Sequence
  chemically synthesized
gtaggatttggctgaaaatcac

SEQ ID NO: 806662 - DNA, 22 bp, Artificial Sequence
  chemically synthesized
ccgagacaatgtgattttcagc

SEQ ID NO: 806663 - DNA, 22 bp, Artificial Sequence
  chemically synthesized
ctggtaggatttggctgaaaat

SEQ ID NO: 806664 - DNA, 22 bp, Artificial Sequence
  chemically synthesized
gctggtaggatttggctgaaaa

SEQ ID NO: 806665 - DNA, 22 bp, Artificial Sequence
  chemically synthesized
tcagccaaatcctaccagcaag

SEQ ID NO: 806666 - DNA, 22 bp, Artificial Sequence
  chemically synthesized
caaagcagcaaacttgctggta

SEQ ID NO: 806667 - DNA, 22 bp, Artificial Sequence
  chemically synthesized
cagccaaatcctaccagcaagt

SEQ ID NO: 806668 - DNA, 22 bp, Artificial Sequence
  chemically synthesized
acaaagcagcaaacttgctggt

SEQ ID NO: 806669 - DNA, 22 bp, Artificial Sequence
  chemically synthesized
agccaaatcctaccagcaagtt

SEQ ID NO: 806670 - DNA, 22 bp, Artificial Sequence
  chemically synthesized
atttacaaagcagcaaacttgc

SEQ ID NO: 806671 - DNA, 22 bp, Artificial Sequence
  chemically synthesized
agggcctaatttacaaagcagc

SEQ ID NO: 806672 - DNA, 22 bp, Artificial Sequence
  chemically synthesized
ccagcaagtttgctgctttgta

SEQ ID NO: 806673 - DNA, 22 bp, Artificial Sequence
  chemically synthesized
cctaagggcctaatttacaaag

SEQ ID NO: 806674 - DNA, 22 bp, Artificial Sequence
  chemically synthesized
ccctaagggcctaatttacaaa

SEQ ID NO: 806675 - DNA, 22 bp, Artificial Sequence
  chemically synthesized
ttccctaagggcctaatttaca

SEQ ID NO: 806676 - DNA, 22 bp, Artificial Sequence
  chemically synthesized
ttcttccctaagggcctaattt

SEQ ID NO: 806677 - DNA, 22 bp, Artificial Sequence
  chemically synthesized
gctgctttgtaaattaggccct

SEQ ID NO: 806678 - DNA, 22 bp, Artificial Sequence
  chemically synthesized
ctgctttgtaaattaggccctt

SEQ ID NO: 806679 - DNA, 22 bp, Artificial Sequence
  chemically synthesized
ctgttcttccctaagggcctaa

SEQ ID NO: 806680 - DNA, 22 bp, Artificial Sequence
  chemically synthesized
ctttgtaaattaggcccttagg

SEQ ID NO: 806681 - DNA, 22 bp, Artificial Sequence
  chemically synthesized
tgtaaattaggcccttagggaa

SEQ ID NO: 806682 - DNA, 22 bp, Artificial Sequence
  chemically synthesized
gtaaattaggcccttagggaag

SEQ ID NO: 806683 - DNA, 22 bp, Artificial Sequence
  chemically synthesized
taaattaggcccttagggaaga

SEQ ID NO: 806684 - DNA, 22 bp, Artificial Sequence
  chemically synthesized
aaagagttactgttcttcccta

SEQ ID NO: 806685 - DNA, 22 bp, Artificial Sequence
  chemically synthesized
tcctgaaagagttactgttctt

SEQ ID NO: 806686 - DNA, 22 bp, Artificial Sequence
  chemically synthesized
ggcccttagggaagaacagtaa

SEQ ID NO: 806687 - DNA, 22 bp, Artificial Sequence
  chemically synthesized
ctgtcctgaaagagttactgtt

SEQ ID NO: 806688 - DNA, 22 bp, Artificial Sequence
  chemically synthesized
actgtcctgaaagagttactgt

SEQ ID NO: 806689 - DNA, 22 bp, Artificial Sequence
  chemically synthesized
ttactgtcctgaaagagttact

SEQ ID NO: 806690 - DNA, 22 bp, Artificial Sequence
  chemically synthesized
cttactgtcctgaaagagttac

SEQ ID NO: 806691 - DNA, 22 bp, Artificial Sequence
  chemically synthesized
agggaagaacagtaactctttc

SEQ ID NO: 806692 - DNA, 22 bp, Artificial Sequence
  chemically synthesized
gggaagaacagtaactctttca

SEQ ID NO: 806693 - DNA, 22 bp, Artificial Sequence
  chemically synthesized
ggaaaatggtttcttactgtcc

SEQ ID NO: 806694 - DNA, 22 bp, Artificial Sequence
  chemically synthesized
aggaaaatggtttcttactgtc

SEQ ID NO: 806695 - DNA, 22 bp, Artificial Sequence
  chemically synthesized
tttcaggacagtaagaaaccat

SEQ ID NO: 806696 - DNA, 22 bp, Artificial Sequence
  chemically synthesized
tcaggacagtaagaaaccattt

SEQ ID NO: 806697 - DNA, 22 bp, Artificial Sequence
  chemically synthesized
caggacagtaagaaaccatttt

SEQ ID NO: 806698 - DNA, 22 bp, Artificial Sequence
  chemically synthesized
aggacagtaagaaaccattttc

SEQ ID NO: 806699 - DNA, 22 bp, Artificial Sequence
  chemically synthesized
agaccacaagggtatcatttag

SEQ ID NO: 806700 - DNA, 22 bp, Artificial Sequence
  chemically synthesized
cagaccacaagggtatcattta

SEQ ID NO: 806701 - DNA, 22 bp, Artificial Sequence
  chemically synthesized
tcctaaatgatacccttgtggt

SEQ ID NO: 806702 - DNA, 22 bp, Artificial Sequence
  chemically synthesized
tcaatatttcagaccacaaggg

SEQ ID NO: 806703 - DNA, 22 bp, Artificial Sequence
  chemically synthesized
cctaaatgatacccttgtggtc

SEQ ID NO: 806704 - DNA, 22 bp, Artificial Sequence
  chemically synthesized
ctaaatgatacccttgtggtct

SEQ ID NO: 806705 - DNA, 22 bp, Artificial Sequence
  chemically synthesized
aatgatacccttgtggtctgaa

SEQ ID NO: 806706 - DNA, 22 bp, Artificial Sequence
  chemically synthesized
atgttgtcaatatttcagacca

SEQ ID NO: 806707 - DNA, 22 bp, Artificial Sequence
  chemically synthesized
agcctgatgttgtcaatatttc

SEQ ID NO: 806708 - DNA, 22 bp, Artificial Sequence
  chemically synthesized
gtggtctgaaatattgacaaca

SEQ ID NO: 806709 - DNA, 22 bp, Artificial Sequence
  chemically synthesized
tggtctgaaatattgacaacat

SEQ ID NO: 806710 - DNA, 22 bp, Artificial Sequence
  chemically synthesized
gaaaatattcagcctgatgttg

SEQ ID NO: 806711 - DNA, 22 bp, Artificial Sequence
  chemically synthesized
aaatattgacaacatcaggctg

SEQ ID NO: 806712 - DNA, 22 bp, Artificial Sequence
  chemically synthesized
caaattagaaaatattcagcct

SEQ ID NO: 806713 - DNA, 22 bp, Artificial Sequence
  chemically synthesized
ccaaattagaaaatattcagcc

SEQ ID NO: 806714 - DNA, 22 bp, Artificial Sequence
  chemically synthesized
tccaaattagaaaatattcagc

SEQ ID NO: 806715 - DNA, 22 bp, Artificial Sequence
  chemically synthesized
acaacatcaggctgaatatttt

SEQ ID NO: 806716 - DNA, 22 bp, Artificial Sequence
  chemically synthesized
acgtattttccaaattagaaaa

SEQ ID NO: 806717 - DNA, 22 bp, Artificial Sequence
  chemically synthesized
aacgtattttccaaattagaaa

SEQ ID NO: 806718 - DNA, 22 bp, Artificial Sequence
  chemically synthesized
taacgtattttccaaattagaa

SEQ ID NO: 806719 - DNA, 22 bp, Artificial Sequence
  chemically synthesized
ttaacgtattttccaaattaga

SEQ ID NO: 806720 - DNA, 22 bp, Artificial Sequence
  chemically synthesized
aatattttctaatttggaaaat

SEQ ID NO: 806721 - DNA, 22 bp, Artificial Sequence
  chemically synthesized
ccatcgaatttttaacgtattt

SEQ ID NO: 806722 - DNA, 22 bp, Artificial Sequence
  chemically synthesized
tctaatttggaaaatacgttaa

SEQ ID NO: 806723 - DNA, 22 bp, Artificial Sequence
  chemically synthesized
ctaatttggaaaatacgttaaa

SEQ ID NO: 806724 - DNA, 22 bp, Artificial Sequence
  chemically synthesized
taatttggaaaatacgttaaaa

SEQ ID NO: 806725 - DNA, 22 bp, Artificial Sequence
  chemically synthesized
ttgccatcgaatttttaacgta

SEQ ID NO: 806726 - DNA, 22 bp, Artificial Sequence
  chemically synthesized
atttggaaaatacgttaaaaat

SEQ ID NO: 806727 - DNA, 22 bp, Artificial Sequence
  chemically synthesized
ttattgccatcgaatttttaac

SEQ ID NO: 806728 - DNA, 22 bp, Artificial Sequence
  chemically synthesized
ggaaaatacgttaaaaattcga

SEQ ID NO: 806729 - DNA, 22 bp, Artificial Sequence
  chemically synthesized
ctgttattgccatcgaattttt

SEQ ID NO: 806730 - DNA, 22 bp, Artificial Sequence
  chemically synthesized
gaaaatacgttaaaaattcgat

SEQ ID NO: 806731 - DNA, 22 bp, Artificial Sequence
  chemically synthesized
tgctgttattgccatcgaattt

SEQ ID NO: 806732 - DNA, 22 bp, Artificial Sequence
  chemically synthesized
ctgctgttattgccatcgaatt

SEQ ID NO: 806733 - DNA, 22 bp, Artificial Sequence
  chemically synthesized
tctgctgttattgccatcgaat

SEQ ID NO: 806734 - DNA, 22 bp, Artificial Sequence
  chemically synthesized
aaaattcgatggcaataacagc

SEQ ID NO: 806735 - DNA, 22 bp, Artificial Sequence
  chemically synthesized
aggagattttctgctgttattg

SEQ ID NO: 806736 - DNA, 22 bp, Artificial Sequence
  chemically synthesized
gaggagattttctgctgttatt

SEQ ID NO: 806737 - DNA, 22 bp, Artificial Sequence
  chemically synthesized
atttgaggagattttctgctgt

SEQ ID NO: 806738 - DNA, 22 bp, Artificial Sequence
  chemically synthesized
gatggcaataacagcagaaaat

SEQ ID NO: 806739 - DNA, 22 bp, Artificial Sequence
  chemically synthesized
aagaggcacgtaaaggagctca

SEQ ID NO: 806740 - DNA, 22 bp, Artificial Sequence
  chemically synthesized
ttcaagaggcacgtaaaggagc

SEQ ID NO: 806741 - DNA, 22 bp, Artificial Sequence
  chemically synthesized
ctcaaatgagctcctttacgtg

SEQ ID NO: 806742 - DNA, 22 bp, Artificial Sequence
  chemically synthesized
ttattcaagaggcacgtaaagg

SEQ ID NO: 806743 - DNA, 22 bp, Artificial Sequence
  chemically synthesized
aaatgagctcctttacgtgcct

SEQ ID NO: 806744 - DNA, 22 bp, Artificial Sequence
  chemically synthesized
cctattattcaagaggcacgta

SEQ ID NO: 806745 - DNA, 22 bp, Artificial Sequence
  chemically synthesized
acctattattcaagaggcacgt

SEQ ID NO: 806746 - DNA, 22 bp, Artificial Sequence
  chemically synthesized
ctttacgtgcctcttgaataat

SEQ ID NO: 806747 - DNA, 22 bp, Artificial Sequence
  chemically synthesized
tacgtgcctcttgaataatagg

SEQ ID NO: 806748 - DNA, 22 bp, Artificial Sequence
  chemically synthesized
acgtgcctcttgaataataggt

SEQ ID NO: 806749 - DNA, 22 bp, Artificial Sequence
  chemically synthesized
cgtgcctcttgaataataggta

SEQ ID NO: 806750 - DNA, 22 bp, Artificial Sequence
  chemically synthesized
ttgaataataggtaagactgtt

SEQ ID NO: 806751 - DNA, 22 bp, Artificial Sequence
  chemically synthesized
gaataataggtaagactgttgt

SEQ ID NO: 806752 - DNA, 22 bp, Artificial Sequence
  chemically synthesized
aataataggtaagactgttgtt

SEQ ID NO: 806753 - DNA, 22 bp, Artificial Sequence
  chemically synthesized
aagccgtaaaacccccacacaa

SEQ ID NO: 806754 - DNA, 22 bp, Artificial Sequence
  chemically synthesized
ttgtttcctgcttgtgtggggg

SEQ ID NO: 806755 - DNA, 22 bp, Artificial Sequence
  chemically synthesized
tttcctgcttgtgtgggggttt

SEQ ID NO: 806756 - DNA, 22 bp, Artificial Sequence
  chemically synthesized
cctgcttgtgtgggggttttac

SEQ ID NO: 806757 - DNA, 22 bp, Artificial Sequence
  chemically synthesized
ctgcttgtgtgggggttttacg

SEQ ID NO: 806758 - DNA, 22 bp, Artificial Sequence
  chemically synthesized
cttgtgtgggggttttacggct

SEQ ID NO: 806759 - DNA, 22 bp, Artificial Sequence
  chemically synthesized
gtgtgggggttttacggcttca

SEQ ID NO: 806760 - DNA, 22 bp, Artificial Sequence
  chemically synthesized
cgagagaaatgttgaagccgta

SEQ ID NO: 806761 - DNA, 22 bp, Artificial Sequence
  chemically synthesized
tgtgggggttttacggcttcaa

SEQ ID NO: 806762 - DNA, 22 bp, Artificial Sequence
  chemically synthesized
tacggcttcaacatttctctcg

SEQ ID NO: 806763 - DNA, 22 bp, Artificial Sequence
  chemically synthesized
acggcttcaacatttctctcgg

SEQ ID NO: 806764 - DNA, 22 bp, Artificial Sequence
  chemically synthesized
cggcttcaacatttctctcgga

SEQ ID NO: 806765 - DNA, 22 bp, Artificial Sequence
  chemically synthesized
caacatttctctcggaatctat

SEQ ID NO: 806766 - DNA, 22 bp, Artificial Sequence
  chemically synthesized
aacatttctctcggaatctatg

SEQ ID NO: 806767 - DNA, 22 bp, Artificial Sequence
  chemically synthesized
aacgtacacacacatagattcc

SEQ ID NO: 806768 - DNA, 22 bp, Artificial Sequence
  chemically synthesized
ctctcggaatctatgtgtgtgt

SEQ ID NO: 806769 - DNA, 22 bp, Artificial Sequence
  chemically synthesized
gggattcaacgtacacacacat

SEQ ID NO: 806770 - DNA, 22 bp, Artificial Sequence
  chemically synthesized
tctcggaatctatgtgtgtgta

SEQ ID NO: 806771 - DNA, 22 bp, Artificial Sequence
  chemically synthesized
agggattcaacgtacacacaca

SEQ ID NO: 806772 - DNA, 22 bp, Artificial Sequence
  chemically synthesized
tcggaatctatgtgtgtgtacg

SEQ ID NO: 806773 - DNA, 22 bp, Artificial Sequence
  chemically synthesized
ggaatctatgtgtgtgtacgtt

SEQ ID NO: 806774 - DNA, 22 bp, Artificial Sequence
  chemically synthesized
aaatttagggattcaacgtaca

SEQ ID NO: 806775 - DNA, 22 bp, Artificial Sequence
  chemically synthesized
tgtgtgtgtacgttgaatccct

SEQ ID NO: 806776 - DNA, 22 bp, Artificial Sequence
  chemically synthesized
gcacaattaaaatttagggatt

SEQ ID NO: 806777 - DNA, 22 bp, Artificial Sequence
  chemically synthesized
gacctggcacaattaaaattta

SEQ ID NO: 806778 - DNA, 22 bp, Artificial Sequence
  chemically synthesized
gactagacctggcacaattaaa

SEQ ID NO: 806779 - DNA, 22 bp, Artificial Sequence
  chemically synthesized
aatccctaaattttaattgtgc

SEQ ID NO: 806780 - DNA, 22 bp, Artificial Sequence
  chemically synthesized
tagactagacctggcacaatta

SEQ ID NO: 806781 - DNA, 22 bp, Artificial Sequence
  chemically synthesized
attctagactagacctggcaca

SEQ ID NO: 806782 - DNA, 22 bp, Artificial Sequence
  chemically synthesized
aattttaattgtgccaggtcta

SEQ ID NO: 806783 - DNA, 22 bp, Artificial Sequence
  chemically synthesized
actcattctagactagacctgg

SEQ ID NO: 806784 - DNA, 22 bp, Artificial Sequence
  chemically synthesized
gactcattctagactagacctg

SEQ ID NO: 806785 - DNA, 22 bp, Artificial Sequence
  chemically synthesized
ttgactcattctagactagacc

SEQ ID NO: 806786 - DNA, 22 bp, Artificial Sequence
  chemically synthesized
taattgtgccaggtctagtcta

SEQ ID NO: 806787 - DNA, 22 bp, Artificial Sequence
  chemically synthesized
aattgtgccaggtctagtctag

SEQ ID NO: 806788 - DNA, 22 bp, Artificial Sequence
  chemically synthesized
attgtgccaggtctagtctaga

SEQ ID NO: 806789 - DNA, 22 bp, Artificial Sequence
  chemically synthesized
tgccaggtctagtctagaatga

SEQ ID NO: 806790 - DNA, 22 bp, Artificial Sequence
  chemically synthesized
agtattcttgactcattctaga

SEQ ID NO: 806791 - DNA, 22 bp, Artificial Sequence
  chemically synthesized
gtctagaatgagtcaagaatac

SEQ ID NO: 806792 - DNA, 22 bp, Artificial Sequence
  chemically synthesized
gaatgagtcaagaatacttaat

SEQ ID NO: 806793 - DNA, 22 bp, Artificial Sequence
  chemically synthesized
aatgcacagatatggaaattaa

SEQ ID NO: 806794 - DNA, 22 bp, Artificial Sequence
  chemically synthesized
gagcatgttgaatgcacagata

SEQ ID NO: 806795 - DNA, 22 bp, Artificial Sequence
  chemically synthesized
agagcatgttgaatgcacagat

SEQ ID NO: 806796 - DNA, 22 bp, Artificial Sequence
  chemically synthesized
aatttccatatctgtgcattca

SEQ ID NO: 806797 - DNA, 22 bp, Artificial Sequence
  chemically synthesized
atttccatatctgtgcattcaa

SEQ ID NO: 806798 - DNA, 22 bp, Artificial Sequence
  chemically synthesized
ccatatctgtgcattcaacatg

SEQ ID NO: 806799 - DNA, 22 bp, Artificial Sequence
  chemically synthesized
catatctgtgcattcaacatgc

SEQ ID NO: 806800 - DNA, 22 bp, Artificial Sequence
  chemically synthesized
tatgatacatttagagcatgtt

SEQ ID NO: 806801 - DNA, 22 bp, Artificial Sequence
  chemically synthesized
tgcattcaacatgctctaaatg

SEQ ID NO: 806802 - DNA, 22 bp, Artificial Sequence
  chemically synthesized
aaactatatgatacatttagag

SEQ ID NO: 806803 - DNA, 22 bp, Artificial Sequence
  chemically synthesized
aaaactatatgatacatttaga

SEQ ID NO: 806804 - DNA, 22 bp, Artificial Sequence
  chemically synthesized
aacatgctctaaatgtatcata

SEQ ID NO: 806805 - DNA, 22 bp, Artificial Sequence
  chemically synthesized
cggaaaatttaaaactatatga

SEQ ID NO: 806806 - DNA, 22 bp, Artificial Sequence
  chemically synthesized
taaatgtatcatatagttttaa

SEQ ID NO: 806807 - DNA, 22 bp, Artificial Sequence
  chemically synthesized
aatgtatcatatagttttaaat

SEQ ID NO: 806808 - DNA, 22 bp, Artificial Sequence
  chemically synthesized
aacccatatggttccggaaaat

SEQ ID NO: 806809 - DNA, 22 bp, Artificial Sequence
  chemically synthesized
aaacccatatggttccggaaaa

SEQ ID NO: 806810 - DNA, 22 bp, Artificial Sequence
  chemically synthesized
taaattttccggaaccatatgg

SEQ ID NO: 806811 - DNA, 22 bp, Artificial Sequence
  chemically synthesized
aaattttccggaaccatatggg

SEQ ID NO: 806812 - DNA, 22 bp, Artificial Sequence
  chemically synthesized
aattttccggaaccatatgggt

SEQ ID NO: 806813 - DNA, 22 bp, Artificial Sequence
  chemically synthesized
tccggaaccatatgggtttaag

SEQ ID NO: 806814 - DNA, 22 bp, Artificial Sequence
  chemically synthesized
tcatataagccacttaaaccca

SEQ ID NO: 806815 - DNA, 22 bp, Artificial Sequence
  chemically synthesized
ccggaaccatatgggtttaagt

SEQ ID NO: 806816 - DNA, 22 bp, Artificial Sequence
  chemically synthesized
atcatataagccacttaaaccc

SEQ ID NO: 806817 - DNA, 22 bp, Artificial Sequence
  chemically synthesized
cggaaccatatgggtttaagtg

SEQ ID NO: 806818 - DNA, 22 bp, Artificial Sequence
  chemically synthesized
cttatcatataagccacttaaa

SEQ ID NO: 806819 - DNA, 22 bp, Artificial Sequence
  chemically synthesized
acttatcatataagccacttaa

SEQ ID NO: 806820 - DNA, 22 bp, Artificial Sequence
  chemically synthesized
tacttatcatataagccactta

SEQ ID NO: 806821 - DNA, 22 bp, Artificial Sequence
  chemically synthesized
cattttacttatcatataagcc

SEQ ID NO: 806822 - DNA, 22 bp, Artificial Sequence
  chemically synthesized
acattttacttatcatataagc

SEQ ID NO: 806823 - DNA, 22 bp, Artificial Sequence
  chemically synthesized
tacattttacttatcatataag

SEQ ID NO: 806824 - DNA, 22 bp, Artificial Sequence
  chemically synthesized
ttacattttacttatcatataa

SEQ ID NO: 806825 - DNA, 22 bp, Artificial Sequence
  chemically synthesized
tttttacattttacttatcata

SEQ ID NO: 806826 - DNA, 22 bp, Artificial Sequence
  chemically synthesized
atttttacattttacttatcat

SEQ ID NO: 806827 - DNA, 22 bp, Artificial Sequence
  chemically synthesized
aagtggcttatatgataagtaa

SEQ ID NO: 806828 - DNA, 22 bp, Artificial Sequence
  chemically synthesized
agtggcttatatgataagtaaa

SEQ ID NO: 806829 - DNA, 22 bp, Artificial Sequence
  chemically synthesized
ttatttttacattttacttatc

SEQ ID NO: 806830 - DNA, 22 bp, Artificial Sequence
  chemically synthesized
tgattcttatttttacatttta

SEQ ID NO: 806831 - DNA, 22 bp, Artificial Sequence
  chemically synthesized
atgattcttatttttacatttt

SEQ ID NO: 806832 - DNA, 22 bp, Artificial Sequence
  chemically synthesized
atatgataagtaaaatgtaaaa

SEQ ID NO: 806833 - DNA, 22 bp, Artificial Sequence
  chemically synthesized
tatgattcttatttttacattt

SEQ ID NO: 806834 - DNA, 22 bp, Artificial Sequence
  chemically synthesized
tatgataagtaaaatgtaaaaa

SEQ ID NO: 806835 - DNA, 22 bp, Artificial Sequence
  chemically synthesized
tttatgattcttatttttacat

SEQ ID NO: 806836 - DNA, 22 bp, Artificial Sequence
  chemically synthesized
ctttatgattcttatttttaca

SEQ ID NO: 806837 - DNA, 22 bp, Artificial Sequence
  chemically synthesized
tctttatgattcttatttttac

SEQ ID NO: 806838 - DNA, 22 bp, Artificial Sequence
  chemically synthesized
ttctttatgattcttattttta

SEQ ID NO: 806839 - DNA, 22 bp, Artificial Sequence
  chemically synthesized
tttctttatgattcttattttt

SEQ ID NO: 806840 - DNA, 22 bp, Artificial Sequence
  chemically synthesized
ttttctttatgattcttatttt

SEQ ID NO: 806841 - DNA, 22 bp, Artificial Sequence
  chemically synthesized
tttttctttatgattcttattt

SEQ ID NO: 806842 - DNA, 22 bp, Artificial Sequence
  chemically synthesized
ttttttctttatgattcttatt

SEQ ID NO: 806843 - DNA, 22 bp, Artificial Sequence
  chemically synthesized
aacatatcttttttttctttat

SEQ ID NO: 806844 - DNA, 22 bp, Artificial Sequence
  chemically synthesized
tgaacatatcttttttttcttt

SEQ ID NO: 806845 - DNA, 22 bp, Artificial Sequence
  chemically synthesized
ctgaacatatcttttttttctt

SEQ ID NO: 806846 - DNA, 22 bp, Artificial Sequence
  chemically synthesized
tctgaacatatcttttttttct

SEQ ID NO: 806847 - DNA, 22 bp, Artificial Sequence
  chemically synthesized
ttctgaacatatcttttttttc

SEQ ID NO: 806848 - DNA, 22 bp, Artificial Sequence
  chemically synthesized
tttctgaacatatctttttttt

SEQ ID NO: 806849 - DNA, 22 bp, Artificial Sequence
  chemically synthesized
ttttctgaacatatcttttttt

SEQ ID NO: 806850 - DNA, 22 bp, Artificial Sequence
  chemically synthesized
tttttctgaacatatctttttt

SEQ ID NO: 806851 - DNA, 22 bp, Artificial Sequence
  chemically synthesized
gttttttttctgaacatatctt

SEQ ID NO: 806852 - DNA, 22 bp, Artificial Sequence
  chemically synthesized
ggttttttttctgaacatatct

SEQ ID NO: 806853 - DNA, 22 bp, Artificial Sequence
  chemically synthesized
tggttttttttctgaacatatc

SEQ ID NO: 806854 - DNA, 22 bp, Artificial Sequence
  chemically synthesized
aagacctttggttttttttctg

SEQ ID NO: 806855 - DNA, 22 bp, Artificial Sequence
  chemically synthesized
attcaagacctttggttttttt

SEQ ID NO: 806856 - DNA, 22 bp, Artificial Sequence
  chemically synthesized
agaaaaaaaaccaaaggtcttg

SEQ ID NO: 806857 - DNA, 22 bp, Artificial Sequence
  chemically synthesized
aaaaaaaatctaattcaagacc

SEQ ID NO: 806858 - DNA, 22 bp, Artificial Sequence
  chemically synthesized
aaaaaaaaatctaattcaagac

SEQ ID NO: 806859 - DNA, 22 bp, Artificial Sequence
  chemically synthesized
gacaaaggaatttaaaaaaaaa

SEQ ID NO: 806860 - DNA, 22 bp, Artificial Sequence
  chemically synthesized
ggacaaaggaatttaaaaaaaa

SEQ ID NO: 806861 - DNA, 22 bp, Artificial Sequence
  chemically synthesized
gaattagatttttttttaaatt

SEQ ID NO: 806862 - DNA, 22 bp, Artificial Sequence
  chemically synthesized
aattagatttttttttaaattc

SEQ ID NO: 806863 - DNA, 22 bp, Artificial Sequence
  chemically synthesized
ataacttggacaaaggaattta

SEQ ID NO: 806864 - DNA, 22 bp, Artificial Sequence
  chemically synthesized
gataacttggacaaaggaattt

SEQ ID NO: 806865 - DNA, 22 bp, Artificial Sequence
  chemically synthesized
gatttttttttaaattcctttg

SEQ ID NO: 806866 - DNA, 22 bp, Artificial Sequence
  chemically synthesized
ttttttaaattcctttgtccaa

SEQ ID NO: 806867 - DNA, 22 bp, Artificial Sequence
  chemically synthesized
tagtttgataacttggacaaag

SEQ ID NO: 806868 - DNA, 22 bp, Artificial Sequence
  chemically synthesized
tttttaaattcctttgtccaag

SEQ ID NO: 806869 - DNA, 22 bp, Artificial Sequence
  chemically synthesized
ttttaaattcctttgtccaagt

SEQ ID NO: 806870 - DNA, 22 bp, Artificial Sequence
  chemically synthesized
tttaaattcctttgtccaagtt

SEQ ID NO: 806871 - DNA, 22 bp, Artificial Sequence
  chemically synthesized
ttaaattcctttgtccaagtta

SEQ ID NO: 806872 - DNA, 22 bp, Artificial Sequence
  chemically synthesized
taaattcctttgtccaagttat

SEQ ID NO: 806873 - DNA, 22 bp, Artificial Sequence
  chemically synthesized
aaattcctttgtccaagttatc

SEQ ID NO: 806874 - DNA, 22 bp, Artificial Sequence
  chemically synthesized
aattcctttgtccaagttatca

SEQ ID NO: 806875 - DNA, 22 bp, Artificial Sequence
  chemically synthesized
cagggcctgtagtttgataact

SEQ ID NO: 806876 - DNA, 22 bp, Artificial Sequence
  chemically synthesized
tccagggcctgtagtttgataa

SEQ ID NO: 806877 - DNA, 22 bp, Artificial Sequence
  chemically synthesized
ctttgtccaagttatcaaacta

SEQ ID NO: 806878 - DNA, 22 bp, Artificial Sequence
  chemically synthesized
ctccagggcctgtagtttgata

SEQ ID NO: 806879 - DNA, 22 bp, Artificial Sequence
  chemically synthesized
tctccagggcctgtagtttgat

SEQ ID NO: 806880 - DNA, 22 bp, Artificial Sequence
  chemically synthesized
tgtccaagttatcaaactacag

SEQ ID NO: 806881 - DNA, 22 bp, Artificial Sequence
  chemically synthesized
gtccaagttatcaaactacagg

SEQ ID NO: 806882 - DNA, 22 bp, Artificial Sequence
  chemically synthesized
tccaagttatcaaactacaggc

SEQ ID NO: 806883 - DNA, 22 bp, Artificial Sequence
  chemically synthesized
agccaaattttctccagggcct

SEQ ID NO: 806884 - DNA, 22 bp, Artificial Sequence
  chemically synthesized
tcaaactacaggccctggagaa

SEQ ID NO: 806885 - DNA, 22 bp, Artificial Sequence
  chemically synthesized
taaaattcagccaaattttctc

SEQ ID NO: 806886 - DNA, 22 bp, Artificial Sequence
  chemically synthesized
gtaaaattcagccaaattttct

SEQ ID NO: 806887 - DNA, 22 bp, Artificial Sequence
  chemically synthesized
caggccctggagaaaatttggc

SEQ ID NO: 806888 - DNA, 22 bp, Artificial Sequence
  chemically synthesized
cttgtaaaattcagccaaattt

SEQ ID NO: 806889 - DNA, 22 bp, Artificial Sequence
  chemically synthesized
ttacttgtaaaattcagccaaa

SEQ ID NO: 806890 - DNA, 22 bp, Artificial Sequence
  chemically synthesized
gagaaaatttggctgaatttta

SEQ ID NO: 806891 - DNA, 22 bp, Artificial Sequence
  chemically synthesized
gtcattgttacttgtaaaattc

SEQ ID NO: 806892 - DNA, 22 bp, Artificial Sequence
  chemically synthesized
atatctggtcattgttacttgt

SEQ ID NO: 806893 - DNA, 22 bp, Artificial Sequence
  chemically synthesized
ggctgaattttacaagtaacaa

SEQ ID NO: 806894 - DNA, 22 bp, Artificial Sequence
  chemically synthesized
gctgaattttacaagtaacaat

SEQ ID NO: 806895 - DNA, 22 bp, Artificial Sequence
  chemically synthesized
taatatctggtcattgttactt

SEQ ID NO: 806896 - DNA, 22 bp, Artificial Sequence
  chemically synthesized
ctaatatctggtcattgttact

SEQ ID NO: 806897 - DNA, 22 bp, Artificial Sequence
  chemically synthesized
aattttacaagtaacaatgacc

SEQ ID NO: 806898 - DNA, 22 bp, Artificial Sequence
  chemically synthesized
cagtttctaatatctggtcatt

SEQ ID NO: 806899 - DNA, 22 bp, Artificial Sequence
  chemically synthesized
tacaagtaacaatgaccagata

SEQ ID NO: 806900 - DNA, 22 bp, Artificial Sequence
  chemically synthesized
acaagtaacaatgaccagatat

SEQ ID NO: 806901 - DNA, 22 bp, Artificial Sequence
  chemically synthesized
ttacagtttctaatatctggtc

SEQ ID NO: 806902 - DNA, 22 bp, Artificial Sequence
  chemically synthesized
caagtaacaatgaccagatatt

SEQ ID NO: 806903 - DNA, 22 bp, Artificial Sequence
  chemically synthesized
caaagcattattacagtttcta

SEQ ID NO: 806904 - DNA, 22 bp, Artificial Sequence
  chemically synthesized
gcaaagcattattacagtttct

SEQ ID NO: 806905 - DNA, 22 bp, Artificial Sequence
  chemically synthesized
tttgcaaagcattattacagtt

SEQ ID NO: 806906 - DNA, 22 bp, Artificial Sequence
  chemically synthesized
tgtttgcaaagcattattacag

SEQ ID NO: 806907 - DNA, 22 bp, Artificial Sequence
  chemically synthesized
gaaactgtaataatgctttgca

SEQ ID NO: 806908 - DNA, 22 bp, Artificial Sequence
  chemically synthesized
taataatgctttgcaaacagaa

SEQ ID NO: 806909 - DNA, 22 bp, Artificial Sequence
  chemically synthesized
accaatacagtagattctgttt

SEQ ID NO: 806910 - DNA, 22 bp, Artificial Sequence
  chemically synthesized
aaccaatacagtagattctgtt

SEQ ID NO: 806911 - DNA, 22 bp, Artificial Sequence
  chemically synthesized
tgcaaacagaatctactgtatt

SEQ ID NO: 806912 - DNA, 22 bp, Artificial Sequence
  chemically synthesized
gcaaacagaatctactgtattg

SEQ ID NO: 806913 - DNA, 22 bp, Artificial Sequence
  chemically synthesized
caaacagaatctactgtattgg

SEQ ID NO: 806914 - DNA, 22 bp, Artificial Sequence
  chemically synthesized
tgtaaaaaagtacttaaccaat

SEQ ID NO: 806915 - DNA, 22 bp, Artificial Sequence
  chemically synthesized
ttatgtaaaaaagtacttaacc

SEQ ID NO: 806916 - DNA, 22 bp, Artificial Sequence
  chemically synthesized
gttatgtaaaaaagtacttaac

SEQ ID NO: 806917 - DNA, 22 bp, Artificial Sequence
  chemically synthesized
tgttatgtaaaaaagtacttaa

SEQ ID NO: 806918 - DNA, 22 bp, Artificial Sequence
  chemically synthesized
ctgtattggttaagtacttttt

SEQ ID NO: 806919 - DNA, 22 bp, Artificial Sequence
  chemically synthesized
tattggttaagtacttttttac

SEQ ID NO: 806920 - DNA, 22 bp, Artificial Sequence
  chemically synthesized
taaaactttgttatgtaaaaaa

SEQ ID NO: 806921 - DNA, 22 bp, Artificial Sequence
  chemically synthesized
gttaagtacttttttacataac

SEQ ID NO: 806922 - DNA, 22 bp, Artificial Sequence
  chemically synthesized
attataaaactttgttatgtaa

SEQ ID NO: 806923 - DNA, 22 bp, Artificial Sequence
  chemically synthesized
agtacttttttacataacaaag

SEQ ID NO: 806924 - DNA, 22 bp, Artificial Sequence
  chemically synthesized
gaatagctgattataaaacttt

SEQ ID NO: 806925 - DNA, 22 bp, Artificial Sequence
  chemically synthesized
ttttacataacaaagttttata

SEQ ID NO: 806926 - DNA, 22 bp, Artificial Sequence
  chemically synthesized
tttacataacaaagttttataa

SEQ ID NO: 806927 - DNA, 22 bp, Artificial Sequence
  chemically synthesized
ttacataacaaagttttataat

SEQ ID NO: 806928 - DNA, 22 bp, Artificial Sequence
  chemically synthesized
tacataacaaagttttataatc

SEQ ID NO: 806929 - DNA, 22 bp, Artificial Sequence
  chemically synthesized
acataacaaagttttataatca

SEQ ID NO: 806930 - DNA, 22 bp, Artificial Sequence
  chemically synthesized
cataacaaagttttataatcag

SEQ ID NO: 806931 - DNA, 22 bp, Artificial Sequence
  chemically synthesized
tgcaccataaagctggaatagc

SEQ ID NO: 806932 - DNA, 22 bp, Artificial Sequence
  chemically synthesized
gtgcaccataaagctggaatag

SEQ ID NO: 806933 - DNA, 22 bp, Artificial Sequence
  chemically synthesized
tgtgcaccataaagctggaata

SEQ ID NO: 806934 - DNA, 22 bp, Artificial Sequence
  chemically synthesized
ttgtgcaccataaagctggaat

SEQ ID NO: 806935 - DNA, 22 bp, Artificial Sequence
  chemically synthesized
tataatcagctattccagcttt

SEQ ID NO: 806936 - DNA, 22 bp, Artificial Sequence
  chemically synthesized
ataatcagctattccagcttta

SEQ ID NO: 806937 - DNA, 22 bp, Artificial Sequence
  chemically synthesized
taatcagctattccagctttat

SEQ ID NO: 806938 - DNA, 22 bp, Artificial Sequence
  chemically synthesized
tttttgtgcaccataaagctgg

SEQ ID NO: 806939 - DNA, 22 bp, Artificial Sequence
  chemically synthesized
agctatttttgtgcaccataaa

SEQ ID NO: 806940 - DNA, 22 bp, Artificial Sequence
  chemically synthesized
tcagctatttttgtgcaccata

SEQ ID NO: 806941 - DNA, 22 bp, Artificial Sequence
  chemically synthesized
ttccagctttatggtgcacaaa

SEQ ID NO: 806942 - DNA, 22 bp, Artificial Sequence
  chemically synthesized
cagctttatggtgcacaaaaat

SEQ ID NO: 806943 - DNA, 22 bp, Artificial Sequence
  chemically synthesized
catcaaattctcagctattttt

SEQ ID NO: 806944 - DNA, 22 bp, Artificial Sequence
  chemically synthesized
tatggtgcacaaaaatagctga

SEQ ID NO: 806945 - DNA, 22 bp, Artificial Sequence
  chemically synthesized
atggtgcacaaaaatagctgag

SEQ ID NO: 806946 - DNA, 22 bp, Artificial Sequence
  chemically synthesized
ctccatcaaattctcagctatt

SEQ ID NO: 806947 - DNA, 22 bp, Artificial Sequence
  chemically synthesized
tggtgcacaaaaatagctgaga

SEQ ID NO: 806948 - DNA, 22 bp, Artificial Sequence
  chemically synthesized
actccatcaaattctcagctat

SEQ ID NO: 806949 - DNA, 22 bp, Artificial Sequence
  chemically synthesized
cttactccatcaaattctcagc

SEQ ID NO: 806950 - DNA, 22 bp, Artificial Sequence
  chemically synthesized
ttccttactccatcaaattctc

SEQ ID NO: 806951 - DNA, 22 bp, Artificial Sequence
  chemically synthesized
aaatcacattattccttactcc

SEQ ID NO: 806952 - DNA, 22 bp, Artificial Sequence
  chemically synthesized
gaaatcacattattccttactc

SEQ ID NO: 806953 - DNA, 22 bp, Artificial Sequence
  chemically synthesized
agaatttgatggagtaaggaat

SEQ ID NO: 806954 - DNA, 22 bp, Artificial Sequence
  chemically synthesized
tgaaatcacattattccttact

SEQ ID NO: 806955 - DNA, 22 bp, Artificial Sequence
  chemically synthesized
ttgaaatcacattattccttac

SEQ ID NO: 806956 - DNA, 22 bp, Artificial Sequence
  chemically synthesized
gatggagtaaggaataatgtga

SEQ ID NO: 806957 - DNA, 22 bp, Artificial Sequence
  chemically synthesized
atggagtaaggaataatgtgat

SEQ ID NO: 806958 - DNA, 22 bp, Artificial Sequence
  chemically synthesized
tgaatagaatgaaaaccttttg

SEQ ID NO: 806959 - DNA, 22 bp, Artificial Sequence
  chemically synthesized
atgaatagaatgaaaacctttt

SEQ ID NO: 806960 - DNA, 22 bp, Artificial Sequence
  chemically synthesized
ttatgaatagaatgaaaacctt

SEQ ID NO: 806961 - DNA, 22 bp, Artificial Sequence
  chemically synthesized
caaaaggttttcattctattca

SEQ ID NO: 806962 - DNA, 22 bp, Artificial Sequence
  chemically synthesized
aaaaggttttcattctattcat

SEQ ID NO: 806963 - DNA, 22 bp, Artificial Sequence
  chemically synthesized
tcattctattcataagagcact

SEQ ID NO: 806964 - DNA, 22 bp, Artificial Sequence
  chemically synthesized
agaatggtacacagtgctctta

SEQ ID NO: 806965 - DNA, 22 bp, Artificial Sequence
  chemically synthesized
cattctattcataagagcactg

SEQ ID NO: 806966 - DNA, 22 bp, Artificial Sequence
  chemically synthesized
attctattcataagagcactgt

SEQ ID NO: 806967 - DNA, 22 bp, Artificial Sequence
  chemically synthesized
tattcataagagcactgtgtac

SEQ ID NO: 806968 - DNA, 22 bp, Artificial Sequence
  chemically synthesized
catactgagaatggtacacagt

SEQ ID NO: 806969 - DNA, 22 bp, Artificial Sequence
  chemically synthesized
ttcataagagcactgtgtacca

SEQ ID NO: 806970 - DNA, 22 bp, Artificial Sequence
  chemically synthesized
acatactgagaatggtacacag

SEQ ID NO: 806971 - DNA, 22 bp, Artificial Sequence
  chemically synthesized
ataagagcactgtgtaccattc

SEQ ID NO: 806972 - DNA, 22 bp, Artificial Sequence
  chemically synthesized
tttacatactgagaatggtaca

SEQ ID NO: 806973 - DNA, 22 bp, Artificial Sequence
  chemically synthesized
atttacatactgagaatggtac

SEQ ID NO: 806974 - DNA, 22 bp, Artificial Sequence
  chemically synthesized
cccttatttacatactgagaat

SEQ ID NO: 806975 - DNA, 22 bp, Artificial Sequence
  chemically synthesized
tgtaccattctcagtatgtaaa

SEQ ID NO: 806976 - DNA, 22 bp, Artificial Sequence
  chemically synthesized
atgctgcccttatttacatact

SEQ ID NO: 806977 - DNA, 22 bp, Artificial Sequence
  chemically synthesized
catgctgcccttatttacatac

SEQ ID NO: 806978 - DNA, 22 bp, Artificial Sequence
  chemically synthesized
tttcatgctgcccttatttaca

SEQ ID NO: 806979 - DNA, 22 bp, Artificial Sequence
  chemically synthesized
tcagtatgtaaataagggcagc

SEQ ID NO: 806980 - DNA, 22 bp, Artificial Sequence
  chemically synthesized
agtatgtaaataagggcagcat

SEQ ID NO: 806981 - DNA, 22 bp, Artificial Sequence
  chemically synthesized
tgagaacactgtttcatgctgc

SEQ ID NO: 806982 - DNA, 22 bp, Artificial Sequence
  chemically synthesized
gtccatggactatgagaacact

SEQ ID NO: 806983 - DNA, 22 bp, Artificial Sequence
  chemically synthesized
ctggtccatggactatgagaac

SEQ ID NO: 806984 - DNA, 22 bp, Artificial Sequence
  chemically synthesized
gtgctgctggtccatggactat

SEQ ID NO: 806985 - DNA, 22 bp, Artificial Sequence
  chemically synthesized
ctggtgctgctggtccatggac

SEQ ID NO: 806986 - DNA, 22 bp, Artificial Sequence
  chemically synthesized
tcatagtccatggaccagcagc

SEQ ID NO: 806987 - DNA, 22 bp, Artificial Sequence
  chemically synthesized
agacgttgctggtgctgctggt

SEQ ID NO: 806988 - DNA, 22 bp, Artificial Sequence
  chemically synthesized
atagtccatggaccagcagcac

SEQ ID NO: 806989 - DNA, 22 bp, Artificial Sequence
  chemically synthesized
tcagacgttgctggtgctgctg

SEQ ID NO: 806990 - DNA, 22 bp, Artificial Sequence
  chemically synthesized
ctcagacgttgctggtgctgct

SEQ ID NO: 806991 - DNA, 22 bp, Artificial Sequence
  chemically synthesized
ataacttctcagacgttgctgg

SEQ ID NO: 806992 - DNA, 22 bp, Artificial Sequence
  chemically synthesized
taataacttctcagacgttgct

SEQ ID NO: 806993 - DNA, 22 bp, Artificial Sequence
  chemically synthesized
ctaataacttctcagacgttgc

SEQ ID NO: 806994 - DNA, 22 bp, Artificial Sequence
  chemically synthesized
catttctaataacttctcagac

SEQ ID NO: 806995 - DNA, 22 bp, Artificial Sequence
  chemically synthesized
gcatttctaataacttctcaga

SEQ ID NO: 806996 - DNA, 22 bp, Artificial Sequence
  chemically synthesized
ggaatttgcatttctaataact

SEQ ID NO: 806997 - DNA, 22 bp, Artificial Sequence
  chemically synthesized
aggcctgggaatttgcatttct

SEQ ID NO: 806998 - DNA, 22 bp, Artificial Sequence
  chemically synthesized
agaagttattagaaatgcaaat

SEQ ID NO: 806999 - DNA, 22 bp, Artificial Sequence
  chemically synthesized
ggctgaggcctgggaatttgca

SEQ ID NO: 807000 - DNA, 22 bp, Artificial Sequence
  chemically synthesized
ttagaaatgcaaattcccaggc

SEQ ID NO: 807001 - DNA, 22 bp, Artificial Sequence
  chemically synthesized
gaaatgcaaattcccaggcctc

SEQ ID NO: 807002 - DNA, 22 bp, Artificial Sequence
  chemically synthesized
agtagagctaggctgaggcctg

SEQ ID NO: 807003 - DNA, 22 bp, Artificial Sequence
  chemically synthesized
attcagtagagctaggctgagg

SEQ ID NO: 807004 - DNA, 22 bp, Artificial Sequence
  chemically synthesized
tgattcagtagagctaggctga

SEQ ID NO: 807005 - DNA, 22 bp, Artificial Sequence
  chemically synthesized
ccaggcctcagcctagctctac

SEQ ID NO: 807006 - DNA, 22 bp, Artificial Sequence
  chemically synthesized
cccacagagtctctgattcagt

SEQ ID NO: 807007 - DNA, 22 bp, Artificial Sequence
  chemically synthesized
agcctagctctactgaatcaga

SEQ ID NO: 807008 - DNA, 22 bp, Artificial Sequence
  chemically synthesized
acccacagagtctctgattcag

SEQ ID NO: 807009 - DNA, 22 bp, Artificial Sequence
  chemically synthesized
tacccacagagtctctgattca

SEQ ID NO: 807010 - DNA, 22 bp, Artificial Sequence
  chemically synthesized
gctctactgaatcagagactct

SEQ ID NO: 807011 - DNA, 22 bp, Artificial Sequence
  chemically synthesized
ccggattttacccacagagtct

SEQ ID NO: 807012 - DNA, 22 bp, Artificial Sequence
  chemically synthesized
tactgaatcagagactctgtgg

SEQ ID NO: 807013 - DNA, 22 bp, Artificial Sequence
  chemically synthesized
gccggattttacccacagagtc

SEQ ID NO: 807014 - DNA, 22 bp, Artificial Sequence
  chemically synthesized
ctgaatcagagactctgtgggt

SEQ ID NO: 807015 - DNA, 22 bp, Artificial Sequence
  chemically synthesized
aatcagagactctgtgggtaaa

SEQ ID NO: 807016 - DNA, 22 bp, Artificial Sequence
  chemically synthesized
aaacacagcttgccggatttta

SEQ ID NO: 807017 - DNA, 22 bp, Artificial Sequence
  chemically synthesized
ttaaaacacagcttgccggatt

SEQ ID NO: 807018 - DNA, 22 bp, Artificial Sequence
  chemically synthesized
gttaaaacacagcttgccggat

SEQ ID NO: 807019 - DNA, 22 bp, Artificial Sequence
  chemically synthesized
tgtgggtaaaatccggcaagct

SEQ ID NO: 807020 - DNA, 22 bp, Artificial Sequence
  chemically synthesized
tgggtaaaatccggcaagctgt

SEQ ID NO: 807021 - DNA, 22 bp, Artificial Sequence
  chemically synthesized
gaaggcttgttaaaacacagct

SEQ ID NO: 807022 - DNA, 22 bp, Artificial Sequence
  chemically synthesized
gcatatattggaaggcttgtta

SEQ ID NO: 807023 - DNA, 22 bp, Artificial Sequence
  chemically synthesized
agcatatattggaaggcttgtt

SEQ ID NO: 807024 - DNA, 22 bp, Artificial Sequence
  chemically synthesized
tagcatatattggaaggcttgt

SEQ ID NO: 807025 - DNA, 22 bp, Artificial Sequence
  chemically synthesized
tgttttaacaagccttccaata

SEQ ID NO: 807026 - DNA, 22 bp, Artificial Sequence
  chemically synthesized
aagctttagcatatattggaag

SEQ ID NO: 807027 - DNA, 22 bp, Artificial Sequence
  chemically synthesized
tcaagctttagcatatattgga

SEQ ID NO: 807028 - DNA, 22 bp, Artificial Sequence
  chemically synthesized
taacaagccttccaatatatgc

SEQ ID NO: 807029 - DNA, 22 bp, Artificial Sequence
  chemically synthesized
aacaagccttccaatatatgct

SEQ ID NO: 807030 - DNA, 22 bp, Artificial Sequence
  chemically synthesized
acaagccttccaatatatgcta

SEQ ID NO: 807031 - DNA, 22 bp, Artificial Sequence
  chemically synthesized
tgattctcaagctttagcatat

SEQ ID NO: 807032 - DNA, 22 bp, Artificial Sequence
  chemically synthesized
ccaatatatgctaaagcttgag

SEQ ID NO: 807033 - DNA, 22 bp, Artificial Sequence
  chemically synthesized
gcaactgtgattctcaagcttt

SEQ ID NO: 807034 - DNA, 22 bp, Artificial Sequence
  chemically synthesized
caatatatgctaaagcttgaga

SEQ ID NO: 807035 - DNA, 22 bp, Artificial Sequence
  chemically synthesized
ctggcaactgtgattctcaagc

SEQ ID NO: 807036 - DNA, 22 bp, Artificial Sequence
  chemically synthesized
gttcctggcaactgtgattctc

SEQ ID NO: 807037 - DNA, 22 bp, Artificial Sequence
  chemically synthesized
aagcttgagaatcacagttgcc

SEQ ID NO: 807038 - DNA, 22 bp, Artificial Sequence
  chemically synthesized
aaatctggttcctggcaactgt

SEQ ID NO: 807039 - DNA, 22 bp, Artificial Sequence
  chemically synthesized
tcaaatctggttcctggcaact

SEQ ID NO: 807040 - DNA, 22 bp, Artificial Sequence
  chemically synthesized
gagaatcacagttgccaggaac

SEQ ID NO: 807041 - DNA, 22 bp, Artificial Sequence
  chemically synthesized
agaatcacagttgccaggaacc

SEQ ID NO: 807042 - DNA, 22 bp, Artificial Sequence
  chemically synthesized
tgccagtcgttctcaaatctgg

SEQ ID NO: 807043 - DNA, 22 bp, Artificial Sequence
  chemically synthesized
ctatgccagtcgttctcaaatc

SEQ ID NO: 807044 - DNA, 22 bp, Artificial Sequence
  chemically synthesized
ccaggaaccagatttgagaacg

SEQ ID NO: 807045 - DNA, 22 bp, Artificial Sequence
  chemically synthesized
gcatctactatgccagtcgttc

SEQ ID NO: 807046 - DNA, 22 bp, Artificial Sequence
  chemically synthesized
agcatctactatgccagtcgtt

SEQ ID NO: 807047 - DNA, 22 bp, Artificial Sequence
  chemically synthesized
gagaacgactggcatagtagat

SEQ ID NO: 807048 - DNA, 22 bp, Artificial Sequence
  chemically synthesized
agaacgactggcatagtagatg

SEQ ID NO: 807049 - DNA, 22 bp, Artificial Sequence
  chemically synthesized
gcatagtagatgctaagctggg

SEQ ID NO: 807050 - DNA, 22 bp, Artificial Sequence
  chemically synthesized
aaaaggggtccgggcagcccag

SEQ ID NO: 807051 - DNA, 22 bp, Artificial Sequence
  chemically synthesized
agtcctgaaaaggggtccgggc

SEQ ID NO: 807052 - DNA, 22 bp, Artificial Sequence
  chemically synthesized
cagtcctgaaaaggggtccggg

SEQ ID NO: 807053 - DNA, 22 bp, Artificial Sequence
  chemically synthesized
agctgggctgcccggacccctt

SEQ ID NO: 807054 - DNA, 22 bp, Artificial Sequence
  chemically synthesized
ggctgcccggaccccttttcag

SEQ ID NO: 807055 - DNA, 22 bp, Artificial Sequence
  chemically synthesized
cccggaccccttttcaggactg

SEQ ID NO: 807056 - DNA, 22 bp, Artificial Sequence
  chemically synthesized
gggtcagaagtatttcagtcct

SEQ ID NO: 807057 - DNA, 22 bp, Artificial Sequence
  chemically synthesized
ttcaggactgaaatacttctga

SEQ ID NO: 807058 - DNA, 22 bp, Artificial Sequence
  chemically synthesized
tcaggactgaaatacttctgac

SEQ ID NO: 807059 - DNA, 22 bp, Artificial Sequence
  chemically synthesized
ccagcagctggggtcagaagta

SEQ ID NO: 807060 - DNA, 22 bp, Artificial Sequence
  chemically synthesized
caggactgaaatacttctgacc

SEQ ID NO: 807061 - DNA, 22 bp, Artificial Sequence
  chemically synthesized
aggactgaaatacttctgaccc

SEQ ID NO: 807062 - DNA, 22 bp, Artificial Sequence
  chemically synthesized
aaatacttctgaccccagctgc

SEQ ID NO: 807063 - DNA, 22 bp, Artificial Sequence
  chemically synthesized
tcagccagtagcactaccagca

SEQ ID NO: 807064 - DNA, 22 bp, Artificial Sequence
  chemically synthesized
ctgaccccagctgctggtagtg

SEQ ID NO: 807065 - DNA, 22 bp, Artificial Sequence
  chemically synthesized
tgaccccagctgctggtagtgc

SEQ ID NO: 807066 - DNA, 22 bp, Artificial Sequence
  chemically synthesized
accccagctgctggtagtgcta

SEQ ID NO: 807067 - DNA, 22 bp, Artificial Sequence
  chemically synthesized
aggactgtcagccagtagcact

SEQ ID NO: 807068 - DNA, 22 bp, Artificial Sequence
  chemically synthesized
ctggtagtgctactggctgaca

SEQ ID NO: 807069 - DNA, 22 bp, Artificial Sequence
  chemically synthesized
gtagtgctactggctgacagtc

SEQ ID NO: 807070 - DNA, 22 bp, Artificial Sequence
  chemically synthesized
agacaggaataacagctgagga

SEQ ID NO: 807071 - DNA, 22 bp, Artificial Sequence
  chemically synthesized
ctggctgacagtcctcagctgt

SEQ ID NO: 807072 - DNA, 22 bp, Artificial Sequence
  chemically synthesized
tcagacaggaataacagctgag

SEQ ID NO: 807073 - DNA, 22 bp, Artificial Sequence
  chemically synthesized
gctgacagtcctcagctgttat

SEQ ID NO: 807074 - DNA, 22 bp, Artificial Sequence
  chemically synthesized
acagtcctcagctgttattcct

SEQ ID NO: 807075 - DNA, 22 bp, Artificial Sequence
  chemically synthesized
agtccagctctcagacaggaat

SEQ ID NO: 807076 - DNA, 22 bp, Artificial Sequence
  chemically synthesized
gctgagtccagctctcagacag

SEQ ID NO: 807077 - DNA, 22 bp, Artificial Sequence
  chemically synthesized
agctgttattcctgtctgagag

SEQ ID NO: 807078 - DNA, 22 bp, Artificial Sequence
  chemically synthesized
agctgagtccagctctcagaca

SEQ ID NO: 807079 - DNA, 22 bp, Artificial Sequence
  chemically synthesized
tagctgagtccagctctcagac

SEQ ID NO: 807080 - DNA, 22 bp, Artificial Sequence
  chemically synthesized
tttagctgagtccagctctcag

SEQ ID NO: 807081 - DNA, 22 bp, Artificial Sequence
  chemically synthesized
ttattcctgtctgagagctgga

SEQ ID NO: 807082 - DNA, 22 bp, Artificial Sequence
  chemically synthesized
tctttagctgagtccagctctc

SEQ ID NO: 807083 - DNA, 22 bp, Artificial Sequence
  chemically synthesized
ttcctgtctgagagctggactc

SEQ ID NO: 807084 - DNA, 22 bp, Artificial Sequence
  chemically synthesized
ctgtctgagagctggactcagc

SEQ ID NO: 807085 - DNA, 22 bp, Artificial Sequence
  chemically synthesized
ggcacctctctttagctgagtc

SEQ ID NO: 807086 - DNA, 22 bp, Artificial Sequence
  chemically synthesized
tctgagagctggactcagctaa

SEQ ID NO: 807087 - DNA, 22 bp, Artificial Sequence
  chemically synthesized
agagctggactcagctaaagag

SEQ ID NO: 807088 - DNA, 22 bp, Artificial Sequence
  chemically synthesized
ggctaggcacctctctttagct

SEQ ID NO: 807089 - DNA, 22 bp, Artificial Sequence
  chemically synthesized
gggctaggcacctctctttagc

SEQ ID NO: 807090 - DNA, 22 bp, Artificial Sequence
  chemically synthesized
tgggctaggcacctctctttag

SEQ ID NO: 807091 - DNA, 22 bp, Artificial Sequence
  chemically synthesized
gactcagctaaagagaggtgcc

SEQ ID NO: 807092 - DNA, 22 bp, Artificial Sequence
  chemically synthesized
agctaaagagaggtgcctagcc

SEQ ID NO: 807093 - DNA, 22 bp, Artificial Sequence
  chemically synthesized
aagagaggtgcctagcccaaag

SEQ ID NO: 807094 - DNA, 22 bp, Artificial Sequence
  chemically synthesized
ggggacatagtgggtaactttg

SEQ ID NO: 807095 - DNA, 22 bp, Artificial Sequence
  chemically synthesized
gcccaaagttacccactatgtc

SEQ ID NO: 807096 - DNA, 22 bp, Artificial Sequence
  chemically synthesized
cccactatgtccccgagacggg

SEQ ID NO: 807097 - DNA, 22 bp, Artificial Sequence
  chemically synthesized
tgtccccgagacgggctgcacg

SEQ ID NO: 807098 - DNA, 22 bp, Artificial Sequence
  chemically synthesized
ccatcaaccaatacgtgcagcc

SEQ ID NO: 807099 - DNA, 22 bp, Artificial Sequence
  chemically synthesized
tcccatcaaccaatacgtgcag

SEQ ID NO: 807100 - DNA, 22 bp, Artificial Sequence
  chemically synthesized
taccccacaactctcccatcaa

SEQ ID NO: 807101 - DNA, 22 bp, Artificial Sequence
  chemically synthesized
ataccccacaactctcccatca

SEQ ID NO: 807102 - DNA, 22 bp, Artificial Sequence
  chemically synthesized
cacgtattggttgatgggagag

SEQ ID NO: 807103 - DNA, 22 bp, Artificial Sequence
  chemically synthesized
tataccccacaactctcccatc

SEQ ID NO: 807104 - DNA, 22 bp, Artificial Sequence
  chemically synthesized
gttgatgggagagttgtggggt

SEQ ID NO: 807105 - DNA, 22 bp, Artificial Sequence
  chemically synthesized
atgggagagttgtggggtataa

SEQ ID NO: 807106 - DNA, 22 bp, Artificial Sequence
  chemically synthesized
cagcaagggacccaggatttta

SEQ ID NO: 807107 - DNA, 22 bp, Artificial Sequence
  chemically synthesized
tggggtataaaatcctgggtcc

SEQ ID NO: 807108 - DNA, 22 bp, Artificial Sequence
  chemically synthesized
agttgcagcaagggacccagga

SEQ ID NO: 807109 - DNA, 22 bp, Artificial Sequence
  chemically synthesized
tcctgagttgcagcaagggacc

SEQ ID NO: 807110 - DNA, 22 bp, Artificial Sequence
  chemically synthesized
agaattgtcctgagttgcagca

SEQ ID NO: 807111 - DNA, 22 bp, Artificial Sequence
  chemically synthesized
cagaattgtcctgagttgcagc

SEQ ID NO: 807112 - DNA, 22 bp, Artificial Sequence
  chemically synthesized
ggtcccttgctgcaactcagga

SEQ ID NO: 807113 - DNA, 22 bp, Artificial Sequence
  chemically synthesized
gctgcaactcaggacaattctg

SEQ ID NO: 807114 - DNA, 22 bp, Artificial Sequence
  chemically synthesized
ctgcaactcaggacaattctga

SEQ ID NO: 807115 - DNA, 22 bp, Artificial Sequence
  chemically synthesized
caactcaggacaattctgaagg

SEQ ID NO: 807116 - DNA, 22 bp, Artificial Sequence
  chemically synthesized
aaggtagaatagcccttcagaa

SEQ ID NO: 807117 - DNA, 22 bp, Artificial Sequence
  chemically synthesized
aggacaattctgaagggctatt

SEQ ID NO: 807118 - DNA, 22 bp, Artificial Sequence
  chemically synthesized
aagtctgaaggtagaatagccc

SEQ ID NO: 807119 - DNA, 22 bp, Artificial Sequence
  chemically synthesized
tgaagtctgaaggtagaatagc

SEQ ID NO: 807120 - DNA, 22 bp, Artificial Sequence
  chemically synthesized
tgaagggctattctaccttcag

SEQ ID NO: 807121 - DNA, 22 bp, Artificial Sequence
  chemically synthesized
aagggctattctaccttcagac

SEQ ID NO: 807122 - DNA, 22 bp, Artificial Sequence
  chemically synthesized
cccaggaggatctctgaagtct

SEQ ID NO: 807123 - DNA, 22 bp, Artificial Sequence
  chemically synthesized
ccccaggaggatctctgaagtc

SEQ ID NO: 807124 - DNA, 22 bp, Artificial Sequence
  chemically synthesized
ttctaccttcagacttcagaga

SEQ ID NO: 807125 - DNA, 22 bp, Artificial Sequence
  chemically synthesized
taccttcagacttcagagatcc

SEQ ID NO: 807126 - DNA, 22 bp, Artificial Sequence
  chemically synthesized
gccttccccaggaggatctctg

SEQ ID NO: 807127 - DNA, 22 bp, Artificial Sequence
  chemically synthesized
ccttcagacttcagagatcctc

SEQ ID NO: 807128 - DNA, 22 bp, Artificial Sequence
  chemically synthesized
ctagccttccccaggaggatct

SEQ ID NO: 807129 - DNA, 22 bp, Artificial Sequence
  chemically synthesized
cctagccttccccaggaggatc

SEQ ID NO: 807130 - DNA, 22 bp, Artificial Sequence
  chemically synthesized
cagacttcagagatcctcctgg

SEQ ID NO: 807131 - DNA, 22 bp, Artificial Sequence
  chemically synthesized
agacttcagagatcctcctggg

SEQ ID NO: 807132 - DNA, 22 bp, Artificial Sequence
  chemically synthesized
cttcctagccttccccaggagg

SEQ ID NO: 807133 - DNA, 22 bp, Artificial Sequence
  chemically synthesized
tccttcctagccttccccagga

SEQ ID NO: 807134 - DNA, 22 bp, Artificial Sequence
  chemically synthesized
cagagatcctcctggggaaggc

SEQ ID NO: 807135 - DNA, 22 bp, Artificial Sequence
  chemically synthesized
agagatcctcctggggaaggct

SEQ ID NO: 807136 - DNA, 22 bp, Artificial Sequence
  chemically synthesized
cgcctctccttcctagccttcc

SEQ ID NO: 807137 - DNA, 22 bp, Artificial Sequence
  chemically synthesized
ctggggaaggctaggaaggaga

SEQ ID NO: 807138 - DNA, 22 bp, Artificial Sequence
  chemically synthesized
gggaaggctaggaaggagaggc

SEQ ID NO: 807139 - DNA, 22 bp, Artificial Sequence
  chemically synthesized
caacacaatcaaccctccgcct

SEQ ID NO: 807140 - DNA, 22 bp, Artificial Sequence
  chemically synthesized
ggaaggagaggcggagggttga

SEQ ID NO: 807141 - DNA, 22 bp, Artificial Sequence
  chemically synthesized
ccatacagtcacaactacaaca

SEQ ID NO: 807142 - DNA, 22 bp, Artificial Sequence
  chemically synthesized
ggctaccatacagtcacaacta

SEQ ID NO: 807143 - DNA, 22 bp, Artificial Sequence
  chemically synthesized
attgtgttgtagttgtgactgt

SEQ ID NO: 807144 - DNA, 22 bp, Artificial Sequence
  chemically synthesized
tgttgtagttgtgactgtatgg

SEQ ID NO: 807145 - DNA, 22 bp, Artificial Sequence
  chemically synthesized
tagttgtgactgtatggtagcc

SEQ ID NO: 807146 - DNA, 22 bp, Artificial Sequence
  chemically synthesized
ggcagaaggagaagctgggcta

SEQ ID NO: 807147 - DNA, 22 bp, Artificial Sequence
  chemically synthesized
tgactgtatggtagcccagctt

SEQ ID NO: 807148 - DNA, 22 bp, Artificial Sequence
  chemically synthesized
tatggtagcccagcttctcctt

SEQ ID NO: 807149 - DNA, 22 bp, Artificial Sequence
  chemically synthesized
ctccttctgcccaatcctgctc

SEQ ID NO: 807150 - DNA, 22 bp, Artificial Sequence
  chemically synthesized
tccttctgcccaatcctgctcc

SEQ ID NO: 807151 - DNA, 22 bp, Artificial Sequence
  chemically synthesized
cttctgcccaatcctgctccct

SEQ ID NO: 807152 - DNA, 22 bp, Artificial Sequence
  chemically synthesized
ctgcccaatcctgctccctttc

SEQ ID NO: 807153 - DNA, 22 bp, Artificial Sequence
  chemically synthesized
tgcccaatcctgctccctttcc

SEQ ID NO: 807154 - DNA, 22 bp, Artificial Sequence
  chemically synthesized
tgagcggaggaaaggaaaggga

SEQ ID NO: 807155 - DNA, 22 bp, Artificial Sequence
  chemically synthesized
cccaatcctgctccctttcctt

SEQ ID NO: 807156 - DNA, 22 bp, Artificial Sequence
  chemically synthesized
acacctgtgagcggaggaaagg

SEQ ID NO: 807157 - DNA, 22 bp, Artificial Sequence
  chemically synthesized
ctccctttcctttcctccgctc

SEQ ID NO: 807158 - DNA, 22 bp, Artificial Sequence
  chemically synthesized
cctttcctttcctccgctcaca

SEQ ID NO: 807159 - DNA, 22 bp, Artificial Sequence
  chemically synthesized
aggattaacacctgtgagcgga

SEQ ID NO: 807160 - DNA, 22 bp, Artificial Sequence
  chemically synthesized
tcaggattaacacctgtgagcg

SEQ ID NO: 807161 - DNA, 22 bp, Artificial Sequence
  chemically synthesized
tcctttcctccgctcacaggtg

SEQ ID NO: 807162 - DNA, 22 bp, Artificial Sequence
  chemically synthesized
cctttcctccgctcacaggtgt

SEQ ID NO: 807163 - DNA, 22 bp, Artificial Sequence
  chemically synthesized
ctttcctccgctcacaggtgtt

SEQ ID NO: 807164 - DNA, 22 bp, Artificial Sequence
  chemically synthesized
tcctccgctcacaggtgttaat

SEQ ID NO: 807165 - DNA, 22 bp, Artificial Sequence
  chemically synthesized
cctccgctcacaggtgttaatc

SEQ ID NO: 807166 - DNA, 22 bp, Artificial Sequence
  chemically synthesized
ctccgctcacaggtgttaatcc

SEQ ID NO: 807167 - DNA, 22 bp, Artificial Sequence
  chemically synthesized
gagagtgctctcaggattaaca

SEQ ID NO: 807168 - DNA, 22 bp, Artificial Sequence
  chemically synthesized
cgctcacaggtgttaatcctga

SEQ ID NO: 807169 - DNA, 22 bp, Artificial Sequence
  chemically synthesized
ttggagagtgctctcaggatta

SEQ ID NO: 807170 - DNA, 22 bp, Artificial Sequence
  chemically synthesized
attggagagtgctctcaggatt

SEQ ID NO: 807171 - DNA, 22 bp, Artificial Sequence
  chemically synthesized
tattggagagtgctctcaggat

SEQ ID NO: 807172 - DNA, 22 bp, Artificial Sequence
  chemically synthesized
acaggtgttaatcctgagagca

SEQ ID NO: 807173 - DNA, 22 bp, Artificial Sequence
  chemically synthesized
atcctgagagcactctccaata

SEQ ID NO: 807174 - DNA, 22 bp, Artificial Sequence
  chemically synthesized
gcatgaaggaattttattggag

SEQ ID NO: 807175 - DNA, 22 bp, Artificial Sequence
  chemically synthesized
agagcactctccaataaaattc

SEQ ID NO: 807176 - DNA, 22 bp, Artificial Sequence
  chemically synthesized
agaaagtgattagcatgaagga

SEQ ID NO: 807177 - DNA, 22 bp, Artificial Sequence
  chemically synthesized
tccaataaaattccttcatgct

SEQ ID NO: 807178 - DNA, 22 bp, Artificial Sequence
  chemically synthesized
tgagaaagtgattagcatgaag

SEQ ID NO: 807179 - DNA, 22 bp, Artificial Sequence
  chemically synthesized
caataaaattccttcatgctaa

SEQ ID NO: 807180 - DNA, 22 bp, Artificial Sequence
  chemically synthesized
cttcatgctaatcactttctca

SEQ ID NO: 807181 - DNA, 22 bp, Artificial Sequence
  chemically synthesized
catgctaatcactttctcagaa

SEQ ID NO: 807182 - DNA, 22 bp, Artificial Sequence
  chemically synthesized
ccagaaagcagattctgagaaa

SEQ ID NO: 807183 - DNA, 22 bp, Artificial Sequence
  chemically synthesized
atgctaatcactttctcagaat

SEQ ID NO: 807184 - DNA, 22 bp, Artificial Sequence
  chemically synthesized
tcccagaaagcagattctgaga

SEQ ID NO: 807185 - DNA, 22 bp, Artificial Sequence
  chemically synthesized
atcactttctcagaatctgctt

SEQ ID NO: 807186 - DNA, 22 bp, Artificial Sequence
  chemically synthesized
tctcagaatctgctttctggga

SEQ ID NO: 807187 - DNA, 22 bp, Artificial Sequence
  chemically synthesized
ctcagaatctgctttctgggag

SEQ ID NO: 807188 - DNA, 22 bp, Artificial Sequence
  chemically synthesized
tcagaatctgctttctgggaga

SEQ ID NO: 807189 - DNA, 22 bp, Artificial Sequence
  chemically synthesized
aggaggtcaagttctcccagaa

SEQ ID NO: 807190 - DNA, 22 bp, Artificial Sequence
  chemically synthesized
agaatctgctttctgggagaac

SEQ ID NO: 807191 - DNA, 22 bp, Artificial Sequence
  chemically synthesized
ctttctgggagaacttgacctc

SEQ ID NO: 807192 - DNA, 22 bp, Artificial Sequence
  chemically synthesized
tctgggagaacttgacctcctg

SEQ ID NO: 807193 - DNA, 22 bp, Artificial Sequence
  chemically synthesized
agcatgacaattcaggaggtca

SEQ ID NO: 807194 - DNA, 22 bp, Artificial Sequence
  chemically synthesized
ctgggagaacttgacctcctga

SEQ ID NO: 807195 - DNA, 22 bp, Artificial Sequence
  chemically synthesized
tgggagaacttgacctcctgaa

SEQ ID NO: 807196 - DNA, 22 bp, Artificial Sequence
  chemically synthesized
ttcagcatgacaattcaggagg

SEQ ID NO: 807197 - DNA, 22 bp, Artificial Sequence
  chemically synthesized
ggagaacttgacctcctgaatt

SEQ ID NO: 807198 - DNA, 22 bp, Artificial Sequence
  chemically synthesized
gttcagcatgacaattcaggag

SEQ ID NO: 807199 - DNA, 22 bp, Artificial Sequence
  chemically synthesized
aaatccttgttcagcatgacaa

SEQ ID NO: 807200 - DNA, 22 bp, Artificial Sequence
  chemically synthesized
gacctcctgaattgtcatgctg

SEQ ID NO: 807201 - DNA, 22 bp, Artificial Sequence
  chemically synthesized
aaaatccttgttcagcatgaca

SEQ ID NO: 807202 - DNA, 22 bp, Artificial Sequence
  chemically synthesized
acctcctgaattgtcatgctga

SEQ ID NO: 807203 - DNA, 22 bp, Artificial Sequence
  chemically synthesized
taaaatccttgttcagcatgac

SEQ ID NO: 807204 - DNA, 22 bp, Artificial Sequence
  chemically synthesized
ttaaaatccttgttcagcatga

SEQ ID NO: 807205 - DNA, 22 bp, Artificial Sequence
  chemically synthesized
ctgaattgtcatgctgaacaag

SEQ ID NO: 807206 - DNA, 22 bp, Artificial Sequence
  chemically synthesized
aattgtcatgctgaacaaggat

SEQ ID NO: 807207 - DNA, 22 bp, Artificial Sequence
  chemically synthesized
tcatgctgaacaaggattttaa

SEQ ID NO: 807208 - DNA, 22 bp, Artificial Sequence
  chemically synthesized
ggcaagtatatttttaaaatcc

SEQ ID NO: 807209 - DNA, 22 bp, Artificial Sequence
  chemically synthesized
aggcaagtatatttttaaaatc

SEQ ID NO: 807210 - DNA, 22 bp, Artificial Sequence
  chemically synthesized
ttaggcaagtatatttttaaaa

SEQ ID NO: 807211 - DNA, 22 bp, Artificial Sequence
  chemically synthesized
cttaggcaagtatatttttaaa

SEQ ID NO: 807212 - DNA, 22 bp, Artificial Sequence
  chemically synthesized
aacaaggattttaaaaatatac

SEQ ID NO: 807213 - DNA, 22 bp, Artificial Sequence
  chemically synthesized
taaaaatatacttgcctaagaa

SEQ ID NO: 807214 - DNA, 22 bp, Artificial Sequence
  chemically synthesized
aaaaatatacttgcctaagaaa

SEQ ID NO: 807215 - DNA, 22 bp, Artificial Sequence
  chemically synthesized
aaaatatacttgcctaagaaat

SEQ ID NO: 807216 - DNA, 22 bp, Artificial Sequence
  chemically synthesized
gagaccacatatatttcttagg

SEQ ID NO: 807217 - DNA, 22 bp, Artificial Sequence
  chemically synthesized
ggagaccacatatatttcttag

SEQ ID NO: 807218 - DNA, 22 bp, Artificial Sequence
  chemically synthesized
tggagaccacatatatttctta

SEQ ID NO: 807219 - DNA, 22 bp, Artificial Sequence
  chemically synthesized
cctttggagaccacatatattt

SEQ ID NO: 807220 - DNA, 22 bp, Artificial Sequence
  chemically synthesized
ttccctttggagaccacatata

SEQ ID NO: 807221 - DNA, 22 bp, Artificial Sequence
  chemically synthesized
gttccctttggagaccacatat

SEQ ID NO: 807222 - DNA, 22 bp, Artificial Sequence
  chemically synthesized
gcctaagaaatatatgtggtct

SEQ ID NO: 807223 - DNA, 22 bp, Artificial Sequence
  chemically synthesized
cctaagaaatatatgtggtctc

SEQ ID NO: 807224 - DNA, 22 bp, Artificial Sequence
  chemically synthesized
agaaatatatgtggtctccaaa

SEQ ID NO: 807225 - DNA, 22 bp, Artificial Sequence
  chemically synthesized
catcttgttccctttggagacc

SEQ ID NO: 807226 - DNA, 22 bp, Artificial Sequence
  chemically synthesized
catgtgagaatcctccatcttg

SEQ ID NO: 807227 - DNA, 22 bp, Artificial Sequence
  chemically synthesized
caaagggaacaagatggaggat

SEQ ID NO: 807228 - DNA, 22 bp, Artificial Sequence
  chemically synthesized
ctgcatgtgagaatcctccatc

SEQ ID NO: 807229 - DNA, 22 bp, Artificial Sequence
  chemically synthesized
aggcacaattactgcatgtgag

SEQ ID NO: 807230 - DNA, 22 bp, Artificial Sequence
  chemically synthesized
agtagcaattcaggcacaatta

SEQ ID NO: 807231 - DNA, 22 bp, Artificial Sequence
  chemically synthesized
tcacatgcagtaattgtgcctg

SEQ ID NO: 807232 - DNA, 22 bp, Artificial Sequence
  chemically synthesized
acatgcagtaattgtgcctgaa

SEQ ID NO: 807233 - DNA, 22 bp, Artificial Sequence
  chemically synthesized
tgcctgaattgctactgaactt

SEQ ID NO: 807234 - DNA, 22 bp, Artificial Sequence
  chemically synthesized
aagggcaaccaaaagttcagta

SEQ ID NO: 807235 - DNA, 22 bp, Artificial Sequence
  chemically synthesized
aaagggcaaccaaaagttcagt

SEQ ID NO: 807236 - DNA, 22 bp, Artificial Sequence
  chemically synthesized
cttaaagggcaaccaaaagttc

SEQ ID NO: 807237 - DNA, 22 bp, Artificial Sequence
  chemically synthesized
aattgctactgaacttttggtt

SEQ ID NO: 807238 - DNA, 22 bp, Artificial Sequence
  chemically synthesized
ctactgaacttttggttgccct

SEQ ID NO: 807239 - DNA, 22 bp, Artificial Sequence
  chemically synthesized
taggtctccttaaagggcaacc

SEQ ID NO: 807240 - DNA, 22 bp, Artificial Sequence
  chemically synthesized
ctgaacttttggttgcccttta

SEQ ID NO: 807241 - DNA, 22 bp, Artificial Sequence
  chemically synthesized
tctataggtctccttaaagggc

SEQ ID NO: 807242 - DNA, 22 bp, Artificial Sequence
  chemically synthesized
aacttttggttgccctttaagg

SEQ ID NO: 807243 - DNA, 22 bp, Artificial Sequence
  chemically synthesized
tattatctataggtctccttaa

SEQ ID NO: 807244 - DNA, 22 bp, Artificial Sequence
  chemically synthesized
ttggttgccctttaaggagacc

SEQ ID NO: 807245 - DNA, 22 bp, Artificial Sequence
  chemically synthesized
tggttgccctttaaggagacct

SEQ ID NO: 807246 - DNA, 22 bp, Artificial Sequence
  chemically synthesized
ggttgccctttaaggagaccta

SEQ ID NO: 807247 - DNA, 22 bp, Artificial Sequence
  chemically synthesized
gttgccctttaaggagacctat

SEQ ID NO: 807248 - DNA, 22 bp, Artificial Sequence
  chemically synthesized
ccctttaaggagacctatagat

SEQ ID NO: 807249 - DNA, 22 bp, Artificial Sequence
  chemically synthesized
taaggagacctatagataatac

SEQ ID NO: 807250 - DNA, 22 bp, Artificial Sequence
  chemically synthesized
aaggagacctatagataataca

SEQ ID NO: 807251 - DNA, 22 bp, Artificial Sequence
  chemically synthesized
aggagacctatagataatacag

SEQ ID NO: 807252 - DNA, 22 bp, Artificial Sequence
  chemically synthesized
atgataatgcaaacctgtatta

SEQ ID NO: 807253 - DNA, 22 bp, Artificial Sequence
  chemically synthesized
taactgatgataatgcaaacct

SEQ ID NO: 807254 - DNA, 22 bp, Artificial Sequence
  chemically synthesized
gtaactgatgataatgcaaacc

SEQ ID NO: 807255 - DNA, 22 bp, Artificial Sequence
  chemically synthesized
tagataatacaggtttgcatta

SEQ ID NO: 807256 - DNA, 22 bp, Artificial Sequence
  chemically synthesized
cttgtaactgatgataatgcaa

SEQ ID NO: 807257 - DNA, 22 bp, Artificial Sequence
  chemically synthesized
gcttgtaactgatgataatgca

SEQ ID NO: 807258 - DNA, 22 bp, Artificial Sequence
  chemically synthesized
ttgcttgtaactgatgataatg

SEQ ID NO: 807259 - DNA, 22 bp, Artificial Sequence
  chemically synthesized
agtagattcttgcttgtaactg

SEQ ID NO: 807260 - DNA, 22 bp, Artificial Sequence
  chemically synthesized
cagtagattcttgcttgtaact

SEQ ID NO: 807261 - DNA, 22 bp, Artificial Sequence
  chemically synthesized
gcattatcatcagttacaagca

SEQ ID NO: 807262 - DNA, 22 bp, Artificial Sequence
  chemically synthesized
cattatcatcagttacaagcaa

SEQ ID NO: 807263 - DNA, 22 bp, Artificial Sequence
  chemically synthesized
tcatcagttacaagcaagaatc

SEQ ID NO: 807264 - DNA, 22 bp, Artificial Sequence
  chemically synthesized
cgccccttcagtagattcttgc

SEQ ID NO: 807265 - DNA, 22 bp, Artificial Sequence
  chemically synthesized
caacactccgccccttcagtag

SEQ ID NO: 807266 - DNA, 22 bp, Artificial Sequence
  chemically synthesized
caagcaagaatctactgaaggg

SEQ ID NO: 807267 - DNA, 22 bp, Artificial Sequence
  chemically synthesized
tagctccaacactccgcccctt

SEQ ID NO: 807268 - DNA, 22 bp, Artificial Sequence
  chemically synthesized
atagctccaacactccgcccct

SEQ ID NO: 807269 - DNA, 22 bp, Artificial Sequence
  chemically synthesized
tatagctccaacactccgcccc

SEQ ID NO: 807270 - DNA, 22 bp, Artificial Sequence
  chemically synthesized
agctttatagctccaacactcc

SEQ ID NO: 807271 - DNA, 22 bp, Artificial Sequence
  chemically synthesized
ctgaaggggcggagtgttggag

SEQ ID NO: 807272 - DNA, 22 bp, Artificial Sequence
  chemically synthesized
aaggggcggagtgttggagcta

SEQ ID NO: 807273 - DNA, 22 bp, Artificial Sequence
  chemically synthesized
cactaagctttatagctccaac

SEQ ID NO: 807274 - DNA, 22 bp, Artificial Sequence
  chemically synthesized
gcacgtatagggttgcactaag

SEQ ID NO: 807275 - DNA, 22 bp, Artificial Sequence
  chemically synthesized
gagctataaagcttagtgcaac

SEQ ID NO: 807276 - DNA, 22 bp, Artificial Sequence
  chemically synthesized
ggcacgtatagggttgcactaa

SEQ ID NO: 807277 - DNA, 22 bp, Artificial Sequence
  chemically synthesized
tggcacgtatagggttgcacta

SEQ ID NO: 807278 - DNA, 22 bp, Artificial Sequence
  chemically synthesized
tttggcacgtatagggttgcac

SEQ ID NO: 807279 - DNA, 22 bp, Artificial Sequence
  chemically synthesized
ctttggcacgtatagggttgca

SEQ ID NO: 807280 - DNA, 22 bp, Artificial Sequence
  chemically synthesized
tctttggcacgtatagggttgc

SEQ ID NO: 807281 - DNA, 22 bp, Artificial Sequence
  chemically synthesized
taaagcttagtgcaaccctata

SEQ ID NO: 807282 - DNA, 22 bp, Artificial Sequence
  chemically synthesized
agtgcaaccctatacgtgccaa

SEQ ID NO: 807283 - DNA, 22 bp, Artificial Sequence
  chemically synthesized
gtgcaaccctatacgtgccaaa

SEQ ID NO: 807284 - DNA, 22 bp, Artificial Sequence
  chemically synthesized
gataaacactttctttggcacg

SEQ ID NO: 807285 - DNA, 22 bp, Artificial Sequence
  chemically synthesized
tggataaacactttctttggca

SEQ ID NO: 807286 - DNA, 22 bp, Artificial Sequence
  chemically synthesized
tctctggataaacactttcttt

SEQ ID NO: 807287 - DNA, 22 bp, Artificial Sequence
  chemically synthesized
tacgtgccaaagaaagtgttta

SEQ ID NO: 807288 - DNA, 22 bp, Artificial Sequence
  chemically synthesized
atgtgcagttgtctctggataa

SEQ ID NO: 807289 - DNA, 22 bp, Artificial Sequence
  chemically synthesized
catgtgcagttgtctctggata

SEQ ID NO: 807290 - DNA, 22 bp, Artificial Sequence
  chemically synthesized
ccttcatgtgcagttgtctctg

SEQ ID NO: 807291 - DNA, 22 bp, Artificial Sequence
  chemically synthesized
accttcatgtgcagttgtctct

SEQ ID NO: 807292 - DNA, 22 bp, Artificial Sequence
  chemically synthesized
taccttcatgtgcagttgtctc

SEQ ID NO: 807293 - DNA, 22 bp, Artificial Sequence
  chemically synthesized
tttaccttcatgtgcagttgtc

SEQ ID NO: 807294 - DNA, 22 bp, Artificial Sequence
  chemically synthesized
atccagagacaactgcacatga

SEQ ID NO: 807295 - DNA, 22 bp, Artificial Sequence
  chemically synthesized
tccagagacaactgcacatgaa

SEQ ID NO: 807296 - DNA, 22 bp, Artificial Sequence
  chemically synthesized
tgattctttaccttcatgtgca

SEQ ID NO: 807297 - DNA, 22 bp, Artificial Sequence
  chemically synthesized
tgtgattctttaccttcatgtg

SEQ ID NO: 807298 - DNA, 22 bp, Artificial Sequence
  chemically synthesized
ctgtgattctttaccttcatgt

SEQ ID NO: 807299 - DNA, 22 bp, Artificial Sequence
  chemically synthesized
cacatgaaggtaaagaatcaca

SEQ ID NO: 807300 - DNA, 22 bp, Artificial Sequence
  chemically synthesized
aaaacatgccttctgtgattct

SEQ ID NO: 807301 - DNA, 22 bp, Artificial Sequence
  chemically synthesized
aaaagaaaatgggtatgctgaa

SEQ ID NO: 807302 - DNA, 22 bp, Artificial Sequence
  chemically synthesized
aaaaagaaaatgggtatgctga

SEQ ID NO: 807303 - DNA, 22 bp, Artificial Sequence
  chemically synthesized
tcagcatacccattttcttttt

SEQ ID NO: 807304 - DNA, 22 bp, Artificial Sequence
  chemically synthesized
cagcatacccattttcttttta

SEQ ID NO: 807305 - DNA, 22 bp, Artificial Sequence
  chemically synthesized
ataatcaggtcttaaaaagaaa

SEQ ID NO: 807306 - DNA, 22 bp, Artificial Sequence
  chemically synthesized
agcatacccattttctttttaa

SEQ ID NO: 807307 - DNA, 22 bp, Artificial Sequence
  chemically synthesized
attgataatcaggtcttaaaaa

SEQ ID NO: 807308 - DNA, 22 bp, Artificial Sequence
  chemically synthesized
cattgataatcaggtcttaaaa

SEQ ID NO: 807309 - DNA, 22 bp, Artificial Sequence
  chemically synthesized
ttcattgataatcaggtcttaa

SEQ ID NO: 807310 - DNA, 22 bp, Artificial Sequence
  chemically synthesized
cttcattgataatcaggtctta

SEQ ID NO: 807311 - DNA, 22 bp, Artificial Sequence
  chemically synthesized
atttcttcattgataatcaggt

SEQ ID NO: 807312 - DNA, 22 bp, Artificial Sequence
  chemically synthesized
gatttcttcattgataatcagg

SEQ ID NO: 807313 - DNA, 22 bp, Artificial Sequence
  chemically synthesized
tctttttaagacctgattatca

SEQ ID NO: 807314 - DNA, 22 bp, Artificial Sequence
  chemically synthesized
ctttttaagacctgattatcaa

SEQ ID NO: 807315 - DNA, 22 bp, Artificial Sequence
  chemically synthesized
tttttaagacctgattatcaat

SEQ ID NO: 807316 - DNA, 22 bp, Artificial Sequence
  chemically synthesized
tttgatttcttcattgataatc

SEQ ID NO: 807317 - DNA, 22 bp, Artificial Sequence
  chemically synthesized
atttgatttcttcattgataat

SEQ ID NO: 807318 - DNA, 22 bp, Artificial Sequence
  chemically synthesized
tttaagacctgattatcaatga

SEQ ID NO: 807319 - DNA, 22 bp, Artificial Sequence
  chemically synthesized
ttaagacctgattatcaatgaa

SEQ ID NO: 807320 - DNA, 22 bp, Artificial Sequence
  chemically synthesized
taagacctgattatcaatgaag

SEQ ID NO: 807321 - DNA, 22 bp, Artificial Sequence
  chemically synthesized
cttatttgatttcttcattgat

SEQ ID NO: 807322 - DNA, 22 bp, Artificial Sequence
  chemically synthesized
aagacctgattatcaatgaaga

SEQ ID NO: 807323 - DNA, 22 bp, Artificial Sequence
  chemically synthesized
acttatttgatttcttcattga

SEQ ID NO: 807324 - DNA, 22 bp, Artificial Sequence
  chemically synthesized
agacctgattatcaatgaagaa

SEQ ID NO: 807325 - DNA, 22 bp, Artificial Sequence
  chemically synthesized
attatcaatgaagaaatcaaat

SEQ ID NO: 807326 - DNA, 22 bp, Artificial Sequence
  chemically synthesized
tcaatgaagaaatcaaataagt

SEQ ID NO: 807327 - DNA, 22 bp, Artificial Sequence
  chemically synthesized
atgacaggtcagaacttactta

SEQ ID NO: 807328 - DNA, 22 bp, Artificial Sequence
  chemically synthesized
taatgacaggtcagaacttact

SEQ ID NO: 807329 - DNA, 22 bp, Artificial Sequence
  chemically synthesized
tgacctgtcattagaaccctac

SEQ ID NO: 807330 - DNA, 22 bp, Artificial Sequence
  chemically synthesized
acctgtcattagaaccctactc

SEQ ID NO: 807331 - DNA, 22 bp, Artificial Sequence
  chemically synthesized
tcattagaaccctactcccgcc

SEQ ID NO: 807332 - DNA, 22 bp, Artificial Sequence
  chemically synthesized
gaaccctactcccgccacacac

SEQ ID NO: 807333 - DNA, 22 bp, Artificial Sequence
  chemically synthesized
agaaataccatggtgtgtgtgt

SEQ ID NO: 807334 - DNA, 22 bp, Artificial Sequence
  chemically synthesized
ctcccgccacacacacacacca

SEQ ID NO: 807335 - DNA, 22 bp, Artificial Sequence
  chemically synthesized
ttcagaaataccatggtgtgtg

SEQ ID NO: 807336 - DNA, 22 bp, Artificial Sequence
  chemically synthesized
attcagaaataccatggtgtgt

SEQ ID NO: 807337 - DNA, 22 bp, Artificial Sequence
  chemically synthesized
ccgccacacacacacaccatgg

SEQ ID NO: 807338 - DNA, 22 bp, Artificial Sequence
  chemically synthesized
gagatttattcagaaataccat

SEQ ID NO: 807339 - DNA, 22 bp, Artificial Sequence
  chemically synthesized
agagatttattcagaaatacca

SEQ ID NO: 807340 - DNA, 22 bp, Artificial Sequence
  chemically synthesized
aatgcagtcttagagatttatt

SEQ ID NO: 807341 - DNA, 22 bp, Artificial Sequence
  chemically synthesized
aactcaatgcagtcttagagat

SEQ ID NO: 807342 - DNA, 22 bp, Artificial Sequence
  chemically synthesized
ctgaataaatctctaagactgc

SEQ ID NO: 807343 - DNA, 22 bp, Artificial Sequence
  chemically synthesized
tgaataaatctctaagactgca

SEQ ID NO: 807344 - DNA, 22 bp, Artificial Sequence
  chemically synthesized
aataaatctctaagactgcatt

SEQ ID NO: 807345 - DNA, 22 bp, Artificial Sequence
  chemically synthesized
atgatattcaactcaatgcagt

SEQ ID NO: 807346 - DNA, 22 bp, Artificial Sequence
  chemically synthesized
taagactgcattgagttgaata

SEQ ID NO: 807347 - DNA, 22 bp, Artificial Sequence
  chemically synthesized
agactgcattgagttgaatatc

SEQ ID NO: 807348 - DNA, 22 bp, Artificial Sequence
  chemically synthesized
gccataagaaattgatgatatt

SEQ ID NO: 807349 - DNA, 22 bp, Artificial Sequence
  chemically synthesized
cattgagttgaatatcatcaat

SEQ ID NO: 807350 - DNA, 22 bp, Artificial Sequence
  chemically synthesized
tgttggccataagaaattgatg

SEQ ID NO: 807351 - DNA, 22 bp, Artificial Sequence
  chemically synthesized
agttgaatatcatcaatttctt

SEQ ID NO: 807352 - DNA, 22 bp, Artificial Sequence
  chemically synthesized
aatatcatcaatttcttatggc

SEQ ID NO: 807353 - DNA, 22 bp, Artificial Sequence
  chemically synthesized
tgtattatgttggccataagaa

SEQ ID NO: 807354 - DNA, 22 bp, Artificial Sequence
  chemically synthesized
atgtattatgttggccataaga

SEQ ID NO: 807355 - DNA, 22 bp, Artificial Sequence
  chemically synthesized
tatgtattatgttggccataag

SEQ ID NO: 807356 - DNA, 22 bp, Artificial Sequence
  chemically synthesized
ttatgtattatgttggccataa

SEQ ID NO: 807357 - DNA, 22 bp, Artificial Sequence
  chemically synthesized
tttatgtattatgttggccata

SEQ ID NO: 807358 - DNA, 22 bp, Artificial Sequence
  chemically synthesized
ctttttatgtattatgttggcc

SEQ ID NO: 807359 - DNA, 22 bp, Artificial Sequence
  chemically synthesized
cctttttatgtattatgttggc

SEQ ID NO: 807360 - DNA, 22 bp, Artificial Sequence
  chemically synthesized
tcctttttatgtattatgttgg

SEQ ID NO: 807361 - DNA, 22 bp, Artificial Sequence
  chemically synthesized
ttcctttttatgtattatgttg

SEQ ID NO: 807362 - DNA, 22 bp, Artificial Sequence
  chemically synthesized
tttcctttttatgtattatgtt

SEQ ID NO: 807363 - DNA, 22 bp, Artificial Sequence
  chemically synthesized
cttatggccaacataatacata

SEQ ID NO: 807364 - DNA, 22 bp, Artificial Sequence
  chemically synthesized
ctttttcctttttatgtattat

SEQ ID NO: 807365 - DNA, 22 bp, Artificial Sequence
  chemically synthesized
ttatggccaacataatacataa

SEQ ID NO: 807366 - DNA, 22 bp, Artificial Sequence
  chemically synthesized
cctttttcctttttatgtatta

SEQ ID NO: 807367 - DNA, 22 bp, Artificial Sequence
  chemically synthesized
atggccaacataatacataaaa

SEQ ID NO: 807368 - DNA, 22 bp, Artificial Sequence
  chemically synthesized
tggccaacataatacataaaaa

SEQ ID NO: 807369 - DNA, 22 bp, Artificial Sequence
  chemically synthesized
ccttcctttttcctttttatgt

SEQ ID NO: 807370 - DNA, 22 bp, Artificial Sequence
  chemically synthesized
cccttcctttttcctttttatg

SEQ ID NO: 807371 - DNA, 22 bp, Artificial Sequence
  chemically synthesized
ccccggaaagcaacaagtttcc

SEQ ID NO: 807372 - DNA, 22 bp, Artificial Sequence
  chemically synthesized
accccggaaagcaacaagtttc

SEQ ID NO: 807373 - DNA, 22 bp, Artificial Sequence
  chemically synthesized
ggcttaccccggaaagcaacaa

SEQ ID NO: 807374 - DNA, 22 bp, Artificial Sequence
  chemically synthesized
aggcttaccccggaaagcaaca

SEQ ID NO: 807375 - DNA, 22 bp, Artificial Sequence
  chemically synthesized
taggcttaccccggaaagcaac

SEQ ID NO: 807376 - DNA, 22 bp, Artificial Sequence
  chemically synthesized
tttaggcttaccccggaaagca

SEQ ID NO: 807377 - DNA, 22 bp, Artificial Sequence
  chemically synthesized
agctctttaggcttaccccgga

SEQ ID NO: 807378 - DNA, 22 bp, Artificial Sequence
  chemically synthesized
gttgctttccggggtaagccta

SEQ ID NO: 807379 - DNA, 22 bp, Artificial Sequence
  chemically synthesized
ttgctttccggggtaagcctaa

SEQ ID NO: 807380 - DNA, 22 bp, Artificial Sequence
  chemically synthesized
ctttccggggtaagcctaaaga

SEQ ID NO: 807381 - DNA, 22 bp, Artificial Sequence
  chemically synthesized
tccggggtaagcctaaagagct

SEQ ID NO: 807382 - DNA, 22 bp, Artificial Sequence
  chemically synthesized
ccggggtaagcctaaagagctt

SEQ ID NO: 807383 - DNA, 22 bp, Artificial Sequence
  chemically synthesized
cggggtaagcctaaagagctta

SEQ ID NO: 807384 - DNA, 22 bp, Artificial Sequence
  chemically synthesized
aagagcttaattattgtataca

SEQ ID NO: 807385 - DNA, 22 bp, Artificial Sequence
  chemically synthesized
atagtagaatggtgtgtataca

SEQ ID NO: 807386 - DNA, 22 bp, Artificial Sequence
  chemically synthesized
aattattgtatacacaccattc

SEQ ID NO: 807387 - DNA, 22 bp, Artificial Sequence
  chemically synthesized
attattgtatacacaccattct

SEQ ID NO: 807388 - DNA, 22 bp, Artificial Sequence
  chemically synthesized
ttgtatacacaccattctacta

SEQ ID NO: 807389 - DNA, 22 bp, Artificial Sequence
  chemically synthesized
atccatatatctaatagtagaa

SEQ ID NO: 807390 - DNA, 22 bp, Artificial Sequence
  chemically synthesized
tatacacaccattctactatta

SEQ ID NO: 807391 - DNA, 22 bp, Artificial Sequence
  chemically synthesized
catccatatatctaatagtaga

SEQ ID NO: 807392 - DNA, 22 bp, Artificial Sequence
  chemically synthesized
tcatccatatatctaatagtag

SEQ ID NO: 807393 - DNA, 22 bp, Artificial Sequence
  chemically synthesized
ttcatccatatatctaatagta

SEQ ID NO: 807394 - DNA, 22 bp, Artificial Sequence
  chemically synthesized
tactattagatatatggatgaa

SEQ ID NO: 807395 - DNA, 22 bp, Artificial Sequence
  chemically synthesized
ctattagatatatggatgaaaa

SEQ ID NO: 807396 - DNA, 22 bp, Artificial Sequence
  chemically synthesized
ttagatatatggatgaaaaata

SEQ ID NO: 807397 - DNA, 22 bp, Artificial Sequence
  chemically synthesized
gatatatggatgaaaaatactt

SEQ ID NO: 807398 - DNA, 22 bp, Artificial Sequence
  chemically synthesized
cacagtataatgcaccgataaa

SEQ ID NO: 807399 - DNA, 22 bp, Artificial Sequence
  chemically synthesized
caattccacagtataatgcacc

SEQ ID NO: 807400 - DNA, 22 bp, Artificial Sequence
  chemically synthesized
acaattccacagtataatgcac

SEQ ID NO: 807401 - DNA, 22 bp, Artificial Sequence
  chemically synthesized
tatcggtgcattatactgtgga

SEQ ID NO: 807402 - DNA, 22 bp, Artificial Sequence
  chemically synthesized
cacacttacaattccacagtat

SEQ ID NO: 807403 - DNA, 22 bp, Artificial Sequence
  chemically synthesized
atcggtgcattatactgtggaa

SEQ ID NO: 807404 - DNA, 22 bp, Artificial Sequence
  chemically synthesized
tcggtgcattatactgtggaat

SEQ ID NO: 807405 - DNA, 22 bp, Artificial Sequence
  chemically synthesized
tacctacacacttacaattcca

SEQ ID NO: 807406 - DNA, 22 bp, Artificial Sequence
  chemically synthesized
taattatacctacacacttaca

SEQ ID NO: 807407 - DNA, 22 bp, Artificial Sequence
  chemically synthesized
tactgtggaattgtaagtgtgt

SEQ ID NO: 807408 - DNA, 22 bp, Artificial Sequence
  chemically synthesized
tgtaattatacctacacactta

SEQ ID NO: 807409 - DNA, 22 bp, Artificial Sequence
  chemically synthesized
ctgtaattatacctacacactt

SEQ ID NO: 807410 - DNA, 22 bp, Artificial Sequence
  chemically synthesized
tggaattgtaagtgtgtaggta

SEQ ID NO: 807411 - DNA, 22 bp, Artificial Sequence
  chemically synthesized
aatatgtttctgtaattatacc

SEQ ID NO: 807412 - DNA, 22 bp, Artificial Sequence
  chemically synthesized
taagtgtgtaggtataattaca

SEQ ID NO: 807413 - DNA, 22 bp, Artificial Sequence
  chemically synthesized
aaaatactcaatatgtttctgt

SEQ ID NO: 807414 - DNA, 22 bp, Artificial Sequence
  chemically synthesized
taaaaatactcaatatgtttct

SEQ ID NO: 807415 - DNA, 22 bp, Artificial Sequence
  chemically synthesized
ctaaaaatactcaatatgtttc

SEQ ID NO: 807416 - DNA, 22 bp, Artificial Sequence
  chemically synthesized
tctaaaaatactcaatatgttt

SEQ ID NO: 807417 - DNA, 22 bp, Artificial Sequence
  chemically synthesized
ttctaaaaatactcaatatgtt

SEQ ID NO: 807418 - DNA, 22 bp, Artificial Sequence
  chemically synthesized
tttctaaaaatactcaatatgt

SEQ ID NO: 807419 - DNA, 22 bp, Artificial Sequence
  chemically synthesized
agcctttttctaaaaatactca

SEQ ID NO: 807420 - DNA, 22 bp, Artificial Sequence
  chemically synthesized
cagaaacatattgagtattttt

SEQ ID NO: 807421 - DNA, 22 bp, Artificial Sequence
  chemically synthesized
atatcagattgagcctttttct

SEQ ID NO: 807422 - DNA, 22 bp, Artificial Sequence
  chemically synthesized
catatcagattgagcctttttc

SEQ ID NO: 807423 - DNA, 22 bp, Artificial Sequence
  chemically synthesized
tcatatcagattgagccttttt

SEQ ID NO: 807424 - DNA, 22 bp, Artificial Sequence
  chemically synthesized
agtatttttagaaaaaggctca

SEQ ID NO: 807425 - DNA, 22 bp, Artificial Sequence
  chemically synthesized
ttagaaaaaggctcaatctgat

SEQ ID NO: 807426 - DNA, 22 bp, Artificial Sequence
  chemically synthesized
tagaaaaaggctcaatctgata

SEQ ID NO: 807427 - DNA, 22 bp, Artificial Sequence
  chemically synthesized
agaaaaaggctcaatctgatat

SEQ ID NO: 807428 - DNA, 22 bp, Artificial Sequence
  chemically synthesized
gaaaaaggctcaatctgatatg

SEQ ID NO: 807429 - DNA, 22 bp, Artificial Sequence
  chemically synthesized
ggcaaaataacctttcatatca

SEQ ID NO: 807430 - DNA, 22 bp, Artificial Sequence
  chemically synthesized
aatctgatatgaaaggttattt

SEQ ID NO: 807431 - DNA, 22 bp, Artificial Sequence
  chemically synthesized
aaaataacctgggcaaaataac

SEQ ID NO: 807432 - DNA, 22 bp, Artificial Sequence
  chemically synthesized
aaaaataacctgggcaaaataa

SEQ ID NO: 807433 - DNA, 22 bp, Artificial Sequence
  chemically synthesized
taaaaataacctgggcaaaata

SEQ ID NO: 807434 - DNA, 22 bp, Artificial Sequence
  chemically synthesized
atatgaaaggttattttgccca

SEQ ID NO: 807435 - DNA, 22 bp, Artificial Sequence
  chemically synthesized
tcacattttaaaaataacctgg

SEQ ID NO: 807436 - DNA, 22 bp, Artificial Sequence
  chemically synthesized
atcacattttaaaaataacctg

SEQ ID NO: 807437 - DNA, 22 bp, Artificial Sequence
  chemically synthesized
atttatcacattttaaaaataa

SEQ ID NO: 807438 - DNA, 22 bp, Artificial Sequence
  chemically synthesized
ttttgcccaggttatttttaaa

SEQ ID NO: 807439 - DNA, 22 bp, Artificial Sequence
  chemically synthesized
ctaatttatcacattttaaaaa

SEQ ID NO: 807440 - DNA, 22 bp, Artificial Sequence
  chemically synthesized
tgcccaggttatttttaaaatg

SEQ ID NO: 807441 - DNA, 22 bp, Artificial Sequence
  chemically synthesized
gcccaggttatttttaaaatgt

SEQ ID NO: 807442 - DNA, 22 bp, Artificial Sequence
  chemically synthesized
cccaggttatttttaaaatgtg

SEQ ID NO: 807443 - DNA, 22 bp, Artificial Sequence
  chemically synthesized
aatgttcctaatttatcacatt

SEQ ID NO: 807444 - DNA, 22 bp, Artificial Sequence
  chemically synthesized
gaatgttcctaatttatcacat

SEQ ID NO: 807445 - DNA, 22 bp, Artificial Sequence
  chemically synthesized
tgaatgttcctaatttatcaca

SEQ ID NO: 807446 - DNA, 22 bp, Artificial Sequence
  chemically synthesized
tttgaatgttcctaatttatca

SEQ ID NO: 807447 - DNA, 22 bp, Artificial Sequence
  chemically synthesized
tttttaaaatgtgataaattag

SEQ ID NO: 807448 - DNA, 22 bp, Artificial Sequence
  chemically synthesized
ttaaaatgtgataaattaggaa

SEQ ID NO: 807449 - DNA, 22 bp, Artificial Sequence
  chemically synthesized
taaaatgtgataaattaggaac

SEQ ID NO: 807450 - DNA, 22 bp, Artificial Sequence
  chemically synthesized
agttctttgaatgttcctaatt

SEQ ID NO: 807451 - DNA, 22 bp, Artificial Sequence
  chemically synthesized
aaaatgtgataaattaggaaca

SEQ ID NO: 807452 - DNA, 22 bp, Artificial Sequence
  chemically synthesized
aaatgtgataaattaggaacat

SEQ ID NO: 807453 - DNA, 22 bp, Artificial Sequence
  chemically synthesized
gcagaagactgagttctttgaa

SEQ ID NO: 807454 - DNA, 22 bp, Artificial Sequence
  chemically synthesized
agcagaagactgagttctttga

SEQ ID NO: 807455 - DNA, 22 bp, Artificial Sequence
  chemically synthesized
tttagcagaagactgagttctt

SEQ ID NO: 807456 - DNA, 22 bp, Artificial Sequence
  chemically synthesized
ggaacattcaaagaactcagtc

SEQ ID NO: 807457 - DNA, 22 bp, Artificial Sequence
  chemically synthesized
aaagaactcagtcttctgctaa

SEQ ID NO: 807458 - DNA, 22 bp, Artificial Sequence
  chemically synthesized
agtcttctgctaaataacactt

SEQ ID NO: 807459 - DNA, 22 bp, Artificial Sequence
  chemically synthesized
ctgctaaataacactttcacta

SEQ ID NO: 807460 - DNA, 22 bp, Artificial Sequence
  chemically synthesized
tgctaaataacactttcactat

SEQ ID NO: 807461 - DNA, 22 bp, Artificial Sequence
  chemically synthesized
ctaaataacactttcactatgg

SEQ ID NO: 807462 - DNA, 22 bp, Artificial Sequence
  chemically synthesized
taacaatgccaggccatagtga

SEQ ID NO: 807463 - DNA, 22 bp, Artificial Sequence
  chemically synthesized
aataacactttcactatggcct

SEQ ID NO: 807464 - DNA, 22 bp, Artificial Sequence
  chemically synthesized
tataacaatgccaggccatagt

SEQ ID NO: 807465 - DNA, 22 bp, Artificial Sequence
  chemically synthesized
ctctataacaatgccaggccat

SEQ ID NO: 807466 - DNA, 22 bp, Artificial Sequence
  chemically synthesized
tcactatggcctggcattgtta

SEQ ID NO: 807467 - DNA, 22 bp, Artificial Sequence
  chemically synthesized
cactatggcctggcattgttat

SEQ ID NO: 807468 - DNA, 22 bp, Artificial Sequence
  chemically synthesized
tgtgattactctataacaatgc

SEQ ID NO: 807469 - DNA, 22 bp, Artificial Sequence
  chemically synthesized
actatggcctggcattgttata

SEQ ID NO: 807470 - DNA, 22 bp, Artificial Sequence
  chemically synthesized
atgtgattactctataacaatg

SEQ ID NO: 807471 - DNA, 22 bp, Artificial Sequence
  chemically synthesized
tatgtgattactctataacaat

SEQ ID NO: 807472 - DNA, 22 bp, Artificial Sequence
  chemically synthesized
tggcctggcattgttatagagt

SEQ ID NO: 807473 - DNA, 22 bp, Artificial Sequence
  chemically synthesized
agagtattttatgtgattactc

SEQ ID NO: 807474 - DNA, 22 bp, Artificial Sequence
  chemically synthesized
gcattgttatagagtaatcaca

SEQ ID NO: 807475 - DNA, 22 bp, Artificial Sequence
  chemically synthesized
ttatagagtaatcacataaaat

SEQ ID NO: 807476 - DNA, 22 bp, Artificial Sequence
  chemically synthesized
tagagtaatcacataaaatact

SEQ ID NO: 807477 - DNA, 22 bp, Artificial Sequence
  chemically synthesized
ggaaggaaagattcagagtatt

SEQ ID NO: 807478 - DNA, 22 bp, Artificial Sequence
  chemically synthesized
caaataaactaggaaggaaaga

SEQ ID NO: 807479 - DNA, 22 bp, Artificial Sequence
  chemically synthesized
aattgcaaataaactaggaagg

SEQ ID NO: 807480 - DNA, 22 bp, Artificial Sequence
  chemically synthesized
tgaatctttccttcctagttta

SEQ ID NO: 807481 - DNA, 22 bp, Artificial Sequence
  chemically synthesized
aatctttccttcctagtttatt

SEQ ID NO: 807482 - DNA, 22 bp, Artificial Sequence
  chemically synthesized
tccttcctagtttatttgcaat

SEQ ID NO: 807483 - DNA, 22 bp, Artificial Sequence
  chemically synthesized
ccttcctagtttatttgcaatt

SEQ ID NO: 807484 - DNA, 22 bp, Artificial Sequence
  chemically synthesized
cttcctagtttatttgcaattt

SEQ ID NO: 807485 - DNA, 22 bp, Artificial Sequence
  chemically synthesized
cctagtttatttgcaatttagc

SEQ ID NO: 807486 - DNA, 22 bp, Artificial Sequence
  chemically synthesized
ctagtttatttgcaatttagcc

SEQ ID NO: 807487 - DNA, 22 bp, Artificial Sequence
  chemically synthesized
gtttatttgcaatttagccact

SEQ ID NO: 807488 - DNA, 22 bp, Artificial Sequence
  chemically synthesized
atttgcaatttagccactatca

SEQ ID NO: 807489 - DNA, 22 bp, Artificial Sequence
  chemically synthesized
tttgcaatttagccactatcat

SEQ ID NO: 807490 - DNA, 22 bp, Artificial Sequence
  chemically synthesized
aaatatcataggaaatgatagt

SEQ ID NO: 807491 - DNA, 22 bp, Artificial Sequence
  chemically synthesized
gcaatttagccactatcatttc

SEQ ID NO: 807492 - DNA, 22 bp, Artificial Sequence
  chemically synthesized
caatttagccactatcatttcc

SEQ ID NO: 807493 - DNA, 22 bp, Artificial Sequence
  chemically synthesized
ctaaaatatcataggaaatgat

SEQ ID NO: 807494 - DNA, 22 bp, Artificial Sequence
  chemically synthesized
tcctaaaatatcataggaaatg

SEQ ID NO: 807495 - DNA, 22 bp, Artificial Sequence
  chemically synthesized
ctcctaaaatatcataggaaat

SEQ ID NO: 807496 - DNA, 22 bp, Artificial Sequence
  chemically synthesized
tctcctaaaatatcataggaaa

SEQ ID NO: 807497 - DNA, 22 bp, Artificial Sequence
  chemically synthesized
agccactatcatttcctatgat

SEQ ID NO: 807498 - DNA, 22 bp, Artificial Sequence
  chemically synthesized
gccactatcatttcctatgata

SEQ ID NO: 807499 - DNA, 22 bp, Artificial Sequence
  chemically synthesized
atctttctcctaaaatatcata

SEQ ID NO: 807500 - DNA, 22 bp, Artificial Sequence
  chemically synthesized
aatctttctcctaaaatatcat

SEQ ID NO: 807501 - DNA, 22 bp, Artificial Sequence
  chemically synthesized
taatctttctcctaaaatatca

SEQ ID NO: 807502 - DNA, 22 bp, Artificial Sequence
  chemically synthesized
tcatttcctatgatattttagg

SEQ ID NO: 807503 - DNA, 22 bp, Artificial Sequence
  chemically synthesized
cctatgatattttaggagaaag

SEQ ID NO: 807504 - DNA, 22 bp, Artificial Sequence
  chemically synthesized
ctatgatattttaggagaaaga

SEQ ID NO: 807505 - DNA, 22 bp, Artificial Sequence
  chemically synthesized
tgatattttaggagaaagatta

SEQ ID NO: 807506 - DNA, 22 bp, Artificial Sequence
  chemically synthesized
taggagaaagattaaaggatca

SEQ ID NO: 807507 - DNA, 22 bp, Artificial Sequence
  chemically synthesized
aggagaaagattaaaggatcat

SEQ ID NO: 807508 - DNA, 22 bp, Artificial Sequence
  chemically synthesized
ggagaaagattaaaggatcatt

SEQ ID NO: 807509 - DNA, 22 bp, Artificial Sequence
  chemically synthesized
accaaaaaaaggaacaaaataa

SEQ ID NO: 807510 - DNA, 22 bp, Artificial Sequence
  chemically synthesized
aaggatcattattttgttcctt

SEQ ID NO: 807511 - DNA, 22 bp, Artificial Sequence
  chemically synthesized
tatctcaccaaaaaaaggaaca

SEQ ID NO: 807512 - DNA, 22 bp, Artificial Sequence
  chemically synthesized
acctatatctcaccaaaaaaag

SEQ ID NO: 807513 - DNA, 22 bp, Artificial Sequence
  chemically synthesized
tgacctatatctcaccaaaaaa

SEQ ID NO: 807514 - DNA, 22 bp, Artificial Sequence
  chemically synthesized
ttttgttcctttttttggtgag

SEQ ID NO: 807515 - DNA, 22 bp, Artificial Sequence
  chemically synthesized
tctgacctatatctcaccaaaa

SEQ ID NO: 807516 - DNA, 22 bp, Artificial Sequence
  chemically synthesized
tgttcctttttttggtgagata

SEQ ID NO: 807517 - DNA, 22 bp, Artificial Sequence
  chemically synthesized
gttcctttttttggtgagatat

SEQ ID NO: 807518 - DNA, 22 bp, Artificial Sequence
  chemically synthesized
ttcctttttttggtgagatata

SEQ ID NO: 807519 - DNA, 22 bp, Artificial Sequence
  chemically synthesized
aggtctctctgacctatatctc

SEQ ID NO: 807520 - DNA, 22 bp, Artificial Sequence
  chemically synthesized
ctttttttggtgagatataggt

SEQ ID NO: 807521 - DNA, 22 bp, Artificial Sequence
  chemically synthesized
ctaaggtctctctgacctatat

SEQ ID NO: 807522 - DNA, 22 bp, Artificial Sequence
  chemically synthesized
tttttggtgagatataggtcag

SEQ ID NO: 807523 - DNA, 22 bp, Artificial Sequence
  chemically synthesized
ttttggtgagatataggtcaga

SEQ ID NO: 807524 - DNA, 22 bp, Artificial Sequence
  chemically synthesized
tttggtgagatataggtcagag

SEQ ID NO: 807525 - DNA, 22 bp, Artificial Sequence
  chemically synthesized
ttggtgagatataggtcagaga

SEQ ID NO: 807526 - DNA, 22 bp, Artificial Sequence
  chemically synthesized
tggtgagatataggtcagagag

SEQ ID NO: 807527 - DNA, 22 bp, Artificial Sequence
  chemically synthesized
ggtgagatataggtcagagaga

SEQ ID NO: 807528 - DNA, 22 bp, Artificial Sequence
  chemically synthesized
gtgagatataggtcagagagac

SEQ ID NO: 807529 - DNA, 22 bp, Artificial Sequence
  chemically synthesized
catccaggtgctactaaggtct

SEQ ID NO: 807530 - DNA, 22 bp, Artificial Sequence
  chemically synthesized
acatccaggtgctactaaggtc

SEQ ID NO: 807531 - DNA, 22 bp, Artificial Sequence
  chemically synthesized
atcttacatccaggtgctacta

SEQ ID NO: 807532 - DNA, 22 bp, Artificial Sequence
  chemically synthesized
gatcttacatccaggtgctact

SEQ ID NO: 807533 - DNA, 22 bp, Artificial Sequence
  chemically synthesized
tgatcttacatccaggtgctac

SEQ ID NO: 807534 - DNA, 22 bp, Artificial Sequence
  chemically synthesized
agtagcacctggatgtaagatc

SEQ ID NO: 807535 - DNA, 22 bp, Artificial Sequence
  chemically synthesized
gtagcacctggatgtaagatca

SEQ ID NO: 807536 - DNA, 22 bp, Artificial Sequence
  chemically synthesized
atatggcaagaatcattttgat

SEQ ID NO: 807537 - DNA, 22 bp, Artificial Sequence
  chemically synthesized
gatgtaagatcaaaatgattct

SEQ ID NO: 807538 - DNA, 22 bp, Artificial Sequence
  chemically synthesized
tgagtagcggttgatatggcaa

SEQ ID NO: 807539 - DNA, 22 bp, Artificial Sequence
  chemically synthesized
tatgagtagcggttgatatggc

SEQ ID NO: 807540 - DNA, 22 bp, Artificial Sequence
  chemically synthesized
gttctatgagtagcggttgata

SEQ ID NO: 807541 - DNA, 22 bp, Artificial Sequence
  chemically synthesized
tggttctatgagtagcggttga

SEQ ID NO: 807542 - DNA, 22 bp, Artificial Sequence
  chemically synthesized
ttgccatatcaaccgctactca

SEQ ID NO: 807543 - DNA, 22 bp, Artificial Sequence
  chemically synthesized
actctggttctatgagtagcgg

SEQ ID NO: 807544 - DNA, 22 bp, Artificial Sequence
  chemically synthesized
gccatatcaaccgctactcata

SEQ ID NO: 807545 - DNA, 22 bp, Artificial Sequence
  chemically synthesized
ccatatcaaccgctactcatag

SEQ ID NO: 807546 - DNA, 22 bp, Artificial Sequence
  chemically synthesized
agattaactctggttctatgag

SEQ ID NO: 807547 - DNA, 22 bp, Artificial Sequence
  chemically synthesized
cagattaactctggttctatga

SEQ ID NO: 807548 - DNA, 22 bp, Artificial Sequence
  chemically synthesized
aatttcagattaactctggttc

SEQ ID NO: 807549 - DNA, 22 bp, Artificial Sequence
  chemically synthesized
gaatttcagattaactctggtt

SEQ ID NO: 807550 - DNA, 22 bp, Artificial Sequence
  chemically synthesized
ctcatagaaccagagttaatct

SEQ ID NO: 807551 - DNA, 22 bp, Artificial Sequence
  chemically synthesized
atagaaccagagttaatctgaa

SEQ ID NO: 807552 - DNA, 22 bp, Artificial Sequence
  chemically synthesized
caggaaatttgaatttcagatt

SEQ ID NO: 807553 - DNA, 22 bp, Artificial Sequence
  chemically synthesized
tggttacaggaaatttgaattt

SEQ ID NO: 807554 - DNA, 22 bp, Artificial Sequence
  chemically synthesized
ttatggttacaggaaatttgaa

SEQ ID NO: 807555 - DNA, 22 bp, Artificial Sequence
  chemically synthesized
atctgaaattcaaatttcctgt

SEQ ID NO: 807556 - DNA, 22 bp, Artificial Sequence
  chemically synthesized
aaattcaaatttcctgtaacca

SEQ ID NO: 807557 - DNA, 22 bp, Artificial Sequence
  chemically synthesized
gtaggaactgttatggttacag

SEQ ID NO: 807558 - DNA, 22 bp, Artificial Sequence
  chemically synthesized
aaatttcctgtaaccataacag

SEQ ID NO: 807559 - DNA, 22 bp, Artificial Sequence
  chemically synthesized
gcaaactagtaggaactgttat

SEQ ID NO: 807560 - DNA, 22 bp, Artificial Sequence
  chemically synthesized
cctgtaaccataacagttccta

SEQ ID NO: 807561 - DNA, 22 bp, Artificial Sequence
  chemically synthesized
ctagcaaactagtaggaactgt

SEQ ID NO: 807562 - DNA, 22 bp, Artificial Sequence
  chemically synthesized
ctgtaaccataacagttcctac

SEQ ID NO: 807563 - DNA, 22 bp, Artificial Sequence
  chemically synthesized
actagcaaactagtaggaactg

SEQ ID NO: 807564 - DNA, 22 bp, Artificial Sequence
  chemically synthesized
taaccataacagttcctactag

SEQ ID NO: 807565 - DNA, 22 bp, Artificial Sequence
  chemically synthesized
aaatcaaaatgcaatttactag

SEQ ID NO: 807566 - DNA, 22 bp, Artificial Sequence
  chemically synthesized
ctactagtttgctagtaaattg

SEQ ID NO: 807567 - DNA, 22 bp, Artificial Sequence
  chemically synthesized
aaaatcaaaatgcaatttacta

SEQ ID NO: 807568 - DNA, 22 bp, Artificial Sequence
  chemically synthesized
taaaatcaaaatgcaatttact

SEQ ID NO: 807569 - DNA, 22 bp, Artificial Sequence
  chemically synthesized
ctagtttgctagtaaattgcat

SEQ ID NO: 807570 - DNA, 22 bp, Artificial Sequence
  chemically synthesized
gtttgctagtaaattgcatttt

SEQ ID NO: 807571 - DNA, 22 bp, Artificial Sequence
  chemically synthesized
tgttttaaaatcaaaatgcaat

SEQ ID NO: 807572 - DNA, 22 bp, Artificial Sequence
  chemically synthesized
gctagtaaattgcattttgatt

SEQ ID NO: 807573 - DNA, 22 bp, Artificial Sequence
  chemically synthesized
ctagtaaattgcattttgattt

SEQ ID NO: 807574 - DNA, 22 bp, Artificial Sequence
  chemically synthesized
gtaaattgcattttgattttaa

SEQ ID NO: 807575 - DNA, 22 bp, Artificial Sequence
  chemically synthesized
cattttgattttaaaacataac

SEQ ID NO: 807576 - DNA, 22 bp, Artificial Sequence
  chemically synthesized
acaagtacaatataaagttatg

SEQ ID NO: 807577 - DNA, 22 bp, Artificial Sequence
  chemically synthesized
tgattttaaaacataactttat

SEQ ID NO: 807578 - DNA, 22 bp, Artificial Sequence
  chemically synthesized
gattttaaaacataactttata

SEQ ID NO: 807579 - DNA, 22 bp, Artificial Sequence
  chemically synthesized
attttaaaacataactttatat

SEQ ID NO: 807580 - DNA, 22 bp, Artificial Sequence
  chemically synthesized
ccctcacaagtacaatataaag

SEQ ID NO: 807581 - DNA, 22 bp, Artificial Sequence
  chemically synthesized
cccctcacaagtacaatataaa

SEQ ID NO: 807582 - DNA, 22 bp, Artificial Sequence
  chemically synthesized
taaaacataactttatattgta

SEQ ID NO: 807583 - DNA, 22 bp, Artificial Sequence
  chemically synthesized
aaaacataactttatattgtac

SEQ ID NO: 807584 - DNA, 22 bp, Artificial Sequence
  chemically synthesized
aaacataactttatattgtact

SEQ ID NO: 807585 - DNA, 22 bp, Artificial Sequence
  chemically synthesized
gcttcccctcacaagtacaata

SEQ ID NO: 807586 - DNA, 22 bp, Artificial Sequence
  chemically synthesized
tagcttcccctcacaagtacaa

SEQ ID NO: 807587 - DNA, 22 bp, Artificial Sequence
  chemically synthesized
tatattgtacttgtgaggggaa

SEQ ID NO: 807588 - DNA, 22 bp, Artificial Sequence
  chemically synthesized
atattgtacttgtgaggggaag

SEQ ID NO: 807589 - DNA, 22 bp, Artificial Sequence
  chemically synthesized
tattgtacttgtgaggggaagc

SEQ ID NO: 807590 - DNA, 22 bp, Artificial Sequence
  chemically synthesized
tacttgtgaggggaagctagaa

SEQ ID NO: 807591 - DNA, 22 bp, Artificial Sequence
  chemically synthesized
gtgaggggaagctagaattttg

SEQ ID NO: 807592 - DNA, 22 bp, Artificial Sequence
  chemically synthesized
tgaggggaagctagaattttgt

SEQ ID NO: 807593 - DNA, 22 bp, Artificial Sequence
  chemically synthesized
tatatccataggtgacaaaatt

SEQ ID NO: 807594 - DNA, 22 bp, Artificial Sequence
  chemically synthesized
caaagtgctgtatatccatagg

SEQ ID NO: 807595 - DNA, 22 bp, Artificial Sequence
  chemically synthesized
gaattttgtcacctatggatat

SEQ ID NO: 807596 - DNA, 22 bp, Artificial Sequence
  chemically synthesized
tacaaagtgctgtatatccata

SEQ ID NO: 807597 - DNA, 22 bp, Artificial Sequence
  chemically synthesized
ctacaaagtgctgtatatccat

SEQ ID NO: 807598 - DNA, 22 bp, Artificial Sequence
  chemically synthesized
tctacaaagtgctgtatatcca

SEQ ID NO: 807599 - DNA, 22 bp, Artificial Sequence
  chemically synthesized
tgtcacctatggatatacagca

SEQ ID NO: 807600 - DNA, 22 bp, Artificial Sequence
  chemically synthesized
gtcacctatggatatacagcac

SEQ ID NO: 807601 - DNA, 22 bp, Artificial Sequence
  chemically synthesized
tcacctatggatatacagcact

SEQ ID NO: 807602 - DNA, 22 bp, Artificial Sequence
  chemically synthesized
tggatatacagcactttgtaga

SEQ ID NO: 807603 - DNA, 22 bp, Artificial Sequence
  chemically synthesized
aaaggaatcctttctacaaagt

SEQ ID NO: 807604 - DNA, 22 bp, Artificial Sequence
  chemically synthesized
gagattaaaaggaatcctttct

SEQ ID NO: 807605 - DNA, 22 bp, Artificial Sequence
  chemically synthesized
ctagagattaaaaggaatcctt

SEQ ID NO: 807606 - DNA, 22 bp, Artificial Sequence
  chemically synthesized
tgtagaaaggattccttttaat

SEQ ID NO: 807607 - DNA, 22 bp, Artificial Sequence
  chemically synthesized
gtagaaaggattccttttaatc

SEQ ID NO: 807608 - DNA, 22 bp, Artificial Sequence
  chemically synthesized
tagaaaggattccttttaatct

SEQ ID NO: 807609 - DNA, 22 bp, Artificial Sequence
  chemically synthesized
atagaattgctagagattaaaa

SEQ ID NO: 807610 - DNA, 22 bp, Artificial Sequence
  chemically synthesized
ctaatagaattgctagagatta

SEQ ID NO: 807611 - DNA, 22 bp, Artificial Sequence
  chemically synthesized
cttttaatctctagcaattcta

SEQ ID NO: 807612 - DNA, 22 bp, Artificial Sequence
  chemically synthesized
gtgcacgttactaatagaattg

SEQ ID NO: 807613 - DNA, 22 bp, Artificial Sequence
  chemically synthesized
ttaatctctagcaattctatta

SEQ ID NO: 807614 - DNA, 22 bp, Artificial Sequence
  chemically synthesized
taatctctagcaattctattag

SEQ ID NO: 807615 - DNA, 22 bp, Artificial Sequence
  chemically synthesized
aatctctagcaattctattagt

SEQ ID NO: 807616 - DNA, 22 bp, Artificial Sequence
  chemically synthesized
atctctagcaattctattagta

SEQ ID NO: 807617 - DNA, 22 bp, Artificial Sequence
  chemically synthesized
attagtgcacgttactaataga

SEQ ID NO: 807618 - DNA, 22 bp, Artificial Sequence
  chemically synthesized
tcattagtgcacgttactaata

SEQ ID NO: 807619 - DNA, 22 bp, Artificial Sequence
  chemically synthesized
ctcattagtgcacgttactaat

SEQ ID NO: 807620 - DNA, 22 bp, Artificial Sequence
  chemically synthesized
tagcaattctattagtaacgtg

SEQ ID NO: 807621 - DNA, 22 bp, Artificial Sequence
  chemically synthesized
cttctcattagtgcacgttact

SEQ ID NO: 807622 - DNA, 22 bp, Artificial Sequence
  chemically synthesized
gcaattctattagtaacgtgca

SEQ ID NO: 807623 - DNA, 22 bp, Artificial Sequence
  chemically synthesized
gcttctcattagtgcacgttac

SEQ ID NO: 807624 - DNA, 22 bp, Artificial Sequence
  chemically synthesized
tgcttctcattagtgcacgtta

SEQ ID NO: 807625 - DNA, 22 bp, Artificial Sequence
  chemically synthesized
ttgcttctcattagtgcacgtt

SEQ ID NO: 807626 - DNA, 22 bp, Artificial Sequence
  chemically synthesized
tattagtaacgtgcactaatga

SEQ ID NO: 807627 - DNA, 22 bp, Artificial Sequence
  chemically synthesized
ttagtaacgtgcactaatgaga

SEQ ID NO: 807628 - DNA, 22 bp, Artificial Sequence
  chemically synthesized
acagcttttgcttctcattagt

SEQ ID NO: 807629 - DNA, 22 bp, Artificial Sequence
  chemically synthesized
gtaacgtgcactaatgagaagc

SEQ ID NO: 807630 - DNA, 22 bp, Artificial Sequence
  chemically synthesized
atccaggcaatgttgacagctt

SEQ ID NO: 807631 - DNA, 22 bp, Artificial Sequence
  chemically synthesized
atgagaagcaaaagctgtcaac

SEQ ID NO: 807632 - DNA, 22 bp, Artificial Sequence
  chemically synthesized
ctaatccaggcaatgttgacag

SEQ ID NO: 807633 - DNA, 22 bp, Artificial Sequence
  chemically synthesized
ggaatggactactaatccaggc

SEQ ID NO: 807634 - DNA, 22 bp, Artificial Sequence
  chemically synthesized
ctaggaatggactactaatcca

SEQ ID NO: 807635 - DNA, 22 bp, Artificial Sequence
  chemically synthesized
tcaacattgcctggattagtag

SEQ ID NO: 807636 - DNA, 22 bp, Artificial Sequence
  chemically synthesized
gctaggaatggactactaatcc

SEQ ID NO: 807637 - DNA, 22 bp, Artificial Sequence
  chemically synthesized
tgctaggaatggactactaatc

SEQ ID NO: 807638 - DNA, 22 bp, Artificial Sequence
  chemically synthesized
gttttgctaggaatggactact

SEQ ID NO: 807639 - DNA, 22 bp, Artificial Sequence
  chemically synthesized
cctggattagtagtccattcct

SEQ ID NO: 807640 - DNA, 22 bp, Artificial Sequence
  chemically synthesized
gattagtagtccattcctagca

SEQ ID NO: 807641 - DNA, 22 bp, Artificial Sequence
  chemically synthesized
gtagtccattcctagcaaaacc

SEQ ID NO: 807642 - DNA, 22 bp, Artificial Sequence
  chemically synthesized
ctagcaaaaccaactctgtggt

SEQ ID NO: 807643 - DNA, 22 bp, Artificial Sequence
  chemically synthesized
gcaaaaccaactctgtggtttt

SEQ ID NO: 807644 - DNA, 22 bp, Artificial Sequence
  chemically synthesized
cccaaaaacagataaaaccaca

SEQ ID NO: 807645 - DNA, 22 bp, Artificial Sequence
  chemically synthesized
ggtagatgttgcccaaaaacag

SEQ ID NO: 807646 - DNA, 22 bp, Artificial Sequence
  chemically synthesized
tgtggttttatctgtttttggg

SEQ ID NO: 807647 - DNA, 22 bp, Artificial Sequence
  chemically synthesized
taggtagatgttgcccaaaaac

SEQ ID NO: 807648 - DNA, 22 bp, Artificial Sequence
  chemically synthesized
tggttttatctgtttttgggca

SEQ ID NO: 807649 - DNA, 22 bp, Artificial Sequence
  chemically synthesized
ctaggtagatgttgcccaaaaa

SEQ ID NO: 807650 - DNA, 22 bp, Artificial Sequence
  chemically synthesized
tatctgtttttgggcaacatct

SEQ ID NO: 807651 - DNA, 22 bp, Artificial Sequence
  chemically synthesized
atctgtttttgggcaacatcta

SEQ ID NO: 807652 - DNA, 22 bp, Artificial Sequence
  chemically synthesized
tctgtttttgggcaacatctac

SEQ ID NO: 807653 - DNA, 22 bp, Artificial Sequence
  chemically synthesized
cagtcatatttctaggtagatg

SEQ ID NO: 807654 - DNA, 22 bp, Artificial Sequence
  chemically synthesized
tttttgggcaacatctacctag

SEQ ID NO: 807655 - DNA, 22 bp, Artificial Sequence
  chemically synthesized
tccagtcatatttctaggtaga

SEQ ID NO: 807656 - DNA, 22 bp, Artificial Sequence
  chemically synthesized
ctccagtcatatttctaggtag

SEQ ID NO: 807657 - DNA, 22 bp, Artificial Sequence
  chemically synthesized
ttgggcaacatctacctagaaa

SEQ ID NO: 807658 - DNA, 22 bp, Artificial Sequence
  chemically synthesized
tgggcaacatctacctagaaat

SEQ ID NO: 807659 - DNA, 22 bp, Artificial Sequence
  chemically synthesized
gggcaacatctacctagaaata

SEQ ID NO: 807660 - DNA, 22 bp, Artificial Sequence
  chemically synthesized
ggcaacatctacctagaaatat

SEQ ID NO: 807661 - DNA, 22 bp, Artificial Sequence
  chemically synthesized
ccaccacccttctccagtcata

SEQ ID NO: 807662 - DNA, 22 bp, Artificial Sequence
  chemically synthesized
cctagaaatatgactggagaag

SEQ ID NO: 807663 - DNA, 22 bp, Artificial Sequence
  chemically synthesized
attgccaccacccttctccagt

SEQ ID NO: 807664 - DNA, 22 bp, Artificial Sequence
  chemically synthesized
tcattgccaccacccttctcca

SEQ ID NO: 807665 - DNA, 22 bp, Artificial Sequence
  chemically synthesized
gaaatatgactggagaagggtg

SEQ ID NO: 807666 - DNA, 22 bp, Artificial Sequence
  chemically synthesized
tctcattgccaccacccttctc

SEQ ID NO: 807667 - DNA, 22 bp, Artificial Sequence
  chemically synthesized
gagaagggtggtggcaatgaga

SEQ ID NO: 807668 - DNA, 22 bp, Artificial Sequence
  chemically synthesized
ataacagaggagaaaagagaaa

SEQ ID NO: 807669 - DNA, 22 bp, Artificial Sequence
  chemically synthesized
cataacagaggagaaaagagaa

SEQ ID NO: 807670 - DNA, 22 bp, Artificial Sequence
  chemically synthesized
cagtttcataacagaggagaaa

SEQ ID NO: 807671 - DNA, 22 bp, Artificial Sequence
  chemically synthesized
acagtttcataacagaggagaa

SEQ ID NO: 807672 - DNA, 22 bp, Artificial Sequence
  chemically synthesized
gccttacagtttcataacagag

SEQ ID NO: 807673 - DNA, 22 bp, Artificial Sequence
  chemically synthesized
ctcttttctcctctgttatgaa

SEQ ID NO: 807674 - DNA, 22 bp, Artificial Sequence
  chemically synthesized
tcttttctcctctgttatgaaa

SEQ ID NO: 807675 - DNA, 22 bp, Artificial Sequence
  chemically synthesized
ctcgccttacagtttcataaca

SEQ ID NO: 807676 - DNA, 22 bp, Artificial Sequence
  chemically synthesized
ttttctcctctgttatgaaact

SEQ ID NO: 807677 - DNA, 22 bp, Artificial Sequence
  chemically synthesized
ttctcctctgttatgaaactgt

SEQ ID NO: 807678 - DNA, 22 bp, Artificial Sequence
  chemically synthesized
tctcctctgttatgaaactgta

SEQ ID NO: 807679 - DNA, 22 bp, Artificial Sequence
  chemically synthesized
ctcctctgttatgaaactgtaa

SEQ ID NO: 807680 - DNA, 22 bp, Artificial Sequence
  chemically synthesized
tcctctgttatgaaactgtaag

SEQ ID NO: 807681 - DNA, 22 bp, Artificial Sequence
  chemically synthesized
ctctgttatgaaactgtaaggc

SEQ ID NO: 807682 - DNA, 22 bp, Artificial Sequence
  chemically synthesized
tgttatgaaactgtaaggcgag

SEQ ID NO: 807683 - DNA, 22 bp, Artificial Sequence
  chemically synthesized
ttatgaaactgtaaggcgagga

SEQ ID NO: 807684 - DNA, 22 bp, Artificial Sequence
  chemically synthesized
tgaaactgtaaggcgaggaata

SEQ ID NO: 807685 - DNA, 22 bp, Artificial Sequence
  chemically synthesized
aaatgatgtcatatattcctcg

SEQ ID NO: 807686 - DNA, 22 bp, Artificial Sequence
  chemically synthesized
aattaaaatgatgtcatatatt

SEQ ID NO: 807687 - DNA, 22 bp, Artificial Sequence
  chemically synthesized
taaggcgaggaatatatgacat

SEQ ID NO: 807688 - DNA, 22 bp, Artificial Sequence
  chemically synthesized
tggatgaaaagcaagcatcaga

SEQ ID NO: 807689 - DNA, 22 bp, Artificial Sequence
  chemically synthesized
taatttaacttctgatgcttgc

SEQ ID NO: 807690 - DNA, 22 bp, Artificial Sequence
  chemically synthesized
aatttaacttctgatgcttgct

SEQ ID NO: 807691 - DNA, 22 bp, Artificial Sequence
  chemically synthesized
atttaacttctgatgcttgctt

SEQ ID NO: 807692 - DNA, 22 bp, Artificial Sequence
  chemically synthesized
atgctgtggatgaaaagcaagc

SEQ ID NO: 807693 - DNA, 22 bp, Artificial Sequence
  chemically synthesized
catgctgtggatgaaaagcaag

SEQ ID NO: 807694 - DNA, 22 bp, Artificial Sequence
  chemically synthesized
aacttctgatgcttgcttttca

SEQ ID NO: 807695 - DNA, 22 bp, Artificial Sequence
  chemically synthesized
acttctgatgcttgcttttcat

SEQ ID NO: 807696 - DNA, 22 bp, Artificial Sequence
  chemically synthesized
ttcatgctgtggatgaaaagca

SEQ ID NO: 807697 - DNA, 22 bp, Artificial Sequence
  chemically synthesized
ctgatgcttgcttttcatccac

SEQ ID NO: 807698 - DNA, 22 bp, Artificial Sequence
  chemically synthesized
tgatgcttgcttttcatccaca

SEQ ID NO: 807699 - DNA, 22 bp, Artificial Sequence
  chemically synthesized
ccattcttcatgctgtggatga

SEQ ID NO: 807700 - DNA, 22 bp, Artificial Sequence
  chemically synthesized
atgcttgcttttcatccacagc

SEQ ID NO: 807701 - DNA, 22 bp, Artificial Sequence
  chemically synthesized
gatctgccattcttcatgctgt

SEQ ID NO: 807702 - DNA, 22 bp, Artificial Sequence
  chemically synthesized
gcttttcatccacagcatgaag

SEQ ID NO: 807703 - DNA, 22 bp, Artificial Sequence
  chemically synthesized
cttttcatccacagcatgaaga

SEQ ID NO: 807704 - DNA, 22 bp, Artificial Sequence
  chemically synthesized
ttcatccacagcatgaagaatg

SEQ ID NO: 807705 - DNA, 22 bp, Artificial Sequence
  chemically synthesized
tcatccacagcatgaagaatgg

SEQ ID NO: 807706 - DNA, 22 bp, Artificial Sequence
  chemically synthesized
catccacagcatgaagaatggc

SEQ ID NO: 807707 - DNA, 22 bp, Artificial Sequence
  chemically synthesized
tacattagatctgccattcttc

SEQ ID NO: 807708 - DNA, 22 bp, Artificial Sequence
  chemically synthesized
atccacagcatgaagaatggca

SEQ ID NO: 807709 - DNA, 22 bp, Artificial Sequence
  chemically synthesized
catgctgtacattagatctgcc

SEQ ID NO: 807710 - DNA, 22 bp, Artificial Sequence
  chemically synthesized
ccatgctgtacattagatctgc

SEQ ID NO: 807711 - DNA, 22 bp, Artificial Sequence
  chemically synthesized
tcttccatgctgtacattagat

SEQ ID NO: 807712 - DNA, 22 bp, Artificial Sequence
  chemically synthesized
aaaattatcttccatgctgtac

SEQ ID NO: 807713 - DNA, 22 bp, Artificial Sequence
  chemically synthesized
aaaaattatcttccatgctgta

SEQ ID NO: 807714 - DNA, 22 bp, Artificial Sequence
  chemically synthesized
taaaaattatcttccatgctgt

SEQ ID NO: 807715 - DNA, 22 bp, Artificial Sequence
  chemically synthesized
gctttaaaaattatcttccatg

SEQ ID NO: 807716 - DNA, 22 bp, Artificial Sequence
  chemically synthesized
atgtacagcatggaagataatt

SEQ ID NO: 807717 - DNA, 22 bp, Artificial Sequence
  chemically synthesized
tgtggatgttagctttaaaaat

SEQ ID NO: 807718 - DNA, 22 bp, Artificial Sequence
  chemically synthesized
ttaaagctaacatccacataac

SEQ ID NO: 807719 - DNA, 22 bp, Artificial Sequence
  chemically synthesized
taaagctaacatccacataact

SEQ ID NO: 807720 - DNA, 22 bp, Artificial Sequence
  chemically synthesized
aaagctaacatccacataactc

SEQ ID NO: 807721 - DNA, 22 bp, Artificial Sequence
  chemically synthesized
aaaacatataaagagttatgtg

SEQ ID NO: 807722 - DNA, 22 bp, Artificial Sequence
  chemically synthesized
aagctaacatccacataactct

SEQ ID NO: 807723 - DNA, 22 bp, Artificial Sequence
  chemically synthesized
gaaaacatataaagagttatgt

SEQ ID NO: 807724 - DNA, 22 bp, Artificial Sequence
  chemically synthesized
acatccacataactctttatat

SEQ ID NO: 807725 - DNA, 22 bp, Artificial Sequence
  chemically synthesized
aatatgtttgaaaacatataaa

SEQ ID NO: 807726 - DNA, 22 bp, Artificial Sequence
  chemically synthesized
tgaatatgtttgaaaacatata

SEQ ID NO: 807727 - DNA, 22 bp, Artificial Sequence
  chemically synthesized
tttatatgttttcaaacatatt

SEQ ID NO: 807728 - DNA, 22 bp, Artificial Sequence
  chemically synthesized
tatatgttttcaaacatattca

SEQ ID NO: 807729 - DNA, 22 bp, Artificial Sequence
  chemically synthesized
atatgttttcaaacatattcag

SEQ ID NO: 807730 - DNA, 22 bp, Artificial Sequence
  chemically synthesized
tatgttttcaaacatattcaga

SEQ ID NO: 807731 - DNA, 22 bp, Artificial Sequence
  chemically synthesized
tcaaacatattcagagttattc

SEQ ID NO: 807732 - DNA, 22 bp, Artificial Sequence
  chemically synthesized
caaacatattcagagttattct

SEQ ID NO: 807733 - DNA, 22 bp, Artificial Sequence
  chemically synthesized
tgaagtgatgatagaataactc

SEQ ID NO: 807734 - DNA, 22 bp, Artificial Sequence
  chemically synthesized
aaacatattcagagttattcta

SEQ ID NO: 807735 - DNA, 22 bp, Artificial Sequence
  chemically synthesized
atgaagtgatgatagaataact

SEQ ID NO: 807736 - DNA, 22 bp, Artificial Sequence
  chemically synthesized
agagttattctatcatcacttc

SEQ ID NO: 807737 - DNA, 22 bp, Artificial Sequence
  chemically synthesized
ttctatcatcacttcataagat

SEQ ID NO: 807738 - DNA, 22 bp, Artificial Sequence
  chemically synthesized
tatcatcacttcataagatatt

SEQ ID NO: 807739 - DNA, 22 bp, Artificial Sequence
  chemically synthesized
tcatcacttcataagatatttt

SEQ ID NO: 807740 - DNA, 22 bp, Artificial Sequence
  chemically synthesized
cataagatattttccatttttc

SEQ ID NO: 807741 - DNA, 22 bp, Artificial Sequence
  chemically synthesized
ataagatattttccatttttct

SEQ ID NO: 807742 - DNA, 22 bp, Artificial Sequence
  chemically synthesized
tccatttttctacctaccttct

SEQ ID NO: 807743 - DNA, 22 bp, Artificial Sequence
  chemically synthesized
ccatttttctacctaccttctt

SEQ ID NO: 807744 - DNA, 22 bp, Artificial Sequence
  chemically synthesized
catttttctacctaccttcttt

SEQ ID NO: 807745 - DNA, 22 bp, Artificial Sequence
  chemically synthesized
agtatacatagaaaaagaaggt

SEQ ID NO: 807746 - DNA, 22 bp, Artificial Sequence
  chemically synthesized
ttctacctaccttctttttcta

SEQ ID NO: 807747 - DNA, 22 bp, Artificial Sequence
  chemically synthesized
tctacctaccttctttttctat

SEQ ID NO: 807748 - DNA, 22 bp, Artificial Sequence
  chemically synthesized
ctacctaccttctttttctatg

SEQ ID NO: 807749 - DNA, 22 bp, Artificial Sequence
  chemically synthesized
tacctaccttctttttctatgt

SEQ ID NO: 807750 - DNA, 22 bp, Artificial Sequence
  chemically synthesized
cctaccttctttttctatgtat

SEQ ID NO: 807751 - DNA, 22 bp, Artificial Sequence
  chemically synthesized
ccttctttttctatgtatactc

SEQ ID NO: 807752 - DNA, 22 bp, Artificial Sequence
  chemically synthesized
ctttttctatgtatactcagct

SEQ ID NO: 807753 - DNA, 22 bp, Artificial Sequence
  chemically synthesized
tttttctatgtatactcagctg

SEQ ID NO: 807754 - DNA, 22 bp, Artificial Sequence
  chemically synthesized
tttctatgtatactcagctgga

SEQ ID NO: 807755 - DNA, 22 bp, Artificial Sequence
  chemically synthesized
ttctatgtatactcagctggat

SEQ ID NO: 807756 - DNA, 22 bp, Artificial Sequence
  chemically synthesized
tctatgtatactcagctggata

SEQ ID NO: 807757 - DNA, 22 bp, Artificial Sequence
  chemically synthesized
ctatgtatactcagctggatat

SEQ ID NO: 807758 - DNA, 22 bp, Artificial Sequence
  chemically synthesized
gcagagaatgaaatatccagct

SEQ ID NO: 807759 - DNA, 22 bp, Artificial Sequence
  chemically synthesized
tatgtatactcagctggatatt

SEQ ID NO: 807760 - DNA, 22 bp, Artificial Sequence
  chemically synthesized
tgtatactcagctggatatttc

SEQ ID NO: 807761 - DNA, 22 bp, Artificial Sequence
  chemically synthesized
agctggatatttcattctctgc

SEQ ID NO: 807762 - DNA, 22 bp, Artificial Sequence
  chemically synthesized
gatatttcattctctgccaatg

SEQ ID NO: 807763 - DNA, 22 bp, Artificial Sequence
  chemically synthesized
tatcgagtgtaaagccattggc

SEQ ID NO: 807764 - DNA, 22 bp, Artificial Sequence
  chemically synthesized
cattctctgccaatggctttac

SEQ ID NO: 807765 - DNA, 22 bp, Artificial Sequence
  chemically synthesized
attctctgccaatggctttaca

SEQ ID NO: 807766 - DNA, 22 bp, Artificial Sequence
  chemically synthesized
tctgccaatggctttacactcg

SEQ ID NO: 807767 - DNA, 22 bp, Artificial Sequence
  chemically synthesized
tgccaatggctttacactcgat

SEQ ID NO: 807768 - DNA, 22 bp, Artificial Sequence
  chemically synthesized
aagataatctgtatcgagtgta

SEQ ID NO: 807769 - DNA, 22 bp, Artificial Sequence
  chemically synthesized
ccaatggctttacactcgatac

SEQ ID NO: 807770 - DNA, 22 bp, Artificial Sequence
  chemically synthesized
agaattaaagataatctgtatc

SEQ ID NO: 807771 - DNA, 22 bp, Artificial Sequence
  chemically synthesized
tacactcgatacagattatctt

SEQ ID NO: 807772 - DNA, 22 bp, Artificial Sequence
  chemically synthesized
acactcgatacagattatcttt

SEQ ID NO: 807773 - DNA, 22 bp, Artificial Sequence
  chemically synthesized
cactcgatacagattatcttta

SEQ ID NO: 807774 - DNA, 22 bp, Artificial Sequence
  chemically synthesized
gatacagattatctttaattct

SEQ ID NO: 807775 - DNA, 22 bp, Artificial Sequence
  chemically synthesized
tctttaattctgaacctcattc

SEQ ID NO: 807776 - DNA, 22 bp, Artificial Sequence
  chemically synthesized
taattctgaacctcattcttat

SEQ ID NO: 807777 - DNA, 22 bp, Artificial Sequence
  chemically synthesized
aattctgaacctcattcttatt

SEQ ID NO: 807778 - DNA, 22 bp, Artificial Sequence
  chemically synthesized
attctgaacctcattcttattt

SEQ ID NO: 807779 - DNA, 22 bp, Artificial Sequence
  chemically synthesized
gtaggcatgtggaaataagaat

SEQ ID NO: 807780 - DNA, 22 bp, Artificial Sequence
  chemically synthesized
tgaacctcattcttatttccac

SEQ ID NO: 807781 - DNA, 22 bp, Artificial Sequence
  chemically synthesized
aacctcattcttatttccacat

SEQ ID NO: 807782 - DNA, 22 bp, Artificial Sequence
  chemically synthesized
gatgttggtaggcatgtggaaa

SEQ ID NO: 807783 - DNA, 22 bp, Artificial Sequence
  chemically synthesized
attcttatttccacatgcctac

SEQ ID NO: 807784 - DNA, 22 bp, Artificial Sequence
  chemically synthesized
aattagatgttggtaggcatgt

SEQ ID NO: 807785 - DNA, 22 bp, Artificial Sequence
  chemically synthesized
ttgaattagatgttggtaggca

SEQ ID NO: 807786 - DNA, 22 bp, Artificial Sequence
  chemically synthesized
ttatttccacatgcctaccaac

SEQ ID NO: 807787 - DNA, 22 bp, Artificial Sequence
  chemically synthesized
atttccacatgcctaccaacat

SEQ ID NO: 807788 - DNA, 22 bp, Artificial Sequence
  chemically synthesized
tttccacatgcctaccaacatc

SEQ ID NO: 807789 - DNA, 22 bp, Artificial Sequence
  chemically synthesized
ccacatgcctaccaacatctaa

SEQ ID NO: 807790 - DNA, 22 bp, Artificial Sequence
  chemically synthesized
cacatgcctaccaacatctaat

SEQ ID NO: 807791 - DNA, 22 bp, Artificial Sequence
  chemically synthesized
ccaacatctaattcaataattc

SEQ ID NO: 807792 - DNA, 22 bp, Artificial Sequence
  chemically synthesized
attcaataattcatccatgcat

SEQ ID NO: 807793 - DNA, 22 bp, Artificial Sequence
  chemically synthesized
aataattcatccatgcatccat

SEQ ID NO: 807794 - DNA, 22 bp, Artificial Sequence
  chemically synthesized
gtacacaataggtacggaatgg

SEQ ID NO: 807795 - DNA, 22 bp, Artificial Sequence
  chemically synthesized
atccatgcatccattccgtacc

SEQ ID NO: 807796 - DNA, 22 bp, Artificial Sequence
  chemically synthesized
cgtacctattgtgtaccaggat

SEQ ID NO: 807797 - DNA, 22 bp, Artificial Sequence
  chemically synthesized
tcaccatcatcaggcacagatc

SEQ ID NO: 807798 - DNA, 22 bp, Artificial Sequence
  chemically synthesized
ttgtgtaccaggatctgtgcct

SEQ ID NO: 807799 - DNA, 22 bp, Artificial Sequence
  chemically synthesized
tgtcaccatcatcaggcacaga

SEQ ID NO: 807800 - DNA, 22 bp, Artificial Sequence
  chemically synthesized
ctgtcaccatcatcaggcacag

SEQ ID NO: 807801 - DNA, 22 bp, Artificial Sequence
  chemically synthesized
tgtaccaggatctgtgcctgat

SEQ ID NO: 807802 - DNA, 22 bp, Artificial Sequence
  chemically synthesized
tctgtcaccatcatcaggcaca

SEQ ID NO: 807803 - DNA, 22 bp, Artificial Sequence
  chemically synthesized
gattttctgtcaccatcatcag

SEQ ID NO: 807804 - DNA, 22 bp, Artificial Sequence
  chemically synthesized
ttggattttctgtcaccatcat

SEQ ID NO: 807805 - DNA, 22 bp, Artificial Sequence
  chemically synthesized
tgcctgatgatggtgacagaaa

SEQ ID NO: 807806 - DNA, 22 bp, Artificial Sequence
  chemically synthesized
atgatggtgacagaaaatccaa

SEQ ID NO: 807807 - DNA, 22 bp, Artificial Sequence
  chemically synthesized
aataccaaagtccatgtattat

SEQ ID NO: 807808 - DNA, 22 bp, Artificial Sequence
  chemically synthesized
aatatgttaaataccaaagtcc

SEQ ID NO: 807809 - DNA, 22 bp, Artificial Sequence
  chemically synthesized
gaatatgttaaataccaaagtc

SEQ ID NO: 807810 - DNA, 22 bp, Artificial Sequence
  chemically synthesized
aacttgaatatgttaaatacca

SEQ ID NO: 807811 - DNA, 22 bp, Artificial Sequence
  chemically synthesized
ttaaacttgaatatgttaaata

SEQ ID NO: 807812 - DNA, 22 bp, Artificial Sequence
  chemically synthesized
tgttaaacttgaatatgttaaa

SEQ ID NO: 807813 - DNA, 22 bp, Artificial Sequence
  chemically synthesized
tggtatttaacatattcaagtt

SEQ ID NO: 807814 - DNA, 22 bp, Artificial Sequence
  chemically synthesized
taccctctgttaaacttgaata

SEQ ID NO: 807815 - DNA, 22 bp, Artificial Sequence
  chemically synthesized
ggtatttaacatattcaagttt

SEQ ID NO: 807816 - DNA, 22 bp, Artificial Sequence
  chemically synthesized
gtatttaacatattcaagttta

SEQ ID NO: 807817 - DNA, 22 bp, Artificial Sequence
  chemically synthesized
tctgtaccctctgttaaacttg

SEQ ID NO: 807818 - DNA, 22 bp, Artificial Sequence
  chemically synthesized
aacatattcaagtttaacagag

SEQ ID NO: 807819 - DNA, 22 bp, Artificial Sequence
  chemically synthesized
cctatctgtaccctctgttaaa

SEQ ID NO: 807820 - DNA, 22 bp, Artificial Sequence
  chemically synthesized
acatattcaagtttaacagagg

SEQ ID NO: 807821 - DNA, 22 bp, Artificial Sequence
  chemically synthesized
acctatctgtaccctctgttaa

SEQ ID NO: 807822 - DNA, 22 bp, Artificial Sequence
  chemically synthesized
aatgtttacctatctgtaccct

SEQ ID NO: 807823 - DNA, 22 bp, Artificial Sequence
  chemically synthesized
aagtttaacagagggtacagat

SEQ ID NO: 807824 - DNA, 22 bp, Artificial Sequence
  chemically synthesized
gttaaatgtttacctatctgta

SEQ ID NO: 807825 - DNA, 22 bp, Artificial Sequence
  chemically synthesized
tagttaaatgtttacctatctg

SEQ ID NO: 807826 - DNA, 22 bp, Artificial Sequence
  chemically synthesized
aacagagggtacagataggtaa

SEQ ID NO: 807827 - DNA, 22 bp, Artificial Sequence
  chemically synthesized
acagagggtacagataggtaaa

SEQ ID NO: 807828 - DNA, 22 bp, Artificial Sequence
  chemically synthesized
taactctagttaaatgtttacc

SEQ ID NO: 807829 - DNA, 22 bp, Artificial Sequence
  chemically synthesized
cattgtaactctagttaaatgt

SEQ ID NO: 807830 - DNA, 22 bp, Artificial Sequence
  chemically synthesized
attacattgtaactctagttaa

SEQ ID NO: 807831 - DNA, 22 bp, Artificial Sequence
  chemically synthesized
aattacattgtaactctagtta

SEQ ID NO: 807832 - DNA, 22 bp, Artificial Sequence
  chemically synthesized
tagccttaattacattgtaact

SEQ ID NO: 807833 - DNA, 22 bp, Artificial Sequence
  chemically synthesized
atagccttaattacattgtaac

SEQ ID NO: 807834 - DNA, 22 bp, Artificial Sequence
  chemically synthesized
aactagagttacaatgtaatta

SEQ ID NO: 807835 - DNA, 22 bp, Artificial Sequence
  chemically synthesized
actagagttacaatgtaattaa

SEQ ID NO: 807836 - DNA, 22 bp, Artificial Sequence
  chemically synthesized
gagttacaatgtaattaaggct

SEQ ID NO: 807837 - DNA, 22 bp, Artificial Sequence
  chemically synthesized
cagatggtttatagccttaatt

SEQ ID NO: 807838 - DNA, 22 bp, Artificial Sequence
  chemically synthesized
caatgtaattaaggctataaac

SEQ ID NO: 807839 - DNA, 22 bp, Artificial Sequence
  chemically synthesized
ggaaggactccagatggtttat

SEQ ID NO: 807840 - DNA, 22 bp, Artificial Sequence
  chemically synthesized
ctgggaaggactccagatggtt

SEQ ID NO: 807841 - DNA, 22 bp, Artificial Sequence
  chemically synthesized
aggctataaaccatctggagtc

SEQ ID NO: 807842 - DNA, 22 bp, Artificial Sequence
  chemically synthesized
agctactgggaaggactccaga

SEQ ID NO: 807843 - DNA, 22 bp, Artificial Sequence
  chemically synthesized
gagctactgggaaggactccag

SEQ ID NO: 807844 - DNA, 22 bp, Artificial Sequence
  chemically synthesized
taaaccatctggagtccttccc

SEQ ID NO: 807845 - DNA, 22 bp, Artificial Sequence
  chemically synthesized
catttgagctactgggaaggac

SEQ ID NO: 807846 - DNA, 22 bp, Artificial Sequence
  chemically synthesized
gagtccttcccagtagctcaaa

SEQ ID NO: 807847 - DNA, 22 bp, Artificial Sequence
  chemically synthesized
atatatgttacatttgagctac

SEQ ID NO: 807848 - DNA, 22 bp, Artificial Sequence
  chemically synthesized
cccagtagctcaaatgtaacat

SEQ ID NO: 807849 - DNA, 22 bp, Artificial Sequence
  chemically synthesized
ccagtagctcaaatgtaacata

SEQ ID NO: 807850 - DNA, 22 bp, Artificial Sequence
  chemically synthesized
tgaaagcagattgatatatgtt

SEQ ID NO: 807851 - DNA, 22 bp, Artificial Sequence
  chemically synthesized
atgaaagcagattgatatatgt

SEQ ID NO: 807852 - DNA, 22 bp, Artificial Sequence
  chemically synthesized
aaatgtaacatatatcaatctg

SEQ ID NO: 807853 - DNA, 22 bp, Artificial Sequence
  chemically synthesized
agatagaagtttatgaaagcag

SEQ ID NO: 807854 - DNA, 22 bp, Artificial Sequence
  chemically synthesized
gcaaattgagatagaagtttat

SEQ ID NO: 807855 - DNA, 22 bp, Artificial Sequence
  chemically synthesized
ggcaaattgagatagaagttta

SEQ ID NO: 807856 - DNA, 22 bp, Artificial Sequence
  chemically synthesized
tttggcaaattgagatagaagt

SEQ ID NO: 807857 - DNA, 22 bp, Artificial Sequence
  chemically synthesized
gtttggcaaattgagatagaag

SEQ ID NO: 807858 - DNA, 22 bp, Artificial Sequence
  chemically synthesized
ctttcataaacttctatctcaa

SEQ ID NO: 807859 - DNA, 22 bp, Artificial Sequence
  chemically synthesized
tcataaacttctatctcaattt

SEQ ID NO: 807860 - DNA, 22 bp, Artificial Sequence
  chemically synthesized
cataaacttctatctcaatttg

SEQ ID NO: 807861 - DNA, 22 bp, Artificial Sequence
  chemically synthesized
tcacttgtttggcaaattgaga

SEQ ID NO: 807862 - DNA, 22 bp, Artificial Sequence
  chemically synthesized
ataaacttctatctcaatttgc

SEQ ID NO: 807863 - DNA, 22 bp, Artificial Sequence
  chemically synthesized
atcacttgtttggcaaattgag

SEQ ID NO: 807864 - DNA, 22 bp, Artificial Sequence
  chemically synthesized
ctatctcaatttgccaaacaag

SEQ ID NO: 807865 - DNA, 22 bp, Artificial Sequence
  chemically synthesized
tatctcaatttgccaaacaagt

SEQ ID NO: 807866 - DNA, 22 bp, Artificial Sequence
  chemically synthesized
agatacatttatcacttgtttg

SEQ ID NO: 807867 - DNA, 22 bp, Artificial Sequence
  chemically synthesized
tctcaatttgccaaacaagtga

SEQ ID NO: 807868 - DNA, 22 bp, Artificial Sequence
  chemically synthesized
aagatacatttatcacttgttt

SEQ ID NO: 807869 - DNA, 22 bp, Artificial Sequence
  chemically synthesized
aatttgccaaacaagtgataaa

SEQ ID NO: 807870 - DNA, 22 bp, Artificial Sequence
  chemically synthesized
gccaaacaagtgataaatgtat

SEQ ID NO: 807871 - DNA, 22 bp, Artificial Sequence
  chemically synthesized
ccaaacaagtgataaatgtatc

SEQ ID NO: 807872 - DNA, 22 bp, Artificial Sequence
  chemically synthesized
atggaaagagtaaaacatgttt

SEQ ID NO: 807873 - DNA, 22 bp, Artificial Sequence
  chemically synthesized
gatggaaagagtaaaacatgtt

SEQ ID NO: 807874 - DNA, 22 bp, Artificial Sequence
  chemically synthesized
tgatggaaagagtaaaacatgt

SEQ ID NO: 807875 - DNA, 22 bp, Artificial Sequence
  chemically synthesized
ttgatggaaagagtaaaacatg

SEQ ID NO: 807876 - DNA, 22 bp, Artificial Sequence
  chemically synthesized
ttttgatggaaagagtaaaaca

SEQ ID NO: 807877 - DNA, 22 bp, Artificial Sequence
  chemically synthesized
cacctcttttgatggaaagagt

SEQ ID NO: 807878 - DNA, 22 bp, Artificial Sequence
  chemically synthesized
aaacatgttttactctttccat

SEQ ID NO: 807879 - DNA, 22 bp, Artificial Sequence
  chemically synthesized
aacatgttttactctttccatc

SEQ ID NO: 807880 - DNA, 22 bp, Artificial Sequence
  chemically synthesized
gatgatctccacctcttttgat

SEQ ID NO: 807881 - DNA, 22 bp, Artificial Sequence
  chemically synthesized
tactctttccatcaaaagaggt

SEQ ID NO: 807882 - DNA, 22 bp, Artificial Sequence
  chemically synthesized
actctttccatcaaaagaggtg

SEQ ID NO: 807883 - DNA, 22 bp, Artificial Sequence
  chemically synthesized
ctggatgatctccacctctttt

SEQ ID NO: 807884 - DNA, 22 bp, Artificial Sequence
  chemically synthesized
ctctttccatcaaaagaggtgg

SEQ ID NO: 807885 - DNA, 22 bp, Artificial Sequence
  chemically synthesized
gctggatgatctccacctcttt

SEQ ID NO: 807886 - DNA, 22 bp, Artificial Sequence
  chemically synthesized
tttccatcaaaagaggtggaga

SEQ ID NO: 807887 - DNA, 22 bp, Artificial Sequence
  chemically synthesized
tccatcaaaagaggtggagatc

SEQ ID NO: 807888 - DNA, 22 bp, Artificial Sequence
  chemically synthesized
ccatcaaaagaggtggagatca

SEQ ID NO: 807889 - DNA, 22 bp, Artificial Sequence
  chemically synthesized
catcaaaagaggtggagatcat

SEQ ID NO: 807890 - DNA, 22 bp, Artificial Sequence
  chemically synthesized
agataaagccttgctggatgat

SEQ ID NO: 807891 - DNA, 22 bp, Artificial Sequence
  chemically synthesized
gagataaagccttgctggatga

SEQ ID NO: 807892 - DNA, 22 bp, Artificial Sequence
  chemically synthesized
tgagataaagccttgctggatg

SEQ ID NO: 807893 - DNA, 22 bp, Artificial Sequence
  chemically synthesized
ttttgagataaagccttgctgg

SEQ ID NO: 807894 - DNA, 22 bp, Artificial Sequence
  chemically synthesized
tattttgagataaagccttgct

SEQ ID NO: 807895 - DNA, 22 bp, Artificial Sequence
  chemically synthesized
agcatccatcactctattttga

SEQ ID NO: 807896 - DNA, 22 bp, Artificial Sequence
  chemically synthesized
ttaagcatccatcactctattt

SEQ ID NO: 807897 - DNA, 22 bp, Artificial Sequence
  chemically synthesized
gttaagcatccatcactctatt

SEQ ID NO: 807898 - DNA, 22 bp, Artificial Sequence
  chemically synthesized
tgttaagcatccatcactctat

SEQ ID NO: 807899 - DNA, 22 bp, Artificial Sequence
  chemically synthesized
ttgttaagcatccatcactcta

SEQ ID NO: 807900 - DNA, 22 bp, Artificial Sequence
  chemically synthesized
tatctcaaaatagagtgatgga

SEQ ID NO: 807901 - DNA, 22 bp, Artificial Sequence
  chemically synthesized
atctcaaaatagagtgatggat

SEQ ID NO: 807902 - DNA, 22 bp, Artificial Sequence
  chemically synthesized
tctcaaaatagagtgatggatg

SEQ ID NO: 807903 - DNA, 22 bp, Artificial Sequence
  chemically synthesized
aaaatagagtgatggatgctta

SEQ ID NO: 807904 - DNA, 22 bp, Artificial Sequence
  chemically synthesized
ggcaaacttttgttaagcatcc

SEQ ID NO: 807905 - DNA, 22 bp, Artificial Sequence
  chemically synthesized
gttaggcaaacttttgttaagc

SEQ ID NO: 807906 - DNA, 22 bp, Artificial Sequence
  chemically synthesized
tgaaaattagttaggcaaactt

SEQ ID NO: 807907 - DNA, 22 bp, Artificial Sequence
  chemically synthesized
atgaaaattagttaggcaaact

SEQ ID NO: 807908 - DNA, 22 bp, Artificial Sequence
  chemically synthesized
tatgaaaattagttaggcaaac

SEQ ID NO: 807909 - DNA, 22 bp, Artificial Sequence
  chemically synthesized
ttatgaaaattagttaggcaaa

SEQ ID NO: 807910 - DNA, 22 bp, Artificial Sequence
  chemically synthesized
tttttatgaaaattagttaggc

SEQ ID NO: 807911 - DNA, 22 bp, Artificial Sequence
  chemically synthesized
aacaaaagtttgcctaactaat

SEQ ID NO: 807912 - DNA, 22 bp, Artificial Sequence
  chemically synthesized
atttttatgaaaattagttagg

SEQ ID NO: 807913 - DNA, 22 bp, Artificial Sequence
  chemically synthesized
acaaaagtttgcctaactaatt

SEQ ID NO: 807914 - DNA, 22 bp, Artificial Sequence
  chemically synthesized
tatttttatgaaaattagttag

SEQ ID NO: 807915 - DNA, 22 bp, Artificial Sequence
  chemically synthesized
ttatttttatgaaaattagtta

SEQ ID NO: 807916 - DNA, 22 bp, Artificial Sequence
  chemically synthesized
tttatttttatgaaaattagtt

SEQ ID NO: 807917 - DNA, 22 bp, Artificial Sequence
  chemically synthesized
gcctaactaattttcataaaaa

SEQ ID NO: 807918 - DNA, 22 bp, Artificial Sequence
  chemically synthesized
aaaggttttttatttttatgaa

SEQ ID NO: 807919 - DNA, 22 bp, Artificial Sequence
  chemically synthesized
cctaactaattttcataaaaat

SEQ ID NO: 807920 - DNA, 22 bp, Artificial Sequence
  chemically synthesized
actaattttcataaaaataaaa

SEQ ID NO: 807921 - DNA, 22 bp, Artificial Sequence
  chemically synthesized
tatatctaaaaggttttttatt

SEQ ID NO: 807922 - DNA, 22 bp, Artificial Sequence
  chemically synthesized
attttcataaaaataaaaaacc

SEQ ID NO: 807923 - DNA, 22 bp, Artificial Sequence
  chemically synthesized
tcataaaaataaaaaacctttt

SEQ ID NO: 807924 - DNA, 22 bp, Artificial Sequence
  chemically synthesized
tactgtatatctaaaaggtttt

SEQ ID NO: 807925 - DNA, 22 bp, Artificial Sequence
  chemically synthesized
cataaaaataaaaaacctttta

SEQ ID NO: 807926 - DNA, 22 bp, Artificial Sequence
  chemically synthesized
ataaaaataaaaaaccttttag

SEQ ID NO: 807927 - DNA, 22 bp, Artificial Sequence
  chemically synthesized
ttagatatacagtacaggcttt

SEQ ID NO: 807928 - DNA, 22 bp, Artificial Sequence
  chemically synthesized
tagatatacagtacaggctttt

SEQ ID NO: 807929 - DNA, 22 bp, Artificial Sequence
  chemically synthesized
agatatacagtacaggcttttg

SEQ ID NO: 807930 - DNA, 22 bp, Artificial Sequence
  chemically synthesized
aaatgaaaccagcaaaagcctg

SEQ ID NO: 807931 - DNA, 22 bp, Artificial Sequence
  chemically synthesized
gatatacagtacaggcttttgc

SEQ ID NO: 807932 - DNA, 22 bp, Artificial Sequence
  chemically synthesized
cagccctaaaatgaaaccagca

SEQ ID NO: 807933 - DNA, 22 bp, Artificial Sequence
  chemically synthesized
tccagccctaaaatgaaaccag

SEQ ID NO: 807934 - DNA, 22 bp, Artificial Sequence
  chemically synthesized
ttgctggtttcattttagggct

SEQ ID NO: 807935 - DNA, 22 bp, Artificial Sequence
  chemically synthesized
tgctggtttcattttagggctg

SEQ ID NO: 807936 - DNA, 22 bp, Artificial Sequence
  chemically synthesized
gctggtttcattttagggctgg

SEQ ID NO: 807937 - DNA, 22 bp, Artificial Sequence
  chemically synthesized
ctggtttcattttagggctgga

SEQ ID NO: 807938 - DNA, 22 bp, Artificial Sequence
  chemically synthesized
agaatcaatctctccagcccta

SEQ ID NO: 807939 - DNA, 22 bp, Artificial Sequence
  chemically synthesized
tcagaatcaatctctccagccc

SEQ ID NO: 807940 - DNA, 22 bp, Artificial Sequence
  chemically synthesized
gtttcattttagggctggagag

SEQ ID NO: 807941 - DNA, 22 bp, Artificial Sequence
  chemically synthesized
tctcagaatcaatctctccagc

SEQ ID NO: 807942 - DNA, 22 bp, Artificial Sequence
  chemically synthesized
cattttagggctggagagattg

SEQ ID NO: 807943 - DNA, 22 bp, Artificial Sequence
  chemically synthesized
attttagggctggagagattga

SEQ ID NO: 807944 - DNA, 22 bp, Artificial Sequence
  chemically synthesized
caattctctcagaatcaatctc

SEQ ID NO: 807945 - DNA, 22 bp, Artificial Sequence
  chemically synthesized
tagggctggagagattgattct

SEQ ID NO: 807946 - DNA, 22 bp, Artificial Sequence
  chemically synthesized
agggctggagagattgattctg

SEQ ID NO: 807947 - DNA, 22 bp, Artificial Sequence
  chemically synthesized
gggctggagagattgattctga

SEQ ID NO: 807948 - DNA, 22 bp, Artificial Sequence
  chemically synthesized
gagagattgattctgagagaat

SEQ ID NO: 807949 - DNA, 22 bp, Artificial Sequence
  chemically synthesized
ggaacatcattacaattctctc

SEQ ID NO: 807950 - DNA, 22 bp, Artificial Sequence
  chemically synthesized
gggaacatcattacaattctct

SEQ ID NO: 807951 - DNA, 22 bp, Artificial Sequence
  chemically synthesized
attctgagagaattgtaatgat

SEQ ID NO: 807952 - DNA, 22 bp, Artificial Sequence
  chemically synthesized
tgagagaattgtaatgatgttc

SEQ ID NO: 807953 - DNA, 22 bp, Artificial Sequence
  chemically synthesized
tatacaaccttgggaacatcat

SEQ ID NO: 807954 - DNA, 22 bp, Artificial Sequence
  chemically synthesized
agagaattgtaatgatgttccc

SEQ ID NO: 807955 - DNA, 22 bp, Artificial Sequence
  chemically synthesized
gtatacaaccttgggaacatca

SEQ ID NO: 807956 - DNA, 22 bp, Artificial Sequence
  chemically synthesized
acttgtatacaaccttgggaac

SEQ ID NO: 807957 - DNA, 22 bp, Artificial Sequence
  chemically synthesized
aacttgtatacaaccttgggaa

SEQ ID NO: 807958 - DNA, 22 bp, Artificial Sequence
  chemically synthesized
taatgatgttcccaaggttgta

SEQ ID NO: 807959 - DNA, 22 bp, Artificial Sequence
  chemically synthesized
ccacttaacttgtatacaacct

SEQ ID NO: 807960 - DNA, 22 bp, Artificial Sequence
  chemically synthesized
tgccacttaacttgtatacaac

SEQ ID NO: 807961 - DNA, 22 bp, Artificial Sequence
  chemically synthesized
ccaaggttgtatacaagttaag

SEQ ID NO: 807962 - DNA, 22 bp, Artificial Sequence
  chemically synthesized
tacccccagctctgccacttaa

SEQ ID NO: 807963 - DNA, 22 bp, Artificial Sequence
  chemically synthesized
tatacaagttaagtggcagagc

SEQ ID NO: 807964 - DNA, 22 bp, Artificial Sequence
  chemically synthesized
ggctatacccccagctctgcca

SEQ ID NO: 807965 - DNA, 22 bp, Artificial Sequence
  chemically synthesized
gggctatacccccagctctgcc

SEQ ID NO: 807966 - DNA, 22 bp, Artificial Sequence
  chemically synthesized
agtggcagagctgggggtatag

SEQ ID NO: 807967 - DNA, 22 bp, Artificial Sequence
  chemically synthesized
gaatgcaagacttgggctatac

SEQ ID NO: 807968 - DNA, 22 bp, Artificial Sequence
  chemically synthesized
tagaatgcaagacttgggctat

SEQ ID NO: 807969 - DNA, 22 bp, Artificial Sequence
  chemically synthesized
ctagaatgcaagacttgggcta

SEQ ID NO: 807970 - DNA, 22 bp, Artificial Sequence
  chemically synthesized
tctagaatgcaagacttgggct

SEQ ID NO: 807971 - DNA, 22 bp, Artificial Sequence
  chemically synthesized
ttctagaatgcaagacttgggc

SEQ ID NO: 807972 - DNA, 22 bp, Artificial Sequence
  chemically synthesized
ttttctagaatgcaagacttgg

SEQ ID NO: 807973 - DNA, 22 bp, Artificial Sequence
  chemically synthesized
cttttctagaatgcaagacttg

SEQ ID NO: 807974 - DNA, 22 bp, Artificial Sequence
  chemically synthesized
ggggtatagcccaagtcttgca

SEQ ID NO: 807975 - DNA, 22 bp, Artificial Sequence
  chemically synthesized
caaaaacttcttttctagaatg

SEQ ID NO: 807976 - DNA, 22 bp, Artificial Sequence
  chemically synthesized
agagttacaaaaacttcttttc

SEQ ID NO: 807977 - DNA, 22 bp, Artificial Sequence
  chemically synthesized
cagagttacaaaaacttctttt

SEQ ID NO: 807978 - DNA, 22 bp, Artificial Sequence
  chemically synthesized
gcattctagaaaagaagttttt

SEQ ID NO: 807979 - DNA, 22 bp, Artificial Sequence
  chemically synthesized
cattctagaaaagaagtttttg

SEQ ID NO: 807980 - DNA, 22 bp, Artificial Sequence
  chemically synthesized
tcttcagagttacaaaaacttc

SEQ ID NO: 807981 - DNA, 22 bp, Artificial Sequence
  chemically synthesized
tagaaaagaagtttttgtaact

SEQ ID NO: 807982 - DNA, 22 bp, Artificial Sequence
  chemically synthesized
gaaaagaagtttttgtaactct

SEQ ID NO: 807983 - DNA, 22 bp, Artificial Sequence
  chemically synthesized
caatatctgtcttcagagttac

SEQ ID NO: 807984 - DNA, 22 bp, Artificial Sequence
  chemically synthesized
ttgtaactctgaagacagatat

SEQ ID NO: 807985 - DNA, 22 bp, Artificial Sequence
  chemically synthesized
tgtaactctgaagacagatatt

SEQ ID NO: 807986 - DNA, 22 bp, Artificial Sequence
  chemically synthesized
gtaactctgaagacagatattg

SEQ ID NO: 807987 - DNA, 22 bp, Artificial Sequence
  chemically synthesized
taactctgaagacagatattgg

SEQ ID NO: 807988 - DNA, 22 bp, Artificial Sequence
  chemically synthesized
tgaagacagatattggaataca

SEQ ID NO: 807989 - DNA, 22 bp, Artificial Sequence
  chemically synthesized
aagacagatattggaatacact

SEQ ID NO: 807990 - DNA, 22 bp, Artificial Sequence
  chemically synthesized
gtacaatgaatatatcagagag

SEQ ID NO: 807991 - DNA, 22 bp, Artificial Sequence
  chemically synthesized
agtacaatgaatatatcagaga

SEQ ID NO: 807992 - DNA, 22 bp, Artificial Sequence
  chemically synthesized
gaatacactcctctctgatata

SEQ ID NO: 807993 - DNA, 22 bp, Artificial Sequence
  chemically synthesized
tagtacaatgaatatatcagag

SEQ ID NO: 807994 - DNA, 22 bp, Artificial Sequence
  chemically synthesized
ttagtacaatgaatatatcaga

SEQ ID NO: 807995 - DNA, 22 bp, Artificial Sequence
  chemically synthesized
ttttagtacaatgaatatatca

SEQ ID NO: 807996 - DNA, 22 bp, Artificial Sequence
  chemically synthesized
cttttagtacaatgaatatatc

SEQ ID NO: 807997 - DNA, 22 bp, Artificial Sequence
  chemically synthesized
tcttttagtacaatgaatatat

SEQ ID NO: 807998 - DNA, 22 bp, Artificial Sequence
  chemically synthesized
tttcttttagtacaatgaatat

SEQ ID NO: 807999 - DNA, 22 bp, Artificial Sequence
  chemically synthesized
ctttcttttagtacaatgaata

SEQ ID NO: 808000 - DNA, 22 bp, Artificial Sequence
  chemically synthesized
tctttcttttagtacaatgaat

SEQ ID NO: 808001 - DNA, 22 bp, Artificial Sequence
  chemically synthesized
ctctctgatatattcattgtac

SEQ ID NO: 808002 - DNA, 22 bp, Artificial Sequence
  chemically synthesized
tctgatatattcattgtactaa

SEQ ID NO: 808003 - DNA, 22 bp, Artificial Sequence
  chemically synthesized
tgatatattcattgtactaaaa

SEQ ID NO: 808004 - DNA, 22 bp, Artificial Sequence
  chemically synthesized
tgcctttctttcttttagtaca

SEQ ID NO: 808005 - DNA, 22 bp, Artificial Sequence
  chemically synthesized
gtgcctttctttcttttagtac

SEQ ID NO: 808006 - DNA, 22 bp, Artificial Sequence
  chemically synthesized
atatattcattgtactaaaaga

SEQ ID NO: 808007 - DNA, 22 bp, Artificial Sequence
  chemically synthesized
cttgtgcctttctttcttttag

SEQ ID NO: 808008 - DNA, 22 bp, Artificial Sequence
  chemically synthesized
ccttgtgcctttctttctttta

SEQ ID NO: 808009 - DNA, 22 bp, Artificial Sequence
  chemically synthesized
attgtactaaaagaaagaaagg

SEQ ID NO: 808010 - DNA, 22 bp, Artificial Sequence
  chemically synthesized
tactaaaagaaagaaaggcaca

SEQ ID NO: 808011 - DNA, 22 bp, Artificial Sequence
  chemically synthesized
aaagaaagaaaggcacaaggaa

SEQ ID NO: 808012 - DNA, 22 bp, Artificial Sequence
  chemically synthesized
agtgacataatcttccttgtgc

SEQ ID NO: 808013 - DNA, 22 bp, Artificial Sequence
  chemically synthesized
aaatgaagaccaggattcagtg

SEQ ID NO: 808014 - DNA, 22 bp, Artificial Sequence
  chemically synthesized
taaaatgaagaccaggattcag

SEQ ID NO: 808015 - DNA, 22 bp, Artificial Sequence
  chemically synthesized
tgctctaaaatgaagaccagga

SEQ ID NO: 808016 - DNA, 22 bp, Artificial Sequence
  chemically synthesized
gtgctctaaaatgaagaccagg

SEQ ID NO: 808017 - DNA, 22 bp, Artificial Sequence
  chemically synthesized
tgtcactgaatcctggtcttca

SEQ ID NO: 808018 - DNA, 22 bp, Artificial Sequence
  chemically synthesized
aatttgtgctctaaaatgaaga

SEQ ID NO: 808019 - DNA, 22 bp, Artificial Sequence
  chemically synthesized
aatcctggtcttcattttagag

SEQ ID NO: 808020 - DNA, 22 bp, Artificial Sequence
  chemically synthesized
gtcttcattttagagcacaaat

SEQ ID NO: 808021 - DNA, 22 bp, Artificial Sequence
  chemically synthesized
cattttagagcacaaatttaat

SEQ ID NO: 808022 - DNA, 22 bp, Artificial Sequence
  chemically synthesized
attttagagcacaaatttaatt

SEQ ID NO: 808023 - DNA, 22 bp, Artificial Sequence
  chemically synthesized
tagagcacaaatttaattttct

SEQ ID NO: 808024 - DNA, 22 bp, Artificial Sequence
  chemically synthesized
agagcacaaatttaattttctg

SEQ ID NO: 808025 - DNA, 22 bp, Artificial Sequence
  chemically synthesized
gagcacaaatttaattttctgt

SEQ ID NO: 808026 - DNA, 22 bp, Artificial Sequence
  chemically synthesized
catatggcaataacagaaaatt

SEQ ID NO: 808027 - DNA, 22 bp, Artificial Sequence
  chemically synthesized
aacgaccctgcatatggcaata

SEQ ID NO: 808028 - DNA, 22 bp, Artificial Sequence
  chemically synthesized
caacgaccctgcatatggcaat

SEQ ID NO: 808029 - DNA, 22 bp, Artificial Sequence
  chemically synthesized
aattttctgttattgccatatg

SEQ ID NO: 808030 - DNA, 22 bp, Artificial Sequence
  chemically synthesized
attttctgttattgccatatgc

SEQ ID NO: 808031 - DNA, 22 bp, Artificial Sequence
  chemically synthesized
tctgttattgccatatgcaggg

SEQ ID NO: 808032 - DNA, 22 bp, Artificial Sequence
  chemically synthesized
ctgttattgccatatgcagggt

SEQ ID NO: 808033 - DNA, 22 bp, Artificial Sequence
  chemically synthesized
tatgtttcaacgaccctgcata

SEQ ID NO: 808034 - DNA, 22 bp, Artificial Sequence
  chemically synthesized
tgttattgccatatgcagggtc

SEQ ID NO: 808035 - DNA, 22 bp, Artificial Sequence
  chemically synthesized
gtatgtttcaacgaccctgcat

SEQ ID NO: 808036 - DNA, 22 bp, Artificial Sequence
  chemically synthesized
ttattgccatatgcagggtcgt

SEQ ID NO: 808037 - DNA, 22 bp, Artificial Sequence
  chemically synthesized
ttgccatatgcagggtcgttga

SEQ ID NO: 808038 - DNA, 22 bp, Artificial Sequence
  chemically synthesized
ccatatgcagggtcgttgaaac

SEQ ID NO: 808039 - DNA, 22 bp, Artificial Sequence
  chemically synthesized
tgtgtaggtatttgtatgtttc

SEQ ID NO: 808040 - DNA, 22 bp, Artificial Sequence
  chemically synthesized
atgtgtaggtatttgtatgttt

SEQ ID NO: 808041 - DNA, 22 bp, Artificial Sequence
  chemically synthesized
ccttatgtgtaggtatttgtat

SEQ ID NO: 808042 - DNA, 22 bp, Artificial Sequence
  chemically synthesized
aaacatacaaatacctacacat

SEQ ID NO: 808043 - DNA, 22 bp, Artificial Sequence
  chemically synthesized
tatgtatgtgttcccttatgtg

SEQ ID NO: 808044 - DNA, 22 bp, Artificial Sequence
  chemically synthesized
gtatgtatgtgttcccttatgt

SEQ ID NO: 808045 - DNA, 22 bp, Artificial Sequence
  chemically synthesized
tgtatgtatgtgttcccttatg

SEQ ID NO: 808046 - DNA, 22 bp, Artificial Sequence
  chemically synthesized
cacataagggaacacatacata

SEQ ID NO: 808047 - DNA, 22 bp, Artificial Sequence
  chemically synthesized
ggtaggagaatatctttgtatg

SEQ ID NO: 808048 - DNA, 22 bp, Artificial Sequence
  chemically synthesized
gggtaggagaatatctttgtat

SEQ ID NO: 808049 - DNA, 22 bp, Artificial Sequence
  chemically synthesized
caatagtttgggtaggagaata

SEQ ID NO: 808050 - DNA, 22 bp, Artificial Sequence
  chemically synthesized
tgcaatagtttgggtaggagaa

SEQ ID NO: 808051 - DNA, 22 bp, Artificial Sequence
  chemically synthesized
ctgcaatagtttgggtaggaga

SEQ ID NO: 808052 - DNA, 22 bp, Artificial Sequence
  chemically synthesized
tctgcaatagtttgggtaggag

SEQ ID NO: 808053 - DNA, 22 bp, Artificial Sequence
  chemically synthesized
ttctgcaatagtttgggtagga

SEQ ID NO: 808054 - DNA, 22 bp, Artificial Sequence
  chemically synthesized
tcctacccaaactattgcagaa

SEQ ID NO: 808055 - DNA, 22 bp, Artificial Sequence
  chemically synthesized
ctacccaaactattgcagaaaa

SEQ ID NO: 808056 - DNA, 22 bp, Artificial Sequence
  chemically synthesized
cccaaactattgcagaaaagat

SEQ ID NO: 808057 - DNA, 22 bp, Artificial Sequence
  chemically synthesized
aagcaaagagcagccagatctt

SEQ ID NO: 808058 - DNA, 22 bp, Artificial Sequence
  chemically synthesized
aaagcaaagagcagccagatct

SEQ ID NO: 808059 - DNA, 22 bp, Artificial Sequence
  chemically synthesized
taaagcaaagagcagccagatc

SEQ ID NO: 808060 - DNA, 22 bp, Artificial Sequence
  chemically synthesized
ttgcagaaaagatctggctgct

SEQ ID NO: 808061 - DNA, 22 bp, Artificial Sequence
  chemically synthesized
ttttaaagcaaagagcagccag

SEQ ID NO: 808062 - DNA, 22 bp, Artificial Sequence
  chemically synthesized
attttaaagcaaagagcagcca

SEQ ID NO: 808063 - DNA, 22 bp, Artificial Sequence
  chemically synthesized
cagaaaagatctggctgctctt

SEQ ID NO: 808064 - DNA, 22 bp, Artificial Sequence
  chemically synthesized
tattttaaagcaaagagcagcc

SEQ ID NO: 808065 - DNA, 22 bp, Artificial Sequence
  chemically synthesized
ttattttaaagcaaagagcagc

SEQ ID NO: 808066 - DNA, 22 bp, Artificial Sequence
  chemically synthesized
aaaatggatttttattttaaag

SEQ ID NO: 808067 - DNA, 22 bp, Artificial Sequence
  chemically synthesized
gctgctctttgctttaaaataa

SEQ ID NO: 808068 - DNA, 22 bp, Artificial Sequence
  chemically synthesized
ctctttgctttaaaataaaaat

SEQ ID NO: 808069 - DNA, 22 bp, Artificial Sequence
  chemically synthesized
cattaaaaatggatttttattt

SEQ ID NO: 808070 - DNA, 22 bp, Artificial Sequence
  chemically synthesized
gcattaaaaatggatttttatt

SEQ ID NO: 808071 - DNA, 22 bp, Artificial Sequence
  chemically synthesized
tttgctttaaaataaaaatcca

SEQ ID NO: 808072 - DNA, 22 bp, Artificial Sequence
  chemically synthesized
tgctttaaaataaaaatccatt

SEQ ID NO: 808073 - DNA, 22 bp, Artificial Sequence
  chemically synthesized
gctttaaaataaaaatccattt

SEQ ID NO: 808074 - DNA, 22 bp, Artificial Sequence
  chemically synthesized
ctttaaaataaaaatccatttt

SEQ ID NO: 808075 - DNA, 22 bp, Artificial Sequence
  chemically synthesized
taaaataaaaatccatttttaa

SEQ ID NO: 808076 - DNA, 22 bp, Artificial Sequence
  chemically synthesized
aaaataaaaatccatttttaat

SEQ ID NO: 808077 - DNA, 22 bp, Artificial Sequence
  chemically synthesized
aaataaaaatccatttttaatg

SEQ ID NO: 808078 - DNA, 22 bp, Artificial Sequence
  chemically synthesized
gtgaacggcaaaccagcaaatt

SEQ ID NO: 808079 - DNA, 22 bp, Artificial Sequence
  chemically synthesized
ttaatgcaaatttgctggtttg

SEQ ID NO: 808080 - DNA, 22 bp, Artificial Sequence
  chemically synthesized
taatgcaaatttgctggtttgc

SEQ ID NO: 808081 - DNA, 22 bp, Artificial Sequence
  chemically synthesized
aatgcaaatttgctggtttgcc

SEQ ID NO: 808082 - DNA, 22 bp, Artificial Sequence
  chemically synthesized
atgcaaatttgctggtttgccg

SEQ ID NO: 808083 - DNA, 22 bp, Artificial Sequence
  chemically synthesized
atatgttggtgaacggcaaacc

SEQ ID NO: 808084 - DNA, 22 bp, Artificial Sequence
  chemically synthesized
attcatatgttggtgaacggca

SEQ ID NO: 808085 - DNA, 22 bp, Artificial Sequence
  chemically synthesized
gttaattcatatgttggtgaac

SEQ ID NO: 808086 - DNA, 22 bp, Artificial Sequence
  chemically synthesized
gctggtttgccgttcaccaaca

SEQ ID NO: 808087 - DNA, 22 bp, Artificial Sequence
  chemically synthesized
ctggtttgccgttcaccaacat

SEQ ID NO: 808088 - DNA, 22 bp, Artificial Sequence
  chemically synthesized
gtttgccgttcaccaacatatg

SEQ ID NO: 808089 - DNA, 22 bp, Artificial Sequence
  chemically synthesized
gccgttcaccaacatatgaatt

SEQ ID NO: 808090 - DNA, 22 bp, Artificial Sequence
  chemically synthesized
ccgttcaccaacatatgaatta

SEQ ID NO: 808091 - DNA, 22 bp, Artificial Sequence
  chemically synthesized
accaacatatgaattaacgagg

SEQ ID NO: 808092 - DNA, 22 bp, Artificial Sequence
  chemically synthesized
aagagagaggggatgaaaacct

SEQ ID NO: 808093 - DNA, 22 bp, Artificial Sequence
  chemically synthesized
acgaggttttcatcccctctct

SEQ ID NO: 808094 - DNA, 22 bp, Artificial Sequence
  chemically synthesized
gtaccagacctcaagagagagg

SEQ ID NO: 808095 - DNA, 22 bp, Artificial Sequence
  chemically synthesized
agtaccagacctcaagagagag

SEQ ID NO: 808096 - DNA, 22 bp, Artificial Sequence
  chemically synthesized
tcatcccctctctcttgaggtc

SEQ ID NO: 808097 - DNA, 22 bp, Artificial Sequence
  chemically synthesized
catcccctctctcttgaggtct

SEQ ID NO: 808098 - DNA, 22 bp, Artificial Sequence
  chemically synthesized
atcccctctctcttgaggtctg

SEQ ID NO: 808099 - DNA, 22 bp, Artificial Sequence
  chemically synthesized
agtaatttagtaccagacctca

SEQ ID NO: 808100 - DNA, 22 bp, Artificial Sequence
  chemically synthesized
gagtaatttagtaccagacctc

SEQ ID NO: 808101 - DNA, 22 bp, Artificial Sequence
  chemically synthesized
tctcttgaggtctggtactaaa

SEQ ID NO: 808102 - DNA, 22 bp, Artificial Sequence
  chemically synthesized
tcttgaggtctggtactaaatt

SEQ ID NO: 808103 - DNA, 22 bp, Artificial Sequence
  chemically synthesized
gagagtttgagtaatttagtac

SEQ ID NO: 808104 - DNA, 22 bp, Artificial Sequence
  chemically synthesized
ttgaggtctggtactaaattac

SEQ ID NO: 808105 - DNA, 22 bp, Artificial Sequence
  chemically synthesized
tggagagtttgagtaatttagt

SEQ ID NO: 808106 - DNA, 22 bp, Artificial Sequence
  chemically synthesized
gaggtctggtactaaattactc

SEQ ID NO: 808107 - DNA, 22 bp, Artificial Sequence
  chemically synthesized
aggtctggtactaaattactca

SEQ ID NO: 808108 - DNA, 22 bp, Artificial Sequence
  chemically synthesized
actctggagagtttgagtaatt

SEQ ID NO: 808109 - DNA, 22 bp, Artificial Sequence
  chemically synthesized
gtactaaattactcaaactctc

SEQ ID NO: 808110 - DNA, 22 bp, Artificial Sequence
  chemically synthesized
caattaactctggagagtttga

SEQ ID NO: 808111 - DNA, 22 bp, Artificial Sequence
  chemically synthesized
ccaattaactctggagagtttg

SEQ ID NO: 808112 - DNA, 22 bp, Artificial Sequence
  chemically synthesized
aattactcaaactctccagagt

SEQ ID NO: 808113 - DNA, 22 bp, Artificial Sequence
  chemically synthesized
ctcaaactctccagagttaatt

SEQ ID NO: 808114 - DNA, 22 bp, Artificial Sequence
  chemically synthesized
ggtcatggtttccaattaactc

SEQ ID NO: 808115 - DNA, 22 bp, Artificial Sequence
  chemically synthesized
aggtcatggtttccaattaact

SEQ ID NO: 808116 - DNA, 22 bp, Artificial Sequence
  chemically synthesized
aaactctccagagttaattgga

SEQ ID NO: 808117 - DNA, 22 bp, Artificial Sequence
  chemically synthesized
tccagagttaattggaaaccat

SEQ ID NO: 808118 - DNA, 22 bp, Artificial Sequence
  chemically synthesized
cagagttaattggaaaccatga

SEQ ID NO: 808119 - DNA, 22 bp, Artificial Sequence
  chemically synthesized
ggaacatttaggtcatggtttc

SEQ ID NO: 808120 - DNA, 22 bp, Artificial Sequence
  chemically synthesized
gggaacatttaggtcatggttt

SEQ ID NO: 808121 - DNA, 22 bp, Artificial Sequence
  chemically synthesized
tgggaacatttaggtcatggtt

SEQ ID NO: 808122 - DNA, 22 bp, Artificial Sequence
  chemically synthesized
attggaaaccatgacctaaatg

SEQ ID NO: 808123 - DNA, 22 bp, Artificial Sequence
  chemically synthesized
gaaaccatgacctaaatgttcc

SEQ ID NO: 808124 - DNA, 22 bp, Artificial Sequence
  chemically synthesized
atcagcaatactttgggaacat

SEQ ID NO: 808125 - DNA, 22 bp, Artificial Sequence
  chemically synthesized
agaactaatcagcaatactttg

SEQ ID NO: 808126 - DNA, 22 bp, Artificial Sequence
  chemically synthesized
tgagaactaatcagcaatactt

SEQ ID NO: 808127 - DNA, 22 bp, Artificial Sequence
  chemically synthesized
ctgagaactaatcagcaatact

SEQ ID NO: 808128 - DNA, 22 bp, Artificial Sequence
  chemically synthesized
aatgttcccaaagtattgctga

SEQ ID NO: 808129 - DNA, 22 bp, Artificial Sequence
  chemically synthesized
tctgagaactaatcagcaatac

SEQ ID NO: 808130 - DNA, 22 bp, Artificial Sequence
  chemically synthesized
ccaaagtattgctgattagttc

SEQ ID NO: 808131 - DNA, 22 bp, Artificial Sequence
  chemically synthesized
ctgattagttctcagaaaactc

SEQ ID NO: 808132 - DNA, 22 bp, Artificial Sequence
  chemically synthesized
attagttctcagaaaactcatt

SEQ ID NO: 808133 - DNA, 22 bp, Artificial Sequence
  chemically synthesized
gttctcagaaaactcattccca

SEQ ID NO: 808134 - DNA, 22 bp, Artificial Sequence
  chemically synthesized
gggtgacaaaagatgggaatga

SEQ ID NO: 808135 - DNA, 22 bp, Artificial Sequence
  chemically synthesized
tcagaaaactcattcccatctt

SEQ ID NO: 808136 - DNA, 22 bp, Artificial Sequence
  chemically synthesized
agaaaactcattcccatctttt

SEQ ID NO: 808137 - DNA, 22 bp, Artificial Sequence
  chemically synthesized
tggtgtctggggtgacaaaaga

SEQ ID NO: 808138 - DNA, 22 bp, Artificial Sequence
  chemically synthesized
attcccatcttttgtcacccca

SEQ ID NO: 808139 - DNA, 22 bp, Artificial Sequence
  chemically synthesized
ccatcttttgtcaccccagaca

SEQ ID NO: 808140 - DNA, 22 bp, Artificial Sequence
  chemically synthesized
aaaagtcatcctgtggtgtctg

SEQ ID NO: 808141 - DNA, 22 bp, Artificial Sequence
  chemically synthesized
ttgtcaccccagacaccacagg

SEQ ID NO: 808142 - DNA, 22 bp, Artificial Sequence
  chemically synthesized
tgtcaccccagacaccacagga

SEQ ID NO: 808143 - DNA, 22 bp, Artificial Sequence
  chemically synthesized
gtcaccccagacaccacaggat

SEQ ID NO: 808144 - DNA, 22 bp, Artificial Sequence
  chemically synthesized
tcaccccagacaccacaggatg

SEQ ID NO: 808145 - DNA, 22 bp, Artificial Sequence
  chemically synthesized
cacatgttaaaaagtcatcctg

SEQ ID NO: 808146 - DNA, 22 bp, Artificial Sequence
  chemically synthesized
ctgcacatgttaaaaagtcatc

SEQ ID NO: 808147 - DNA, 22 bp, Artificial Sequence
  chemically synthesized
ctactgcacatgttaaaaagtc

SEQ ID NO: 808148 - DNA, 22 bp, Artificial Sequence
  chemically synthesized
atgccagtgtgttgctactgca

SEQ ID NO: 808149 - DNA, 22 bp, Artificial Sequence
  chemically synthesized
tcatgccagtgtgttgctactg

SEQ ID NO: 808150 - DNA, 22 bp, Artificial Sequence
  chemically synthesized
tttaacatgtgcagtagcaaca

SEQ ID NO: 808151 - DNA, 22 bp, Artificial Sequence
  chemically synthesized
ctcatgccagtgtgttgctact

SEQ ID NO: 808152 - DNA, 22 bp, Artificial Sequence
  chemically synthesized
ttaacatgtgcagtagcaacac

SEQ ID NO: 808153 - DNA, 22 bp, Artificial Sequence
  chemically synthesized
taacatgtgcagtagcaacaca

SEQ ID NO: 808154 - DNA, 22 bp, Artificial Sequence
  chemically synthesized
aacatgtgcagtagcaacacac

SEQ ID NO: 808155 - DNA, 22 bp, Artificial Sequence
  chemically synthesized
tttctcatgccagtgtgttgct

SEQ ID NO: 808156 - DNA, 22 bp, Artificial Sequence
  chemically synthesized
acatgtgcagtagcaacacact

SEQ ID NO: 808157 - DNA, 22 bp, Artificial Sequence
  chemically synthesized
atctatttctcatgccagtgtg

SEQ ID NO: 808158 - DNA, 22 bp, Artificial Sequence
  chemically synthesized
gaggattaatctatttctcatg

SEQ ID NO: 808159 - DNA, 22 bp, Artificial Sequence
  chemically synthesized
ggaggattaatctatttctcat

SEQ ID NO: 808160 - DNA, 22 bp, Artificial Sequence
  chemically synthesized
tggaggattaatctatttctca

SEQ ID NO: 808161 - DNA, 22 bp, Artificial Sequence
  chemically synthesized
tctttggaggattaatctattt

SEQ ID NO: 808162 - DNA, 22 bp, Artificial Sequence
  chemically synthesized
atctttggaggattaatctatt

SEQ ID NO: 808163 - DNA, 22 bp, Artificial Sequence
  chemically synthesized
gcatgagaaatagattaatcct

SEQ ID NO: 808164 - DNA, 22 bp, Artificial Sequence
  chemically synthesized
tggtttatctttggaggattaa

SEQ ID NO: 808165 - DNA, 22 bp, Artificial Sequence
  chemically synthesized
aaagctgtggtttatctttgga

SEQ ID NO: 808166 - DNA, 22 bp, Artificial Sequence
  chemically synthesized
caaagctgtggtttatctttgg

SEQ ID NO: 808167 - DNA, 22 bp, Artificial Sequence
  chemically synthesized
atcctccaaagataaaccacag

SEQ ID NO: 808168 - DNA, 22 bp, Artificial Sequence
  chemically synthesized
cacagatagcttcaaagctgtg

SEQ ID NO: 808169 - DNA, 22 bp, Artificial Sequence
  chemically synthesized
caaagataaaccacagctttga

SEQ ID NO: 808170 - DNA, 22 bp, Artificial Sequence
  chemically synthesized
acacagatagcttcaaagctgt

SEQ ID NO: 808171 - DNA, 22 bp, Artificial Sequence
  chemically synthesized
tatcagtgaaggaagtttacac

SEQ ID NO: 808172 - DNA, 22 bp, Artificial Sequence
  chemically synthesized
tgaagctatctgtgtaaacttc

SEQ ID NO: 808173 - DNA, 22 bp, Artificial Sequence
  chemically synthesized
gaagctatctgtgtaaacttcc

SEQ ID NO: 808174 - DNA, 22 bp, Artificial Sequence
  chemically synthesized
aagctatctgtgtaaacttcct

SEQ ID NO: 808175 - DNA, 22 bp, Artificial Sequence
  chemically synthesized
tctgtgtaaacttccttcactg

SEQ ID NO: 808176 - DNA, 22 bp, Artificial Sequence
  chemically synthesized
tgtaaacttccttcactgatac

SEQ ID NO: 808177 - DNA, 22 bp, Artificial Sequence
  chemically synthesized
aaaaataaaatgtctgtatcag

SEQ ID NO: 808178 - DNA, 22 bp, Artificial Sequence
  chemically synthesized
aaaaaataaaatgtctgtatca

SEQ ID NO: 808179 - DNA, 22 bp, Artificial Sequence
  chemically synthesized
taaaaaataaaatgtctgtatc

SEQ ID NO: 808180 - DNA, 22 bp, Artificial Sequence
  chemically synthesized
ttaaaaaataaaatgtctgtat

SEQ ID NO: 808181 - DNA, 22 bp, Artificial Sequence
  chemically synthesized
tttaaaaaataaaatgtctgta

SEQ ID NO: 808182 - DNA, 22 bp, Artificial Sequence
  chemically synthesized
ttttaaaaaataaaatgtctgt

SEQ ID NO: 808183 - DNA, 22 bp, Artificial Sequence
  chemically synthesized
ccttcactgatacagacatttt

SEQ ID NO: 808184 - DNA, 22 bp, Artificial Sequence
  chemically synthesized
tttttaaaaaataaaatgtctg

SEQ ID NO: 808185 - DNA, 22 bp, Artificial Sequence
  chemically synthesized
cttcactgatacagacatttta

SEQ ID NO: 808186 - DNA, 22 bp, Artificial Sequence
  chemically synthesized
cactgatacagacattttattt

SEQ ID NO: 808187 - DNA, 22 bp, Artificial Sequence
  chemically synthesized
actgatacagacattttatttt

SEQ ID NO: 808188 - DNA, 22 bp, Artificial Sequence
  chemically synthesized
atacagacattttattttttaa

SEQ ID NO: 808189 - DNA, 22 bp, Artificial Sequence
  chemically synthesized
ggtgatatgtatatttttttta

SEQ ID NO: 808190 - DNA, 22 bp, Artificial Sequence
  chemically synthesized
tattttttaaaaaaaatataca

SEQ ID NO: 808191 - DNA, 22 bp, Artificial Sequence
  chemically synthesized
attttttaaaaaaaatatacat

SEQ ID NO: 808192 - DNA, 22 bp, Artificial Sequence
  chemically synthesized
ttttttaaaaaaaatatacata

SEQ ID NO: 808193 - DNA, 22 bp, Artificial Sequence
  chemically synthesized
aagtctaggtgatatgtatatt

SEQ ID NO: 808194 - DNA, 22 bp, Artificial Sequence
  chemically synthesized
tttaaaaaaaatatacatatca

SEQ ID NO: 808195 - DNA, 22 bp, Artificial Sequence
  chemically synthesized
ttaaaaaaaatatacatatcac

SEQ ID NO: 808196 - DNA, 22 bp, Artificial Sequence
  chemically synthesized
tctaaagtctaggtgatatgta

SEQ ID NO: 808197 - DNA, 22 bp, Artificial Sequence
  chemically synthesized
taaaaaaaatatacatatcacc

SEQ ID NO: 808198 - DNA, 22 bp, Artificial Sequence
  chemically synthesized
aaaaaaaatatacatatcacct

SEQ ID NO: 808199 - DNA, 22 bp, Artificial Sequence
  chemically synthesized
aaaaaaatatacatatcaccta

SEQ ID NO: 808200 - DNA, 22 bp, Artificial Sequence
  chemically synthesized
ctatctaaagtctaggtgatat

SEQ ID NO: 808201 - DNA, 22 bp, Artificial Sequence
  chemically synthesized
actatctaaagtctaggtgata

SEQ ID NO: 808202 - DNA, 22 bp, Artificial Sequence
  chemically synthesized
ttactatctaaagtctaggtga

SEQ ID NO: 808203 - DNA, 22 bp, Artificial Sequence
  chemically synthesized
tcttactatctaaagtctaggt

SEQ ID NO: 808204 - DNA, 22 bp, Artificial Sequence
  chemically synthesized
tactctcttactatctaaagtc

SEQ ID NO: 808205 - DNA, 22 bp, Artificial Sequence
  chemically synthesized
ataatgcctatactctcttact

SEQ ID NO: 808206 - DNA, 22 bp, Artificial Sequence
  chemically synthesized
gactttagatagtaagagagta

SEQ ID NO: 808207 - DNA, 22 bp, Artificial Sequence
  chemically synthesized
tagatagtaagagagtataggc

SEQ ID NO: 808208 - DNA, 22 bp, Artificial Sequence
  chemically synthesized
agatagtaagagagtataggca

SEQ ID NO: 808209 - DNA, 22 bp, Artificial Sequence
  chemically synthesized
cgtgattgataatgcctatact

SEQ ID NO: 808210 - DNA, 22 bp, Artificial Sequence
  chemically synthesized
gatagtaagagagtataggcat

SEQ ID NO: 808211 - DNA, 22 bp, Artificial Sequence
  chemically synthesized
acgtgattgataatgcctatac

SEQ ID NO: 808212 - DNA, 22 bp, Artificial Sequence
  chemically synthesized
cttacgtgattgataatgccta

SEQ ID NO: 808213 - DNA, 22 bp, Artificial Sequence
  chemically synthesized
aaaattccttacgtgattgata

SEQ ID NO: 808214 - DNA, 22 bp, Artificial Sequence
  chemically synthesized
caaaattccttacgtgattgat

SEQ ID NO: 808215 - DNA, 22 bp, Artificial Sequence
  chemically synthesized
tcaaaattccttacgtgattga

SEQ ID NO: 808216 - DNA, 22 bp, Artificial Sequence
  chemically synthesized
tcaatcacgtaaggaattttga

SEQ ID NO: 808217 - DNA, 22 bp, Artificial Sequence
  chemically synthesized
aaaaaatgagagatgaaatgtg

SEQ ID NO: 808218 - DNA, 22 bp, Artificial Sequence
  chemically synthesized
tgaaagacacatttcatctctc

SEQ ID NO: 808219 - DNA, 22 bp, Artificial Sequence
  chemically synthesized
gaaagacacatttcatctctca

SEQ ID NO: 808220 - DNA, 22 bp, Artificial Sequence
  chemically synthesized
aaagacacatttcatctctcat

SEQ ID NO: 808221 - DNA, 22 bp, Artificial Sequence
  chemically synthesized
ataaggttaaaaaaatgagaga

SEQ ID NO: 808222 - DNA, 22 bp, Artificial Sequence
  chemically synthesized
aaaacattcataaggttaaaaa

SEQ ID NO: 808223 - DNA, 22 bp, Artificial Sequence
  chemically synthesized
catctctcatttttttaacctt

SEQ ID NO: 808224 - DNA, 22 bp, Artificial Sequence
  chemically synthesized
aaaaacattcataaggttaaaa

SEQ ID NO: 808225 - DNA, 22 bp, Artificial Sequence
  chemically synthesized
atctctcatttttttaacctta

SEQ ID NO: 808226 - DNA, 22 bp, Artificial Sequence
  chemically synthesized
taaaaacattcataaggttaaa

SEQ ID NO: 808227 - DNA, 22 bp, Artificial Sequence
  chemically synthesized
ttttaaaaacattcataaggtt

SEQ ID NO: 808228 - DNA, 22 bp, Artificial Sequence
  chemically synthesized
tcatttttttaaccttatgaat

SEQ ID NO: 808229 - DNA, 22 bp, Artificial Sequence
  chemically synthesized
tattttaaaaacattcataagg

SEQ ID NO: 808230 - DNA, 22 bp, Artificial Sequence
  chemically synthesized
atttttttaaccttatgaatgt

SEQ ID NO: 808231 - DNA, 22 bp, Artificial Sequence
  chemically synthesized
ttttaaccttatgaatgttttt

SEQ ID NO: 808232 - DNA, 22 bp, Artificial Sequence
  chemically synthesized
tttaaccttatgaatgttttta

SEQ ID NO: 808233 - DNA, 22 bp, Artificial Sequence
  chemically synthesized
ttaaccttatgaatgtttttaa

SEQ ID NO: 808234 - DNA, 22 bp, Artificial Sequence
  chemically synthesized
taaccttatgaatgtttttaaa

SEQ ID NO: 808235 - DNA, 22 bp, Artificial Sequence
  chemically synthesized
gcaaatctctattttaaaaaca

SEQ ID NO: 808236 - DNA, 22 bp, Artificial Sequence
  chemically synthesized
aaccttatgaatgtttttaaaa

SEQ ID NO: 808237 - DNA, 22 bp, Artificial Sequence
  chemically synthesized
accttatgaatgtttttaaaat

SEQ ID NO: 808238 - DNA, 22 bp, Artificial Sequence
  chemically synthesized
atgaatgtttttaaaatagaga

SEQ ID NO: 808239 - DNA, 22 bp, Artificial Sequence
  chemically synthesized
tgaatgtttttaaaatagagat

SEQ ID NO: 808240 - DNA, 22 bp, Artificial Sequence
  chemically synthesized
atgataaattcgcaaatctcta

SEQ ID NO: 808241 - DNA, 22 bp, Artificial Sequence
  chemically synthesized
cctaatgataaattcgcaaatc

SEQ ID NO: 808242 - DNA, 22 bp, Artificial Sequence
  chemically synthesized
ccctaatgataaattcgcaaat

SEQ ID NO: 808243 - DNA, 22 bp, Artificial Sequence
  chemically synthesized
ttaaaatagagatttgcgaatt

SEQ ID NO: 808244 - DNA, 22 bp, Artificial Sequence
  chemically synthesized
taaaatagagatttgcgaattt

SEQ ID NO: 808245 - DNA, 22 bp, Artificial Sequence
  chemically synthesized
aaaatagagatttgcgaattta

SEQ ID NO: 808246 - DNA, 22 bp, Artificial Sequence
  chemically synthesized
tttccctaatgataaattcgca

SEQ ID NO: 808247 - DNA, 22 bp, Artificial Sequence
  chemically synthesized
aaatagagatttgcgaatttat

SEQ ID NO: 808248 - DNA, 22 bp, Artificial Sequence
  chemically synthesized
tggttgtttccctaatgataaa

SEQ ID NO: 808249 - DNA, 22 bp, Artificial Sequence
  chemically synthesized
gcgaatttatcattagggaaac

SEQ ID NO: 808250 - DNA, 22 bp, Artificial Sequence
  chemically synthesized
cgaatttatcattagggaaaca

SEQ ID NO: 808251 - DNA, 22 bp, Artificial Sequence
  chemically synthesized
atcattagggaaacaaccataa

SEQ ID NO: 808252 - DNA, 22 bp, Artificial Sequence
  chemically synthesized
tcattagggaaacaaccataat

SEQ ID NO: 808253 - DNA, 22 bp, Artificial Sequence
  chemically synthesized
gggaaagtgtataattatggtt

SEQ ID NO: 808254 - DNA, 22 bp, Artificial Sequence
  chemically synthesized
agggaaagtgtataattatggt

SEQ ID NO: 808255 - DNA, 22 bp, Artificial Sequence
  chemically synthesized
tagggaaagtgtataattatgg

SEQ ID NO: 808256 - DNA, 22 bp, Artificial Sequence
  chemically synthesized
gggaaacaaccataattataca

SEQ ID NO: 808257 - DNA, 22 bp, Artificial Sequence
  chemically synthesized
atggttttagggaaagtgtata

SEQ ID NO: 808258 - DNA, 22 bp, Artificial Sequence
  chemically synthesized
aggaaagtactaatggttttag

SEQ ID NO: 808259 - DNA, 22 bp, Artificial Sequence
  chemically synthesized
caggaaagtactaatggtttta

SEQ ID NO: 808260 - DNA, 22 bp, Artificial Sequence
  chemically synthesized
tacactttccctaaaaccatta

SEQ ID NO: 808261 - DNA, 22 bp, Artificial Sequence
  chemically synthesized
tcaggaaagtactaatggtttt

SEQ ID NO: 808262 - DNA, 22 bp, Artificial Sequence
  chemically synthesized
ttcaggaaagtactaatggttt

SEQ ID NO: 808263 - DNA, 22 bp, Artificial Sequence
  chemically synthesized
tccctaaaaccattagtacttt

SEQ ID NO: 808264 - DNA, 22 bp, Artificial Sequence
  chemically synthesized
ccctaaaaccattagtactttc

SEQ ID NO: 808265 - DNA, 22 bp, Artificial Sequence
  chemically synthesized
cctaaaaccattagtactttcc

SEQ ID NO: 808266 - DNA, 22 bp, Artificial Sequence
  chemically synthesized
atgcaggtcttttcaggaaagt

SEQ ID NO: 808267 - DNA, 22 bp, Artificial Sequence
  chemically synthesized
aaaccattagtactttcctgaa

SEQ ID NO: 808268 - DNA, 22 bp, Artificial Sequence
  chemically synthesized
ctaatgcaggtcttttcaggaa

SEQ ID NO: 808269 - DNA, 22 bp, Artificial Sequence
  chemically synthesized
tctcctaatgcaggtcttttca

SEQ ID NO: 808270 - DNA, 22 bp, Artificial Sequence
  chemically synthesized
gtactttcctgaaaagacctgc

SEQ ID NO: 808271 - DNA, 22 bp, Artificial Sequence
  chemically synthesized
ctgtctcctaatgcaggtcttt

SEQ ID NO: 808272 - DNA, 22 bp, Artificial Sequence
  chemically synthesized
ctgctgtctcctaatgcaggtc

SEQ ID NO: 808273 - DNA, 22 bp, Artificial Sequence
  chemically synthesized
tactgctgtctcctaatgcagg

SEQ ID NO: 808274 - DNA, 22 bp, Artificial Sequence
  chemically synthesized
tcctgaaaagacctgcattagg

SEQ ID NO: 808275 - DNA, 22 bp, Artificial Sequence
  chemically synthesized
ctactgctgtctcctaatgcag

SEQ ID NO: 808276 - DNA, 22 bp, Artificial Sequence
  chemically synthesized
cctgaaaagacctgcattagga

SEQ ID NO: 808277 - DNA, 22 bp, Artificial Sequence
  chemically synthesized
tctactgctgtctcctaatgca

SEQ ID NO: 808278 - DNA, 22 bp, Artificial Sequence
  chemically synthesized
ctgaaaagacctgcattaggag

SEQ ID NO: 808279 - DNA, 22 bp, Artificial Sequence
  chemically synthesized
aaaagacctgcattaggagaca

SEQ ID NO: 808280 - DNA, 22 bp, Artificial Sequence
  chemically synthesized
cattaggagacagcagtagaaa

SEQ ID NO: 808281 - DNA, 22 bp, Artificial Sequence
  chemically synthesized
ggagacagcagtagaaaatgtg

SEQ ID NO: 808282 - DNA, 22 bp, Artificial Sequence
  chemically synthesized
tctactttactttgcattaccc

SEQ ID NO: 808283 - DNA, 22 bp, Artificial Sequence
  chemically synthesized
ctactttactttgcattacccg

SEQ ID NO: 808284 - DNA, 22 bp, Artificial Sequence
  chemically synthesized
tactttactttgcattacccgt

SEQ ID NO: 808285 - DNA, 22 bp, Artificial Sequence
  chemically synthesized
ctttactttgcattacccgttt

SEQ ID NO: 808286 - DNA, 22 bp, Artificial Sequence
  chemically synthesized
tactttgcattacccgtttcat

SEQ ID NO: 808287 - DNA, 22 bp, Artificial Sequence
  chemically synthesized
actttgcattacccgtttcatt

SEQ ID NO: 808288 - DNA, 22 bp, Artificial Sequence
  chemically synthesized
aaatacaaatcaaatgaaacgg

SEQ ID NO: 808289 - DNA, 22 bp, Artificial Sequence
  chemically synthesized
ctttgcattacccgtttcattt

SEQ ID NO: 808290 - DNA, 22 bp, Artificial Sequence
  chemically synthesized
tgcattacccgtttcatttgat

SEQ ID NO: 808291 - DNA, 22 bp, Artificial Sequence
  chemically synthesized
gcattacccgtttcatttgatt

SEQ ID NO: 808292 - DNA, 22 bp, Artificial Sequence
  chemically synthesized
cattacccgtttcatttgattt

SEQ ID NO: 808293 - DNA, 22 bp, Artificial Sequence
  chemically synthesized
tgagttgaaatacaaatcaaat

SEQ ID NO: 808294 - DNA, 22 bp, Artificial Sequence
  chemically synthesized
atgagttgaaatacaaatcaaa

SEQ ID NO: 808295 - DNA, 22 bp, Artificial Sequence
  chemically synthesized
cccgtttcatttgatttgtatt

SEQ ID NO: 808296 - DNA, 22 bp, Artificial Sequence
  chemically synthesized
agtgatttatgagttgaaatac

SEQ ID NO: 808297 - DNA, 22 bp, Artificial Sequence
  chemically synthesized
cagtgatttatgagttgaaata

SEQ ID NO: 808298 - DNA, 22 bp, Artificial Sequence
  chemically synthesized
catttgatttgtatttcaactc

SEQ ID NO: 808299 - DNA, 22 bp, Artificial Sequence
  chemically synthesized
tcagtgatttatgagttgaaat

SEQ ID NO: 808300 - DNA, 22 bp, Artificial Sequence
  chemically synthesized
atttgatttgtatttcaactca

SEQ ID NO: 808301 - DNA, 22 bp, Artificial Sequence
  chemically synthesized
ttcagtgatttatgagttgaaa

SEQ ID NO: 808302 - DNA, 22 bp, Artificial Sequence
  chemically synthesized
tttcagtgatttatgagttgaa

SEQ ID NO: 808303 - DNA, 22 bp, Artificial Sequence
  chemically synthesized
ttttcagtgatttatgagttga

SEQ ID NO: 808304 - DNA, 22 bp, Artificial Sequence
  chemically synthesized
gatttgtatttcaactcataaa

SEQ ID NO: 808305 - DNA, 22 bp, Artificial Sequence
  chemically synthesized
atttgtatttcaactcataaat

SEQ ID NO: 808306 - DNA, 22 bp, Artificial Sequence
  chemically synthesized
atttttttcagtgatttatgag

SEQ ID NO: 808307 - DNA, 22 bp, Artificial Sequence
  chemically synthesized
gtatttcaactcataaatcact

SEQ ID NO: 808308 - DNA, 22 bp, Artificial Sequence
  chemically synthesized
tatttcaactcataaatcactg

SEQ ID NO: 808309 - DNA, 22 bp, Artificial Sequence
  chemically synthesized
tcaactaatttttttcagtgat

SEQ ID NO: 808310 - DNA, 22 bp, Artificial Sequence
  chemically synthesized
atcaactaatttttttcagtga

SEQ ID NO: 808311 - DNA, 22 bp, Artificial Sequence
  chemically synthesized
caactcataaatcactgaaaaa

SEQ ID NO: 808312 - DNA, 22 bp, Artificial Sequence
  chemically synthesized
tatcaactaatttttttcagtg

SEQ ID NO: 808313 - DNA, 22 bp, Artificial Sequence
  chemically synthesized
aactcataaatcactgaaaaaa

SEQ ID NO: 808314 - DNA, 22 bp, Artificial Sequence
  chemically synthesized
tttatcaactaatttttttcag

SEQ ID NO: 808315 - DNA, 22 bp, Artificial Sequence
  chemically synthesized
ctttatcaactaatttttttca

SEQ ID NO: 808316 - DNA, 22 bp, Artificial Sequence
  chemically synthesized
ataaatcactgaaaaaaattag

SEQ ID NO: 808317 - DNA, 22 bp, Artificial Sequence
  chemically synthesized
tgtacatttctttatcaactaa

SEQ ID NO: 808318 - DNA, 22 bp, Artificial Sequence
  chemically synthesized
aaaaaaattagttgataaagaa

SEQ ID NO: 808319 - DNA, 22 bp, Artificial Sequence
  chemically synthesized
ataacactgtgtacatttcttt

SEQ ID NO: 808320 - DNA, 22 bp, Artificial Sequence
  chemically synthesized
ctcataacactgtgtacatttc

SEQ ID NO: 808321 - DNA, 22 bp, Artificial Sequence
  chemically synthesized
gttgataaagaaatgtacacag

SEQ ID NO: 808322 - DNA, 22 bp, Artificial Sequence
  chemically synthesized
atctgctcataacactgtgtac

SEQ ID NO: 808323 - DNA, 22 bp, Artificial Sequence
  chemically synthesized
catctgctcataacactgtgta

SEQ ID NO: 808324 - DNA, 22 bp, Artificial Sequence
  chemically synthesized
ataaagaaatgtacacagtgtt

SEQ ID NO: 808325 - DNA, 22 bp, Artificial Sequence
  chemically synthesized
tgagcagatgaaatacacgtct

SEQ ID NO: 808326 - DNA, 22 bp, Artificial Sequence
  chemically synthesized
aagaaagaaaaaaatatgtgtg

SEQ ID NO: 808327 - DNA, 22 bp, Artificial Sequence
  chemically synthesized
aaaattcaagaaagaaaaaaat

SEQ ID NO: 808328 - DNA, 22 bp, Artificial Sequence
  chemically synthesized
tatacacacatatttttttctt

SEQ ID NO: 808329 - DNA, 22 bp, Artificial Sequence
  chemically synthesized
aaaaattcaagaaagaaaaaaa

SEQ ID NO: 808330 - DNA, 22 bp, Artificial Sequence
  chemically synthesized
taaaaattcaagaaagaaaaaa

SEQ ID NO: 808331 - DNA, 22 bp, Artificial Sequence
  chemically synthesized
tacacacatatttttttctttc

SEQ ID NO: 808332 - DNA, 22 bp, Artificial Sequence
  chemically synthesized
tttaaaaattcaagaaagaaaa

SEQ ID NO: 808333 - DNA, 22 bp, Artificial Sequence
  chemically synthesized
ttttctttcttgaatttttaaa

SEQ ID NO: 808334 - DNA, 22 bp, Artificial Sequence
  chemically synthesized
tttctttcttgaatttttaaag

SEQ ID NO: 808335 - DNA, 22 bp, Artificial Sequence
  chemically synthesized
ttctttcttgaatttttaaaga

SEQ ID NO: 808336 - DNA, 22 bp, Artificial Sequence
  chemically synthesized
tctttcttgaatttttaaagag

SEQ ID NO: 808337 - DNA, 22 bp, Artificial Sequence
  chemically synthesized
aagagtatcaatctctttaaaa

SEQ ID NO: 808338 - DNA, 22 bp, Artificial Sequence
  chemically synthesized
ctttcttgaatttttaaagaga

SEQ ID NO: 808339 - DNA, 22 bp, Artificial Sequence
  chemically synthesized
aaagagtatcaatctctttaaa

SEQ ID NO: 808340 - DNA, 22 bp, Artificial Sequence
  chemically synthesized
tttcttgaatttttaaagagat

SEQ ID NO: 808341 - DNA, 22 bp, Artificial Sequence
  chemically synthesized
tcttgaatttttaaagagattg

SEQ ID NO: 808342 - DNA, 22 bp, Artificial Sequence
  chemically synthesized
cttgaatttttaaagagattga

SEQ ID NO: 808343 - DNA, 22 bp, Artificial Sequence
  chemically synthesized
ttgaatttttaaagagattgat

SEQ ID NO: 808344 - DNA, 22 bp, Artificial Sequence
  chemically synthesized
gaatttttaaagagattgatac

SEQ ID NO: 808345 - DNA, 22 bp, Artificial Sequence
  chemically synthesized
aatttttaaagagattgatact

SEQ ID NO: 808346 - DNA, 22 bp, Artificial Sequence
  chemically synthesized
ttaaagagattgatactcttta

SEQ ID NO: 808347 - DNA, 22 bp, Artificial Sequence
  chemically synthesized
taaagagattgatactctttaa

SEQ ID NO: 808348 - DNA, 22 bp, Artificial Sequence
  chemically synthesized
aaagagattgatactctttaag

SEQ ID NO: 808349 - DNA, 22 bp, Artificial Sequence
  chemically synthesized
aagagattgatactctttaaga

SEQ ID NO: 808350 - DNA, 22 bp, Artificial Sequence
  chemically synthesized
atactctttaagatctgcattt

SEQ ID NO: 808351 - DNA, 22 bp, Artificial Sequence
  chemically synthesized
tttaagatctgcattttatatt

SEQ ID NO: 808352 - DNA, 22 bp, Artificial Sequence
  chemically synthesized
tatcagcagaaaaatataaaat

SEQ ID NO: 808353 - DNA, 22 bp, Artificial Sequence
  chemically synthesized
taagatctgcattttatatttt

SEQ ID NO: 808354 - DNA, 22 bp, Artificial Sequence
  chemically synthesized
aagatctgcattttatattttt

SEQ ID NO: 808355 - DNA, 22 bp, Artificial Sequence
  chemically synthesized
agatctgcattttatatttttc

SEQ ID NO: 808356 - DNA, 22 bp, Artificial Sequence
  chemically synthesized
gtattgtatcagcagaaaaata

SEQ ID NO: 808357 - DNA, 22 bp, Artificial Sequence
  chemically synthesized
cgtattgtatcagcagaaaaat

SEQ ID NO: 808358 - DNA, 22 bp, Artificial Sequence
  chemically synthesized
tcgtattgtatcagcagaaaaa

SEQ ID NO: 808359 - DNA, 22 bp, Artificial Sequence
  chemically synthesized
ttcgtattgtatcagcagaaaa

SEQ ID NO: 808360 - DNA, 22 bp, Artificial Sequence
  chemically synthesized
cattttatatttttctgctgat

SEQ ID NO: 808361 - DNA, 22 bp, Artificial Sequence
  chemically synthesized
tatatttttctgctgatacaat

SEQ ID NO: 808362 - DNA, 22 bp, Artificial Sequence
  chemically synthesized
atatttttctgctgatacaata

SEQ ID NO: 808363 - DNA, 22 bp, Artificial Sequence
  chemically synthesized
tatttttctgctgatacaatac

SEQ ID NO: 808364 - DNA, 22 bp, Artificial Sequence
  chemically synthesized
caaatagtaccttttcgtattg

SEQ ID NO: 808365 - DNA, 22 bp, Artificial Sequence
  chemically synthesized
ttctgctgatacaatacgaaaa

SEQ ID NO: 808366 - DNA, 22 bp, Artificial Sequence
  chemically synthesized
tctgctgatacaatacgaaaag

SEQ ID NO: 808367 - DNA, 22 bp, Artificial Sequence
  chemically synthesized
tccaaatagtaccttttcgtat

SEQ ID NO: 808368 - DNA, 22 bp, Artificial Sequence
  chemically synthesized
ctgctgatacaatacgaaaagg

SEQ ID NO: 808369 - DNA, 22 bp, Artificial Sequence
  chemically synthesized
tgctgatacaatacgaaaaggt

SEQ ID NO: 808370 - DNA, 22 bp, Artificial Sequence
  chemically synthesized
ctgatacaatacgaaaaggtac

SEQ ID NO: 808371 - DNA, 22 bp, Artificial Sequence
  chemically synthesized
aacctctccaaatagtaccttt

SEQ ID NO: 808372 - DNA, 22 bp, Artificial Sequence
  chemically synthesized
atacaatacgaaaaggtactat

SEQ ID NO: 808373 - DNA, 22 bp, Artificial Sequence
  chemically synthesized
caacctctccaaatagtacctt

SEQ ID NO: 808374 - DNA, 22 bp, Artificial Sequence
  chemically synthesized
tatttcaacctctccaaatagt

SEQ ID NO: 808375 - DNA, 22 bp, Artificial Sequence
  chemically synthesized
ccaacattatatttcaacctct

SEQ ID NO: 808376 - DNA, 22 bp, Artificial Sequence
  chemically synthesized
ctcccaacattatatttcaacc

SEQ ID NO: 808377 - DNA, 22 bp, Artificial Sequence
  chemically synthesized
tttggagaggttgaaatataat

SEQ ID NO: 808378 - DNA, 22 bp, Artificial Sequence
  chemically synthesized
attactcccaacattatatttc

SEQ ID NO: 808379 - DNA, 22 bp, Artificial Sequence
  chemically synthesized
ggagaggttgaaatataatgtt

SEQ ID NO: 808380 - DNA, 22 bp, Artificial Sequence
  chemically synthesized
gagaggttgaaatataatgttg

SEQ ID NO: 808381 - DNA, 22 bp, Artificial Sequence
  chemically synthesized
aaatataatgttgggagtaatg

SEQ ID NO: 808382 - DNA, 22 bp, Artificial Sequence
  chemically synthesized
accaaaccaaatgtaattcatt

SEQ ID NO: 808383 - DNA, 22 bp, Artificial Sequence
  chemically synthesized
ggagtaatgaattacatttggt

SEQ ID NO: 808384 - DNA, 22 bp, Artificial Sequence
  chemically synthesized
tatattaaccaaaccaaatgta

SEQ ID NO: 808385 - DNA, 22 bp, Artificial Sequence
  chemically synthesized
tgtatattaaccaaaccaaatg

SEQ ID NO: 808386 - DNA, 22 bp, Artificial Sequence
  chemically synthesized
agtctctgtatattaaccaaac

SEQ ID NO: 808387 - DNA, 22 bp, Artificial Sequence
  chemically synthesized
gagtctctgtatattaaccaaa

SEQ ID NO: 808388 - DNA, 22 bp, Artificial Sequence
  chemically synthesized
tgagtctctgtatattaaccaa

SEQ ID NO: 808389 - DNA, 22 bp, Artificial Sequence
  chemically synthesized
catttggtttggttaatataca

SEQ ID NO: 808390 - DNA, 22 bp, Artificial Sequence
  chemically synthesized
ggtttggttaatatacagagac

SEQ ID NO: 808391 - DNA, 22 bp, Artificial Sequence
  chemically synthesized
gtttggttaatatacagagact

SEQ ID NO: 808392 - DNA, 22 bp, Artificial Sequence
  chemically synthesized
ggttaatatacagagactcaaa

SEQ ID NO: 808393 - DNA, 22 bp, Artificial Sequence
  chemically synthesized
gttaatatacagagactcaaaa

SEQ ID NO: 808394 - DNA, 22 bp, Artificial Sequence
  chemically synthesized
atatacagagactcaaaatatc

SEQ ID NO: 808395 - DNA, 22 bp, Artificial Sequence
  chemically synthesized
tataaatgcccaaaaggatatt

SEQ ID NO: 808396 - DNA, 22 bp, Artificial Sequence
  chemically synthesized
cagttgtataaatgcccaaaag

SEQ ID NO: 808397 - DNA, 22 bp, Artificial Sequence
  chemically synthesized
acagttgtataaatgcccaaaa

SEQ ID NO: 808398 - DNA, 22 bp, Artificial Sequence
  chemically synthesized
aaaatatccttttgggcattta

SEQ ID NO: 808399 - DNA, 22 bp, Artificial Sequence
  chemically synthesized
aagatcccttacagttgtataa

SEQ ID NO: 808400 - DNA, 22 bp, Artificial Sequence
  chemically synthesized
taaagatcccttacagttgtat

SEQ ID NO: 808401 - DNA, 22 bp, Artificial Sequence
  chemically synthesized
ctaaagatcccttacagttgta

SEQ ID NO: 808402 - DNA, 22 bp, Artificial Sequence
  chemically synthesized
ttgggcatttatacaactgtaa

SEQ ID NO: 808403 - DNA, 22 bp, Artificial Sequence
  chemically synthesized
tctaaagatcccttacagttgt

SEQ ID NO: 808404 - DNA, 22 bp, Artificial Sequence
  chemically synthesized
tgggcatttatacaactgtaag

SEQ ID NO: 808405 - DNA, 22 bp, Artificial Sequence
  chemically synthesized
ttctaaagatcccttacagttg

SEQ ID NO: 808406 - DNA, 22 bp, Artificial Sequence
  chemically synthesized
gggcatttatacaactgtaagg

SEQ ID NO: 808407 - DNA, 22 bp, Artificial Sequence
  chemically synthesized
tttctaaagatcccttacagtt

SEQ ID NO: 808408 - DNA, 22 bp, Artificial Sequence
  chemically synthesized
ggcatttatacaactgtaaggg

SEQ ID NO: 808409 - DNA, 22 bp, Artificial Sequence
  chemically synthesized
ttttctaaagatcccttacagt

SEQ ID NO: 808410 - DNA, 22 bp, Artificial Sequence
  chemically synthesized
catttttttctaaagatccctt

SEQ ID NO: 808411 - DNA, 22 bp, Artificial Sequence
  chemically synthesized
atacaactgtaagggatcttta

SEQ ID NO: 808412 - DNA, 22 bp, Artificial Sequence
  chemically synthesized
tacaactgtaagggatctttag

SEQ ID NO: 808413 - DNA, 22 bp, Artificial Sequence
  chemically synthesized
actgcatttttttctaaagatc

SEQ ID NO: 808414 - DNA, 22 bp, Artificial Sequence
  chemically synthesized
taagggatctttagaaaaaaat

SEQ ID NO: 808415 - DNA, 22 bp, Artificial Sequence
  chemically synthesized
ggaagtagtgttaactgcattt

SEQ ID NO: 808416 - DNA, 22 bp, Artificial Sequence
  chemically synthesized
tctgggaagtagtgttaactgc

SEQ ID NO: 808417 - DNA, 22 bp, Artificial Sequence
  chemically synthesized
tagaaaaaaatgcagttaacac

SEQ ID NO: 808418 - DNA, 22 bp, Artificial Sequence
  chemically synthesized
agaaaaaaatgcagttaacact

SEQ ID NO: 808419 - DNA, 22 bp, Artificial Sequence
  chemically synthesized
gaaaaaaatgcagttaacacta

SEQ ID NO: 808420 - DNA, 22 bp, Artificial Sequence
  chemically synthesized
agtgtgtaattatctgggaagt

SEQ ID NO: 808421 - DNA, 22 bp, Artificial Sequence
  chemically synthesized
aagtgtgtaattatctgggaag

SEQ ID NO: 808422 - DNA, 22 bp, Artificial Sequence
  chemically synthesized
taagtgtgtaattatctgggaa

SEQ ID NO: 808423 - DNA, 22 bp, Artificial Sequence
  chemically synthesized
acactacttcccagataattac

SEQ ID NO: 808424 - DNA, 22 bp, Artificial Sequence
  chemically synthesized
cttcccagataattacacactt

SEQ ID NO: 808425 - DNA, 22 bp, Artificial Sequence
  chemically synthesized
cccagataattacacacttaaa

SEQ ID NO: 808426 - DNA, 22 bp, Artificial Sequence
  chemically synthesized
ccagataattacacacttaaaa

SEQ ID NO: 808427 - DNA, 22 bp, Artificial Sequence
  chemically synthesized
taggtcaacaccaattttaagt

SEQ ID NO: 808428 - DNA, 22 bp, Artificial Sequence
  chemically synthesized
cacacttaaaattggtgttgac

SEQ ID NO: 808429 - DNA, 22 bp, Artificial Sequence
  chemically synthesized
aaaattggtgttgacctatagt

SEQ ID NO: 808430 - DNA, 22 bp, Artificial Sequence
  chemically synthesized
aaattggtgttgacctatagtt

SEQ ID NO: 808431 - DNA, 22 bp, Artificial Sequence
  chemically synthesized
gaacagaaatgtgtccaactat

SEQ ID NO: 808432 - DNA, 22 bp, Artificial Sequence
  chemically synthesized
agaacagaaatgtgtccaacta

SEQ ID NO: 808433 - DNA, 22 bp, Artificial Sequence
  chemically synthesized
gtgttgacctatagttggacac

SEQ ID NO: 808434 - DNA, 22 bp, Artificial Sequence
  chemically synthesized
tttagaacagaaatgtgtccaa

SEQ ID NO: 808435 - DNA, 22 bp, Artificial Sequence
  chemically synthesized
atttagaacagaaatgtgtcca

SEQ ID NO: 808436 - DNA, 22 bp, Artificial Sequence
  chemically synthesized
acctatagttggacacatttct

SEQ ID NO: 808437 - DNA, 22 bp, Artificial Sequence
  chemically synthesized
agaatttatttagaacagaaat

SEQ ID NO: 808438 - DNA, 22 bp, Artificial Sequence
  chemically synthesized
tagttggacacatttctgttct

SEQ ID NO: 808439 - DNA, 22 bp, Artificial Sequence
  chemically synthesized
gacacatttctgttctaaataa

SEQ ID NO: 808440 - DNA, 22 bp, Artificial Sequence
  chemically synthesized
tacaaatcattgagaatttatt

SEQ ID NO: 808441 - DNA, 22 bp, Artificial Sequence
  chemically synthesized
ctgttctaaataaattctcaat

SEQ ID NO: 808442 - DNA, 22 bp, Artificial Sequence
  chemically synthesized
tgttctaaataaattctcaatg

SEQ ID NO: 808443 - DNA, 22 bp, Artificial Sequence
  chemically synthesized
gcattatacaaatcattgagaa

SEQ ID NO: 808444 - DNA, 22 bp, Artificial Sequence
  chemically synthesized
ttctaaataaattctcaatgat

SEQ ID NO: 808445 - DNA, 22 bp, Artificial Sequence
  chemically synthesized
taaataaattctcaatgatttg

SEQ ID NO: 808446 - DNA, 22 bp, Artificial Sequence
  chemically synthesized
aataaattctcaatgatttgta

SEQ ID NO: 808447 - DNA, 22 bp, Artificial Sequence
  chemically synthesized
aaaattcgcattatacaaatca

SEQ ID NO: 808448 - DNA, 22 bp, Artificial Sequence
  chemically synthesized
aaaaattcgcattatacaaatc

SEQ ID NO: 808449 - DNA, 22 bp, Artificial Sequence
  chemically synthesized
tcaatgatttgtataatgcgaa

SEQ ID NO: 808450 - DNA, 22 bp, Artificial Sequence
  chemically synthesized
aatgatttgtataatgcgaatt

SEQ ID NO: 808451 - DNA, 22 bp, Artificial Sequence
  chemically synthesized
gtataatgcgaatttttaagtt

SEQ ID NO: 808452 - DNA, 22 bp, Artificial Sequence
  chemically synthesized
tataatgcgaatttttaagttg

SEQ ID NO: 808453 - DNA, 22 bp, Artificial Sequence
  chemically synthesized
caagtaaccaaagccaacttaa

SEQ ID NO: 808454 - DNA, 22 bp, Artificial Sequence
  chemically synthesized
tcactgcaagtaaccaaagcca

SEQ ID NO: 808455 - DNA, 22 bp, Artificial Sequence
  chemically synthesized
atcactgcaagtaaccaaagcc

SEQ ID NO: 808456 - DNA, 22 bp, Artificial Sequence
  chemically synthesized
ttaagttggctttggttacttg

SEQ ID NO: 808457 - DNA, 22 bp, Artificial Sequence
  chemically synthesized
taagttggctttggttacttgc

SEQ ID NO: 808458 - DNA, 22 bp, Artificial Sequence
  chemically synthesized
aagttggctttggttacttgca

SEQ ID NO: 808459 - DNA, 22 bp, Artificial Sequence
  chemically synthesized
agttggctttggttacttgcag

SEQ ID NO: 808460 - DNA, 22 bp, Artificial Sequence
  chemically synthesized
aagagtttatcactgcaagtaa

SEQ ID NO: 808461 - DNA, 22 bp, Artificial Sequence
  chemically synthesized
aaagagtttatcactgcaagta

SEQ ID NO: 808462 - DNA, 22 bp, Artificial Sequence
  chemically synthesized
taaagagtttatcactgcaagt

SEQ ID NO: 808463 - DNA, 22 bp, Artificial Sequence
  chemically synthesized
gctttggttacttgcagtgata

SEQ ID NO: 808464 - DNA, 22 bp, Artificial Sequence
  chemically synthesized
tggttacttgcagtgataaact

SEQ ID NO: 808465 - DNA, 22 bp, Artificial Sequence
  chemically synthesized
ggttacttgcagtgataaactc

SEQ ID NO: 808466 - DNA, 22 bp, Artificial Sequence
  chemically synthesized
gttacttgcagtgataaactct

SEQ ID NO: 808467 - DNA, 22 bp, Artificial Sequence
  chemically synthesized
cttgcagtgataaactctttaa

SEQ ID NO: 808468 - DNA, 22 bp, Artificial Sequence
  chemically synthesized
ggaaatatatctttaaagagtt

SEQ ID NO: 808469 - DNA, 22 bp, Artificial Sequence
  chemically synthesized
gcagtgataaactctttaaaga

SEQ ID NO: 808470 - DNA, 22 bp, Artificial Sequence
  chemically synthesized
cagtgataaactctttaaagat

SEQ ID NO: 808471 - DNA, 22 bp, Artificial Sequence
  chemically synthesized
tcaacattaggaaatatatctt

SEQ ID NO: 808472 - DNA, 22 bp, Artificial Sequence
  chemically synthesized
gtctatcaacattaggaaatat

SEQ ID NO: 808473 - DNA, 22 bp, Artificial Sequence
  chemically synthesized
agtctatcaacattaggaaata

SEQ ID NO: 808474 - DNA, 22 bp, Artificial Sequence
  chemically synthesized
tttaaagatatatttcctaatg

SEQ ID NO: 808475 - DNA, 22 bp, Artificial Sequence
  chemically synthesized
cttagtctatcaacattaggaa

SEQ ID NO: 808476 - DNA, 22 bp, Artificial Sequence
  chemically synthesized
taaagatatatttcctaatgtt

SEQ ID NO: 808477 - DNA, 22 bp, Artificial Sequence
  chemically synthesized
aaagatatatttcctaatgttg

SEQ ID NO: 808478 - DNA, 22 bp, Artificial Sequence
  chemically synthesized
aagatatatttcctaatgttga

SEQ ID NO: 808479 - DNA, 22 bp, Artificial Sequence
  chemically synthesized
cctaatgttgatagactaagca

SEQ ID NO: 808480 - DNA, 22 bp, Artificial Sequence
  chemically synthesized
ctaatgttgatagactaagcag

SEQ ID NO: 808481 - DNA, 22 bp, Artificial Sequence
  chemically synthesized
ggagagaagaaaagctgcttag

SEQ ID NO: 808482 - DNA, 22 bp, Artificial Sequence
  chemically synthesized
atgttgatagactaagcagctt

SEQ ID NO: 808483 - DNA, 22 bp, Artificial Sequence
  chemically synthesized
aggagagaagaaaagctgctta

SEQ ID NO: 808484 - DNA, 22 bp, Artificial Sequence
  chemically synthesized
taggagagaagaaaagctgctt

SEQ ID NO: 808485 - DNA, 22 bp, Artificial Sequence
  chemically synthesized
ttaggagagaagaaaagctgct

SEQ ID NO: 808486 - DNA, 22 bp, Artificial Sequence
  chemically synthesized
atagactaagcagcttttcttc

SEQ ID NO: 808487 - DNA, 22 bp, Artificial Sequence
  chemically synthesized
aacaaatccttttaggagagaa

SEQ ID NO: 808488 - DNA, 22 bp, Artificial Sequence
  chemically synthesized
agcagcttttcttctctcctaa

SEQ ID NO: 808489 - DNA, 22 bp, Artificial Sequence
  chemically synthesized
aaacaaatccttttaggagaga

SEQ ID NO: 808490 - DNA, 22 bp, Artificial Sequence
  chemically synthesized
taaacaaatccttttaggagag

SEQ ID NO: 808491 - DNA, 22 bp, Artificial Sequence
  chemically synthesized
ttttaaacaaatccttttagga

SEQ ID NO: 808492 - DNA, 22 bp, Artificial Sequence
  chemically synthesized
ttcttctctcctaaaaggattt

SEQ ID NO: 808493 - DNA, 22 bp, Artificial Sequence
  chemically synthesized
tcttctctcctaaaaggatttg

SEQ ID NO: 808494 - DNA, 22 bp, Artificial Sequence
  chemically synthesized
tactattttaaacaaatccttt

SEQ ID NO: 808495 - DNA, 22 bp, Artificial Sequence
  chemically synthesized
cttctctcctaaaaggatttgt

SEQ ID NO: 808496 - DNA, 22 bp, Artificial Sequence
  chemically synthesized
atactattttaaacaaatcctt

SEQ ID NO: 808497 - DNA, 22 bp, Artificial Sequence
  chemically synthesized
ttctctcctaaaaggatttgtt

SEQ ID NO: 808498 - DNA, 22 bp, Artificial Sequence
  chemically synthesized
tatactattttaaacaaatcct

SEQ ID NO: 808499 - DNA, 22 bp, Artificial Sequence
  chemically synthesized
ttatactattttaaacaaatcc

SEQ ID NO: 808500 - DNA, 22 bp, Artificial Sequence
  chemically synthesized
ctctcctaaaaggatttgttta

SEQ ID NO: 808501 - DNA, 22 bp, Artificial Sequence
  chemically synthesized
tctcctaaaaggatttgtttaa

SEQ ID NO: 808502 - DNA, 22 bp, Artificial Sequence
  chemically synthesized
tcctaaaaggatttgtttaaaa

SEQ ID NO: 808503 - DNA, 22 bp, Artificial Sequence
  chemically synthesized
gtttttatactattttaaacaa

SEQ ID NO: 808504 - DNA, 22 bp, Artificial Sequence
  chemically synthesized
ctaaaaggatttgtttaaaata

SEQ ID NO: 808505 - DNA, 22 bp, Artificial Sequence
  chemically synthesized
aaaggatttgtttaaaatagta

SEQ ID NO: 808506 - DNA, 22 bp, Artificial Sequence
  chemically synthesized
aattggtttttatactatttta

SEQ ID NO: 808507 - DNA, 22 bp, Artificial Sequence
  chemically synthesized
aaattggtttttatactatttt

SEQ ID NO: 808508 - DNA, 22 bp, Artificial Sequence
  chemically synthesized
taaattggtttttatactattt

SEQ ID NO: 808509 - DNA, 22 bp, Artificial Sequence
  chemically synthesized
ttaaattggtttttatactatt

SEQ ID NO: 808510 - DNA, 22 bp, Artificial Sequence
  chemically synthesized
atcttttaaattggtttttata

SEQ ID NO: 808511 - DNA, 22 bp, Artificial Sequence
  chemically synthesized
gtttaaaatagtataaaaacca

SEQ ID NO: 808512 - DNA, 22 bp, Artificial Sequence
  chemically synthesized
tttaaaatagtataaaaaccaa

SEQ ID NO: 808513 - DNA, 22 bp, Artificial Sequence
  chemically synthesized
aaaatagtataaaaaccaattt

SEQ ID NO: 808514 - DNA, 22 bp, Artificial Sequence
  chemically synthesized
ggctcatcttttaaattggttt

SEQ ID NO: 808515 - DNA, 22 bp, Artificial Sequence
  chemically synthesized
aaatagtataaaaaccaattta

SEQ ID NO: 808516 - DNA, 22 bp, Artificial Sequence
  chemically synthesized
aggctcatcttttaaattggtt

SEQ ID NO: 808517 - DNA, 22 bp, Artificial Sequence
  chemically synthesized
taagagatgatcttaggctcat

SEQ ID NO: 808518 - DNA, 22 bp, Artificial Sequence
  chemically synthesized
gtaagagatgatcttaggctca

SEQ ID NO: 808519 - DNA, 22 bp, Artificial Sequence
  chemically synthesized
aaaagatgagcctaagatcatc

SEQ ID NO: 808520 - DNA, 22 bp, Artificial Sequence
  chemically synthesized
aaagatgagcctaagatcatct

SEQ ID NO: 808521 - DNA, 22 bp, Artificial Sequence
  chemically synthesized
tcaggtttgtaagagatgatct

SEQ ID NO: 808522 - DNA, 22 bp, Artificial Sequence
  chemically synthesized
atcaggtttgtaagagatgatc

SEQ ID NO: 808523 - DNA, 22 bp, Artificial Sequence
  chemically synthesized
cacagtcttatcaggtttgtaa

SEQ ID NO: 808524 - DNA, 22 bp, Artificial Sequence
  chemically synthesized
agatcatctcttacaaacctga

SEQ ID NO: 808525 - DNA, 22 bp, Artificial Sequence
  chemically synthesized
ttacaaacctgataagactgtg

SEQ ID NO: 808526 - DNA, 22 bp, Artificial Sequence
  chemically synthesized
acaaacctgataagactgtgca

SEQ ID NO: 808527 - DNA, 22 bp, Artificial Sequence
  chemically synthesized
caaacctgataagactgtgcag

SEQ ID NO: 808528 - DNA, 22 bp, Artificial Sequence
  chemically synthesized
tggatgaggatatatataactg

SEQ ID NO: 808529 - DNA, 22 bp, Artificial Sequence
  chemically synthesized
ataagactgtgcagttatatat

SEQ ID NO: 808530 - DNA, 22 bp, Artificial Sequence
  chemically synthesized
ttgtggatgaggatatatataa

SEQ ID NO: 808531 - DNA, 22 bp, Artificial Sequence
  chemically synthesized
agttattgtggatgaggatata

SEQ ID NO: 808532 - DNA, 22 bp, Artificial Sequence
  chemically synthesized
tgcagttatatatatcctcatc

SEQ ID NO: 808533 - DNA, 22 bp, Artificial Sequence
  chemically synthesized
taagttattgtggatgaggata

SEQ ID NO: 808534 - DNA, 22 bp, Artificial Sequence
  chemically synthesized
tctaagttattgtggatgagga

SEQ ID NO: 808535 - DNA, 22 bp, Artificial Sequence
  chemically synthesized
ctctaagttattgtggatgagg

SEQ ID NO: 808536 - DNA, 22 bp, Artificial Sequence
  chemically synthesized
tctctaagttattgtggatgag

SEQ ID NO: 808537 - DNA, 22 bp, Artificial Sequence
  chemically synthesized
ttctctaagttattgtggatga

SEQ ID NO: 808538 - DNA, 22 bp, Artificial Sequence
  chemically synthesized
tatatatcctcatccacaataa

SEQ ID NO: 808539 - DNA, 22 bp, Artificial Sequence
  chemically synthesized
tttttctctaagttattgtgga

SEQ ID NO: 808540 - DNA, 22 bp, Artificial Sequence
  chemically synthesized
tgtttttctctaagttattgtg

SEQ ID NO: 808541 - DNA, 22 bp, Artificial Sequence
  chemically synthesized
ttctgtttttctctaagttatt

SEQ ID NO: 808542 - DNA, 22 bp, Artificial Sequence
  chemically synthesized
gttctgtttttctctaagttat

SEQ ID NO: 808543 - DNA, 22 bp, Artificial Sequence
  chemically synthesized
tgttctgtttttctctaagtta

SEQ ID NO: 808544 - DNA, 22 bp, Artificial Sequence
  chemically synthesized
ttttgttctgtttttctctaag

SEQ ID NO: 808545 - DNA, 22 bp, Artificial Sequence
  chemically synthesized
atccacaataacttagagaaaa

SEQ ID NO: 808546 - DNA, 22 bp, Artificial Sequence
  chemically synthesized
gttgttttgttctgtttttctc

SEQ ID NO: 808547 - DNA, 22 bp, Artificial Sequence
  chemically synthesized
cagttagttgttttgttctgtt

SEQ ID NO: 808548 - DNA, 22 bp, Artificial Sequence
  chemically synthesized
agagaaaaacagaacaaaacaa

SEQ ID NO: 808549 - DNA, 22 bp, Artificial Sequence
  chemically synthesized
gagaaaaacagaacaaaacaac

SEQ ID NO: 808550 - DNA, 22 bp, Artificial Sequence
  chemically synthesized
acaagctacagttagttgtttt

SEQ ID NO: 808551 - DNA, 22 bp, Artificial Sequence
  chemically synthesized
tgtatcaacaactaacaagcta

SEQ ID NO: 808552 - DNA, 22 bp, Artificial Sequence
  chemically synthesized
aatattatgtatcaacaactaa

SEQ ID NO: 808553 - DNA, 22 bp, Artificial Sequence
  chemically synthesized
actgtagcttgttagttgttga

SEQ ID NO: 808554 - DNA, 22 bp, Artificial Sequence
  chemically synthesized
tgaatattatgtatcaacaact

SEQ ID NO: 808555 - DNA, 22 bp, Artificial Sequence
  chemically synthesized
ctgaatattatgtatcaacaac

SEQ ID NO: 808556 - DNA, 22 bp, Artificial Sequence
  chemically synthesized
tagcttgttagttgttgataca

SEQ ID NO: 808557 - DNA, 22 bp, Artificial Sequence
  chemically synthesized
tcttctgaatattatgtatcaa

SEQ ID NO: 808558 - DNA, 22 bp, Artificial Sequence
  chemically synthesized
ctgtcttctgaatattatgtat

SEQ ID NO: 808559 - DNA, 22 bp, Artificial Sequence
  chemically synthesized
gttagttgttgatacataatat

SEQ ID NO: 808560 - DNA, 22 bp, Artificial Sequence
  chemically synthesized
gctgtcttctgaatattatgta

SEQ ID NO: 808561 - DNA, 22 bp, Artificial Sequence
  chemically synthesized
ttagttgttgatacataatatt

SEQ ID NO: 808562 - DNA, 22 bp, Artificial Sequence
  chemically synthesized
tgctgtcttctgaatattatgt

SEQ ID NO: 808563 - DNA, 22 bp, Artificial Sequence
  chemically synthesized
gttgttgatacataatattcag

SEQ ID NO: 808564 - DNA, 22 bp, Artificial Sequence
  chemically synthesized
ctttgctgtcttctgaatatta

SEQ ID NO: 808565 - DNA, 22 bp, Artificial Sequence
  chemically synthesized
ttgatacataatattcagaaga

SEQ ID NO: 808566 - DNA, 22 bp, Artificial Sequence
  chemically synthesized
cctgctttgctgtcttctgaat

SEQ ID NO: 808567 - DNA, 22 bp, Artificial Sequence
  chemically synthesized
atacataatattcagaagacag

SEQ ID NO: 808568 - DNA, 22 bp, Artificial Sequence
  chemically synthesized
aacctgcctgctttgctgtctt

SEQ ID NO: 808569 - DNA, 22 bp, Artificial Sequence
  chemically synthesized
gaaaactgaacctgcctgcttt

SEQ ID NO: 808570 - DNA, 22 bp, Artificial Sequence
  chemically synthesized
agaagacagcaaagcaggcagg

SEQ ID NO: 808571 - DNA, 22 bp, Artificial Sequence
  chemically synthesized
atattagaaaactgaacctgcc

SEQ ID NO: 808572 - DNA, 22 bp, Artificial Sequence
  chemically synthesized
gatattagaaaactgaacctgc

SEQ ID NO: 808573 - DNA, 22 bp, Artificial Sequence
  chemically synthesized
ccatttgatattagaaaactga

SEQ ID NO: 808574 - DNA, 22 bp, Artificial Sequence
  chemically synthesized
gccatttgatattagaaaactg

SEQ ID NO: 808575 - DNA, 22 bp, Artificial Sequence
  chemically synthesized
tgtgtttgccatttgatattag

SEQ ID NO: 808576 - DNA, 22 bp, Artificial Sequence
  chemically synthesized
ttgtgtgtttgccatttgatat

SEQ ID NO: 808577 - DNA, 22 bp, Artificial Sequence
  chemically synthesized
agttttctaatatcaaatggca

SEQ ID NO: 808578 - DNA, 22 bp, Artificial Sequence
  chemically synthesized
tctaatatcaaatggcaaacac

SEQ ID NO: 808579 - DNA, 22 bp, Artificial Sequence
  chemically synthesized
ctaatatcaaatggcaaacaca

SEQ ID NO: 808580 - DNA, 22 bp, Artificial Sequence
  chemically synthesized
taatatcaaatggcaaacacac

SEQ ID NO: 808581 - DNA, 22 bp, Artificial Sequence
  chemically synthesized
aagtgaatctgttgtgtgtttg

SEQ ID NO: 808582 - DNA, 22 bp, Artificial Sequence
  chemically synthesized
atatcaaatggcaaacacacaa

SEQ ID NO: 808583 - DNA, 22 bp, Artificial Sequence
  chemically synthesized
aaagtgaatctgttgtgtgttt

SEQ ID NO: 808584 - DNA, 22 bp, Artificial Sequence
  chemically synthesized
taaagtgaatctgttgtgtgtt

SEQ ID NO: 808585 - DNA, 22 bp, Artificial Sequence
  chemically synthesized
ttaaagtgaatctgttgtgtgt

SEQ ID NO: 808586 - DNA, 22 bp, Artificial Sequence
  chemically synthesized
ttttaaagtgaatctgttgtgt

SEQ ID NO: 808587 - DNA, 22 bp, Artificial Sequence
  chemically synthesized
cttttaaagtgaatctgttgtg

SEQ ID NO: 808588 - DNA, 22 bp, Artificial Sequence
  chemically synthesized
tcttttaaagtgaatctgttgt

SEQ ID NO: 808589 - DNA, 22 bp, Artificial Sequence
  chemically synthesized
tttcttttaaagtgaatctgtt

SEQ ID NO: 808590 - DNA, 22 bp, Artificial Sequence
  chemically synthesized
ctttcttttaaagtgaatctgt

SEQ ID NO: 808591 - DNA, 22 bp, Artificial Sequence
  chemically synthesized
gccacttctttcttttaaagtg

SEQ ID NO: 808592 - DNA, 22 bp, Artificial Sequence
  chemically synthesized
agccacttctttcttttaaagt

SEQ ID NO: 808593 - DNA, 22 bp, Artificial Sequence
  chemically synthesized
tagccacttctttcttttaaag

SEQ ID NO: 808594 - DNA, 22 bp, Artificial Sequence
  chemically synthesized
ttagccacttctttcttttaaa

SEQ ID NO: 808595 - DNA, 22 bp, Artificial Sequence
  chemically synthesized
atatgtttttagccacttcttt

SEQ ID NO: 808596 - DNA, 22 bp, Artificial Sequence
  chemically synthesized
actttaaaagaaagaagtggct

SEQ ID NO: 808597 - DNA, 22 bp, Artificial Sequence
  chemically synthesized
ttgatatgtttttagccacttc

SEQ ID NO: 808598 - DNA, 22 bp, Artificial Sequence
  chemically synthesized
taaaagaaagaagtggctaaaa

SEQ ID NO: 808599 - DNA, 22 bp, Artificial Sequence
  chemically synthesized
aaaagaaagaagtggctaaaaa

SEQ ID NO: 808600 - DNA, 22 bp, Artificial Sequence
  chemically synthesized
aaagaaagaagtggctaaaaac

SEQ ID NO: 808601 - DNA, 22 bp, Artificial Sequence
  chemically synthesized
atctgttgatatgtttttagcc

SEQ ID NO: 808602 - DNA, 22 bp, Artificial Sequence
  chemically synthesized
catctgttgatatgtttttagc

SEQ ID NO: 808603 - DNA, 22 bp, Artificial Sequence
  chemically synthesized
tttcatctgttgatatgttttt

SEQ ID NO: 808604 - DNA, 22 bp, Artificial Sequence
  chemically synthesized
atttcatctgttgatatgtttt

SEQ ID NO: 808605 - DNA, 22 bp, Artificial Sequence
  chemically synthesized
taagtttatttcatctgttgat

SEQ ID NO: 808606 - DNA, 22 bp, Artificial Sequence
  chemically synthesized
ctataagtttatttcatctgtt

SEQ ID NO: 808607 - DNA, 22 bp, Artificial Sequence
  chemically synthesized
aaaacatatcaacagatgaaat

SEQ ID NO: 808608 - DNA, 22 bp, Artificial Sequence
  chemically synthesized
tactataagtttatttcatctg

SEQ ID NO: 808609 - DNA, 22 bp, Artificial Sequence
  chemically synthesized
acaggactctactataagttta

SEQ ID NO: 808610 - DNA, 22 bp, Artificial Sequence
  chemically synthesized
cactgacaggactctactataa

SEQ ID NO: 808611 - DNA, 22 bp, Artificial Sequence
  chemically synthesized
caaattccactgacaggactct

SEQ ID NO: 808612 - DNA, 22 bp, Artificial Sequence
  chemically synthesized
ccaaattccactgacaggactc

SEQ ID NO: 808613 - DNA, 22 bp, Artificial Sequence
  chemically synthesized
atagtagagtcctgtcagtgga

SEQ ID NO: 808614 - DNA, 22 bp, Artificial Sequence
  chemically synthesized
gtatttccaaattccactgaca

SEQ ID NO: 808615 - DNA, 22 bp, Artificial Sequence
  chemically synthesized
tagtagagtcctgtcagtggaa

SEQ ID NO: 808616 - DNA, 22 bp, Artificial Sequence
  chemically synthesized
ttcgtatttccaaattccactg

SEQ ID NO: 808617 - DNA, 22 bp, Artificial Sequence
  chemically synthesized
tgaaattgttcgtatttccaaa

SEQ ID NO: 808618 - DNA, 22 bp, Artificial Sequence
  chemically synthesized
tcagtggaatttggaaatacga

SEQ ID NO: 808619 - DNA, 22 bp, Artificial Sequence
  chemically synthesized
gatcagcggttatgaaattgtt

SEQ ID NO: 808620 - DNA, 22 bp, Artificial Sequence
  chemically synthesized
agatcagcggttatgaaattgt

SEQ ID NO: 808621 - DNA, 22 bp, Artificial Sequence
  chemically synthesized
ggaaatacgaacaatttcataa

SEQ ID NO: 808622 - DNA, 22 bp, Artificial Sequence
  chemically synthesized
gaaatacgaacaatttcataac

SEQ ID NO: 808623 - DNA, 22 bp, Artificial Sequence
  chemically synthesized
agaatttagatcagcggttatg

SEQ ID NO: 808624 - DNA, 22 bp, Artificial Sequence
  chemically synthesized
cataaccgctgatctaaattct

SEQ ID NO: 808625 - DNA, 22 bp, Artificial Sequence
  chemically synthesized
ataaccgctgatctaaattctg

SEQ ID NO: 808626 - DNA, 22 bp, Artificial Sequence
  chemically synthesized
gatatcataattcagaatttag

SEQ ID NO: 808627 - DNA, 22 bp, Artificial Sequence
  chemically synthesized
cgatatcataattcagaattta

SEQ ID NO: 808628 - DNA, 22 bp, Artificial Sequence
  chemically synthesized
atctaaattctgaattatgata

SEQ ID NO: 808629 - DNA, 22 bp, Artificial Sequence
  chemically synthesized
aattctgaattatgatatcgaa

SEQ ID NO: 808630 - DNA, 22 bp, Artificial Sequence
  chemically synthesized
tgaattatgatatcgaaatatt

SEQ ID NO: 808631 - DNA, 22 bp, Artificial Sequence
  chemically synthesized
aattatgatatcgaaatatttg

SEQ ID NO: 808632 - DNA, 22 bp, Artificial Sequence
  chemically synthesized
ggtaataaaagtcacaaatatt

SEQ ID NO: 808633 - DNA, 22 bp, Artificial Sequence
  chemically synthesized
tgatatcgaaatatttgtgact

SEQ ID NO: 808634 - DNA, 22 bp, Artificial Sequence
  chemically synthesized
agtaagagactaggtaataaaa

SEQ ID NO: 808635 - DNA, 22 bp, Artificial Sequence
  chemically synthesized
gtgacttttattacctagtctc

SEQ ID NO: 808636 - DNA, 22 bp, Artificial Sequence
  chemically synthesized
tgacttttattacctagtctct

SEQ ID NO: 808637 - DNA, 22 bp, Artificial Sequence
  chemically synthesized
ttattacctagtctcttactca

SEQ ID NO: 808638 - DNA, 22 bp, Artificial Sequence
  chemically synthesized
tattacctagtctcttactcag

SEQ ID NO: 808639 - DNA, 22 bp, Artificial Sequence
  chemically synthesized
attacctagtctcttactcagt

SEQ ID NO: 808640 - DNA, 22 bp, Artificial Sequence
  chemically synthesized
ttacctagtctcttactcagta

SEQ ID NO: 808641 - DNA, 22 bp, Artificial Sequence
  chemically synthesized
accacaagagagtactgagtaa

SEQ ID NO: 808642 - DNA, 22 bp, Artificial Sequence
  chemically synthesized
cctagtctcttactcagtactc

SEQ ID NO: 808643 - DNA, 22 bp, Artificial Sequence
  chemically synthesized
ttaaccacaagagagtactgag

SEQ ID NO: 808644 - DNA, 22 bp, Artificial Sequence
  chemically synthesized
gtctcttactcagtactctctt

SEQ ID NO: 808645 - DNA, 22 bp, Artificial Sequence
  chemically synthesized
ttactcagtactctcttgtggt

SEQ ID NO: 808646 - DNA, 22 bp, Artificial Sequence
  chemically synthesized
actcagtactctcttgtggtta

SEQ ID NO: 808647 - DNA, 22 bp, Artificial Sequence
  chemically synthesized
ctcagtactctcttgtggttaa

SEQ ID NO: 808648 - DNA, 22 bp, Artificial Sequence
  chemically synthesized
aaatgtgtattattaaccacaa

SEQ ID NO: 808649 - DNA, 22 bp, Artificial Sequence
  chemically synthesized
caaatgtgtattattaaccaca

SEQ ID NO: 808650 - DNA, 22 bp, Artificial Sequence
  chemically synthesized
tcaaatgtgtattattaaccac

SEQ ID NO: 808651 - DNA, 22 bp, Artificial Sequence
  chemically synthesized
agtactctcttgtggttaataa

SEQ ID NO: 808652 - DNA, 22 bp, Artificial Sequence
  chemically synthesized
tcttgtggttaataatacacat

SEQ ID NO: 808653 - DNA, 22 bp, Artificial Sequence
  chemically synthesized
ttgtggttaataatacacattt

SEQ ID NO: 808654 - DNA, 22 bp, Artificial Sequence
  chemically synthesized
aaagggccctttcaaatgtgta

SEQ ID NO: 808655 - DNA, 22 bp, Artificial Sequence
  chemically synthesized
gtggttaataatacacatttga

SEQ ID NO: 808656 - DNA, 22 bp, Artificial Sequence
  chemically synthesized
tggttaataatacacatttgaa

SEQ ID NO: 808657 - DNA, 22 bp, Artificial Sequence
  chemically synthesized
ctaaaagggccctttcaaatgt

SEQ ID NO: 808658 - DNA, 22 bp, Artificial Sequence
  chemically synthesized
gctaaaagggccctttcaaatg

SEQ ID NO: 808659 - DNA, 22 bp, Artificial Sequence
  chemically synthesized
tgctaaaagggccctttcaaat

SEQ ID NO: 808660 - DNA, 22 bp, Artificial Sequence
  chemically synthesized
ataatacacatttgaaagggcc

SEQ ID NO: 808661 - DNA, 22 bp, Artificial Sequence
  chemically synthesized
atgtgctttgctaaaagggccc

SEQ ID NO: 808662 - DNA, 22 bp, Artificial Sequence
  chemically synthesized
ttcatgtgctttgctaaaaggg

SEQ ID NO: 808663 - DNA, 22 bp, Artificial Sequence
  chemically synthesized
gaaagggcccttttagcaaagc

SEQ ID NO: 808664 - DNA, 22 bp, Artificial Sequence
  chemically synthesized
aaagggcccttttagcaaagca

SEQ ID NO: 808665 - DNA, 22 bp, Artificial Sequence
  chemically synthesized
aaaagtgtctgttcatgtgctt

SEQ ID NO: 808666 - DNA, 22 bp, Artificial Sequence
  chemically synthesized
aaaaagtgtctgttcatgtgct

SEQ ID NO: 808667 - DNA, 22 bp, Artificial Sequence
  chemically synthesized
taaaaagtgtctgttcatgtgc

SEQ ID NO: 808668 - DNA, 22 bp, Artificial Sequence
  chemically synthesized
ttaaaaagtgtctgttcatgtg

SEQ ID NO: 808669 - DNA, 22 bp, Artificial Sequence
  chemically synthesized
ttttaaaaagtgtctgttcatg

SEQ ID NO: 808670 - DNA, 22 bp, Artificial Sequence
  chemically synthesized
ttagcaaagcacatgaacagac

SEQ ID NO: 808671 - DNA, 22 bp, Artificial Sequence
  chemically synthesized
cttttaaaaagtgtctgttcat

SEQ ID NO: 808672 - DNA, 22 bp, Artificial Sequence
  chemically synthesized
tagcaaagcacatgaacagaca

SEQ ID NO: 808673 - DNA, 22 bp, Artificial Sequence
  chemically synthesized
tcttttaaaaagtgtctgttca

SEQ ID NO: 808674 - DNA, 22 bp, Artificial Sequence
  chemically synthesized
agcaaagcacatgaacagacac

SEQ ID NO: 808675 - DNA, 22 bp, Artificial Sequence
  chemically synthesized
gcaaagcacatgaacagacact

SEQ ID NO: 808676 - DNA, 22 bp, Artificial Sequence
  chemically synthesized
gtcgcatgtatgttttctttta

SEQ ID NO: 808677 - DNA, 22 bp, Artificial Sequence
  chemically synthesized
ttggtcgcatgtatgttttctt

SEQ ID NO: 808678 - DNA, 22 bp, Artificial Sequence
  chemically synthesized
gttggtcgcatgtatgttttct

SEQ ID NO: 808679 - DNA, 22 bp, Artificial Sequence
  chemically synthesized
tttaaaagaaaacatacatgcg

SEQ ID NO: 808680 - DNA, 22 bp, Artificial Sequence
  chemically synthesized
ttaaaagaaaacatacatgcga

SEQ ID NO: 808681 - DNA, 22 bp, Artificial Sequence
  chemically synthesized
taaaagaaaacatacatgcgac

SEQ ID NO: 808682 - DNA, 22 bp, Artificial Sequence
  chemically synthesized
atatgcttgttggtcgcatgta

SEQ ID NO: 808683 - DNA, 22 bp, Artificial Sequence
  chemically synthesized
aaaagaaaacatacatgcgacc

SEQ ID NO: 808684 - DNA, 22 bp, Artificial Sequence
  chemically synthesized
catatgcttgttggtcgcatgt

SEQ ID NO: 808685 - DNA, 22 bp, Artificial Sequence
  chemically synthesized
aaagaaaacatacatgcgacca

SEQ ID NO: 808686 - DNA, 22 bp, Artificial Sequence
  chemically synthesized
tcatatgcttgttggtcgcatg

SEQ ID NO: 808687 - DNA, 22 bp, Artificial Sequence
  chemically synthesized
ttcatatgcttgttggtcgcat

SEQ ID NO: 808688 - DNA, 22 bp, Artificial Sequence
  chemically synthesized
tttcatatgcttgttggtcgca

SEQ ID NO: 808689 - DNA, 22 bp, Artificial Sequence
  chemically synthesized
ttttcatatgcttgttggtcgc

SEQ ID NO: 808690 - DNA, 22 bp, Artificial Sequence
  chemically synthesized
tttttcatatgcttgttggtcg

SEQ ID NO: 808691 - DNA, 22 bp, Artificial Sequence
  chemically synthesized
agctttttttcatatgcttgtt

SEQ ID NO: 808692 - DNA, 22 bp, Artificial Sequence
  chemically synthesized
caatgatcagtgatgttgagct

SEQ ID NO: 808693 - DNA, 22 bp, Artificial Sequence
  chemically synthesized
tccaatgatcagtgatgttgag

SEQ ID NO: 808694 - DNA, 22 bp, Artificial Sequence
  chemically synthesized
ctccaatgatcagtgatgttga

SEQ ID NO: 808695 - DNA, 22 bp, Artificial Sequence
  chemically synthesized
catttctccaatgatcagtgat

SEQ ID NO: 808696 - DNA, 22 bp, Artificial Sequence
  chemically synthesized
gcatttctccaatgatcagtga

SEQ ID NO: 808697 - DNA, 22 bp, Artificial Sequence
  chemically synthesized
atttgcatttctccaatgatca

SEQ ID NO: 808698 - DNA, 22 bp, Artificial Sequence
  chemically synthesized
gatttgcatttctccaatgatc

SEQ ID NO: 808699 - DNA, 22 bp, Artificial Sequence
  chemically synthesized
tgatttgcatttctccaatgat

SEQ ID NO: 808700 - DNA, 22 bp, Artificial Sequence
  chemically synthesized
aacatcactgatcattggagaa

SEQ ID NO: 808701 - DNA, 22 bp, Artificial Sequence
  chemically synthesized
tggttttgatttgcatttctcc

SEQ ID NO: 808702 - DNA, 22 bp, Artificial Sequence
  chemically synthesized
gtggttttgatttgcatttctc

SEQ ID NO: 808703 - DNA, 22 bp, Artificial Sequence
  chemically synthesized
cttgtggttttgatttgcattt

SEQ ID NO: 808704 - DNA, 22 bp, Artificial Sequence
  chemically synthesized
atcattggagaaatgcaaatca

SEQ ID NO: 808705 - DNA, 22 bp, Artificial Sequence
  chemically synthesized
gagaaatgcaaatcaaaaccac

SEQ ID NO: 808706 - DNA, 22 bp, Artificial Sequence
  chemically synthesized
gtatgtgatggtatctccttgt

SEQ ID NO: 808707 - DNA, 22 bp, Artificial Sequence
  chemically synthesized
actggtatgtgatggtatctcc

SEQ ID NO: 808708 - DNA, 22 bp, Artificial Sequence
  chemically synthesized
tgactggtatgtgatggtatct

SEQ ID NO: 808709 - DNA, 22 bp, Artificial Sequence
  chemically synthesized
gtgatagccattctgactggta

SEQ ID NO: 808710 - DNA, 22 bp, Artificial Sequence
  chemically synthesized
agtgatagccattctgactggt

SEQ ID NO: 808711 - DNA, 22 bp, Artificial Sequence
  chemically synthesized
tttagtgatagccattctgact

SEQ ID NO: 808712 - DNA, 22 bp, Artificial Sequence
  chemically synthesized
actatttagtgatagccattct

SEQ ID NO: 808713 - DNA, 22 bp, Artificial Sequence
  chemically synthesized
gactatttagtgatagccattc

SEQ ID NO: 808714 - DNA, 22 bp, Artificial Sequence
  chemically synthesized
tgactatttagtgatagccatt

SEQ ID NO: 808715 - DNA, 22 bp, Artificial Sequence
  chemically synthesized
ttgactatttagtgatagccat

SEQ ID NO: 808716 - DNA, 22 bp, Artificial Sequence
  chemically synthesized
tttttgactatttagtgatagc

SEQ ID NO: 808717 - DNA, 22 bp, Artificial Sequence
  chemically synthesized
ttatttttgactatttagtgat

SEQ ID NO: 808718 - DNA, 22 bp, Artificial Sequence
  chemically synthesized
cagaacctgttatttttgacta

SEQ ID NO: 808719 - DNA, 22 bp, Artificial Sequence
  chemically synthesized
tccagaacctgttatttttgac

SEQ ID NO: 808720 - DNA, 22 bp, Artificial Sequence
  chemically synthesized
ctccagaacctgttatttttga

SEQ ID NO: 808721 - DNA, 22 bp, Artificial Sequence
  chemically synthesized
tcactaaatagtcaaaaataac

SEQ ID NO: 808722 - DNA, 22 bp, Artificial Sequence
  chemically synthesized
tctccagaacctgttatttttg

SEQ ID NO: 808723 - DNA, 22 bp, Artificial Sequence
  chemically synthesized
ttctccagaacctgttattttt

SEQ ID NO: 808724 - DNA, 22 bp, Artificial Sequence
  chemically synthesized
tttctccagaacctgttatttt

SEQ ID NO: 808725 - DNA, 22 bp, Artificial Sequence
  chemically synthesized
aatagtcaaaaataacaggttc

SEQ ID NO: 808726 - DNA, 22 bp, Artificial Sequence
  chemically synthesized
taagcaatgctttttctccaga

SEQ ID NO: 808727 - DNA, 22 bp, Artificial Sequence
  chemically synthesized
ataagcaatgctttttctccag

SEQ ID NO: 808728 - DNA, 22 bp, Artificial Sequence
  chemically synthesized
tggagaaaaagcattgcttata

SEQ ID NO: 808729 - DNA, 22 bp, Artificial Sequence
  chemically synthesized
taaccaacagtttataagcaat

SEQ ID NO: 808730 - DNA, 22 bp, Artificial Sequence
  chemically synthesized
gagaaaaagcattgcttataaa

SEQ ID NO: 808731 - DNA, 22 bp, Artificial Sequence
  chemically synthesized
aaataacatacactataaccaa

SEQ ID NO: 808732 - DNA, 22 bp, Artificial Sequence
  chemically synthesized
cttataaactgttggttatagt

SEQ ID NO: 808733 - DNA, 22 bp, Artificial Sequence
  chemically synthesized
ataaactgttggttatagtgta

SEQ ID NO: 808734 - DNA, 22 bp, Artificial Sequence
  chemically synthesized
taaactgttggttatagtgtat

SEQ ID NO: 808735 - DNA, 22 bp, Artificial Sequence
  chemically synthesized
acaatgactgaaataacataca

SEQ ID NO: 808736 - DNA, 22 bp, Artificial Sequence
  chemically synthesized
cacaatgactgaaataacatac

SEQ ID NO: 808737 - DNA, 22 bp, Artificial Sequence
  chemically synthesized
ttggttatagtgtatgttattt

SEQ ID NO: 808738 - DNA, 22 bp, Artificial Sequence
  chemically synthesized
tcacaatgactgaaataacata

SEQ ID NO: 808739 - DNA, 22 bp, Artificial Sequence
  chemically synthesized
gttatagtgtatgttatttcag

SEQ ID NO: 808740 - DNA, 22 bp, Artificial Sequence
  chemically synthesized
gttttcacaatgactgaaataa

SEQ ID NO: 808741 - DNA, 22 bp, Artificial Sequence
  chemically synthesized
tagtgtatgttatttcagtcat

SEQ ID NO: 808742 - DNA, 22 bp, Artificial Sequence
  chemically synthesized
cacactggttttcacaatgact

SEQ ID NO: 808743 - DNA, 22 bp, Artificial Sequence
  chemically synthesized
tttcagtcattgtgaaaaccag

SEQ ID NO: 808744 - DNA, 22 bp, Artificial Sequence
  chemically synthesized
aagaatctccacactggttttc

SEQ ID NO: 808745 - DNA, 22 bp, Artificial Sequence
  chemically synthesized
cagtcattgtgaaaaccagtgt

SEQ ID NO: 808746 - DNA, 22 bp, Artificial Sequence
  chemically synthesized
tgaagaatctccacactggttt

SEQ ID NO: 808747 - DNA, 22 bp, Artificial Sequence
  chemically synthesized
agtcattgtgaaaaccagtgtg

SEQ ID NO: 808748 - DNA, 22 bp, Artificial Sequence
  chemically synthesized
tgaaaaccagtgtggagattct

SEQ ID NO: 808749 - DNA, 22 bp, Artificial Sequence
  chemically synthesized
catccatgatctctgaagaatc

SEQ ID NO: 808750 - DNA, 22 bp, Artificial Sequence
  chemically synthesized
cagctccatccatgatctctga

SEQ ID NO: 808751 - DNA, 22 bp, Artificial Sequence
  chemically synthesized
ttcagagatcatggatggagct

SEQ ID NO: 808752 - DNA, 22 bp, Artificial Sequence
  chemically synthesized
cagagatcatggatggagctgc

SEQ ID NO: 808753 - DNA, 22 bp, Artificial Sequence
  chemically synthesized
agagatcatggatggagctgca

SEQ ID NO: 808754 - DNA, 22 bp, Artificial Sequence
  chemically synthesized
aggacaatggcctgcagctcca

SEQ ID NO: 808755 - DNA, 22 bp, Artificial Sequence
  chemically synthesized
ctaaggacaatggcctgcagct

SEQ ID NO: 808756 - DNA, 22 bp, Artificial Sequence
  chemically synthesized
gctaaggacaatggcctgcagc

SEQ ID NO: 808757 - DNA, 22 bp, Artificial Sequence
  chemically synthesized
gtttgctaaggacaatggcctg

SEQ ID NO: 808758 - DNA, 22 bp, Artificial Sequence
  chemically synthesized
cattagtttgctaaggacaatg

SEQ ID NO: 808759 - DNA, 22 bp, Artificial Sequence
  chemically synthesized
ctgcattagtttgctaaggaca

SEQ ID NO: 808760 - DNA, 22 bp, Artificial Sequence
  chemically synthesized
ttcctgcattagtttgctaagg

SEQ ID NO: 808761 - DNA, 22 bp, Artificial Sequence
  chemically synthesized
caggccattgtccttagcaaac

SEQ ID NO: 808762 - DNA, 22 bp, Artificial Sequence
  chemically synthesized
tgttcctgcattagtttgctaa

SEQ ID NO: 808763 - DNA, 22 bp, Artificial Sequence
  chemically synthesized
ctgttcctgcattagtttgcta

SEQ ID NO: 808764 - DNA, 22 bp, Artificial Sequence
  chemically synthesized
tctgttcctgcattagtttgct

SEQ ID NO: 808765 - DNA, 22 bp, Artificial Sequence
  chemically synthesized
gttttctgttcctgcattagtt

SEQ ID NO: 808766 - DNA, 22 bp, Artificial Sequence
  chemically synthesized
ggttttctgttcctgcattagt

SEQ ID NO: 808767 - DNA, 22 bp, Artificial Sequence
  chemically synthesized
tccttagcaaactaatgcagga

SEQ ID NO: 808768 - DNA, 22 bp, Artificial Sequence
  chemically synthesized
agcaaactaatgcaggaacaga

SEQ ID NO: 808769 - DNA, 22 bp, Artificial Sequence
  chemically synthesized
gcaaactaatgcaggaacagaa

SEQ ID NO: 808770 - DNA, 22 bp, Artificial Sequence
  chemically synthesized
atgcaggaacagaaaaccaaat

SEQ ID NO: 808771 - DNA, 22 bp, Artificial Sequence
  chemically synthesized
ataagtgagaacatgcagtatt

SEQ ID NO: 808772 - DNA, 22 bp, Artificial Sequence
  chemically synthesized
ccactaataagtgagaacatgc

SEQ ID NO: 808773 - DNA, 22 bp, Artificial Sequence
  chemically synthesized
gctcccactaataagtgagaac

SEQ ID NO: 808774 - DNA, 22 bp, Artificial Sequence
  chemically synthesized
agctcccactaataagtgagaa

SEQ ID NO: 808775 - DNA, 22 bp, Artificial Sequence
  chemically synthesized
atcatttagctcccactaataa

SEQ ID NO: 808776 - DNA, 22 bp, Artificial Sequence
  chemically synthesized
catgttctcacttattagtggg

SEQ ID NO: 808777 - DNA, 22 bp, Artificial Sequence
  chemically synthesized
tcatcatttagctcccactaat

SEQ ID NO: 808778 - DNA, 22 bp, Artificial Sequence
  chemically synthesized
tcacttattagtgggagctaaa

SEQ ID NO: 808779 - DNA, 22 bp, Artificial Sequence
  chemically synthesized
acttattagtgggagctaaatg

SEQ ID NO: 808780 - DNA, 22 bp, Artificial Sequence
  chemically synthesized
attagtgggagctaaatgatga

SEQ ID NO: 808781 - DNA, 22 bp, Artificial Sequence
  chemically synthesized
ttagtgggagctaaatgatgag

SEQ ID NO: 808782 - DNA, 22 bp, Artificial Sequence
  chemically synthesized
tgtccatgtgttctcatcattt

SEQ ID NO: 808783 - DNA, 22 bp, Artificial Sequence
  chemically synthesized
tgtgtccatgtgttctcatcat

SEQ ID NO: 808784 - DNA, 22 bp, Artificial Sequence
  chemically synthesized
gtgggagctaaatgatgagaac

SEQ ID NO: 808785 - DNA, 22 bp, Artificial Sequence
  chemically synthesized
tctgtgtccatgtgttctcatc

SEQ ID NO: 808786 - DNA, 22 bp, Artificial Sequence
  chemically synthesized
ctctctgtgtccatgtgttctc

SEQ ID NO: 808787 - DNA, 22 bp, Artificial Sequence
  chemically synthesized
ttcctctctgtgtccatgtgtt

SEQ ID NO: 808788 - DNA, 22 bp, Artificial Sequence
  chemically synthesized
aatgatgagaacacatggacac

SEQ ID NO: 808789 - DNA, 22 bp, Artificial Sequence
  chemically synthesized
ttgttcctctctgtgtccatgt

SEQ ID NO: 808790 - DNA, 22 bp, Artificial Sequence
  chemically synthesized
cacgtctgttgttcctctctgt

SEQ ID NO: 808791 - DNA, 22 bp, Artificial Sequence
  chemically synthesized
ccacgtctgttgttcctctctg

SEQ ID NO: 808792 - DNA, 22 bp, Artificial Sequence
  chemically synthesized
cagtaggcttccacgtctgttg

SEQ ID NO: 808793 - DNA, 22 bp, Artificial Sequence
  chemically synthesized
cccactccagtaggcttccacg

SEQ ID NO: 808794 - DNA, 22 bp, Artificial Sequence
  chemically synthesized
ccaccctccccactccagtagg

SEQ ID NO: 808795 - DNA, 22 bp, Artificial Sequence
  chemically synthesized
ctcccaccctccccactccagt

SEQ ID NO: 808796 - DNA, 22 bp, Artificial Sequence
  chemically synthesized
cctcctcccaccctccccactc

SEQ ID NO: 808797 - DNA, 22 bp, Artificial Sequence
  chemically synthesized
tccctcctcccaccctccccac

SEQ ID NO: 808798 - DNA, 22 bp, Artificial Sequence
  chemically synthesized
atcctctccctcctcccaccct

SEQ ID NO: 808799 - DNA, 22 bp, Artificial Sequence
  chemically synthesized
ctggagtggggagggtgggagg

SEQ ID NO: 808800 - DNA, 22 bp, Artificial Sequence
  chemically synthesized
gatcctctccctcctcccaccc

SEQ ID NO: 808801 - DNA, 22 bp, Artificial Sequence
  chemically synthesized
ttgatcctctccctcctcccac

SEQ ID NO: 808802 - DNA, 22 bp, Artificial Sequence
  chemically synthesized
gagtggggagggtgggaggagg

SEQ ID NO: 808803 - DNA, 22 bp, Artificial Sequence
  chemically synthesized
cttgatcctctccctcctccca

SEQ ID NO: 808804 - DNA, 22 bp, Artificial Sequence
  chemically synthesized
tcttgatcctctccctcctccc

SEQ ID NO: 808805 - DNA, 22 bp, Artificial Sequence
  chemically synthesized
ttcttgatcctctccctcctcc

SEQ ID NO: 808806 - DNA, 22 bp, Artificial Sequence
  chemically synthesized
gatatttttcttgatcctctcc

SEQ ID NO: 808807 - DNA, 22 bp, Artificial Sequence
  chemically synthesized
agcgtagtacacattagatatt

SEQ ID NO: 808808 - DNA, 22 bp, Artificial Sequence
  chemically synthesized
cccaggtattaagcgtagtaca

SEQ ID NO: 808809 - DNA, 22 bp, Artificial Sequence
  chemically synthesized
ttacccaggtattaagcgtagt

SEQ ID NO: 808810 - DNA, 22 bp, Artificial Sequence
  chemically synthesized
gttacccaggtattaagcgtag

SEQ ID NO: 808811 - DNA, 22 bp, Artificial Sequence
  chemically synthesized
tgttacccaggtattaagcgta

SEQ ID NO: 808812 - DNA, 22 bp, Artificial Sequence
  chemically synthesized
ttttgttacccaggtattaagc

SEQ ID NO: 808813 - DNA, 22 bp, Artificial Sequence
  chemically synthesized
atgtgtactacgcttaatacct

SEQ ID NO: 808814 - DNA, 22 bp, Artificial Sequence
  chemically synthesized
taccgattattttgttacccag

SEQ ID NO: 808815 - DNA, 22 bp, Artificial Sequence
  chemically synthesized
cgcttaatacctgggtaacaaa

SEQ ID NO: 808816 - DNA, 22 bp, Artificial Sequence
  chemically synthesized
ttgtaccgattattttgttacc

SEQ ID NO: 808817 - DNA, 22 bp, Artificial Sequence
  chemically synthesized
gttgtaccgattattttgttac

SEQ ID NO: 808818 - DNA, 22 bp, Artificial Sequence
  chemically synthesized
aatacctgggtaacaaaataat

SEQ ID NO: 808819 - DNA, 22 bp, Artificial Sequence
  chemically synthesized
atacctgggtaacaaaataatc

SEQ ID NO: 808820 - DNA, 22 bp, Artificial Sequence
  chemically synthesized
ggtaacaaaataatcggtacaa

SEQ ID NO: 808821 - DNA, 22 bp, Artificial Sequence
  chemically synthesized
atgtcatgggggtttgttgtac

SEQ ID NO: 808822 - DNA, 22 bp, Artificial Sequence
  chemically synthesized
tataggtaaactcatgtcatgg

SEQ ID NO: 808823 - DNA, 22 bp, Artificial Sequence
  chemically synthesized
ttatataggtaaactcatgtca

SEQ ID NO: 808824 - DNA, 22 bp, Artificial Sequence
  chemically synthesized
gttatataggtaaactcatgtc

SEQ ID NO: 808825 - DNA, 22 bp, Artificial Sequence
  chemically synthesized
aggagcacgtgtgcaggtttgt

SEQ ID NO: 808826 - DNA, 22 bp, Artificial Sequence
  chemically synthesized
acctatataacaaacctgcaca

SEQ ID NO: 808827 - DNA, 22 bp, Artificial Sequence
  chemically synthesized
cctatataacaaacctgcacac

SEQ ID NO: 808828 - DNA, 22 bp, Artificial Sequence
  chemically synthesized
agttcaggagcacgtgtgcagg

SEQ ID NO: 808829 - DNA, 22 bp, Artificial Sequence
  chemically synthesized
aagttcaggagcacgtgtgcag

SEQ ID NO: 808830 - DNA, 22 bp, Artificial Sequence
  chemically synthesized
taagttcaggagcacgtgtgca

SEQ ID NO: 808831 - DNA, 22 bp, Artificial Sequence
  chemically synthesized
tataacaaacctgcacacgtgc

SEQ ID NO: 808832 - DNA, 22 bp, Artificial Sequence
  chemically synthesized
ttttaagttcaggagcacgtgt

SEQ ID NO: 808833 - DNA, 22 bp, Artificial Sequence
  chemically synthesized
attttaagttcaggagcacgtg

SEQ ID NO: 808834 - DNA, 22 bp, Artificial Sequence
  chemically synthesized
tattttaagttcaggagcacgt

SEQ ID NO: 808835 - DNA, 22 bp, Artificial Sequence
  chemically synthesized
ttattttaagttcaggagcacg

SEQ ID NO: 808836 - DNA, 22 bp, Artificial Sequence
  chemically synthesized
acttttattttaagttcaggag

SEQ ID NO: 808837 - DNA, 22 bp, Artificial Sequence
  chemically synthesized
aacttttattttaagttcagga

SEQ ID NO: 808838 - DNA, 22 bp, Artificial Sequence
  chemically synthesized
ttaacttttattttaagttcag

SEQ ID NO: 808839 - DNA, 22 bp, Artificial Sequence
  chemically synthesized
cacacgtgctcctgaacttaaa

SEQ ID NO: 808840 - DNA, 22 bp, Artificial Sequence
  chemically synthesized
cttaacttttattttaagttca

SEQ ID NO: 808841 - DNA, 22 bp, Artificial Sequence
  chemically synthesized
tcttaacttttattttaagttc

SEQ ID NO: 808842 - DNA, 22 bp, Artificial Sequence
  chemically synthesized
ttcttaacttttattttaagtt

SEQ ID NO: 808843 - DNA, 22 bp, Artificial Sequence
  chemically synthesized
tttcttaacttttattttaagt

SEQ ID NO: 808844 - DNA, 22 bp, Artificial Sequence
  chemically synthesized
ctgaacttaaaataaaagttaa

SEQ ID NO: 808845 - DNA, 22 bp, Artificial Sequence
  chemically synthesized
aacttaaaataaaagttaagaa

SEQ ID NO: 808846 - DNA, 22 bp, Artificial Sequence
  chemically synthesized
aatataaaatggctttttctta

SEQ ID NO: 808847 - DNA, 22 bp, Artificial Sequence
  chemically synthesized
aaaataaaagttaagaaaaagc

SEQ ID NO: 808848 - DNA, 22 bp, Artificial Sequence
  chemically synthesized
aaataaaagttaagaaaaagcc

SEQ ID NO: 808849 - DNA, 22 bp, Artificial Sequence
  chemically synthesized
agaaaaagccattttatattca

SEQ ID NO: 808850 - DNA, 22 bp, Artificial Sequence
  chemically synthesized
taacaatacatgttgaatataa

SEQ ID NO: 808851 - DNA, 22 bp, Artificial Sequence
  chemically synthesized
tatattcaacatgtattgttat

SEQ ID NO: 808852 - DNA, 22 bp, Artificial Sequence
  chemically synthesized
gtgtaaaatactataacaatac

SEQ ID NO: 808853 - DNA, 22 bp, Artificial Sequence
  chemically synthesized
atattcaacatgtattgttata

SEQ ID NO: 808854 - DNA, 22 bp, Artificial Sequence
  chemically synthesized
agtgtaaaatactataacaata

SEQ ID NO: 808855 - DNA, 22 bp, Artificial Sequence
  chemically synthesized
tattcaacatgtattgttatag

SEQ ID NO: 808856 - DNA, 22 bp, Artificial Sequence
  chemically synthesized
tagtgtaaaatactataacaat

SEQ ID NO: 808857 - DNA, 22 bp, Artificial Sequence
  chemically synthesized
ttttagtgtaaaatactataac

SEQ ID NO: 808858 - DNA, 22 bp, Artificial Sequence
  chemically synthesized
aacatgtattgttatagtattt

SEQ ID NO: 808859 - DNA, 22 bp, Artificial Sequence
  chemically synthesized
cagaacattattttagtgtaaa

SEQ ID NO: 808860 - DNA, 22 bp, Artificial Sequence
  chemically synthesized
ttatagtattttacactaaaat

SEQ ID NO: 808861 - DNA, 22 bp, Artificial Sequence
  chemically synthesized
tagtattttacactaaaataat

SEQ ID NO: 808862 - DNA, 22 bp, Artificial Sequence
  chemically synthesized
aaaactgcagaacattatttta

SEQ ID NO: 808863 - DNA, 22 bp, Artificial Sequence
  chemically synthesized
gaaaactgcagaacattatttt

SEQ ID NO: 808864 - DNA, 22 bp, Artificial Sequence
  chemically synthesized
tacactaaaataatgttctgca

SEQ ID NO: 808865 - DNA, 22 bp, Artificial Sequence
  chemically synthesized
acactaaaataatgttctgcag

SEQ ID NO: 808866 - DNA, 22 bp, Artificial Sequence
  chemically synthesized
cactaaaataatgttctgcagt

SEQ ID NO: 808867 - DNA, 22 bp, Artificial Sequence
  chemically synthesized
tcaaaggagcttgaaaactgca

SEQ ID NO: 808868 - DNA, 22 bp, Artificial Sequence
  chemically synthesized
aaataatgttctgcagttttca

SEQ ID NO: 808869 - DNA, 22 bp, Artificial Sequence
  chemically synthesized
tggatcctgtcaaaggagcttg

SEQ ID NO: 808870 - DNA, 22 bp, Artificial Sequence
  chemically synthesized
tgcagttttcaagctcctttga

SEQ ID NO: 808871 - DNA, 22 bp, Artificial Sequence
  chemically synthesized
tctgtggatcctgtcaaaggag

SEQ ID NO: 808872 - DNA, 22 bp, Artificial Sequence
  chemically synthesized
cagttttcaagctcctttgaca

SEQ ID NO: 808873 - DNA, 22 bp, Artificial Sequence
  chemically synthesized
tcaagctcctttgacaggatcc

SEQ ID NO: 808874 - DNA, 22 bp, Artificial Sequence
  chemically synthesized
caagctcctttgacaggatcca

SEQ ID NO: 808875 - DNA, 22 bp, Artificial Sequence
  chemically synthesized
aagctcctttgacaggatccac

SEQ ID NO: 808876 - DNA, 22 bp, Artificial Sequence
  chemically synthesized
ctttgacaggatccacagatag

SEQ ID NO: 808877 - DNA, 22 bp, Artificial Sequence
  chemically synthesized
tgacaggatccacagatagcac

SEQ ID NO: 808878 - DNA, 22 bp, Artificial Sequence
  chemically synthesized
gacaggatccacagatagcacc

SEQ ID NO: 808879 - DNA, 22 bp, Artificial Sequence
  chemically synthesized
acaggatccacagatagcacct

SEQ ID NO: 808880 - DNA, 22 bp, Artificial Sequence
  chemically synthesized
aaatatgaaaggaggtgctatc

SEQ ID NO: 808881 - DNA, 22 bp, Artificial Sequence
  chemically synthesized
aaaatatgaaaggaggtgctat

SEQ ID NO: 808882 - DNA, 22 bp, Artificial Sequence
  chemically synthesized
tttaaaatatgaaaggaggtgc

SEQ ID NO: 808883 - DNA, 22 bp, Artificial Sequence
  chemically synthesized
atcaagctatttaaaatatgaa

SEQ ID NO: 808884 - DNA, 22 bp, Artificial Sequence
  chemically synthesized
gcctcatcaagctatttaaaat

SEQ ID NO: 808885 - DNA, 22 bp, Artificial Sequence
  chemically synthesized
attagcctcatcaagctattta

SEQ ID NO: 808886 - DNA, 22 bp, Artificial Sequence
  chemically synthesized
ctttcatattttaaatagcttg

SEQ ID NO: 808887 - DNA, 22 bp, Artificial Sequence
  chemically synthesized
tcatattttaaatagcttgatg

SEQ ID NO: 808888 - DNA, 22 bp, Artificial Sequence
  chemically synthesized
cctcattagcctcatcaagcta

SEQ ID NO: 808889 - DNA, 22 bp, Artificial Sequence
  chemically synthesized
catattttaaatagcttgatga

SEQ ID NO: 808890 - DNA, 22 bp, Artificial Sequence
  chemically synthesized
atattttaaatagcttgatgag

SEQ ID NO: 808891 - DNA, 22 bp, Artificial Sequence
  chemically synthesized
caacctgcctcattagcctcat

SEQ ID NO: 808892 - DNA, 22 bp, Artificial Sequence
  chemically synthesized
taaatagcttgatgaggctaat

SEQ ID NO: 808893 - DNA, 22 bp, Artificial Sequence
  chemically synthesized
aaatagcttgatgaggctaatg

SEQ ID NO: 808894 - DNA, 22 bp, Artificial Sequence
  chemically synthesized
aatagcttgatgaggctaatga

SEQ ID NO: 808895 - DNA, 22 bp, Artificial Sequence
  chemically synthesized
atgataattacaacctgcctca

SEQ ID NO: 808896 - DNA, 22 bp, Artificial Sequence
  chemically synthesized
gatgaggctaatgaggcaggtt

SEQ ID NO: 808897 - DNA, 22 bp, Artificial Sequence
  chemically synthesized
atgaggctaatgaggcaggttg

SEQ ID NO: 808898 - DNA, 22 bp, Artificial Sequence
  chemically synthesized
ttcatgataattacaacctgcc

SEQ ID NO: 808899 - DNA, 22 bp, Artificial Sequence
  chemically synthesized
taaactgttcatgataattaca

SEQ ID NO: 808900 - DNA, 22 bp, Artificial Sequence
  chemically synthesized
atgaggcaggttgtaattatca

SEQ ID NO: 808901 - DNA, 22 bp, Artificial Sequence
  chemically synthesized
atctataaactgttcatgataa

SEQ ID NO: 808902 - DNA, 22 bp, Artificial Sequence
  chemically synthesized
ctcatctataaactgttcatga

SEQ ID NO: 808903 - DNA, 22 bp, Artificial Sequence
  chemically synthesized
agttcctcatctataaactgtt

SEQ ID NO: 808904 - DNA, 22 bp, Artificial Sequence
  chemically synthesized
taattatcatgaacagtttata

SEQ ID NO: 808905 - DNA, 22 bp, Artificial Sequence
  chemically synthesized
tcatgaacagtttatagatgag

SEQ ID NO: 808906 - DNA, 22 bp, Artificial Sequence
  chemically synthesized
aaagttaagttcctcatctata

SEQ ID NO: 808907 - DNA, 22 bp, Artificial Sequence
  chemically synthesized
cctgaaagttaagttcctcatc

SEQ ID NO: 808908 - DNA, 22 bp, Artificial Sequence
  chemically synthesized
ccctgaaagttaagttcctcat

SEQ ID NO: 808909 - DNA, 22 bp, Artificial Sequence
  chemically synthesized
atagatgaggaacttaactttc

SEQ ID NO: 808910 - DNA, 22 bp, Artificial Sequence
  chemically synthesized
tagatgaggaacttaactttca

SEQ ID NO: 808911 - DNA, 22 bp, Artificial Sequence
  chemically synthesized
acccagcttccctgaaagttaa

SEQ ID NO: 808912 - DNA, 22 bp, Artificial Sequence
  chemically synthesized
gcaactcacccagcttccctga

SEQ ID NO: 808913 - DNA, 22 bp, Artificial Sequence
  chemically synthesized
ggcaactcacccagcttccctg

SEQ ID NO: 808914 - DNA, 22 bp, Artificial Sequence
  chemically synthesized
tggcaactcacccagcttccct

SEQ ID NO: 808915 - DNA, 22 bp, Artificial Sequence
  chemically synthesized
ttttggcaactcacccagcttc

SEQ ID NO: 808916 - DNA, 22 bp, Artificial Sequence
  chemically synthesized
attttggcaactcacccagctt

SEQ ID NO: 808917 - DNA, 22 bp, Artificial Sequence
  chemically synthesized
aactttcagggaagctgggtga

SEQ ID NO: 808918 - DNA, 22 bp, Artificial Sequence
  chemically synthesized
actttcagggaagctgggtgag

SEQ ID NO: 808919 - DNA, 22 bp, Artificial Sequence
  chemically synthesized
tcagggaagctgggtgagttgc

SEQ ID NO: 808920 - DNA, 22 bp, Artificial Sequence
  chemically synthesized
tcatttattttggcaactcacc

SEQ ID NO: 808921 - DNA, 22 bp, Artificial Sequence
  chemically synthesized
cagggaagctgggtgagttgcc

SEQ ID NO: 808922 - DNA, 22 bp, Artificial Sequence
  chemically synthesized
gtcatttattttggcaactcac

SEQ ID NO: 808923 - DNA, 22 bp, Artificial Sequence
  chemically synthesized
agggaagctgggtgagttgcca

SEQ ID NO: 808924 - DNA, 22 bp, Artificial Sequence
  chemically synthesized
aagatttgtcatttattttggc

SEQ ID NO: 808925 - DNA, 22 bp, Artificial Sequence
  chemically synthesized
caagatttgtcatttattttgg

SEQ ID NO: 808926 - DNA, 22 bp, Artificial Sequence
  chemically synthesized
ggtgagttgccaaaataaatga

SEQ ID NO: 808927 - DNA, 22 bp, Artificial Sequence
  chemically synthesized
tttcaagatttgtcatttattt

SEQ ID NO: 808928 - DNA, 22 bp, Artificial Sequence
  chemically synthesized
gattgtttcaagatttgtcatt

SEQ ID NO: 808929 - DNA, 22 bp, Artificial Sequence
  chemically synthesized
ccaaaataaatgacaaatcttg

SEQ ID NO: 808930 - DNA, 22 bp, Artificial Sequence
  chemically synthesized
tagtacagtggactagattgtt

SEQ ID NO: 808931 - DNA, 22 bp, Artificial Sequence
  chemically synthesized
atagtacagtggactagattgt

SEQ ID NO: 808932 - DNA, 22 bp, Artificial Sequence
  chemically synthesized
gaaacaatctagtccactgtac

SEQ ID NO: 808933 - DNA, 22 bp, Artificial Sequence
  chemically synthesized
aaacaatctagtccactgtact

SEQ ID NO: 808934 - DNA, 22 bp, Artificial Sequence
  chemically synthesized
agaggtaatgtcttatagtaca

SEQ ID NO: 808935 - DNA, 22 bp, Artificial Sequence
  chemically synthesized
gagaggtaatgtcttatagtac

SEQ ID NO: 808936 - DNA, 22 bp, Artificial Sequence
  chemically synthesized
ccttgagaggtaatgtcttata

SEQ ID NO: 808937 - DNA, 22 bp, Artificial Sequence
  chemically synthesized
gtccactgtactataagacatt

SEQ ID NO: 808938 - DNA, 22 bp, Artificial Sequence
  chemically synthesized
tactataagacattacctctca

SEQ ID NO: 808939 - DNA, 22 bp, Artificial Sequence
  chemically synthesized
gcaagtctaccttgagaggtaa

SEQ ID NO: 808940 - DNA, 22 bp, Artificial Sequence
  chemically synthesized
taagacattacctctcaaggta

SEQ ID NO: 808941 - DNA, 22 bp, Artificial Sequence
  chemically synthesized
acagggagactggcaagtctac

SEQ ID NO: 808942 - DNA, 22 bp, Artificial Sequence
  chemically synthesized
cacagggagactggcaagtcta

SEQ ID NO: 808943 - DNA, 22 bp, Artificial Sequence
  chemically synthesized
cctctcaaggtagacttgccag

SEQ ID NO: 808944 - DNA, 22 bp, Artificial Sequence
  chemically synthesized
cttcacagggagactggcaagt

SEQ ID NO: 808945 - DNA, 22 bp, Artificial Sequence
  chemically synthesized
acttcacagggagactggcaag

SEQ ID NO: 808946 - DNA, 22 bp, Artificial Sequence
  chemically synthesized
tcaaggtagacttgccagtctc

SEQ ID NO: 808947 - DNA, 22 bp, Artificial Sequence
  chemically synthesized
aaggtagacttgccagtctccc

SEQ ID NO: 808948 - DNA, 22 bp, Artificial Sequence
  chemically synthesized
tatttacttcacagggagactg

SEQ ID NO: 808949 - DNA, 22 bp, Artificial Sequence
  chemically synthesized
gccagtctccctgtgaagtaaa

SEQ ID NO: 808950 - DNA, 22 bp, Artificial Sequence
  chemically synthesized
atatccattatatttacttcac

SEQ ID NO: 808951 - DNA, 22 bp, Artificial Sequence
  chemically synthesized
ccagtctccctgtgaagtaaat

SEQ ID NO: 808952 - DNA, 22 bp, Artificial Sequence
  chemically synthesized
cctgtgaagtaaatataatgga

SEQ ID NO: 808953 - DNA, 22 bp, Artificial Sequence
  chemically synthesized
tgaagtaaatataatggatatt

SEQ ID NO: 808954 - DNA, 22 bp, Artificial Sequence
  chemically synthesized
agaatagtgacatattaatatc

SEQ ID NO: 808955 - DNA, 22 bp, Artificial Sequence
  chemically synthesized
gagaatagtgacatattaatat

SEQ ID NO: 808956 - DNA, 22 bp, Artificial Sequence
  chemically synthesized
tgagaatagtgacatattaata

SEQ ID NO: 808957 - DNA, 22 bp, Artificial Sequence
  chemically synthesized
ttgagaatagtgacatattaat

SEQ ID NO: 808958 - DNA, 22 bp, Artificial Sequence
  chemically synthesized
atatgtcactattctcaaaagc

SEQ ID NO: 808959 - DNA, 22 bp, Artificial Sequence
  chemically synthesized
ttctcaaaagccctttgttttc

SEQ ID NO: 808960 - DNA, 22 bp, Artificial Sequence
  chemically synthesized
atataataataacagaaaacaa

SEQ ID NO: 808961 - DNA, 22 bp, Artificial Sequence
  chemically synthesized
tcaaaagccctttgttttctgt

SEQ ID NO: 808962 - DNA, 22 bp, Artificial Sequence
  chemically synthesized
aaaagccctttgttttctgtta

SEQ ID NO: 808963 - DNA, 22 bp, Artificial Sequence
  chemically synthesized
attcatataataataacagaaa

SEQ ID NO: 808964 - DNA, 22 bp, Artificial Sequence
  chemically synthesized
tgttttctgttattattatatg

SEQ ID NO: 808965 - DNA, 22 bp, Artificial Sequence
  chemically synthesized
gttttctgttattattatatga

SEQ ID NO: 808966 - DNA, 22 bp, Artificial Sequence
  chemically synthesized
ttttctgttattattatatgaa

SEQ ID NO: 808967 - DNA, 22 bp, Artificial Sequence
  chemically synthesized
tctgttattattatatgaatta

SEQ ID NO: 808968 - DNA, 22 bp, Artificial Sequence
  chemically synthesized
ctgttattattatatgaattag

SEQ ID NO: 808969 - DNA, 22 bp, Artificial Sequence
  chemically synthesized
tgttattattatatgaattagg

SEQ ID NO: 808970 - DNA, 22 bp, Artificial Sequence
  chemically synthesized
ttattattatatgaattaggat

SEQ ID NO: 808971 - DNA, 22 bp, Artificial Sequence
  chemically synthesized
ttattatatgaattaggattat

SEQ ID NO: 808972 - DNA, 22 bp, Artificial Sequence
  chemically synthesized
ttatatgaattaggattatggg

SEQ ID NO: 808973 - DNA, 22 bp, Artificial Sequence
  chemically synthesized
tatgaattaggattatggggta

SEQ ID NO: 808974 - DNA, 22 bp, Artificial Sequence
  chemically synthesized
acacatatatacacacataccc

SEQ ID NO: 808975 - DNA, 22 bp, Artificial Sequence
  chemically synthesized
cacacatatatacacacatacc

SEQ ID NO: 808976 - DNA, 22 bp, Artificial Sequence
  chemically synthesized
tcacacatatatacacacatac

SEQ ID NO: 808977 - DNA, 22 bp, Artificial Sequence
  chemically synthesized
ttcacacatatatacacacata

SEQ ID NO: 808978 - DNA, 22 bp, Artificial Sequence
  chemically synthesized
ggattatggggtatgtgtgtat

SEQ ID NO: 808979 - DNA, 22 bp, Artificial Sequence
  chemically synthesized
ttttcacacatatatacacaca

SEQ ID NO: 808980 - DNA, 22 bp, Artificial Sequence
  chemically synthesized
tcttttcacacatatatacaca

SEQ ID NO: 808981 - DNA, 22 bp, Artificial Sequence
  chemically synthesized
ctcttttcacacatatatacac

SEQ ID NO: 808982 - DNA, 22 bp, Artificial Sequence
  chemically synthesized
tctcttttcacacatatataca

SEQ ID NO: 808983 - DNA, 22 bp, Artificial Sequence
  chemically synthesized
tggggtatgtgtgtatatatgt

SEQ ID NO: 808984 - DNA, 22 bp, Artificial Sequence
  chemically synthesized
ttctcttttcacacatatatac

SEQ ID NO: 808985 - DNA, 22 bp, Artificial Sequence
  chemically synthesized
ttttctcttttcacacatatat

SEQ ID NO: 808986 - DNA, 22 bp, Artificial Sequence
  chemically synthesized
cttttctcttttcacacatata

SEQ ID NO: 808987 - DNA, 22 bp, Artificial Sequence
  chemically synthesized
ttattcctttgcttaccatctt

SEQ ID NO: 808988 - DNA, 22 bp, Artificial Sequence
  chemically synthesized
atagatgacggatgaagatggt

SEQ ID NO: 808989 - DNA, 22 bp, Artificial Sequence
  chemically synthesized
ttcctttgcttaccatcttcat

SEQ ID NO: 808990 - DNA, 22 bp, Artificial Sequence
  chemically synthesized
ctttgcttaccatcttcatccg

SEQ ID NO: 808991 - DNA, 22 bp, Artificial Sequence
  chemically synthesized
tgcttaccatcttcatccgtca

SEQ ID NO: 808992 - DNA, 22 bp, Artificial Sequence
  chemically synthesized
gcttaccatcttcatccgtcat

SEQ ID NO: 808993 - DNA, 22 bp, Artificial Sequence
  chemically synthesized
cttaccatcttcatccgtcatc

SEQ ID NO: 808994 - DNA, 22 bp, Artificial Sequence
  chemically synthesized
taacacatctcatagatgacgg

SEQ ID NO: 808995 - DNA, 22 bp, Artificial Sequence
  chemically synthesized
accatcttcatccgtcatctat

SEQ ID NO: 808996 - DNA, 22 bp, Artificial Sequence
  chemically synthesized
ccatcttcatccgtcatctatg

SEQ ID NO: 808997 - DNA, 22 bp, Artificial Sequence
  chemically synthesized
ttgtaacacatctcatagatga

SEQ ID NO: 808998 - DNA, 22 bp, Artificial Sequence
  chemically synthesized
attgtaacacatctcatagatg

SEQ ID NO: 808999 - DNA, 22 bp, Artificial Sequence
  chemically synthesized
catccgtcatctatgagatgtg

SEQ ID NO: 809000 - DNA, 22 bp, Artificial Sequence
  chemically synthesized
atccgtcatctatgagatgtgt

SEQ ID NO: 809001 - DNA, 22 bp, Artificial Sequence
  chemically synthesized
agtatttattgtaacacatctc

SEQ ID NO: 809002 - DNA, 22 bp, Artificial Sequence
  chemically synthesized
aaagttcagtatttattgtaac

SEQ ID NO: 809003 - DNA, 22 bp, Artificial Sequence
  chemically synthesized
tgagatgtgttacaataaatac

SEQ ID NO: 809004 - DNA, 22 bp, Artificial Sequence
  chemically synthesized
gagttcaaagttcagtatttat

SEQ ID NO: 809005 - DNA, 22 bp, Artificial Sequence
  chemically synthesized
cctcgagttcaaagttcagtat

SEQ ID NO: 809006 - DNA, 22 bp, Artificial Sequence
  chemically synthesized
acctcgagttcaaagttcagta

SEQ ID NO: 809007 - DNA, 22 bp, Artificial Sequence
  chemically synthesized
caataaatactgaactttgaac

SEQ ID NO: 809008 - DNA, 22 bp, Artificial Sequence
  chemically synthesized
aagcttacctcgagttcaaagt

SEQ ID NO: 809009 - DNA, 22 bp, Artificial Sequence
  chemically synthesized
aactttgaactcgaggtaagct

SEQ ID NO: 809010 - DNA, 22 bp, Artificial Sequence
  chemically synthesized
aatcaaatcctcaagcttacct

SEQ ID NO: 809011 - DNA, 22 bp, Artificial Sequence
  chemically synthesized
taaatcaaatcctcaagcttac

SEQ ID NO: 809012 - DNA, 22 bp, Artificial Sequence
  chemically synthesized
ctaaatcaaatcctcaagctta

SEQ ID NO: 809013 - DNA, 22 bp, Artificial Sequence
  chemically synthesized
tgaactcgaggtaagcttgagg

SEQ ID NO: 809014 - DNA, 22 bp, Artificial Sequence
  chemically synthesized
tctaaatcaaatcctcaagctt

SEQ ID NO: 809015 - DNA, 22 bp, Artificial Sequence
  chemically synthesized
gaactcgaggtaagcttgagga

SEQ ID NO: 809016 - DNA, 22 bp, Artificial Sequence
  chemically synthesized
aactcgaggtaagcttgaggat

SEQ ID NO: 809017 - DNA, 22 bp, Artificial Sequence
  chemically synthesized
tttctaaatcaaatcctcaagc

SEQ ID NO: 809018 - DNA, 22 bp, Artificial Sequence
  chemically synthesized
ctttctaaatcaaatcctcaag

SEQ ID NO: 809019 - DNA, 22 bp, Artificial Sequence
  chemically synthesized
gaggtaagcttgaggatttgat

SEQ ID NO: 809020 - DNA, 22 bp, Artificial Sequence
  chemically synthesized
taatgccttctttctaaatcaa

SEQ ID NO: 809021 - DNA, 22 bp, Artificial Sequence
  chemically synthesized
gaggatttgatttagaaagaag

SEQ ID NO: 809022 - DNA, 22 bp, Artificial Sequence
  chemically synthesized
aggatttgatttagaaagaagg

SEQ ID NO: 809023 - DNA, 22 bp, Artificial Sequence
  chemically synthesized
atgcctgtaatgccttctttct

SEQ ID NO: 809024 - DNA, 22 bp, Artificial Sequence
  chemically synthesized
gattaatgcctgtaatgccttc

SEQ ID NO: 809025 - DNA, 22 bp, Artificial Sequence
  chemically synthesized
gatttagaaagaaggcattaca

SEQ ID NO: 809026 - DNA, 22 bp, Artificial Sequence
  chemically synthesized
atttagaaagaaggcattacag

SEQ ID NO: 809027 - DNA, 22 bp, Artificial Sequence
  chemically synthesized
agaaagaaggcattacaggcat

SEQ ID NO: 809028 - DNA, 22 bp, Artificial Sequence
  chemically synthesized
gaaagaaggcattacaggcatt

SEQ ID NO: 809029 - DNA, 22 bp, Artificial Sequence
  chemically synthesized
aaatattcgattaatgcctgta

SEQ ID NO: 809030 - DNA, 22 bp, Artificial Sequence
  chemically synthesized
ataagaattaaaatattcgatt

SEQ ID NO: 809031 - DNA, 22 bp, Artificial Sequence
  chemically synthesized
cataagaattaaaatattcgat

SEQ ID NO: 809032 - DNA, 22 bp, Artificial Sequence
  chemically synthesized
caggcattaatcgaatatttta

SEQ ID NO: 809033 - DNA, 22 bp, Artificial Sequence
  chemically synthesized
tataatttcataagaattaaaa

SEQ ID NO: 809034 - DNA, 22 bp, Artificial Sequence
  chemically synthesized
gtataatttcataagaattaaa

SEQ ID NO: 809035 - DNA, 22 bp, Artificial Sequence
  chemically synthesized
tgtataatttcataagaattaa

SEQ ID NO: 809036 - DNA, 22 bp, Artificial Sequence
  chemically synthesized
atcgaatattttaattcttatg

SEQ ID NO: 809037 - DNA, 22 bp, Artificial Sequence
  chemically synthesized
taactttgtataatttcataag

SEQ ID NO: 809038 - DNA, 22 bp, Artificial Sequence
  chemically synthesized
taattcttatgaaattatacaa

SEQ ID NO: 809039 - DNA, 22 bp, Artificial Sequence
  chemically synthesized
aattcttatgaaattatacaaa

SEQ ID NO: 809040 - DNA, 22 bp, Artificial Sequence
  chemically synthesized
attcttatgaaattatacaaag

SEQ ID NO: 809041 - DNA, 22 bp, Artificial Sequence
  chemically synthesized
tatgtactataactttgtataa

SEQ ID NO: 809042 - DNA, 22 bp, Artificial Sequence
  chemically synthesized
ttatgaaattatacaaagttat

SEQ ID NO: 809043 - DNA, 22 bp, Artificial Sequence
  chemically synthesized
atgaaattatacaaagttatag

SEQ ID NO: 809044 - DNA, 22 bp, Artificial Sequence
  chemically synthesized
tgaaattatacaaagttatagt

SEQ ID NO: 809045 - DNA, 22 bp, Artificial Sequence
  chemically synthesized
tacaaagttatagtacatacaa

SEQ ID NO: 809046 - DNA, 22 bp, Artificial Sequence
  chemically synthesized
gagaaggccaaaattgtatgta

SEQ ID NO: 809047 - DNA, 22 bp, Artificial Sequence
  chemically synthesized
agagaaggccaaaattgtatgt

SEQ ID NO: 809048 - DNA, 22 bp, Artificial Sequence
  chemically synthesized
tcatttagagaaggccaaaatt

SEQ ID NO: 809049 - DNA, 22 bp, Artificial Sequence
  chemically synthesized
atcatttagagaaggccaaaat

SEQ ID NO: 809050 - DNA, 22 bp, Artificial Sequence
  chemically synthesized
tagtacatacaattttggcctt

SEQ ID NO: 809051 - DNA, 22 bp, Artificial Sequence
  chemically synthesized
acttatcatttagagaaggcca

SEQ ID NO: 809052 - DNA, 22 bp, Artificial Sequence
  chemically synthesized
ctaacttatcatttagagaagg

SEQ ID NO: 809053 - DNA, 22 bp, Artificial Sequence
  chemically synthesized
actaacttatcatttagagaag

SEQ ID NO: 809054 - DNA, 22 bp, Artificial Sequence
  chemically synthesized
tggccttctctaaatgataagt

SEQ ID NO: 809055 - DNA, 22 bp, Artificial Sequence
  chemically synthesized
ggccttctctaaatgataagtt

SEQ ID NO: 809056 - DNA, 22 bp, Artificial Sequence
  chemically synthesized
gccttctctaaatgataagtta

SEQ ID NO: 809057 - DNA, 22 bp, Artificial Sequence
  chemically synthesized
accaacatttactaacttatca

SEQ ID NO: 809058 - DNA, 22 bp, Artificial Sequence
  chemically synthesized
ctctaaatgataagttagtaaa

SEQ ID NO: 809059 - DNA, 22 bp, Artificial Sequence
  chemically synthesized
tctaaatgataagttagtaaat

SEQ ID NO: 809060 - DNA, 22 bp, Artificial Sequence
  chemically synthesized
taaatgataagttagtaaatgt

SEQ ID NO: 809061 - DNA, 22 bp, Artificial Sequence
  chemically synthesized
tatcattaaccaacatttacta

SEQ ID NO: 809062 - DNA, 22 bp, Artificial Sequence
  chemically synthesized
aatgataagttagtaaatgttg

SEQ ID NO: 809063 - DNA, 22 bp, Artificial Sequence
  chemically synthesized
tgtatcattaaccaacatttac

SEQ ID NO: 809064 - DNA, 22 bp, Artificial Sequence
  chemically synthesized
tctgtatcattaaccaacattt

SEQ ID NO: 809065 - DNA, 22 bp, Artificial Sequence
  chemically synthesized
agatactctctgtatcattaac

SEQ ID NO: 809066 - DNA, 22 bp, Artificial Sequence
  chemically synthesized
gtaaatgttggttaatgataca

SEQ ID NO: 809067 - DNA, 22 bp, Artificial Sequence
  chemically synthesized
gttaatgatacagagagtatct

SEQ ID NO: 809068 - DNA, 22 bp, Artificial Sequence
  chemically synthesized
atgatacagagagtatctgaat

SEQ ID NO: 809069 - DNA, 22 bp, Artificial Sequence
  chemically synthesized
tgtaaaagatatcccaaaatac

SEQ ID NO: 809070 - DNA, 22 bp, Artificial Sequence
  chemically synthesized
atgtaaaagatatcccaaaata

SEQ ID NO: 809071 - DNA, 22 bp, Artificial Sequence
  chemically synthesized
tatgtaaaagatatcccaaaat

SEQ ID NO: 809072 - DNA, 22 bp, Artificial Sequence
  chemically synthesized
aatgtctatgtattttgggata

SEQ ID NO: 809073 - DNA, 22 bp, Artificial Sequence
  chemically synthesized
gaaattttatgtaaaagatatc

SEQ ID NO: 809074 - DNA, 22 bp, Artificial Sequence
  chemically synthesized
tgtattttgggatatcttttac

SEQ ID NO: 809075 - DNA, 22 bp, Artificial Sequence
  chemically synthesized
atgttagaaattttatgtaaaa

SEQ ID NO: 809076 - DNA, 22 bp, Artificial Sequence
  chemically synthesized
catgttagaaattttatgtaaa

SEQ ID NO: 809077 - DNA, 22 bp, Artificial Sequence
  chemically synthesized
tcatgttagaaattttatgtaa

SEQ ID NO: 809078 - DNA, 22 bp, Artificial Sequence
  chemically synthesized
tgggatatcttttacataaaat

SEQ ID NO: 809079 - DNA, 22 bp, Artificial Sequence
  chemically synthesized
gggatatcttttacataaaatt

SEQ ID NO: 809080 - DNA, 22 bp, Artificial Sequence
  chemically synthesized
ggatatcttttacataaaattt

SEQ ID NO: 809081 - DNA, 22 bp, Artificial Sequence
  chemically synthesized
ttttcatgttagaaattttatg

SEQ ID NO: 809082 - DNA, 22 bp, Artificial Sequence
  chemically synthesized
attttcatgttagaaattttat

SEQ ID NO: 809083 - DNA, 22 bp, Artificial Sequence
  chemically synthesized
tattttcatgttagaaatttta

SEQ ID NO: 809084 - DNA, 22 bp, Artificial Sequence
  chemically synthesized
ttacataaaatttctaacatga

SEQ ID NO: 809085 - DNA, 22 bp, Artificial Sequence
  chemically synthesized
tacataaaatttctaacatgaa

SEQ ID NO: 809086 - DNA, 22 bp, Artificial Sequence
  chemically synthesized
acataaaatttctaacatgaaa

SEQ ID NO: 809087 - DNA, 22 bp, Artificial Sequence
  chemically synthesized
cataaaatttctaacatgaaaa

SEQ ID NO: 809088 - DNA, 22 bp, Artificial Sequence
  chemically synthesized
ctaacatgaaaataaaatactt

SEQ ID NO: 809089 - DNA, 22 bp, Artificial Sequence
  chemically synthesized
taacatgaaaataaaatacttc

SEQ ID NO: 809090 - DNA, 22 bp, Artificial Sequence
  chemically synthesized
acatgaaaataaaatacttcat

SEQ ID NO: 809091 - DNA, 22 bp, Artificial Sequence
  chemically synthesized
gtaaagcaatgtatgaagtatt

SEQ ID NO: 809092 - DNA, 22 bp, Artificial Sequence
  chemically synthesized
taaaatgtctagtaaagcaatg

SEQ ID NO: 809093 - DNA, 22 bp, Artificial Sequence
  chemically synthesized
actgtaaaatgtctagtaaagc

SEQ ID NO: 809094 - DNA, 22 bp, Artificial Sequence
  chemically synthesized
cactgtaaaatgtctagtaaag

SEQ ID NO: 809095 - DNA, 22 bp, Artificial Sequence
  chemically synthesized
catacattgctttactagacat

SEQ ID NO: 809096 - DNA, 22 bp, Artificial Sequence
  chemically synthesized
tttcactgtaaaatgtctagta

SEQ ID NO: 809097 - DNA, 22 bp, Artificial Sequence
  chemically synthesized
atacattgctttactagacatt

SEQ ID NO: 809098 - DNA, 22 bp, Artificial Sequence
  chemically synthesized
atttcactgtaaaatgtctagt

SEQ ID NO: 809099 - DNA, 22 bp, Artificial Sequence
  chemically synthesized
ctttactagacattttacagtg

SEQ ID NO: 809100 - DNA, 22 bp, Artificial Sequence
  chemically synthesized
aaatgtatttatttcactgtaa

SEQ ID NO: 809101 - DNA, 22 bp, Artificial Sequence
  chemically synthesized
tactagacattttacagtgaaa

SEQ ID NO: 809102 - DNA, 22 bp, Artificial Sequence
  chemically synthesized
actagacattttacagtgaaat

SEQ ID NO: 809103 - DNA, 22 bp, Artificial Sequence
  chemically synthesized
ctagacattttacagtgaaata

SEQ ID NO: 809104 - DNA, 22 bp, Artificial Sequence
  chemically synthesized
ttaaaatgtatttatttcactg

SEQ ID NO: 809105 - DNA, 22 bp, Artificial Sequence
  chemically synthesized
attaaaatgtatttatttcact

SEQ ID NO: 809106 - DNA, 22 bp, Artificial Sequence
  chemically synthesized
tattaaaatgtatttatttcac

SEQ ID NO: 809107 - DNA, 22 bp, Artificial Sequence
  chemically synthesized
gacattttacagtgaaataaat

SEQ ID NO: 809108 - DNA, 22 bp, Artificial Sequence
  chemically synthesized
gttttattaaaatgtatttatt

SEQ ID NO: 809109 - DNA, 22 bp, Artificial Sequence
  chemically synthesized
tacagtgaaataaatacatttt

SEQ ID NO: 809110 - DNA, 22 bp, Artificial Sequence
  chemically synthesized
acagtgaaataaatacatttta

SEQ ID NO: 809111 - DNA, 22 bp, Artificial Sequence
  chemically synthesized
agttggttttattaaaatgtat

SEQ ID NO: 809112 - DNA, 22 bp, Artificial Sequence
  chemically synthesized
cagtgaaataaatacattttaa

SEQ ID NO: 809113 - DNA, 22 bp, Artificial Sequence
  chemically synthesized
atcgttcagttggttttattaa

SEQ ID NO: 809114 - DNA, 22 bp, Artificial Sequence
  chemically synthesized
attcatcgttcagttggtttta

SEQ ID NO: 809115 - DNA, 22 bp, Artificial Sequence
  chemically synthesized
taataaaaccaactgaacgatg

SEQ ID NO: 809116 - DNA, 22 bp, Artificial Sequence
  chemically synthesized
gacaaattaattcatcgttcag

SEQ ID NO: 809117 - DNA, 22 bp, Artificial Sequence
  chemically synthesized
aataaaaccaactgaacgatga

SEQ ID NO: 809118 - DNA, 22 bp, Artificial Sequence
  chemically synthesized
cgacaaattaattcatcgttca

SEQ ID NO: 809119 - DNA, 22 bp, Artificial Sequence
  chemically synthesized
ataaaaccaactgaacgatgaa

SEQ ID NO: 809120 - DNA, 22 bp, Artificial Sequence
  chemically synthesized
agtcacttcgacaaattaattc

SEQ ID NO: 809121 - DNA, 22 bp, Artificial Sequence
  chemically synthesized
aactaagtcacttcgacaaatt

SEQ ID NO: 809122 - DNA, 22 bp, Artificial Sequence
  chemically synthesized
aacgatgaattaatttgtcgaa

SEQ ID NO: 809123 - DNA, 22 bp, Artificial Sequence
  chemically synthesized
aaactaagtcacttcgacaaat

SEQ ID NO: 809124 - DNA, 22 bp, Artificial Sequence
  chemically synthesized
cttaaactaagtcacttcgaca

SEQ ID NO: 809125 - DNA, 22 bp, Artificial Sequence
  chemically synthesized
gaatctacttaaactaagtcac

SEQ ID NO: 809126 - DNA, 22 bp, Artificial Sequence
  chemically synthesized
agaatctacttaaactaagtca

SEQ ID NO: 809127 - DNA, 22 bp, Artificial Sequence
  chemically synthesized
atttgtcgaagtgacttagttt

SEQ ID NO: 809128 - DNA, 22 bp, Artificial Sequence
  chemically synthesized
tagaatctacttaaactaagtc

SEQ ID NO: 809129 - DNA, 22 bp, Artificial Sequence
  chemically synthesized
ttagaatctacttaaactaagt

SEQ ID NO: 809130 - DNA, 22 bp, Artificial Sequence
  chemically synthesized
ttttagaatctacttaaactaa

SEQ ID NO: 809131 - DNA, 22 bp, Artificial Sequence
  chemically synthesized
gtcgaagtgacttagtttaagt

SEQ ID NO: 809132 - DNA, 22 bp, Artificial Sequence
  chemically synthesized
tcgaagtgacttagtttaagta

SEQ ID NO: 809133 - DNA, 22 bp, Artificial Sequence
  chemically synthesized
gaagggcaattcttttagaatc

SEQ ID NO: 809134 - DNA, 22 bp, Artificial Sequence
  chemically synthesized
agtttaagtagattctaaaaga

SEQ ID NO: 809135 - DNA, 22 bp, Artificial Sequence
  chemically synthesized
gtttaagtagattctaaaagaa

SEQ ID NO: 809136 - DNA, 22 bp, Artificial Sequence
  chemically synthesized
caattagaagggcaattctttt

SEQ ID NO: 809137 - DNA, 22 bp, Artificial Sequence
  chemically synthesized
aagtagattctaaaagaattgc

SEQ ID NO: 809138 - DNA, 22 bp, Artificial Sequence
  chemically synthesized
acaattagaagggcaattcttt

SEQ ID NO: 809139 - DNA, 22 bp, Artificial Sequence
  chemically synthesized
agtagattctaaaagaattgcc

SEQ ID NO: 809140 - DNA, 22 bp, Artificial Sequence
  chemically synthesized
taaaagaattgcccttctaatt

SEQ ID NO: 809141 - DNA, 22 bp, Artificial Sequence
  chemically synthesized
aaataggtttacaattagaagg

SEQ ID NO: 809142 - DNA, 22 bp, Artificial Sequence
  chemically synthesized
aaagaattgcccttctaattgt

SEQ ID NO: 809143 - DNA, 22 bp, Artificial Sequence
  chemically synthesized
agccattaaaataggtttacaa

SEQ ID NO: 809144 - DNA, 22 bp, Artificial Sequence
  chemically synthesized
cccttctaattgtaaacctatt

SEQ ID NO: 809145 - DNA, 22 bp, Artificial Sequence
  chemically synthesized
ctaattgtaaacctattttaat

SEQ ID NO: 809146 - DNA, 22 bp, Artificial Sequence
  chemically synthesized
taattgtaaacctattttaatg

SEQ ID NO: 809147 - DNA, 22 bp, Artificial Sequence
  chemically synthesized
attgtaaacctattttaatggc

SEQ ID NO: 809148 - DNA, 22 bp, Artificial Sequence
  chemically synthesized
taaatcatatctgagccattaa

SEQ ID NO: 809149 - DNA, 22 bp, Artificial Sequence
  chemically synthesized
gtaaatcatatctgagccatta

SEQ ID NO: 809150 - DNA, 22 bp, Artificial Sequence
  chemically synthesized
taaacctattttaatggctcag

SEQ ID NO: 809151 - DNA, 22 bp, Artificial Sequence
  chemically synthesized
tcttgtaaatcatatctgagcc

SEQ ID NO: 809152 - DNA, 22 bp, Artificial Sequence
  chemically synthesized
gtcttgtaaatcatatctgagc

SEQ ID NO: 809153 - DNA, 22 bp, Artificial Sequence
  chemically synthesized
ttttaatggctcagatatgatt

SEQ ID NO: 809154 - DNA, 22 bp, Artificial Sequence
  chemically synthesized
taatggctcagatatgatttac

SEQ ID NO: 809155 - DNA, 22 bp, Artificial Sequence
  chemically synthesized
aatggctcagatatgatttaca

SEQ ID NO: 809156 - DNA, 22 bp, Artificial Sequence
  chemically synthesized
atggctcagatatgatttacaa

SEQ ID NO: 809157 - DNA, 22 bp, Artificial Sequence
  chemically synthesized
taatcccacatcttgtcttgta

SEQ ID NO: 809158 - DNA, 22 bp, Artificial Sequence
  chemically synthesized
gtaatcccacatcttgtcttgt

SEQ ID NO: 809159 - DNA, 22 bp, Artificial Sequence
  chemically synthesized
agatatgatttacaagacaaga

SEQ ID NO: 809160 - DNA, 22 bp, Artificial Sequence
  chemically synthesized
cttgtaatcccacatcttgtct

SEQ ID NO: 809161 - DNA, 22 bp, Artificial Sequence
  chemically synthesized
aagctacttgtaatcccacatc

SEQ ID NO: 809162 - DNA, 22 bp, Artificial Sequence
  chemically synthesized
acaagacaagatgtgggattac

SEQ ID NO: 809163 - DNA, 22 bp, Artificial Sequence
  chemically synthesized
caagacaagatgtgggattaca

SEQ ID NO: 809164 - DNA, 22 bp, Artificial Sequence
  chemically synthesized
gctcaagctacttgtaatccca

SEQ ID NO: 809165 - DNA, 22 bp, Artificial Sequence
  chemically synthesized
attagctcaagctacttgtaat

SEQ ID NO: 809166 - DNA, 22 bp, Artificial Sequence
  chemically synthesized
aattagctcaagctacttgtaa

SEQ ID NO: 809167 - DNA, 22 bp, Artificial Sequence
  chemically synthesized
taattagctcaagctacttgta

SEQ ID NO: 809168 - DNA, 22 bp, Artificial Sequence
  chemically synthesized
ataagttttaattagctcaagc

SEQ ID NO: 809169 - DNA, 22 bp, Artificial Sequence
  chemically synthesized
gataagttttaattagctcaag

SEQ ID NO: 809170 - DNA, 22 bp, Artificial Sequence
  chemically synthesized
tgataagttttaattagctcaa

SEQ ID NO: 809171 - DNA, 22 bp, Artificial Sequence
  chemically synthesized
ttttgataagttttaattagct

SEQ ID NO: 809172 - DNA, 22 bp, Artificial Sequence
  chemically synthesized
caagtagcttgagctaattaaa

SEQ ID NO: 809173 - DNA, 22 bp, Artificial Sequence
  chemically synthesized
attttgataagttttaattagc

SEQ ID NO: 809174 - DNA, 22 bp, Artificial Sequence
  chemically synthesized
tattttgataagttttaattag

SEQ ID NO: 809175 - DNA, 22 bp, Artificial Sequence
  chemically synthesized
aatctttattttgataagtttt

SEQ ID NO: 809176 - DNA, 22 bp, Artificial Sequence
  chemically synthesized
aaatctttattttgataagttt

SEQ ID NO: 809177 - DNA, 22 bp, Artificial Sequence
  chemically synthesized
taaatctttattttgataagtt

SEQ ID NO: 809178 - DNA, 22 bp, Artificial Sequence
  chemically synthesized
gagctaattaaaacttatcaaa

SEQ ID NO: 809179 - DNA, 22 bp, Artificial Sequence
  chemically synthesized
agctaattaaaacttatcaaaa

SEQ ID NO: 809180 - DNA, 22 bp, Artificial Sequence
  chemically synthesized
attaaaacttatcaaaataaag

SEQ ID NO: 809181 - DNA, 22 bp, Artificial Sequence
  chemically synthesized
aaacttatcaaaataaagattt

SEQ ID NO: 809182 - DNA, 22 bp, Artificial Sequence
  chemically synthesized
atcaaaataaagatttaaagtt

SEQ ID NO: 809183 - DNA, 22 bp, Artificial Sequence
  chemically synthesized
tcaaaataaagatttaaagttt

SEQ ID NO: 809184 - DNA, 22 bp, Artificial Sequence
  chemically synthesized
aaagtacgaaagcaagaaactt

SEQ ID NO: 809185 - DNA, 22 bp, Artificial Sequence
  chemically synthesized
gtaattaaaagtacgaaagcaa

SEQ ID NO: 809186 - DNA, 22 bp, Artificial Sequence
  chemically synthesized
aaagtttcttgctttcgtactt

SEQ ID NO: 809187 - DNA, 22 bp, Artificial Sequence
  chemically synthesized
aagtttcttgctttcgtacttt

SEQ ID NO: 809188 - DNA, 22 bp, Artificial Sequence
  chemically synthesized
accctggtaattaaaagtacga

SEQ ID NO: 809189 - DNA, 22 bp, Artificial Sequence
  chemically synthesized
caccctggtaattaaaagtacg

SEQ ID NO: 809190 - DNA, 22 bp, Artificial Sequence
  chemically synthesized
tcaccctggtaattaaaagtac

SEQ ID NO: 809191 - DNA, 22 bp, Artificial Sequence
  chemically synthesized
ttcaccctggtaattaaaagta

SEQ ID NO: 809192 - DNA, 22 bp, Artificial Sequence
  chemically synthesized
cttgctttcgtacttttaatta

SEQ ID NO: 809193 - DNA, 22 bp, Artificial Sequence
  chemically synthesized
ttgctttcgtacttttaattac

SEQ ID NO: 809194 - DNA, 22 bp, Artificial Sequence
  chemically synthesized
gctttcgtacttttaattacca

SEQ ID NO: 809195 - DNA, 22 bp, Artificial Sequence
  chemically synthesized
ctttcgtacttttaattaccag

SEQ ID NO: 809196 - DNA, 22 bp, Artificial Sequence
  chemically synthesized
tcgtacttttaattaccagggt

SEQ ID NO: 809197 - DNA, 22 bp, Artificial Sequence
  chemically synthesized
cgtacttttaattaccagggtg

SEQ ID NO: 809198 - DNA, 22 bp, Artificial Sequence
  chemically synthesized
aatgcaatttttcaccctggta

SEQ ID NO: 809199 - DNA, 22 bp, Artificial Sequence
  chemically synthesized
gtacttttaattaccagggtga

SEQ ID NO: 809200 - DNA, 22 bp, Artificial Sequence
  chemically synthesized
aaatgcaatttttcaccctggt

SEQ ID NO: 809201 - DNA, 22 bp, Artificial Sequence
  chemically synthesized
taaatgcaatttttcaccctgg

SEQ ID NO: 809202 - DNA, 22 bp, Artificial Sequence
  chemically synthesized
ttaaatgcaatttttcaccctg

SEQ ID NO: 809203 - DNA, 22 bp, Artificial Sequence
  chemically synthesized
ttaattaccagggtgaaaaatt

SEQ ID NO: 809204 - DNA, 22 bp, Artificial Sequence
  chemically synthesized
taattaccagggtgaaaaattg

SEQ ID NO: 809205 - DNA, 22 bp, Artificial Sequence
  chemically synthesized
aattaccagggtgaaaaattgc

SEQ ID NO: 809206 - DNA, 22 bp, Artificial Sequence
  chemically synthesized
ggtcttttaaatgcaatttttc

SEQ ID NO: 809207 - DNA, 22 bp, Artificial Sequence
  chemically synthesized
attaccagggtgaaaaattgca

SEQ ID NO: 809208 - DNA, 22 bp, Artificial Sequence
  chemically synthesized
ccagggtgaaaaattgcattta

SEQ ID NO: 809209 - DNA, 22 bp, Artificial Sequence
  chemically synthesized
aaagtatctaggtcttttaaat

SEQ ID NO: 809210 - DNA, 22 bp, Artificial Sequence
  chemically synthesized
caaagtatctaggtcttttaaa

SEQ ID NO: 809211 - DNA, 22 bp, Artificial Sequence
  chemically synthesized
catttaaaagacctagatactt

SEQ ID NO: 809212 - DNA, 22 bp, Artificial Sequence
  chemically synthesized
aaaagacctagatactttgaaa

SEQ ID NO: 809213 - DNA, 22 bp, Artificial Sequence
  chemically synthesized
aaagacctagatactttgaaat

SEQ ID NO: 809214 - DNA, 22 bp, Artificial Sequence
  chemically synthesized
taaaaggccatcaatacatttc

SEQ ID NO: 809215 - DNA, 22 bp, Artificial Sequence
  chemically synthesized
ataaaaggccatcaatacattt

SEQ ID NO: 809216 - DNA, 22 bp, Artificial Sequence
  chemically synthesized
gatactttgaaatgtattgatg

SEQ ID NO: 809217 - DNA, 22 bp, Artificial Sequence
  chemically synthesized
atcttataaaaggccatcaata

SEQ ID NO: 809218 - DNA, 22 bp, Artificial Sequence
  chemically synthesized
attgatcttataaaaggccatc

SEQ ID NO: 809219 - DNA, 22 bp, Artificial Sequence
  chemically synthesized
tgaaatgtattgatggcctttt

SEQ ID NO: 809220 - DNA, 22 bp, Artificial Sequence
  chemically synthesized
aattgatcttataaaaggccat

SEQ ID NO: 809221 - DNA, 22 bp, Artificial Sequence
  chemically synthesized
gaaatgtattgatggcctttta

SEQ ID NO: 809222 - DNA, 22 bp, Artificial Sequence
  chemically synthesized
taattgatcttataaaaggcca

SEQ ID NO: 809223 - DNA, 22 bp, Artificial Sequence
  chemically synthesized
aaatgtattgatggccttttat

SEQ ID NO: 809224 - DNA, 22 bp, Artificial Sequence
  chemically synthesized
taaattttaattgatcttataa

SEQ ID NO: 809225 - DNA, 22 bp, Artificial Sequence
  chemically synthesized
ataaattttaattgatcttata

SEQ ID NO: 809226 - DNA, 22 bp, Artificial Sequence
  chemically synthesized
tataaattttaattgatcttat

SEQ ID NO: 809227 - DNA, 22 bp, Artificial Sequence
  chemically synthesized
atggccttttataagatcaatt

SEQ ID NO: 809228 - DNA, 22 bp, Artificial Sequence
  chemically synthesized
tttataaattttaattgatctt

SEQ ID NO: 809229 - DNA, 22 bp, Artificial Sequence
  chemically synthesized
ttctttataaattttaattgat

SEQ ID NO: 809230 - DNA, 22 bp, Artificial Sequence
  chemically synthesized
ttataagatcaattaaaattta

SEQ ID NO: 809231 - DNA, 22 bp, Artificial Sequence
  chemically synthesized
tataagatcaattaaaatttat

SEQ ID NO: 809232 - DNA, 22 bp, Artificial Sequence
  chemically synthesized
tgactgttctttataaatttta

SEQ ID NO: 809233 - DNA, 22 bp, Artificial Sequence
  chemically synthesized
ataagatcaattaaaatttata

SEQ ID NO: 809234 - DNA, 22 bp, Artificial Sequence
  chemically synthesized
taagatcaattaaaatttataa

SEQ ID NO: 809235 - DNA, 22 bp, Artificial Sequence
  chemically synthesized
aattatgactgttctttataaa

SEQ ID NO: 809236 - DNA, 22 bp, Artificial Sequence
  chemically synthesized
aaatttataaagaacagtcata

SEQ ID NO: 809237 - DNA, 22 bp, Artificial Sequence
  chemically synthesized
ataaagaacagtcataatttag

SEQ ID NO: 809238 - DNA, 22 bp, Artificial Sequence
  chemically synthesized
taaagaacagtcataatttagg

SEQ ID NO: 809239 - DNA, 22 bp, Artificial Sequence
  chemically synthesized
aaaaaaataaatcctaaattat

SEQ ID NO: 809240 - DNA, 22 bp, Artificial Sequence
  chemically synthesized
attgaaaaaaataaatcctaaa

SEQ ID NO: 809241 - DNA, 22 bp, Artificial Sequence
  chemically synthesized
taattgaaaaaaataaatccta

SEQ ID NO: 809242 - DNA, 22 bp, Artificial Sequence
  chemically synthesized
ctaattgaaaaaaataaatcct

SEQ ID NO: 809243 - DNA, 22 bp, Artificial Sequence
  chemically synthesized
tacttctaattgaaaaaaataa

SEQ ID NO: 809244 - DNA, 22 bp, Artificial Sequence
  chemically synthesized
atgttgtacttctaattgaaaa

SEQ ID NO: 809245 - DNA, 22 bp, Artificial Sequence
  chemically synthesized
aggatttatttttttcaattag

SEQ ID NO: 809246 - DNA, 22 bp, Artificial Sequence
  chemically synthesized
catgttgtacttctaattgaaa

SEQ ID NO: 809247 - DNA, 22 bp, Artificial Sequence
  chemically synthesized
ggatttatttttttcaattaga

SEQ ID NO: 809248 - DNA, 22 bp, Artificial Sequence
  chemically synthesized
tcatgttgtacttctaattgaa

SEQ ID NO: 809249 - DNA, 22 bp, Artificial Sequence
  chemically synthesized
ctttcatgttgtacttctaatt

SEQ ID NO: 809250 - DNA, 22 bp, Artificial Sequence
  chemically synthesized
atttttttcaattagaagtaca

SEQ ID NO: 809251 - DNA, 22 bp, Artificial Sequence
  chemically synthesized
tttttttcaattagaagtacaa

SEQ ID NO: 809252 - DNA, 22 bp, Artificial Sequence
  chemically synthesized
attcctttcatgttgtacttct

SEQ ID NO: 809253 - DNA, 22 bp, Artificial Sequence
  chemically synthesized
ttttcaattagaagtacaacat

SEQ ID NO: 809254 - DNA, 22 bp, Artificial Sequence
  chemically synthesized
tttcaattagaagtacaacatg

SEQ ID NO: 809255 - DNA, 22 bp, Artificial Sequence
  chemically synthesized
ttcaattagaagtacaacatga

SEQ ID NO: 809256 - DNA, 22 bp, Artificial Sequence
  chemically synthesized
tcaattagaagtacaacatgaa

SEQ ID NO: 809257 - DNA, 22 bp, Artificial Sequence
  chemically synthesized
agattcattcctttcatgttgt

SEQ ID NO: 809258 - DNA, 22 bp, Artificial Sequence
  chemically synthesized
caattagaagtacaacatgaaa

SEQ ID NO: 809259 - DNA, 22 bp, Artificial Sequence
  chemically synthesized
aattagaagtacaacatgaaag

SEQ ID NO: 809260 - DNA, 22 bp, Artificial Sequence
  chemically synthesized
gaagtacaacatgaaaggaatg

SEQ ID NO: 809261 - DNA, 22 bp, Artificial Sequence
  chemically synthesized
aaaccagatgcaccctcagatt

SEQ ID NO: 809262 - DNA, 22 bp, Artificial Sequence
  chemically synthesized
aaaaccagatgcaccctcagat

SEQ ID NO: 809263 - DNA, 22 bp, Artificial Sequence
  chemically synthesized
ttaaaaccagatgcaccctcag

SEQ ID NO: 809264 - DNA, 22 bp, Artificial Sequence
  chemically synthesized
agggtgcatctggttttaagaa

SEQ ID NO: 809265 - DNA, 22 bp, Artificial Sequence
  chemically synthesized
ataagtcagaggattcttaaaa

SEQ ID NO: 809266 - DNA, 22 bp, Artificial Sequence
  chemically synthesized
gttttaagaatcctctgactta

SEQ ID NO: 809267 - DNA, 22 bp, Artificial Sequence
  chemically synthesized
taagaatcctctgacttatgaa

SEQ ID NO: 809268 - DNA, 22 bp, Artificial Sequence
  chemically synthesized
aagaatcctctgacttatgaat

SEQ ID NO: 809269 - DNA, 22 bp, Artificial Sequence
  chemically synthesized
agaatcctctgacttatgaata

SEQ ID NO: 809270 - DNA, 22 bp, Artificial Sequence
  chemically synthesized
tagtaagtggtatattcataag

SEQ ID NO: 809271 - DNA, 22 bp, Artificial Sequence
  chemically synthesized
tgacttatgaatataccactta

SEQ ID NO: 809272 - DNA, 22 bp, Artificial Sequence
  chemically synthesized
acttatgaatataccacttact

SEQ ID NO: 809273 - DNA, 22 bp, Artificial Sequence
  chemically synthesized
atgaatataccacttactatag

SEQ ID NO: 809274 - DNA, 22 bp, Artificial Sequence
  chemically synthesized
tgaatataccacttactatagt

SEQ ID NO: 809275 - DNA, 22 bp, Artificial Sequence
  chemically synthesized
actatagtctggatattcatca

SEQ ID NO: 809276 - DNA, 22 bp, Artificial Sequence
  chemically synthesized
ctatagtctggatattcatcat

SEQ ID NO: 809277 - DNA, 22 bp, Artificial Sequence
  chemically synthesized
tagtctggatattcatcatcgt

SEQ ID NO: 809278 - DNA, 22 bp, Artificial Sequence
  chemically synthesized
atgaatggtgatgacgatgatg

SEQ ID NO: 809279 - DNA, 22 bp, Artificial Sequence
  chemically synthesized
gatattcatcatcgtcatcacc

SEQ ID NO: 809280 - DNA, 22 bp, Artificial Sequence
  chemically synthesized
tggttgatgaatggtgatgacg

SEQ ID NO: 809281 - DNA, 22 bp, Artificial Sequence
  chemically synthesized
atcatcgtcatcaccattcatc

SEQ ID NO: 809282 - DNA, 22 bp, Artificial Sequence
  chemically synthesized
cagtaagttgtggttgatgaat

SEQ ID NO: 809283 - DNA, 22 bp, Artificial Sequence
  chemically synthesized
acagtaagttgtggttgatgaa

SEQ ID NO: 809284 - DNA, 22 bp, Artificial Sequence
  chemically synthesized
aaataatttacagtaagttgtg

SEQ ID NO: 809285 - DNA, 22 bp, Artificial Sequence
  chemically synthesized
ccctcaaataatttacagtaag

SEQ ID NO: 809286 - DNA, 22 bp, Artificial Sequence
  chemically synthesized
atcaaccacaacttactgtaaa

SEQ ID NO: 809287 - DNA, 22 bp, Artificial Sequence
  chemically synthesized
gccctcaaataatttacagtaa

SEQ ID NO: 809288 - DNA, 22 bp, Artificial Sequence
  chemically synthesized
tgccctcaaataatttacagta

SEQ ID NO: 809289 - DNA, 22 bp, Artificial Sequence
  chemically synthesized
actgtaaattatttgagggcaa

SEQ ID NO: 809290 - DNA, 22 bp, Artificial Sequence
  chemically synthesized
tggtgtgaatctttgccctcaa

SEQ ID NO: 809291 - DNA, 22 bp, Artificial Sequence
  chemically synthesized
ctgtaaattatttgagggcaaa

SEQ ID NO: 809292 - DNA, 22 bp, Artificial Sequence
  chemically synthesized
taaattatttgagggcaaagat

SEQ ID NO: 809293 - DNA, 22 bp, Artificial Sequence
  chemically synthesized
ccaggaactgtggtgtgaatct

SEQ ID NO: 809294 - DNA, 22 bp, Artificial Sequence
  chemically synthesized
tttgagggcaaagattcacacc

SEQ ID NO: 809295 - DNA, 22 bp, Artificial Sequence
  chemically synthesized
gagggcaaagattcacaccaca

SEQ ID NO: 809296 - DNA, 22 bp, Artificial Sequence
  chemically synthesized
agggcaaagattcacaccacag

SEQ ID NO: 809297 - DNA, 22 bp, Artificial Sequence
  chemically synthesized
aattgccaggaactgtggtgtg

SEQ ID NO: 809298 - DNA, 22 bp, Artificial Sequence
  chemically synthesized
ttaaattgccaggaactgtggt

SEQ ID NO: 809299 - DNA, 22 bp, Artificial Sequence
  chemically synthesized
agtatctattaaattgccagga

SEQ ID NO: 809300 - DNA, 22 bp, Artificial Sequence
  chemically synthesized
acaccacagttcctggcaattt

SEQ ID NO: 809301 - DNA, 22 bp, Artificial Sequence
  chemically synthesized
ttgagtatctattaaattgcca

SEQ ID NO: 809302 - DNA, 22 bp, Artificial Sequence
  chemically synthesized
attgagtatctattaaattgcc

SEQ ID NO: 809303 - DNA, 22 bp, Artificial Sequence
  chemically synthesized
aatttattgagtatctattaaa

SEQ ID NO: 809304 - DNA, 22 bp, Artificial Sequence
  chemically synthesized
attaaatttattgagtatctat

SEQ ID NO: 809305 - DNA, 22 bp, Artificial Sequence
  chemically synthesized
ctggcaatttaatagatactca

SEQ ID NO: 809306 - DNA, 22 bp, Artificial Sequence
  chemically synthesized
aattaaatttattgagtatcta

SEQ ID NO: 809307 - DNA, 22 bp, Artificial Sequence
  chemically synthesized
taattaaatttattgagtatct

SEQ ID NO: 809308 - DNA, 22 bp, Artificial Sequence
  chemically synthesized
gcaatttaatagatactcaata

SEQ ID NO: 809309 - DNA, 22 bp, Artificial Sequence
  chemically synthesized
actttaattaaatttattgagt

SEQ ID NO: 809310 - DNA, 22 bp, Artificial Sequence
  chemically synthesized
ttgactttaattaaatttattg

SEQ ID NO: 809311 - DNA, 22 bp, Artificial Sequence
  chemically synthesized
attgactttaattaaatttatt

SEQ ID NO: 809312 - DNA, 22 bp, Artificial Sequence
  chemically synthesized
aatagatactcaataaatttaa

SEQ ID NO: 809313 - DNA, 22 bp, Artificial Sequence
  chemically synthesized
atagatactcaataaatttaat

SEQ ID NO: 809314 - DNA, 22 bp, Artificial Sequence
  chemically synthesized
aataaatttaattaaagtcaat

SEQ ID NO: 809315 - DNA, 22 bp, Artificial Sequence
  chemically synthesized
tcggtagtaggtttattgactt

SEQ ID NO: 809316 - DNA, 22 bp, Artificial Sequence
  chemically synthesized
atcggtagtaggtttattgact

SEQ ID NO: 809317 - DNA, 22 bp, Artificial Sequence
  chemically synthesized
aattaaagtcaataaacctact

SEQ ID NO: 809318 - DNA, 22 bp, Artificial Sequence
  chemically synthesized
attaaagtcaataaacctacta

SEQ ID NO: 809319 - DNA, 22 bp, Artificial Sequence
  chemically synthesized
tataccttatcggtagtaggtt

SEQ ID NO: 809320 - DNA, 22 bp, Artificial Sequence
  chemically synthesized
aagtcaataaacctactaccga

SEQ ID NO: 809321 - DNA, 22 bp, Artificial Sequence
  chemically synthesized
gaagctgtataccttatcggta

SEQ ID NO: 809322 - DNA, 22 bp, Artificial Sequence
  chemically synthesized
agaagctgtataccttatcggt

SEQ ID NO: 809323 - DNA, 22 bp, Artificial Sequence
  chemically synthesized
tagaagctgtataccttatcgg

SEQ ID NO: 809324 - DNA, 22 bp, Artificial Sequence
  chemically synthesized
ttagaagctgtataccttatcg

SEQ ID NO: 809325 - DNA, 22 bp, Artificial Sequence
  chemically synthesized
tttttagaagctgtatacctta

SEQ ID NO: 809326 - DNA, 22 bp, Artificial Sequence
  chemically synthesized
gtttttagaagctgtatacctt

SEQ ID NO: 809327 - DNA, 22 bp, Artificial Sequence
  chemically synthesized
ctaccgataaggtatacagctt

SEQ ID NO: 809328 - DNA, 22 bp, Artificial Sequence
  chemically synthesized
ccgataaggtatacagcttcta

SEQ ID NO: 809329 - DNA, 22 bp, Artificial Sequence
  chemically synthesized
tggccttgtttttagaagctgt

SEQ ID NO: 809330 - DNA, 22 bp, Artificial Sequence
  chemically synthesized
agaacaagagcctatggccttg

SEQ ID NO: 809331 - DNA, 22 bp, Artificial Sequence
  chemically synthesized
aagaacaagagcctatggcctt

SEQ ID NO: 809332 - DNA, 22 bp, Artificial Sequence
  chemically synthesized
taagaacaagagcctatggcct

SEQ ID NO: 809333 - DNA, 22 bp, Artificial Sequence
  chemically synthesized
ttaagaacaagagcctatggcc

SEQ ID NO: 809334 - DNA, 22 bp, Artificial Sequence
  chemically synthesized
tttaagaacaagagcctatggc

SEQ ID NO: 809335 - DNA, 22 bp, Artificial Sequence
  chemically synthesized
ctaaaaacaaggccataggctc

SEQ ID NO: 809336 - DNA, 22 bp, Artificial Sequence
  chemically synthesized
taaaaacaaggccataggctct

SEQ ID NO: 809337 - DNA, 22 bp, Artificial Sequence
  chemically synthesized
aaaacaaggccataggctcttg

SEQ ID NO: 809338 - DNA, 22 bp, Artificial Sequence
  chemically synthesized
agttttttaagaacaagagcct

SEQ ID NO: 809339 - DNA, 22 bp, Artificial Sequence
  chemically synthesized
aagttttttaagaacaagagcc

SEQ ID NO: 809340 - DNA, 22 bp, Artificial Sequence
  chemically synthesized
taagttttttaagaacaagagc

SEQ ID NO: 809341 - DNA, 22 bp, Artificial Sequence
  chemically synthesized
acatcaagaaaattttaagttt

SEQ ID NO: 809342 - DNA, 22 bp, Artificial Sequence
  chemically synthesized
ttgttcttaaaaaacttaaaat

SEQ ID NO: 809343 - DNA, 22 bp, Artificial Sequence
  chemically synthesized
gttcttaaaaaacttaaaattt

SEQ ID NO: 809344 - DNA, 22 bp, Artificial Sequence
  chemically synthesized
ttcttaaaaaacttaaaatttt

SEQ ID NO: 809345 - DNA, 22 bp, Artificial Sequence
  chemically synthesized
ttaaaaaacttaaaattttctt

SEQ ID NO: 809346 - DNA, 22 bp, Artificial Sequence
  chemically synthesized
aaaaaacttaaaattttcttga

SEQ ID NO: 809347 - DNA, 22 bp, Artificial Sequence
  chemically synthesized
aataaattcacatcaagaaaat

SEQ ID NO: 809348 - DNA, 22 bp, Artificial Sequence
  chemically synthesized
aaaaacttaaaattttcttgat

SEQ ID NO: 809349 - DNA, 22 bp, Artificial Sequence
  chemically synthesized
ttcaataaattcacatcaagaa

SEQ ID NO: 809350 - DNA, 22 bp, Artificial Sequence
  chemically synthesized
ttattcaataaattcacatcaa

SEQ ID NO: 809351 - DNA, 22 bp, Artificial Sequence
  chemically synthesized
aaaattttcttgatgtgaattt

SEQ ID NO: 809352 - DNA, 22 bp, Artificial Sequence
  chemically synthesized
aaattttcttgatgtgaattta

SEQ ID NO: 809353 - DNA, 22 bp, Artificial Sequence
  chemically synthesized
tcttgatgtgaatttattgaat

SEQ ID NO: 809354 - DNA, 22 bp, Artificial Sequence
  chemically synthesized
cttgatgtgaatttattgaata

SEQ ID NO: 809355 - DNA, 22 bp, Artificial Sequence
  chemically synthesized
ttgatgtgaatttattgaataa

SEQ ID NO: 809356 - DNA, 22 bp, Artificial Sequence
  chemically synthesized
gatgtgaatttattgaataata

SEQ ID NO: 809357 - DNA, 22 bp, Artificial Sequence
  chemically synthesized
atgtgaatttattgaataataa

SEQ ID NO: 809358 - DNA, 22 bp, Artificial Sequence
  chemically synthesized
tataaatataaattattattca

SEQ ID NO: 809359 - DNA, 22 bp, Artificial Sequence
  chemically synthesized
tatataaatataaattattatt

SEQ ID NO: 809360 - DNA, 22 bp, Artificial Sequence
  chemically synthesized
aaattctatataaatataaatt

SEQ ID NO: 809361 - DNA, 22 bp, Artificial Sequence
  chemically synthesized
attgaataataatttatattta

SEQ ID NO: 809362 - DNA, 22 bp, Artificial Sequence
  chemically synthesized
taaaattctatataaatataaa

SEQ ID NO: 809363 - DNA, 22 bp, Artificial Sequence
  chemically synthesized
ttgaataataatttatatttat

SEQ ID NO: 809364 - DNA, 22 bp, Artificial Sequence
  chemically synthesized
aataataatttatatttatata

SEQ ID NO: 809365 - DNA, 22 bp, Artificial Sequence
  chemically synthesized
aactctaaaattctatataaat

SEQ ID NO: 809366 - DNA, 22 bp, Artificial Sequence
  chemically synthesized
atatttatatagaattttagag

SEQ ID NO: 809367 - DNA, 22 bp, Artificial Sequence
  chemically synthesized
tatttatatagaattttagagt

SEQ ID NO: 809368 - DNA, 22 bp, Artificial Sequence
  chemically synthesized
atatagaattttagagtttaga

SEQ ID NO: 809369 - DNA, 22 bp, Artificial Sequence
  chemically synthesized
tatagaattttagagtttagac

SEQ ID NO: 809370 - DNA, 22 bp, Artificial Sequence
  chemically synthesized
tgtgaaagcaatgtctaaactc

SEQ ID NO: 809371 - DNA, 22 bp, Artificial Sequence
  chemically synthesized
atgtgaaagcaatgtctaaact

SEQ ID NO: 809372 - DNA, 22 bp, Artificial Sequence
  chemically synthesized
tagagtttagacattgctttca

SEQ ID NO: 809373 - DNA, 22 bp, Artificial Sequence
  chemically synthesized
aaataatttatgtgaaagcaat

SEQ ID NO: 809374 - DNA, 22 bp, Artificial Sequence
  chemically synthesized
agagtttagacattgctttcac

SEQ ID NO: 809375 - DNA, 22 bp, Artificial Sequence
  chemically synthesized
gagtttagacattgctttcaca

SEQ ID NO: 809376 - DNA, 22 bp, Artificial Sequence
  chemically synthesized
aactgaaataatttatgtgaaa

SEQ ID NO: 809377 - DNA, 22 bp, Artificial Sequence
  chemically synthesized
agacattgctttcacataaatt

SEQ ID NO: 809378 - DNA, 22 bp, Artificial Sequence
  chemically synthesized
gacattgctttcacataaatta

SEQ ID NO: 809379 - DNA, 22 bp, Artificial Sequence
  chemically synthesized
tgaggttcaactgaaataattt

SEQ ID NO: 809380 - DNA, 22 bp, Artificial Sequence
  chemically synthesized
ctttcacataaattatttcagt

SEQ ID NO: 809381 - DNA, 22 bp, Artificial Sequence
  chemically synthesized
ttatgaggttcaactgaaataa

SEQ ID NO: 809382 - DNA, 22 bp, Artificial Sequence
  chemically synthesized
tcacataaattatttcagttga

SEQ ID NO: 809383 - DNA, 22 bp, Artificial Sequence
  chemically synthesized
cacataaattatttcagttgaa

SEQ ID NO: 809384 - DNA, 22 bp, Artificial Sequence
  chemically synthesized
acataaattatttcagttgaac

SEQ ID NO: 809385 - DNA, 22 bp, Artificial Sequence
  chemically synthesized
aaattattatgaggttcaactg

SEQ ID NO: 809386 - DNA, 22 bp, Artificial Sequence
  chemically synthesized
caaattattatgaggttcaact

SEQ ID NO: 809387 - DNA, 22 bp, Artificial Sequence
  chemically synthesized
tcaaattattatgaggttcaac

SEQ ID NO: 809388 - DNA, 22 bp, Artificial Sequence
  chemically synthesized
tttcagttgaacctcataataa

SEQ ID NO: 809389 - DNA, 22 bp, Artificial Sequence
  chemically synthesized
cagttgaacctcataataattt

SEQ ID NO: 809390 - DNA, 22 bp, Artificial Sequence
  chemically synthesized
agttgaacctcataataatttg

SEQ ID NO: 809391 - DNA, 22 bp, Artificial Sequence
  chemically synthesized
aacctcataataatttgaaaat

SEQ ID NO: 809392 - DNA, 22 bp, Artificial Sequence
  chemically synthesized
taacaaagataatattttcaaa

SEQ ID NO: 809393 - DNA, 22 bp, Artificial Sequence
  chemically synthesized
ataacaaagataatattttcaa

SEQ ID NO: 809394 - DNA, 22 bp, Artificial Sequence
  chemically synthesized
tataacaaagataatattttca

SEQ ID NO: 809395 - DNA, 22 bp, Artificial Sequence
  chemically synthesized
ttataacaaagataatattttc

SEQ ID NO: 809396 - DNA, 22 bp, Artificial Sequence
  chemically synthesized
tttataacaaagataatatttt

SEQ ID NO: 809397 - DNA, 22 bp, Artificial Sequence
  chemically synthesized
ataataatttgaaaatattatc

SEQ ID NO: 809398 - DNA, 22 bp, Artificial Sequence
  chemically synthesized
gaaaatattatctttgttataa

SEQ ID NO: 809399 - DNA, 22 bp, Artificial Sequence
  chemically synthesized
aacaatagttttttataacaaa

SEQ ID NO: 809400 - DNA, 22 bp, Artificial Sequence
  chemically synthesized
aaaatattatctttgttataaa

SEQ ID NO: 809401 - DNA, 22 bp, Artificial Sequence
  chemically synthesized
taactgaacaatagttttttat

SEQ ID NO: 809402 - DNA, 22 bp, Artificial Sequence
  chemically synthesized
tctttgttataaaaaactattg

SEQ ID NO: 809403 - DNA, 22 bp, Artificial Sequence
  chemically synthesized
gttataactgaacaatagtttt

SEQ ID NO: 809404 - DNA, 22 bp, Artificial Sequence
  chemically synthesized
ggttataactgaacaatagttt

SEQ ID NO: 809405 - DNA, 22 bp, Artificial Sequence
  chemically synthesized
tgttataaaaaactattgttca

SEQ ID NO: 809406 - DNA, 22 bp, Artificial Sequence
  chemically synthesized
gttataaaaaactattgttcag

SEQ ID NO: 809407 - DNA, 22 bp, Artificial Sequence
  chemically synthesized
ttataaaaaactattgttcagt

SEQ ID NO: 809408 - DNA, 22 bp, Artificial Sequence
  chemically synthesized
taaaaaactattgttcagttat

SEQ ID NO: 809409 - DNA, 22 bp, Artificial Sequence
  chemically synthesized
aacatcttggttataactgaac

SEQ ID NO: 809410 - DNA, 22 bp, Artificial Sequence
  chemically synthesized
aaacatcttggttataactgaa

SEQ ID NO: 809411 - DNA, 22 bp, Artificial Sequence
  chemically synthesized
taaacatcttggttataactga

SEQ ID NO: 809412 - DNA, 22 bp, Artificial Sequence
  chemically synthesized
ttaaacatcttggttataactg

SEQ ID NO: 809413 - DNA, 22 bp, Artificial Sequence
  chemically synthesized
atttttaaacatcttggttata

SEQ ID NO: 809414 - DNA, 22 bp, Artificial Sequence
  chemically synthesized
tcatttttaaacatcttggtta

SEQ ID NO: 809415 - DNA, 22 bp, Artificial Sequence
  chemically synthesized
ttgttcagttataaccaagatg

SEQ ID NO: 809416 - DNA, 22 bp, Artificial Sequence
  chemically synthesized
ttcagttataaccaagatgttt

SEQ ID NO: 809417 - DNA, 22 bp, Artificial Sequence
  chemically synthesized
attctcatttttaaacatcttg

SEQ ID NO: 809418 - DNA, 22 bp, Artificial Sequence
  chemically synthesized
agttataaccaagatgtttaaa

SEQ ID NO: 809419 - DNA, 22 bp, Artificial Sequence
  chemically synthesized
ctcattctcatttttaaacatc

SEQ ID NO: 809420 - DNA, 22 bp, Artificial Sequence
  chemically synthesized
taaccaagatgtttaaaaatga

SEQ ID NO: 809421 - DNA, 22 bp, Artificial Sequence
  chemically synthesized
ggcacagaattgctcattctca

SEQ ID NO: 809422 - DNA, 22 bp, Artificial Sequence
  chemically synthesized
gggcacagaattgctcattctc

SEQ ID NO: 809423 - DNA, 22 bp, Artificial Sequence
  chemically synthesized
tgggcacagaattgctcattct

SEQ ID NO: 809424 - DNA, 22 bp, Artificial Sequence
  chemically synthesized
aaaaatgagaatgagcaattct

SEQ ID NO: 809425 - DNA, 22 bp, Artificial Sequence
  chemically synthesized
aaaatgagaatgagcaattctg

SEQ ID NO: 809426 - DNA, 22 bp, Artificial Sequence
  chemically synthesized
caaagcaaaacacaattttggg

SEQ ID NO: 809427 - DNA, 22 bp, Artificial Sequence
  chemically synthesized
gcaaagcaaaacacaattttgg

SEQ ID NO: 809428 - DNA, 22 bp, Artificial Sequence
  chemically synthesized
tgtgcccaaaattgtgttttgc

SEQ ID NO: 809429 - DNA, 22 bp, Artificial Sequence
  chemically synthesized
tacatttgcaaagcaaaacaca

SEQ ID NO: 809430 - DNA, 22 bp, Artificial Sequence
  chemically synthesized
tgcccaaaattgtgttttgctt

SEQ ID NO: 809431 - DNA, 22 bp, Artificial Sequence
  chemically synthesized
aatatctgtacatttgcaaagc

SEQ ID NO: 809432 - DNA, 22 bp, Artificial Sequence
  chemically synthesized
tgttttgctttgcaaatgtaca

SEQ ID NO: 809433 - DNA, 22 bp, Artificial Sequence
  chemically synthesized
caaagattgaatatctgtacat

SEQ ID NO: 809434 - DNA, 22 bp, Artificial Sequence
  chemically synthesized
tgctttgcaaatgtacagatat

SEQ ID NO: 809435 - DNA, 22 bp, Artificial Sequence
  chemically synthesized
gctttgcaaatgtacagatatt

SEQ ID NO: 809436 - DNA, 22 bp, Artificial Sequence
  chemically synthesized
ctttgcaaatgtacagatattc

SEQ ID NO: 809437 - DNA, 22 bp, Artificial Sequence
  chemically synthesized
tgcaaatgtacagatattcaat

SEQ ID NO: 809438 - DNA, 22 bp, Artificial Sequence
  chemically synthesized
gcaaatgtacagatattcaatc

SEQ ID NO: 809439 - DNA, 22 bp, Artificial Sequence
  chemically synthesized
caaatgtacagatattcaatct

SEQ ID NO: 809440 - DNA, 22 bp, Artificial Sequence
  chemically synthesized
atgaaagatacaaattccaaag

SEQ ID NO: 809441 - DNA, 22 bp, Artificial Sequence
  chemically synthesized
gatgaaagatacaaattccaaa

SEQ ID NO: 809442 - DNA, 22 bp, Artificial Sequence
  chemically synthesized
aatctttggaatttgtatcttt

SEQ ID NO: 809443 - DNA, 22 bp, Artificial Sequence
  chemically synthesized
atataaaatttgatgaaagata

SEQ ID NO: 809444 - DNA, 22 bp, Artificial Sequence
  chemically synthesized
tggaatttgtatctttcatcaa

SEQ ID NO: 809445 - DNA, 22 bp, Artificial Sequence
  chemically synthesized
ggaatttgtatctttcatcaaa

SEQ ID NO: 809446 - DNA, 22 bp, Artificial Sequence
  chemically synthesized
gaatttgtatctttcatcaaat

SEQ ID NO: 809447 - DNA, 22 bp, Artificial Sequence
  chemically synthesized
atggctaatataaaatttgatg

SEQ ID NO: 809448 - DNA, 22 bp, Artificial Sequence
  chemically synthesized
catggctaatataaaatttgat

SEQ ID NO: 809449 - DNA, 22 bp, Artificial Sequence
  chemically synthesized
tcatggctaatataaaatttga

SEQ ID NO: 809450 - DNA, 22 bp, Artificial Sequence
  chemically synthesized
gtatctttcatcaaattttata

SEQ ID NO: 809451 - DNA, 22 bp, Artificial Sequence
  chemically synthesized
tatctttcatcaaattttatat

SEQ ID NO: 809452 - DNA, 22 bp, Artificial Sequence
  chemically synthesized
actttcatggctaatataaaat

SEQ ID NO: 809453 - DNA, 22 bp, Artificial Sequence
  chemically synthesized
cactttcatggctaatataaaa

SEQ ID NO: 809454 - DNA, 22 bp, Artificial Sequence
  chemically synthesized
tcatcaaattttatattagcca

SEQ ID NO: 809455 - DNA, 22 bp, Artificial Sequence
  chemically synthesized
catcaaattttatattagccat

SEQ ID NO: 809456 - DNA, 22 bp, Artificial Sequence
  chemically synthesized
atcaaattttatattagccatg

SEQ ID NO: 809457 - DNA, 22 bp, Artificial Sequence
  chemically synthesized
tatattagccatgaaagtgaag

SEQ ID NO: 809458 - DNA, 22 bp, Artificial Sequence
  chemically synthesized
atattagccatgaaagtgaagg

SEQ ID NO: 809459 - DNA, 22 bp, Artificial Sequence
  chemically synthesized
tattagccatgaaagtgaaggg

SEQ ID NO: 809460 - DNA, 22 bp, Artificial Sequence
  chemically synthesized
gccatgaaagtgaaggggtgga

SEQ ID NO: 809461 - DNA, 22 bp, Artificial Sequence
  chemically synthesized
cccagtaaaatagtccacccct

SEQ ID NO: 809462 - DNA, 22 bp, Artificial Sequence
  chemically synthesized
aatacaatgtgttgcccagtaa

SEQ ID NO: 809463 - DNA, 22 bp, Artificial Sequence
  chemically synthesized
acagctaaatacaatgtgttgc

SEQ ID NO: 809464 - DNA, 22 bp, Artificial Sequence
  chemically synthesized
ttttactgggcaacacattgta

SEQ ID NO: 809465 - DNA, 22 bp, Artificial Sequence
  chemically synthesized
tactgggcaacacattgtattt

SEQ ID NO: 809466 - DNA, 22 bp, Artificial Sequence
  chemically synthesized
actgggcaacacattgtattta

SEQ ID NO: 809467 - DNA, 22 bp, Artificial Sequence
  chemically synthesized
ctgggcaacacattgtatttag

SEQ ID NO: 809468 - DNA, 22 bp, Artificial Sequence
  chemically synthesized
agtcattgacagctaaatacaa

SEQ ID NO: 809469 - DNA, 22 bp, Artificial Sequence
  chemically synthesized
ggcaacacattgtatttagctg

SEQ ID NO: 809470 - DNA, 22 bp, Artificial Sequence
  chemically synthesized
tatttagctgtcaatgactgag

SEQ ID NO: 809471 - DNA, 22 bp, Artificial Sequence
  chemically synthesized
agctgtcaatgactgagtttct

SEQ ID NO: 809472 - DNA, 22 bp, Artificial Sequence
  chemically synthesized
gctgtcaatgactgagtttctg

SEQ ID NO: 809473 - DNA, 22 bp, Artificial Sequence
  chemically synthesized
gtggaagagtaacagaaactca

SEQ ID NO: 809474 - DNA, 22 bp, Artificial Sequence
  chemically synthesized
cgtggaagagtaacagaaactc

SEQ ID NO: 809475 - DNA, 22 bp, Artificial Sequence
  chemically synthesized
tcgtggaagagtaacagaaact

SEQ ID NO: 809476 - DNA, 22 bp, Artificial Sequence
  chemically synthesized
tcaatgactgagtttctgttac

SEQ ID NO: 809477 - DNA, 22 bp, Artificial Sequence
  chemically synthesized
actttcgtggaagagtaacaga

SEQ ID NO: 809478 - DNA, 22 bp, Artificial Sequence
  chemically synthesized
ttaactttcgtggaagagtaac

SEQ ID NO: 809479 - DNA, 22 bp, Artificial Sequence
  chemically synthesized
agtttctgttactcttccacga

SEQ ID NO: 809480 - DNA, 22 bp, Artificial Sequence
  chemically synthesized
ctgttactcttccacgaaagtt

SEQ ID NO: 809481 - DNA, 22 bp, Artificial Sequence
  chemically synthesized
tgttactcttccacgaaagtta

SEQ ID NO: 809482 - DNA, 22 bp, Artificial Sequence
  chemically synthesized
ttactcttccacgaaagttaac

SEQ ID NO: 809483 - DNA, 22 bp, Artificial Sequence
  chemically synthesized
agaaaaaaaattgttaactttc

SEQ ID NO: 809484 - DNA, 22 bp, Artificial Sequence
  chemically synthesized
ctcttccacgaaagttaacaat

SEQ ID NO: 809485 - DNA, 22 bp, Artificial Sequence
  chemically synthesized
ttccacgaaagttaacaatttt

SEQ ID NO: 809486 - DNA, 22 bp, Artificial Sequence
  chemically synthesized
aaaattcagaaaaaaaattgtt

SEQ ID NO: 809487 - DNA, 22 bp, Artificial Sequence
  chemically synthesized
ccacgaaagttaacaatttttt

SEQ ID NO: 809488 - DNA, 22 bp, Artificial Sequence
  chemically synthesized
gaaaattcagaaaaaaaattgt

SEQ ID NO: 809489 - DNA, 22 bp, Artificial Sequence
  chemically synthesized
cacgaaagttaacaattttttt

SEQ ID NO: 809490 - DNA, 22 bp, Artificial Sequence
  chemically synthesized
tgaaaattcagaaaaaaaattg

SEQ ID NO: 809491 - DNA, 22 bp, Artificial Sequence
  chemically synthesized
attttgaaaattcagaaaaaaa

SEQ ID NO: 809492 - DNA, 22 bp, Artificial Sequence
  chemically synthesized
acaattttttttctgaattttc

SEQ ID NO: 809493 - DNA, 22 bp, Artificial Sequence
  chemically synthesized
cagacactcattttgaaaattc

SEQ ID NO: 809494 - DNA, 22 bp, Artificial Sequence
  chemically synthesized
gcagacactcattttgaaaatt

SEQ ID NO: 809495 - DNA, 22 bp, Artificial Sequence
  chemically synthesized
tgcagacactcattttgaaaat

SEQ ID NO: 809496 - DNA, 22 bp, Artificial Sequence
  chemically synthesized
ttgcagacactcattttgaaaa

SEQ ID NO: 809497 - DNA, 22 bp, Artificial Sequence
  chemically synthesized
tttgcagacactcattttgaaa

SEQ ID NO: 809498 - DNA, 22 bp, Artificial Sequence
  chemically synthesized
tttttctgaattttcaaaatga

SEQ ID NO: 809499 - DNA, 22 bp, Artificial Sequence
  chemically synthesized
ttttctgaattttcaaaatgag

SEQ ID NO: 809500 - DNA, 22 bp, Artificial Sequence
  chemically synthesized
tttctgaattttcaaaatgagt

SEQ ID NO: 809501 - DNA, 22 bp, Artificial Sequence
  chemically synthesized
ttctgaattttcaaaatgagtg

SEQ ID NO: 809502 - DNA, 22 bp, Artificial Sequence
  chemically synthesized
tctgaattttcaaaatgagtgt

SEQ ID NO: 809503 - DNA, 22 bp, Artificial Sequence
  chemically synthesized
ctgaattttcaaaatgagtgtc

SEQ ID NO: 809504 - DNA, 22 bp, Artificial Sequence
  chemically synthesized
tgaattttcaaaatgagtgtct

SEQ ID NO: 809505 - DNA, 22 bp, Artificial Sequence
  chemically synthesized
aattttcaaaatgagtgtctgc

SEQ ID NO: 809506 - DNA, 22 bp, Artificial Sequence
  chemically synthesized
aaataacattttttgcagacac

SEQ ID NO: 809507 - DNA, 22 bp, Artificial Sequence
  chemically synthesized
tcaaaatgagtgtctgcaaaaa

SEQ ID NO: 809508 - DNA, 22 bp, Artificial Sequence
  chemically synthesized
caaaatgagtgtctgcaaaaaa

SEQ ID NO: 809509 - DNA, 22 bp, Artificial Sequence
  chemically synthesized
aaaatgagtgtctgcaaaaaat

SEQ ID NO: 809510 - DNA, 22 bp, Artificial Sequence
  chemically synthesized
gaaagtattgaaataacatttt

SEQ ID NO: 809511 - DNA, 22 bp, Artificial Sequence
  chemically synthesized
caaaaaatgttatttcaatact

SEQ ID NO: 809512 - DNA, 22 bp, Artificial Sequence
  chemically synthesized
atacacctagaaagtattgaaa

SEQ ID NO: 809513 - DNA, 22 bp, Artificial Sequence
  chemically synthesized
aatacacctagaaagtattgaa

SEQ ID NO: 809514 - DNA, 22 bp, Artificial Sequence
  chemically synthesized
taatacacctagaaagtattga

SEQ ID NO: 809515 - DNA, 22 bp, Artificial Sequence
  chemically synthesized
tttaatacacctagaaagtatt

SEQ ID NO: 809516 - DNA, 22 bp, Artificial Sequence
  chemically synthesized
ctttaatacacctagaaagtat

SEQ ID NO: 809517 - DNA, 22 bp, Artificial Sequence
  chemically synthesized
tttctttaatacacctagaaag

SEQ ID NO: 809518 - DNA, 22 bp, Artificial Sequence
  chemically synthesized
tttcaatactttctaggtgtat

SEQ ID NO: 809519 - DNA, 22 bp, Artificial Sequence
  chemically synthesized
tctatttctttaatacacctag

SEQ ID NO: 809520 - DNA, 22 bp, Artificial Sequence
  chemically synthesized
caatactttctaggtgtattaa

SEQ ID NO: 809521 - DNA, 22 bp, Artificial Sequence
  chemically synthesized
aatactttctaggtgtattaaa

SEQ ID NO: 809522 - DNA, 22 bp, Artificial Sequence
  chemically synthesized
tatgctgtctatttctttaata

SEQ ID NO: 809523 - DNA, 22 bp, Artificial Sequence
  chemically synthesized
gtatgctgtctatttctttaat

SEQ ID NO: 809524 - DNA, 22 bp, Artificial Sequence
  chemically synthesized
tctaggtgtattaaagaaatag

SEQ ID NO: 809525 - DNA, 22 bp, Artificial Sequence
  chemically synthesized
tttgtatgctgtctatttcttt

SEQ ID NO: 809526 - DNA, 22 bp, Artificial Sequence
  chemically synthesized
ctaggtgtattaaagaaataga

SEQ ID NO: 809527 - DNA, 22 bp, Artificial Sequence
  chemically synthesized
taggtgtattaaagaaatagac

SEQ ID NO: 809528 - DNA, 22 bp, Artificial Sequence
  chemically synthesized
ttatttgtatgctgtctatttc

SEQ ID NO: 809529 - DNA, 22 bp, Artificial Sequence
  chemically synthesized
ggtgtattaaagaaatagacag

SEQ ID NO: 809530 - DNA, 22 bp, Artificial Sequence
  chemically synthesized
aagaaatagacagcatacaaat

SEQ ID NO: 809531 - DNA, 22 bp, Artificial Sequence
  chemically synthesized
acagaagttattatttgtatgc

SEQ ID NO: 809532 - DNA, 22 bp, Artificial Sequence
  chemically synthesized
gacagaagttattatttgtatg

SEQ ID NO: 809533 - DNA, 22 bp, Artificial Sequence
  chemically synthesized
tgacagaagttattatttgtat

SEQ ID NO: 809534 - DNA, 22 bp, Artificial Sequence
  chemically synthesized
attttgacagaagttattattt

SEQ ID NO: 809535 - DNA, 22 bp, Artificial Sequence
  chemically synthesized
ccaaaataacaggttaattttg

SEQ ID NO: 809536 - DNA, 22 bp, Artificial Sequence
  chemically synthesized
gccaaaataacaggttaatttt

SEQ ID NO: 809537 - DNA, 22 bp, Artificial Sequence
  chemically synthesized
ctgtcaaaattaacctgttatt

SEQ ID NO: 809538 - DNA, 22 bp, Artificial Sequence
  chemically synthesized
aacatttgccaaaataacaggt

SEQ ID NO: 809539 - DNA, 22 bp, Artificial Sequence
  chemically synthesized
tgtcaaaattaacctgttattt

SEQ ID NO: 809540 - DNA, 22 bp, Artificial Sequence
  chemically synthesized
tcaaaattaacctgttattttg

SEQ ID NO: 809541 - DNA, 22 bp, Artificial Sequence
  chemically synthesized
taggcaatctgaacatttgcca

SEQ ID NO: 809542 - DNA, 22 bp, Artificial Sequence
  chemically synthesized
acctgttattttggcaaatgtt

SEQ ID NO: 809543 - DNA, 22 bp, Artificial Sequence
  chemically synthesized
ataggcaatctgaacatttgcc

SEQ ID NO: 809544 - DNA, 22 bp, Artificial Sequence
  chemically synthesized
ttattttggcaaatgttcagat

SEQ ID NO: 809545 - DNA, 22 bp, Artificial Sequence
  chemically synthesized
ttttggcaaatgttcagattgc

SEQ ID NO: 809546 - DNA, 22 bp, Artificial Sequence
  chemically synthesized
tggcaaatgttcagattgccta

SEQ ID NO: 809547 - DNA, 22 bp, Artificial Sequence
  chemically synthesized
ggcaaatgttcagattgcctat

SEQ ID NO: 809548 - DNA, 22 bp, Artificial Sequence
  chemically synthesized
gcaaatgttcagattgcctata

SEQ ID NO: 809549 - DNA, 22 bp, Artificial Sequence
  chemically synthesized
aagaccaggatcaaacttatag

SEQ ID NO: 809550 - DNA, 22 bp, Artificial Sequence
  chemically synthesized
agattgcctataagtttgatcc

SEQ ID NO: 809551 - DNA, 22 bp, Artificial Sequence
  chemically synthesized
atgtctgaagaccaggatcaaa

SEQ ID NO: 809552 - DNA, 22 bp, Artificial Sequence
  chemically synthesized
gatgtctgaagaccaggatcaa

SEQ ID NO: 809553 - DNA, 22 bp, Artificial Sequence
  chemically synthesized
cctataagtttgatcctggtct

SEQ ID NO: 809554 - DNA, 22 bp, Artificial Sequence
  chemically synthesized
gtacttgatgtctgaagaccag

SEQ ID NO: 809555 - DNA, 22 bp, Artificial Sequence
  chemically synthesized
taagtttgatcctggtcttcag

SEQ ID NO: 809556 - DNA, 22 bp, Artificial Sequence
  chemically synthesized
ggtacttgatgtctgaagacca

SEQ ID NO: 809557 - DNA, 22 bp, Artificial Sequence
  chemically synthesized
tggtacttgatgtctgaagacc

SEQ ID NO: 809558 - DNA, 22 bp, Artificial Sequence
  chemically synthesized
ttggtacttgatgtctgaagac

SEQ ID NO: 809559 - DNA, 22 bp, Artificial Sequence
  chemically synthesized
gatcctggtcttcagacatcaa

SEQ ID NO: 809560 - DNA, 22 bp, Artificial Sequence
  chemically synthesized
atcctggtcttcagacatcaag

SEQ ID NO: 809561 - DNA, 22 bp, Artificial Sequence
  chemically synthesized
aggcacttttggtacttgatgt

SEQ ID NO: 809562 - DNA, 22 bp, Artificial Sequence
  chemically synthesized
aaggcacttttggtacttgatg

SEQ ID NO: 809563 - DNA, 22 bp, Artificial Sequence
  chemically synthesized
taaggcacttttggtacttgat

SEQ ID NO: 809564 - DNA, 22 bp, Artificial Sequence
  chemically synthesized
gtcttcagacatcaagtaccaa

SEQ ID NO: 809565 - DNA, 22 bp, Artificial Sequence
  chemically synthesized
cagacatcaagtaccaaaagtg

SEQ ID NO: 809566 - DNA, 22 bp, Artificial Sequence
  chemically synthesized
agacatcaagtaccaaaagtgc

SEQ ID NO: 809567 - DNA, 22 bp, Artificial Sequence
  chemically synthesized
gacaggatgcgttttaaggcac

SEQ ID NO: 809568 - DNA, 22 bp, Artificial Sequence
  chemically synthesized
aaaacgcatcctgtccagacac

SEQ ID NO: 809569 - DNA, 22 bp, Artificial Sequence
  chemically synthesized
aaacgcatcctgtccagacacc

SEQ ID NO: 809570 - DNA, 22 bp, Artificial Sequence
  chemically synthesized
ggtgacagaagccaaatgggtg

SEQ ID NO: 809571 - DNA, 22 bp, Artificial Sequence
  chemically synthesized
gggtgacagaagccaaatgggt

SEQ ID NO: 809572 - DNA, 22 bp, Artificial Sequence
  chemically synthesized
tgggtgacagaagccaaatggg

SEQ ID NO: 809573 - DNA, 22 bp, Artificial Sequence
  chemically synthesized
tccagacacccatttggcttct

SEQ ID NO: 809574 - DNA, 22 bp, Artificial Sequence
  chemically synthesized
ggcttctgtcacccaaaatact

SEQ ID NO: 809575 - DNA, 22 bp, Artificial Sequence
  chemically synthesized
gcttctgtcacccaaaatactc

SEQ ID NO: 809576 - DNA, 22 bp, Artificial Sequence
  chemically synthesized
ctgtcacccaaaatactcctgc

SEQ ID NO: 809577 - DNA, 22 bp, Artificial Sequence
  chemically synthesized
tgtcacccaaaatactcctgcc

SEQ ID NO: 809578 - DNA, 22 bp, Artificial Sequence
  chemically synthesized
tcacccaaaatactcctgccct

SEQ ID NO: 809579 - DNA, 22 bp, Artificial Sequence
  chemically synthesized
tgggtgataaaaagcagggagg

SEQ ID NO: 809580 - DNA, 22 bp, Artificial Sequence
  chemically synthesized
atgggtgataaaaagcagggag

SEQ ID NO: 809581 - DNA, 22 bp, Artificial Sequence
  chemically synthesized
ctgccctccctgctttttatca

SEQ ID NO: 809582 - DNA, 22 bp, Artificial Sequence
  chemically synthesized
ccctccctgctttttatcaccc

SEQ ID NO: 809583 - DNA, 22 bp, Artificial Sequence
  chemically synthesized
cctgctttttatcacccataag

SEQ ID NO: 809584 - DNA, 22 bp, Artificial Sequence
  chemically synthesized
ctttttatcacccataagtttg

SEQ ID NO: 809585 - DNA, 22 bp, Artificial Sequence
  chemically synthesized
tttatcacccataagtttgatg

SEQ ID NO: 809586 - DNA, 22 bp, Artificial Sequence
  chemically synthesized
ttatcacccataagtttgatgg

SEQ ID NO: 809587 - DNA, 22 bp, Artificial Sequence
  chemically synthesized
cagagaggaggcccatcaaact

SEQ ID NO: 809588 - DNA, 22 bp, Artificial Sequence
  chemically synthesized
tatcacccataagtttgatggg

SEQ ID NO: 809589 - DNA, 22 bp, Artificial Sequence
  chemically synthesized
atcacccataagtttgatgggc

SEQ ID NO: 809590 - DNA, 22 bp, Artificial Sequence
  chemically synthesized
tcacccataagtttgatgggcc

SEQ ID NO: 809591 - DNA, 22 bp, Artificial Sequence
  chemically synthesized
gatgggcctcctctctgtagtt

SEQ ID NO: 809592 - DNA, 22 bp, Artificial Sequence
  chemically synthesized
atgggcctcctctctgtagttc

SEQ ID NO: 809593 - DNA, 22 bp, Artificial Sequence
  chemically synthesized
acagaacatgagtagaactaca

SEQ ID NO: 809594 - DNA, 22 bp, Artificial Sequence
  chemically synthesized
gacagaacatgagtagaactac

SEQ ID NO: 809595 - DNA, 22 bp, Artificial Sequence
  chemically synthesized
tgacagaacatgagtagaacta

SEQ ID NO: 809596 - DNA, 22 bp, Artificial Sequence
  chemically synthesized
ttgacagaacatgagtagaact

SEQ ID NO: 809597 - DNA, 22 bp, Artificial Sequence
  chemically synthesized
ctctctgtagttctactcatgt

SEQ ID NO: 809598 - DNA, 22 bp, Artificial Sequence
  chemically synthesized
tctgtagttctactcatgttct

SEQ ID NO: 809599 - DNA, 22 bp, Artificial Sequence
  chemically synthesized
gatgtttttgacagaacatgag

SEQ ID NO: 809600 - DNA, 22 bp, Artificial Sequence
  chemically synthesized
tgtagttctactcatgttctgt

SEQ ID NO: 809601 - DNA, 22 bp, Artificial Sequence
  chemically synthesized
tagttctactcatgttctgtca

SEQ ID NO: 809602 - DNA, 22 bp, Artificial Sequence
  chemically synthesized
acacactggatgtttttgacag

SEQ ID NO: 809603 - DNA, 22 bp, Artificial Sequence
  chemically synthesized
tactcatgttctgtcaaaaaca

SEQ ID NO: 809604 - DNA, 22 bp, Artificial Sequence
  chemically synthesized
ctcatgttctgtcaaaaacatc

SEQ ID NO: 809605 - DNA, 22 bp, Artificial Sequence
  chemically synthesized
atgttctgtcaaaaacatccag

SEQ ID NO: 809606 - DNA, 22 bp, Artificial Sequence
  chemically synthesized
aaccctgacacactggatgttt

SEQ ID NO: 809607 - DNA, 22 bp, Artificial Sequence
  chemically synthesized
tcaaccctgacacactggatgt

SEQ ID NO: 809608 - DNA, 22 bp, Artificial Sequence
  chemically synthesized
ttctcaaccctgacacactgga

SEQ ID NO: 809609 - DNA, 22 bp, Artificial Sequence
  chemically synthesized
tgtcaaaaacatccagtgtgtc

SEQ ID NO: 809610 - DNA, 22 bp, Artificial Sequence
  chemically synthesized
tgttctcaaccctgacacactg

SEQ ID NO: 809611 - DNA, 22 bp, Artificial Sequence
  chemically synthesized
tcaaaaacatccagtgtgtcag

SEQ ID NO: 809612 - DNA, 22 bp, Artificial Sequence
  chemically synthesized
ctgttctcaaccctgacacact

SEQ ID NO: 809613 - DNA, 22 bp, Artificial Sequence
  chemically synthesized
tgtcacaagcttctgttctcaa

SEQ ID NO: 809614 - DNA, 22 bp, Artificial Sequence
  chemically synthesized
gtgctatgtcacaagcttctgt

SEQ ID NO: 809615 - DNA, 22 bp, Artificial Sequence
  chemically synthesized
tggtgctatgtcacaagcttct

SEQ ID NO: 809616 - DNA, 22 bp, Artificial Sequence
  chemically synthesized
agaacagaagcttgtgacatag

SEQ ID NO: 809617 - DNA, 22 bp, Artificial Sequence
  chemically synthesized
gtgacatagcaccagagatctt

SEQ ID NO: 809618 - DNA, 22 bp, Artificial Sequence
  chemically synthesized
tgacatagcaccagagatcttc

SEQ ID NO: 809619 - DNA, 22 bp, Artificial Sequence
  chemically synthesized
atagaccagtgtcaggtggtga

SEQ ID NO: 809620 - DNA, 22 bp, Artificial Sequence
  chemically synthesized
ccatcaccacctgacactggtc

SEQ ID NO: 809621 - DNA, 22 bp, Artificial Sequence
  chemically synthesized
catcaccacctgacactggtct

SEQ ID NO: 809622 - DNA, 22 bp, Artificial Sequence
  chemically synthesized
cgcaaaggatgtcgattaatag

SEQ ID NO: 809623 - DNA, 22 bp, Artificial Sequence
  chemically synthesized
acgcaaaggatgtcgattaata

SEQ ID NO: 809624 - DNA, 22 bp, Artificial Sequence
  chemically synthesized
tacgcaaaggatgtcgattaat

SEQ ID NO: 809625 - DNA, 22 bp, Artificial Sequence
  chemically synthesized
acactggtctattaatcgacat

SEQ ID NO: 809626 - DNA, 22 bp, Artificial Sequence
  chemically synthesized
atgattttacgcaaaggatgtc

SEQ ID NO: 809627 - DNA, 22 bp, Artificial Sequence
  chemically synthesized
gtctattaatcgacatcctttg

SEQ ID NO: 809628 - DNA, 22 bp, Artificial Sequence
  chemically synthesized
catgattttacgcaaaggatgt

SEQ ID NO: 809629 - DNA, 22 bp, Artificial Sequence
  chemically synthesized
ttaatcgacatcctttgcgtaa

SEQ ID NO: 809630 - DNA, 22 bp, Artificial Sequence
  chemically synthesized
atcgacatcctttgcgtaaaat

SEQ ID NO: 809631 - DNA, 22 bp, Artificial Sequence
  chemically synthesized
gaagccacttcatgattttacg

SEQ ID NO: 809632 - DNA, 22 bp, Artificial Sequence
  chemically synthesized
agaagccacttcatgattttac

SEQ ID NO: 809633 - DNA, 22 bp, Artificial Sequence
  chemically synthesized
gatggcttagaagccacttcat

SEQ ID NO: 809634 - DNA, 22 bp, Artificial Sequence
  chemically synthesized
tgcgtaaaatcatgaagtggct

SEQ ID NO: 809635 - DNA, 22 bp, Artificial Sequence
  chemically synthesized
gcgtaaaatcatgaagtggctt

SEQ ID NO: 809636 - DNA, 22 bp, Artificial Sequence
  chemically synthesized
cgtaaaatcatgaagtggcttc

SEQ ID NO: 809637 - DNA, 22 bp, Artificial Sequence
  chemically synthesized
gatgcaagataaattggatggc

SEQ ID NO: 809638 - DNA, 22 bp, Artificial Sequence
  chemically synthesized
gctagatgcaagataaattgga

SEQ ID NO: 809639 - DNA, 22 bp, Artificial Sequence
  chemically synthesized
ctaagccatccaatttatcttg

SEQ ID NO: 809640 - DNA, 22 bp, Artificial Sequence
  chemically synthesized
taagccatccaatttatcttgc

SEQ ID NO: 809641 - DNA, 22 bp, Artificial Sequence
  chemically synthesized
agccatccaatttatcttgcat

SEQ ID NO: 809642 - DNA, 22 bp, Artificial Sequence
  chemically synthesized
gagaaatactggctagatgcaa

SEQ ID NO: 809643 - DNA, 22 bp, Artificial Sequence
  chemically synthesized
atcttgcatctagccagtattt

SEQ ID NO: 809644 - DNA, 22 bp, Artificial Sequence
  chemically synthesized
tcttgcatctagccagtatttc

SEQ ID NO: 809645 - DNA, 22 bp, Artificial Sequence
  chemically synthesized
tgaataagttggagaaatactg

SEQ ID NO: 809646 - DNA, 22 bp, Artificial Sequence
  chemically synthesized
gtgaataagttggagaaatact

SEQ ID NO: 809647 - DNA, 22 bp, Artificial Sequence
  chemically synthesized
gcatctagccagtatttctcca

SEQ ID NO: 809648 - DNA, 22 bp, Artificial Sequence
  chemically synthesized
ttgtgaataagttggagaaata

SEQ ID NO: 809649 - DNA, 22 bp, Artificial Sequence
  chemically synthesized
catctagccagtatttctccaa

SEQ ID NO: 809650 - DNA, 22 bp, Artificial Sequence
  chemically synthesized
tactcttgtgaataagttggag

SEQ ID NO: 809651 - DNA, 22 bp, Artificial Sequence
  chemically synthesized
gccagtatttctccaacttatt

SEQ ID NO: 809652 - DNA, 22 bp, Artificial Sequence
  chemically synthesized
gttatactcttgtgaataagtt

SEQ ID NO: 809653 - DNA, 22 bp, Artificial Sequence
  chemically synthesized
cgttatactcttgtgaataagt

SEQ ID NO: 809654 - DNA, 22 bp, Artificial Sequence
  chemically synthesized
tcgttatactcttgtgaataag

SEQ ID NO: 809655 - DNA, 22 bp, Artificial Sequence
  chemically synthesized
ctccaacttattcacaagagta

SEQ ID NO: 809656 - DNA, 22 bp, Artificial Sequence
  chemically synthesized
tccaacttattcacaagagtat

SEQ ID NO: 809657 - DNA, 22 bp, Artificial Sequence
  chemically synthesized
caacttattcacaagagtataa

SEQ ID NO: 809658 - DNA, 22 bp, Artificial Sequence
  chemically synthesized
acaaagtctttcgttatactct

SEQ ID NO: 809659 - DNA, 22 bp, Artificial Sequence
  chemically synthesized
gacaaagtctttcgttatactc

SEQ ID NO: 809660 - DNA, 22 bp, Artificial Sequence
  chemically synthesized
attcacaagagtataacgaaag

SEQ ID NO: 809661 - DNA, 22 bp, Artificial Sequence
  chemically synthesized
ttcacaagagtataacgaaaga

SEQ ID NO: 809662 - DNA, 22 bp, Artificial Sequence
  chemically synthesized
ggcatttgacaaagtctttcgt

SEQ ID NO: 809663 - DNA, 22 bp, Artificial Sequence
  chemically synthesized
acaagagtataacgaaagactt

SEQ ID NO: 809664 - DNA, 22 bp, Artificial Sequence
  chemically synthesized
atctgggcatttgacaaagtct

SEQ ID NO: 809665 - DNA, 22 bp, Artificial Sequence
  chemically synthesized
catctgggcatttgacaaagtc

SEQ ID NO: 809666 - DNA, 22 bp, Artificial Sequence
  chemically synthesized
catttcatctgggcatttgaca

SEQ ID NO: 809667 - DNA, 22 bp, Artificial Sequence
  chemically synthesized
gcatttcatctgggcatttgac

SEQ ID NO: 809668 - DNA, 22 bp, Artificial Sequence
  chemically synthesized
tttgcatttcatctgggcattt

SEQ ID NO: 809669 - DNA, 22 bp, Artificial Sequence
  chemically synthesized
tgtcaaatgcccagatgaaatg

SEQ ID NO: 809670 - DNA, 22 bp, Artificial Sequence
  chemically synthesized
gtcaaatgcccagatgaaatgc

SEQ ID NO: 809671 - DNA, 22 bp, Artificial Sequence
  chemically synthesized
tcaaatgcccagatgaaatgca

SEQ ID NO: 809672 - DNA, 22 bp, Artificial Sequence
  chemically synthesized
gacaagtaggtaagtaaaatgc

SEQ ID NO: 809673 - DNA, 22 bp, Artificial Sequence
  chemically synthesized
agacaagtaggtaagtaaaatg

SEQ ID NO: 809674 - DNA, 22 bp, Artificial Sequence
  chemically synthesized
tagacaagtaggtaagtaaaat

SEQ ID NO: 809675 - DNA, 22 bp, Artificial Sequence
  chemically synthesized
ttagacaagtaggtaagtaaaa

SEQ ID NO: 809676 - DNA, 22 bp, Artificial Sequence
  chemically synthesized
ctgcattttacttacctacttg

SEQ ID NO: 809677 - DNA, 22 bp, Artificial Sequence
  chemically synthesized
cattttacttacctacttgtct

SEQ ID NO: 809678 - DNA, 22 bp, Artificial Sequence
  chemically synthesized
caatgaaaaacttttagacaag

SEQ ID NO: 809679 - DNA, 22 bp, Artificial Sequence
  chemically synthesized
acaatgaaaaacttttagacaa

SEQ ID NO: 809680 - DNA, 22 bp, Artificial Sequence
  chemically synthesized
tacttacctacttgtctaaaag

SEQ ID NO: 809681 - DNA, 22 bp, Artificial Sequence
  chemically synthesized
tacaatgaaaaacttttagaca

SEQ ID NO: 809682 - DNA, 22 bp, Artificial Sequence
  chemically synthesized
acttacctacttgtctaaaagt

SEQ ID NO: 809683 - DNA, 22 bp, Artificial Sequence
  chemically synthesized
cttacctacttgtctaaaagtt

SEQ ID NO: 809684 - DNA, 22 bp, Artificial Sequence
  chemically synthesized
acctacttgtctaaaagttttt

SEQ ID NO: 809685 - DNA, 22 bp, Artificial Sequence
  chemically synthesized
cctacttgtctaaaagtttttc

SEQ ID NO: 809686 - DNA, 22 bp, Artificial Sequence
  chemically synthesized
cttgtctaaaagtttttcattg

SEQ ID NO: 809687 - DNA, 22 bp, Artificial Sequence
  chemically synthesized
gtctaaaagtttttcattgtaa

SEQ ID NO: 809688 - DNA, 22 bp, Artificial Sequence
  chemically synthesized
tctaaaagtttttcattgtaaa

SEQ ID NO: 809689 - DNA, 22 bp, Artificial Sequence
  chemically synthesized
agataaaataatgttttacaat

SEQ ID NO: 809690 - DNA, 22 bp, Artificial Sequence
  chemically synthesized
aaagtttttcattgtaaaacat

SEQ ID NO: 809691 - DNA, 22 bp, Artificial Sequence
  chemically synthesized
ttgagataaaataatgttttac

SEQ ID NO: 809692 - DNA, 22 bp, Artificial Sequence
  chemically synthesized
aattattgagataaaataatgt

SEQ ID NO: 809693 - DNA, 22 bp, Artificial Sequence
  chemically synthesized
ttcattgtaaaacattatttta

SEQ ID NO: 809694 - DNA, 22 bp, Artificial Sequence
  chemically synthesized
tcattgtaaaacattattttat

SEQ ID NO: 809695 - DNA, 22 bp, Artificial Sequence
  chemically synthesized
cattgtaaaacattattttatc

SEQ ID NO: 809696 - DNA, 22 bp, Artificial Sequence
  chemically synthesized
attgtaaaacattattttatct

SEQ ID NO: 809697 - DNA, 22 bp, Artificial Sequence
  chemically synthesized
tctaaattattgagataaaata

SEQ ID NO: 809698 - DNA, 22 bp, Artificial Sequence
  chemically synthesized
ttgtctaaattattgagataaa

SEQ ID NO: 809699 - DNA, 22 bp, Artificial Sequence
  chemically synthesized
taaaacattattttatctcaat

SEQ ID NO: 809700 - DNA, 22 bp, Artificial Sequence
  chemically synthesized
ttttatctcaataatttagaca

SEQ ID NO: 809701 - DNA, 22 bp, Artificial Sequence
  chemically synthesized
tatctcaataatttagacaata

SEQ ID NO: 809702 - DNA, 22 bp, Artificial Sequence
  chemically synthesized
atctcaataatttagacaatag

SEQ ID NO: 809703 - DNA, 22 bp, Artificial Sequence
  chemically synthesized
tctcaataatttagacaatagg

SEQ ID NO: 809704 - DNA, 22 bp, Artificial Sequence
  chemically synthesized
aataatttagacaatagggatt

SEQ ID NO: 809705 - DNA, 22 bp, Artificial Sequence
  chemically synthesized
catacagggataaatccctatt

SEQ ID NO: 809706 - DNA, 22 bp, Artificial Sequence
  chemically synthesized
agacaatagggatttatccctg

SEQ ID NO: 809707 - DNA, 22 bp, Artificial Sequence
  chemically synthesized
gacaatagggatttatccctgt

SEQ ID NO: 809708 - DNA, 22 bp, Artificial Sequence
  chemically synthesized
atccctgtatgcaggtatatct

SEQ ID NO: 809709 - DNA, 22 bp, Artificial Sequence
  chemically synthesized
gtaaaacaacacagatatacct

SEQ ID NO: 809710 - DNA, 22 bp, Artificial Sequence
  chemically synthesized
tccctgtatgcaggtatatctg

SEQ ID NO: 809711 - DNA, 22 bp, Artificial Sequence
  chemically synthesized
agtaaaacaacacagatatacc

SEQ ID NO: 809712 - DNA, 22 bp, Artificial Sequence
  chemically synthesized
atttagtaaaacaacacagata

SEQ ID NO: 809713 - DNA, 22 bp, Artificial Sequence
  chemically synthesized
tatgcaggtatatctgtgttgt

SEQ ID NO: 809714 - DNA, 22 bp, Artificial Sequence
  chemically synthesized
gctaatttagtaaaacaacaca

SEQ ID NO: 809715 - DNA, 22 bp, Artificial Sequence
  chemically synthesized
aagagattagctaatttagtaa

SEQ ID NO: 809716 - DNA, 22 bp, Artificial Sequence
  chemically synthesized
ttgaagagattagctaatttag

SEQ ID NO: 809717 - DNA, 22 bp, Artificial Sequence
  chemically synthesized
attgaagagattagctaattta

SEQ ID NO: 809718 - DNA, 22 bp, Artificial Sequence
  chemically synthesized
tgttgttttactaaattagcta

SEQ ID NO: 809719 - DNA, 22 bp, Artificial Sequence
  chemically synthesized
ttttactaaattagctaatctc

SEQ ID NO: 809720 - DNA, 22 bp, Artificial Sequence
  chemically synthesized
tactaaattagctaatctcttc

SEQ ID NO: 809721 - DNA, 22 bp, Artificial Sequence
  chemically synthesized
actaaattagctaatctcttca

SEQ ID NO: 809722 - DNA, 22 bp, Artificial Sequence
  chemically synthesized
ctaaattagctaatctcttcaa

SEQ ID NO: 809723 - DNA, 22 bp, Artificial Sequence
  chemically synthesized
aattagctaatctcttcaataa

SEQ ID NO: 809724 - DNA, 22 bp, Artificial Sequence
  chemically synthesized
gctaatctcttcaataaatggg

SEQ ID NO: 809725 - DNA, 22 bp, Artificial Sequence
  chemically synthesized
taagagaaatatgaacccattt

SEQ ID NO: 809726 - DNA, 22 bp, Artificial Sequence
  chemically synthesized
atctcttcaataaatgggttca

SEQ ID NO: 809727 - DNA, 22 bp, Artificial Sequence
  chemically synthesized
ttcaataaatgggttcatattt

SEQ ID NO: 809728 - DNA, 22 bp, Artificial Sequence
  chemically synthesized
caataaatgggttcatatttct

SEQ ID NO: 809729 - DNA, 22 bp, Artificial Sequence
  chemically synthesized
aataaatgggttcatatttctc

SEQ ID NO: 809730 - DNA, 22 bp, Artificial Sequence
  chemically synthesized
cgtggaggctataagagaaata

SEQ ID NO: 809731 - DNA, 22 bp, Artificial Sequence
  chemically synthesized
acgtggaggctataagagaaat

SEQ ID NO: 809732 - DNA, 22 bp, Artificial Sequence
  chemically synthesized
atatttctcttatagcctccac

SEQ ID NO: 809733 - DNA, 22 bp, Artificial Sequence
  chemically synthesized
aatgcaacttacgtggaggcta

SEQ ID NO: 809734 - DNA, 22 bp, Artificial Sequence
  chemically synthesized
ctcttatagcctccacgtaagt

SEQ ID NO: 809735 - DNA, 22 bp, Artificial Sequence
  chemically synthesized
tcttatagcctccacgtaagtt

SEQ ID NO: 809736 - DNA, 22 bp, Artificial Sequence
  chemically synthesized
aaatgctaaatgcaacttacgt

SEQ ID NO: 809737 - DNA, 22 bp, Artificial Sequence
  chemically synthesized
ttatagcctccacgtaagttgc

SEQ ID NO: 809738 - DNA, 22 bp, Artificial Sequence
  chemically synthesized
aaaatgctaaatgcaacttacg

SEQ ID NO: 809739 - DNA, 22 bp, Artificial Sequence
  chemically synthesized
atagcctccacgtaagttgcat

SEQ ID NO: 809740 - DNA, 22 bp, Artificial Sequence
  chemically synthesized
tagcctccacgtaagttgcatt

SEQ ID NO: 809741 - DNA, 22 bp, Artificial Sequence
  chemically synthesized
cacgtaagttgcatttagcatt

SEQ ID NO: 809742 - DNA, 22 bp, Artificial Sequence
  chemically synthesized
tccaagacatttaaaatgctaa

SEQ ID NO: 809743 - DNA, 22 bp, Artificial Sequence
  chemically synthesized
tagctgtccaagacatttaaaa

SEQ ID NO: 809744 - DNA, 22 bp, Artificial Sequence
  chemically synthesized
catttagcattttaaatgtctt

SEQ ID NO: 809745 - DNA, 22 bp, Artificial Sequence
  chemically synthesized
ttgtagctgtccaagacattta

SEQ ID NO: 809746 - DNA, 22 bp, Artificial Sequence
  chemically synthesized
agcattttaaatgtcttggaca

SEQ ID NO: 809747 - DNA, 22 bp, Artificial Sequence
  chemically synthesized
gcattttaaatgtcttggacag

SEQ ID NO: 809748 - DNA, 22 bp, Artificial Sequence
  chemically synthesized
taaatgtcttggacagctacaa

SEQ ID NO: 809749 - DNA, 22 bp, Artificial Sequence
  chemically synthesized
taagagatattattgtagctgt

SEQ ID NO: 809750 - DNA, 22 bp, Artificial Sequence
  chemically synthesized
aaatgtcttggacagctacaat

SEQ ID NO: 809751 - DNA, 22 bp, Artificial Sequence
  chemically synthesized
aatgtcttggacagctacaata

SEQ ID NO: 809752 - DNA, 22 bp, Artificial Sequence
  chemically synthesized
ggacagctacaataatatctct

SEQ ID NO: 809753 - DNA, 22 bp, Artificial Sequence
  chemically synthesized
gacagctacaataatatctctt

SEQ ID NO: 809754 - DNA, 22 bp, Artificial Sequence
  chemically synthesized
tgtaaaaattataagagatatt

SEQ ID NO: 809755 - DNA, 22 bp, Artificial Sequence
  chemically synthesized
atgtaaaaattataagagatat

SEQ ID NO: 809756 - DNA, 22 bp, Artificial Sequence
  chemically synthesized
tatgtaaaaattataagagata

SEQ ID NO: 809757 - DNA, 22 bp, Artificial Sequence
  chemically synthesized
aattttatgtaaaaattataag

SEQ ID NO: 809758 - DNA, 22 bp, Artificial Sequence
  chemically synthesized
caataatatctcttataatttt

SEQ ID NO: 809759 - DNA, 22 bp, Artificial Sequence
  chemically synthesized
ttataatttttacataaaattc

SEQ ID NO: 809760 - DNA, 22 bp, Artificial Sequence
  chemically synthesized
ataaatgcagttgaattttatg

SEQ ID NO: 809761 - DNA, 22 bp, Artificial Sequence
  chemically synthesized
ataatttttacataaaattcaa

SEQ ID NO: 809762 - DNA, 22 bp, Artificial Sequence
  chemically synthesized
taatttttacataaaattcaac

SEQ ID NO: 809763 - DNA, 22 bp, Artificial Sequence
  chemically synthesized
ttgataaatgcagttgaatttt

SEQ ID NO: 809764 - DNA, 22 bp, Artificial Sequence
  chemically synthesized
ttacataaaattcaactgcatt

SEQ ID NO: 809765 - DNA, 22 bp, Artificial Sequence
  chemically synthesized
tacataaaattcaactgcattt

SEQ ID NO: 809766 - DNA, 22 bp, Artificial Sequence
  chemically synthesized
acataaaattcaactgcattta

SEQ ID NO: 809767 - DNA, 22 bp, Artificial Sequence
  chemically synthesized
accagttgttgataaatgcagt

SEQ ID NO: 809768 - DNA, 22 bp, Artificial Sequence
  chemically synthesized
cataaaattcaactgcatttat

SEQ ID NO: 809769 - DNA, 22 bp, Artificial Sequence
  chemically synthesized
aactgcatttatcaacaactgg

SEQ ID NO: 809770 - DNA, 22 bp, Artificial Sequence
  chemically synthesized
catttatcaacaactggttagg

SEQ ID NO: 809771 - DNA, 22 bp, Artificial Sequence
  chemically synthesized
tatcaatcgccccctaaccagt

SEQ ID NO: 809772 - DNA, 22 bp, Artificial Sequence
  chemically synthesized
atcaacaactggttagggggcg

SEQ ID NO: 809773 - DNA, 22 bp, Artificial Sequence
  chemically synthesized
tcaacaactggttagggggcga

SEQ ID NO: 809774 - DNA, 22 bp, Artificial Sequence
  chemically synthesized
acatagctatatcaatcgcccc

SEQ ID NO: 809775 - DNA, 22 bp, Artificial Sequence
  chemically synthesized
ccctcacatagctatatcaatc

SEQ ID NO: 809776 - DNA, 22 bp, Artificial Sequence
  chemically synthesized
cccctcacatagctatatcaat

SEQ ID NO: 809777 - DNA, 22 bp, Artificial Sequence
  chemically synthesized
gttagggggcgattgatatagc

SEQ ID NO: 809778 - DNA, 22 bp, Artificial Sequence
  chemically synthesized
cttcccctcacatagctatatc

SEQ ID NO: 809779 - DNA, 22 bp, Artificial Sequence
  chemically synthesized
gggggcgattgatatagctatg

SEQ ID NO: 809780 - DNA, 22 bp, Artificial Sequence
  chemically synthesized
tccttcccctcacatagctata

SEQ ID NO: 809781 - DNA, 22 bp, Artificial Sequence
  chemically synthesized
ttctccttcccctcacatagct

SEQ ID NO: 809782 - DNA, 22 bp, Artificial Sequence
  chemically synthesized
atctattctccttcccctcaca

SEQ ID NO: 809783 - DNA, 22 bp, Artificial Sequence
  chemically synthesized
atatagctatgtgaggggaagg

SEQ ID NO: 809784 - DNA, 22 bp, Artificial Sequence
  chemically synthesized
tgtgaggggaaggagaatagat

SEQ ID NO: 809785 - DNA, 22 bp, Artificial Sequence
  chemically synthesized
taaaagggtggtgataacactc

SEQ ID NO: 809786 - DNA, 22 bp, Artificial Sequence
  chemically synthesized
tataaaagggtggtgataacac

SEQ ID NO: 809787 - DNA, 22 bp, Artificial Sequence
  chemically synthesized
aatggcatgatctctataaaag

SEQ ID NO: 809788 - DNA, 22 bp, Artificial Sequence
  chemically synthesized
gaatggcatgatctctataaaa

SEQ ID NO: 809789 - DNA, 22 bp, Artificial Sequence
  chemically synthesized
tcaccacccttttatagagatc

SEQ ID NO: 809790 - DNA, 22 bp, Artificial Sequence
  chemically synthesized
accacttgaatggcatgatctc

SEQ ID NO: 809791 - DNA, 22 bp, Artificial Sequence
  chemically synthesized
caccacttgaatggcatgatct

SEQ ID NO: 809792 - DNA, 22 bp, Artificial Sequence
  chemically synthesized
tcaccacttgaatggcatgatc

SEQ ID NO: 809793 - DNA, 22 bp, Artificial Sequence
  chemically synthesized
ttttcaccacttgaatggcatg

SEQ ID NO: 809794 - DNA, 22 bp, Artificial Sequence
  chemically synthesized
ttatagagatcatgccattcaa

SEQ ID NO: 809795 - DNA, 22 bp, Artificial Sequence
  chemically synthesized
tatagagatcatgccattcaag

SEQ ID NO: 809796 - DNA, 22 bp, Artificial Sequence
  chemically synthesized
atagagatcatgccattcaagt

SEQ ID NO: 809797 - DNA, 22 bp, Artificial Sequence
  chemically synthesized
tagagatcatgccattcaagtg

SEQ ID NO: 809798 - DNA, 22 bp, Artificial Sequence
  chemically synthesized
taatctattttcaccacttgaa

SEQ ID NO: 809799 - DNA, 22 bp, Artificial Sequence
  chemically synthesized
caattataatctattttcacca

SEQ ID NO: 809800 - DNA, 22 bp, Artificial Sequence
  chemically synthesized
tcactgcaattataatctattt

SEQ ID NO: 809801 - DNA, 22 bp, Artificial Sequence
  chemically synthesized
aagtggtgaaaatagattataa

SEQ ID NO: 809802 - DNA, 22 bp, Artificial Sequence
  chemically synthesized
tgattatcactgcaattataat

SEQ ID NO: 809803 - DNA, 22 bp, Artificial Sequence
  chemically synthesized
tgtgattatcactgcaattata

SEQ ID NO: 809804 - DNA, 22 bp, Artificial Sequence
  chemically synthesized
caattctgtgattatcactgca

SEQ ID NO: 809805 - DNA, 22 bp, Artificial Sequence
  chemically synthesized
acaattctgtgattatcactgc

SEQ ID NO: 809806 - DNA, 22 bp, Artificial Sequence
  chemically synthesized
tacaattctgtgattatcactg

SEQ ID NO: 809807 - DNA, 22 bp, Artificial Sequence
  chemically synthesized
ttacaattctgtgattatcact

SEQ ID NO: 809808 - DNA, 22 bp, Artificial Sequence
  chemically synthesized
taattgcagtgataatcacaga

SEQ ID NO: 809809 - DNA, 22 bp, Artificial Sequence
  chemically synthesized
gcccagtcttttacaattctgt

SEQ ID NO: 809810 - DNA, 22 bp, Artificial Sequence
  chemically synthesized
cagtgataatcacagaattgta

SEQ ID NO: 809811 - DNA, 22 bp, Artificial Sequence
  chemically synthesized
tctagcccagtcttttacaatt

SEQ ID NO: 809812 - DNA, 22 bp, Artificial Sequence
  chemically synthesized
ccagattgtctagcccagtctt

SEQ ID NO: 809813 - DNA, 22 bp, Artificial Sequence
  chemically synthesized
agacctgccagattgtctagcc

SEQ ID NO: 809814 - DNA, 22 bp, Artificial Sequence
  chemically synthesized
cagacctgccagattgtctagc

SEQ ID NO: 809815 - DNA, 22 bp, Artificial Sequence
  chemically synthesized
taaaagactgggctagacaatc

SEQ ID NO: 809816 - DNA, 22 bp, Artificial Sequence
  chemically synthesized
ccatttcagacctgccagattg

SEQ ID NO: 809817 - DNA, 22 bp, Artificial Sequence
  chemically synthesized
ggctagacaatctggcaggtct

SEQ ID NO: 809818 - DNA, 22 bp, Artificial Sequence
  chemically synthesized
gacaatctggcaggtctgaaat

SEQ ID NO: 809819 - DNA, 22 bp, Artificial Sequence
  chemically synthesized
aatgaaattaccatttcagacc

SEQ ID NO: 809820 - DNA, 22 bp, Artificial Sequence
  chemically synthesized
caagactaaatgaaattaccat

SEQ ID NO: 809821 - DNA, 22 bp, Artificial Sequence
  chemically synthesized
gcaggtctgaaatggtaatttc

SEQ ID NO: 809822 - DNA, 22 bp, Artificial Sequence
  chemically synthesized
acaagactaaatgaaattacca

SEQ ID NO: 809823 - DNA, 22 bp, Artificial Sequence
  chemically synthesized
tacaagactaaatgaaattacc

SEQ ID NO: 809824 - DNA, 22 bp, Artificial Sequence
  chemically synthesized
ttacaagactaaatgaaattac

SEQ ID NO: 809825 - DNA, 22 bp, Artificial Sequence
  chemically synthesized
ccatttttacaagactaaatga

SEQ ID NO: 809826 - DNA, 22 bp, Artificial Sequence
  chemically synthesized
aaatggtaatttcatttagtct

SEQ ID NO: 809827 - DNA, 22 bp, Artificial Sequence
  chemically synthesized
catttagtcttgtaaaaatggc

SEQ ID NO: 809828 - DNA, 22 bp, Artificial Sequence
  chemically synthesized
agtgatacagttgccattttta

SEQ ID NO: 809829 - DNA, 22 bp, Artificial Sequence
  chemically synthesized
atttagtcttgtaaaaatggca

SEQ ID NO: 809830 - DNA, 22 bp, Artificial Sequence
  chemically synthesized
tgagtgatacagttgccatttt

SEQ ID NO: 809831 - DNA, 22 bp, Artificial Sequence
  chemically synthesized
ctgagtgatacagttgccattt

SEQ ID NO: 809832 - DNA, 22 bp, Artificial Sequence
  chemically synthesized
agtcttgtaaaaatggcaactg

SEQ ID NO: 809833 - DNA, 22 bp, Artificial Sequence
  chemically synthesized
gtcttgtaaaaatggcaactgt

SEQ ID NO: 809834 - DNA, 22 bp, Artificial Sequence
  chemically synthesized
tttctgagtgatacagttgcca

SEQ ID NO: 809835 - DNA, 22 bp, Artificial Sequence
  chemically synthesized
gtaaaaatggcaactgtatcac

SEQ ID NO: 809836 - DNA, 22 bp, Artificial Sequence
  chemically synthesized
acctatttctgagtgatacagt

SEQ ID NO: 809837 - DNA, 22 bp, Artificial Sequence
  chemically synthesized
taaaaatggcaactgtatcact

SEQ ID NO: 809838 - DNA, 22 bp, Artificial Sequence
  chemically synthesized
ggagcacctaacctatttctga

SEQ ID NO: 809839 - DNA, 22 bp, Artificial Sequence
  chemically synthesized
cggagcacctaacctatttctg

SEQ ID NO: 809840 - DNA, 22 bp, Artificial Sequence
  chemically synthesized
tcggagcacctaacctatttct

SEQ ID NO: 809841 - DNA, 22 bp, Artificial Sequence
  chemically synthesized
tatcactcagaaataggttagg

SEQ ID NO: 809842 - DNA, 22 bp, Artificial Sequence
  chemically synthesized
agaaataggttaggtgctccga

SEQ ID NO: 809843 - DNA, 22 bp, Artificial Sequence
  chemically synthesized
atgaaatagcagtattttcgga

SEQ ID NO: 809844 - DNA, 22 bp, Artificial Sequence
  chemically synthesized
ggtgctccgaaaatactgctat

SEQ ID NO: 809845 - DNA, 22 bp, Artificial Sequence
  chemically synthesized
tgaattaatgaaatagcagtat

SEQ ID NO: 809846 - DNA, 22 bp, Artificial Sequence
  chemically synthesized
gtgaattaatgaaatagcagta

SEQ ID NO: 809847 - DNA, 22 bp, Artificial Sequence
  chemically synthesized
atttgtgaattaatgaaatagc

SEQ ID NO: 809848 - DNA, 22 bp, Artificial Sequence
  chemically synthesized
cgaaaatactgctatttcatta

SEQ ID NO: 809849 - DNA, 22 bp, Artificial Sequence
  chemically synthesized
ctatttcattaattcacaaatc

SEQ ID NO: 809850 - DNA, 22 bp, Artificial Sequence
  chemically synthesized
cagacaaatactgatttgtgaa

SEQ ID NO: 809851 - DNA, 22 bp, Artificial Sequence
  chemically synthesized
ccagacaaatactgatttgtga

SEQ ID NO: 809852 - DNA, 22 bp, Artificial Sequence
  chemically synthesized
tccagacaaatactgatttgtg

SEQ ID NO: 809853 - DNA, 22 bp, Artificial Sequence
  chemically synthesized
tttcattaattcacaaatcagt

SEQ ID NO: 809854 - DNA, 22 bp, Artificial Sequence
  chemically synthesized
cattaattcacaaatcagtatt

SEQ ID NO: 809855 - DNA, 22 bp, Artificial Sequence
  chemically synthesized
attaattcacaaatcagtattt

SEQ ID NO: 809856 - DNA, 22 bp, Artificial Sequence
  chemically synthesized
aatatctttccagacaaatact

SEQ ID NO: 809857 - DNA, 22 bp, Artificial Sequence
  chemically synthesized
attcacaaatcagtatttgtct

SEQ ID NO: 809858 - DNA, 22 bp, Artificial Sequence
  chemically synthesized
gttaaatatctttccagacaaa

SEQ ID NO: 809859 - DNA, 22 bp, Artificial Sequence
  chemically synthesized
acaaatcagtatttgtctggaa

SEQ ID NO: 809860 - DNA, 22 bp, Artificial Sequence
  chemically synthesized
ggttaaatatctttccagacaa

SEQ ID NO: 809861 - DNA, 22 bp, Artificial Sequence
  chemically synthesized
tataatttggttaaatatcttt

SEQ ID NO: 809862 - DNA, 22 bp, Artificial Sequence
  chemically synthesized
gtctggaaagatatttaaccaa

SEQ ID NO: 809863 - DNA, 22 bp, Artificial Sequence
  chemically synthesized
tctggaaagatatttaaccaaa

SEQ ID NO: 809864 - DNA, 22 bp, Artificial Sequence
  chemically synthesized
tggtctgtataatttggttaaa

SEQ ID NO: 809865 - DNA, 22 bp, Artificial Sequence
  chemically synthesized
gtggtctgtataatttggttaa

SEQ ID NO: 809866 - DNA, 22 bp, Artificial Sequence
  chemically synthesized
tgtggtctgtataatttggtta

SEQ ID NO: 809867 - DNA, 22 bp, Artificial Sequence
  chemically synthesized
ttgtggtctgtataatttggtt

SEQ ID NO: 809868 - DNA, 22 bp, Artificial Sequence
  chemically synthesized
gaaagatatttaaccaaattat

SEQ ID NO: 809869 - DNA, 22 bp, Artificial Sequence
  chemically synthesized
tttgtggtctgtataatttggt

SEQ ID NO: 809870 - DNA, 22 bp, Artificial Sequence
  chemically synthesized
ttttgtggtctgtataatttgg

SEQ ID NO: 809871 - DNA, 22 bp, Artificial Sequence
  chemically synthesized
tttttgtggtctgtataatttg

SEQ ID NO: 809872 - DNA, 22 bp, Artificial Sequence
  chemically synthesized
ttttttgtggtctgtataattt

SEQ ID NO: 809873 - DNA, 22 bp, Artificial Sequence
  chemically synthesized
ttttttttgtggtctgtataat

SEQ ID NO: 809874 - DNA, 22 bp, Artificial Sequence
  chemically synthesized
aaccaaattatacagaccacaa

SEQ ID NO: 809875 - DNA, 22 bp, Artificial Sequence
  chemically synthesized
accaaattatacagaccacaaa

SEQ ID NO: 809876 - DNA, 22 bp, Artificial Sequence
  chemically synthesized
ggatgcctcttttttttgtggt

SEQ ID NO: 809877 - DNA, 22 bp, Artificial Sequence
  chemically synthesized
taggatgcctcttttttttgtg

SEQ ID NO: 809878 - DNA, 22 bp, Artificial Sequence
  chemically synthesized
ctaggatgcctcttttttttgt

SEQ ID NO: 809879 - DNA, 22 bp, Artificial Sequence
  chemically synthesized
tacagaccacaaaaaaaagagg

SEQ ID NO: 809880 - DNA, 22 bp, Artificial Sequence
  chemically synthesized
aatttctaggatgcctcttttt

SEQ ID NO: 809881 - DNA, 22 bp, Artificial Sequence
  chemically synthesized
cctcaatttctaggatgcctct

SEQ ID NO: 809882 - DNA, 22 bp, Artificial Sequence
  chemically synthesized
tgatagtcaaatgtcctccctc

SEQ ID NO: 809883 - DNA, 22 bp, Artificial Sequence
  chemically synthesized
gaaattgagggaggacatttga

SEQ ID NO: 809884 - DNA, 22 bp, Artificial Sequence
  chemically synthesized
aatcactgtgatagtcaaatgt

SEQ ID NO: 809885 - DNA, 22 bp, Artificial Sequence
  chemically synthesized
caatcactgtgatagtcaaatg

SEQ ID NO: 809886 - DNA, 22 bp, Artificial Sequence
  chemically synthesized
ttcaatcactgtgatagtcaaa

SEQ ID NO: 809887 - DNA, 22 bp, Artificial Sequence
  chemically synthesized
agggaggacatttgactatcac

SEQ ID NO: 809888 - DNA, 22 bp, Artificial Sequence
  chemically synthesized
tagtaacactcttcaatcactg

SEQ ID NO: 809889 - DNA, 22 bp, Artificial Sequence
  chemically synthesized
ttatagtaacactcttcaatca

SEQ ID NO: 809890 - DNA, 22 bp, Artificial Sequence
  chemically synthesized
gactatcacagtgattgaagag

SEQ ID NO: 809891 - DNA, 22 bp, Artificial Sequence
  chemically synthesized
actatcacagtgattgaagagt

SEQ ID NO: 809892 - DNA, 22 bp, Artificial Sequence
  chemically synthesized
tcacagtgattgaagagtgtta

SEQ ID NO: 809893 - DNA, 22 bp, Artificial Sequence
  chemically synthesized
cacagaatgctattatagtaac

SEQ ID NO: 809894 - DNA, 22 bp, Artificial Sequence
  chemically synthesized
tccacagaatgctattatagta

SEQ ID NO: 809895 - DNA, 22 bp, Artificial Sequence
  chemically synthesized
aagagtgttactataatagcat

SEQ ID NO: 809896 - DNA, 22 bp, Artificial Sequence
  chemically synthesized
cctctccacagaatgctattat

SEQ ID NO: 809897 - DNA, 22 bp, Artificial Sequence
  chemically synthesized
attccctctccacagaatgcta

SEQ ID NO: 809898 - DNA, 22 bp, Artificial Sequence
  chemically synthesized
cattccctctccacagaatgct

SEQ ID NO: 809899 - DNA, 22 bp, Artificial Sequence
  chemically synthesized
ctataatagcattctgtggaga

SEQ ID NO: 809900 - DNA, 22 bp, Artificial Sequence
  chemically synthesized
ccatcttcattccctctccaca

SEQ ID NO: 809901 - DNA, 22 bp, Artificial Sequence
  chemically synthesized
taatagcattctgtggagaggg

SEQ ID NO: 809902 - DNA, 22 bp, Artificial Sequence
  chemically synthesized
tgtggagagggaatgaagatgg

SEQ ID NO: 809903 - DNA, 22 bp, Artificial Sequence
  chemically synthesized
tataagaagtctaccatcttca

SEQ ID NO: 809904 - DNA, 22 bp, Artificial Sequence
  chemically synthesized
tggagagggaatgaagatggta

SEQ ID NO: 809905 - DNA, 22 bp, Artificial Sequence
  chemically synthesized
ttgtataagaagtctaccatct

SEQ ID NO: 809906 - DNA, 22 bp, Artificial Sequence
  chemically synthesized
gttgtataagaagtctaccatc

SEQ ID NO: 809907 - DNA, 22 bp, Artificial Sequence
  chemically synthesized
tgttgtataagaagtctaccat

SEQ ID NO: 809908 - DNA, 22 bp, Artificial Sequence
  chemically synthesized
tttgttgtataagaagtctacc

SEQ ID NO: 809909 - DNA, 22 bp, Artificial Sequence
  chemically synthesized
ggagagttctttgttgtataag

SEQ ID NO: 809910 - DNA, 22 bp, Artificial Sequence
  chemically synthesized
gggagagttctttgttgtataa

SEQ ID NO: 809911 - DNA, 22 bp, Artificial Sequence
  chemically synthesized
tcagacttgggagagttctttg

SEQ ID NO: 809912 - DNA, 22 bp, Artificial Sequence
  chemically synthesized
cttatacaacaaagaactctcc

SEQ ID NO: 809913 - DNA, 22 bp, Artificial Sequence
  chemically synthesized
ttatacaacaaagaactctccc

SEQ ID NO: 809914 - DNA, 22 bp, Artificial Sequence
  chemically synthesized
atacaacaaagaactctcccaa

SEQ ID NO: 809915 - DNA, 22 bp, Artificial Sequence
  chemically synthesized
tacaacaaagaactctcccaag

SEQ ID NO: 809916 - DNA, 22 bp, Artificial Sequence
  chemically synthesized
caaagtgctgtcagacttggga

SEQ ID NO: 809917 - DNA, 22 bp, Artificial Sequence
  chemically synthesized
tcccaagtctgacagcactttg

SEQ ID NO: 809918 - DNA, 22 bp, Artificial Sequence
  chemically synthesized
ccaagtctgacagcactttgga

SEQ ID NO: 809919 - DNA, 22 bp, Artificial Sequence
  chemically synthesized
acagcactttggaatatcccac

SEQ ID NO: 809920 - DNA, 22 bp, Artificial Sequence
  chemically synthesized
cacatacatgcatgtccagtgg

SEQ ID NO: 809921 - DNA, 22 bp, Artificial Sequence
  chemically synthesized
ccacatacatgcatgtccagtg

SEQ ID NO: 809922 - DNA, 22 bp, Artificial Sequence
  chemically synthesized
tggaatatcccactggacatgc

SEQ ID NO: 809923 - DNA, 22 bp, Artificial Sequence
  chemically synthesized
ggaatatcccactggacatgca

SEQ ID NO: 809924 - DNA, 22 bp, Artificial Sequence
  chemically synthesized
gaatatcccactggacatgcat

SEQ ID NO: 809925 - DNA, 22 bp, Artificial Sequence
  chemically synthesized
taaacagggtttccacatacat

SEQ ID NO: 809926 - DNA, 22 bp, Artificial Sequence
  chemically synthesized
ataaacagggtttccacataca

SEQ ID NO: 809927 - DNA, 22 bp, Artificial Sequence
  chemically synthesized
gacatgcatgtatgtggaaacc

SEQ ID NO: 809928 - DNA, 22 bp, Artificial Sequence
  chemically synthesized
ggtgtttataaacagggtttcc

SEQ ID NO: 809929 - DNA, 22 bp, Artificial Sequence
  chemically synthesized
aggtgtttataaacagggtttc

SEQ ID NO: 809930 - DNA, 22 bp, Artificial Sequence
  chemically synthesized
caggtttaggtgtttataaaca

SEQ ID NO: 809931 - DNA, 22 bp, Artificial Sequence
  chemically synthesized
cgttccaggtttaggtgtttat

SEQ ID NO: 809932 - DNA, 22 bp, Artificial Sequence
  chemically synthesized
agttacgttccaggtttaggtg

SEQ ID NO: 809933 - DNA, 22 bp, Artificial Sequence
  chemically synthesized
tttataaacacctaaacctgga

SEQ ID NO: 809934 - DNA, 22 bp, Artificial Sequence
  chemically synthesized
ataaacacctaaacctggaacg

SEQ ID NO: 809935 - DNA, 22 bp, Artificial Sequence
  chemically synthesized
taaacacctaaacctggaacgt

SEQ ID NO: 809936 - DNA, 22 bp, Artificial Sequence
  chemically synthesized
cgtgtaaaattgagttacgttc

SEQ ID NO: 809937 - DNA, 22 bp, Artificial Sequence
  chemically synthesized
acgtgtaaaattgagttacgtt

SEQ ID NO: 809938 - DNA, 22 bp, Artificial Sequence
  chemically synthesized
aacctggaacgtaactcaattt

SEQ ID NO: 809939 - DNA, 22 bp, Artificial Sequence
  chemically synthesized
tgtttacgtgtaaaattgagtt

SEQ ID NO: 809940 - DNA, 22 bp, Artificial Sequence
  chemically synthesized
atgtttacgtgtaaaattgagt

SEQ ID NO: 809941 - DNA, 22 bp, Artificial Sequence
  chemically synthesized
gaacgtaactcaattttacacg

SEQ ID NO: 809942 - DNA, 22 bp, Artificial Sequence
  chemically synthesized
aattttacacgtaaacataaga

SEQ ID NO: 809943 - DNA, 22 bp, Artificial Sequence
  chemically synthesized
tacacgtaaacataagatattt

SEQ ID NO: 809944 - DNA, 22 bp, Artificial Sequence
  chemically synthesized
aaatcatgaggaaaatatctta

SEQ ID NO: 809945 - DNA, 22 bp, Artificial Sequence
  chemically synthesized
acacgtaaacataagatatttt

SEQ ID NO: 809946 - DNA, 22 bp, Artificial Sequence
  chemically synthesized
aaaatcatgaggaaaatatctt

SEQ ID NO: 809947 - DNA, 22 bp, Artificial Sequence
  chemically synthesized
cacgtaaacataagatattttc

SEQ ID NO: 809948 - DNA, 22 bp, Artificial Sequence
  chemically synthesized
aatgtcttaaaatcatgaggaa

SEQ ID NO: 809949 - DNA, 22 bp, Artificial Sequence
  chemically synthesized
aaaaattcaatgtcttaaaatc

SEQ ID NO: 809950 - DNA, 22 bp, Artificial Sequence
  chemically synthesized
tcctcatgattttaagacattg

SEQ ID NO: 809951 - DNA, 22 bp, Artificial Sequence
  chemically synthesized
cctcatgattttaagacattga

SEQ ID NO: 809952 - DNA, 22 bp, Artificial Sequence
  chemically synthesized
ctcatgattttaagacattgaa

SEQ ID NO: 809953 - DNA, 22 bp, Artificial Sequence
  chemically synthesized
catggctgaaaaattcaatgtc

SEQ ID NO: 809954 - DNA, 22 bp, Artificial Sequence
  chemically synthesized
atgattttaagacattgaattt

SEQ ID NO: 809955 - DNA, 22 bp, Artificial Sequence
  chemically synthesized
gttgcatggctgaaaaattcaa

SEQ ID NO: 809956 - DNA, 22 bp, Artificial Sequence
  chemically synthesized
taagacattgaatttttcagcc

SEQ ID NO: 809957 - DNA, 22 bp, Artificial Sequence
  chemically synthesized
aagacattgaatttttcagcca

SEQ ID NO: 809958 - DNA, 22 bp, Artificial Sequence
  chemically synthesized
agacattgaatttttcagccat

SEQ ID NO: 809959 - DNA, 22 bp, Artificial Sequence
  chemically synthesized
tggcagttagttgcatggctga

SEQ ID NO: 809960 - DNA, 22 bp, Artificial Sequence
  chemically synthesized
aatttttcagccatgcaactaa

SEQ ID NO: 809961 - DNA, 22 bp, Artificial Sequence
  chemically synthesized
gatcgttatggcagttagttgc

SEQ ID NO: 809962 - DNA, 22 bp, Artificial Sequence
  chemically synthesized
ggatcgttatggcagttagttg

SEQ ID NO: 809963 - DNA, 22 bp, Artificial Sequence
  chemically synthesized
ttcagccatgcaactaactgcc

SEQ ID NO: 809964 - DNA, 22 bp, Artificial Sequence
  chemically synthesized
ttggatcgttatggcagttagt

SEQ ID NO: 809965 - DNA, 22 bp, Artificial Sequence
  chemically synthesized
tcagccatgcaactaactgcca

SEQ ID NO: 809966 - DNA, 22 bp, Artificial Sequence
  chemically synthesized
cttggatcgttatggcagttag

SEQ ID NO: 809967 - DNA, 22 bp, Artificial Sequence
  chemically synthesized
cagccatgcaactaactgccat

SEQ ID NO: 809968 - DNA, 22 bp, Artificial Sequence
  chemically synthesized
tcttggatcgttatggcagtta

SEQ ID NO: 809969 - DNA, 22 bp, Artificial Sequence
  chemically synthesized
agccatgcaactaactgccata

SEQ ID NO: 809970 - DNA, 22 bp, Artificial Sequence
  chemically synthesized
ttcttggatcgttatggcagtt

SEQ ID NO: 809971 - DNA, 22 bp, Artificial Sequence
  chemically synthesized
tttcttggatcgttatggcagt

SEQ ID NO: 809972 - DNA, 22 bp, Artificial Sequence
  chemically synthesized
actgccataacgatccaagaaa

SEQ ID NO: 809973 - DNA, 22 bp, Artificial Sequence
  chemically synthesized
ccataacgatccaagaaaaaat

SEQ ID NO: 809974 - DNA, 22 bp, Artificial Sequence
  chemically synthesized
acaccatgaaataaattttttc

SEQ ID NO: 809975 - DNA, 22 bp, Artificial Sequence
  chemically synthesized
ctaacaccatgaaataaatttt

SEQ ID NO: 809976 - DNA, 22 bp, Artificial Sequence
  chemically synthesized
gcaaaattcctaacaccatgaa

SEQ ID NO: 809977 - DNA, 22 bp, Artificial Sequence
  chemically synthesized
ggcaaaattcctaacaccatga

SEQ ID NO: 809978 - DNA, 22 bp, Artificial Sequence
  chemically synthesized
ttggcaaaattcctaacaccat

SEQ ID NO: 809979 - DNA, 22 bp, Artificial Sequence
  chemically synthesized
atttcatggtgttaggaatttt

SEQ ID NO: 809980 - DNA, 22 bp, Artificial Sequence
  chemically synthesized
tttcatggtgttaggaattttg

SEQ ID NO: 809981 - DNA, 22 bp, Artificial Sequence
  chemically synthesized
aacaactcttggcaaaattcct

SEQ ID NO: 809982 - DNA, 22 bp, Artificial Sequence
  chemically synthesized
catggtgttaggaattttgcca

SEQ ID NO: 809983 - DNA, 22 bp, Artificial Sequence
  chemically synthesized
atggtgttaggaattttgccaa

SEQ ID NO: 809984 - DNA, 22 bp, Artificial Sequence
  chemically synthesized
caaaatgctgaacaactcttgg

SEQ ID NO: 809985 - DNA, 22 bp, Artificial Sequence
  chemically synthesized
ccaaaatgctgaacaactcttg

SEQ ID NO: 809986 - DNA, 22 bp, Artificial Sequence
  chemically synthesized
tccaaaatgctgaacaactctt

SEQ ID NO: 809987 - DNA, 22 bp, Artificial Sequence
  chemically synthesized
ggaattttgccaagagttgttc

SEQ ID NO: 809988 - DNA, 22 bp, Artificial Sequence
  chemically synthesized
tgccaagagttgttcagcattt

SEQ ID NO: 809989 - DNA, 22 bp, Artificial Sequence
  chemically synthesized
gccaagagttgttcagcatttt

SEQ ID NO: 809990 - DNA, 22 bp, Artificial Sequence
  chemically synthesized
ccaagagttgttcagcattttg

SEQ ID NO: 809991 - DNA, 22 bp, Artificial Sequence
  chemically synthesized
gtcatccatagcgtaattttcc

SEQ ID NO: 809992 - DNA, 22 bp, Artificial Sequence
  chemically synthesized
ttcagcattttggaaaattacg

SEQ ID NO: 809993 - DNA, 22 bp, Artificial Sequence
  chemically synthesized
agcattttggaaaattacgcta

SEQ ID NO: 809994 - DNA, 22 bp, Artificial Sequence
  chemically synthesized
tggaaaattacgctatggatga

SEQ ID NO: 809995 - DNA, 22 bp, Artificial Sequence
  chemically synthesized
ggaaaattacgctatggatgac

SEQ ID NO: 809996 - DNA, 22 bp, Artificial Sequence
  chemically synthesized
gaaaattacgctatggatgacc

SEQ ID NO: 809997 - DNA, 22 bp, Artificial Sequence
  chemically synthesized
aaataccatgaggggcattggt

SEQ ID NO: 809998 - DNA, 22 bp, Artificial Sequence
  chemically synthesized
cgctatggatgaccaatgcccc

SEQ ID NO: 809999 - DNA, 22 bp, Artificial Sequence
  chemically synthesized
tggatgaccaatgcccctcatg

SEQ ID NO: 810000 - DNA, 22 bp, Artificial Sequence
  chemically synthesized
tatggagactcaaataccatga

SEQ ID NO: 810001 - DNA, 22 bp, Artificial Sequence
  chemically synthesized
tgttgtatggagactcaaatac

SEQ ID NO: 810002 - DNA, 22 bp, Artificial Sequence
  chemically synthesized
atggtatttgagtctccataca

SEQ ID NO: 810003 - DNA, 22 bp, Artificial Sequence
  chemically synthesized
gagtctccatacaacacaatgg

SEQ ID NO: 810004 - DNA, 22 bp, Artificial Sequence
  chemically synthesized
agtctccatacaacacaatggt

SEQ ID NO: 810005 - DNA, 22 bp, Artificial Sequence
  chemically synthesized
catacaacacaatggtgtcatt

SEQ ID NO: 810006 - DNA, 22 bp, Artificial Sequence
  chemically synthesized
tcaatgcagtataaacaaatgc

SEQ ID NO: 810007 - DNA, 22 bp, Artificial Sequence
  chemically synthesized
tgcatttgtttatactgcattg

SEQ ID NO: 810008 - DNA, 22 bp, Artificial Sequence
  chemically synthesized
catttgtttatactgcattgat

SEQ ID NO: 810009 - DNA, 22 bp, Artificial Sequence
  chemically synthesized
gatcacgagactatcaatgcag

SEQ ID NO: 810010 - DNA, 22 bp, Artificial Sequence
  chemically synthesized
agatcacgagactatcaatgca

SEQ ID NO: 810011 - DNA, 22 bp, Artificial Sequence
  chemically synthesized
tagatcacgagactatcaatgc

SEQ ID NO: 810012 - DNA, 22 bp, Artificial Sequence
  chemically synthesized
ttagatcacgagactatcaatg

SEQ ID NO: 810013 - DNA, 22 bp, Artificial Sequence
  chemically synthesized
gtttatactgcattgatagtct

SEQ ID NO: 810014 - DNA, 22 bp, Artificial Sequence
  chemically synthesized
tttatactgcattgatagtctc

SEQ ID NO: 810015 - DNA, 22 bp, Artificial Sequence
  chemically synthesized
atactgcattgatagtctcgtg

SEQ ID NO: 810016 - DNA, 22 bp, Artificial Sequence
  chemically synthesized
tactgcattgatagtctcgtga

SEQ ID NO: 810017 - DNA, 22 bp, Artificial Sequence
  chemically synthesized
cattgatagtctcgtgatctaa

SEQ ID NO: 810018 - DNA, 22 bp, Artificial Sequence
  chemically synthesized
atagtctcgtgatctaaaaact

SEQ ID NO: 810019 - DNA, 22 bp, Artificial Sequence
  chemically synthesized
gaacacaagtgaagtttttaga

SEQ ID NO: 810020 - DNA, 22 bp, Artificial Sequence
  chemically synthesized
gtgatctaaaaacttcacttgt

SEQ ID NO: 810021 - DNA, 22 bp, Artificial Sequence
  chemically synthesized
aaaacttcacttgtgttccagt

SEQ ID NO: 810022 - DNA, 22 bp, Artificial Sequence
  chemically synthesized
aggcaggatcacactggaacac

SEQ ID NO: 810023 - DNA, 22 bp, Artificial Sequence
  chemically synthesized
ttcaggcaggatcacactggaa

SEQ ID NO: 810024 - DNA, 22 bp, Artificial Sequence
  chemically synthesized
cacttgtgttccagtgtgatcc

SEQ ID NO: 810025 - DNA, 22 bp, Artificial Sequence
  chemically synthesized
acttgtgttccagtgtgatcct

SEQ ID NO: 810026 - DNA, 22 bp, Artificial Sequence
  chemically synthesized
gtgttccagtgtgatcctgcct

SEQ ID NO: 810027 - DNA, 22 bp, Artificial Sequence
  chemically synthesized
tgttccagtgtgatcctgcctg

SEQ ID NO: 810028 - DNA, 22 bp, Artificial Sequence
  chemically synthesized
tagtatgcagttattcaggcag

SEQ ID NO: 810029 - DNA, 22 bp, Artificial Sequence
  chemically synthesized
cagtgtgatcctgcctgaataa

SEQ ID NO: 810030 - DNA, 22 bp, Artificial Sequence
  chemically synthesized
cctgaataactgcatactacaa

SEQ ID NO: 810031 - DNA, 22 bp, Artificial Sequence
  chemically synthesized
aataactgcatactacaacaca

SEQ ID NO: 810032 - DNA, 22 bp, Artificial Sequence
  chemically synthesized
taataaaataatatgtgttgta

SEQ ID NO: 810033 - DNA, 22 bp, Artificial Sequence
  chemically synthesized
ataataaaataatatgtgttgt

SEQ ID NO: 810034 - DNA, 22 bp, Artificial Sequence
  chemically synthesized
catactacaacacatattattt

SEQ ID NO: 810035 - DNA, 22 bp, Artificial Sequence
  chemically synthesized
caacacatattattttattata

SEQ ID NO: 810036 - DNA, 22 bp, Artificial Sequence
  chemically synthesized
aagagaaataagagtcatttat

SEQ ID NO: 810037 - DNA, 22 bp, Artificial Sequence
  chemically synthesized
aaagagaaataagagtcattta

SEQ ID NO: 810038 - DNA, 22 bp, Artificial Sequence
  chemically synthesized
taaagagaaataagagtcattt

SEQ ID NO: 810039 - DNA, 22 bp, Artificial Sequence
  chemically synthesized
ttttattataaatgactcttat

SEQ ID NO: 810040 - DNA, 22 bp, Artificial Sequence
  chemically synthesized
ttttaaagagaaataagagtca

SEQ ID NO: 810041 - DNA, 22 bp, Artificial Sequence
  chemically synthesized
tattttaaagagaaataagagt

SEQ ID NO: 810042 - DNA, 22 bp, Artificial Sequence
  chemically synthesized
tattataaatgactcttatttc

SEQ ID NO: 810043 - DNA, 22 bp, Artificial Sequence
  chemically synthesized
attataaatgactcttatttct

SEQ ID NO: 810044 - DNA, 22 bp, Artificial Sequence
  chemically synthesized
ttataaatgactcttatttctc

SEQ ID NO: 810045 - DNA, 22 bp, Artificial Sequence
  chemically synthesized
taaatgactcttatttctcttt

SEQ ID NO: 810046 - DNA, 22 bp, Artificial Sequence
  chemically synthesized
ttatttctctttaaaatagagt

SEQ ID NO: 810047 - DNA, 22 bp, Artificial Sequence
  chemically synthesized
aatgatgccgtaactctatttt

SEQ ID NO: 810048 - DNA, 22 bp, Artificial Sequence
  chemically synthesized
aaatgatgccgtaactctattt

SEQ ID NO: 810049 - DNA, 22 bp, Artificial Sequence
  chemically synthesized
atttctctttaaaatagagtta

SEQ ID NO: 810050 - DNA, 22 bp, Artificial Sequence
  chemically synthesized
tttctctttaaaatagagttac

SEQ ID NO: 810051 - DNA, 22 bp, Artificial Sequence
  chemically synthesized
ctctttaaaatagagttacggc

SEQ ID NO: 810052 - DNA, 22 bp, Artificial Sequence
  chemically synthesized
tctttaaaatagagttacggca

SEQ ID NO: 810053 - DNA, 22 bp, Artificial Sequence
  chemically synthesized
tttaaaatagagttacggcatc

SEQ ID NO: 810054 - DNA, 22 bp, Artificial Sequence
  chemically synthesized
taaaatagagttacggcatcat

SEQ ID NO: 810055 - DNA, 22 bp, Artificial Sequence
  chemically synthesized
aaaatagagttacggcatcatt

SEQ ID NO: 810056 - DNA, 22 bp, Artificial Sequence
  chemically synthesized
aaatagagttacggcatcattt

SEQ ID NO: 810057 - DNA, 22 bp, Artificial Sequence
  chemically synthesized
tacaggcaatagtttaaatgat

SEQ ID NO: 810058 - DNA, 22 bp, Artificial Sequence
  chemically synthesized
atacaggcaatagtttaaatga

SEQ ID NO: 810059 - DNA, 22 bp, Artificial Sequence
  chemically synthesized
cttatacaggcaatagtttaaa

SEQ ID NO: 810060 - DNA, 22 bp, Artificial Sequence
  chemically synthesized
cggcatcatttaaactattgcc

SEQ ID NO: 810061 - DNA, 22 bp, Artificial Sequence
  chemically synthesized
aaactattgcctgtataagtag

SEQ ID NO: 810062 - DNA, 22 bp, Artificial Sequence
  chemically synthesized
aactattgcctgtataagtagg

SEQ ID NO: 810063 - DNA, 22 bp, Artificial Sequence
  chemically synthesized
ttgcctgtataagtagggtatg

SEQ ID NO: 810064 - DNA, 22 bp, Artificial Sequence
  chemically synthesized
cctgtataagtagggtatgttg

SEQ ID NO: 810065 - DNA, 22 bp, Artificial Sequence
  chemically synthesized
tataagtagggtatgttgtcta

SEQ ID NO: 810066 - DNA, 22 bp, Artificial Sequence
  chemically synthesized
taagccaaaatatgtagacaac

SEQ ID NO: 810067 - DNA, 22 bp, Artificial Sequence
  chemically synthesized
cgattataagccaaaatatgta

SEQ ID NO: 810068 - DNA, 22 bp, Artificial Sequence
  chemically synthesized
acgattataagccaaaatatgt

SEQ ID NO: 810069 - DNA, 22 bp, Artificial Sequence
  chemically synthesized
tacgattataagccaaaatatg

SEQ ID NO: 810070 - DNA, 22 bp, Artificial Sequence
  chemically synthesized
tttacgattataagccaaaata

SEQ ID NO: 810071 - DNA, 22 bp, Artificial Sequence
  chemically synthesized
ctttacgattataagccaaaat

SEQ ID NO: 810072 - DNA, 22 bp, Artificial Sequence
  chemically synthesized
tctacatattttggcttataat

SEQ ID NO: 810073 - DNA, 22 bp, Artificial Sequence
  chemically synthesized
catattttggcttataatcgta

SEQ ID NO: 810074 - DNA, 22 bp, Artificial Sequence
  chemically synthesized
taataccttctttacgattata

SEQ ID NO: 810075 - DNA, 22 bp, Artificial Sequence
  chemically synthesized
gtaataccttctttacgattat

SEQ ID NO: 810076 - DNA, 22 bp, Artificial Sequence
  chemically synthesized
tgtaataccttctttacgatta

SEQ ID NO: 810077 - DNA, 22 bp, Artificial Sequence
  chemically synthesized
tggcttataatcgtaaagaagg

SEQ ID NO: 810078 - DNA, 22 bp, Artificial Sequence
  chemically synthesized
ggcttataatcgtaaagaaggt

SEQ ID NO: 810079 - DNA, 22 bp, Artificial Sequence
  chemically synthesized
gcttataatcgtaaagaaggta

SEQ ID NO: 810080 - DNA, 22 bp, Artificial Sequence
  chemically synthesized
ataatcgtaaagaaggtattac

SEQ ID NO: 810081 - DNA, 22 bp, Artificial Sequence
  chemically synthesized
taatcgtaaagaaggtattaca

SEQ ID NO: 810082 - DNA, 22 bp, Artificial Sequence
  chemically synthesized
aataacaaatactttgtaatac

SEQ ID NO: 810083 - DNA, 22 bp, Artificial Sequence
  chemically synthesized
aaataacaaatactttgtaata

SEQ ID NO: 810084 - DNA, 22 bp, Artificial Sequence
  chemically synthesized
taaataacaaatactttgtaat

SEQ ID NO: 810085 - DNA, 22 bp, Artificial Sequence
  chemically synthesized
ttaaataacaaatactttgtaa

SEQ ID NO: 810086 - DNA, 22 bp, Artificial Sequence
  chemically synthesized
tttaaataacaaatactttgta

SEQ ID NO: 810087 - DNA, 22 bp, Artificial Sequence
  chemically synthesized
ttttaaataacaaatactttgt

SEQ ID NO: 810088 - DNA, 22 bp, Artificial Sequence
  chemically synthesized
ttttttaaataacaaatacttt

SEQ ID NO: 810089 - DNA, 22 bp, Artificial Sequence
  chemically synthesized
cttttttaaataacaaatactt

SEQ ID NO: 810090 - DNA, 22 bp, Artificial Sequence
  chemically synthesized
tcttttttaaataacaaatact

SEQ ID NO: 810091 - DNA, 22 bp, Artificial Sequence
  chemically synthesized
ttcttttttaaataacaaatac

SEQ ID NO: 810092 - DNA, 22 bp, Artificial Sequence
  chemically synthesized
ttttcttttttaaataacaaat

SEQ ID NO: 810093 - DNA, 22 bp, Artificial Sequence
  chemically synthesized
caaagtatttgttatttaaaaa

SEQ ID NO: 810094 - DNA, 22 bp, Artificial Sequence
  chemically synthesized
gttatttaaaaaagaaaagagg

SEQ ID NO: 810095 - DNA, 22 bp, Artificial Sequence
  chemically synthesized
ttatttaaaaaagaaaagaggg

SEQ ID NO: 810096 - DNA, 22 bp, Artificial Sequence
  chemically synthesized
agacccaatgccacccctcttt

SEQ ID NO: 810097 - DNA, 22 bp, Artificial Sequence
  chemically synthesized
tttaaaaaagaaaagaggggtg

SEQ ID NO: 810098 - DNA, 22 bp, Artificial Sequence
  chemically synthesized
tcagacccaatgccacccctct

SEQ ID NO: 810099 - DNA, 22 bp, Artificial Sequence
  chemically synthesized
ctcagacccaatgccacccctc

SEQ ID NO: 810100 - DNA, 22 bp, Artificial Sequence
  chemically synthesized
aaaaaagaaaagaggggtggca

SEQ ID NO: 810101 - DNA, 22 bp, Artificial Sequence
  chemically synthesized
aaaaagaaaagaggggtggcat

SEQ ID NO: 810102 - DNA, 22 bp, Artificial Sequence
  chemically synthesized
aaacttctcagacccaatgcca

SEQ ID NO: 810103 - DNA, 22 bp, Artificial Sequence
  chemically synthesized
caaacttctcagacccaatgcc

SEQ ID NO: 810104 - DNA, 22 bp, Artificial Sequence
  chemically synthesized
tcaaacttctcagacccaatgc

SEQ ID NO: 810105 - DNA, 22 bp, Artificial Sequence
  chemically synthesized
tatcggtggttttcaaacttct

SEQ ID NO: 810106 - DNA, 22 bp, Artificial Sequence
  chemically synthesized
tgtatcggtggttttcaaactt

SEQ ID NO: 810107 - DNA, 22 bp, Artificial Sequence
  chemically synthesized
ggtctgagaagtttgaaaacca

SEQ ID NO: 810108 - DNA, 22 bp, Artificial Sequence
  chemically synthesized
agaagtttgaaaaccaccgata

SEQ ID NO: 810109 - DNA, 22 bp, Artificial Sequence
  chemically synthesized
cccagtggctctgtatcggtgg

SEQ ID NO: 810110 - DNA, 22 bp, Artificial Sequence
  chemically synthesized
agattccccagtggctctgtat

SEQ ID NO: 810111 - DNA, 22 bp, Artificial Sequence
  chemically synthesized
gaaaaccaccgatacagagcca

SEQ ID NO: 810112 - DNA, 22 bp, Artificial Sequence
  chemically synthesized
gagattccccagtggctctgta

SEQ ID NO: 810113 - DNA, 22 bp, Artificial Sequence
  chemically synthesized
aaaaccaccgatacagagccac

SEQ ID NO: 810114 - DNA, 22 bp, Artificial Sequence
  chemically synthesized
ttgagattccccagtggctctg

SEQ ID NO: 810115 - DNA, 22 bp, Artificial Sequence
  chemically synthesized
tcttgagattccccagtggctc

SEQ ID NO: 810116 - DNA, 22 bp, Artificial Sequence
  chemically synthesized
ctcttgagattccccagtggct

SEQ ID NO: 810117 - DNA, 22 bp, Artificial Sequence
  chemically synthesized
tctcttgagattccccagtggc

SEQ ID NO: 810118 - DNA, 22 bp, Artificial Sequence
  chemically synthesized
agtataataaactttctcttga

SEQ ID NO: 810119 - DNA, 22 bp, Artificial Sequence
  chemically synthesized
cagtataataaactttctcttg

SEQ ID NO: 810120 - DNA, 22 bp, Artificial Sequence
  chemically synthesized
tcagtataataaactttctctt

SEQ ID NO: 810121 - DNA, 22 bp, Artificial Sequence
  chemically synthesized
gggaatctcaagagaaagttta

SEQ ID NO: 810122 - DNA, 22 bp, Artificial Sequence
  chemically synthesized
attttcagtataataaactttc

SEQ ID NO: 810123 - DNA, 22 bp, Artificial Sequence
  chemically synthesized
ttaattttcagtataataaact

SEQ ID NO: 810124 - DNA, 22 bp, Artificial Sequence
  chemically synthesized
tattaattttcagtataataaa

SEQ ID NO: 810125 - DNA, 22 bp, Artificial Sequence
  chemically synthesized
aagagaaagtttattatactga

SEQ ID NO: 810126 - DNA, 22 bp, Artificial Sequence
  chemically synthesized
aaaaattctattaattttcagt

SEQ ID NO: 810127 - DNA, 22 bp, Artificial Sequence
  chemically synthesized
ctgaaaaattctattaattttc

SEQ ID NO: 810128 - DNA, 22 bp, Artificial Sequence
  chemically synthesized
tcctgaaaaattctattaattt

SEQ ID NO: 810129 - DNA, 22 bp, Artificial Sequence
  chemically synthesized
attatactgaaaattaatagaa

SEQ ID NO: 810130 - DNA, 22 bp, Artificial Sequence
  chemically synthesized
tctcctgaaaaattctattaat

SEQ ID NO: 810131 - DNA, 22 bp, Artificial Sequence
  chemically synthesized
ttatactgaaaattaatagaat

SEQ ID NO: 810132 - DNA, 22 bp, Artificial Sequence
  chemically synthesized
tactgaaaattaatagaatttt

SEQ ID NO: 810133 - DNA, 22 bp, Artificial Sequence
  chemically synthesized
attctctcctgaaaaattctat

SEQ ID NO: 810134 - DNA, 22 bp, Artificial Sequence
  chemically synthesized
aaaattaatagaatttttcagg

SEQ ID NO: 810135 - DNA, 22 bp, Artificial Sequence
  chemically synthesized
atagaatttttcaggagagaat

SEQ ID NO: 810136 - DNA, 22 bp, Artificial Sequence
  chemically synthesized
ttcaggagagaatgaggatgtg

SEQ ID NO: 810137 - DNA, 22 bp, Artificial Sequence
  chemically synthesized
tcaggagagaatgaggatgtgt

SEQ ID NO: 810138 - DNA, 22 bp, Artificial Sequence
  chemically synthesized
caggagagaatgaggatgtgtc

SEQ ID NO: 810139 - DNA, 22 bp, Artificial Sequence
  chemically synthesized
aggagagaatgaggatgtgtcc

SEQ ID NO: 810140 - DNA, 22 bp, Artificial Sequence
  chemically synthesized
gatgcacagggaggggacacat

SEQ ID NO: 810141 - DNA, 22 bp, Artificial Sequence
  chemically synthesized
gggatcagagattggatgcaca

SEQ ID NO: 810142 - DNA, 22 bp, Artificial Sequence
  chemically synthesized
tagggatcagagattggatgca

SEQ ID NO: 810143 - DNA, 22 bp, Artificial Sequence
  chemically synthesized
cctgtgcatccaatctctgatc

SEQ ID NO: 810144 - DNA, 22 bp, Artificial Sequence
  chemically synthesized
tggagctctagggatcagagat

SEQ ID NO: 810145 - DNA, 22 bp, Artificial Sequence
  chemically synthesized
tatggagctctagggatcagag

SEQ ID NO: 810146 - DNA, 22 bp, Artificial Sequence
  chemically synthesized
tgcatccaatctctgatcccta

SEQ ID NO: 810147 - DNA, 22 bp, Artificial Sequence
  chemically synthesized
tctatggagctctagggatcag

SEQ ID NO: 810148 - DNA, 22 bp, Artificial Sequence
  chemically synthesized
attctctatggagctctaggga

SEQ ID NO: 810149 - DNA, 22 bp, Artificial Sequence
  chemically synthesized
cattctctatggagctctaggg

SEQ ID NO: 810150 - DNA, 22 bp, Artificial Sequence
  chemically synthesized
tttcattctctatggagctcta

SEQ ID NO: 810151 - DNA, 22 bp, Artificial Sequence
  chemically synthesized
tgatccctagagctccatagag

SEQ ID NO: 810152 - DNA, 22 bp, Artificial Sequence
  chemically synthesized
atccctagagctccatagagaa

SEQ ID NO: 810153 - DNA, 22 bp, Artificial Sequence
  chemically synthesized
aaatgctatttcattctctatg

SEQ ID NO: 810154 - DNA, 22 bp, Artificial Sequence
  chemically synthesized
aaaatgctatttcattctctat

SEQ ID NO: 810155 - DNA, 22 bp, Artificial Sequence
  chemically synthesized
taaaatgctatttcattctcta

SEQ ID NO: 810156 - DNA, 22 bp, Artificial Sequence
  chemically synthesized
ttaaaatgctatttcattctct

SEQ ID NO: 810157 - DNA, 22 bp, Artificial Sequence
  chemically synthesized
gagctccatagagaatgaaata

SEQ ID NO: 810158 - DNA, 22 bp, Artificial Sequence
  chemically synthesized
catagagaatgaaatagcattt

SEQ ID NO: 810159 - DNA, 22 bp, Artificial Sequence
  chemically synthesized
tagaagagagcaatttttaaaa

SEQ ID NO: 810160 - DNA, 22 bp, Artificial Sequence
  chemically synthesized
gttgtagaagagagcaattttt

SEQ ID NO: 810161 - DNA, 22 bp, Artificial Sequence
  chemically synthesized
taaaaattgctctcttctacaa

SEQ ID NO: 810162 - DNA, 22 bp, Artificial Sequence
  chemically synthesized
aaaaattgctctcttctacaac

SEQ ID NO: 810163 - DNA, 22 bp, Artificial Sequence
  chemically synthesized
aaaattgctctcttctacaacc

SEQ ID NO: 810164 - DNA, 22 bp, Artificial Sequence
  chemically synthesized
accgatagtcacagctggttgt

SEQ ID NO: 810165 - DNA, 22 bp, Artificial Sequence
  chemically synthesized
ctctcttctacaaccagctgtg

SEQ ID NO: 810166 - DNA, 22 bp, Artificial Sequence
  chemically synthesized
tcttctacaaccagctgtgact

SEQ ID NO: 810167 - DNA, 22 bp, Artificial Sequence
  chemically synthesized
cggttcaccgatagtcacagct

SEQ ID NO: 810168 - DNA, 22 bp, Artificial Sequence
  chemically synthesized
ttctacaaccagctgtgactat

SEQ ID NO: 810169 - DNA, 22 bp, Artificial Sequence
  chemically synthesized
ctacaaccagctgtgactatcg

SEQ ID NO: 810170 - DNA, 22 bp, Artificial Sequence
  chemically synthesized
tacaaccagctgtgactatcgg

SEQ ID NO: 810171 - DNA, 22 bp, Artificial Sequence
  chemically synthesized
caaccagctgtgactatcggtg

SEQ ID NO: 810172 - DNA, 22 bp, Artificial Sequence
  chemically synthesized
tgactatcggtgaaccggaggt

SEQ ID NO: 810173 - DNA, 22 bp, Artificial Sequence
  chemically synthesized
gtatatgaagtagacctccggt

SEQ ID NO: 810174 - DNA, 22 bp, Artificial Sequence
  chemically synthesized
tcggtgaaccggaggtctactt

SEQ ID NO: 810175 - DNA, 22 bp, Artificial Sequence
  chemically synthesized
aggttcgtatatgaagtagacc

SEQ ID NO: 810176 - DNA, 22 bp, Artificial Sequence
  chemically synthesized
attcaggttcgtatatgaagta

SEQ ID NO: 810177 - DNA, 22 bp, Artificial Sequence
  chemically synthesized
aattcaggttcgtatatgaagt

SEQ ID NO: 810178 - DNA, 22 bp, Artificial Sequence
  chemically synthesized
taattcaggttcgtatatgaag

SEQ ID NO: 810179 - DNA, 22 bp, Artificial Sequence
  chemically synthesized
ttaattcaggttcgtatatgaa

SEQ ID NO: 810180 - DNA, 22 bp, Artificial Sequence
  chemically synthesized
tttttaattcaggttcgtatat

SEQ ID NO: 810181 - DNA, 22 bp, Artificial Sequence
  chemically synthesized
gctgtttttaattcaggttcgt

SEQ ID NO: 810182 - DNA, 22 bp, Artificial Sequence
  chemically synthesized
cttcatatacgaacctgaatta

SEQ ID NO: 810183 - DNA, 22 bp, Artificial Sequence
  chemically synthesized
catatacgaacctgaattaaaa

SEQ ID NO: 810184 - DNA, 22 bp, Artificial Sequence
  chemically synthesized
atatacgaacctgaattaaaaa

SEQ ID NO: 810185 - DNA, 22 bp, Artificial Sequence
  chemically synthesized
aagggctggctgtttttaattc

SEQ ID NO: 810186 - DNA, 22 bp, Artificial Sequence
  chemically synthesized
actcaagggctggctgttttta

SEQ ID NO: 810187 - DNA, 22 bp, Artificial Sequence
  chemically synthesized
aactgactcaagggctggctgt

SEQ ID NO: 810188 - DNA, 22 bp, Artificial Sequence
  chemically synthesized
tgaactgactcaagggctggct

SEQ ID NO: 810189 - DNA, 22 bp, Artificial Sequence
  chemically synthesized
aattaaaaacagccagcccttg

SEQ ID NO: 810190 - DNA, 22 bp, Artificial Sequence
  chemically synthesized
aaaacagccagcccttgagtca

SEQ ID NO: 810191 - DNA, 22 bp, Artificial Sequence
  chemically synthesized
gagtcagttcagagcccacgtt

SEQ ID NO: 810192 - DNA, 22 bp, Artificial Sequence
  chemically synthesized
agtcagttcagagcccacgttc

SEQ ID NO: 810193 - DNA, 22 bp, Artificial Sequence
  chemically synthesized
tgtcaaatgtaatcaagaacgt

SEQ ID NO: 810194 - DNA, 22 bp, Artificial Sequence
  chemically synthesized
ttgtgtcaaatgtaatcaagaa

SEQ ID NO: 810195 - DNA, 22 bp, Artificial Sequence
  chemically synthesized
agagcccacgttcttgattaca

SEQ ID NO: 810196 - DNA, 22 bp, Artificial Sequence
  chemically synthesized
ttgattacatttgacacaataa

SEQ ID NO: 810197 - DNA, 22 bp, Artificial Sequence
  chemically synthesized
gattacatttgacacaataatc

SEQ ID NO: 810198 - DNA, 22 bp, Artificial Sequence
  chemically synthesized
agatatgatgatgattattgtg

SEQ ID NO: 810199 - DNA, 22 bp, Artificial Sequence
  chemically synthesized
attacatttgacacaataatca

SEQ ID NO: 810200 - DNA, 22 bp, Artificial Sequence
  chemically synthesized
aagatatgatgatgattattgt

SEQ ID NO: 810201 - DNA, 22 bp, Artificial Sequence
  chemically synthesized
catttgacacaataatcatcat

SEQ ID NO: 810202 - DNA, 22 bp, Artificial Sequence
  chemically synthesized
agtcttaagatatgatgatgat

SEQ ID NO: 810203 - DNA, 22 bp, Artificial Sequence
  chemically synthesized
gagtcttaagatatgatgatga

SEQ ID NO: 810204 - DNA, 22 bp, Artificial Sequence
  chemically synthesized
gacacaataatcatcatcatat

SEQ ID NO: 810205 - DNA, 22 bp, Artificial Sequence
  chemically synthesized
acacaataatcatcatcatatc

SEQ ID NO: 810206 - DNA, 22 bp, Artificial Sequence
  chemically synthesized
atttgagtcttaagatatgatg

SEQ ID NO: 810207 - DNA, 22 bp, Artificial Sequence
  chemically synthesized
tcaggctgatttgagtcttaag

SEQ ID NO: 810208 - DNA, 22 bp, Artificial Sequence
  chemically synthesized
agcactgtcaggctgatttgag

SEQ ID NO: 810209 - DNA, 22 bp, Artificial Sequence
  chemically synthesized
agttgagcactgtcaggctgat

SEQ ID NO: 810210 - DNA, 22 bp, Artificial Sequence
  chemically synthesized
aagactcaaatcagcctgacag

SEQ ID NO: 810211 - DNA, 22 bp, Artificial Sequence
  chemically synthesized
agactcaaatcagcctgacagt

SEQ ID NO: 810212 - DNA, 22 bp, Artificial Sequence
  chemically synthesized
aaatcagcctgacagtgctcaa

SEQ ID NO: 810213 - DNA, 22 bp, Artificial Sequence
  chemically synthesized
ggagaagcagccctgagttgag

SEQ ID NO: 810214 - DNA, 22 bp, Artificial Sequence
  chemically synthesized
attgggagaagcagccctgagt

SEQ ID NO: 810215 - DNA, 22 bp, Artificial Sequence
  chemically synthesized
acagtgctcaactcagggctgc

SEQ ID NO: 810216 - DNA, 22 bp, Artificial Sequence
  chemically synthesized
agctaattgggagaagcagccc

SEQ ID NO: 810217 - DNA, 22 bp, Artificial Sequence
  chemically synthesized
cagctaattgggagaagcagcc

SEQ ID NO: 810218 - DNA, 22 bp, Artificial Sequence
  chemically synthesized
tcagctaattgggagaagcagc

SEQ ID NO: 810219 - DNA, 22 bp, Artificial Sequence
  chemically synthesized
aactcagggctgcttctcccaa

SEQ ID NO: 810220 - DNA, 22 bp, Artificial Sequence
  chemically synthesized
caattttcagctaattgggaga

SEQ ID NO: 810221 - DNA, 22 bp, Artificial Sequence
  chemically synthesized
agggctgcttctcccaattagc

SEQ ID NO: 810222 - DNA, 22 bp, Artificial Sequence
  chemically synthesized
ggctgcaattttcagctaattg

SEQ ID NO: 810223 - DNA, 22 bp, Artificial Sequence
  chemically synthesized
cttctcccaattagctgaaaat

SEQ ID NO: 810224 - DNA, 22 bp, Artificial Sequence
  chemically synthesized
ctcccaattagctgaaaattgc

SEQ ID NO: 810225 - DNA, 22 bp, Artificial Sequence
  chemically synthesized
tcccaattagctgaaaattgca

SEQ ID NO: 810226 - DNA, 22 bp, Artificial Sequence
  chemically synthesized
ccaattagctgaaaattgcagc

SEQ ID NO: 810227 - DNA, 22 bp, Artificial Sequence
  chemically synthesized
ggagatgagctgggctgcaatt

SEQ ID NO: 810228 - DNA, 22 bp, Artificial Sequence
  chemically synthesized
cctaggagatgagctgggctgc

SEQ ID NO: 810229 - DNA, 22 bp, Artificial Sequence
  chemically synthesized
gctgaaaattgcagcccagctc

SEQ ID NO: 810230 - DNA, 22 bp, Artificial Sequence
  chemically synthesized
aaaattgcagcccagctcatct

SEQ ID NO: 810231 - DNA, 22 bp, Artificial Sequence
  chemically synthesized
cagcccagctcatctcctaggg

SEQ ID NO: 810232 - DNA, 22 bp, Artificial Sequence
  chemically synthesized
taaatgtaaacgtattccctag

SEQ ID NO: 810233 - DNA, 22 bp, Artificial Sequence
  chemically synthesized
atctcctagggaatacgtttac

SEQ ID NO: 810234 - DNA, 22 bp, Artificial Sequence
  chemically synthesized
ctagggaatacgtttacattta

SEQ ID NO: 810235 - DNA, 22 bp, Artificial Sequence
  chemically synthesized
ccacagcaaaattgtaaatgta

SEQ ID NO: 810236 - DNA, 22 bp, Artificial Sequence
  chemically synthesized
gggaatacgtttacatttacaa

SEQ ID NO: 810237 - DNA, 22 bp, Artificial Sequence
  chemically synthesized
gccacagcaaaattgtaaatgt

SEQ ID NO: 810238 - DNA, 22 bp, Artificial Sequence
  chemically synthesized
tgccacagcaaaattgtaaatg

SEQ ID NO: 810239 - DNA, 22 bp, Artificial Sequence
  chemically synthesized
ttgccacagcaaaattgtaaat

SEQ ID NO: 810240 - DNA, 22 bp, Artificial Sequence
  chemically synthesized
tttgccacagcaaaattgtaaa

SEQ ID NO: 810241 - DNA, 22 bp, Artificial Sequence
  chemically synthesized
cctttttgccacagcaaaattg

SEQ ID NO: 810242 - DNA, 22 bp, Artificial Sequence
  chemically synthesized
ttgcctttttgccacagcaaaa

SEQ ID NO: 810243 - DNA, 22 bp, Artificial Sequence
  chemically synthesized
gttgcctttttgccacagcaaa

SEQ ID NO: 810244 - DNA, 22 bp, Artificial Sequence
  chemically synthesized
acatttacaattttgctgtggc

SEQ ID NO: 810245 - DNA, 22 bp, Artificial Sequence
  chemically synthesized
catttacaattttgctgtggca

SEQ ID NO: 810246 - DNA, 22 bp, Artificial Sequence
  chemically synthesized
acaattttgctgtggcaaaaag

SEQ ID NO: 810247 - DNA, 22 bp, Artificial Sequence
  chemically synthesized
caattttgctgtggcaaaaagg

SEQ ID NO: 810248 - DNA, 22 bp, Artificial Sequence
  chemically synthesized
cagcgtgtttgttgcctttttg

SEQ ID NO: 810249 - DNA, 22 bp, Artificial Sequence
  chemically synthesized
ccagcgtgtttgttgccttttt

SEQ ID NO: 810250 - DNA, 22 bp, Artificial Sequence
  chemically synthesized
tgctgtggcaaaaaggcaacaa

SEQ ID NO: 810251 - DNA, 22 bp, Artificial Sequence
  chemically synthesized
cttccagcgtgtttgttgcctt

SEQ ID NO: 810252 - DNA, 22 bp, Artificial Sequence
  chemically synthesized
gctgtggcaaaaaggcaacaaa

SEQ ID NO: 810253 - DNA, 22 bp, Artificial Sequence
  chemically synthesized
ctgtggcaaaaaggcaacaaac

SEQ ID NO: 810254 - DNA, 22 bp, Artificial Sequence
  chemically synthesized
ctccttccagcgtgtttgttgc

SEQ ID NO: 810255 - DNA, 22 bp, Artificial Sequence
  chemically synthesized
gctccttccagcgtgtttgttg

SEQ ID NO: 810256 - DNA, 22 bp, Artificial Sequence
  chemically synthesized
tggcaaaaaggcaacaaacacg

SEQ ID NO: 810257 - DNA, 22 bp, Artificial Sequence
  chemically synthesized
atttgctccttccagcgtgttt

SEQ ID NO: 810258 - DNA, 22 bp, Artificial Sequence
  chemically synthesized
aaaagctgatttgctccttcca

SEQ ID NO: 810259 - DNA, 22 bp, Artificial Sequence
  chemically synthesized
gtgtaaaagttaaaaagctgat

SEQ ID NO: 810260 - DNA, 22 bp, Artificial Sequence
  chemically synthesized
gaaggagcaaatcagcttttta

SEQ ID NO: 810261 - DNA, 22 bp, Artificial Sequence
  chemically synthesized
aaatagttagtgtaaaagttaa

SEQ ID NO: 810262 - DNA, 22 bp, Artificial Sequence
  chemically synthesized
aaaatagttagtgtaaaagtta

SEQ ID NO: 810263 - DNA, 22 bp, Artificial Sequence
  chemically synthesized
ggtaaacttaaaatagttagtg

SEQ ID NO: 810264 - DNA, 22 bp, Artificial Sequence
  chemically synthesized
tttaacttttacactaactatt

SEQ ID NO: 810265 - DNA, 22 bp, Artificial Sequence
  chemically synthesized
aggtaaacttaaaatagttagt

SEQ ID NO: 810266 - DNA, 22 bp, Artificial Sequence
  chemically synthesized
ttaacttttacactaactattt

SEQ ID NO: 810267 - DNA, 22 bp, Artificial Sequence
  chemically synthesized
taacttttacactaactatttt

SEQ ID NO: 810268 - DNA, 22 bp, Artificial Sequence
  chemically synthesized
aacttttacactaactatttta

SEQ ID NO: 810269 - DNA, 22 bp, Artificial Sequence
  chemically synthesized
acttttacactaactattttaa

SEQ ID NO: 810270 - DNA, 22 bp, Artificial Sequence
  chemically synthesized
ttacactaactattttaagttt

SEQ ID NO: 810271 - DNA, 22 bp, Artificial Sequence
  chemically synthesized
ccagacttaggtaaacttaaaa

SEQ ID NO: 810272 - DNA, 22 bp, Artificial Sequence
  chemically synthesized
tacactaactattttaagttta

SEQ ID NO: 810273 - DNA, 22 bp, Artificial Sequence
  chemically synthesized
accagacttaggtaaacttaaa

SEQ ID NO: 810274 - DNA, 22 bp, Artificial Sequence
  chemically synthesized
acactaactattttaagtttac

SEQ ID NO: 810275 - DNA, 22 bp, Artificial Sequence
  chemically synthesized
cactaactattttaagtttacc

SEQ ID NO: 810276 - DNA, 22 bp, Artificial Sequence
  chemically synthesized
actattttaagtttacctaagt

SEQ ID NO: 810277 - DNA, 22 bp, Artificial Sequence
  chemically synthesized
ttttaagtttacctaagtctgg

SEQ ID NO: 810278 - DNA, 22 bp, Artificial Sequence
  chemically synthesized
tcaaaacaggtttaccagactt

SEQ ID NO: 810279 - DNA, 22 bp, Artificial Sequence
  chemically synthesized
taagtttacctaagtctggtaa

SEQ ID NO: 810280 - DNA, 22 bp, Artificial Sequence
  chemically synthesized
gtcaaaacaggtttaccagact

SEQ ID NO: 810281 - DNA, 22 bp, Artificial Sequence
  chemically synthesized
aagtttacctaagtctggtaaa

SEQ ID NO: 810282 - DNA, 22 bp, Artificial Sequence
  chemically synthesized
agtttacctaagtctggtaaac

SEQ ID NO: 810283 - DNA, 22 bp, Artificial Sequence
  chemically synthesized
ttgtcaaaacaggtttaccaga

SEQ ID NO: 810284 - DNA, 22 bp, Artificial Sequence
  chemically synthesized
acctaagtctggtaaacctgtt

SEQ ID NO: 810285 - DNA, 22 bp, Artificial Sequence
  chemically synthesized
cctaagtctggtaaacctgttt

SEQ ID NO: 810286 - DNA, 22 bp, Artificial Sequence
  chemically synthesized
tcattcttgtcaaaacaggttt

SEQ ID NO: 810287 - DNA, 22 bp, Artificial Sequence
  chemically synthesized
agtctggtaaacctgttttgac

SEQ ID NO: 810288 - DNA, 22 bp, Artificial Sequence
  chemically synthesized
gttgtcattcttgtcaaaacag

SEQ ID NO: 810289 - DNA, 22 bp, Artificial Sequence
  chemically synthesized
ctcgttgtcattcttgtcaaaa

SEQ ID NO: 810290 - DNA, 22 bp, Artificial Sequence
  chemically synthesized
cctcgttgtcattcttgtcaaa

SEQ ID NO: 810291 - DNA, 22 bp, Artificial Sequence
  chemically synthesized
gtaaacctgttttgacaagaat

SEQ ID NO: 810292 - DNA, 22 bp, Artificial Sequence
  chemically synthesized
ttttgacaagaatgacaacgag

SEQ ID NO: 810293 - DNA, 22 bp, Artificial Sequence
  chemically synthesized
tgacaagaatgacaacgaggaa

SEQ ID NO: 810294 - DNA, 22 bp, Artificial Sequence
  chemically synthesized
gacaagaatgacaacgaggaag

SEQ ID NO: 810295 - DNA, 22 bp, Artificial Sequence
  chemically synthesized
acaagaatgacaacgaggaagc

SEQ ID NO: 810296 - DNA, 22 bp, Artificial Sequence
  chemically synthesized
taaaaaatcataacaaaaaaag

SEQ ID NO: 810297 - DNA, 22 bp, Artificial Sequence
  chemically synthesized
cgcagttataaaaaatcataac

SEQ ID NO: 810298 - DNA, 22 bp, Artificial Sequence
  chemically synthesized
gcgcagttataaaaaatcataa

SEQ ID NO: 810299 - DNA, 22 bp, Artificial Sequence
  chemically synthesized
tgcgcagttataaaaaatcata

SEQ ID NO: 810300 - DNA, 22 bp, Artificial Sequence
  chemically synthesized
tttttgttatgattttttataa

SEQ ID NO: 810301 - DNA, 22 bp, Artificial Sequence
  chemically synthesized
aactttgcgcagttataaaaaa

SEQ ID NO: 810302 - DNA, 22 bp, Artificial Sequence
  chemically synthesized
ttttgttatgattttttataac

SEQ ID NO: 810303 - DNA, 22 bp, Artificial Sequence
  chemically synthesized
aaactttgcgcagttataaaaa

SEQ ID NO: 810304 - DNA, 22 bp, Artificial Sequence
  chemically synthesized
tttgttatgattttttataact

SEQ ID NO: 810305 - DNA, 22 bp, Artificial Sequence
  chemically synthesized
ttgttatgattttttataactg

SEQ ID NO: 810306 - DNA, 22 bp, Artificial Sequence
  chemically synthesized
tgttatgattttttataactgc

SEQ ID NO: 810307 - DNA, 22 bp, Artificial Sequence
  chemically synthesized
gttatgattttttataactgcg

SEQ ID NO: 810308 - DNA, 22 bp, Artificial Sequence
  chemically synthesized
tcttaaactttgcgcagttata

SEQ ID NO: 810309 - DNA, 22 bp, Artificial Sequence
  chemically synthesized
ttatgattttttataactgcgc

SEQ ID NO: 810310 - DNA, 22 bp, Artificial Sequence
  chemically synthesized
tgattttttataactgcgcaaa

SEQ ID NO: 810311 - DNA, 22 bp, Artificial Sequence
  chemically synthesized
gttatcttaaactttgcgcagt

SEQ ID NO: 810312 - DNA, 22 bp, Artificial Sequence
  chemically synthesized
tagttatcttaaactttgcgca

SEQ ID NO: 810313 - DNA, 22 bp, Artificial Sequence
  chemically synthesized
tttataactgcgcaaagtttaa

SEQ ID NO: 810314 - DNA, 22 bp, Artificial Sequence
  chemically synthesized
ttataactgcgcaaagtttaag

SEQ ID NO: 810315 - DNA, 22 bp, Artificial Sequence
  chemically synthesized
tataactgcgcaaagtttaaga

SEQ ID NO: 810316 - DNA, 22 bp, Artificial Sequence
  chemically synthesized
ataactgcgcaaagtttaagat

SEQ ID NO: 810317 - DNA, 22 bp, Artificial Sequence
  chemically synthesized
taactgcgcaaagtttaagata

SEQ ID NO: 810318 - DNA, 22 bp, Artificial Sequence
  chemically synthesized
gtccaaactctagttatcttaa

SEQ ID NO: 810319 - DNA, 22 bp, Artificial Sequence
  chemically synthesized
tagtccaaactctagttatctt

SEQ ID NO: 810320 - DNA, 22 bp, Artificial Sequence
  chemically synthesized
ctagtccaaactctagttatct

SEQ ID NO: 810321 - DNA, 22 bp, Artificial Sequence
  chemically synthesized
cgcaaagtttaagataactaga

SEQ ID NO: 810322 - DNA, 22 bp, Artificial Sequence
  chemically synthesized
cccttctagtccaaactctagt

SEQ ID NO: 810323 - DNA, 22 bp, Artificial Sequence
  chemically synthesized
ccccttctagtccaaactctag

SEQ ID NO: 810324 - DNA, 22 bp, Artificial Sequence
  chemically synthesized
tccccttctagtccaaactcta

SEQ ID NO: 810325 - DNA, 22 bp, Artificial Sequence
  chemically synthesized
ttttccccttctagtccaaact

SEQ ID NO: 810326 - DNA, 22 bp, Artificial Sequence
  chemically synthesized
aagataactagagtttggacta

SEQ ID NO: 810327 - DNA, 22 bp, Artificial Sequence
  chemically synthesized
agataactagagtttggactag

SEQ ID NO: 810328 - DNA, 22 bp, Artificial Sequence
  chemically synthesized
tgtatctgttttccccttctag

SEQ ID NO: 810329 - DNA, 22 bp, Artificial Sequence
  chemically synthesized
gagtttggactagaaggggaaa

SEQ ID NO: 810330 - DNA, 22 bp, Artificial Sequence
  chemically synthesized
acattgtgtatctgttttcccc

SEQ ID NO: 810331 - DNA, 22 bp, Artificial Sequence
  chemically synthesized
ggactagaaggggaaaacagat

SEQ ID NO: 810332 - DNA, 22 bp, Artificial Sequence
  chemically synthesized
gactagaaggggaaaacagata

SEQ ID NO: 810333 - DNA, 22 bp, Artificial Sequence
  chemically synthesized
gaaggggaaaacagatacacaa

SEQ ID NO: 810334 - DNA, 22 bp, Artificial Sequence
  chemically synthesized
taaaaatattcacattgtgtat

SEQ ID NO: 810335 - DNA, 22 bp, Artificial Sequence
  chemically synthesized
gtaaaaatattcacattgtgta

SEQ ID NO: 810336 - DNA, 22 bp, Artificial Sequence
  chemically synthesized
acaagtaacttgtaaaaatatt

SEQ ID NO: 810337 - DNA, 22 bp, Artificial Sequence
  chemically synthesized
gacaagtaacttgtaaaaatat

SEQ ID NO: 810338 - DNA, 22 bp, Artificial Sequence
  chemically synthesized
atttgacaagtaacttgtaaaa

SEQ ID NO: 810339 - DNA, 22 bp, Artificial Sequence
  chemically synthesized
catttgacaagtaacttgtaaa

SEQ ID NO: 810340 - DNA, 22 bp, Artificial Sequence
  chemically synthesized
tcatttgacaagtaacttgtaa

SEQ ID NO: 810341 - DNA, 22 bp, Artificial Sequence
  chemically synthesized
aaagctttcatttgacaagtaa

SEQ ID NO: 810342 - DNA, 22 bp, Artificial Sequence
  chemically synthesized
tgaaagctttcatttgacaagt

SEQ ID NO: 810343 - DNA, 22 bp, Artificial Sequence
  chemically synthesized
ctgaaagctttcatttgacaag

SEQ ID NO: 810344 - DNA, 22 bp, Artificial Sequence
  chemically synthesized
ttacaagttacttgtcaaatga

SEQ ID NO: 810345 - DNA, 22 bp, Artificial Sequence
  chemically synthesized
ttctgaaagctttcatttgaca

SEQ ID NO: 810346 - DNA, 22 bp, Artificial Sequence
  chemically synthesized
tacaagttacttgtcaaatgaa

SEQ ID NO: 810347 - DNA, 22 bp, Artificial Sequence
  chemically synthesized
cttctgaaagctttcatttgac

SEQ ID NO: 810348 - DNA, 22 bp, Artificial Sequence
  chemically synthesized
acaagttacttgtcaaatgaaa

SEQ ID NO: 810349 - DNA, 22 bp, Artificial Sequence
  chemically synthesized
caagttacttgtcaaatgaaag

SEQ ID NO: 810350 - DNA, 22 bp, Artificial Sequence
  chemically synthesized
tttcttctgaaagctttcattt

SEQ ID NO: 810351 - DNA, 22 bp, Artificial Sequence
  chemically synthesized
cttgtcaaatgaaagctttcag

SEQ ID NO: 810352 - DNA, 22 bp, Artificial Sequence
  chemically synthesized
gtcaaatgaaagctttcagaag

SEQ ID NO: 810353 - DNA, 22 bp, Artificial Sequence
  chemically synthesized
tcaaatgaaagctttcagaaga

SEQ ID NO: 810354 - DNA, 22 bp, Artificial Sequence
  chemically synthesized
ccaaagaaaggctgtttcttct

SEQ ID NO: 810355 - DNA, 22 bp, Artificial Sequence
  chemically synthesized
accaaagaaaggctgtttcttc

SEQ ID NO: 810356 - DNA, 22 bp, Artificial Sequence
  chemically synthesized
tcagaagaaacagcctttcttt

SEQ ID NO: 810357 - DNA, 22 bp, Artificial Sequence
  chemically synthesized
cagaagaaacagcctttctttg

SEQ ID NO: 810358 - DNA, 22 bp, Artificial Sequence
  chemically synthesized
agaagaaacagcctttctttgg

SEQ ID NO: 810359 - DNA, 22 bp, Artificial Sequence
  chemically synthesized
atgcaccgtttaccaaagaaag

SEQ ID NO: 810360 - DNA, 22 bp, Artificial Sequence
  chemically synthesized
aatgcaccgtttaccaaagaaa

SEQ ID NO: 810361 - DNA, 22 bp, Artificial Sequence
  chemically synthesized
taatgcaccgtttaccaaagaa

SEQ ID NO: 810362 - DNA, 22 bp, Artificial Sequence
  chemically synthesized
ttttaatgcaccgtttaccaaa

SEQ ID NO: 810363 - DNA, 22 bp, Artificial Sequence
  chemically synthesized
caaattattttaatgcaccgtt

SEQ ID NO: 810364 - DNA, 22 bp, Artificial Sequence
  chemically synthesized
tctttggtaaacggtgcattaa

SEQ ID NO: 810365 - DNA, 22 bp, Artificial Sequence
  chemically synthesized
ctttggtaaacggtgcattaaa

SEQ ID NO: 810366 - DNA, 22 bp, Artificial Sequence
  chemically synthesized
gttgcaaattattttaatgcac

SEQ ID NO: 810367 - DNA, 22 bp, Artificial Sequence
  chemically synthesized
tttggtaaacggtgcattaaaa

SEQ ID NO: 810368 - DNA, 22 bp, Artificial Sequence
  chemically synthesized
tggtaaacggtgcattaaaata

SEQ ID NO: 810369 - DNA, 22 bp, Artificial Sequence
  chemically synthesized
ttagttgcaaattattttaatg

SEQ ID NO: 810370 - DNA, 22 bp, Artificial Sequence
  chemically synthesized
ggtaaacggtgcattaaaataa

SEQ ID NO: 810371 - DNA, 22 bp, Artificial Sequence
  chemically synthesized
gtaaacggtgcattaaaataat

SEQ ID NO: 810372 - DNA, 22 bp, Artificial Sequence
  chemically synthesized
tctattagttgcaaattatttt

SEQ ID NO: 810373 - DNA, 22 bp, Artificial Sequence
  chemically synthesized
catgtccctatctattagttgc

SEQ ID NO: 810374 - DNA, 22 bp, Artificial Sequence
  chemically synthesized
aaataatttgcaactaatagat

SEQ ID NO: 810375 - DNA, 22 bp, Artificial Sequence
  chemically synthesized
aaattacatgtccctatctatt

SEQ ID NO: 810376 - DNA, 22 bp, Artificial Sequence
  chemically synthesized
caaattacatgtccctatctat

SEQ ID NO: 810377 - DNA, 22 bp, Artificial Sequence
  chemically synthesized
tcaaattacatgtccctatcta

SEQ ID NO: 810378 - DNA, 22 bp, Artificial Sequence
  chemically synthesized
ttttcaaattacatgtccctat

SEQ ID NO: 810379 - DNA, 22 bp, Artificial Sequence
  chemically synthesized
gcaactaatagatagggacatg

SEQ ID NO: 810380 - DNA, 22 bp, Artificial Sequence
  chemically synthesized
gttttcaaattacatgtcccta

SEQ ID NO: 810381 - DNA, 22 bp, Artificial Sequence
  chemically synthesized
caactaatagatagggacatgt

SEQ ID NO: 810382 - DNA, 22 bp, Artificial Sequence
  chemically synthesized
tgttttcaaattacatgtccct

SEQ ID NO: 810383 - DNA, 22 bp, Artificial Sequence
  chemically synthesized
ttgttttcaaattacatgtccc

SEQ ID NO: 810384 - DNA, 22 bp, Artificial Sequence
  chemically synthesized
tttgttttcaaattacatgtcc

SEQ ID NO: 810385 - DNA, 22 bp, Artificial Sequence
  chemically synthesized
atagatagggacatgtaatttg

SEQ ID NO: 810386 - DNA, 22 bp, Artificial Sequence
  chemically synthesized
actttttgttttcaaattacat

SEQ ID NO: 810387 - DNA, 22 bp, Artificial Sequence
  chemically synthesized
ctcactttttgttttcaaatta

SEQ ID NO: 810388 - DNA, 22 bp, Artificial Sequence
  chemically synthesized
actcactttttgttttcaaatt

SEQ ID NO: 810389 - DNA, 22 bp, Artificial Sequence
  chemically synthesized
acatttactcactttttgtttt

SEQ ID NO: 810390 - DNA, 22 bp, Artificial Sequence
  chemically synthesized
gacatttactcactttttgttt

SEQ ID NO: 810391 - DNA, 22 bp, Artificial Sequence
  chemically synthesized
ggaccttgacatttactcactt

SEQ ID NO: 810392 - DNA, 22 bp, Artificial Sequence
  chemically synthesized
gaaaacaaaaagtgagtaaatg

SEQ ID NO: 810393 - DNA, 22 bp, Artificial Sequence
  chemically synthesized
ctaggaccttgacatttactca

SEQ ID NO: 810394 - DNA, 22 bp, Artificial Sequence
  chemically synthesized
aaaacaaaaagtgagtaaatgt

SEQ ID NO: 810395 - DNA, 22 bp, Artificial Sequence
  chemically synthesized
cctaggaccttgacatttactc

SEQ ID NO: 810396 - DNA, 22 bp, Artificial Sequence
  chemically synthesized
gaaaatatttcctaggaccttg

SEQ ID NO: 810397 - DNA, 22 bp, Artificial Sequence
  chemically synthesized
gcatataattggaaaatatttc

SEQ ID NO: 810398 - DNA, 22 bp, Artificial Sequence
  chemically synthesized
tcgggttagcatataattggaa

SEQ ID NO: 810399 - DNA, 22 bp, Artificial Sequence
  chemically synthesized
ggaaatattttccaattatatg

SEQ ID NO: 810400 - DNA, 22 bp, Artificial Sequence
  chemically synthesized
tccaattatatgctaacccgat

SEQ ID NO: 810401 - DNA, 22 bp, Artificial Sequence
  chemically synthesized
ccaattatatgctaacccgata

SEQ ID NO: 810402 - DNA, 22 bp, Artificial Sequence
  chemically synthesized
caattatatgctaacccgataa

SEQ ID NO: 810403 - DNA, 22 bp, Artificial Sequence
  chemically synthesized
tatgctaacccgataactccat

SEQ ID NO: 810404 - DNA, 22 bp, Artificial Sequence
  chemically synthesized
tgtcacatggacatggagttat

SEQ ID NO: 810405 - DNA, 22 bp, Artificial Sequence
  chemically synthesized
acccgataactccatgtccatg

SEQ ID NO: 810406 - DNA, 22 bp, Artificial Sequence
  chemically synthesized
cacagaataacgctatgtcaca

SEQ ID NO: 810407 - DNA, 22 bp, Artificial Sequence
  chemically synthesized
catgtccatgtgacatagcgtt

SEQ ID NO: 810408 - DNA, 22 bp, Artificial Sequence
  chemically synthesized
cagaattacacagaataacgct

SEQ ID NO: 810409 - DNA, 22 bp, Artificial Sequence
  chemically synthesized
acagaattacacagaataacgc

SEQ ID NO: 810410 - DNA, 22 bp, Artificial Sequence
  chemically synthesized
ttctgtgtaattctgtaaatta

SEQ ID NO: 810411 - DNA, 22 bp, Artificial Sequence
  chemically synthesized
tgtgtaattctgtaaattactt

SEQ ID NO: 810412 - DNA, 22 bp, Artificial Sequence
  chemically synthesized
tgtaattctgtaaattacttct

SEQ ID NO: 810413 - DNA, 22 bp, Artificial Sequence
  chemically synthesized
agaaatataggagagaagtaat

SEQ ID NO: 810414 - DNA, 22 bp, Artificial Sequence
  chemically synthesized
tgtaaattacttctctcctata

SEQ ID NO: 810415 - DNA, 22 bp, Artificial Sequence
  chemically synthesized
cacccctcagaaatataggaga

SEQ ID NO: 810416 - DNA, 22 bp, Artificial Sequence
  chemically synthesized
taaattacttctctcctatatt

SEQ ID NO: 810417 - DNA, 22 bp, Artificial Sequence
  chemically synthesized
ttccacccctcagaaatatagg

SEQ ID NO: 810418 - DNA, 22 bp, Artificial Sequence
  chemically synthesized
gttattccacccctcagaaata

SEQ ID NO: 810419 - DNA, 22 bp, Artificial Sequence
  chemically synthesized
cttctctcctatatttctgagg

SEQ ID NO: 810420 - DNA, 22 bp, Artificial Sequence
  chemically synthesized
ggttattccacccctcagaaat

SEQ ID NO: 810421 - DNA, 22 bp, Artificial Sequence
  chemically synthesized
ctctcctatatttctgaggggt

SEQ ID NO: 810422 - DNA, 22 bp, Artificial Sequence
  chemically synthesized
tctcctatatttctgaggggtg

SEQ ID NO: 810423 - DNA, 22 bp, Artificial Sequence
  chemically synthesized
tcctatatttctgaggggtgga

SEQ ID NO: 810424 - DNA, 22 bp, Artificial Sequence
  chemically synthesized
ctatatttctgaggggtggaat

SEQ ID NO: 810425 - DNA, 22 bp, Artificial Sequence
  chemically synthesized
tatttctgaggggtggaataac

SEQ ID NO: 810426 - DNA, 22 bp, Artificial Sequence
  chemically synthesized
ctgaggggtggaataaccaagg

SEQ ID NO: 810427 - DNA, 22 bp, Artificial Sequence
  chemically synthesized
tgaggggtggaataaccaagga

SEQ ID NO: 810428 - DNA, 22 bp, Artificial Sequence
  chemically synthesized
aggggtggaataaccaaggaca

SEQ ID NO: 810429 - DNA, 22 bp, Artificial Sequence
  chemically synthesized
aggaaacaaaatgcacaaaaat

SEQ ID NO: 810430 - DNA, 22 bp, Artificial Sequence
  chemically synthesized
ttgtgcattttgtttcctcaat

SEQ ID NO: 810431 - DNA, 22 bp, Artificial Sequence
  chemically synthesized
tgtgcattttgtttcctcaatt

SEQ ID NO: 810432 - DNA, 22 bp, Artificial Sequence
  chemically synthesized
gtgcattttgtttcctcaatta

SEQ ID NO: 810433 - DNA, 22 bp, Artificial Sequence
  chemically synthesized
tgcattttgtttcctcaattat

SEQ ID NO: 810434 - DNA, 22 bp, Artificial Sequence
  chemically synthesized
catagaaaggtatcataattga

SEQ ID NO: 810435 - DNA, 22 bp, Artificial Sequence
  chemically synthesized
tgtttcctcaattatgatacct

SEQ ID NO: 810436 - DNA, 22 bp, Artificial Sequence
  chemically synthesized
atctgcatagaaaggtatcata

SEQ ID NO: 810437 - DNA, 22 bp, Artificial Sequence
  chemically synthesized
gtttcctcaattatgatacctt

SEQ ID NO: 810438 - DNA, 22 bp, Artificial Sequence
  chemically synthesized
tttcctcaattatgataccttt

SEQ ID NO: 810439 - DNA, 22 bp, Artificial Sequence
  chemically synthesized
cctcaattatgatacctttcta

SEQ ID NO: 810440 - DNA, 22 bp, Artificial Sequence
  chemically synthesized
ccctgatctgcatagaaaggta

SEQ ID NO: 810441 - DNA, 22 bp, Artificial Sequence
  chemically synthesized
ctcaattatgatacctttctat

SEQ ID NO: 810442 - DNA, 22 bp, Artificial Sequence
  chemically synthesized
aattatgatacctttctatgca

SEQ ID NO: 810443 - DNA, 22 bp, Artificial Sequence
  chemically synthesized
tgatacctttctatgcagatca

SEQ ID NO: 810444 - DNA, 22 bp, Artificial Sequence
  chemically synthesized
tctatgcagatcagggcagttt

SEQ ID NO: 810445 - DNA, 22 bp, Artificial Sequence
  chemically synthesized
ctatgcagatcagggcagtttg

SEQ ID NO: 810446 - DNA, 22 bp, Artificial Sequence
  chemically synthesized
ccatagtgtgtgcaaactgccc

SEQ ID NO: 810447 - DNA, 22 bp, Artificial Sequence
  chemically synthesized
tatgcagatcagggcagtttgc

SEQ ID NO: 810448 - DNA, 22 bp, Artificial Sequence
  chemically synthesized
cccatagtgtgtgcaaactgcc

SEQ ID NO: 810449 - DNA, 22 bp, Artificial Sequence
  chemically synthesized
tcccatagtgtgtgcaaactgc

SEQ ID NO: 810450 - DNA, 22 bp, Artificial Sequence
  chemically synthesized
tgcagatcagggcagtttgcac

SEQ ID NO: 810451 - DNA, 22 bp, Artificial Sequence
  chemically synthesized
ttcccatagtgtgtgcaaactg

SEQ ID NO: 810452 - DNA, 22 bp, Artificial Sequence
  chemically synthesized
catttttcccatagtgtgtgca

SEQ ID NO: 810453 - DNA, 22 bp, Artificial Sequence
  chemically synthesized
ccatttttcccatagtgtgtgc

SEQ ID NO: 810454 - DNA, 22 bp, Artificial Sequence
  chemically synthesized
tccatttttcccatagtgtgtg

SEQ ID NO: 810455 - DNA, 22 bp, Artificial Sequence
  chemically synthesized
tcactttccatttttcccatag

SEQ ID NO: 810456 - DNA, 22 bp, Artificial Sequence
  chemically synthesized
gtcactttccatttttcccata

SEQ ID NO: 810457 - DNA, 22 bp, Artificial Sequence
  chemically synthesized
gcacacactatgggaaaaatgg

SEQ ID NO: 810458 - DNA, 22 bp, Artificial Sequence
  chemically synthesized
ccttgtcactttccatttttcc

SEQ ID NO: 810459 - DNA, 22 bp, Artificial Sequence
  chemically synthesized
cacacactatgggaaaaatgga

SEQ ID NO: 810460 - DNA, 22 bp, Artificial Sequence
  chemically synthesized
tgggaaaaatggaaagtgacaa

SEQ ID NO: 810461 - DNA, 22 bp, Artificial Sequence
  chemically synthesized
agcacagccaccatgaagcatg

SEQ ID NO: 810462 - DNA, 22 bp, Artificial Sequence
  chemically synthesized
cagcacagccaccatgaagcat

SEQ ID NO: 810463 - DNA, 22 bp, Artificial Sequence
  chemically synthesized
agcaaatcttcagcacagccac

SEQ ID NO: 810464 - DNA, 22 bp, Artificial Sequence
  chemically synthesized
tctgagcaaatcttcagcacag

SEQ ID NO: 810465 - DNA, 22 bp, Artificial Sequence
  chemically synthesized
ttatctgagcaaatcttcagca

SEQ ID NO: 810466 - DNA, 22 bp, Artificial Sequence
  chemically synthesized
catggtggctgtgctgaagatt

SEQ ID NO: 810467 - DNA, 22 bp, Artificial Sequence
  chemically synthesized
atggtggctgtgctgaagattt

SEQ ID NO: 810468 - DNA, 22 bp, Artificial Sequence
  chemically synthesized
tgctgaagatttgctcagataa

SEQ ID NO: 810469 - DNA, 22 bp, Artificial Sequence
  chemically synthesized
aagatttgctcagataacagtg

SEQ ID NO: 810470 - DNA, 22 bp, Artificial Sequence
  chemically synthesized
gaagacagcgcataaggacact

SEQ ID NO: 810471 - DNA, 22 bp, Artificial Sequence
  chemically synthesized
gctcagataacagtgtccttat

SEQ ID NO: 810472 - DNA, 22 bp, Artificial Sequence
  chemically synthesized
agaagacagcgcataaggacac

SEQ ID NO: 810473 - DNA, 22 bp, Artificial Sequence
  chemically synthesized
ctcagataacagtgtccttatg

SEQ ID NO: 810474 - DNA, 22 bp, Artificial Sequence
  chemically synthesized
agataacagtgtccttatgcgc

SEQ ID NO: 810475 - DNA, 22 bp, Artificial Sequence
  chemically synthesized
tcatccgcttagaagacagcgc

SEQ ID NO: 810476 - DNA, 22 bp, Artificial Sequence
  chemically synthesized
cactgtcatccgcttagaagac

SEQ ID NO: 810477 - DNA, 22 bp, Artificial Sequence
  chemically synthesized
atgcgctgtcttctaagcggat

SEQ ID NO: 810478 - DNA, 22 bp, Artificial Sequence
  chemically synthesized
tgcgctgtcttctaagcggatg

SEQ ID NO: 810479 - DNA, 22 bp, Artificial Sequence
  chemically synthesized
catgtctgcactgtcatccgct

SEQ ID NO: 810480 - DNA, 22 bp, Artificial Sequence
  chemically synthesized
ccatgtctgcactgtcatccgc

SEQ ID NO: 810481 - DNA, 22 bp, Artificial Sequence
  chemically synthesized
ttccatgtctgcactgtcatcc

SEQ ID NO: 810482 - DNA, 22 bp, Artificial Sequence
  chemically synthesized
tcttctaagcggatgacagtgc

SEQ ID NO: 810483 - DNA, 22 bp, Artificial Sequence
  chemically synthesized
tcttccatgtctgcactgtcat

SEQ ID NO: 810484 - DNA, 22 bp, Artificial Sequence
  chemically synthesized
ctcttccatgtctgcactgtca

SEQ ID NO: 810485 - DNA, 22 bp, Artificial Sequence
  chemically synthesized
ctaagcggatgacagtgcagac

SEQ ID NO: 810486 - DNA, 22 bp, Artificial Sequence
  chemically synthesized
taagcggatgacagtgcagaca

SEQ ID NO: 810487 - DNA, 22 bp, Artificial Sequence
  chemically synthesized
agcggatgacagtgcagacatg

SEQ ID NO: 810488 - DNA, 22 bp, Artificial Sequence
  chemically synthesized
catatttctcttccatgtctgc

SEQ ID NO: 810489 - DNA, 22 bp, Artificial Sequence
  chemically synthesized
ccatctgcatatttctcttcca

SEQ ID NO: 810490 - DNA, 22 bp, Artificial Sequence
  chemically synthesized
cccatctgcatatttctcttcc

SEQ ID NO: 810491 - DNA, 22 bp, Artificial Sequence
  chemically synthesized
tcccatctgcatatttctcttc

SEQ ID NO: 810492 - DNA, 22 bp, Artificial Sequence
  chemically synthesized
atgttttcccatctgcatattt

SEQ ID NO: 810493 - DNA, 22 bp, Artificial Sequence
  chemically synthesized
gattcatgttttcccatctgca

SEQ ID NO: 810494 - DNA, 22 bp, Artificial Sequence
  chemically synthesized
tagattcatgttttcccatctg

SEQ ID NO: 810495 - DNA, 22 bp, Artificial Sequence
  chemically synthesized
ctagattcatgttttcccatct

SEQ ID NO: 810496 - DNA, 22 bp, Artificial Sequence
  chemically synthesized
tctagattcatgttttcccatc

SEQ ID NO: 810497 - DNA, 22 bp, Artificial Sequence
  chemically synthesized
ttctagattcatgttttcccat

SEQ ID NO: 810498 - DNA, 22 bp, Artificial Sequence
  chemically synthesized
ccacttttctagattcatgttt

SEQ ID NO: 810499 - DNA, 22 bp, Artificial Sequence
  chemically synthesized
cccacttttctagattcatgtt

SEQ ID NO: 810500 - DNA, 22 bp, Artificial Sequence
  chemically synthesized
tcccacttttctagattcatgt

SEQ ID NO: 810501 - DNA, 22 bp, Artificial Sequence
  chemically synthesized
ttcccacttttctagattcatg

SEQ ID NO: 810502 - DNA, 22 bp, Artificial Sequence
  chemically synthesized
agtatttttcccacttttctag

SEQ ID NO: 810503 - DNA, 22 bp, Artificial Sequence
  chemically synthesized
ctcagtatttttcccacttttc

SEQ ID NO: 810504 - DNA, 22 bp, Artificial Sequence
  chemically synthesized
ctcctcagtatttttcccactt

SEQ ID NO: 810505 - DNA, 22 bp, Artificial Sequence
  chemically synthesized
ctgctcctcagtatttttccca

SEQ ID NO: 810506 - DNA, 22 bp, Artificial Sequence
  chemically synthesized
gaaaagtgggaaaaatactgag

SEQ ID NO: 810507 - DNA, 22 bp, Artificial Sequence
  chemically synthesized
caggtctcctgctcctcagtat

SEQ ID NO: 810508 - DNA, 22 bp, Artificial Sequence
  chemically synthesized
ccaggtctcctgctcctcagta

SEQ ID NO: 810509 - DNA, 22 bp, Artificial Sequence
  chemically synthesized
tccaggtctcctgctcctcagt

SEQ ID NO: 810510 - DNA, 22 bp, Artificial Sequence
  chemically synthesized
ttccaggtctcctgctcctcag

SEQ ID NO: 810511 - DNA, 22 bp, Artificial Sequence
  chemically synthesized
cttttccaggtctcctgctcct

SEQ ID NO: 810512 - DNA, 22 bp, Artificial Sequence
  chemically synthesized
acttttccaggtctcctgctcc

SEQ ID NO: 810513 - DNA, 22 bp, Artificial Sequence
  chemically synthesized
tcttacttttccaggtctcctg

SEQ ID NO: 810514 - DNA, 22 bp, Artificial Sequence
  chemically synthesized
gaattgtcttacttttccaggt

SEQ ID NO: 810515 - DNA, 22 bp, Artificial Sequence
  chemically synthesized
aggagcaggagacctggaaaag

SEQ ID NO: 810516 - DNA, 22 bp, Artificial Sequence
  chemically synthesized
tagaattgtcttacttttccag

SEQ ID NO: 810517 - DNA, 22 bp, Artificial Sequence
  chemically synthesized
agcccactctagaattgtctta

SEQ ID NO: 810518 - DNA, 22 bp, Artificial Sequence
  chemically synthesized
tctcagcccactctagaattgt

SEQ ID NO: 810519 - DNA, 22 bp, Artificial Sequence
  chemically synthesized
gaaaagtaagacaattctagag

SEQ ID NO: 810520 - DNA, 22 bp, Artificial Sequence
  chemically synthesized
tatctcagcccactctagaatt

SEQ ID NO: 810521 - DNA, 22 bp, Artificial Sequence
  chemically synthesized
ctatctcagcccactctagaat

SEQ ID NO: 810522 - DNA, 22 bp, Artificial Sequence
  chemically synthesized
caacatgtcttctatctcagcc

SEQ ID NO: 810523 - DNA, 22 bp, Artificial Sequence
  chemically synthesized
tagagtgggctgagatagaaga

SEQ ID NO: 810524 - DNA, 22 bp, Artificial Sequence
  chemically synthesized
gagtgggctgagatagaagaca

SEQ ID NO: 810525 - DNA, 22 bp, Artificial Sequence
  chemically synthesized
tccccagtggttacaacatgtc

SEQ ID NO: 810526 - DNA, 22 bp, Artificial Sequence
  chemically synthesized
ctgtccccagtggttacaacat

SEQ ID NO: 810527 - DNA, 22 bp, Artificial Sequence
  chemically synthesized
agatagaagacatgttgtaacc

SEQ ID NO: 810528 - DNA, 22 bp, Artificial Sequence
  chemically synthesized
cctgtccccagtggttacaaca

SEQ ID NO: 810529 - DNA, 22 bp, Artificial Sequence
  chemically synthesized
tcctgtccccagtggttacaac

SEQ ID NO: 810530 - DNA, 22 bp, Artificial Sequence
  chemically synthesized
acatgttttcctgtccccagtg

SEQ ID NO: 810531 - DNA, 22 bp, Artificial Sequence
  chemically synthesized
ttcacatgttttcctgtcccca

SEQ ID NO: 810532 - DNA, 22 bp, Artificial Sequence
  chemically synthesized
ctgttcacatgttttcctgtcc

SEQ ID NO: 810533 - DNA, 22 bp, Artificial Sequence
  chemically synthesized
taaccactggggacaggaaaac

SEQ ID NO: 810534 - DNA, 22 bp, Artificial Sequence
  chemically synthesized
gggacaggaaaacatgtgaaca

SEQ ID NO: 810535 - DNA, 22 bp, Artificial Sequence
  chemically synthesized
tatacatgttcctgttcacatg

SEQ ID NO: 810536 - DNA, 22 bp, Artificial Sequence
  chemically synthesized
atatacatgttcctgttcacat

SEQ ID NO: 810537 - DNA, 22 bp, Artificial Sequence
  chemically synthesized
tcagcttatatacatgttcctg

SEQ ID NO: 810538 - DNA, 22 bp, Artificial Sequence
  chemically synthesized
cacactgtcagcttatatacat

SEQ ID NO: 810539 - DNA, 22 bp, Artificial Sequence
  chemically synthesized
gcacactgtcagcttatataca

SEQ ID NO: 810540 - DNA, 22 bp, Artificial Sequence
  chemically synthesized
ttgcacactgtcagcttatata

SEQ ID NO: 810541 - DNA, 22 bp, Artificial Sequence
  chemically synthesized
tgagctcttgcacactgtcagc

SEQ ID NO: 810542 - DNA, 22 bp, Artificial Sequence
  chemically synthesized
tgtgagctcttgcacactgtca

SEQ ID NO: 810543 - DNA, 22 bp, Artificial Sequence
  chemically synthesized
ctgtgagctcttgcacactgtc

SEQ ID NO: 810544 - DNA, 22 bp, Artificial Sequence
  chemically synthesized
tctgtgagctcttgcacactgt

SEQ ID NO: 810545 - DNA, 22 bp, Artificial Sequence
  chemically synthesized
ctttctgtgagctcttgcacac

SEQ ID NO: 810546 - DNA, 22 bp, Artificial Sequence
  chemically synthesized
gctttctgtgagctcttgcaca

SEQ ID NO: 810547 - DNA, 22 bp, Artificial Sequence
  chemically synthesized
gcatttgctttctgtgagctct

SEQ ID NO: 810548 - DNA, 22 bp, Artificial Sequence
  chemically synthesized
acagtgtgcaagagctcacaga

SEQ ID NO: 810549 - DNA, 22 bp, Artificial Sequence
  chemically synthesized
ttagcatttgctttctgtgagc

SEQ ID NO: 810550 - DNA, 22 bp, Artificial Sequence
  chemically synthesized
ctgttagcatttgctttctgtg

SEQ ID NO: 810551 - DNA, 22 bp, Artificial Sequence
  chemically synthesized
ttactgttagcatttgctttct

SEQ ID NO: 810552 - DNA, 22 bp, Artificial Sequence
  chemically synthesized
tattactgttagcatttgcttt

SEQ ID NO: 810553 - DNA, 22 bp, Artificial Sequence
  chemically synthesized
tctattactgttagcatttgct

SEQ ID NO: 810554 - DNA, 22 bp, Artificial Sequence
  chemically synthesized
ctctattactgttagcatttgc

SEQ ID NO: 810555 - DNA, 22 bp, Artificial Sequence
  chemically synthesized
acagaaagcaaatgctaacagt

SEQ ID NO: 810556 - DNA, 22 bp, Artificial Sequence
  chemically synthesized
aatggtatttctctattactgt

SEQ ID NO: 810557 - DNA, 22 bp, Artificial Sequence
  chemically synthesized
cctcaatggtatttctctatta

SEQ ID NO: 810558 - DNA, 22 bp, Artificial Sequence
  chemically synthesized
tgcctcaatggtatttctctat

SEQ ID NO: 810559 - DNA, 22 bp, Artificial Sequence
  chemically synthesized
cctctgcctcaatggtatttct

SEQ ID NO: 810560 - DNA, 22 bp, Artificial Sequence
  chemically synthesized
acagtaatagagaaataccatt

SEQ ID NO: 810561 - DNA, 22 bp, Artificial Sequence
  chemically synthesized
tacctctgcctcaatggtattt

SEQ ID NO: 810562 - DNA, 22 bp, Artificial Sequence
  chemically synthesized
tctctacctctgcctcaatggt

SEQ ID NO: 810563 - DNA, 22 bp, Artificial Sequence
  chemically synthesized
atctctacctctgcctcaatgg

SEQ ID NO: 810564 - DNA, 22 bp, Artificial Sequence
  chemically synthesized
tatctctacctctgcctcaatg

SEQ ID NO: 810565 - DNA, 22 bp, Artificial Sequence
  chemically synthesized
ttatctctacctctgcctcaat

SEQ ID NO: 810566 - DNA, 22 bp, Artificial Sequence
  chemically synthesized
tttatctctacctctgcctcaa

SEQ ID NO: 810567 - DNA, 22 bp, Artificial Sequence
  chemically synthesized
tttttatctctacctctgcctc

SEQ ID NO: 810568 - DNA, 22 bp, Artificial Sequence
  chemically synthesized
ctttttatctctacctctgcct

SEQ ID NO: 810569 - DNA, 22 bp, Artificial Sequence
  chemically synthesized
tttctttttatctctacctctg

SEQ ID NO: 810570 - DNA, 22 bp, Artificial Sequence
  chemically synthesized
atttctttttatctctacctct

SEQ ID NO: 810571 - DNA, 22 bp, Artificial Sequence
  chemically synthesized
cttatttctttttatctctacc

SEQ ID NO: 810572 - DNA, 22 bp, Artificial Sequence
  chemically synthesized
aggcagaggtagagataaaaag

SEQ ID NO: 810573 - DNA, 22 bp, Artificial Sequence
  chemically synthesized
caggcgtgagccaccatggccg

SEQ ID NO: 810574 - DNA, 22 bp, Artificial Sequence
  chemically synthesized
ggattacaggcgtgagccacca

SEQ ID NO: 810575 - DNA, 22 bp, Artificial Sequence
  chemically synthesized
ccaaagtgctgggattacaggc

SEQ ID NO: 810576 - DNA, 22 bp, Artificial Sequence
  chemically synthesized
gcctcccaaagtgctgggatta

SEQ ID NO: 810577 - DNA, 22 bp, Artificial Sequence
  chemically synthesized
ggcctcccaaagtgctgggatt

SEQ ID NO: 810578 - DNA, 22 bp, Artificial Sequence
  chemically synthesized
acgcctgtaatcccagcacttt

SEQ ID NO: 810579 - DNA, 22 bp, Artificial Sequence
  chemically synthesized
taatcccagcactttgggaggc

SEQ ID NO: 810580 - DNA, 22 bp, Artificial Sequence
  chemically synthesized
gtgatccacccaccttggcctc

SEQ ID NO: 810581 - DNA, 22 bp, Artificial Sequence
  chemically synthesized
acctcgtgatccacccaccttg

SEQ ID NO: 810582 - DNA, 22 bp, Artificial Sequence
  chemically synthesized
ctgacctcgtgatccacccacc

SEQ ID NO: 810583 - DNA, 22 bp, Artificial Sequence
  chemically synthesized
tgggaggccaaggtgggtggat

SEQ ID NO: 810584 - DNA, 22 bp, Artificial Sequence
  chemically synthesized
gggaggccaaggtgggtggatc

SEQ ID NO: 810585 - DNA, 22 bp, Artificial Sequence
  chemically synthesized
ggaggccaaggtgggtggatca

SEQ ID NO: 810586 - DNA, 22 bp, Artificial Sequence
  chemically synthesized
aactcctgacctcgtgatccac

SEQ ID NO: 810587 - DNA, 22 bp, Artificial Sequence
  chemically synthesized
gaactcctgacctcgtgatcca

SEQ ID NO: 810588 - DNA, 22 bp, Artificial Sequence
  chemically synthesized
gtcttgaactcctgacctcgtg

SEQ ID NO: 810589 - DNA, 22 bp, Artificial Sequence
  chemically synthesized
gccaggctggtcttgaactcct

SEQ ID NO: 810590 - DNA, 22 bp, Artificial Sequence
  chemically synthesized
ggccaggctggtcttgaactcc

SEQ ID NO: 810591 - DNA, 22 bp, Artificial Sequence
  chemically synthesized
accatcttggccaggctggtct

SEQ ID NO: 810592 - DNA, 22 bp, Artificial Sequence
  chemically synthesized
caccatcttggccaggctggtc

SEQ ID NO: 810593 - DNA, 22 bp, Artificial Sequence
  chemically synthesized
aagaccagcctggccaagatgg

SEQ ID NO: 810594 - DNA, 22 bp, Artificial Sequence
  chemically synthesized
gtagagacagggtttcaccatc

SEQ ID NO: 810595 - DNA, 22 bp, Artificial Sequence
  chemically synthesized
agtagagacagggtttcaccat

SEQ ID NO: 810596 - DNA, 22 bp, Artificial Sequence
  chemically synthesized
tagtagagacagggtttcacca

SEQ ID NO: 810597 - DNA, 22 bp, Artificial Sequence
  chemically synthesized
ttagtagagacagggtttcacc

SEQ ID NO: 810598 - DNA, 22 bp, Artificial Sequence
  chemically synthesized
gccaagatggtgaaaccctgtc

SEQ ID NO: 810599 - DNA, 22 bp, Artificial Sequence
  chemically synthesized
tatttttagtagagacagggtt

SEQ ID NO: 810600 - DNA, 22 bp, Artificial Sequence
  chemically synthesized
gtatttttagtagagacagggt

SEQ ID NO: 810601 - DNA, 22 bp, Artificial Sequence
  chemically synthesized
tgtatttttagtagagacaggg

SEQ ID NO: 810602 - DNA, 22 bp, Artificial Sequence
  chemically synthesized
ttgtatttttagtagagacagg

SEQ ID NO: 810603 - DNA, 22 bp, Artificial Sequence
  chemically synthesized
tttgtatttttagtagagacag

SEQ ID NO: 810604 - DNA, 22 bp, Artificial Sequence
  chemically synthesized
ttttgtatttttagtagagaca

SEQ ID NO: 810605 - DNA, 22 bp, Artificial Sequence
  chemically synthesized
tttttgtatttttagtagagac

SEQ ID NO: 810606 - DNA, 22 bp, Artificial Sequence
  chemically synthesized
attttttttgtatttttagtag

SEQ ID NO: 810607 - DNA, 22 bp, Artificial Sequence
  chemically synthesized
ctaattttttttgtatttttag

SEQ ID NO: 810608 - DNA, 22 bp, Artificial Sequence
  chemically synthesized
tctctactaaaaatacaaaaaa

SEQ ID NO: 810609 - DNA, 22 bp, Artificial Sequence
  chemically synthesized
tactaaaaatacaaaaaaaatt

SEQ ID NO: 810610 - DNA, 22 bp, Artificial Sequence
  chemically synthesized
ctaaaaatacaaaaaaaattag

SEQ ID NO: 810611 - DNA, 22 bp, Artificial Sequence
  chemically synthesized
aaaatacaaaaaaaattagcag

SEQ ID NO: 810612 - DNA, 22 bp, Artificial Sequence
  chemically synthesized
caggcacccaccaccacgccct

SEQ ID NO: 810613 - DNA, 22 bp, Artificial Sequence
  chemically synthesized
ggattacaggcacccaccacca

SEQ ID NO: 810614 - DNA, 22 bp, Artificial Sequence
  chemically synthesized
gcagggcgtggtggtgggtgcc

SEQ ID NO: 810615 - DNA, 22 bp, Artificial Sequence
  chemically synthesized
ccgagtggctgggattacaggc

SEQ ID NO: 810616 - DNA, 22 bp, Artificial Sequence
  chemically synthesized
agcctcccgagtggctgggatt

SEQ ID NO: 810617 - DNA, 22 bp, Artificial Sequence
  chemically synthesized
tctcagcctcccgagtggctgg

SEQ ID NO: 810618 - DNA, 22 bp, Artificial Sequence
  chemically synthesized
tgtctcagcctcccgagtggct

SEQ ID NO: 810619 - DNA, 22 bp, Artificial Sequence
  chemically synthesized
tctgtctcagcctcccgagtgg

SEQ ID NO: 810620 - DNA, 22 bp, Artificial Sequence
  chemically synthesized
taatcccagccactcgggaggc

SEQ ID NO: 810621 - DNA, 22 bp, Artificial Sequence
  chemically synthesized
aagcaattctctgtctcagcct

SEQ ID NO: 810622 - DNA, 22 bp, Artificial Sequence
  chemically synthesized
ggttcaagcaattctctgtctc

SEQ ID NO: 810623 - DNA, 22 bp, Artificial Sequence
  chemically synthesized
ctgggttcaagcaattctctgt

SEQ ID NO: 810624 - DNA, 22 bp, Artificial Sequence
  chemically synthesized
gggaggctgagacagagaattg

SEQ ID NO: 810625 - DNA, 22 bp, Artificial Sequence
  chemically synthesized
cctcctgggttcaagcaattct

SEQ ID NO: 810626 - DNA, 22 bp, Artificial Sequence
  chemically synthesized
tccctcctgggttcaagcaatt

SEQ ID NO: 810627 - DNA, 22 bp, Artificial Sequence
  chemically synthesized
agacagagaattgcttgaaccc

SEQ ID NO: 810628 - DNA, 22 bp, Artificial Sequence
  chemically synthesized
caacctctccctcctgggttca

SEQ ID NO: 810629 - DNA, 22 bp, Artificial Sequence
  chemically synthesized
actgcaacctctccctcctggg

SEQ ID NO: 810630 - DNA, 22 bp, Artificial Sequence
  chemically synthesized
gctcactgcaacctctccctcc

SEQ ID NO: 810631 - DNA, 22 bp, Artificial Sequence
  chemically synthesized
ggctcactgcaacctctccctc

SEQ ID NO: 810632 - DNA, 22 bp, Artificial Sequence
  chemically synthesized
cttgaacccaggagggagaggt

SEQ ID NO: 810633 - DNA, 22 bp, Artificial Sequence
  chemically synthesized
gaacccaggagggagaggttgc

SEQ ID NO: 810634 - DNA, 22 bp, Artificial Sequence
  chemically synthesized
aacccaggagggagaggttgca

SEQ ID NO: 810635 - DNA, 22 bp, Artificial Sequence
  chemically synthesized
tagtgcagtggtgcgatcttgg

SEQ ID NO: 810636 - DNA, 22 bp, Artificial Sequence
  chemically synthesized
cagtgagccaagatcgcaccac

SEQ ID NO: 810637 - DNA, 22 bp, Artificial Sequence
  chemically synthesized
cccaggctgtagtgcagtggtg

SEQ ID NO: 810638 - DNA, 22 bp, Artificial Sequence
  chemically synthesized
gcccaggctgtagtgcagtggt

SEQ ID NO: 810639 - DNA, 22 bp, Artificial Sequence
  chemically synthesized
ttgcccaggctgtagtgcagtg

SEQ ID NO: 810640 - DNA, 22 bp, Artificial Sequence
  chemically synthesized
tcttgcccaggctgtagtgcag

SEQ ID NO: 810641 - DNA, 22 bp, Artificial Sequence
  chemically synthesized
gctctcttgcccaggctgtagt

SEQ ID NO: 810642 - DNA, 22 bp, Artificial Sequence
  chemically synthesized
cactacagcctgggcaagagag

SEQ ID NO: 810643 - DNA, 22 bp, Artificial Sequence
  chemically synthesized
agacggagtctcgctctcttgc

SEQ ID NO: 810644 - DNA, 22 bp, Artificial Sequence
  chemically synthesized
gagacggagtctcgctctcttg

SEQ ID NO: 810645 - DNA, 22 bp, Artificial Sequence
  chemically synthesized
tgagacggagtctcgctctctt

SEQ ID NO: 810646 - DNA, 22 bp, Artificial Sequence
  chemically synthesized
ttgagacggagtctcgctctct

SEQ ID NO: 810647 - DNA, 22 bp, Artificial Sequence
  chemically synthesized
cagcctgggcaagagagcgaga

SEQ ID NO: 810648 - DNA, 22 bp, Artificial Sequence
  chemically synthesized
tttgagacggagtctcgctctc

SEQ ID NO: 810649 - DNA, 22 bp, Artificial Sequence
  chemically synthesized
ttttgagacggagtctcgctct

SEQ ID NO: 810650 - DNA, 22 bp, Artificial Sequence
  chemically synthesized
tttttgagacggagtctcgctc

SEQ ID NO: 810651 - DNA, 22 bp, Artificial Sequence
  chemically synthesized
ttttttgagacggagtctcgct

SEQ ID NO: 810652 - DNA, 22 bp, Artificial Sequence
  chemically synthesized
tttttttgagacggagtctcgc

SEQ ID NO: 810653 - DNA, 22 bp, Artificial Sequence
  chemically synthesized
ttttttttgagacggagtctcg

SEQ ID NO: 810654 - DNA, 22 bp, Artificial Sequence
  chemically synthesized
tttttttttgagacggagtctc

SEQ ID NO: 810655 - DNA, 22 bp, Artificial Sequence
  chemically synthesized
ggcaagagagcgagactccgtc

SEQ ID NO: 810656 - DNA, 22 bp, Artificial Sequence
  chemically synthesized
ttttttttttgagacggagtct

SEQ ID NO: 810657 - DNA, 22 bp, Artificial Sequence
  chemically synthesized
tttttttttttgagacggagtc

SEQ ID NO: 810658 - DNA, 22 bp, Artificial Sequence
  chemically synthesized
ttttttttttttgagacggagt

SEQ ID NO: 810659 - DNA, 22 bp, Artificial Sequence
  chemically synthesized
tttttttttttttgagacggag

SEQ ID NO: 810660 - DNA, 22 bp, Artificial Sequence
  chemically synthesized
ttttttttttttttgagacgga

SEQ ID NO: 810661 - DNA, 22 bp, Artificial Sequence
  chemically synthesized
tttttttttttttttgagacgg

SEQ ID NO: 810662 - DNA, 22 bp, Artificial Sequence
  chemically synthesized
ttttttttttttttttgagacg

SEQ ID NO: 810663 - DNA, 22 bp, Artificial Sequence
  chemically synthesized
tttttttttttttttttgagac

SEQ ID NO: 810664 - DNA, 22 bp, Artificial Sequence
  chemically synthesized
ttttttttttttttttttgaga

SEQ ID NO: 810665 - DNA, 22 bp, Artificial Sequence
  chemically synthesized
tttttttttttttttttttgag

SEQ ID NO: 810666 - DNA, 22 bp, Artificial Sequence
  chemically synthesized
cttttttttttttttttttttt

SEQ ID NO: 810667 - DNA, 22 bp, Artificial Sequence
  chemically synthesized
ttcctttttttttttttttttt

SEQ ID NO: 810668 - DNA, 22 bp, Artificial Sequence
  chemically synthesized
attccttttttttttttttttt

SEQ ID NO: 810669 - DNA, 22 bp, Artificial Sequence
  chemically synthesized
cgtctcaaaaaaaaaaaaaaaa

SEQ ID NO: 810670 - DNA, 22 bp, Artificial Sequence
  chemically synthesized
cttattcctttttttttttttt

SEQ ID NO: 810671 - DNA, 22 bp, Artificial Sequence
  chemically synthesized
tccttattcctttttttttttt

SEQ ID NO: 810672 - DNA, 22 bp, Artificial Sequence
  chemically synthesized
tctccttattcctttttttttt

SEQ ID NO: 810673 - DNA, 22 bp, Artificial Sequence
  chemically synthesized
aaaaaaaaaaaaaaaaaaaaag

SEQ ID NO: 810674 - DNA, 22 bp, Artificial Sequence
  chemically synthesized
cctctctccttattcctttttt

SEQ ID NO: 810675 - DNA, 22 bp, Artificial Sequence
  chemically synthesized
gcctctctccttattccttttt

SEQ ID NO: 810676 - DNA, 22 bp, Artificial Sequence
  chemically synthesized
tgcctctctccttattcctttt

SEQ ID NO: 810677 - DNA, 22 bp, Artificial Sequence
  chemically synthesized
aactttgcctctctccttattc

SEQ ID NO: 810678 - DNA, 22 bp, Artificial Sequence
  chemically synthesized
tcctcaactttgcctctctcct

SEQ ID NO: 810679 - DNA, 22 bp, Artificial Sequence
  chemically synthesized
cccagtgcgcctgtcctcaact

SEQ ID NO: 810680 - DNA, 22 bp, Artificial Sequence
  chemically synthesized
ccccagtgcgcctgtcctcaac

SEQ ID NO: 810681 - DNA, 22 bp, Artificial Sequence
  chemically synthesized
tcatttccccagtgcgcctgtc

SEQ ID NO: 810682 - DNA, 22 bp, Artificial Sequence
  chemically synthesized
tgtcatttccccagtgcgcctg

SEQ ID NO: 810683 - DNA, 22 bp, Artificial Sequence
  chemically synthesized
ctgtcatttccccagtgcgcct

SEQ ID NO: 810684 - DNA, 22 bp, Artificial Sequence
  chemically synthesized
tttctgtcatttccccagtgcg

SEQ ID NO: 810685 - DNA, 22 bp, Artificial Sequence
  chemically synthesized
ttatttctgtcatttccccagt

SEQ ID NO: 810686 - DNA, 22 bp, Artificial Sequence
  chemically synthesized
aggacaggcgcactggggaaat

SEQ ID NO: 810687 - DNA, 22 bp, Artificial Sequence
  chemically synthesized
agttgttatttctgtcatttcc

SEQ ID NO: 810688 - DNA, 22 bp, Artificial Sequence
  chemically synthesized
tgagttgttatttctgtcattt

SEQ ID NO: 810689 - DNA, 22 bp, Artificial Sequence
  chemically synthesized
tctgagttgttatttctgtcat

SEQ ID NO: 810690 - DNA, 22 bp, Artificial Sequence
  chemically synthesized
ctctgagttgttatttctgtca

SEQ ID NO: 810691 - DNA, 22 bp, Artificial Sequence
  chemically synthesized
tctctgagttgttatttctgtc

SEQ ID NO: 810692 - DNA, 22 bp, Artificial Sequence
  chemically synthesized
ttctctgagttgttatttctgt

SEQ ID NO: 810693 - DNA, 22 bp, Artificial Sequence
  chemically synthesized
gggaaatgacagaaataacaac

SEQ ID NO: 810694 - DNA, 22 bp, Artificial Sequence
  chemically synthesized
acttttctctgagttgttattt

SEQ ID NO: 810695 - DNA, 22 bp, Artificial Sequence
  chemically synthesized
ctcacttttctctgagttgtta

SEQ ID NO: 810696 - DNA, 22 bp, Artificial Sequence
  chemically synthesized
actcacttttctctgagttgtt

SEQ ID NO: 810697 - DNA, 22 bp, Artificial Sequence
  chemically synthesized
cacttactcacttttctctgag

SEQ ID NO: 810698 - DNA, 22 bp, Artificial Sequence
  chemically synthesized
aaagagatgttgcacttactca

SEQ ID NO: 810699 - DNA, 22 bp, Artificial Sequence
  chemically synthesized
agagaaaagtgagtaagtgcaa

SEQ ID NO: 810700 - DNA, 22 bp, Artificial Sequence
  chemically synthesized
ggaataacaagactcaaagaga

SEQ ID NO: 810701 - DNA, 22 bp, Artificial Sequence
  chemically synthesized
gggaataacaagactcaaagag

SEQ ID NO: 810702 - DNA, 22 bp, Artificial Sequence
  chemically synthesized
tttgagtcttgttattcccaaa

SEQ ID NO: 810703 - DNA, 22 bp, Artificial Sequence
  chemically synthesized
tgagtcttgttattcccaaaca

SEQ ID NO: 810704 - DNA, 22 bp, Artificial Sequence
  chemically synthesized
ggtgaatagggatgtttgggaa

SEQ ID NO: 810705 - DNA, 22 bp, Artificial Sequence
  chemically synthesized
gagtcttgttattcccaaacat

SEQ ID NO: 810706 - DNA, 22 bp, Artificial Sequence
  chemically synthesized
gggtgaatagggatgtttggga

SEQ ID NO: 810707 - DNA, 22 bp, Artificial Sequence
  chemically synthesized
agtcttgttattcccaaacatc

SEQ ID NO: 810708 - DNA, 22 bp, Artificial Sequence
  chemically synthesized
tgggtgaatagggatgtttggg

SEQ ID NO: 810709 - DNA, 22 bp, Artificial Sequence
  chemically synthesized
atctttgggtgaatagggatgt

SEQ ID NO: 810710 - DNA, 22 bp, Artificial Sequence
  chemically synthesized
gttattcccaaacatccctatt

SEQ ID NO: 810711 - DNA, 22 bp, Artificial Sequence
  chemically synthesized
ttattcccaaacatccctattc

SEQ ID NO: 810712 - DNA, 22 bp, Artificial Sequence
  chemically synthesized
ttcccaaacatccctattcacc

SEQ ID NO: 810713 - DNA, 22 bp, Artificial Sequence
  chemically synthesized
ccaaacatccctattcacccaa

SEQ ID NO: 810714 - DNA, 22 bp, Artificial Sequence
  chemically synthesized
taggaaatgttaatctttgggt

SEQ ID NO: 810715 - DNA, 22 bp, Artificial Sequence
  chemically synthesized
gtaggaaatgttaatctttggg

SEQ ID NO: 810716 - DNA, 22 bp, Artificial Sequence
  chemically synthesized
ttcacccaaagattaacatttc

SEQ ID NO: 810717 - DNA, 22 bp, Artificial Sequence
  chemically synthesized
acccaaagattaacatttccta

SEQ ID NO: 810718 - DNA, 22 bp, Artificial Sequence
  chemically synthesized
ataacatggtgtcttgtaggaa

SEQ ID NO: 810719 - DNA, 22 bp, Artificial Sequence
  chemically synthesized
acatttcctacaagacaccatg

SEQ ID NO: 810720 - DNA, 22 bp, Artificial Sequence
  chemically synthesized
aggatattcataacatggtgtc

SEQ ID NO: 810721 - DNA, 22 bp, Artificial Sequence
  chemically synthesized
gttaaggatattcataacatgg

SEQ ID NO: 810722 - DNA, 22 bp, Artificial Sequence
  chemically synthesized
cctacaagacaccatgttatga

SEQ ID NO: 810723 - DNA, 22 bp, Artificial Sequence
  chemically synthesized
ctacaagacaccatgttatgaa

SEQ ID NO: 810724 - DNA, 22 bp, Artificial Sequence
  chemically synthesized
caagacaccatgttatgaatat

SEQ ID NO: 810725 - DNA, 22 bp, Artificial Sequence
  chemically synthesized
agggatatccattagttaagga

SEQ ID NO: 810726 - DNA, 22 bp, Artificial Sequence
  chemically synthesized
gagggatatccattagttaagg

SEQ ID NO: 810727 - DNA, 22 bp, Artificial Sequence
  chemically synthesized
ttgagggatatccattagttaa

SEQ ID NO: 810728 - DNA, 22 bp, Artificial Sequence
  chemically synthesized
cttgagggatatccattagtta

SEQ ID NO: 810729 - DNA, 22 bp, Artificial Sequence
  chemically synthesized
tgaatatccttaactaatggat

SEQ ID NO: 810730 - DNA, 22 bp, Artificial Sequence
  chemically synthesized
ttcttgagggatatccattagt

SEQ ID NO: 810731 - DNA, 22 bp, Artificial Sequence
  chemically synthesized
cttcttgagggatatccattag

SEQ ID NO: 810732 - DNA, 22 bp, Artificial Sequence
  chemically synthesized
aactaatggatatccctcaaga

SEQ ID NO: 810733 - DNA, 22 bp, Artificial Sequence
  chemically synthesized
actaatggatatccctcaagaa

SEQ ID NO: 810734 - DNA, 22 bp, Artificial Sequence
  chemically synthesized
atggatatccctcaagaagaaa

SEQ ID NO: 810735 - DNA, 22 bp, Artificial Sequence
  chemically synthesized
taagaaaaataaatatttcttc

SEQ ID NO: 810736 - DNA, 22 bp, Artificial Sequence
  chemically synthesized
tactataagaaaaataaatatt

SEQ ID NO: 810737 - DNA, 22 bp, Artificial Sequence
  chemically synthesized
aagaagaaatatttatttttct

SEQ ID NO: 810738 - DNA, 22 bp, Artificial Sequence
  chemically synthesized
ccaaatgtatgtaactgtacta

SEQ ID NO: 810739 - DNA, 22 bp, Artificial Sequence
  chemically synthesized
atttttcttatagtacagttac

SEQ ID NO: 810740 - DNA, 22 bp, Artificial Sequence
  chemically synthesized
tttttcttatagtacagttaca

SEQ ID NO: 810741 - DNA, 22 bp, Artificial Sequence
  chemically synthesized
attcccaaatgtatgtaactgt

SEQ ID NO: 810742 - DNA, 22 bp, Artificial Sequence
  chemically synthesized
ttcttatagtacagttacatac

SEQ ID NO: 810743 - DNA, 22 bp, Artificial Sequence
  chemically synthesized
taattcccaaatgtatgtaact

SEQ ID NO: 810744 - DNA, 22 bp, Artificial Sequence
  chemically synthesized
tcttatagtacagttacataca

SEQ ID NO: 810745 - DNA, 22 bp, Artificial Sequence
  chemically synthesized
cttatagtacagttacatacat

SEQ ID NO: 810746 - DNA, 22 bp, Artificial Sequence
  chemically synthesized
ttatagtacagttacatacatt

SEQ ID NO: 810747 - DNA, 22 bp, Artificial Sequence
  chemically synthesized
atagtacagttacatacatttg

SEQ ID NO: 810748 - DNA, 22 bp, Artificial Sequence
  chemically synthesized
tagtacagttacatacatttgg

SEQ ID NO: 810749 - DNA, 22 bp, Artificial Sequence
  chemically synthesized
aaaatccattctaattcccaaa

SEQ ID NO: 810750 - DNA, 22 bp, Artificial Sequence
  chemically synthesized
catacatttgggaattagaatg

SEQ ID NO: 810751 - DNA, 22 bp, Artificial Sequence
  chemically synthesized
gggaattagaatggatttttaa

SEQ ID NO: 810752 - DNA, 22 bp, Artificial Sequence
  chemically synthesized
ggaattagaatggatttttaat

SEQ ID NO: 810753 - DNA, 22 bp, Artificial Sequence
  chemically synthesized
gatcagaaaccaattaaaaatc

SEQ ID NO: 810754 - DNA, 22 bp, Artificial Sequence
  chemically synthesized
ggatcagaaaccaattaaaaat

SEQ ID NO: 810755 - DNA, 22 bp, Artificial Sequence
  chemically synthesized
gaatggatttttaattggtttc

SEQ ID NO: 810756 - DNA, 22 bp, Artificial Sequence
  chemically synthesized
aaacttggatcagaaaccaatt

SEQ ID NO: 810757 - DNA, 22 bp, Artificial Sequence
  chemically synthesized
ttaattggtttctgatccaagt

SEQ ID NO: 810758 - DNA, 22 bp, Artificial Sequence
  chemically synthesized
taattggtttctgatccaagtt

SEQ ID NO: 810759 - DNA, 22 bp, Artificial Sequence
  chemically synthesized
caaaatgattaaaacttggatc

SEQ ID NO: 810760 - DNA, 22 bp, Artificial Sequence
  chemically synthesized
aattggtttctgatccaagttt

SEQ ID NO: 810761 - DNA, 22 bp, Artificial Sequence
  chemically synthesized
attggtttctgatccaagtttt

SEQ ID NO: 810762 - DNA, 22 bp, Artificial Sequence
  chemically synthesized
ctgcaaaatgattaaaacttgg

SEQ ID NO: 810763 - DNA, 22 bp, Artificial Sequence
  chemically synthesized
cctgcaaaatgattaaaacttg

SEQ ID NO: 810764 - DNA, 22 bp, Artificial Sequence
  chemically synthesized
tcctgcaaaatgattaaaactt

SEQ ID NO: 810765 - DNA, 22 bp, Artificial Sequence
  chemically synthesized
gtttctgatccaagttttaatc

SEQ ID NO: 810766 - DNA, 22 bp, Artificial Sequence
  chemically synthesized
tttcctgcaaaatgattaaaac

SEQ ID NO: 810767 - DNA, 22 bp, Artificial Sequence
  chemically synthesized
ctttcctgcaaaatgattaaaa

SEQ ID NO: 810768 - DNA, 22 bp, Artificial Sequence
  chemically synthesized
ctgatccaagttttaatcattt

SEQ ID NO: 810769 - DNA, 22 bp, Artificial Sequence
  chemically synthesized
tgatccaagttttaatcatttt

SEQ ID NO: 810770 - DNA, 22 bp, Artificial Sequence
  chemically synthesized
gcttctttcctgcaaaatgatt

SEQ ID NO: 810771 - DNA, 22 bp, Artificial Sequence
  chemically synthesized
atccaagttttaatcattttgc

SEQ ID NO: 810772 - DNA, 22 bp, Artificial Sequence
  chemically synthesized
taatcattttgcaggaaagaag

SEQ ID NO: 810773 - DNA, 22 bp, Artificial Sequence
  chemically synthesized
taagagtcctggcttctttcct

SEQ ID NO: 810774 - DNA, 22 bp, Artificial Sequence
  chemically synthesized
aatcattttgcaggaaagaagc

SEQ ID NO: 810775 - DNA, 22 bp, Artificial Sequence
  chemically synthesized
atcattttgcaggaaagaagcc

SEQ ID NO: 810776 - DNA, 22 bp, Artificial Sequence
  chemically synthesized
atatgttgtaagagtcctggct

SEQ ID NO: 810777 - DNA, 22 bp, Artificial Sequence
  chemically synthesized
tgcaggaaagaagccaggactc

SEQ ID NO: 810778 - DNA, 22 bp, Artificial Sequence
  chemically synthesized
gcaggaaagaagccaggactct

SEQ ID NO: 810779 - DNA, 22 bp, Artificial Sequence
  chemically synthesized
caggaaagaagccaggactctt

SEQ ID NO: 810780 - DNA, 22 bp, Artificial Sequence
  chemically synthesized
tacataatagatgagtattcat

SEQ ID NO: 810781 - DNA, 22 bp, Artificial Sequence
  chemically synthesized
ttacaacatatgaatactcatc

SEQ ID NO: 810782 - DNA, 22 bp, Artificial Sequence
  chemically synthesized
acaacatatgaatactcatcta

SEQ ID NO: 810783 - DNA, 22 bp, Artificial Sequence
  chemically synthesized
caacatatgaatactcatctat

SEQ ID NO: 810784 - DNA, 22 bp, Artificial Sequence
  chemically synthesized
aatgatattatacataatagat

SEQ ID NO: 810785 - DNA, 22 bp, Artificial Sequence
  chemically synthesized
aaatgatattatacataataga

SEQ ID NO: 810786 - DNA, 22 bp, Artificial Sequence
  chemically synthesized
atctattatgtataatatcatt

SEQ ID NO: 810787 - DNA, 22 bp, Artificial Sequence
  chemically synthesized
gggcaaaatccacttaaatgat

SEQ ID NO: 810788 - DNA, 22 bp, Artificial Sequence
  chemically synthesized
ttatgtataatatcatttaagt

SEQ ID NO: 810789 - DNA, 22 bp, Artificial Sequence
  chemically synthesized
ggggcaaaatccacttaaatga

SEQ ID NO: 810790 - DNA, 22 bp, Artificial Sequence
  chemically synthesized
tgtataatatcatttaagtgga

SEQ ID NO: 810791 - DNA, 22 bp, Artificial Sequence
  chemically synthesized
aagtggattttgccccaaatct

SEQ ID NO: 810792 - DNA, 22 bp, Artificial Sequence
  chemically synthesized
agtggattttgccccaaatctt

SEQ ID NO: 810793 - DNA, 22 bp, Artificial Sequence
  chemically synthesized
tgcacatccacaaagatttggg

SEQ ID NO: 810794 - DNA, 22 bp, Artificial Sequence
  chemically synthesized
aattatgcacatccacaaagat

SEQ ID NO: 810795 - DNA, 22 bp, Artificial Sequence
  chemically synthesized
caattatgcacatccacaaaga

SEQ ID NO: 810796 - DNA, 22 bp, Artificial Sequence
  chemically synthesized
ttcaattatgcacatccacaaa

SEQ ID NO: 810797 - DNA, 22 bp, Artificial Sequence
  chemically synthesized
tgccccaaatctttgtggatgt

SEQ ID NO: 810798 - DNA, 22 bp, Artificial Sequence
  chemically synthesized
cttcaattatgcacatccacaa

SEQ ID NO: 810799 - DNA, 22 bp, Artificial Sequence
  chemically synthesized
gccccaaatctttgtggatgtg

SEQ ID NO: 810800 - DNA, 22 bp, Artificial Sequence
  chemically synthesized
tcttcaattatgcacatccaca

SEQ ID NO: 810801 - DNA, 22 bp, Artificial Sequence
  chemically synthesized
ccccaaatctttgtggatgtgc

SEQ ID NO: 810802 - DNA, 22 bp, Artificial Sequence
  chemically synthesized
ttcttcaattatgcacatccac

SEQ ID NO: 810803 - DNA, 22 bp, Artificial Sequence
  chemically synthesized
tttcttcaattatgcacatcca

SEQ ID NO: 810804 - DNA, 22 bp, Artificial Sequence
  chemically synthesized
tctttttcttcaattatgcaca

SEQ ID NO: 810805 - DNA, 22 bp, Artificial Sequence
  chemically synthesized
tgtggatgtgcataattgaaga

SEQ ID NO: 810806 - DNA, 22 bp, Artificial Sequence
  chemically synthesized
gtggatgtgcataattgaagaa

SEQ ID NO: 810807 - DNA, 22 bp, Artificial Sequence
  chemically synthesized
tggatgtgcataattgaagaaa

SEQ ID NO: 810808 - DNA, 22 bp, Artificial Sequence
  chemically synthesized
ccgagaagtaataacattatct

SEQ ID NO: 810809 - DNA, 22 bp, Artificial Sequence
  chemically synthesized
accgagaagtaataacattatc

SEQ ID NO: 810810 - DNA, 22 bp, Artificial Sequence
  chemically synthesized
aagaaaaagataatgttattac

SEQ ID NO: 810811 - DNA, 22 bp, Artificial Sequence
  chemically synthesized
atttaccgagaagtaataacat

SEQ ID NO: 810812 - DNA, 22 bp, Artificial Sequence
  chemically synthesized
ttacttctcggtaaattaattg

SEQ ID NO: 810813 - DNA, 22 bp, Artificial Sequence
  chemically synthesized
aaggagaaaccgtcaattaatt

SEQ ID NO: 810814 - DNA, 22 bp, Artificial Sequence
  chemically synthesized
aaaggagaaaccgtcaattaat

SEQ ID NO: 810815 - DNA, 22 bp, Artificial Sequence
  chemically synthesized
cttctcggtaaattaattgacg

SEQ ID NO: 810816 - DNA, 22 bp, Artificial Sequence
  chemically synthesized
ctcggtaaattaattgacggtt

SEQ ID NO: 810817 - DNA, 22 bp, Artificial Sequence
  chemically synthesized
tcggtaaattaattgacggttt

SEQ ID NO: 810818 - DNA, 22 bp, Artificial Sequence
  chemically synthesized
ggtaaattaattgacggtttct

SEQ ID NO: 810819 - DNA, 22 bp, Artificial Sequence
  chemically synthesized
accaatcttaaaggagaaaccg

SEQ ID NO: 810820 - DNA, 22 bp, Artificial Sequence
  chemically synthesized
ttgaccaatcttaaaggagaaa

SEQ ID NO: 810821 - DNA, 22 bp, Artificial Sequence
  chemically synthesized
attgacggtttctcctttaaga

SEQ ID NO: 810822 - DNA, 22 bp, Artificial Sequence
  chemically synthesized
agattgttgaccaatcttaaag

SEQ ID NO: 810823 - DNA, 22 bp, Artificial Sequence
  chemically synthesized
acggtttctcctttaagattgg

SEQ ID NO: 810824 - DNA, 22 bp, Artificial Sequence
  chemically synthesized
ctcctttaagattggtcaacaa

SEQ ID NO: 810825 - DNA, 22 bp, Artificial Sequence
  chemically synthesized
atagtactcagattgttgacca

SEQ ID NO: 810826 - DNA, 22 bp, Artificial Sequence
  chemically synthesized
tcctttaagattggtcaacaat

SEQ ID NO: 810827 - DNA, 22 bp, Artificial Sequence
  chemically synthesized
ctttaagattggtcaacaatct

SEQ ID NO: 810828 - DNA, 22 bp, Artificial Sequence
  chemically synthesized
ctcatagtactcagattgttga

SEQ ID NO: 810829 - DNA, 22 bp, Artificial Sequence
  chemically synthesized
taagattggtcaacaatctgag

SEQ ID NO: 810830 - DNA, 22 bp, Artificial Sequence
  chemically synthesized
aagattggtcaacaatctgagt

SEQ ID NO: 810831 - DNA, 22 bp, Artificial Sequence
  chemically synthesized
agattggtcaacaatctgagta

SEQ ID NO: 810832 - DNA, 22 bp, Artificial Sequence
  chemically synthesized
gtcaacaatctgagtactatga

SEQ ID NO: 810833 - DNA, 22 bp, Artificial Sequence
  chemically synthesized
tagaagaagtgttgctcatagt

SEQ ID NO: 810834 - DNA, 22 bp, Artificial Sequence
  chemically synthesized
agtactatgagcaacacttctt

SEQ ID NO: 810835 - DNA, 22 bp, Artificial Sequence
  chemically synthesized
tgagcaacacttcttctataga

SEQ ID NO: 810836 - DNA, 22 bp, Artificial Sequence
  chemically synthesized
aaggagaacagaatctatagaa

SEQ ID NO: 810837 - DNA, 22 bp, Artificial Sequence
  chemically synthesized
taaaggagaacagaatctatag

SEQ ID NO: 810838 - DNA, 22 bp, Artificial Sequence
  chemically synthesized
ctaaaggagaacagaatctata

SEQ ID NO: 810839 - DNA, 22 bp, Artificial Sequence
  chemically synthesized
tctaaaggagaacagaatctat

SEQ ID NO: 810840 - DNA, 22 bp, Artificial Sequence
  chemically synthesized
ttttctaaaggagaacagaatc

SEQ ID NO: 810841 - DNA, 22 bp, Artificial Sequence
  chemically synthesized
gttttctaaaggagaacagaat

SEQ ID NO: 810842 - DNA, 22 bp, Artificial Sequence
  chemically synthesized
tgttttctaaaggagaacagaa

SEQ ID NO: 810843 - DNA, 22 bp, Artificial Sequence
  chemically synthesized
cttctatagattctgttctcct

SEQ ID NO: 810844 - DNA, 22 bp, Artificial Sequence
  chemically synthesized
ttctatagattctgttctcctt

SEQ ID NO: 810845 - DNA, 22 bp, Artificial Sequence
  chemically synthesized
ctatagattctgttctccttta

SEQ ID NO: 810846 - DNA, 22 bp, Artificial Sequence
  chemically synthesized
tatagattctgttctcctttag

SEQ ID NO: 810847 - DNA, 22 bp, Artificial Sequence
  chemically synthesized
tagattctgttctcctttagaa

SEQ ID NO: 810848 - DNA, 22 bp, Artificial Sequence
  chemically synthesized
tgttctcctttagaaaacaaaa

SEQ ID NO: 810849 - DNA, 22 bp, Artificial Sequence
  chemically synthesized
ttctcctttagaaaacaaaatt

SEQ ID NO: 810850 - DNA, 22 bp, Artificial Sequence
  chemically synthesized
caacagaagacgtgaattttgt

SEQ ID NO: 810851 - DNA, 22 bp, Artificial Sequence
  chemically synthesized
tcctttagaaaacaaaattcac

SEQ ID NO: 810852 - DNA, 22 bp, Artificial Sequence
  chemically synthesized
tacaacagaagacgtgaatttt

SEQ ID NO: 810853 - DNA, 22 bp, Artificial Sequence
  chemically synthesized
ctttagaaaacaaaattcacgt

SEQ ID NO: 810854 - DNA, 22 bp, Artificial Sequence
  chemically synthesized
tagaaaacaaaattcacgtctt

SEQ ID NO: 810855 - DNA, 22 bp, Artificial Sequence
  chemically synthesized
attctacaacagaagacgtgaa

SEQ ID NO: 810856 - DNA, 22 bp, Artificial Sequence
  chemically synthesized
agaaaacaaaattcacgtcttc

SEQ ID NO: 810857 - DNA, 22 bp, Artificial Sequence
  chemically synthesized
aattctacaacagaagacgtga

SEQ ID NO: 810858 - DNA, 22 bp, Artificial Sequence
  chemically synthesized
gaaaacaaaattcacgtcttct

SEQ ID NO: 810859 - DNA, 22 bp, Artificial Sequence
  chemically synthesized
tcaaagatttaattctacaaca

SEQ ID NO: 810860 - DNA, 22 bp, Artificial Sequence
  chemically synthesized
acgtcttctgttgtagaattaa

SEQ ID NO: 810861 - DNA, 22 bp, Artificial Sequence
  chemically synthesized
agaactgtcaaagatttaattc

SEQ ID NO: 810862 - DNA, 22 bp, Artificial Sequence
  chemically synthesized
ctgttgtagaattaaatctttg

SEQ ID NO: 810863 - DNA, 22 bp, Artificial Sequence
  chemically synthesized
tgttgtagaattaaatctttga

SEQ ID NO: 810864 - DNA, 22 bp, Artificial Sequence
  chemically synthesized
ttgtagaattaaatctttgaca

SEQ ID NO: 810865 - DNA, 22 bp, Artificial Sequence
  chemically synthesized
aacattaagaactgtcaaagat

SEQ ID NO: 810866 - DNA, 22 bp, Artificial Sequence
  chemically synthesized
tcaacattaagaactgtcaaag

SEQ ID NO: 810867 - DNA, 22 bp, Artificial Sequence
  chemically synthesized
tagaattaaatctttgacagtt

SEQ ID NO: 810868 - DNA, 22 bp, Artificial Sequence
  chemically synthesized
ctcaacattaagaactgtcaaa

SEQ ID NO: 810869 - DNA, 22 bp, Artificial Sequence
  chemically synthesized
tctcaacattaagaactgtcaa

SEQ ID NO: 810870 - DNA, 22 bp, Artificial Sequence
  chemically synthesized
ttctcaacattaagaactgtca

SEQ ID NO: 810871 - DNA, 22 bp, Artificial Sequence
  chemically synthesized
tttttctcaacattaagaactg

SEQ ID NO: 810872 - DNA, 22 bp, Artificial Sequence
  chemically synthesized
atttttctcaacattaagaact

SEQ ID NO: 810873 - DNA, 22 bp, Artificial Sequence
  chemically synthesized
tatttttctcaacattaagaac

SEQ ID NO: 810874 - DNA, 22 bp, Artificial Sequence
  chemically synthesized
aatctttgacagttcttaatgt

SEQ ID NO: 810875 - DNA, 22 bp, Artificial Sequence
  chemically synthesized
ttatttttctcaacattaagaa

SEQ ID NO: 810876 - DNA, 22 bp, Artificial Sequence
  chemically synthesized
tgacagttcttaatgttgagaa

SEQ ID NO: 810877 - DNA, 22 bp, Artificial Sequence
  chemically synthesized
gacagttcttaatgttgagaaa

SEQ ID NO: 810878 - DNA, 22 bp, Artificial Sequence
  chemically synthesized
acagttcttaatgttgagaaaa

SEQ ID NO: 810879 - DNA, 22 bp, Artificial Sequence
  chemically synthesized
gtgaggatatttttatttttct

SEQ ID NO: 810880 - DNA, 22 bp, Artificial Sequence
  chemically synthesized
cgtgaggatatttttatttttc

SEQ ID NO: 810881 - DNA, 22 bp, Artificial Sequence
  chemically synthesized
tcgtgaggatatttttattttt

SEQ ID NO: 810882 - DNA, 22 bp, Artificial Sequence
  chemically synthesized
ttaatgttgagaaaaataaaaa

SEQ ID NO: 810883 - DNA, 22 bp, Artificial Sequence
  chemically synthesized
aatgttgagaaaaataaaaata

SEQ ID NO: 810884 - DNA, 22 bp, Artificial Sequence
  chemically synthesized
atgttgagaaaaataaaaatat

SEQ ID NO: 810885 - DNA, 22 bp, Artificial Sequence
  chemically synthesized
actttcgtgaggatatttttat

SEQ ID NO: 810886 - DNA, 22 bp, Artificial Sequence
  chemically synthesized
agaaaaataaaaatatcctcac

SEQ ID NO: 810887 - DNA, 22 bp, Artificial Sequence
  chemically synthesized
aagaatgttgactttcgtgagg

SEQ ID NO: 810888 - DNA, 22 bp, Artificial Sequence
  chemically synthesized
aataatattaaagaatgttgac

SEQ ID NO: 810889 - DNA, 22 bp, Artificial Sequence
  chemically synthesized
tcaataatattaaagaatgttg

SEQ ID NO: 810890 - DNA, 22 bp, Artificial Sequence
  chemically synthesized
ctcaataatattaaagaatgtt

SEQ ID NO: 810891 - DNA, 22 bp, Artificial Sequence
  chemically synthesized
tctcaataatattaaagaatgt

SEQ ID NO: 810892 - DNA, 22 bp, Artificial Sequence
  chemically synthesized
ttctcaataatattaaagaatg

SEQ ID NO: 810893 - DNA, 22 bp, Artificial Sequence
  chemically synthesized
acgaaagtcaacattctttaat

SEQ ID NO: 810894 - DNA, 22 bp, Artificial Sequence
  chemically synthesized
ttttctcaataatattaaagaa

SEQ ID NO: 810895 - DNA, 22 bp, Artificial Sequence
  chemically synthesized
tttaatattattgagaaaagag

SEQ ID NO: 810896 - DNA, 22 bp, Artificial Sequence
  chemically synthesized
taatattattgagaaaagagta

SEQ ID NO: 810897 - DNA, 22 bp, Artificial Sequence
  chemically synthesized
aatattattgagaaaagagtat

SEQ ID NO: 810898 - DNA, 22 bp, Artificial Sequence
  chemically synthesized
atattattgagaaaagagtata

SEQ ID NO: 810899 - DNA, 22 bp, Artificial Sequence
  chemically synthesized
ataaaatgtgaatgtatactct

SEQ ID NO: 810900 - DNA, 22 bp, Artificial Sequence
  chemically synthesized
aataaaatgtgaatgtatactc

SEQ ID NO: 810901 - DNA, 22 bp, Artificial Sequence
  chemically synthesized
taataaaatgtgaatgtatact

SEQ ID NO: 810902 - DNA, 22 bp, Artificial Sequence
  chemically synthesized
ttgagaaaagagtatacattca

SEQ ID NO: 810903 - DNA, 22 bp, Artificial Sequence
  chemically synthesized
agaaaagagtatacattcacat

SEQ ID NO: 810904 - DNA, 22 bp, Artificial Sequence
  chemically synthesized
tagcagtggaccgtagttttaa

SEQ ID NO: 810905 - DNA, 22 bp, Artificial Sequence
  chemically synthesized
atagcagtggaccgtagtttta

SEQ ID NO: 810906 - DNA, 22 bp, Artificial Sequence
  chemically synthesized
acattttattaaaactacggtc

SEQ ID NO: 810907 - DNA, 22 bp, Artificial Sequence
  chemically synthesized
tattaaaactacggtccactgc

SEQ ID NO: 810908 - DNA, 22 bp, Artificial Sequence
  chemically synthesized
atgacacttatagcagtggacc

SEQ ID NO: 810909 - DNA, 22 bp, Artificial Sequence
  chemically synthesized
attaaaactacggtccactgct

SEQ ID NO: 810910 - DNA, 22 bp, Artificial Sequence
  chemically synthesized
catgacacttatagcagtggac

SEQ ID NO: 810911 - DNA, 22 bp, Artificial Sequence
  chemically synthesized
ttaaaactacggtccactgcta

SEQ ID NO: 810912 - DNA, 22 bp, Artificial Sequence
  chemically synthesized
aaactacggtccactgctataa

SEQ ID NO: 810913 - DNA, 22 bp, Artificial Sequence
  chemically synthesized
acttcatgacacttatagcagt

SEQ ID NO: 810914 - DNA, 22 bp, Artificial Sequence
  chemically synthesized
cggtccactgctataagtgtca

SEQ ID NO: 810915 - DNA, 22 bp, Artificial Sequence
  chemically synthesized
ggtatatgttaacttcatgaca

SEQ ID NO: 810916 - DNA, 22 bp, Artificial Sequence
  chemically synthesized
ctaggtatatgttaacttcatg

SEQ ID NO: 810917 - DNA, 22 bp, Artificial Sequence
  chemically synthesized
actaggtatatgttaacttcat

SEQ ID NO: 810918 - DNA, 22 bp, Artificial Sequence
  chemically synthesized
ctataagtgtcatgaagttaac

SEQ ID NO: 810919 - DNA, 22 bp, Artificial Sequence
  chemically synthesized
tactaggtatatgttaacttca

SEQ ID NO: 810920 - DNA, 22 bp, Artificial Sequence
  chemically synthesized
taagtgtcatgaagttaacata

SEQ ID NO: 810921 - DNA, 22 bp, Artificial Sequence
  chemically synthesized
caaactttactaggtatatgtt

SEQ ID NO: 810922 - DNA, 22 bp, Artificial Sequence
  chemically synthesized
acaaactttactaggtatatgt

SEQ ID NO: 810923 - DNA, 22 bp, Artificial Sequence
  chemically synthesized
tacaaactttactaggtatatg

SEQ ID NO: 810924 - DNA, 22 bp, Artificial Sequence
  chemically synthesized
ttacaaactttactaggtatat

SEQ ID NO: 810925 - DNA, 22 bp, Artificial Sequence
  chemically synthesized
tttacaaactttactaggtata

SEQ ID NO: 810926 - DNA, 22 bp, Artificial Sequence
  chemically synthesized
ttttttacaaactttactaggt

SEQ ID NO: 810927 - DNA, 22 bp, Artificial Sequence
  chemically synthesized
attattttttacaaactttact

SEQ ID NO: 810928 - DNA, 22 bp, Artificial Sequence
  chemically synthesized
acatatacctagtaaagtttgt

SEQ ID NO: 810929 - DNA, 22 bp, Artificial Sequence
  chemically synthesized
tgattattttttacaaacttta

SEQ ID NO: 810930 - DNA, 22 bp, Artificial Sequence
  chemically synthesized
ctgattattttttacaaacttt

SEQ ID NO: 810931 - DNA, 22 bp, Artificial Sequence
  chemically synthesized
tttctgattattttttacaaac

SEQ ID NO: 810932 - DNA, 22 bp, Artificial Sequence
  chemically synthesized
atttctgattattttttacaaa

SEQ ID NO: 810933 - DNA, 22 bp, Artificial Sequence
  chemically synthesized
gtaaagtttgtaaaaaataatc

SEQ ID NO: 810934 - DNA, 22 bp, Artificial Sequence
  chemically synthesized
aagcttatttctgattattttt

SEQ ID NO: 810935 - DNA, 22 bp, Artificial Sequence
  chemically synthesized
actaaagcttatttctgattat

SEQ ID NO: 810936 - DNA, 22 bp, Artificial Sequence
  chemically synthesized
cactaaagcttatttctgatta

SEQ ID NO: 810937 - DNA, 22 bp, Artificial Sequence
  chemically synthesized
tcactaaagcttatttctgatt

SEQ ID NO: 810938 - DNA, 22 bp, Artificial Sequence
  chemically synthesized
ttcactaaagcttatttctgat

SEQ ID NO: 810939 - DNA, 22 bp, Artificial Sequence
  chemically synthesized
tttcactaaagcttatttctga

SEQ ID NO: 810940 - DNA, 22 bp, Artificial Sequence
  chemically synthesized
gtaaaaaataatcagaaataag

SEQ ID NO: 810941 - DNA, 22 bp, Artificial Sequence
  chemically synthesized
taaaaaataatcagaaataagc

SEQ ID NO: 810942 - DNA, 22 bp, Artificial Sequence
  chemically synthesized
aacatgtggattttttcactaa

SEQ ID NO: 810943 - DNA, 22 bp, Artificial Sequence
  chemically synthesized
tagtgaaaaaatccacatgttg

SEQ ID NO: 810944 - DNA, 22 bp, Artificial Sequence
  chemically synthesized
agtgaaaaaatccacatgttga

SEQ ID NO: 810945 - DNA, 22 bp, Artificial Sequence
  chemically synthesized
gtgaaaaaatccacatgttgaa

SEQ ID NO: 810946 - DNA, 22 bp, Artificial Sequence
  chemically synthesized
aggtaatgtgagaaacagcaaa

SEQ ID NO: 810947 - DNA, 22 bp, Artificial Sequence
  chemically synthesized
aaggtaatgtgagaaacagcaa

SEQ ID NO: 810948 - DNA, 22 bp, Artificial Sequence
  chemically synthesized
taaggtaatgtgagaaacagca

SEQ ID NO: 810949 - DNA, 22 bp, Artificial Sequence
  chemically synthesized
aattttgctgtttctcacatta

SEQ ID NO: 810950 - DNA, 22 bp, Artificial Sequence
  chemically synthesized
gaaaaacactttaaggtaatgt

SEQ ID NO: 810951 - DNA, 22 bp, Artificial Sequence
  chemically synthesized
tgctgtttctcacattacctta

SEQ ID NO: 810952 - DNA, 22 bp, Artificial Sequence
  chemically synthesized
ggaaaaacactttaaggtaatg

SEQ ID NO: 810953 - DNA, 22 bp, Artificial Sequence
  chemically synthesized
gctgtttctcacattaccttaa

SEQ ID NO: 810954 - DNA, 22 bp, Artificial Sequence
  chemically synthesized
ctgtttctcacattaccttaaa

SEQ ID NO: 810955 - DNA, 22 bp, Artificial Sequence
  chemically synthesized
tttctcacattaccttaaagtg

SEQ ID NO: 810956 - DNA, 22 bp, Artificial Sequence
  chemically synthesized
gaatttggaaaaacactttaag

SEQ ID NO: 810957 - DNA, 22 bp, Artificial Sequence
  chemically synthesized
ctcacattaccttaaagtgttt

SEQ ID NO: 810958 - DNA, 22 bp, Artificial Sequence
  chemically synthesized
tcacattaccttaaagtgtttt

SEQ ID NO: 810959 - DNA, 22 bp, Artificial Sequence
  chemically synthesized
acattaccttaaagtgtttttc

SEQ ID NO: 810960 - DNA, 22 bp, Artificial Sequence
  chemically synthesized
agctagaatttggaaaaacact

SEQ ID NO: 810961 - DNA, 22 bp, Artificial Sequence
  chemically synthesized
gctaagctagaatttggaaaaa

SEQ ID NO: 810962 - DNA, 22 bp, Artificial Sequence
  chemically synthesized
ggctaagctagaatttggaaaa

SEQ ID NO: 810963 - DNA, 22 bp, Artificial Sequence
  chemically synthesized
ccttaaagtgtttttccaaatt

SEQ ID NO: 810964 - DNA, 22 bp, Artificial Sequence
  chemically synthesized
aaagtgtttttccaaattctag

SEQ ID NO: 810965 - DNA, 22 bp, Artificial Sequence
  chemically synthesized
aagtgtttttccaaattctagc

SEQ ID NO: 810966 - DNA, 22 bp, Artificial Sequence
  chemically synthesized
tgatttggctaagctagaattt

SEQ ID NO: 810967 - DNA, 22 bp, Artificial Sequence
  chemically synthesized
atgatttggctaagctagaatt

SEQ ID NO: 810968 - DNA, 22 bp, Artificial Sequence
  chemically synthesized
cttatgatttggctaagctaga

SEQ ID NO: 810969 - DNA, 22 bp, Artificial Sequence
  chemically synthesized
ccttatgatttggctaagctag

SEQ ID NO: 810970 - DNA, 22 bp, Artificial Sequence
  chemically synthesized
ttccaaattctagcttagccaa

SEQ ID NO: 810971 - DNA, 22 bp, Artificial Sequence
  chemically synthesized
tccaaattctagcttagccaaa

SEQ ID NO: 810972 - DNA, 22 bp, Artificial Sequence
  chemically synthesized
ccaaattctagcttagccaaat

SEQ ID NO: 810973 - DNA, 22 bp, Artificial Sequence
  chemically synthesized
agtttccttatgatttggctaa

SEQ ID NO: 810974 - DNA, 22 bp, Artificial Sequence
  chemically synthesized
caaattctagcttagccaaatc

SEQ ID NO: 810975 - DNA, 22 bp, Artificial Sequence
  chemically synthesized
cagtttccttatgatttggcta

SEQ ID NO: 810976 - DNA, 22 bp, Artificial Sequence
  chemically synthesized
tttcagtttccttatgatttgg

SEQ ID NO: 810977 - DNA, 22 bp, Artificial Sequence
  chemically synthesized
tatttcagtttccttatgattt

SEQ ID NO: 810978 - DNA, 22 bp, Artificial Sequence
  chemically synthesized
ctatttcagtttccttatgatt

SEQ ID NO: 810979 - DNA, 22 bp, Artificial Sequence
  chemically synthesized
tagcttagccaaatcataagga

SEQ ID NO: 810980 - DNA, 22 bp, Artificial Sequence
  chemically synthesized
gcttagccaaatcataaggaaa

SEQ ID NO: 810981 - DNA, 22 bp, Artificial Sequence
  chemically synthesized
agccaaatcataaggaaactga

SEQ ID NO: 810982 - DNA, 22 bp, Artificial Sequence
  chemically synthesized
gccaaatcataaggaaactgaa

SEQ ID NO: 810983 - DNA, 22 bp, Artificial Sequence
  chemically synthesized
aaaggatttctatttcagtttc

SEQ ID NO: 810984 - DNA, 22 bp, Artificial Sequence
  chemically synthesized
aaatagaaatcctttgagtgac

SEQ ID NO: 810985 - DNA, 22 bp, Artificial Sequence
  chemically synthesized
aagtatgtagtagtcactcaaa

SEQ ID NO: 810986 - DNA, 22 bp, Artificial Sequence
  chemically synthesized
aaagtatgtagtagtcactcaa

SEQ ID NO: 810987 - DNA, 22 bp, Artificial Sequence
  chemically synthesized
tgagtgactactacatacttta

SEQ ID NO: 810988 - DNA, 22 bp, Artificial Sequence
  chemically synthesized
gagtgactactacatactttaa

SEQ ID NO: 810989 - DNA, 22 bp, Artificial Sequence
  chemically synthesized
agtgactactacatactttaaa

SEQ ID NO: 810990 - DNA, 22 bp, Artificial Sequence
  chemically synthesized
caacatgatatccataatttaa

SEQ ID NO: 810991 - DNA, 22 bp, Artificial Sequence
  chemically synthesized
acaacatgatatccataattta

SEQ ID NO: 810992 - DNA, 22 bp, Artificial Sequence
  chemically synthesized
tacaacatgatatccataattt

SEQ ID NO: 810993 - DNA, 22 bp, Artificial Sequence
  chemically synthesized
ctacatactttaaattatggat

SEQ ID NO: 810994 - DNA, 22 bp, Artificial Sequence
  chemically synthesized
catactttaaattatggatatc

SEQ ID NO: 810995 - DNA, 22 bp, Artificial Sequence
  chemically synthesized
taaattatggatatcatgttgt

SEQ ID NO: 810996 - DNA, 22 bp, Artificial Sequence
  chemically synthesized
aaattatggatatcatgttgta

SEQ ID NO: 810997 - DNA, 22 bp, Artificial Sequence
  chemically synthesized
aattatggatatcatgttgtaa

SEQ ID NO: 810998 - DNA, 22 bp, Artificial Sequence
  chemically synthesized
tggatatcatgttgtaaaacat

SEQ ID NO: 810999 - DNA, 22 bp, Artificial Sequence
  chemically synthesized
taaaacatctggctcattcttg

SEQ ID NO: 811000 - DNA, 22 bp, Artificial Sequence
  chemically synthesized
gaaaatcatgacagcacaagaa

SEQ ID NO: 811001 - DNA, 22 bp, Artificial Sequence
  chemically synthesized
ggaaaatcatgacagcacaaga

SEQ ID NO: 811002 - DNA, 22 bp, Artificial Sequence
  chemically synthesized
tggaaaatcatgacagcacaag

SEQ ID NO: 811003 - DNA, 22 bp, Artificial Sequence
  chemically synthesized
ttttggaaaatcatgacagcac

SEQ ID NO: 811004 - DNA, 22 bp, Artificial Sequence
  chemically synthesized
attttggaaaatcatgacagca

SEQ ID NO: 811005 - DNA, 22 bp, Artificial Sequence
  chemically synthesized
gctcattcttgtgctgtcatga

SEQ ID NO: 811006 - DNA, 22 bp, Artificial Sequence
  chemically synthesized
tattttggaaaatcatgacagc

SEQ ID NO: 811007 - DNA, 22 bp, Artificial Sequence
  chemically synthesized
attcttgtgctgtcatgatttt

SEQ ID NO: 811008 - DNA, 22 bp, Artificial Sequence
  chemically synthesized
ttgtgctgtcatgattttccaa

SEQ ID NO: 811009 - DNA, 22 bp, Artificial Sequence
  chemically synthesized
gtgctgtcatgattttccaaaa

SEQ ID NO: 811010 - DNA, 22 bp, Artificial Sequence
  chemically synthesized
tgctgtcatgattttccaaaat

SEQ ID NO: 811011 - DNA, 22 bp, Artificial Sequence
  chemically synthesized
aacagcaaatgttttattttgg

SEQ ID NO: 811012 - DNA, 22 bp, Artificial Sequence
  chemically synthesized
tcatgattttccaaaataaaac

SEQ ID NO: 811013 - DNA, 22 bp, Artificial Sequence
  chemically synthesized
tccaaaataaaacatttgctgt

SEQ ID NO: 811014 - DNA, 22 bp, Artificial Sequence
  chemically synthesized
ccaaaataaaacatttgctgtt

SEQ ID NO: 811015 - DNA, 22 bp, Artificial Sequence
  chemically synthesized
caaaataaaacatttgctgttt

SEQ ID NO: 811016 - DNA, 22 bp, Artificial Sequence
  chemically synthesized
aatgacaacatctaaacagcaa

SEQ ID NO: 811017 - DNA, 22 bp, Artificial Sequence
  chemically synthesized
aaatgacaacatctaaacagca

SEQ ID NO: 811018 - DNA, 22 bp, Artificial Sequence
  chemically synthesized
taaatgacaacatctaaacagc

SEQ ID NO: 811019 - DNA, 22 bp, Artificial Sequence
  chemically synthesized
ttaaatgacaacatctaaacag

SEQ ID NO: 811020 - DNA, 22 bp, Artificial Sequence
  chemically synthesized
tttaaatgacaacatctaaaca

SEQ ID NO: 811021 - DNA, 22 bp, Artificial Sequence
  chemically synthesized
agggtctttttaaatgacaaca

SEQ ID NO: 811022 - DNA, 22 bp, Artificial Sequence
  chemically synthesized
gctgtttagatgttgtcattta

SEQ ID NO: 811023 - DNA, 22 bp, Artificial Sequence
  chemically synthesized
ctgtttagatgttgtcatttaa

SEQ ID NO: 811024 - DNA, 22 bp, Artificial Sequence
  chemically synthesized
tttagatgttgtcatttaaaaa

SEQ ID NO: 811025 - DNA, 22 bp, Artificial Sequence
  chemically synthesized
atcattaagggtctttttaaat

SEQ ID NO: 811026 - DNA, 22 bp, Artificial Sequence
  chemically synthesized
agatgttgtcatttaaaaagac

SEQ ID NO: 811027 - DNA, 22 bp, Artificial Sequence
  chemically synthesized
gatgttgtcatttaaaaagacc

SEQ ID NO: 811028 - DNA, 22 bp, Artificial Sequence
  chemically synthesized
actaatcattaagggtcttttt

SEQ ID NO: 811029 - DNA, 22 bp, Artificial Sequence
  chemically synthesized
tcatttaaaaagacccttaatg

SEQ ID NO: 811030 - DNA, 22 bp, Artificial Sequence
  chemically synthesized
aaaaagacccttaatgattagt

SEQ ID NO: 811031 - DNA, 22 bp, Artificial Sequence
  chemically synthesized
aaaagacccttaatgattagtc

SEQ ID NO: 811032 - DNA, 22 bp, Artificial Sequence
  chemically synthesized
aagcaaatcagttgactaatca

SEQ ID NO: 811033 - DNA, 22 bp, Artificial Sequence
  chemically synthesized
aatgattagtcaactgatttgc

SEQ ID NO: 811034 - DNA, 22 bp, Artificial Sequence
  chemically synthesized
aaatcaactaaagcaaatcagt

SEQ ID NO: 811035 - DNA, 22 bp, Artificial Sequence
  chemically synthesized
atgattagtcaactgatttgct

SEQ ID NO: 811036 - DNA, 22 bp, Artificial Sequence
  chemically synthesized
gaaatcaactaaagcaaatcag

SEQ ID NO: 811037 - DNA, 22 bp, Artificial Sequence
  chemically synthesized
tgaaatcaactaaagcaaatca

SEQ ID NO: 811038 - DNA, 22 bp, Artificial Sequence
  chemically synthesized
gtcaactgatttgctttagttg

SEQ ID NO: 811039 - DNA, 22 bp, Artificial Sequence
  chemically synthesized
gcatatactttgaaatcaacta

SEQ ID NO: 811040 - DNA, 22 bp, Artificial Sequence
  chemically synthesized
atttgctttagttgatttcaaa

SEQ ID NO: 811041 - DNA, 22 bp, Artificial Sequence
  chemically synthesized
tcaattagcatatactttgaaa

SEQ ID NO: 811042 - DNA, 22 bp, Artificial Sequence
  chemically synthesized
gctttagttgatttcaaagtat

SEQ ID NO: 811043 - DNA, 22 bp, Artificial Sequence
  chemically synthesized
ctttagttgatttcaaagtata

SEQ ID NO: 811044 - DNA, 22 bp, Artificial Sequence
  chemically synthesized
tagttgatttcaaagtatatgc

SEQ ID NO: 811045 - DNA, 22 bp, Artificial Sequence
  chemically synthesized
agttgatttcaaagtatatgct

SEQ ID NO: 811046 - DNA, 22 bp, Artificial Sequence
  chemically synthesized
gttgatttcaaagtatatgcta

SEQ ID NO: 811047 - DNA, 22 bp, Artificial Sequence
  chemically synthesized
atttcaaagtatatgctaattg

SEQ ID NO: 811048 - DNA, 22 bp, Artificial Sequence
  chemically synthesized
caaagtatatgctaattgacaa

SEQ ID NO: 811049 - DNA, 22 bp, Artificial Sequence
  chemically synthesized
aaagtatatgctaattgacaac

SEQ ID NO: 811050 - DNA, 22 bp, Artificial Sequence
  chemically synthesized
tgtcatcatcaatgttgtcaat

SEQ ID NO: 811051 - DNA, 22 bp, Artificial Sequence
  chemically synthesized
agtattgtgtcatcatcaatgt

SEQ ID NO: 811052 - DNA, 22 bp, Artificial Sequence
  chemically synthesized
aagtattgtgtcatcatcaatg

SEQ ID NO: 811053 - DNA, 22 bp, Artificial Sequence
  chemically synthesized
taagtattgtgtcatcatcaat

SEQ ID NO: 811054 - DNA, 22 bp, Artificial Sequence
  chemically synthesized
ttaagtattgtgtcatcatcaa

SEQ ID NO: 811055 - DNA, 22 bp, Artificial Sequence
  chemically synthesized
attgacaacattgatgatgaca

SEQ ID NO: 811056 - DNA, 22 bp, Artificial Sequence
  chemically synthesized
acaacattgatgatgacacaat

SEQ ID NO: 811057 - DNA, 22 bp, Artificial Sequence
  chemically synthesized
tatgggatttttaagtattgtg

SEQ ID NO: 811058 - DNA, 22 bp, Artificial Sequence
  chemically synthesized
gtatgggatttttaagtattgt

SEQ ID NO: 811059 - DNA, 22 bp, Artificial Sequence
  chemically synthesized
atgatgacacaatacttaaaaa

SEQ ID NO: 811060 - DNA, 22 bp, Artificial Sequence
  chemically synthesized
agtggacaacttgtatgggatt

SEQ ID NO: 811061 - DNA, 22 bp, Artificial Sequence
  chemically synthesized
ttcagtggacaacttgtatggg

SEQ ID NO: 811062 - DNA, 22 bp, Artificial Sequence
  chemically synthesized
aaaaatcccatacaagttgtcc

SEQ ID NO: 811063 - DNA, 22 bp, Artificial Sequence
  chemically synthesized
aaaatcccatacaagttgtcca

SEQ ID NO: 811064 - DNA, 22 bp, Artificial Sequence
  chemically synthesized
tccactgaacaatttggtcatt

SEQ ID NO: 811065 - DNA, 22 bp, Artificial Sequence
  chemically synthesized
aacaatttggtcatttccttat

SEQ ID NO: 811066 - DNA, 22 bp, Artificial Sequence
  chemically synthesized
ataaggaaatgaataaggaaat

SEQ ID NO: 811067 - DNA, 22 bp, Artificial Sequence
  chemically synthesized
ggtcatttccttattcatttcc

SEQ ID NO: 811068 - DNA, 22 bp, Artificial Sequence
  chemically synthesized
gtcatttccttattcatttcct

SEQ ID NO: 811069 - DNA, 22 bp, Artificial Sequence
  chemically synthesized
tgagcattaataaggaaatgaa

SEQ ID NO: 811070 - DNA, 22 bp, Artificial Sequence
  chemically synthesized
tgtgagcattaataaggaaatg

SEQ ID NO: 811071 - DNA, 22 bp, Artificial Sequence
  chemically synthesized
ctgtgagcattaataaggaaat

SEQ ID NO: 811072 - DNA, 22 bp, Artificial Sequence
  chemically synthesized
ccttattcatttccttattaat

SEQ ID NO: 811073 - DNA, 22 bp, Artificial Sequence
  chemically synthesized
cttattcatttccttattaatg

SEQ ID NO: 811074 - DNA, 22 bp, Artificial Sequence
  chemically synthesized
tgcttctgtgagcattaataag

SEQ ID NO: 811075 - DNA, 22 bp, Artificial Sequence
  chemically synthesized
attcatttccttattaatgctc

SEQ ID NO: 811076 - DNA, 22 bp, Artificial Sequence
  chemically synthesized
ttcatttccttattaatgctca

SEQ ID NO: 811077 - DNA, 22 bp, Artificial Sequence
  chemically synthesized
atttccttattaatgctcacag

SEQ ID NO: 811078 - DNA, 22 bp, Artificial Sequence
  chemically synthesized
ccttattaatgctcacagaagc

SEQ ID NO: 811079 - DNA, 22 bp, Artificial Sequence
  chemically synthesized
cttattaatgctcacagaagca

SEQ ID NO: 811080 - DNA, 22 bp, Artificial Sequence
  chemically synthesized
attaatgctcacagaagcatag

SEQ ID NO: 811081 - DNA, 22 bp, Artificial Sequence
  chemically synthesized
ttaatgctcacagaagcatagt

SEQ ID NO: 811082 - DNA, 22 bp, Artificial Sequence
  chemically synthesized
aaaaaaaaatgataactatgct

SEQ ID NO: 811083 - DNA, 22 bp, Artificial Sequence
  chemically synthesized
atgctcacagaagcatagttat

SEQ ID NO: 811084 - DNA, 22 bp, Artificial Sequence
  chemically synthesized
actaaaaaaaaaatgataacta

SEQ ID NO: 811085 - DNA, 22 bp, Artificial Sequence
  chemically synthesized
acagaagcatagttatcatttt

SEQ ID NO: 811086 - DNA, 22 bp, Artificial Sequence
  chemically synthesized
tgactcactaaaaaaaaaatga

SEQ ID NO: 811087 - DNA, 22 bp, Artificial Sequence
  chemically synthesized
tgtgactcactaaaaaaaaaat

SEQ ID NO: 811088 - DNA, 22 bp, Artificial Sequence
  chemically synthesized
ccattctgtgactcactaaaaa

SEQ ID NO: 811089 - DNA, 22 bp, Artificial Sequence
  chemically synthesized
tcattttttttttagtgagtca

SEQ ID NO: 811090 - DNA, 22 bp, Artificial Sequence
  chemically synthesized
attcccattctgtgactcacta

SEQ ID NO: 811091 - DNA, 22 bp, Artificial Sequence
  chemically synthesized
tttttttagtgagtcacagaat

SEQ ID NO: 811092 - DNA, 22 bp, Artificial Sequence
  chemically synthesized
ttttttagtgagtcacagaatg

SEQ ID NO: 811093 - DNA, 22 bp, Artificial Sequence
  chemically synthesized
tttttagtgagtcacagaatgg

SEQ ID NO: 811094 - DNA, 22 bp, Artificial Sequence
  chemically synthesized
ttttagtgagtcacagaatggg

SEQ ID NO: 811095 - DNA, 22 bp, Artificial Sequence
  chemically synthesized
tttagtgagtcacagaatggga

SEQ ID NO: 811096 - DNA, 22 bp, Artificial Sequence
  chemically synthesized
aaataaattaattcccattctg

SEQ ID NO: 811097 - DNA, 22 bp, Artificial Sequence
  chemically synthesized
ttagtgagtcacagaatgggaa

SEQ ID NO: 811098 - DNA, 22 bp, Artificial Sequence
  chemically synthesized
tagtgagtcacagaatgggaat

SEQ ID NO: 811099 - DNA, 22 bp, Artificial Sequence
  chemically synthesized
agtgagtcacagaatgggaatt

SEQ ID NO: 811100 - DNA, 22 bp, Artificial Sequence
  chemically synthesized
gtgagtcacagaatgggaatta

SEQ ID NO: 811101 - DNA, 22 bp, Artificial Sequence
  chemically synthesized
gattaaaataaattaattccca

SEQ ID NO: 811102 - DNA, 22 bp, Artificial Sequence
  chemically synthesized
atttattttaatccaatgttcc

SEQ ID NO: 811103 - DNA, 22 bp, Artificial Sequence
  chemically synthesized
attttaatccaatgttccgttt

SEQ ID NO: 811104 - DNA, 22 bp, Artificial Sequence
  chemically synthesized
ttttaatccaatgttccgtttt

SEQ ID NO: 811105 - DNA, 22 bp, Artificial Sequence
  chemically synthesized
taatccaatgttccgttttcct

SEQ ID NO: 811106 - DNA, 22 bp, Artificial Sequence
  chemically synthesized
aatccaatgttccgttttcctt

SEQ ID NO: 811107 - DNA, 22 bp, Artificial Sequence
  chemically synthesized
atagagcaaaataaggaaaacg

SEQ ID NO: 811108 - DNA, 22 bp, Artificial Sequence
  chemically synthesized
atccaatgttccgttttcctta

SEQ ID NO: 811109 - DNA, 22 bp, Artificial Sequence
  chemically synthesized
acaaaactgatagagcaaaata

SEQ ID NO: 811110 - DNA, 22 bp, Artificial Sequence
  chemically synthesized
cgttttccttattttgctctat

SEQ ID NO: 811111 - DNA, 22 bp, Artificial Sequence
  chemically synthesized
ggctcacaaaactgatagagca

SEQ ID NO: 811112 - DNA, 22 bp, Artificial Sequence
  chemically synthesized
gggctcacaaaactgatagagc

SEQ ID NO: 811113 - DNA, 22 bp, Artificial Sequence
  chemically synthesized
tgggctcacaaaactgatagag

SEQ ID NO: 811114 - DNA, 22 bp, Artificial Sequence
  chemically synthesized
tccttattttgctctatcagtt

SEQ ID NO: 811115 - DNA, 22 bp, Artificial Sequence
  chemically synthesized
ccttattttgctctatcagttt

SEQ ID NO: 811116 - DNA, 22 bp, Artificial Sequence
  chemically synthesized
tttgggctcacaaaactgatag

SEQ ID NO: 811117 - DNA, 22 bp, Artificial Sequence
  chemically synthesized
cttattttgctctatcagtttt

SEQ ID NO: 811118 - DNA, 22 bp, Artificial Sequence
  chemically synthesized
ctttgggctcacaaaactgata

SEQ ID NO: 811119 - DNA, 22 bp, Artificial Sequence
  chemically synthesized
attttgctctatcagttttgtg

SEQ ID NO: 811120 - DNA, 22 bp, Artificial Sequence
  chemically synthesized
tttctttgggctcacaaaactg

SEQ ID NO: 811121 - DNA, 22 bp, Artificial Sequence
  chemically synthesized
ttttgctctatcagttttgtga

SEQ ID NO: 811122 - DNA, 22 bp, Artificial Sequence
  chemically synthesized
atttctttgggctcacaaaact

SEQ ID NO: 811123 - DNA, 22 bp, Artificial Sequence
  chemically synthesized
tatttctttgggctcacaaaac

SEQ ID NO: 811124 - DNA, 22 bp, Artificial Sequence
  chemically synthesized
tgctctatcagttttgtgagcc

SEQ ID NO: 811125 - DNA, 22 bp, Artificial Sequence
  chemically synthesized
gctctatcagttttgtgagccc

SEQ ID NO: 811126 - DNA, 22 bp, Artificial Sequence
  chemically synthesized
ctctatcagttttgtgagccca

SEQ ID NO: 811127 - DNA, 22 bp, Artificial Sequence
  chemically synthesized
tatcagttttgtgagcccaaag

SEQ ID NO: 811128 - DNA, 22 bp, Artificial Sequence
  chemically synthesized
tcagttttgtgagcccaaagaa

SEQ ID NO: 811129 - DNA, 22 bp, Artificial Sequence
  chemically synthesized
tggtcaactttatttctttggg

SEQ ID NO: 811130 - DNA, 22 bp, Artificial Sequence
  chemically synthesized
ctgtggtcaactttatttcttt

SEQ ID NO: 811131 - DNA, 22 bp, Artificial Sequence
  chemically synthesized
gctgtggtcaactttatttctt

SEQ ID NO: 811132 - DNA, 22 bp, Artificial Sequence
  chemically synthesized
tgctgtggtcaactttatttct

SEQ ID NO: 811133 - DNA, 22 bp, Artificial Sequence
  chemically synthesized
tgtgagcccaaagaaataaagt

SEQ ID NO: 811134 - DNA, 22 bp, Artificial Sequence
  chemically synthesized
ttgctgtggtcaactttatttc

SEQ ID NO: 811135 - DNA, 22 bp, Artificial Sequence
  chemically synthesized
gtgagcccaaagaaataaagtt

SEQ ID NO: 811136 - DNA, 22 bp, Artificial Sequence
  chemically synthesized
tgagcccaaagaaataaagttg

SEQ ID NO: 811137 - DNA, 22 bp, Artificial Sequence
  chemically synthesized
cttttgctgtggtcaactttat

SEQ ID NO: 811138 - DNA, 22 bp, Artificial Sequence
  chemically synthesized
cccagcactgcttttgctgtgg

SEQ ID NO: 811139 - DNA, 22 bp, Artificial Sequence
  chemically synthesized
ccccagcactgcttttgctgtg

SEQ ID NO: 811140 - DNA, 22 bp, Artificial Sequence
  chemically synthesized
ttccccagcactgcttttgctg

SEQ ID NO: 811141 - DNA, 22 bp, Artificial Sequence
  chemically synthesized
gcctcttccccagcactgcttt

SEQ ID NO: 811142 - DNA, 22 bp, Artificial Sequence
  chemically synthesized
accacagcaaaagcagtgctgg

SEQ ID NO: 811143 - DNA, 22 bp, Artificial Sequence
  chemically synthesized
taaactggcctcttccccagca

SEQ ID NO: 811144 - DNA, 22 bp, Artificial Sequence
  chemically synthesized
tcctataaactggcctcttccc

SEQ ID NO: 811145 - DNA, 22 bp, Artificial Sequence
  chemically synthesized
cagttatcctataaactggcct

SEQ ID NO: 811146 - DNA, 22 bp, Artificial Sequence
  chemically synthesized
gggaagaggccagtttatagga

SEQ ID NO: 811147 - DNA, 22 bp, Artificial Sequence
  chemically synthesized
caagtaaaaggtattgcagtta

SEQ ID NO: 811148 - DNA, 22 bp, Artificial Sequence
  chemically synthesized
ccaagtaaaaggtattgcagtt

SEQ ID NO: 811149 - DNA, 22 bp, Artificial Sequence
  chemically synthesized
ataggataactgcaataccttt

SEQ ID NO: 811150 - DNA, 22 bp, Artificial Sequence
  chemically synthesized
taggataactgcaatacctttt

SEQ ID NO: 811151 - DNA, 22 bp, Artificial Sequence
  chemically synthesized
aaacatatttccaagtaaaagg

SEQ ID NO: 811152 - DNA, 22 bp, Artificial Sequence
  chemically synthesized
caaacatatttccaagtaaaag

SEQ ID NO: 811153 - DNA, 22 bp, Artificial Sequence
  chemically synthesized
caataccttttacttggaaata

SEQ ID NO: 811154 - DNA, 22 bp, Artificial Sequence
  chemically synthesized
aggtgatcttcaaacatatttc

SEQ ID NO: 811155 - DNA, 22 bp, Artificial Sequence
  chemically synthesized
caggtgatcttcaaacatattt

SEQ ID NO: 811156 - DNA, 22 bp, Artificial Sequence
  chemically synthesized
tcaggtgatcttcaaacatatt

SEQ ID NO: 811157 - DNA, 22 bp, Artificial Sequence
  chemically synthesized
ttacttggaaatatgtttgaag

SEQ ID NO: 811158 - DNA, 22 bp, Artificial Sequence
  chemically synthesized
tacttggaaatatgtttgaaga

SEQ ID NO: 811159 - DNA, 22 bp, Artificial Sequence
  chemically synthesized
acttggaaatatgtttgaagat

SEQ ID NO: 811160 - DNA, 22 bp, Artificial Sequence
  chemically synthesized
aactttcaggtgatcttcaaac

SEQ ID NO: 811161 - DNA, 22 bp, Artificial Sequence
  chemically synthesized
cttggaaatatgtttgaagatc

SEQ ID NO: 811162 - DNA, 22 bp, Artificial Sequence
  chemically synthesized
ggaaatatgtttgaagatcacc

SEQ ID NO: 811163 - DNA, 22 bp, Artificial Sequence
  chemically synthesized
gaaatatgtttgaagatcacct

SEQ ID NO: 811164 - DNA, 22 bp, Artificial Sequence
  chemically synthesized
tgtcaattaaactttcaggtga

SEQ ID NO: 811165 - DNA, 22 bp, Artificial Sequence
  chemically synthesized
gaagatcacctgaaagtttaat

SEQ ID NO: 811166 - DNA, 22 bp, Artificial Sequence
  chemically synthesized
aagatcacctgaaagtttaatt

SEQ ID NO: 811167 - DNA, 22 bp, Artificial Sequence
  chemically synthesized
tcccatcctgtgtcaattaaac

SEQ ID NO: 811168 - DNA, 22 bp, Artificial Sequence
  chemically synthesized
aaagtttaattgacacaggatg

SEQ ID NO: 811169 - DNA, 22 bp, Artificial Sequence
  chemically synthesized
gatgtgctgtcccatcctgtgt

SEQ ID NO: 811170 - DNA, 22 bp, Artificial Sequence
  chemically synthesized
ctagatgtgctgtcccatcctg

SEQ ID NO: 811171 - DNA, 22 bp, Artificial Sequence
  chemically synthesized
cctagatgtgctgtcccatcct

SEQ ID NO: 811172 - DNA, 22 bp, Artificial Sequence
  chemically synthesized
tcctagatgtgctgtcccatcc

SEQ ID NO: 811173 - DNA, 22 bp, Artificial Sequence
  chemically synthesized
ttcctagatgtgctgtcccatc

SEQ ID NO: 811174 - DNA, 22 bp, Artificial Sequence
  chemically synthesized
aattgacacaggatgggacagc

SEQ ID NO: 811175 - DNA, 22 bp, Artificial Sequence
  chemically synthesized
attgacacaggatgggacagca

SEQ ID NO: 811176 - DNA, 22 bp, Artificial Sequence
  chemically synthesized
acacaggatgggacagcacatc

SEQ ID NO: 811177 - DNA, 22 bp, Artificial Sequence
  chemically synthesized
aatggcatccatttttcctaga

SEQ ID NO: 811178 - DNA, 22 bp, Artificial Sequence
  chemically synthesized
tctgaatggcatccatttttcc

SEQ ID NO: 811179 - DNA, 22 bp, Artificial Sequence
  chemically synthesized
ggaaaaatggatgccattcaga

SEQ ID NO: 811180 - DNA, 22 bp, Artificial Sequence
  chemically synthesized
agacaatcgttcttccgatttt

SEQ ID NO: 811181 - DNA, 22 bp, Artificial Sequence
  chemically synthesized
ttccgattttgatctgactatc

SEQ ID NO: 811182 - DNA, 22 bp, Artificial Sequence
  chemically synthesized
ccgattttgatctgactatctg

SEQ ID NO: 811183 - DNA, 22 bp, Artificial Sequence
  chemically synthesized
cgattttgatctgactatctgt

SEQ ID NO: 811184 - DNA, 22 bp, Artificial Sequence
  chemically synthesized
tgatctgactatctgttcgctt

SEQ ID NO: 811185 - DNA, 22 bp, Artificial Sequence
  chemically synthesized
atatacaccgcaaagcgaacag

SEQ ID NO: 811186 - DNA, 22 bp, Artificial Sequence
  chemically synthesized
gatctgactatctgttcgcttt

SEQ ID NO: 811187 - DNA, 22 bp, Artificial Sequence
  chemically synthesized
gatatacaccgcaaagcgaaca

SEQ ID NO: 811188 - DNA, 22 bp, Artificial Sequence
  chemically synthesized
atctgactatctgttcgctttg

SEQ ID NO: 811189 - DNA, 22 bp, Artificial Sequence
  chemically synthesized
actatctgttcgctttgcggtg

SEQ ID NO: 811190 - DNA, 22 bp, Artificial Sequence
  chemically synthesized
aacaatttgatatacaccgcaa

SEQ ID NO: 811191 - DNA, 22 bp, Artificial Sequence
  chemically synthesized
tctgttcgctttgcggtgtata

SEQ ID NO: 811192 - DNA, 22 bp, Artificial Sequence
  chemically synthesized
attcaacaatttgatatacacc

SEQ ID NO: 811193 - DNA, 22 bp, Artificial Sequence
  chemically synthesized
aattcaacaatttgatatacac

SEQ ID NO: 811194 - DNA, 22 bp, Artificial Sequence
  chemically synthesized
ttcgctttgcggtgtatatcaa

SEQ ID NO: 811195 - DNA, 22 bp, Artificial Sequence
  chemically synthesized
gctttgcggtgtatatcaaatt

SEQ ID NO: 811196 - DNA, 22 bp, Artificial Sequence
  chemically synthesized
aaatttaattcaacaatttgat

SEQ ID NO: 811197 - DNA, 22 bp, Artificial Sequence
  chemically synthesized
gaaatttaattcaacaatttga

SEQ ID NO: 811198 - DNA, 22 bp, Artificial Sequence
  chemically synthesized
tgcggtgtatatcaaattgttg

SEQ ID NO: 811199 - DNA, 22 bp, Artificial Sequence
  chemically synthesized
tgaaatttaattcaacaatttg

SEQ ID NO: 811200 - DNA, 22 bp, Artificial Sequence
  chemically synthesized
gcggtgtatatcaaattgttga

SEQ ID NO: 811201 - DNA, 22 bp, Artificial Sequence
  chemically synthesized
ttgaaatttaattcaacaattt

SEQ ID NO: 811202 - DNA, 22 bp, Artificial Sequence
  chemically synthesized
cggtgtatatcaaattgttgaa

SEQ ID NO: 811203 - DNA, 22 bp, Artificial Sequence
  chemically synthesized
tgatgtttttgaaatttaattc

SEQ ID NO: 811204 - DNA, 22 bp, Artificial Sequence
  chemically synthesized
tagacctgtgatgtttttgaaa

SEQ ID NO: 811205 - DNA, 22 bp, Artificial Sequence
  chemically synthesized
ttgaattaaatttcaaaaacat

SEQ ID NO: 811206 - DNA, 22 bp, Artificial Sequence
  chemically synthesized
cctgtagacctgtgatgttttt

SEQ ID NO: 811207 - DNA, 22 bp, Artificial Sequence
  chemically synthesized
aattaaatttcaaaaacatcac

SEQ ID NO: 811208 - DNA, 22 bp, Artificial Sequence
  chemically synthesized
aatttcaaaaacatcacaggtc

SEQ ID NO: 811209 - DNA, 22 bp, Artificial Sequence
  chemically synthesized
atgattccctgtagacctgtga

SEQ ID NO: 811210 - DNA, 22 bp, Artificial Sequence
  chemically synthesized
caaaaacatcacaggtctacag

SEQ ID NO: 811211 - DNA, 22 bp, Artificial Sequence
  chemically synthesized
aaaaacatcacaggtctacagg

SEQ ID NO: 811212 - DNA, 22 bp, Artificial Sequence
  chemically synthesized
ggggaactaatgattccctgta

SEQ ID NO: 811213 - DNA, 22 bp, Artificial Sequence
  chemically synthesized
gggggaactaatgattccctgt

SEQ ID NO: 811214 - DNA, 22 bp, Artificial Sequence
  chemically synthesized
gaaagtacttgggggaactaat

SEQ ID NO: 811215 - DNA, 22 bp, Artificial Sequence
  chemically synthesized
tcgaaagtacttgggggaacta

SEQ ID NO: 811216 - DNA, 22 bp, Artificial Sequence
  chemically synthesized
cagggaatcattagttccccca

SEQ ID NO: 811217 - DNA, 22 bp, Artificial Sequence
  chemically synthesized
cagtcaactctcgaaagtactt

SEQ ID NO: 811218 - DNA, 22 bp, Artificial Sequence
  chemically synthesized
gttcccccaagtactttcgaga

SEQ ID NO: 811219 - DNA, 22 bp, Artificial Sequence
  chemically synthesized
ccccaagtactttcgagagttg

SEQ ID NO: 811220 - DNA, 22 bp, Artificial Sequence
  chemically synthesized
tcgagagttgactgtagctctt

SEQ ID NO: 811221 - DNA, 22 bp, Artificial Sequence
  chemically synthesized
cgagagttgactgtagctcttt

SEQ ID NO: 811222 - DNA, 22 bp, Artificial Sequence
  chemically synthesized
gagagttgactgtagctctttt

SEQ ID NO: 811223 - DNA, 22 bp, Artificial Sequence
  chemically synthesized
cagcagggaagtaaaagagcta

SEQ ID NO: 811224 - DNA, 22 bp, Artificial Sequence
  chemically synthesized
tcattacagcagggaagtaaaa

SEQ ID NO: 811225 - DNA, 22 bp, Artificial Sequence
  chemically synthesized
actgtagctcttttacttccct

SEQ ID NO: 811226 - DNA, 22 bp, Artificial Sequence
  chemically synthesized
ctgtcattacagcagggaagta

SEQ ID NO: 811227 - DNA, 22 bp, Artificial Sequence
  chemically synthesized
cctgtcattacagcagggaagt

SEQ ID NO: 811228 - DNA, 22 bp, Artificial Sequence
  chemically synthesized
tagctcttttacttccctgctg

SEQ ID NO: 811229 - DNA, 22 bp, Artificial Sequence
  chemically synthesized
ttttacttccctgctgtaatga

SEQ ID NO: 811230 - DNA, 22 bp, Artificial Sequence
  chemically synthesized
ttacttccctgctgtaatgaca

SEQ ID NO: 811231 - DNA, 22 bp, Artificial Sequence
  chemically synthesized
tacttccctgctgtaatgacag

SEQ ID NO: 811232 - DNA, 22 bp, Artificial Sequence
  chemically synthesized
agaccacgtttcctgtcattac

SEQ ID NO: 811233 - DNA, 22 bp, Artificial Sequence
  chemically synthesized
acttccctgctgtaatgacagg

SEQ ID NO: 811234 - DNA, 22 bp, Artificial Sequence
  chemically synthesized
cttccctgctgtaatgacagga

SEQ ID NO: 811235 - DNA, 22 bp, Artificial Sequence
  chemically synthesized
ccctgctgtaatgacaggaaac

SEQ ID NO: 811236 - DNA, 22 bp, Artificial Sequence
  chemically synthesized
cctgctgtaatgacaggaaacg

SEQ ID NO: 811237 - DNA, 22 bp, Artificial Sequence
  chemically synthesized
ctgtaatgacaggaaacgtggt

SEQ ID NO: 811238 - DNA, 22 bp, Artificial Sequence
  chemically synthesized
taatgacaggaaacgtggtctg

SEQ ID NO: 811239 - DNA, 22 bp, Artificial Sequence
  chemically synthesized
agagaggtgggagatagcaata

SEQ ID NO: 811240 - DNA, 22 bp, Artificial Sequence
  chemically synthesized
taagagaggtgggagatagcaa

SEQ ID NO: 811241 - DNA, 22 bp, Artificial Sequence
  chemically synthesized
aatttattgctatctcccacct

SEQ ID NO: 811242 - DNA, 22 bp, Artificial Sequence
  chemically synthesized
attgctatctcccacctctctt

SEQ ID NO: 811243 - DNA, 22 bp, Artificial Sequence
  chemically synthesized
ttgctatctcccacctctctta

SEQ ID NO: 811244 - DNA, 22 bp, Artificial Sequence
  chemically synthesized
ctatctcccacctctcttagag

SEQ ID NO: 811245 - DNA, 22 bp, Artificial Sequence
  chemically synthesized
tctcccacctctcttagagacc

SEQ ID NO: 811246 - DNA, 22 bp, Artificial Sequence
  chemically synthesized
ccacctctcttagagaccattg

SEQ ID NO: 811247 - DNA, 22 bp, Artificial Sequence
  chemically synthesized
tcttagagaccattgttcattt

SEQ ID NO: 811248 - DNA, 22 bp, Artificial Sequence
  chemically synthesized
ttagagaccattgttcatttca

SEQ ID NO: 811249 - DNA, 22 bp, Artificial Sequence
  chemically synthesized
agagaccattgttcatttcact

SEQ ID NO: 811250 - DNA, 22 bp, Artificial Sequence
  chemically synthesized
gagaccattgttcatttcactc

SEQ ID NO: 811251 - DNA, 22 bp, Artificial Sequence
  chemically synthesized
aggaaggaaaatggatgagtga

SEQ ID NO: 811252 - DNA, 22 bp, Artificial Sequence
  chemically synthesized
ttcaggaaggaaaatggatgag

SEQ ID NO: 811253 - DNA, 22 bp, Artificial Sequence
  chemically synthesized
attcaggaaggaaaatggatga

SEQ ID NO: 811254 - DNA, 22 bp, Artificial Sequence
  chemically synthesized
ttcatttcactcatccattttc

SEQ ID NO: 811255 - DNA, 22 bp, Artificial Sequence
  chemically synthesized
atttcactcatccattttcctt

SEQ ID NO: 811256 - DNA, 22 bp, Artificial Sequence
  chemically synthesized
acatttattcaggaaggaaaat

SEQ ID NO: 811257 - DNA, 22 bp, Artificial Sequence
  chemically synthesized
cactcatccattttccttcctg

SEQ ID NO: 811258 - DNA, 22 bp, Artificial Sequence
  chemically synthesized
ttgacatttattcaggaaggaa

SEQ ID NO: 811259 - DNA, 22 bp, Artificial Sequence
  chemically synthesized
actcatccattttccttcctga

SEQ ID NO: 811260 - DNA, 22 bp, Artificial Sequence
  chemically synthesized
ctattgacatttattcaggaag

SEQ ID NO: 811261 - DNA, 22 bp, Artificial Sequence
  chemically synthesized
cctattgacatttattcaggaa

SEQ ID NO: 811262 - DNA, 22 bp, Artificial Sequence
  chemically synthesized
atccattttccttcctgaataa

SEQ ID NO: 811263 - DNA, 22 bp, Artificial Sequence
  chemically synthesized
tcctattgacatttattcagga

SEQ ID NO: 811264 - DNA, 22 bp, Artificial Sequence
  chemically synthesized
ttcctattgacatttattcagg

SEQ ID NO: 811265 - DNA, 22 bp, Artificial Sequence
  chemically synthesized
tccttcctgaataaatgtcaat

SEQ ID NO: 811266 - DNA, 22 bp, Artificial Sequence
  chemically synthesized
ccttcctgaataaatgtcaata

SEQ ID NO: 811267 - DNA, 22 bp, Artificial Sequence
  chemically synthesized
cttcctgaataaatgtcaatag

SEQ ID NO: 811268 - DNA, 22 bp, Artificial Sequence
  chemically synthesized
cctgaataaatgtcaataggaa

SEQ ID NO: 811269 - DNA, 22 bp, Artificial Sequence
  chemically synthesized
ctgaataaatgtcaataggaaa

SEQ ID NO: 811270 - DNA, 22 bp, Artificial Sequence
  chemically synthesized
tcaaaaccaatttttcctattg

SEQ ID NO: 811271 - DNA, 22 bp, Artificial Sequence
  chemically synthesized
atcaaaaccaatttttcctatt

SEQ ID NO: 811272 - DNA, 22 bp, Artificial Sequence
  chemically synthesized
aataaatgtcaataggaaaaat

SEQ ID NO: 811273 - DNA, 22 bp, Artificial Sequence
  chemically synthesized
taaaatatagtttatcaaaacc

SEQ ID NO: 811274 - DNA, 22 bp, Artificial Sequence
  chemically synthesized
tcaaactataaaatatagttta

SEQ ID NO: 811275 - DNA, 22 bp, Artificial Sequence
  chemically synthesized
atcaaactataaaatatagttt

SEQ ID NO: 811276 - DNA, 22 bp, Artificial Sequence
  chemically synthesized
gttttgataaactatattttat

SEQ ID NO: 811277 - DNA, 22 bp, Artificial Sequence
  chemically synthesized
tgataaactatattttatagtt

SEQ ID NO: 811278 - DNA, 22 bp, Artificial Sequence
  chemically synthesized
gataaactatattttatagttt

SEQ ID NO: 811279 - DNA, 22 bp, Artificial Sequence
  chemically synthesized
ataaactatattttatagtttg

SEQ ID NO: 811280 - DNA, 22 bp, Artificial Sequence
  chemically synthesized
tattttatagtttgataaacta

SEQ ID NO: 811281 - DNA, 22 bp, Artificial Sequence
  chemically synthesized
tatagtttgataaactatatat

SEQ ID NO: 811282 - DNA, 22 bp, Artificial Sequence
  chemically synthesized
atagtttgataaactatatatg

SEQ ID NO: 811283 - DNA, 22 bp, Artificial Sequence
  chemically synthesized
tagtttgataaactatatatgc

SEQ ID NO: 811284 - DNA, 22 bp, Artificial Sequence
  chemically synthesized
gataaactatatatgctttctt

SEQ ID NO: 811285 - DNA, 22 bp, Artificial Sequence
  chemically synthesized
ataaactatatatgctttcttt

SEQ ID NO: 811286 - DNA, 22 bp, Artificial Sequence
  chemically synthesized
tcaataagaaggtgaaaaagaa

SEQ ID NO: 811287 - DNA, 22 bp, Artificial Sequence
  chemically synthesized
tatatgctttctttttcacctt

SEQ ID NO: 811288 - DNA, 22 bp, Artificial Sequence
  chemically synthesized
tctttttcaccttcttattgac

SEQ ID NO: 811289 - DNA, 22 bp, Artificial Sequence
  chemically synthesized
ctttttcaccttcttattgaca

SEQ ID NO: 811290 - DNA, 22 bp, Artificial Sequence
  chemically synthesized
tttttcaccttcttattgacaa

SEQ ID NO: 811291 - DNA, 22 bp, Artificial Sequence
  chemically synthesized
tttcaccttcttattgacaaca

SEQ ID NO: 811292 - DNA, 22 bp, Artificial Sequence
  chemically synthesized
ttcaccttcttattgacaacat

SEQ ID NO: 811293 - DNA, 22 bp, Artificial Sequence
  chemically synthesized
tcaccttcttattgacaacatt

SEQ ID NO: 811294 - DNA, 22 bp, Artificial Sequence
  chemically synthesized
caccttcttattgacaacattt

SEQ ID NO: 811295 - DNA, 22 bp, Artificial Sequence
  chemically synthesized
atataatcggacaaatgttgtc

SEQ ID NO: 811296 - DNA, 22 bp, Artificial Sequence
  chemically synthesized
accttcttattgacaacatttg

SEQ ID NO: 811297 - DNA, 22 bp, Artificial Sequence
  chemically synthesized
ctaatataatcggacaaatgtt

SEQ ID NO: 811298 - DNA, 22 bp, Artificial Sequence
  chemically synthesized
cttattgacaacatttgtccga

SEQ ID NO: 811299 - DNA, 22 bp, Artificial Sequence
  chemically synthesized
ttattgacaacatttgtccgat

SEQ ID NO: 811300 - DNA, 22 bp, Artificial Sequence
  chemically synthesized
attgacaacatttgtccgatta

SEQ ID NO: 811301 - DNA, 22 bp, Artificial Sequence
  chemically synthesized
ttgacaacatttgtccgattat

SEQ ID NO: 811302 - DNA, 22 bp, Artificial Sequence
  chemically synthesized
gaacctgctaatataatcggac

SEQ ID NO: 811303 - DNA, 22 bp, Artificial Sequence
  chemically synthesized
acaacatttgtccgattatatt

SEQ ID NO: 811304 - DNA, 22 bp, Artificial Sequence
  chemically synthesized
gtcctggaacctgctaatataa

SEQ ID NO: 811305 - DNA, 22 bp, Artificial Sequence
  chemically synthesized
agtcctggaacctgctaatata

SEQ ID NO: 811306 - DNA, 22 bp, Artificial Sequence
  chemically synthesized
gtccgattatattagcaggttc

SEQ ID NO: 811307 - DNA, 22 bp, Artificial Sequence
  chemically synthesized
aacttagtcctggaacctgcta

SEQ ID NO: 811308 - DNA, 22 bp, Artificial Sequence
  chemically synthesized
tccgattatattagcaggttcc

SEQ ID NO: 811309 - DNA, 22 bp, Artificial Sequence
  chemically synthesized
ttaaacttagtcctggaacctg

SEQ ID NO: 811310 - DNA, 22 bp, Artificial Sequence
  chemically synthesized
tattagcaggttccaggactaa

SEQ ID NO: 811311 - DNA, 22 bp, Artificial Sequence
  chemically synthesized
acaataattgttaaacttagtc

SEQ ID NO: 811312 - DNA, 22 bp, Artificial Sequence
  chemically synthesized
gcaggttccaggactaagttta

SEQ ID NO: 811313 - DNA, 22 bp, Artificial Sequence
  chemically synthesized
aacaataattgttaaacttagt

SEQ ID NO: 811314 - DNA, 22 bp, Artificial Sequence
  chemically synthesized
ttaacaataattgttaaactta

SEQ ID NO: 811315 - DNA, 22 bp, Artificial Sequence
  chemically synthesized
caggactaagtttaacaattat

SEQ ID NO: 811316 - DNA, 22 bp, Artificial Sequence
  chemically synthesized
caaaaactcttaacaataattg

SEQ ID NO: 811317 - DNA, 22 bp, Artificial Sequence
  chemically synthesized
cctacaaaaactcttaacaata

SEQ ID NO: 811318 - DNA, 22 bp, Artificial Sequence
  chemically synthesized
agtttaacaattattgttaaga

SEQ ID NO: 811319 - DNA, 22 bp, Artificial Sequence
  chemically synthesized
ccctacaaaaactcttaacaat

SEQ ID NO: 811320 - DNA, 22 bp, Artificial Sequence
  chemically synthesized
tccctacaaaaactcttaacaa

SEQ ID NO: 811321 - DNA, 22 bp, Artificial Sequence
  chemically synthesized
ttccctacaaaaactcttaaca

SEQ ID NO: 811322 - DNA, 22 bp, Artificial Sequence
  chemically synthesized
aacaattattgttaagagtttt

SEQ ID NO: 811323 - DNA, 22 bp, Artificial Sequence
  chemically synthesized
acaattattgttaagagttttt

SEQ ID NO: 811324 - DNA, 22 bp, Artificial Sequence
  chemically synthesized
ttgttaagagtttttgtaggga

SEQ ID NO: 811325 - DNA, 22 bp, Artificial Sequence
  chemically synthesized
ttaagagtttttgtagggaaaa

SEQ ID NO: 811326 - DNA, 22 bp, Artificial Sequence
  chemically synthesized
caagaaataccatttttcccta

SEQ ID NO: 811327 - DNA, 22 bp, Artificial Sequence
  chemically synthesized
agagtttttgtagggaaaaatg

SEQ ID NO: 811328 - DNA, 22 bp, Artificial Sequence
  chemically synthesized
ttgtagggaaaaatggtatttc

SEQ ID NO: 811329 - DNA, 22 bp, Artificial Sequence
  chemically synthesized
atatatctacaagaaataccat

SEQ ID NO: 811330 - DNA, 22 bp, Artificial Sequence
  chemically synthesized
tgtagggaaaaatggtatttct

SEQ ID NO: 811331 - DNA, 22 bp, Artificial Sequence
  chemically synthesized
gtagggaaaaatggtatttctt

SEQ ID NO: 811332 - DNA, 22 bp, Artificial Sequence
  chemically synthesized
tagggaaaaatggtatttcttg

SEQ ID NO: 811333 - DNA, 22 bp, Artificial Sequence
  chemically synthesized
ctaatatatctacaagaaatac

SEQ ID NO: 811334 - DNA, 22 bp, Artificial Sequence
  chemically synthesized
tcaactactaatatatctacaa

SEQ ID NO: 811335 - DNA, 22 bp, Artificial Sequence
  chemically synthesized
cataaattatcaactactaata

SEQ ID NO: 811336 - DNA, 22 bp, Artificial Sequence
  chemically synthesized
acataaattatcaactactaat

SEQ ID NO: 811337 - DNA, 22 bp, Artificial Sequence
  chemically synthesized
cttgtagatatattagtagttg

SEQ ID NO: 811338 - DNA, 22 bp, Artificial Sequence
  chemically synthesized
tacataaattatcaactactaa

SEQ ID NO: 811339 - DNA, 22 bp, Artificial Sequence
  chemically synthesized
ttgtagatatattagtagttga

SEQ ID NO: 811340 - DNA, 22 bp, Artificial Sequence
  chemically synthesized
ttacataaattatcaactacta

SEQ ID NO: 811341 - DNA, 22 bp, Artificial Sequence
  chemically synthesized
gtagatatattagtagttgata

SEQ ID NO: 811342 - DNA, 22 bp, Artificial Sequence
  chemically synthesized
tagatatattagtagttgataa

SEQ ID NO: 811343 - DNA, 22 bp, Artificial Sequence
  chemically synthesized
aatttttacataaattatcaac

SEQ ID NO: 811344 - DNA, 22 bp, Artificial Sequence
  chemically synthesized
gtagttgataatttatgtaaaa

SEQ ID NO: 811345 - DNA, 22 bp, Artificial Sequence
  chemically synthesized
tcacaaacactaaatttttaca

SEQ ID NO: 811346 - DNA, 22 bp, Artificial Sequence
  chemically synthesized
ataatttatgtaaaaatttagt

SEQ ID NO: 811347 - DNA, 22 bp, Artificial Sequence
  chemically synthesized
atgtaaaaatttagtgtttgtg

SEQ ID NO: 811348 - DNA, 22 bp, Artificial Sequence
  chemically synthesized
tgtaaaaatttagtgtttgtga

SEQ ID NO: 811349 - DNA, 22 bp, Artificial Sequence
  chemically synthesized
aaaaagtgcctatcacaaacac

SEQ ID NO: 811350 - DNA, 22 bp, Artificial Sequence
  chemically synthesized
aaaaaagtgcctatcacaaaca

SEQ ID NO: 811351 - DNA, 22 bp, Artificial Sequence
  chemically synthesized
taaaaaagtgcctatcacaaac

SEQ ID NO: 811352 - DNA, 22 bp, Artificial Sequence
  chemically synthesized
agtgtttgtgataggcactttt

SEQ ID NO: 811353 - DNA, 22 bp, Artificial Sequence
  chemically synthesized
gtgtttgtgataggcacttttt

SEQ ID NO: 811354 - DNA, 22 bp, Artificial Sequence
  chemically synthesized
aaatgaaaagttttaaaaaagt

SEQ ID NO: 811355 - DNA, 22 bp, Artificial Sequence
  chemically synthesized
caaatgaaaagttttaaaaaag

SEQ ID NO: 811356 - DNA, 22 bp, Artificial Sequence
  chemically synthesized
tcaaatgaaaagttttaaaaaa

SEQ ID NO: 811357 - DNA, 22 bp, Artificial Sequence
  chemically synthesized
gtgataggcacttttttaaaac

SEQ ID NO: 811358 - DNA, 22 bp, Artificial Sequence
  chemically synthesized
tgataggcacttttttaaaact

SEQ ID NO: 811359 - DNA, 22 bp, Artificial Sequence
  chemically synthesized
atattttcaaatgaaaagtttt

SEQ ID NO: 811360 - DNA, 22 bp, Artificial Sequence
  chemically synthesized
ttttaaaacttttcatttgaaa

SEQ ID NO: 811361 - DNA, 22 bp, Artificial Sequence
  chemically synthesized
tttaaaacttttcatttgaaaa

SEQ ID NO: 811362 - DNA, 22 bp, Artificial Sequence
  chemically synthesized
ttaaaacttttcatttgaaaat

SEQ ID NO: 811363 - DNA, 22 bp, Artificial Sequence
  chemically synthesized
taaaacttttcatttgaaaata

SEQ ID NO: 811364 - DNA, 22 bp, Artificial Sequence
  chemically synthesized
aaaacttttcatttgaaaatat

SEQ ID NO: 811365 - DNA, 22 bp, Artificial Sequence
  chemically synthesized
aaacttttcatttgaaaatatg

SEQ ID NO: 811366 - DNA, 22 bp, Artificial Sequence
  chemically synthesized
ttcatttgaaaatatgaacatc

SEQ ID NO: 811367 - DNA, 22 bp, Artificial Sequence
  chemically synthesized
tcatttgaaaatatgaacatca

SEQ ID NO: 811368 - DNA, 22 bp, Artificial Sequence
  chemically synthesized
catttgaaaatatgaacatcat

SEQ ID NO: 811369 - DNA, 22 bp, Artificial Sequence
  chemically synthesized
atttgaaaatatgaacatcatc

SEQ ID NO: 811370 - DNA, 22 bp, Artificial Sequence
  chemically synthesized
gatggggaaatggatgatgttc

SEQ ID NO: 811371 - DNA, 22 bp, Artificial Sequence
  chemically synthesized
gaaaatatgaacatcatccatt

SEQ ID NO: 811372 - DNA, 22 bp, Artificial Sequence
  chemically synthesized
aaaatatgaacatcatccattt

SEQ ID NO: 811373 - DNA, 22 bp, Artificial Sequence
  chemically synthesized
aggaaagacatgattagatggg

SEQ ID NO: 811374 - DNA, 22 bp, Artificial Sequence
  chemically synthesized
caggaaagacatgattagatgg

SEQ ID NO: 811375 - DNA, 22 bp, Artificial Sequence
  chemically synthesized
ccccatctaatcatgtctttcc

SEQ ID NO: 811376 - DNA, 22 bp, Artificial Sequence
  chemically synthesized
cccatctaatcatgtctttcct

SEQ ID NO: 811377 - DNA, 22 bp, Artificial Sequence
  chemically synthesized
aaaatatatgcttcaggaaaga

SEQ ID NO: 811378 - DNA, 22 bp, Artificial Sequence
  chemically synthesized
aaaaatatatgcttcaggaaag

SEQ ID NO: 811379 - DNA, 22 bp, Artificial Sequence
  chemically synthesized
taaaaatatatgcttcaggaaa

SEQ ID NO: 811380 - DNA, 22 bp, Artificial Sequence
  chemically synthesized
ctttaaaaatatatgcttcagg

SEQ ID NO: 811381 - DNA, 22 bp, Artificial Sequence
  chemically synthesized
atcatgtctttcctgaagcata

SEQ ID NO: 811382 - DNA, 22 bp, Artificial Sequence
  chemically synthesized
agagctactttaaaaatatatg

SEQ ID NO: 811383 - DNA, 22 bp, Artificial Sequence
  chemically synthesized
aagagctactttaaaaatatat

SEQ ID NO: 811384 - DNA, 22 bp, Artificial Sequence
  chemically synthesized
taagagctactttaaaaatata

SEQ ID NO: 811385 - DNA, 22 bp, Artificial Sequence
  chemically synthesized
tcctgaagcatatatttttaaa

SEQ ID NO: 811386 - DNA, 22 bp, Artificial Sequence
  chemically synthesized
cctgaagcatatatttttaaag

SEQ ID NO: 811387 - DNA, 22 bp, Artificial Sequence
  chemically synthesized
ctgaagcatatatttttaaagt

SEQ ID NO: 811388 - DNA, 22 bp, Artificial Sequence
  chemically synthesized
aagcatatatttttaaagtagc

SEQ ID NO: 811389 - DNA, 22 bp, Artificial Sequence
  chemically synthesized
caagttttaagagctactttaa

SEQ ID NO: 811390 - DNA, 22 bp, Artificial Sequence
  chemically synthesized
ttaaagtagctcttaaaacttg

SEQ ID NO: 811391 - DNA, 22 bp, Artificial Sequence
  chemically synthesized
catcacatgttgcaagttttaa

SEQ ID NO: 811392 - DNA, 22 bp, Artificial Sequence
  chemically synthesized
taaagtagctcttaaaacttgc

SEQ ID NO: 811393 - DNA, 22 bp, Artificial Sequence
  chemically synthesized
aaagtagctcttaaaacttgca

SEQ ID NO: 811394 - DNA, 22 bp, Artificial Sequence
  chemically synthesized
aagtagctcttaaaacttgcaa

SEQ ID NO: 811395 - DNA, 22 bp, Artificial Sequence
  chemically synthesized
tagctacatcacatgttgcaag

SEQ ID NO: 811396 - DNA, 22 bp, Artificial Sequence
  chemically synthesized
ttaaaacttgcaacatgtgatg

SEQ ID NO: 811397 - DNA, 22 bp, Artificial Sequence
  chemically synthesized
aaaacttgcaacatgtgatgta

SEQ ID NO: 811398 - DNA, 22 bp, Artificial Sequence
  chemically synthesized
aaacttgcaacatgtgatgtag

SEQ ID NO: 811399 - DNA, 22 bp, Artificial Sequence
  chemically synthesized
aaataattatagctacatcaca

SEQ ID NO: 811400 - DNA, 22 bp, Artificial Sequence
  chemically synthesized
gcaacatgtgatgtagctataa

SEQ ID NO: 811401 - DNA, 22 bp, Artificial Sequence
  chemically synthesized
caacatgtgatgtagctataat

SEQ ID NO: 811402 - DNA, 22 bp, Artificial Sequence
  chemically synthesized
atgcagattaaaataattatag

SEQ ID NO: 811403 - DNA, 22 bp, Artificial Sequence
  chemically synthesized
catgcagattaaaataattata

SEQ ID NO: 811404 - DNA, 22 bp, Artificial Sequence
  chemically synthesized
tcatgcagattaaaataattat

SEQ ID NO: 811405 - DNA, 22 bp, Artificial Sequence
  chemically synthesized
ttcatgcagattaaaataatta

SEQ ID NO: 811406 - DNA, 22 bp, Artificial Sequence
  chemically synthesized
tttttcatgcagattaaaataa

SEQ ID NO: 811407 - DNA, 22 bp, Artificial Sequence
  chemically synthesized
ttatttttcatgcagattaaaa

SEQ ID NO: 811408 - DNA, 22 bp, Artificial Sequence
  chemically synthesized
tcctattatttttcatgcagat

SEQ ID NO: 811409 - DNA, 22 bp, Artificial Sequence
  chemically synthesized
taattattttaatctgcatgaa

SEQ ID NO: 811410 - DNA, 22 bp, Artificial Sequence
  chemically synthesized
atcctattatttttcatgcaga

SEQ ID NO: 811411 - DNA, 22 bp, Artificial Sequence
  chemically synthesized
tatcctattatttttcatgcag

SEQ ID NO: 811412 - DNA, 22 bp, Artificial Sequence
  chemically synthesized
ttatcctattatttttcatgca

SEQ ID NO: 811413 - DNA, 22 bp, Artificial Sequence
  chemically synthesized
ttttaatctgcatgaaaaataa

SEQ ID NO: 811414 - DNA, 22 bp, Artificial Sequence
  chemically synthesized
atttttatcctattatttttca

SEQ ID NO: 811415 - DNA, 22 bp, Artificial Sequence
  chemically synthesized
aatttttatcctattatttttc

SEQ ID NO: 811416 - DNA, 22 bp, Artificial Sequence
  chemically synthesized
taatttttatcctattattttt

SEQ ID NO: 811417 - DNA, 22 bp, Artificial Sequence
  chemically synthesized
taatctgcatgaaaaataatag

SEQ ID NO: 811418 - DNA, 22 bp, Artificial Sequence
  chemically synthesized
aatctgcatgaaaaataatagg

SEQ ID NO: 811419 - DNA, 22 bp, Artificial Sequence
  chemically synthesized
atctgcatgaaaaataatagga

SEQ ID NO: 811420 - DNA, 22 bp, Artificial Sequence
  chemically synthesized
atactttaatttttatcctatt

SEQ ID NO: 811421 - DNA, 22 bp, Artificial Sequence
  chemically synthesized
catgaaaaataataggataaaa

SEQ ID NO: 811422 - DNA, 22 bp, Artificial Sequence
  chemically synthesized
cactgatactttaatttttatc

SEQ ID NO: 811423 - DNA, 22 bp, Artificial Sequence
  chemically synthesized
acatcaaaattacactgatact

SEQ ID NO: 811424 - DNA, 22 bp, Artificial Sequence
  chemically synthesized
taacatcaaaattacactgata

SEQ ID NO: 811425 - DNA, 22 bp, Artificial Sequence
  chemically synthesized
gttctaacatcaaaattacact

SEQ ID NO: 811426 - DNA, 22 bp, Artificial Sequence
  chemically synthesized
ttagttctaacatcaaaattac

SEQ ID NO: 811427 - DNA, 22 bp, Artificial Sequence
  chemically synthesized
aagtatcagtgtaattttgatg

SEQ ID NO: 811428 - DNA, 22 bp, Artificial Sequence
  chemically synthesized
tgatgttagaactaataacatt

SEQ ID NO: 811429 - DNA, 22 bp, Artificial Sequence
  chemically synthesized
gatgttagaactaataacattg

SEQ ID NO: 811430 - DNA, 22 bp, Artificial Sequence
  chemically synthesized
atgttagaactaataacattgc

SEQ ID NO: 811431 - DNA, 22 bp, Artificial Sequence
  chemically synthesized
acaaaacaaatgtgcaatgtta

SEQ ID NO: 811432 - DNA, 22 bp, Artificial Sequence
  chemically synthesized
actaacaaaacaaatgtgcaat

SEQ ID NO: 811433 - DNA, 22 bp, Artificial Sequence
  chemically synthesized
gaactaataacattgcacattt

SEQ ID NO: 811434 - DNA, 22 bp, Artificial Sequence
  chemically synthesized
cactaacaaaacaaatgtgcaa

SEQ ID NO: 811435 - DNA, 22 bp, Artificial Sequence
  chemically synthesized
ataacattgcacatttgttttg

SEQ ID NO: 811436 - DNA, 22 bp, Artificial Sequence
  chemically synthesized
agcacatatttcactaacaaaa

SEQ ID NO: 811437 - DNA, 22 bp, Artificial Sequence
  chemically synthesized
gagcacatatttcactaacaaa

SEQ ID NO: 811438 - DNA, 22 bp, Artificial Sequence
  chemically synthesized
cacatttgttttgttagtgaaa

SEQ ID NO: 811439 - DNA, 22 bp, Artificial Sequence
  chemically synthesized
tatcatttgagcacatatttca

SEQ ID NO: 811440 - DNA, 22 bp, Artificial Sequence
  chemically synthesized
atatcatttgagcacatatttc

SEQ ID NO: 811441 - DNA, 22 bp, Artificial Sequence
  chemically synthesized
gttttgttagtgaaatatgtgc

SEQ ID NO: 811442 - DNA, 22 bp, Artificial Sequence
  chemically synthesized
ttttgttagtgaaatatgtgct

SEQ ID NO: 811443 - DNA, 22 bp, Artificial Sequence
  chemically synthesized
ttatatcatttgagcacatatt

SEQ ID NO: 811444 - DNA, 22 bp, Artificial Sequence
  chemically synthesized
tgttagtgaaatatgtgctcaa

SEQ ID NO: 811445 - DNA, 22 bp, Artificial Sequence
  chemically synthesized
ttcttatatcatttgagcacat

SEQ ID NO: 811446 - DNA, 22 bp, Artificial Sequence
  chemically synthesized
gttagtgaaatatgtgctcaaa

SEQ ID NO: 811447 - DNA, 22 bp, Artificial Sequence
  chemically synthesized
ttagtgaaatatgtgctcaaat

SEQ ID NO: 811448 - DNA, 22 bp, Artificial Sequence
  chemically synthesized
gtgaaatatgtgctcaaatgat

SEQ ID NO: 811449 - DNA, 22 bp, Artificial Sequence
  chemically synthesized
atattattcttatatcatttga

SEQ ID NO: 811450 - DNA, 22 bp, Artificial Sequence
  chemically synthesized
cctaatattattcttatatcat

SEQ ID NO: 811451 - DNA, 22 bp, Artificial Sequence
  chemically synthesized
acctaatattattcttatatca

SEQ ID NO: 811452 - DNA, 22 bp, Artificial Sequence
  chemically synthesized
catatttacctaatattattct

SEQ ID NO: 811453 - DNA, 22 bp, Artificial Sequence
  chemically synthesized
ccatatttacctaatattattc

SEQ ID NO: 811454 - DNA, 22 bp, Artificial Sequence
  chemically synthesized
aaatgatataagaataatatta

SEQ ID NO: 811455 - DNA, 22 bp, Artificial Sequence
  chemically synthesized
tccatatttacctaatattatt

SEQ ID NO: 811456 - DNA, 22 bp, Artificial Sequence
  chemically synthesized
ttccatatttacctaatattat

SEQ ID NO: 811457 - DNA, 22 bp, Artificial Sequence
  chemically synthesized
cttttccatatttacctaatat

SEQ ID NO: 811458 - DNA, 22 bp, Artificial Sequence
  chemically synthesized
atagaactacttttccatattt

SEQ ID NO: 811459 - DNA, 22 bp, Artificial Sequence
  chemically synthesized
catagaactacttttccatatt

SEQ ID NO: 811460 - DNA, 22 bp, Artificial Sequence
  chemically synthesized
ttcatagaactacttttccata

SEQ ID NO: 811461 - DNA, 22 bp, Artificial Sequence
  chemically synthesized
ggtaaatatggaaaagtagttc

SEQ ID NO: 811462 - DNA, 22 bp, Artificial Sequence
  chemically synthesized
aaaaatgtattcttcatagaac

SEQ ID NO: 811463 - DNA, 22 bp, Artificial Sequence
  chemically synthesized
aaaaaatgtattcttcatagaa

SEQ ID NO: 811464 - DNA, 22 bp, Artificial Sequence
  chemically synthesized
taaaaaatgtattcttcataga

SEQ ID NO: 811465 - DNA, 22 bp, Artificial Sequence
  chemically synthesized
ttaaaaaatgtattcttcatag

SEQ ID NO: 811466 - DNA, 22 bp, Artificial Sequence
  chemically synthesized
agatttttaaaaaatgtattct

SEQ ID NO: 811467 - DNA, 22 bp, Artificial Sequence
  chemically synthesized
tatgaagaatacattttttaaa

SEQ ID NO: 811468 - DNA, 22 bp, Artificial Sequence
  chemically synthesized
atgaactaagatttttaaaaaa

SEQ ID NO: 811469 - DNA, 22 bp, Artificial Sequence
  chemically synthesized
tgaagaatacattttttaaaaa

SEQ ID NO: 811470 - DNA, 22 bp, Artificial Sequence
  chemically synthesized
cattgatgaactaagattttta

SEQ ID NO: 811471 - DNA, 22 bp, Artificial Sequence
  chemically synthesized
actgcattgatgaactaagatt

SEQ ID NO: 811472 - DNA, 22 bp, Artificial Sequence
  chemically synthesized
cactgcattgatgaactaagat

SEQ ID NO: 811473 - DNA, 22 bp, Artificial Sequence
  chemically synthesized
tcactgcattgatgaactaaga

SEQ ID NO: 811474 - DNA, 22 bp, Artificial Sequence
  chemically synthesized
ctttcactgcattgatgaacta

SEQ ID NO: 811475 - DNA, 22 bp, Artificial Sequence
  chemically synthesized
tttaaaaatcttagttcatcaa

SEQ ID NO: 811476 - DNA, 22 bp, Artificial Sequence
  chemically synthesized
gctttcactgcattgatgaact

SEQ ID NO: 811477 - DNA, 22 bp, Artificial Sequence
  chemically synthesized
ttaaaaatcttagttcatcaat

SEQ ID NO: 811478 - DNA, 22 bp, Artificial Sequence
  chemically synthesized
taaaaatcttagttcatcaatg

SEQ ID NO: 811479 - DNA, 22 bp, Artificial Sequence
  chemically synthesized
aaaaatcttagttcatcaatgc

SEQ ID NO: 811480 - DNA, 22 bp, Artificial Sequence
  chemically synthesized
aaaatcttagttcatcaatgca

SEQ ID NO: 811481 - DNA, 22 bp, Artificial Sequence
  chemically synthesized
tatttgctttcactgcattgat

SEQ ID NO: 811482 - DNA, 22 bp, Artificial Sequence
  chemically synthesized
tgtatttgctttcactgcattg

SEQ ID NO: 811483 - DNA, 22 bp, Artificial Sequence
  chemically synthesized
agttcatcaatgcagtgaaagc

SEQ ID NO: 811484 - DNA, 22 bp, Artificial Sequence
  chemically synthesized
gttcatcaatgcagtgaaagca

SEQ ID NO: 811485 - DNA, 22 bp, Artificial Sequence
  chemically synthesized
gagaattctgtatttgctttca

SEQ ID NO: 811486 - DNA, 22 bp, Artificial Sequence
  chemically synthesized
atcaatgcagtgaaagcaaata

SEQ ID NO: 811487 - DNA, 22 bp, Artificial Sequence
  chemically synthesized
atgggagaatctagagaattct

SEQ ID NO: 811488 - DNA, 22 bp, Artificial Sequence
  chemically synthesized
aatgggagaatctagagaattc

SEQ ID NO: 811489 - DNA, 22 bp, Artificial Sequence
  chemically synthesized
taatttaatgggagaatctaga

SEQ ID NO: 811490 - DNA, 22 bp, Artificial Sequence
  chemically synthesized
ttataatttaatgggagaatct

SEQ ID NO: 811491 - DNA, 22 bp, Artificial Sequence
  chemically synthesized
aatactgttataatttaatggg

SEQ ID NO: 811492 - DNA, 22 bp, Artificial Sequence
  chemically synthesized
tctagattctcccattaaatta

SEQ ID NO: 811493 - DNA, 22 bp, Artificial Sequence
  chemically synthesized
tgaatactgttataatttaatg

SEQ ID NO: 811494 - DNA, 22 bp, Artificial Sequence
  chemically synthesized
tagattctcccattaaattata

SEQ ID NO: 811495 - DNA, 22 bp, Artificial Sequence
  chemically synthesized
gattctcccattaaattataac

SEQ ID NO: 811496 - DNA, 22 bp, Artificial Sequence
  chemically synthesized
tcccattaaattataacagtat

SEQ ID NO: 811497 - DNA, 22 bp, Artificial Sequence
  chemically synthesized
aaagaattctgaatactgttat

SEQ ID NO: 811498 - DNA, 22 bp, Artificial Sequence
  chemically synthesized
ccattaaattataacagtattc

SEQ ID NO: 811499 - DNA, 22 bp, Artificial Sequence
  chemically synthesized
aattataacagtattcagaatt

SEQ ID NO: 811500 - DNA, 22 bp, Artificial Sequence
  chemically synthesized
caccatatattgaaagaattct

SEQ ID NO: 811501 - DNA, 22 bp, Artificial Sequence
  chemically synthesized
taacagtattcagaattctttc

SEQ ID NO: 811502 - DNA, 22 bp, Artificial Sequence
  chemically synthesized
ccaccatatattgaaagaattc

SEQ ID NO: 811503 - DNA, 22 bp, Artificial Sequence
  chemically synthesized
ttccaccatatattgaaagaat

SEQ ID NO: 811504 - DNA, 22 bp, Artificial Sequence
  chemically synthesized
cttccaccatatattgaaagaa

SEQ ID NO: 811505 - DNA, 22 bp, Artificial Sequence
  chemically synthesized
cttcttccaccatatattgaaa

SEQ ID NO: 811506 - DNA, 22 bp, Artificial Sequence
  chemically synthesized
gcttcttccaccatatattgaa

SEQ ID NO: 811507 - DNA, 22 bp, Artificial Sequence
  chemically synthesized
tgcttcttccaccatatattga

SEQ ID NO: 811508 - DNA, 22 bp, Artificial Sequence
  chemically synthesized
ttgcttcttccaccatatattg

SEQ ID NO: 811509 - DNA, 22 bp, Artificial Sequence
  chemically synthesized
agaattctttcaatatatggtg

SEQ ID NO: 811510 - DNA, 22 bp, Artificial Sequence
  chemically synthesized
tttcaatatatggtggaagaag

SEQ ID NO: 811511 - DNA, 22 bp, Artificial Sequence
  chemically synthesized
atatcagcttttgcttcttcca

SEQ ID NO: 811512 - DNA, 22 bp, Artificial Sequence
  chemically synthesized
tcaatatatggtggaagaagca

SEQ ID NO: 811513 - DNA, 22 bp, Artificial Sequence
  chemically synthesized
caatatatggtggaagaagcaa

SEQ ID NO: 811514 - DNA, 22 bp, Artificial Sequence
  chemically synthesized
aatatatggtggaagaagcaaa

SEQ ID NO: 811515 - DNA, 22 bp, Artificial Sequence
  chemically synthesized
ttaatatcagcttttgcttctt

SEQ ID NO: 811516 - DNA, 22 bp, Artificial Sequence
  chemically synthesized
tattaatatcagcttttgcttc

SEQ ID NO: 811517 - DNA, 22 bp, Artificial Sequence
  chemically synthesized
agaaaaggcataatattctatt

SEQ ID NO: 811518 - DNA, 22 bp, Artificial Sequence
  chemically synthesized
tgagaaaaggcataatattcta

SEQ ID NO: 811519 - DNA, 22 bp, Artificial Sequence
  chemically synthesized
ctgagaaaaggcataatattct

SEQ ID NO: 811520 - DNA, 22 bp, Artificial Sequence
  chemically synthesized
tctgagaaaaggcataatattc

SEQ ID NO: 811521 - DNA, 22 bp, Artificial Sequence
  chemically synthesized
ttctgagaaaaggcataatatt

SEQ ID NO: 811522 - DNA, 22 bp, Artificial Sequence
  chemically synthesized
atattaatagaatattatgcct

SEQ ID NO: 811523 - DNA, 22 bp, Artificial Sequence
  chemically synthesized
atagaatattatgccttttctc

SEQ ID NO: 811524 - DNA, 22 bp, Artificial Sequence
  chemically synthesized
tgaaagtataatgtttttctga

SEQ ID NO: 811525 - DNA, 22 bp, Artificial Sequence
  chemically synthesized
tatgaaagtataatgtttttct

SEQ ID NO: 811526 - DNA, 22 bp, Artificial Sequence
  chemically synthesized
tgccttttctcagaaaaacatt

SEQ ID NO: 811527 - DNA, 22 bp, Artificial Sequence
  chemically synthesized
ttctcagaaaaacattatactt

SEQ ID NO: 811528 - DNA, 22 bp, Artificial Sequence
  chemically synthesized
tctcagaaaaacattatacttt

SEQ ID NO: 811529 - DNA, 22 bp, Artificial Sequence
  chemically synthesized
ctcagaaaaacattatactttc

SEQ ID NO: 811530 - DNA, 22 bp, Artificial Sequence
  chemically synthesized
tcagaaaaacattatactttca

SEQ ID NO: 811531 - DNA, 22 bp, Artificial Sequence
  chemically synthesized
agaaaaacattatactttcata

SEQ ID NO: 811532 - DNA, 22 bp, Artificial Sequence
  chemically synthesized
tactttcatagaatgtggactc

SEQ ID NO: 811533 - DNA, 22 bp, Artificial Sequence
  chemically synthesized
catatacatatatatgagtcca

SEQ ID NO: 811534 - DNA, 22 bp, Artificial Sequence
  chemically synthesized
tcatagaatgtggactcatata

SEQ ID NO: 811535 - DNA, 22 bp, Artificial Sequence
  chemically synthesized
tccatatacatatatatgagtc

SEQ ID NO: 811536 - DNA, 22 bp, Artificial Sequence
  chemically synthesized
catagaatgtggactcatatat

SEQ ID NO: 811537 - DNA, 22 bp, Artificial Sequence
  chemically synthesized
atagaatgtggactcatatata

SEQ ID NO: 811538 - DNA, 22 bp, Artificial Sequence
  chemically synthesized
aacaaaattctccatatacata

SEQ ID NO: 811539 - DNA, 22 bp, Artificial Sequence
  chemically synthesized
atatatatgtatatggagaatt

SEQ ID NO: 811540 - DNA, 22 bp, Artificial Sequence
  chemically synthesized
agcacattgaacaaaattctcc

SEQ ID NO: 811541 - DNA, 22 bp, Artificial Sequence
  chemically synthesized
caatagatattgagcacattga

SEQ ID NO: 811542 - DNA, 22 bp, Artificial Sequence
  chemically synthesized
tgttcaatgtgctcaatatcta

SEQ ID NO: 811543 - DNA, 22 bp, Artificial Sequence
  chemically synthesized
gttcaatgtgctcaatatctat

SEQ ID NO: 811544 - DNA, 22 bp, Artificial Sequence
  chemically synthesized
ccagatactgcaatagatattg

SEQ ID NO: 811545 - DNA, 22 bp, Artificial Sequence
  chemically synthesized
ttcaatgtgctcaatatctatt

SEQ ID NO: 811546 - DNA, 22 bp, Artificial Sequence
  chemically synthesized
gccagatactgcaatagatatt

SEQ ID NO: 811547 - DNA, 22 bp, Artificial Sequence
  chemically synthesized
tgccagatactgcaatagatat

SEQ ID NO: 811548 - DNA, 22 bp, Artificial Sequence
  chemically synthesized
aatgtgctcaatatctattgca

SEQ ID NO: 811549 - DNA, 22 bp, Artificial Sequence
  chemically synthesized
tttgccagatactgcaatagat

SEQ ID NO: 811550 - DNA, 22 bp, Artificial Sequence
  chemically synthesized
actctttgccagatactgcaat

SEQ ID NO: 811551 - DNA, 22 bp, Artificial Sequence
  chemically synthesized
aatatctattgcagtatctggc

SEQ ID NO: 811552 - DNA, 22 bp, Artificial Sequence
  chemically synthesized
agcactcactctttgccagata

SEQ ID NO: 811553 - DNA, 22 bp, Artificial Sequence
  chemically synthesized
ttgcagtatctggcaaagagtg

SEQ ID NO: 811554 - DNA, 22 bp, Artificial Sequence
  chemically synthesized
cagtatctggcaaagagtgagt

SEQ ID NO: 811555 - DNA, 22 bp, Artificial Sequence
  chemically synthesized
agtaaaaattaagcactcactc

SEQ ID NO: 811556 - DNA, 22 bp, Artificial Sequence
  chemically synthesized
cagtaaaaattaagcactcact

SEQ ID NO: 811557 - DNA, 22 bp, Artificial Sequence
  chemically synthesized
gcaaagagtgagtgcttaattt

SEQ ID NO: 811558 - DNA, 22 bp, Artificial Sequence
  chemically synthesized
agtgcttcagtaaaaattaagc

SEQ ID NO: 811559 - DNA, 22 bp, Artificial Sequence
  chemically synthesized
attaagtgcttcagtaaaaatt

SEQ ID NO: 811560 - DNA, 22 bp, Artificial Sequence
  chemically synthesized
taattaagtgcttcagtaaaaa

SEQ ID NO: 811561 - DNA, 22 bp, Artificial Sequence
  chemically synthesized
ctaattaagtgcttcagtaaaa

SEQ ID NO: 811562 - DNA, 22 bp, Artificial Sequence
  chemically synthesized
tctaattaagtgcttcagtaaa

SEQ ID NO: 811563 - DNA, 22 bp, Artificial Sequence
  chemically synthesized
ccattttctaattaagtgcttc

SEQ ID NO: 811564 - DNA, 22 bp, Artificial Sequence
  chemically synthesized
gccattttctaattaagtgctt

SEQ ID NO: 811565 - DNA, 22 bp, Artificial Sequence
  chemically synthesized
aatttttactgaagcacttaat

SEQ ID NO: 811566 - DNA, 22 bp, Artificial Sequence
  chemically synthesized
atttttactgaagcacttaatt

SEQ ID NO: 811567 - DNA, 22 bp, Artificial Sequence
  chemically synthesized
ttactgaagcacttaattagaa

SEQ ID NO: 811568 - DNA, 22 bp, Artificial Sequence
  chemically synthesized
tactgaagcacttaattagaaa

SEQ ID NO: 811569 - DNA, 22 bp, Artificial Sequence
  chemically synthesized
actgaagcacttaattagaaaa

SEQ ID NO: 811570 - DNA, 22 bp, Artificial Sequence
  chemically synthesized
ctgaagcacttaattagaaaat

SEQ ID NO: 811571 - DNA, 22 bp, Artificial Sequence
  chemically synthesized
acatatatttgccattttctaa

SEQ ID NO: 811572 - DNA, 22 bp, Artificial Sequence
  chemically synthesized
aagcacttaattagaaaatggc

SEQ ID NO: 811573 - DNA, 22 bp, Artificial Sequence
  chemically synthesized
atactgacatatatttgccatt

SEQ ID NO: 811574 - DNA, 22 bp, Artificial Sequence
  chemically synthesized
aattagaaaatggcaaatatat

SEQ ID NO: 811575 - DNA, 22 bp, Artificial Sequence
  chemically synthesized
attagaaaatggcaaatatatg

SEQ ID NO: 811576 - DNA, 22 bp, Artificial Sequence
  chemically synthesized
gaaaatggcaaatatatgtcag

SEQ ID NO: 811577 - DNA, 22 bp, Artificial Sequence
  chemically synthesized
tggtgaaaatactgatactgac

SEQ ID NO: 811578 - DNA, 22 bp, Artificial Sequence
  chemically synthesized
tataatgaaagtatctatggtg

SEQ ID NO: 811579 - DNA, 22 bp, Artificial Sequence
  chemically synthesized
ctatataatgaaagtatctatg

SEQ ID NO: 811580 - DNA, 22 bp, Artificial Sequence
  chemically synthesized
tgattactatataatgaaagta

SEQ ID NO: 811581 - DNA, 22 bp, Artificial Sequence
  chemically synthesized
tcaccatagatactttcattat

SEQ ID NO: 811582 - DNA, 22 bp, Artificial Sequence
  chemically synthesized
caccatagatactttcattata

SEQ ID NO: 811583 - DNA, 22 bp, Artificial Sequence
  chemically synthesized
ctgtgattactatataatgaaa

SEQ ID NO: 811584 - DNA, 22 bp, Artificial Sequence
  chemically synthesized
accatagatactttcattatat

SEQ ID NO: 811585 - DNA, 22 bp, Artificial Sequence
  chemically synthesized
tatatgcactactgtgattact

SEQ ID NO: 811586 - DNA, 22 bp, Artificial Sequence
  chemically synthesized
tcattatatagtaatcacagta

SEQ ID NO: 811587 - DNA, 22 bp, Artificial Sequence
  chemically synthesized
cattatatagtaatcacagtag

SEQ ID NO: 811588 - DNA, 22 bp, Artificial Sequence
  chemically synthesized
attatatagtaatcacagtagt

SEQ ID NO: 811589 - DNA, 22 bp, Artificial Sequence
  chemically synthesized
tatagtaatcacagtagtgcat

SEQ ID NO: 811590 - DNA, 22 bp, Artificial Sequence
  chemically synthesized
aaagtacaagtcagaatcagac

SEQ ID NO: 811591 - DNA, 22 bp, Artificial Sequence
  chemically synthesized
gaaagtacaagtcagaatcaga

SEQ ID NO: 811592 - DNA, 22 bp, Artificial Sequence
  chemically synthesized
tgaaagtacaagtcagaatcag

SEQ ID NO: 811593 - DNA, 22 bp, Artificial Sequence
  chemically synthesized
actttgaaagtacaagtcagaa

SEQ ID NO: 811594 - DNA, 22 bp, Artificial Sequence
  chemically synthesized
ccactgtctgattctgacttgt

SEQ ID NO: 811595 - DNA, 22 bp, Artificial Sequence
  chemically synthesized
taactttgaaagtacaagtcag

SEQ ID NO: 811596 - DNA, 22 bp, Artificial Sequence
  chemically synthesized
ttctaactttgaaagtacaagt

SEQ ID NO: 811597 - DNA, 22 bp, Artificial Sequence
  chemically synthesized
tctgattctgacttgtactttc

SEQ ID NO: 811598 - DNA, 22 bp, Artificial Sequence
  chemically synthesized
ttattctaactttgaaagtaca

SEQ ID NO: 811599 - DNA, 22 bp, Artificial Sequence
  chemically synthesized
attattctaactttgaaagtac

SEQ ID NO: 811600 - DNA, 22 bp, Artificial Sequence
  chemically synthesized
tattattctaactttgaaagta

SEQ ID NO: 811601 - DNA, 22 bp, Artificial Sequence
  chemically synthesized
attctgacttgtactttcaaag

SEQ ID NO: 811602 - DNA, 22 bp, Artificial Sequence
  chemically synthesized
tgacttgtactttcaaagttag

SEQ ID NO: 811603 - DNA, 22 bp, Artificial Sequence
  chemically synthesized
acttgtactttcaaagttagaa

SEQ ID NO: 811604 - DNA, 22 bp, Artificial Sequence
  chemically synthesized
gcagagctttattattctaact

SEQ ID NO: 811605 - DNA, 22 bp, Artificial Sequence
  chemically synthesized
gtactttcaaagttagaataat

SEQ ID NO: 811606 - DNA, 22 bp, Artificial Sequence
  chemically synthesized
tactttcaaagttagaataata

SEQ ID NO: 811607 - DNA, 22 bp, Artificial Sequence
  chemically synthesized
cctggcagagctttattattct

SEQ ID NO: 811608 - DNA, 22 bp, Artificial Sequence
  chemically synthesized
tcaaagttagaataataaagct

SEQ ID NO: 811609 - DNA, 22 bp, Artificial Sequence
  chemically synthesized
caaagttagaataataaagctc

SEQ ID NO: 811610 - DNA, 22 bp, Artificial Sequence
  chemically synthesized
aaagttagaataataaagctct

SEQ ID NO: 811611 - DNA, 22 bp, Artificial Sequence
  chemically synthesized
aaaatgggttacctggcagagc

SEQ ID NO: 811612 - DNA, 22 bp, Artificial Sequence
  chemically synthesized
gaaaatgggttacctggcagag

SEQ ID NO: 811613 - DNA, 22 bp, Artificial Sequence
  chemically synthesized
gaataataaagctctgccaggt

SEQ ID NO: 811614 - DNA, 22 bp, Artificial Sequence
  chemically synthesized
tgaaaatgggttacctggcaga

SEQ ID NO: 811615 - DNA, 22 bp, Artificial Sequence
  chemically synthesized
ttgaaaatgggttacctggcag

SEQ ID NO: 811616 - DNA, 22 bp, Artificial Sequence
  chemically synthesized
cttttgaaaatgggttacctgg

SEQ ID NO: 811617 - DNA, 22 bp, Artificial Sequence
  chemically synthesized
gcttttgaaaatgggttacctg

SEQ ID NO: 811618 - DNA, 22 bp, Artificial Sequence
  chemically synthesized
tgccaggtaacccattttcaaa

SEQ ID NO: 811619 - DNA, 22 bp, Artificial Sequence
  chemically synthesized
ccaaagtttgcttttgaaaatg

SEQ ID NO: 811620 - DNA, 22 bp, Artificial Sequence
  chemically synthesized
gccaaagtttgcttttgaaaat

SEQ ID NO: 811621 - DNA, 22 bp, Artificial Sequence
  chemically synthesized
ccaggtaacccattttcaaaag

SEQ ID NO: 811622 - DNA, 22 bp, Artificial Sequence
  chemically synthesized
tgccaaagtttgcttttgaaaa

SEQ ID NO: 811623 - DNA, 22 bp, Artificial Sequence
  chemically synthesized
caaagttttgccaaagtttgct

SEQ ID NO: 811624 - DNA, 22 bp, Artificial Sequence
  chemically synthesized
tattccaaagttttgccaaagt

SEQ ID NO: 811625 - DNA, 22 bp, Artificial Sequence
  chemically synthesized
gtattccaaagttttgccaaag

SEQ ID NO: 811626 - DNA, 22 bp, Artificial Sequence
  chemically synthesized
tcaaaagcaaactttggcaaaa

SEQ ID NO: 811627 - DNA, 22 bp, Artificial Sequence
  chemically synthesized
tgtattccaaagttttgccaaa

SEQ ID NO: 811628 - DNA, 22 bp, Artificial Sequence
  chemically synthesized
caaaagcaaactttggcaaaac

SEQ ID NO: 811629 - DNA, 22 bp, Artificial Sequence
  chemically synthesized
ttgtattccaaagttttgccaa

SEQ ID NO: 811630 - DNA, 22 bp, Artificial Sequence
  chemically synthesized
aaaagcaaactttggcaaaact

SEQ ID NO: 811631 - DNA, 22 bp, Artificial Sequence
  chemically synthesized
tttgtattccaaagttttgcca

SEQ ID NO: 811632 - DNA, 22 bp, Artificial Sequence
  chemically synthesized
ttttgtattccaaagttttgcc

SEQ ID NO: 811633 - DNA, 22 bp, Artificial Sequence
  chemically synthesized
ttttttgtattccaaagttttg

SEQ ID NO: 811634 - DNA, 22 bp, Artificial Sequence
  chemically synthesized
cttttttgtattccaaagtttt

SEQ ID NO: 811635 - DNA, 22 bp, Artificial Sequence
  chemically synthesized
catcttcttttttgtattccaa

SEQ ID NO: 811636 - DNA, 22 bp, Artificial Sequence
  chemically synthesized
tggcaaaactttggaatacaaa

SEQ ID NO: 811637 - DNA, 22 bp, Artificial Sequence
  chemically synthesized
tccatcttcttttttgtattcc

SEQ ID NO: 811638 - DNA, 22 bp, Artificial Sequence
  chemically synthesized
ggcaaaactttggaatacaaaa

SEQ ID NO: 811639 - DNA, 22 bp, Artificial Sequence
  chemically synthesized
gcaaaactttggaatacaaaaa

SEQ ID NO: 811640 - DNA, 22 bp, Artificial Sequence
  chemically synthesized
tctccatcttcttttttgtatt

SEQ ID NO: 811641 - DNA, 22 bp, Artificial Sequence
  chemically synthesized
ctctccatcttcttttttgtat

SEQ ID NO: 811642 - DNA, 22 bp, Artificial Sequence
  chemically synthesized
tggaatacaaaaaagaagatgg

SEQ ID NO: 811643 - DNA, 22 bp, Artificial Sequence
  chemically synthesized
ggaatacaaaaaagaagatgga

SEQ ID NO: 811644 - DNA, 22 bp, Artificial Sequence
  chemically synthesized
gaatacaaaaaagaagatggag

SEQ ID NO: 811645 - DNA, 22 bp, Artificial Sequence
  chemically synthesized
gaaaggcaagtttctctccatc

SEQ ID NO: 811646 - DNA, 22 bp, Artificial Sequence
  chemically synthesized
ctggaaaggcaagtttctctcc

SEQ ID NO: 811647 - DNA, 22 bp, Artificial Sequence
  chemically synthesized
cctggaaaggcaagtttctctc

SEQ ID NO: 811648 - DNA, 22 bp, Artificial Sequence
  chemically synthesized
ttcctggaaaggcaagtttctc

SEQ ID NO: 811649 - DNA, 22 bp, Artificial Sequence
  chemically synthesized
ccattcttcctggaaaggcaag

SEQ ID NO: 811650 - DNA, 22 bp, Artificial Sequence
  chemically synthesized
gccattcttcctggaaaggcaa

SEQ ID NO: 811651 - DNA, 22 bp, Artificial Sequence
  chemically synthesized
tgccattcttcctggaaaggca

SEQ ID NO: 811652 - DNA, 22 bp, Artificial Sequence
  chemically synthesized
accacatctttgccattcttcc

SEQ ID NO: 811653 - DNA, 22 bp, Artificial Sequence
  chemically synthesized
gcctttccaggaagaatggcaa

SEQ ID NO: 811654 - DNA, 22 bp, Artificial Sequence
  chemically synthesized
cctttccaggaagaatggcaaa

SEQ ID NO: 811655 - DNA, 22 bp, Artificial Sequence
  chemically synthesized
tccaggaagaatggcaaagatg

SEQ ID NO: 811656 - DNA, 22 bp, Artificial Sequence
  chemically synthesized
ccaggaagaatggcaaagatgt

SEQ ID NO: 811657 - DNA, 22 bp, Artificial Sequence
  chemically synthesized
caggaagaatggcaaagatgtg

SEQ ID NO: 811658 - DNA, 22 bp, Artificial Sequence
  chemically synthesized
agagggcatctcaccacatctt

SEQ ID NO: 811659 - DNA, 22 bp, Artificial Sequence
  chemically synthesized
taagagggcatctcaccacatc

SEQ ID NO: 811660 - DNA, 22 bp, Artificial Sequence
  chemically synthesized
gctctaagagggcatctcacca

SEQ ID NO: 811661 - DNA, 22 bp, Artificial Sequence
  chemically synthesized
acatactggctctaagagggca

SEQ ID NO: 811662 - DNA, 22 bp, Artificial Sequence
  chemically synthesized
gcgtattaacatactggctcta

SEQ ID NO: 811663 - DNA, 22 bp, Artificial Sequence
  chemically synthesized
ttagcgtattaacatactggct

SEQ ID NO: 811664 - DNA, 22 bp, Artificial Sequence
  chemically synthesized
attagcgtattaacatactggc

SEQ ID NO: 811665 - DNA, 22 bp, Artificial Sequence
  chemically synthesized
tattagcgtattaacatactgg

SEQ ID NO: 811666 - DNA, 22 bp, Artificial Sequence
  chemically synthesized
ttattagcgtattaacatactg

SEQ ID NO: 811667 - DNA, 22 bp, Artificial Sequence
  chemically synthesized
cttttattagcgtattaacata

SEQ ID NO: 811668 - DNA, 22 bp, Artificial Sequence
  chemically synthesized
ttagagccagtatgttaatacg

SEQ ID NO: 811669 - DNA, 22 bp, Artificial Sequence
  chemically synthesized
tacttttattagcgtattaaca

SEQ ID NO: 811670 - DNA, 22 bp, Artificial Sequence
  chemically synthesized
ctacttttattagcgtattaac

SEQ ID NO: 811671 - DNA, 22 bp, Artificial Sequence
  chemically synthesized
agagccagtatgttaatacgct

SEQ ID NO: 811672 - DNA, 22 bp, Artificial Sequence
  chemically synthesized
tctacttttattagcgtattaa

SEQ ID NO: 811673 - DNA, 22 bp, Artificial Sequence
  chemically synthesized
gagccagtatgttaatacgcta

SEQ ID NO: 811674 - DNA, 22 bp, Artificial Sequence
  chemically synthesized
ttctacttttattagcgtatta

SEQ ID NO: 811675 - DNA, 22 bp, Artificial Sequence
  chemically synthesized
gtaagtcttttctacttttatt

SEQ ID NO: 811676 - DNA, 22 bp, Artificial Sequence
  chemically synthesized
tagtaagtcttttctactttta

SEQ ID NO: 811677 - DNA, 22 bp, Artificial Sequence
  chemically synthesized
atacgctaataaaagtagaaaa

SEQ ID NO: 811678 - DNA, 22 bp, Artificial Sequence
  chemically synthesized
aaatagttctagtaagtctttt

SEQ ID NO: 811679 - DNA, 22 bp, Artificial Sequence
  chemically synthesized
caaatagttctagtaagtcttt

SEQ ID NO: 811680 - DNA, 22 bp, Artificial Sequence
  chemically synthesized
ataaaagtagaaaagacttact

SEQ ID NO: 811681 - DNA, 22 bp, Artificial Sequence
  chemically synthesized
atatttcaaatagttctagtaa

SEQ ID NO: 811682 - DNA, 22 bp, Artificial Sequence
  chemically synthesized
gatatttcaaatagttctagta

SEQ ID NO: 811683 - DNA, 22 bp, Artificial Sequence
  chemically synthesized
tgatatttcaaatagttctagt

SEQ ID NO: 811684 - DNA, 22 bp, Artificial Sequence
  chemically synthesized
ttgatatttcaaatagttctag

SEQ ID NO: 811685 - DNA, 22 bp, Artificial Sequence
  chemically synthesized
tttgatatttcaaatagttcta

SEQ ID NO: 811686 - DNA, 22 bp, Artificial Sequence
  chemically synthesized
ctttttgatatttcaaatagtt

SEQ ID NO: 811687 - DNA, 22 bp, Artificial Sequence
  chemically synthesized
actagaactatttgaaatatca

SEQ ID NO: 811688 - DNA, 22 bp, Artificial Sequence
  chemically synthesized
ctagaactatttgaaatatcaa

SEQ ID NO: 811689 - DNA, 22 bp, Artificial Sequence
  chemically synthesized
gaactatttgaaatatcaaaaa

SEQ ID NO: 811690 - DNA, 22 bp, Artificial Sequence
  chemically synthesized
tttgaaatatcaaaaagtaaca

SEQ ID NO: 811691 - DNA, 22 bp, Artificial Sequence
  chemically synthesized
acatacagtgatgtgttacttt

SEQ ID NO: 811692 - DNA, 22 bp, Artificial Sequence
  chemically synthesized
gaaatatcaaaaagtaacacat

SEQ ID NO: 811693 - DNA, 22 bp, Artificial Sequence
  chemically synthesized
tcacatacagtgatgtgttact

SEQ ID NO: 811694 - DNA, 22 bp, Artificial Sequence
  chemically synthesized
aaatatcaaaaagtaacacatc

SEQ ID NO: 811695 - DNA, 22 bp, Artificial Sequence
  chemically synthesized
ctcacatacagtgatgtgttac

SEQ ID NO: 811696 - DNA, 22 bp, Artificial Sequence
  chemically synthesized
tctcacatacagtgatgtgtta

SEQ ID NO: 811697 - DNA, 22 bp, Artificial Sequence
  chemically synthesized
agaattttctcacatacagtga

SEQ ID NO: 811698 - DNA, 22 bp, Artificial Sequence
  chemically synthesized
gagaattttctcacatacagtg

SEQ ID NO: 811699 - DNA, 22 bp, Artificial Sequence
  chemically synthesized
tgagaattttctcacatacagt

SEQ ID NO: 811700 - DNA, 22 bp, Artificial Sequence
  chemically synthesized
ttgagaattttctcacatacag

SEQ ID NO: 811701 - DNA, 22 bp, Artificial Sequence
  chemically synthesized
tttgagaattttctcacataca

SEQ ID NO: 811702 - DNA, 22 bp, Artificial Sequence
  chemically synthesized
taactttttgagaattttctca

SEQ ID NO: 811703 - DNA, 22 bp, Artificial Sequence
  chemically synthesized
tgtaactttttgagaattttct

SEQ ID NO: 811704 - DNA, 22 bp, Artificial Sequence
  chemically synthesized
ggttctgtaactttttgagaat

SEQ ID NO: 811705 - DNA, 22 bp, Artificial Sequence
  chemically synthesized
tatgtgagaaaattctcaaaaa

SEQ ID NO: 811706 - DNA, 22 bp, Artificial Sequence
  chemically synthesized
tatgatgttaggttctgtaact

SEQ ID NO: 811707 - DNA, 22 bp, Artificial Sequence
  chemically synthesized
tcaaaaagttacagaacctaac

SEQ ID NO: 811708 - DNA, 22 bp, Artificial Sequence
  chemically synthesized
aaaaagttacagaacctaacat

SEQ ID NO: 811709 - DNA, 22 bp, Artificial Sequence
  chemically synthesized
cagcatcacctatatgatgtta

SEQ ID NO: 811710 - DNA, 22 bp, Artificial Sequence
  chemically synthesized
cagaacctaacatcatataggt

SEQ ID NO: 811711 - DNA, 22 bp, Artificial Sequence
  chemically synthesized
cattgcagcatcacctatatga

SEQ ID NO: 811712 - DNA, 22 bp, Artificial Sequence
  chemically synthesized
acattgcagcatcacctatatg

SEQ ID NO: 811713 - DNA, 22 bp, Artificial Sequence
  chemically synthesized
tacattgcagcatcacctatat

SEQ ID NO: 811714 - DNA, 22 bp, Artificial Sequence
  chemically synthesized
ttacattgcagcatcacctata

SEQ ID NO: 811715 - DNA, 22 bp, Artificial Sequence
  chemically synthesized
acatcatataggtgatgctgca

SEQ ID NO: 811716 - DNA, 22 bp, Artificial Sequence
  chemically synthesized
tgtgtgtgtgtgtttttacatt

SEQ ID NO: 811717 - DNA, 22 bp, Artificial Sequence
  chemically synthesized
tgtgtgtgtgtgtgtttttaca

SEQ ID NO: 811718 - DNA, 22 bp, Artificial Sequence
  chemically synthesized
ctgtgtgtgtgtgtgtttttac

SEQ ID NO: 811719 - DNA, 22 bp, Artificial Sequence
  chemically synthesized
tctgtgtgtgtgtgtgttttta

SEQ ID NO: 811720 - DNA, 22 bp, Artificial Sequence
  chemically synthesized
ttctgtgtgtgtgtgtgttttt

SEQ ID NO: 811721 - DNA, 22 bp, Artificial Sequence
  chemically synthesized
tttctgtgtgtgtgtgtgtttt

SEQ ID NO: 811722 - DNA, 22 bp, Artificial Sequence
  chemically synthesized
ctttttctgtgtgtgtgtgtgt

SEQ ID NO: 811723 - DNA, 22 bp, Artificial Sequence
  chemically synthesized
caatgtaaaaacacacacacac

SEQ ID NO: 811724 - DNA, 22 bp, Artificial Sequence
  chemically synthesized
tcagtctcctttttctgtgtgt

SEQ ID NO: 811725 - DNA, 22 bp, Artificial Sequence
  chemically synthesized
ctatcagtctcctttttctgtg

SEQ ID NO: 811726 - DNA, 22 bp, Artificial Sequence
  chemically synthesized
gctatcagtctcctttttctgt

SEQ ID NO: 811727 - DNA, 22 bp, Artificial Sequence
  chemically synthesized
tatttgctatcagtctcctttt

SEQ ID NO: 811728 - DNA, 22 bp, Artificial Sequence
  chemically synthesized
gtatttgctatcagtctccttt

SEQ ID NO: 811729 - DNA, 22 bp, Artificial Sequence
  chemically synthesized
ttgtatttgctatcagtctcct

SEQ ID NO: 811730 - DNA, 22 bp, Artificial Sequence
  chemically synthesized
acacagaaattcttgtatttgc

SEQ ID NO: 811731 - DNA, 22 bp, Artificial Sequence
  chemically synthesized
tgacacagaaattcttgtattt

SEQ ID NO: 811732 - DNA, 22 bp, Artificial Sequence
  chemically synthesized
attctgacacagaaattcttgt

SEQ ID NO: 811733 - DNA, 22 bp, Artificial Sequence
  chemically synthesized
atagcaaatacaagaatttctg

SEQ ID NO: 811734 - DNA, 22 bp, Artificial Sequence
  chemically synthesized
tgttaattctgacacagaaatt

SEQ ID NO: 811735 - DNA, 22 bp, Artificial Sequence
  chemically synthesized
gtgttaattctgacacagaaat

SEQ ID NO: 811736 - DNA, 22 bp, Artificial Sequence
  chemically synthesized
aaaacaccagtttgtgttaatt

SEQ ID NO: 811737 - DNA, 22 bp, Artificial Sequence
  chemically synthesized
ctgtgtcagaattaacacaaac

SEQ ID NO: 811738 - DNA, 22 bp, Artificial Sequence
  chemically synthesized
tgtgtcagaattaacacaaact

SEQ ID NO: 811739 - DNA, 22 bp, Artificial Sequence
  chemically synthesized
agctcaaaacaccagtttgtgt

SEQ ID NO: 811740 - DNA, 22 bp, Artificial Sequence
  chemically synthesized
tgtcagaattaacacaaactgg

SEQ ID NO: 811741 - DNA, 22 bp, Artificial Sequence
  chemically synthesized
ctaagctcaaaacaccagtttg

SEQ ID NO: 811742 - DNA, 22 bp, Artificial Sequence
  chemically synthesized
cctaagctcaaaacaccagttt

SEQ ID NO: 811743 - DNA, 22 bp, Artificial Sequence
  chemically synthesized
tcctaagctcaaaacaccagtt

SEQ ID NO: 811744 - DNA, 22 bp, Artificial Sequence
  chemically synthesized
tgactttcctaagctcaaaaca

SEQ ID NO: 811745 - DNA, 22 bp, Artificial Sequence
  chemically synthesized
acacaaactggtgttttgagct

SEQ ID NO: 811746 - DNA, 22 bp, Artificial Sequence
  chemically synthesized
gtgttttgagcttaggaaagtc

SEQ ID NO: 811747 - DNA, 22 bp, Artificial Sequence
  chemically synthesized
aggcacagagagtctgtgactt

SEQ ID NO: 811748 - DNA, 22 bp, Artificial Sequence
  chemically synthesized
tgagcttaggaaagtcacagac

SEQ ID NO: 811749 - DNA, 22 bp, Artificial Sequence
  chemically synthesized
gagcttaggaaagtcacagact

SEQ ID NO: 811750 - DNA, 22 bp, Artificial Sequence
  chemically synthesized
agcttaggaaagtcacagactc

SEQ ID NO: 811751 - DNA, 22 bp, Artificial Sequence
  chemically synthesized
aggaaagtcacagactctctgt

SEQ ID NO: 811752 - DNA, 22 bp, Artificial Sequence
  chemically synthesized
ggaaagtcacagactctctgtg

SEQ ID NO: 811753 - DNA, 22 bp, Artificial Sequence
  chemically synthesized
tgacagagaaaaggatactgag

SEQ ID NO: 811754 - DNA, 22 bp, Artificial Sequence
  chemically synthesized
atgacagagaaaaggatactga

SEQ ID NO: 811755 - DNA, 22 bp, Artificial Sequence
  chemically synthesized
tctgtgcctcagtatccttttc

SEQ ID NO: 811756 - DNA, 22 bp, Artificial Sequence
  chemically synthesized
tgtgcctcagtatccttttctc

SEQ ID NO: 811757 - DNA, 22 bp, Artificial Sequence
  chemically synthesized
tgcctcagtatccttttctctg

SEQ ID NO: 811758 - DNA, 22 bp, Artificial Sequence
  chemically synthesized
agtatccttttctctgtcataa

SEQ ID NO: 811759 - DNA, 22 bp, Artificial Sequence
  chemically synthesized
aatatcaaaatatttatgacag

SEQ ID NO: 811760 - DNA, 22 bp, Artificial Sequence
  chemically synthesized
caatatcaaaatatttatgaca

SEQ ID NO: 811761 - DNA, 22 bp, Artificial Sequence
  chemically synthesized
ttctctgtcataaatattttga

SEQ ID NO: 811762 - DNA, 22 bp, Artificial Sequence
  chemically synthesized
tctctgtcataaatattttgat

SEQ ID NO: 811763 - DNA, 22 bp, Artificial Sequence
  chemically synthesized
ctctgtcataaatattttgata

SEQ ID NO: 811764 - DNA, 22 bp, Artificial Sequence
  chemically synthesized
tctgtcataaatattttgatat

SEQ ID NO: 811765 - DNA, 22 bp, Artificial Sequence
  chemically synthesized
tgtcataaatattttgatattg

SEQ ID NO: 811766 - DNA, 22 bp, Artificial Sequence
  chemically synthesized
tcataaatattttgatattgaa

SEQ ID NO: 811767 - DNA, 22 bp, Artificial Sequence
  chemically synthesized
tgaagtcaccaatttcaatatc

SEQ ID NO: 811768 - DNA, 22 bp, Artificial Sequence
  chemically synthesized
acctatgaagtcaccaatttca

SEQ ID NO: 811769 - DNA, 22 bp, Artificial Sequence
  chemically synthesized
agttaacctatgaagtcaccaa

SEQ ID NO: 811770 - DNA, 22 bp, Artificial Sequence
  chemically synthesized
tgatattgaaattggtgacttc

SEQ ID NO: 811771 - DNA, 22 bp, Artificial Sequence
  chemically synthesized
gatattgaaattggtgacttca

SEQ ID NO: 811772 - DNA, 22 bp, Artificial Sequence
  chemically synthesized
atattgaaattggtgacttcat

SEQ ID NO: 811773 - DNA, 22 bp, Artificial Sequence
  chemically synthesized
taggtctgagttaacctatgaa

SEQ ID NO: 811774 - DNA, 22 bp, Artificial Sequence
  chemically synthesized
aaattggtgacttcataggtta

SEQ ID NO: 811775 - DNA, 22 bp, Artificial Sequence
  chemically synthesized
tataggtctgagttaacctatg

SEQ ID NO: 811776 - DNA, 22 bp, Artificial Sequence
  chemically synthesized
gtgacttcataggttaactcag

SEQ ID NO: 811777 - DNA, 22 bp, Artificial Sequence
  chemically synthesized
cataggttaactcagacctata

SEQ ID NO: 811778 - DNA, 22 bp, Artificial Sequence
  chemically synthesized
ataggttaactcagacctatag

SEQ ID NO: 811779 - DNA, 22 bp, Artificial Sequence
  chemically synthesized
aatgaacgtgacattctatagg

SEQ ID NO: 811780 - DNA, 22 bp, Artificial Sequence
  chemically synthesized
taaatgaacgtgacattctata

SEQ ID NO: 811781 - DNA, 22 bp, Artificial Sequence
  chemically synthesized
actcagacctatagaatgtcac

SEQ ID NO: 811782 - DNA, 22 bp, Artificial Sequence
  chemically synthesized
agacctatagaatgtcacgttc

SEQ ID NO: 811783 - DNA, 22 bp, Artificial Sequence
  chemically synthesized
tcccatattctaaatgaacgtg

SEQ ID NO: 811784 - DNA, 22 bp, Artificial Sequence
  chemically synthesized
ctgtcccatattctaaatgaac

SEQ ID NO: 811785 - DNA, 22 bp, Artificial Sequence
  chemically synthesized
tagaatgtcacgttcatttaga

SEQ ID NO: 811786 - DNA, 22 bp, Artificial Sequence
  chemically synthesized
gctgtcccatattctaaatgaa

SEQ ID NO: 811787 - DNA, 22 bp, Artificial Sequence
  chemically synthesized
caatttgctgtcccatattcta

SEQ ID NO: 811788 - DNA, 22 bp, Artificial Sequence
  chemically synthesized
acaatttgctgtcccatattct

SEQ ID NO: 811789 - DNA, 22 bp, Artificial Sequence
  chemically synthesized
tacaatttgctgtcccatattc

SEQ ID NO: 811790 - DNA, 22 bp, Artificial Sequence
  chemically synthesized
atttagaatatgggacagcaaa

SEQ ID NO: 811791 - DNA, 22 bp, Artificial Sequence
  chemically synthesized
agaatatgggacagcaaattgt

SEQ ID NO: 811792 - DNA, 22 bp, Artificial Sequence
  chemically synthesized
gaatatgggacagcaaattgta

SEQ ID NO: 811793 - DNA, 22 bp, Artificial Sequence
  chemically synthesized
ccaaatgagtagcaggtggaca

SEQ ID NO: 811794 - DNA, 22 bp, Artificial Sequence
  chemically synthesized
gccaaatgagtagcaggtggac

SEQ ID NO: 811795 - DNA, 22 bp, Artificial Sequence
  chemically synthesized
taaagatgtctgtccacctgct

SEQ ID NO: 811796 - DNA, 22 bp, Artificial Sequence
  chemically synthesized
tttgccaaatgagtagcaggtg

SEQ ID NO: 811797 - DNA, 22 bp, Artificial Sequence
  chemically synthesized
tccacctgctactcatttggca

SEQ ID NO: 811798 - DNA, 22 bp, Artificial Sequence
  chemically synthesized
ggatatgcactgtttgccaaat

SEQ ID NO: 811799 - DNA, 22 bp, Artificial Sequence
  chemically synthesized
cctgggatatgcactgtttgcc

SEQ ID NO: 811800 - DNA, 22 bp, Artificial Sequence
  chemically synthesized
ctactcatttggcaaacagtgc

SEQ ID NO: 811801 - DNA, 22 bp, Artificial Sequence
  chemically synthesized
ctccctgggatatgcactgttt

SEQ ID NO: 811802 - DNA, 22 bp, Artificial Sequence
  chemically synthesized
ctcatttggcaaacagtgcata

SEQ ID NO: 811803 - DNA, 22 bp, Artificial Sequence
  chemically synthesized
tgctccctgggatatgcactgt

SEQ ID NO: 811804 - DNA, 22 bp, Artificial Sequence
  chemically synthesized
atttggcaaacagtgcatatcc

SEQ ID NO: 811805 - DNA, 22 bp, Artificial Sequence
  chemically synthesized
ggttctgctccctgggatatgc

SEQ ID NO: 811806 - DNA, 22 bp, Artificial Sequence
  chemically synthesized
ggcaaacagtgcatatcccagg

SEQ ID NO: 811807 - DNA, 22 bp, Artificial Sequence
  chemically synthesized
gcaaacagtgcatatcccaggg

SEQ ID NO: 811808 - DNA, 22 bp, Artificial Sequence
  chemically synthesized
cgctgggttctgctccctggga

SEQ ID NO: 811809 - DNA, 22 bp, Artificial Sequence
  chemically synthesized
gcgctgggttctgctccctggg

SEQ ID NO: 811810 - DNA, 22 bp, Artificial Sequence
  chemically synthesized
cttgcgctgggttctgctccct

SEQ ID NO: 811811 - DNA, 22 bp, Artificial Sequence
  chemically synthesized
gcttgcgctgggttctgctccc

SEQ ID NO: 811812 - DNA, 22 bp, Artificial Sequence
  chemically synthesized
ataatggtaggacagcttgctt

SEQ ID NO: 811813 - DNA, 22 bp, Artificial Sequence
  chemically synthesized
attgataatggtaggacagctt

SEQ ID NO: 811814 - DNA, 22 bp, Artificial Sequence
  chemically synthesized
aattgataatggtaggacagct

SEQ ID NO: 811815 - DNA, 22 bp, Artificial Sequence
  chemically synthesized
aagcccttaattgataatggta

SEQ ID NO: 811816 - DNA, 22 bp, Artificial Sequence
  chemically synthesized
caagcccttaattgataatggt

SEQ ID NO: 811817 - DNA, 22 bp, Artificial Sequence
  chemically synthesized
acttcaagcccttaattgataa

SEQ ID NO: 811818 - DNA, 22 bp, Artificial Sequence
  chemically synthesized
gacttcaagcccttaattgata

SEQ ID NO: 811819 - DNA, 22 bp, Artificial Sequence
  chemically synthesized
ttgacttcaagcccttaattga

SEQ ID NO: 811820 - DNA, 22 bp, Artificial Sequence
  chemically synthesized
tcctaccattatcaattaaggg

SEQ ID NO: 811821 - DNA, 22 bp, Artificial Sequence
  chemically synthesized
attcttgacttcaagcccttaa

SEQ ID NO: 811822 - DNA, 22 bp, Artificial Sequence
  chemically synthesized
ccattatcaattaagggcttga

SEQ ID NO: 811823 - DNA, 22 bp, Artificial Sequence
  chemically synthesized
ggactcattcttgacttcaagc

SEQ ID NO: 811824 - DNA, 22 bp, Artificial Sequence
  chemically synthesized
gggactcattcttgacttcaag

SEQ ID NO: 811825 - DNA, 22 bp, Artificial Sequence
  chemically synthesized
tcaattaagggcttgaagtcaa

SEQ ID NO: 811826 - DNA, 22 bp, Artificial Sequence
  chemically synthesized
agggcttgaagtcaagaatgag

SEQ ID NO: 811827 - DNA, 22 bp, Artificial Sequence
  chemically synthesized
gaagtcaagaatgagtcccaag

SEQ ID NO: 811828 - DNA, 22 bp, Artificial Sequence
  chemically synthesized
gcaaaccagtggcttgggactc

SEQ ID NO: 811829 - DNA, 22 bp, Artificial Sequence
  chemically synthesized
aagtcaagaatgagtcccaagc

SEQ ID NO: 811830 - DNA, 22 bp, Artificial Sequence
  chemically synthesized
ggcaaaccagtggcttgggact

SEQ ID NO: 811831 - DNA, 22 bp, Artificial Sequence
  chemically synthesized
cttggcaaaccagtggcttggg

SEQ ID NO: 811832 - DNA, 22 bp, Artificial Sequence
  chemically synthesized
cagactccttggcaaaccagtg

SEQ ID NO: 811833 - DNA, 22 bp, Artificial Sequence
  chemically synthesized
gcagactccttggcaaaccagt

SEQ ID NO: 811834 - DNA, 22 bp, Artificial Sequence
  chemically synthesized
tgcagactccttggcaaaccag

SEQ ID NO: 811835 - DNA, 22 bp, Artificial Sequence
  chemically synthesized
gcaagattttgcagactccttg

SEQ ID NO: 811836 - DNA, 22 bp, Artificial Sequence
  chemically synthesized
tagcaagattttgcagactcct

SEQ ID NO: 811837 - DNA, 22 bp, Artificial Sequence
  chemically synthesized
gtttgccaaggagtctgcaaaa

SEQ ID NO: 811838 - DNA, 22 bp, Artificial Sequence
  chemically synthesized
gccaaggagtctgcaaaatctt

SEQ ID NO: 811839 - DNA, 22 bp, Artificial Sequence
  chemically synthesized
ccaaggagtctgcaaaatcttg

SEQ ID NO: 811840 - DNA, 22 bp, Artificial Sequence
  chemically synthesized
aaagtcaaagttctagcaagat

SEQ ID NO: 811841 - DNA, 22 bp, Artificial Sequence
  chemically synthesized
caaaatcttgctagaactttga

SEQ ID NO: 811842 - DNA, 22 bp, Artificial Sequence
  chemically synthesized
caagaaccagaattgaaagtca

SEQ ID NO: 811843 - DNA, 22 bp, Artificial Sequence
  chemically synthesized
gctagaactttgactttcaatt

SEQ ID NO: 811844 - DNA, 22 bp, Artificial Sequence
  chemically synthesized
ctagaactttgactttcaattc

SEQ ID NO: 811845 - DNA, 22 bp, Artificial Sequence
  chemically synthesized
gaactttgactttcaattctgg

SEQ ID NO: 811846 - DNA, 22 bp, Artificial Sequence
  chemically synthesized
tgactttcaattctggttcttg

SEQ ID NO: 811847 - DNA, 22 bp, Artificial Sequence
  chemically synthesized
atagtgcagttgcaagaaccag

SEQ ID NO: 811848 - DNA, 22 bp, Artificial Sequence
  chemically synthesized
gactttcaattctggttcttgc

SEQ ID NO: 811849 - DNA, 22 bp, Artificial Sequence
  chemically synthesized
aatagtgcagttgcaagaacca

SEQ ID NO: 811850 - DNA, 22 bp, Artificial Sequence
  chemically synthesized
actttcaattctggttcttgca

SEQ ID NO: 811851 - DNA, 22 bp, Artificial Sequence
  chemically synthesized
taatagtgcagttgcaagaacc

SEQ ID NO: 811852 - DNA, 22 bp, Artificial Sequence
  chemically synthesized
tttaatagtgcagttgcaagaa

SEQ ID NO: 811853 - DNA, 22 bp, Artificial Sequence
  chemically synthesized
tcaattctggttcttgcaactg

SEQ ID NO: 811854 - DNA, 22 bp, Artificial Sequence
  chemically synthesized
caattctggttcttgcaactgc

SEQ ID NO: 811855 - DNA, 22 bp, Artificial Sequence
  chemically synthesized
aattctggttcttgcaactgca

SEQ ID NO: 811856 - DNA, 22 bp, Artificial Sequence
  chemically synthesized
tggttcttgcaactgcactatt

SEQ ID NO: 811857 - DNA, 22 bp, Artificial Sequence
  chemically synthesized
gttcttgcaactgcactattaa

SEQ ID NO: 811858 - DNA, 22 bp, Artificial Sequence
  chemically synthesized
ttgcaactgcactattaaagaa

SEQ ID NO: 811859 - DNA, 22 bp, Artificial Sequence
  chemically synthesized
gcaactgcactattaaagaacc

SEQ ID NO: 811860 - DNA, 22 bp, Artificial Sequence
  chemically synthesized
agaagaggccaaggttctttaa

SEQ ID NO: 811861 - DNA, 22 bp, Artificial Sequence
  chemically synthesized
caactgcactattaaagaacct

SEQ ID NO: 811862 - DNA, 22 bp, Artificial Sequence
  chemically synthesized
taagaagaggccaaggttcttt

SEQ ID NO: 811863 - DNA, 22 bp, Artificial Sequence
  chemically synthesized
ctctaagaagaggccaaggttc

SEQ ID NO: 811864 - DNA, 22 bp, Artificial Sequence
  chemically synthesized
cactattaaagaaccttggcct

SEQ ID NO: 811865 - DNA, 22 bp, Artificial Sequence
  chemically synthesized
gtctactctaagaagaggccaa

SEQ ID NO: 811866 - DNA, 22 bp, Artificial Sequence
  chemically synthesized
ttaaagaaccttggcctcttct

SEQ ID NO: 811867 - DNA, 22 bp, Artificial Sequence
  chemically synthesized
aagaaccttggcctcttcttag

SEQ ID NO: 811868 - DNA, 22 bp, Artificial Sequence
  chemically synthesized
gtggacggacctggtctactct

SEQ ID NO: 811869 - DNA, 22 bp, Artificial Sequence
  chemically synthesized
ggcctcttcttagagtagacca

SEQ ID NO: 811870 - DNA, 22 bp, Artificial Sequence
  chemically synthesized
gcctcttcttagagtagaccag

SEQ ID NO: 811871 - DNA, 22 bp, Artificial Sequence
  chemically synthesized
ctggtggacggacctggtctac

SEQ ID NO: 811872 - DNA, 22 bp, Artificial Sequence
  chemically synthesized
ttcctggtggacggacctggtc

SEQ ID NO: 811873 - DNA, 22 bp, Artificial Sequence
  chemically synthesized
ttcttagagtagaccaggtccg

SEQ ID NO: 811874 - DNA, 22 bp, Artificial Sequence
  chemically synthesized
cttagagtagaccaggtccgtc

SEQ ID NO: 811875 - DNA, 22 bp, Artificial Sequence
  chemically synthesized
ttagagtagaccaggtccgtcc

SEQ ID NO: 811876 - DNA, 22 bp, Artificial Sequence
  chemically synthesized
agagtagaccaggtccgtccac

SEQ ID NO: 811877 - DNA, 22 bp, Artificial Sequence
  chemically synthesized
gagtagaccaggtccgtccacc

SEQ ID NO: 811878 - DNA, 22 bp, Artificial Sequence
  chemically synthesized
gcaactattcctggtggacgga

SEQ ID NO: 811879 - DNA, 22 bp, Artificial Sequence
  chemically synthesized
agcaactattcctggtggacgg

SEQ ID NO: 811880 - DNA, 22 bp, Artificial Sequence
  chemically synthesized
ttagcaactattcctggtggac

SEQ ID NO: 811881 - DNA, 22 bp, Artificial Sequence
  chemically synthesized
gccaacccataactcttagcaa

SEQ ID NO: 811882 - DNA, 22 bp, Artificial Sequence
  chemically synthesized
ctaagagttatgggttggccag

SEQ ID NO: 811883 - DNA, 22 bp, Artificial Sequence
  chemically synthesized
atgtagagtaaccctggccaac

SEQ ID NO: 811884 - DNA, 22 bp, Artificial Sequence
  chemically synthesized
agagttatgggttggccagggt

SEQ ID NO: 811885 - DNA, 22 bp, Artificial Sequence
  chemically synthesized
tcatgtagagtaaccctggcca

SEQ ID NO: 811886 - DNA, 22 bp, Artificial Sequence
  chemically synthesized
ctcatgtagagtaaccctggcc

SEQ ID NO: 811887 - DNA, 22 bp, Artificial Sequence
  chemically synthesized
tgggttggccagggttactcta

SEQ ID NO: 811888 - DNA, 22 bp, Artificial Sequence
  chemically synthesized
gccagggttactctacatgaga

SEQ ID NO: 811889 - DNA, 22 bp, Artificial Sequence
  chemically synthesized
ctctacatgagaagtgtatggg

SEQ ID NO: 811890 - DNA, 22 bp, Artificial Sequence
  chemically synthesized
tacatgagaagtgtatgggggt

SEQ ID NO: 811891 - DNA, 22 bp, Artificial Sequence
  chemically synthesized
catgagaagtgtatgggggttt

SEQ ID NO: 811892 - DNA, 22 bp, Artificial Sequence
  chemically synthesized
gtgtgtgtgagtaaacccccat

SEQ ID NO: 811893 - DNA, 22 bp, Artificial Sequence
  chemically synthesized
ggtgtgtgtgagtaaaccccca

SEQ ID NO: 811894 - DNA, 22 bp, Artificial Sequence
  chemically synthesized
actcacacacaccaagtgcttg

SEQ ID NO: 811895 - DNA, 22 bp, Artificial Sequence
  chemically synthesized
cagaagcccagccaagcacttg

SEQ ID NO: 811896 - DNA, 22 bp, Artificial Sequence
  chemically synthesized
ctcacacacaccaagtgcttgg

SEQ ID NO: 811897 - DNA, 22 bp, Artificial Sequence
  chemically synthesized
acacacaccaagtgcttggctg

SEQ ID NO: 811898 - DNA, 22 bp, Artificial Sequence
  chemically synthesized
acaggtaggcaattccagaagc

SEQ ID NO: 811899 - DNA, 22 bp, Artificial Sequence
  chemically synthesized
tcctgacaggtaggcaattcca

SEQ ID NO: 811900 - DNA, 22 bp, Artificial Sequence
  chemically synthesized
ggctgggcttctggaattgcct

SEQ ID NO: 811901 - DNA, 22 bp, Artificial Sequence
  chemically synthesized
atcctgacaggtaggcaattcc

SEQ ID NO: 811902 - DNA, 22 bp, Artificial Sequence
  chemically synthesized
gctgggcttctggaattgccta

SEQ ID NO: 811903 - DNA, 22 bp, Artificial Sequence
  chemically synthesized
ggcttctggaattgcctacctg

SEQ ID NO: 811904 - DNA, 22 bp, Artificial Sequence
  chemically synthesized
ctggaattgcctacctgtcagg

SEQ ID NO: 811905 - DNA, 22 bp, Artificial Sequence
  chemically synthesized
tggaattgcctacctgtcagga

SEQ ID NO: 811906 - DNA, 22 bp, Artificial Sequence
  chemically synthesized
gaattgcctacctgtcaggata

SEQ ID NO: 811907 - DNA, 22 bp, Artificial Sequence
  chemically synthesized
gtaacagtaaaacttatcctga

SEQ ID NO: 811908 - DNA, 22 bp, Artificial Sequence
  chemically synthesized
ctggtaacagtaaaacttatcc

SEQ ID NO: 811909 - DNA, 22 bp, Artificial Sequence
  chemically synthesized
cctacctgtcaggataagtttt

SEQ ID NO: 811910 - DNA, 22 bp, Artificial Sequence
  chemically synthesized
ctgctggtaacagtaaaactta

SEQ ID NO: 811911 - DNA, 22 bp, Artificial Sequence
  chemically synthesized
cctgtcaggataagttttactg

SEQ ID NO: 811912 - DNA, 22 bp, Artificial Sequence
  chemically synthesized
ggttgctgctggtaacagtaaa

SEQ ID NO: 811913 - DNA, 22 bp, Artificial Sequence
  chemically synthesized
tcaggataagttttactgttac

SEQ ID NO: 811914 - DNA, 22 bp, Artificial Sequence
  chemically synthesized
ctaggttgctgctggtaacagt

SEQ ID NO: 811915 - DNA, 22 bp, Artificial Sequence
  chemically synthesized
gttgctaggttgctgctggtaa

SEQ ID NO: 811916 - DNA, 22 bp, Artificial Sequence
  chemically synthesized
gcctagttgctaggttgctgct

SEQ ID NO: 811917 - DNA, 22 bp, Artificial Sequence
  chemically synthesized
agcctagttgctaggttgctgc

SEQ ID NO: 811918 - DNA, 22 bp, Artificial Sequence
  chemically synthesized
tactgttaccagcagcaaccta

SEQ ID NO: 811919 - DNA, 22 bp, Artificial Sequence
  chemically synthesized
tagcctagttgctaggttgctg

SEQ ID NO: 811920 - DNA, 22 bp, Artificial Sequence
  chemically synthesized
actgttaccagcagcaacctag

SEQ ID NO: 811921 - DNA, 22 bp, Artificial Sequence
  chemically synthesized
ttagcctagttgctaggttgct

SEQ ID NO: 811922 - DNA, 22 bp, Artificial Sequence
  chemically synthesized
ctgttaccagcagcaacctagc

SEQ ID NO: 811923 - DNA, 22 bp, Artificial Sequence
  chemically synthesized
cttttagcctagttgctaggtt

SEQ ID NO: 811924 - DNA, 22 bp, Artificial Sequence
  chemically synthesized
ttaccagcagcaacctagcaac

SEQ ID NO: 811925 - DNA, 22 bp, Artificial Sequence
  chemically synthesized
ccagcagcaacctagcaactag

SEQ ID NO: 811926 - DNA, 22 bp, Artificial Sequence
  chemically synthesized
gtgattacttttagcctagttg

SEQ ID NO: 811927 - DNA, 22 bp, Artificial Sequence
  chemically synthesized
gcaactaggctaaaagtaatca

SEQ ID NO: 811928 - DNA, 22 bp, Artificial Sequence
  chemically synthesized
taaaccacaccacgctagtgat

SEQ ID NO: 811929 - DNA, 22 bp, Artificial Sequence
  chemically synthesized
ggctaaaagtaatcactagcgt

SEQ ID NO: 811930 - DNA, 22 bp, Artificial Sequence
  chemically synthesized
aaagtaatcactagcgtggtgt

SEQ ID NO: 811931 - DNA, 22 bp, Artificial Sequence
  chemically synthesized
ccacacaaaacctataaaccac

SEQ ID NO: 811932 - DNA, 22 bp, Artificial Sequence
  chemically synthesized
cccacacaaaacctataaacca

SEQ ID NO: 811933 - DNA, 22 bp, Artificial Sequence
  chemically synthesized
tcccacacaaaacctataaacc

SEQ ID NO: 811934 - DNA, 22 bp, Artificial Sequence
  chemically synthesized
ttcccacacaaaacctataaac

SEQ ID NO: 811935 - DNA, 22 bp, Artificial Sequence
  chemically synthesized
tttcccacacaaaacctataaa

SEQ ID NO: 811936 - DNA, 22 bp, Artificial Sequence
  chemically synthesized
gcgtggtgtggtttataggttt

SEQ ID NO: 811937 - DNA, 22 bp, Artificial Sequence
  chemically synthesized
ttttcccacacaaaacctataa

SEQ ID NO: 811938 - DNA, 22 bp, Artificial Sequence
  chemically synthesized
aggatttttttcccacacaaaa

SEQ ID NO: 811939 - DNA, 22 bp, Artificial Sequence
  chemically synthesized
gaggatttttttcccacacaaa

SEQ ID NO: 811940 - DNA, 22 bp, Artificial Sequence
  chemically synthesized
tgaggatttttttcccacacaa

SEQ ID NO: 811941 - DNA, 22 bp, Artificial Sequence
  chemically synthesized
ataggttttgtgtgggaaaaaa

SEQ ID NO: 811942 - DNA, 22 bp, Artificial Sequence
  chemically synthesized
taggttttgtgtgggaaaaaaa

SEQ ID NO: 811943 - DNA, 22 bp, Artificial Sequence
  chemically synthesized
ataattttgaggatttttttcc

SEQ ID NO: 811944 - DNA, 22 bp, Artificial Sequence
  chemically synthesized
tgtgtgggaaaaaaatcctcaa

SEQ ID NO: 811945 - DNA, 22 bp, Artificial Sequence
  chemically synthesized
gtgtgggaaaaaaatcctcaaa

SEQ ID NO: 811946 - DNA, 22 bp, Artificial Sequence
  chemically synthesized
tgtgggaaaaaaatcctcaaaa

SEQ ID NO: 811947 - DNA, 22 bp, Artificial Sequence
  chemically synthesized
atagaatggaagtaactcataa

SEQ ID NO: 811948 - DNA, 22 bp, Artificial Sequence
  chemically synthesized
taatagaatggaagtaactcat

SEQ ID NO: 811949 - DNA, 22 bp, Artificial Sequence
  chemically synthesized
aaaattatgagttacttccatt

SEQ ID NO: 811950 - DNA, 22 bp, Artificial Sequence
  chemically synthesized
atcaacattctaatagaatgga

SEQ ID NO: 811951 - DNA, 22 bp, Artificial Sequence
  chemically synthesized
catcaacattctaatagaatgg

SEQ ID NO: 811952 - DNA, 22 bp, Artificial Sequence
  chemically synthesized
tgagttacttccattctattag

SEQ ID NO: 811953 - DNA, 22 bp, Artificial Sequence
  chemically synthesized
tcttcatcaacattctaataga

SEQ ID NO: 811954 - DNA, 22 bp, Artificial Sequence
  chemically synthesized
tgtcttcatcaacattctaata

SEQ ID NO: 811955 - DNA, 22 bp, Artificial Sequence
  chemically synthesized
cttccattctattagaatgttg

SEQ ID NO: 811956 - DNA, 22 bp, Artificial Sequence
  chemically synthesized
ccattctattagaatgttgatg

SEQ ID NO: 811957 - DNA, 22 bp, Artificial Sequence
  chemically synthesized
acactctgtcttcatcaacatt

SEQ ID NO: 811958 - DNA, 22 bp, Artificial Sequence
  chemically synthesized
cattctattagaatgttgatga

SEQ ID NO: 811959 - DNA, 22 bp, Artificial Sequence
  chemically synthesized
gacactctgtcttcatcaacat

SEQ ID NO: 811960 - DNA, 22 bp, Artificial Sequence
  chemically synthesized
cttgacactctgtcttcatcaa

SEQ ID NO: 811961 - DNA, 22 bp, Artificial Sequence
  chemically synthesized
tattagaatgttgatgaagaca

SEQ ID NO: 811962 - DNA, 22 bp, Artificial Sequence
  chemically synthesized
ttagaatgttgatgaagacaga

SEQ ID NO: 811963 - DNA, 22 bp, Artificial Sequence
  chemically synthesized
accctccttgacactctgtctt

SEQ ID NO: 811964 - DNA, 22 bp, Artificial Sequence
  chemically synthesized
gaatgttgatgaagacagagtg

SEQ ID NO: 811965 - DNA, 22 bp, Artificial Sequence
  chemically synthesized
atgaagacagagtgtcaaggag

SEQ ID NO: 811966 - DNA, 22 bp, Artificial Sequence
  chemically synthesized
aaacaaatgccattaaccctcc

SEQ ID NO: 811967 - DNA, 22 bp, Artificial Sequence
  chemically synthesized
cctgaaacaaatgccattaacc

SEQ ID NO: 811968 - DNA, 22 bp, Artificial Sequence
  chemically synthesized
ccctgaaacaaatgccattaac

SEQ ID NO: 811969 - DNA, 22 bp, Artificial Sequence
  chemically synthesized
tccctgaaacaaatgccattaa

SEQ ID NO: 811970 - DNA, 22 bp, Artificial Sequence
  chemically synthesized
ttccctgaaacaaatgccatta

SEQ ID NO: 811971 - DNA, 22 bp, Artificial Sequence
  chemically synthesized
ttttccctgaaacaaatgccat

SEQ ID NO: 811972 - DNA, 22 bp, Artificial Sequence
  chemically synthesized
cttttccctgaaacaaatgcca

SEQ ID NO: 811973 - DNA, 22 bp, Artificial Sequence
  chemically synthesized
tcttttccctgaaacaaatgcc

SEQ ID NO: 811974 - DNA, 22 bp, Artificial Sequence
  chemically synthesized
ttcttttccctgaaacaaatgc

SEQ ID NO: 811975 - DNA, 22 bp, Artificial Sequence
  chemically synthesized
atggcatttgtttcagggaaaa

SEQ ID NO: 811976 - DNA, 22 bp, Artificial Sequence
  chemically synthesized
ataacgtttttcttttccctga

SEQ ID NO: 811977 - DNA, 22 bp, Artificial Sequence
  chemically synthesized
ctaataacgtttttcttttccc

SEQ ID NO: 811978 - DNA, 22 bp, Artificial Sequence
  chemically synthesized
gtttcagggaaaagaaaaacgt

SEQ ID NO: 811979 - DNA, 22 bp, Artificial Sequence
  chemically synthesized
tttcagggaaaagaaaaacgtt

SEQ ID NO: 811980 - DNA, 22 bp, Artificial Sequence
  chemically synthesized
ggatctgctaataacgtttttc

SEQ ID NO: 811981 - DNA, 22 bp, Artificial Sequence
  chemically synthesized
cagggaaaagaaaaacgttatt

SEQ ID NO: 811982 - DNA, 22 bp, Artificial Sequence
  chemically synthesized
ctgggatctgctaataacgttt

SEQ ID NO: 811983 - DNA, 22 bp, Artificial Sequence
  chemically synthesized
agggaaaagaaaaacgttatta

SEQ ID NO: 811984 - DNA, 22 bp, Artificial Sequence
  chemically synthesized
aaattgctgggatctgctaata

SEQ ID NO: 811985 - DNA, 22 bp, Artificial Sequence
  chemically synthesized
ttaaaattgctgggatctgcta

SEQ ID NO: 811986 - DNA, 22 bp, Artificial Sequence
  chemically synthesized
ttagcagatcccagcaatttta

SEQ ID NO: 811987 - DNA, 22 bp, Artificial Sequence
  chemically synthesized
gcagatcccagcaattttaata

SEQ ID NO: 811988 - DNA, 22 bp, Artificial Sequence
  chemically synthesized
taatagactctattgtctattg

SEQ ID NO: 811989 - DNA, 22 bp, Artificial Sequence
  chemically synthesized
aatagactctattgtctattgc

SEQ ID NO: 811990 - DNA, 22 bp, Artificial Sequence
  chemically synthesized
atagactctattgtctattgcc

SEQ ID NO: 811991 - DNA, 22 bp, Artificial Sequence
  chemically synthesized
tattgtctattgcctctattgt

SEQ ID NO: 811992 - DNA, 22 bp, Artificial Sequence
  chemically synthesized
ttgtctattgcctctattgttg

SEQ ID NO: 811993 - DNA, 22 bp, Artificial Sequence
  chemically synthesized
gcagatggcaatcaacaataga

SEQ ID NO: 811994 - DNA, 22 bp, Artificial Sequence
  chemically synthesized
agcagatggcaatcaacaatag

SEQ ID NO: 811995 - DNA, 22 bp, Artificial Sequence
  chemically synthesized
tagcagatggcaatcaacaata

SEQ ID NO: 811996 - DNA, 22 bp, Artificial Sequence
  chemically synthesized
tctattgcctctattgttgatt

SEQ ID NO: 811997 - DNA, 22 bp, Artificial Sequence
  chemically synthesized
ttttagcagatggcaatcaaca

SEQ ID NO: 811998 - DNA, 22 bp, Artificial Sequence
  chemically synthesized
ttgcctctattgttgattgcca

SEQ ID NO: 811999 - DNA, 22 bp, Artificial Sequence
  chemically synthesized
tattttagcagatggcaatcaa

SEQ ID NO: 812000 - DNA, 22 bp, Artificial Sequence
  chemically synthesized
cctctattgttgattgccatct

SEQ ID NO: 812001 - DNA, 22 bp, Artificial Sequence
  chemically synthesized
tattgttgattgccatctgcta

SEQ ID NO: 812002 - DNA, 22 bp, Artificial Sequence
  chemically synthesized
ttgttgattgccatctgctaaa

SEQ ID NO: 812003 - DNA, 22 bp, Artificial Sequence
  chemically synthesized
ataaagtctctattttagcaga

SEQ ID NO: 812004 - DNA, 22 bp, Artificial Sequence
  chemically synthesized
aataaagtctctattttagcag

SEQ ID NO: 812005 - DNA, 22 bp, Artificial Sequence
  chemically synthesized
ttgattgccatctgctaaaata

SEQ ID NO: 812006 - DNA, 22 bp, Artificial Sequence
  chemically synthesized
attgccatctgctaaaatagag

SEQ ID NO: 812007 - DNA, 22 bp, Artificial Sequence
  chemically synthesized
tacttaataaagtctctatttt

SEQ ID NO: 812008 - DNA, 22 bp, Artificial Sequence
  chemically synthesized
ccatctgctaaaatagagactt

SEQ ID NO: 812009 - DNA, 22 bp, Artificial Sequence
  chemically synthesized
ctaaaatagagactttattaag

SEQ ID NO: 812010 - DNA, 22 bp, Artificial Sequence
  chemically synthesized
aaatagagactttattaagtat

SEQ ID NO: 812011 - DNA, 22 bp, Artificial Sequence
  chemically synthesized
agtaaaagaagctatacttaat

SEQ ID NO: 812012 - DNA, 22 bp, Artificial Sequence
  chemically synthesized
cagtaaaagaagctatacttaa

SEQ ID NO: 812013 - DNA, 22 bp, Artificial Sequence
  chemically synthesized
tattaagtatagcttcttttac

SEQ ID NO: 812014 - DNA, 22 bp, Artificial Sequence
  chemically synthesized
attaagtatagcttcttttact

SEQ ID NO: 812015 - DNA, 22 bp, Artificial Sequence
  chemically synthesized
ttaagtatagcttcttttactg

SEQ ID NO: 812016 - DNA, 22 bp, Artificial Sequence
  chemically synthesized
agtatagcttcttttactgaag

SEQ ID NO: 812017 - DNA, 22 bp, Artificial Sequence
  chemically synthesized
cttttactgaagatatccctga

SEQ ID NO: 812018 - DNA, 22 bp, Artificial Sequence
  chemically synthesized
ttttactgaagatatccctgat

SEQ ID NO: 812019 - DNA, 22 bp, Artificial Sequence
  chemically synthesized
ttactgaagatatccctgatta

SEQ ID NO: 812020 - DNA, 22 bp, Artificial Sequence
  chemically synthesized
tactgaagatatccctgattac

SEQ ID NO: 812021 - DNA, 22 bp, Artificial Sequence
  chemically synthesized
actgaagatatccctgattact

SEQ ID NO: 812022 - DNA, 22 bp, Artificial Sequence
  chemically synthesized
gaaatccaccgaagtaatcagg

SEQ ID NO: 812023 - DNA, 22 bp, Artificial Sequence
  chemically synthesized
ctgaagatatccctgattactt

SEQ ID NO: 812024 - DNA, 22 bp, Artificial Sequence
  chemically synthesized
agaaatccaccgaagtaatcag

SEQ ID NO: 812025 - DNA, 22 bp, Artificial Sequence
  chemically synthesized
tagaaatccaccgaagtaatca

SEQ ID NO: 812026 - DNA, 22 bp, Artificial Sequence
  chemically synthesized
ttagaaatccaccgaagtaatc

SEQ ID NO: 812027 - DNA, 22 bp, Artificial Sequence
  chemically synthesized
aagatatccctgattacttcgg

SEQ ID NO: 812028 - DNA, 22 bp, Artificial Sequence
  chemically synthesized
tttagaaatccaccgaagtaat

SEQ ID NO: 812029 - DNA, 22 bp, Artificial Sequence
  chemically synthesized
attacttcggtggatttctaaa

SEQ ID NO: 812030 - DNA, 22 bp, Artificial Sequence
  chemically synthesized
cttcggtggatttctaaaaaat

SEQ ID NO: 812031 - DNA, 22 bp, Artificial Sequence
  chemically synthesized
cggtggatttctaaaaaatttc

SEQ ID NO: 812032 - DNA, 22 bp, Artificial Sequence
  chemically synthesized
ggtggatttctaaaaaatttct

SEQ ID NO: 812033 - DNA, 22 bp, Artificial Sequence
  chemically synthesized
ccacaaggaggatggaggagaa

SEQ ID NO: 812034 - DNA, 22 bp, Artificial Sequence
  chemically synthesized
cccacaaggaggatggaggaga

SEQ ID NO: 812035 - DNA, 22 bp, Artificial Sequence
  chemically synthesized
ctaaaaaatttctcctccatcc

SEQ ID NO: 812036 - DNA, 22 bp, Artificial Sequence
  chemically synthesized
taaaaaatttctcctccatcct

SEQ ID NO: 812037 - DNA, 22 bp, Artificial Sequence
  chemically synthesized
aaaaatttctcctccatcctcc

SEQ ID NO: 812038 - DNA, 22 bp, Artificial Sequence
  chemically synthesized
agacttcccacaaggaggatgg

SEQ ID NO: 812039 - DNA, 22 bp, Artificial Sequence
  chemically synthesized
ctgagacttcccacaaggagga

SEQ ID NO: 812040 - DNA, 22 bp, Artificial Sequence
  chemically synthesized
cctgagacttcccacaaggagg

SEQ ID NO: 812041 - DNA, 22 bp, Artificial Sequence
  chemically synthesized
tcctgagacttcccacaaggag

SEQ ID NO: 812042 - DNA, 22 bp, Artificial Sequence
  chemically synthesized
ttcctgagacttcccacaagga

SEQ ID NO: 812043 - DNA, 22 bp, Artificial Sequence
  chemically synthesized
ctcctccatcctccttgtggga

SEQ ID NO: 812044 - DNA, 22 bp, Artificial Sequence
  chemically synthesized
tttcctgagacttcccacaagg

SEQ ID NO: 812045 - DNA, 22 bp, Artificial Sequence
  chemically synthesized
tcctccatcctccttgtgggaa

SEQ ID NO: 812046 - DNA, 22 bp, Artificial Sequence
  chemically synthesized
ttttcctgagacttcccacaag

SEQ ID NO: 812047 - DNA, 22 bp, Artificial Sequence
  chemically synthesized
tttttcctgagacttcccacaa

SEQ ID NO: 812048 - DNA, 22 bp, Artificial Sequence
  chemically synthesized
ctccatcctccttgtgggaagt

SEQ ID NO: 812049 - DNA, 22 bp, Artificial Sequence
  chemically synthesized
ttttttcctgagacttcccaca

SEQ ID NO: 812050 - DNA, 22 bp, Artificial Sequence
  chemically synthesized
tttttttcctgagacttcccac

SEQ ID NO: 812051 - DNA, 22 bp, Artificial Sequence
  chemically synthesized
catcctccttgtgggaagtctc

SEQ ID NO: 812052 - DNA, 22 bp, Artificial Sequence
  chemically synthesized
aatctttttttttcctgagact

SEQ ID NO: 812053 - DNA, 22 bp, Artificial Sequence
  chemically synthesized
cttgtgggaagtctcaggaaaa

SEQ ID NO: 812054 - DNA, 22 bp, Artificial Sequence
  chemically synthesized
gtgggaagtctcaggaaaaaaa

SEQ ID NO: 812055 - DNA, 22 bp, Artificial Sequence
  chemically synthesized
tgggaagtctcaggaaaaaaaa

SEQ ID NO: 812056 - DNA, 22 bp, Artificial Sequence
  chemically synthesized
aatcatattgaatctttttttt

SEQ ID NO: 812057 - DNA, 22 bp, Artificial Sequence
  chemically synthesized
gaatcatattgaatcttttttt

SEQ ID NO: 812058 - DNA, 22 bp, Artificial Sequence
  chemically synthesized
tttgaatcatattgaatctttt

SEQ ID NO: 812059 - DNA, 22 bp, Artificial Sequence
  chemically synthesized
aggaaaaaaaaagattcaatat

SEQ ID NO: 812060 - DNA, 22 bp, Artificial Sequence
  chemically synthesized
gcagagcctatttgaatcatat

SEQ ID NO: 812061 - DNA, 22 bp, Artificial Sequence
  chemically synthesized
tggcagagcctatttgaatcat

SEQ ID NO: 812062 - DNA, 22 bp, Artificial Sequence
  chemically synthesized
tctggcagagcctatttgaatc

SEQ ID NO: 812063 - DNA, 22 bp, Artificial Sequence
  chemically synthesized
attctctggcagagcctatttg

SEQ ID NO: 812064 - DNA, 22 bp, Artificial Sequence
  chemically synthesized
aatatgattcaaataggctctg

SEQ ID NO: 812065 - DNA, 22 bp, Artificial Sequence
  chemically synthesized
aaataggctctgccagagaatc

SEQ ID NO: 812066 - DNA, 22 bp, Artificial Sequence
  chemically synthesized
tgccagagaatcaatctctatc

SEQ ID NO: 812067 - DNA, 22 bp, Artificial Sequence
  chemically synthesized
gagacagagagaggatagagat

SEQ ID NO: 812068 - DNA, 22 bp, Artificial Sequence
  chemically synthesized
ccagagaatcaatctctatcct

SEQ ID NO: 812069 - DNA, 22 bp, Artificial Sequence
  chemically synthesized
gctagagacagagagaggatag

SEQ ID NO: 812070 - DNA, 22 bp, Artificial Sequence
  chemically synthesized
gctagctagagacagagagagg

SEQ ID NO: 812071 - DNA, 22 bp, Artificial Sequence
  chemically synthesized
gctagctagctagagacagaga

SEQ ID NO: 812072 - DNA, 22 bp, Artificial Sequence
  chemically synthesized
attagctagctagctagagaca

SEQ ID NO: 812073 - DNA, 22 bp, Artificial Sequence
  chemically synthesized
tatcctctctctgtctctagct

SEQ ID NO: 812074 - DNA, 22 bp, Artificial Sequence
  chemically synthesized
tcctctctctgtctctagctag

SEQ ID NO: 812075 - DNA, 22 bp, Artificial Sequence
  chemically synthesized
attaattagctagctagctaga

SEQ ID NO: 812076 - DNA, 22 bp, Artificial Sequence
  chemically synthesized
tctctgtctctagctagctagc

SEQ ID NO: 812077 - DNA, 22 bp, Artificial Sequence
  chemically synthesized
tctgtctctagctagctagcta

SEQ ID NO: 812078 - DNA, 22 bp, Artificial Sequence
  chemically synthesized
tgtctctagctagctagctaat

SEQ ID NO: 812079 - DNA, 22 bp, Artificial Sequence
  chemically synthesized
ggaatattgattaattagctag

SEQ ID NO: 812080 - DNA, 22 bp, Artificial Sequence
  chemically synthesized
tctctagctagctagctaatta

SEQ ID NO: 812081 - DNA, 22 bp, Artificial Sequence
  chemically synthesized
tgggaatattgattaattagct

SEQ ID NO: 812082 - DNA, 22 bp, Artificial Sequence
  chemically synthesized
ctgggaatattgattaattagc

SEQ ID NO: 812083 - DNA, 22 bp, Artificial Sequence
  chemically synthesized
tctgggaatattgattaattag

SEQ ID NO: 812084 - DNA, 22 bp, Artificial Sequence
  chemically synthesized
tagctagctagctaattaatca

SEQ ID NO: 812085 - DNA, 22 bp, Artificial Sequence
  chemically synthesized
ttctgggaatattgattaatta

SEQ ID NO: 812086 - DNA, 22 bp, Artificial Sequence
  chemically synthesized
tttctgggaatattgattaatt

SEQ ID NO: 812087 - DNA, 22 bp, Artificial Sequence
  chemically synthesized
gctagctagctaattaatcaat

SEQ ID NO: 812088 - DNA, 22 bp, Artificial Sequence
  chemically synthesized
ttttctgggaatattgattaat

SEQ ID NO: 812089 - DNA, 22 bp, Artificial Sequence
  chemically synthesized
gctagctaattaatcaatattc

SEQ ID NO: 812090 - DNA, 22 bp, Artificial Sequence
  chemically synthesized
aggacttttttctgggaatatt

SEQ ID NO: 812091 - DNA, 22 bp, Artificial Sequence
  chemically synthesized
gctaattaatcaatattcccag

SEQ ID NO: 812092 - DNA, 22 bp, Artificial Sequence
  chemically synthesized
aaggacttttttctgggaatat

SEQ ID NO: 812093 - DNA, 22 bp, Artificial Sequence
  chemically synthesized
attaatcaatattcccagaaaa

SEQ ID NO: 812094 - DNA, 22 bp, Artificial Sequence
  chemically synthesized
atcaatattcccagaaaaaagt

SEQ ID NO: 812095 - DNA, 22 bp, Artificial Sequence
  chemically synthesized
gtagaagtttaaggactttttt

SEQ ID NO: 812096 - DNA, 22 bp, Artificial Sequence
  chemically synthesized
tggtagaagtttaaggactttt

SEQ ID NO: 812097 - DNA, 22 bp, Artificial Sequence
  chemically synthesized
ccagaaaaaagtccttaaactt

SEQ ID NO: 812098 - DNA, 22 bp, Artificial Sequence
  chemically synthesized
atattctggtagaagtttaagg

SEQ ID NO: 812099 - DNA, 22 bp, Artificial Sequence
  chemically synthesized
cctcatattctggtagaagttt

SEQ ID NO: 812100 - DNA, 22 bp, Artificial Sequence
  chemically synthesized
acctcatattctggtagaagtt

SEQ ID NO: 812101 - DNA, 22 bp, Artificial Sequence
  chemically synthesized
ttacctcatattctggtagaag

SEQ ID NO: 812102 - DNA, 22 bp, Artificial Sequence
  chemically synthesized
ttcttacctcatattctggtag

SEQ ID NO: 812103 - DNA, 22 bp, Artificial Sequence
  chemically synthesized
ttattcttacctcatattctgg

SEQ ID NO: 812104 - DNA, 22 bp, Artificial Sequence
  chemically synthesized
aaacttctaccagaatatgagg

SEQ ID NO: 812105 - DNA, 22 bp, Artificial Sequence
  chemically synthesized
aacttctaccagaatatgaggt

SEQ ID NO: 812106 - DNA, 22 bp, Artificial Sequence
  chemically synthesized
caaggctgttattcttacctca

SEQ ID NO: 812107 - DNA, 22 bp, Artificial Sequence
  chemically synthesized
ctaccagaatatgaggtaagaa

SEQ ID NO: 812108 - DNA, 22 bp, Artificial Sequence
  chemically synthesized
taccagaatatgaggtaagaat

SEQ ID NO: 812109 - DNA, 22 bp, Artificial Sequence
  chemically synthesized
ctccaaggctgttattcttacc

SEQ ID NO: 812110 - DNA, 22 bp, Artificial Sequence
  chemically synthesized
ccagaatatgaggtaagaataa

SEQ ID NO: 812111 - DNA, 22 bp, Artificial Sequence
  chemically synthesized
tgactcctccaaggctgttatt

SEQ ID NO: 812112 - DNA, 22 bp, Artificial Sequence
  chemically synthesized
tatgactcctccaaggctgtta

SEQ ID NO: 812113 - DNA, 22 bp, Artificial Sequence
  chemically synthesized
ctatgactcctccaaggctgtt

SEQ ID NO: 812114 - DNA, 22 bp, Artificial Sequence
  chemically synthesized
tctatgactcctccaaggctgt

SEQ ID NO: 812115 - DNA, 22 bp, Artificial Sequence
  chemically synthesized
ttctatgactcctccaaggctg

SEQ ID NO: 812116 - DNA, 22 bp, Artificial Sequence
  chemically synthesized
tttctatgactcctccaaggct

SEQ ID NO: 812117 - DNA, 22 bp, Artificial Sequence
  chemically synthesized
ttttctatgactcctccaaggc

SEQ ID NO: 812118 - DNA, 22 bp, Artificial Sequence
  chemically synthesized
agacatttttttctatgactcc

SEQ ID NO: 812119 - DNA, 22 bp, Artificial Sequence
  chemically synthesized
ttcagacatttttttctatgac

SEQ ID NO: 812120 - DNA, 22 bp, Artificial Sequence
  chemically synthesized
tattcagacatttttttctatg

SEQ ID NO: 812121 - DNA, 22 bp, Artificial Sequence
  chemically synthesized
ggaggagtcatagaaaaaaatg

SEQ ID NO: 812122 - DNA, 22 bp, Artificial Sequence
  chemically synthesized
actctattcagacatttttttc

SEQ ID NO: 812123 - DNA, 22 bp, Artificial Sequence
  chemically synthesized
gaggagtcatagaaaaaaatgt

SEQ ID NO: 812124 - DNA, 22 bp, Artificial Sequence
  chemically synthesized
gactctattcagacattttttt

SEQ ID NO: 812125 - DNA, 22 bp, Artificial Sequence
  chemically synthesized
tgactctattcagacatttttt

SEQ ID NO: 812126 - DNA, 22 bp, Artificial Sequence
  chemically synthesized
cgtgaattttgactctattcag

SEQ ID NO: 812127 - DNA, 22 bp, Artificial Sequence
  chemically synthesized
tgttacgtgaattttgactcta

SEQ ID NO: 812128 - DNA, 22 bp, Artificial Sequence
  chemically synthesized
gtgttacgtgaattttgactct

SEQ ID NO: 812129 - DNA, 22 bp, Artificial Sequence
  chemically synthesized
aatagagtcaaaattcacgtaa

SEQ ID NO: 812130 - DNA, 22 bp, Artificial Sequence
  chemically synthesized
accaagggaatttgtgttacgt

SEQ ID NO: 812131 - DNA, 22 bp, Artificial Sequence
  chemically synthesized
ccatgctaaccaagggaatttg

SEQ ID NO: 812132 - DNA, 22 bp, Artificial Sequence
  chemically synthesized
gccatgctaaccaagggaattt

SEQ ID NO: 812133 - DNA, 22 bp, Artificial Sequence
  chemically synthesized
acgtaacacaaattcccttggt

SEQ ID NO: 812134 - DNA, 22 bp, Artificial Sequence
  chemically synthesized
tacatttgccatgctaaccaag

SEQ ID NO: 812135 - DNA, 22 bp, Artificial Sequence
  chemically synthesized
ccttggttagcatggcaaatgt

SEQ ID NO: 812136 - DNA, 22 bp, Artificial Sequence
  chemically synthesized
ggttagcatggcaaatgtatag

SEQ ID NO: 812137 - DNA, 22 bp, Artificial Sequence
  chemically synthesized
gttagcatggcaaatgtatagg

SEQ ID NO: 812138 - DNA, 22 bp, Artificial Sequence
  chemically synthesized
acgtaggcataagcctatacat

SEQ ID NO: 812139 - DNA, 22 bp, Artificial Sequence
  chemically synthesized
cacgtaggcataagcctataca

SEQ ID NO: 812140 - DNA, 22 bp, Artificial Sequence
  chemically synthesized
gcatggcaaatgtataggctta

SEQ ID NO: 812141 - DNA, 22 bp, Artificial Sequence
  chemically synthesized
ttcacgtaggcataagcctata

SEQ ID NO: 812142 - DNA, 22 bp, Artificial Sequence
  chemically synthesized
aattcttcacgtaggcataagc

SEQ ID NO: 812143 - DNA, 22 bp, Artificial Sequence
  chemically synthesized
gctcaattcttcacgtaggcat

SEQ ID NO: 812144 - DNA, 22 bp, Artificial Sequence
  chemically synthesized
gtgccattagctcaattcttca

SEQ ID NO: 812145 - DNA, 22 bp, Artificial Sequence
  chemically synthesized
tagtgccattagctcaattctt

SEQ ID NO: 812146 - DNA, 22 bp, Artificial Sequence
  chemically synthesized
atgcctacgtgaagaattgagc

SEQ ID NO: 812147 - DNA, 22 bp, Artificial Sequence
  chemically synthesized
tgcctacgtgaagaattgagct

SEQ ID NO: 812148 - DNA, 22 bp, Artificial Sequence
  chemically synthesized
tctagtgccattagctcaattc

SEQ ID NO: 812149 - DNA, 22 bp, Artificial Sequence
  chemically synthesized
cgtgaagaattgagctaatggc

SEQ ID NO: 812150 - DNA, 22 bp, Artificial Sequence
  chemically synthesized
aatagtattctctagtgccatt

SEQ ID NO: 812151 - DNA, 22 bp, Artificial Sequence
  chemically synthesized
cctgaatagtattctctagtgc

SEQ ID NO: 812152 - DNA, 22 bp, Artificial Sequence
  chemically synthesized
agctaatggcactagagaatac

SEQ ID NO: 812153 - DNA, 22 bp, Artificial Sequence
  chemically synthesized
atggcactagagaatactattc

SEQ ID NO: 812154 - DNA, 22 bp, Artificial Sequence
  chemically synthesized
accgtgagttacctgaatagta

SEQ ID NO: 812155 - DNA, 22 bp, Artificial Sequence
  chemically synthesized
gagaatactattcaggtaactc

SEQ ID NO: 812156 - DNA, 22 bp, Artificial Sequence
  chemically synthesized
aagggaaatcatctcaccgtga

SEQ ID NO: 812157 - DNA, 22 bp, Artificial Sequence
  chemically synthesized
ttcaggtaactcacggtgagat

SEQ ID NO: 812158 - DNA, 22 bp, Artificial Sequence
  chemically synthesized
aggtaactcacggtgagatgat

SEQ ID NO: 812159 - DNA, 22 bp, Artificial Sequence
  chemically synthesized
acggtgagatgatttcccttca

SEQ ID NO: 812160 - DNA, 22 bp, Artificial Sequence
  chemically synthesized
cccttcagtggcctggcctata

SEQ ID NO: 812161 - DNA, 22 bp, Artificial Sequence
  chemically synthesized
ccttcagtggcctggcctatat

SEQ ID NO: 812162 - DNA, 22 bp, Artificial Sequence
  chemically synthesized
cagtggcctggcctatatgcta

SEQ ID NO: 812163 - DNA, 22 bp, Artificial Sequence
  chemically synthesized
agtggcctggcctatatgctat

SEQ ID NO: 812164 - DNA, 22 bp, Artificial Sequence
  chemically synthesized
taagatagatagcatagcatat

SEQ ID NO: 812165 - DNA, 22 bp, Artificial Sequence
  chemically synthesized
gtaagatagatagcatagcata

SEQ ID NO: 812166 - DNA, 22 bp, Artificial Sequence
  chemically synthesized
gcctatatgctatgctatctat

SEQ ID NO: 812167 - DNA, 22 bp, Artificial Sequence
  chemically synthesized
agtaagtgtttgtaagatagat

SEQ ID NO: 812168 - DNA, 22 bp, Artificial Sequence
  chemically synthesized
tatgctatgctatctatcttac

SEQ ID NO: 812169 - DNA, 22 bp, Artificial Sequence
  chemically synthesized
tgctatctatcttacaaacact

SEQ ID NO: 812170 - DNA, 22 bp, Artificial Sequence
  chemically synthesized
tctatcttacaaacacttactg

SEQ ID NO: 812171 - DNA, 22 bp, Artificial Sequence
  chemically synthesized
tcttacaaacacttactgagtg

SEQ ID NO: 812172 - DNA, 22 bp, Artificial Sequence
  chemically synthesized
tgcatagaacatgcactcagta

SEQ ID NO: 812173 - DNA, 22 bp, Artificial Sequence
  chemically synthesized
acaaacacttactgagtgcatg

SEQ ID NO: 812174 - DNA, 22 bp, Artificial Sequence
  chemically synthesized
caaacacttactgagtgcatgt

SEQ ID NO: 812175 - DNA, 22 bp, Artificial Sequence
  chemically synthesized
gtccaatactatgcatagaaca

SEQ ID NO: 812176 - DNA, 22 bp, Artificial Sequence
  chemically synthesized
actgagtgcatgttctatgcat

SEQ ID NO: 812177 - DNA, 22 bp, Artificial Sequence
  chemically synthesized
ctgagtgcatgttctatgcata

SEQ ID NO: 812178 - DNA, 22 bp, Artificial Sequence
  chemically synthesized
agtgcatgttctatgcatagta

SEQ ID NO: 812179 - DNA, 22 bp, Artificial Sequence
  chemically synthesized
cagtatctggtccaatactatg

SEQ ID NO: 812180 - DNA, 22 bp, Artificial Sequence
  chemically synthesized
tatgcatagtattggaccagat

SEQ ID NO: 812181 - DNA, 22 bp, Artificial Sequence
  chemically synthesized
tgcatagtattggaccagatac

SEQ ID NO: 812182 - DNA, 22 bp, Artificial Sequence
  chemically synthesized
tacaacactacagtatctggtc

SEQ ID NO: 812183 - DNA, 22 bp, Artificial Sequence
  chemically synthesized
atacaacactacagtatctggt

SEQ ID NO: 812184 - DNA, 22 bp, Artificial Sequence
  chemically synthesized
aagaatcttatacaacactaca

SEQ ID NO: 812185 - DNA, 22 bp, Artificial Sequence
  chemically synthesized
gaccagatactgtagtgttgta

SEQ ID NO: 812186 - DNA, 22 bp, Artificial Sequence
  chemically synthesized
tcaagaatcttatacaacacta

SEQ ID NO: 812187 - DNA, 22 bp, Artificial Sequence
  chemically synthesized
ctcaagaatcttatacaacact

SEQ ID NO: 812188 - DNA, 22 bp, Artificial Sequence
  chemically synthesized
tagtgttgtataagattcttga

SEQ ID NO: 812189 - DNA, 22 bp, Artificial Sequence
  chemically synthesized
accatgaaaacaatttctcaag

SEQ ID NO: 812190 - DNA, 22 bp, Artificial Sequence
  chemically synthesized
gaccatgaaaacaatttctcaa

SEQ ID NO: 812191 - DNA, 22 bp, Artificial Sequence
  chemically synthesized
tataagattcttgagaaattgt

SEQ ID NO: 812192 - DNA, 22 bp, Artificial Sequence
  chemically synthesized
aaagtttgaccatgaaaacaat

SEQ ID NO: 812193 - DNA, 22 bp, Artificial Sequence
  chemically synthesized
taaaagtttgaccatgaaaaca

SEQ ID NO: 812194 - DNA, 22 bp, Artificial Sequence
  chemically synthesized
ctaaaagtttgaccatgaaaac

SEQ ID NO: 812195 - DNA, 22 bp, Artificial Sequence
  chemically synthesized
ttgagaaattgttttcatggtc

SEQ ID NO: 812196 - DNA, 22 bp, Artificial Sequence
  chemically synthesized
gagaaattgttttcatggtcaa

SEQ ID NO: 812197 - DNA, 22 bp, Artificial Sequence
  chemically synthesized
agaaattgttttcatggtcaaa

SEQ ID NO: 812198 - DNA, 22 bp, Artificial Sequence
  chemically synthesized
ttttcatggtcaaacttttaga

SEQ ID NO: 812199 - DNA, 22 bp, Artificial Sequence
  chemically synthesized
tcatggtcaaacttttagaagg

SEQ ID NO: 812200 - DNA, 22 bp, Artificial Sequence
  chemically synthesized
catggtcaaacttttagaaggg

SEQ ID NO: 812201 - DNA, 22 bp, Artificial Sequence
  chemically synthesized
tacagtatgcatcccttctaaa

SEQ ID NO: 812202 - DNA, 22 bp, Artificial Sequence
  chemically synthesized
atggtcaaacttttagaaggga

SEQ ID NO: 812203 - DNA, 22 bp, Artificial Sequence
  chemically synthesized
ttagaagggatgcatactgtat

SEQ ID NO: 812204 - DNA, 22 bp, Artificial Sequence
  chemically synthesized
tagaagggatgcatactgtata

SEQ ID NO: 812205 - DNA, 22 bp, Artificial Sequence
  chemically synthesized
agaagggatgcatactgtatag

SEQ ID NO: 812206 - DNA, 22 bp, Artificial Sequence
  chemically synthesized
gaagggatgcatactgtataga

SEQ ID NO: 812207 - DNA, 22 bp, Artificial Sequence
  chemically synthesized
tgaaagtatggggggaagggat

SEQ ID NO: 812208 - DNA, 22 bp, Artificial Sequence
  chemically synthesized
atgaaagtatggggggaaggga

SEQ ID NO: 812209 - DNA, 22 bp, Artificial Sequence
  chemically synthesized
tatagattatcccttcccccca

SEQ ID NO: 812210 - DNA, 22 bp, Artificial Sequence
  chemically synthesized
tcccttccccccatactttcat

SEQ ID NO: 812211 - DNA, 22 bp, Artificial Sequence
  chemically synthesized
ccccccatactttcataaatac

SEQ ID NO: 812212 - DNA, 22 bp, Artificial Sequence
  chemically synthesized
cccccatactttcataaataca

SEQ ID NO: 812213 - DNA, 22 bp, Artificial Sequence
  chemically synthesized
gtgaatcaacaaagtatgtgta

SEQ ID NO: 812214 - DNA, 22 bp, Artificial Sequence
  chemically synthesized
ggtgaatcaacaaagtatgtgt

SEQ ID NO: 812215 - DNA, 22 bp, Artificial Sequence
  chemically synthesized
tcataaatacacatactttgtt

SEQ ID NO: 812216 - DNA, 22 bp, Artificial Sequence
  chemically synthesized
cataaatacacatactttgttg

SEQ ID NO: 812217 - DNA, 22 bp, Artificial Sequence
  chemically synthesized
ataaatacacatactttgttga

SEQ ID NO: 812218 - DNA, 22 bp, Artificial Sequence
  chemically synthesized
cagtgcatgcttggtgaatcaa

SEQ ID NO: 812219 - DNA, 22 bp, Artificial Sequence
  chemically synthesized
ttacagtgcatgcttggtgaat

SEQ ID NO: 812220 - DNA, 22 bp, Artificial Sequence
  chemically synthesized
attacagtgcatgcttggtgaa

SEQ ID NO: 812221 - DNA, 22 bp, Artificial Sequence
  chemically synthesized
tgttgattcaccaagcatgcac

SEQ ID NO: 812222 - DNA, 22 bp, Artificial Sequence
  chemically synthesized
gttgattcaccaagcatgcact

SEQ ID NO: 812223 - DNA, 22 bp, Artificial Sequence
  chemically synthesized
ttgattcaccaagcatgcactg

SEQ ID NO: 812224 - DNA, 22 bp, Artificial Sequence
  chemically synthesized
attcaccaagcatgcactgtaa

SEQ ID NO: 812225 - DNA, 22 bp, Artificial Sequence
  chemically synthesized
accaagcatgcactgtaataag

SEQ ID NO: 812226 - DNA, 22 bp, Artificial Sequence
  chemically synthesized
ccataggagtaatcagaccctt

SEQ ID NO: 812227 - DNA, 22 bp, Artificial Sequence
  chemically synthesized
cccataggagtaatcagaccct

SEQ ID NO: 812228 - DNA, 22 bp, Artificial Sequence
  chemically synthesized
tcccataggagtaatcagaccc

SEQ ID NO: 812229 - DNA, 22 bp, Artificial Sequence
  chemically synthesized
tttcccataggagtaatcagac

SEQ ID NO: 812230 - DNA, 22 bp, Artificial Sequence
  chemically synthesized
ctttcccataggagtaatcaga

SEQ ID NO: 812231 - DNA, 22 bp, Artificial Sequence
  chemically synthesized
taataagggtctgattactcct

SEQ ID NO: 812232 - DNA, 22 bp, Artificial Sequence
  chemically synthesized
attactcctatgggaaagaagt

SEQ ID NO: 812233 - DNA, 22 bp, Artificial Sequence
  chemically synthesized
aatcaaagcgaacagacttctt

SEQ ID NO: 812234 - DNA, 22 bp, Artificial Sequence
  chemically synthesized
ctcctatgggaaagaagtctgt

SEQ ID NO: 812235 - DNA, 22 bp, Artificial Sequence
  chemically synthesized
ctatgggaaagaagtctgttcg

SEQ ID NO: 812236 - DNA, 22 bp, Artificial Sequence
  chemically synthesized
tgggaaagaagtctgttcgctt

SEQ ID NO: 812237 - DNA, 22 bp, Artificial Sequence
  chemically synthesized
ggtaatatcaagttaaatcaaa

SEQ ID NO: 812238 - DNA, 22 bp, Artificial Sequence
  chemically synthesized
ttcgctttgatttaacttgata

SEQ ID NO: 812239 - DNA, 22 bp, Artificial Sequence
  chemically synthesized
gctttgatttaacttgatatta

SEQ ID NO: 812240 - DNA, 22 bp, Artificial Sequence
  chemically synthesized
tgatttaacttgatattaccta

SEQ ID NO: 812241 - DNA, 22 bp, Artificial Sequence
  chemically synthesized
gatttaacttgatattacctaa

SEQ ID NO: 812242 - DNA, 22 bp, Artificial Sequence
  chemically synthesized
atttaacttgatattacctaat

SEQ ID NO: 812243 - DNA, 22 bp, Artificial Sequence
  chemically synthesized
tggatgaaaaaatgattaggta

SEQ ID NO: 812244 - DNA, 22 bp, Artificial Sequence
  chemically synthesized
aacttgatattacctaatcatt

SEQ ID NO: 812245 - DNA, 22 bp, Artificial Sequence
  chemically synthesized
tatggatgaaaaaatgattagg

SEQ ID NO: 812246 - DNA, 22 bp, Artificial Sequence
  chemically synthesized
acttgatattacctaatcattt

SEQ ID NO: 812247 - DNA, 22 bp, Artificial Sequence
  chemically synthesized
gatattacctaatcattttttc

SEQ ID NO: 812248 - DNA, 22 bp, Artificial Sequence
  chemically synthesized
atattacctaatcattttttca

SEQ ID NO: 812249 - DNA, 22 bp, Artificial Sequence
  chemically synthesized
cctaatcattttttcatccata

SEQ ID NO: 812250 - DNA, 22 bp, Artificial Sequence
  chemically synthesized
aagaaagggttctatggatgaa

SEQ ID NO: 812251 - DNA, 22 bp, Artificial Sequence
  chemically synthesized
atcattttttcatccatagaac

SEQ ID NO: 812252 - DNA, 22 bp, Artificial Sequence
  chemically synthesized
tttcatccatagaaccctttct

SEQ ID NO: 812253 - DNA, 22 bp, Artificial Sequence
  chemically synthesized
ttcatccatagaaccctttctt

SEQ ID NO: 812254 - DNA, 22 bp, Artificial Sequence
  chemically synthesized
tcatccatagaaccctttcttg

SEQ ID NO: 812255 - DNA, 22 bp, Artificial Sequence
  chemically synthesized
catccatagaaccctttcttga

SEQ ID NO: 812256 - DNA, 22 bp, Artificial Sequence
  chemically synthesized
ataagtaataactcaagaaagg

SEQ ID NO: 812257 - DNA, 22 bp, Artificial Sequence
  chemically synthesized
atccatagaaccctttcttgag

SEQ ID NO: 812258 - DNA, 22 bp, Artificial Sequence
  chemically synthesized
aataagtaataactcaagaaag

SEQ ID NO: 812259 - DNA, 22 bp, Artificial Sequence
  chemically synthesized
tatcttaataagtaataactca

SEQ ID NO: 812260 - DNA, 22 bp, Artificial Sequence
  chemically synthesized
cactgtatcttaataagtaata

SEQ ID NO: 812261 - DNA, 22 bp, Artificial Sequence
  chemically synthesized
tcttgagttattacttattaag

SEQ ID NO: 812262 - DNA, 22 bp, Artificial Sequence
  chemically synthesized
gttccactgtatcttaataagt

SEQ ID NO: 812263 - DNA, 22 bp, Artificial Sequence
  chemically synthesized
cttgagttattacttattaaga

SEQ ID NO: 812264 - DNA, 22 bp, Artificial Sequence
  chemically synthesized
ttgagttattacttattaagat

SEQ ID NO: 812265 - DNA, 22 bp, Artificial Sequence
  chemically synthesized
gagttattacttattaagatac

SEQ ID NO: 812266 - DNA, 22 bp, Artificial Sequence
  chemically synthesized
agttattacttattaagataca

SEQ ID NO: 812267 - DNA, 22 bp, Artificial Sequence
  chemically synthesized
gcagaactagttccactgtatc

SEQ ID NO: 812268 - DNA, 22 bp, Artificial Sequence
  chemically synthesized
ttacttattaagatacagtgga

SEQ ID NO: 812269 - DNA, 22 bp, Artificial Sequence
  chemically synthesized
ggcagaactagttccactgtat

SEQ ID NO: 812270 - DNA, 22 bp, Artificial Sequence
  chemically synthesized
tggcagaactagttccactgta

SEQ ID NO: 812271 - DNA, 22 bp, Artificial Sequence
  chemically synthesized
cttattaagatacagtggaact

SEQ ID NO: 812272 - DNA, 22 bp, Artificial Sequence
  chemically synthesized
attaagatacagtggaactagt

SEQ ID NO: 812273 - DNA, 22 bp, Artificial Sequence
  chemically synthesized
ttaagatacagtggaactagtt

SEQ ID NO: 812274 - DNA, 22 bp, Artificial Sequence
  chemically synthesized
agatacagtggaactagttctg

SEQ ID NO: 812275 - DNA, 22 bp, Artificial Sequence
  chemically synthesized
caaatggggttttggcagaact

SEQ ID NO: 812276 - DNA, 22 bp, Artificial Sequence
  chemically synthesized
ccaaatggggttttggcagaac

SEQ ID NO: 812277 - DNA, 22 bp, Artificial Sequence
  chemically synthesized
tccaaatggggttttggcagaa

SEQ ID NO: 812278 - DNA, 22 bp, Artificial Sequence
  chemically synthesized
ttccaaatggggttttggcaga

SEQ ID NO: 812279 - DNA, 22 bp, Artificial Sequence
  chemically synthesized
tttccaaatggggttttggcag

SEQ ID NO: 812280 - DNA, 22 bp, Artificial Sequence
  chemically synthesized
tttttccaaatggggttttggc

SEQ ID NO: 812281 - DNA, 22 bp, Artificial Sequence
  chemically synthesized
ctttttccaaatggggttttgg

SEQ ID NO: 812282 - DNA, 22 bp, Artificial Sequence
  chemically synthesized
tctttttccaaatggggttttg

SEQ ID NO: 812283 - DNA, 22 bp, Artificial Sequence
  chemically synthesized
gttctgccaaaaccccatttgg

SEQ ID NO: 812284 - DNA, 22 bp, Artificial Sequence
  chemically synthesized
tgccaaaaccccatttggaaaa

SEQ ID NO: 812285 - DNA, 22 bp, Artificial Sequence
  chemically synthesized
ccaaaaccccatttggaaaaag

SEQ ID NO: 812286 - DNA, 22 bp, Artificial Sequence
  chemically synthesized
gagtgggagttttctttttcca

SEQ ID NO: 812287 - DNA, 22 bp, Artificial Sequence
  chemically synthesized
atcatctagagtgggagttttc

SEQ ID NO: 812288 - DNA, 22 bp, Artificial Sequence
  chemically synthesized
ggaaaaagaaaactcccactct

SEQ ID NO: 812289 - DNA, 22 bp, Artificial Sequence
  chemically synthesized
gaaaaagaaaactcccactcta

SEQ ID NO: 812290 - DNA, 22 bp, Artificial Sequence
  chemically synthesized
acatactcatcatctagagtgg

SEQ ID NO: 812291 - DNA, 22 bp, Artificial Sequence
  chemically synthesized
cacatactcatcatctagagtg

SEQ ID NO: 812292 - DNA, 22 bp, Artificial Sequence
  chemically synthesized
atcttcacatactcatcatcta

SEQ ID NO: 812293 - DNA, 22 bp, Artificial Sequence
  chemically synthesized
ccactctagatgatgagtatgt

SEQ ID NO: 812294 - DNA, 22 bp, Artificial Sequence
  chemically synthesized
tagatgatgagtatgtgaagat

SEQ ID NO: 812295 - DNA, 22 bp, Artificial Sequence
  chemically synthesized
gatgatgagtatgtgaagatca

SEQ ID NO: 812296 - DNA, 22 bp, Artificial Sequence
  chemically synthesized
tatggtataacatcctgatctt

SEQ ID NO: 812297 - DNA, 22 bp, Artificial Sequence
  chemically synthesized
gtggttgtatggtataacatcc

SEQ ID NO: 812298 - DNA, 22 bp, Artificial Sequence
  chemically synthesized
ggtggttgtatggtataacatc

SEQ ID NO: 812299 - DNA, 22 bp, Artificial Sequence
  chemically synthesized
gtgataccttggtggttgtatg

SEQ ID NO: 812300 - DNA, 22 bp, Artificial Sequence
  chemically synthesized
taccatacaaccaccaaggtat

SEQ ID NO: 812301 - DNA, 22 bp, Artificial Sequence
  chemically synthesized
aggaacaggttggtgatacctt

SEQ ID NO: 812302 - DNA, 22 bp, Artificial Sequence
  chemically synthesized
tagaagtattcaggaacaggtt

SEQ ID NO: 812303 - DNA, 22 bp, Artificial Sequence
  chemically synthesized
taaagttgtagaagtattcagg

SEQ ID NO: 812304 - DNA, 22 bp, Artificial Sequence
  chemically synthesized
gtaaagttgtagaagtattcag

SEQ ID NO: 812305 - DNA, 22 bp, Artificial Sequence
  chemically synthesized
ccttgtaaagttgtagaagtat

SEQ ID NO: 812306 - DNA, 22 bp, Artificial Sequence
  chemically synthesized
ttcctgaatacttctacaactt

SEQ ID NO: 812307 - DNA, 22 bp, Artificial Sequence
  chemically synthesized
ctgaatacttctacaactttac

SEQ ID NO: 812308 - DNA, 22 bp, Artificial Sequence
  chemically synthesized
aatacttctacaactttacaag

SEQ ID NO: 812309 - DNA, 22 bp, Artificial Sequence
  chemically synthesized
ctacaactttacaaggcagcct

SEQ ID NO: 812310 - DNA, 22 bp, Artificial Sequence
  chemically synthesized
tacaactttacaaggcagcctg

SEQ ID NO: 812311 - DNA, 22 bp, Artificial Sequence
  chemically synthesized
tccaaagatggaacaggctgcc

SEQ ID NO: 812312 - DNA, 22 bp, Artificial Sequence
  chemically synthesized
caactttacaaggcagcctgtt

SEQ ID NO: 812313 - DNA, 22 bp, Artificial Sequence
  chemically synthesized
tacaaggcagcctgttccatct

SEQ ID NO: 812314 - DNA, 22 bp, Artificial Sequence
  chemically synthesized
acaaggcagcctgttccatctt

SEQ ID NO: 812315 - DNA, 22 bp, Artificial Sequence
  chemically synthesized
taaagctgtccaaagatggaac

SEQ ID NO: 812316 - DNA, 22 bp, Artificial Sequence
  chemically synthesized
caaggcagcctgttccatcttt

SEQ ID NO: 812317 - DNA, 22 bp, Artificial Sequence
  chemically synthesized
ttataaagctgtccaaagatgg

SEQ ID NO: 812318 - DNA, 22 bp, Artificial Sequence
  chemically synthesized
ttccatctttggacagctttat

SEQ ID NO: 812319 - DNA, 22 bp, Artificial Sequence
  chemically synthesized
catctttggacagctttataac

SEQ ID NO: 812320 - DNA, 22 bp, Artificial Sequence
  chemically synthesized
atagagagaggaatattgttat

SEQ ID NO: 812321 - DNA, 22 bp, Artificial Sequence
  chemically synthesized
tggacagctttataacaatatt

SEQ ID NO: 812322 - DNA, 22 bp, Artificial Sequence
  chemically synthesized
aatagagagaggaatattgtta

SEQ ID NO: 812323 - DNA, 22 bp, Artificial Sequence
  chemically synthesized
ggacagctttataacaatattc

SEQ ID NO: 812324 - DNA, 22 bp, Artificial Sequence
  chemically synthesized
gacagctttataacaatattcc

SEQ ID NO: 812325 - DNA, 22 bp, Artificial Sequence
  chemically synthesized
agcttaatagagagaggaatat

SEQ ID NO: 812326 - DNA, 22 bp, Artificial Sequence
  chemically synthesized
cagcttaatagagagaggaata

SEQ ID NO: 812327 - DNA, 22 bp, Artificial Sequence
  chemically synthesized
tataacaatattcctctctcta

SEQ ID NO: 812328 - DNA, 22 bp, Artificial Sequence
  chemically synthesized
ataacaatattcctctctctat

SEQ ID NO: 812329 - DNA, 22 bp, Artificial Sequence
  chemically synthesized
taacaatattcctctctctatt

SEQ ID NO: 812330 - DNA, 22 bp, Artificial Sequence
  chemically synthesized
agaacgtatatttcagcttaat

SEQ ID NO: 812331 - DNA, 22 bp, Artificial Sequence
  chemically synthesized
ctctctctattaagctgaaata

SEQ ID NO: 812332 - DNA, 22 bp, Artificial Sequence
  chemically synthesized
gtcctaagaacgtatatttcag

SEQ ID NO: 812333 - DNA, 22 bp, Artificial Sequence
  chemically synthesized
tctctattaagctgaaatatac

SEQ ID NO: 812334 - DNA, 22 bp, Artificial Sequence
  chemically synthesized
tctattaagctgaaatatacgt

SEQ ID NO: 812335 - DNA, 22 bp, Artificial Sequence
  chemically synthesized
tattaagctgaaatatacgttc

SEQ ID NO: 812336 - DNA, 22 bp, Artificial Sequence
  chemically synthesized
ttaagctgaaatatacgttctt

SEQ ID NO: 812337 - DNA, 22 bp, Artificial Sequence
  chemically synthesized
agctgaaatatacgttcttagg

SEQ ID NO: 812338 - DNA, 22 bp, Artificial Sequence
  chemically synthesized
agcatataacctagtcctaaga

SEQ ID NO: 812339 - DNA, 22 bp, Artificial Sequence
  chemically synthesized
aagcatataacctagtcctaag

SEQ ID NO: 812340 - DNA, 22 bp, Artificial Sequence
  chemically synthesized
aaatatacgttcttaggactag

SEQ ID NO: 812341 - DNA, 22 bp, Artificial Sequence
  chemically synthesized
ttaggactaggttatatgctta

SEQ ID NO: 812342 - DNA, 22 bp, Artificial Sequence
  chemically synthesized
ggccgaataaatttaagcatat

SEQ ID NO: 812343 - DNA, 22 bp, Artificial Sequence
  chemically synthesized
aggactaggttatatgcttaaa

SEQ ID NO: 812344 - DNA, 22 bp, Artificial Sequence
  chemically synthesized
aggccgaataaatttaagcata

SEQ ID NO: 812345 - DNA, 22 bp, Artificial Sequence
  chemically synthesized
ggactaggttatatgcttaaat

SEQ ID NO: 812346 - DNA, 22 bp, Artificial Sequence
  chemically synthesized
ggttatatgcttaaatttattc

SEQ ID NO: 812347 - DNA, 22 bp, Artificial Sequence
  chemically synthesized
tatgcttaaatttattcggcct

SEQ ID NO: 812348 - DNA, 22 bp, Artificial Sequence
  chemically synthesized
aaatttattcggcctaagatcc

SEQ ID NO: 812349 - DNA, 22 bp, Artificial Sequence
  chemically synthesized
aatttattcggcctaagatccc

SEQ ID NO: 812350 - DNA, 22 bp, Artificial Sequence
  chemically synthesized
attcggcctaagatcccctttg

SEQ ID NO: 812351 - DNA, 22 bp, Artificial Sequence
  chemically synthesized
ttcggcctaagatcccctttgg

SEQ ID NO: 812352 - DNA, 22 bp, Artificial Sequence
  chemically synthesized
ggcctaagatcccctttggctt

SEQ ID NO: 812353 - DNA, 22 bp, Artificial Sequence
  chemically synthesized
agatcccctttggctttccttt

SEQ ID NO: 812354 - DNA, 22 bp, Artificial Sequence
  chemically synthesized
tggctttcctttcccactgttc

SEQ ID NO: 812355 - DNA, 22 bp, Artificial Sequence
  chemically synthesized
ggctttcctttcccactgttct

SEQ ID NO: 812356 - DNA, 22 bp, Artificial Sequence
  chemically synthesized
gctttcctttcccactgttcta

SEQ ID NO: 812357 - DNA, 22 bp, Artificial Sequence
  chemically synthesized
tcctttcccactgttctatcac

SEQ ID NO: 812358 - DNA, 22 bp, Artificial Sequence
  chemically synthesized
cctttcccactgttctatcaca

SEQ ID NO: 812359 - DNA, 22 bp, Artificial Sequence
  chemically synthesized
ctttcccactgttctatcacat

SEQ ID NO: 812360 - DNA, 22 bp, Artificial Sequence
  chemically synthesized
tcccactgttctatcacattgt

SEQ ID NO: 812361 - DNA, 22 bp, Artificial Sequence
  chemically synthesized
cccactgttctatcacattgtg

SEQ ID NO: 812362 - DNA, 22 bp, Artificial Sequence
  chemically synthesized
ccactgttctatcacattgtgt

SEQ ID NO: 812363 - DNA, 22 bp, Artificial Sequence
  chemically synthesized
ttctatcacattgtgtgttgtg

SEQ ID NO: 812364 - DNA, 22 bp, Artificial Sequence
  chemically synthesized
tatcacattgtgtgttgtgtgt

SEQ ID NO: 812365 - DNA, 22 bp, Artificial Sequence
  chemically synthesized
tcacattgtgtgttgtgtgttg

SEQ ID NO: 812366 - DNA, 22 bp, Artificial Sequence
  chemically synthesized
tgtgttgtgtgttgtgtgtgtg

SEQ ID NO: 812367 - DNA, 22 bp, Artificial Sequence
  chemically synthesized
cacacacacacacacacacaca

SEQ ID NO: 812368 - DNA, 22 bp, Artificial Sequence
  chemically synthesized
tgtgttgtgtgtgtgtgtgtgt

SEQ ID NO: 812369 - DNA, 22 bp, Artificial Sequence
  chemically synthesized
acacacacacacacacacacac

SEQ ID NO: 812370 - DNA, 22 bp, Artificial Sequence
  chemically synthesized
tacacacacacacacacacaca

SEQ ID NO: 812371 - DNA, 22 bp, Artificial Sequence
  chemically synthesized
tttacacacacacacacacaca

SEQ ID NO: 812372 - DNA, 22 bp, Artificial Sequence
  chemically synthesized
tctttacacacacacacacaca

SEQ ID NO: 812373 - DNA, 22 bp, Artificial Sequence
  chemically synthesized
tgtgtgtgtgtgtgtgtgtgtg

SEQ ID NO: 812374 - DNA, 22 bp, Artificial Sequence
  chemically synthesized
tctctttacacacacacacaca

SEQ ID NO: 812375 - DNA, 22 bp, Artificial Sequence
  chemically synthesized
ctctctttacacacacacacac

SEQ ID NO: 812376 - DNA, 22 bp, Artificial Sequence
  chemically synthesized
acttctctctttacacacacac

SEQ ID NO: 812377 - DNA, 22 bp, Artificial Sequence
  chemically synthesized
cacttctctctttacacacaca

SEQ ID NO: 812378 - DNA, 22 bp, Artificial Sequence
  chemically synthesized
tttcacttctctctttacacac

SEQ ID NO: 812379 - DNA, 22 bp, Artificial Sequence
  chemically synthesized
tgtttcacttctctctttacac

SEQ ID NO: 812380 - DNA, 22 bp, Artificial Sequence
  chemically synthesized
ctgtttcacttctctctttaca

SEQ ID NO: 812381 - DNA, 22 bp, Artificial Sequence
  chemically synthesized
cttctgtttcacttctctcttt

SEQ ID NO: 812382 - DNA, 22 bp, Artificial Sequence
  chemically synthesized
gcaacaataatctccttctgtt

SEQ ID NO: 812383 - DNA, 22 bp, Artificial Sequence
  chemically synthesized
agcaacaataatctccttctgt

SEQ ID NO: 812384 - DNA, 22 bp, Artificial Sequence
  chemically synthesized
tagcaacaataatctccttctg

SEQ ID NO: 812385 - DNA, 22 bp, Artificial Sequence
  chemically synthesized
ttagcaacaataatctccttct

SEQ ID NO: 812386 - DNA, 22 bp, Artificial Sequence
  chemically synthesized
ttgttgctaaaaactctatgtt

SEQ ID NO: 812387 - DNA, 22 bp, Artificial Sequence
  chemically synthesized
caaatatggagataacatagag

SEQ ID NO: 812388 - DNA, 22 bp, Artificial Sequence
  chemically synthesized
ttgctaaaaactctatgttatc

SEQ ID NO: 812389 - DNA, 22 bp, Artificial Sequence
  chemically synthesized
ctaaaaactctatgttatctcc

SEQ ID NO: 812390 - DNA, 22 bp, Artificial Sequence
  chemically synthesized
aaaactctatgttatctccata

SEQ ID NO: 812391 - DNA, 22 bp, Artificial Sequence
  chemically synthesized
tatgttatctccatatttggaa

SEQ ID NO: 812392 - DNA, 22 bp, Artificial Sequence
  chemically synthesized
tgttatctccatatttggaatg

SEQ ID NO: 812393 - DNA, 22 bp, Artificial Sequence
  chemically synthesized
caccaaccaaaaacattccaaa

SEQ ID NO: 812394 - DNA, 22 bp, Artificial Sequence
  chemically synthesized
tctccatatttggaatgttttt

SEQ ID NO: 812395 - DNA, 22 bp, Artificial Sequence
  chemically synthesized
cctacaccaaccaaaaacattc

SEQ ID NO: 812396 - DNA, 22 bp, Artificial Sequence
  chemically synthesized
catatttggaatgtttttggtt

SEQ ID NO: 812397 - DNA, 22 bp, Artificial Sequence
  chemically synthesized
agaaccactgcctacaccaacc

SEQ ID NO: 812398 - DNA, 22 bp, Artificial Sequence
  chemically synthesized
ggaatgtttttggttggtgtag

SEQ ID NO: 812399 - DNA, 22 bp, Artificial Sequence
  chemically synthesized
gagaaccactgcctacaccaac

SEQ ID NO: 812400 - DNA, 22 bp, Artificial Sequence
  chemically synthesized
gaatgtttttggttggtgtagg

SEQ ID NO: 812401 - DNA, 22 bp, Artificial Sequence
  chemically synthesized
aaatttgagaaccactgcctac

SEQ ID NO: 812402 - DNA, 22 bp, Artificial Sequence
  chemically synthesized
ttggttggtgtaggcagtggtt

SEQ ID NO: 812403 - DNA, 22 bp, Artificial Sequence
  chemically synthesized
tggttggtgtaggcagtggttc

SEQ ID NO: 812404 - DNA, 22 bp, Artificial Sequence
  chemically synthesized
ggttggtgtaggcagtggttct

SEQ ID NO: 812405 - DNA, 22 bp, Artificial Sequence
  chemically synthesized
gttggtgtaggcagtggttctc

SEQ ID NO: 812406 - DNA, 22 bp, Artificial Sequence
  chemically synthesized
tgcatattaaaatttgagaacc

SEQ ID NO: 812407 - DNA, 22 bp, Artificial Sequence
  chemically synthesized
gtgtaggcagtggttctcaaat

SEQ ID NO: 812408 - DNA, 22 bp, Artificial Sequence
  chemically synthesized
tatgcatattaaaatttgagaa

SEQ ID NO: 812409 - DNA, 22 bp, Artificial Sequence
  chemically synthesized
ctatgcatattaaaatttgaga

SEQ ID NO: 812410 - DNA, 22 bp, Artificial Sequence
  chemically synthesized
tttctatgcatattaaaatttg

SEQ ID NO: 812411 - DNA, 22 bp, Artificial Sequence
  chemically synthesized
caagttatttctatgcatatta

SEQ ID NO: 812412 - DNA, 22 bp, Artificial Sequence
  chemically synthesized
tcaaattttaatatgcatagaa

SEQ ID NO: 812413 - DNA, 22 bp, Artificial Sequence
  chemically synthesized
aaattttaatatgcatagaaat

SEQ ID NO: 812414 - DNA, 22 bp, Artificial Sequence
  chemically synthesized
aggcctccaagttatttctatg

SEQ ID NO: 812415 - DNA, 22 bp, Artificial Sequence
  chemically synthesized
caggcctccaagttatttctat

SEQ ID NO: 812416 - DNA, 22 bp, Artificial Sequence
  chemically synthesized
tcaggcctccaagttatttcta

SEQ ID NO: 812417 - DNA, 22 bp, Artificial Sequence
  chemically synthesized
taatatgcatagaaataacttg

SEQ ID NO: 812418 - DNA, 22 bp, Artificial Sequence
  chemically synthesized
aatatgcatagaaataacttgg

SEQ ID NO: 812419 - DNA, 22 bp, Artificial Sequence
  chemically synthesized
atatgcatagaaataacttgga

SEQ ID NO: 812420 - DNA, 22 bp, Artificial Sequence
  chemically synthesized
acaagctttcaggcctccaagt

SEQ ID NO: 812421 - DNA, 22 bp, Artificial Sequence
  chemically synthesized
aacaagctttcaggcctccaag

SEQ ID NO: 812422 - DNA, 22 bp, Artificial Sequence
  chemically synthesized
taacaagctttcaggcctccaa

SEQ ID NO: 812423 - DNA, 22 bp, Artificial Sequence
  chemically synthesized
ttaacaagctttcaggcctcca

SEQ ID NO: 812424 - DNA, 22 bp, Artificial Sequence
  chemically synthesized
gggaacttttaacaagctttca

SEQ ID NO: 812425 - DNA, 22 bp, Artificial Sequence
  chemically synthesized
ggggaacttttaacaagctttc

SEQ ID NO: 812426 - DNA, 22 bp, Artificial Sequence
  chemically synthesized
ggaggcctgaaagcttgttaaa

SEQ ID NO: 812427 - DNA, 22 bp, Artificial Sequence
  chemically synthesized
gaggcctgaaagcttgttaaaa

SEQ ID NO: 812428 - DNA, 22 bp, Artificial Sequence
  chemically synthesized
gggatgggacttggggaacttt

SEQ ID NO: 812429 - DNA, 22 bp, Artificial Sequence
  chemically synthesized
aaagcttgttaaaagttcccca

SEQ ID NO: 812430 - DNA, 22 bp, Artificial Sequence
  chemically synthesized
tggggatgggacttggggaact

SEQ ID NO: 812431 - DNA, 22 bp, Artificial Sequence
  chemically synthesized
gttaaaagttccccaagtccca

SEQ ID NO: 812432 - DNA, 22 bp, Artificial Sequence
  chemically synthesized
ttaaaagttccccaagtcccat

SEQ ID NO: 812433 - DNA, 22 bp, Artificial Sequence
  chemically synthesized
aaagttccccaagtcccatccc

SEQ ID NO: 812434 - DNA, 22 bp, Artificial Sequence
  chemically synthesized
aatcagaatctctggggatggg

SEQ ID NO: 812435 - DNA, 22 bp, Artificial Sequence
  chemically synthesized
cccaagtcccatccccagagat

SEQ ID NO: 812436 - DNA, 22 bp, Artificial Sequence
  chemically synthesized
ccccatccaactaaatcagaat

SEQ ID NO: 812437 - DNA, 22 bp, Artificial Sequence
  chemically synthesized
taggtcctaccccatccaacta

SEQ ID NO: 812438 - DNA, 22 bp, Artificial Sequence
  chemically synthesized
gtaggtcctaccccatccaact

SEQ ID NO: 812439 - DNA, 22 bp, Artificial Sequence
  chemically synthesized
aatttgtaggtcctaccccatc

SEQ ID NO: 812440 - DNA, 22 bp, Artificial Sequence
  chemically synthesized
tgatttagttggatggggtagg

SEQ ID NO: 812441 - DNA, 22 bp, Artificial Sequence
  chemically synthesized
aaatttgtaggtcctaccccat

SEQ ID NO: 812442 - DNA, 22 bp, Artificial Sequence
  chemically synthesized
atttagttggatggggtaggac

SEQ ID NO: 812443 - DNA, 22 bp, Artificial Sequence
  chemically synthesized
agttggatggggtaggacctac

SEQ ID NO: 812444 - DNA, 22 bp, Artificial Sequence
  chemically synthesized
gttggatggggtaggacctaca

SEQ ID NO: 812445 - DNA, 22 bp, Artificial Sequence
  chemically synthesized
gaaatttaaatttgtaggtcct

SEQ ID NO: 812446 - DNA, 22 bp, Artificial Sequence
  chemically synthesized
gatggggtaggacctacaaatt

SEQ ID NO: 812447 - DNA, 22 bp, Artificial Sequence
  chemically synthesized
actagaaatttaaatttgtagg

SEQ ID NO: 812448 - DNA, 22 bp, Artificial Sequence
  chemically synthesized
tgagctcactagaaatttaaat

SEQ ID NO: 812449 - DNA, 22 bp, Artificial Sequence
  chemically synthesized
caaatttaaatttctagtgagc

SEQ ID NO: 812450 - DNA, 22 bp, Artificial Sequence
  chemically synthesized
gtatcacctatgagctcactag

SEQ ID NO: 812451 - DNA, 22 bp, Artificial Sequence
  chemically synthesized
aaatttctagtgagctcatagg

SEQ ID NO: 812452 - DNA, 22 bp, Artificial Sequence
  chemically synthesized
aatttctagtgagctcataggt

SEQ ID NO: 812453 - DNA, 22 bp, Artificial Sequence
  chemically synthesized
gcagcattggtatcacctatga

SEQ ID NO: 812454 - DNA, 22 bp, Artificial Sequence
  chemically synthesized
ctagtgagctcataggtgatac

SEQ ID NO: 812455 - DNA, 22 bp, Artificial Sequence
  chemically synthesized
tagtgagctcataggtgatacc

SEQ ID NO: 812456 - DNA, 22 bp, Artificial Sequence
  chemically synthesized
actggcagcattggtatcacct

SEQ ID NO: 812457 - DNA, 22 bp, Artificial Sequence
  chemically synthesized
gtgagctcataggtgataccaa

SEQ ID NO: 812458 - DNA, 22 bp, Artificial Sequence
  chemically synthesized
tgactggcagcattggtatcac

SEQ ID NO: 812459 - DNA, 22 bp, Artificial Sequence
  chemically synthesized
ataggtgataccaatgctgcca

SEQ ID NO: 812460 - DNA, 22 bp, Artificial Sequence
  chemically synthesized
cccaaagtatggtcctctgact

SEQ ID NO: 812461 - DNA, 22 bp, Artificial Sequence
  chemically synthesized
ccagtcagaggaccatactttg

SEQ ID NO: 812462 - DNA, 22 bp, Artificial Sequence
  chemically synthesized
tgggtaacactgcggtcttggg

SEQ ID NO: 812463 - DNA, 22 bp, Artificial Sequence
  chemically synthesized
gggtaacactgcggtcttgggt

SEQ ID NO: 812464 - DNA, 22 bp, Artificial Sequence
  chemically synthesized
ggtaacactgcggtcttgggta

SEQ ID NO: 812465 - DNA, 22 bp, Artificial Sequence
  chemically synthesized
gcagagcaacagtgtacccaag

SEQ ID NO: 812466 - DNA, 22 bp, Artificial Sequence
  chemically synthesized
ggcagagcaacagtgtacccaa

SEQ ID NO: 812467 - DNA, 22 bp, Artificial Sequence
  chemically synthesized
cggtcttgggtacactgttgct

SEQ ID NO: 812468 - DNA, 22 bp, Artificial Sequence
  chemically synthesized
gggtacactgttgctctgccaa

SEQ ID NO: 812469 - DNA, 22 bp, Artificial Sequence
  chemically synthesized
gggcatgaggtcttggcagagc

SEQ ID NO: 812470 - DNA, 22 bp, Artificial Sequence
  chemically synthesized
ggtacactgttgctctgccaag

SEQ ID NO: 812471 - DNA, 22 bp, Artificial Sequence
  chemically synthesized
ttgctctgccaagacctcatgc

SEQ ID NO: 812472 - DNA, 22 bp, Artificial Sequence
  chemically synthesized
caaccagctagggcatgaggtc

SEQ ID NO: 812473 - DNA, 22 bp, Artificial Sequence
  chemically synthesized
ctctgccaagacctcatgccct

SEQ ID NO: 812474 - DNA, 22 bp, Artificial Sequence
  chemically synthesized
tgccaagacctcatgccctagc

SEQ ID NO: 812475 - DNA, 22 bp, Artificial Sequence
  chemically synthesized
ccaagacctcatgccctagctg

SEQ ID NO: 812476 - DNA, 22 bp, Artificial Sequence
  chemically synthesized
gtagtcaatattccaaccagct

SEQ ID NO: 812477 - DNA, 22 bp, Artificial Sequence
  chemically synthesized
ttagtagtcaatattccaacca

SEQ ID NO: 812478 - DNA, 22 bp, Artificial Sequence
  chemically synthesized
atgccctagctggttggaatat

SEQ ID NO: 812479 - DNA, 22 bp, Artificial Sequence
  chemically synthesized
tgagctgttagtagtcaatatt

SEQ ID NO: 812480 - DNA, 22 bp, Artificial Sequence
  chemically synthesized
gctggttggaatattgactact

SEQ ID NO: 812481 - DNA, 22 bp, Artificial Sequence
  chemically synthesized
gttggaatattgactactaaca

SEQ ID NO: 812482 - DNA, 22 bp, Artificial Sequence
  chemically synthesized
gaatattgactactaacagctc

SEQ ID NO: 812483 - DNA, 22 bp, Artificial Sequence
  chemically synthesized
cagggagggaggcagctgtgag

SEQ ID NO: 812484 - DNA, 22 bp, Artificial Sequence
  chemically synthesized
actactaacagctcacagctgc

SEQ ID NO: 812485 - DNA, 22 bp, Artificial Sequence
  chemically synthesized
ccagggagggaggcagctgtga

SEQ ID NO: 812486 - DNA, 22 bp, Artificial Sequence
  chemically synthesized
ctaacagctcacagctgcctcc

SEQ ID NO: 812487 - DNA, 22 bp, Artificial Sequence
  chemically synthesized
acagctcacagctgcctccctc

SEQ ID NO: 812488 - DNA, 22 bp, Artificial Sequence
  chemically synthesized
aaggcaatttccagggagggag

SEQ ID NO: 812489 - DNA, 22 bp, Artificial Sequence
  chemically synthesized
acagctgcctccctccctggaa

SEQ ID NO: 812490 - DNA, 22 bp, Artificial Sequence
  chemically synthesized
cagctgaaggcaatttccaggg

SEQ ID NO: 812491 - DNA, 22 bp, Artificial Sequence
  chemically synthesized
cctacagctgaaggcaatttcc

SEQ ID NO: 812492 - DNA, 22 bp, Artificial Sequence
  chemically synthesized
cctccctccctggaaattgcct

SEQ ID NO: 812493 - DNA, 22 bp, Artificial Sequence
  chemically synthesized
ttacctacagctgaaggcaatt

SEQ ID NO: 812494 - DNA, 22 bp, Artificial Sequence
  chemically synthesized
cctccctggaaattgccttcag

SEQ ID NO: 812495 - DNA, 22 bp, Artificial Sequence
  chemically synthesized
cctggaaattgccttcagctgt

SEQ ID NO: 812496 - DNA, 22 bp, Artificial Sequence
  chemically synthesized
gaaattgccttcagctgtaggt

SEQ ID NO: 812497 - DNA, 22 bp, Artificial Sequence
  chemically synthesized
gagtaagattgttacctacagc

SEQ ID NO: 812498 - DNA, 22 bp, Artificial Sequence
  chemically synthesized
ccttcagctgtaggtaacaatc

SEQ ID NO: 812499 - DNA, 22 bp, Artificial Sequence
  chemically synthesized
cagctgtaggtaacaatcttac

SEQ ID NO: 812500 - DNA, 22 bp, Artificial Sequence
  chemically synthesized
agctgtaggtaacaatcttact

SEQ ID NO: 812501 - DNA, 22 bp, Artificial Sequence
  chemically synthesized
taggtaacaatcttactccagt

SEQ ID NO: 812502 - DNA, 22 bp, Artificial Sequence
  chemically synthesized
ggtcaccccatgggaaagagca

SEQ ID NO: 812503 - DNA, 22 bp, Artificial Sequence
  chemically synthesized
actccagtctgctctttcccat

SEQ ID NO: 812504 - DNA, 22 bp, Artificial Sequence
  chemically synthesized
ctccagtctgctctttcccatg

SEQ ID NO: 812505 - DNA, 22 bp, Artificial Sequence
  chemically synthesized
cagtctgctctttcccatgggg

SEQ ID NO: 812506 - DNA, 22 bp, Artificial Sequence
  chemically synthesized
atggtcctgggtcaccccatgg

SEQ ID NO: 812507 - DNA, 22 bp, Artificial Sequence
  chemically synthesized
ctctttcccatggggtgaccca

SEQ ID NO: 812508 - DNA, 22 bp, Artificial Sequence
  chemically synthesized
tttcccatggggtgacccagga

SEQ ID NO: 812509 - DNA, 22 bp, Artificial Sequence
  chemically synthesized
gagagttaatggtcctgggtca

SEQ ID NO: 812510 - DNA, 22 bp, Artificial Sequence
  chemically synthesized
tcccatggggtgacccaggacc

SEQ ID NO: 812511 - DNA, 22 bp, Artificial Sequence
  chemically synthesized
cccatggggtgacccaggacca

SEQ ID NO: 812512 - DNA, 22 bp, Artificial Sequence
  chemically synthesized
ccatggggtgacccaggaccat

SEQ ID NO: 812513 - DNA, 22 bp, Artificial Sequence
  chemically synthesized
aacccaatactagagagttaat

SEQ ID NO: 812514 - DNA, 22 bp, Artificial Sequence
  chemically synthesized
gaacccaatactagagagttaa

SEQ ID NO: 812515 - DNA, 22 bp, Artificial Sequence
  chemically synthesized
tgaacccaatactagagagtta

SEQ ID NO: 812516 - DNA, 22 bp, Artificial Sequence
  chemically synthesized
gacctttgaacccaatactaga

SEQ ID NO: 812517 - DNA, 22 bp, Artificial Sequence
  chemically synthesized
actctctagtattgggttcaaa

SEQ ID NO: 812518 - DNA, 22 bp, Artificial Sequence
  chemically synthesized
tctagtattgggttcaaaggtc

SEQ ID NO: 812519 - DNA, 22 bp, Artificial Sequence
  chemically synthesized
tagtattgggttcaaaggtcca

SEQ ID NO: 812520 - DNA, 22 bp, Artificial Sequence
  chemically synthesized
aagcaagggatctggacctttg

SEQ ID NO: 812521 - DNA, 22 bp, Artificial Sequence
  chemically synthesized
gtattgggttcaaaggtccaga

SEQ ID NO: 812522 - DNA, 22 bp, Artificial Sequence
  chemically synthesized
aattgaagcaagggatctggac

SEQ ID NO: 812523 - DNA, 22 bp, Artificial Sequence
  chemically synthesized
ggttcaaaggtccagatccctt

SEQ ID NO: 812524 - DNA, 22 bp, Artificial Sequence
  chemically synthesized
aaaggtccagatcccttgcttc

SEQ ID NO: 812525 - DNA, 22 bp, Artificial Sequence
  chemically synthesized
gagacacgctgaattgaagcaa

SEQ ID NO: 812526 - DNA, 22 bp, Artificial Sequence
  chemically synthesized
agagacacgctgaattgaagca

SEQ ID NO: 812527 - DNA, 22 bp, Artificial Sequence
  chemically synthesized
tagagacacgctgaattgaagc

SEQ ID NO: 812528 - DNA, 22 bp, Artificial Sequence
  chemically synthesized
catggccctttagagacacgct

SEQ ID NO: 812529 - DNA, 22 bp, Artificial Sequence
  chemically synthesized
gcttcaattcagcgtgtctcta

SEQ ID NO: 812530 - DNA, 22 bp, Artificial Sequence
  chemically synthesized
cttcaattcagcgtgtctctaa

SEQ ID NO: 812531 - DNA, 22 bp, Artificial Sequence
  chemically synthesized
caattcagcgtgtctctaaagg

SEQ ID NO: 812532 - DNA, 22 bp, Artificial Sequence
  chemically synthesized
aattcagcgtgtctctaaaggg

SEQ ID NO: 812533 - DNA, 22 bp, Artificial Sequence
  chemically synthesized
gaaattgcatggccctttagag

SEQ ID NO: 812534 - DNA, 22 bp, Artificial Sequence
  chemically synthesized
tggaaattgcatggccctttag

SEQ ID NO: 812535 - DNA, 22 bp, Artificial Sequence
  chemically synthesized
agcgtgtctctaaagggccatg

SEQ ID NO: 812536 - DNA, 22 bp, Artificial Sequence
  chemically synthesized
aggggagttctggaaattgcat

SEQ ID NO: 812537 - DNA, 22 bp, Artificial Sequence
  chemically synthesized
caggggagttctggaaattgca

SEQ ID NO: 812538 - DNA, 22 bp, Artificial Sequence
  chemically synthesized
tcaggggagttctggaaattgc

SEQ ID NO: 812539 - DNA, 22 bp, Artificial Sequence
  chemically synthesized
taaagggccatgcaatttccag

SEQ ID NO: 812540 - DNA, 22 bp, Artificial Sequence
  chemically synthesized
aagggccatgcaatttccagaa

SEQ ID NO: 812541 - DNA, 22 bp, Artificial Sequence
  chemically synthesized
atcagattttcaggggagttct

SEQ ID NO: 812542 - DNA, 22 bp, Artificial Sequence
  chemically synthesized
cggcctcatcagattttcaggg

SEQ ID NO: 812543 - DNA, 22 bp, Artificial Sequence
  chemically synthesized
ccagaactcccctgaaaatctg

SEQ ID NO: 812544 - DNA, 22 bp, Artificial Sequence
  chemically synthesized
cagaactcccctgaaaatctga

SEQ ID NO: 812545 - DNA, 22 bp, Artificial Sequence
  chemically synthesized
cagtgcgttgcggcctcatcag

SEQ ID NO: 812546 - DNA, 22 bp, Artificial Sequence
  chemically synthesized
ccctgaaaatctgatgaggccg

SEQ ID NO: 812547 - DNA, 22 bp, Artificial Sequence
  chemically synthesized
aaaatctgatgaggccgcaacg

SEQ ID NO: 812548 - DNA, 22 bp, Artificial Sequence
  chemically synthesized
atgaggccgcaacgcactgcag

SEQ ID NO: 812549 - DNA, 22 bp, Artificial Sequence
  chemically synthesized
cacagacgaagaagtgcagtga

SEQ ID NO: 812550 - DNA, 22 bp, Artificial Sequence
  chemically synthesized
caggcttcactgcacttcttcg

SEQ ID NO: 812551 - DNA, 22 bp, Artificial Sequence
  chemically synthesized
cactgcacttcttcgtctgtgc

SEQ ID NO: 812552 - DNA, 22 bp, Artificial Sequence
  chemically synthesized
actgcacttcttcgtctgtgca

SEQ ID NO: 812553 - DNA, 22 bp, Artificial Sequence
  chemically synthesized
taagataggcaagattgcacag

SEQ ID NO: 812554 - DNA, 22 bp, Artificial Sequence
  chemically synthesized
cacttcttcgtctgtgcaatct

SEQ ID NO: 812555 - DNA, 22 bp, Artificial Sequence
  chemically synthesized
cttcgtctgtgcaatcttgcct

SEQ ID NO: 812556 - DNA, 22 bp, Artificial Sequence
  chemically synthesized
ttcgtctgtgcaatcttgccta

SEQ ID NO: 812557 - DNA, 22 bp, Artificial Sequence
  chemically synthesized
cgtctgtgcaatcttgcctatc

SEQ ID NO: 812558 - DNA, 22 bp, Artificial Sequence
  chemically synthesized
gtctgtgcaatcttgcctatct

SEQ ID NO: 812559 - DNA, 22 bp, Artificial Sequence
  chemically synthesized
tgcaatcttgcctatcttacaa

SEQ ID NO: 812560 - DNA, 22 bp, Artificial Sequence
  chemically synthesized
gcctatcttacaaccttacaca

SEQ ID NO: 812561 - DNA, 22 bp, Artificial Sequence
  chemically synthesized
ccatgagatacatgtgtaaggt

SEQ ID NO: 812562 - DNA, 22 bp, Artificial Sequence
  chemically synthesized
cctatcttacaaccttacacat

SEQ ID NO: 812563 - DNA, 22 bp, Artificial Sequence
  chemically synthesized
tcttacaaccttacacatgtat

SEQ ID NO: 812564 - DNA, 22 bp, Artificial Sequence
  chemically synthesized
acaaccttacacatgtatctca

SEQ ID NO: 812565 - DNA, 22 bp, Artificial Sequence
  chemically synthesized
caaccttacacatgtatctcat

SEQ ID NO: 812566 - DNA, 22 bp, Artificial Sequence
  chemically synthesized
aggagtgttcccatgagataca

SEQ ID NO: 812567 - DNA, 22 bp, Artificial Sequence
  chemically synthesized
ttgaggagtgttcccatgagat

SEQ ID NO: 812568 - DNA, 22 bp, Artificial Sequence
  chemically synthesized
gttgaggagtgttcccatgaga

SEQ ID NO: 812569 - DNA, 22 bp, Artificial Sequence
  chemically synthesized
acacatgtatctcatgggaaca

SEQ ID NO: 812570 - DNA, 22 bp, Artificial Sequence
  chemically synthesized
cacatgtatctcatgggaacac

SEQ ID NO: 812571 - DNA, 22 bp, Artificial Sequence
  chemically synthesized
tgtgcataaggtttgttgagga

SEQ ID NO: 812572 - DNA, 22 bp, Artificial Sequence
  chemically synthesized
atgggaacactcctcaacaaac

SEQ ID NO: 812573 - DNA, 22 bp, Artificial Sequence
  chemically synthesized
agatagagagttgtgtgcataa

SEQ ID NO: 812574 - DNA, 22 bp, Artificial Sequence
  chemically synthesized
ctcaacaaaccttatgcacaca

SEQ ID NO: 812575 - DNA, 22 bp, Artificial Sequence
  chemically synthesized
aacaaaccttatgcacacaact

SEQ ID NO: 812576 - DNA, 22 bp, Artificial Sequence
  chemically synthesized
gaaatagactaagatagagagt

SEQ ID NO: 812577 - DNA, 22 bp, Artificial Sequence
  chemically synthesized
atgcacacaactctctatctta

SEQ ID NO: 812578 - DNA, 22 bp, Artificial Sequence
  chemically synthesized
tgcacacaactctctatcttag

SEQ ID NO: 812579 - DNA, 22 bp, Artificial Sequence
  chemically synthesized
cctggaaatagactaagataga

SEQ ID NO: 812580 - DNA, 22 bp, Artificial Sequence
  chemically synthesized
ggctccctggaaatagactaag

SEQ ID NO: 812581 - DNA, 22 bp, Artificial Sequence
  chemically synthesized
gactgggctccctggaaataga

SEQ ID NO: 812582 - DNA, 22 bp, Artificial Sequence
  chemically synthesized
agactgggctccctggaaatag

SEQ ID NO: 812583 - DNA, 22 bp, Artificial Sequence
  chemically synthesized
tctatcttagtctatttccagg

SEQ ID NO: 812584 - DNA, 22 bp, Artificial Sequence
  chemically synthesized
tatcttagtctatttccaggga

SEQ ID NO: 812585 - DNA, 22 bp, Artificial Sequence
  chemically synthesized
acttagactgggctccctggaa

SEQ ID NO: 812586 - DNA, 22 bp, Artificial Sequence
  chemically synthesized
tcttagtctatttccagggagc

SEQ ID NO: 812587 - DNA, 22 bp, Artificial Sequence
  chemically synthesized
agtctatttccagggagcccag

SEQ ID NO: 812588 - DNA, 22 bp, Artificial Sequence
  chemically synthesized
gtctatttccagggagcccagt

SEQ ID NO: 812589 - DNA, 22 bp, Artificial Sequence
  chemically synthesized
tttccagggagcccagtctaag

SEQ ID NO: 812590 - DNA, 22 bp, Artificial Sequence
  chemically synthesized
ccagggagcccagtctaagtta

SEQ ID NO: 812591 - DNA, 22 bp, Artificial Sequence
  chemically synthesized
cagggagcccagtctaagttag

SEQ ID NO: 812592 - DNA, 22 bp, Artificial Sequence
  chemically synthesized
aaaagaaacatgaaacaaaaaa

SEQ ID NO: 812593 - DNA, 22 bp, Artificial Sequence
  chemically synthesized
agttagatgggttttttgtttc

SEQ ID NO: 812594 - DNA, 22 bp, Artificial Sequence
  chemically synthesized
gatgggttttttgtttcatgtt

SEQ ID NO: 812595 - DNA, 22 bp, Artificial Sequence
  chemically synthesized
catgtgggttcaaaagaaacat

SEQ ID NO: 812596 - DNA, 22 bp, Artificial Sequence
  chemically synthesized
tttgtttcatgtttcttttgaa

SEQ ID NO: 812597 - DNA, 22 bp, Artificial Sequence
  chemically synthesized
ttgtttcatgtttcttttgaac

SEQ ID NO: 812598 - DNA, 22 bp, Artificial Sequence
  chemically synthesized
tgtttcatgtttcttttgaacc

SEQ ID NO: 812599 - DNA, 22 bp, Artificial Sequence
  chemically synthesized
gtttcatgtttcttttgaaccc

SEQ ID NO: 812600 - DNA, 22 bp, Artificial Sequence
  chemically synthesized
tttcatgtttcttttgaaccca

SEQ ID NO: 812601 - DNA, 22 bp, Artificial Sequence
  chemically synthesized
catgtttcttttgaacccacat

SEQ ID NO: 812602 - DNA, 22 bp, Artificial Sequence
  chemically synthesized
atgtttcttttgaacccacatg

SEQ ID NO: 812603 - DNA, 22 bp, Artificial Sequence
  chemically synthesized
cttttgaacccacatgtagcac

SEQ ID NO: 812604 - DNA, 22 bp, Artificial Sequence
  chemically synthesized
ttttgaacccacatgtagcacc

SEQ ID NO: 812605 - DNA, 22 bp, Artificial Sequence
  chemically synthesized
ttgaacccacatgtagcacctt

SEQ ID NO: 812606 - DNA, 22 bp, Artificial Sequence
  chemically synthesized
tgaacccacatgtagcaccttg

SEQ ID NO: 812607 - DNA, 22 bp, Artificial Sequence
  chemically synthesized
gaacccacatgtagcaccttgc

SEQ ID NO: 812608 - DNA, 22 bp, Artificial Sequence
  chemically synthesized
aacccacatgtagcaccttgca

SEQ ID NO: 812609 - DNA, 22 bp, Artificial Sequence
  chemically synthesized
aaagatgtaatgtaaatgcaag

SEQ ID NO: 812610 - DNA, 22 bp, Artificial Sequence
  chemically synthesized
aatactgaaagatgtaatgtaa

SEQ ID NO: 812611 - DNA, 22 bp, Artificial Sequence
  chemically synthesized
gcatttacattacatctttcag

SEQ ID NO: 812612 - DNA, 22 bp, Artificial Sequence
  chemically synthesized
gtaggctgaatactgaaagatg

SEQ ID NO: 812613 - DNA, 22 bp, Artificial Sequence
  chemically synthesized
catttacattacatctttcagt

SEQ ID NO: 812614 - DNA, 22 bp, Artificial Sequence
  chemically synthesized
gactggtaggctgaatactgaa

SEQ ID NO: 812615 - DNA, 22 bp, Artificial Sequence
  chemically synthesized
acattacatctttcagtattca

SEQ ID NO: 812616 - DNA, 22 bp, Artificial Sequence
  chemically synthesized
cattacatctttcagtattcag

SEQ ID NO: 812617 - DNA, 22 bp, Artificial Sequence
  chemically synthesized
catctttcagtattcagcctac

SEQ ID NO: 812618 - DNA, 22 bp, Artificial Sequence
  chemically synthesized
aacaagttggactggtaggctg

SEQ ID NO: 812619 - DNA, 22 bp, Artificial Sequence
  chemically synthesized
caacaagttggactggtaggct

SEQ ID NO: 812620 - DNA, 22 bp, Artificial Sequence
  chemically synthesized
tcaacaagttggactggtaggc

SEQ ID NO: 812621 - DNA, 22 bp, Artificial Sequence
  chemically synthesized
tcagtattcagcctaccagtcc

SEQ ID NO: 812622 - DNA, 22 bp, Artificial Sequence
  chemically synthesized
cagtattcagcctaccagtcca

SEQ ID NO: 812623 - DNA, 22 bp, Artificial Sequence
  chemically synthesized
agtattcagcctaccagtccaa

SEQ ID NO: 812624 - DNA, 22 bp, Artificial Sequence
  chemically synthesized
agcctaccagtccaacttgttg

SEQ ID NO: 812625 - DNA, 22 bp, Artificial Sequence
  chemically synthesized
ccagtccaacttgttgaaaact

SEQ ID NO: 812626 - DNA, 22 bp, Artificial Sequence
  chemically synthesized
gttgaaaactttttggctcctg

SEQ ID NO: 812627 - DNA, 22 bp, Artificial Sequence
  chemically synthesized
ttgaaaactttttggctcctga

SEQ ID NO: 812628 - DNA, 22 bp, Artificial Sequence
  chemically synthesized
aaaactttttggctcctgatac

SEQ ID NO: 812629 - DNA, 22 bp, Artificial Sequence
  chemically synthesized
tttggctcctgatactcttgtc

SEQ ID NO: 812630 - DNA, 22 bp, Artificial Sequence
  chemically synthesized
ttggctcctgatactcttgtct

SEQ ID NO: 812631 - DNA, 22 bp, Artificial Sequence
  chemically synthesized
tggctcctgatactcttgtctg

SEQ ID NO: 812632 - DNA, 22 bp, Artificial Sequence
  chemically synthesized
ggctcctgatactcttgtctgc

SEQ ID NO: 812633 - DNA, 22 bp, Artificial Sequence
  chemically synthesized
gctcctgatactcttgtctgct

SEQ ID NO: 812634 - DNA, 22 bp, Artificial Sequence
  chemically synthesized
ctgatactcttgtctgctatat

SEQ ID NO: 812635 - DNA, 22 bp, Artificial Sequence
  chemically synthesized
atactcttgtctgctatatttg

SEQ ID NO: 812636 - DNA, 22 bp, Artificial Sequence
  chemically synthesized
ttgtctgctatatttgctattt

SEQ ID NO: 812637 - DNA, 22 bp, Artificial Sequence
  chemically synthesized
gtctgctatatttgctatttct

SEQ ID NO: 812638 - DNA, 22 bp, Artificial Sequence
  chemically synthesized
tctgctatatttgctatttctc

SEQ ID NO: 812639 - DNA, 22 bp, Artificial Sequence
  chemically synthesized
ctatatttgctatttctccctg

SEQ ID NO: 812640 - DNA, 22 bp, Artificial Sequence
  chemically synthesized
tatttgctatttctccctgctt

SEQ ID NO: 812641 - DNA, 22 bp, Artificial Sequence
  chemically synthesized
tcaaatcaatgccacaaagcag

SEQ ID NO: 812642 - DNA, 22 bp, Artificial Sequence
  chemically synthesized
gctatttctccctgctttgtgg

SEQ ID NO: 812643 - DNA, 22 bp, Artificial Sequence
  chemically synthesized
atcaaatcaatgccacaaagca

SEQ ID NO: 812644 - DNA, 22 bp, Artificial Sequence
  chemically synthesized
ctatttctccctgctttgtggc

SEQ ID NO: 812645 - DNA, 22 bp, Artificial Sequence
  chemically synthesized
ttatcaaatcaatgccacaaag

SEQ ID NO: 812646 - DNA, 22 bp, Artificial Sequence
  chemically synthesized
tttctccctgctttgtggcatt

SEQ ID NO: 812647 - DNA, 22 bp, Artificial Sequence
  chemically synthesized
ctccctgctttgtggcattgat

SEQ ID NO: 812648 - DNA, 22 bp, Artificial Sequence
  chemically synthesized
tccctgctttgtggcattgatt

SEQ ID NO: 812649 - DNA, 22 bp, Artificial Sequence
  chemically synthesized
cctgctttgtggcattgatttg

SEQ ID NO: 812650 - DNA, 22 bp, Artificial Sequence
  chemically synthesized
ctttgtggcattgatttgataa

SEQ ID NO: 812651 - DNA, 22 bp, Artificial Sequence
  chemically synthesized
tgtggcattgatttgataagaa

SEQ ID NO: 812652 - DNA, 22 bp, Artificial Sequence
  chemically synthesized
gtggcattgatttgataagaat

SEQ ID NO: 812653 - DNA, 22 bp, Artificial Sequence
  chemically synthesized
tggcattgatttgataagaatg

SEQ ID NO: 812654 - DNA, 22 bp, Artificial Sequence
  chemically synthesized
gatgaagacatagataacattc

SEQ ID NO: 812655 - DNA, 22 bp, Artificial Sequence
  chemically synthesized
ggatgaagacatagataacatt

SEQ ID NO: 812656 - DNA, 22 bp, Artificial Sequence
  chemically synthesized
atttgataagaatgttatctat

SEQ ID NO: 812657 - DNA, 22 bp, Artificial Sequence
  chemically synthesized
gataagaatgttatctatgtct

SEQ ID NO: 812658 - DNA, 22 bp, Artificial Sequence
  chemically synthesized
ataagaatgttatctatgtctt

SEQ ID NO: 812659 - DNA, 22 bp, Artificial Sequence
  chemically synthesized
atcagtggcttggatgaagaca

SEQ ID NO: 812660 - DNA, 22 bp, Artificial Sequence
  chemically synthesized
catcagtggcttggatgaagac

SEQ ID NO: 812661 - DNA, 22 bp, Artificial Sequence
  chemically synthesized
tcatcagtggcttggatgaaga

SEQ ID NO: 812662 - DNA, 22 bp, Artificial Sequence
  chemically synthesized
tctatgtcttcatccaagccac

SEQ ID NO: 812663 - DNA, 22 bp, Artificial Sequence
  chemically synthesized
aatattttcatcagtggcttgg

SEQ ID NO: 812664 - DNA, 22 bp, Artificial Sequence
  chemically synthesized
caatattttcatcagtggcttg

SEQ ID NO: 812665 - DNA, 22 bp, Artificial Sequence
  chemically synthesized
tcaatattttcatcagtggctt

SEQ ID NO: 812666 - DNA, 22 bp, Artificial Sequence
  chemically synthesized
tgtcttcatccaagccactgat

SEQ ID NO: 812667 - DNA, 22 bp, Artificial Sequence
  chemically synthesized
ttcaatattttcatcagtggct

SEQ ID NO: 812668 - DNA, 22 bp, Artificial Sequence
  chemically synthesized
tccttttcaatattttcatcag

SEQ ID NO: 812669 - DNA, 22 bp, Artificial Sequence
  chemically synthesized
catccaagccactgatgaaaat

SEQ ID NO: 812670 - DNA, 22 bp, Artificial Sequence
  chemically synthesized
atccaagccactgatgaaaata

SEQ ID NO: 812671 - DNA, 22 bp, Artificial Sequence
  chemically synthesized
tgtccttttcaatattttcatc

SEQ ID NO: 812672 - DNA, 22 bp, Artificial Sequence
  chemically synthesized
agctctgtccttttcaatattt

SEQ ID NO: 812673 - DNA, 22 bp, Artificial Sequence
  chemically synthesized
atctcagctctgtccttttcaa

SEQ ID NO: 812674 - DNA, 22 bp, Artificial Sequence
  chemically synthesized
atgaaaatattgaaaaggacag

SEQ ID NO: 812675 - DNA, 22 bp, Artificial Sequence
  chemically synthesized
ccggtaatctaatctcagctct

SEQ ID NO: 812676 - DNA, 22 bp, Artificial Sequence
  chemically synthesized
ttcccggtaatctaatctcagc

SEQ ID NO: 812677 - DNA, 22 bp, Artificial Sequence
  chemically synthesized
aaaaggacagagctgagattag

SEQ ID NO: 812678 - DNA, 22 bp, Artificial Sequence
  chemically synthesized
aggcagctattcccggtaatct

SEQ ID NO: 812679 - DNA, 22 bp, Artificial Sequence
  chemically synthesized
caggcagctattcccggtaatc

SEQ ID NO: 812680 - DNA, 22 bp, Artificial Sequence
  chemically synthesized
agattagattaccgggaatagc

SEQ ID NO: 812681 - DNA, 22 bp, Artificial Sequence
  chemically synthesized
gaaggaggtttcaggcagctat

SEQ ID NO: 812682 - DNA, 22 bp, Artificial Sequence
  chemically synthesized
gattaccgggaatagctgcctg

SEQ ID NO: 812683 - DNA, 22 bp, Artificial Sequence
  chemically synthesized
ggaaggaggtttcaggcagcta

SEQ ID NO: 812684 - DNA, 22 bp, Artificial Sequence
  chemically synthesized
ccgggaatagctgcctgaaacc

SEQ ID NO: 812685 - DNA, 22 bp, Artificial Sequence
  chemically synthesized
tcaatttggaaggaggtttcag

SEQ ID NO: 812686 - DNA, 22 bp, Artificial Sequence
  chemically synthesized
cctgaaacctccttccaaattg

SEQ ID NO: 812687 - DNA, 22 bp, Artificial Sequence
  chemically synthesized
atggatacctatcaatttggaa

SEQ ID NO: 812688 - DNA, 22 bp, Artificial Sequence
  chemically synthesized
aaacctccttccaaattgatag

SEQ ID NO: 812689 - DNA, 22 bp, Artificial Sequence
  chemically synthesized
tctaatggatacctatcaattt

SEQ ID NO: 812690 - DNA, 22 bp, Artificial Sequence
  chemically synthesized
ctgtctaatggatacctatcaa

SEQ ID NO: 812691 - DNA, 22 bp, Artificial Sequence
  chemically synthesized
cttccaaattgataggtatcca

SEQ ID NO: 812692 - DNA, 22 bp, Artificial Sequence
  chemically synthesized
actgctgtctaatggataccta

SEQ ID NO: 812693 - DNA, 22 bp, Artificial Sequence
  chemically synthesized
cactgctgtctaatggatacct

SEQ ID NO: 812694 - DNA, 22 bp, Artificial Sequence
  chemically synthesized
ccaaattgataggtatccatta

SEQ ID NO: 812695 - DNA, 22 bp, Artificial Sequence
  chemically synthesized
caaattgataggtatccattag

SEQ ID NO: 812696 - DNA, 22 bp, Artificial Sequence
  chemically synthesized
ccttcactgctgtctaatggat

SEQ ID NO: 812697 - DNA, 22 bp, Artificial Sequence
  chemically synthesized
tgctcccttcactgctgtctaa

SEQ ID NO: 812698 - DNA, 22 bp, Artificial Sequence
  chemically synthesized
ataggtatccattagacagcag

SEQ ID NO: 812699 - DNA, 22 bp, Artificial Sequence
  chemically synthesized
aggcctatgctcccttcactgc

SEQ ID NO: 812700 - DNA, 22 bp, Artificial Sequence
  chemically synthesized
tgaggcctatgctcccttcact

SEQ ID NO: 812701 - DNA, 22 bp, Artificial Sequence
  chemically synthesized
gacagcagtgaagggagcatag

SEQ ID NO: 812702 - DNA, 22 bp, Artificial Sequence
  chemically synthesized
caactctgaggcctatgctccc

SEQ ID NO: 812703 - DNA, 22 bp, Artificial Sequence
  chemically synthesized
catcccaaatctgcaactctga

SEQ ID NO: 812704 - DNA, 22 bp, Artificial Sequence
  chemically synthesized
ttccatcccaaatctgcaactc

SEQ ID NO: 812705 - DNA, 22 bp, Artificial Sequence
  chemically synthesized
ttgttccatcccaaatctgcaa

SEQ ID NO: 812706 - DNA, 22 bp, Artificial Sequence
  chemically synthesized
agagttgcagatttgggatgga

SEQ ID NO: 812707 - DNA, 22 bp, Artificial Sequence
  chemically synthesized
aacggaactgttgttccatccc

SEQ ID NO: 812708 - DNA, 22 bp, Artificial Sequence
  chemically synthesized
aaacggaactgttgttccatcc

SEQ ID NO: 812709 - DNA, 22 bp, Artificial Sequence
  chemically synthesized
cttaaacggaactgttgttcca

SEQ ID NO: 812710 - DNA, 22 bp, Artificial Sequence
  chemically synthesized
cagatttgggatggaacaacag

SEQ ID NO: 812711 - DNA, 22 bp, Artificial Sequence
  chemically synthesized
tgcttaaacggaactgttgttc

SEQ ID NO: 812712 - DNA, 22 bp, Artificial Sequence
  chemically synthesized
acctctgcttaaacggaactgt

SEQ ID NO: 812713 - DNA, 22 bp, Artificial Sequence
  chemically synthesized
gggatggaacaacagttccgtt

SEQ ID NO: 812714 - DNA, 22 bp, Artificial Sequence
  chemically synthesized
gacctctgcttaaacggaactg

SEQ ID NO: 812715 - DNA, 22 bp, Artificial Sequence
  chemically synthesized
ggatggaacaacagttccgttt

SEQ ID NO: 812716 - DNA, 22 bp, Artificial Sequence
  chemically synthesized
tgacctctgcttaaacggaact

SEQ ID NO: 812717 - DNA, 22 bp, Artificial Sequence
  chemically synthesized
ttgacctctgcttaaacggaac

SEQ ID NO: 812718 - DNA, 22 bp, Artificial Sequence
  chemically synthesized
gcttttgacctctgcttaaacg

SEQ ID NO: 812719 - DNA, 22 bp, Artificial Sequence
  chemically synthesized
tgagtctagcttttgacctctg

SEQ ID NO: 812720 - DNA, 22 bp, Artificial Sequence
  chemically synthesized
cgtttaagcagaggtcaaaagc

SEQ ID NO: 812721 - DNA, 22 bp, Artificial Sequence
  chemically synthesized
gctgtgagtctagcttttgacc

SEQ ID NO: 812722 - DNA, 22 bp, Artificial Sequence
  chemically synthesized
agctgtgagtctagcttttgac

SEQ ID NO: 812723 - DNA, 22 bp, Artificial Sequence
  chemically synthesized
tagctgtgagtctagcttttga

SEQ ID NO: 812724 - DNA, 22 bp, Artificial Sequence
  chemically synthesized
tttagctgtgagtctagctttt

SEQ ID NO: 812725 - DNA, 22 bp, Artificial Sequence
  chemically synthesized
aagcagaggtcaaaagctagac

SEQ ID NO: 812726 - DNA, 22 bp, Artificial Sequence
  chemically synthesized
agcagaggtcaaaagctagact

SEQ ID NO: 812727 - DNA, 22 bp, Artificial Sequence
  chemically synthesized
tctttagctgtgagtctagctt

SEQ ID NO: 812728 - DNA, 22 bp, Artificial Sequence
  chemically synthesized
ttctctttagctgtgagtctag

SEQ ID NO: 812729 - DNA, 22 bp, Artificial Sequence
  chemically synthesized
aaatggcattgttctctttagc

SEQ ID NO: 812730 - DNA, 22 bp, Artificial Sequence
  chemically synthesized
gactcacagctaaagagaacaa

SEQ ID NO: 812731 - DNA, 22 bp, Artificial Sequence
  chemically synthesized
acagctaaagagaacaatgcca

SEQ ID NO: 812732 - DNA, 22 bp, Artificial Sequence
  chemically synthesized
aaatagaaatgctaaaatggca

SEQ ID NO: 812733 - DNA, 22 bp, Artificial Sequence
  chemically synthesized
aagagaacaatgccattttagc

SEQ ID NO: 812734 - DNA, 22 bp, Artificial Sequence
  chemically synthesized
ttaaaatagaaatgctaaaatg

SEQ ID NO: 812735 - DNA, 22 bp, Artificial Sequence
  chemically synthesized
ctattaaaatagaaatgctaaa

SEQ ID NO: 812736 - DNA, 22 bp, Artificial Sequence
  chemically synthesized
cctattaaaatagaaatgctaa

SEQ ID NO: 812737 - DNA, 22 bp, Artificial Sequence
  chemically synthesized
agtttcctattaaaatagaaat

SEQ ID NO: 812738 - DNA, 22 bp, Artificial Sequence
  chemically synthesized
aagtttcctattaaaatagaaa

SEQ ID NO: 812739 - DNA, 22 bp, Artificial Sequence
  chemically synthesized
tagcatttctattttaatagga

SEQ ID NO: 812740 - DNA, 22 bp, Artificial Sequence
  chemically synthesized
agcatttctattttaataggaa

SEQ ID NO: 812741 - DNA, 22 bp, Artificial Sequence
  chemically synthesized
gcatttctattttaataggaaa

SEQ ID NO: 812742 - DNA, 22 bp, Artificial Sequence
  chemically synthesized
tataagtgatacttaagtttcc

SEQ ID NO: 812743 - DNA, 22 bp, Artificial Sequence
  chemically synthesized
ctattttaataggaaacttaag

SEQ ID NO: 812744 - DNA, 22 bp, Artificial Sequence
  chemically synthesized
tattttaataggaaacttaagt

SEQ ID NO: 812745 - DNA, 22 bp, Artificial Sequence
  chemically synthesized
ttttaataggaaacttaagtat

SEQ ID NO: 812746 - DNA, 22 bp, Artificial Sequence
  chemically synthesized
taataggaaacttaagtatcac

SEQ ID NO: 812747 - DNA, 22 bp, Artificial Sequence
  chemically synthesized
aataggaaacttaagtatcact

SEQ ID NO: 812748 - DNA, 22 bp, Artificial Sequence
  chemically synthesized
ataggaaacttaagtatcactt

SEQ ID NO: 812749 - DNA, 22 bp, Artificial Sequence
  chemically synthesized
aaatgtgttatataagtgatac

SEQ ID NO: 812750 - DNA, 22 bp, Artificial Sequence
  chemically synthesized
ttgaaatgtgttatataagtga

SEQ ID NO: 812751 - DNA, 22 bp, Artificial Sequence
  chemically synthesized
gttgaaatgtgttatataagtg

SEQ ID NO: 812752 - DNA, 22 bp, Artificial Sequence
  chemically synthesized
tgttgaaatgtgttatataagt

SEQ ID NO: 812753 - DNA, 22 bp, Artificial Sequence
  chemically synthesized
aagtatcacttatataacacat

SEQ ID NO: 812754 - DNA, 22 bp, Artificial Sequence
  chemically synthesized
agtatcacttatataacacatt

SEQ ID NO: 812755 - DNA, 22 bp, Artificial Sequence
  chemically synthesized
tagtgagatatgttttgttgaa

SEQ ID NO: 812756 - DNA, 22 bp, Artificial Sequence
  chemically synthesized
atataacacatttcaacaaaac

SEQ ID NO: 812757 - DNA, 22 bp, Artificial Sequence
  chemically synthesized
atagtgagatatgttttgttga

SEQ ID NO: 812758 - DNA, 22 bp, Artificial Sequence
  chemically synthesized
tataacacatttcaacaaaaca

SEQ ID NO: 812759 - DNA, 22 bp, Artificial Sequence
  chemically synthesized
tatagtgagatatgttttgttg

SEQ ID NO: 812760 - DNA, 22 bp, Artificial Sequence
  chemically synthesized
ttatagtgagatatgttttgtt

SEQ ID NO: 812761 - DNA, 22 bp, Artificial Sequence
  chemically synthesized
tgtttttatagtgagatatgtt

SEQ ID NO: 812762 - DNA, 22 bp, Artificial Sequence
  chemically synthesized
atgtttttatagtgagatatgt

SEQ ID NO: 812763 - DNA, 22 bp, Artificial Sequence
  chemically synthesized
tatgtttttatagtgagatatg

SEQ ID NO: 812764 - DNA, 22 bp, Artificial Sequence
  chemically synthesized
caacaaaacatatctcactata

SEQ ID NO: 812765 - DNA, 22 bp, Artificial Sequence
  chemically synthesized
aacaaaacatatctcactataa

SEQ ID NO: 812766 - DNA, 22 bp, Artificial Sequence
  chemically synthesized
tgattttatgtttttatagtga

SEQ ID NO: 812767 - DNA, 22 bp, Artificial Sequence
  chemically synthesized
atgattttatgtttttatagtg

SEQ ID NO: 812768 - DNA, 22 bp, Artificial Sequence
  chemically synthesized
tttatgattttatgtttttata

SEQ ID NO: 812769 - DNA, 22 bp, Artificial Sequence
  chemically synthesized
actataaaaacataaaatcata

SEQ ID NO: 812770 - DNA, 22 bp, Artificial Sequence
  chemically synthesized
ataatgattatttatgatttta

SEQ ID NO: 812771 - DNA, 22 bp, Artificial Sequence
  chemically synthesized
taaaaacataaaatcataaata

SEQ ID NO: 812772 - DNA, 22 bp, Artificial Sequence
  chemically synthesized
gatgaataataatcataaattc

SEQ ID NO: 812773 - DNA, 22 bp, Artificial Sequence
  chemically synthesized
ggacaaattagatgaataataa

SEQ ID NO: 812774 - DNA, 22 bp, Artificial Sequence
  chemically synthesized
tgaatttatgattattattcat

SEQ ID NO: 812775 - DNA, 22 bp, Artificial Sequence
  chemically synthesized
atgctgggacaaattagatgaa

SEQ ID NO: 812776 - DNA, 22 bp, Artificial Sequence
  chemically synthesized
catgctgggacaaattagatga

SEQ ID NO: 812777 - DNA, 22 bp, Artificial Sequence
  chemically synthesized
atgattattattcatctaattt

SEQ ID NO: 812778 - DNA, 22 bp, Artificial Sequence
  chemically synthesized
tcatgctgggacaaattagatg

SEQ ID NO: 812779 - DNA, 22 bp, Artificial Sequence
  chemically synthesized
tgattattattcatctaatttg

SEQ ID NO: 812780 - DNA, 22 bp, Artificial Sequence
  chemically synthesized
ttattcatctaatttgtcccag

SEQ ID NO: 812781 - DNA, 22 bp, Artificial Sequence
  chemically synthesized
ttcatctaatttgtcccagcat

SEQ ID NO: 812782 - DNA, 22 bp, Artificial Sequence
  chemically synthesized
atctaatttgtcccagcatgaa

SEQ ID NO: 812783 - DNA, 22 bp, Artificial Sequence
  chemically synthesized
atttgtcccagcatgaaaactg

SEQ ID NO: 812784 - DNA, 22 bp, Artificial Sequence
  chemically synthesized
gtcccagcatgaaaactgtatt

SEQ ID NO: 812785 - DNA, 22 bp, Artificial Sequence
  chemically synthesized
tcccagcatgaaaactgtattt

SEQ ID NO: 812786 - DNA, 22 bp, Artificial Sequence
  chemically synthesized
catgaaatgaccaaatacagtt

SEQ ID NO: 812787 - DNA, 22 bp, Artificial Sequence
  chemically synthesized
tatttggtcatttcatggaggg

SEQ ID NO: 812788 - DNA, 22 bp, Artificial Sequence
  chemically synthesized
ggtcatttcatggagggttttt

SEQ ID NO: 812789 - DNA, 22 bp, Artificial Sequence
  chemically synthesized
gtcatttcatggagggtttttt

SEQ ID NO: 812790 - DNA, 22 bp, Artificial Sequence
  chemically synthesized
aaatgtgtaaacgaaaaaaccc

SEQ ID NO: 812791 - DNA, 22 bp, Artificial Sequence
  chemically synthesized
aaaatgtgtaaacgaaaaaacc

SEQ ID NO: 812792 - DNA, 22 bp, Artificial Sequence
  chemically synthesized
taaaatgtgtaaacgaaaaaac

SEQ ID NO: 812793 - DNA, 22 bp, Artificial Sequence
  chemically synthesized
ttaaaatgtgtaaacgaaaaaa

SEQ ID NO: 812794 - DNA, 22 bp, Artificial Sequence
  chemically synthesized
tttaaaatgtgtaaacgaaaaa

SEQ ID NO: 812795 - DNA, 22 bp, Artificial Sequence
  chemically synthesized
ttttaaaatgtgtaaacgaaaa

SEQ ID NO: 812796 - DNA, 22 bp, Artificial Sequence
  chemically synthesized
catggagggttttttcgtttac

SEQ ID NO: 812797 - DNA, 22 bp, Artificial Sequence
  chemically synthesized
atggagggttttttcgtttaca

SEQ ID NO: 812798 - DNA, 22 bp, Artificial Sequence
  chemically synthesized
ttttttaaaatgtgtaaacgaa

SEQ ID NO: 812799 - DNA, 22 bp, Artificial Sequence
  chemically synthesized
tcacaacctcttttttaaaatg

SEQ ID NO: 812800 - DNA, 22 bp, Artificial Sequence
  chemically synthesized
tttcgtttacacattttaaaaa

SEQ ID NO: 812801 - DNA, 22 bp, Artificial Sequence
  chemically synthesized
atcacaacctcttttttaaaat

SEQ ID NO: 812802 - DNA, 22 bp, Artificial Sequence
  chemically synthesized
ttcgtttacacattttaaaaaa

SEQ ID NO: 812803 - DNA, 22 bp, Artificial Sequence
  chemically synthesized
tatcacaacctcttttttaaaa

SEQ ID NO: 812804 - DNA, 22 bp, Artificial Sequence
  chemically synthesized
tcgtttacacattttaaaaaag

SEQ ID NO: 812805 - DNA, 22 bp, Artificial Sequence
  chemically synthesized
cgtttacacattttaaaaaaga

SEQ ID NO: 812806 - DNA, 22 bp, Artificial Sequence
  chemically synthesized
gtttacacattttaaaaaagag

SEQ ID NO: 812807 - DNA, 22 bp, Artificial Sequence
  chemically synthesized
aactttatcacaacctcttttt

SEQ ID NO: 812808 - DNA, 22 bp, Artificial Sequence
  chemically synthesized
caactttatcacaacctctttt

SEQ ID NO: 812809 - DNA, 22 bp, Artificial Sequence
  chemically synthesized
acacattttaaaaaagaggttg

SEQ ID NO: 812810 - DNA, 22 bp, Artificial Sequence
  chemically synthesized
cacattttaaaaaagaggttgt

SEQ ID NO: 812811 - DNA, 22 bp, Artificial Sequence
  chemically synthesized
aacttcaactttatcacaacct

SEQ ID NO: 812812 - DNA, 22 bp, Artificial Sequence
  chemically synthesized
ttgaacttcaactttatcacaa

SEQ ID NO: 812813 - DNA, 22 bp, Artificial Sequence
  chemically synthesized
taaaaaagaggttgtgataaag

SEQ ID NO: 812814 - DNA, 22 bp, Artificial Sequence
  chemically synthesized
aaaaaagaggttgtgataaagt

SEQ ID NO: 812815 - DNA, 22 bp, Artificial Sequence
  chemically synthesized
aaaaagaggttgtgataaagtt

SEQ ID NO: 812816 - DNA, 22 bp, Artificial Sequence
  chemically synthesized
gggtagctgttgaacttcaact

SEQ ID NO: 812817 - DNA, 22 bp, Artificial Sequence
  chemically synthesized
tgataaagttgaagttcaacag

SEQ ID NO: 812818 - DNA, 22 bp, Artificial Sequence
  chemically synthesized
gtgaagttggggtagctgttga

SEQ ID NO: 812819 - DNA, 22 bp, Artificial Sequence
  chemically synthesized
aagttcaacagctaccccaact

SEQ ID NO: 812820 - DNA, 22 bp, Artificial Sequence
  chemically synthesized
aatgtcctagtgaagttggggt

SEQ ID NO: 812821 - DNA, 22 bp, Artificial Sequence
  chemically synthesized
aaatgtcctagtgaagttgggg

SEQ ID NO: 812822 - DNA, 22 bp, Artificial Sequence
  chemically synthesized
taaatgtcctagtgaagttggg

SEQ ID NO: 812823 - DNA, 22 bp, Artificial Sequence
  chemically synthesized
aacagctaccccaacttcacta

SEQ ID NO: 812824 - DNA, 22 bp, Artificial Sequence
  chemically synthesized
ccagtattttaaatgtcctagt

SEQ ID NO: 812825 - DNA, 22 bp, Artificial Sequence
  chemically synthesized
ccccaacttcactaggacattt

SEQ ID NO: 812826 - DNA, 22 bp, Artificial Sequence
  chemically synthesized
tattgccagtattttaaatgtc

SEQ ID NO: 812827 - DNA, 22 bp, Artificial Sequence
  chemically synthesized
atattgccagtattttaaatgt

SEQ ID NO: 812828 - DNA, 22 bp, Artificial Sequence
  chemically synthesized
tatattgccagtattttaaatg

SEQ ID NO: 812829 - DNA, 22 bp, Artificial Sequence
  chemically synthesized
ttatattgccagtattttaaat

SEQ ID NO: 812830 - DNA, 22 bp, Artificial Sequence
  chemically synthesized
ttttatattgccagtattttaa

SEQ ID NO: 812831 - DNA, 22 bp, Artificial Sequence
  chemically synthesized
cactaggacatttaaaatactg

SEQ ID NO: 812832 - DNA, 22 bp, Artificial Sequence
  chemically synthesized
cttttatattgccagtatttta

SEQ ID NO: 812833 - DNA, 22 bp, Artificial Sequence
  chemically synthesized
actaggacatttaaaatactgg

SEQ ID NO: 812834 - DNA, 22 bp, Artificial Sequence
  chemically synthesized
tcttttatattgccagtatttt

SEQ ID NO: 812835 - DNA, 22 bp, Artificial Sequence
  chemically synthesized
ttcttttatattgccagtattt

SEQ ID NO: 812836 - DNA, 22 bp, Artificial Sequence
  chemically synthesized
tttcttttatattgccagtatt

SEQ ID NO: 812837 - DNA, 22 bp, Artificial Sequence
  chemically synthesized
ggacatttaaaatactggcaat

SEQ ID NO: 812838 - DNA, 22 bp, Artificial Sequence
  chemically synthesized
cctttttcttttatattgccag

SEQ ID NO: 812839 - DNA, 22 bp, Artificial Sequence
  chemically synthesized
aaaatactggcaatataaaaga

SEQ ID NO: 812840 - DNA, 22 bp, Artificial Sequence
  chemically synthesized
aaatactggcaatataaaagaa

SEQ ID NO: 812841 - DNA, 22 bp, Artificial Sequence
  chemically synthesized
atggattgcctttttcttttat

SEQ ID NO: 812842 - DNA, 22 bp, Artificial Sequence
  chemically synthesized
ctgatggattgcctttttcttt

SEQ ID NO: 812843 - DNA, 22 bp, Artificial Sequence
  chemically synthesized
gcaatataaaagaaaaaggcaa

SEQ ID NO: 812844 - DNA, 22 bp, Artificial Sequence
  chemically synthesized
atacaattactgatggattgcc

SEQ ID NO: 812845 - DNA, 22 bp, Artificial Sequence
  chemically synthesized
tggccgctcatacaattactga

SEQ ID NO: 812846 - DNA, 22 bp, Artificial Sequence
  chemically synthesized
atggccgctcatacaattactg

SEQ ID NO: 812847 - DNA, 22 bp, Artificial Sequence
  chemically synthesized
aacttatggccgctcatacaat

SEQ ID NO: 812848 - DNA, 22 bp, Artificial Sequence
  chemically synthesized
aaacttatggccgctcatacaa

SEQ ID NO: 812849 - DNA, 22 bp, Artificial Sequence
  chemically synthesized
cttaaacttatggccgctcata

SEQ ID NO: 812850 - DNA, 22 bp, Artificial Sequence
  chemically synthesized
cgttgcttaaacttatggccgc

SEQ ID NO: 812851 - DNA, 22 bp, Artificial Sequence
  chemically synthesized
tatgagcggccataagtttaag

SEQ ID NO: 812852 - DNA, 22 bp, Artificial Sequence
  chemically synthesized
tagataataacctacgttgctt

SEQ ID NO: 812853 - DNA, 22 bp, Artificial Sequence
  chemically synthesized
gtagataataacctacgttgct

SEQ ID NO: 812854 - DNA, 22 bp, Artificial Sequence
  chemically synthesized
tgtagataataacctacgttgc

SEQ ID NO: 812855 - DNA, 22 bp, Artificial Sequence
  chemically synthesized
aatcacctttgtagataataac

SEQ ID NO: 812856 - DNA, 22 bp, Artificial Sequence
  chemically synthesized
aagcaacgtaggttattatcta

SEQ ID NO: 812857 - DNA, 22 bp, Artificial Sequence
  chemically synthesized
agcaacgtaggttattatctac

SEQ ID NO: 812858 - DNA, 22 bp, Artificial Sequence
  chemically synthesized
ttatctacaaaggtgattgaat

SEQ ID NO: 812859 - DNA, 22 bp, Artificial Sequence
  chemically synthesized
tctacaaaggtgattgaatttg

SEQ ID NO: 812860 - DNA, 22 bp, Artificial Sequence
  chemically synthesized
caaaggtgattgaatttggttc

SEQ ID NO: 812861 - DNA, 22 bp, Artificial Sequence
  chemically synthesized
aagcaaatcaggtgaaccaaat

SEQ ID NO: 812862 - DNA, 22 bp, Artificial Sequence
  chemically synthesized
aatttggttcacctgatttgct

SEQ ID NO: 812863 - DNA, 22 bp, Artificial Sequence
  chemically synthesized
ggttcacctgatttgctttaat

SEQ ID NO: 812864 - DNA, 22 bp, Artificial Sequence
  chemically synthesized
tgccacagagcaattaaagcaa

SEQ ID NO: 812865 - DNA, 22 bp, Artificial Sequence
  chemically synthesized
gttcacctgatttgctttaatt

SEQ ID NO: 812866 - DNA, 22 bp, Artificial Sequence
  chemically synthesized
atgccacagagcaattaaagca

SEQ ID NO: 812867 - DNA, 22 bp, Artificial Sequence
  chemically synthesized
acctgatttgctttaattgctc

SEQ ID NO: 812868 - DNA, 22 bp, Artificial Sequence
  chemically synthesized
atttgctttaattgctctgtgg

SEQ ID NO: 812869 - DNA, 22 bp, Artificial Sequence
  chemically synthesized
gctttaattgctctgtggcata

SEQ ID NO: 812870 - DNA, 22 bp, Artificial Sequence
  chemically synthesized
ctttaattgctctgtggcataa

SEQ ID NO: 812871 - DNA, 22 bp, Artificial Sequence
  chemically synthesized
taattgctctgtggcataaaca

SEQ ID NO: 812872 - DNA, 22 bp, Artificial Sequence
  chemically synthesized
aattgctctgtggcataaacac

SEQ ID NO: 812873 - DNA, 22 bp, Artificial Sequence
  chemically synthesized
tgtccagtcagtgtgtttatgc

SEQ ID NO: 812874 - DNA, 22 bp, Artificial Sequence
  chemically synthesized
attgctctgtggcataaacaca

SEQ ID NO: 812875 - DNA, 22 bp, Artificial Sequence
  chemically synthesized
tgtgtccagtcagtgtgtttat

SEQ ID NO: 812876 - DNA, 22 bp, Artificial Sequence
  chemically synthesized
ctctgtggcataaacacactga

SEQ ID NO: 812877 - DNA, 22 bp, Artificial Sequence
  chemically synthesized
tgtggcataaacacactgactg

SEQ ID NO: 812878 - DNA, 22 bp, Artificial Sequence
  chemically synthesized
tggcataaacacactgactgga

SEQ ID NO: 812879 - DNA, 22 bp, Artificial Sequence
  chemically synthesized
catcactctgtgtccagtcagt

SEQ ID NO: 812880 - DNA, 22 bp, Artificial Sequence
  chemically synthesized
attacatcactctgtgtccagt

SEQ ID NO: 812881 - DNA, 22 bp, Artificial Sequence
  chemically synthesized
tgatactcattacatcactctg

SEQ ID NO: 812882 - DNA, 22 bp, Artificial Sequence
  chemically synthesized
actggacacagagtgatgtaat

SEQ ID NO: 812883 - DNA, 22 bp, Artificial Sequence
  chemically synthesized
attatgatactcattacatcac

SEQ ID NO: 812884 - DNA, 22 bp, Artificial Sequence
  chemically synthesized
ctaattatgatactcattacat

SEQ ID NO: 812885 - DNA, 22 bp, Artificial Sequence
  chemically synthesized
gacacagagtgatgtaatgagt

SEQ ID NO: 812886 - DNA, 22 bp, Artificial Sequence
  chemically synthesized
tcaaattcctaattatgatact

SEQ ID NO: 812887 - DNA, 22 bp, Artificial Sequence
  chemically synthesized
atcaaattcctaattatgatac

SEQ ID NO: 812888 - DNA, 22 bp, Artificial Sequence
  chemically synthesized
tatcaaattcctaattatgata

SEQ ID NO: 812889 - DNA, 22 bp, Artificial Sequence
  chemically synthesized
gctttatcaaattcctaattat

SEQ ID NO: 812890 - DNA, 22 bp, Artificial Sequence
  chemically synthesized
agctttatcaaattcctaatta

SEQ ID NO: 812891 - DNA, 22 bp, Artificial Sequence
  chemically synthesized
acacttagctttatcaaattcc

SEQ ID NO: 812892 - DNA, 22 bp, Artificial Sequence
  chemically synthesized
cacacttagctttatcaaattc

SEQ ID NO: 812893 - DNA, 22 bp, Artificial Sequence
  chemically synthesized
ggaatttgataaagctaagtgt

SEQ ID NO: 812894 - DNA, 22 bp, Artificial Sequence
  chemically synthesized
atagtcagtttcacacttagct

SEQ ID NO: 812895 - DNA, 22 bp, Artificial Sequence
  chemically synthesized
taatagtcagtttcacacttag

SEQ ID NO: 812896 - DNA, 22 bp, Artificial Sequence
  chemically synthesized
ctaatagtcagtttcacactta

SEQ ID NO: 812897 - DNA, 22 bp, Artificial Sequence
  chemically synthesized
gataaagctaagtgtgaaactg

SEQ ID NO: 812898 - DNA, 22 bp, Artificial Sequence
  chemically synthesized
ataaagctaagtgtgaaactga

SEQ ID NO: 812899 - DNA, 22 bp, Artificial Sequence
  chemically synthesized
aaatatcttctaatagtcagtt

SEQ ID NO: 812900 - DNA, 22 bp, Artificial Sequence
  chemically synthesized
caaatatcttctaatagtcagt

SEQ ID NO: 812901 - DNA, 22 bp, Artificial Sequence
  chemically synthesized
agtgtgaaactgactattagaa

SEQ ID NO: 812902 - DNA, 22 bp, Artificial Sequence
  chemically synthesized
tgtgtttcaaatatcttctaat

SEQ ID NO: 812903 - DNA, 22 bp, Artificial Sequence
  chemically synthesized
actattagaagatatttgaaac

SEQ ID NO: 812904 - DNA, 22 bp, Artificial Sequence
  chemically synthesized
ttagaagatatttgaaacacac

SEQ ID NO: 812905 - DNA, 22 bp, Artificial Sequence
  chemically synthesized
aaagcagtagttgtgtgtttca

SEQ ID NO: 812906 - DNA, 22 bp, Artificial Sequence
  chemically synthesized
gaagatatttgaaacacacaac

SEQ ID NO: 812907 - DNA, 22 bp, Artificial Sequence
  chemically synthesized
cccattcaaagcagtagttgtg

SEQ ID NO: 812908 - DNA, 22 bp, Artificial Sequence
  chemically synthesized
gaaacacacaactactgctttg

SEQ ID NO: 812909 - DNA, 22 bp, Artificial Sequence
  chemically synthesized
aaacacacaactactgctttga

SEQ ID NO: 812910 - DNA, 22 bp, Artificial Sequence
  chemically synthesized
ggaaatcaattccccattcaaa

SEQ ID NO: 812911 - DNA, 22 bp, Artificial Sequence
  chemically synthesized
actaggaaatcaattccccatt

SEQ ID NO: 812912 - DNA, 22 bp, Artificial Sequence
  chemically synthesized
ctgctttgaatggggaattgat

SEQ ID NO: 812913 - DNA, 22 bp, Artificial Sequence
  chemically synthesized
aattaactaggaaatcaattcc

SEQ ID NO: 812914 - DNA, 22 bp, Artificial Sequence
  chemically synthesized
aaattaactaggaaatcaattc

SEQ ID NO: 812915 - DNA, 22 bp, Artificial Sequence
  chemically synthesized
ctttgaatggggaattgatttc

SEQ ID NO: 812916 - DNA, 22 bp, Artificial Sequence
  chemically synthesized
tttaaattaactaggaaatcaa

SEQ ID NO: 812917 - DNA, 22 bp, Artificial Sequence
  chemically synthesized
tgaatggggaattgatttccta

SEQ ID NO: 812918 - DNA, 22 bp, Artificial Sequence
  chemically synthesized
gaatggggaattgatttcctag

SEQ ID NO: 812919 - DNA, 22 bp, Artificial Sequence
  chemically synthesized
aatggggaattgatttcctagt

SEQ ID NO: 812920 - DNA, 22 bp, Artificial Sequence
  chemically synthesized
atttcctagttaatttaaataa

SEQ ID NO: 812921 - DNA, 22 bp, Artificial Sequence
  chemically synthesized
cctagttaatttaaataatttt

SEQ ID NO: 812922 - DNA, 22 bp, Artificial Sequence
  chemically synthesized
ctagttaatttaaataattttc

SEQ ID NO: 812923 - DNA, 22 bp, Artificial Sequence
  chemically synthesized
atagaaagagatgaaaattatt

SEQ ID NO: 812924 - DNA, 22 bp, Artificial Sequence
  chemically synthesized
gttaatttaaataattttcatc

SEQ ID NO: 812925 - DNA, 22 bp, Artificial Sequence
  chemically synthesized
atttaaataattttcatctctt

SEQ ID NO: 812926 - DNA, 22 bp, Artificial Sequence
  chemically synthesized
aaataattttcatctctttcta

SEQ ID NO: 812927 - DNA, 22 bp, Artificial Sequence
  chemically synthesized
aataattttcatctctttctat

SEQ ID NO: 812928 - DNA, 22 bp, Artificial Sequence
  chemically synthesized
tcatcagtattcatagaaagag

SEQ ID NO: 812929 - DNA, 22 bp, Artificial Sequence
  chemically synthesized
cgtctgtcatcagtattcatag

SEQ ID NO: 812930 - DNA, 22 bp, Artificial Sequence
  chemically synthesized
tcatctctttctatgaatactg

SEQ ID NO: 812931 - DNA, 22 bp, Artificial Sequence
  chemically synthesized
catctctttctatgaatactga

SEQ ID NO: 812932 - DNA, 22 bp, Artificial Sequence
  chemically synthesized
atctctttctatgaatactgat

SEQ ID NO: 812933 - DNA, 22 bp, Artificial Sequence
  chemically synthesized
tttctatgaatactgatgacag

SEQ ID NO: 812934 - DNA, 22 bp, Artificial Sequence
  chemically synthesized
tggtcattccgtctgtcatcag

SEQ ID NO: 812935 - DNA, 22 bp, Artificial Sequence
  chemically synthesized
tctatgaatactgatgacagac

SEQ ID NO: 812936 - DNA, 22 bp, Artificial Sequence
  chemically synthesized
ctatgaatactgatgacagacg

SEQ ID NO: 812937 - DNA, 22 bp, Artificial Sequence
  chemically synthesized
tatgaatactgatgacagacgg

SEQ ID NO: 812938 - DNA, 22 bp, Artificial Sequence
  chemically synthesized
tgctgtggtcattccgtctgtc

SEQ ID NO: 812939 - DNA, 22 bp, Artificial Sequence
  chemically synthesized
tgaatactgatgacagacggaa

SEQ ID NO: 812940 - DNA, 22 bp, Artificial Sequence
  chemically synthesized
atgctgtggtcattccgtctgt

SEQ ID NO: 812941 - DNA, 22 bp, Artificial Sequence
  chemically synthesized
tatgctgtggtcattccgtctg

SEQ ID NO: 812942 - DNA, 22 bp, Artificial Sequence
  chemically synthesized
atgacagacggaatgaccacag

SEQ ID NO: 812943 - DNA, 22 bp, Artificial Sequence
  chemically synthesized
cagccaatgttttatgctgtgg

SEQ ID NO: 812944 - DNA, 22 bp, Artificial Sequence
  chemically synthesized
ccagccaatgttttatgctgtg

SEQ ID NO: 812945 - DNA, 22 bp, Artificial Sequence
  chemically synthesized
ttccagccaatgttttatgctg

SEQ ID NO: 812946 - DNA, 22 bp, Artificial Sequence
  chemically synthesized
aagtacatagtgacattcttcc

SEQ ID NO: 812947 - DNA, 22 bp, Artificial Sequence
  chemically synthesized
gaagtacatagtgacattcttc

SEQ ID NO: 812948 - DNA, 22 bp, Artificial Sequence
  chemically synthesized
ttgaagtacatagtgacattct

SEQ ID NO: 812949 - DNA, 22 bp, Artificial Sequence
  chemically synthesized
cttgaagtacatagtgacattc

SEQ ID NO: 812950 - DNA, 22 bp, Artificial Sequence
  chemically synthesized
gctggaagaatgtcactatgta

SEQ ID NO: 812951 - DNA, 22 bp, Artificial Sequence
  chemically synthesized
gaagaatgtcactatgtacttc

SEQ ID NO: 812952 - DNA, 22 bp, Artificial Sequence
  chemically synthesized
tgtacttcaagaaattatttcc

SEQ ID NO: 812953 - DNA, 22 bp, Artificial Sequence
  chemically synthesized
aataaaaaacatgggggaaata

SEQ ID NO: 812954 - DNA, 22 bp, Artificial Sequence
  chemically synthesized
caataaaaaacatgggggaaat

SEQ ID NO: 812955 - DNA, 22 bp, Artificial Sequence
  chemically synthesized
tcaataaaaaacatgggggaaa

SEQ ID NO: 812956 - DNA, 22 bp, Artificial Sequence
  chemically synthesized
ttcaataaaaaacatgggggaa

SEQ ID NO: 812957 - DNA, 22 bp, Artificial Sequence
  chemically synthesized
caagaaattatttcccccatgt

SEQ ID NO: 812958 - DNA, 22 bp, Artificial Sequence
  chemically synthesized
aagaaattatttcccccatgtt

SEQ ID NO: 812959 - DNA, 22 bp, Artificial Sequence
  chemically synthesized
tcttttcaataaaaaacatggg

SEQ ID NO: 812960 - DNA, 22 bp, Artificial Sequence
  chemically synthesized
atcttttcaataaaaaacatgg

SEQ ID NO: 812961 - DNA, 22 bp, Artificial Sequence
  chemically synthesized
tttcccccatgttttttattga

SEQ ID NO: 812962 - DNA, 22 bp, Artificial Sequence
  chemically synthesized
cccccatgttttttattgaaaa

SEQ ID NO: 812963 - DNA, 22 bp, Artificial Sequence
  chemically synthesized
ccccatgttttttattgaaaag

SEQ ID NO: 812964 - DNA, 22 bp, Artificial Sequence
  chemically synthesized
tttattgaaaagataaacacct

SEQ ID NO: 812965 - DNA, 22 bp, Artificial Sequence
  chemically synthesized
ttattgaaaagataaacacctg

SEQ ID NO: 812966 - DNA, 22 bp, Artificial Sequence
  chemically synthesized
tattgaaaagataaacacctgt

SEQ ID NO: 812967 - DNA, 22 bp, Artificial Sequence
  chemically synthesized
ggaaggaaatggacaggtgttt

SEQ ID NO: 812968 - DNA, 22 bp, Artificial Sequence
  chemically synthesized
attgaaaagataaacacctgtc

SEQ ID NO: 812969 - DNA, 22 bp, Artificial Sequence
  chemically synthesized
ttgaaaagataaacacctgtcc

SEQ ID NO: 812970 - DNA, 22 bp, Artificial Sequence
  chemically synthesized
ttaggaaggaaatggacaggtg

SEQ ID NO: 812971 - DNA, 22 bp, Artificial Sequence
  chemically synthesized
attaggaaggaaatggacaggt

SEQ ID NO: 812972 - DNA, 22 bp, Artificial Sequence
  chemically synthesized
aaaagataaacacctgtccatt

SEQ ID NO: 812973 - DNA, 22 bp, Artificial Sequence
  chemically synthesized
tattaggaaggaaatggacagg

SEQ ID NO: 812974 - DNA, 22 bp, Artificial Sequence
  chemically synthesized
ttattaggaaggaaatggacag

SEQ ID NO: 812975 - DNA, 22 bp, Artificial Sequence
  chemically synthesized
ccacatttttattaggaaggaa

SEQ ID NO: 812976 - DNA, 22 bp, Artificial Sequence
  chemically synthesized
accacatttttattaggaagga

SEQ ID NO: 812977 - DNA, 22 bp, Artificial Sequence
  chemically synthesized
tccatttccttcctaataaaaa

SEQ ID NO: 812978 - DNA, 22 bp, Artificial Sequence
  chemically synthesized
aaaaaatcttaccacattttta

SEQ ID NO: 812979 - DNA, 22 bp, Artificial Sequence
  chemically synthesized
aaaaaaatcttaccacattttt

SEQ ID NO: 812980 - DNA, 22 bp, Artificial Sequence
  chemically synthesized
ccttcctaataaaaatgtggta

SEQ ID NO: 812981 - DNA, 22 bp, Artificial Sequence
  chemically synthesized
cttcctaataaaaatgtggtaa

SEQ ID NO: 812982 - DNA, 22 bp, Artificial Sequence
  chemically synthesized
atttaaaaaaatcttaccacat

SEQ ID NO: 812983 - DNA, 22 bp, Artificial Sequence
  chemically synthesized
catttaaaaaaatcttaccaca

SEQ ID NO: 812984 - DNA, 22 bp, Artificial Sequence
  chemically synthesized
cctaataaaaatgtggtaagat

SEQ ID NO: 812985 - DNA, 22 bp, Artificial Sequence
  chemically synthesized
tcatttaaaaaaatcttaccac

SEQ ID NO: 812986 - DNA, 22 bp, Artificial Sequence
  chemically synthesized
ctaataaaaatgtggtaagatt

SEQ ID NO: 812987 - DNA, 22 bp, Artificial Sequence
  chemically synthesized
ttcatttaaaaaaatcttacca

SEQ ID NO: 812988 - DNA, 22 bp, Artificial Sequence
  chemically synthesized
tttcatttaaaaaaatcttacc

SEQ ID NO: 812989 - DNA, 22 bp, Artificial Sequence
  chemically synthesized
ataaaaatgtggtaagattttt

SEQ ID NO: 812990 - DNA, 22 bp, Artificial Sequence
  chemically synthesized
ttttttcatttaaaaaaatctt

SEQ ID NO: 812991 - DNA, 22 bp, Artificial Sequence
  chemically synthesized
attttttcatttaaaaaaatct

SEQ ID NO: 812992 - DNA, 22 bp, Artificial Sequence
  chemically synthesized
tattttttcatttaaaaaaatc

SEQ ID NO: 812993 - DNA, 22 bp, Artificial Sequence
  chemically synthesized
agatagttttattttttcattt

SEQ ID NO: 812994 - DNA, 22 bp, Artificial Sequence
  chemically synthesized
cagatagttttattttttcatt

SEQ ID NO: 812995 - DNA, 22 bp, Artificial Sequence
  chemically synthesized
tcagatagttttattttttcat

SEQ ID NO: 812996 - DNA, 22 bp, Artificial Sequence
  chemically synthesized
ttttaaatgaaaaaataaaact

SEQ ID NO: 812997 - DNA, 22 bp, Artificial Sequence
  chemically synthesized
tttaaatgaaaaaataaaacta

SEQ ID NO: 812998 - DNA, 22 bp, Artificial Sequence
  chemically synthesized
ttaaatgaaaaaataaaactat

SEQ ID NO: 812999 - DNA, 22 bp, Artificial Sequence
  chemically synthesized
taaatgaaaaaataaaactatc

SEQ ID NO: 813000 - DNA, 22 bp, Artificial Sequence
  chemically synthesized
aaagcattttcagatagtttta

SEQ ID NO: 813001 - DNA, 22 bp, Artificial Sequence
  chemically synthesized
aaatgaaaaaataaaactatct

SEQ ID NO: 813002 - DNA, 22 bp, Artificial Sequence
  chemically synthesized
aatgaaaaaataaaactatctg

SEQ ID NO: 813003 - DNA, 22 bp, Artificial Sequence
  chemically synthesized
acagttaaaagcattttcagat

SEQ ID NO: 813004 - DNA, 22 bp, Artificial Sequence
  chemically synthesized
ttaacagttaaaagcattttca

SEQ ID NO: 813005 - DNA, 22 bp, Artificial Sequence
  chemically synthesized
attaacagttaaaagcattttc

SEQ ID NO: 813006 - DNA, 22 bp, Artificial Sequence
  chemically synthesized
tttattaacagttaaaagcatt

SEQ ID NO: 813007 - DNA, 22 bp, Artificial Sequence
  chemically synthesized
cctgtttattaacagttaaaag

SEQ ID NO: 813008 - DNA, 22 bp, Artificial Sequence
  chemically synthesized
tctgaaaatgcttttaactgtt

SEQ ID NO: 813009 - DNA, 22 bp, Artificial Sequence
  chemically synthesized
ctccctgtttattaacagttaa

SEQ ID NO: 813010 - DNA, 22 bp, Artificial Sequence
  chemically synthesized
actccctgtttattaacagtta

SEQ ID NO: 813011 - DNA, 22 bp, Artificial Sequence
  chemically synthesized
aaaatgcttttaactgttaata

SEQ ID NO: 813012 - DNA, 22 bp, Artificial Sequence
  chemically synthesized
cttactccctgtttattaacag

SEQ ID NO: 813013 - DNA, 22 bp, Artificial Sequence
  chemically synthesized
acttactccctgtttattaaca

SEQ ID NO: 813014 - DNA, 22 bp, Artificial Sequence
  chemically synthesized
tacttactccctgtttattaac

SEQ ID NO: 813015 - DNA, 22 bp, Artificial Sequence
  chemically synthesized
ttttacttactccctgtttatt

SEQ ID NO: 813016 - DNA, 22 bp, Artificial Sequence
  chemically synthesized
attttacttactccctgtttat

SEQ ID NO: 813017 - DNA, 22 bp, Artificial Sequence
  chemically synthesized
tattttacttactccctgttta

SEQ ID NO: 813018 - DNA, 22 bp, Artificial Sequence
  chemically synthesized
ttaactgttaataaacagggag

SEQ ID NO: 813019 - DNA, 22 bp, Artificial Sequence
  chemically synthesized
ttattttacttactccctgttt

SEQ ID NO: 813020 - DNA, 22 bp, Artificial Sequence
  chemically synthesized
taactgttaataaacagggagt

SEQ ID NO: 813021 - DNA, 22 bp, Artificial Sequence
  chemically synthesized
aactgttaataaacagggagta

SEQ ID NO: 813022 - DNA, 22 bp, Artificial Sequence
  chemically synthesized
actgttaataaacagggagtaa

SEQ ID NO: 813023 - DNA, 22 bp, Artificial Sequence
  chemically synthesized
tttttattttacttactccctg

SEQ ID NO: 813024 - DNA, 22 bp, Artificial Sequence
  chemically synthesized
ttaataaacagggagtaagtaa

SEQ ID NO: 813025 - DNA, 22 bp, Artificial Sequence
  chemically synthesized
cctatttttattttacttactc

SEQ ID NO: 813026 - DNA, 22 bp, Artificial Sequence
  chemically synthesized
gcctatttttattttacttact

SEQ ID NO: 813027 - DNA, 22 bp, Artificial Sequence
  chemically synthesized
tgcctatttttattttacttac

SEQ ID NO: 813028 - DNA, 22 bp, Artificial Sequence
  chemically synthesized
ataaacagggagtaagtaaaat

SEQ ID NO: 813029 - DNA, 22 bp, Artificial Sequence
  chemically synthesized
ttgcctatttttattttactta

SEQ ID NO: 813030 - DNA, 22 bp, Artificial Sequence
  chemically synthesized
caaatatatttttgcctatttt

SEQ ID NO: 813031 - DNA, 22 bp, Artificial Sequence
  chemically synthesized
gcaaatatatttttgcctattt

SEQ ID NO: 813032 - DNA, 22 bp, Artificial Sequence
  chemically synthesized
tgcaaatatatttttgcctatt

SEQ ID NO: 813033 - DNA, 22 bp, Artificial Sequence
  chemically synthesized
ttgcaaatatatttttgcctat

SEQ ID NO: 813034 - DNA, 22 bp, Artificial Sequence
  chemically synthesized
tcatatttttgcaaatatattt

SEQ ID NO: 813035 - DNA, 22 bp, Artificial Sequence
  chemically synthesized
tatcatatttttgcaaatatat

SEQ ID NO: 813036 - DNA, 22 bp, Artificial Sequence
  chemically synthesized
ctatcatatttttgcaaatata

SEQ ID NO: 813037 - DNA, 22 bp, Artificial Sequence
  chemically synthesized
cttctatcatatttttgcaaat

SEQ ID NO: 813038 - DNA, 22 bp, Artificial Sequence
  chemically synthesized
gcaattccttctatcatatttt

SEQ ID NO: 813039 - DNA, 22 bp, Artificial Sequence
  chemically synthesized
agcaattccttctatcatattt

SEQ ID NO: 813040 - DNA, 22 bp, Artificial Sequence
  chemically synthesized
ttagcaattccttctatcatat

SEQ ID NO: 813041 - DNA, 22 bp, Artificial Sequence
  chemically synthesized
gcaaaaatatgatagaaggaat

SEQ ID NO: 813042 - DNA, 22 bp, Artificial Sequence
  chemically synthesized
caaaaatatgatagaaggaatt

SEQ ID NO: 813043 - DNA, 22 bp, Artificial Sequence
  chemically synthesized
aacattcttagcaattccttct

SEQ ID NO: 813044 - DNA, 22 bp, Artificial Sequence
  chemically synthesized
tcaacattcttagcaattcctt

SEQ ID NO: 813045 - DNA, 22 bp, Artificial Sequence
  chemically synthesized
caaataaagaatcattctcaac

SEQ ID NO: 813046 - DNA, 22 bp, Artificial Sequence
  chemically synthesized
acaaataaagaatcattctcaa

SEQ ID NO: 813047 - DNA, 22 bp, Artificial Sequence
  chemically synthesized
ctaagaatgttgagaatgattc

SEQ ID NO: 813048 - DNA, 22 bp, Artificial Sequence
  chemically synthesized
agaatgttgagaatgattcttt

SEQ ID NO: 813049 - DNA, 22 bp, Artificial Sequence
  chemically synthesized
tcaaaaatttacaaataaagaa

SEQ ID NO: 813050 - DNA, 22 bp, Artificial Sequence
  chemically synthesized
agaatgattctttatttgtaaa

SEQ ID NO: 813051 - DNA, 22 bp, Artificial Sequence
  chemically synthesized
tagaaactatcaaaaatttaca

SEQ ID NO: 813052 - DNA, 22 bp, Artificial Sequence
  chemically synthesized
ttgtagaaactatcaaaaattt

SEQ ID NO: 813053 - DNA, 22 bp, Artificial Sequence
  chemically synthesized
attgtagaaactatcaaaaatt

SEQ ID NO: 813054 - DNA, 22 bp, Artificial Sequence
  chemically synthesized
tttatttgtaaatttttgatag

SEQ ID NO: 813055 - DNA, 22 bp, Artificial Sequence
  chemically synthesized
ttattgtagaaactatcaaaaa

SEQ ID NO: 813056 - DNA, 22 bp, Artificial Sequence
  chemically synthesized
tatttgtaaatttttgatagtt

SEQ ID NO: 813057 - DNA, 22 bp, Artificial Sequence
  chemically synthesized
atttgtaaatttttgatagttt

SEQ ID NO: 813058 - DNA, 22 bp, Artificial Sequence
  chemically synthesized
tttgtaaatttttgatagtttc

SEQ ID NO: 813059 - DNA, 22 bp, Artificial Sequence
  chemically synthesized
gtaaatttttgatagtttctac

SEQ ID NO: 813060 - DNA, 22 bp, Artificial Sequence
  chemically synthesized
taaatttttgatagtttctaca

SEQ ID NO: 813061 - DNA, 22 bp, Artificial Sequence
  chemically synthesized
gtacaagtgattcttattgtag

SEQ ID NO: 813062 - DNA, 22 bp, Artificial Sequence
  chemically synthesized
agtacaagtgattcttattgta

SEQ ID NO: 813063 - DNA, 22 bp, Artificial Sequence
  chemically synthesized
ttgatagtttctacaataagaa

SEQ ID NO: 813064 - DNA, 22 bp, Artificial Sequence
  chemically synthesized
tagtacaagtgattcttattgt

SEQ ID NO: 813065 - DNA, 22 bp, Artificial Sequence
  chemically synthesized
tgatagtttctacaataagaat

SEQ ID NO: 813066 - DNA, 22 bp, Artificial Sequence
  chemically synthesized
gatagtttctacaataagaatc

SEQ ID NO: 813067 - DNA, 22 bp, Artificial Sequence
  chemically synthesized
atagtttctacaataagaatca

SEQ ID NO: 813068 - DNA, 22 bp, Artificial Sequence
  chemically synthesized
ctttagtacaagtgattcttat

SEQ ID NO: 813069 - DNA, 22 bp, Artificial Sequence
  chemically synthesized
cctttagtacaagtgattctta

SEQ ID NO: 813070 - DNA, 22 bp, Artificial Sequence
  chemically synthesized
tcctttagtacaagtgattctt

SEQ ID NO: 813071 - DNA, 22 bp, Artificial Sequence
  chemically synthesized
tttcctttagtacaagtgattc

SEQ ID NO: 813072 - DNA, 22 bp, Artificial Sequence
  chemically synthesized
ctttcctttagtacaagtgatt

SEQ ID NO: 813073 - DNA, 22 bp, Artificial Sequence
  chemically synthesized
ctacaataagaatcacttgtac

SEQ ID NO: 813074 - DNA, 22 bp, Artificial Sequence
  chemically synthesized
tacaataagaatcacttgtact

SEQ ID NO: 813075 - DNA, 22 bp, Artificial Sequence
  chemically synthesized
caataagaatcacttgtactaa

SEQ ID NO: 813076 - DNA, 22 bp, Artificial Sequence
  chemically synthesized
aaataacttctttcctttagta

SEQ ID NO: 813077 - DNA, 22 bp, Artificial Sequence
  chemically synthesized
gaaataacttctttcctttagt

SEQ ID NO: 813078 - DNA, 22 bp, Artificial Sequence
  chemically synthesized
tgaaataacttctttcctttag

SEQ ID NO: 813079 - DNA, 22 bp, Artificial Sequence
  chemically synthesized
tattttgaaataacttctttcc

SEQ ID NO: 813080 - DNA, 22 bp, Artificial Sequence
  chemically synthesized
tatattttgaaataacttcttt

SEQ ID NO: 813081 - DNA, 22 bp, Artificial Sequence
  chemically synthesized
ctatattttgaaataacttctt

SEQ ID NO: 813082 - DNA, 22 bp, Artificial Sequence
  chemically synthesized
gtactaaaggaaagaagttatt

SEQ ID NO: 813083 - DNA, 22 bp, Artificial Sequence
  chemically synthesized
tactaaaggaaagaagttattt

SEQ ID NO: 813084 - DNA, 22 bp, Artificial Sequence
  chemically synthesized
ttctatattttgaaataacttc

SEQ ID NO: 813085 - DNA, 22 bp, Artificial Sequence
  chemically synthesized
cttctatattttgaaataactt

SEQ ID NO: 813086 - DNA, 22 bp, Artificial Sequence
  chemically synthesized
aaggaaagaagttatttcaaaa

SEQ ID NO: 813087 - DNA, 22 bp, Artificial Sequence
  chemically synthesized
gatgtttcttctatattttgaa

SEQ ID NO: 813088 - DNA, 22 bp, Artificial Sequence
  chemically synthesized
ggatgtttcttctatattttga

SEQ ID NO: 813089 - DNA, 22 bp, Artificial Sequence
  chemically synthesized
tgtttggatgtttcttctatat

SEQ ID NO: 813090 - DNA, 22 bp, Artificial Sequence
  chemically synthesized
tgtgtttggatgtttcttctat

SEQ ID NO: 813091 - DNA, 22 bp, Artificial Sequence
  chemically synthesized
ctgtgtttggatgtttcttcta

SEQ ID NO: 813092 - DNA, 22 bp, Artificial Sequence
  chemically synthesized
tctgtgtttggatgtttcttct

SEQ ID NO: 813093 - DNA, 22 bp, Artificial Sequence
  chemically synthesized
tttcaaaatatagaagaaacat

SEQ ID NO: 813094 - DNA, 22 bp, Artificial Sequence
  chemically synthesized
ttctgtgtttggatgtttcttc

SEQ ID NO: 813095 - DNA, 22 bp, Artificial Sequence
  chemically synthesized
caaaatatagaagaaacatcca

SEQ ID NO: 813096 - DNA, 22 bp, Artificial Sequence
  chemically synthesized
aaaatatagaagaaacatccaa

SEQ ID NO: 813097 - DNA, 22 bp, Artificial Sequence
  chemically synthesized
ccatttttctgtgtttggatgt

SEQ ID NO: 813098 - DNA, 22 bp, Artificial Sequence
  chemically synthesized
tctaccatttttctgtgtttgg

SEQ ID NO: 813099 - DNA, 22 bp, Artificial Sequence
  chemically synthesized
atctaccatttttctgtgtttg

SEQ ID NO: 813100 - DNA, 22 bp, Artificial Sequence
  chemically synthesized
tatctaccatttttctgtgttt

SEQ ID NO: 813101 - DNA, 22 bp, Artificial Sequence
  chemically synthesized
gtattttatctaccatttttct

SEQ ID NO: 813102 - DNA, 22 bp, Artificial Sequence
  chemically synthesized
ggtattttatctaccatttttc

SEQ ID NO: 813103 - DNA, 22 bp, Artificial Sequence
  chemically synthesized
tggtattttatctaccattttt

SEQ ID NO: 813104 - DNA, 22 bp, Artificial Sequence
  chemically synthesized
ttttggtattttatctaccatt

SEQ ID NO: 813105 - DNA, 22 bp, Artificial Sequence
  chemically synthesized
tattttggtattttatctacca

SEQ ID NO: 813106 - DNA, 22 bp, Artificial Sequence
  chemically synthesized
ctattttggtattttatctacc

SEQ ID NO: 813107 - DNA, 22 bp, Artificial Sequence
  chemically synthesized
tctattttggtattttatctac

SEQ ID NO: 813108 - DNA, 22 bp, Artificial Sequence
  chemically synthesized
attttctattttggtattttat

SEQ ID NO: 813109 - DNA, 22 bp, Artificial Sequence
  chemically synthesized
gattttctattttggtatttta

SEQ ID NO: 813110 - DNA, 22 bp, Artificial Sequence
  chemically synthesized
tgattttctattttggtatttt

SEQ ID NO: 813111 - DNA, 22 bp, Artificial Sequence
  chemically synthesized
ttgattttctattttggtattt

SEQ ID NO: 813112 - DNA, 22 bp, Artificial Sequence
  chemically synthesized
tttgattttctattttggtatt

SEQ ID NO: 813113 - DNA, 22 bp, Artificial Sequence
  chemically synthesized
tgcctttttgattttctatttt

SEQ ID NO: 813114 - DNA, 22 bp, Artificial Sequence
  chemically synthesized
agcccagattgtgcctttttga

SEQ ID NO: 813115 - DNA, 22 bp, Artificial Sequence
  chemically synthesized
taagcccagattgtgccttttt

SEQ ID NO: 813116 - DNA, 22 bp, Artificial Sequence
  chemically synthesized
ctaagcccagattgtgcctttt

SEQ ID NO: 813117 - DNA, 22 bp, Artificial Sequence
  chemically synthesized
tttctaagcccagattgtgcct

SEQ ID NO: 813118 - DNA, 22 bp, Artificial Sequence
  chemically synthesized
gtttctaagcccagattgtgcc

SEQ ID NO: 813119 - DNA, 22 bp, Artificial Sequence
  chemically synthesized
acttgtttctaagcccagattg

SEQ ID NO: 813120 - DNA, 22 bp, Artificial Sequence
  chemically synthesized
aacttgtttctaagcccagatt

SEQ ID NO: 813121 - DNA, 22 bp, Artificial Sequence
  chemically synthesized
cttaacttgtttctaagcccag

SEQ ID NO: 813122 - DNA, 22 bp, Artificial Sequence
  chemically synthesized
aaacacagagctacttaacttg

SEQ ID NO: 813123 - DNA, 22 bp, Artificial Sequence
  chemically synthesized
ggcttagaaacaagttaagtag

SEQ ID NO: 813124 - DNA, 22 bp, Artificial Sequence
  chemically synthesized
tgaaacacagagctacttaact

SEQ ID NO: 813125 - DNA, 22 bp, Artificial Sequence
  chemically synthesized
ctgaaacacagagctacttaac

SEQ ID NO: 813126 - DNA, 22 bp, Artificial Sequence
  chemically synthesized
agaaacaagttaagtagctctg

SEQ ID NO: 813127 - DNA, 22 bp, Artificial Sequence
  chemically synthesized
gaaacaagttaagtagctctgt

SEQ ID NO: 813128 - DNA, 22 bp, Artificial Sequence
  chemically synthesized
tggcatttctgaaacacagagc

SEQ ID NO: 813129 - DNA, 22 bp, Artificial Sequence
  chemically synthesized
gtggcatttctgaaacacagag

SEQ ID NO: 813130 - DNA, 22 bp, Artificial Sequence
  chemically synthesized
tgtggcatttctgaaacacaga

SEQ ID NO: 813131 - DNA, 22 bp, Artificial Sequence
  chemically synthesized
ttgtggcatttctgaaacacag

SEQ ID NO: 813132 - DNA, 22 bp, Artificial Sequence
  chemically synthesized
agtagctctgtgtttcagaaat

SEQ ID NO: 813133 - DNA, 22 bp, Artificial Sequence
  chemically synthesized
tgtgtttttgtggcatttctga

SEQ ID NO: 813134 - DNA, 22 bp, Artificial Sequence
  chemically synthesized
tgtgtttcagaaatgccacaaa

SEQ ID NO: 813135 - DNA, 22 bp, Artificial Sequence
  chemically synthesized
tgtttcagaaatgccacaaaaa

SEQ ID NO: 813136 - DNA, 22 bp, Artificial Sequence
  chemically synthesized
cagaaatgccacaaaaacacac

SEQ ID NO: 813137 - DNA, 22 bp, Artificial Sequence
  chemically synthesized
agaaatgccacaaaaacacaca

SEQ ID NO: 813138 - DNA, 22 bp, Artificial Sequence
  chemically synthesized
cagccccgtgcaccactgtgtg

SEQ ID NO: 813139 - DNA, 22 bp, Artificial Sequence
  chemically synthesized
tgtctgcagccccgtgcaccac

SEQ ID NO: 813140 - DNA, 22 bp, Artificial Sequence
  chemically synthesized
ccagcccaggccccaaaagccc

SEQ ID NO: 813141 - DNA, 22 bp, Artificial Sequence
  chemically synthesized
cccagcccaggccccaaaagcc

SEQ ID NO: 813142 - DNA, 22 bp, Artificial Sequence
  chemically synthesized
cagacatagggcttttggggcc

SEQ ID NO: 813143 - DNA, 22 bp, Artificial Sequence
  chemically synthesized
cttcccagcccaggccccaaaa

SEQ ID NO: 813144 - DNA, 22 bp, Artificial Sequence
  chemically synthesized
cctacttcccagcccaggcccc

SEQ ID NO: 813145 - DNA, 22 bp, Artificial Sequence
  chemically synthesized
ctacctacttcccagcccaggc

SEQ ID NO: 813146 - DNA, 22 bp, Artificial Sequence
  chemically synthesized
ctgctacctacttcccagccca

SEQ ID NO: 813147 - DNA, 22 bp, Artificial Sequence
  chemically synthesized
ttggggcctgggctgggaagta

SEQ ID NO: 813148 - DNA, 22 bp, Artificial Sequence
  chemically synthesized
gctactgctacctacttcccag

SEQ ID NO: 813149 - DNA, 22 bp, Artificial Sequence
  chemically synthesized
tggggcctgggctgggaagtag

SEQ ID NO: 813150 - DNA, 22 bp, Artificial Sequence
  chemically synthesized
ggggcctgggctgggaagtagg

SEQ ID NO: 813151 - DNA, 22 bp, Artificial Sequence
  chemically synthesized
gggcctgggctgggaagtaggt

SEQ ID NO: 813152 - DNA, 22 bp, Artificial Sequence
  chemically synthesized
ctggctactgctacctacttcc

SEQ ID NO: 813153 - DNA, 22 bp, Artificial Sequence
  chemically synthesized
aactcctggctactgctaccta

SEQ ID NO: 813154 - DNA, 22 bp, Artificial Sequence
  chemically synthesized
ggctgggaagtaggtagcagta

SEQ ID NO: 813155 - DNA, 22 bp, Artificial Sequence
  chemically synthesized
ggaagtaggtagcagtagccag

SEQ ID NO: 813156 - DNA, 22 bp, Artificial Sequence
  chemically synthesized
agcccagcagaatctgaactcc

SEQ ID NO: 813157 - DNA, 22 bp, Artificial Sequence
  chemically synthesized
gagcccagcagaatctgaactc

SEQ ID NO: 813158 - DNA, 22 bp, Artificial Sequence
  chemically synthesized
ttgagcccagcagaatctgaac

SEQ ID NO: 813159 - DNA, 22 bp, Artificial Sequence
  chemically synthesized
tagattcttgagcccagcagaa

SEQ ID NO: 813160 - DNA, 22 bp, Artificial Sequence
  chemically synthesized
atagattcttgagcccagcaga

SEQ ID NO: 813161 - DNA, 22 bp, Artificial Sequence
  chemically synthesized
agattctgctgggctcaagaat

SEQ ID NO: 813162 - DNA, 22 bp, Artificial Sequence
  chemically synthesized
taccgagtgtttatagattctt

SEQ ID NO: 813163 - DNA, 22 bp, Artificial Sequence
  chemically synthesized
ataccgagtgtttatagattct

SEQ ID NO: 813164 - DNA, 22 bp, Artificial Sequence
  chemically synthesized
tgctgggctcaagaatctataa

SEQ ID NO: 813165 - DNA, 22 bp, Artificial Sequence
  chemically synthesized
ctgggctcaagaatctataaac

SEQ ID NO: 813166 - DNA, 22 bp, Artificial Sequence
  chemically synthesized
tcttataccgagtgtttataga

SEQ ID NO: 813167 - DNA, 22 bp, Artificial Sequence
  chemically synthesized
gtcttataccgagtgtttatag

SEQ ID NO: 813168 - DNA, 22 bp, Artificial Sequence
  chemically synthesized
ggctcaagaatctataaacact

SEQ ID NO: 813169 - DNA, 22 bp, Artificial Sequence
  chemically synthesized
tgtcttataccgagtgtttata

SEQ ID NO: 813170 - DNA, 22 bp, Artificial Sequence
  chemically synthesized
aagaatctataaacactcggta

SEQ ID NO: 813171 - DNA, 22 bp, Artificial Sequence
  chemically synthesized
aggtcctttgtcttataccgag

SEQ ID NO: 813172 - DNA, 22 bp, Artificial Sequence
  chemically synthesized
gctcaggtcctttgtcttatac

SEQ ID NO: 813173 - DNA, 22 bp, Artificial Sequence
  chemically synthesized
taaacactcggtataagacaaa

SEQ ID NO: 813174 - DNA, 22 bp, Artificial Sequence
  chemically synthesized
ggtataagacaaaggacctgag

SEQ ID NO: 813175 - DNA, 22 bp, Artificial Sequence
  chemically synthesized
cagcaaagagcctggctcaggt

SEQ ID NO: 813176 - DNA, 22 bp, Artificial Sequence
  chemically synthesized
attgcagcaaagagcctggctc

SEQ ID NO: 813177 - DNA, 22 bp, Artificial Sequence
  chemically synthesized
actaattgcagcaaagagcctg

SEQ ID NO: 813178 - DNA, 22 bp, Artificial Sequence
  chemically synthesized
gactaattgcagcaaagagcct

SEQ ID NO: 813179 - DNA, 22 bp, Artificial Sequence
  chemically synthesized
agccaggctctttgctgcaatt

SEQ ID NO: 813180 - DNA, 22 bp, Artificial Sequence
  chemically synthesized
atatcatccttgactaattgca

SEQ ID NO: 813181 - DNA, 22 bp, Artificial Sequence
  chemically synthesized
tttgctgcaattagtcaaggat

SEQ ID NO: 813182 - DNA, 22 bp, Artificial Sequence
  chemically synthesized
tgctgcaattagtcaaggatga

SEQ ID NO: 813183 - DNA, 22 bp, Artificial Sequence
  chemically synthesized
gctgcaattagtcaaggatgat

SEQ ID NO: 813184 - DNA, 22 bp, Artificial Sequence
  chemically synthesized
ctgcaattagtcaaggatgata

SEQ ID NO: 813185 - DNA, 22 bp, Artificial Sequence
  chemically synthesized
caattagtcaaggatgatatca

SEQ ID NO: 813186 - DNA, 22 bp, Artificial Sequence
  chemically synthesized
accccgtagggaaacctgatat

SEQ ID NO: 813187 - DNA, 22 bp, Artificial Sequence
  chemically synthesized
caccccgtagggaaacctgata

SEQ ID NO: 813188 - DNA, 22 bp, Artificial Sequence
  chemically synthesized
gtcaaggatgatatcaggtttc

SEQ ID NO: 813189 - DNA, 22 bp, Artificial Sequence
  chemically synthesized
tcaccccgtagggaaacctgat

SEQ ID NO: 813190 - DNA, 22 bp, Artificial Sequence
  chemically synthesized
cctttcaccccgtagggaaacc

SEQ ID NO: 813191 - DNA, 22 bp, Artificial Sequence
  chemically synthesized
cagctccctttcaccccgtagg

SEQ ID NO: 813192 - DNA, 22 bp, Artificial Sequence
  chemically synthesized
gcagctccctttcaccccgtag

SEQ ID NO: 813193 - DNA, 22 bp, Artificial Sequence
  chemically synthesized
tgcagctccctttcaccccgta

SEQ ID NO: 813194 - DNA, 22 bp, Artificial Sequence
  chemically synthesized
ttgcagctccctttcaccccgt

SEQ ID NO: 813195 - DNA, 22 bp, Artificial Sequence
  chemically synthesized
tttgcagctccctttcaccccg

SEQ ID NO: 813196 - DNA, 22 bp, Artificial Sequence
  chemically synthesized
ttttgcagctccctttcacccc

SEQ ID NO: 813197 - DNA, 22 bp, Artificial Sequence
  chemically synthesized
tttttgcagctccctttcaccc

SEQ ID NO: 813198 - DNA, 22 bp, Artificial Sequence
  chemically synthesized
ttttttgcagctccctttcacc

SEQ ID NO: 813199 - DNA, 22 bp, Artificial Sequence
  chemically synthesized
tttttttgcagctccctttcac

SEQ ID NO: 813200 - DNA, 22 bp, Artificial Sequence
  chemically synthesized
ttttttttgcagctccctttca

SEQ ID NO: 813201 - DNA, 22 bp, Artificial Sequence
  chemically synthesized
tttttttttgcagctccctttc

SEQ ID NO: 813202 - DNA, 22 bp, Artificial Sequence
  chemically synthesized
ccctacggggtgaaagggagct

SEQ ID NO: 813203 - DNA, 22 bp, Artificial Sequence
  chemically synthesized
ttttttttttgcagctcccttt

SEQ ID NO: 813204 - DNA, 22 bp, Artificial Sequence
  chemically synthesized
cctacggggtgaaagggagctg

SEQ ID NO: 813205 - DNA, 22 bp, Artificial Sequence
  chemically synthesized
tttttttttttgcagctccctt

SEQ ID NO: 813206 - DNA, 22 bp, Artificial Sequence
  chemically synthesized
ttttttttttttgcagctccct

SEQ ID NO: 813207 - DNA, 22 bp, Artificial Sequence
  chemically synthesized
tttttttttttttgcagctccc

SEQ ID NO: 813208 - DNA, 22 bp, Artificial Sequence
  chemically synthesized
ttttttttttttttgcagctcc

SEQ ID NO: 813209 - DNA, 22 bp, Artificial Sequence
  chemically synthesized
cggggtgaaagggagctgcaaa

SEQ ID NO: 813210 - DNA, 22 bp, Artificial Sequence
  chemically synthesized
tttttttttttttttgcagctc

SEQ ID NO: 813211 - DNA, 22 bp, Artificial Sequence
  chemically synthesized
ttttttttttttttttgcagct

SEQ ID NO: 813212 - DNA, 22 bp, Artificial Sequence
  chemically synthesized
tttttttttttttttttgcagc

SEQ ID NO: 813213 - DNA, 22 bp, Artificial Sequence
  chemically synthesized
ttttttttttttttttttgcag

SEQ ID NO: 813214 - DNA, 22 bp, Artificial Sequence
  chemically synthesized
tttttttttttttttttttgca

SEQ ID NO: 813215 - DNA, 22 bp, Artificial Sequence
  chemically synthesized
ttttttttttttttttttttgc

SEQ ID NO: 813216 - DNA, 22 bp, Artificial Sequence
  chemically synthesized
tttttttttttttttttttttg

SEQ ID NO: 813217 - DNA, 22 bp, Artificial Sequence
  chemically synthesized
tttttttttttttttttttttt

SEQ ID NO: 813218 - DNA, 22 bp, Artificial Sequence
  chemically synthesized
tttttttttttttttttttttt

SEQ ID NO: 813219 - DNA, 22 bp, Artificial Sequence
  chemically synthesized
tttttttttttttttttttttt

SEQ ID NO: 813220 - DNA, 22 bp, Artificial Sequence
  chemically synthesized
tttttttttttttttttttttt

SEQ ID NO: 813221 - DNA, 22 bp, Artificial Sequence
  chemically synthesized
tttttttttttttttttttttt

SEQ ID NO: 813222 - DNA, 22 bp, Artificial Sequence
  chemically synthesized
tttttttttttttttttttttt

SEQ ID NO: 813223 - DNA, 22 bp, Artificial Sequence
  chemically synthesized
tttttttttttttttttttttt

SEQ ID NO: 813224 - DNA, 22 bp, Artificial Sequence
  chemically synthesized
tttttttttttttttttttttt

SEQ ID NO: 813225 - DNA, 22 bp, Artificial Sequence
  chemically synthesized
tttttttttttttttttttttt

SEQ ID NO: 813226 - DNA, 22 bp, Artificial Sequence
  chemically synthesized
tttttttttttttttttttttt

SEQ ID NO: 813227 - DNA, 22 bp, Artificial Sequence
  chemically synthesized
tttttttttttttttttttttt

SEQ ID NO: 813228 - DNA, 22 bp, Artificial Sequence
  chemically synthesized
caaaaaaaaaaaaaaaaaaaaa

SEQ ID NO: 813229 - DNA, 22 bp, Artificial Sequence
  chemically synthesized
tttttttttttttttttttttt

SEQ ID NO: 813230 - DNA, 22 bp, Artificial Sequence
  chemically synthesized
tttttttttttttttttttttt

SEQ ID NO: 813231 - DNA, 22 bp, Artificial Sequence
  chemically synthesized
tttttttttttttttttttttt

SEQ ID NO: 813232 - DNA, 22 bp, Artificial Sequence
  chemically synthesized
tttttttttttttttttttttt

SEQ ID NO: 813233 - DNA, 22 bp, Artificial Sequence
  chemically synthesized
tttttttttttttttttttttt

SEQ ID NO: 813234 - DNA, 22 bp, Artificial Sequence
  chemically synthesized
tttttttttttttttttttttt

SEQ ID NO: 813235 - DNA, 22 bp, Artificial Sequence
  chemically synthesized
tttttttttttttttttttttt

SEQ ID NO: 813236 - DNA, 22 bp, Artificial Sequence
  chemically synthesized
tttttttttttttttttttttt

SEQ ID NO: 813237 - DNA, 22 bp, Artificial Sequence
  chemically synthesized
tttttttttttttttttttttt

SEQ ID NO: 813238 - DNA, 22 bp, Artificial Sequence
  chemically synthesized
tttttttttttttttttttttt

SEQ ID NO: 813239 - DNA, 22 bp, Artificial Sequence
  chemically synthesized
tttttttttttttttttttttt

SEQ ID NO: 813240 - DNA, 22 bp, Artificial Sequence
  chemically synthesized
tttttttttttttttttttttt

SEQ ID NO: 813241 - DNA, 22 bp, Artificial Sequence
  chemically synthesized
tgatcaatagcagatttttttt

SEQ ID NO: 813242 - DNA, 22 bp, Artificial Sequence
  chemically synthesized
ggttgtgatcaatagcagattt

SEQ ID NO: 813243 - DNA, 22 bp, Artificial Sequence
  chemically synthesized
taggttgtgatcaatagcagat

SEQ ID NO: 813244 - DNA, 22 bp, Artificial Sequence
  chemically synthesized
atcagttctaggttgtgatcaa

SEQ ID NO: 813245 - DNA, 22 bp, Artificial Sequence
  chemically synthesized
aatcagttctaggttgtgatca

SEQ ID NO: 813246 - DNA, 22 bp, Artificial Sequence
  chemically synthesized
ctattgatcacaacctagaact

SEQ ID NO: 813247 - DNA, 22 bp, Artificial Sequence
  chemically synthesized
ttgatcacaacctagaactgat

SEQ ID NO: 813248 - DNA, 22 bp, Artificial Sequence
  chemically synthesized
atcacaacctagaactgattaa

SEQ ID NO: 813249 - DNA, 22 bp, Artificial Sequence
  chemically synthesized
aaaagggatgtcatttaatcag

SEQ ID NO: 813250 - DNA, 22 bp, Artificial Sequence
  chemically synthesized
cccctaaaaagggatgtcattt

SEQ ID NO: 813251 - DNA, 22 bp, Artificial Sequence
  chemically synthesized
ccccctaaaaagggatgtcatt

SEQ ID NO: 813252 - DNA, 22 bp, Artificial Sequence
  chemically synthesized
gaactgattaaatgacatccct

SEQ ID NO: 813253 - DNA, 22 bp, Artificial Sequence
  chemically synthesized
caatttccccctaaaaagggat

SEQ ID NO: 813254 - DNA, 22 bp, Artificial Sequence
  chemically synthesized
ccaatttccccctaaaaaggga

SEQ ID NO: 813255 - DNA, 22 bp, Artificial Sequence
  chemically synthesized
attaaatgacatccctttttag

SEQ ID NO: 813256 - DNA, 22 bp, Artificial Sequence
  chemically synthesized
tccaatttccccctaaaaaggg

SEQ ID NO: 813257 - DNA, 22 bp, Artificial Sequence
  chemically synthesized
aatgacatccctttttaggggg

SEQ ID NO: 813258 - DNA, 22 bp, Artificial Sequence
  chemically synthesized
atctttccaatttccccctaaa

SEQ ID NO: 813259 - DNA, 22 bp, Artificial Sequence
  chemically synthesized
tgaaatctaatctttccaattt

SEQ ID NO: 813260 - DNA, 22 bp, Artificial Sequence
  chemically synthesized
atgaaatctaatctttccaatt

SEQ ID NO: 813261 - DNA, 22 bp, Artificial Sequence
  chemically synthesized
tatgaaatctaatctttccaat

SEQ ID NO: 813262 - DNA, 22 bp, Artificial Sequence
  chemically synthesized
tttagggggaaattggaaagat

SEQ ID NO: 813263 - DNA, 22 bp, Artificial Sequence
  chemically synthesized
ttagggggaaattggaaagatt

SEQ ID NO: 813264 - DNA, 22 bp, Artificial Sequence
  chemically synthesized
tagggggaaattggaaagatta

SEQ ID NO: 813265 - DNA, 22 bp, Artificial Sequence
  chemically synthesized
agggggaaattggaaagattag

SEQ ID NO: 813266 - DNA, 22 bp, Artificial Sequence
  chemically synthesized
gggggaaattggaaagattaga

SEQ ID NO: 813267 - DNA, 22 bp, Artificial Sequence
  chemically synthesized
atgagttttatgaaatctaatc

SEQ ID NO: 813268 - DNA, 22 bp, Artificial Sequence
  chemically synthesized
gaaagattagatttcataaaac

SEQ ID NO: 813269 - DNA, 22 bp, Artificial Sequence
  chemically synthesized
gacatataggtattaatgagtt

SEQ ID NO: 813270 - DNA, 22 bp, Artificial Sequence
  chemically synthesized
ggacatataggtattaatgagt

SEQ ID NO: 813271 - DNA, 22 bp, Artificial Sequence
  chemically synthesized
gatttcataaaactcattaata

SEQ ID NO: 813272 - DNA, 22 bp, Artificial Sequence
  chemically synthesized
cataaaactcattaatacctat

SEQ ID NO: 813273 - DNA, 22 bp, Artificial Sequence
  chemically synthesized
ataaaactcattaatacctata

SEQ ID NO: 813274 - DNA, 22 bp, Artificial Sequence
  chemically synthesized
aaaatgtttggacatataggta

SEQ ID NO: 813275 - DNA, 22 bp, Artificial Sequence
  chemically synthesized
tattaaaaatgtttggacatat

SEQ ID NO: 813276 - DNA, 22 bp, Artificial Sequence
  chemically synthesized
atattaaaaatgtttggacata

SEQ ID NO: 813277 - DNA, 22 bp, Artificial Sequence
  chemically synthesized
attaatacctatatgtccaaac

SEQ ID NO: 813278 - DNA, 22 bp, Artificial Sequence
  chemically synthesized
ttatattaaaaatgtttggaca

SEQ ID NO: 813279 - DNA, 22 bp, Artificial Sequence
  chemically synthesized
cttatattaaaaatgtttggac

SEQ ID NO: 813280 - DNA, 22 bp, Artificial Sequence
  chemically synthesized
atacctatatgtccaaacattt

SEQ ID NO: 813281 - DNA, 22 bp, Artificial Sequence
  chemically synthesized
tatgtccaaacatttttaatat

SEQ ID NO: 813282 - DNA, 22 bp, Artificial Sequence
  chemically synthesized
aaatgatttcttatattaaaaa

SEQ ID NO: 813283 - DNA, 22 bp, Artificial Sequence
  chemically synthesized
attcaaatgatttcttatatta

SEQ ID NO: 813284 - DNA, 22 bp, Artificial Sequence
  chemically synthesized
aatcattaattcaaatgatttc

SEQ ID NO: 813285 - DNA, 22 bp, Artificial Sequence
  chemically synthesized
taaatcattaattcaaatgatt

SEQ ID NO: 813286 - DNA, 22 bp, Artificial Sequence
  chemically synthesized
ttaatataagaaatcatttgaa

SEQ ID NO: 813287 - DNA, 22 bp, Artificial Sequence
  chemically synthesized
taatataagaaatcatttgaat

SEQ ID NO: 813288 - DNA, 22 bp, Artificial Sequence
  chemically synthesized
tctaaatcattaattcaaatga

SEQ ID NO: 813289 - DNA, 22 bp, Artificial Sequence
  chemically synthesized
aatataagaaatcatttgaatt

SEQ ID NO: 813290 - DNA, 22 bp, Artificial Sequence
  chemically synthesized
ctctaaatcattaattcaaatg

SEQ ID NO: 813291 - DNA, 22 bp, Artificial Sequence
  chemically synthesized
atataagaaatcatttgaatta

SEQ ID NO: 813292 - DNA, 22 bp, Artificial Sequence
  chemically synthesized
tctctaaatcattaattcaaat

SEQ ID NO: 813293 - DNA, 22 bp, Artificial Sequence
  chemically synthesized
ctttctctaaatcattaattca

SEQ ID NO: 813294 - DNA, 22 bp, Artificial Sequence
  chemically synthesized
cctttctctaaatcattaattc

SEQ ID NO: 813295 - DNA, 22 bp, Artificial Sequence
  chemically synthesized
tttcctttctctaaatcattaa

SEQ ID NO: 813296 - DNA, 22 bp, Artificial Sequence
  chemically synthesized
gaattaatgatttagagaaagg

SEQ ID NO: 813297 - DNA, 22 bp, Artificial Sequence
  chemically synthesized
aattaatgatttagagaaagga

SEQ ID NO: 813298 - DNA, 22 bp, Artificial Sequence
  chemically synthesized
atgatttagagaaaggaaacag

SEQ ID NO: 813299 - DNA, 22 bp, Artificial Sequence
  chemically synthesized
agtatgtaacagggatctgttt

SEQ ID NO: 813300 - DNA, 22 bp, Artificial Sequence
  chemically synthesized
agagaaaggaaacagatccctg

SEQ ID NO: 813301 - DNA, 22 bp, Artificial Sequence
  chemically synthesized
ttcagtatgtaacagggatctg

SEQ ID NO: 813302 - DNA, 22 bp, Artificial Sequence
  chemically synthesized
gagaaaggaaacagatccctgt

SEQ ID NO: 813303 - DNA, 22 bp, Artificial Sequence
  chemically synthesized
attcagtatgtaacagggatct

SEQ ID NO: 813304 - DNA, 22 bp, Artificial Sequence
  chemically synthesized
tattcagtatgtaacagggatc

SEQ ID NO: 813305 - DNA, 22 bp, Artificial Sequence
  chemically synthesized
gctttattcagtatgtaacagg

SEQ ID NO: 813306 - DNA, 22 bp, Artificial Sequence
  chemically synthesized
ggctttattcagtatgtaacag

SEQ ID NO: 813307 - DNA, 22 bp, Artificial Sequence
  chemically synthesized
tggctttattcagtatgtaaca

SEQ ID NO: 813308 - DNA, 22 bp, Artificial Sequence
  chemically synthesized
ggatcctttggctttattcagt

SEQ ID NO: 813309 - DNA, 22 bp, Artificial Sequence
  chemically synthesized
gggatcctttggctttattcag

SEQ ID NO: 813310 - DNA, 22 bp, Artificial Sequence
  chemically synthesized
tgggatcctttggctttattca

SEQ ID NO: 813311 - DNA, 22 bp, Artificial Sequence
  chemically synthesized
ttacatactgaataaagccaaa

SEQ ID NO: 813312 - DNA, 22 bp, Artificial Sequence
  chemically synthesized
tagttttgggatcctttggctt

SEQ ID NO: 813313 - DNA, 22 bp, Artificial Sequence
  chemically synthesized
catactgaataaagccaaagga

SEQ ID NO: 813314 - DNA, 22 bp, Artificial Sequence
  chemically synthesized
atagttttgggatcctttggct

SEQ ID NO: 813315 - DNA, 22 bp, Artificial Sequence
  chemically synthesized
aataaagccaaaggatcccaaa

SEQ ID NO: 813316 - DNA, 22 bp, Artificial Sequence
  chemically synthesized
gaaatcttatagttttgggatc

SEQ ID NO: 813317 - DNA, 22 bp, Artificial Sequence
  chemically synthesized
tagaaatcttatagttttggga

SEQ ID NO: 813318 - DNA, 22 bp, Artificial Sequence
  chemically synthesized
cacaattctagaaatcttatag

SEQ ID NO: 813319 - DNA, 22 bp, Artificial Sequence
  chemically synthesized
tgcacaattctagaaatcttat

SEQ ID NO: 813320 - DNA, 22 bp, Artificial Sequence
  chemically synthesized
ctgcacaattctagaaatctta

SEQ ID NO: 813321 - DNA, 22 bp, Artificial Sequence
  chemically synthesized
tctgcacaattctagaaatctt

SEQ ID NO: 813322 - DNA, 22 bp, Artificial Sequence
  chemically synthesized
ttctgcacaattctagaaatct

SEQ ID NO: 813323 - DNA, 22 bp, Artificial Sequence
  chemically synthesized
tttctgcacaattctagaaatc

SEQ ID NO: 813324 - DNA, 22 bp, Artificial Sequence
  chemically synthesized
ttttctgcacaattctagaaat

SEQ ID NO: 813325 - DNA, 22 bp, Artificial Sequence
  chemically synthesized
atttttttctgcacaattctag

SEQ ID NO: 813326 - DNA, 22 bp, Artificial Sequence
  chemically synthesized
aatttttttctgcacaattcta

SEQ ID NO: 813327 - DNA, 22 bp, Artificial Sequence
  chemically synthesized
taagatttctagaattgtgcag

SEQ ID NO: 813328 - DNA, 22 bp, Artificial Sequence
  chemically synthesized
acttaatttttttctgcacaat

SEQ ID NO: 813329 - DNA, 22 bp, Artificial Sequence
  chemically synthesized
gacttaatttttttctgcacaa

SEQ ID NO: 813330 - DNA, 22 bp, Artificial Sequence
  chemically synthesized
ctagaattgtgcagaaaaaaat

SEQ ID NO: 813331 - DNA, 22 bp, Artificial Sequence
  chemically synthesized
tagaattgtgcagaaaaaaatt

SEQ ID NO: 813332 - DNA, 22 bp, Artificial Sequence
  chemically synthesized
gaattgtgcagaaaaaaattaa

SEQ ID NO: 813333 - DNA, 22 bp, Artificial Sequence
  chemically synthesized
tgcagaaaaaaattaagtcaag

SEQ ID NO: 813334 - DNA, 22 bp, Artificial Sequence
  chemically synthesized
ataaatgaatataatcatcact

SEQ ID NO: 813335 - DNA, 22 bp, Artificial Sequence
  chemically synthesized
aataaatgaatataatcatcac

SEQ ID NO: 813336 - DNA, 22 bp, Artificial Sequence
  chemically synthesized
taataaatgaatataatcatca

SEQ ID NO: 813337 - DNA, 22 bp, Artificial Sequence
  chemically synthesized
ttaataaatgaatataatcatc

SEQ ID NO: 813338 - DNA, 22 bp, Artificial Sequence
  chemically synthesized
tttaataaatgaatataatcat

SEQ ID NO: 813339 - DNA, 22 bp, Artificial Sequence
  chemically synthesized
ttttaataaatgaatataatca

SEQ ID NO: 813340 - DNA, 22 bp, Artificial Sequence
  chemically synthesized
agtcaagtgatgattatattca

SEQ ID NO: 813341 - DNA, 22 bp, Artificial Sequence
  chemically synthesized
agtttttttaataaatgaatat

SEQ ID NO: 813342 - DNA, 22 bp, Artificial Sequence
  chemically synthesized
gaaagttgagtttttttaataa

SEQ ID NO: 813343 - DNA, 22 bp, Artificial Sequence
  chemically synthesized
agaaagttgagtttttttaata

SEQ ID NO: 813344 - DNA, 22 bp, Artificial Sequence
  chemically synthesized
tagaaagttgagtttttttaat

SEQ ID NO: 813345 - DNA, 22 bp, Artificial Sequence
  chemically synthesized
ttagaaagttgagtttttttaa

SEQ ID NO: 813346 - DNA, 22 bp, Artificial Sequence
  chemically synthesized
tattcatttattaaaaaaactc

SEQ ID NO: 813347 - DNA, 22 bp, Artificial Sequence
  chemically synthesized
tttttagaaagttgagtttttt

SEQ ID NO: 813348 - DNA, 22 bp, Artificial Sequence
  chemically synthesized
atttttagaaagttgagttttt

SEQ ID NO: 813349 - DNA, 22 bp, Artificial Sequence
  chemically synthesized
atttattaaaaaaactcaactt

SEQ ID NO: 813350 - DNA, 22 bp, Artificial Sequence
  chemically synthesized
attaaaaaaactcaactttcta

SEQ ID NO: 813351 - DNA, 22 bp, Artificial Sequence
  chemically synthesized
ttaaaaaaactcaactttctaa

SEQ ID NO: 813352 - DNA, 22 bp, Artificial Sequence
  chemically synthesized
ggtagatttatttttagaaagt

SEQ ID NO: 813353 - DNA, 22 bp, Artificial Sequence
  chemically synthesized
aggtagatttatttttagaaag

SEQ ID NO: 813354 - DNA, 22 bp, Artificial Sequence
  chemically synthesized
aaaaaactcaactttctaaaaa

SEQ ID NO: 813355 - DNA, 22 bp, Artificial Sequence
  chemically synthesized
aactttctaaaaataaatctac

SEQ ID NO: 813356 - DNA, 22 bp, Artificial Sequence
  chemically synthesized
tctaaaaataaatctacctaaa

SEQ ID NO: 813357 - DNA, 22 bp, Artificial Sequence
  chemically synthesized
ctaaaaataaatctacctaaat

SEQ ID NO: 813358 - DNA, 22 bp, Artificial Sequence
  chemically synthesized
aataaaaatagaatttaggtag

SEQ ID NO: 813359 - DNA, 22 bp, Artificial Sequence
  chemically synthesized
taaaaataaatctacctaaatt

SEQ ID NO: 813360 - DNA, 22 bp, Artificial Sequence
  chemically synthesized
aaaataaatctacctaaattct

SEQ ID NO: 813361 - DNA, 22 bp, Artificial Sequence
  chemically synthesized
aaacattcaataaaaatagaat

SEQ ID NO: 813362 - DNA, 22 bp, Artificial Sequence
  chemically synthesized
aaaacattcaataaaaatagaa

SEQ ID NO: 813363 - DNA, 22 bp, Artificial Sequence
  chemically synthesized
taaaacattcaataaaaataga

SEQ ID NO: 813364 - DNA, 22 bp, Artificial Sequence
  chemically synthesized
tttaaaacattcaataaaaata

SEQ ID NO: 813365 - DNA, 22 bp, Artificial Sequence
  chemically synthesized
ctttaaaacattcaataaaaat

SEQ ID NO: 813366 - DNA, 22 bp, Artificial Sequence
  chemically synthesized
cctaaattctatttttattgaa

SEQ ID NO: 813367 - DNA, 22 bp, Artificial Sequence
  chemically synthesized
aattctatttttattgaatgtt

SEQ ID NO: 813368 - DNA, 22 bp, Artificial Sequence
  chemically synthesized
agaaagacttctttaaaacatt

SEQ ID NO: 813369 - DNA, 22 bp, Artificial Sequence
  chemically synthesized
tatttttattgaatgttttaaa

SEQ ID NO: 813370 - DNA, 22 bp, Artificial Sequence
  chemically synthesized
tcagaaagacttctttaaaaca

SEQ ID NO: 813371 - DNA, 22 bp, Artificial Sequence
  chemically synthesized
tttttattgaatgttttaaaga

SEQ ID NO: 813372 - DNA, 22 bp, Artificial Sequence
  chemically synthesized
ttattgaatgttttaaagaagt

SEQ ID NO: 813373 - DNA, 22 bp, Artificial Sequence
  chemically synthesized
tattgaatgttttaaagaagtc

SEQ ID NO: 813374 - DNA, 22 bp, Artificial Sequence
  chemically synthesized
attgaatgttttaaagaagtct

SEQ ID NO: 813375 - DNA, 22 bp, Artificial Sequence
  chemically synthesized
ttgaatgttttaaagaagtctt

SEQ ID NO: 813376 - DNA, 22 bp, Artificial Sequence
  chemically synthesized
tatcattctcagaaagacttct

SEQ ID NO: 813377 - DNA, 22 bp, Artificial Sequence
  chemically synthesized
aatgttttaaagaagtctttct

SEQ ID NO: 813378 - DNA, 22 bp, Artificial Sequence
  chemically synthesized
tctgtatcattctcagaaagac

SEQ ID NO: 813379 - DNA, 22 bp, Artificial Sequence
  chemically synthesized
tatctgtatcattctcagaaag

SEQ ID NO: 813380 - DNA, 22 bp, Artificial Sequence
  chemically synthesized
ctatctgtatcattctcagaaa

SEQ ID NO: 813381 - DNA, 22 bp, Artificial Sequence
  chemically synthesized
taaagaagtctttctgagaatg

SEQ ID NO: 813382 - DNA, 22 bp, Artificial Sequence
  chemically synthesized
aaagaagtctttctgagaatga

SEQ ID NO: 813383 - DNA, 22 bp, Artificial Sequence
  chemically synthesized
tttctatctgtatcattctcag

SEQ ID NO: 813384 - DNA, 22 bp, Artificial Sequence
  chemically synthesized
aagaagtctttctgagaatgat

SEQ ID NO: 813385 - DNA, 22 bp, Artificial Sequence
  chemically synthesized
atttctatctgtatcattctca

SEQ ID NO: 813386 - DNA, 22 bp, Artificial Sequence
  chemically synthesized
tatttctatctgtatcattctc

SEQ ID NO: 813387 - DNA, 22 bp, Artificial Sequence
  chemically synthesized
attttatttctatctgtatcat

SEQ ID NO: 813388 - DNA, 22 bp, Artificial Sequence
  chemically synthesized
cattttatttctatctgtatca

SEQ ID NO: 813389 - DNA, 22 bp, Artificial Sequence
  chemically synthesized
tcattttatttctatctgtatc

SEQ ID NO: 813390 - DNA, 22 bp, Artificial Sequence
  chemically synthesized
tctgagaatgatacagatagaa

SEQ ID NO: 813391 - DNA, 22 bp, Artificial Sequence
  chemically synthesized
ctgagaatgatacagatagaaa

SEQ ID NO: 813392 - DNA, 22 bp, Artificial Sequence
  chemically synthesized
tgagaatgatacagatagaaat

SEQ ID NO: 813393 - DNA, 22 bp, Artificial Sequence
  chemically synthesized
tattttcattttatttctatct

SEQ ID NO: 813394 - DNA, 22 bp, Artificial Sequence
  chemically synthesized
atattttcattttatttctatc

SEQ ID NO: 813395 - DNA, 22 bp, Artificial Sequence
  chemically synthesized
agaatgatacagatagaaataa

SEQ ID NO: 813396 - DNA, 22 bp, Artificial Sequence
  chemically synthesized
tatttatattttcattttattt

SEQ ID NO: 813397 - DNA, 22 bp, Artificial Sequence
  chemically synthesized
aattatatttatattttcattt

SEQ ID NO: 813398 - DNA, 22 bp, Artificial Sequence
  chemically synthesized
caattatatttatattttcatt

SEQ ID NO: 813399 - DNA, 22 bp, Artificial Sequence
  chemically synthesized
tcaattatatttatattttcat

SEQ ID NO: 813400 - DNA, 22 bp, Artificial Sequence
  chemically synthesized
ttcaattatatttatattttca

SEQ ID NO: 813401 - DNA, 22 bp, Artificial Sequence
  chemically synthesized
cttttcaattatatttatattt

SEQ ID NO: 813402 - DNA, 22 bp, Artificial Sequence
  chemically synthesized
caatacccatcatgttactttt

SEQ ID NO: 813403 - DNA, 22 bp, Artificial Sequence
  chemically synthesized
gctacaatacccatcatgttac

SEQ ID NO: 813404 - DNA, 22 bp, Artificial Sequence
  chemically synthesized
atgttagctacaatacccatca

SEQ ID NO: 813405 - DNA, 22 bp, Artificial Sequence
  chemically synthesized
aaaagtaacatgatgggtattg

SEQ ID NO: 813406 - DNA, 22 bp, Artificial Sequence
  chemically synthesized
aaccattaatgttagctacaat

SEQ ID NO: 813407 - DNA, 22 bp, Artificial Sequence
  chemically synthesized
attgaaccattaatgttagcta

SEQ ID NO: 813408 - DNA, 22 bp, Artificial Sequence
  chemically synthesized
aattgaaccattaatgttagct

SEQ ID NO: 813409 - DNA, 22 bp, Artificial Sequence
  chemically synthesized
gtttaattgaaccattaatgtt

SEQ ID NO: 813410 - DNA, 22 bp, Artificial Sequence
  chemically synthesized
ggtttaattgaaccattaatgt

SEQ ID NO: 813411 - DNA, 22 bp, Artificial Sequence
  chemically synthesized
tttggtttaattgaaccattaa

SEQ ID NO: 813412 - DNA, 22 bp, Artificial Sequence
  chemically synthesized
atttggtttaattgaaccatta

SEQ ID NO: 813413 - DNA, 22 bp, Artificial Sequence
  chemically synthesized
tagctaacattaatggttcaat

SEQ ID NO: 813414 - DNA, 22 bp, Artificial Sequence
  chemically synthesized
ttatttggtttaattgaaccat

SEQ ID NO: 813415 - DNA, 22 bp, Artificial Sequence
  chemically synthesized
cttatttggtttaattgaacca

SEQ ID NO: 813416 - DNA, 22 bp, Artificial Sequence
  chemically synthesized
tcttatttggtttaattgaacc

SEQ ID NO: 813417 - DNA, 22 bp, Artificial Sequence
  chemically synthesized
ttcttatttggtttaattgaac

SEQ ID NO: 813418 - DNA, 22 bp, Artificial Sequence
  chemically synthesized
acattaatggttcaattaaacc

SEQ ID NO: 813419 - DNA, 22 bp, Artificial Sequence
  chemically synthesized
atggttcaattaaaccaaataa

SEQ ID NO: 813420 - DNA, 22 bp, Artificial Sequence
  chemically synthesized
aattaaaccaaataagaaaaac

SEQ ID NO: 813421 - DNA, 22 bp, Artificial Sequence
  chemically synthesized
aagcaaatgggagaaagttttt

SEQ ID NO: 813422 - DNA, 22 bp, Artificial Sequence
  chemically synthesized
aaccaaataagaaaaactttct

SEQ ID NO: 813423 - DNA, 22 bp, Artificial Sequence
  chemically synthesized
cagtatcaaatattaaagcaaa

SEQ ID NO: 813424 - DNA, 22 bp, Artificial Sequence
  chemically synthesized
tctcccatttgctttaatattt

SEQ ID NO: 813425 - DNA, 22 bp, Artificial Sequence
  chemically synthesized
ctcccatttgctttaatatttg

SEQ ID NO: 813426 - DNA, 22 bp, Artificial Sequence
  chemically synthesized
atattacagtatcaaatattaa

SEQ ID NO: 813427 - DNA, 22 bp, Artificial Sequence
  chemically synthesized
tcccatttgctttaatatttga

SEQ ID NO: 813428 - DNA, 22 bp, Artificial Sequence
  chemically synthesized
aatattacagtatcaaatatta

SEQ ID NO: 813429 - DNA, 22 bp, Artificial Sequence
  chemically synthesized
ccatttgctttaatatttgata

SEQ ID NO: 813430 - DNA, 22 bp, Artificial Sequence
  chemically synthesized
gctttaatatttgatactgtaa

SEQ ID NO: 813431 - DNA, 22 bp, Artificial Sequence
  chemically synthesized
ataaatttaatattacagtatc

SEQ ID NO: 813432 - DNA, 22 bp, Artificial Sequence
  chemically synthesized
ctttaatatttgatactgtaat

SEQ ID NO: 813433 - DNA, 22 bp, Artificial Sequence
  chemically synthesized
ttcataaatttaatattacagt

SEQ ID NO: 813434 - DNA, 22 bp, Artificial Sequence
  chemically synthesized
taatatttgatactgtaatatt

SEQ ID NO: 813435 - DNA, 22 bp, Artificial Sequence
  chemically synthesized
gttcataaatttaatattacag

SEQ ID NO: 813436 - DNA, 22 bp, Artificial Sequence
  chemically synthesized
aatatttgatactgtaatatta

SEQ ID NO: 813437 - DNA, 22 bp, Artificial Sequence
  chemically synthesized
tgttcataaatttaatattaca

SEQ ID NO: 813438 - DNA, 22 bp, Artificial Sequence
  chemically synthesized
atatttgatactgtaatattaa

SEQ ID NO: 813439 - DNA, 22 bp, Artificial Sequence
  chemically synthesized
ttgttcataaatttaatattac

SEQ ID NO: 813440 - DNA, 22 bp, Artificial Sequence
  chemically synthesized
tttgttcataaatttaatatta

SEQ ID NO: 813441 - DNA, 22 bp, Artificial Sequence
  chemically synthesized
ttttttgttcataaatttaata

SEQ ID NO: 813442 - DNA, 22 bp, Artificial Sequence
  chemically synthesized
gatactgtaatattaaatttat

SEQ ID NO: 813443 - DNA, 22 bp, Artificial Sequence
  chemically synthesized
atactgtaatattaaatttatg

SEQ ID NO: 813444 - DNA, 22 bp, Artificial Sequence
  chemically synthesized
taatattaaatttatgaacaaa

SEQ ID NO: 813445 - DNA, 22 bp, Artificial Sequence
  chemically synthesized
aatttatgaacaaaaaacagtc

SEQ ID NO: 813446 - DNA, 22 bp, Artificial Sequence
  chemically synthesized
taggataccaacagactgtttt

SEQ ID NO: 813447 - DNA, 22 bp, Artificial Sequence
  chemically synthesized
atgaacaaaaaacagtctgttg

SEQ ID NO: 813448 - DNA, 22 bp, Artificial Sequence
  chemically synthesized
tgaacaaaaaacagtctgttgg

SEQ ID NO: 813449 - DNA, 22 bp, Artificial Sequence
  chemically synthesized
ataaaaaattataggataccaa

SEQ ID NO: 813450 - DNA, 22 bp, Artificial Sequence
  chemically synthesized
ctaataaaaaattataggatac

SEQ ID NO: 813451 - DNA, 22 bp, Artificial Sequence
  chemically synthesized
cctaataaaaaattataggata

SEQ ID NO: 813452 - DNA, 22 bp, Artificial Sequence
  chemically synthesized
tttcctaataaaaaattatagg

SEQ ID NO: 813453 - DNA, 22 bp, Artificial Sequence
  chemically synthesized
ttggtatcctataattttttat

SEQ ID NO: 813454 - DNA, 22 bp, Artificial Sequence
  chemically synthesized
ccattgtttcctaataaaaaat

SEQ ID NO: 813455 - DNA, 22 bp, Artificial Sequence
  chemically synthesized
accattgtttcctaataaaaaa

SEQ ID NO: 813456 - DNA, 22 bp, Artificial Sequence
  chemically synthesized
gtatcctataattttttattag

SEQ ID NO: 813457 - DNA, 22 bp, Artificial Sequence
  chemically synthesized
taattttttattaggaaacaat

SEQ ID NO: 813458 - DNA, 22 bp, Artificial Sequence
  chemically synthesized
tcgaaaacttaccattgtttcc

SEQ ID NO: 813459 - DNA, 22 bp, Artificial Sequence
  chemically synthesized
tttattaggaaacaatggtaag

SEQ ID NO: 813460 - DNA, 22 bp, Artificial Sequence
  chemically synthesized
ttattaggaaacaatggtaagt

SEQ ID NO: 813461 - DNA, 22 bp, Artificial Sequence
  chemically synthesized
tattaggaaacaatggtaagtt

SEQ ID NO: 813462 - DNA, 22 bp, Artificial Sequence
  chemically synthesized
attaggaaacaatggtaagttt

SEQ ID NO: 813463 - DNA, 22 bp, Artificial Sequence
  chemically synthesized
ttaggaaacaatggtaagtttt

SEQ ID NO: 813464 - DNA, 22 bp, Artificial Sequence
  chemically synthesized
ggaaacaatggtaagttttcga

SEQ ID NO: 813465 - DNA, 22 bp, Artificial Sequence
  chemically synthesized
ccaggaaaaacaatagtattat

SEQ ID NO: 813466 - DNA, 22 bp, Artificial Sequence
  chemically synthesized
cccaggaaaaacaatagtatta

SEQ ID NO: 813467 - DNA, 22 bp, Artificial Sequence
  chemically synthesized
tcccaggaaaaacaatagtatt

SEQ ID NO: 813468 - DNA, 22 bp, Artificial Sequence
  chemically synthesized
tcgataatactattgtttttcc

SEQ ID NO: 813469 - DNA, 22 bp, Artificial Sequence
  chemically synthesized
cgataatactattgtttttcct

SEQ ID NO: 813470 - DNA, 22 bp, Artificial Sequence
  chemically synthesized
gataatactattgtttttcctg

SEQ ID NO: 813471 - DNA, 22 bp, Artificial Sequence
  chemically synthesized
tgtatcagttttcccaggaaaa

SEQ ID NO: 813472 - DNA, 22 bp, Artificial Sequence
  chemically synthesized
ctatgtatcagttttcccagga

SEQ ID NO: 813473 - DNA, 22 bp, Artificial Sequence
  chemically synthesized
ttgtttttcctgggaaaactga

SEQ ID NO: 813474 - DNA, 22 bp, Artificial Sequence
  chemically synthesized
tttttcctgggaaaactgatac

SEQ ID NO: 813475 - DNA, 22 bp, Artificial Sequence
  chemically synthesized
gaaatgctcctatgtatcagtt

SEQ ID NO: 813476 - DNA, 22 bp, Artificial Sequence
  chemically synthesized
agaaatgctcctatgtatcagt

SEQ ID NO: 813477 - DNA, 22 bp, Artificial Sequence
  chemically synthesized
ttcctgggaaaactgatacata

SEQ ID NO: 813478 - DNA, 22 bp, Artificial Sequence
  chemically synthesized
tcctgggaaaactgatacatag

SEQ ID NO: 813479 - DNA, 22 bp, Artificial Sequence
  chemically synthesized
cctgggaaaactgatacatagg

SEQ ID NO: 813480 - DNA, 22 bp, Artificial Sequence
  chemically synthesized
ctgggaaaactgatacatagga

SEQ ID NO: 813481 - DNA, 22 bp, Artificial Sequence
  chemically synthesized
ggaaaactgatacataggagca

SEQ ID NO: 813482 - DNA, 22 bp, Artificial Sequence
  chemically synthesized
atacataggagcatttctaagc

SEQ ID NO: 813483 - DNA, 22 bp, Artificial Sequence
  chemically synthesized
aaccaacgcaccaaaatatatg

SEQ ID NO: 813484 - DNA, 22 bp, Artificial Sequence
  chemically synthesized
ggctgaaccaacgcaccaaaat

SEQ ID NO: 813485 - DNA, 22 bp, Artificial Sequence
  chemically synthesized
ctaagcatatattttggtgcgt

SEQ ID NO: 813486 - DNA, 22 bp, Artificial Sequence
  chemically synthesized
taagcatatattttggtgcgtt

SEQ ID NO: 813487 - DNA, 22 bp, Artificial Sequence
  chemically synthesized
agcatatattttggtgcgttgg

SEQ ID NO: 813488 - DNA, 22 bp, Artificial Sequence
  chemically synthesized
aactgggctgaaccaacgcacc

SEQ ID NO: 813489 - DNA, 22 bp, Artificial Sequence
  chemically synthesized
cagtcctgaactgggctgaacc

SEQ ID NO: 813490 - DNA, 22 bp, Artificial Sequence
  chemically synthesized
tggtgcgttggttcagcccagt

SEQ ID NO: 813491 - DNA, 22 bp, Artificial Sequence
  chemically synthesized
ggtgcgttggttcagcccagtt

SEQ ID NO: 813492 - DNA, 22 bp, Artificial Sequence
  chemically synthesized
gtgcgttggttcagcccagttc

SEQ ID NO: 813493 - DNA, 22 bp, Artificial Sequence
  chemically synthesized
acccagtcctacagtcctgaac

SEQ ID NO: 813494 - DNA, 22 bp, Artificial Sequence
  chemically synthesized
gttcagcccagttcaggactgt

SEQ ID NO: 813495 - DNA, 22 bp, Artificial Sequence
  chemically synthesized
taacccagtcctacagtcctga

SEQ ID NO: 813496 - DNA, 22 bp, Artificial Sequence
  chemically synthesized
agcccagttcaggactgtagga

SEQ ID NO: 813497 - DNA, 22 bp, Artificial Sequence
  chemically synthesized
attctaacccagtcctacagtc

SEQ ID NO: 813498 - DNA, 22 bp, Artificial Sequence
  chemically synthesized
cattctaacccagtcctacagt

SEQ ID NO: 813499 - DNA, 22 bp, Artificial Sequence
  chemically synthesized
tcattctaacccagtcctacag

SEQ ID NO: 813500 - DNA, 22 bp, Artificial Sequence
  chemically synthesized
aggactgtaggactgggttaga

SEQ ID NO: 813501 - DNA, 22 bp, Artificial Sequence
  chemically synthesized
taggactgggttagaatgaaaa

SEQ ID NO: 813502 - DNA, 22 bp, Artificial Sequence
  chemically synthesized
ggttagaatgaaaatggctact

SEQ ID NO: 813503 - DNA, 22 bp, Artificial Sequence
  chemically synthesized
gtgatgtagccaagtagccatt

SEQ ID NO: 813504 - DNA, 22 bp, Artificial Sequence
  chemically synthesized
cctggtgatgtagccaagtagc

SEQ ID NO: 813505 - DNA, 22 bp, Artificial Sequence
  chemically synthesized
gaatgaaaatggctacttggct

SEQ ID NO: 813506 - DNA, 22 bp, Artificial Sequence
  chemically synthesized
gtgtggaaaattacctggtgat

SEQ ID NO: 813507 - DNA, 22 bp, Artificial Sequence
  chemically synthesized
cttggctacatcaccaggtaat

SEQ ID NO: 813508 - DNA, 22 bp, Artificial Sequence
  chemically synthesized
ctggtgtggaaaattacctggt

SEQ ID NO: 813509 - DNA, 22 bp, Artificial Sequence
  chemically synthesized
actggtgtggaaaattacctgg

SEQ ID NO: 813510 - DNA, 22 bp, Artificial Sequence
  chemically synthesized
ggctacatcaccaggtaatttt

SEQ ID NO: 813511 - DNA, 22 bp, Artificial Sequence
  chemically synthesized
gctacatcaccaggtaattttc

SEQ ID NO: 813512 - DNA, 22 bp, Artificial Sequence
  chemically synthesized
catcaccaggtaattttccaca

SEQ ID NO: 813513 - DNA, 22 bp, Artificial Sequence
  chemically synthesized
gtgatttactggtgtggaaaat

SEQ ID NO: 813514 - DNA, 22 bp, Artificial Sequence
  chemically synthesized
gaaccatgtcattggtgattta

SEQ ID NO: 813515 - DNA, 22 bp, Artificial Sequence
  chemically synthesized
ggaaccatgtcattggtgattt

SEQ ID NO: 813516 - DNA, 22 bp, Artificial Sequence
  chemically synthesized
tccacaccagtaaatcaccaat

SEQ ID NO: 813517 - DNA, 22 bp, Artificial Sequence
  chemically synthesized
ccacaccagtaaatcaccaatg

SEQ ID NO: 813518 - DNA, 22 bp, Artificial Sequence
  chemically synthesized
cacaccagtaaatcaccaatga

SEQ ID NO: 813519 - DNA, 22 bp, Artificial Sequence
  chemically synthesized
cacacaaagggagacatttgga

SEQ ID NO: 813520 - DNA, 22 bp, Artificial Sequence
  chemically synthesized
cagggattgcacacaaagggag

SEQ ID NO: 813521 - DNA, 22 bp, Artificial Sequence
  chemically synthesized
gcagggattgcacacaaaggga

SEQ ID NO: 813522 - DNA, 22 bp, Artificial Sequence
  chemically synthesized
caaatgtctccctttgtgtgca

SEQ ID NO: 813523 - DNA, 22 bp, Artificial Sequence
  chemically synthesized
gcttgcagggattgcacacaaa

SEQ ID NO: 813524 - DNA, 22 bp, Artificial Sequence
  chemically synthesized
tagcttgcagggattgcacaca

SEQ ID NO: 813525 - DNA, 22 bp, Artificial Sequence
  chemically synthesized
ctagcttgcagggattgcacac

SEQ ID NO: 813526 - DNA, 22 bp, Artificial Sequence
  chemically synthesized
cctttgtgtgcaatccctgcaa

SEQ ID NO: 813527 - DNA, 22 bp, Artificial Sequence
  chemically synthesized
gaatgtttctagcttgcaggga

SEQ ID NO: 813528 - DNA, 22 bp, Artificial Sequence
  chemically synthesized
tgtgtgcaatccctgcaagcta

SEQ ID NO: 813529 - DNA, 22 bp, Artificial Sequence
  chemically synthesized
gtgtgcaatccctgcaagctag

SEQ ID NO: 813530 - DNA, 22 bp, Artificial Sequence
  chemically synthesized
tgtgcaatccctgcaagctaga

SEQ ID NO: 813531 - DNA, 22 bp, Artificial Sequence
  chemically synthesized
aagtaattagaatgtttctagc

SEQ ID NO: 813532 - DNA, 22 bp, Artificial Sequence
  chemically synthesized
caagtaattagaatgtttctag

SEQ ID NO: 813533 - DNA, 22 bp, Artificial Sequence
  chemically synthesized
tcaagtaattagaatgtttcta

SEQ ID NO: 813534 - DNA, 22 bp, Artificial Sequence
  chemically synthesized
ctttcaagtaattagaatgttt

SEQ ID NO: 813535 - DNA, 22 bp, Artificial Sequence
  chemically synthesized
caagctagaaacattctaatta

SEQ ID NO: 813536 - DNA, 22 bp, Artificial Sequence
  chemically synthesized
tgtcatctcctttcaagtaatt

SEQ ID NO: 813537 - DNA, 22 bp, Artificial Sequence
  chemically synthesized
atgtcatctcctttcaagtaat

SEQ ID NO: 813538 - DNA, 22 bp, Artificial Sequence
  chemically synthesized
gaaacattctaattacttgaaa

SEQ ID NO: 813539 - DNA, 22 bp, Artificial Sequence
  chemically synthesized
tatgtcatctcctttcaagtaa

SEQ ID NO: 813540 - DNA, 22 bp, Artificial Sequence
  chemically synthesized
attttatgtcatctcctttcaa

SEQ ID NO: 813541 - DNA, 22 bp, Artificial Sequence
  chemically synthesized
cattttatgtcatctcctttca

SEQ ID NO: 813542 - DNA, 22 bp, Artificial Sequence
  chemically synthesized
cttcattttatgtcatctcctt

SEQ ID NO: 813543 - DNA, 22 bp, Artificial Sequence
  chemically synthesized
taattacttgaaaggagatgac

SEQ ID NO: 813544 - DNA, 22 bp, Artificial Sequence
  chemically synthesized
attacttgaaaggagatgacat

SEQ ID NO: 813545 - DNA, 22 bp, Artificial Sequence
  chemically synthesized
cttgaaaggagatgacataaaa

SEQ ID NO: 813546 - DNA, 22 bp, Artificial Sequence
  chemically synthesized
gaaaggagatgacataaaatga

SEQ ID NO: 813547 - DNA, 22 bp, Artificial Sequence
  chemically synthesized
aaaggagatgacataaaatgaa

SEQ ID NO: 813548 - DNA, 22 bp, Artificial Sequence
  chemically synthesized
atagtggtaacagcctgcttca

SEQ ID NO: 813549 - DNA, 22 bp, Artificial Sequence
  chemically synthesized
aaaggttcatagtggtaacagc

SEQ ID NO: 813550 - DNA, 22 bp, Artificial Sequence
  chemically synthesized
ttaccactatgaaccttttaga

SEQ ID NO: 813551 - DNA, 22 bp, Artificial Sequence
  chemically synthesized
ccactatgaaccttttagatcc

SEQ ID NO: 813552 - DNA, 22 bp, Artificial Sequence
  chemically synthesized
tgaaccttttagatccatatgg

SEQ ID NO: 813553 - DNA, 22 bp, Artificial Sequence
  chemically synthesized
ttagatccatatggatcatgac

SEQ ID NO: 813554 - DNA, 22 bp, Artificial Sequence
  chemically synthesized
tagatccatatggatcatgaca

SEQ ID NO: 813555 - DNA, 22 bp, Artificial Sequence
  chemically synthesized
cgggccagagagtgtcatgatc

SEQ ID NO: 813556 - DNA, 22 bp, Artificial Sequence
  chemically synthesized
agatccatatggatcatgacac

SEQ ID NO: 813557 - DNA, 22 bp, Artificial Sequence
  chemically synthesized
gatccatatggatcatgacact

SEQ ID NO: 813558 - DNA, 22 bp, Artificial Sequence
  chemically synthesized
gggctccgggccagagagtgtc

SEQ ID NO: 813559 - DNA, 22 bp, Artificial Sequence
  chemically synthesized
ggggctccgggccagagagtgt

SEQ ID NO: 813560 - DNA, 22 bp, Artificial Sequence
  chemically synthesized
tgatgtgaaatcttggggctcc

SEQ ID NO: 813561 - DNA, 22 bp, Artificial Sequence
  chemically synthesized
tctggcccggagccccaagatt

SEQ ID NO: 813562 - DNA, 22 bp, Artificial Sequence
  chemically synthesized
tggcccggagccccaagatttc

SEQ ID NO: 813563 - DNA, 22 bp, Artificial Sequence
  chemically synthesized
gcccggagccccaagatttcac

SEQ ID NO: 813564 - DNA, 22 bp, Artificial Sequence
  chemically synthesized
cagtagggtaatataacatcta

SEQ ID NO: 813565 - DNA, 22 bp, Artificial Sequence
  chemically synthesized
tacagtagggtaatataacatc

SEQ ID NO: 813566 - DNA, 22 bp, Artificial Sequence
  chemically synthesized
cacatcatagatgttatattac

SEQ ID NO: 813567 - DNA, 22 bp, Artificial Sequence
  chemically synthesized
acatcatagatgttatattacc

SEQ ID NO: 813568 - DNA, 22 bp, Artificial Sequence
  chemically synthesized
cattctacagtagggtaatata

SEQ ID NO: 813569 - DNA, 22 bp, Artificial Sequence
  chemically synthesized
tgcattctacagtagggtaata

SEQ ID NO: 813570 - DNA, 22 bp, Artificial Sequence
  chemically synthesized
tctgcattctacagtagggtaa

SEQ ID NO: 813571 - DNA, 22 bp, Artificial Sequence
  chemically synthesized
tattaccctactgtagaatgca

SEQ ID NO: 813572 - DNA, 22 bp, Artificial Sequence
  chemically synthesized
ccctactgtagaatgcagagaa

SEQ ID NO: 813573 - DNA, 22 bp, Artificial Sequence
  chemically synthesized
aaaaaaaaaaaaaaattctctg

SEQ ID NO: 813574 - DNA, 22 bp, Artificial Sequence
  chemically synthesized
ctgtagaatgcagagaattttt

SEQ ID NO: 813575 - DNA, 22 bp, Artificial Sequence
  chemically synthesized
tctcaaaaaaaaaaaaaaattc

SEQ ID NO: 813576 - DNA, 22 bp, Artificial Sequence
  chemically synthesized
tagaatgcagagaatttttttt

SEQ ID NO: 813577 - DNA, 22 bp, Artificial Sequence
  chemically synthesized
gtctcaaaaaaaaaaaaaaatt

SEQ ID NO: 813578 - DNA, 22 bp, Artificial Sequence
  chemically synthesized
tgtctcaaaaaaaaaaaaaaat

SEQ ID NO: 813579 - DNA, 22 bp, Artificial Sequence
  chemically synthesized
ttttttttttttgagacaaagt

SEQ ID NO: 813580 - DNA, 22 bp, Artificial Sequence
  chemically synthesized
tttttttttttgagacaaagtc

SEQ ID NO: 813581 - DNA, 22 bp, Artificial Sequence
  chemically synthesized
ttttttttttgagacaaagtct

SEQ ID NO: 813582 - DNA, 22 bp, Artificial Sequence
  chemically synthesized
ggcgacagagcaagactttgtc

SEQ ID NO: 813583 - DNA, 22 bp, Artificial Sequence
  chemically synthesized
tttttttttgagacaaagtctt

SEQ ID NO: 813584 - DNA, 22 bp, Artificial Sequence
  chemically synthesized
ttttttttgagacaaagtcttg

SEQ ID NO: 813585 - DNA, 22 bp, Artificial Sequence
  chemically synthesized
tttttttgagacaaagtcttgc

SEQ ID NO: 813586 - DNA, 22 bp, Artificial Sequence
  chemically synthesized
ttttttgagacaaagtcttgct

SEQ ID NO: 813587 - DNA, 22 bp, Artificial Sequence
  chemically synthesized
tttttgagacaaagtcttgctc

SEQ ID NO: 813588 - DNA, 22 bp, Artificial Sequence
  chemically synthesized
ttttgagacaaagtcttgctct

SEQ ID NO: 813589 - DNA, 22 bp, Artificial Sequence
  chemically synthesized
tttgagacaaagtcttgctctg

SEQ ID NO: 813590 - DNA, 22 bp, Artificial Sequence
  chemically synthesized
cagcctgggcgacagagcaaga

SEQ ID NO: 813591 - DNA, 22 bp, Artificial Sequence
  chemically synthesized
ttgagacaaagtcttgctctgt

SEQ ID NO: 813592 - DNA, 22 bp, Artificial Sequence
  chemically synthesized
tgagacaaagtcttgctctgtc

SEQ ID NO: 813593 - DNA, 22 bp, Artificial Sequence
  chemically synthesized
gagacaaagtcttgctctgtcg

SEQ ID NO: 813594 - DNA, 22 bp, Artificial Sequence
  chemically synthesized
agacaaagtcttgctctgtcgc

SEQ ID NO: 813595 - DNA, 22 bp, Artificial Sequence
  chemically synthesized
cactacagcctgggcgacagag

SEQ ID NO: 813596 - DNA, 22 bp, Artificial Sequence
  chemically synthesized
tgccactgcactacagcctggg

SEQ ID NO: 813597 - DNA, 22 bp, Artificial Sequence
  chemically synthesized
gctctgtcgcccaggctgtagt

SEQ ID NO: 813598 - DNA, 22 bp, Artificial Sequence
  chemically synthesized
ctctgtcgcccaggctgtagtg

SEQ ID NO: 813599 - DNA, 22 bp, Artificial Sequence
  chemically synthesized
agattgtgccactgcactacag

SEQ ID NO: 813600 - DNA, 22 bp, Artificial Sequence
  chemically synthesized
tgtcgcccaggctgtagtgcag

SEQ ID NO: 813601 - DNA, 22 bp, Artificial Sequence
  chemically synthesized
tcgcccaggctgtagtgcagtg

SEQ ID NO: 813602 - DNA, 22 bp, Artificial Sequence
  chemically synthesized
agtgagctgagattgtgccact

SEQ ID NO: 813603 - DNA, 22 bp, Artificial Sequence
  chemically synthesized
aagtgagctgagattgtgccac

SEQ ID NO: 813604 - DNA, 22 bp, Artificial Sequence
  chemically synthesized
tagtgcagtggcacaatctcag

SEQ ID NO: 813605 - DNA, 22 bp, Artificial Sequence
  chemically synthesized
ggaggtttaagtgagctgagat

SEQ ID NO: 813606 - DNA, 22 bp, Artificial Sequence
  chemically synthesized
cggaggtttaagtgagctgaga

SEQ ID NO: 813607 - DNA, 22 bp, Artificial Sequence
  chemically synthesized
ttcggaggtttaagtgagctga

SEQ ID NO: 813608 - DNA, 22 bp, Artificial Sequence
  chemically synthesized
agctcacttaaacctccgaaga

SEQ ID NO: 813609 - DNA, 22 bp, Artificial Sequence
  chemically synthesized
tgaagcataagaactcttcgga

SEQ ID NO: 813610 - DNA, 22 bp, Artificial Sequence
  chemically synthesized
acttaaacctccgaagagttct

SEQ ID NO: 813611 - DNA, 22 bp, Artificial Sequence
  chemically synthesized
attatgaagcataagaactctt

SEQ ID NO: 813612 - DNA, 22 bp, Artificial Sequence
  chemically synthesized
aaacctccgaagagttcttatg

SEQ ID NO: 813613 - DNA, 22 bp, Artificial Sequence
  chemically synthesized
aacctccgaagagttcttatgc

SEQ ID NO: 813614 - DNA, 22 bp, Artificial Sequence
  chemically synthesized
ccaactgattatgaagcataag

SEQ ID NO: 813615 - DNA, 22 bp, Artificial Sequence
  chemically synthesized
cccaactgattatgaagcataa

SEQ ID NO: 813616 - DNA, 22 bp, Artificial Sequence
  chemically synthesized
cgaagagttcttatgcttcata

SEQ ID NO: 813617 - DNA, 22 bp, Artificial Sequence
  chemically synthesized
ttatgcttcataatcagttggg

SEQ ID NO: 813618 - DNA, 22 bp, Artificial Sequence
  chemically synthesized
agacccaaatcttcccaactga

SEQ ID NO: 813619 - DNA, 22 bp, Artificial Sequence
  chemically synthesized
atgcttcataatcagttgggaa

SEQ ID NO: 813620 - DNA, 22 bp, Artificial Sequence
  chemically synthesized
tgcttcataatcagttgggaag

SEQ ID NO: 813621 - DNA, 22 bp, Artificial Sequence
  chemically synthesized
ctgagacccaaatcttcccaac

SEQ ID NO: 813622 - DNA, 22 bp, Artificial Sequence
  chemically synthesized
cataatcagttgggaagatttg

SEQ ID NO: 813623 - DNA, 22 bp, Artificial Sequence
  chemically synthesized
ataatcagttgggaagatttgg

SEQ ID NO: 813624 - DNA, 22 bp, Artificial Sequence
  chemically synthesized
tattgctgagacccaaatcttc

SEQ ID NO: 813625 - DNA, 22 bp, Artificial Sequence
  chemically synthesized
atattgctgagacccaaatctt

SEQ ID NO: 813626 - DNA, 22 bp, Artificial Sequence
  chemically synthesized
tatattgctgagacccaaatct

SEQ ID NO: 813627 - DNA, 22 bp, Artificial Sequence
  chemically synthesized
ttatattgctgagacccaaatc

SEQ ID NO: 813628 - DNA, 22 bp, Artificial Sequence
  chemically synthesized
ggaagatttgggtctcagcaat

SEQ ID NO: 813629 - DNA, 22 bp, Artificial Sequence
  chemically synthesized
caagacaatcccatttttatat

SEQ ID NO: 813630 - DNA, 22 bp, Artificial Sequence
  chemically synthesized
gggtctcagcaatataaaaatg

SEQ ID NO: 813631 - DNA, 22 bp, Artificial Sequence
  chemically synthesized
ggtctcagcaatataaaaatgg

SEQ ID NO: 813632 - DNA, 22 bp, Artificial Sequence
  chemically synthesized
agcaatataaaaatgggattgt

SEQ ID NO: 813633 - DNA, 22 bp, Artificial Sequence
  chemically synthesized
aggagagagtcatatgtatagt

SEQ ID NO: 813634 - DNA, 22 bp, Artificial Sequence
  chemically synthesized
caggagagagtcatatgtatag

SEQ ID NO: 813635 - DNA, 22 bp, Artificial Sequence
  chemically synthesized
ttcaggagagagtcatatgtat

SEQ ID NO: 813636 - DNA, 22 bp, Artificial Sequence
  chemically synthesized
tcttgtaactatacatatgact

SEQ ID NO: 813637 - DNA, 22 bp, Artificial Sequence
  chemically synthesized
ggctcttcaggagagagtcata

SEQ ID NO: 813638 - DNA, 22 bp, Artificial Sequence
  chemically synthesized
gtaactatacatatgactctct

SEQ ID NO: 813639 - DNA, 22 bp, Artificial Sequence
  chemically synthesized
cggctcttcaggagagagtcat

SEQ ID NO: 813640 - DNA, 22 bp, Artificial Sequence
  chemically synthesized
taactatacatatgactctctc

SEQ ID NO: 813641 - DNA, 22 bp, Artificial Sequence
  chemically synthesized
tcggctcttcaggagagagtca

SEQ ID NO: 813642 - DNA, 22 bp, Artificial Sequence
  chemically synthesized
tacatatgactctctcctgaag

SEQ ID NO: 813643 - DNA, 22 bp, Artificial Sequence
  chemically synthesized
tctcctgaagagccgaaagaca

SEQ ID NO: 813644 - DNA, 22 bp, Artificial Sequence
  chemically synthesized
tcctgaagagccgaaagacaca

SEQ ID NO: 813645 - DNA, 22 bp, Artificial Sequence
  chemically synthesized
gcagtatgaaaatgtgtctttc

SEQ ID NO: 813646 - DNA, 22 bp, Artificial Sequence
  chemically synthesized
agcagtatgaaaatgtgtcttt

SEQ ID NO: 813647 - DNA, 22 bp, Artificial Sequence
  chemically synthesized
ctgaagagccgaaagacacatt

SEQ ID NO: 813648 - DNA, 22 bp, Artificial Sequence
  chemically synthesized
aagagccgaaagacacattttc

SEQ ID NO: 813649 - DNA, 22 bp, Artificial Sequence
  chemically synthesized
ggtacacttagcagtatgaaaa

SEQ ID NO: 813650 - DNA, 22 bp, Artificial Sequence
  chemically synthesized
aggtacacttagcagtatgaaa

SEQ ID NO: 813651 - DNA, 22 bp, Artificial Sequence
  chemically synthesized
taggtacacttagcagtatgaa

SEQ ID NO: 813652 - DNA, 22 bp, Artificial Sequence
  chemically synthesized
ctttaggtacacttagcagtat

SEQ ID NO: 813653 - DNA, 22 bp, Artificial Sequence
  chemically synthesized
tcaactcctttaggtacactta

SEQ ID NO: 813654 - DNA, 22 bp, Artificial Sequence
  chemically synthesized
tcatactgctaagtgtacctaa

SEQ ID NO: 813655 - DNA, 22 bp, Artificial Sequence
  chemically synthesized
catactgctaagtgtacctaaa

SEQ ID NO: 813656 - DNA, 22 bp, Artificial Sequence
  chemically synthesized
atactgctaagtgtacctaaag

SEQ ID NO: 813657 - DNA, 22 bp, Artificial Sequence
  chemically synthesized
aatccattatcaactcctttag

SEQ ID NO: 813658 - DNA, 22 bp, Artificial Sequence
  chemically synthesized
ctaagtgtacctaaaggagttg

SEQ ID NO: 813659 - DNA, 22 bp, Artificial Sequence
  chemically synthesized
agtgtacctaaaggagttgata

SEQ ID NO: 813660 - DNA, 22 bp, Artificial Sequence
  chemically synthesized
aaaaattcaatccattatcaac

SEQ ID NO: 813661 - DNA, 22 bp, Artificial Sequence
  chemically synthesized
aaggagttgataatggattgaa

SEQ ID NO: 813662 - DNA, 22 bp, Artificial Sequence
  chemically synthesized
gtatgttaaaaaattcaatcca

SEQ ID NO: 813663 - DNA, 22 bp, Artificial Sequence
  chemically synthesized
ggtatgttaaaaaattcaatcc

SEQ ID NO: 813664 - DNA, 22 bp, Artificial Sequence
  chemically synthesized
ataatggattgaattttttaac

SEQ ID NO: 813665 - DNA, 22 bp, Artificial Sequence
  chemically synthesized
agaggatttggtatgttaaaaa

SEQ ID NO: 813666 - DNA, 22 bp, Artificial Sequence
  chemically synthesized
aggactgagaggatttggtatg

SEQ ID NO: 813667 - DNA, 22 bp, Artificial Sequence
  chemically synthesized
aaggactgagaggatttggtat

SEQ ID NO: 813668 - DNA, 22 bp, Artificial Sequence
  chemically synthesized
aattttttaacataccaaatcc

SEQ ID NO: 813669 - DNA, 22 bp, Artificial Sequence
  chemically synthesized
taaggactgagaggatttggta

SEQ ID NO: 813670 - DNA, 22 bp, Artificial Sequence
  chemically synthesized
tttaacataccaaatcctctca

SEQ ID NO: 813671 - DNA, 22 bp, Artificial Sequence
  chemically synthesized
ttaacataccaaatcctctcag

SEQ ID NO: 813672 - DNA, 22 bp, Artificial Sequence
  chemically synthesized
taacataccaaatcctctcagt

SEQ ID NO: 813673 - DNA, 22 bp, Artificial Sequence
  chemically synthesized
aacataccaaatcctctcagtc

SEQ ID NO: 813674 - DNA, 22 bp, Artificial Sequence
  chemically synthesized
acataccaaatcctctcagtcc

SEQ ID NO: 813675 - DNA, 22 bp, Artificial Sequence
  chemically synthesized
tagtccattttaaggactgaga

SEQ ID NO: 813676 - DNA, 22 bp, Artificial Sequence
  chemically synthesized
gtagtccattttaaggactgag

SEQ ID NO: 813677 - DNA, 22 bp, Artificial Sequence
  chemically synthesized
tcagtccttaaaatggactaca

SEQ ID NO: 813678 - DNA, 22 bp, Artificial Sequence
  chemically synthesized
agtccttaaaatggactacaag

SEQ ID NO: 813679 - DNA, 22 bp, Artificial Sequence
  chemically synthesized
tgcgaaatgtaccttgtagtcc

SEQ ID NO: 813680 - DNA, 22 bp, Artificial Sequence
  chemically synthesized
atgcgaaatgtaccttgtagtc

SEQ ID NO: 813681 - DNA, 22 bp, Artificial Sequence
  chemically synthesized
ttatgcgaaatgtaccttgtag

SEQ ID NO: 813682 - DNA, 22 bp, Artificial Sequence
  chemically synthesized
ctcttatgcgaaatgtaccttg

SEQ ID NO: 813683 - DNA, 22 bp, Artificial Sequence
  chemically synthesized
aaaatggactacaaggtacatt

SEQ ID NO: 813684 - DNA, 22 bp, Artificial Sequence
  chemically synthesized
aaatggactacaaggtacattt

SEQ ID NO: 813685 - DNA, 22 bp, Artificial Sequence
  chemically synthesized
aattcctcttatgcgaaatgta

SEQ ID NO: 813686 - DNA, 22 bp, Artificial Sequence
  chemically synthesized
aaattcctcttatgcgaaatgt

SEQ ID NO: 813687 - DNA, 22 bp, Artificial Sequence
  chemically synthesized
taaattcctcttatgcgaaatg

SEQ ID NO: 813688 - DNA, 22 bp, Artificial Sequence
  chemically synthesized
ttttaaattcctcttatgcgaa

SEQ ID NO: 813689 - DNA, 22 bp, Artificial Sequence
  chemically synthesized
caaggtacatttcgcataagag

SEQ ID NO: 813690 - DNA, 22 bp, Artificial Sequence
  chemically synthesized
aataccctattttaaattcctc

SEQ ID NO: 813691 - DNA, 22 bp, Artificial Sequence
  chemically synthesized
gaataccctattttaaattcct

SEQ ID NO: 813692 - DNA, 22 bp, Artificial Sequence
  chemically synthesized
tgaataccctattttaaattcc

SEQ ID NO: 813693 - DNA, 22 bp, Artificial Sequence
  chemically synthesized
cgcataagaggaatttaaaata

SEQ ID NO: 813694 - DNA, 22 bp, Artificial Sequence
  chemically synthesized
gcataagaggaatttaaaatag

SEQ ID NO: 813695 - DNA, 22 bp, Artificial Sequence
  chemically synthesized
aattttgaataccctattttaa

SEQ ID NO: 813696 - DNA, 22 bp, Artificial Sequence
  chemically synthesized
tcaattttgaataccctatttt

SEQ ID NO: 813697 - DNA, 22 bp, Artificial Sequence
  chemically synthesized
aaccctctcaattttgaatacc

SEQ ID NO: 813698 - DNA, 22 bp, Artificial Sequence
  chemically synthesized
aaaatagggtattcaaaattga

SEQ ID NO: 813699 - DNA, 22 bp, Artificial Sequence
  chemically synthesized
aaatagggtattcaaaattgag

SEQ ID NO: 813700 - DNA, 22 bp, Artificial Sequence
  chemically synthesized
aaaattgagagggttgaactgg

SEQ ID NO: 813701 - DNA, 22 bp, Artificial Sequence
  chemically synthesized
caaatgaccccaaagccaccag

SEQ ID NO: 813702 - DNA, 22 bp, Artificial Sequence
  chemically synthesized
agagggttgaactggtggcttt

SEQ ID NO: 813703 - DNA, 22 bp, Artificial Sequence
  chemically synthesized
aagctacaaatgaccccaaagc

SEQ ID NO: 813704 - DNA, 22 bp, Artificial Sequence
  chemically synthesized
aaagctacaaatgaccccaaag

SEQ ID NO: 813705 - DNA, 22 bp, Artificial Sequence
  chemically synthesized
aactggtggctttggggtcatt

SEQ ID NO: 813706 - DNA, 22 bp, Artificial Sequence
  chemically synthesized
aatttaaagctacaaatgaccc

SEQ ID NO: 813707 - DNA, 22 bp, Artificial Sequence
  chemically synthesized
gtggctttggggtcatttgtag

SEQ ID NO: 813708 - DNA, 22 bp, Artificial Sequence
  chemically synthesized
aattaaatttaaagctacaaat

SEQ ID NO: 813709 - DNA, 22 bp, Artificial Sequence
  chemically synthesized
tggggtcatttgtagctttaaa

SEQ ID NO: 813710 - DNA, 22 bp, Artificial Sequence
  chemically synthesized
ggggtcatttgtagctttaaat

SEQ ID NO: 813711 - DNA, 22 bp, Artificial Sequence
  chemically synthesized
aaattaaattaaatttaaagct

SEQ ID NO: 813712 - DNA, 22 bp, Artificial Sequence
  chemically synthesized
gggtcatttgtagctttaaatt

SEQ ID NO: 813713 - DNA, 22 bp, Artificial Sequence
  chemically synthesized
aaaattaaattaaatttaaagc

SEQ ID NO: 813714 - DNA, 22 bp, Artificial Sequence
  chemically synthesized
ttaaaattaaattaaatttaaa

SEQ ID NO: 813715 - DNA, 22 bp, Artificial Sequence
  chemically synthesized
catctcttaaaattaaattaaa

SEQ ID NO: 813716 - DNA, 22 bp, Artificial Sequence
  chemically synthesized
gtagctttaaatttaatttaat

SEQ ID NO: 813717 - DNA, 22 bp, Artificial Sequence
  chemically synthesized
tagctttaaatttaatttaatt

SEQ ID NO: 813718 - DNA, 22 bp, Artificial Sequence
  chemically synthesized
taaatttaatttaattttaaga

SEQ ID NO: 813719 - DNA, 22 bp, Artificial Sequence
  chemically synthesized
aaatttaatttaattttaagag

SEQ ID NO: 813720 - DNA, 22 bp, Artificial Sequence
  chemically synthesized
aatttaatttaattttaagaga

SEQ ID NO: 813721 - DNA, 22 bp, Artificial Sequence
  chemically synthesized
aatttaattttaagagatggag

SEQ ID NO: 813722 - DNA, 22 bp, Artificial Sequence
  chemically synthesized
atttaattttaagagatggagt

SEQ ID NO: 813723 - DNA, 22 bp, Artificial Sequence
  chemically synthesized
ggtgacgtagtgagactccatc

SEQ ID NO: 813724 - DNA, 22 bp, Artificial Sequence
  chemically synthesized
aattttaagagatggagtctca

SEQ ID NO: 813725 - DNA, 22 bp, Artificial Sequence
  chemically synthesized
attttaagagatggagtctcac

SEQ ID NO: 813726 - DNA, 22 bp, Artificial Sequence
  chemically synthesized
taagagatggagtctcactacg

SEQ ID NO: 813727 - DNA, 22 bp, Artificial Sequence
  chemically synthesized
cagcctgggtgacgtagtgaga

SEQ ID NO: 813728 - DNA, 22 bp, Artificial Sequence
  chemically synthesized
aagagatggagtctcactacgt

SEQ ID NO: 813729 - DNA, 22 bp, Artificial Sequence
  chemically synthesized
agagatggagtctcactacgtc

SEQ ID NO: 813730 - DNA, 22 bp, Artificial Sequence
  chemically synthesized
actacgtcacccaggctggagt

SEQ ID NO: 813731 - DNA, 22 bp, Artificial Sequence
  chemically synthesized
tgatcatgccagtgtactccag

SEQ ID NO: 813732 - DNA, 22 bp, Artificial Sequence
  chemically synthesized
cgtcacccaggctggagtacac

SEQ ID NO: 813733 - DNA, 22 bp, Artificial Sequence
  chemically synthesized
cagtgagctatgatcatgccag

SEQ ID NO: 813734 - DNA, 22 bp, Artificial Sequence
  chemically synthesized
gagtacactggcatgatcatag

SEQ ID NO: 813735 - DNA, 22 bp, Artificial Sequence
  chemically synthesized
aaggctgcagtgagctatgatc

SEQ ID NO: 813736 - DNA, 22 bp, Artificial Sequence
  chemically synthesized
agttcaaggctgcagtgagcta

SEQ ID NO: 813737 - DNA, 22 bp, Artificial Sequence
  chemically synthesized
gcatgatcatagctcactgcag

SEQ ID NO: 813738 - DNA, 22 bp, Artificial Sequence
  chemically synthesized
ggagttcagttcaaggctgcag

SEQ ID NO: 813739 - DNA, 22 bp, Artificial Sequence
  chemically synthesized
aacctaggagttcagttcaagg

SEQ ID NO: 813740 - DNA, 22 bp, Artificial Sequence
  chemically synthesized
gaacctaggagttcagttcaag

SEQ ID NO: 813741 - DNA, 22 bp, Artificial Sequence
  chemically synthesized
ttgaacctaggagttcagttca

SEQ ID NO: 813742 - DNA, 22 bp, Artificial Sequence
  chemically synthesized
cttgaacctaggagttcagttc

SEQ ID NO: 813743 - DNA, 22 bp, Artificial Sequence
  chemically synthesized
actgcagccttgaactgaactc

SEQ ID NO: 813744 - DNA, 22 bp, Artificial Sequence
  chemically synthesized
cagccttgaactgaactcctag

SEQ ID NO: 813745 - DNA, 22 bp, Artificial Sequence
  chemically synthesized
gaactgaactcctaggttcaag

SEQ ID NO: 813746 - DNA, 22 bp, Artificial Sequence
  chemically synthesized
aactgaactcctaggttcaaga

SEQ ID NO: 813747 - DNA, 22 bp, Artificial Sequence
  chemically synthesized
aggcaagaggatttcttgaacc

SEQ ID NO: 813748 - DNA, 22 bp, Artificial Sequence
  chemically synthesized
aactcctaggttcaagaaatcc

SEQ ID NO: 813749 - DNA, 22 bp, Artificial Sequence
  chemically synthesized
ggaagctgaggcaagaggattt

SEQ ID NO: 813750 - DNA, 22 bp, Artificial Sequence
  chemically synthesized
ctaggttcaagaaatcctcttg

SEQ ID NO: 813751 - DNA, 22 bp, Artificial Sequence
  chemically synthesized
gggaagctgaggcaagaggatt

SEQ ID NO: 813752 - DNA, 22 bp, Artificial Sequence
  chemically synthesized
ggttcaagaaatcctcttgcct

SEQ ID NO: 813753 - DNA, 22 bp, Artificial Sequence
  chemically synthesized
cttgggaagctgaggcaagagg

SEQ ID NO: 813754 - DNA, 22 bp, Artificial Sequence
  chemically synthesized
aagaaatcctcttgcctcagct

SEQ ID NO: 813755 - DNA, 22 bp, Artificial Sequence
  chemically synthesized
tagtcccagctacttgggaagc

SEQ ID NO: 813756 - DNA, 22 bp, Artificial Sequence
  chemically synthesized
gtagtcccagctacttgggaag

SEQ ID NO: 813757 - DNA, 22 bp, Artificial Sequence
  chemically synthesized
ttgcctcagcttcccaagtagc

SEQ ID NO: 813758 - DNA, 22 bp, Artificial Sequence
  chemically synthesized
gcctcagcttcccaagtagctg

SEQ ID NO: 813759 - DNA, 22 bp, Artificial Sequence
  chemically synthesized
cctcagcttcccaagtagctgg

SEQ ID NO: 813760 - DNA, 22 bp, Artificial Sequence
  chemically synthesized
agcttcccaagtagctgggact

SEQ ID NO: 813761 - DNA, 22 bp, Artificial Sequence
  chemically synthesized
cccaagtagctgggactacaaa

SEQ ID NO: 813762 - DNA, 22 bp, Artificial Sequence
  chemically synthesized
ccaagtagctgggactacaaac

SEQ ID NO: 813763 - DNA, 22 bp, Artificial Sequence
  chemically synthesized
ggactacaaacttggctttttt

SEQ ID NO: 813764 - DNA, 22 bp, Artificial Sequence
  chemically synthesized
caaacttggctttttttttttt

SEQ ID NO: 813765 - DNA, 22 bp, Artificial Sequence
  chemically synthesized
caaaacataaaaaaaaaaaaaa

SEQ ID NO: 813766 - DNA, 22 bp, Artificial Sequence
  chemically synthesized
tacaaaacataaaaaaaaaaaa

SEQ ID NO: 813767 - DNA, 22 bp, Artificial Sequence
  chemically synthesized
ctacaaaacataaaaaaaaaaa

SEQ ID NO: 813768 - DNA, 22 bp, Artificial Sequence
  chemically synthesized
ggctttttttttttttttttta

SEQ ID NO: 813769 - DNA, 22 bp, Artificial Sequence
  chemically synthesized
gcttttttttttttttttttat

SEQ ID NO: 813770 - DNA, 22 bp, Artificial Sequence
  chemically synthesized
ttttttttttttttttatgttt

SEQ ID NO: 813771 - DNA, 22 bp, Artificial Sequence
  chemically synthesized
tttttttttttttttatgtttt

SEQ ID NO: 813772 - DNA, 22 bp, Artificial Sequence
  chemically synthesized
ttttttttttttttatgttttg

SEQ ID NO: 813773 - DNA, 22 bp, Artificial Sequence
  chemically synthesized
tttttttttttttatgttttgt

SEQ ID NO: 813774 - DNA, 22 bp, Artificial Sequence
  chemically synthesized
ttttttttttttatgttttgta

SEQ ID NO: 813775 - DNA, 22 bp, Artificial Sequence
  chemically synthesized
tttttttttttatgttttgtag

SEQ ID NO: 813776 - DNA, 22 bp, Artificial Sequence
  chemically synthesized
ttttttttttatgttttgtaga

SEQ ID NO: 813777 - DNA, 22 bp, Artificial Sequence
  chemically synthesized
tttttttttatgttttgtagaa

SEQ ID NO: 813778 - DNA, 22 bp, Artificial Sequence
  chemically synthesized
ttttttttatgttttgtagaaa

SEQ ID NO: 813779 - DNA, 22 bp, Artificial Sequence
  chemically synthesized
tttttttatgttttgtagaaat

SEQ ID NO: 813780 - DNA, 22 bp, Artificial Sequence
  chemically synthesized
ttttttatgttttgtagaaatg

SEQ ID NO: 813781 - DNA, 22 bp, Artificial Sequence
  chemically synthesized
tttttatgttttgtagaaatgg

SEQ ID NO: 813782 - DNA, 22 bp, Artificial Sequence
  chemically synthesized
ttttatgttttgtagaaatggt

SEQ ID NO: 813783 - DNA, 22 bp, Artificial Sequence
  chemically synthesized
tttatgttttgtagaaatggta

SEQ ID NO: 813784 - DNA, 22 bp, Artificial Sequence
  chemically synthesized
ttatgttttgtagaaatggtat

SEQ ID NO: 813785 - DNA, 22 bp, Artificial Sequence
  chemically synthesized
tatgttttgtagaaatggtatc

SEQ ID NO: 813786 - DNA, 22 bp, Artificial Sequence
  chemically synthesized
atgttttgtagaaatggtatct

SEQ ID NO: 813787 - DNA, 22 bp, Artificial Sequence
  chemically synthesized
ggcaacatagtgagataccatt

SEQ ID NO: 813788 - DNA, 22 bp, Artificial Sequence
  chemically synthesized
tgttttgtagaaatggtatctc

SEQ ID NO: 813789 - DNA, 22 bp, Artificial Sequence
  chemically synthesized
tgtagaaatggtatctcactat

SEQ ID NO: 813790 - DNA, 22 bp, Artificial Sequence
  chemically synthesized
gtagaaatggtatctcactatg

SEQ ID NO: 813791 - DNA, 22 bp, Artificial Sequence
  chemically synthesized
tagaaatggtatctcactatgt

SEQ ID NO: 813792 - DNA, 22 bp, Artificial Sequence
  chemically synthesized
agaccagcctgggcaacatagt

SEQ ID NO: 813793 - DNA, 22 bp, Artificial Sequence
  chemically synthesized
gagaccagcctgggcaacatag

SEQ ID NO: 813794 - DNA, 22 bp, Artificial Sequence
  chemically synthesized
actatgttgcccaggctggtct

SEQ ID NO: 813795 - DNA, 22 bp, Artificial Sequence
  chemically synthesized
gaggccaagagtttgagaccag

SEQ ID NO: 813796 - DNA, 22 bp, Artificial Sequence
  chemically synthesized
tgttgcccaggctggtctcaaa

SEQ ID NO: 813797 - DNA, 22 bp, Artificial Sequence
  chemically synthesized
cccaggctggtctcaaactctt

SEQ ID NO: 813798 - DNA, 22 bp, Artificial Sequence
  chemically synthesized
gtctcaaactcttggcctctag

SEQ ID NO: 813799 - DNA, 22 bp, Artificial Sequence
  chemically synthesized
aaactcttggcctctagtgatc

SEQ ID NO: 813800 - DNA, 22 bp, Artificial Sequence
  chemically synthesized
ttggcctctagtgatcctccca

SEQ ID NO: 813801 - DNA, 22 bp, Artificial Sequence
  chemically synthesized
ggcctctagtgatcctcccacc

SEQ ID NO: 813802 - DNA, 22 bp, Artificial Sequence
  chemically synthesized
gcctctagtgatcctcccaccc

SEQ ID NO: 813803 - DNA, 22 bp, Artificial Sequence
  chemically synthesized
ggaggccgaggtgggggtggga

SEQ ID NO: 813804 - DNA, 22 bp, Artificial Sequence
  chemically synthesized
gggaggccgaggtgggggtggg

SEQ ID NO: 813805 - DNA, 22 bp, Artificial Sequence
  chemically synthesized
tgggaggccgaggtgggggtgg

SEQ ID NO: 813806 - DNA, 22 bp, Artificial Sequence
  chemically synthesized
tagtgatcctcccacccccacc

SEQ ID NO: 813807 - DNA, 22 bp, Artificial Sequence
  chemically synthesized
gtgatcctcccacccccacctc

SEQ ID NO: 813808 - DNA, 22 bp, Artificial Sequence
  chemically synthesized
ccacccccacctcggcctccca

SEQ ID NO: 813809 - DNA, 22 bp, Artificial Sequence
  chemically synthesized
ggcctcccaaagtgctgggatt

SEQ ID NO: 813810 - DNA, 22 bp, Artificial Sequence
  chemically synthesized
gtgggacatgtccccataatcc

SEQ ID NO: 813811 - DNA, 22 bp, Artificial Sequence
  chemically synthesized
ccaaagtgctgggattatgggg

SEQ ID NO: 813812 - DNA, 22 bp, Artificial Sequence
  chemically synthesized
ctggtgggacatgtccccataa

SEQ ID NO: 813813 - DNA, 22 bp, Artificial Sequence
  chemically synthesized
aagttcctggtgggacatgtcc

SEQ ID NO: 813814 - DNA, 22 bp, Artificial Sequence
  chemically synthesized
ggattatggggacatgtcccac

SEQ ID NO: 813815 - DNA, 22 bp, Artificial Sequence
  chemically synthesized
aaatattaaagttcctggtggg

SEQ ID NO: 813816 - DNA, 22 bp, Artificial Sequence
  chemically synthesized
tggggacatgtcccaccaggaa

SEQ ID NO: 813817 - DNA, 22 bp, Artificial Sequence
  chemically synthesized
aaaatattaaagttcctggtgg

SEQ ID NO: 813818 - DNA, 22 bp, Artificial Sequence
  chemically synthesized
tttaaaatattaaagttcctgg

SEQ ID NO: 813819 - DNA, 22 bp, Artificial Sequence
  chemically synthesized
atttaaaatattaaagttcctg

SEQ ID NO: 813820 - DNA, 22 bp, Artificial Sequence
  chemically synthesized
tatttaaaatattaaagttcct

SEQ ID NO: 813821 - DNA, 22 bp, Artificial Sequence
  chemically synthesized
taatattttaaataaaatgtgc

SEQ ID NO: 813822 - DNA, 22 bp, Artificial Sequence
  chemically synthesized
aatattttaaataaaatgtgcc

SEQ ID NO: 813823 - DNA, 22 bp, Artificial Sequence
  chemically synthesized
atattttaaataaaatgtgcca

SEQ ID NO: 813824 - DNA, 22 bp, Artificial Sequence
  chemically synthesized
ataatatatatgtggcacattt

SEQ ID NO: 813825 - DNA, 22 bp, Artificial Sequence
  chemically synthesized
ctcataatatatatgtggcaca

SEQ ID NO: 813826 - DNA, 22 bp, Artificial Sequence
  chemically synthesized
taaataaaatgtgccacatata

SEQ ID NO: 813827 - DNA, 22 bp, Artificial Sequence
  chemically synthesized
aaataaaatgtgccacatatat

SEQ ID NO: 813828 - DNA, 22 bp, Artificial Sequence
  chemically synthesized
aataaaatgtgccacatatata

SEQ ID NO: 813829 - DNA, 22 bp, Artificial Sequence
  chemically synthesized
gggcctgctcataatatatatg

SEQ ID NO: 813830 - DNA, 22 bp, Artificial Sequence
  chemically synthesized
cattggggcctgctcataatat

SEQ ID NO: 813831 - DNA, 22 bp, Artificial Sequence
  chemically synthesized
ttacattggggcctgctcataa

SEQ ID NO: 813832 - DNA, 22 bp, Artificial Sequence
  chemically synthesized
attacattggggcctgctcata

SEQ ID NO: 813833 - DNA, 22 bp, Artificial Sequence
  chemically synthesized
tattacattggggcctgctcat

SEQ ID NO: 813834 - DNA, 22 bp, Artificial Sequence
  chemically synthesized
aaatacaacctttattacattg

SEQ ID NO: 813835 - DNA, 22 bp, Artificial Sequence
  chemically synthesized
tgagcaggccccaatgtaataa

SEQ ID NO: 813836 - DNA, 22 bp, Artificial Sequence
  chemically synthesized
aaaatacaacctttattacatt

SEQ ID NO: 813837 - DNA, 22 bp, Artificial Sequence
  chemically synthesized
tttaaaatacaacctttattac

SEQ ID NO: 813838 - DNA, 22 bp, Artificial Sequence
  chemically synthesized
gtttaaaatacaacctttatta

SEQ ID NO: 813839 - DNA, 22 bp, Artificial Sequence
  chemically synthesized
gcgggatatttgtttaaaatac

SEQ ID NO: 813840 - DNA, 22 bp, Artificial Sequence
  chemically synthesized
tattttaaacaaatatcccgct

SEQ ID NO: 813841 - DNA, 22 bp, Artificial Sequence
  chemically synthesized
taaacaaatatcccgctagcat

SEQ ID NO: 813842 - DNA, 22 bp, Artificial Sequence
  chemically synthesized
aaacaaatatcccgctagcatt

SEQ ID NO: 813843 - DNA, 22 bp, Artificial Sequence
  chemically synthesized
aacaaatatcccgctagcattc

SEQ ID NO: 813844 - DNA, 22 bp, Artificial Sequence
  chemically synthesized
tgtacaaaaatatgatagaatg

SEQ ID NO: 813845 - DNA, 22 bp, Artificial Sequence
  chemically synthesized
aaagctatgtacaaaaatatga

SEQ ID NO: 813846 - DNA, 22 bp, Artificial Sequence
  chemically synthesized
caaagctatgtacaaaaatatg

SEQ ID NO: 813847 - DNA, 22 bp, Artificial Sequence
  chemically synthesized
gcattctatcatatttttgtac

SEQ ID NO: 813848 - DNA, 22 bp, Artificial Sequence
  chemically synthesized
ccttcaaagctatgtacaaaaa

SEQ ID NO: 813849 - DNA, 22 bp, Artificial Sequence
  chemically synthesized
ctgccttcaaagctatgtacaa

SEQ ID NO: 813850 - DNA, 22 bp, Artificial Sequence
  chemically synthesized
gctgccttcaaagctatgtaca

SEQ ID NO: 813851 - DNA, 22 bp, Artificial Sequence
  chemically synthesized
tatcatatttttgtacatagct

SEQ ID NO: 813852 - DNA, 22 bp, Artificial Sequence
  chemically synthesized
tcatatttttgtacatagcttt

SEQ ID NO: 813853 - DNA, 22 bp, Artificial Sequence
  chemically synthesized
ttgtacatagctttgaaggcag

SEQ ID NO: 813854 - DNA, 22 bp, Artificial Sequence
  chemically synthesized
tgtacatagctttgaaggcagc

SEQ ID NO: 813855 - DNA, 22 bp, Artificial Sequence
  chemically synthesized
gtacatagctttgaaggcagca

SEQ ID NO: 813856 - DNA, 22 bp, Artificial Sequence
  chemically synthesized
tacatagctttgaaggcagcaa

SEQ ID NO: 813857 - DNA, 22 bp, Artificial Sequence
  chemically synthesized
aaggataaagatttgctgcctt

SEQ ID NO: 813858 - DNA, 22 bp, Artificial Sequence
  chemically synthesized
aaaggataaagatttgctgcct

SEQ ID NO: 813859 - DNA, 22 bp, Artificial Sequence
  chemically synthesized
tgaaggcagcaaatctttatcc

SEQ ID NO: 813860 - DNA, 22 bp, Artificial Sequence
  chemically synthesized
caaaaatttaaaggataaagat

SEQ ID NO: 813861 - DNA, 22 bp, Artificial Sequence
  chemically synthesized
gaaggcagcaaatctttatcct

SEQ ID NO: 813862 - DNA, 22 bp, Artificial Sequence
  chemically synthesized
ccaaaaatttaaaggataaaga

SEQ ID NO: 813863 - DNA, 22 bp, Artificial Sequence
  chemically synthesized
aaggcagcaaatctttatcctt

SEQ ID NO: 813864 - DNA, 22 bp, Artificial Sequence
  chemically synthesized
tttccaaaaatttaaaggataa

SEQ ID NO: 813865 - DNA, 22 bp, Artificial Sequence
  chemically synthesized
gattatttccaaaaatttaaag

SEQ ID NO: 813866 - DNA, 22 bp, Artificial Sequence
  chemically synthesized
ggattatttccaaaaatttaaa

SEQ ID NO: 813867 - DNA, 22 bp, Artificial Sequence
  chemically synthesized
tggattatttccaaaaatttaa

SEQ ID NO: 813868 - DNA, 22 bp, Artificial Sequence
  chemically synthesized
tatcctttaaatttttggaaat

SEQ ID NO: 813869 - DNA, 22 bp, Artificial Sequence
  chemically synthesized
atcctttaaatttttggaaata

SEQ ID NO: 813870 - DNA, 22 bp, Artificial Sequence
  chemically synthesized
tcctttaaatttttggaaataa

SEQ ID NO: 813871 - DNA, 22 bp, Artificial Sequence
  chemically synthesized
aatggctttggattatttccaa

SEQ ID NO: 813872 - DNA, 22 bp, Artificial Sequence
  chemically synthesized
taaatttttggaaataatccaa

SEQ ID NO: 813873 - DNA, 22 bp, Artificial Sequence
  chemically synthesized
aaatttttggaaataatccaaa

SEQ ID NO: 813874 - DNA, 22 bp, Artificial Sequence
  chemically synthesized
aatttttggaaataatccaaag

SEQ ID NO: 813875 - DNA, 22 bp, Artificial Sequence
  chemically synthesized
ggcactgaatggctttggatta

SEQ ID NO: 813876 - DNA, 22 bp, Artificial Sequence
  chemically synthesized
ttggaaataatccaaagccatt

SEQ ID NO: 813877 - DNA, 22 bp, Artificial Sequence
  chemically synthesized
tggaaataatccaaagccattc

SEQ ID NO: 813878 - DNA, 22 bp, Artificial Sequence
  chemically synthesized
ggaaataatccaaagccattca

SEQ ID NO: 813879 - DNA, 22 bp, Artificial Sequence
  chemically synthesized
gaaataatccaaagccattcag

SEQ ID NO: 813880 - DNA, 22 bp, Artificial Sequence
  chemically synthesized
atcagatgttgggcactgaatg

SEQ ID NO: 813881 - DNA, 22 bp, Artificial Sequence
  chemically synthesized
aatgaaacaattcatcagatgt

SEQ ID NO: 813882 - DNA, 22 bp, Artificial Sequence
  chemically synthesized
agtgcccaacatctgatgaatt

SEQ ID NO: 813883 - DNA, 22 bp, Artificial Sequence
  chemically synthesized
taattgaatgaaacaattcatc

SEQ ID NO: 813884 - DNA, 22 bp, Artificial Sequence
  chemically synthesized
gtaattgaatgaaacaattcat

SEQ ID NO: 813885 - DNA, 22 bp, Artificial Sequence
  chemically synthesized
tttgtaattgaatgaaacaatt

SEQ ID NO: 813886 - DNA, 22 bp, Artificial Sequence
  chemically synthesized
aataattgtttgtaattgaatg

SEQ ID NO: 813887 - DNA, 22 bp, Artificial Sequence
  chemically synthesized
atgaattgtttcattcaattac

SEQ ID NO: 813888 - DNA, 22 bp, Artificial Sequence
  chemically synthesized
tactcaataattgtttgtaatt

SEQ ID NO: 813889 - DNA, 22 bp, Artificial Sequence
  chemically synthesized
tttcattcaattacaaacaatt

SEQ ID NO: 813890 - DNA, 22 bp, Artificial Sequence
  chemically synthesized
cattcaattacaaacaattatt

SEQ ID NO: 813891 - DNA, 22 bp, Artificial Sequence
  chemically synthesized
attcaattacaaacaattattg

SEQ ID NO: 813892 - DNA, 22 bp, Artificial Sequence
  chemically synthesized
agtaattgtactcaataattgt

SEQ ID NO: 813893 - DNA, 22 bp, Artificial Sequence
  chemically synthesized
ctgagtaattgtactcaataat

SEQ ID NO: 813894 - DNA, 22 bp, Artificial Sequence
  chemically synthesized
aattacaaacaattattgagta

SEQ ID NO: 813895 - DNA, 22 bp, Artificial Sequence
  chemically synthesized
gctgagtaattgtactcaataa

SEQ ID NO: 813896 - DNA, 22 bp, Artificial Sequence
  chemically synthesized
tttgctgagtaattgtactcaa

SEQ ID NO: 813897 - DNA, 22 bp, Artificial Sequence
  chemically synthesized
atttgctgagtaattgtactca

SEQ ID NO: 813898 - DNA, 22 bp, Artificial Sequence
  chemically synthesized
caaacaattattgagtacaatt

SEQ ID NO: 813899 - DNA, 22 bp, Artificial Sequence
  chemically synthesized
tatttgctgagtaattgtactc

SEQ ID NO: 813900 - DNA, 22 bp, Artificial Sequence
  chemically synthesized
ttatttgctgagtaattgtact

SEQ ID NO: 813901 - DNA, 22 bp, Artificial Sequence
  chemically synthesized
ttgagtacaattactcagcaaa

SEQ ID NO: 813902 - DNA, 22 bp, Artificial Sequence
  chemically synthesized
agtacaattactcagcaaataa

SEQ ID NO: 813903 - DNA, 22 bp, Artificial Sequence
  chemically synthesized
tagccataccttttatttgctg

SEQ ID NO: 813904 - DNA, 22 bp, Artificial Sequence
  chemically synthesized
atagccataccttttatttgct

SEQ ID NO: 813905 - DNA, 22 bp, Artificial Sequence
  chemically synthesized
tatagccataccttttatttgc

SEQ ID NO: 813906 - DNA, 22 bp, Artificial Sequence
  chemically synthesized
ttttatagccataccttttatt

SEQ ID NO: 813907 - DNA, 22 bp, Artificial Sequence
  chemically synthesized
ctcagcaaataaaaggtatggc

SEQ ID NO: 813908 - DNA, 22 bp, Artificial Sequence
  chemically synthesized
tattattttatagccatacctt

SEQ ID NO: 813909 - DNA, 22 bp, Artificial Sequence
  chemically synthesized
agcaaataaaaggtatggctat

SEQ ID NO: 813910 - DNA, 22 bp, Artificial Sequence
  chemically synthesized
ttatattattttatagccatac

SEQ ID NO: 813911 - DNA, 22 bp, Artificial Sequence
  chemically synthesized
agcagactgttatattatttta

SEQ ID NO: 813912 - DNA, 22 bp, Artificial Sequence
  chemically synthesized
tgatcctcagcagactgttata

SEQ ID NO: 813913 - DNA, 22 bp, Artificial Sequence
  chemically synthesized
atgatcctcagcagactgttat

SEQ ID NO: 813914 - DNA, 22 bp, Artificial Sequence
  chemically synthesized
tatgatcctcagcagactgtta

SEQ ID NO: 813915 - DNA, 22 bp, Artificial Sequence
  chemically synthesized
taaaataatataacagtctgct

SEQ ID NO: 813916 - DNA, 22 bp, Artificial Sequence
  chemically synthesized
ttttatgatcctcagcagactg

SEQ ID NO: 813917 - DNA, 22 bp, Artificial Sequence
  chemically synthesized
aggactgttttatgatcctcag

SEQ ID NO: 813918 - DNA, 22 bp, Artificial Sequence
  chemically synthesized
aaggactgttttatgatcctca

SEQ ID NO: 813919 - DNA, 22 bp, Artificial Sequence
  chemically synthesized
cttaaggactgttttatgatcc

SEQ ID NO: 813920 - DNA, 22 bp, Artificial Sequence
  chemically synthesized
gaactacttaaggactgtttta

SEQ ID NO: 813921 - DNA, 22 bp, Artificial Sequence
  chemically synthesized
ctgaggatcataaaacagtcct

SEQ ID NO: 813922 - DNA, 22 bp, Artificial Sequence
  chemically synthesized
tggaactacttaaggactgttt

SEQ ID NO: 813923 - DNA, 22 bp, Artificial Sequence
  chemically synthesized
ctggaactacttaaggactgtt

SEQ ID NO: 813924 - DNA, 22 bp, Artificial Sequence
  chemically synthesized
tctggaactacttaaggactgt

SEQ ID NO: 813925 - DNA, 22 bp, Artificial Sequence
  chemically synthesized
aggatcataaaacagtccttaa

SEQ ID NO: 813926 - DNA, 22 bp, Artificial Sequence
  chemically synthesized
ttctggaactacttaaggactg

SEQ ID NO: 813927 - DNA, 22 bp, Artificial Sequence
  chemically synthesized
cttttctggaactacttaagga

SEQ ID NO: 813928 - DNA, 22 bp, Artificial Sequence
  chemically synthesized
gagttccttttctggaactact

SEQ ID NO: 813929 - DNA, 22 bp, Artificial Sequence
  chemically synthesized
agagttccttttctggaactac

SEQ ID NO: 813930 - DNA, 22 bp, Artificial Sequence
  chemically synthesized
tagagttccttttctggaacta

SEQ ID NO: 813931 - DNA, 22 bp, Artificial Sequence
  chemically synthesized
aagtagttccagaaaaggaact

SEQ ID NO: 813932 - DNA, 22 bp, Artificial Sequence
  chemically synthesized
agtagttccagaaaaggaactc

SEQ ID NO: 813933 - DNA, 22 bp, Artificial Sequence
  chemically synthesized
gcaatataattttagagttcct

SEQ ID NO: 813934 - DNA, 22 bp, Artificial Sequence
  chemically synthesized
ggcaatataattttagagttcc

SEQ ID NO: 813935 - DNA, 22 bp, Artificial Sequence
  chemically synthesized
cagaaaaggaactctaaaatta

SEQ ID NO: 813936 - DNA, 22 bp, Artificial Sequence
  chemically synthesized
caaataccgtcccttggcaata

SEQ ID NO: 813937 - DNA, 22 bp, Artificial Sequence
  chemically synthesized
taaaattatattgccaagggac

SEQ ID NO: 813938 - DNA, 22 bp, Artificial Sequence
  chemically synthesized
aaattatattgccaagggacgg

SEQ ID NO: 813939 - DNA, 22 bp, Artificial Sequence
  chemically synthesized
tatctacaaataccgtcccttg

SEQ ID NO: 813940 - DNA, 22 bp, Artificial Sequence
  chemically synthesized
tattgccaagggacggtatttg

SEQ ID NO: 813941 - DNA, 22 bp, Artificial Sequence
  chemically synthesized
tatgctgtatctacaaataccg

SEQ ID NO: 813942 - DNA, 22 bp, Artificial Sequence
  chemically synthesized
atatgctgtatctacaaatacc

SEQ ID NO: 813943 - DNA, 22 bp, Artificial Sequence
  chemically synthesized
ccaagggacggtatttgtagat

SEQ ID NO: 813944 - DNA, 22 bp, Artificial Sequence
  chemically synthesized
ataagagtcttatatgctgtat

SEQ ID NO: 813945 - DNA, 22 bp, Artificial Sequence
  chemically synthesized
cataagagtcttatatgctgta

SEQ ID NO: 813946 - DNA, 22 bp, Artificial Sequence
  chemically synthesized
gaacttcataagagtcttatat

SEQ ID NO: 813947 - DNA, 22 bp, Artificial Sequence
  chemically synthesized
gtagatacagcatataagactc

SEQ ID NO: 813948 - DNA, 22 bp, Artificial Sequence
  chemically synthesized
tagatacagcatataagactct

SEQ ID NO: 813949 - DNA, 22 bp, Artificial Sequence
  chemically synthesized
ggagagggacaagcattagaac

SEQ ID NO: 813950 - DNA, 22 bp, Artificial Sequence
  chemically synthesized
aggagagggacaagcattagaa

SEQ ID NO: 813951 - DNA, 22 bp, Artificial Sequence
  chemically synthesized
tttaggagagggacaagcatta

SEQ ID NO: 813952 - DNA, 22 bp, Artificial Sequence
  chemically synthesized
ttatgaagttctaatgcttgtc

SEQ ID NO: 813953 - DNA, 22 bp, Artificial Sequence
  chemically synthesized
atttaggagagggacaagcatt

SEQ ID NO: 813954 - DNA, 22 bp, Artificial Sequence
  chemically synthesized
atgaagttctaatgcttgtccc

SEQ ID NO: 813955 - DNA, 22 bp, Artificial Sequence
  chemically synthesized
tgaagttctaatgcttgtccct

SEQ ID NO: 813956 - DNA, 22 bp, Artificial Sequence
  chemically synthesized
tttatttaggagagggacaagc

SEQ ID NO: 813957 - DNA, 22 bp, Artificial Sequence
  chemically synthesized
gtttatttaggagagggacaag

SEQ ID NO: 813958 - DNA, 22 bp, Artificial Sequence
  chemically synthesized
tttgtttatttaggagagggac

SEQ ID NO: 813959 - DNA, 22 bp, Artificial Sequence
  chemically synthesized
gtttgtttatttaggagaggga

SEQ ID NO: 813960 - DNA, 22 bp, Artificial Sequence
  chemically synthesized
taatgcttgtccctctcctaaa

SEQ ID NO: 813961 - DNA, 22 bp, Artificial Sequence
  chemically synthesized
atttgtttgtttatttaggaga

SEQ ID NO: 813962 - DNA, 22 bp, Artificial Sequence
  chemically synthesized
atgcttgtccctctcctaaata

SEQ ID NO: 813963 - DNA, 22 bp, Artificial Sequence
  chemically synthesized
ttcatttgtttgtttatttagg

SEQ ID NO: 813964 - DNA, 22 bp, Artificial Sequence
  chemically synthesized
gttcatttgtttgtttatttag

SEQ ID NO: 813965 - DNA, 22 bp, Artificial Sequence
  chemically synthesized
gtccctctcctaaataaacaaa

SEQ ID NO: 813966 - DNA, 22 bp, Artificial Sequence
  chemically synthesized
cttgttcatttgtttgtttatt

SEQ ID NO: 813967 - DNA, 22 bp, Artificial Sequence
  chemically synthesized
tccctctcctaaataaacaaac

SEQ ID NO: 813968 - DNA, 22 bp, Artificial Sequence
  chemically synthesized
gcttgttcatttgtttgtttat

SEQ ID NO: 813969 - DNA, 22 bp, Artificial Sequence
  chemically synthesized
tgcttgttcatttgtttgttta

SEQ ID NO: 813970 - DNA, 22 bp, Artificial Sequence
  chemically synthesized
ttgcttgttcatttgtttgttt

SEQ ID NO: 813971 - DNA, 22 bp, Artificial Sequence
  chemically synthesized
tcctaaataaacaaacaaatga

SEQ ID NO: 813972 - DNA, 22 bp, Artificial Sequence
  chemically synthesized
ctaaataaacaaacaaatgaac

SEQ ID NO: 813973 - DNA, 22 bp, Artificial Sequence
  chemically synthesized
tacatttttgcttgttcatttg

SEQ ID NO: 813974 - DNA, 22 bp, Artificial Sequence
  chemically synthesized
aataaacaaacaaatgaacaag

SEQ ID NO: 813975 - DNA, 22 bp, Artificial Sequence
  chemically synthesized
ggaagaaaagcaaatagtgtta

SEQ ID NO: 813976 - DNA, 22 bp, Artificial Sequence
  chemically synthesized
ctgggaagaaaagcaaatagtg

SEQ ID NO: 813977 - DNA, 22 bp, Artificial Sequence
  chemically synthesized
cctgggaagaaaagcaaatagt

SEQ ID NO: 813978 - DNA, 22 bp, Artificial Sequence
  chemically synthesized
tcctgggaagaaaagcaaatag

SEQ ID NO: 813979 - DNA, 22 bp, Artificial Sequence
  chemically synthesized
tttgcttttcttcccaggaaaa

SEQ ID NO: 813980 - DNA, 22 bp, Artificial Sequence
  chemically synthesized
gcttttcttcccaggaaaatgt

SEQ ID NO: 813981 - DNA, 22 bp, Artificial Sequence
  chemically synthesized
cttttcttcccaggaaaatgtt

SEQ ID NO: 813982 - DNA, 22 bp, Artificial Sequence
  chemically synthesized
ttcttcccaggaaaatgtttta

SEQ ID NO: 813983 - DNA, 22 bp, Artificial Sequence
  chemically synthesized
tcttcccaggaaaatgttttac

SEQ ID NO: 813984 - DNA, 22 bp, Artificial Sequence
  chemically synthesized
cttcccaggaaaatgttttact

SEQ ID NO: 813985 - DNA, 22 bp, Artificial Sequence
  chemically synthesized
ttcccaggaaaatgttttactt

SEQ ID NO: 813986 - DNA, 22 bp, Artificial Sequence
  chemically synthesized
cccaggaaaatgttttactttt

SEQ ID NO: 813987 - DNA, 22 bp, Artificial Sequence
  chemically synthesized
ccaggaaaatgttttacttttt

SEQ ID NO: 813988 - DNA, 22 bp, Artificial Sequence
  chemically synthesized
aaagtaaaaacaaatgaaaaag

SEQ ID NO: 813989 - DNA, 22 bp, Artificial Sequence
  chemically synthesized
tgaaagtaaaaacaaatgaaaa

SEQ ID NO: 813990 - DNA, 22 bp, Artificial Sequence
  chemically synthesized
ctgaaagtaaaaacaaatgaaa

SEQ ID NO: 813991 - DNA, 22 bp, Artificial Sequence
  chemically synthesized
tctgaaagtaaaaacaaatgaa

SEQ ID NO: 813992 - DNA, 22 bp, Artificial Sequence
  chemically synthesized
ttctgaaagtaaaaacaaatga

SEQ ID NO: 813993 - DNA, 22 bp, Artificial Sequence
  chemically synthesized
tactttttcatttgtttttact

SEQ ID NO: 813994 - DNA, 22 bp, Artificial Sequence
  chemically synthesized
actttttcatttgtttttactt

SEQ ID NO: 813995 - DNA, 22 bp, Artificial Sequence
  chemically synthesized
aaatttttctgaaagtaaaaac

SEQ ID NO: 813996 - DNA, 22 bp, Artificial Sequence
  chemically synthesized
ctttttcatttgtttttacttt

SEQ ID NO: 813997 - DNA, 22 bp, Artificial Sequence
  chemically synthesized
tcaaatttttctgaaagtaaaa

SEQ ID NO: 813998 - DNA, 22 bp, Artificial Sequence
  chemically synthesized
tttcatttgtttttactttcag

SEQ ID NO: 813999 - DNA, 22 bp, Artificial Sequence
  chemically synthesized
ttcatttgtttttactttcaga

SEQ ID NO: 814000 - DNA, 22 bp, Artificial Sequence
  chemically synthesized
tcatttgtttttactttcagaa

SEQ ID NO: 814001 - DNA, 22 bp, Artificial Sequence
  chemically synthesized
catttgtttttactttcagaaa

SEQ ID NO: 814002 - DNA, 22 bp, Artificial Sequence
  chemically synthesized
atttgtttttactttcagaaaa

SEQ ID NO: 814003 - DNA, 22 bp, Artificial Sequence
  chemically synthesized
gtttttactttcagaaaaattt

SEQ ID NO: 814004 - DNA, 22 bp, Artificial Sequence
  chemically synthesized
tttttactttcagaaaaatttg

SEQ ID NO: 814005 - DNA, 22 bp, Artificial Sequence
  chemically synthesized
caaaagcattctcaaatttttc

SEQ ID NO: 814006 - DNA, 22 bp, Artificial Sequence
  chemically synthesized
ccaaaagcattctcaaattttt

SEQ ID NO: 814007 - DNA, 22 bp, Artificial Sequence
  chemically synthesized
ttactttcagaaaaatttgaga

SEQ ID NO: 814008 - DNA, 22 bp, Artificial Sequence
  chemically synthesized
tactttcagaaaaatttgagaa

SEQ ID NO: 814009 - DNA, 22 bp, Artificial Sequence
  chemically synthesized
actttcagaaaaatttgagaat

SEQ ID NO: 814010 - DNA, 22 bp, Artificial Sequence
  chemically synthesized
ctttcagaaaaatttgagaatg

SEQ ID NO: 814011 - DNA, 22 bp, Artificial Sequence
  chemically synthesized
tcagaaaaatttgagaatgctt

SEQ ID NO: 814012 - DNA, 22 bp, Artificial Sequence
  chemically synthesized
cagaaaaatttgagaatgcttt

SEQ ID NO: 814013 - DNA, 22 bp, Artificial Sequence
  chemically synthesized
agaaaaatttgagaatgctttt

SEQ ID NO: 814014 - DNA, 22 bp, Artificial Sequence
  chemically synthesized
catgtatgacatgtttccaaaa

SEQ ID NO: 814015 - DNA, 22 bp, Artificial Sequence
  chemically synthesized
acatgtatgacatgtttccaaa

SEQ ID NO: 814016 - DNA, 22 bp, Artificial Sequence
  chemically synthesized
gagaatgcttttggaaacatgt

SEQ ID NO: 814017 - DNA, 22 bp, Artificial Sequence
  chemically synthesized
agaatgcttttggaaacatgtc

SEQ ID NO: 814018 - DNA, 22 bp, Artificial Sequence
  chemically synthesized
ttggaaacatgtcatacatgta

SEQ ID NO: 814019 - DNA, 22 bp, Artificial Sequence
  chemically synthesized
atgcatgatatttacatgtatg

SEQ ID NO: 814020 - DNA, 22 bp, Artificial Sequence
  chemically synthesized
tggaaacatgtcatacatgtaa

SEQ ID NO: 814021 - DNA, 22 bp, Artificial Sequence
  chemically synthesized
gatgcatgatatttacatgtat

SEQ ID NO: 814022 - DNA, 22 bp, Artificial Sequence
  chemically synthesized
ggaaacatgtcatacatgtaaa

SEQ ID NO: 814023 - DNA, 22 bp, Artificial Sequence
  chemically synthesized
gaaacatgtcatacatgtaaat

SEQ ID NO: 814024 - DNA, 22 bp, Artificial Sequence
  chemically synthesized
agacttgatgcatgatatttac

SEQ ID NO: 814025 - DNA, 22 bp, Artificial Sequence
  chemically synthesized
ctgagacttgatgcatgatatt

SEQ ID NO: 814026 - DNA, 22 bp, Artificial Sequence
  chemically synthesized
ccctcctgagacttgatgcatg

SEQ ID NO: 814027 - DNA, 22 bp, Artificial Sequence
  chemically synthesized
accctcctgagacttgatgcat

SEQ ID NO: 814028 - DNA, 22 bp, Artificial Sequence
  chemically synthesized
taccctcctgagacttgatgca

SEQ ID NO: 814029 - DNA, 22 bp, Artificial Sequence
  chemically synthesized
ttaccctcctgagacttgatgc

SEQ ID NO: 814030 - DNA, 22 bp, Artificial Sequence
  chemically synthesized
tttaccctcctgagacttgatg

SEQ ID NO: 814031 - DNA, 22 bp, Artificial Sequence
  chemically synthesized
ttttaccctcctgagacttgat

SEQ ID NO: 814032 - DNA, 22 bp, Artificial Sequence
  chemically synthesized
tttttaccctcctgagacttga

SEQ ID NO: 814033 - DNA, 22 bp, Artificial Sequence
  chemically synthesized
ttttttaccctcctgagacttg

SEQ ID NO: 814034 - DNA, 22 bp, Artificial Sequence
  chemically synthesized
tttttttaccctcctgagactt

SEQ ID NO: 814035 - DNA, 22 bp, Artificial Sequence
  chemically synthesized
cagtgctttttttttaccctcc

SEQ ID NO: 814036 - DNA, 22 bp, Artificial Sequence
  chemically synthesized
attccagtgctttttttttacc

SEQ ID NO: 814037 - DNA, 22 bp, Artificial Sequence
  chemically synthesized
gattccagtgctttttttttac

SEQ ID NO: 814038 - DNA, 22 bp, Artificial Sequence
  chemically synthesized
tgattccagtgcttttttttta

SEQ ID NO: 814039 - DNA, 22 bp, Artificial Sequence
  chemically synthesized
cctttgattccagtgctttttt

SEQ ID NO: 814040 - DNA, 22 bp, Artificial Sequence
  chemically synthesized
aggagggtaaaaaaaaagcact

SEQ ID NO: 814041 - DNA, 22 bp, Artificial Sequence
  chemically synthesized
ccctttgattccagtgcttttt

SEQ ID NO: 814042 - DNA, 22 bp, Artificial Sequence
  chemically synthesized
cttccctttgattccagtgctt

SEQ ID NO: 814043 - DNA, 22 bp, Artificial Sequence
  chemically synthesized
gcttccctttgattccagtgct

SEQ ID NO: 814044 - DNA, 22 bp, Artificial Sequence
  chemically synthesized
ttgcttccctttgattccagtg

SEQ ID NO: 814045 - DNA, 22 bp, Artificial Sequence
  chemically synthesized
cttgcttccctttgattccagt

SEQ ID NO: 814046 - DNA, 22 bp, Artificial Sequence
  chemically synthesized
aaatgaatcttcttgcttccct

SEQ ID NO: 814047 - DNA, 22 bp, Artificial Sequence
  chemically synthesized
gaaatgaatcttcttgcttccc

SEQ ID NO: 814048 - DNA, 22 bp, Artificial Sequence
  chemically synthesized
cttgaaatgaatcttcttgctt

SEQ ID NO: 814049 - DNA, 22 bp, Artificial Sequence
  chemically synthesized
gaatcaaagggaagcaagaaga

SEQ ID NO: 814050 - DNA, 22 bp, Artificial Sequence
  chemically synthesized
ccttgaaatgaatcttcttgct

SEQ ID NO: 814051 - DNA, 22 bp, Artificial Sequence
  chemically synthesized
tcttccttgaaatgaatcttct

SEQ ID NO: 814052 - DNA, 22 bp, Artificial Sequence
  chemically synthesized
gatctgtcttccttgaaatgaa

SEQ ID NO: 814053 - DNA, 22 bp, Artificial Sequence
  chemically synthesized
ggatctgtcttccttgaaatga

SEQ ID NO: 814054 - DNA, 22 bp, Artificial Sequence
  chemically synthesized
acaacagccttggatctgtctt

SEQ ID NO: 814055 - DNA, 22 bp, Artificial Sequence
  chemically synthesized
atttcaaggaagacagatccaa

SEQ ID NO: 814056 - DNA, 22 bp, Artificial Sequence
  chemically synthesized
acattcacaacagccttggatc

SEQ ID NO: 814057 - DNA, 22 bp, Artificial Sequence
  chemically synthesized
caaggaagacagatccaaggct

SEQ ID NO: 814058 - DNA, 22 bp, Artificial Sequence
  chemically synthesized
gacattcacaacagccttggat

SEQ ID NO: 814059 - DNA, 22 bp, Artificial Sequence
  chemically synthesized
aaggaagacagatccaaggctg

SEQ ID NO: 814060 - DNA, 22 bp, Artificial Sequence
  chemically synthesized
atttgacattcacaacagcctt

SEQ ID NO: 814061 - DNA, 22 bp, Artificial Sequence
  chemically synthesized
cgctcatttgacattcacaaca

SEQ ID NO: 814062 - DNA, 22 bp, Artificial Sequence
  chemically synthesized
acgctcatttgacattcacaac

SEQ ID NO: 814063 - DNA, 22 bp, Artificial Sequence
  chemically synthesized
tacgctcatttgacattcacaa

SEQ ID NO: 814064 - DNA, 22 bp, Artificial Sequence
  chemically synthesized
tcaagtctttacgctcatttga

SEQ ID NO: 814065 - DNA, 22 bp, Artificial Sequence
  chemically synthesized
ttgtgaatgtcaaatgagcgta

SEQ ID NO: 814066 - DNA, 22 bp, Artificial Sequence
  chemically synthesized
tgaatgtcaaatgagcgtaaag

SEQ ID NO: 814067 - DNA, 22 bp, Artificial Sequence
  chemically synthesized
ccagttatcaagtctttacgct

SEQ ID NO: 814068 - DNA, 22 bp, Artificial Sequence
  chemically synthesized
tgccagttatcaagtctttacg

SEQ ID NO: 814069 - DNA, 22 bp, Artificial Sequence
  chemically synthesized
ttctgccagttatcaagtcttt

SEQ ID NO: 814070 - DNA, 22 bp, Artificial Sequence
  chemically synthesized
tattctgccagttatcaagtct

SEQ ID NO: 814071 - DNA, 22 bp, Artificial Sequence
  chemically synthesized
tctattctgccagttatcaagt

SEQ ID NO: 814072 - DNA, 22 bp, Artificial Sequence
  chemically synthesized
ctctattctgccagttatcaag

SEQ ID NO: 814073 - DNA, 22 bp, Artificial Sequence
  chemically synthesized
tctctattctgccagttatcaa

SEQ ID NO: 814074 - DNA, 22 bp, Artificial Sequence
  chemically synthesized
ttctctattctgccagttatca

SEQ ID NO: 814075 - DNA, 22 bp, Artificial Sequence
  chemically synthesized
taaccaacttttctctattctg

SEQ ID NO: 814076 - DNA, 22 bp, Artificial Sequence
  chemically synthesized
gataactggcagaatagagaaa

SEQ ID NO: 814077 - DNA, 22 bp, Artificial Sequence
  chemically synthesized
ataactggcagaatagagaaaa

SEQ ID NO: 814078 - DNA, 22 bp, Artificial Sequence
  chemically synthesized
ggagattgtaaccaacttttct

SEQ ID NO: 814079 - DNA, 22 bp, Artificial Sequence
  chemically synthesized
tgggagattgtaaccaactttt

SEQ ID NO: 814080 - DNA, 22 bp, Artificial Sequence
  chemically synthesized
gcagaatagagaaaagttggtt

SEQ ID NO: 814081 - DNA, 22 bp, Artificial Sequence
  chemically synthesized
ctgggagattgtaaccaacttt

SEQ ID NO: 814082 - DNA, 22 bp, Artificial Sequence
  chemically synthesized
tagatttctgggagattgtaac

SEQ ID NO: 814083 - DNA, 22 bp, Artificial Sequence
  chemically synthesized
gtagatttctgggagattgtaa

SEQ ID NO: 814084 - DNA, 22 bp, Artificial Sequence
  chemically synthesized
tgtagatttctgggagattgta

SEQ ID NO: 814085 - DNA, 22 bp, Artificial Sequence
  chemically synthesized
atcctttgtagatttctgggag

SEQ ID NO: 814086 - DNA, 22 bp, Artificial Sequence
  chemically synthesized
catcctttgtagatttctggga

SEQ ID NO: 814087 - DNA, 22 bp, Artificial Sequence
  chemically synthesized
ttcatcctttgtagatttctgg

SEQ ID NO: 814088 - DNA, 22 bp, Artificial Sequence
  chemically synthesized
gttacaatctcccagaaatcta

SEQ ID NO: 814089 - DNA, 22 bp, Artificial Sequence
  chemically synthesized
caatctcccagaaatctacaaa

SEQ ID NO: 814090 - DNA, 22 bp, Artificial Sequence
  chemically synthesized
aagcctcttcatcctttgtaga

SEQ ID NO: 814091 - DNA, 22 bp, Artificial Sequence
  chemically synthesized
ccagaaatctacaaaggatgaa

SEQ ID NO: 814092 - DNA, 22 bp, Artificial Sequence
  chemically synthesized
atcctaaagcctcttcatcctt

SEQ ID NO: 814093 - DNA, 22 bp, Artificial Sequence
  chemically synthesized
tcacctcatcctaaagcctctt

SEQ ID NO: 814094 - DNA, 22 bp, Artificial Sequence
  chemically synthesized
caaaggatgaagaggctttagg

SEQ ID NO: 814095 - DNA, 22 bp, Artificial Sequence
  chemically synthesized
ttgtcacctcatcctaaagcct

SEQ ID NO: 814096 - DNA, 22 bp, Artificial Sequence
  chemically synthesized
tccctattgtcacctcatccta

SEQ ID NO: 814097 - DNA, 22 bp, Artificial Sequence
  chemically synthesized
atccctattgtcacctcatcct

SEQ ID NO: 814098 - DNA, 22 bp, Artificial Sequence
  chemically synthesized
tatccctattgtcacctcatcc

SEQ ID NO: 814099 - DNA, 22 bp, Artificial Sequence
  chemically synthesized
tttatccctattgtcacctcat

SEQ ID NO: 814100 - DNA, 22 bp, Artificial Sequence
  chemically synthesized
tctttatccctattgtcacctc

SEQ ID NO: 814101 - DNA, 22 bp, Artificial Sequence
  chemically synthesized
cctctctttatccctattgtca

SEQ ID NO: 814102 - DNA, 22 bp, Artificial Sequence
  chemically synthesized
taggatgaggtgacaataggga

SEQ ID NO: 814103 - DNA, 22 bp, Artificial Sequence
  chemically synthesized
aggatgaggtgacaatagggat

SEQ ID NO: 814104 - DNA, 22 bp, Artificial Sequence
  chemically synthesized
ggatgaggtgacaatagggata

SEQ ID NO: 814105 - DNA, 22 bp, Artificial Sequence
  chemically synthesized
gaaacaattccctctctttatc

SEQ ID NO: 814106 - DNA, 22 bp, Artificial Sequence
  chemically synthesized
tagaaacaattccctctcttta

SEQ ID NO: 814107 - DNA, 22 bp, Artificial Sequence
  chemically synthesized
ctctagaaacaattccctctct

SEQ ID NO: 814108 - DNA, 22 bp, Artificial Sequence
  chemically synthesized
aaaaattgctctagaaacaatt

SEQ ID NO: 814109 - DNA, 22 bp, Artificial Sequence
  chemically synthesized
caaaaattgctctagaaacaat

SEQ ID NO: 814110 - DNA, 22 bp, Artificial Sequence
  chemically synthesized
cttcaaaaattgctctagaaac

SEQ ID NO: 814111 - DNA, 22 bp, Artificial Sequence
  chemically synthesized
tacttcaaaaattgctctagaa

SEQ ID NO: 814112 - DNA, 22 bp, Artificial Sequence
  chemically synthesized
tgaattctacttcaaaaattgc

SEQ ID NO: 814113 - DNA, 22 bp, Artificial Sequence
  chemically synthesized
tgtgaattctacttcaaaaatt

SEQ ID NO: 814114 - DNA, 22 bp, Artificial Sequence
  chemically synthesized
tttctagagcaatttttgaagt

SEQ ID NO: 814115 - DNA, 22 bp, Artificial Sequence
  chemically synthesized
ctagagcaatttttgaagtaga

SEQ ID NO: 814116 - DNA, 22 bp, Artificial Sequence
  chemically synthesized
tagagcaatttttgaagtagaa

SEQ ID NO: 814117 - DNA, 22 bp, Artificial Sequence
  chemically synthesized
caaattctgtgaattctacttc

SEQ ID NO: 814118 - DNA, 22 bp, Artificial Sequence
  chemically synthesized
gagcaatttttgaagtagaatt

SEQ ID NO: 814119 - DNA, 22 bp, Artificial Sequence
  chemically synthesized
ccaaattctgtgaattctactt

SEQ ID NO: 814120 - DNA, 22 bp, Artificial Sequence
  chemically synthesized
gcttccaaattctgtgaattct

SEQ ID NO: 814121 - DNA, 22 bp, Artificial Sequence
  chemically synthesized
ttgaagtagaattcacagaatt

SEQ ID NO: 814122 - DNA, 22 bp, Artificial Sequence
  chemically synthesized
aactggcttccaaattctgtga

SEQ ID NO: 814123 - DNA, 22 bp, Artificial Sequence
  chemically synthesized
tgaagtagaattcacagaattt

SEQ ID NO: 814124 - DNA, 22 bp, Artificial Sequence
  chemically synthesized
gaagtagaattcacagaatttg

SEQ ID NO: 814125 - DNA, 22 bp, Artificial Sequence
  chemically synthesized
aagtagaattcacagaatttgg

SEQ ID NO: 814126 - DNA, 22 bp, Artificial Sequence
  chemically synthesized
acacatgtattaaactggcttc

SEQ ID NO: 814127 - DNA, 22 bp, Artificial Sequence
  chemically synthesized
acagaatttggaagccagttta

SEQ ID NO: 814128 - DNA, 22 bp, Artificial Sequence
  chemically synthesized
ctgacacatgtattaaactggc

SEQ ID NO: 814129 - DNA, 22 bp, Artificial Sequence
  chemically synthesized
ggaagccagtttaatacatgtg

SEQ ID NO: 814130 - DNA, 22 bp, Artificial Sequence
  chemically synthesized
ccaatctactgacacatgtatt

SEQ ID NO: 814131 - DNA, 22 bp, Artificial Sequence
  chemically synthesized
gaagccagtttaatacatgtgt

SEQ ID NO: 814132 - DNA, 22 bp, Artificial Sequence
  chemically synthesized
cccaatctactgacacatgtat

SEQ ID NO: 814133 - DNA, 22 bp, Artificial Sequence
  chemically synthesized
tcccaatctactgacacatgta

SEQ ID NO: 814134 - DNA, 22 bp, Artificial Sequence
  chemically synthesized
tttcccaatctactgacacatg

SEQ ID NO: 814135 - DNA, 22 bp, Artificial Sequence
  chemically synthesized
tctttcccaatctactgacaca

SEQ ID NO: 814136 - DNA, 22 bp, Artificial Sequence
  chemically synthesized
atctctctttcccaatctactg

SEQ ID NO: 814137 - DNA, 22 bp, Artificial Sequence
  chemically synthesized
aatacatgtgtcagtagattgg

SEQ ID NO: 814138 - DNA, 22 bp, Artificial Sequence
  chemically synthesized
gatctctctttcccaatctact

SEQ ID NO: 814139 - DNA, 22 bp, Artificial Sequence
  chemically synthesized
atacatgtgtcagtagattggg

SEQ ID NO: 814140 - DNA, 22 bp, Artificial Sequence
  chemically synthesized
ttgatctctctttcccaatcta

SEQ ID NO: 814141 - DNA, 22 bp, Artificial Sequence
  chemically synthesized
tcttgatctctctttcccaatc

SEQ ID NO: 814142 - DNA, 22 bp, Artificial Sequence
  chemically synthesized
ctcttgatctctctttcccaat

SEQ ID NO: 814143 - DNA, 22 bp, Artificial Sequence
  chemically synthesized
tctcttgatctctctttcccaa

SEQ ID NO: 814144 - DNA, 22 bp, Artificial Sequence
  chemically synthesized
cctttctcttgatctctctttc

SEQ ID NO: 814145 - DNA, 22 bp, Artificial Sequence
  chemically synthesized
tacctttctcttgatctctctt

SEQ ID NO: 814146 - DNA, 22 bp, Artificial Sequence
  chemically synthesized
ctacctttctcttgatctctct

SEQ ID NO: 814147 - DNA, 22 bp, Artificial Sequence
  chemically synthesized
ccttctacctttctcttgatct

SEQ ID NO: 814148 - DNA, 22 bp, Artificial Sequence
  chemically synthesized
ggaaagagagatcaagagaaag

SEQ ID NO: 814149 - DNA, 22 bp, Artificial Sequence
  chemically synthesized
agaattaccttctacctttctc

SEQ ID NO: 814150 - DNA, 22 bp, Artificial Sequence
  chemically synthesized
gaaacctaagaattaccttcta

SEQ ID NO: 814151 - DNA, 22 bp, Artificial Sequence
  chemically synthesized
aaactggaaacctaagaattac

SEQ ID NO: 814152 - DNA, 22 bp, Artificial Sequence
  chemically synthesized
taaaactggaaacctaagaatt

SEQ ID NO: 814153 - DNA, 22 bp, Artificial Sequence
  chemically synthesized
tctctaaaactggaaacctaag

SEQ ID NO: 814154 - DNA, 22 bp, Artificial Sequence
  chemically synthesized
attgtctctaaaactggaaacc

SEQ ID NO: 814155 - DNA, 22 bp, Artificial Sequence
  chemically synthesized
aattgtctctaaaactggaaac

SEQ ID NO: 814156 - DNA, 22 bp, Artificial Sequence
  chemically synthesized
acttaattgtctctaaaactgg

SEQ ID NO: 814157 - DNA, 22 bp, Artificial Sequence
  chemically synthesized
ttaggtttccagttttagagac

SEQ ID NO: 814158 - DNA, 22 bp, Artificial Sequence
  chemically synthesized
tctaacttaattgtctctaaaa

SEQ ID NO: 814159 - DNA, 22 bp, Artificial Sequence
  chemically synthesized
aggtttccagttttagagacaa

SEQ ID NO: 814160 - DNA, 22 bp, Artificial Sequence
  chemically synthesized
ggtttccagttttagagacaat

SEQ ID NO: 814161 - DNA, 22 bp, Artificial Sequence
  chemically synthesized
ccagttttagagacaattaagt

SEQ ID NO: 814162 - DNA, 22 bp, Artificial Sequence
  chemically synthesized
cagttttagagacaattaagtt

SEQ ID NO: 814163 - DNA, 22 bp, Artificial Sequence
  chemically synthesized
tagagacaattaagttagacaa

SEQ ID NO: 814164 - DNA, 22 bp, Artificial Sequence
  chemically synthesized
agtgtagtgtaattgtctaact

SEQ ID NO: 814165 - DNA, 22 bp, Artificial Sequence
  chemically synthesized
agagacaattaagttagacaat

SEQ ID NO: 814166 - DNA, 22 bp, Artificial Sequence
  chemically synthesized
cagtgtagtgtaattgtctaac

SEQ ID NO: 814167 - DNA, 22 bp, Artificial Sequence
  chemically synthesized
gagacaattaagttagacaatt

SEQ ID NO: 814168 - DNA, 22 bp, Artificial Sequence
  chemically synthesized
tcagtgtagtgtaattgtctaa

SEQ ID NO: 814169 - DNA, 22 bp, Artificial Sequence
  chemically synthesized
tgttttcagtgtagtgtaattg

SEQ ID NO: 814170 - DNA, 22 bp, Artificial Sequence
  chemically synthesized
tgtgttttcagtgtagtgtaat

SEQ ID NO: 814171 - DNA, 22 bp, Artificial Sequence
  chemically synthesized
ctgtgttttcagtgtagtgtaa

SEQ ID NO: 814172 - DNA, 22 bp, Artificial Sequence
  chemically synthesized
tctgtgttttcagtgtagtgta

SEQ ID NO: 814173 - DNA, 22 bp, Artificial Sequence
  chemically synthesized
agttagacaattacactacact

SEQ ID NO: 814174 - DNA, 22 bp, Artificial Sequence
  chemically synthesized
aattttctgtgttttcagtgta

SEQ ID NO: 814175 - DNA, 22 bp, Artificial Sequence
  chemically synthesized
gacaattacactacactgaaaa

SEQ ID NO: 814176 - DNA, 22 bp, Artificial Sequence
  chemically synthesized
cactacactgaaaacacagaaa

SEQ ID NO: 814177 - DNA, 22 bp, Artificial Sequence
  chemically synthesized
aaagaaagttaaattttctgtg

SEQ ID NO: 814178 - DNA, 22 bp, Artificial Sequence
  chemically synthesized
cactgaaaacacagaaaattta

SEQ ID NO: 814179 - DNA, 22 bp, Artificial Sequence
  chemically synthesized
cccctaaaagaaagttaaattt

SEQ ID NO: 814180 - DNA, 22 bp, Artificial Sequence
  chemically synthesized
gcccctaaaagaaagttaaatt

SEQ ID NO: 814181 - DNA, 22 bp, Artificial Sequence
  chemically synthesized
aaaacacagaaaatttaacttt

SEQ ID NO: 814182 - DNA, 22 bp, Artificial Sequence
  chemically synthesized
tcttgcccctaaaagaaagtta

SEQ ID NO: 814183 - DNA, 22 bp, Artificial Sequence
  chemically synthesized
aactttcttttaggggcaagat

SEQ ID NO: 814184 - DNA, 22 bp, Artificial Sequence
  chemically synthesized
actttcttttaggggcaagata

SEQ ID NO: 814185 - DNA, 22 bp, Artificial Sequence
  chemically synthesized
tcttttaggggcaagataatgc

SEQ ID NO: 814186 - DNA, 22 bp, Artificial Sequence
  chemically synthesized
cttttaggggcaagataatgca

SEQ ID NO: 814187 - DNA, 22 bp, Artificial Sequence
  chemically synthesized
ttttaggggcaagataatgcat

SEQ ID NO: 814188 - DNA, 22 bp, Artificial Sequence
  chemically synthesized
ttaggggcaagataatgcattc

SEQ ID NO: 814189 - DNA, 22 bp, Artificial Sequence
  chemically synthesized
taggggcaagataatgcattct

SEQ ID NO: 814190 - DNA, 22 bp, Artificial Sequence
  chemically synthesized
aggggcaagataatgcattcta

SEQ ID NO: 814191 - DNA, 22 bp, Artificial Sequence
  chemically synthesized
ggggcaagataatgcattctac

SEQ ID NO: 814192 - DNA, 22 bp, Artificial Sequence
  chemically synthesized
caaaatgtgtcaagtagaatgc

SEQ ID NO: 814193 - DNA, 22 bp, Artificial Sequence
  chemically synthesized
caggctgcaaaatgtgtcaagt

SEQ ID NO: 814194 - DNA, 22 bp, Artificial Sequence
  chemically synthesized
gatatgctacaggctgcaaaat

SEQ ID NO: 814195 - DNA, 22 bp, Artificial Sequence
  chemically synthesized
tacttgacacattttgcagcct

SEQ ID NO: 814196 - DNA, 22 bp, Artificial Sequence
  chemically synthesized
cttgacacattttgcagcctgt

SEQ ID NO: 814197 - DNA, 22 bp, Artificial Sequence
  chemically synthesized
gacacattttgcagcctgtagc

SEQ ID NO: 814198 - DNA, 22 bp, Artificial Sequence
  chemically synthesized
ccacctggatatgctacaggct

SEQ ID NO: 814199 - DNA, 22 bp, Artificial Sequence
  chemically synthesized
acacattttgcagcctgtagca

SEQ ID NO: 814200 - DNA, 22 bp, Artificial Sequence
  chemically synthesized
cattaccacctggatatgctac

SEQ ID NO: 814201 - DNA, 22 bp, Artificial Sequence
  chemically synthesized
tgcagcctgtagcatatccagg

SEQ ID NO: 814202 - DNA, 22 bp, Artificial Sequence
  chemically synthesized
gcagcctgtagcatatccaggt

SEQ ID NO: 814203 - DNA, 22 bp, Artificial Sequence
  chemically synthesized
acctacattaccacctggatat

SEQ ID NO: 814204 - DNA, 22 bp, Artificial Sequence
  chemically synthesized
cagcctgtagcatatccaggtg

SEQ ID NO: 814205 - DNA, 22 bp, Artificial Sequence
  chemically synthesized
ccacctaacctacattaccacc

SEQ ID NO: 814206 - DNA, 22 bp, Artificial Sequence
  chemically synthesized
tagcatatccaggtggtaatgt

SEQ ID NO: 814207 - DNA, 22 bp, Artificial Sequence
  chemically synthesized
tgccacctaacctacattacca

SEQ ID NO: 814208 - DNA, 22 bp, Artificial Sequence
  chemically synthesized
ctgccacctaacctacattacc

SEQ ID NO: 814209 - DNA, 22 bp, Artificial Sequence
  chemically synthesized
tctgccacctaacctacattac

SEQ ID NO: 814210 - DNA, 22 bp, Artificial Sequence
  chemically synthesized
tactttctgccacctaacctac

SEQ ID NO: 814211 - DNA, 22 bp, Artificial Sequence
  chemically synthesized
cagaactgtactttctgccacc

SEQ ID NO: 814212 - DNA, 22 bp, Artificial Sequence
  chemically synthesized
atctccagaactgtactttctg

SEQ ID NO: 814213 - DNA, 22 bp, Artificial Sequence
  chemically synthesized
ctgatctccagaactgtacttt

SEQ ID NO: 814214 - DNA, 22 bp, Artificial Sequence
  chemically synthesized
tcctgatctccagaactgtact

SEQ ID NO: 814215 - DNA, 22 bp, Artificial Sequence
  chemically synthesized
ctcctgatctccagaactgtac

SEQ ID NO: 814216 - DNA, 22 bp, Artificial Sequence
  chemically synthesized
ggtggcagaaagtacagttctg

SEQ ID NO: 814217 - DNA, 22 bp, Artificial Sequence
  chemically synthesized
ttctcctgatctccagaactgt

SEQ ID NO: 814218 - DNA, 22 bp, Artificial Sequence
  chemically synthesized
cactcttctcctgatctccaga

SEQ ID NO: 814219 - DNA, 22 bp, Artificial Sequence
  chemically synthesized
acactcttctcctgatctccag

SEQ ID NO: 814220 - DNA, 22 bp, Artificial Sequence
  chemically synthesized
catcttacactcttctcctgat

SEQ ID NO: 814221 - DNA, 22 bp, Artificial Sequence
  chemically synthesized
ccatcttacactcttctcctga

SEQ ID NO: 814222 - DNA, 22 bp, Artificial Sequence
  chemically synthesized
tggagatcaggagaagagtgta

SEQ ID NO: 814223 - DNA, 22 bp, Artificial Sequence
  chemically synthesized
gagatcaggagaagagtgtaag

SEQ ID NO: 814224 - DNA, 22 bp, Artificial Sequence
  chemically synthesized
agtgtcaacttccatcttacac

SEQ ID NO: 814225 - DNA, 22 bp, Artificial Sequence
  chemically synthesized
ctcagtgtcaacttccatctta

SEQ ID NO: 814226 - DNA, 22 bp, Artificial Sequence
  chemically synthesized
agactcctcagtgtcaacttcc

SEQ ID NO: 814227 - DNA, 22 bp, Artificial Sequence
  chemically synthesized
acattaagactcctcagtgtca

SEQ ID NO: 814228 - DNA, 22 bp, Artificial Sequence
  chemically synthesized
agttaacattaagactcctcag

SEQ ID NO: 814229 - DNA, 22 bp, Artificial Sequence
  chemically synthesized
cagttaacattaagactcctca

SEQ ID NO: 814230 - DNA, 22 bp, Artificial Sequence
  chemically synthesized
gcttcagttaacattaagactc

SEQ ID NO: 814231 - DNA, 22 bp, Artificial Sequence
  chemically synthesized
ttggcttcagttaacattaaga

SEQ ID NO: 814232 - DNA, 22 bp, Artificial Sequence
  chemically synthesized
acactgaggagtcttaatgtta

SEQ ID NO: 814233 - DNA, 22 bp, Artificial Sequence
  chemically synthesized
tctgttggcttcagttaacatt

SEQ ID NO: 814234 - DNA, 22 bp, Artificial Sequence
  chemically synthesized
gtctgttggcttcagttaacat

SEQ ID NO: 814235 - DNA, 22 bp, Artificial Sequence
  chemically synthesized
tgtctgttggcttcagttaaca

SEQ ID NO: 814236 - DNA, 22 bp, Artificial Sequence
  chemically synthesized
aggagtcttaatgttaactgaa

SEQ ID NO: 814237 - DNA, 22 bp, Artificial Sequence
  chemically synthesized
agtagctttgtctgttggcttc

SEQ ID NO: 814238 - DNA, 22 bp, Artificial Sequence
  chemically synthesized
gagtagctttgtctgttggctt

SEQ ID NO: 814239 - DNA, 22 bp, Artificial Sequence
  chemically synthesized
aatgttaactgaagccaacaga

SEQ ID NO: 814240 - DNA, 22 bp, Artificial Sequence
  chemically synthesized
tgagtagctttgtctgttggct

SEQ ID NO: 814241 - DNA, 22 bp, Artificial Sequence
  chemically synthesized
atgttaactgaagccaacagac

SEQ ID NO: 814242 - DNA, 22 bp, Artificial Sequence
  chemically synthesized
actgaagccaacagacaaagct

SEQ ID NO: 814243 - DNA, 22 bp, Artificial Sequence
  chemically synthesized
cacattttgagtagctttgtct

SEQ ID NO: 814244 - DNA, 22 bp, Artificial Sequence
  chemically synthesized
tgcacattttgagtagctttgt

SEQ ID NO: 814245 - DNA, 22 bp, Artificial Sequence
  chemically synthesized
aagccaacagacaaagctactc

SEQ ID NO: 814246 - DNA, 22 bp, Artificial Sequence
  chemically synthesized
tctgcacattttgagtagcttt

SEQ ID NO: 814247 - DNA, 22 bp, Artificial Sequence
  chemically synthesized
tctctgcacattttgagtagct

SEQ ID NO: 814248 - DNA, 22 bp, Artificial Sequence
  chemically synthesized
ctctctgcacattttgagtagc

SEQ ID NO: 814249 - DNA, 22 bp, Artificial Sequence
  chemically synthesized
tctctctgcacattttgagtag

SEQ ID NO: 814250 - DNA, 22 bp, Artificial Sequence
  chemically synthesized
tttctctctgcacattttgagt

SEQ ID NO: 814251 - DNA, 22 bp, Artificial Sequence
  chemically synthesized
ctttctctctgcacattttgag

SEQ ID NO: 814252 - DNA, 22 bp, Artificial Sequence
  chemically synthesized
ttctttctctctgcacattttg

SEQ ID NO: 814253 - DNA, 22 bp, Artificial Sequence
  chemically synthesized
tcttctttctctctgcacattt

SEQ ID NO: 814254 - DNA, 22 bp, Artificial Sequence
  chemically synthesized
tctctcttctttctctctgcac

SEQ ID NO: 814255 - DNA, 22 bp, Artificial Sequence
  chemically synthesized
ctcaaaatgtgcagagagaaag

SEQ ID NO: 814256 - DNA, 22 bp, Artificial Sequence
  chemically synthesized
attgtctctcttctttctctct

SEQ ID NO: 814257 - DNA, 22 bp, Artificial Sequence
  chemically synthesized
aattgtctctcttctttctctc

SEQ ID NO: 814258 - DNA, 22 bp, Artificial Sequence
  chemically synthesized
aaaatgtgcagagagaaagaag

SEQ ID NO: 814259 - DNA, 22 bp, Artificial Sequence
  chemically synthesized
ttaattgtctctcttctttctc

SEQ ID NO: 814260 - DNA, 22 bp, Artificial Sequence
  chemically synthesized
cattcttaattgtctctcttct

SEQ ID NO: 814261 - DNA, 22 bp, Artificial Sequence
  chemically synthesized
atgttccattcttaattgtctc

SEQ ID NO: 814262 - DNA, 22 bp, Artificial Sequence
  chemically synthesized
aatgttgatgttccattcttaa

SEQ ID NO: 814263 - DNA, 22 bp, Artificial Sequence
  chemically synthesized
aaatgttgatgttccattctta

SEQ ID NO: 814264 - DNA, 22 bp, Artificial Sequence
  chemically synthesized
taaatgttgatgttccattctt

SEQ ID NO: 814265 - DNA, 22 bp, Artificial Sequence
  chemically synthesized
aatgcaattttaaatgttgatg

SEQ ID NO: 814266 - DNA, 22 bp, Artificial Sequence
  chemically synthesized
caatgcaattttaaatgttgat

SEQ ID NO: 814267 - DNA, 22 bp, Artificial Sequence
  chemically synthesized
agaatggaacatcaacatttaa

SEQ ID NO: 814268 - DNA, 22 bp, Artificial Sequence
  chemically synthesized
tcttcaatgcaattttaaatgt

SEQ ID NO: 814269 - DNA, 22 bp, Artificial Sequence
  chemically synthesized
tgtcttcaatgcaattttaaat

SEQ ID NO: 814270 - DNA, 22 bp, Artificial Sequence
  chemically synthesized
tctgtcttcaatgcaattttaa

SEQ ID NO: 814271 - DNA, 22 bp, Artificial Sequence
  chemically synthesized
aaaattgcattgaagacagaga

SEQ ID NO: 814272 - DNA, 22 bp, Artificial Sequence
  chemically synthesized
aaattgcattgaagacagagaa

SEQ ID NO: 814273 - DNA, 22 bp, Artificial Sequence
  chemically synthesized
cattgaagacagagaacttgca

SEQ ID NO: 814274 - DNA, 22 bp, Artificial Sequence
  chemically synthesized
taacaatgatcagtgcaagttc

SEQ ID NO: 814275 - DNA, 22 bp, Artificial Sequence
  chemically synthesized
aagacagagaacttgcactgat

SEQ ID NO: 814276 - DNA, 22 bp, Artificial Sequence
  chemically synthesized
ggagttgtaacaatgatcagtg

SEQ ID NO: 814277 - DNA, 22 bp, Artificial Sequence
  chemically synthesized
gcactgatcattgttacaactc

SEQ ID NO: 814278 - DNA, 22 bp, Artificial Sequence
  chemically synthesized
cactgatcattgttacaactcc

SEQ ID NO: 814279 - DNA, 22 bp, Artificial Sequence
  chemically synthesized
aagatacaaagttgggagttgt

SEQ ID NO: 814280 - DNA, 22 bp, Artificial Sequence
  chemically synthesized
atcattgttacaactcccaact

SEQ ID NO: 814281 - DNA, 22 bp, Artificial Sequence
  chemically synthesized
ttacaactcccaactttgtatc

SEQ ID NO: 814282 - DNA, 22 bp, Artificial Sequence
  chemically synthesized
caactcccaactttgtatcttg

SEQ ID NO: 814283 - DNA, 22 bp, Artificial Sequence
  chemically synthesized
tggggagtagctcaagatacaa

SEQ ID NO: 814284 - DNA, 22 bp, Artificial Sequence
  chemically synthesized
agttatggggagtagctcaaga

SEQ ID NO: 814285 - DNA, 22 bp, Artificial Sequence
  chemically synthesized
ccaactttgtatcttgagctac

SEQ ID NO: 814286 - DNA, 22 bp, Artificial Sequence
  chemically synthesized
aagttatggggagtagctcaag

SEQ ID NO: 814287 - DNA, 22 bp, Artificial Sequence
  chemically synthesized
tgtatcttgagctactccccat

SEQ ID NO: 814288 - DNA, 22 bp, Artificial Sequence
  chemically synthesized
gtatcttgagctactccccata

SEQ ID NO: 814289 - DNA, 22 bp, Artificial Sequence
  chemically synthesized
tatcttgagctactccccataa

SEQ ID NO: 814290 - DNA, 22 bp, Artificial Sequence
  chemically synthesized
gatatatgaatcttaagttatg

SEQ ID NO: 814291 - DNA, 22 bp, Artificial Sequence
  chemically synthesized
gagctactccccataacttaag

SEQ ID NO: 814292 - DNA, 22 bp, Artificial Sequence
  chemically synthesized
agctactccccataacttaaga

SEQ ID NO: 814293 - DNA, 22 bp, Artificial Sequence
  chemically synthesized
ctccccataacttaagattcat

SEQ ID NO: 814294 - DNA, 22 bp, Artificial Sequence
  chemically synthesized
cccataacttaagattcatata

SEQ ID NO: 814295 - DNA, 22 bp, Artificial Sequence
  chemically synthesized
aagattcatatatccagctatc

SEQ ID NO: 814296 - DNA, 22 bp, Artificial Sequence
  chemically synthesized
agattcatatatccagctatct

SEQ ID NO: 814297 - DNA, 22 bp, Artificial Sequence
  chemically synthesized
ggagatgtgtggagtagatagc

SEQ ID NO: 814298 - DNA, 22 bp, Artificial Sequence
  chemically synthesized
atatatccagctatctactcca

SEQ ID NO: 814299 - DNA, 22 bp, Artificial Sequence
  chemically synthesized
tacatctaggagatgtgtggag

SEQ ID NO: 814300 - DNA, 22 bp, Artificial Sequence
  chemically synthesized
ttatacatctaggagatgtgtg

SEQ ID NO: 814301 - DNA, 22 bp, Artificial Sequence
  chemically synthesized
tctactccacacatctcctaga

SEQ ID NO: 814302 - DNA, 22 bp, Artificial Sequence
  chemically synthesized
ctccacacatctcctagatgta

SEQ ID NO: 814303 - DNA, 22 bp, Artificial Sequence
  chemically synthesized
aaatgcctattatacatctagg

SEQ ID NO: 814304 - DNA, 22 bp, Artificial Sequence
  chemically synthesized
gaaatgcctattatacatctag

SEQ ID NO: 814305 - DNA, 22 bp, Artificial Sequence
  chemically synthesized
cacacatctcctagatgtataa

SEQ ID NO: 814306 - DNA, 22 bp, Artificial Sequence
  chemically synthesized
catttgaaatgcctattataca

SEQ ID NO: 814307 - DNA, 22 bp, Artificial Sequence
  chemically synthesized
ctagatgtataataggcatttc

SEQ ID NO: 814308 - DNA, 22 bp, Artificial Sequence
  chemically synthesized
gatgtataataggcatttcaaa

SEQ ID NO: 814309 - DNA, 22 bp, Artificial Sequence
  chemically synthesized
ggaggaagatgtggatatgtta

SEQ ID NO: 814310 - DNA, 22 bp, Artificial Sequence
  chemically synthesized
gggaggaagatgtggatatgtt

SEQ ID NO: 814311 - DNA, 22 bp, Artificial Sequence
  chemically synthesized
tgggaggaagatgtggatatgt

SEQ ID NO: 814312 - DNA, 22 bp, Artificial Sequence
  chemically synthesized
caaatgtaacatatccacatct

SEQ ID NO: 814313 - DNA, 22 bp, Artificial Sequence
  chemically synthesized
aaatgtaacatatccacatctt

SEQ ID NO: 814314 - DNA, 22 bp, Artificial Sequence
  chemically synthesized
caggagtaacatattttgggag

SEQ ID NO: 814315 - DNA, 22 bp, Artificial Sequence
  chemically synthesized
cctcccaaaatatgttactcct

SEQ ID NO: 814316 - DNA, 22 bp, Artificial Sequence
  chemically synthesized
ctcccaaaatatgttactcctg

SEQ ID NO: 814317 - DNA, 22 bp, Artificial Sequence
  chemically synthesized
ccaaaatatgttactcctggag

SEQ ID NO: 814318 - DNA, 22 bp, Artificial Sequence
  chemically synthesized
agatggggaaggctccaggagt

SEQ ID NO: 814319 - DNA, 22 bp, Artificial Sequence
  chemically synthesized
ctgagatggggaaggctccagg

SEQ ID NO: 814320 - DNA, 22 bp, Artificial Sequence
  chemically synthesized
actgagatggggaaggctccag

SEQ ID NO: 814321 - DNA, 22 bp, Artificial Sequence
  chemically synthesized
ctcctggagccttccccatctc

SEQ ID NO: 814322 - DNA, 22 bp, Artificial Sequence
  chemically synthesized
ctggagccttccccatctcagt

SEQ ID NO: 814323 - DNA, 22 bp, Artificial Sequence
  chemically synthesized
gagccttccccatctcagtaaa

SEQ ID NO: 814324 - DNA, 22 bp, Artificial Sequence
  chemically synthesized
ccccatctcagtaaatgatgac

SEQ ID NO: 814325 - DNA, 22 bp, Artificial Sequence
  chemically synthesized
cccatctcagtaaatgatgacc

SEQ ID NO: 814326 - DNA, 22 bp, Artificial Sequence
  chemically synthesized
agcaacggaaagatggggtcat

SEQ ID NO: 814327 - DNA, 22 bp, Artificial Sequence
  chemically synthesized
agtaaatgatgaccccatcttt

SEQ ID NO: 814328 - DNA, 22 bp, Artificial Sequence
  chemically synthesized
gcctgagcaacggaaagatggg

SEQ ID NO: 814329 - DNA, 22 bp, Artificial Sequence
  chemically synthesized
agcctgagcaacggaaagatgg

SEQ ID NO: 814330 - DNA, 22 bp, Artificial Sequence
  chemically synthesized
tagcctgagcaacggaaagatg

SEQ ID NO: 814331 - DNA, 22 bp, Artificial Sequence
  chemically synthesized
ttagcctgagcaacggaaagat

SEQ ID NO: 814332 - DNA, 22 bp, Artificial Sequence
  chemically synthesized
aagaatttttagcctgagcaac

SEQ ID NO: 814333 - DNA, 22 bp, Artificial Sequence
  chemically synthesized
tccgttgctcaggctaaaaatt

SEQ ID NO: 814334 - DNA, 22 bp, Artificial Sequence
  chemically synthesized
ccgttgctcaggctaaaaattc

SEQ ID NO: 814335 - DNA, 22 bp, Artificial Sequence
  chemically synthesized
cgttgctcaggctaaaaattct

SEQ ID NO: 814336 - DNA, 22 bp, Artificial Sequence
  chemically synthesized
ctcaggctaaaaattcttgagt

SEQ ID NO: 814337 - DNA, 22 bp, Artificial Sequence
  chemically synthesized
aggctaaaaattcttgagtctt

SEQ ID NO: 814338 - DNA, 22 bp, Artificial Sequence
  chemically synthesized
aaaattcttgagtcttcttgac

SEQ ID NO: 814339 - DNA, 22 bp, Artificial Sequence
  chemically synthesized
ggtgtgagagaaagagtcaaga

SEQ ID NO: 814340 - DNA, 22 bp, Artificial Sequence
  chemically synthesized
aggtgtgagagaaagagtcaag

SEQ ID NO: 814341 - DNA, 22 bp, Artificial Sequence
  chemically synthesized
ttgagtcttcttgactctttct

SEQ ID NO: 814342 - DNA, 22 bp, Artificial Sequence
  chemically synthesized
gagtcttcttgactctttctct

SEQ ID NO: 814343 - DNA, 22 bp, Artificial Sequence
  chemically synthesized
agtcttcttgactctttctctc

SEQ ID NO: 814344 - DNA, 22 bp, Artificial Sequence
  chemically synthesized
cttgactctttctctcacacct

SEQ ID NO: 814345 - DNA, 22 bp, Artificial Sequence
  chemically synthesized
ttgactctttctctcacaccta

SEQ ID NO: 814346 - DNA, 22 bp, Artificial Sequence
  chemically synthesized
gactctttctctcacacctaaa

SEQ ID NO: 814347 - DNA, 22 bp, Artificial Sequence
  chemically synthesized
taatggaataaatttaggtgtg

SEQ ID NO: 814348 - DNA, 22 bp, Artificial Sequence
  chemically synthesized
actctttctctcacacctaaat

SEQ ID NO: 814349 - DNA, 22 bp, Artificial Sequence
  chemically synthesized
ataatggaataaatttaggtgt

SEQ ID NO: 814350 - DNA, 22 bp, Artificial Sequence
  chemically synthesized
tataatggaataaatttaggtg

SEQ ID NO: 814351 - DNA, 22 bp, Artificial Sequence
  chemically synthesized
tttctctcacacctaaatttat

SEQ ID NO: 814352 - DNA, 22 bp, Artificial Sequence
  chemically synthesized
tctctcacacctaaatttattc

SEQ ID NO: 814353 - DNA, 22 bp, Artificial Sequence
  chemically synthesized
ctctcacacctaaatttattcc

SEQ ID NO: 814354 - DNA, 22 bp, Artificial Sequence
  chemically synthesized
tctcacacctaaatttattcca

SEQ ID NO: 814355 - DNA, 22 bp, Artificial Sequence
  chemically synthesized
tcacacctaaatttattccatt

SEQ ID NO: 814356 - DNA, 22 bp, Artificial Sequence
  chemically synthesized
acacctaaatttattccattat

SEQ ID NO: 814357 - DNA, 22 bp, Artificial Sequence
  chemically synthesized
aatttattccattataaaatct

SEQ ID NO: 814358 - DNA, 22 bp, Artificial Sequence
  chemically synthesized
ggtacagagcacaacagatttt

SEQ ID NO: 814359 - DNA, 22 bp, Artificial Sequence
  chemically synthesized
gggtacagagcacaacagattt

SEQ ID NO: 814360 - DNA, 22 bp, Artificial Sequence
  chemically synthesized
attccattataaaatctgttgt

SEQ ID NO: 814361 - DNA, 22 bp, Artificial Sequence
  chemically synthesized
tgggtacagagcacaacagatt

SEQ ID NO: 814362 - DNA, 22 bp, Artificial Sequence
  chemically synthesized
ttccattataaaatctgttgtg

SEQ ID NO: 814363 - DNA, 22 bp, Artificial Sequence
  chemically synthesized
cattataaaatctgttgtgctc

SEQ ID NO: 814364 - DNA, 22 bp, Artificial Sequence
  chemically synthesized
tattttgggtacagagcacaac

SEQ ID NO: 814365 - DNA, 22 bp, Artificial Sequence
  chemically synthesized
ctatattttgggtacagagcac

SEQ ID NO: 814366 - DNA, 22 bp, Artificial Sequence
  chemically synthesized
taaaatctgttgtgctctgtac

SEQ ID NO: 814367 - DNA, 22 bp, Artificial Sequence
  chemically synthesized
tactatattttgggtacagagc

SEQ ID NO: 814368 - DNA, 22 bp, Artificial Sequence
  chemically synthesized
gattctactatattttgggtac

SEQ ID NO: 814369 - DNA, 22 bp, Artificial Sequence
  chemically synthesized
ttgtgctctgtacccaaaatat

SEQ ID NO: 814370 - DNA, 22 bp, Artificial Sequence
  chemically synthesized
tgctctgtacccaaaatatagt

SEQ ID NO: 814371 - DNA, 22 bp, Artificial Sequence
  chemically synthesized
tgtacccaaaatatagtagaat

SEQ ID NO: 814372 - DNA, 22 bp, Artificial Sequence
  chemically synthesized
tacccaaaatatagtagaatcc

SEQ ID NO: 814373 - DNA, 22 bp, Artificial Sequence
  chemically synthesized
ggatcagaatgggagaggtgaa

SEQ ID NO: 814374 - DNA, 22 bp, Artificial Sequence
  chemically synthesized
ctcaccacattcacctctccca

SEQ ID NO: 814375 - DNA, 22 bp, Artificial Sequence
  chemically synthesized
accacattcacctctcccattc

SEQ ID NO: 814376 - DNA, 22 bp, Artificial Sequence
  chemically synthesized
tggctgggatcagaatgggaga

SEQ ID NO: 814377 - DNA, 22 bp, Artificial Sequence
  chemically synthesized
acctctcccattctgatcccag

SEQ ID NO: 814378 - DNA, 22 bp, Artificial Sequence
  chemically synthesized
tcccattctgatcccagccaca

SEQ ID NO: 814379 - DNA, 22 bp, Artificial Sequence
  chemically synthesized
ccattctgatcccagccacagt

SEQ ID NO: 814380 - DNA, 22 bp, Artificial Sequence
  chemically synthesized
agtcaagagatgactgtggctg

SEQ ID NO: 814381 - DNA, 22 bp, Artificial Sequence
  chemically synthesized
tgatcccagccacagtcatctc

SEQ ID NO: 814382 - DNA, 22 bp, Artificial Sequence
  chemically synthesized
atcccagccacagtcatctctt

SEQ ID NO: 814383 - DNA, 22 bp, Artificial Sequence
  chemically synthesized
tcataattcagtcaagagatga

SEQ ID NO: 814384 - DNA, 22 bp, Artificial Sequence
  chemically synthesized
ttgtcataattcagtcaagaga

SEQ ID NO: 814385 - DNA, 22 bp, Artificial Sequence
  chemically synthesized
ggaaactgttgtcataattcag

SEQ ID NO: 814386 - DNA, 22 bp, Artificial Sequence
  chemically synthesized
ttgactgaattatgacaacagt

SEQ ID NO: 814387 - DNA, 22 bp, Artificial Sequence
  chemically synthesized
gactgaattatgacaacagttt

SEQ ID NO: 814388 - DNA, 22 bp, Artificial Sequence
  chemically synthesized
actgaattatgacaacagtttc

SEQ ID NO: 814389 - DNA, 22 bp, Artificial Sequence
  chemically synthesized
aattatgacaacagtttcctaa

SEQ ID NO: 814390 - DNA, 22 bp, Artificial Sequence
  chemically synthesized
tgacaacagtttcctaatggtc

SEQ ID NO: 814391 - DNA, 22 bp, Artificial Sequence
  chemically synthesized
aacagaagtagtgagaccatta

SEQ ID NO: 814392 - DNA, 22 bp, Artificial Sequence
  chemically synthesized
cctaatggtctcactacttctg

SEQ ID NO: 814393 - DNA, 22 bp, Artificial Sequence
  chemically synthesized
caatagactaaacagaagtagt

SEQ ID NO: 814394 - DNA, 22 bp, Artificial Sequence
  chemically synthesized
ctaatggtctcactacttctgt

SEQ ID NO: 814395 - DNA, 22 bp, Artificial Sequence
  chemically synthesized
ttacaatagactaaacagaagt

SEQ ID NO: 814396 - DNA, 22 bp, Artificial Sequence
  chemically synthesized
atggtctcactacttctgttta

SEQ ID NO: 814397 - DNA, 22 bp, Artificial Sequence
  chemically synthesized
tgttacaatagactaaacagaa

SEQ ID NO: 814398 - DNA, 22 bp, Artificial Sequence
  chemically synthesized
ctctgttacaatagactaaaca

SEQ ID NO: 814399 - DNA, 22 bp, Artificial Sequence
  chemically synthesized
actacttctgtttagtctattg

SEQ ID NO: 814400 - DNA, 22 bp, Artificial Sequence
  chemically synthesized
gctcctctgttacaatagacta

SEQ ID NO: 814401 - DNA, 22 bp, Artificial Sequence
  chemically synthesized
cttctgtttagtctattgtaac

SEQ ID NO: 814402 - DNA, 22 bp, Artificial Sequence
  chemically synthesized
tctggctcctctgttacaatag

SEQ ID NO: 814403 - DNA, 22 bp, Artificial Sequence
  chemically synthesized
atctggctcctctgttacaata

SEQ ID NO: 814404 - DNA, 22 bp, Artificial Sequence
  chemically synthesized
ctgtttagtctattgtaacaga

SEQ ID NO: 814405 - DNA, 22 bp, Artificial Sequence
  chemically synthesized
tgtttagtctattgtaacagag

SEQ ID NO: 814406 - DNA, 22 bp, Artificial Sequence
  chemically synthesized
tcttatctggctcctctgttac

SEQ ID NO: 814407 - DNA, 22 bp, Artificial Sequence
  chemically synthesized
tttagtctattgtaacagagga

SEQ ID NO: 814408 - DNA, 22 bp, Artificial Sequence
  chemically synthesized
gtcttatctggctcctctgtta

SEQ ID NO: 814409 - DNA, 22 bp, Artificial Sequence
  chemically synthesized
tgtcttatctggctcctctgtt

SEQ ID NO: 814410 - DNA, 22 bp, Artificial Sequence
  chemically synthesized
agtctattgtaacagaggagcc

SEQ ID NO: 814411 - DNA, 22 bp, Artificial Sequence
  chemically synthesized
gtctattgtaacagaggagcca

SEQ ID NO: 814412 - DNA, 22 bp, Artificial Sequence
  chemically synthesized
ttgtaacagaggagccagataa

SEQ ID NO: 814413 - DNA, 22 bp, Artificial Sequence
  chemically synthesized
taacagaggagccagataagac

SEQ ID NO: 814414 - DNA, 22 bp, Artificial Sequence
  chemically synthesized
aatggaggagtgacatgttttg

SEQ ID NO: 814415 - DNA, 22 bp, Artificial Sequence
  chemically synthesized
gaatggaggagtgacatgtttt

SEQ ID NO: 814416 - DNA, 22 bp, Artificial Sequence
  chemically synthesized
tgaatggaggagtgacatgttt

SEQ ID NO: 814417 - DNA, 22 bp, Artificial Sequence
  chemically synthesized
gagggttttgaatggaggagtg

SEQ ID NO: 814418 - DNA, 22 bp, Artificial Sequence
  chemically synthesized
ttggagggttttgaatggagga

SEQ ID NO: 814419 - DNA, 22 bp, Artificial Sequence
  chemically synthesized
ctccattcaaaaccctccaata

SEQ ID NO: 814420 - DNA, 22 bp, Artificial Sequence
  chemically synthesized
aatgagatgggagttattggag

SEQ ID NO: 814421 - DNA, 22 bp, Artificial Sequence
  chemically synthesized
cattcaaaaccctccaataact

SEQ ID NO: 814422 - DNA, 22 bp, Artificial Sequence
  chemically synthesized
atctgaatgagatgggagttat

SEQ ID NO: 814423 - DNA, 22 bp, Artificial Sequence
  chemically synthesized
aaaaccctccaataactcccat

SEQ ID NO: 814424 - DNA, 22 bp, Artificial Sequence
  chemically synthesized
aatctgaatgagatgggagtta

SEQ ID NO: 814425 - DNA, 22 bp, Artificial Sequence
  chemically synthesized
taatctgaatgagatgggagtt

SEQ ID NO: 814426 - DNA, 22 bp, Artificial Sequence
  chemically synthesized
ttaatctgaatgagatgggagt

SEQ ID NO: 814427 - DNA, 22 bp, Artificial Sequence
  chemically synthesized
gcttttaatctgaatgagatgg

SEQ ID NO: 814428 - DNA, 22 bp, Artificial Sequence
  chemically synthesized
agcttttaatctgaatgagatg

SEQ ID NO: 814429 - DNA, 22 bp, Artificial Sequence
  chemically synthesized
tagcttttaatctgaatgagat

SEQ ID NO: 814430 - DNA, 22 bp, Artificial Sequence
  chemically synthesized
caataactcccatctcattcag

SEQ ID NO: 814431 - DNA, 22 bp, Artificial Sequence
  chemically synthesized
tggactttagcttttaatctga

SEQ ID NO: 814432 - DNA, 22 bp, Artificial Sequence
  chemically synthesized
ccatctcattcagattaaaagc

SEQ ID NO: 814433 - DNA, 22 bp, Artificial Sequence
  chemically synthesized
ggcctgtggactttagctttta

SEQ ID NO: 814434 - DNA, 22 bp, Artificial Sequence
  chemically synthesized
aggcctgtggactttagctttt

SEQ ID NO: 814435 - DNA, 22 bp, Artificial Sequence
  chemically synthesized
taggcctgtggactttagcttt

SEQ ID NO: 814436 - DNA, 22 bp, Artificial Sequence
  chemically synthesized
ttaggcctgtggactttagctt

SEQ ID NO: 814437 - DNA, 22 bp, Artificial Sequence
  chemically synthesized
attcagattaaaagctaaagtc

SEQ ID NO: 814438 - DNA, 22 bp, Artificial Sequence
  chemically synthesized
agattaaaagctaaagtccaca

SEQ ID NO: 814439 - DNA, 22 bp, Artificial Sequence
  chemically synthesized
gccttttaggcctgtggacttt

SEQ ID NO: 814440 - DNA, 22 bp, Artificial Sequence
  chemically synthesized
tattggccttttaggcctgtgg

SEQ ID NO: 814441 - DNA, 22 bp, Artificial Sequence
  chemically synthesized
aaagctaaagtccacaggccta

SEQ ID NO: 814442 - DNA, 22 bp, Artificial Sequence
  chemically synthesized
attatattggccttttaggcct

SEQ ID NO: 814443 - DNA, 22 bp, Artificial Sequence
  chemically synthesized
aagtccacaggcctaaaaggcc

SEQ ID NO: 814444 - DNA, 22 bp, Artificial Sequence
  chemically synthesized
gcatctgattatattggccttt

SEQ ID NO: 814445 - DNA, 22 bp, Artificial Sequence
  chemically synthesized
aaaggccaatataatcagatgc

SEQ ID NO: 814446 - DNA, 22 bp, Artificial Sequence
  chemically synthesized
gaggggtaactggcatctgatt

SEQ ID NO: 814447 - DNA, 22 bp, Artificial Sequence
  chemically synthesized
agaggggtaactggcatctgat

SEQ ID NO: 814448 - DNA, 22 bp, Artificial Sequence
  chemically synthesized
acaataaatttagaggggtaac

SEQ ID NO: 814449 - DNA, 22 bp, Artificial Sequence
  chemically synthesized
cccctctaaatttattgtcaac

SEQ ID NO: 814450 - DNA, 22 bp, Artificial Sequence
  chemically synthesized
taaatttattgtcaactacctt

SEQ ID NO: 814451 - DNA, 22 bp, Artificial Sequence
  chemically synthesized
aatttattgtcaactaccttcc

SEQ ID NO: 814452 - DNA, 22 bp, Artificial Sequence
  chemically synthesized
attgtcaactaccttcctgctc

SEQ ID NO: 814453 - DNA, 22 bp, Artificial Sequence
  chemically synthesized
ttgtcaactaccttcctgctcg

SEQ ID NO: 814454 - DNA, 22 bp, Artificial Sequence
  chemically synthesized
tcaactaccttcctgctcgctt

SEQ ID NO: 814455 - DNA, 22 bp, Artificial Sequence
  chemically synthesized
ggcagaaaaggatcaagcgagc

SEQ ID NO: 814456 - DNA, 22 bp, Artificial Sequence
  chemically synthesized
ccttcctgctcgcttgatcctt

SEQ ID NO: 814457 - DNA, 22 bp, Artificial Sequence
  chemically synthesized
cctgctcgcttgatccttttct

SEQ ID NO: 814458 - DNA, 22 bp, Artificial Sequence
  chemically synthesized
ctgctcgcttgatccttttctg

SEQ ID NO: 814459 - DNA, 22 bp, Artificial Sequence
  chemically synthesized
ctcgcttgatccttttctgcct

SEQ ID NO: 814460 - DNA, 22 bp, Artificial Sequence
  chemically synthesized
gcttgatccttttctgcctaac

SEQ ID NO: 814461 - DNA, 22 bp, Artificial Sequence
  chemically synthesized
aaagggagatcagttaggcaga

SEQ ID NO: 814462 - DNA, 22 bp, Artificial Sequence
  chemically synthesized
aaaagggagatcagttaggcag

SEQ ID NO: 814463 - DNA, 22 bp, Artificial Sequence
  chemically synthesized
gatccttttctgcctaactgat

SEQ ID NO: 814464 - DNA, 22 bp, Artificial Sequence
  chemically synthesized
atccttttctgcctaactgatc

SEQ ID NO: 814465 - DNA, 22 bp, Artificial Sequence
  chemically synthesized
ttctgcctaactgatctccctt

SEQ ID NO: 814466 - DNA, 22 bp, Artificial Sequence
  chemically synthesized
aaggaaccttaaaagggagatc

SEQ ID NO: 814467 - DNA, 22 bp, Artificial Sequence
  chemically synthesized
tctgcctaactgatctcccttt

SEQ ID NO: 814468 - DNA, 22 bp, Artificial Sequence
  chemically synthesized
ctgcctaactgatctccctttt

SEQ ID NO: 814469 - DNA, 22 bp, Artificial Sequence
  chemically synthesized
tgcctaactgatctccctttta

SEQ ID NO: 814470 - DNA, 22 bp, Artificial Sequence
  chemically synthesized
cctaactgatctcccttttaag

SEQ ID NO: 814471 - DNA, 22 bp, Artificial Sequence
  chemically synthesized
gcatgttgaaggaaccttaaaa

SEQ ID NO: 814472 - DNA, 22 bp, Artificial Sequence
  chemically synthesized
actgatctcccttttaaggttc

SEQ ID NO: 814473 - DNA, 22 bp, Artificial Sequence
  chemically synthesized
ggcatgttgaaggaaccttaaa

SEQ ID NO: 814474 - DNA, 22 bp, Artificial Sequence
  chemically synthesized
ttggcatgttgaaggaacctta

SEQ ID NO: 814475 - DNA, 22 bp, Artificial Sequence
  chemically synthesized
atctcccttttaaggttccttc

SEQ ID NO: 814476 - DNA, 22 bp, Artificial Sequence
  chemically synthesized
ccttttaaggttccttcaacat

SEQ ID NO: 814477 - DNA, 22 bp, Artificial Sequence
  chemically synthesized
ttaaggttccttcaacatgcca

SEQ ID NO: 814478 - DNA, 22 bp, Artificial Sequence
  chemically synthesized
taaggttccttcaacatgccaa

SEQ ID NO: 814479 - DNA, 22 bp, Artificial Sequence
  chemically synthesized
aaggttccttcaacatgccaag

SEQ ID NO: 814480 - DNA, 22 bp, Artificial Sequence
  chemically synthesized
aggttccttcaacatgccaaga

SEQ ID NO: 814481 - DNA, 22 bp, Artificial Sequence
  chemically synthesized
cttcaacatgccaagaatattc

SEQ ID NO: 814482 - DNA, 22 bp, Artificial Sequence
  chemically synthesized
caacatgccaagaatattcctg

SEQ ID NO: 814483 - DNA, 22 bp, Artificial Sequence
  chemically synthesized
aacatgccaagaatattcctgc

SEQ ID NO: 814484 - DNA, 22 bp, Artificial Sequence
  chemically synthesized
aaatgccccaaagcaggaatat

SEQ ID NO: 814485 - DNA, 22 bp, Artificial Sequence
  chemically synthesized
ataagttaaaatgccccaaagc

SEQ ID NO: 814486 - DNA, 22 bp, Artificial Sequence
  chemically synthesized
ctgctttggggcattttaactt

SEQ ID NO: 814487 - DNA, 22 bp, Artificial Sequence
  chemically synthesized
ctttggggcattttaacttatt

SEQ ID NO: 814488 - DNA, 22 bp, Artificial Sequence
  chemically synthesized
tggggcattttaacttattagg

SEQ ID NO: 814489 - DNA, 22 bp, Artificial Sequence
  chemically synthesized
ggggcattttaacttattagga

SEQ ID NO: 814490 - DNA, 22 bp, Artificial Sequence
  chemically synthesized
gggcattttaacttattaggac

SEQ ID NO: 814491 - DNA, 22 bp, Artificial Sequence
  chemically synthesized
taacttattaggactctcctgg

SEQ ID NO: 814492 - DNA, 22 bp, Artificial Sequence
  chemically synthesized
aacttattaggactctcctgga

SEQ ID NO: 814493 - DNA, 22 bp, Artificial Sequence
  chemically synthesized
acttattaggactctcctggac

SEQ ID NO: 814494 - DNA, 22 bp, Artificial Sequence
  chemically synthesized
ggggggaaaaagtagtccagga

SEQ ID NO: 814495 - DNA, 22 bp, Artificial Sequence
  chemically synthesized
attaggactctcctggactact

SEQ ID NO: 814496 - DNA, 22 bp, Artificial Sequence
  chemically synthesized
ttaggactctcctggactactt

SEQ ID NO: 814497 - DNA, 22 bp, Artificial Sequence
  chemically synthesized
ggactctcctggactacttttt

SEQ ID NO: 814498 - DNA, 22 bp, Artificial Sequence
  chemically synthesized
tcctggactactttttcccccc

SEQ ID NO: 814499 - DNA, 22 bp, Artificial Sequence
  chemically synthesized
ctggactactttttccccccca

SEQ ID NO: 814500 - DNA, 22 bp, Artificial Sequence
  chemically synthesized
gactactttttcccccccaatt

SEQ ID NO: 814501 - DNA, 22 bp, Artificial Sequence
  chemically synthesized
ctttttcccccccaattataca

SEQ ID NO: 814502 - DNA, 22 bp, Artificial Sequence
  chemically synthesized
tttcccccccaattatacatat

SEQ ID NO: 814503 - DNA, 22 bp, Artificial Sequence
  chemically synthesized
aggatgtgggccatatgtataa

SEQ ID NO: 814504 - DNA, 22 bp, Artificial Sequence
  chemically synthesized
ttcccccccaattatacatatg

SEQ ID NO: 814505 - DNA, 22 bp, Artificial Sequence
  chemically synthesized
tcccccccaattatacatatgg

SEQ ID NO: 814506 - DNA, 22 bp, Artificial Sequence
  chemically synthesized
cccccccaattatacatatggc

SEQ ID NO: 814507 - DNA, 22 bp, Artificial Sequence
  chemically synthesized
ccccccaattatacatatggcc

SEQ ID NO: 814508 - DNA, 22 bp, Artificial Sequence
  chemically synthesized
aaagacctgaggatgtgggcca

SEQ ID NO: 814509 - DNA, 22 bp, Artificial Sequence
  chemically synthesized
taaaagacctgaggatgtgggc

SEQ ID NO: 814510 - DNA, 22 bp, Artificial Sequence
  chemically synthesized
tacatatggcccacatcctcag

SEQ ID NO: 814511 - DNA, 22 bp, Artificial Sequence
  chemically synthesized
agcaaattctaaaagacctgag

SEQ ID NO: 814512 - DNA, 22 bp, Artificial Sequence
  chemically synthesized
aagcaaattctaaaagacctga

SEQ ID NO: 814513 - DNA, 22 bp, Artificial Sequence
  chemically synthesized
aggtcttttagaatttgcttaa

SEQ ID NO: 814514 - DNA, 22 bp, Artificial Sequence
  chemically synthesized
aaaaggtggcatttaagcaaat

SEQ ID NO: 814515 - DNA, 22 bp, Artificial Sequence
  chemically synthesized
ctgaaaaggtggcatttaagca

SEQ ID NO: 814516 - DNA, 22 bp, Artificial Sequence
  chemically synthesized
actgaaaaggtggcatttaagc

SEQ ID NO: 814517 - DNA, 22 bp, Artificial Sequence
  chemically synthesized
ttagaatttgcttaaatgccac

SEQ ID NO: 814518 - DNA, 22 bp, Artificial Sequence
  chemically synthesized
tagaatttgcttaaatgccacc

SEQ ID NO: 814519 - DNA, 22 bp, Artificial Sequence
  chemically synthesized
agaatttgcttaaatgccacct

SEQ ID NO: 814520 - DNA, 22 bp, Artificial Sequence
  chemically synthesized
gaatttgcttaaatgccacctt

SEQ ID NO: 814521 - DNA, 22 bp, Artificial Sequence
  chemically synthesized
gcttaaatgccaccttttcagt

SEQ ID NO: 814522 - DNA, 22 bp, Artificial Sequence
  chemically synthesized
cttaaatgccaccttttcagta

SEQ ID NO: 814523 - DNA, 22 bp, Artificial Sequence
  chemically synthesized
aaatgccaccttttcagtaaga

SEQ ID NO: 814524 - DNA, 22 bp, Artificial Sequence
  chemically synthesized
aatgccaccttttcagtaagac

SEQ ID NO: 814525 - DNA, 22 bp, Artificial Sequence
  chemically synthesized
ttcagtaagaccttttttgatt

SEQ ID NO: 814526 - DNA, 22 bp, Artificial Sequence
  chemically synthesized
tcagtaagaccttttttgatta

SEQ ID NO: 814527 - DNA, 22 bp, Artificial Sequence
  chemically synthesized
cagtaagaccttttttgattac

SEQ ID NO: 814528 - DNA, 22 bp, Artificial Sequence
  chemically synthesized
agtaagaccttttttgattacc

SEQ ID NO: 814529 - DNA, 22 bp, Artificial Sequence
  chemically synthesized
ccatgaaaatgtggtaatcaaa

SEQ ID NO: 814530 - DNA, 22 bp, Artificial Sequence
  chemically synthesized
ttttgattaccacattttcatg

SEQ ID NO: 814531 - DNA, 22 bp, Artificial Sequence
  chemically synthesized
tttgattaccacattttcatgg

SEQ ID NO: 814532 - DNA, 22 bp, Artificial Sequence
  chemically synthesized
ttgattaccacattttcatggc

SEQ ID NO: 814533 - DNA, 22 bp, Artificial Sequence
  chemically synthesized
tgattaccacattttcatggca

SEQ ID NO: 814534 - DNA, 22 bp, Artificial Sequence
  chemically synthesized
gattaccacattttcatggcag

SEQ ID NO: 814535 - DNA, 22 bp, Artificial Sequence
  chemically synthesized
attaccacattttcatggcagc

SEQ ID NO: 814536 - DNA, 22 bp, Artificial Sequence
  chemically synthesized
ccacattttcatggcagcactc

SEQ ID NO: 814537 - DNA, 22 bp, Artificial Sequence
  chemically synthesized
tcatggcagcactcctcttcca

SEQ ID NO: 814538 - DNA, 22 bp, Artificial Sequence
  chemically synthesized
catggcagcactcctcttccac

SEQ ID NO: 814539 - DNA, 22 bp, Artificial Sequence
  chemically synthesized
atggcagcactcctcttccacc

SEQ ID NO: 814540 - DNA, 22 bp, Artificial Sequence
  chemically synthesized
ctcttccacctccctctctctc

SEQ ID NO: 814541 - DNA, 22 bp, Artificial Sequence
  chemically synthesized
ttccacctccctctctctctcc

SEQ ID NO: 814542 - DNA, 22 bp, Artificial Sequence
  chemically synthesized
ccacctccctctctctctccac

SEQ ID NO: 814543 - DNA, 22 bp, Artificial Sequence
  chemically synthesized
cacctccctctctctctccact

SEQ ID NO: 814544 - DNA, 22 bp, Artificial Sequence
  chemically synthesized
cctctctctctccacttgtttt

SEQ ID NO: 814545 - DNA, 22 bp, Artificial Sequence
  chemically synthesized
tctctctccacttgttttcctc

SEQ ID NO: 814546 - DNA, 22 bp, Artificial Sequence
  chemically synthesized
tctctccacttgttttcctctt

SEQ ID NO: 814547 - DNA, 22 bp, Artificial Sequence
  chemically synthesized
tctccacttgttttcctctttg

SEQ ID NO: 814548 - DNA, 22 bp, Artificial Sequence
  chemically synthesized
tccacttgttttcctctttgtt

SEQ ID NO: 814549 - DNA, 22 bp, Artificial Sequence
  chemically synthesized
cacttgttttcctctttgttct

SEQ ID NO: 814550 - DNA, 22 bp, Artificial Sequence
  chemically synthesized
gttttcctctttgttcttccac

SEQ ID NO: 814551 - DNA, 22 bp, Artificial Sequence
  chemically synthesized
ttttcctctttgttcttccaca

SEQ ID NO: 814552 - DNA, 22 bp, Artificial Sequence
  chemically synthesized
tcctctttgttcttccacactg

SEQ ID NO: 814553 - DNA, 22 bp, Artificial Sequence
  chemically synthesized
cctctttgttcttccacactgt

SEQ ID NO: 814554 - DNA, 22 bp, Artificial Sequence
  chemically synthesized
ctctttgttcttccacactgtg

SEQ ID NO: 814555 - DNA, 22 bp, Artificial Sequence
  chemically synthesized
tttgttcttccacactgtgtgt

SEQ ID NO: 814556 - DNA, 22 bp, Artificial Sequence
  chemically synthesized
tgttcttccacactgtgtgtat

SEQ ID NO: 814557 - DNA, 22 bp, Artificial Sequence
  chemically synthesized
gttcttccacactgtgtgtatg

SEQ ID NO: 814558 - DNA, 22 bp, Artificial Sequence
  chemically synthesized
ttcttccacactgtgtgtatga

SEQ ID NO: 814559 - DNA, 22 bp, Artificial Sequence
  chemically synthesized
ttccacactgtgtgtatgacca

SEQ ID NO: 814560 - DNA, 22 bp, Artificial Sequence
  chemically synthesized
ccacactgtgtgtatgaccatc

SEQ ID NO: 814561 - DNA, 22 bp, Artificial Sequence
  chemically synthesized
cacactgtgtgtatgaccatct

SEQ ID NO: 814562 - DNA, 22 bp, Artificial Sequence
  chemically synthesized
aatacatgatgtgtcagatggt

SEQ ID NO: 814563 - DNA, 22 bp, Artificial Sequence
  chemically synthesized
tgtgtatgaccatctgacacat

SEQ ID NO: 814564 - DNA, 22 bp, Artificial Sequence
  chemically synthesized
acaaataaaaattaaatacatg

SEQ ID NO: 814565 - DNA, 22 bp, Artificial Sequence
  chemically synthesized
acacatcatgtatttaattttt

SEQ ID NO: 814566 - DNA, 22 bp, Artificial Sequence
  chemically synthesized
gaagacagacattgacaaataa

SEQ ID NO: 814567 - DNA, 22 bp, Artificial Sequence
  chemically synthesized
aatttttatttgtcaatgtctg

SEQ ID NO: 814568 - DNA, 22 bp, Artificial Sequence
  chemically synthesized
atttttatttgtcaatgtctgt

SEQ ID NO: 814569 - DNA, 22 bp, Artificial Sequence
  chemically synthesized
ttatttgtcaatgtctgtcttc

SEQ ID NO: 814570 - DNA, 22 bp, Artificial Sequence
  chemically synthesized
tatttgtcaatgtctgtcttcc

SEQ ID NO: 814571 - DNA, 22 bp, Artificial Sequence
  chemically synthesized
gaagcagaagttggaagacaga

SEQ ID NO: 814572 - DNA, 22 bp, Artificial Sequence
  chemically synthesized
atttgtcaatgtctgtcttcca

SEQ ID NO: 814573 - DNA, 22 bp, Artificial Sequence
  chemically synthesized
ggaagcagaagttggaagacag

SEQ ID NO: 814574 - DNA, 22 bp, Artificial Sequence
  chemically synthesized
tttgtcaatgtctgtcttccaa

SEQ ID NO: 814575 - DNA, 22 bp, Artificial Sequence
  chemically synthesized
ttggaagcagaagttggaagac

SEQ ID NO: 814576 - DNA, 22 bp, Artificial Sequence
  chemically synthesized
gtcaatgtctgtcttccaactt

SEQ ID NO: 814577 - DNA, 22 bp, Artificial Sequence
  chemically synthesized
tcaatgtctgtcttccaacttc

SEQ ID NO: 814578 - DNA, 22 bp, Artificial Sequence
  chemically synthesized
tattcttggaagcagaagttgg

SEQ ID NO: 814579 - DNA, 22 bp, Artificial Sequence
  chemically synthesized
atattcttggaagcagaagttg

SEQ ID NO: 814580 - DNA, 22 bp, Artificial Sequence
  chemically synthesized
tcttccaacttctgcttccaag

SEQ ID NO: 814581 - DNA, 22 bp, Artificial Sequence
  chemically synthesized
ataaagcttatattcttggaag

SEQ ID NO: 814582 - DNA, 22 bp, Artificial Sequence
  chemically synthesized
ccaacttctgcttccaagaata

SEQ ID NO: 814583 - DNA, 22 bp, Artificial Sequence
  chemically synthesized
caacttctgcttccaagaatat

SEQ ID NO: 814584 - DNA, 22 bp, Artificial Sequence
  chemically synthesized
ccctcataaagcttatattctt

SEQ ID NO: 814585 - DNA, 22 bp, Artificial Sequence
  chemically synthesized
ctgcttccaagaatataagctt

SEQ ID NO: 814586 - DNA, 22 bp, Artificial Sequence
  chemically synthesized
tgcttccaagaatataagcttt

SEQ ID NO: 814587 - DNA, 22 bp, Artificial Sequence
  chemically synthesized
cttccaagaatataagctttat

SEQ ID NO: 814588 - DNA, 22 bp, Artificial Sequence
  chemically synthesized
ccaagaatataagctttatgag

SEQ ID NO: 814589 - DNA, 22 bp, Artificial Sequence
  chemically synthesized
caagaatataagctttatgagg

SEQ ID NO: 814590 - DNA, 22 bp, Artificial Sequence
  chemically synthesized
gtatagagcaatgaaaagccct

SEQ ID NO: 814591 - DNA, 22 bp, Artificial Sequence
  chemically synthesized
ggtatagagcaatgaaaagccc

SEQ ID NO: 814592 - DNA, 22 bp, Artificial Sequence
  chemically synthesized
tatgagggtagggcttttcatt

SEQ ID NO: 814593 - DNA, 22 bp, Artificial Sequence
  chemically synthesized
atgagggtagggcttttcattg

SEQ ID NO: 814594 - DNA, 22 bp, Artificial Sequence
  chemically synthesized
tgagggtagggcttttcattgc

SEQ ID NO: 814595 - DNA, 22 bp, Artificial Sequence
  chemically synthesized
gtacttggtatagagcaatgaa

SEQ ID NO: 814596 - DNA, 22 bp, Artificial Sequence
  chemically synthesized
ttcattgctctataccaagtac

SEQ ID NO: 814597 - DNA, 22 bp, Artificial Sequence
  chemically synthesized
tcattgctctataccaagtacc

SEQ ID NO: 814598 - DNA, 22 bp, Artificial Sequence
  chemically synthesized
cattgctctataccaagtacca

SEQ ID NO: 814599 - DNA, 22 bp, Artificial Sequence
  chemically synthesized
attgctctataccaagtaccaa

SEQ ID NO: 814600 - DNA, 22 bp, Artificial Sequence
  chemically synthesized
ggtaggcccagtaattggtact

SEQ ID NO: 814601 - DNA, 22 bp, Artificial Sequence
  chemically synthesized
ctctataccaagtaccaattac

SEQ ID NO: 814602 - DNA, 22 bp, Artificial Sequence
  chemically synthesized
tataccaagtaccaattactgg

SEQ ID NO: 814603 - DNA, 22 bp, Artificial Sequence
  chemically synthesized
tgctaggtaggcccagtaattg

SEQ ID NO: 814604 - DNA, 22 bp, Artificial Sequence
  chemically synthesized
gtgctaggtaggcccagtaatt

SEQ ID NO: 814605 - DNA, 22 bp, Artificial Sequence
  chemically synthesized
taccaagtaccaattactgggc

SEQ ID NO: 814606 - DNA, 22 bp, Artificial Sequence
  chemically synthesized
tatgaagtttgtgctaggtagg

SEQ ID NO: 814607 - DNA, 22 bp, Artificial Sequence
  chemically synthesized
gtatgaagtttgtgctaggtag

SEQ ID NO: 814608 - DNA, 22 bp, Artificial Sequence
  chemically synthesized
tgtatgaagtttgtgctaggta

SEQ ID NO: 814609 - DNA, 22 bp, Artificial Sequence
  chemically synthesized
ttgtatgaagtttgtgctaggt

SEQ ID NO: 814610 - DNA, 22 bp, Artificial Sequence
  chemically synthesized
ctgggcctacctagcacaaact

SEQ ID NO: 814611 - DNA, 22 bp, Artificial Sequence
  chemically synthesized
ggcctacctagcacaaacttca

SEQ ID NO: 814612 - DNA, 22 bp, Artificial Sequence
  chemically synthesized
aacaaatacttttgtatgaagt

SEQ ID NO: 814613 - DNA, 22 bp, Artificial Sequence
  chemically synthesized
cctagcacaaacttcatacaaa

SEQ ID NO: 814614 - DNA, 22 bp, Artificial Sequence
  chemically synthesized
ctcaacaaatacttttgtatga

SEQ ID NO: 814615 - DNA, 22 bp, Artificial Sequence
  chemically synthesized
actcaacaaatacttttgtatg

SEQ ID NO: 814616 - DNA, 22 bp, Artificial Sequence
  chemically synthesized
gcacaaacttcatacaaaagta

SEQ ID NO: 814617 - DNA, 22 bp, Artificial Sequence
  chemically synthesized
cttactcaacaaatacttttgt

SEQ ID NO: 814618 - DNA, 22 bp, Artificial Sequence
  chemically synthesized
acttactcaacaaatacttttg

SEQ ID NO: 814619 - DNA, 22 bp, Artificial Sequence
  chemically synthesized
atttacttactcaacaaatact

SEQ ID NO: 814620 - DNA, 22 bp, Artificial Sequence
  chemically synthesized
catacaaaagtatttgttgagt

SEQ ID NO: 814621 - DNA, 22 bp, Artificial Sequence
  chemically synthesized
atacaaaagtatttgttgagta

SEQ ID NO: 814622 - DNA, 22 bp, Artificial Sequence
  chemically synthesized
gttgagtaagtaaattaatttt

SEQ ID NO: 814623 - DNA, 22 bp, Artificial Sequence
  chemically synthesized
ttgagtaagtaaattaattttt

SEQ ID NO: 814624 - DNA, 22 bp, Artificial Sequence
  chemically synthesized
ccatcgacaccataaaaattaa

SEQ ID NO: 814625 - DNA, 22 bp, Artificial Sequence
  chemically synthesized
agtaagtaaattaatttttatg

SEQ ID NO: 814626 - DNA, 22 bp, Artificial Sequence
  chemically synthesized
atttttatggtgtcgatggcag

SEQ ID NO: 814627 - DNA, 22 bp, Artificial Sequence
  chemically synthesized
agtaaaatatcatctgccatcg

SEQ ID NO: 814628 - DNA, 22 bp, Artificial Sequence
  chemically synthesized
ttatggtgtcgatggcagatga

SEQ ID NO: 814629 - DNA, 22 bp, Artificial Sequence
  chemically synthesized
tatggtgtcgatggcagatgat

SEQ ID NO: 814630 - DNA, 22 bp, Artificial Sequence
  chemically synthesized
atggtgtcgatggcagatgata

SEQ ID NO: 814631 - DNA, 22 bp, Artificial Sequence
  chemically synthesized
tggtgtcgatggcagatgatat

SEQ ID NO: 814632 - DNA, 22 bp, Artificial Sequence
  chemically synthesized
gtgcgtagtaagaactcagtaa

SEQ ID NO: 814633 - DNA, 22 bp, Artificial Sequence
  chemically synthesized
gcacaatgcctagtgcgtagta

SEQ ID NO: 814634 - DNA, 22 bp, Artificial Sequence
  chemically synthesized
tactgagttcttactacgcact

SEQ ID NO: 814635 - DNA, 22 bp, Artificial Sequence
  chemically synthesized
ggcacaatgcctagtgcgtagt

SEQ ID NO: 814636 - DNA, 22 bp, Artificial Sequence
  chemically synthesized
actgagttcttactacgcacta

SEQ ID NO: 814637 - DNA, 22 bp, Artificial Sequence
  chemically synthesized
ctgagttcttactacgcactag

SEQ ID NO: 814638 - DNA, 22 bp, Artificial Sequence
  chemically synthesized
agttcttactacgcactaggca

SEQ ID NO: 814639 - DNA, 22 bp, Artificial Sequence
  chemically synthesized
ttactacgcactaggcattgtg

SEQ ID NO: 814640 - DNA, 22 bp, Artificial Sequence
  chemically synthesized
tgaggtgcttggcacaatgcct

SEQ ID NO: 814641 - DNA, 22 bp, Artificial Sequence
  chemically synthesized
actacgcactaggcattgtgcc

SEQ ID NO: 814642 - DNA, 22 bp, Artificial Sequence
  chemically synthesized
ctacgcactaggcattgtgcca

SEQ ID NO: 814643 - DNA, 22 bp, Artificial Sequence
  chemically synthesized
cgcactaggcattgtgccaagc

SEQ ID NO: 814644 - DNA, 22 bp, Artificial Sequence
  chemically synthesized
ggcattgtgccaagcacctcac

SEQ ID NO: 814645 - DNA, 22 bp, Artificial Sequence
  chemically synthesized
atcatataataattgtgaggtg

SEQ ID NO: 814646 - DNA, 22 bp, Artificial Sequence
  chemically synthesized
taatcatataataattgtgagg

SEQ ID NO: 814647 - DNA, 22 bp, Artificial Sequence
  chemically synthesized
tctaatcatataataattgtga

SEQ ID NO: 814648 - DNA, 22 bp, Artificial Sequence
  chemically synthesized
tgccaagcacctcacaattatt

SEQ ID NO: 814649 - DNA, 22 bp, Artificial Sequence
  chemically synthesized
ctctaatcatataataattgtg

SEQ ID NO: 814650 - DNA, 22 bp, Artificial Sequence
  chemically synthesized
atttctctaatcatataataat

SEQ ID NO: 814651 - DNA, 22 bp, Artificial Sequence
  chemically synthesized
aatatctcatttctctaatcat

SEQ ID NO: 814652 - DNA, 22 bp, Artificial Sequence
  chemically synthesized
acaattattatatgattagaga

SEQ ID NO: 814653 - DNA, 22 bp, Artificial Sequence
  chemically synthesized
gaatatctcatttctctaatca

SEQ ID NO: 814654 - DNA, 22 bp, Artificial Sequence
  chemically synthesized
tcttgaatatctcatttctcta

SEQ ID NO: 814655 - DNA, 22 bp, Artificial Sequence
  chemically synthesized
ttatatgattagagaaatgaga

SEQ ID NO: 814656 - DNA, 22 bp, Artificial Sequence
  chemically synthesized
tatgattagagaaatgagatat

SEQ ID NO: 814657 - DNA, 22 bp, Artificial Sequence
  chemically synthesized
gagaaatgagatattcaagata

SEQ ID NO: 814658 - DNA, 22 bp, Artificial Sequence
  chemically synthesized
ccagaacaatattatcttgaat

SEQ ID NO: 814659 - DNA, 22 bp, Artificial Sequence
  chemically synthesized
gttcccagaacaatattatctt

SEQ ID NO: 814660 - DNA, 22 bp, Artificial Sequence
  chemically synthesized
ggttcccagaacaatattatct

SEQ ID NO: 814661 - DNA, 22 bp, Artificial Sequence
  chemically synthesized
cttggttcccagaacaatatta

SEQ ID NO: 814662 - DNA, 22 bp, Artificial Sequence
  chemically synthesized
tcctccttggttcccagaacaa

SEQ ID NO: 814663 - DNA, 22 bp, Artificial Sequence
  chemically synthesized
atcctccttggttcccagaaca

SEQ ID NO: 814664 - DNA, 22 bp, Artificial Sequence
  chemically synthesized
tatcctccttggttcccagaac

SEQ ID NO: 814665 - DNA, 22 bp, Artificial Sequence
  chemically synthesized
aagataatattgttctgggaac

SEQ ID NO: 814666 - DNA, 22 bp, Artificial Sequence
  chemically synthesized
atcaaaactttatcctccttgg

SEQ ID NO: 814667 - DNA, 22 bp, Artificial Sequence
  chemically synthesized
ttctgggaaccaaggaggataa

SEQ ID NO: 814668 - DNA, 22 bp, Artificial Sequence
  chemically synthesized
ctaatcaaaactttatcctcct

SEQ ID NO: 814669 - DNA, 22 bp, Artificial Sequence
  chemically synthesized
tgctaatcaaaactttatcctc

SEQ ID NO: 814670 - DNA, 22 bp, Artificial Sequence
  chemically synthesized
tgggaaccaaggaggataaagt

SEQ ID NO: 814671 - DNA, 22 bp, Artificial Sequence
  chemically synthesized
ggaaccaaggaggataaagttt

SEQ ID NO: 814672 - DNA, 22 bp, Artificial Sequence
  chemically synthesized
gtcaactctgctaatcaaaact

SEQ ID NO: 814673 - DNA, 22 bp, Artificial Sequence
  chemically synthesized
ttggtcaactctgctaatcaaa

SEQ ID NO: 814674 - DNA, 22 bp, Artificial Sequence
  chemically synthesized
atcctgttggtcaactctgcta

SEQ ID NO: 814675 - DNA, 22 bp, Artificial Sequence
  chemically synthesized
acattgatcctgttggtcaact

SEQ ID NO: 814676 - DNA, 22 bp, Artificial Sequence
  chemically synthesized
aacattgatcctgttggtcaac

SEQ ID NO: 814677 - DNA, 22 bp, Artificial Sequence
  chemically synthesized
tgattagcagagttgaccaaca

SEQ ID NO: 814678 - DNA, 22 bp, Artificial Sequence
  chemically synthesized
taacattgatcctgttggtcaa

SEQ ID NO: 814679 - DNA, 22 bp, Artificial Sequence
  chemically synthesized
gattagcagagttgaccaacag

SEQ ID NO: 814680 - DNA, 22 bp, Artificial Sequence
  chemically synthesized
attagcagagttgaccaacagg

SEQ ID NO: 814681 - DNA, 22 bp, Artificial Sequence
  chemically synthesized
tattttaacattgatcctgttg

SEQ ID NO: 814682 - DNA, 22 bp, Artificial Sequence
  chemically synthesized
gcagagttgaccaacaggatca

SEQ ID NO: 814683 - DNA, 22 bp, Artificial Sequence
  chemically synthesized
actatattttaacattgatcct

SEQ ID NO: 814684 - DNA, 22 bp, Artificial Sequence
  chemically synthesized
gactatattttaacattgatcc

SEQ ID NO: 814685 - DNA, 22 bp, Artificial Sequence
  chemically synthesized
ttgactatattttaacattgat

SEQ ID NO: 814686 - DNA, 22 bp, Artificial Sequence
  chemically synthesized
cttgactatattttaacattga

SEQ ID NO: 814687 - DNA, 22 bp, Artificial Sequence
  chemically synthesized
accaacaggatcaatgttaaaa

SEQ ID NO: 814688 - DNA, 22 bp, Artificial Sequence
  chemically synthesized
gtccatcttcttgactatattt

SEQ ID NO: 814689 - DNA, 22 bp, Artificial Sequence
  chemically synthesized
attcgtccatcttcttgactat

SEQ ID NO: 814690 - DNA, 22 bp, Artificial Sequence
  chemically synthesized
aattcgtccatcttcttgacta

SEQ ID NO: 814691 - DNA, 22 bp, Artificial Sequence
  chemically synthesized
taattcgtccatcttcttgact

SEQ ID NO: 814692 - DNA, 22 bp, Artificial Sequence
  chemically synthesized
aaatatagtcaagaagatggac

SEQ ID NO: 814693 - DNA, 22 bp, Artificial Sequence
  chemically synthesized
gtgtattttaattcgtccatct

SEQ ID NO: 814694 - DNA, 22 bp, Artificial Sequence
  chemically synthesized
attagtgtattttaattcgtcc

SEQ ID NO: 814695 - DNA, 22 bp, Artificial Sequence
  chemically synthesized
taatagctaattagtgtatttt

SEQ ID NO: 814696 - DNA, 22 bp, Artificial Sequence
  chemically synthesized
gtaatagctaattagtgtattt

SEQ ID NO: 814697 - DNA, 22 bp, Artificial Sequence
  chemically synthesized
tgtaatagctaattagtgtatt

SEQ ID NO: 814698 - DNA, 22 bp, Artificial Sequence
  chemically synthesized
aaatacactaattagctattac

SEQ ID NO: 814699 - DNA, 22 bp, Artificial Sequence
  chemically synthesized
agatcatcagtgactttgtaat

SEQ ID NO: 814700 - DNA, 22 bp, Artificial Sequence
  chemically synthesized
ctaagatcatcagtgactttgt

SEQ ID NO: 814701 - DNA, 22 bp, Artificial Sequence
  chemically synthesized
actaagatcatcagtgactttg

SEQ ID NO: 814702 - DNA, 22 bp, Artificial Sequence
  chemically synthesized
attagctattacaaagtcactg

SEQ ID NO: 814703 - DNA, 22 bp, Artificial Sequence
  chemically synthesized
gctattacaaagtcactgatga

SEQ ID NO: 814704 - DNA, 22 bp, Artificial Sequence
  chemically synthesized
ttacaaagtcactgatgatctt

SEQ ID NO: 814705 - DNA, 22 bp, Artificial Sequence
  chemically synthesized
caaagtcactgatgatcttagt

SEQ ID NO: 814706 - DNA, 22 bp, Artificial Sequence
  chemically synthesized
tgaaaacaaggacttactaaga

SEQ ID NO: 814707 - DNA, 22 bp, Artificial Sequence
  chemically synthesized
atgaaaacaaggacttactaag

SEQ ID NO: 814708 - DNA, 22 bp, Artificial Sequence
  chemically synthesized
tatgaaaacaaggacttactaa

SEQ ID NO: 814709 - DNA, 22 bp, Artificial Sequence
  chemically synthesized
atgatcttagtaagtccttgtt

SEQ ID NO: 814710 - DNA, 22 bp, Artificial Sequence
  chemically synthesized
agtaagtccttgttttcataaa

SEQ ID NO: 814711 - DNA, 22 bp, Artificial Sequence
  chemically synthesized
gtaagtccttgttttcataaag

SEQ ID NO: 814712 - DNA, 22 bp, Artificial Sequence
  chemically synthesized
cccagcaccaccactttatgaa

SEQ ID NO: 814713 - DNA, 22 bp, Artificial Sequence
  chemically synthesized
ccccagcaccaccactttatga

SEQ ID NO: 814714 - DNA, 22 bp, Artificial Sequence
  chemically synthesized
acttccccagcaccaccacttt

SEQ ID NO: 814715 - DNA, 22 bp, Artificial Sequence
  chemically synthesized
gttttcataaagtggtggtgct

SEQ ID NO: 814716 - DNA, 22 bp, Artificial Sequence
  chemically synthesized
ttttcataaagtggtggtgctg

SEQ ID NO: 814717 - DNA, 22 bp, Artificial Sequence
  chemically synthesized
cagtctcacttccccagcacca

SEQ ID NO: 814718 - DNA, 22 bp, Artificial Sequence
  chemically synthesized
tcataaagtggtggtgctgggg

SEQ ID NO: 814719 - DNA, 22 bp, Artificial Sequence
  chemically synthesized
cataaagtggtggtgctgggga

SEQ ID NO: 814720 - DNA, 22 bp, Artificial Sequence
  chemically synthesized
ataaagtggtggtgctggggaa

SEQ ID NO: 814721 - DNA, 22 bp, Artificial Sequence
  chemically synthesized
acccactccagtctcacttccc

SEQ ID NO: 814722 - DNA, 22 bp, Artificial Sequence
  chemically synthesized
gacccactccagtctcacttcc

SEQ ID NO: 814723 - DNA, 22 bp, Artificial Sequence
  chemically synthesized
tgacccactccagtctcacttc

SEQ ID NO: 814724 - DNA, 22 bp, Artificial Sequence
  chemically synthesized
tactttgacccactccagtctc

SEQ ID NO: 814725 - DNA, 22 bp, Artificial Sequence
  chemically synthesized
gttgtactttgacccactccag

SEQ ID NO: 814726 - DNA, 22 bp, Artificial Sequence
  chemically synthesized
gggaagtgagactggagtgggt

SEQ ID NO: 814727 - DNA, 22 bp, Artificial Sequence
  chemically synthesized
ctagttgtactttgacccactc

SEQ ID NO: 814728 - DNA, 22 bp, Artificial Sequence
  chemically synthesized
gctactagttgtactttgaccc

SEQ ID NO: 814729 - DNA, 22 bp, Artificial Sequence
  chemically synthesized
agctactagttgtactttgacc

SEQ ID NO: 814730 - DNA, 22 bp, Artificial Sequence
  chemically synthesized
tagctactagttgtactttgac

SEQ ID NO: 814731 - DNA, 22 bp, Artificial Sequence
  chemically synthesized
tttagctactagttgtactttg

SEQ ID NO: 814732 - DNA, 22 bp, Artificial Sequence
  chemically synthesized
ttctttagctactagttgtact

SEQ ID NO: 814733 - DNA, 22 bp, Artificial Sequence
  chemically synthesized
gagtgggtcaaagtacaactag

SEQ ID NO: 814734 - DNA, 22 bp, Artificial Sequence
  chemically synthesized
ctgttctttagctactagttgt

SEQ ID NO: 814735 - DNA, 22 bp, Artificial Sequence
  chemically synthesized
cctgttctttagctactagttg

SEQ ID NO: 814736 - DNA, 22 bp, Artificial Sequence
  chemically synthesized
tttcctgttctttagctactag

SEQ ID NO: 814737 - DNA, 22 bp, Artificial Sequence
  chemically synthesized
ctgtttcctgttctttagctac

SEQ ID NO: 814738 - DNA, 22 bp, Artificial Sequence
  chemically synthesized
gcattactgtttcctgttcttt

SEQ ID NO: 814739 - DNA, 22 bp, Artificial Sequence
  chemically synthesized
gtagctaaagaacaggaaacag

SEQ ID NO: 814740 - DNA, 22 bp, Artificial Sequence
  chemically synthesized
agcagtagttggcattactgtt

SEQ ID NO: 814741 - DNA, 22 bp, Artificial Sequence
  chemically synthesized
aagcagtagttggcattactgt

SEQ ID NO: 814742 - DNA, 22 bp, Artificial Sequence
  chemically synthesized
aagaacaggaaacagtaatgcc

SEQ ID NO: 814743 - DNA, 22 bp, Artificial Sequence
  chemically synthesized
taagcagtagttggcattactg

SEQ ID NO: 814744 - DNA, 22 bp, Artificial Sequence
  chemically synthesized
ttaagcagtagttggcattact

SEQ ID NO: 814745 - DNA, 22 bp, Artificial Sequence
  chemically synthesized
tatcatttttaagcagtagttg

SEQ ID NO: 814746 - DNA, 22 bp, Artificial Sequence
  chemically synthesized
ctatatcatttttaagcagtag

SEQ ID NO: 814747 - DNA, 22 bp, Artificial Sequence
  chemically synthesized
actatatcatttttaagcagta

SEQ ID NO: 814748 - DNA, 22 bp, Artificial Sequence
  chemically synthesized
cttactatatcatttttaagca

SEQ ID NO: 814749 - DNA, 22 bp, Artificial Sequence
  chemically synthesized
tgcttactatatcatttttaag

SEQ ID NO: 814750 - DNA, 22 bp, Artificial Sequence
  chemically synthesized
ctgcttactatatcatttttaa

SEQ ID NO: 814751 - DNA, 22 bp, Artificial Sequence
  chemically synthesized
cttctgcttactatatcatttt

SEQ ID NO: 814752 - DNA, 22 bp, Artificial Sequence
  chemically synthesized
gcttctgcttactatatcattt

SEQ ID NO: 814753 - DNA, 22 bp, Artificial Sequence
  chemically synthesized
ctgcttaaaaatgatatagtaa

SEQ ID NO: 814754 - DNA, 22 bp, Artificial Sequence
  chemically synthesized
tacttgcttctgcttactatat

SEQ ID NO: 814755 - DNA, 22 bp, Artificial Sequence
  chemically synthesized
cttaaaaatgatatagtaagca

SEQ ID NO: 814756 - DNA, 22 bp, Artificial Sequence
  chemically synthesized
aaaaatgatatagtaagcagaa

SEQ ID NO: 814757 - DNA, 22 bp, Artificial Sequence
  chemically synthesized
aaaatgatatagtaagcagaag

SEQ ID NO: 814758 - DNA, 22 bp, Artificial Sequence
  chemically synthesized
tccagctgtacttgcttctgct

SEQ ID NO: 814759 - DNA, 22 bp, Artificial Sequence
  chemically synthesized
tatccagctgtacttgcttctg

SEQ ID NO: 814760 - DNA, 22 bp, Artificial Sequence
  chemically synthesized
ctatccagctgtacttgcttct

SEQ ID NO: 814761 - DNA, 22 bp, Artificial Sequence
  chemically synthesized
tctatccagctgtacttgcttc

SEQ ID NO: 814762 - DNA, 22 bp, Artificial Sequence
  chemically synthesized
ttctatccagctgtacttgctt

SEQ ID NO: 814763 - DNA, 22 bp, Artificial Sequence
  chemically synthesized
tttctatccagctgtacttgct

SEQ ID NO: 814764 - DNA, 22 bp, Artificial Sequence
  chemically synthesized
ttttctatccagctgtacttgc

SEQ ID NO: 814765 - DNA, 22 bp, Artificial Sequence
  chemically synthesized
tttttctatccagctgtacttg

SEQ ID NO: 814766 - DNA, 22 bp, Artificial Sequence
  chemically synthesized
gtatatcattttttttctatcc

SEQ ID NO: 814767 - DNA, 22 bp, Artificial Sequence
  chemically synthesized
agtatatcattttttttctatc

SEQ ID NO: 814768 - DNA, 22 bp, Artificial Sequence
  chemically synthesized
tagtatatcattttttttctat

SEQ ID NO: 814769 - DNA, 22 bp, Artificial Sequence
  chemically synthesized
ttagtatatcattttttttcta

SEQ ID NO: 814770 - DNA, 22 bp, Artificial Sequence
  chemically synthesized
tttagtatatcattttttttct

SEQ ID NO: 814771 - DNA, 22 bp, Artificial Sequence
  chemically synthesized
ttttagtatatcattttttttc

SEQ ID NO: 814772 - DNA, 22 bp, Artificial Sequence
  chemically synthesized
gatagaaaaaaaatgatatact

SEQ ID NO: 814773 - DNA, 22 bp, Artificial Sequence
  chemically synthesized
agagaacttttttagtatatca

SEQ ID NO: 814774 - DNA, 22 bp, Artificial Sequence
  chemically synthesized
atcctaagagaacttttttagt

SEQ ID NO: 814775 - DNA, 22 bp, Artificial Sequence
  chemically synthesized
cctcatcctaagagaacttttt

SEQ ID NO: 814776 - DNA, 22 bp, Artificial Sequence
  chemically synthesized
aagtctccctcatcctaagaga

SEQ ID NO: 814777 - DNA, 22 bp, Artificial Sequence
  chemically synthesized
aaaaagttctcttaggatgagg

SEQ ID NO: 814778 - DNA, 22 bp, Artificial Sequence
  chemically synthesized
tcttaggatgagggagacttga

SEQ ID NO: 814779 - DNA, 22 bp, Artificial Sequence
  chemically synthesized
ttaggatgagggagacttgagt

SEQ ID NO: 814780 - DNA, 22 bp, Artificial Sequence
  chemically synthesized
gcaggccaacatactcaagtct

SEQ ID NO: 814781 - DNA, 22 bp, Artificial Sequence
  chemically synthesized
agcaggccaacatactcaagtc

SEQ ID NO: 814782 - DNA, 22 bp, Artificial Sequence
  chemically synthesized
aggatgagggagacttgagtat

SEQ ID NO: 814783 - DNA, 22 bp, Artificial Sequence
  chemically synthesized
tagcaggccaacatactcaagt

SEQ ID NO: 814784 - DNA, 22 bp, Artificial Sequence
  chemically synthesized
ggatgagggagacttgagtatg

SEQ ID NO: 814785 - DNA, 22 bp, Artificial Sequence
  chemically synthesized
ccctttagcaggccaacatact

SEQ ID NO: 814786 - DNA, 22 bp, Artificial Sequence
  chemically synthesized
ctcccctttagcaggccaacat

SEQ ID NO: 814787 - DNA, 22 bp, Artificial Sequence
  chemically synthesized
ctcctcccctttagcaggccaa

SEQ ID NO: 814788 - DNA, 22 bp, Artificial Sequence
  chemically synthesized
gctcctcccctttagcaggcca

SEQ ID NO: 814789 - DNA, 22 bp, Artificial Sequence
  chemically synthesized
tgctcctcccctttagcaggcc

SEQ ID NO: 814790 - DNA, 22 bp, Artificial Sequence
  chemically synthesized
ttgctcctcccctttagcaggc

SEQ ID NO: 814791 - DNA, 22 bp, Artificial Sequence
  chemically synthesized
tttgctcctcccctttagcagg

SEQ ID NO: 814792 - DNA, 22 bp, Artificial Sequence
  chemically synthesized
gagtatgttggcctgctaaagg

SEQ ID NO: 814793 - DNA, 22 bp, Artificial Sequence
  chemically synthesized
agtatgttggcctgctaaaggg

SEQ ID NO: 814794 - DNA, 22 bp, Artificial Sequence
  chemically synthesized
tttttgctcctcccctttagca

SEQ ID NO: 814795 - DNA, 22 bp, Artificial Sequence
  chemically synthesized
ctttttgctcctcccctttagc

SEQ ID NO: 814796 - DNA, 22 bp, Artificial Sequence
  chemically synthesized
tctttttgctcctcccctttag

SEQ ID NO: 814797 - DNA, 22 bp, Artificial Sequence
  chemically synthesized
tttctttttgctcctccccttt

SEQ ID NO: 814798 - DNA, 22 bp, Artificial Sequence
  chemically synthesized
ctttctttttgctcctcccctt

SEQ ID NO: 814799 - DNA, 22 bp, Artificial Sequence
  chemically synthesized
ttctttctttttgctcctcccc

SEQ ID NO: 814800 - DNA, 22 bp, Artificial Sequence
  chemically synthesized
cttctttctttttgctcctccc

SEQ ID NO: 814801 - DNA, 22 bp, Artificial Sequence
  chemically synthesized
gcctgctaaaggggaggagcaa

SEQ ID NO: 814802 - DNA, 22 bp, Artificial Sequence
  chemically synthesized
aatttcttctttctttttgctc

SEQ ID NO: 814803 - DNA, 22 bp, Artificial Sequence
  chemically synthesized
ctaaaggggaggagcaaaaaga

SEQ ID NO: 814804 - DNA, 22 bp, Artificial Sequence
  chemically synthesized
aaggggaggagcaaaaagaaag

SEQ ID NO: 814805 - DNA, 22 bp, Artificial Sequence
  chemically synthesized
ggatattcaatttcttctttct

SEQ ID NO: 814806 - DNA, 22 bp, Artificial Sequence
  chemically synthesized
gggatattcaatttcttctttc

SEQ ID NO: 814807 - DNA, 22 bp, Artificial Sequence
  chemically synthesized
tgggatattcaatttcttcttt

SEQ ID NO: 814808 - DNA, 22 bp, Artificial Sequence
  chemically synthesized
ttgggatattcaatttcttctt

SEQ ID NO: 814809 - DNA, 22 bp, Artificial Sequence
  chemically synthesized
tttgggatattcaatttcttct

SEQ ID NO: 814810 - DNA, 22 bp, Artificial Sequence
  chemically synthesized
ttttgggatattcaatttcttc

SEQ ID NO: 814811 - DNA, 22 bp, Artificial Sequence
  chemically synthesized
tttttgggatattcaatttctt

SEQ ID NO: 814812 - DNA, 22 bp, Artificial Sequence
  chemically synthesized
ctttttttgggatattcaattt

SEQ ID NO: 814813 - DNA, 22 bp, Artificial Sequence
  chemically synthesized
cctttttttgggatattcaatt

SEQ ID NO: 814814 - DNA, 22 bp, Artificial Sequence
  chemically synthesized
tcctttttttgggatattcaat

SEQ ID NO: 814815 - DNA, 22 bp, Artificial Sequence
  chemically synthesized
ctttcctttttttgggatattc

SEQ ID NO: 814816 - DNA, 22 bp, Artificial Sequence
  chemically synthesized
tactttcctttttttgggatat

SEQ ID NO: 814817 - DNA, 22 bp, Artificial Sequence
  chemically synthesized
ttctactttcctttttttggga

SEQ ID NO: 814818 - DNA, 22 bp, Artificial Sequence
  chemically synthesized
gtaattattctactttcctttt

SEQ ID NO: 814819 - DNA, 22 bp, Artificial Sequence
  chemically synthesized
aatatcccaaaaaaaggaaagt

SEQ ID NO: 814820 - DNA, 22 bp, Artificial Sequence
  chemically synthesized
agtaattattctactttccttt

SEQ ID NO: 814821 - DNA, 22 bp, Artificial Sequence
  chemically synthesized
tagtaattattctactttcctt

SEQ ID NO: 814822 - DNA, 22 bp, Artificial Sequence
  chemically synthesized
ttttagtaattattctactttc

SEQ ID NO: 814823 - DNA, 22 bp, Artificial Sequence
  chemically synthesized
caacatgttgttttagtaatta

SEQ ID NO: 814824 - DNA, 22 bp, Artificial Sequence
  chemically synthesized
tccaacatgttgttttagtaat

SEQ ID NO: 814825 - DNA, 22 bp, Artificial Sequence
  chemically synthesized
cattctccaacatgttgtttta

SEQ ID NO: 814826 - DNA, 22 bp, Artificial Sequence
  chemically synthesized
acattctccaacatgttgtttt

SEQ ID NO: 814827 - DNA, 22 bp, Artificial Sequence
  chemically synthesized
tacattctccaacatgttgttt

SEQ ID NO: 814828 - DNA, 22 bp, Artificial Sequence
  chemically synthesized
ttacattctccaacatgttgtt

SEQ ID NO: 814829 - DNA, 22 bp, Artificial Sequence
  chemically synthesized
ttttacattctccaacatgttg

SEQ ID NO: 814830 - DNA, 22 bp, Artificial Sequence
  chemically synthesized
ctaaaacaacatgttggagaat

SEQ ID NO: 814831 - DNA, 22 bp, Artificial Sequence
  chemically synthesized
gatctcttttacattctccaac

SEQ ID NO: 814832 - DNA, 22 bp, Artificial Sequence
  chemically synthesized
aaacaacatgttggagaatgta

SEQ ID NO: 814833 - DNA, 22 bp, Artificial Sequence
  chemically synthesized
aacactagatctcttttacatt

SEQ ID NO: 814834 - DNA, 22 bp, Artificial Sequence
  chemically synthesized
gttaaacactagatctctttta

SEQ ID NO: 814835 - DNA, 22 bp, Artificial Sequence
  chemically synthesized
tagttaaacactagatctcttt

SEQ ID NO: 814836 - DNA, 22 bp, Artificial Sequence
  chemically synthesized
gagaatgtaaaagagatctagt

SEQ ID NO: 814837 - DNA, 22 bp, Artificial Sequence
  chemically synthesized
ctctagttaaacactagatctc

SEQ ID NO: 814838 - DNA, 22 bp, Artificial Sequence
  chemically synthesized
tgtgtagcaaggagctactcta

SEQ ID NO: 814839 - DNA, 22 bp, Artificial Sequence
  chemically synthesized
gtgtgtagcaaggagctactct

SEQ ID NO: 814840 - DNA, 22 bp, Artificial Sequence
  chemically synthesized
tgtgtgtagcaaggagctactc

SEQ ID NO: 814841 - DNA, 22 bp, Artificial Sequence
  chemically synthesized
gtgtttaactagagtagctcct

SEQ ID NO: 814842 - DNA, 22 bp, Artificial Sequence
  chemically synthesized
ttttgtgtgtagcaaggagcta

SEQ ID NO: 814843 - DNA, 22 bp, Artificial Sequence
  chemically synthesized
aactagagtagctccttgctac

SEQ ID NO: 814844 - DNA, 22 bp, Artificial Sequence
  chemically synthesized
actagagtagctccttgctaca

SEQ ID NO: 814845 - DNA, 22 bp, Artificial Sequence
  chemically synthesized
agccctattttgtgtgtagcaa

SEQ ID NO: 814846 - DNA, 22 bp, Artificial Sequence
  chemically synthesized
gagtagctccttgctacacaca

SEQ ID NO: 814847 - DNA, 22 bp, Artificial Sequence
  chemically synthesized
cttgctacacacaaaatagggc

SEQ ID NO: 814848 - DNA, 22 bp, Artificial Sequence
  chemically synthesized
gctacacacaaaatagggctca

SEQ ID NO: 814849 - DNA, 22 bp, Artificial Sequence
  chemically synthesized
ctacacacaaaatagggctcaa

SEQ ID NO: 814850 - DNA, 22 bp, Artificial Sequence
  chemically synthesized
cacacaaaatagggctcaattg

SEQ ID NO: 814851 - DNA, 22 bp, Artificial Sequence
  chemically synthesized
caacaagaaaagagaaaacaat

SEQ ID NO: 814852 - DNA, 22 bp, Artificial Sequence
  chemically synthesized
attgcaacaagaaaagagaaaa

SEQ ID NO: 814853 - DNA, 22 bp, Artificial Sequence
  chemically synthesized
cattgcaacaagaaaagagaaa

SEQ ID NO: 814854 - DNA, 22 bp, Artificial Sequence
  chemically synthesized
atcttcattgcaacaagaaaag

SEQ ID NO: 814855 - DNA, 22 bp, Artificial Sequence
  chemically synthesized
aattgttttctcttttcttgtt

SEQ ID NO: 814856 - DNA, 22 bp, Artificial Sequence
  chemically synthesized
tcatcttcattgcaacaagaaa

SEQ ID NO: 814857 - DNA, 22 bp, Artificial Sequence
  chemically synthesized
ctcatcttcattgcaacaagaa

SEQ ID NO: 814858 - DNA, 22 bp, Artificial Sequence
  chemically synthesized
tctcatcttcattgcaacaaga

SEQ ID NO: 814859 - DNA, 22 bp, Artificial Sequence
  chemically synthesized
ttttctcttttcttgttgcaat

SEQ ID NO: 814860 - DNA, 22 bp, Artificial Sequence
  chemically synthesized
tctcttttcttgttgcaatgaa

SEQ ID NO: 814861 - DNA, 22 bp, Artificial Sequence
  chemically synthesized
ctcttttcttgttgcaatgaag

SEQ ID NO: 814862 - DNA, 22 bp, Artificial Sequence
  chemically synthesized
tcttttcttgttgcaatgaaga

SEQ ID NO: 814863 - DNA, 22 bp, Artificial Sequence
  chemically synthesized
ggtcctttctcatcttcattgc

SEQ ID NO: 814864 - DNA, 22 bp, Artificial Sequence
  chemically synthesized
ttttcttgttgcaatgaagatg

SEQ ID NO: 814865 - DNA, 22 bp, Artificial Sequence
  chemically synthesized
ctaggtcctttctcatcttcat

SEQ ID NO: 814866 - DNA, 22 bp, Artificial Sequence
  chemically synthesized
ttcttgttgcaatgaagatgag

SEQ ID NO: 814867 - DNA, 22 bp, Artificial Sequence
  chemically synthesized
tcttgttgcaatgaagatgaga

SEQ ID NO: 814868 - DNA, 22 bp, Artificial Sequence
  chemically synthesized
cttgttgcaatgaagatgagaa

SEQ ID NO: 814869 - DNA, 22 bp, Artificial Sequence
  chemically synthesized
ttcctaggtcctttctcatctt

SEQ ID NO: 814870 - DNA, 22 bp, Artificial Sequence
  chemically synthesized
ttgttgcaatgaagatgagaaa

SEQ ID NO: 814871 - DNA, 22 bp, Artificial Sequence
  chemically synthesized
tattcctaggtcctttctcatc

SEQ ID NO: 814872 - DNA, 22 bp, Artificial Sequence
  chemically synthesized
gttgcaatgaagatgagaaagg

SEQ ID NO: 814873 - DNA, 22 bp, Artificial Sequence
  chemically synthesized
ttgcaatgaagatgagaaagga

SEQ ID NO: 814874 - DNA, 22 bp, Artificial Sequence
  chemically synthesized
tctattcctaggtcctttctca

SEQ ID NO: 814875 - DNA, 22 bp, Artificial Sequence
  chemically synthesized
ctctattcctaggtcctttctc

SEQ ID NO: 814876 - DNA, 22 bp, Artificial Sequence
  chemically synthesized
caatgaagatgagaaaggacct

SEQ ID NO: 814877 - DNA, 22 bp, Artificial Sequence
  chemically synthesized
cttctctattcctaggtccttt

SEQ ID NO: 814878 - DNA, 22 bp, Artificial Sequence
  chemically synthesized
gcttctctattcctaggtcctt

SEQ ID NO: 814879 - DNA, 22 bp, Artificial Sequence
  chemically synthesized
tgcttctctattcctaggtcct

SEQ ID NO: 814880 - DNA, 22 bp, Artificial Sequence
  chemically synthesized
tttgcttctctattcctaggtc

SEQ ID NO: 814881 - DNA, 22 bp, Artificial Sequence
  chemically synthesized
taagtcactctttgcttctcta

SEQ ID NO: 814882 - DNA, 22 bp, Artificial Sequence
  chemically synthesized
gtaagtcactctttgcttctct

SEQ ID NO: 814883 - DNA, 22 bp, Artificial Sequence
  chemically synthesized
ggaatagagaagcaaagagtga

SEQ ID NO: 814884 - DNA, 22 bp, Artificial Sequence
  chemically synthesized
aaggcacttgtaagtcactctt

SEQ ID NO: 814885 - DNA, 22 bp, Artificial Sequence
  chemically synthesized
gaaggcacttgtaagtcactct

SEQ ID NO: 814886 - DNA, 22 bp, Artificial Sequence
  chemically synthesized
acaaccttgaaggcacttgtaa

SEQ ID NO: 814887 - DNA, 22 bp, Artificial Sequence
  chemically synthesized
gacaaccttgaaggcacttgta

SEQ ID NO: 814888 - DNA, 22 bp, Artificial Sequence
  chemically synthesized
tgacaaccttgaaggcacttgt

SEQ ID NO: 814889 - DNA, 22 bp, Artificial Sequence
  chemically synthesized
cgtctttgacaaccttgaaggc

SEQ ID NO: 814890 - DNA, 22 bp, Artificial Sequence
  chemically synthesized
tccgtctttgacaaccttgaag

SEQ ID NO: 814891 - DNA, 22 bp, Artificial Sequence
  chemically synthesized
ctccgtctttgacaaccttgaa

SEQ ID NO: 814892 - DNA, 22 bp, Artificial Sequence
  chemically synthesized
tctccgtctttgacaaccttga

SEQ ID NO: 814893 - DNA, 22 bp, Artificial Sequence
  chemically synthesized
acaagtgccttcaaggttgtca

SEQ ID NO: 814894 - DNA, 22 bp, Artificial Sequence
  chemically synthesized
caagtgccttcaaggttgtcaa

SEQ ID NO: 814895 - DNA, 22 bp, Artificial Sequence
  chemically synthesized
ttttctccgtctttgacaacct

SEQ ID NO: 814896 - DNA, 22 bp, Artificial Sequence
  chemically synthesized
acctgttttctccgtctttgac

SEQ ID NO: 814897 - DNA, 22 bp, Artificial Sequence
  chemically synthesized
gacctgttttctccgtctttga

SEQ ID NO: 814898 - DNA, 22 bp, Artificial Sequence
  chemically synthesized
tgacctgttttctccgtctttg

SEQ ID NO: 814899 - DNA, 22 bp, Artificial Sequence
  chemically synthesized
caaggttgtcaaagacggagaa

SEQ ID NO: 814900 - DNA, 22 bp, Artificial Sequence
  chemically synthesized
aaggttgtcaaagacggagaaa

SEQ ID NO: 814901 - DNA, 22 bp, Artificial Sequence
  chemically synthesized
aaaacattttgacctgttttct

SEQ ID NO: 814902 - DNA, 22 bp, Artificial Sequence
  chemically synthesized
tcaaagacggagaaaacaggtc

SEQ ID NO: 814903 - DNA, 22 bp, Artificial Sequence
  chemically synthesized
atcatctgaaaacattttgacc

SEQ ID NO: 814904 - DNA, 22 bp, Artificial Sequence
  chemically synthesized
atagttgatcatctgaaaacat

SEQ ID NO: 814905 - DNA, 22 bp, Artificial Sequence
  chemically synthesized
atgatcaaaattaatagttgat

SEQ ID NO: 814906 - DNA, 22 bp, Artificial Sequence
  chemically synthesized
aatgatcaaaattaatagttga

SEQ ID NO: 814907 - DNA, 22 bp, Artificial Sequence
  chemically synthesized
taatgatcaaaattaatagttg

SEQ ID NO: 814908 - DNA, 22 bp, Artificial Sequence
  chemically synthesized
tcagatgatcaactattaattt

SEQ ID NO: 814909 - DNA, 22 bp, Artificial Sequence
  chemically synthesized
cagatgatcaactattaatttt

SEQ ID NO: 814910 - DNA, 22 bp, Artificial Sequence
  chemically synthesized
agatgatcaactattaattttg

SEQ ID NO: 814911 - DNA, 22 bp, Artificial Sequence
  chemically synthesized
tattttaatgatcaaaattaat

SEQ ID NO: 814912 - DNA, 22 bp, Artificial Sequence
  chemically synthesized
gtattttaatgatcaaaattaa

SEQ ID NO: 814913 - DNA, 22 bp, Artificial Sequence
  chemically synthesized
tgtattttaatgatcaaaatta

SEQ ID NO: 814914 - DNA, 22 bp, Artificial Sequence
  chemically synthesized
ttttgtattttaatgatcaaaa

SEQ ID NO: 814915 - DNA, 22 bp, Artificial Sequence
  chemically synthesized
ttaattttgatcattaaaatac

SEQ ID NO: 814916 - DNA, 22 bp, Artificial Sequence
  chemically synthesized
taatactgttttgtattttaat

SEQ ID NO: 814917 - DNA, 22 bp, Artificial Sequence
  chemically synthesized
ataatactgttttgtattttaa

SEQ ID NO: 814918 - DNA, 22 bp, Artificial Sequence
  chemically synthesized
tataatactgttttgtatttta

SEQ ID NO: 814919 - DNA, 22 bp, Artificial Sequence
  chemically synthesized
attttgatcattaaaatacaaa

SEQ ID NO: 814920 - DNA, 22 bp, Artificial Sequence
  chemically synthesized
tttataatactgttttgtattt

SEQ ID NO: 814921 - DNA, 22 bp, Artificial Sequence
  chemically synthesized
tgatcattaaaatacaaaacag

SEQ ID NO: 814922 - DNA, 22 bp, Artificial Sequence
  chemically synthesized
ttctttataatactgttttgta

SEQ ID NO: 814923 - DNA, 22 bp, Artificial Sequence
  chemically synthesized
gatcattaaaatacaaaacagt

SEQ ID NO: 814924 - DNA, 22 bp, Artificial Sequence
  chemically synthesized
atcattaaaatacaaaacagta

SEQ ID NO: 814925 - DNA, 22 bp, Artificial Sequence
  chemically synthesized
tgttctttataatactgttttg

SEQ ID NO: 814926 - DNA, 22 bp, Artificial Sequence
  chemically synthesized
tctgttctttataatactgttt

SEQ ID NO: 814927 - DNA, 22 bp, Artificial Sequence
  chemically synthesized
aaatacaaaacagtattataaa

SEQ ID NO: 814928 - DNA, 22 bp, Artificial Sequence
  chemically synthesized
agtattctctgttctttataat

SEQ ID NO: 814929 - DNA, 22 bp, Artificial Sequence
  chemically synthesized
cataacatctcagtattctctg

SEQ ID NO: 814930 - DNA, 22 bp, Artificial Sequence
  chemically synthesized
ccataacatctcagtattctct

SEQ ID NO: 814931 - DNA, 22 bp, Artificial Sequence
  chemically synthesized
ttccataacatctcagtattct

SEQ ID NO: 814932 - DNA, 22 bp, Artificial Sequence
  chemically synthesized
cttccataacatctcagtattc

SEQ ID NO: 814933 - DNA, 22 bp, Artificial Sequence
  chemically synthesized
taaagaacagagaatactgaga

SEQ ID NO: 814934 - DNA, 22 bp, Artificial Sequence
  chemically synthesized
tcttccataacatctcagtatt

SEQ ID NO: 814935 - DNA, 22 bp, Artificial Sequence
  chemically synthesized
agatgttatggaagaaaatgtg

SEQ ID NO: 814936 - DNA, 22 bp, Artificial Sequence
  chemically synthesized
tggaagaaaatgtgtttgtatg

SEQ ID NO: 814937 - DNA, 22 bp, Artificial Sequence
  chemically synthesized
gtatgtatatgcatgcatatgc

SEQ ID NO: 814938 - DNA, 22 bp, Artificial Sequence
  chemically synthesized
tatgtatatgcatgcatatgca

SEQ ID NO: 814939 - DNA, 22 bp, Artificial Sequence
  chemically synthesized
agcatgtacatgtgtgtacatg

SEQ ID NO: 814940 - DNA, 22 bp, Artificial Sequence
  chemically synthesized
agaaagattcagcatgtacatg

SEQ ID NO: 814941 - DNA, 22 bp, Artificial Sequence
  chemically synthesized
taagaaagattcagcatgtaca

SEQ ID NO: 814942 - DNA, 22 bp, Artificial Sequence
  chemically synthesized
ggttctaagaaagattcagcat

SEQ ID NO: 814943 - DNA, 22 bp, Artificial Sequence
  chemically synthesized
taggttctaagaaagattcagc

SEQ ID NO: 814944 - DNA, 22 bp, Artificial Sequence
  chemically synthesized
aaaaatccctctaggttctaag

SEQ ID NO: 814945 - DNA, 22 bp, Artificial Sequence
  chemically synthesized
aatctttcttagaacctagagg

SEQ ID NO: 814946 - DNA, 22 bp, Artificial Sequence
  chemically synthesized
ccagatactaaaaaatccctct

SEQ ID NO: 814947 - DNA, 22 bp, Artificial Sequence
  chemically synthesized
tcttagaacctagagggatttt

SEQ ID NO: 814948 - DNA, 22 bp, Artificial Sequence
  chemically synthesized
cttagaacctagagggattttt

SEQ ID NO: 814949 - DNA, 22 bp, Artificial Sequence
  chemically synthesized
ttagaacctagagggatttttt

SEQ ID NO: 814950 - DNA, 22 bp, Artificial Sequence
  chemically synthesized
agaacctagagggattttttag

SEQ ID NO: 814951 - DNA, 22 bp, Artificial Sequence
  chemically synthesized
agctcccagatactaaaaaatc

SEQ ID NO: 814952 - DNA, 22 bp, Artificial Sequence
  chemically synthesized
gaacctagagggattttttagt

SEQ ID NO: 814953 - DNA, 22 bp, Artificial Sequence
  chemically synthesized
gctaagctcccagatactaaaa

SEQ ID NO: 814954 - DNA, 22 bp, Artificial Sequence
  chemically synthesized
agctaagctcccagatactaaa

SEQ ID NO: 814955 - DNA, 22 bp, Artificial Sequence
  chemically synthesized
gagggattttttagtatctggg

SEQ ID NO: 814956 - DNA, 22 bp, Artificial Sequence
  chemically synthesized
cttagctaagctcccagatact

SEQ ID NO: 814957 - DNA, 22 bp, Artificial Sequence
  chemically synthesized
gaagttccttagctaagctccc

SEQ ID NO: 814958 - DNA, 22 bp, Artificial Sequence
  chemically synthesized
tttagtatctgggagcttagct

SEQ ID NO: 814959 - DNA, 22 bp, Artificial Sequence
  chemically synthesized
ttagtatctgggagcttagcta

SEQ ID NO: 814960 - DNA, 22 bp, Artificial Sequence
  chemically synthesized
tagtatctgggagcttagctaa

SEQ ID NO: 814961 - DNA, 22 bp, Artificial Sequence
  chemically synthesized
agtatctgggagcttagctaag

SEQ ID NO: 814962 - DNA, 22 bp, Artificial Sequence
  chemically synthesized
gtatctgggagcttagctaagg

SEQ ID NO: 814963 - DNA, 22 bp, Artificial Sequence
  chemically synthesized
aacatgcctagaagttccttag

SEQ ID NO: 814964 - DNA, 22 bp, Artificial Sequence
  chemically synthesized
ggagcttagctaaggaacttct

SEQ ID NO: 814965 - DNA, 22 bp, Artificial Sequence
  chemically synthesized
agctaaggaacttctaggcatg

SEQ ID NO: 814966 - DNA, 22 bp, Artificial Sequence
  chemically synthesized
gctaaggaacttctaggcatgt

SEQ ID NO: 814967 - DNA, 22 bp, Artificial Sequence
  chemically synthesized
catcagagggttaaacatgcct

SEQ ID NO: 814968 - DNA, 22 bp, Artificial Sequence
  chemically synthesized
gcatcagagggttaaacatgcc

SEQ ID NO: 814969 - DNA, 22 bp, Artificial Sequence
  chemically synthesized
aggaacttctaggcatgtttaa

SEQ ID NO: 814970 - DNA, 22 bp, Artificial Sequence
  chemically synthesized
ctaggcatgtttaaccctctga

SEQ ID NO: 814971 - DNA, 22 bp, Artificial Sequence
  chemically synthesized
taggcatgtttaaccctctgat

SEQ ID NO: 814972 - DNA, 22 bp, Artificial Sequence
  chemically synthesized
ggcatgtttaaccctctgatgc

SEQ ID NO: 814973 - DNA, 22 bp, Artificial Sequence
  chemically synthesized
aaccctctgatgcaaggaccat

SEQ ID NO: 814974 - DNA, 22 bp, Artificial Sequence
  chemically synthesized
accctctgatgcaaggaccatc

SEQ ID NO: 814975 - DNA, 22 bp, Artificial Sequence
  chemically synthesized
atcaagcagaggagatggtcct

SEQ ID NO: 814976 - DNA, 22 bp, Artificial Sequence
  chemically synthesized
tgatgcaaggaccatctcctct

SEQ ID NO: 814977 - DNA, 22 bp, Artificial Sequence
  chemically synthesized
atgcaaggaccatctcctctgc

SEQ ID NO: 814978 - DNA, 22 bp, Artificial Sequence
  chemically synthesized
gccaggtacaaactcatcaagc

SEQ ID NO: 814979 - DNA, 22 bp, Artificial Sequence
  chemically synthesized
ccaactagccaggtacaaactc

SEQ ID NO: 814980 - DNA, 22 bp, Artificial Sequence
  chemically synthesized
ctctgcttgatgagtttgtacc

SEQ ID NO: 814981 - DNA, 22 bp, Artificial Sequence
  chemically synthesized
tgcttgatgagtttgtacctgg

SEQ ID NO: 814982 - DNA, 22 bp, Artificial Sequence
  chemically synthesized
cttgatgagtttgtacctggct

SEQ ID NO: 814983 - DNA, 22 bp, Artificial Sequence
  chemically synthesized
cacaactgccaactagccaggt

SEQ ID NO: 814984 - DNA, 22 bp, Artificial Sequence
  chemically synthesized
gatgagtttgtacctggctagt

SEQ ID NO: 814985 - DNA, 22 bp, Artificial Sequence
  chemically synthesized
ccacaactgccaactagccagg

SEQ ID NO: 814986 - DNA, 22 bp, Artificial Sequence
  chemically synthesized
atgagtttgtacctggctagtt

SEQ ID NO: 814987 - DNA, 22 bp, Artificial Sequence
  chemically synthesized
gtacctggctagttggcagttg

SEQ ID NO: 814988 - DNA, 22 bp, Artificial Sequence
  chemically synthesized
tacctggctagttggcagttgt

SEQ ID NO: 814989 - DNA, 22 bp, Artificial Sequence
  chemically synthesized
tatgagggcttccacaactgcc

SEQ ID NO: 814990 - DNA, 22 bp, Artificial Sequence
  chemically synthesized
gctagttggcagttgtggaagc

SEQ ID NO: 814991 - DNA, 22 bp, Artificial Sequence
  chemically synthesized
tagctgtatgagggcttccaca

SEQ ID NO: 814992 - DNA, 22 bp, Artificial Sequence
  chemically synthesized
gtagctgtatgagggcttccac

SEQ ID NO: 814993 - DNA, 22 bp, Artificial Sequence
  chemically synthesized
gttggcagttgtggaagccctc

SEQ ID NO: 814994 - DNA, 22 bp, Artificial Sequence
  chemically synthesized
cttgtagctgtatgagggcttc

SEQ ID NO: 814995 - DNA, 22 bp, Artificial Sequence
  chemically synthesized
gcagttgtggaagccctcatac

SEQ ID NO: 814996 - DNA, 22 bp, Artificial Sequence
  chemically synthesized
tctgcttgtagctgtatgaggg

SEQ ID NO: 814997 - DNA, 22 bp, Artificial Sequence
  chemically synthesized
aattgtctgcttgtagctgtat

SEQ ID NO: 814998 - DNA, 22 bp, Artificial Sequence
  chemically synthesized
tggaagccctcatacagctaca

SEQ ID NO: 814999 - DNA, 22 bp, Artificial Sequence
  chemically synthesized
tgaattgtctgcttgtagctgt

SEQ ID NO: 815000 - DNA, 22 bp, Artificial Sequence
  chemically synthesized
actctgaattgtctgcttgtag

SEQ ID NO: 815001 - DNA, 22 bp, Artificial Sequence
  chemically synthesized
atacagctacaagcagacaatt

SEQ ID NO: 815002 - DNA, 22 bp, Artificial Sequence
  chemically synthesized
caagcagacaattcagagttaa

SEQ ID NO: 815003 - DNA, 22 bp, Artificial Sequence
  chemically synthesized
aacaagaaataagcattaactc

SEQ ID NO: 815004 - DNA, 22 bp, Artificial Sequence
  chemically synthesized
aaacaagaaataagcattaact

SEQ ID NO: 815005 - DNA, 22 bp, Artificial Sequence
  chemically synthesized
taaacaagaaataagcattaac

SEQ ID NO: 815006 - DNA, 22 bp, Artificial Sequence
  chemically synthesized
tttaaacaagaaataagcatta

SEQ ID NO: 815007 - DNA, 22 bp, Artificial Sequence
  chemically synthesized
agagttaatgcttatttcttgt

SEQ ID NO: 815008 - DNA, 22 bp, Artificial Sequence
  chemically synthesized
caggatcactctttaaacaaga

SEQ ID NO: 815009 - DNA, 22 bp, Artificial Sequence
  chemically synthesized
atgcttatttcttgtttaaaga

SEQ ID NO: 815010 - DNA, 22 bp, Artificial Sequence
  chemically synthesized
ttccaggatcactctttaaaca

SEQ ID NO: 815011 - DNA, 22 bp, Artificial Sequence
  chemically synthesized
tgttccaggatcactctttaaa

SEQ ID NO: 815012 - DNA, 22 bp, Artificial Sequence
  chemically synthesized
ctgttccaggatcactctttaa

SEQ ID NO: 815013 - DNA, 22 bp, Artificial Sequence
  chemically synthesized
atttcttgtttaaagagtgatc

SEQ ID NO: 815014 - DNA, 22 bp, Artificial Sequence
  chemically synthesized
tttctgttccaggatcactctt

SEQ ID NO: 815015 - DNA, 22 bp, Artificial Sequence
  chemically synthesized
tttcttgtttaaagagtgatcc

SEQ ID NO: 815016 - DNA, 22 bp, Artificial Sequence
  chemically synthesized
atttctgttccaggatcactct

SEQ ID NO: 815017 - DNA, 22 bp, Artificial Sequence
  chemically synthesized
cttgtttaaagagtgatcctgg

SEQ ID NO: 815018 - DNA, 22 bp, Artificial Sequence
  chemically synthesized
cttatttctgttccaggatcac

SEQ ID NO: 815019 - DNA, 22 bp, Artificial Sequence
  chemically synthesized
ttgtttaaagagtgatcctgga

SEQ ID NO: 815020 - DNA, 22 bp, Artificial Sequence
  chemically synthesized
ccttatttctgttccaggatca

SEQ ID NO: 815021 - DNA, 22 bp, Artificial Sequence
  chemically synthesized
gtttaaagagtgatcctggaac

SEQ ID NO: 815022 - DNA, 22 bp, Artificial Sequence
  chemically synthesized
tttaaagagtgatcctggaaca

SEQ ID NO: 815023 - DNA, 22 bp, Artificial Sequence
  chemically synthesized
atttccttatttctgttccagg

SEQ ID NO: 815024 - DNA, 22 bp, Artificial Sequence
  chemically synthesized
catttccttatttctgttccag

SEQ ID NO: 815025 - DNA, 22 bp, Artificial Sequence
  chemically synthesized
aaagagtgatcctggaacagaa

SEQ ID NO: 815026 - DNA, 22 bp, Artificial Sequence
  chemically synthesized
aagagtgatcctggaacagaaa

SEQ ID NO: 815027 - DNA, 22 bp, Artificial Sequence
  chemically synthesized
tcatgagatttcatttccttat

SEQ ID NO: 815028 - DNA, 22 bp, Artificial Sequence
  chemically synthesized
gaacagaaataaggaaatgaaa

SEQ ID NO: 815029 - DNA, 22 bp, Artificial Sequence
  chemically synthesized
tgatgacactgtcatgagattt

SEQ ID NO: 815030 - DNA, 22 bp, Artificial Sequence
  chemically synthesized
atgatgacactgtcatgagatt

SEQ ID NO: 815031 - DNA, 22 bp, Artificial Sequence
  chemically synthesized
tatgatgacactgtcatgagat

SEQ ID NO: 815032 - DNA, 22 bp, Artificial Sequence
  chemically synthesized
atgactttatgatgacactgtc

SEQ ID NO: 815033 - DNA, 22 bp, Artificial Sequence
  chemically synthesized
gctgatgactttatgatgacac

SEQ ID NO: 815034 - DNA, 22 bp, Artificial Sequence
  chemically synthesized
atgacagtgtcatcataaagtc

SEQ ID NO: 815035 - DNA, 22 bp, Artificial Sequence
  chemically synthesized
ccatctggctgatgactttatg

SEQ ID NO: 815036 - DNA, 22 bp, Artificial Sequence
  chemically synthesized
aaggactgccatctggctgatg

SEQ ID NO: 815037 - DNA, 22 bp, Artificial Sequence
  chemically synthesized
caaggactgccatctggctgat

SEQ ID NO: 815038 - DNA, 22 bp, Artificial Sequence
  chemically synthesized
gatttcaaggactgccatctgg

SEQ ID NO: 815039 - DNA, 22 bp, Artificial Sequence
  chemically synthesized
aggattagatttcaaggactgc

SEQ ID NO: 815040 - DNA, 22 bp, Artificial Sequence
  chemically synthesized
taaggattagatttcaaggact

SEQ ID NO: 815041 - DNA, 22 bp, Artificial Sequence
  chemically synthesized
tgagaagcctctaaggattaga

SEQ ID NO: 815042 - DNA, 22 bp, Artificial Sequence
  chemically synthesized
ttgtgagaagcctctaaggatt

SEQ ID NO: 815043 - DNA, 22 bp, Artificial Sequence
  chemically synthesized
gaaatctaatccttagaggctt

SEQ ID NO: 815044 - DNA, 22 bp, Artificial Sequence
  chemically synthesized
aaatctaatccttagaggcttc

SEQ ID NO: 815045 - DNA, 22 bp, Artificial Sequence
  chemically synthesized
caaattattgtgagaagcctct

SEQ ID NO: 815046 - DNA, 22 bp, Artificial Sequence
  chemically synthesized
atccttagaggcttctcacaat

SEQ ID NO: 815047 - DNA, 22 bp, Artificial Sequence
  chemically synthesized
agaggcttctcacaataatttg

SEQ ID NO: 815048 - DNA, 22 bp, Artificial Sequence
  chemically synthesized
gatgtgatattacaaattattg

SEQ ID NO: 815049 - DNA, 22 bp, Artificial Sequence
  chemically synthesized
gaggcttctcacaataatttgt

SEQ ID NO: 815050 - DNA, 22 bp, Artificial Sequence
  chemically synthesized
ctcacaataatttgtaatatca

SEQ ID NO: 815051 - DNA, 22 bp, Artificial Sequence
  chemically synthesized
tcacaataatttgtaatatcac

SEQ ID NO: 815052 - DNA, 22 bp, Artificial Sequence
  chemically synthesized
acaataatttgtaatatcacat

SEQ ID NO: 815053 - DNA, 22 bp, Artificial Sequence
  chemically synthesized
tgaataagataatattagatgt

SEQ ID NO: 815054 - DNA, 22 bp, Artificial Sequence
  chemically synthesized
gtgaataagataatattagatg

SEQ ID NO: 815055 - DNA, 22 bp, Artificial Sequence
  chemically synthesized
gtaatatcacatctaatattat

SEQ ID NO: 815056 - DNA, 22 bp, Artificial Sequence
  chemically synthesized
taatatcacatctaatattatc

SEQ ID NO: 815057 - DNA, 22 bp, Artificial Sequence
  chemically synthesized
tgaatagatatgagtttgtgaa

SEQ ID NO: 815058 - DNA, 22 bp, Artificial Sequence
  chemically synthesized
atattatcttattcacaaactc

SEQ ID NO: 815059 - DNA, 22 bp, Artificial Sequence
  chemically synthesized
tgtgaatagatatgagtttgtg

SEQ ID NO: 815060 - DNA, 22 bp, Artificial Sequence
  chemically synthesized
tcttattcacaaactcatatct

SEQ ID NO: 815061 - DNA, 22 bp, Artificial Sequence
  chemically synthesized
aatctctgtgaatagatatgag

SEQ ID NO: 815062 - DNA, 22 bp, Artificial Sequence
  chemically synthesized
caatctctgtgaatagatatga

SEQ ID NO: 815063 - DNA, 22 bp, Artificial Sequence
  chemically synthesized
attcacaaactcatatctattc

SEQ ID NO: 815064 - DNA, 22 bp, Artificial Sequence
  chemically synthesized
ttcacaaactcatatctattca

SEQ ID NO: 815065 - DNA, 22 bp, Artificial Sequence
  chemically synthesized
tcttcaatctctgtgaatagat

SEQ ID NO: 815066 - DNA, 22 bp, Artificial Sequence
  chemically synthesized
gtcttcaatctctgtgaataga

SEQ ID NO: 815067 - DNA, 22 bp, Artificial Sequence
  chemically synthesized
acaaactcatatctattcacag

SEQ ID NO: 815068 - DNA, 22 bp, Artificial Sequence
  chemically synthesized
tgtcttcaatctctgtgaatag

SEQ ID NO: 815069 - DNA, 22 bp, Artificial Sequence
  chemically synthesized
tttgtcttcaatctctgtgaat

SEQ ID NO: 815070 - DNA, 22 bp, Artificial Sequence
  chemically synthesized
ctttgtcttcaatctctgtgaa

SEQ ID NO: 815071 - DNA, 22 bp, Artificial Sequence
  chemically synthesized
atttctttgtcttcaatctctg

SEQ ID NO: 815072 - DNA, 22 bp, Artificial Sequence
  chemically synthesized
atatctattcacagagattgaa

SEQ ID NO: 815073 - DNA, 22 bp, Artificial Sequence
  chemically synthesized
caagttcatttctttgtcttca

SEQ ID NO: 815074 - DNA, 22 bp, Artificial Sequence
  chemically synthesized
ttcacagagattgaagacaaag

SEQ ID NO: 815075 - DNA, 22 bp, Artificial Sequence
  chemically synthesized
tgcaagttcatttctttgtctt

SEQ ID NO: 815076 - DNA, 22 bp, Artificial Sequence
  chemically synthesized
acagagattgaagacaaagaaa

SEQ ID NO: 815077 - DNA, 22 bp, Artificial Sequence
  chemically synthesized
aagacaaagaaatgaacttgca

SEQ ID NO: 815078 - DNA, 22 bp, Artificial Sequence
  chemically synthesized
gcagaggctcacatttctggct

SEQ ID NO: 815079 - DNA, 22 bp, Artificial Sequence
  chemically synthesized
cagaggctcacatttctggctt

SEQ ID NO: 815080 - DNA, 22 bp, Artificial Sequence
  chemically synthesized
acatttctggctttatatgtta

SEQ ID NO: 815081 - DNA, 22 bp, Artificial Sequence
  chemically synthesized
cagagtccatgataacatataa

SEQ ID NO: 815082 - DNA, 22 bp, Artificial Sequence
  chemically synthesized
acagagtccatgataacatata

SEQ ID NO: 815083 - DNA, 22 bp, Artificial Sequence
  chemically synthesized
ctggctttatatgttatcatgg

SEQ ID NO: 815084 - DNA, 22 bp, Artificial Sequence
  chemically synthesized
tggctttatatgttatcatgga

SEQ ID NO: 815085 - DNA, 22 bp, Artificial Sequence
  chemically synthesized
gctttatatgttatcatggact

SEQ ID NO: 815086 - DNA, 22 bp, Artificial Sequence
  chemically synthesized
tcgtagtccttacagagtccat

SEQ ID NO: 815087 - DNA, 22 bp, Artificial Sequence
  chemically synthesized
tatatgttatcatggactctgt

SEQ ID NO: 815088 - DNA, 22 bp, Artificial Sequence
  chemically synthesized
atcgtagtccttacagagtcca

SEQ ID NO: 815089 - DNA, 22 bp, Artificial Sequence
  chemically synthesized
atatgttatcatggactctgta

SEQ ID NO: 815090 - DNA, 22 bp, Artificial Sequence
  chemically synthesized
tatgttatcatggactctgtaa

SEQ ID NO: 815091 - DNA, 22 bp, Artificial Sequence
  chemically synthesized
cttatcgtagtccttacagagt

SEQ ID NO: 815092 - DNA, 22 bp, Artificial Sequence
  chemically synthesized
ccttatcgtagtccttacagag

SEQ ID NO: 815093 - DNA, 22 bp, Artificial Sequence
  chemically synthesized
tccttatcgtagtccttacaga

SEQ ID NO: 815094 - DNA, 22 bp, Artificial Sequence
  chemically synthesized
ttttccttatcgtagtccttac

SEQ ID NO: 815095 - DNA, 22 bp, Artificial Sequence
  chemically synthesized
tcatggactctgtaaggactac

SEQ ID NO: 815096 - DNA, 22 bp, Artificial Sequence
  chemically synthesized
tgtaaggactacgataaggaaa

SEQ ID NO: 815097 - DNA, 22 bp, Artificial Sequence
  chemically synthesized
taaggactacgataaggaaaac

SEQ ID NO: 815098 - DNA, 22 bp, Artificial Sequence
  chemically synthesized
tgtaggaaaatatgttgttttc

SEQ ID NO: 815099 - DNA, 22 bp, Artificial Sequence
  chemically synthesized
cgataaggaaaacaacatattt

SEQ ID NO: 815100 - DNA, 22 bp, Artificial Sequence
  chemically synthesized
tgacctatgtaggaaaatatgt

SEQ ID NO: 815101 - DNA, 22 bp, Artificial Sequence
  chemically synthesized
ttgtgacctatgtaggaaaata

SEQ ID NO: 815102 - DNA, 22 bp, Artificial Sequence
  chemically synthesized
ttgttgtgacctatgtaggaaa

SEQ ID NO: 815103 - DNA, 22 bp, Artificial Sequence
  chemically synthesized
aacatagattattgttgtgacc

SEQ ID NO: 815104 - DNA, 22 bp, Artificial Sequence
  chemically synthesized
tcctacataggtcacaacaata

SEQ ID NO: 815105 - DNA, 22 bp, Artificial Sequence
  chemically synthesized
cctacataggtcacaacaataa

SEQ ID NO: 815106 - DNA, 22 bp, Artificial Sequence
  chemically synthesized
ctacataggtcacaacaataat

SEQ ID NO: 815107 - DNA, 22 bp, Artificial Sequence
  chemically synthesized
cataggtcacaacaataatcta

SEQ ID NO: 815108 - DNA, 22 bp, Artificial Sequence
  chemically synthesized
gaaacccagatctgaacataga

SEQ ID NO: 815109 - DNA, 22 bp, Artificial Sequence
  chemically synthesized
agaaacccagatctgaacatag

SEQ ID NO: 815110 - DNA, 22 bp, Artificial Sequence
  chemically synthesized
tacagtttagaaacccagatct

SEQ ID NO: 815111 - DNA, 22 bp, Artificial Sequence
  chemically synthesized
aattgtacagtttagaaaccca

SEQ ID NO: 815112 - DNA, 22 bp, Artificial Sequence
  chemically synthesized
tgttcagatctgggtttctaaa

SEQ ID NO: 815113 - DNA, 22 bp, Artificial Sequence
  chemically synthesized
aactaaattgtacagtttagaa

SEQ ID NO: 815114 - DNA, 22 bp, Artificial Sequence
  chemically synthesized
agatctgggtttctaaactgta

SEQ ID NO: 815115 - DNA, 22 bp, Artificial Sequence
  chemically synthesized
tcaactaaattgtacagtttag

SEQ ID NO: 815116 - DNA, 22 bp, Artificial Sequence
  chemically synthesized
ctcaactaaattgtacagttta

SEQ ID NO: 815117 - DNA, 22 bp, Artificial Sequence
  chemically synthesized
cttctcaactaaattgtacagt

SEQ ID NO: 815118 - DNA, 22 bp, Artificial Sequence
  chemically synthesized
ggtttctaaactgtacaattta

SEQ ID NO: 815119 - DNA, 22 bp, Artificial Sequence
  chemically synthesized
ctaaactgtacaatttagttga

SEQ ID NO: 815120 - DNA, 22 bp, Artificial Sequence
  chemically synthesized
taaactgtacaatttagttgag

SEQ ID NO: 815121 - DNA, 22 bp, Artificial Sequence
  chemically synthesized
aactgtacaatttagttgagaa

SEQ ID NO: 815122 - DNA, 22 bp, Artificial Sequence
  chemically synthesized
tacaatttagttgagaagcagc

SEQ ID NO: 815123 - DNA, 22 bp, Artificial Sequence
  chemically synthesized
tggaaaaaagagaaggctgctt

SEQ ID NO: 815124 - DNA, 22 bp, Artificial Sequence
  chemically synthesized
tctatggaaaaaagagaaggct

SEQ ID NO: 815125 - DNA, 22 bp, Artificial Sequence
  chemically synthesized
agttgagaagcagccttctctt

SEQ ID NO: 815126 - DNA, 22 bp, Artificial Sequence
  chemically synthesized
gttgagaagcagccttctcttt

SEQ ID NO: 815127 - DNA, 22 bp, Artificial Sequence
  chemically synthesized
atctatctatggaaaaaagaga

SEQ ID NO: 815128 - DNA, 22 bp, Artificial Sequence
  chemically synthesized
agaagcagccttctcttttttc

SEQ ID NO: 815129 - DNA, 22 bp, Artificial Sequence
  chemically synthesized
aaaggaactaatctatctatgg

SEQ ID NO: 815130 - DNA, 22 bp, Artificial Sequence
  chemically synthesized
aaaaggaactaatctatctatg

SEQ ID NO: 815131 - DNA, 22 bp, Artificial Sequence
  chemically synthesized
ctcttttttccatagatagatt

SEQ ID NO: 815132 - DNA, 22 bp, Artificial Sequence
  chemically synthesized
tcttttttccatagatagatta

SEQ ID NO: 815133 - DNA, 22 bp, Artificial Sequence
  chemically synthesized
ttttttccatagatagattagt

SEQ ID NO: 815134 - DNA, 22 bp, Artificial Sequence
  chemically synthesized
tgcttaaaaggaactaatctat

SEQ ID NO: 815135 - DNA, 22 bp, Artificial Sequence
  chemically synthesized
atgcttaaaaggaactaatcta

SEQ ID NO: 815136 - DNA, 22 bp, Artificial Sequence
  chemically synthesized
ttttccatagatagattagttc

SEQ ID NO: 815137 - DNA, 22 bp, Artificial Sequence
  chemically synthesized
tttccatagatagattagttcc

SEQ ID NO: 815138 - DNA, 22 bp, Artificial Sequence
  chemically synthesized
ttccatagatagattagttcct

SEQ ID NO: 815139 - DNA, 22 bp, Artificial Sequence
  chemically synthesized
tccatagatagattagttcctt

SEQ ID NO: 815140 - DNA, 22 bp, Artificial Sequence
  chemically synthesized
ccatagatagattagttccttt

SEQ ID NO: 815141 - DNA, 22 bp, Artificial Sequence
  chemically synthesized
catagatagattagttcctttt

SEQ ID NO: 815142 - DNA, 22 bp, Artificial Sequence
  chemically synthesized
gttccttttaagcataaatgcc

SEQ ID NO: 815143 - DNA, 22 bp, Artificial Sequence
  chemically synthesized
cttttaagcataaatgcctatt

SEQ ID NO: 815144 - DNA, 22 bp, Artificial Sequence
  chemically synthesized
ttaagcataaatgcctatttat

SEQ ID NO: 815145 - DNA, 22 bp, Artificial Sequence
  chemically synthesized
tatagaataaatataaataggc

SEQ ID NO: 815146 - DNA, 22 bp, Artificial Sequence
  chemically synthesized
taagcataaatgcctatttata

SEQ ID NO: 815147 - DNA, 22 bp, Artificial Sequence
  chemically synthesized
atatagaataaatataaatagg

SEQ ID NO: 815148 - DNA, 22 bp, Artificial Sequence
  chemically synthesized
aagcataaatgcctatttatat

SEQ ID NO: 815149 - DNA, 22 bp, Artificial Sequence
  chemically synthesized
tatatagaataaatataaatag

SEQ ID NO: 815150 - DNA, 22 bp, Artificial Sequence
  chemically synthesized
agcataaatgcctatttatatt

SEQ ID NO: 815151 - DNA, 22 bp, Artificial Sequence
  chemically synthesized
ccattttatatagaataaatat

SEQ ID NO: 815152 - DNA, 22 bp, Artificial Sequence
  chemically synthesized
gccattttatatagaataaata

SEQ ID NO: 815153 - DNA, 22 bp, Artificial Sequence
  chemically synthesized
cttgccattttatatagaataa

SEQ ID NO: 815154 - DNA, 22 bp, Artificial Sequence
  chemically synthesized
acttgccattttatatagaata

SEQ ID NO: 815155 - DNA, 22 bp, Artificial Sequence
  chemically synthesized
tacttgccattttatatagaat

SEQ ID NO: 815156 - DNA, 22 bp, Artificial Sequence
  chemically synthesized
ttacttgccattttatatagaa

SEQ ID NO: 815157 - DNA, 22 bp, Artificial Sequence
  chemically synthesized
tttatatttattctatataaaa

SEQ ID NO: 815158 - DNA, 22 bp, Artificial Sequence
  chemically synthesized
atatttattctatataaaatgg

SEQ ID NO: 815159 - DNA, 22 bp, Artificial Sequence
  chemically synthesized
tatttattctatataaaatggc

SEQ ID NO: 815160 - DNA, 22 bp, Artificial Sequence
  chemically synthesized
attctatataaaatggcaagta

SEQ ID NO: 815161 - DNA, 22 bp, Artificial Sequence
  chemically synthesized
ttctatataaaatggcaagtaa

SEQ ID NO: 815162 - DNA, 22 bp, Artificial Sequence
  chemically synthesized
atatgatcatttttacttgcca

SEQ ID NO: 815163 - DNA, 22 bp, Artificial Sequence
  chemically synthesized
gatatgatcatttttacttgcc

SEQ ID NO: 815164 - DNA, 22 bp, Artificial Sequence
  chemically synthesized
tgatatgatcatttttacttgc

SEQ ID NO: 815165 - DNA, 22 bp, Artificial Sequence
  chemically synthesized
tatataaaatggcaagtaaaaa

SEQ ID NO: 815166 - DNA, 22 bp, Artificial Sequence
  chemically synthesized
ttgatatgatcatttttacttg

SEQ ID NO: 815167 - DNA, 22 bp, Artificial Sequence
  chemically synthesized
tataaaatggcaagtaaaaatg

SEQ ID NO: 815168 - DNA, 22 bp, Artificial Sequence
  chemically synthesized
cagtggcttttgatatgatcat

SEQ ID NO: 815169 - DNA, 22 bp, Artificial Sequence
  chemically synthesized
tacagtggcttttgatatgatc

SEQ ID NO: 815170 - DNA, 22 bp, Artificial Sequence
  chemically synthesized
aaattctacagtggcttttgat

SEQ ID NO: 815171 - DNA, 22 bp, Artificial Sequence
  chemically synthesized
caaattctacagtggcttttga

SEQ ID NO: 815172 - DNA, 22 bp, Artificial Sequence
  chemically synthesized
atacatcagatgagtcttcaaa

SEQ ID NO: 815173 - DNA, 22 bp, Artificial Sequence
  chemically synthesized
ttaatacatcagatgagtcttc

SEQ ID NO: 815174 - DNA, 22 bp, Artificial Sequence
  chemically synthesized
attaatacatcagatgagtctt

SEQ ID NO: 815175 - DNA, 22 bp, Artificial Sequence
  chemically synthesized
tagaatttgaagactcatctga

SEQ ID NO: 815176 - DNA, 22 bp, Artificial Sequence
  chemically synthesized
agtttattaatacatcagatga

SEQ ID NO: 815177 - DNA, 22 bp, Artificial Sequence
  chemically synthesized
aagtttattaatacatcagatg

SEQ ID NO: 815178 - DNA, 22 bp, Artificial Sequence
  chemically synthesized
tttaagtttattaatacatcag

SEQ ID NO: 815179 - DNA, 22 bp, Artificial Sequence
  chemically synthesized
gaagactcatctgatgtattaa

SEQ ID NO: 815180 - DNA, 22 bp, Artificial Sequence
  chemically synthesized
aagactcatctgatgtattaat

SEQ ID NO: 815181 - DNA, 22 bp, Artificial Sequence
  chemically synthesized
ctgtttaagtttattaatacat

SEQ ID NO: 815182 - DNA, 22 bp, Artificial Sequence
  chemically synthesized
gctgtttaagtttattaataca

SEQ ID NO: 815183 - DNA, 22 bp, Artificial Sequence
  chemically synthesized
tgctgtttaagtttattaatac

SEQ ID NO: 815184 - DNA, 22 bp, Artificial Sequence
  chemically synthesized
atctgatgtattaataaactta

SEQ ID NO: 815185 - DNA, 22 bp, Artificial Sequence
  chemically synthesized
tattttgctgtttaagtttatt

SEQ ID NO: 815186 - DNA, 22 bp, Artificial Sequence
  chemically synthesized
atattttgctgtttaagtttat

SEQ ID NO: 815187 - DNA, 22 bp, Artificial Sequence
  chemically synthesized
atgtattaataaacttaaacag

SEQ ID NO: 815188 - DNA, 22 bp, Artificial Sequence
  chemically synthesized
atgtttatattttgctgtttaa

SEQ ID NO: 815189 - DNA, 22 bp, Artificial Sequence
  chemically synthesized
ataaacttaaacagcaaaatat

SEQ ID NO: 815190 - DNA, 22 bp, Artificial Sequence
  chemically synthesized
aaacagcaaaatataaacatta

SEQ ID NO: 815191 - DNA, 22 bp, Artificial Sequence
  chemically synthesized
aacagcaaaatataaacattag

SEQ ID NO: 815192 - DNA, 22 bp, Artificial Sequence
  chemically synthesized
aagacataataaaaaagtaaac

SEQ ID NO: 815193 - DNA, 22 bp, Artificial Sequence
  chemically synthesized
caagacataataaaaaagtaaa

SEQ ID NO: 815194 - DNA, 22 bp, Artificial Sequence
  chemically synthesized
cagtttcaagacataataaaaa

SEQ ID NO: 815195 - DNA, 22 bp, Artificial Sequence
  chemically synthesized
gtttacttttttattatgtctt

SEQ ID NO: 815196 - DNA, 22 bp, Artificial Sequence
  chemically synthesized
ccatgttgcagtttcaagacat

SEQ ID NO: 815197 - DNA, 22 bp, Artificial Sequence
  chemically synthesized
acttttttattatgtcttgaaa

SEQ ID NO: 815198 - DNA, 22 bp, Artificial Sequence
  chemically synthesized
cttttttattatgtcttgaaac

SEQ ID NO: 815199 - DNA, 22 bp, Artificial Sequence
  chemically synthesized
ttttattatgtcttgaaactgc

SEQ ID NO: 815200 - DNA, 22 bp, Artificial Sequence
  chemically synthesized
tttattatgtcttgaaactgca

SEQ ID NO: 815201 - DNA, 22 bp, Artificial Sequence
  chemically synthesized
ttattatgtcttgaaactgcaa

SEQ ID NO: 815202 - DNA, 22 bp, Artificial Sequence
  chemically synthesized
tattatgtcttgaaactgcaac

SEQ ID NO: 815203 - DNA, 22 bp, Artificial Sequence
  chemically synthesized
attatgtcttgaaactgcaaca

SEQ ID NO: 815204 - DNA, 22 bp, Artificial Sequence
  chemically synthesized
ttatgtcttgaaactgcaacat

SEQ ID NO: 815205 - DNA, 22 bp, Artificial Sequence
  chemically synthesized
tgtcttgaaactgcaacatggc

SEQ ID NO: 815206 - DNA, 22 bp, Artificial Sequence
  chemically synthesized
atatcagacactgccatgttgc

SEQ ID NO: 815207 - DNA, 22 bp, Artificial Sequence
  chemically synthesized
gatatcagacactgccatgttg

SEQ ID NO: 815208 - DNA, 22 bp, Artificial Sequence
  chemically synthesized
tgatatcagacactgccatgtt

SEQ ID NO: 815209 - DNA, 22 bp, Artificial Sequence
  chemically synthesized
ctttgatatcagacactgccat

SEQ ID NO: 815210 - DNA, 22 bp, Artificial Sequence
  chemically synthesized
gaaactgcaacatggcagtgtc

SEQ ID NO: 815211 - DNA, 22 bp, Artificial Sequence
  chemically synthesized
gctttgatatcagacactgcca

SEQ ID NO: 815212 - DNA, 22 bp, Artificial Sequence
  chemically synthesized
aaactgcaacatggcagtgtct

SEQ ID NO: 815213 - DNA, 22 bp, Artificial Sequence
  chemically synthesized
caacatggcagtgtctgatatc

SEQ ID NO: 815214 - DNA, 22 bp, Artificial Sequence
  chemically synthesized
aaagaaatttgctttgatatca

SEQ ID NO: 815215 - DNA, 22 bp, Artificial Sequence
  chemically synthesized
gaaagaaatttgctttgatatc

SEQ ID NO: 815216 - DNA, 22 bp, Artificial Sequence
  chemically synthesized
atatcaaagcaaatttctttca

SEQ ID NO: 815217 - DNA, 22 bp, Artificial Sequence
  chemically synthesized
aataagatataaaatgtacttg

SEQ ID NO: 815218 - DNA, 22 bp, Artificial Sequence
  chemically synthesized
aatgttaaataagatataaaat

SEQ ID NO: 815219 - DNA, 22 bp, Artificial Sequence
  chemically synthesized
ctttcaagtacattttatatct

SEQ ID NO: 815220 - DNA, 22 bp, Artificial Sequence
  chemically synthesized
tttcaagtacattttatatctt

SEQ ID NO: 815221 - DNA, 22 bp, Artificial Sequence
  chemically synthesized
ttgaatgttaaataagatataa

SEQ ID NO: 815222 - DNA, 22 bp, Artificial Sequence
  chemically synthesized
tcaagtacattttatatcttat

SEQ ID NO: 815223 - DNA, 22 bp, Artificial Sequence
  chemically synthesized
caagtacattttatatcttatt

SEQ ID NO: 815224 - DNA, 22 bp, Artificial Sequence
  chemically synthesized
aagtacattttatatcttattt

SEQ ID NO: 815225 - DNA, 22 bp, Artificial Sequence
  chemically synthesized
aactgttgaatgttaaataaga

SEQ ID NO: 815226 - DNA, 22 bp, Artificial Sequence
  chemically synthesized
aaactgttgaatgttaaataag

SEQ ID NO: 815227 - DNA, 22 bp, Artificial Sequence
  chemically synthesized
taaactgttgaatgttaaataa

SEQ ID NO: 815228 - DNA, 22 bp, Artificial Sequence
  chemically synthesized
gttttaaactgttgaatgttaa

SEQ ID NO: 815229 - DNA, 22 bp, Artificial Sequence
  chemically synthesized
agttttaaactgttgaatgtta

SEQ ID NO: 815230 - DNA, 22 bp, Artificial Sequence
  chemically synthesized
tatatcttatttaacattcaac

SEQ ID NO: 815231 - DNA, 22 bp, Artificial Sequence
  chemically synthesized
tagttttaaactgttgaatgtt

SEQ ID NO: 815232 - DNA, 22 bp, Artificial Sequence
  chemically synthesized
atatcttatttaacattcaaca

SEQ ID NO: 815233 - DNA, 22 bp, Artificial Sequence
  chemically synthesized
tatcttatttaacattcaacag

SEQ ID NO: 815234 - DNA, 22 bp, Artificial Sequence
  chemically synthesized
atttaacattcaacagtttaaa

SEQ ID NO: 815235 - DNA, 22 bp, Artificial Sequence
  chemically synthesized
tttaacattcaacagtttaaaa

SEQ ID NO: 815236 - DNA, 22 bp, Artificial Sequence
  chemically synthesized
aacattcaacagtttaaaacta

SEQ ID NO: 815237 - DNA, 22 bp, Artificial Sequence
  chemically synthesized
acattcaacagtttaaaactaa

SEQ ID NO: 815238 - DNA, 22 bp, Artificial Sequence
  chemically synthesized
gtaataaaatctttagttttaa

SEQ ID NO: 815239 - DNA, 22 bp, Artificial Sequence
  chemically synthesized
aattagtaataaaatctttagt

SEQ ID NO: 815240 - DNA, 22 bp, Artificial Sequence
  chemically synthesized
aacagtttaaaactaaagattt

SEQ ID NO: 815241 - DNA, 22 bp, Artificial Sequence
  chemically synthesized
aaattagtaataaaatctttag

SEQ ID NO: 815242 - DNA, 22 bp, Artificial Sequence
  chemically synthesized
aaaactaaagattttattacta

SEQ ID NO: 815243 - DNA, 22 bp, Artificial Sequence
  chemically synthesized
aaactaaagattttattactaa

SEQ ID NO: 815244 - DNA, 22 bp, Artificial Sequence
  chemically synthesized
gaagaatatttaaattagtaat

SEQ ID NO: 815245 - DNA, 22 bp, Artificial Sequence
  chemically synthesized
ggaagaatatttaaattagtaa

SEQ ID NO: 815246 - DNA, 22 bp, Artificial Sequence
  chemically synthesized
aagattttattactaatttaaa

SEQ ID NO: 815247 - DNA, 22 bp, Artificial Sequence
  chemically synthesized
tacacttggaagaatatttaaa

SEQ ID NO: 815248 - DNA, 22 bp, Artificial Sequence
  chemically synthesized
gtacacttggaagaatatttaa

SEQ ID NO: 815249 - DNA, 22 bp, Artificial Sequence
  chemically synthesized
tgtacacttggaagaatattta

SEQ ID NO: 815250 - DNA, 22 bp, Artificial Sequence
  chemically synthesized
tattactaatttaaatattctt

SEQ ID NO: 815251 - DNA, 22 bp, Artificial Sequence
  chemically synthesized
ttgtacacttggaagaatattt

SEQ ID NO: 815252 - DNA, 22 bp, Artificial Sequence
  chemically synthesized
attactaatttaaatattcttc

SEQ ID NO: 815253 - DNA, 22 bp, Artificial Sequence
  chemically synthesized
ttactaatttaaatattcttcc

SEQ ID NO: 815254 - DNA, 22 bp, Artificial Sequence
  chemically synthesized
ctaatttaaatattcttccaag

SEQ ID NO: 815255 - DNA, 22 bp, Artificial Sequence
  chemically synthesized
atttaaatattcttccaagtgt

SEQ ID NO: 815256 - DNA, 22 bp, Artificial Sequence
  chemically synthesized
ggcaaaatttttgtacacttgg

SEQ ID NO: 815257 - DNA, 22 bp, Artificial Sequence
  chemically synthesized
aaatattcttccaagtgtacaa

SEQ ID NO: 815258 - DNA, 22 bp, Artificial Sequence
  chemically synthesized
aatattcttccaagtgtacaaa

SEQ ID NO: 815259 - DNA, 22 bp, Artificial Sequence
  chemically synthesized
ttccaagtgtacaaaaattttg

SEQ ID NO: 815260 - DNA, 22 bp, Artificial Sequence
  chemically synthesized
ccaagtgtacaaaaattttgcc

SEQ ID NO: 815261 - DNA, 22 bp, Artificial Sequence
  chemically synthesized
caagtgtacaaaaattttgcct

SEQ ID NO: 815262 - DNA, 22 bp, Artificial Sequence
  chemically synthesized
agtcacatggagaaacctaggc

SEQ ID NO: 815263 - DNA, 22 bp, Artificial Sequence
  chemically synthesized
cagtcacatggagaaacctagg

SEQ ID NO: 815264 - DNA, 22 bp, Artificial Sequence
  chemically synthesized
tcagtcacatggagaaacctag

SEQ ID NO: 815265 - DNA, 22 bp, Artificial Sequence
  chemically synthesized
agactttcagtcacatggagaa

SEQ ID NO: 815266 - DNA, 22 bp, Artificial Sequence
  chemically synthesized
tgcctaggtttctccatgtgac

SEQ ID NO: 815267 - DNA, 22 bp, Artificial Sequence
  chemically synthesized
gcctaggtttctccatgtgact

SEQ ID NO: 815268 - DNA, 22 bp, Artificial Sequence
  chemically synthesized
cctaggtttctccatgtgactg

SEQ ID NO: 815269 - DNA, 22 bp, Artificial Sequence
  chemically synthesized
cactgagactttcagtcacatg

SEQ ID NO: 815270 - DNA, 22 bp, Artificial Sequence
  chemically synthesized
ggtttctccatgtgactgaaag

SEQ ID NO: 815271 - DNA, 22 bp, Artificial Sequence
  chemically synthesized
cctgcactgagactttcagtca

SEQ ID NO: 815272 - DNA, 22 bp, Artificial Sequence
  chemically synthesized
ctccatgtgactgaaagtctca

SEQ ID NO: 815273 - DNA, 22 bp, Artificial Sequence
  chemically synthesized
tccatgtgactgaaagtctcag

SEQ ID NO: 815274 - DNA, 22 bp, Artificial Sequence
  chemically synthesized
catgtgactgaaagtctcagtg

SEQ ID NO: 815275 - DNA, 22 bp, Artificial Sequence
  chemically synthesized
atgcattgcctgcactgagact

SEQ ID NO: 815276 - DNA, 22 bp, Artificial Sequence
  chemically synthesized
aaagtctcagtgcaggcaatgc

SEQ ID NO: 815277 - DNA, 22 bp, Artificial Sequence
  chemically synthesized
tgaaacactaatgcattgcctg

SEQ ID NO: 815278 - DNA, 22 bp, Artificial Sequence
  chemically synthesized
ctatgaaacactaatgcattgc

SEQ ID NO: 815279 - DNA, 22 bp, Artificial Sequence
  chemically synthesized
actatgaaacactaatgcattg

SEQ ID NO: 815280 - DNA, 22 bp, Artificial Sequence
  chemically synthesized
tactatgaaacactaatgcatt

SEQ ID NO: 815281 - DNA, 22 bp, Artificial Sequence
  chemically synthesized
agtgcaggcaatgcattagtgt

SEQ ID NO: 815282 - DNA, 22 bp, Artificial Sequence
  chemically synthesized
gacaccattttactatgaaaca

SEQ ID NO: 815283 - DNA, 22 bp, Artificial Sequence
  chemically synthesized
aggttagacaccattttactat

SEQ ID NO: 815284 - DNA, 22 bp, Artificial Sequence
  chemically synthesized
gtgtttcatagtaaaatggtgt

SEQ ID NO: 815285 - DNA, 22 bp, Artificial Sequence
  chemically synthesized
acagttcaggttagacaccatt

SEQ ID NO: 815286 - DNA, 22 bp, Artificial Sequence
  chemically synthesized
tcacagttcaggttagacacca

SEQ ID NO: 815287 - DNA, 22 bp, Artificial Sequence
  chemically synthesized
ctcacagttcaggttagacacc

SEQ ID NO: 815288 - DNA, 22 bp, Artificial Sequence
  chemically synthesized
catagtaaaatggtgtctaacc

SEQ ID NO: 815289 - DNA, 22 bp, Artificial Sequence
  chemically synthesized
atagtaaaatggtgtctaacct

SEQ ID NO: 815290 - DNA, 22 bp, Artificial Sequence
  chemically synthesized
catcatttctcacagttcaggt

SEQ ID NO: 815291 - DNA, 22 bp, Artificial Sequence
  chemically synthesized
attacatcatttctcacagttc

SEQ ID NO: 815292 - DNA, 22 bp, Artificial Sequence
  chemically synthesized
tgattacatcatttctcacagt

SEQ ID NO: 815293 - DNA, 22 bp, Artificial Sequence
  chemically synthesized
ctgattacatcatttctcacag

SEQ ID NO: 815294 - DNA, 22 bp, Artificial Sequence
  chemically synthesized
tctgattacatcatttctcaca

SEQ ID NO: 815295 - DNA, 22 bp, Artificial Sequence
  chemically synthesized
acctgaactgtgagaaatgatg

SEQ ID NO: 815296 - DNA, 22 bp, Artificial Sequence
  chemically synthesized
aactgtgagaaatgatgtaatc

SEQ ID NO: 815297 - DNA, 22 bp, Artificial Sequence
  chemically synthesized
tggaaagttttctgattacatc

SEQ ID NO: 815298 - DNA, 22 bp, Artificial Sequence
  chemically synthesized
tgtggaaagttttctgattaca

SEQ ID NO: 815299 - DNA, 22 bp, Artificial Sequence
  chemically synthesized
tgagaaatgatgtaatcagaaa

SEQ ID NO: 815300 - DNA, 22 bp, Artificial Sequence
  chemically synthesized
ggtaggagggattctgtggaaa

SEQ ID NO: 815301 - DNA, 22 bp, Artificial Sequence
  chemically synthesized
aggtaggagggattctgtggaa

SEQ ID NO: 815302 - DNA, 22 bp, Artificial Sequence
  chemically synthesized
taggtaggagggattctgtgga

SEQ ID NO: 815303 - DNA, 22 bp, Artificial Sequence
  chemically synthesized
ttaggtaggagggattctgtgg

SEQ ID NO: 815304 - DNA, 22 bp, Artificial Sequence
  chemically synthesized
tttaggtaggagggattctgtg

SEQ ID NO: 815305 - DNA, 22 bp, Artificial Sequence
  chemically synthesized
tagctttttaggtaggagggat

SEQ ID NO: 815306 - DNA, 22 bp, Artificial Sequence
  chemically synthesized
tccacagaatccctcctaccta

SEQ ID NO: 815307 - DNA, 22 bp, Artificial Sequence
  chemically synthesized
ccacagaatccctcctacctaa

SEQ ID NO: 815308 - DNA, 22 bp, Artificial Sequence
  chemically synthesized
cacagaatccctcctacctaaa

SEQ ID NO: 815309 - DNA, 22 bp, Artificial Sequence
  chemically synthesized
taactatagctttttaggtagg

SEQ ID NO: 815310 - DNA, 22 bp, Artificial Sequence
  chemically synthesized
tgtaactatagctttttaggta

SEQ ID NO: 815311 - DNA, 22 bp, Artificial Sequence
  chemically synthesized
aaaaagttctgtaactatagct

SEQ ID NO: 815312 - DNA, 22 bp, Artificial Sequence
  chemically synthesized
gaaaaagttctgtaactatagc

SEQ ID NO: 815313 - DNA, 22 bp, Artificial Sequence
  chemically synthesized
ctacctaaaaagctatagttac

SEQ ID NO: 815314 - DNA, 22 bp, Artificial Sequence
  chemically synthesized
tgaaaaagttctgtaactatag

SEQ ID NO: 815315 - DNA, 22 bp, Artificial Sequence
  chemically synthesized
cctaaaaagctatagttacaga

SEQ ID NO: 815316 - DNA, 22 bp, Artificial Sequence
  chemically synthesized
aaaagctatagttacagaactt

SEQ ID NO: 815317 - DNA, 22 bp, Artificial Sequence
  chemically synthesized
atatctttgaaaaagttctgta

SEQ ID NO: 815318 - DNA, 22 bp, Artificial Sequence
  chemically synthesized
tagttacagaactttttcaaag

SEQ ID NO: 815319 - DNA, 22 bp, Artificial Sequence
  chemically synthesized
cagaactttttcaaagatatga

SEQ ID NO: 815320 - DNA, 22 bp, Artificial Sequence
  chemically synthesized
tggagaaaaagtatctcatatc

SEQ ID NO: 815321 - DNA, 22 bp, Artificial Sequence
  chemically synthesized
tttcaaagatatgagatacttt

SEQ ID NO: 815322 - DNA, 22 bp, Artificial Sequence
  chemically synthesized
ggttatggagaaaaagtatctc

SEQ ID NO: 815323 - DNA, 22 bp, Artificial Sequence
  chemically synthesized
ttcaaagatatgagatactttt

SEQ ID NO: 815324 - DNA, 22 bp, Artificial Sequence
  chemically synthesized
gggttatggagaaaaagtatct

SEQ ID NO: 815325 - DNA, 22 bp, Artificial Sequence
  chemically synthesized
tcaaagatatgagatacttttt

SEQ ID NO: 815326 - DNA, 22 bp, Artificial Sequence
  chemically synthesized
caaagatatgagatactttttc

SEQ ID NO: 815327 - DNA, 22 bp, Artificial Sequence
  chemically synthesized
aaagatatgagatactttttct

SEQ ID NO: 815328 - DNA, 22 bp, Artificial Sequence
  chemically synthesized
ataatgtcaatatttgggttat

SEQ ID NO: 815329 - DNA, 22 bp, Artificial Sequence
  chemically synthesized
tttctccataacccaaatattg

SEQ ID NO: 815330 - DNA, 22 bp, Artificial Sequence
  chemically synthesized
ttctccataacccaaatattga

SEQ ID NO: 815331 - DNA, 22 bp, Artificial Sequence
  chemically synthesized
tctccataacccaaatattgac

SEQ ID NO: 815332 - DNA, 22 bp, Artificial Sequence
  chemically synthesized
ctccataacccaaatattgaca

SEQ ID NO: 815333 - DNA, 22 bp, Artificial Sequence
  chemically synthesized
tccataacccaaatattgacat

SEQ ID NO: 815334 - DNA, 22 bp, Artificial Sequence
  chemically synthesized
cataacccaaatattgacatta

SEQ ID NO: 815335 - DNA, 22 bp, Artificial Sequence
  chemically synthesized
aaaaggaaagattaataatgtc

SEQ ID NO: 815336 - DNA, 22 bp, Artificial Sequence
  chemically synthesized
aaaaaggaaagattaataatgt

SEQ ID NO: 815337 - DNA, 22 bp, Artificial Sequence
  chemically synthesized
atcttaaaaaggaaagattaat

SEQ ID NO: 815338 - DNA, 22 bp, Artificial Sequence
  chemically synthesized
aactcatcttaaaaaggaaaga

SEQ ID NO: 815339 - DNA, 22 bp, Artificial Sequence
  chemically synthesized
acattattaatctttccttttt

SEQ ID NO: 815340 - DNA, 22 bp, Artificial Sequence
  chemically synthesized
tattaaactcatcttaaaaagg

SEQ ID NO: 815341 - DNA, 22 bp, Artificial Sequence
  chemically synthesized
ttaatctttcctttttaagatg

SEQ ID NO: 815342 - DNA, 22 bp, Artificial Sequence
  chemically synthesized
ttatattaaactcatcttaaaa

SEQ ID NO: 815343 - DNA, 22 bp, Artificial Sequence
  chemically synthesized
atctttcctttttaagatgagt

SEQ ID NO: 815344 - DNA, 22 bp, Artificial Sequence
  chemically synthesized
ttgttatattaaactcatctta

SEQ ID NO: 815345 - DNA, 22 bp, Artificial Sequence
  chemically synthesized
gttgttatattaaactcatctt

SEQ ID NO: 815346 - DNA, 22 bp, Artificial Sequence
  chemically synthesized
tgttgttatattaaactcatct

SEQ ID NO: 815347 - DNA, 22 bp, Artificial Sequence
  chemically synthesized
ttgttgttatattaaactcatc

SEQ ID NO: 815348 - DNA, 22 bp, Artificial Sequence
  chemically synthesized
tcctttttaagatgagtttaat

SEQ ID NO: 815349 - DNA, 22 bp, Artificial Sequence
  chemically synthesized
cctttttaagatgagtttaata

SEQ ID NO: 815350 - DNA, 22 bp, Artificial Sequence
  chemically synthesized
ctttttaagatgagtttaatat

SEQ ID NO: 815351 - DNA, 22 bp, Artificial Sequence
  chemically synthesized
acttttgttgttatattaaact

SEQ ID NO: 815352 - DNA, 22 bp, Artificial Sequence
  chemically synthesized
cacttttgttgttatattaaac

SEQ ID NO: 815353 - DNA, 22 bp, Artificial Sequence
  chemically synthesized
tcacttttgttgttatattaaa

SEQ ID NO: 815354 - DNA, 22 bp, Artificial Sequence
  chemically synthesized
tttaagatgagtttaatataac

SEQ ID NO: 815355 - DNA, 22 bp, Artificial Sequence
  chemically synthesized
ttaagatgagtttaatataaca

SEQ ID NO: 815356 - DNA, 22 bp, Artificial Sequence
  chemically synthesized
taagatgagtttaatataacaa

SEQ ID NO: 815357 - DNA, 22 bp, Artificial Sequence
  chemically synthesized
aagatgagtttaatataacaac

SEQ ID NO: 815358 - DNA, 22 bp, Artificial Sequence
  chemically synthesized
agatgagtttaatataacaaca

SEQ ID NO: 815359 - DNA, 22 bp, Artificial Sequence
  chemically synthesized
aatataacaacaaaagtgaaaa

SEQ ID NO: 815360 - DNA, 22 bp, Artificial Sequence
  chemically synthesized
atataacaacaaaagtgaaaat

SEQ ID NO: 815361 - DNA, 22 bp, Artificial Sequence
  chemically synthesized
tgacaggatggcattttcactt

SEQ ID NO: 815362 - DNA, 22 bp, Artificial Sequence
  chemically synthesized
caactatgacaggatggcattt

SEQ ID NO: 815363 - DNA, 22 bp, Artificial Sequence
  chemically synthesized
aaaaactacaactatgacagga

SEQ ID NO: 815364 - DNA, 22 bp, Artificial Sequence
  chemically synthesized
gtctcaaaaactacaactatga

SEQ ID NO: 815365 - DNA, 22 bp, Artificial Sequence
  chemically synthesized
tgttggtctcaaaaactacaac

SEQ ID NO: 815366 - DNA, 22 bp, Artificial Sequence
  chemically synthesized
gtgttggtctcaaaaactacaa

SEQ ID NO: 815367 - DNA, 22 bp, Artificial Sequence
  chemically synthesized
tcatagttgtagtttttgagac

SEQ ID NO: 815368 - DNA, 22 bp, Artificial Sequence
  chemically synthesized
catggtatttgtgttggtctca

SEQ ID NO: 815369 - DNA, 22 bp, Artificial Sequence
  chemically synthesized
tagtttttgagaccaacacaaa

SEQ ID NO: 815370 - DNA, 22 bp, Artificial Sequence
  chemically synthesized
cgtagtattccatggtatttgt

SEQ ID NO: 815371 - DNA, 22 bp, Artificial Sequence
  chemically synthesized
ttgagaccaacacaaataccat

SEQ ID NO: 815372 - DNA, 22 bp, Artificial Sequence
  chemically synthesized
tgagaccaacacaaataccatg

SEQ ID NO: 815373 - DNA, 22 bp, Artificial Sequence
  chemically synthesized
gagaccaacacaaataccatgg

SEQ ID NO: 815374 - DNA, 22 bp, Artificial Sequence
  chemically synthesized
agaccaacacaaataccatgga

SEQ ID NO: 815375 - DNA, 22 bp, Artificial Sequence
  chemically synthesized
tggctacgtagtattccatggt

SEQ ID NO: 815376 - DNA, 22 bp, Artificial Sequence
  chemically synthesized
atggctacgtagtattccatgg

SEQ ID NO: 815377 - DNA, 22 bp, Artificial Sequence
  chemically synthesized
tatggctacgtagtattccatg

SEQ ID NO: 815378 - DNA, 22 bp, Artificial Sequence
  chemically synthesized
ttatggctacgtagtattccat

SEQ ID NO: 815379 - DNA, 22 bp, Artificial Sequence
  chemically synthesized
tttatggctacgtagtattcca

SEQ ID NO: 815380 - DNA, 22 bp, Artificial Sequence
  chemically synthesized
ttttatggctacgtagtattcc

SEQ ID NO: 815381 - DNA, 22 bp, Artificial Sequence
  chemically synthesized
tttttatggctacgtagtattc

SEQ ID NO: 815382 - DNA, 22 bp, Artificial Sequence
  chemically synthesized
tttttttatggctacgtagtat

SEQ ID NO: 815383 - DNA, 22 bp, Artificial Sequence
  chemically synthesized
attctttttttatggctacgta

SEQ ID NO: 815384 - DNA, 22 bp, Artificial Sequence
  chemically synthesized
cgtagccataaaaaaagaatga

SEQ ID NO: 815385 - DNA, 22 bp, Artificial Sequence
  chemically synthesized
caaaggacatgatctcattctt

SEQ ID NO: 815386 - DNA, 22 bp, Artificial Sequence
  chemically synthesized
tgtccctgcaaaggacatgatc

SEQ ID NO: 815387 - DNA, 22 bp, Artificial Sequence
  chemically synthesized
cagatccatctatgtccctgca

SEQ ID NO: 815388 - DNA, 22 bp, Artificial Sequence
  chemically synthesized
tgcagggacatagatggatctg

SEQ ID NO: 815389 - DNA, 22 bp, Artificial Sequence
  chemically synthesized
gcagggacatagatggatctgg

SEQ ID NO: 815390 - DNA, 22 bp, Artificial Sequence
  chemically synthesized
cagggacatagatggatctgga

SEQ ID NO: 815391 - DNA, 22 bp, Artificial Sequence
  chemically synthesized
ataaggacaatggcctccagat

SEQ ID NO: 815392 - DNA, 22 bp, Artificial Sequence
  chemically synthesized
gataaggacaatggcctccaga

SEQ ID NO: 815393 - DNA, 22 bp, Artificial Sequence
  chemically synthesized
gtttgataaggacaatggcctc

SEQ ID NO: 815394 - DNA, 22 bp, Artificial Sequence
  chemically synthesized
tattagtttgataaggacaatg

SEQ ID NO: 815395 - DNA, 22 bp, Artificial Sequence
  chemically synthesized
ctgtattagtttgataaggaca

SEQ ID NO: 815396 - DNA, 22 bp, Artificial Sequence
  chemically synthesized
ttcctgtattagtttgataagg

SEQ ID NO: 815397 - DNA, 22 bp, Artificial Sequence
  chemically synthesized
gaggccattgtccttatcaaac

SEQ ID NO: 815398 - DNA, 22 bp, Artificial Sequence
  chemically synthesized
gttcctgtattagtttgataag

SEQ ID NO: 815399 - DNA, 22 bp, Artificial Sequence
  chemically synthesized
tgttcctgtattagtttgataa

SEQ ID NO: 815400 - DNA, 22 bp, Artificial Sequence
  chemically synthesized
ttgttcctgtattagtttgata

SEQ ID NO: 815401 - DNA, 22 bp, Artificial Sequence
  chemically synthesized
tttgttcctgtattagtttgat

SEQ ID NO: 815402 - DNA, 22 bp, Artificial Sequence
  chemically synthesized
gttttttgttcctgtattagtt

SEQ ID NO: 815403 - DNA, 22 bp, Artificial Sequence
  chemically synthesized
ggttttttgttcctgtattagt

SEQ ID NO: 815404 - DNA, 22 bp, Artificial Sequence
  chemically synthesized
tccttatcaaactaatacagga

SEQ ID NO: 815405 - DNA, 22 bp, Artificial Sequence
  chemically synthesized
atcaaactaatacaggaacaaa

SEQ ID NO: 815406 - DNA, 22 bp, Artificial Sequence
  chemically synthesized
tcaaactaatacaggaacaaaa

SEQ ID NO: 815407 - DNA, 22 bp, Artificial Sequence
  chemically synthesized
atacaggaacaaaaaaccaaat

SEQ ID NO: 815408 - DNA, 22 bp, Artificial Sequence
  chemically synthesized
taaatgagaacatggggtattt

SEQ ID NO: 815409 - DNA, 22 bp, Artificial Sequence
  chemically synthesized
ataaatgagaacatggggtatt

SEQ ID NO: 815410 - DNA, 22 bp, Artificial Sequence
  chemically synthesized
ccacttataaatgagaacatgg

SEQ ID NO: 815411 - DNA, 22 bp, Artificial Sequence
  chemically synthesized
gctcccacttataaatgagaac

SEQ ID NO: 815412 - DNA, 22 bp, Artificial Sequence
  chemically synthesized
agctcccacttataaatgagaa

SEQ ID NO: 815413 - DNA, 22 bp, Artificial Sequence
  chemically synthesized
atcatttagctcccacttataa

SEQ ID NO: 815414 - DNA, 22 bp, Artificial Sequence
  chemically synthesized
tcatcatttagctcccacttat

SEQ ID NO: 815415 - DNA, 22 bp, Artificial Sequence
  chemically synthesized
tcatttataagtgggagctaaa

SEQ ID NO: 815416 - DNA, 22 bp, Artificial Sequence
  chemically synthesized
atttataagtgggagctaaatg

SEQ ID NO: 815417 - DNA, 22 bp, Artificial Sequence
  chemically synthesized
ataagtgggagctaaatgatga

SEQ ID NO: 815418 - DNA, 22 bp, Artificial Sequence
  chemically synthesized
taagtgggagctaaatgatgag

SEQ ID NO: 815419 - DNA, 22 bp, Artificial Sequence
  chemically synthesized
cgtgtccatgtgttctcatcat

SEQ ID NO: 815420 - DNA, 22 bp, Artificial Sequence
  chemically synthesized
tacgtgtccatgtgttctcatc

SEQ ID NO: 815421 - DNA, 22 bp, Artificial Sequence
  chemically synthesized
ccctctacgtgtccatgtgttc

SEQ ID NO: 815422 - DNA, 22 bp, Artificial Sequence
  chemically synthesized
ttcccctctacgtgtccatgtg

SEQ ID NO: 815423 - DNA, 22 bp, Artificial Sequence
  chemically synthesized
aatgatgagaacacatggacac

SEQ ID NO: 815424 - DNA, 22 bp, Artificial Sequence
  chemically synthesized
gcatgtgttgttcccctctacg

SEQ ID NO: 815425 - DNA, 22 bp, Artificial Sequence
  chemically synthesized
atagtccctagcatgtgttgtt

SEQ ID NO: 815426 - DNA, 22 bp, Artificial Sequence
  chemically synthesized
taatagtccctagcatgtgttg

SEQ ID NO: 815427 - DNA, 22 bp, Artificial Sequence
  chemically synthesized
cacactctaatagtccctagca

SEQ ID NO: 815428 - DNA, 22 bp, Artificial Sequence
  chemically synthesized
ccaccctccacactctaatagt

SEQ ID NO: 815429 - DNA, 22 bp, Artificial Sequence
  chemically synthesized
ctcccaccctccacactctaat

SEQ ID NO: 815430 - DNA, 22 bp, Artificial Sequence
  chemically synthesized
gctcctcccaccctccacactc

SEQ ID NO: 815431 - DNA, 22 bp, Artificial Sequence
  chemically synthesized
gggactattagagtgtggaggg

SEQ ID NO: 815432 - DNA, 22 bp, Artificial Sequence
  chemically synthesized
tcgctcctcccaccctccacac

SEQ ID NO: 815433 - DNA, 22 bp, Artificial Sequence
  chemically synthesized
atcctctcgctcctcccaccct

SEQ ID NO: 815434 - DNA, 22 bp, Artificial Sequence
  chemically synthesized
ttagagtgtggagggtgggagg

SEQ ID NO: 815435 - DNA, 22 bp, Artificial Sequence
  chemically synthesized
ctgatcctctcgctcctcccac

SEQ ID NO: 815436 - DNA, 22 bp, Artificial Sequence
  chemically synthesized
gagtgtggagggtgggaggagc

SEQ ID NO: 815437 - DNA, 22 bp, Artificial Sequence
  chemically synthesized
cctgatcctctcgctcctccca

SEQ ID NO: 815438 - DNA, 22 bp, Artificial Sequence
  chemically synthesized
tcctgatcctctcgctcctccc

SEQ ID NO: 815439 - DNA, 22 bp, Artificial Sequence
  chemically synthesized
actttcctgatcctctcgctcc

SEQ ID NO: 815440 - DNA, 22 bp, Artificial Sequence
  chemically synthesized
gttgactttcctgatcctctcg

SEQ ID NO: 815441 - DNA, 22 bp, Artificial Sequence
  chemically synthesized
gtacccgttagttgactttcct

SEQ ID NO: 815442 - DNA, 22 bp, Artificial Sequence
  chemically synthesized
atcctggtacccgttagttgac

SEQ ID NO: 815443 - DNA, 22 bp, Artificial Sequence
  chemically synthesized
ggtattaatcctggtacccgtt

SEQ ID NO: 815444 - DNA, 22 bp, Artificial Sequence
  chemically synthesized
atcacctaggtattaatcctgg

SEQ ID NO: 815445 - DNA, 22 bp, Artificial Sequence
  chemically synthesized
catcacctaggtattaatcctg

SEQ ID NO: 815446 - DNA, 22 bp, Artificial Sequence
  chemically synthesized
tttcatcacctaggtattaatc

SEQ ID NO: 815447 - DNA, 22 bp, Artificial Sequence
  chemically synthesized
acgggtaccaggattaatacct

SEQ ID NO: 815448 - DNA, 22 bp, Artificial Sequence
  chemically synthesized
tacagattatttcatcacctag

SEQ ID NO: 815449 - DNA, 22 bp, Artificial Sequence
  chemically synthesized
ttgtacagattatttcatcacc

SEQ ID NO: 815450 - DNA, 22 bp, Artificial Sequence
  chemically synthesized
atacctaggtgatgaaataatc

SEQ ID NO: 815451 - DNA, 22 bp, Artificial Sequence
  chemically synthesized
ggtgatgaaataatctgtacaa

SEQ ID NO: 815452 - DNA, 22 bp, Artificial Sequence
  chemically synthesized
tgtcatgggggtctgttgtaca

SEQ ID NO: 815453 - DNA, 22 bp, Artificial Sequence
  chemically synthesized
gtgtcatgggggtctgttgtac

SEQ ID NO: 815454 - DNA, 22 bp, Artificial Sequence
  chemically synthesized
tacaacagacccccatgacaca

SEQ ID NO: 815455 - DNA, 22 bp, Artificial Sequence
  chemically synthesized
cataggtaaacttgtgtcatgg

SEQ ID NO: 815456 - DNA, 22 bp, Artificial Sequence
  chemically synthesized
ttacataggtaaacttgtgtca

SEQ ID NO: 815457 - DNA, 22 bp, Artificial Sequence
  chemically synthesized
gttacataggtaaacttgtgtc

SEQ ID NO: 815458 - DNA, 22 bp, Artificial Sequence
  chemically synthesized
aggggtacatgtgcaggtttgt

SEQ ID NO: 815459 - DNA, 22 bp, Artificial Sequence
  chemically synthesized
acctatgtaacaaacctgcaca

SEQ ID NO: 815460 - DNA, 22 bp, Artificial Sequence
  chemically synthesized
cctatgtaacaaacctgcacat

SEQ ID NO: 815461 - DNA, 22 bp, Artificial Sequence
  chemically synthesized
agttcaggggtacatgtgcagg

SEQ ID NO: 815462 - DNA, 22 bp, Artificial Sequence
  chemically synthesized
aagttcaggggtacatgtgcag

SEQ ID NO: 815463 - DNA, 22 bp, Artificial Sequence
  chemically synthesized
taagttcaggggtacatgtgca

SEQ ID NO: 815464 - DNA, 22 bp, Artificial Sequence
  chemically synthesized
tgtaacaaacctgcacatgtac

SEQ ID NO: 815465 - DNA, 22 bp, Artificial Sequence
  chemically synthesized
ttaagttcaggggtacatgtgc

SEQ ID NO: 815466 - DNA, 22 bp, Artificial Sequence
  chemically synthesized
acttttaagttcaggggtacat

SEQ ID NO: 815467 - DNA, 22 bp, Artificial Sequence
  chemically synthesized
cacttttaagttcaggggtaca

SEQ ID NO: 815468 - DNA, 22 bp, Artificial Sequence
  chemically synthesized
tcacttttaagttcaggggtac

SEQ ID NO: 815469 - DNA, 22 bp, Artificial Sequence
  chemically synthesized
ttcacttttaagttcaggggta

SEQ ID NO: 815470 - DNA, 22 bp, Artificial Sequence
  chemically synthesized
tttcacttttaagttcaggggt

SEQ ID NO: 815471 - DNA, 22 bp, Artificial Sequence
  chemically synthesized
ttttttcacttttaagttcagg

SEQ ID NO: 815472 - DNA, 22 bp, Artificial Sequence
  chemically synthesized
attttttcacttttaagttcag

SEQ ID NO: 815473 - DNA, 22 bp, Artificial Sequence
  chemically synthesized
cacatgtacccctgaacttaaa

SEQ ID NO: 815474 - DNA, 22 bp, Artificial Sequence
  chemically synthesized
tattttttcacttttaagttca

SEQ ID NO: 815475 - DNA, 22 bp, Artificial Sequence
  chemically synthesized
ttattttttcacttttaagttc

SEQ ID NO: 815476 - DNA, 22 bp, Artificial Sequence
  chemically synthesized
tttttattttttcacttttaag

SEQ ID NO: 815477 - DNA, 22 bp, Artificial Sequence
  chemically synthesized
atttttattttttcacttttaa

SEQ ID NO: 815478 - DNA, 22 bp, Artificial Sequence
  chemically synthesized
tatttttattttttcactttta

SEQ ID NO: 815479 - DNA, 22 bp, Artificial Sequence
  chemically synthesized
ttatttttattttttcactttt

SEQ ID NO: 815480 - DNA, 22 bp, Artificial Sequence
  chemically synthesized
tttttatttttattttttcact

SEQ ID NO: 815481 - DNA, 22 bp, Artificial Sequence
  chemically synthesized
atttttatttttattttttcac

SEQ ID NO: 815482 - DNA, 22 bp, Artificial Sequence
  chemically synthesized
tatttttatttttattttttca

SEQ ID NO: 815483 - DNA, 22 bp, Artificial Sequence
  chemically synthesized
ttatttttatttttattttttc

SEQ ID NO: 815484 - DNA, 22 bp, Artificial Sequence
  chemically synthesized
aacttaaaagtgaaaaaataaa

SEQ ID NO: 815485 - DNA, 22 bp, Artificial Sequence
  chemically synthesized
tttatttttatttttatttttt

SEQ ID NO: 815486 - DNA, 22 bp, Artificial Sequence
  chemically synthesized
ttttatttttatttttattttt

SEQ ID NO: 815487 - DNA, 22 bp, Artificial Sequence
  chemically synthesized
ttttttatttttatttttattt

SEQ ID NO: 815488 - DNA, 22 bp, Artificial Sequence
  chemically synthesized
cttttttatttttatttttatt

SEQ ID NO: 815489 - DNA, 22 bp, Artificial Sequence
  chemically synthesized
aaaagtgaaaaaataaaaataa

SEQ ID NO: 815490 - DNA, 22 bp, Artificial Sequence
  chemically synthesized
tcttttttatttttatttttat

SEQ ID NO: 815491 - DNA, 22 bp, Artificial Sequence
  chemically synthesized
aaagtgaaaaaataaaaataaa

SEQ ID NO: 815492 - DNA, 22 bp, Artificial Sequence
  chemically synthesized
tacattttcttttttattttta

SEQ ID NO: 815493 - DNA, 22 bp, Artificial Sequence
  chemically synthesized
atacattttcttttttattttt

SEQ ID NO: 815494 - DNA, 22 bp, Artificial Sequence
  chemically synthesized
tttatacattttcttttttatt

SEQ ID NO: 815495 - DNA, 22 bp, Artificial Sequence
  chemically synthesized
tatttatacattttctttttta

SEQ ID NO: 815496 - DNA, 22 bp, Artificial Sequence
  chemically synthesized
ctatttatacattttctttttt

SEQ ID NO: 815497 - DNA, 22 bp, Artificial Sequence
  chemically synthesized
tctatttatacattttcttttt

SEQ ID NO: 815498 - DNA, 22 bp, Artificial Sequence
  chemically synthesized
ttctatttatacattttctttt

SEQ ID NO: 815499 - DNA, 22 bp, Artificial Sequence
  chemically synthesized
tttctatttatacattttcttt

SEQ ID NO: 815500 - DNA, 22 bp, Artificial Sequence
  chemically synthesized
attttttctatttatacatttt

SEQ ID NO: 815501 - DNA, 22 bp, Artificial Sequence
  chemically synthesized
cctgattttttctatttataca

SEQ ID NO: 815502 - DNA, 22 bp, Artificial Sequence
  chemically synthesized
tgcctgattttttctatttata

SEQ ID NO: 815503 - DNA, 22 bp, Artificial Sequence
  chemically synthesized
ctgcctgattttttctatttat

SEQ ID NO: 815504 - DNA, 22 bp, Artificial Sequence
  chemically synthesized
tttctgcctgattttttctatt

SEQ ID NO: 815505 - DNA, 22 bp, Artificial Sequence
  chemically synthesized
gtttctgcctgattttttctat

SEQ ID NO: 815506 - DNA, 22 bp, Artificial Sequence
  chemically synthesized
cttgtttctgcctgattttttc

SEQ ID NO: 815507 - DNA, 22 bp, Artificial Sequence
  chemically synthesized
acttgtttctgcctgatttttt

SEQ ID NO: 815508 - DNA, 22 bp, Artificial Sequence
  chemically synthesized
taatgcatttacttgtttctgc

SEQ ID NO: 815509 - DNA, 22 bp, Artificial Sequence
  chemically synthesized
ttgtaatgcatttacttgtttc

SEQ ID NO: 815510 - DNA, 22 bp, Artificial Sequence
  chemically synthesized
gttgtaatgcatttacttgttt

SEQ ID NO: 815511 - DNA, 22 bp, Artificial Sequence
  chemically synthesized
cacagtggcttgttgtaatgca

SEQ ID NO: 815512 - DNA, 22 bp, Artificial Sequence
  chemically synthesized
tacacagtggcttgttgtaatg

SEQ ID NO: 815513 - DNA, 22 bp, Artificial Sequence
  chemically synthesized
tctctacacagtggcttgttgt

SEQ ID NO: 815514 - DNA, 22 bp, Artificial Sequence
  chemically synthesized
caacaagccactgtgtagagac

SEQ ID NO: 815515 - DNA, 22 bp, Artificial Sequence
  chemically synthesized
taaataaaaagtgttgtctcta

SEQ ID NO: 815516 - DNA, 22 bp, Artificial Sequence
  chemically synthesized
ataaataaaaagtgttgtctct

SEQ ID NO: 815517 - DNA, 22 bp, Artificial Sequence
  chemically synthesized
tttataaataaaaagtgttgtc

SEQ ID NO: 815518 - DNA, 22 bp, Artificial Sequence
  chemically synthesized
tatttataaataaaaagtgttg

SEQ ID NO: 815519 - DNA, 22 bp, Artificial Sequence
  chemically synthesized
tgtagagacaacactttttatt

SEQ ID NO: 815520 - DNA, 22 bp, Artificial Sequence
  chemically synthesized
cctctatttataaataaaaagt

SEQ ID NO: 815521 - DNA, 22 bp, Artificial Sequence
  chemically synthesized
ttgcctctatttataaataaaa

SEQ ID NO: 815522 - DNA, 22 bp, Artificial Sequence
  chemically synthesized
attgcctctatttataaataaa

SEQ ID NO: 815523 - DNA, 22 bp, Artificial Sequence
  chemically synthesized
aaaaatcttattgcctctattt

SEQ ID NO: 815524 - DNA, 22 bp, Artificial Sequence
  chemically synthesized
caaaaatcttattgcctctatt

SEQ ID NO: 815525 - DNA, 22 bp, Artificial Sequence
  chemically synthesized
tttatttataaatagaggcaat

SEQ ID NO: 815526 - DNA, 22 bp, Artificial Sequence
  chemically synthesized
ttatttataaatagaggcaata

SEQ ID NO: 815527 - DNA, 22 bp, Artificial Sequence
  chemically synthesized
cttcaaaaatcttattgcctct

SEQ ID NO: 815528 - DNA, 22 bp, Artificial Sequence
  chemically synthesized
tatttataaatagaggcaataa

SEQ ID NO: 815529 - DNA, 22 bp, Artificial Sequence
  chemically synthesized
atttataaatagaggcaataag

SEQ ID NO: 815530 - DNA, 22 bp, Artificial Sequence
  chemically synthesized
tttataaatagaggcaataaga

SEQ ID NO: 815531 - DNA, 22 bp, Artificial Sequence
  chemically synthesized
tgctacttcaaaaatcttattg

SEQ ID NO: 815532 - DNA, 22 bp, Artificial Sequence
  chemically synthesized
ataaatagaggcaataagattt

SEQ ID NO: 815533 - DNA, 22 bp, Artificial Sequence
  chemically synthesized
taaatagaggcaataagatttt

SEQ ID NO: 815534 - DNA, 22 bp, Artificial Sequence
  chemically synthesized
ctgtgctacttcaaaaatctta

SEQ ID NO: 815535 - DNA, 22 bp, Artificial Sequence
  chemically synthesized
actgtgctacttcaaaaatctt

SEQ ID NO: 815536 - DNA, 22 bp, Artificial Sequence
  chemically synthesized
tttactgtgctacttcaaaaat

SEQ ID NO: 815537 - DNA, 22 bp, Artificial Sequence
  chemically synthesized
taataattatttactgtgctac

SEQ ID NO: 815538 - DNA, 22 bp, Artificial Sequence
  chemically synthesized
ataataattatttactgtgcta

SEQ ID NO: 815539 - DNA, 22 bp, Artificial Sequence
  chemically synthesized
ttgaagtagcacagtaaataat

SEQ ID NO: 815540 - DNA, 22 bp, Artificial Sequence
  chemically synthesized
tgaagtagcacagtaaataatt

SEQ ID NO: 815541 - DNA, 22 bp, Artificial Sequence
  chemically synthesized
gaagtagcacagtaaataatta

SEQ ID NO: 815542 - DNA, 22 bp, Artificial Sequence
  chemically synthesized
aagtagcacagtaaataattat

SEQ ID NO: 815543 - DNA, 22 bp, Artificial Sequence
  chemically synthesized
gggtacatttataataattatt

SEQ ID NO: 815544 - DNA, 22 bp, Artificial Sequence
  chemically synthesized
agggtacatttataataattat

SEQ ID NO: 815545 - DNA, 22 bp, Artificial Sequence
  chemically synthesized
agcagtttagggtacatttata

SEQ ID NO: 815546 - DNA, 22 bp, Artificial Sequence
  chemically synthesized
ttataaatgtaccctaaactgc

SEQ ID NO: 815547 - DNA, 22 bp, Artificial Sequence
  chemically synthesized
taaatgtaccctaaactgctta

SEQ ID NO: 815548 - DNA, 22 bp, Artificial Sequence
  chemically synthesized
ggcataaatgggttaagcagtt

SEQ ID NO: 815549 - DNA, 22 bp, Artificial Sequence
  chemically synthesized
aggcataaatgggttaagcagt

SEQ ID NO: 815550 - DNA, 22 bp, Artificial Sequence
  chemically synthesized
caaccttaggcataaatgggtt

SEQ ID NO: 815551 - DNA, 22 bp, Artificial Sequence
  chemically synthesized
aactgcttaacccatttatgcc

SEQ ID NO: 815552 - DNA, 22 bp, Artificial Sequence
  chemically synthesized
cttaacccatttatgcctaagg

SEQ ID NO: 815553 - DNA, 22 bp, Artificial Sequence
  chemically synthesized
aaaaaattgcaaccttaggcat

SEQ ID NO: 815554 - DNA, 22 bp, Artificial Sequence
  chemically synthesized
aacccatttatgcctaaggttg

SEQ ID NO: 815555 - DNA, 22 bp, Artificial Sequence
  chemically synthesized
acccatttatgcctaaggttgc

SEQ ID NO: 815556 - DNA, 22 bp, Artificial Sequence
  chemically synthesized
caaaaattcaaaaaattgcaac

SEQ ID NO: 815557 - DNA, 22 bp, Artificial Sequence
  chemically synthesized
atgcctaaggttgcaatttttt

SEQ ID NO: 815558 - DNA, 22 bp, Artificial Sequence
  chemically synthesized
tgcctaaggttgcaattttttg

SEQ ID NO: 815559 - DNA, 22 bp, Artificial Sequence
  chemically synthesized
attgcaaaaattcaaaaaattg

SEQ ID NO: 815560 - DNA, 22 bp, Artificial Sequence
  chemically synthesized
aggttgcaattttttgaatttt

SEQ ID NO: 815561 - DNA, 22 bp, Artificial Sequence
  chemically synthesized
accaaggtctgattgcaaaaat

SEQ ID NO: 815562 - DNA, 22 bp, Artificial Sequence
  chemically synthesized
caattttttgaatttttgcaat

SEQ ID NO: 815563 - DNA, 22 bp, Artificial Sequence
  chemically synthesized
tttgaatttttgcaatcagacc

SEQ ID NO: 815564 - DNA, 22 bp, Artificial Sequence
  chemically synthesized
ttgaatttttgcaatcagacct

SEQ ID NO: 815565 - DNA, 22 bp, Artificial Sequence
  chemically synthesized
tgaatttttgcaatcagacctt

SEQ ID NO: 815566 - DNA, 22 bp, Artificial Sequence
  chemically synthesized
aaggtcctcaccaaggtctgat

SEQ ID NO: 815567 - DNA, 22 bp, Artificial Sequence
  chemically synthesized
gaatttttgcaatcagaccttg

SEQ ID NO: 815568 - DNA, 22 bp, Artificial Sequence
  chemically synthesized
aatttttgcaatcagaccttgg

SEQ ID NO: 815569 - DNA, 22 bp, Artificial Sequence
  chemically synthesized
ttcaaggtcctcaccaaggtct

SEQ ID NO: 815570 - DNA, 22 bp, Artificial Sequence
  chemically synthesized
ctgttcaaggtcctcaccaagg

SEQ ID NO: 815571 - DNA, 22 bp, Artificial Sequence
  chemically synthesized
ttgcaatcagaccttggtgagg

SEQ ID NO: 815572 - DNA, 22 bp, Artificial Sequence
  chemically synthesized
tgcaatcagaccttggtgagga

SEQ ID NO: 815573 - DNA, 22 bp, Artificial Sequence
  chemically synthesized
tactgttcaaggtcctcaccaa

SEQ ID NO: 815574 - DNA, 22 bp, Artificial Sequence
  chemically synthesized
gcaatcagaccttggtgaggac

SEQ ID NO: 815575 - DNA, 22 bp, Artificial Sequence
  chemically synthesized
caatcagaccttggtgaggacc

SEQ ID NO: 815576 - DNA, 22 bp, Artificial Sequence
  chemically synthesized
tattctactgttcaaggtcctc

SEQ ID NO: 815577 - DNA, 22 bp, Artificial Sequence
  chemically synthesized
atattctactgttcaaggtcct

SEQ ID NO: 815578 - DNA, 22 bp, Artificial Sequence
  chemically synthesized
tttatattctactgttcaaggt

SEQ ID NO: 815579 - DNA, 22 bp, Artificial Sequence
  chemically synthesized
ggtgaggaccttgaacagtaga

SEQ ID NO: 815580 - DNA, 22 bp, Artificial Sequence
  chemically synthesized
gtgaggaccttgaacagtagaa

SEQ ID NO: 815581 - DNA, 22 bp, Artificial Sequence
  chemically synthesized
agcatgtgggaattatttatat

SEQ ID NO: 815582 - DNA, 22 bp, Artificial Sequence
  chemically synthesized
gaacagtagaatataaataatt

SEQ ID NO: 815583 - DNA, 22 bp, Artificial Sequence
  chemically synthesized
aacagtagaatataaataattc

SEQ ID NO: 815584 - DNA, 22 bp, Artificial Sequence
  chemically synthesized
gaatactaagcatgtgggaatt

SEQ ID NO: 815585 - DNA, 22 bp, Artificial Sequence
  chemically synthesized
ttggaatactaagcatgtggga

SEQ ID NO: 815586 - DNA, 22 bp, Artificial Sequence
  chemically synthesized
cattattggaatactaagcatg

SEQ ID NO: 815587 - DNA, 22 bp, Artificial Sequence
  chemically synthesized
gtgttccattattggaatacta

SEQ ID NO: 815588 - DNA, 22 bp, Artificial Sequence
  chemically synthesized
ccacatgcttagtattccaata

SEQ ID NO: 815589 - DNA, 22 bp, Artificial Sequence
  chemically synthesized
tcctagtgttccattattggaa

SEQ ID NO: 815590 - DNA, 22 bp, Artificial Sequence
  chemically synthesized
atcctagtgttccattattgga

SEQ ID NO: 815591 - DNA, 22 bp, Artificial Sequence
  chemically synthesized
tttatcctagtgttccattatt

SEQ ID NO: 815592 - DNA, 22 bp, Artificial Sequence
  chemically synthesized
agtattccaataatggaacact

SEQ ID NO: 815593 - DNA, 22 bp, Artificial Sequence
  chemically synthesized
gctatttatcctagtgttccat

SEQ ID NO: 815594 - DNA, 22 bp, Artificial Sequence
  chemically synthesized
gtattccaataatggaacacta

SEQ ID NO: 815595 - DNA, 22 bp, Artificial Sequence
  chemically synthesized
agctatttatcctagtgttcca

SEQ ID NO: 815596 - DNA, 22 bp, Artificial Sequence
  chemically synthesized
tagctatttatcctagtgttcc

SEQ ID NO: 815597 - DNA, 22 bp, Artificial Sequence
  chemically synthesized
actttagctatttatcctagtg

SEQ ID NO: 815598 - DNA, 22 bp, Artificial Sequence
  chemically synthesized
caataatggaacactaggataa

SEQ ID NO: 815599 - DNA, 22 bp, Artificial Sequence
  chemically synthesized
tgttcactttagctatttatcc

SEQ ID NO: 815600 - DNA, 22 bp, Artificial Sequence
  chemically synthesized
tctatgttcactttagctattt

SEQ ID NO: 815601 - DNA, 22 bp, Artificial Sequence
  chemically synthesized
gtctatgttcactttagctatt

SEQ ID NO: 815602 - DNA, 22 bp, Artificial Sequence
  chemically synthesized
tgtctatgttcactttagctat

SEQ ID NO: 815603 - DNA, 22 bp, Artificial Sequence
  chemically synthesized
ggataaatagctaaagtgaaca

SEQ ID NO: 815604 - DNA, 22 bp, Artificial Sequence
  chemically synthesized
gatcatctttgtctatgttcac

SEQ ID NO: 815605 - DNA, 22 bp, Artificial Sequence
  chemically synthesized
tagatcatctttgtctatgttc

SEQ ID NO: 815606 - DNA, 22 bp, Artificial Sequence
  chemically synthesized
ctctagatcatctttgtctatg

SEQ ID NO: 815607 - DNA, 22 bp, Artificial Sequence
  chemically synthesized
aagtgaacatagacaaagatga

SEQ ID NO: 815608 - DNA, 22 bp, Artificial Sequence
  chemically synthesized
atagtcctgctctagatcatct

SEQ ID NO: 815609 - DNA, 22 bp, Artificial Sequence
  chemically synthesized
ctgatagtcctgctctagatca

SEQ ID NO: 815610 - DNA, 22 bp, Artificial Sequence
  chemically synthesized
actgatagtcctgctctagatc

SEQ ID NO: 815611 - DNA, 22 bp, Artificial Sequence
  chemically synthesized
tactgatagtcctgctctagat

SEQ ID NO: 815612 - DNA, 22 bp, Artificial Sequence
  chemically synthesized
gagcaggactatcagtaaaact

SEQ ID NO: 815613 - DNA, 22 bp, Artificial Sequence
  chemically synthesized
tcagtaaaactttctgtgattg

SEQ ID NO: 815614 - DNA, 22 bp, Artificial Sequence
  chemically synthesized
ccagcatcaggtaaccaccaat

SEQ ID NO: 815615 - DNA, 22 bp, Artificial Sequence
  chemically synthesized
cccagcatcaggtaaccaccaa

SEQ ID NO: 815616 - DNA, 22 bp, Artificial Sequence
  chemically synthesized
tctgtgattggtggttacctga

SEQ ID NO: 815617 - DNA, 22 bp, Artificial Sequence
  chemically synthesized
cccttcccagcatcaggtaacc

SEQ ID NO: 815618 - DNA, 22 bp, Artificial Sequence
  chemically synthesized
ctgtgattggtggttacctgat

SEQ ID NO: 815619 - DNA, 22 bp, Artificial Sequence
  chemically synthesized
tgtgattggtggttacctgatg

SEQ ID NO: 815620 - DNA, 22 bp, Artificial Sequence
  chemically synthesized
tgattggtggttacctgatgct

SEQ ID NO: 815621 - DNA, 22 bp, Artificial Sequence
  chemically synthesized
accccctacccttcccagcatc

SEQ ID NO: 815622 - DNA, 22 bp, Artificial Sequence
  chemically synthesized
gtggttacctgatgctgggaag

SEQ ID NO: 815623 - DNA, 22 bp, Artificial Sequence
  chemically synthesized
atcccctcaccccctacccttc

SEQ ID NO: 815624 - DNA, 22 bp, Artificial Sequence
  chemically synthesized
cctgatgctgggaagggtaggg

SEQ ID NO: 815625 - DNA, 22 bp, Artificial Sequence
  chemically synthesized
atgctgggaagggtagggggtg

SEQ ID NO: 815626 - DNA, 22 bp, Artificial Sequence
  chemically synthesized
ggaagggtagggggtgagggga

SEQ ID NO: 815627 - DNA, 22 bp, Artificial Sequence
  chemically synthesized
caaaatcgaatcaagttcatcc

SEQ ID NO: 815628 - DNA, 22 bp, Artificial Sequence
  chemically synthesized
agcctgcaaaatcgaatcaagt

SEQ ID NO: 815629 - DNA, 22 bp, Artificial Sequence
  chemically synthesized
tgagcctgcaaaatcgaatcaa

SEQ ID NO: 815630 - DNA, 22 bp, Artificial Sequence
  chemically synthesized
catctctgagcctgcaaaatcg

SEQ ID NO: 815631 - DNA, 22 bp, Artificial Sequence
  chemically synthesized
ccatctctgagcctgcaaaatc

SEQ ID NO: 815632 - DNA, 22 bp, Artificial Sequence
  chemically synthesized
ccttccatctctgagcctgcaa

SEQ ID NO: 815633 - DNA, 22 bp, Artificial Sequence
  chemically synthesized
gattcgattttgcaggctcaga

SEQ ID NO: 815634 - DNA, 22 bp, Artificial Sequence
  chemically synthesized
attcgattttgcaggctcagag

SEQ ID NO: 815635 - DNA, 22 bp, Artificial Sequence
  chemically synthesized
gattttgcaggctcagagatgg

SEQ ID NO: 815636 - DNA, 22 bp, Artificial Sequence
  chemically synthesized
tgcaggctcagagatggaaggg

SEQ ID NO: 815637 - DNA, 22 bp, Artificial Sequence
  chemically synthesized
gcaggctcagagatggaaggga

SEQ ID NO: 815638 - DNA, 22 bp, Artificial Sequence
  chemically synthesized
caggctcagagatggaagggaa

SEQ ID NO: 815639 - DNA, 22 bp, Artificial Sequence
  chemically synthesized
atcgtgaggcaaattcccttcc

SEQ ID NO: 815640 - DNA, 22 bp, Artificial Sequence
  chemically synthesized
agagatggaagggaatttgcct

SEQ ID NO: 815641 - DNA, 22 bp, Artificial Sequence
  chemically synthesized
aaggcacaattcatcgtgaggc

SEQ ID NO: 815642 - DNA, 22 bp, Artificial Sequence
  chemically synthesized
gcctcacgatgaattgtgcctt

SEQ ID NO: 815643 - DNA, 22 bp, Artificial Sequence
  chemically synthesized
cctcacgatgaattgtgccttg

SEQ ID NO: 815644 - DNA, 22 bp, Artificial Sequence
  chemically synthesized
gatatgggtgagactcaaggca

SEQ ID NO: 815645 - DNA, 22 bp, Artificial Sequence
  chemically synthesized
acgatgaattgtgccttgagtc

SEQ ID NO: 815646 - DNA, 22 bp, Artificial Sequence
  chemically synthesized
atataaattagatatgggtgag

SEQ ID NO: 815647 - DNA, 22 bp, Artificial Sequence
  chemically synthesized
tgccttgagtctcacccatatc

SEQ ID NO: 815648 - DNA, 22 bp, Artificial Sequence
  chemically synthesized
gagtctcacccatatctaattt

SEQ ID NO: 815649 - DNA, 22 bp, Artificial Sequence
  chemically synthesized
agtctcacccatatctaattta

SEQ ID NO: 815650 - DNA, 22 bp, Artificial Sequence
  chemically synthesized
aaaagtgcaatctaatataaat

SEQ ID NO: 815651 - DNA, 22 bp, Artificial Sequence
  chemically synthesized
acccatatctaatttatattag

SEQ ID NO: 815652 - DNA, 22 bp, Artificial Sequence
  chemically synthesized
agcataaactcaaaagtgcaat

SEQ ID NO: 815653 - DNA, 22 bp, Artificial Sequence
  chemically synthesized
atttatattagattgcactttt

SEQ ID NO: 815654 - DNA, 22 bp, Artificial Sequence
  chemically synthesized
cagcataaactcaaaagtgcaa

SEQ ID NO: 815655 - DNA, 22 bp, Artificial Sequence
  chemically synthesized
tttcagcataaactcaaaagtg

SEQ ID NO: 815656 - DNA, 22 bp, Artificial Sequence
  chemically synthesized
atattagattgcacttttgagt

SEQ ID NO: 815657 - DNA, 22 bp, Artificial Sequence
  chemically synthesized
atttcagcataaactcaaaagt

SEQ ID NO: 815658 - DNA, 22 bp, Artificial Sequence
  chemically synthesized
tattagattgcacttttgagtt

SEQ ID NO: 815659 - DNA, 22 bp, Artificial Sequence
  chemically synthesized
gattgcacttttgagtttatgc

SEQ ID NO: 815660 - DNA, 22 bp, Artificial Sequence
  chemically synthesized
cacttttgagtttatgctgaaa

SEQ ID NO: 815661 - DNA, 22 bp, Artificial Sequence
  chemically synthesized
ttgagtttatgctgaaataaga

SEQ ID NO: 815662 - DNA, 22 bp, Artificial Sequence
  chemically synthesized
tgagtttatgctgaaataagat

SEQ ID NO: 815663 - DNA, 22 bp, Artificial Sequence
  chemically synthesized
gagtttatgctgaaataagatt

SEQ ID NO: 815664 - DNA, 22 bp, Artificial Sequence
  chemically synthesized
agtttatgctgaaataagattt

SEQ ID NO: 815665 - DNA, 22 bp, Artificial Sequence
  chemically synthesized
atccccaaagccccaaaaatct

SEQ ID NO: 815666 - DNA, 22 bp, Artificial Sequence
  chemically synthesized
atgctgaaataagatttttggg

SEQ ID NO: 815667 - DNA, 22 bp, Artificial Sequence
  chemically synthesized
catccccaaagccccaaaaatc

SEQ ID NO: 815668 - DNA, 22 bp, Artificial Sequence
  chemically synthesized
tgctgaaataagatttttgggg

SEQ ID NO: 815669 - DNA, 22 bp, Artificial Sequence
  chemically synthesized
atttcatccccaaagccccaaa

SEQ ID NO: 815670 - DNA, 22 bp, Artificial Sequence
  chemically synthesized
aaataagatttttggggctttg

SEQ ID NO: 815671 - DNA, 22 bp, Artificial Sequence
  chemically synthesized
ttggggctttggggatgaaatg

SEQ ID NO: 815672 - DNA, 22 bp, Artificial Sequence
  chemically synthesized
tggggctttggggatgaaatga

SEQ ID NO: 815673 - DNA, 22 bp, Artificial Sequence
  chemically synthesized
ggggctttggggatgaaatgaa

SEQ ID NO: 815674 - DNA, 22 bp, Artificial Sequence
  chemically synthesized
gggctttggggatgaaatgaat

SEQ ID NO: 815675 - DNA, 22 bp, Artificial Sequence
  chemically synthesized
aaagacaaaatacattcatttc

SEQ ID NO: 815676 - DNA, 22 bp, Artificial Sequence
  chemically synthesized
tcaaagacaaaatacattcatt

SEQ ID NO: 815677 - DNA, 22 bp, Artificial Sequence
  chemically synthesized
ctcaaagacaaaatacattcat

SEQ ID NO: 815678 - DNA, 22 bp, Artificial Sequence
  chemically synthesized
tggggatgaaatgaatgtattt

SEQ ID NO: 815679 - DNA, 22 bp, Artificial Sequence
  chemically synthesized
ttctcaaagacaaaatacattc

SEQ ID NO: 815680 - DNA, 22 bp, Artificial Sequence
  chemically synthesized
ggggatgaaatgaatgtatttt

SEQ ID NO: 815681 - DNA, 22 bp, Artificial Sequence
  chemically synthesized
gggatgaaatgaatgtattttg

SEQ ID NO: 815682 - DNA, 22 bp, Artificial Sequence
  chemically synthesized
ttcttctcaaagacaaaataca

SEQ ID NO: 815683 - DNA, 22 bp, Artificial Sequence
  chemically synthesized
gttcttctcaaagacaaaatac

SEQ ID NO: 815684 - DNA, 22 bp, Artificial Sequence
  chemically synthesized
ttgttcttctcaaagacaaaat

SEQ ID NO: 815685 - DNA, 22 bp, Artificial Sequence
  chemically synthesized
cccaaaattcttgttcttctca

SEQ ID NO: 815686 - DNA, 22 bp, Artificial Sequence
  chemically synthesized
ccccaaaattcttgttcttctc

SEQ ID NO: 815687 - DNA, 22 bp, Artificial Sequence
  chemically synthesized
tccccaaaattcttgttcttct

SEQ ID NO: 815688 - DNA, 22 bp, Artificial Sequence
  chemically synthesized
ttccccaaaattcttgttcttc

SEQ ID NO: 815689 - DNA, 22 bp, Artificial Sequence
  chemically synthesized
tgtctttgagaagaacaagaat

SEQ ID NO: 815690 - DNA, 22 bp, Artificial Sequence
  chemically synthesized
gtctttgagaagaacaagaatt

SEQ ID NO: 815691 - DNA, 22 bp, Artificial Sequence
  chemically synthesized
tctttgagaagaacaagaattt

SEQ ID NO: 815692 - DNA, 22 bp, Artificial Sequence
  chemically synthesized
cccccttttccccaaaattctt

SEQ ID NO: 815693 - DNA, 22 bp, Artificial Sequence
  chemically synthesized
tgagaagaacaagaattttggg

SEQ ID NO: 815694 - DNA, 22 bp, Artificial Sequence
  chemically synthesized
tgcccccttttccccaaaattc

SEQ ID NO: 815695 - DNA, 22 bp, Artificial Sequence
  chemically synthesized
gagaagaacaagaattttgggg

SEQ ID NO: 815696 - DNA, 22 bp, Artificial Sequence
  chemically synthesized
agaagaacaagaattttgggga

SEQ ID NO: 815697 - DNA, 22 bp, Artificial Sequence
  chemically synthesized
aaccatagcattctgccccctt

SEQ ID NO: 815698 - DNA, 22 bp, Artificial Sequence
  chemically synthesized
tggggaaaagggggcagaatgc

SEQ ID NO: 815699 - DNA, 22 bp, Artificial Sequence
  chemically synthesized
ggggaaaagggggcagaatgct

SEQ ID NO: 815700 - DNA, 22 bp, Artificial Sequence
  chemically synthesized
gggaaaagggggcagaatgcta

SEQ ID NO: 815701 - DNA, 22 bp, Artificial Sequence
  chemically synthesized
ggaagggaaaaacattaaacca

SEQ ID NO: 815702 - DNA, 22 bp, Artificial Sequence
  chemically synthesized
gggaagggaaaaacattaaacc

SEQ ID NO: 815703 - DNA, 22 bp, Artificial Sequence
  chemically synthesized
ccataagtttgggaagggaaaa

SEQ ID NO: 815704 - DNA, 22 bp, Artificial Sequence
  chemically synthesized
tggtttaatgtttttcccttcc

SEQ ID NO: 815705 - DNA, 22 bp, Artificial Sequence
  chemically synthesized
accataagtttgggaagggaaa

SEQ ID NO: 815706 - DNA, 22 bp, Artificial Sequence
  chemically synthesized
taccataagtttgggaagggaa

SEQ ID NO: 815707 - DNA, 22 bp, Artificial Sequence
  chemically synthesized
aatgtttttcccttcccaaact

SEQ ID NO: 815708 - DNA, 22 bp, Artificial Sequence
  chemically synthesized
aattttaccataagtttgggaa

SEQ ID NO: 815709 - DNA, 22 bp, Artificial Sequence
  chemically synthesized
atgtttttcccttcccaaactt

SEQ ID NO: 815710 - DNA, 22 bp, Artificial Sequence
  chemically synthesized
ttcccttcccaaacttatggta

SEQ ID NO: 815711 - DNA, 22 bp, Artificial Sequence
  chemically synthesized
tcccttcccaaacttatggtaa

SEQ ID NO: 815712 - DNA, 22 bp, Artificial Sequence
  chemically synthesized
cccttcccaaacttatggtaaa

SEQ ID NO: 815713 - DNA, 22 bp, Artificial Sequence
  chemically synthesized
ccttcccaaacttatggtaaaa

SEQ ID NO: 815714 - DNA, 22 bp, Artificial Sequence
  chemically synthesized
caatggcaattaaattttacca

SEQ ID NO: 815715 - DNA, 22 bp, Artificial Sequence
  chemically synthesized
cccaaacttatggtaaaattta

SEQ ID NO: 815716 - DNA, 22 bp, Artificial Sequence
  chemically synthesized
ccaaacttatggtaaaatttaa

SEQ ID NO: 815717 - DNA, 22 bp, Artificial Sequence
  chemically synthesized
ttgcaatggcaattaaatttta

SEQ ID NO: 815718 - DNA, 22 bp, Artificial Sequence
  chemically synthesized
ctgttgcaatggcaattaaatt

SEQ ID NO: 815719 - DNA, 22 bp, Artificial Sequence
  chemically synthesized
ctactgttgcaatggcaattaa

SEQ ID NO: 815720 - DNA, 22 bp, Artificial Sequence
  chemically synthesized
actactgttgcaatggcaatta

SEQ ID NO: 815721 - DNA, 22 bp, Artificial Sequence
  chemically synthesized
atggtaaaatttaattgccatt

SEQ ID NO: 815722 - DNA, 22 bp, Artificial Sequence
  chemically synthesized
tggtaaaatttaattgccattg

SEQ ID NO: 815723 - DNA, 22 bp, Artificial Sequence
  chemically synthesized
aaggtcacatttactactgttg

SEQ ID NO: 815724 - DNA, 22 bp, Artificial Sequence
  chemically synthesized
aattgccattgcaacagtagta

SEQ ID NO: 815725 - DNA, 22 bp, Artificial Sequence
  chemically synthesized
caaggtcacatttactactgtt

SEQ ID NO: 815726 - DNA, 22 bp, Artificial Sequence
  chemically synthesized
attgccattgcaacagtagtaa

SEQ ID NO: 815727 - DNA, 22 bp, Artificial Sequence
  chemically synthesized
ttcaaggtcacatttactactg

SEQ ID NO: 815728 - DNA, 22 bp, Artificial Sequence
  chemically synthesized
ccattgcaacagtagtaaatgt

SEQ ID NO: 815729 - DNA, 22 bp, Artificial Sequence
  chemically synthesized
atcacctcttcaaggtcacatt

SEQ ID NO: 815730 - DNA, 22 bp, Artificial Sequence
  chemically synthesized
caacagtagtaaatgtgacctt

SEQ ID NO: 815731 - DNA, 22 bp, Artificial Sequence
  chemically synthesized
atgtcctaatcacctcttcaag

SEQ ID NO: 815732 - DNA, 22 bp, Artificial Sequence
  chemically synthesized
catgtcctaatcacctcttcaa

SEQ ID NO: 815733 - DNA, 22 bp, Artificial Sequence
  chemically synthesized
gaagaggtgattaggacatgaa

SEQ ID NO: 815734 - DNA, 22 bp, Artificial Sequence
  chemically synthesized
aagaggtgattaggacatgaag

SEQ ID NO: 815735 - DNA, 22 bp, Artificial Sequence
  chemically synthesized
atgaaggcagagccttcatgtc

SEQ ID NO: 815736 - DNA, 22 bp, Artificial Sequence
  chemically synthesized
atccgttcatgaaggcagagcc

SEQ ID NO: 815737 - DNA, 22 bp, Artificial Sequence
  chemically synthesized
ggacatgaaggctctgccttca

SEQ ID NO: 815738 - DNA, 22 bp, Artificial Sequence
  chemically synthesized
tgccttcatgaacggattagca

SEQ ID NO: 815739 - DNA, 22 bp, Artificial Sequence
  chemically synthesized
ccacaataatgatgctaatccg

SEQ ID NO: 815740 - DNA, 22 bp, Artificial Sequence
  chemically synthesized
ccttcatgaacggattagcatc

SEQ ID NO: 815741 - DNA, 22 bp, Artificial Sequence
  chemically synthesized
actcccacaataatgatgctaa

SEQ ID NO: 815742 - DNA, 22 bp, Artificial Sequence
  chemically synthesized
catgaacggattagcatcatta

SEQ ID NO: 815743 - DNA, 22 bp, Artificial Sequence
  chemically synthesized
atgaacggattagcatcattat

SEQ ID NO: 815744 - DNA, 22 bp, Artificial Sequence
  chemically synthesized
tatgaaactcactcccacaata

SEQ ID NO: 815745 - DNA, 22 bp, Artificial Sequence
  chemically synthesized
atatgaaactcactcccacaat

SEQ ID NO: 815746 - DNA, 22 bp, Artificial Sequence
  chemically synthesized
gcatcattattgtgggagtgag

SEQ ID NO: 815747 - DNA, 22 bp, Artificial Sequence
  chemically synthesized
tccttatatgaaactcactccc

SEQ ID NO: 815748 - DNA, 22 bp, Artificial Sequence
  chemically synthesized
gtccttatatgaaactcactcc

SEQ ID NO: 815749 - DNA, 22 bp, Artificial Sequence
  chemically synthesized
ttgtgggagtgagtttcatata

SEQ ID NO: 815750 - DNA, 22 bp, Artificial Sequence
  chemically synthesized
tgggagtgagtttcatataagg

SEQ ID NO: 815751 - DNA, 22 bp, Artificial Sequence
  chemically synthesized
catataaggacaagtttggccc

SEQ ID NO: 815752 - DNA, 22 bp, Artificial Sequence
  chemically synthesized
atataaggacaagtttggcccc

SEQ ID NO: 815753 - DNA, 22 bp, Artificial Sequence
  chemically synthesized
ggccccattttttctctctttt

SEQ ID NO: 815754 - DNA, 22 bp, Artificial Sequence
  chemically synthesized
gccccattttttctctcttttg

SEQ ID NO: 815755 - DNA, 22 bp, Artificial Sequence
  chemically synthesized
catgatggaaggtggaagacca

SEQ ID NO: 815756 - DNA, 22 bp, Artificial Sequence
  chemically synthesized
tttctctcttttggtcttccac

SEQ ID NO: 815757 - DNA, 22 bp, Artificial Sequence
  chemically synthesized
ttctctcttttggtcttccacc

SEQ ID NO: 815758 - DNA, 22 bp, Artificial Sequence
  chemically synthesized
tctctcttttggtcttccacct

SEQ ID NO: 815759 - DNA, 22 bp, Artificial Sequence
  chemically synthesized
ctctcttttggtcttccacctt

SEQ ID NO: 815760 - DNA, 22 bp, Artificial Sequence
  chemically synthesized
tctcttttggtcttccaccttc

SEQ ID NO: 815761 - DNA, 22 bp, Artificial Sequence
  chemically synthesized
tcttttggtcttccaccttcca

SEQ ID NO: 815762 - DNA, 22 bp, Artificial Sequence
  chemically synthesized
ttttggtcttccaccttccatc

SEQ ID NO: 815763 - DNA, 22 bp, Artificial Sequence
  chemically synthesized
ttggtcttccaccttccatcat

SEQ ID NO: 815764 - DNA, 22 bp, Artificial Sequence
  chemically synthesized
tgtcatgattccatgatggaag

SEQ ID NO: 815765 - DNA, 22 bp, Artificial Sequence
  chemically synthesized
tggtcttccaccttccatcatg

SEQ ID NO: 815766 - DNA, 22 bp, Artificial Sequence
  chemically synthesized
ggtcttccaccttccatcatgg

SEQ ID NO: 815767 - DNA, 22 bp, Artificial Sequence
  chemically synthesized
gtcttccaccttccatcatgga

SEQ ID NO: 815768 - DNA, 22 bp, Artificial Sequence
  chemically synthesized
ttgtgtcatgattccatgatgg

SEQ ID NO: 815769 - DNA, 22 bp, Artificial Sequence
  chemically synthesized
gttgtgtcatgattccatgatg

SEQ ID NO: 815770 - DNA, 22 bp, Artificial Sequence
  chemically synthesized
ttgttgtgtcatgattccatga

SEQ ID NO: 815771 - DNA, 22 bp, Artificial Sequence
  chemically synthesized
cttgttgtgtcatgattccatg

SEQ ID NO: 815772 - DNA, 22 bp, Artificial Sequence
  chemically synthesized
ccaccttccatcatggaatcat

SEQ ID NO: 815773 - DNA, 22 bp, Artificial Sequence
  chemically synthesized
caccttccatcatggaatcatg

SEQ ID NO: 815774 - DNA, 22 bp, Artificial Sequence
  chemically synthesized
ccatcatggaatcatgacacaa

SEQ ID NO: 815775 - DNA, 22 bp, Artificial Sequence
  chemically synthesized
catcatggaatcatgacacaac

SEQ ID NO: 815776 - DNA, 22 bp, Artificial Sequence
  chemically synthesized
gtaagggccttcttgttgtgtc

SEQ ID NO: 815777 - DNA, 22 bp, Artificial Sequence
  chemically synthesized
gaatctggtaagggccttcttg

SEQ ID NO: 815778 - DNA, 22 bp, Artificial Sequence
  chemically synthesized
cgaagtccaagatcaaggggct

SEQ ID NO: 815779 - DNA, 22 bp, Artificial Sequence
  chemically synthesized
accagattccagccccttgatc

SEQ ID NO: 815780 - DNA, 22 bp, Artificial Sequence
  chemically synthesized
ccagattccagccccttgatct

SEQ ID NO: 815781 - DNA, 22 bp, Artificial Sequence
  chemically synthesized
gaggctgcgaagtccaagatca

SEQ ID NO: 815782 - DNA, 22 bp, Artificial Sequence
  chemically synthesized
tggaggctgcgaagtccaagat

SEQ ID NO: 815783 - DNA, 22 bp, Artificial Sequence
  chemically synthesized
cagccccttgatcttggacttc

SEQ ID NO: 815784 - DNA, 22 bp, Artificial Sequence
  chemically synthesized
atagttctggaggctgcgaagt

SEQ ID NO: 815785 - DNA, 22 bp, Artificial Sequence
  chemically synthesized
gatcttggacttcgcagcctcc

SEQ ID NO: 815786 - DNA, 22 bp, Artificial Sequence
  chemically synthesized
gctcatagttctggaggctgcg

SEQ ID NO: 815787 - DNA, 22 bp, Artificial Sequence
  chemically synthesized
atcttggacttcgcagcctcca

SEQ ID NO: 815788 - DNA, 22 bp, Artificial Sequence
  chemically synthesized
ttggctcatagttctggaggct

SEQ ID NO: 815789 - DNA, 22 bp, Artificial Sequence
  chemically synthesized
gttggctcatagttctggaggc

SEQ ID NO: 815790 - DNA, 22 bp, Artificial Sequence
  chemically synthesized
ggacttcgcagcctccagaact

SEQ ID NO: 815791 - DNA, 22 bp, Artificial Sequence
  chemically synthesized
gacttcgcagcctccagaacta

SEQ ID NO: 815792 - DNA, 22 bp, Artificial Sequence
  chemically synthesized
cgcagcctccagaactatgagc

SEQ ID NO: 815793 - DNA, 22 bp, Artificial Sequence
  chemically synthesized
gcagcctccagaactatgagcc

SEQ ID NO: 815794 - DNA, 22 bp, Artificial Sequence
  chemically synthesized
taatgaacagggatttgttggc

SEQ ID NO: 815795 - DNA, 22 bp, Artificial Sequence
  chemically synthesized
cagaactatgagccaacaaatc

SEQ ID NO: 815796 - DNA, 22 bp, Artificial Sequence
  chemically synthesized
ataatgaacagggatttgttgg

SEQ ID NO: 815797 - DNA, 22 bp, Artificial Sequence
  chemically synthesized
tgagccaacaaatccctgttca

SEQ ID NO: 815798 - DNA, 22 bp, Artificial Sequence
  chemically synthesized
ggtaatttataatgaacaggga

SEQ ID NO: 815799 - DNA, 22 bp, Artificial Sequence
  chemically synthesized
ttcattataaattacccagtct

SEQ ID NO: 815800 - DNA, 22 bp, Artificial Sequence
  chemically synthesized
attataaattacccagtctgtg

SEQ ID NO: 815801 - DNA, 22 bp, Artificial Sequence
  chemically synthesized
cgtaacaaaataccacagactg

SEQ ID NO: 815802 - DNA, 22 bp, Artificial Sequence
  chemically synthesized
ccgtaacaaaataccacagact

SEQ ID NO: 815803 - DNA, 22 bp, Artificial Sequence
  chemically synthesized
taaattacccagtctgtggtat

SEQ ID NO: 815804 - DNA, 22 bp, Artificial Sequence
  chemically synthesized
gtgcttccgtaacaaaatacca

SEQ ID NO: 815805 - DNA, 22 bp, Artificial Sequence
  chemically synthesized
cgtgcttccgtaacaaaatacc

SEQ ID NO: 815806 - DNA, 22 bp, Artificial Sequence
  chemically synthesized
tcgtgcttccgtaacaaaatac

SEQ ID NO: 815807 - DNA, 22 bp, Artificial Sequence
  chemically synthesized
cccagtctgtggtattttgtta

SEQ ID NO: 815808 - DNA, 22 bp, Artificial Sequence
  chemically synthesized
ttcgtgcttccgtaacaaaata

SEQ ID NO: 815809 - DNA, 22 bp, Artificial Sequence
  chemically synthesized
gtccttttcgtgcttccgtaac

SEQ ID NO: 815810 - DNA, 22 bp, Artificial Sequence
  chemically synthesized
agtccttttcgtgcttccgtaa

SEQ ID NO: 815811 - DNA, 22 bp, Artificial Sequence
  chemically synthesized
tggtattttgttacggaagcac

SEQ ID NO: 815812 - DNA, 22 bp, Artificial Sequence
  chemically synthesized
tcttagtccttttcgtgcttcc

SEQ ID NO: 815813 - DNA, 22 bp, Artificial Sequence
  chemically synthesized
gtcttagtccttttcgtgcttc

SEQ ID NO: 815814 - DNA, 22 bp, Artificial Sequence
  chemically synthesized
tgttacggaagcacgaaaagga

SEQ ID NO: 815815 - DNA, 22 bp, Artificial Sequence
  chemically synthesized
tccttgtcttagtccttttcgt

SEQ ID NO: 815816 - DNA, 22 bp, Artificial Sequence
  chemically synthesized
gttacggaagcacgaaaaggac

SEQ ID NO: 815817 - DNA, 22 bp, Artificial Sequence
  chemically synthesized
ttacggaagcacgaaaaggact

SEQ ID NO: 815818 - DNA, 22 bp, Artificial Sequence
  chemically synthesized
ttgtccttgtcttagtcctttt

SEQ ID NO: 815819 - DNA, 22 bp, Artificial Sequence
  chemically synthesized
cggaagcacgaaaaggactaag

SEQ ID NO: 815820 - DNA, 22 bp, Artificial Sequence
  chemically synthesized
tgttgtccttgtcttagtcctt

SEQ ID NO: 815821 - DNA, 22 bp, Artificial Sequence
  chemically synthesized
ctgttgtccttgtcttagtcct

SEQ ID NO: 815822 - DNA, 22 bp, Artificial Sequence
  chemically synthesized
cttctgttgtccttgtcttagt

SEQ ID NO: 815823 - DNA, 22 bp, Artificial Sequence
  chemically synthesized
caaatgcaacctacttctgttg

SEQ ID NO: 815824 - DNA, 22 bp, Artificial Sequence
  chemically synthesized
tccaaatgcaacctacttctgt

SEQ ID NO: 815825 - DNA, 22 bp, Artificial Sequence
  chemically synthesized
agacaaggacaacagaagtagg

SEQ ID NO: 815826 - DNA, 22 bp, Artificial Sequence
  chemically synthesized
ctccaaatgcaacctacttctg

SEQ ID NO: 815827 - DNA, 22 bp, Artificial Sequence
  chemically synthesized
tctccaaatgcaacctacttct

SEQ ID NO: 815828 - DNA, 22 bp, Artificial Sequence
  chemically synthesized
tttctccaaatgcaacctactt

SEQ ID NO: 815829 - DNA, 22 bp, Artificial Sequence
  chemically synthesized
caatctctttctccaaatgcaa

SEQ ID NO: 815830 - DNA, 22 bp, Artificial Sequence
  chemically synthesized
ccaatctctttctccaaatgca

SEQ ID NO: 815831 - DNA, 22 bp, Artificial Sequence
  chemically synthesized
ttccaatctctttctccaaatg

SEQ ID NO: 815832 - DNA, 22 bp, Artificial Sequence
  chemically synthesized
cttccaatctctttctccaaat

SEQ ID NO: 815833 - DNA, 22 bp, Artificial Sequence
  chemically synthesized
ccttcttccaatctctttctcc

SEQ ID NO: 815834 - DNA, 22 bp, Artificial Sequence
  chemically synthesized
gccttcttccaatctctttctc

SEQ ID NO: 815835 - DNA, 22 bp, Artificial Sequence
  chemically synthesized
tgccttcttccaatctctttct

SEQ ID NO: 815836 - DNA, 22 bp, Artificial Sequence
  chemically synthesized
catttggagaaagagattggaa

SEQ ID NO: 815837 - DNA, 22 bp, Artificial Sequence
  chemically synthesized
atctttgccttcttccaatctc

SEQ ID NO: 815838 - DNA, 22 bp, Artificial Sequence
  chemically synthesized
ggagaaagagattggaagaagg

SEQ ID NO: 815839 - DNA, 22 bp, Artificial Sequence
  chemically synthesized
aactcatctttgccttcttcca

SEQ ID NO: 815840 - DNA, 22 bp, Artificial Sequence
  chemically synthesized
gagaaagagattggaagaaggc

SEQ ID NO: 815841 - DNA, 22 bp, Artificial Sequence
  chemically synthesized
gaagaaggcaaagatgagttta

SEQ ID NO: 815842 - DNA, 22 bp, Artificial Sequence
  chemically synthesized
aagaggtccaaagctaaactca

SEQ ID NO: 815843 - DNA, 22 bp, Artificial Sequence
  chemically synthesized
acattgaagaggtccaaagcta

SEQ ID NO: 815844 - DNA, 22 bp, Artificial Sequence
  chemically synthesized
cacattgaagaggtccaaagct

SEQ ID NO: 815845 - DNA, 22 bp, Artificial Sequence
  chemically synthesized
agctttggacctcttcaatgtg

SEQ ID NO: 815846 - DNA, 22 bp, Artificial Sequence
  chemically synthesized
gctttggacctcttcaatgtga

SEQ ID NO: 815847 - DNA, 22 bp, Artificial Sequence
  chemically synthesized
tggacctcttcaatgtgaagtt

SEQ ID NO: 815848 - DNA, 22 bp, Artificial Sequence
  chemically synthesized
atgtcccacaggaacttcacat

SEQ ID NO: 815849 - DNA, 22 bp, Artificial Sequence
  chemically synthesized
ggacctcttcaatgtgaagttc

SEQ ID NO: 815850 - DNA, 22 bp, Artificial Sequence
  chemically synthesized
gacctcttcaatgtgaagttcc

SEQ ID NO: 815851 - DNA, 22 bp, Artificial Sequence
  chemically synthesized
gatgttaatgtcccacaggaac

SEQ ID NO: 815852 - DNA, 22 bp, Artificial Sequence
  chemically synthesized
ttcaatgtgaagttcctgtggg

SEQ ID NO: 815853 - DNA, 22 bp, Artificial Sequence
  chemically synthesized
cgatgttaatgtcccacaggaa

SEQ ID NO: 815854 - DNA, 22 bp, Artificial Sequence
  chemically synthesized
tcgatgttaatgtcccacagga

SEQ ID NO: 815855 - DNA, 22 bp, Artificial Sequence
  chemically synthesized
caatgtgaagttcctgtgggac

SEQ ID NO: 815856 - DNA, 22 bp, Artificial Sequence
  chemically synthesized
aatgtgaagttcctgtgggaca

SEQ ID NO: 815857 - DNA, 22 bp, Artificial Sequence
  chemically synthesized
tttcgatgttaatgtcccacag

SEQ ID NO: 815858 - DNA, 22 bp, Artificial Sequence
  chemically synthesized
ctttcgatgttaatgtcccaca

SEQ ID NO: 815859 - DNA, 22 bp, Artificial Sequence
  chemically synthesized
tctttcgatgttaatgtcccac

SEQ ID NO: 815860 - DNA, 22 bp, Artificial Sequence
  chemically synthesized
ctttctttcgatgttaatgtcc

SEQ ID NO: 815861 - DNA, 22 bp, Artificial Sequence
  chemically synthesized
ctgctttctttcgatgttaatg

SEQ ID NO: 815862 - DNA, 22 bp, Artificial Sequence
  chemically synthesized
ctgtgggacattaacatcgaaa

SEQ ID NO: 815863 - DNA, 22 bp, Artificial Sequence
  chemically synthesized
tgggacattaacatcgaaagaa

SEQ ID NO: 815864 - DNA, 22 bp, Artificial Sequence
  chemically synthesized
gacatgtagatcctgctgcttt

SEQ ID NO: 815865 - DNA, 22 bp, Artificial Sequence
  chemically synthesized
agacatgtagatcctgctgctt

SEQ ID NO: 815866 - DNA, 22 bp, Artificial Sequence
  chemically synthesized
acatcgaaagaaagcagcagga

SEQ ID NO: 815867 - DNA, 22 bp, Artificial Sequence
  chemically synthesized
tagacatgtagatcctgctgct

SEQ ID NO: 815868 - DNA, 22 bp, Artificial Sequence
  chemically synthesized
agttttagacatgtagatcctg

SEQ ID NO: 815869 - DNA, 22 bp, Artificial Sequence
  chemically synthesized
gagttttagacatgtagatcct

SEQ ID NO: 815870 - DNA, 22 bp, Artificial Sequence
  chemically synthesized
tgagttttagacatgtagatcc

SEQ ID NO: 815871 - DNA, 22 bp, Artificial Sequence
  chemically synthesized
ttgagttttagacatgtagatc

SEQ ID NO: 815872 - DNA, 22 bp, Artificial Sequence
  chemically synthesized
agaatgatcttttgagttttag

SEQ ID NO: 815873 - DNA, 22 bp, Artificial Sequence
  chemically synthesized
cagctgagaatgatcttttgag

SEQ ID NO: 815874 - DNA, 22 bp, Artificial Sequence
  chemically synthesized
catgtctaaaactcaaaagatc

SEQ ID NO: 815875 - DNA, 22 bp, Artificial Sequence
  chemically synthesized
taattccagctgagaatgatct

SEQ ID NO: 815876 - DNA, 22 bp, Artificial Sequence
  chemically synthesized
aaactcaaaagatcattctcag

SEQ ID NO: 815877 - DNA, 22 bp, Artificial Sequence
  chemically synthesized
cccatctataattccagctgag

SEQ ID NO: 815878 - DNA, 22 bp, Artificial Sequence
  chemically synthesized
aaaagatcattctcagctggaa

SEQ ID NO: 815879 - DNA, 22 bp, Artificial Sequence
  chemically synthesized
atgactacccatctataattcc

SEQ ID NO: 815880 - DNA, 22 bp, Artificial Sequence
  chemically synthesized
ttgatgactacccatctataat

SEQ ID NO: 815881 - DNA, 22 bp, Artificial Sequence
  chemically synthesized
tcagctggaattatagatgggt

SEQ ID NO: 815882 - DNA, 22 bp, Artificial Sequence
  chemically synthesized
agctggaattatagatgggtag

SEQ ID NO: 815883 - DNA, 22 bp, Artificial Sequence
  chemically synthesized
agtctgttgatgactacccatc

SEQ ID NO: 815884 - DNA, 22 bp, Artificial Sequence
  chemically synthesized
cagtctgttgatgactacccat

SEQ ID NO: 815885 - DNA, 22 bp, Artificial Sequence
  chemically synthesized
gaattatagatgggtagtcatc

SEQ ID NO: 815886 - DNA, 22 bp, Artificial Sequence
  chemically synthesized
tgtagtttcagtctgttgatga

SEQ ID NO: 815887 - DNA, 22 bp, Artificial Sequence
  chemically synthesized
tagatgggtagtcatcaacaga

SEQ ID NO: 815888 - DNA, 22 bp, Artificial Sequence
  chemically synthesized
gtgtagtttcagtctgttgatg

SEQ ID NO: 815889 - DNA, 22 bp, Artificial Sequence
  chemically synthesized
atccacttgtgtagtttcagtc

SEQ ID NO: 815890 - DNA, 22 bp, Artificial Sequence
  chemically synthesized
caagaattcatccacttgtgta

SEQ ID NO: 815891 - DNA, 22 bp, Artificial Sequence
  chemically synthesized
gcaagaattcatccacttgtgt

SEQ ID NO: 815892 - DNA, 22 bp, Artificial Sequence
  chemically synthesized
tgcaagaattcatccacttgtg

SEQ ID NO: 815893 - DNA, 22 bp, Artificial Sequence
  chemically synthesized
tttgcaagaattcatccacttg

SEQ ID NO: 815894 - DNA, 22 bp, Artificial Sequence
  chemically synthesized
aaactacacaagtggatgaatt

SEQ ID NO: 815895 - DNA, 22 bp, Artificial Sequence
  chemically synthesized
cacaagtggatgaattcttgca

SEQ ID NO: 815896 - DNA, 22 bp, Artificial Sequence
  chemically synthesized
acatgtactctttgcaagaatt

SEQ ID NO: 815897 - DNA, 22 bp, Artificial Sequence
  chemically synthesized
cacatgtactctttgcaagaat

SEQ ID NO: 815898 - DNA, 22 bp, Artificial Sequence
  chemically synthesized
acttcacatgtactctttgcaa

SEQ ID NO: 815899 - DNA, 22 bp, Artificial Sequence
  chemically synthesized
tcacttcacatgtactctttgc

SEQ ID NO: 815900 - DNA, 22 bp, Artificial Sequence
  chemically synthesized
ctcacttcacatgtactctttg

SEQ ID NO: 815901 - DNA, 22 bp, Artificial Sequence
  chemically synthesized
tctcacttcacatgtactcttt

SEQ ID NO: 815902 - DNA, 22 bp, Artificial Sequence
  chemically synthesized
ttctcacttcacatgtactctt

SEQ ID NO: 815903 - DNA, 22 bp, Artificial Sequence
  chemically synthesized
ttttctcacttcacatgtactc

SEQ ID NO: 815904 - DNA, 22 bp, Artificial Sequence
  chemically synthesized
ttcttttctcacttcacatgta

SEQ ID NO: 815905 - DNA, 22 bp, Artificial Sequence
  chemically synthesized
ttgcaaagagtacatgtgaagt

SEQ ID NO: 815906 - DNA, 22 bp, Artificial Sequence
  chemically synthesized
gcaaagagtacatgtgaagtga

SEQ ID NO: 815907 - DNA, 22 bp, Artificial Sequence
  chemically synthesized
cctgttcttttctcacttcaca

SEQ ID NO: 815908 - DNA, 22 bp, Artificial Sequence
  chemically synthesized
caaagagtacatgtgaagtgag

SEQ ID NO: 815909 - DNA, 22 bp, Artificial Sequence
  chemically synthesized
ccctgttcttttctcacttcac

SEQ ID NO: 815910 - DNA, 22 bp, Artificial Sequence
  chemically synthesized
ttccctgttcttttctcacttc

SEQ ID NO: 815911 - DNA, 22 bp, Artificial Sequence
  chemically synthesized
taaagttcttccctgttctttt

SEQ ID NO: 815912 - DNA, 22 bp, Artificial Sequence
  chemically synthesized
atgtctataaagttcttccctg

SEQ ID NO: 815913 - DNA, 22 bp, Artificial Sequence
  chemically synthesized
actcatgtctataaagttcttc

SEQ ID NO: 815914 - DNA, 22 bp, Artificial Sequence
  chemically synthesized
tgactcatgtctataaagttct

SEQ ID NO: 815915 - DNA, 22 bp, Artificial Sequence
  chemically synthesized
ctgactcatgtctataaagttc

SEQ ID NO: 815916 - DNA, 22 bp, Artificial Sequence
  chemically synthesized
cttctgactcatgtctataaag

SEQ ID NO: 815917 - DNA, 22 bp, Artificial Sequence
  chemically synthesized
accaagctacttctgactcatg

SEQ ID NO: 815918 - DNA, 22 bp, Artificial Sequence
  chemically synthesized
tatagacatgagtcagaagtag

SEQ ID NO: 815919 - DNA, 22 bp, Artificial Sequence
  chemically synthesized
caattcaccaagctacttctga

SEQ ID NO: 815920 - DNA, 22 bp, Artificial Sequence
  chemically synthesized
atagacatgagtcagaagtagc

SEQ ID NO: 815921 - DNA, 22 bp, Artificial Sequence
  chemically synthesized
tagacatgagtcagaagtagct

SEQ ID NO: 815922 - DNA, 22 bp, Artificial Sequence
  chemically synthesized
tacagaatctgcaattcaccaa

SEQ ID NO: 815923 - DNA, 22 bp, Artificial Sequence
  chemically synthesized
gcctgtacagaatctgcaattc

SEQ ID NO: 815924 - DNA, 22 bp, Artificial Sequence
  chemically synthesized
agcctgtacagaatctgcaatt

SEQ ID NO: 815925 - DNA, 22 bp, Artificial Sequence
  chemically synthesized
tagcctgtacagaatctgcaat

SEQ ID NO: 815926 - DNA, 22 bp, Artificial Sequence
  chemically synthesized
ttagcctgtacagaatctgcaa

SEQ ID NO: 815927 - DNA, 22 bp, Artificial Sequence
  chemically synthesized
ggtgaattgcagattctgtaca

SEQ ID NO: 815928 - DNA, 22 bp, Artificial Sequence
  chemically synthesized
acatttttagcctgtacagaat

SEQ ID NO: 815929 - DNA, 22 bp, Artificial Sequence
  chemically synthesized
gtgaattgcagattctgtacag

SEQ ID NO: 815930 - DNA, 22 bp, Artificial Sequence
  chemically synthesized
cagattctgtacaggctaaaaa

SEQ ID NO: 815931 - DNA, 22 bp, Artificial Sequence
  chemically synthesized
gaagccaactcacatttttagc

SEQ ID NO: 815932 - DNA, 22 bp, Artificial Sequence
  chemically synthesized
agaagccaactcacatttttag

SEQ ID NO: 815933 - DNA, 22 bp, Artificial Sequence
  chemically synthesized
tagaagccaactcacattttta

SEQ ID NO: 815934 - DNA, 22 bp, Artificial Sequence
  chemically synthesized
tgtacaggctaaaaatgtgagt

SEQ ID NO: 815935 - DNA, 22 bp, Artificial Sequence
  chemically synthesized
tacaggctaaaaatgtgagttg

SEQ ID NO: 815936 - DNA, 22 bp, Artificial Sequence
  chemically synthesized
aaaatgtgagttggcttctaaa

SEQ ID NO: 815937 - DNA, 22 bp, Artificial Sequence
  chemically synthesized
tgggtaaagtaaatgagaattt

SEQ ID NO: 815938 - DNA, 22 bp, Artificial Sequence
  chemically synthesized
gcttctaaaattctcatttact

SEQ ID NO: 815939 - DNA, 22 bp, Artificial Sequence
  chemically synthesized
ccctatgggtaaagtaaatgag

SEQ ID NO: 815940 - DNA, 22 bp, Artificial Sequence
  chemically synthesized
cccctatgggtaaagtaaatga

SEQ ID NO: 815941 - DNA, 22 bp, Artificial Sequence
  chemically synthesized
ctaaaattctcatttactttac

SEQ ID NO: 815942 - DNA, 22 bp, Artificial Sequence
  chemically synthesized
cttcccctatgggtaaagtaaa

SEQ ID NO: 815943 - DNA, 22 bp, Artificial Sequence
  chemically synthesized
taaaattctcatttactttacc

SEQ ID NO: 815944 - DNA, 22 bp, Artificial Sequence
  chemically synthesized
acttcccctatgggtaaagtaa

SEQ ID NO: 815945 - DNA, 22 bp, Artificial Sequence
  chemically synthesized
aaattctcatttactttaccca

SEQ ID NO: 815946 - DNA, 22 bp, Artificial Sequence
  chemically synthesized
tcatttactttacccatagggg

SEQ ID NO: 815947 - DNA, 22 bp, Artificial Sequence
  chemically synthesized
atttactttacccataggggaa

SEQ ID NO: 815948 - DNA, 22 bp, Artificial Sequence
  chemically synthesized
actttacccataggggaagtaa

SEQ ID NO: 815949 - DNA, 22 bp, Artificial Sequence
  chemically synthesized
ctttacccataggggaagtaag

SEQ ID NO: 815950 - DNA, 22 bp, Artificial Sequence
  chemically synthesized
aggaatgcatatacttacttcc

SEQ ID NO: 815951 - DNA, 22 bp, Artificial Sequence
  chemically synthesized
tacccataggggaagtaagtat

SEQ ID NO: 815952 - DNA, 22 bp, Artificial Sequence
  chemically synthesized
acccataggggaagtaagtata

SEQ ID NO: 815953 - DNA, 22 bp, Artificial Sequence
  chemically synthesized
cccataggggaagtaagtatat

SEQ ID NO: 815954 - DNA, 22 bp, Artificial Sequence
  chemically synthesized
tcagctaaggaatgcatatact

SEQ ID NO: 815955 - DNA, 22 bp, Artificial Sequence
  chemically synthesized
caaaaagctatcagctaaggaa

SEQ ID NO: 815956 - DNA, 22 bp, Artificial Sequence
  chemically synthesized
gttccaaaaagctatcagctaa

SEQ ID NO: 815957 - DNA, 22 bp, Artificial Sequence
  chemically synthesized
ggttccaaaaagctatcagcta

SEQ ID NO: 815958 - DNA, 22 bp, Artificial Sequence
  chemically synthesized
gcttggttccaaaaagctatca

SEQ ID NO: 815959 - DNA, 22 bp, Artificial Sequence
  chemically synthesized
ggcttggttccaaaaagctatc

SEQ ID NO: 815960 - DNA, 22 bp, Artificial Sequence
  chemically synthesized
tggcttggttccaaaaagctat

SEQ ID NO: 815961 - DNA, 22 bp, Artificial Sequence
  chemically synthesized
ttggcttggttccaaaaagcta

SEQ ID NO: 815962 - DNA, 22 bp, Artificial Sequence
  chemically synthesized
tttggcttggttccaaaaagct

SEQ ID NO: 815963 - DNA, 22 bp, Artificial Sequence
  chemically synthesized
cttagctgatagctttttggaa

SEQ ID NO: 815964 - DNA, 22 bp, Artificial Sequence
  chemically synthesized
agctgatagctttttggaacca

SEQ ID NO: 815965 - DNA, 22 bp, Artificial Sequence
  chemically synthesized
tattttttggcttggttccaaa

SEQ ID NO: 815966 - DNA, 22 bp, Artificial Sequence
  chemically synthesized
gctgatagctttttggaaccaa

SEQ ID NO: 815967 - DNA, 22 bp, Artificial Sequence
  chemically synthesized
atattttttggcttggttccaa

SEQ ID NO: 815968 - DNA, 22 bp, Artificial Sequence
  chemically synthesized
atagctttttggaaccaagcca

SEQ ID NO: 815969 - DNA, 22 bp, Artificial Sequence
  chemically synthesized
cagtttatattttttggcttgg

SEQ ID NO: 815970 - DNA, 22 bp, Artificial Sequence
  chemically synthesized
ccagtttatattttttggcttg

SEQ ID NO: 815971 - DNA, 22 bp, Artificial Sequence
  chemically synthesized
tttggaaccaagccaaaaaata

SEQ ID NO: 815972 - DNA, 22 bp, Artificial Sequence
  chemically synthesized
ttggaaccaagccaaaaaatat

SEQ ID NO: 815973 - DNA, 22 bp, Artificial Sequence
  chemically synthesized
tggaaccaagccaaaaaatata

SEQ ID NO: 815974 - DNA, 22 bp, Artificial Sequence
  chemically synthesized
ggaaccaagccaaaaaatataa

SEQ ID NO: 815975 - DNA, 22 bp, Artificial Sequence
  chemically synthesized
gaaccaagccaaaaaatataaa

SEQ ID NO: 815976 - DNA, 22 bp, Artificial Sequence
  chemically synthesized
atgggaatgacttccagtttat

SEQ ID NO: 815977 - DNA, 22 bp, Artificial Sequence
  chemically synthesized
catgggaatgacttccagttta

SEQ ID NO: 815978 - DNA, 22 bp, Artificial Sequence
  chemically synthesized
ttcatgggaatgacttccagtt

SEQ ID NO: 815979 - DNA, 22 bp, Artificial Sequence
  chemically synthesized
gattcttcatgggaatgacttc

SEQ ID NO: 815980 - DNA, 22 bp, Artificial Sequence
  chemically synthesized
tggattcttcatgggaatgact

SEQ ID NO: 815981 - DNA, 22 bp, Artificial Sequence
  chemically synthesized
gaagtcattcccatgaagaatc

SEQ ID NO: 815982 - DNA, 22 bp, Artificial Sequence
  chemically synthesized
tcaaggtctctggattcttcat

SEQ ID NO: 815983 - DNA, 22 bp, Artificial Sequence
  chemically synthesized
atcaaggtctctggattcttca

SEQ ID NO: 815984 - DNA, 22 bp, Artificial Sequence
  chemically synthesized
tatcaaggtctctggattcttc

SEQ ID NO: 815985 - DNA, 22 bp, Artificial Sequence
  chemically synthesized
ttttatcaaggtctctggattc

SEQ ID NO: 815986 - DNA, 22 bp, Artificial Sequence
  chemically synthesized
ccatgaagaatccagagacctt

SEQ ID NO: 815987 - DNA, 22 bp, Artificial Sequence
  chemically synthesized
aaaaattgttttatcaaggtct

SEQ ID NO: 815988 - DNA, 22 bp, Artificial Sequence
  chemically synthesized
aaaaaattgttttatcaaggtc

SEQ ID NO: 815989 - DNA, 22 bp, Artificial Sequence
  chemically synthesized
taaaaaattgttttatcaaggt

SEQ ID NO: 815990 - DNA, 22 bp, Artificial Sequence
  chemically synthesized
ttaaaaaattgttttatcaagg

SEQ ID NO: 815991 - DNA, 22 bp, Artificial Sequence
  chemically synthesized
tttaaaaaattgttttatcaag

SEQ ID NO: 815992 - DNA, 22 bp, Artificial Sequence
  chemically synthesized
agttttttaaaaaattgtttta

SEQ ID NO: 815993 - DNA, 22 bp, Artificial Sequence
  chemically synthesized
tcagttttttaaaaaattgttt

SEQ ID NO: 815994 - DNA, 22 bp, Artificial Sequence
  chemically synthesized
tctcagttttttaaaaaattgt

SEQ ID NO: 815995 - DNA, 22 bp, Artificial Sequence
  chemically synthesized
gataaaacaattttttaaaaaa

SEQ ID NO: 815996 - DNA, 22 bp, Artificial Sequence
  chemically synthesized
ataaaacaattttttaaaaaac

SEQ ID NO: 815997 - DNA, 22 bp, Artificial Sequence
  chemically synthesized
atggcccaagccactctctcag

SEQ ID NO: 815998 - DNA, 22 bp, Artificial Sequence
  chemically synthesized
gatggcccaagccactctctca

SEQ ID NO: 815999 - DNA, 22 bp, Artificial Sequence
  chemically synthesized
tttaaaaaactgagagagtggc

SEQ ID NO: 816000 - DNA, 22 bp, Artificial Sequence
  chemically synthesized
ttaaaaaactgagagagtggct

SEQ ID NO: 816001 - DNA, 22 bp, Artificial Sequence
  chemically synthesized
cttgatggcccaagccactctc

SEQ ID NO: 816002 - DNA, 22 bp, Artificial Sequence
  chemically synthesized
taaaaaactgagagagtggctt

SEQ ID NO: 816003 - DNA, 22 bp, Artificial Sequence
  chemically synthesized
aaaaaactgagagagtggcttg

SEQ ID NO: 816004 - DNA, 22 bp, Artificial Sequence
  chemically synthesized
aaaaactgagagagtggcttgg

SEQ ID NO: 816005 - DNA, 22 bp, Artificial Sequence
  chemically synthesized
atgctccttgatggcccaagcc

SEQ ID NO: 816006 - DNA, 22 bp, Artificial Sequence
  chemically synthesized
tcatgctccttgatggcccaag

SEQ ID NO: 816007 - DNA, 22 bp, Artificial Sequence
  chemically synthesized
agagagtggcttgggccatcaa

SEQ ID NO: 816008 - DNA, 22 bp, Artificial Sequence
  chemically synthesized
attctcatgctccttgatggcc

SEQ ID NO: 816009 - DNA, 22 bp, Artificial Sequence
  chemically synthesized
cattctcatgctccttgatggc

SEQ ID NO: 816010 - DNA, 22 bp, Artificial Sequence
  chemically synthesized
ttcattctcatgctccttgatg

SEQ ID NO: 816011 - DNA, 22 bp, Artificial Sequence
  chemically synthesized
tcttcattctcatgctccttga

SEQ ID NO: 816012 - DNA, 22 bp, Artificial Sequence
  chemically synthesized
gggccatcaaggagcatgagaa

SEQ ID NO: 816013 - DNA, 22 bp, Artificial Sequence
  chemically synthesized
ggccatcaaggagcatgagaat

SEQ ID NO: 816014 - DNA, 22 bp, Artificial Sequence
  chemically synthesized
acagacccctctcttcattctc

SEQ ID NO: 816015 - DNA, 22 bp, Artificial Sequence
  chemically synthesized
tgacagacccctctcttcattc

SEQ ID NO: 816016 - DNA, 22 bp, Artificial Sequence
  chemically synthesized
ctgacagacccctctcttcatt

SEQ ID NO: 816017 - DNA, 22 bp, Artificial Sequence
  chemically synthesized
tctgacagacccctctcttcat

SEQ ID NO: 816018 - DNA, 22 bp, Artificial Sequence
  chemically synthesized
tttctgacagacccctctcttc

SEQ ID NO: 816019 - DNA, 22 bp, Artificial Sequence
  chemically synthesized
ctctttctgacagacccctctc

SEQ ID NO: 816020 - DNA, 22 bp, Artificial Sequence
  chemically synthesized
tactactctttctgacagaccc

SEQ ID NO: 816021 - DNA, 22 bp, Artificial Sequence
  chemically synthesized
tctatactactctttctgacag

SEQ ID NO: 816022 - DNA, 22 bp, Artificial Sequence
  chemically synthesized
gtctatctatactactctttct

SEQ ID NO: 816023 - DNA, 22 bp, Artificial Sequence
  chemically synthesized
atctagtctatctatactactc

SEQ ID NO: 816024 - DNA, 22 bp, Artificial Sequence
  chemically synthesized
tcagaaagagtagtatagatag

SEQ ID NO: 816025 - DNA, 22 bp, Artificial Sequence
  chemically synthesized
aggacactgatctagtctatct

SEQ ID NO: 816026 - DNA, 22 bp, Artificial Sequence
  chemically synthesized
gaggacactgatctagtctatc

SEQ ID NO: 816027 - DNA, 22 bp, Artificial Sequence
  chemically synthesized
gagcttgaggacactgatctag

SEQ ID NO: 816028 - DNA, 22 bp, Artificial Sequence
  chemically synthesized
atggtatgaaactagagcttga

SEQ ID NO: 816029 - DNA, 22 bp, Artificial Sequence
  chemically synthesized
gatcagtgtcctcaagctctag

SEQ ID NO: 816030 - DNA, 22 bp, Artificial Sequence
  chemically synthesized
ctcatggtatgaaactagagct

SEQ ID NO: 816031 - DNA, 22 bp, Artificial Sequence
  chemically synthesized
gctcatggtatgaaactagagc

SEQ ID NO: 816032 - DNA, 22 bp, Artificial Sequence
  chemically synthesized
aagctctagtttcataccatga

SEQ ID NO: 816033 - DNA, 22 bp, Artificial Sequence
  chemically synthesized
tagtttcataccatgagcaagc

SEQ ID NO: 816034 - DNA, 22 bp, Artificial Sequence
  chemically synthesized
gtttcataccatgagcaagctt

SEQ ID NO: 816035 - DNA, 22 bp, Artificial Sequence
  chemically synthesized
aggggccaagaaaaaagcttgc

SEQ ID NO: 816036 - DNA, 22 bp, Artificial Sequence
  chemically synthesized
cataccatgagcaagctttttt

SEQ ID NO: 816037 - DNA, 22 bp, Artificial Sequence
  chemically synthesized
ataccatgagcaagcttttttc

SEQ ID NO: 816038 - DNA, 22 bp, Artificial Sequence
  chemically synthesized
ggtaatataaactaaggggcca

SEQ ID NO: 816039 - DNA, 22 bp, Artificial Sequence
  chemically synthesized
aggtaatataaactaaggggcc

SEQ ID NO: 816040 - DNA, 22 bp, Artificial Sequence
  chemically synthesized
ttttcttggccccttagtttat

SEQ ID NO: 816041 - DNA, 22 bp, Artificial Sequence
  chemically synthesized
tttcttggccccttagtttata

SEQ ID NO: 816042 - DNA, 22 bp, Artificial Sequence
  chemically synthesized
ttcttggccccttagtttatat

SEQ ID NO: 816043 - DNA, 22 bp, Artificial Sequence
  chemically synthesized
tcttggccccttagtttatatt

SEQ ID NO: 816044 - DNA, 22 bp, Artificial Sequence
  chemically synthesized
atgagtttaggtaatataaact

SEQ ID NO: 816045 - DNA, 22 bp, Artificial Sequence
  chemically synthesized
cttggccccttagtttatatta

SEQ ID NO: 816046 - DNA, 22 bp, Artificial Sequence
  chemically synthesized
gatgagtttaggtaatataaac

SEQ ID NO: 816047 - DNA, 22 bp, Artificial Sequence
  chemically synthesized
ttggccccttagtttatattac

SEQ ID NO: 816048 - DNA, 22 bp, Artificial Sequence
  chemically synthesized
ggccccttagtttatattacct

SEQ ID NO: 816049 - DNA, 22 bp, Artificial Sequence
  chemically synthesized
gccccttagtttatattaccta

SEQ ID NO: 816050 - DNA, 22 bp, Artificial Sequence
  chemically synthesized
atttgatgagtttaggtaatat

SEQ ID NO: 816051 - DNA, 22 bp, Artificial Sequence
  chemically synthesized
agtttatattacctaaactcat

SEQ ID NO: 816052 - DNA, 22 bp, Artificial Sequence
  chemically synthesized
gtttatattacctaaactcatc

SEQ ID NO: 816053 - DNA, 22 bp, Artificial Sequence
  chemically synthesized
atattacctaaactcatcaaat

SEQ ID NO: 816054 - DNA, 22 bp, Artificial Sequence
  chemically synthesized
tattacctaaactcatcaaatt

SEQ ID NO: 816055 - DNA, 22 bp, Artificial Sequence
  chemically synthesized
aagtcagagattaatttgatga

SEQ ID NO: 816056 - DNA, 22 bp, Artificial Sequence
  chemically synthesized
cctaaactcatcaaattaatct

SEQ ID NO: 816057 - DNA, 22 bp, Artificial Sequence
  chemically synthesized
aactcatcaaattaatctctga

SEQ ID NO: 816058 - DNA, 22 bp, Artificial Sequence
  chemically synthesized
atcaaattaatctctgacttta

SEQ ID NO: 816059 - DNA, 22 bp, Artificial Sequence
  chemically synthesized
gggaaagcaaattaaagtcaga

SEQ ID NO: 816060 - DNA, 22 bp, Artificial Sequence
  chemically synthesized
ggggaaagcaaattaaagtcag

SEQ ID NO: 816061 - DNA, 22 bp, Artificial Sequence
  chemically synthesized
tggggaaagcaaattaaagtca

SEQ ID NO: 816062 - DNA, 22 bp, Artificial Sequence
  chemically synthesized
ttggggaaagcaaattaaagtc

SEQ ID NO: 816063 - DNA, 22 bp, Artificial Sequence
  chemically synthesized
atctctgactttaatttgcttt

SEQ ID NO: 816064 - DNA, 22 bp, Artificial Sequence
  chemically synthesized
tgactttaatttgctttcccca

SEQ ID NO: 816065 - DNA, 22 bp, Artificial Sequence
  chemically synthesized
actttaatttgctttccccaaa

SEQ ID NO: 816066 - DNA, 22 bp, Artificial Sequence
  chemically synthesized
aaagagaagtcttttggggaaa

SEQ ID NO: 816067 - DNA, 22 bp, Artificial Sequence
  chemically synthesized
tcaaagagaagtcttttgggga

SEQ ID NO: 816068 - DNA, 22 bp, Artificial Sequence
  chemically synthesized
ctcaaagagaagtcttttgggg

SEQ ID NO: 816069 - DNA, 22 bp, Artificial Sequence
  chemically synthesized
taatttgctttccccaaaagac

SEQ ID NO: 816070 - DNA, 22 bp, Artificial Sequence
  chemically synthesized
aatttgctttccccaaaagact

SEQ ID NO: 816071 - DNA, 22 bp, Artificial Sequence
  chemically synthesized
atttgctttccccaaaagactt

SEQ ID NO: 816072 - DNA, 22 bp, Artificial Sequence
  chemically synthesized
cttctcaaagagaagtcttttg

SEQ ID NO: 816073 - DNA, 22 bp, Artificial Sequence
  chemically synthesized
gctttccccaaaagacttctct

SEQ ID NO: 816074 - DNA, 22 bp, Artificial Sequence
  chemically synthesized
ctttccccaaaagacttctctt

SEQ ID NO: 816075 - DNA, 22 bp, Artificial Sequence
  chemically synthesized
tccccaaaagacttctctttga

SEQ ID NO: 816076 - DNA, 22 bp, Artificial Sequence
  chemically synthesized
ccccaaaagacttctctttgag

SEQ ID NO: 816077 - DNA, 22 bp, Artificial Sequence
  chemically synthesized
cccaaaagacttctctttgaga

SEQ ID NO: 816078 - DNA, 22 bp, Artificial Sequence
  chemically synthesized
gtgggaaatatctgcttctcaa

SEQ ID NO: 816079 - DNA, 22 bp, Artificial Sequence
  chemically synthesized
agtgggaaatatctgcttctca

SEQ ID NO: 816080 - DNA, 22 bp, Artificial Sequence
  chemically synthesized
gatcttagtgggaaatatctgc

SEQ ID NO: 816081 - DNA, 22 bp, Artificial Sequence
  chemically synthesized
ctctttgagaagcagatatttc

SEQ ID NO: 816082 - DNA, 22 bp, Artificial Sequence
  chemically synthesized
tctttgagaagcagatatttcc

SEQ ID NO: 816083 - DNA, 22 bp, Artificial Sequence
  chemically synthesized
tttgagaagcagatatttccca

SEQ ID NO: 816084 - DNA, 22 bp, Artificial Sequence
  chemically synthesized
tgagaagcagatatttcccact

SEQ ID NO: 816085 - DNA, 22 bp, Artificial Sequence
  chemically synthesized
gagaagcagatatttcccacta

SEQ ID NO: 816086 - DNA, 22 bp, Artificial Sequence
  chemically synthesized
agaagcagatatttcccactaa

SEQ ID NO: 816087 - DNA, 22 bp, Artificial Sequence
  chemically synthesized
gtatcagagagtcaaccattag

SEQ ID NO: 816088 - DNA, 22 bp, Artificial Sequence
  chemically synthesized
cccactaagatctaatggttga

SEQ ID NO: 816089 - DNA, 22 bp, Artificial Sequence
  chemically synthesized
ccactaagatctaatggttgac

SEQ ID NO: 816090 - DNA, 22 bp, Artificial Sequence
  chemically synthesized
agatctaatggttgactctctg

SEQ ID NO: 816091 - DNA, 22 bp, Artificial Sequence
  chemically synthesized
atggttgactctctgataccaa

SEQ ID NO: 816092 - DNA, 22 bp, Artificial Sequence
  chemically synthesized
acatggaatcaattggtatcag

SEQ ID NO: 816093 - DNA, 22 bp, Artificial Sequence
  chemically synthesized
ttcacatggaatcaattggtat

SEQ ID NO: 816094 - DNA, 22 bp, Artificial Sequence
  chemically synthesized
actctctgataccaattgattc

SEQ ID NO: 816095 - DNA, 22 bp, Artificial Sequence
  chemically synthesized
tctgataccaattgattccatg

SEQ ID NO: 816096 - DNA, 22 bp, Artificial Sequence
  chemically synthesized
tgataccaattgattccatgtg

SEQ ID NO: 816097 - DNA, 22 bp, Artificial Sequence
  chemically synthesized
aggaagaattattcacatggaa

SEQ ID NO: 816098 - DNA, 22 bp, Artificial Sequence
  chemically synthesized
ataccaattgattccatgtgaa

SEQ ID NO: 816099 - DNA, 22 bp, Artificial Sequence
  chemically synthesized
ggttcaggaagaattattcaca

SEQ ID NO: 816100 - DNA, 22 bp, Artificial Sequence
  chemically synthesized
attccatgtgaataattcttcc

SEQ ID NO: 816101 - DNA, 22 bp, Artificial Sequence
  chemically synthesized
catgtgaataattcttcctgaa

SEQ ID NO: 816102 - DNA, 22 bp, Artificial Sequence
  chemically synthesized
aacagggacagattaggttcag

SEQ ID NO: 816103 - DNA, 22 bp, Artificial Sequence
  chemically synthesized
aattaaacagggacagattagg

SEQ ID NO: 816104 - DNA, 22 bp, Artificial Sequence
  chemically synthesized
ttcctgaacctaatctgtccct

SEQ ID NO: 816105 - DNA, 22 bp, Artificial Sequence
  chemically synthesized
cctgaacctaatctgtccctgt

SEQ ID NO: 816106 - DNA, 22 bp, Artificial Sequence
  chemically synthesized
ctgaacctaatctgtccctgtt

SEQ ID NO: 816107 - DNA, 22 bp, Artificial Sequence
  chemically synthesized
tatgtgttcaattaaacaggga

SEQ ID NO: 816108 - DNA, 22 bp, Artificial Sequence
  chemically synthesized
aacctaatctgtccctgtttaa

SEQ ID NO: 816109 - DNA, 22 bp, Artificial Sequence
  chemically synthesized
atatgtgttcaattaaacaggg

SEQ ID NO: 816110 - DNA, 22 bp, Artificial Sequence
  chemically synthesized
atctgtccctgtttaattgaac

SEQ ID NO: 816111 - DNA, 22 bp, Artificial Sequence
  chemically synthesized
tccctgtttaattgaacacata

SEQ ID NO: 816112 - DNA, 22 bp, Artificial Sequence
  chemically synthesized
aaaatacagatcttatatgtgt

SEQ ID NO: 816113 - DNA, 22 bp, Artificial Sequence
  chemically synthesized
tcaaaatacagatcttatatgt

SEQ ID NO: 816114 - DNA, 22 bp, Artificial Sequence
  chemically synthesized
tttaattgaacacatataagat

SEQ ID NO: 816115 - DNA, 22 bp, Artificial Sequence
  chemically synthesized
ctcaaaatacagatcttatatg

SEQ ID NO: 816116 - DNA, 22 bp, Artificial Sequence
  chemically synthesized
ttctcaaaatacagatcttata

SEQ ID NO: 816117 - DNA, 22 bp, Artificial Sequence
  chemically synthesized
aattgaacacatataagatctg

SEQ ID NO: 816118 - DNA, 22 bp, Artificial Sequence
  chemically synthesized
cttctcaaaatacagatcttat

SEQ ID NO: 816119 - DNA, 22 bp, Artificial Sequence
  chemically synthesized
attgaacacatataagatctgt

SEQ ID NO: 816120 - DNA, 22 bp, Artificial Sequence
  chemically synthesized
tcttctcaaaatacagatctta

SEQ ID NO: 816121 - DNA, 22 bp, Artificial Sequence
  chemically synthesized
aacacatataagatctgtattt

SEQ ID NO: 816122 - DNA, 22 bp, Artificial Sequence
  chemically synthesized
gactttcttctcaaaatacaga

SEQ ID NO: 816123 - DNA, 22 bp, Artificial Sequence
  chemically synthesized
ggactttcttctcaaaatacag

SEQ ID NO: 816124 - DNA, 22 bp, Artificial Sequence
  chemically synthesized
aatggcaaggcttggactttct

SEQ ID NO: 816125 - DNA, 22 bp, Artificial Sequence
  chemically synthesized
tattttgagaagaaagtccaag

SEQ ID NO: 816126 - DNA, 22 bp, Artificial Sequence
  chemically synthesized
tcaatggcaaggcttggacttt

SEQ ID NO: 816127 - DNA, 22 bp, Artificial Sequence
  chemically synthesized
ctcaatggcaaggcttggactt

SEQ ID NO: 816128 - DNA, 22 bp, Artificial Sequence
  chemically synthesized
tctcaatggcaaggcttggact

SEQ ID NO: 816129 - DNA, 22 bp, Artificial Sequence
  chemically synthesized
ttctcaatggcaaggcttggac

SEQ ID NO: 816130 - DNA, 22 bp, Artificial Sequence
  chemically synthesized
tttctcaatggcaaggcttgga

SEQ ID NO: 816131 - DNA, 22 bp, Artificial Sequence
  chemically synthesized
tgagaagaaagtccaagccttg

SEQ ID NO: 816132 - DNA, 22 bp, Artificial Sequence
  chemically synthesized
gagaagaaagtccaagccttgc

SEQ ID NO: 816133 - DNA, 22 bp, Artificial Sequence
  chemically synthesized
agaagaaagtccaagccttgcc

SEQ ID NO: 816134 - DNA, 22 bp, Artificial Sequence
  chemically synthesized
ctttttctcaatggcaaggctt

SEQ ID NO: 816135 - DNA, 22 bp, Artificial Sequence
  chemically synthesized
atagtaactactttttctcaat

SEQ ID NO: 816136 - DNA, 22 bp, Artificial Sequence
  chemically synthesized
tcatagtaactactttttctca

SEQ ID NO: 816137 - DNA, 22 bp, Artificial Sequence
  chemically synthesized
gccattgagaaaaagtagttac

SEQ ID NO: 816138 - DNA, 22 bp, Artificial Sequence
  chemically synthesized
ccattgagaaaaagtagttact

SEQ ID NO: 816139 - DNA, 22 bp, Artificial Sequence
  chemically synthesized
gaaaaattctcatagtaactac

SEQ ID NO: 816140 - DNA, 22 bp, Artificial Sequence
  chemically synthesized
ggaaaaattctcatagtaacta

SEQ ID NO: 816141 - DNA, 22 bp, Artificial Sequence
  chemically synthesized
agaaaaagtagttactatgaga

SEQ ID NO: 816142 - DNA, 22 bp, Artificial Sequence
  chemically synthesized
atatttggaaaaattctcatag

SEQ ID NO: 816143 - DNA, 22 bp, Artificial Sequence
  chemically synthesized
ctatgagaatttttccaaatat

SEQ ID NO: 816144 - DNA, 22 bp, Artificial Sequence
  chemically synthesized
aatatggagctgatatttggaa

SEQ ID NO: 816145 - DNA, 22 bp, Artificial Sequence
  chemically synthesized
gaatatggagctgatatttgga

SEQ ID NO: 816146 - DNA, 22 bp, Artificial Sequence
  chemically synthesized
tgagaatttttccaaatatcag

SEQ ID NO: 816147 - DNA, 22 bp, Artificial Sequence
  chemically synthesized
ttccaaatatcagctccatatt

SEQ ID NO: 816148 - DNA, 22 bp, Artificial Sequence
  chemically synthesized
tccaaatatcagctccatattc

SEQ ID NO: 816149 - DNA, 22 bp, Artificial Sequence
  chemically synthesized
ccaaatatcagctccatattca

SEQ ID NO: 816150 - DNA, 22 bp, Artificial Sequence
  chemically synthesized
caaatatcagctccatattcaa

SEQ ID NO: 816151 - DNA, 22 bp, Artificial Sequence
  chemically synthesized
gtggagaaagggcaaacttgaa

SEQ ID NO: 816152 - DNA, 22 bp, Artificial Sequence
  chemically synthesized
catattcaagtttgccctttct

SEQ ID NO: 816153 - DNA, 22 bp, Artificial Sequence
  chemically synthesized
tgaaaaagaccctggtggagaa

SEQ ID NO: 816154 - DNA, 22 bp, Artificial Sequence
  chemically synthesized
aagtttgccctttctccaccag

SEQ ID NO: 816155 - DNA, 22 bp, Artificial Sequence
  chemically synthesized
gccctttctccaccagggtctt

SEQ ID NO: 816156 - DNA, 22 bp, Artificial Sequence
  chemically synthesized
ccctttctccaccagggtcttt

SEQ ID NO: 816157 - DNA, 22 bp, Artificial Sequence
  chemically synthesized
gagccctatgaaaaagaccctg

SEQ ID NO: 816158 - DNA, 22 bp, Artificial Sequence
  chemically synthesized
attggagccctatgaaaaagac

SEQ ID NO: 816159 - DNA, 22 bp, Artificial Sequence
  chemically synthesized
tctccaccagggtctttttcat

SEQ ID NO: 816160 - DNA, 22 bp, Artificial Sequence
  chemically synthesized
aattggagccctatgaaaaaga

SEQ ID NO: 816161 - DNA, 22 bp, Artificial Sequence
  chemically synthesized
ctccaccagggtctttttcata

SEQ ID NO: 816162 - DNA, 22 bp, Artificial Sequence
  chemically synthesized
taattggagccctatgaaaaag

SEQ ID NO: 816163 - DNA, 22 bp, Artificial Sequence
  chemically synthesized
tccaccagggtctttttcatag

SEQ ID NO: 816164 - DNA, 22 bp, Artificial Sequence
  chemically synthesized
caccagggtctttttcataggg

SEQ ID NO: 816165 - DNA, 22 bp, Artificial Sequence
  chemically synthesized
ggaagttttaattggagcccta

SEQ ID NO: 816166 - DNA, 22 bp, Artificial Sequence
  chemically synthesized
aagttgggaagttttaattgga

SEQ ID NO: 816167 - DNA, 22 bp, Artificial Sequence
  chemically synthesized
tttcatagggctccaattaaaa

SEQ ID NO: 816168 - DNA, 22 bp, Artificial Sequence
  chemically synthesized
ttcatagggctccaattaaaac

SEQ ID NO: 816169 - DNA, 22 bp, Artificial Sequence
  chemically synthesized
tcatagggctccaattaaaact

SEQ ID NO: 816170 - DNA, 22 bp, Artificial Sequence
  chemically synthesized
catagggctccaattaaaactt

SEQ ID NO: 816171 - DNA, 22 bp, Artificial Sequence
  chemically synthesized
atagggctccaattaaaacttc

SEQ ID NO: 816172 - DNA, 22 bp, Artificial Sequence
  chemically synthesized
aacctaaagttgggaagtttta

SEQ ID NO: 816173 - DNA, 22 bp, Artificial Sequence
  chemically synthesized
caattaaaacttcccaacttta

SEQ ID NO: 816174 - DNA, 22 bp, Artificial Sequence
  chemically synthesized
aaacttcccaactttaggttga

SEQ ID NO: 816175 - DNA, 22 bp, Artificial Sequence
  chemically synthesized
cccaactttaggttgaatcttc

SEQ ID NO: 816176 - DNA, 22 bp, Artificial Sequence
  chemically synthesized
ccaactttaggttgaatcttct

SEQ ID NO: 816177 - DNA, 22 bp, Artificial Sequence
  chemically synthesized
taggttgaatcttcttttccat

SEQ ID NO: 816178 - DNA, 22 bp, Artificial Sequence
  chemically synthesized
aggttgaatcttcttttccatg

SEQ ID NO: 816179 - DNA, 22 bp, Artificial Sequence
  chemically synthesized
ggttgaatcttcttttccatgg

SEQ ID NO: 816180 - DNA, 22 bp, Artificial Sequence
  chemically synthesized
aatcttcttttccatggtcttt

SEQ ID NO: 816181 - DNA, 22 bp, Artificial Sequence
  chemically synthesized
cttttccatggtcttttccatc

SEQ ID NO: 816182 - DNA, 22 bp, Artificial Sequence
  chemically synthesized
ttttccatggtcttttccatct

SEQ ID NO: 816183 - DNA, 22 bp, Artificial Sequence
  chemically synthesized
ttccatggtcttttccatctat

SEQ ID NO: 816184 - DNA, 22 bp, Artificial Sequence
  chemically synthesized
tccatggtcttttccatctata

SEQ ID NO: 816185 - DNA, 22 bp, Artificial Sequence
  chemically synthesized
ccatggtcttttccatctatac

SEQ ID NO: 816186 - DNA, 22 bp, Artificial Sequence
  chemically synthesized
cagacagtaggtgtatagatgg

SEQ ID NO: 816187 - DNA, 22 bp, Artificial Sequence
  chemically synthesized
catggtcttttccatctataca

SEQ ID NO: 816188 - DNA, 22 bp, Artificial Sequence
  chemically synthesized
aattccagacagtaggtgtata

SEQ ID NO: 816189 - DNA, 22 bp, Artificial Sequence
  chemically synthesized
ttccatctatacacctactgtc

SEQ ID NO: 816190 - DNA, 22 bp, Artificial Sequence
  chemically synthesized
tccatctatacacctactgtct

SEQ ID NO: 816191 - DNA, 22 bp, Artificial Sequence
  chemically synthesized
atcctgaattccagacagtagg

SEQ ID NO: 816192 - DNA, 22 bp, Artificial Sequence
  chemically synthesized
ccatctatacacctactgtctg

SEQ ID NO: 816193 - DNA, 22 bp, Artificial Sequence
  chemically synthesized
catctatacacctactgtctgg

SEQ ID NO: 816194 - DNA, 22 bp, Artificial Sequence
  chemically synthesized
taatcctgaattccagacagta

SEQ ID NO: 816195 - DNA, 22 bp, Artificial Sequence
  chemically synthesized
tacacctactgtctggaattca

SEQ ID NO: 816196 - DNA, 22 bp, Artificial Sequence
  chemically synthesized
ctgtctggaattcaggattaga

SEQ ID NO: 816197 - DNA, 22 bp, Artificial Sequence
  chemically synthesized
gggaatagagcaactctaatcc

SEQ ID NO: 816198 - DNA, 22 bp, Artificial Sequence
  chemically synthesized
tctggaattcaggattagagtt

SEQ ID NO: 816199 - DNA, 22 bp, Artificial Sequence
  chemically synthesized
gaattcaggattagagttgctc

SEQ ID NO: 816200 - DNA, 22 bp, Artificial Sequence
  chemically synthesized
gtcaccctggggaatagagcaa

SEQ ID NO: 816201 - DNA, 22 bp, Artificial Sequence
  chemically synthesized
aggattagagttgctctattcc

SEQ ID NO: 816202 - DNA, 22 bp, Artificial Sequence
  chemically synthesized
agctggtcaccctggggaatag

SEQ ID NO: 816203 - DNA, 22 bp, Artificial Sequence
  chemically synthesized
aagctggtcaccctggggaata

SEQ ID NO: 816204 - DNA, 22 bp, Artificial Sequence
  chemically synthesized
gagttgctctattccccagggt

SEQ ID NO: 816205 - DNA, 22 bp, Artificial Sequence
  chemically synthesized
aatttaagctggtcaccctggg

SEQ ID NO: 816206 - DNA, 22 bp, Artificial Sequence
  chemically synthesized
ctctattccccagggtgaccag

SEQ ID NO: 816207 - DNA, 22 bp, Artificial Sequence
  chemically synthesized
tattccccagggtgaccagctt

SEQ ID NO: 816208 - DNA, 22 bp, Artificial Sequence
  chemically synthesized
tgaagctgaatttaagctggtc

SEQ ID NO: 816209 - DNA, 22 bp, Artificial Sequence
  chemically synthesized
ttccccagggtgaccagcttaa

SEQ ID NO: 816210 - DNA, 22 bp, Artificial Sequence
  chemically synthesized
ctgtgaagctgaatttaagctg

SEQ ID NO: 816211 - DNA, 22 bp, Artificial Sequence
  chemically synthesized
cccagggtgaccagcttaaatt

SEQ ID NO: 816212 - DNA, 22 bp, Artificial Sequence
  chemically synthesized
gagagtaaaaactcctgtgaag

SEQ ID NO: 816213 - DNA, 22 bp, Artificial Sequence
  chemically synthesized
aaattcagcttcacaggagttt

SEQ ID NO: 816214 - DNA, 22 bp, Artificial Sequence
  chemically synthesized
aattcagcttcacaggagtttt

SEQ ID NO: 816215 - DNA, 22 bp, Artificial Sequence
  chemically synthesized
gacattagagagtaaaaactcc

SEQ ID NO: 816216 - DNA, 22 bp, Artificial Sequence
  chemically synthesized
agcttcacaggagtttttactc

SEQ ID NO: 816217 - DNA, 22 bp, Artificial Sequence
  chemically synthesized
agctagacattagagagtaaaa

SEQ ID NO: 816218 - DNA, 22 bp, Artificial Sequence
  chemically synthesized
cacaggagtttttactctctaa

SEQ ID NO: 816219 - DNA, 22 bp, Artificial Sequence
  chemically synthesized
acaggagtttttactctctaat

SEQ ID NO: 816220 - DNA, 22 bp, Artificial Sequence
  chemically synthesized
aaactgagctagacattagaga

SEQ ID NO: 816221 - DNA, 22 bp, Artificial Sequence
  chemically synthesized
gaaactgagctagacattagag

SEQ ID NO: 816222 - DNA, 22 bp, Artificial Sequence
  chemically synthesized
tgaaactgagctagacattaga

SEQ ID NO: 816223 - DNA, 22 bp, Artificial Sequence
  chemically synthesized
aattttgaaactgagctagaca

SEQ ID NO: 816224 - DNA, 22 bp, Artificial Sequence
  chemically synthesized
ttactctctaatgtctagctca

SEQ ID NO: 816225 - DNA, 22 bp, Artificial Sequence
  chemically synthesized
tactctctaatgtctagctcag

SEQ ID NO: 816226 - DNA, 22 bp, Artificial Sequence
  chemically synthesized
actctctaatgtctagctcagt

SEQ ID NO: 816227 - DNA, 22 bp, Artificial Sequence
  chemically synthesized
ctctctaatgtctagctcagtt

SEQ ID NO: 816228 - DNA, 22 bp, Artificial Sequence
  chemically synthesized
tctaatgtctagctcagtttca

SEQ ID NO: 816229 - DNA, 22 bp, Artificial Sequence
  chemically synthesized
taatgtctagctcagtttcaaa

SEQ ID NO: 816230 - DNA, 22 bp, Artificial Sequence
  chemically synthesized
atgtctagctcagtttcaaaat

SEQ ID NO: 816231 - DNA, 22 bp, Artificial Sequence
  chemically synthesized
agcggccaactaaattttgaaa

SEQ ID NO: 816232 - DNA, 22 bp, Artificial Sequence
  chemically synthesized
gctcagtttcaaaatttagttg

SEQ ID NO: 816233 - DNA, 22 bp, Artificial Sequence
  chemically synthesized
agtttcaaaatttagttggccg

SEQ ID NO: 816234 - DNA, 22 bp, Artificial Sequence
  chemically synthesized
caaaatttagttggccgcttaa

SEQ ID NO: 816235 - DNA, 22 bp, Artificial Sequence
  chemically synthesized
aaaatttagttggccgcttaat

SEQ ID NO: 816236 - DNA, 22 bp, Artificial Sequence
  chemically synthesized
agttggccgcttaatttccata

SEQ ID NO: 816237 - DNA, 22 bp, Artificial Sequence
  chemically synthesized
gttggccgcttaatttccatat

SEQ ID NO: 816238 - DNA, 22 bp, Artificial Sequence
  chemically synthesized
gccgcttaatttccatatatca

SEQ ID NO: 816239 - DNA, 22 bp, Artificial Sequence
  chemically synthesized
ggagaaatgagataatgatata

SEQ ID NO: 816240 - DNA, 22 bp, Artificial Sequence
  chemically synthesized
aggagaaatgagataatgatat

SEQ ID NO: 816241 - DNA, 22 bp, Artificial Sequence
  chemically synthesized
aatttccatatatcattatctc

SEQ ID NO: 816242 - DNA, 22 bp, Artificial Sequence
  chemically synthesized
atttccatatatcattatctca

SEQ ID NO: 816243 - DNA, 22 bp, Artificial Sequence
  chemically synthesized
ccatatatcattatctcatttc

SEQ ID NO: 816244 - DNA, 22 bp, Artificial Sequence
  chemically synthesized
catatatcattatctcatttct

SEQ ID NO: 816245 - DNA, 22 bp, Artificial Sequence
  chemically synthesized
agagtaggaagtcttaggagaa

SEQ ID NO: 816246 - DNA, 22 bp, Artificial Sequence
  chemically synthesized
aactaagagtaggaagtcttag

SEQ ID NO: 816247 - DNA, 22 bp, Artificial Sequence
  chemically synthesized
tctcatttctcctaagacttcc

SEQ ID NO: 816248 - DNA, 22 bp, Artificial Sequence
  chemically synthesized
gaactaagagtaggaagtctta

SEQ ID NO: 816249 - DNA, 22 bp, Artificial Sequence
  chemically synthesized
tgaactaagagtaggaagtctt

SEQ ID NO: 816250 - DNA, 22 bp, Artificial Sequence
  chemically synthesized
atttctcctaagacttcctact

SEQ ID NO: 816251 - DNA, 22 bp, Artificial Sequence
  chemically synthesized
ctcctaagacttcctactctta

SEQ ID NO: 816252 - DNA, 22 bp, Artificial Sequence
  chemically synthesized
tcctaagacttcctactcttag

SEQ ID NO: 816253 - DNA, 22 bp, Artificial Sequence
  chemically synthesized
ctaagacttcctactcttagtt

SEQ ID NO: 816254 - DNA, 22 bp, Artificial Sequence
  chemically synthesized
agacttcctactcttagttcaa

SEQ ID NO: 816255 - DNA, 22 bp, Artificial Sequence
  chemically synthesized
gggccaaaacagattttgaact

SEQ ID NO: 816256 - DNA, 22 bp, Artificial Sequence
  chemically synthesized
cctactcttagttcaaaatctg

SEQ ID NO: 816257 - DNA, 22 bp, Artificial Sequence
  chemically synthesized
ctactcttagttcaaaatctgt

SEQ ID NO: 816258 - DNA, 22 bp, Artificial Sequence
  chemically synthesized
ctcttagttcaaaatctgtttt

SEQ ID NO: 816259 - DNA, 22 bp, Artificial Sequence
  chemically synthesized
ttagttcaaaatctgttttggc

SEQ ID NO: 816260 - DNA, 22 bp, Artificial Sequence
  chemically synthesized
agttcaaaatctgttttggccc

SEQ ID NO: 816261 - DNA, 22 bp, Artificial Sequence
  chemically synthesized
gttcaaaatctgttttggcccc

SEQ ID NO: 816262 - DNA, 22 bp, Artificial Sequence
  chemically synthesized
aaaatctgttttggccccagtg

SEQ ID NO: 816263 - DNA, 22 bp, Artificial Sequence
  chemically synthesized
acaagaagtaaaagtcaccact

SEQ ID NO: 816264 - DNA, 22 bp, Artificial Sequence
  chemically synthesized
aacaagaagtaaaagtcaccac

SEQ ID NO: 816265 - DNA, 22 bp, Artificial Sequence
  chemically synthesized
ttttggccccagtggtgacttt

SEQ ID NO: 816266 - DNA, 22 bp, Artificial Sequence
  chemically synthesized
taacaagaagtaaaagtcacca

SEQ ID NO: 816267 - DNA, 22 bp, Artificial Sequence
  chemically synthesized
ttaacaagaagtaaaagtcacc

SEQ ID NO: 816268 - DNA, 22 bp, Artificial Sequence
  chemically synthesized
tggccccagtggtgacttttac

SEQ ID NO: 816269 - DNA, 22 bp, Artificial Sequence
  chemically synthesized
ggccccagtggtgacttttact

SEQ ID NO: 816270 - DNA, 22 bp, Artificial Sequence
  chemically synthesized
gccccagtggtgacttttactt

SEQ ID NO: 816271 - DNA, 22 bp, Artificial Sequence
  chemically synthesized
ggtgatttttaacaagaagtaa

SEQ ID NO: 816272 - DNA, 22 bp, Artificial Sequence
  chemically synthesized
ttacttcttgttaaaaatcacc

SEQ ID NO: 816273 - DNA, 22 bp, Artificial Sequence
  chemically synthesized
tacttcttgttaaaaatcaccg

SEQ ID NO: 816274 - DNA, 22 bp, Artificial Sequence
  chemically synthesized
aaaaaataagctcggtgatttt

SEQ ID NO: 816275 - DNA, 22 bp, Artificial Sequence
  chemically synthesized
acttcttgttaaaaatcaccga

SEQ ID NO: 816276 - DNA, 22 bp, Artificial Sequence
  chemically synthesized
cttcttgttaaaaatcaccgag

SEQ ID NO: 816277 - DNA, 22 bp, Artificial Sequence
  chemically synthesized
ctgaaaaaataagctcggtgat

SEQ ID NO: 816278 - DNA, 22 bp, Artificial Sequence
  chemically synthesized
cttgttaaaaatcaccgagctt

SEQ ID NO: 816279 - DNA, 22 bp, Artificial Sequence
  chemically synthesized
ttgttaaaaatcaccgagctta

SEQ ID NO: 816280 - DNA, 22 bp, Artificial Sequence
  chemically synthesized
gttaaaaatcaccgagcttatt

SEQ ID NO: 816281 - DNA, 22 bp, Artificial Sequence
  chemically synthesized
ttaaaaatcaccgagcttattt

SEQ ID NO: 816282 - DNA, 22 bp, Artificial Sequence
  chemically synthesized
aaaatcaccgagcttatttttt

SEQ ID NO: 816283 - DNA, 22 bp, Artificial Sequence
  chemically synthesized
caaaatatgacatcaattactg

SEQ ID NO: 816284 - DNA, 22 bp, Artificial Sequence
  chemically synthesized
attttttcagtaattgatgtca

SEQ ID NO: 816285 - DNA, 22 bp, Artificial Sequence
  chemically synthesized
agttccaaaatatgacatcaat

SEQ ID NO: 816286 - DNA, 22 bp, Artificial Sequence
  chemically synthesized
ttttttcagtaattgatgtcat

SEQ ID NO: 816287 - DNA, 22 bp, Artificial Sequence
  chemically synthesized
tttcagtaattgatgtcatatt

SEQ ID NO: 816288 - DNA, 22 bp, Artificial Sequence
  chemically synthesized
ttcagtaattgatgtcatattt

SEQ ID NO: 816289 - DNA, 22 bp, Artificial Sequence
  chemically synthesized
tcagtaattgatgtcatatttt

SEQ ID NO: 816290 - DNA, 22 bp, Artificial Sequence
  chemically synthesized
cagtaattgatgtcatattttg

SEQ ID NO: 816291 - DNA, 22 bp, Artificial Sequence
  chemically synthesized
agtaattgatgtcatattttgg

SEQ ID NO: 816292 - DNA, 22 bp, Artificial Sequence
  chemically synthesized
atgtcatattttggaactcaat

SEQ ID NO: 816293 - DNA, 22 bp, Artificial Sequence
  chemically synthesized
tggaactcaattatttttcacc

SEQ ID NO: 816294 - DNA, 22 bp, Artificial Sequence
  chemically synthesized
ggaactcaattatttttcaccg

SEQ ID NO: 816295 - DNA, 22 bp, Artificial Sequence
  chemically synthesized
gaactcaattatttttcaccgt

SEQ ID NO: 816296 - DNA, 22 bp, Artificial Sequence
  chemically synthesized
aattatttttcaccgtggtctt

SEQ ID NO: 816297 - DNA, 22 bp, Artificial Sequence
  chemically synthesized
tacaatatgaggaagaccacgg

SEQ ID NO: 816298 - DNA, 22 bp, Artificial Sequence
  chemically synthesized
tttttcaccgtggtcttcctca

SEQ ID NO: 816299 - DNA, 22 bp, Artificial Sequence
  chemically synthesized
ttcaccgtggtcttcctcatat

SEQ ID NO: 816300 - DNA, 22 bp, Artificial Sequence
  chemically synthesized
tcaccgtggtcttcctcatatt

SEQ ID NO: 816301 - DNA, 22 bp, Artificial Sequence
  chemically synthesized
caccgtggtcttcctcatattg

SEQ ID NO: 816302 - DNA, 22 bp, Artificial Sequence
  chemically synthesized
accgtggtcttcctcatattgt

SEQ ID NO: 816303 - DNA, 22 bp, Artificial Sequence
  chemically synthesized
aaaaaatagcacctgtacaata

SEQ ID NO: 816304 - DNA, 22 bp, Artificial Sequence
  chemically synthesized
cctcatattgtacaggtgctat

SEQ ID NO: 816305 - DNA, 22 bp, Artificial Sequence
  chemically synthesized
ctcatattgtacaggtgctatt

SEQ ID NO: 816306 - DNA, 22 bp, Artificial Sequence
  chemically synthesized
tgcaagctgaaaaaatagcacc

SEQ ID NO: 816307 - DNA, 22 bp, Artificial Sequence
  chemically synthesized
gtgcaagctgaaaaaatagcac

SEQ ID NO: 816308 - DNA, 22 bp, Artificial Sequence
  chemically synthesized
atattgtacaggtgctattttt

SEQ ID NO: 816309 - DNA, 22 bp, Artificial Sequence
  chemically synthesized
ccttgtgcaagctgaaaaaata

SEQ ID NO: 816310 - DNA, 22 bp, Artificial Sequence
  chemically synthesized
tacaggtgctattttttcagct

SEQ ID NO: 816311 - DNA, 22 bp, Artificial Sequence
  chemically synthesized
ttttttcagcttgcacaaggta

SEQ ID NO: 816312 - DNA, 22 bp, Artificial Sequence
  chemically synthesized
cagaatgtacaattaccttgtg

SEQ ID NO: 816313 - DNA, 22 bp, Artificial Sequence
  chemically synthesized
gcagaatgtacaattaccttgt

SEQ ID NO: 816314 - DNA, 22 bp, Artificial Sequence
  chemically synthesized
tttcagcttgcacaaggtaatt

SEQ ID NO: 816315 - DNA, 22 bp, Artificial Sequence
  chemically synthesized
tgcagaatgtacaattaccttg

SEQ ID NO: 816316 - DNA, 22 bp, Artificial Sequence
  chemically synthesized
ttcagcttgcacaaggtaattg

SEQ ID NO: 816317 - DNA, 22 bp, Artificial Sequence
  chemically synthesized
tcagcttgcacaaggtaattgt

SEQ ID NO: 816318 - DNA, 22 bp, Artificial Sequence
  chemically synthesized
cagcttgcacaaggtaattgta

SEQ ID NO: 816319 - DNA, 22 bp, Artificial Sequence
  chemically synthesized
agcttgcacaaggtaattgtac

SEQ ID NO: 816320 - DNA, 22 bp, Artificial Sequence
  chemically synthesized
cctttgcagaatgtacaattac

SEQ ID NO: 816321 - DNA, 22 bp, Artificial Sequence
  chemically synthesized
gcacaaggtaattgtacattct

SEQ ID NO: 816322 - DNA, 22 bp, Artificial Sequence
  chemically synthesized
cacaaggtaattgtacattctg

SEQ ID NO: 816323 - DNA, 22 bp, Artificial Sequence
  chemically synthesized
aatgatgactccctttgcagaa

SEQ ID NO: 816324 - DNA, 22 bp, Artificial Sequence
  chemically synthesized
gaatgatgactccctttgcaga

SEQ ID NO: 816325 - DNA, 22 bp, Artificial Sequence
  chemically synthesized
tgaatgatgactccctttgcag

SEQ ID NO: 816326 - DNA, 22 bp, Artificial Sequence
  chemically synthesized
ttgaatgatgactccctttgca

SEQ ID NO: 816327 - DNA, 22 bp, Artificial Sequence
  chemically synthesized
tttgaatgatgactccctttgc

SEQ ID NO: 816328 - DNA, 22 bp, Artificial Sequence
  chemically synthesized
tacattctgcaaagggagtcat

SEQ ID NO: 816329 - DNA, 22 bp, Artificial Sequence
  chemically synthesized
gtaaatgttttttgaatgatga

SEQ ID NO: 816330 - DNA, 22 bp, Artificial Sequence
  chemically synthesized
tgcaaagggagtcatcattcaa

SEQ ID NO: 816331 - DNA, 22 bp, Artificial Sequence
  chemically synthesized
caaagggagtcatcattcaaaa

SEQ ID NO: 816332 - DNA, 22 bp, Artificial Sequence
  chemically synthesized
aaaaaacatttactagctccct

SEQ ID NO: 816333 - DNA, 22 bp, Artificial Sequence
  chemically synthesized
aaccacgtgatataatagggag

SEQ ID NO: 816334 - DNA, 22 bp, Artificial Sequence
  chemically synthesized
actagctccctattatatcacg

SEQ ID NO: 816335 - DNA, 22 bp, Artificial Sequence
  chemically synthesized
ctagctccctattatatcacgt

SEQ ID NO: 816336 - DNA, 22 bp, Artificial Sequence
  chemically synthesized
gctccctattatatcacgtggt

SEQ ID NO: 816337 - DNA, 22 bp, Artificial Sequence
  chemically synthesized
cctattatatcacgtggttcag

SEQ ID NO: 816338 - DNA, 22 bp, Artificial Sequence
  chemically synthesized
atacatccccaggtcctgaacc

SEQ ID NO: 816339 - DNA, 22 bp, Artificial Sequence
  chemically synthesized
ttatatcacgtggttcaggacc

SEQ ID NO: 816340 - DNA, 22 bp, Artificial Sequence
  chemically synthesized
gatacatccccaggtcctgaac

SEQ ID NO: 816341 - DNA, 22 bp, Artificial Sequence
  chemically synthesized
tatcacgtggttcaggacctgg

SEQ ID NO: 816342 - DNA, 22 bp, Artificial Sequence
  chemically synthesized
atttgatacatccccaggtcct

SEQ ID NO: 816343 - DNA, 22 bp, Artificial Sequence
  chemically synthesized
tcatttgatacatccccaggtc

SEQ ID NO: 816344 - DNA, 22 bp, Artificial Sequence
  chemically synthesized
ctcatttgatacatccccaggt

SEQ ID NO: 816345 - DNA, 22 bp, Artificial Sequence
  chemically synthesized
tctcatttgatacatccccagg

SEQ ID NO: 816346 - DNA, 22 bp, Artificial Sequence
  chemically synthesized
tctttctcatttgatacatccc

SEQ ID NO: 816347 - DNA, 22 bp, Artificial Sequence
  chemically synthesized
gtctttctcatttgatacatcc

SEQ ID NO: 816348 - DNA, 22 bp, Artificial Sequence
  chemically synthesized
tgtctttctcatttgatacatc

SEQ ID NO: 816349 - DNA, 22 bp, Artificial Sequence
  chemically synthesized
aggacctggggatgtatcaaat

SEQ ID NO: 816350 - DNA, 22 bp, Artificial Sequence
  chemically synthesized
gggatgtatcaaatgagaaaga

SEQ ID NO: 816351 - DNA, 22 bp, Artificial Sequence
  chemically synthesized
aatgccatgagggcagagattt

SEQ ID NO: 816352 - DNA, 22 bp, Artificial Sequence
  chemically synthesized
atctaaatgccatgagggcaga

SEQ ID NO: 816353 - DNA, 22 bp, Artificial Sequence
  chemically synthesized
aattaatctaaatgccatgagg

SEQ ID NO: 816354 - DNA, 22 bp, Artificial Sequence
  chemically synthesized
aaattaatctaaatgccatgag

SEQ ID NO: 816355 - DNA, 22 bp, Artificial Sequence
  chemically synthesized
taaattaatctaaatgccatga

SEQ ID NO: 816356 - DNA, 22 bp, Artificial Sequence
  chemically synthesized
tcctttaaattaatctaaatgc

SEQ ID NO: 816357 - DNA, 22 bp, Artificial Sequence
  chemically synthesized
gtcctttaaattaatctaaatg

SEQ ID NO: 816358 - DNA, 22 bp, Artificial Sequence
  chemically synthesized
tgccctcatggcatttagatta

SEQ ID NO: 816359 - DNA, 22 bp, Artificial Sequence
  chemically synthesized
ccctcatggcatttagattaat

SEQ ID NO: 816360 - DNA, 22 bp, Artificial Sequence
  chemically synthesized
aatatttgtcctttaaattaat

SEQ ID NO: 816361 - DNA, 22 bp, Artificial Sequence
  chemically synthesized
atggcatttagattaatttaaa

SEQ ID NO: 816362 - DNA, 22 bp, Artificial Sequence
  chemically synthesized
ttaaatatttgtcctttaaatt

SEQ ID NO: 816363 - DNA, 22 bp, Artificial Sequence
  chemically synthesized
attgttaaatatttgtccttta

SEQ ID NO: 816364 - DNA, 22 bp, Artificial Sequence
  chemically synthesized
agattaatttaaaggacaaata

SEQ ID NO: 816365 - DNA, 22 bp, Artificial Sequence
  chemically synthesized
gattaatttaaaggacaaatat

SEQ ID NO: 816366 - DNA, 22 bp, Artificial Sequence
  chemically synthesized
tgtaactaattgttaaatattt

SEQ ID NO: 816367 - DNA, 22 bp, Artificial Sequence
  chemically synthesized
atttaaaggacaaatatttaac

SEQ ID NO: 816368 - DNA, 22 bp, Artificial Sequence
  chemically synthesized
aaaggacaaatatttaacaatt

SEQ ID NO: 816369 - DNA, 22 bp, Artificial Sequence
  chemically synthesized
aaggacaaatatttaacaatta

SEQ ID NO: 816370 - DNA, 22 bp, Artificial Sequence
  chemically synthesized
aacaattagttacataatttat

SEQ ID NO: 816371 - DNA, 22 bp, Artificial Sequence
  chemically synthesized
acaattagttacataatttata

SEQ ID NO: 816372 - DNA, 22 bp, Artificial Sequence
  chemically synthesized
caatcataaataaaaatataaa

SEQ ID NO: 816373 - DNA, 22 bp, Artificial Sequence
  chemically synthesized
gttacataatttatatttttat

SEQ ID NO: 816374 - DNA, 22 bp, Artificial Sequence
  chemically synthesized
ttccaatcataaataaaaatat

SEQ ID NO: 816375 - DNA, 22 bp, Artificial Sequence
  chemically synthesized
attccaatcataaataaaaata

SEQ ID NO: 816376 - DNA, 22 bp, Artificial Sequence
  chemically synthesized
cataatttatatttttatttat

SEQ ID NO: 816377 - DNA, 22 bp, Artificial Sequence
  chemically synthesized
gcatttattccaatcataaata

SEQ ID NO: 816378 - DNA, 22 bp, Artificial Sequence
  chemically synthesized
actagcatttattccaatcata

SEQ ID NO: 816379 - DNA, 22 bp, Artificial Sequence
  chemically synthesized
atatttttatttatgattggaa

SEQ ID NO: 816380 - DNA, 22 bp, Artificial Sequence
  chemically synthesized
cactagcatttattccaatcat

SEQ ID NO: 816381 - DNA, 22 bp, Artificial Sequence
  chemically synthesized
tatttttatttatgattggaat

SEQ ID NO: 816382 - DNA, 22 bp, Artificial Sequence
  chemically synthesized
tcactagcatttattccaatca

SEQ ID NO: 816383 - DNA, 22 bp, Artificial Sequence
  chemically synthesized
ttcactagcatttattccaatc

SEQ ID NO: 816384 - DNA, 22 bp, Artificial Sequence
  chemically synthesized
tttcactagcatttattccaat

SEQ ID NO: 816385 - DNA, 22 bp, Artificial Sequence
  chemically synthesized
ttttcactagcatttattccaa

SEQ ID NO: 816386 - DNA, 22 bp, Artificial Sequence
  chemically synthesized
ttatttatgattggaataaatg

SEQ ID NO: 816387 - DNA, 22 bp, Artificial Sequence
  chemically synthesized
tatttatgattggaataaatgc

SEQ ID NO: 816388 - DNA, 22 bp, Artificial Sequence
  chemically synthesized
atttatgattggaataaatgct

SEQ ID NO: 816389 - DNA, 22 bp, Artificial Sequence
  chemically synthesized
tttatgattggaataaatgcta

SEQ ID NO: 816390 - DNA, 22 bp, Artificial Sequence
  chemically synthesized
gtgcttttttcactagcattta

SEQ ID NO: 816391 - DNA, 22 bp, Artificial Sequence
  chemically synthesized
atgattggaataaatgctagtg

SEQ ID NO: 816392 - DNA, 22 bp, Artificial Sequence
  chemically synthesized
tagtgcttttttcactagcatt

SEQ ID NO: 816393 - DNA, 22 bp, Artificial Sequence
  chemically synthesized
tgattggaataaatgctagtga

SEQ ID NO: 816394 - DNA, 22 bp, Artificial Sequence
  chemically synthesized
atctctagtgcttttttcacta

SEQ ID NO: 816395 - DNA, 22 bp, Artificial Sequence
  chemically synthesized
gatctctagtgcttttttcact

SEQ ID NO: 816396 - DNA, 22 bp, Artificial Sequence
  chemically synthesized
gaataaatgctagtgaaaaaag

SEQ ID NO: 816397 - DNA, 22 bp, Artificial Sequence
  chemically synthesized
ttgatctctagtgcttttttca

SEQ ID NO: 816398 - DNA, 22 bp, Artificial Sequence
  chemically synthesized
tcttgatctctagtgctttttt

SEQ ID NO: 816399 - DNA, 22 bp, Artificial Sequence
  chemically synthesized
tacctctcttgatctctagtgc

SEQ ID NO: 816400 - DNA, 22 bp, Artificial Sequence
  chemically synthesized
gtgaaaaaagcactagagatca

SEQ ID NO: 816401 - DNA, 22 bp, Artificial Sequence
  chemically synthesized
ttatacctctcttgatctctag

SEQ ID NO: 816402 - DNA, 22 bp, Artificial Sequence
  chemically synthesized
attatacctctcttgatctcta

SEQ ID NO: 816403 - DNA, 22 bp, Artificial Sequence
  chemically synthesized
tatccttattatacctctcttg

SEQ ID NO: 816404 - DNA, 22 bp, Artificial Sequence
  chemically synthesized
gtatccttattatacctctctt

SEQ ID NO: 816405 - DNA, 22 bp, Artificial Sequence
  chemically synthesized
gagatcaagagaggtataataa

SEQ ID NO: 816406 - DNA, 22 bp, Artificial Sequence
  chemically synthesized
agccttgtatccttattatacc

SEQ ID NO: 816407 - DNA, 22 bp, Artificial Sequence
  chemically synthesized
aaactaagccttgtatccttat

SEQ ID NO: 816408 - DNA, 22 bp, Artificial Sequence
  chemically synthesized
ctcaaactaagccttgtatcct

SEQ ID NO: 816409 - DNA, 22 bp, Artificial Sequence
  chemically synthesized
tagacagtatctcctcaaacta

SEQ ID NO: 816410 - DNA, 22 bp, Artificial Sequence
  chemically synthesized
atagacagtatctcctcaaact

SEQ ID NO: 816411 - DNA, 22 bp, Artificial Sequence
  chemically synthesized
acagcgcttatagacagtatct

SEQ ID NO: 816412 - DNA, 22 bp, Artificial Sequence
  chemically synthesized
agtttgaggagatactgtctat

SEQ ID NO: 816413 - DNA, 22 bp, Artificial Sequence
  chemically synthesized
gtttgaggagatactgtctata

SEQ ID NO: 816414 - DNA, 22 bp, Artificial Sequence
  chemically synthesized
gaggagatactgtctataagcg

SEQ ID NO: 816415 - DNA, 22 bp, Artificial Sequence
  chemically synthesized
aggagatactgtctataagcgc

SEQ ID NO: 816416 - DNA, 22 bp, Artificial Sequence
  chemically synthesized
tatatgaatggaaattaacagc

SEQ ID NO: 816417 - DNA, 22 bp, Artificial Sequence
  chemically synthesized
tctataagcgctgttaatttcc

SEQ ID NO: 816418 - DNA, 22 bp, Artificial Sequence
  chemically synthesized
ccattatatatgaatggaaatt

SEQ ID NO: 816419 - DNA, 22 bp, Artificial Sequence
  chemically synthesized
taagcgctgttaatttccattc

SEQ ID NO: 816420 - DNA, 22 bp, Artificial Sequence
  chemically synthesized
cccattatatatgaatggaaat

SEQ ID NO: 816421 - DNA, 22 bp, Artificial Sequence
  chemically synthesized
atttcccattatatatgaatgg

SEQ ID NO: 816422 - DNA, 22 bp, Artificial Sequence
  chemically synthesized
catttcccattatatatgaatg

SEQ ID NO: 816423 - DNA, 22 bp, Artificial Sequence
  chemically synthesized
ttaatttccattcatatataat

SEQ ID NO: 816424 - DNA, 22 bp, Artificial Sequence
  chemically synthesized
atttccattcatatataatggg

SEQ ID NO: 816425 - DNA, 22 bp, Artificial Sequence
  chemically synthesized
gtcacttcatttcccattatat

SEQ ID NO: 816426 - DNA, 22 bp, Artificial Sequence
  chemically synthesized
ccattcatatataatgggaaat

SEQ ID NO: 816427 - DNA, 22 bp, Artificial Sequence
  chemically synthesized
cattcatatataatgggaaatg

SEQ ID NO: 816428 - DNA, 22 bp, Artificial Sequence
  chemically synthesized
atatataatgggaaatgaagtg

SEQ ID NO: 816429 - DNA, 22 bp, Artificial Sequence
  chemically synthesized
tggagggcaatatgactcgtca

SEQ ID NO: 816430 - DNA, 22 bp, Artificial Sequence
  chemically synthesized
gtggagggcaatatgactcgtc

SEQ ID NO: 816431 - DNA, 22 bp, Artificial Sequence
  chemically synthesized
cacacacccaatgggaaaattt

SEQ ID NO: 816432 - DNA, 22 bp, Artificial Sequence
  chemically synthesized
ccctccacaaattttcccattg

SEQ ID NO: 816433 - DNA, 22 bp, Artificial Sequence
  chemically synthesized
actccacacacccaatgggaaa

SEQ ID NO: 816434 - DNA, 22 bp, Artificial Sequence
  chemically synthesized
cacaaattttcccattgggtgt

SEQ ID NO: 816435 - DNA, 22 bp, Artificial Sequence
  chemically synthesized
gtatctcactccacacacccaa

SEQ ID NO: 816436 - DNA, 22 bp, Artificial Sequence
  chemically synthesized
atcctagtatctcactccacac

SEQ ID NO: 816437 - DNA, 22 bp, Artificial Sequence
  chemically synthesized
tcccattgggtgtgtggagtga

SEQ ID NO: 816438 - DNA, 22 bp, Artificial Sequence
  chemically synthesized
cccattgggtgtgtggagtgag

SEQ ID NO: 816439 - DNA, 22 bp, Artificial Sequence
  chemically synthesized
ccattgggtgtgtggagtgaga

SEQ ID NO: 816440 - DNA, 22 bp, Artificial Sequence
  chemically synthesized
ggtgtgtggagtgagatactag

SEQ ID NO: 816441 - DNA, 22 bp, Artificial Sequence
  chemically synthesized
tacatggtctcatcctagtatc

SEQ ID NO: 816442 - DNA, 22 bp, Artificial Sequence
  chemically synthesized
tagctgtacatggtctcatcct

SEQ ID NO: 816443 - DNA, 22 bp, Artificial Sequence
  chemically synthesized
atgatagagttatagctgtaca

SEQ ID NO: 816444 - DNA, 22 bp, Artificial Sequence
  chemically synthesized
ggatgagaccatgtacagctat

SEQ ID NO: 816445 - DNA, 22 bp, Artificial Sequence
  chemically synthesized
ggattcatgatagagttatagc

SEQ ID NO: 816446 - DNA, 22 bp, Artificial Sequence
  chemically synthesized
gggattcatgatagagttatag

SEQ ID NO: 816447 - DNA, 22 bp, Artificial Sequence
  chemically synthesized
tgggattcatgatagagttata

SEQ ID NO: 816448 - DNA, 22 bp, Artificial Sequence
  chemically synthesized
taactctatcatgaatcccaaa

SEQ ID NO: 816449 - DNA, 22 bp, Artificial Sequence
  chemically synthesized
ataaataagtcactttgggatt

SEQ ID NO: 816450 - DNA, 22 bp, Artificial Sequence
  chemically synthesized
tctgataaataagtcactttgg

SEQ ID NO: 816451 - DNA, 22 bp, Artificial Sequence
  chemically synthesized
tatcatgaatcccaaagtgact

SEQ ID NO: 816452 - DNA, 22 bp, Artificial Sequence
  chemically synthesized
tcatgaatcccaaagtgactta

SEQ ID NO: 816453 - DNA, 22 bp, Artificial Sequence
  chemically synthesized
ttatctgataaataagtcactt

SEQ ID NO: 816454 - DNA, 22 bp, Artificial Sequence
  chemically synthesized
cctgttatctgataaataagtc

SEQ ID NO: 816455 - DNA, 22 bp, Artificial Sequence
  chemically synthesized
acctgttatctgataaataagt

SEQ ID NO: 816456 - DNA, 22 bp, Artificial Sequence
  chemically synthesized
ccttacctgttatctgataaat

SEQ ID NO: 816457 - DNA, 22 bp, Artificial Sequence
  chemically synthesized
atttatcagataacaggtaagg

SEQ ID NO: 816458 - DNA, 22 bp, Artificial Sequence
  chemically synthesized
tttatcagataacaggtaaggc

SEQ ID NO: 816459 - DNA, 22 bp, Artificial Sequence
  chemically synthesized
atcagataacaggtaaggcagt

SEQ ID NO: 816460 - DNA, 22 bp, Artificial Sequence
  chemically synthesized
atcatggcgcacactgccttac

SEQ ID NO: 816461 - DNA, 22 bp, Artificial Sequence
  chemically synthesized
tcagataacaggtaaggcagtg

SEQ ID NO: 816462 - DNA, 22 bp, Artificial Sequence
  chemically synthesized
tctcatcatggcgcacactgcc

SEQ ID NO: 816463 - DNA, 22 bp, Artificial Sequence
  chemically synthesized
tatctcatcatggcgcacactg

SEQ ID NO: 816464 - DNA, 22 bp, Artificial Sequence
  chemically synthesized
ctatctcatcatggcgcacact

SEQ ID NO: 816465 - DNA, 22 bp, Artificial Sequence
  chemically synthesized
tctatctcatcatggcgcacac

SEQ ID NO: 816466 - DNA, 22 bp, Artificial Sequence
  chemically synthesized
tccaaaggaatatctttctatc

SEQ ID NO: 816467 - DNA, 22 bp, Artificial Sequence
  chemically synthesized
tatccaaaggaatatctttcta

SEQ ID NO: 816468 - DNA, 22 bp, Artificial Sequence
  chemically synthesized
ataactctatccaaaggaatat

SEQ ID NO: 816469 - DNA, 22 bp, Artificial Sequence
  chemically synthesized
gataactctatccaaaggaata

SEQ ID NO: 816470 - DNA, 22 bp, Artificial Sequence
  chemically synthesized
tgataactctatccaaaggaat

SEQ ID NO: 816471 - DNA, 22 bp, Artificial Sequence
  chemically synthesized
ctttgataactctatccaaagg

SEQ ID NO: 816472 - DNA, 22 bp, Artificial Sequence
  chemically synthesized
tcagtctactttgataactcta

SEQ ID NO: 816473 - DNA, 22 bp, Artificial Sequence
  chemically synthesized
atcagtctactttgataactct

SEQ ID NO: 816474 - DNA, 22 bp, Artificial Sequence
  chemically synthesized
ctttggatagagttatcaaagt

SEQ ID NO: 816475 - DNA, 22 bp, Artificial Sequence
  chemically synthesized
tggatagagttatcaaagtaga

SEQ ID NO: 816476 - DNA, 22 bp, Artificial Sequence
  chemically synthesized
ggatagagttatcaaagtagac

SEQ ID NO: 816477 - DNA, 22 bp, Artificial Sequence
  chemically synthesized
gatagagttatcaaagtagact

SEQ ID NO: 816478 - DNA, 22 bp, Artificial Sequence
  chemically synthesized
gaagagccatttatcagtctac

SEQ ID NO: 816479 - DNA, 22 bp, Artificial Sequence
  chemically synthesized
tagctagaagagccatttatca

SEQ ID NO: 816480 - DNA, 22 bp, Artificial Sequence
  chemically synthesized
tcaaagtagactgataaatggc

SEQ ID NO: 816481 - DNA, 22 bp, Artificial Sequence
  chemically synthesized
atagctagaagagccatttatc

SEQ ID NO: 816482 - DNA, 22 bp, Artificial Sequence
  chemically synthesized
atttatagctagaagagccatt

SEQ ID NO: 816483 - DNA, 22 bp, Artificial Sequence
  chemically synthesized
ataaatggctcttctagctata

SEQ ID NO: 816484 - DNA, 22 bp, Artificial Sequence
  chemically synthesized
aacaaaaagcaaaatactgatt

SEQ ID NO: 816485 - DNA, 22 bp, Artificial Sequence
  chemically synthesized
ttctagctataaatcagtattt

SEQ ID NO: 816486 - DNA, 22 bp, Artificial Sequence
  chemically synthesized
ctagctataaatcagtattttg

SEQ ID NO: 816487 - DNA, 22 bp, Artificial Sequence
  chemically synthesized
tagctataaatcagtattttgc

SEQ ID NO: 816488 - DNA, 22 bp, Artificial Sequence
  chemically synthesized
gctataaatcagtattttgctt

SEQ ID NO: 816489 - DNA, 22 bp, Artificial Sequence
  chemically synthesized
taaatcagtattttgctttttg

SEQ ID NO: 816490 - DNA, 22 bp, Artificial Sequence
  chemically synthesized
tgctttttgtttaatctcttgg

SEQ ID NO: 816491 - DNA, 22 bp, Artificial Sequence
  chemically synthesized
gctttttgtttaatctcttggt

SEQ ID NO: 816492 - DNA, 22 bp, Artificial Sequence
  chemically synthesized
ctttttgtttaatctcttggtt

SEQ ID NO: 816493 - DNA, 22 bp, Artificial Sequence
  chemically synthesized
tttgtttaatctcttggttatg

SEQ ID NO: 816494 - DNA, 22 bp, Artificial Sequence
  chemically synthesized
ttgtttaatctcttggttatgt

SEQ ID NO: 816495 - DNA, 22 bp, Artificial Sequence
  chemically synthesized
tgtttaatctcttggttatgtc

SEQ ID NO: 816496 - DNA, 22 bp, Artificial Sequence
  chemically synthesized
gtttaatctcttggttatgtca

SEQ ID NO: 816497 - DNA, 22 bp, Artificial Sequence
  chemically synthesized
tcacaaaagtagtgacataacc

SEQ ID NO: 816498 - DNA, 22 bp, Artificial Sequence
  chemically synthesized
tttaatctcttggttatgtcac

SEQ ID NO: 816499 - DNA, 22 bp, Artificial Sequence
  chemically synthesized
aatctcttggttatgtcactac

SEQ ID NO: 816500 - DNA, 22 bp, Artificial Sequence
  chemically synthesized
atctcttggttatgtcactact

SEQ ID NO: 816501 - DNA, 22 bp, Artificial Sequence
  chemically synthesized
cccgctgtcacaaaagtagtga

SEQ ID NO: 816502 - DNA, 22 bp, Artificial Sequence
  chemically synthesized
gcccgctgtcacaaaagtagtg

SEQ ID NO: 816503 - DNA, 22 bp, Artificial Sequence
  chemically synthesized
ttggttatgtcactacttttgt

SEQ ID NO: 816504 - DNA, 22 bp, Artificial Sequence
  chemically synthesized
ggttatgtcactacttttgtga

SEQ ID NO: 816505 - DNA, 22 bp, Artificial Sequence
  chemically synthesized
atttgcccgctgtcacaaaagt

SEQ ID NO: 816506 - DNA, 22 bp, Artificial Sequence
  chemically synthesized
gttatgtcactacttttgtgac

SEQ ID NO: 816507 - DNA, 22 bp, Artificial Sequence
  chemically synthesized
tgtcactacttttgtgacagcg

SEQ ID NO: 816508 - DNA, 22 bp, Artificial Sequence
  chemically synthesized
cttttgtgacagcgggcaaatg

SEQ ID NO: 816509 - DNA, 22 bp, Artificial Sequence
  chemically synthesized
ttgtgacagcgggcaaatgaga

SEQ ID NO: 816510 - DNA, 22 bp, Artificial Sequence
  chemically synthesized
tgtgacagcgggcaaatgagat

SEQ ID NO: 816511 - DNA, 22 bp, Artificial Sequence
  chemically synthesized
gtgacagcgggcaaatgagatc

SEQ ID NO: 816512 - DNA, 22 bp, Artificial Sequence
  chemically synthesized
tgacagcgggcaaatgagatct

SEQ ID NO: 816513 - DNA, 22 bp, Artificial Sequence
  chemically synthesized
aaaacgaggaacataagatctc

SEQ ID NO: 816514 - DNA, 22 bp, Artificial Sequence
  chemically synthesized
aaaaacgaggaacataagatct

SEQ ID NO: 816515 - DNA, 22 bp, Artificial Sequence
  chemically synthesized
taaaaacgaggaacataagatc

SEQ ID NO: 816516 - DNA, 22 bp, Artificial Sequence
  chemically synthesized
ttttaaaaacgaggaacataag

SEQ ID NO: 816517 - DNA, 22 bp, Artificial Sequence
  chemically synthesized
tattttaaaaacgaggaacata

SEQ ID NO: 816518 - DNA, 22 bp, Artificial Sequence
  chemically synthesized
ctattttaaaaacgaggaacat

SEQ ID NO: 816519 - DNA, 22 bp, Artificial Sequence
  chemically synthesized
agacttctattttaaaaacgag

SEQ ID NO: 816520 - DNA, 22 bp, Artificial Sequence
  chemically synthesized
gctcagacttctattttaaaaa

SEQ ID NO: 816521 - DNA, 22 bp, Artificial Sequence
  chemically synthesized
ggctcagacttctattttaaaa

SEQ ID NO: 816522 - DNA, 22 bp, Artificial Sequence
  chemically synthesized
atgttcctcgtttttaaaatag

SEQ ID NO: 816523 - DNA, 22 bp, Artificial Sequence
  chemically synthesized
tgttcctcgtttttaaaataga

SEQ ID NO: 816524 - DNA, 22 bp, Artificial Sequence
  chemically synthesized
ctcgtttttaaaatagaagtct

SEQ ID NO: 816525 - DNA, 22 bp, Artificial Sequence
  chemically synthesized
acggacttggctcagacttcta

SEQ ID NO: 816526 - DNA, 22 bp, Artificial Sequence
  chemically synthesized
gtttttaaaatagaagtctgag

SEQ ID NO: 816527 - DNA, 22 bp, Artificial Sequence
  chemically synthesized
aactcacggacttggctcagac

SEQ ID NO: 816528 - DNA, 22 bp, Artificial Sequence
  chemically synthesized
ttaaaatagaagtctgagccaa

SEQ ID NO: 816529 - DNA, 22 bp, Artificial Sequence
  chemically synthesized
taaaatagaagtctgagccaag

SEQ ID NO: 816530 - DNA, 22 bp, Artificial Sequence
  chemically synthesized
aaaatagaagtctgagccaagt

SEQ ID NO: 816531 - DNA, 22 bp, Artificial Sequence
  chemically synthesized
aaatagaagtctgagccaagtc

SEQ ID NO: 816532 - DNA, 22 bp, Artificial Sequence
  chemically synthesized
agccaagtccgtgagtttagtt

SEQ ID NO: 816533 - DNA, 22 bp, Artificial Sequence
  chemically synthesized
aagacgataaataccaactaaa

SEQ ID NO: 816534 - DNA, 22 bp, Artificial Sequence
  chemically synthesized
ggagggttcaagacgataaata

SEQ ID NO: 816535 - DNA, 22 bp, Artificial Sequence
  chemically synthesized
gggagggttcaagacgataaat

SEQ ID NO: 816536 - DNA, 22 bp, Artificial Sequence
  chemically synthesized
agttggtatttatcgtcttgaa

SEQ ID NO: 816537 - DNA, 22 bp, Artificial Sequence
  chemically synthesized
gttggtatttatcgtcttgaac

SEQ ID NO: 816538 - DNA, 22 bp, Artificial Sequence
  chemically synthesized
gagcttgggagggttcaagacg

SEQ ID NO: 816539 - DNA, 22 bp, Artificial Sequence
  chemically synthesized
gtatttatcgtcttgaaccctc

SEQ ID NO: 816540 - DNA, 22 bp, Artificial Sequence
  chemically synthesized
aactggagcttgggagggttca

SEQ ID NO: 816541 - DNA, 22 bp, Artificial Sequence
  chemically synthesized
atcgtcttgaaccctcccaagc

SEQ ID NO: 816542 - DNA, 22 bp, Artificial Sequence
  chemically synthesized
tcgtcttgaaccctcccaagct

SEQ ID NO: 816543 - DNA, 22 bp, Artificial Sequence
  chemically synthesized
caatccagctaaactggagctt

SEQ ID NO: 816544 - DNA, 22 bp, Artificial Sequence
  chemically synthesized
ccaatccagctaaactggagct

SEQ ID NO: 816545 - DNA, 22 bp, Artificial Sequence
  chemically synthesized
gaaccctcccaagctccagttt

SEQ ID NO: 816546 - DNA, 22 bp, Artificial Sequence
  chemically synthesized
tccaatccagctaaactggagc

SEQ ID NO: 816547 - DNA, 22 bp, Artificial Sequence
  chemically synthesized
aaccctcccaagctccagttta

SEQ ID NO: 816548 - DNA, 22 bp, Artificial Sequence
  chemically synthesized
ttccaatccagctaaactggag

SEQ ID NO: 816549 - DNA, 22 bp, Artificial Sequence
  chemically synthesized
tttttccaatccagctaaactg

SEQ ID NO: 816550 - DNA, 22 bp, Artificial Sequence
  chemically synthesized
gtttttccaatccagctaaact

SEQ ID NO: 816551 - DNA, 22 bp, Artificial Sequence
  chemically synthesized
ccaagctccagtttagctggat

SEQ ID NO: 816552 - DNA, 22 bp, Artificial Sequence
  chemically synthesized
cagtttagctggattggaaaaa

SEQ ID NO: 816553 - DNA, 22 bp, Artificial Sequence
  chemically synthesized
agctggattggaaaaacaaatc

SEQ ID NO: 816554 - DNA, 22 bp, Artificial Sequence
  chemically synthesized
gctggattggaaaaacaaatcc

SEQ ID NO: 816555 - DNA, 22 bp, Artificial Sequence
  chemically synthesized
gatggaccatgaggatttgttt

SEQ ID NO: 816556 - DNA, 22 bp, Artificial Sequence
  chemically synthesized
gattggaaaaacaaatcctcat

SEQ ID NO: 816557 - DNA, 22 bp, Artificial Sequence
  chemically synthesized
gaaaaacaaatcctcatggtcc

SEQ ID NO: 816558 - DNA, 22 bp, Artificial Sequence
  chemically synthesized
taataatggggtggtgaaactg

SEQ ID NO: 816559 - DNA, 22 bp, Artificial Sequence
  chemically synthesized
atggtccatccagtttcaccac

SEQ ID NO: 816560 - DNA, 22 bp, Artificial Sequence
  chemically synthesized
gctgtaataatggggtggtgaa

SEQ ID NO: 816561 - DNA, 22 bp, Artificial Sequence
  chemically synthesized
ttggctgtaataatggggtggt

SEQ ID NO: 816562 - DNA, 22 bp, Artificial Sequence
  chemically synthesized
ctgttggctgtaataatggggt

SEQ ID NO: 816563 - DNA, 22 bp, Artificial Sequence
  chemically synthesized
aaactactgttggctgtaataa

SEQ ID NO: 816564 - DNA, 22 bp, Artificial Sequence
  chemically synthesized
caccaccccattattacagcca

SEQ ID NO: 816565 - DNA, 22 bp, Artificial Sequence
  chemically synthesized
taaaactactgttggctgtaat

SEQ ID NO: 816566 - DNA, 22 bp, Artificial Sequence
  chemically synthesized
accaccccattattacagccaa

SEQ ID NO: 816567 - DNA, 22 bp, Artificial Sequence
  chemically synthesized
ctaaaactactgttggctgtaa

SEQ ID NO: 816568 - DNA, 22 bp, Artificial Sequence
  chemically synthesized
tttctaaaactactgttggctg

SEQ ID NO: 816569 - DNA, 22 bp, Artificial Sequence
  chemically synthesized
cattatttctaaaactactgtt

SEQ ID NO: 816570 - DNA, 22 bp, Artificial Sequence
  chemically synthesized
ttacagccaacagtagttttag

SEQ ID NO: 816571 - DNA, 22 bp, Artificial Sequence
  chemically synthesized
cagccaacagtagttttagaaa

SEQ ID NO: 816572 - DNA, 22 bp, Artificial Sequence
  chemically synthesized
ataaaaggtatgaattacatta

SEQ ID NO: 816573 - DNA, 22 bp, Artificial Sequence
  chemically synthesized
tagaaataatgtaattcatacc

SEQ ID NO: 816574 - DNA, 22 bp, Artificial Sequence
  chemically synthesized
agaaataatgtaattcatacct

SEQ ID NO: 816575 - DNA, 22 bp, Artificial Sequence
  chemically synthesized
gaaataatgtaattcatacctt

SEQ ID NO: 816576 - DNA, 22 bp, Artificial Sequence
  chemically synthesized
gagaagcattcataaaaggtat

SEQ ID NO: 816577 - DNA, 22 bp, Artificial Sequence
  chemically synthesized
ggagaagcattcataaaaggta

SEQ ID NO: 816578 - DNA, 22 bp, Artificial Sequence
  chemically synthesized
ttggagaagcattcataaaagg

SEQ ID NO: 816579 - DNA, 22 bp, Artificial Sequence
  chemically synthesized
ataccttttatgaatgcttctc

SEQ ID NO: 816580 - DNA, 22 bp, Artificial Sequence
  chemically synthesized
ttatgaatgcttctccaagagg

SEQ ID NO: 816581 - DNA, 22 bp, Artificial Sequence
  chemically synthesized
tatgaatgcttctccaagaggc

SEQ ID NO: 816582 - DNA, 22 bp, Artificial Sequence
  chemically synthesized
atgaatgcttctccaagaggca

SEQ ID NO: 816583 - DNA, 22 bp, Artificial Sequence
  chemically synthesized
tgaatgcttctccaagaggcat

SEQ ID NO: 816584 - DNA, 22 bp, Artificial Sequence
  chemically synthesized
ctccaagaggcattgatattct

SEQ ID NO: 816585 - DNA, 22 bp, Artificial Sequence
  chemically synthesized
tccaagaggcattgatattctc

SEQ ID NO: 816586 - DNA, 22 bp, Artificial Sequence
  chemically synthesized
caagaggcattgatattctctg

SEQ ID NO: 816587 - DNA, 22 bp, Artificial Sequence
  chemically synthesized
atattctctgttatcatgtgga

SEQ ID NO: 816588 - DNA, 22 bp, Artificial Sequence
  chemically synthesized
tctgttatcatgtggacttttc

SEQ ID NO: 816589 - DNA, 22 bp, Artificial Sequence
  chemically synthesized
cagatgataccagaaaagtcca

SEQ ID NO: 816590 - DNA, 22 bp, Artificial Sequence
  chemically synthesized
tgttatcatgtggacttttctg

SEQ ID NO: 816591 - DNA, 22 bp, Artificial Sequence
  chemically synthesized
tgcagatgataccagaaaagtc

SEQ ID NO: 816592 - DNA, 22 bp, Artificial Sequence
  chemically synthesized
ttatcatgtggacttttctggt

SEQ ID NO: 816593 - DNA, 22 bp, Artificial Sequence
  chemically synthesized
ttctgcagatgataccagaaaa

SEQ ID NO: 816594 - DNA, 22 bp, Artificial Sequence
  chemically synthesized
tcatgtggacttttctggtatc

SEQ ID NO: 816595 - DNA, 22 bp, Artificial Sequence
  chemically synthesized
cgggattattctgcagatgata

SEQ ID NO: 816596 - DNA, 22 bp, Artificial Sequence
  chemically synthesized
tccgggattattctgcagatga

SEQ ID NO: 816597 - DNA, 22 bp, Artificial Sequence
  chemically synthesized
ctccgggattattctgcagatg

SEQ ID NO: 816598 - DNA, 22 bp, Artificial Sequence
  chemically synthesized
ttctggtatcatctgcagaata

SEQ ID NO: 816599 - DNA, 22 bp, Artificial Sequence
  chemically synthesized
tctggtatcatctgcagaataa

SEQ ID NO: 816600 - DNA, 22 bp, Artificial Sequence
  chemically synthesized
ctggtatcatctgcagaataat

SEQ ID NO: 816601 - DNA, 22 bp, Artificial Sequence
  chemically synthesized
tggtatcatctgcagaataatc

SEQ ID NO: 816602 - DNA, 22 bp, Artificial Sequence
  chemically synthesized
aaacttctccgggattattctg

SEQ ID NO: 816603 - DNA, 22 bp, Artificial Sequence
  chemically synthesized
gtatcatctgcagaataatccc

SEQ ID NO: 816604 - DNA, 22 bp, Artificial Sequence
  chemically synthesized
gccctgaaacttctccgggatt

SEQ ID NO: 816605 - DNA, 22 bp, Artificial Sequence
  chemically synthesized
ggccctgaaacttctccgggat

SEQ ID NO: 816606 - DNA, 22 bp, Artificial Sequence
  chemically synthesized
cagaataatcccggagaagttt

SEQ ID NO: 816607 - DNA, 22 bp, Artificial Sequence
  chemically synthesized
cagggccaagtcatttgccaca

SEQ ID NO: 816608 - DNA, 22 bp, Artificial Sequence
  chemically synthesized
agggccaagtcatttgccacat

SEQ ID NO: 816609 - DNA, 22 bp, Artificial Sequence
  chemically synthesized
cgccagtggcagacaaatgtag

SEQ ID NO: 816610 - DNA, 22 bp, Artificial Sequence
  chemically synthesized
gccacatctacatttgtctgcc

SEQ ID NO: 816611 - DNA, 22 bp, Artificial Sequence
  chemically synthesized
ccacatctacatttgtctgcca

SEQ ID NO: 816612 - DNA, 22 bp, Artificial Sequence
  chemically synthesized
gccaaagacctccgccagtggc

SEQ ID NO: 816613 - DNA, 22 bp, Artificial Sequence
  chemically synthesized
catttgtctgccactggcggag

SEQ ID NO: 816614 - DNA, 22 bp, Artificial Sequence
  chemically synthesized
gtctgccactggcggaggtctt

SEQ ID NO: 816615 - DNA, 22 bp, Artificial Sequence
  chemically synthesized
tctgccactggcggaggtcttt

SEQ ID NO: 816616 - DNA, 22 bp, Artificial Sequence
  chemically synthesized
tagcagttggccaaagacctcc

SEQ ID NO: 816617 - DNA, 22 bp, Artificial Sequence
  chemically synthesized
ccactggcggaggtctttggcc

SEQ ID NO: 816618 - DNA, 22 bp, Artificial Sequence
  chemically synthesized
gcggaggtctttggccaactgc

SEQ ID NO: 816619 - DNA, 22 bp, Artificial Sequence
  chemically synthesized
ataaaaatctatagcagttggc

SEQ ID NO: 816620 - DNA, 22 bp, Artificial Sequence
  chemically synthesized
tcataaaaatctatagcagttg

SEQ ID NO: 816621 - DNA, 22 bp, Artificial Sequence
  chemically synthesized
ctcataaaaatctatagcagtt

SEQ ID NO: 816622 - DNA, 22 bp, Artificial Sequence
  chemically synthesized
tctcataaaaatctatagcagt

SEQ ID NO: 816623 - DNA, 22 bp, Artificial Sequence
  chemically synthesized
tttctcataaaaatctatagca

SEQ ID NO: 816624 - DNA, 22 bp, Artificial Sequence
  chemically synthesized
tctttctcataaaaatctatag

SEQ ID NO: 816625 - DNA, 22 bp, Artificial Sequence
  chemically synthesized
tggccaactgctatagattttt

SEQ ID NO: 816626 - DNA, 22 bp, Artificial Sequence
  chemically synthesized
ggccaactgctatagattttta

SEQ ID NO: 816627 - DNA, 22 bp, Artificial Sequence
  chemically synthesized
gccaactgctatagatttttat

SEQ ID NO: 816628 - DNA, 22 bp, Artificial Sequence
  chemically synthesized
attctctttctcataaaaatct

SEQ ID NO: 816629 - DNA, 22 bp, Artificial Sequence
  chemically synthesized
acattcattctctttctcataa

SEQ ID NO: 816630 - DNA, 22 bp, Artificial Sequence
  chemically synthesized
ctatagatttttatgagaaaga

SEQ ID NO: 816631 - DNA, 22 bp, Artificial Sequence
  chemically synthesized
tagatttttatgagaaagagaa

SEQ ID NO: 816632 - DNA, 22 bp, Artificial Sequence
  chemically synthesized
ttatgagaaagagaatgaatgt

SEQ ID NO: 816633 - DNA, 22 bp, Artificial Sequence
  chemically synthesized
tatgagaaagagaatgaatgtc

SEQ ID NO: 816634 - DNA, 22 bp, Artificial Sequence
  chemically synthesized
ataaaaaaaactgacattcatt

SEQ ID NO: 816635 - DNA, 22 bp, Artificial Sequence
  chemically synthesized
atgagaaagagaatgaatgtca

SEQ ID NO: 816636 - DNA, 22 bp, Artificial Sequence
  chemically synthesized
cataaaaaaaactgacattcat

SEQ ID NO: 816637 - DNA, 22 bp, Artificial Sequence
  chemically synthesized
tgagaaagagaatgaatgtcag

SEQ ID NO: 816638 - DNA, 22 bp, Artificial Sequence
  chemically synthesized
gagatttcataaaaaaaactga

SEQ ID NO: 816639 - DNA, 22 bp, Artificial Sequence
  chemically synthesized
caactagagatttcataaaaaa

SEQ ID NO: 816640 - DNA, 22 bp, Artificial Sequence
  chemically synthesized
agacactccaactagagatttc

SEQ ID NO: 816641 - DNA, 22 bp, Artificial Sequence
  chemically synthesized
aagacactccaactagagattt

SEQ ID NO: 816642 - DNA, 22 bp, Artificial Sequence
  chemically synthesized
taagacactccaactagagatt

SEQ ID NO: 816643 - DNA, 22 bp, Artificial Sequence
  chemically synthesized
tttttatgaaatctctagttgg

SEQ ID NO: 816644 - DNA, 22 bp, Artificial Sequence
  chemically synthesized
ttttatgaaatctctagttgga

SEQ ID NO: 816645 - DNA, 22 bp, Artificial Sequence
  chemically synthesized
tttatgaaatctctagttggag

SEQ ID NO: 816646 - DNA, 22 bp, Artificial Sequence
  chemically synthesized
ttatgaaatctctagttggagt

SEQ ID NO: 816647 - DNA, 22 bp, Artificial Sequence
  chemically synthesized
tatgaaatctctagttggagtg

SEQ ID NO: 816648 - DNA, 22 bp, Artificial Sequence
  chemically synthesized
atgaaatctctagttggagtgt

SEQ ID NO: 816649 - DNA, 22 bp, Artificial Sequence
  chemically synthesized
tgaaatctctagttggagtgtc

SEQ ID NO: 816650 - DNA, 22 bp, Artificial Sequence
  chemically synthesized
cgaagtattttaagacactcca

SEQ ID NO: 816651 - DNA, 22 bp, Artificial Sequence
  chemically synthesized
acgaagtattttaagacactcc

SEQ ID NO: 816652 - DNA, 22 bp, Artificial Sequence
  chemically synthesized
tttacgaagtattttaagacac

SEQ ID NO: 816653 - DNA, 22 bp, Artificial Sequence
  chemically synthesized
tagttggagtgtcttaaaatac

SEQ ID NO: 816654 - DNA, 22 bp, Artificial Sequence
  chemically synthesized
gttggagtgtcttaaaatactt

SEQ ID NO: 816655 - DNA, 22 bp, Artificial Sequence
  chemically synthesized
agaagctgtttacgaagtattt

SEQ ID NO: 816656 - DNA, 22 bp, Artificial Sequence
  chemically synthesized
gagtgtcttaaaatacttcgta

SEQ ID NO: 816657 - DNA, 22 bp, Artificial Sequence
  chemically synthesized
aggattcagaagctgtttacga

SEQ ID NO: 816658 - DNA, 22 bp, Artificial Sequence
  chemically synthesized
aaaatacttcgtaaacagcttc

SEQ ID NO: 816659 - DNA, 22 bp, Artificial Sequence
  chemically synthesized
aaatacttcgtaaacagcttct

SEQ ID NO: 816660 - DNA, 22 bp, Artificial Sequence
  chemically synthesized
acctgaggattcagaagctgtt

SEQ ID NO: 816661 - DNA, 22 bp, Artificial Sequence
  chemically synthesized
tgacctgaggattcagaagctg

SEQ ID NO: 816662 - DNA, 22 bp, Artificial Sequence
  chemically synthesized
cgtaaacagcttctgaatcctc

SEQ ID NO: 816663 - DNA, 22 bp, Artificial Sequence
  chemically synthesized
gtaaacagcttctgaatcctca

SEQ ID NO: 816664 - DNA, 22 bp, Artificial Sequence
  chemically synthesized
atatatgtattctgacctgagg

SEQ ID NO: 816665 - DNA, 22 bp, Artificial Sequence
  chemically synthesized
ctgaatcctcaggtcagaatac

SEQ ID NO: 816666 - DNA, 22 bp, Artificial Sequence
  chemically synthesized
tgaatcctcaggtcagaataca

SEQ ID NO: 816667 - DNA, 22 bp, Artificial Sequence
  chemically synthesized
aatcctcaggtcagaatacata

SEQ ID NO: 816668 - DNA, 22 bp, Artificial Sequence
  chemically synthesized
aaagcaatctaatatatgtatt

SEQ ID NO: 816669 - DNA, 22 bp, Artificial Sequence
  chemically synthesized
aggtcagaatacatatattaga

SEQ ID NO: 816670 - DNA, 22 bp, Artificial Sequence
  chemically synthesized
aatcatatggtaggttaaaagc

SEQ ID NO: 816671 - DNA, 22 bp, Artificial Sequence
  chemically synthesized
actaaatcatatggtaggttaa

SEQ ID NO: 816672 - DNA, 22 bp, Artificial Sequence
  chemically synthesized
gattgcttttaacctaccatat

SEQ ID NO: 816673 - DNA, 22 bp, Artificial Sequence
  chemically synthesized
cttttaacctaccatatgattt

SEQ ID NO: 816674 - DNA, 22 bp, Artificial Sequence
  chemically synthesized
tcatgattgactaaatcatatg

SEQ ID NO: 816675 - DNA, 22 bp, Artificial Sequence
  chemically synthesized
ttaacctaccatatgatttagt

SEQ ID NO: 816676 - DNA, 22 bp, Artificial Sequence
  chemically synthesized
taacctaccatatgatttagtc

SEQ ID NO: 816677 - DNA, 22 bp, Artificial Sequence
  chemically synthesized
aacctaccatatgatttagtca

SEQ ID NO: 816678 - DNA, 22 bp, Artificial Sequence
  chemically synthesized
tactgtcatgattgactaaatc

SEQ ID NO: 816679 - DNA, 22 bp, Artificial Sequence
  chemically synthesized
acctaccatatgatttagtcaa

SEQ ID NO: 816680 - DNA, 22 bp, Artificial Sequence
  chemically synthesized
atactgtcatgattgactaaat

SEQ ID NO: 816681 - DNA, 22 bp, Artificial Sequence
  chemically synthesized
ccttatactgtcatgattgact

SEQ ID NO: 816682 - DNA, 22 bp, Artificial Sequence
  chemically synthesized
ccatatgatttagtcaatcatg

SEQ ID NO: 816683 - DNA, 22 bp, Artificial Sequence
  chemically synthesized
agtcaatcatgacagtataagg

SEQ ID NO: 816684 - DNA, 22 bp, Artificial Sequence
  chemically synthesized
aaaggtgggttaccttatactg

SEQ ID NO: 816685 - DNA, 22 bp, Artificial Sequence
  chemically synthesized
gtcaatcatgacagtataaggt

SEQ ID NO: 816686 - DNA, 22 bp, Artificial Sequence
  chemically synthesized
tcctgaaaggtgggttacctta

SEQ ID NO: 816687 - DNA, 22 bp, Artificial Sequence
  chemically synthesized
gtcctgaaaggtgggttacctt

SEQ ID NO: 816688 - DNA, 22 bp, Artificial Sequence
  chemically synthesized
aaaagtttgtcctgaaaggtgg

SEQ ID NO: 816689 - DNA, 22 bp, Artificial Sequence
  chemically synthesized
gaaaagtttgtcctgaaaggtg

SEQ ID NO: 816690 - DNA, 22 bp, Artificial Sequence
  chemically synthesized
catttgaaaagtttgtcctgaa

SEQ ID NO: 816691 - DNA, 22 bp, Artificial Sequence
  chemically synthesized
aagatgctgcatttgaaaagtt

SEQ ID NO: 816692 - DNA, 22 bp, Artificial Sequence
  chemically synthesized
ctcaagatgctgcatttgaaaa

SEQ ID NO: 816693 - DNA, 22 bp, Artificial Sequence
  chemically synthesized
tcaggacaaacttttcaaatgc

SEQ ID NO: 816694 - DNA, 22 bp, Artificial Sequence
  chemically synthesized
caggacaaacttttcaaatgca

SEQ ID NO: 816695 - DNA, 22 bp, Artificial Sequence
  chemically synthesized
aggacaaacttttcaaatgcag

SEQ ID NO: 816696 - DNA, 22 bp, Artificial Sequence
  chemically synthesized
ttgctcaagatgctgcatttga

SEQ ID NO: 816697 - DNA, 22 bp, Artificial Sequence
  chemically synthesized
gttattgctcaagatgctgcat

SEQ ID NO: 816698 - DNA, 22 bp, Artificial Sequence
  chemically synthesized
atactggttattgctcaagatg

SEQ ID NO: 816699 - DNA, 22 bp, Artificial Sequence
  chemically synthesized
ttcaaatgcagcatcttgagca

SEQ ID NO: 816700 - DNA, 22 bp, Artificial Sequence
  chemically synthesized
gatactggttattgctcaagat

SEQ ID NO: 816701 - DNA, 22 bp, Artificial Sequence
  chemically synthesized
tcaaatgcagcatcttgagcaa

SEQ ID NO: 816702 - DNA, 22 bp, Artificial Sequence
  chemically synthesized
caaatgcagcatcttgagcaat

SEQ ID NO: 816703 - DNA, 22 bp, Artificial Sequence
  chemically synthesized
aaatgcagcatcttgagcaata

SEQ ID NO: 816704 - DNA, 22 bp, Artificial Sequence
  chemically synthesized
aaatacttgatactggttattg

SEQ ID NO: 816705 - DNA, 22 bp, Artificial Sequence
  chemically synthesized
agttgaaatacttgatactggt

SEQ ID NO: 816706 - DNA, 22 bp, Artificial Sequence
  chemically synthesized
ctaagttgaaatacttgatact

SEQ ID NO: 816707 - DNA, 22 bp, Artificial Sequence
  chemically synthesized
gagcaataaccagtatcaagta

SEQ ID NO: 816708 - DNA, 22 bp, Artificial Sequence
  chemically synthesized
agcaataaccagtatcaagtat

SEQ ID NO: 816709 - DNA, 22 bp, Artificial Sequence
  chemically synthesized
ctactaagttgaaatacttgat

SEQ ID NO: 816710 - DNA, 22 bp, Artificial Sequence
  chemically synthesized
attgctactaagttgaaatact

SEQ ID NO: 816711 - DNA, 22 bp, Artificial Sequence
  chemically synthesized
ccaattaattgctactaagttg

SEQ ID NO: 816712 - DNA, 22 bp, Artificial Sequence
  chemically synthesized
ttgccaattaattgctactaag

SEQ ID NO: 816713 - DNA, 22 bp, Artificial Sequence
  chemically synthesized
attgccaattaattgctactaa

SEQ ID NO: 816714 - DNA, 22 bp, Artificial Sequence
  chemically synthesized
tattgccaattaattgctacta

SEQ ID NO: 816715 - DNA, 22 bp, Artificial Sequence
  chemically synthesized
caacttagtagcaattaattgg

SEQ ID NO: 816716 - DNA, 22 bp, Artificial Sequence
  chemically synthesized
aacttagtagcaattaattggc

SEQ ID NO: 816717 - DNA, 22 bp, Artificial Sequence
  chemically synthesized
agcccactttattgccaattaa

SEQ ID NO: 816718 - DNA, 22 bp, Artificial Sequence
  chemically synthesized
agtagcaattaattggcaataa

SEQ ID NO: 816719 - DNA, 22 bp, Artificial Sequence
  chemically synthesized
gtagcaattaattggcaataaa

SEQ ID NO: 816720 - DNA, 22 bp, Artificial Sequence
  chemically synthesized
attggcaataaagtgggcttaa

SEQ ID NO: 816721 - DNA, 22 bp, Artificial Sequence
  chemically synthesized
tgataaaaacaattaagcccac

SEQ ID NO: 816722 - DNA, 22 bp, Artificial Sequence
  chemically synthesized
gtgataaaaacaattaagccca

SEQ ID NO: 816723 - DNA, 22 bp, Artificial Sequence
  chemically synthesized
ttgtgataaaaacaattaagcc

SEQ ID NO: 816724 - DNA, 22 bp, Artificial Sequence
  chemically synthesized
gcaataaagtgggcttaattgt

SEQ ID NO: 816725 - DNA, 22 bp, Artificial Sequence
  chemically synthesized
tcttgtgataaaaacaattaag

SEQ ID NO: 816726 - DNA, 22 bp, Artificial Sequence
  chemically synthesized
ctcttgtgataaaaacaattaa

SEQ ID NO: 816727 - DNA, 22 bp, Artificial Sequence
  chemically synthesized
tctcttgtgataaaaacaatta

SEQ ID NO: 816728 - DNA, 22 bp, Artificial Sequence
  chemically synthesized
ttctcttgtgataaaaacaatt

SEQ ID NO: 816729 - DNA, 22 bp, Artificial Sequence
  chemically synthesized
tttctcttgtgataaaaacaat

SEQ ID NO: 816730 - DNA, 22 bp, Artificial Sequence
  chemically synthesized
ttttctcttgtgataaaaacaa

SEQ ID NO: 816731 - DNA, 22 bp, Artificial Sequence
  chemically synthesized
tagtttttttctcttgtgataa

SEQ ID NO: 816732 - DNA, 22 bp, Artificial Sequence
  chemically synthesized
gtagtttttttctcttgtgata

SEQ ID NO: 816733 - DNA, 22 bp, Artificial Sequence
  chemically synthesized
tgtagtttttttctcttgtgat

SEQ ID NO: 816734 - DNA, 22 bp, Artificial Sequence
  chemically synthesized
ttgtagtttttttctcttgtga

SEQ ID NO: 816735 - DNA, 22 bp, Artificial Sequence
  chemically synthesized
aattgtttttatcacaagagaa

SEQ ID NO: 816736 - DNA, 22 bp, Artificial Sequence
  chemically synthesized
attgtttttatcacaagagaaa

SEQ ID NO: 816737 - DNA, 22 bp, Artificial Sequence
  chemically synthesized
tttttgtagtttttttctcttg

SEQ ID NO: 816738 - DNA, 22 bp, Artificial Sequence
  chemically synthesized
atttttgtagtttttttctctt

SEQ ID NO: 816739 - DNA, 22 bp, Artificial Sequence
  chemically synthesized
tttttatcacaagagaaaaaaa

SEQ ID NO: 816740 - DNA, 22 bp, Artificial Sequence
  chemically synthesized
ttatcacaagagaaaaaaacta

SEQ ID NO: 816741 - DNA, 22 bp, Artificial Sequence
  chemically synthesized
tatcacaagagaaaaaaactac

SEQ ID NO: 816742 - DNA, 22 bp, Artificial Sequence
  chemically synthesized
atcacaagagaaaaaaactaca

SEQ ID NO: 816743 - DNA, 22 bp, Artificial Sequence
  chemically synthesized
tcacaagagaaaaaaactacaa

SEQ ID NO: 816744 - DNA, 22 bp, Artificial Sequence
  chemically synthesized
tatatgagcttatttttgtagt

SEQ ID NO: 816745 - DNA, 22 bp, Artificial Sequence
  chemically synthesized
aacaattatatatgagcttatt

SEQ ID NO: 816746 - DNA, 22 bp, Artificial Sequence
  chemically synthesized
caaaaataagctcatatataat

SEQ ID NO: 816747 - DNA, 22 bp, Artificial Sequence
  chemically synthesized
tatgtcacatattcaacaatta

SEQ ID NO: 816748 - DNA, 22 bp, Artificial Sequence
  chemically synthesized
ttatatgtcacatattcaacaa

SEQ ID NO: 816749 - DNA, 22 bp, Artificial Sequence
  chemically synthesized
atatataattgttgaatatgtg

SEQ ID NO: 816750 - DNA, 22 bp, Artificial Sequence
  chemically synthesized
aaatgttgttatatgtcacata

SEQ ID NO: 816751 - DNA, 22 bp, Artificial Sequence
  chemically synthesized
gttcaaatgttgttatatgtca

SEQ ID NO: 816752 - DNA, 22 bp, Artificial Sequence
  chemically synthesized
cgttcaaatgttgttatatgtc

SEQ ID NO: 816753 - DNA, 22 bp, Artificial Sequence
  chemically synthesized
tcgttcaaatgttgttatatgt

SEQ ID NO: 816754 - DNA, 22 bp, Artificial Sequence
  chemically synthesized
ttgaatatgtgacatataacaa

SEQ ID NO: 816755 - DNA, 22 bp, Artificial Sequence
  chemically synthesized
ttcgttcaaatgttgttatatg

SEQ ID NO: 816756 - DNA, 22 bp, Artificial Sequence
  chemically synthesized
tttcgttcaaatgttgttatat

SEQ ID NO: 816757 - DNA, 22 bp, Artificial Sequence
  chemically synthesized
ttttcgttcaaatgttgttata

SEQ ID NO: 816758 - DNA, 22 bp, Artificial Sequence
  chemically synthesized
aatatgtgacatataacaacat

SEQ ID NO: 816759 - DNA, 22 bp, Artificial Sequence
  chemically synthesized
gaacgaaaaaaacctcatacat

SEQ ID NO: 816760 - DNA, 22 bp, Artificial Sequence
  chemically synthesized
aacgaaaaaaacctcatacatt

SEQ ID NO: 816761 - DNA, 22 bp, Artificial Sequence
  chemically synthesized
atgaagagggaaagaaatgtat

SEQ ID NO: 816762 - DNA, 22 bp, Artificial Sequence
  chemically synthesized
aacaagttaatgaagagggaaa

SEQ ID NO: 816763 - DNA, 22 bp, Artificial Sequence
  chemically synthesized
atacatttctttccctcttcat

SEQ ID NO: 816764 - DNA, 22 bp, Artificial Sequence
  chemically synthesized
ctttccctcttcattaacttgt

SEQ ID NO: 816765 - DNA, 22 bp, Artificial Sequence
  chemically synthesized
tttccctcttcattaacttgtt

SEQ ID NO: 816766 - DNA, 22 bp, Artificial Sequence
  chemically synthesized
cataaacaattcaacaagttaa

SEQ ID NO: 816767 - DNA, 22 bp, Artificial Sequence
  chemically synthesized
tccctcttcattaacttgttga

SEQ ID NO: 816768 - DNA, 22 bp, Artificial Sequence
  chemically synthesized
ccctcttcattaacttgttgaa

SEQ ID NO: 816769 - DNA, 22 bp, Artificial Sequence
  chemically synthesized
cctcttcattaacttgttgaat

SEQ ID NO: 816770 - DNA, 22 bp, Artificial Sequence
  chemically synthesized
attacataaacaattcaacaag

SEQ ID NO: 816771 - DNA, 22 bp, Artificial Sequence
  chemically synthesized
ttcattaacttgttgaattgtt

SEQ ID NO: 816772 - DNA, 22 bp, Artificial Sequence
  chemically synthesized
cattaacttgttgaattgttta

SEQ ID NO: 816773 - DNA, 22 bp, Artificial Sequence
  chemically synthesized
attaacttgttgaattgtttat

SEQ ID NO: 816774 - DNA, 22 bp, Artificial Sequence
  chemically synthesized
acttgttgaattgtttatgtaa

SEQ ID NO: 816775 - DNA, 22 bp, Artificial Sequence
  chemically synthesized
gttgaattgtttatgtaattag

SEQ ID NO: 816776 - DNA, 22 bp, Artificial Sequence
  chemically synthesized
ttgaattgtttatgtaattagt

SEQ ID NO: 816777 - DNA, 22 bp, Artificial Sequence
  chemically synthesized
aattgtttatgtaattagtgcc

SEQ ID NO: 816778 - DNA, 22 bp, Artificial Sequence
  chemically synthesized
aacgccagtagatggcactaat

SEQ ID NO: 816779 - DNA, 22 bp, Artificial Sequence
  chemically synthesized
tttatgtaattagtgccatcta

SEQ ID NO: 816780 - DNA, 22 bp, Artificial Sequence
  chemically synthesized
gttgaacgccagtagatggcac

SEQ ID NO: 816781 - DNA, 22 bp, Artificial Sequence
  chemically synthesized
agttgaacgccagtagatggca

SEQ ID NO: 816782 - DNA, 22 bp, Artificial Sequence
  chemically synthesized
atgtaattagtgccatctactg

SEQ ID NO: 816783 - DNA, 22 bp, Artificial Sequence
  chemically synthesized
tgtaattagtgccatctactgg

SEQ ID NO: 816784 - DNA, 22 bp, Artificial Sequence
  chemically synthesized
gtgccatctactggcgttcaac

SEQ ID NO: 816785 - DNA, 22 bp, Artificial Sequence
  chemically synthesized
tatgcaggtttagttgaacgcc

SEQ ID NO: 816786 - DNA, 22 bp, Artificial Sequence
  chemically synthesized
tgtatgcaggtttagttgaacg

SEQ ID NO: 816787 - DNA, 22 bp, Artificial Sequence
  chemically synthesized
ctgtatgcaggtttagttgaac

SEQ ID NO: 816788 - DNA, 22 bp, Artificial Sequence
  chemically synthesized
tctgtatgcaggtttagttgaa

SEQ ID NO: 816789 - DNA, 22 bp, Artificial Sequence
  chemically synthesized
ctggcgttcaactaaacctgca

SEQ ID NO: 816790 - DNA, 22 bp, Artificial Sequence
  chemically synthesized
aatattttctgtatgcaggttt

SEQ ID NO: 816791 - DNA, 22 bp, Artificial Sequence
  chemically synthesized
gcgttcaactaaacctgcatac

SEQ ID NO: 816792 - DNA, 22 bp, Artificial Sequence
  chemically synthesized
ttcaatattttctgtatgcagg

SEQ ID NO: 816793 - DNA, 22 bp, Artificial Sequence
  chemically synthesized
ttgttcaatattttctgtatgc

SEQ ID NO: 816794 - DNA, 22 bp, Artificial Sequence
  chemically synthesized
gttgttcaatattttctgtatg

SEQ ID NO: 816795 - DNA, 22 bp, Artificial Sequence
  chemically synthesized
aactaaacctgcatacagaaaa

SEQ ID NO: 816796 - DNA, 22 bp, Artificial Sequence
  chemically synthesized
tgttgttcaatattttctgtat

SEQ ID NO: 816797 - DNA, 22 bp, Artificial Sequence
  chemically synthesized
ttgttgttcaatattttctgta

SEQ ID NO: 816798 - DNA, 22 bp, Artificial Sequence
  chemically synthesized
ttttgttgttcaatattttctg

SEQ ID NO: 816799 - DNA, 22 bp, Artificial Sequence
  chemically synthesized
aacctgcatacagaaaatattg

SEQ ID NO: 816800 - DNA, 22 bp, Artificial Sequence
  chemically synthesized
ttcttttgttgttcaatatttt

SEQ ID NO: 816801 - DNA, 22 bp, Artificial Sequence
  chemically synthesized
catacagaaaatattgaacaac

SEQ ID NO: 816802 - DNA, 22 bp, Artificial Sequence
  chemically synthesized
gaataacagtactattcttttg

SEQ ID NO: 816803 - DNA, 22 bp, Artificial Sequence
  chemically synthesized
aacaacaaaagaatagtactgt

SEQ ID NO: 816804 - DNA, 22 bp, Artificial Sequence
  chemically synthesized
gtgactagaataacagtactat

SEQ ID NO: 816805 - DNA, 22 bp, Artificial Sequence
  chemically synthesized
aaaaaattcgtgactagaataa

SEQ ID NO: 816806 - DNA, 22 bp, Artificial Sequence
  chemically synthesized
caaaaaattcgtgactagaata

SEQ ID NO: 816807 - DNA, 22 bp, Artificial Sequence
  chemically synthesized
atccttcaaaaaattcgtgact

SEQ ID NO: 816808 - DNA, 22 bp, Artificial Sequence
  chemically synthesized
gatccttcaaaaaattcgtgac

SEQ ID NO: 816809 - DNA, 22 bp, Artificial Sequence
  chemically synthesized
tgatccttcaaaaaattcgtga

SEQ ID NO: 816810 - DNA, 22 bp, Artificial Sequence
  chemically synthesized
ttattctagtcacgaatttttt

SEQ ID NO: 816811 - DNA, 22 bp, Artificial Sequence
  chemically synthesized
ttctagtcacgaattttttgaa

SEQ ID NO: 816812 - DNA, 22 bp, Artificial Sequence
  chemically synthesized
tagtcacgaattttttgaagga

SEQ ID NO: 816813 - DNA, 22 bp, Artificial Sequence
  chemically synthesized
aaagtattttgatccttcaaaa

SEQ ID NO: 816814 - DNA, 22 bp, Artificial Sequence
  chemically synthesized
gtcacgaattttttgaaggatc

SEQ ID NO: 816815 - DNA, 22 bp, Artificial Sequence
  chemically synthesized
taaaagtattttgatccttcaa

SEQ ID NO: 816816 - DNA, 22 bp, Artificial Sequence
  chemically synthesized
tttgaaggatcaaaatactttt

SEQ ID NO: 816817 - DNA, 22 bp, Artificial Sequence
  chemically synthesized
ttgaaggatcaaaatactttta

SEQ ID NO: 816818 - DNA, 22 bp, Artificial Sequence
  chemically synthesized
tgaaggatcaaaatacttttag

SEQ ID NO: 816819 - DNA, 22 bp, Artificial Sequence
  chemically synthesized
aagtaaggtattctaaaagtat

SEQ ID NO: 816820 - DNA, 22 bp, Artificial Sequence
  chemically synthesized
gaaggatcaaaatacttttaga

SEQ ID NO: 816821 - DNA, 22 bp, Artificial Sequence
  chemically synthesized
aaagtaaggtattctaaaagta

SEQ ID NO: 816822 - DNA, 22 bp, Artificial Sequence
  chemically synthesized
aaggatcaaaatacttttagaa

SEQ ID NO: 816823 - DNA, 22 bp, Artificial Sequence
  chemically synthesized
taaagtaaggtattctaaaagt

SEQ ID NO: 816824 - DNA, 22 bp, Artificial Sequence
  chemically synthesized
attttaaagtaaggtattctaa

SEQ ID NO: 816825 - DNA, 22 bp, Artificial Sequence
  chemically synthesized
taattttaaagtaaggtattct

SEQ ID NO: 816826 - DNA, 22 bp, Artificial Sequence
  chemically synthesized
ctaattttaaagtaaggtattc

SEQ ID NO: 816827 - DNA, 22 bp, Artificial Sequence
  chemically synthesized
tctaattttaaagtaaggtatt

SEQ ID NO: 816828 - DNA, 22 bp, Artificial Sequence
  chemically synthesized
ttctaattttaaagtaaggtat

SEQ ID NO: 816829 - DNA, 22 bp, Artificial Sequence
  chemically synthesized
tttctaattttaaagtaaggta

SEQ ID NO: 816830 - DNA, 22 bp, Artificial Sequence
  chemically synthesized
ttttctaattttaaagtaaggt

SEQ ID NO: 816831 - DNA, 22 bp, Artificial Sequence
  chemically synthesized
tttttctaattttaaagtaagg

SEQ ID NO: 816832 - DNA, 22 bp, Artificial Sequence
  chemically synthesized
ttagaataccttactttaaaat

SEQ ID NO: 816833 - DNA, 22 bp, Artificial Sequence
  chemically synthesized
actttttttctaattttaaagt

SEQ ID NO: 816834 - DNA, 22 bp, Artificial Sequence
  chemically synthesized
tagaataccttactttaaaatt

SEQ ID NO: 816835 - DNA, 22 bp, Artificial Sequence
  chemically synthesized
gactttttttctaattttaaag

SEQ ID NO: 816836 - DNA, 22 bp, Artificial Sequence
  chemically synthesized
agaataccttactttaaaatta

SEQ ID NO: 816837 - DNA, 22 bp, Artificial Sequence
  chemically synthesized
tgactttttttctaattttaaa

SEQ ID NO: 816838 - DNA, 22 bp, Artificial Sequence
  chemically synthesized
gaataccttactttaaaattag

SEQ ID NO: 816839 - DNA, 22 bp, Artificial Sequence
  chemically synthesized
tattttgactttttttctaatt

SEQ ID NO: 816840 - DNA, 22 bp, Artificial Sequence
  chemically synthesized
atattttgactttttttctaat

SEQ ID NO: 816841 - DNA, 22 bp, Artificial Sequence
  chemically synthesized
ttatattttgactttttttcta

SEQ ID NO: 816842 - DNA, 22 bp, Artificial Sequence
  chemically synthesized
actttaaaattagaaaaaaagt

SEQ ID NO: 816843 - DNA, 22 bp, Artificial Sequence
  chemically synthesized
ctttaaaattagaaaaaaagtc

SEQ ID NO: 816844 - DNA, 22 bp, Artificial Sequence
  chemically synthesized
taaaattagaaaaaaagtcaaa

SEQ ID NO: 816845 - DNA, 22 bp, Artificial Sequence
  chemically synthesized
aaaattagaaaaaaagtcaaaa

SEQ ID NO: 816846 - DNA, 22 bp, Artificial Sequence
  chemically synthesized
aaattagaaaaaaagtcaaaat

SEQ ID NO: 816847 - DNA, 22 bp, Artificial Sequence
  chemically synthesized
gtaagattcttatattttgact

SEQ ID NO: 816848 - DNA, 22 bp, Artificial Sequence
  chemically synthesized
agtaagattcttatattttgac

SEQ ID NO: 816849 - DNA, 22 bp, Artificial Sequence
  chemically synthesized
gaaaaaaagtcaaaatataaga

SEQ ID NO: 816850 - DNA, 22 bp, Artificial Sequence
  chemically synthesized
gtttagtaagattcttatattt

SEQ ID NO: 816851 - DNA, 22 bp, Artificial Sequence
  chemically synthesized
ggtttagtaagattcttatatt

SEQ ID NO: 816852 - DNA, 22 bp, Artificial Sequence
  chemically synthesized
actaaaccaaatcacctacatt

SEQ ID NO: 816853 - DNA, 22 bp, Artificial Sequence
  chemically synthesized
ctaaaccaaatcacctacattt

SEQ ID NO: 816854 - DNA, 22 bp, Artificial Sequence
  chemically synthesized
aaccaaatcacctacattttct

SEQ ID NO: 816855 - DNA, 22 bp, Artificial Sequence
  chemically synthesized
ccaaagacaaacaacgaagaaa

SEQ ID NO: 816856 - DNA, 22 bp, Artificial Sequence
  chemically synthesized
aattgccaaagacaaacaacga

SEQ ID NO: 816857 - DNA, 22 bp, Artificial Sequence
  chemically synthesized
cattttcttcgttgtttgtctt

SEQ ID NO: 816858 - DNA, 22 bp, Artificial Sequence
  chemically synthesized
tcttcgttgtttgtctttggca

SEQ ID NO: 816859 - DNA, 22 bp, Artificial Sequence
  chemically synthesized
aaaacactgaattgccaaagac

SEQ ID NO: 816860 - DNA, 22 bp, Artificial Sequence
  chemically synthesized
cttcgttgtttgtctttggcaa

SEQ ID NO: 816861 - DNA, 22 bp, Artificial Sequence
  chemically synthesized
gaaaacactgaattgccaaaga

SEQ ID NO: 816862 - DNA, 22 bp, Artificial Sequence
  chemically synthesized
ttcgttgtttgtctttggcaat

SEQ ID NO: 816863 - DNA, 22 bp, Artificial Sequence
  chemically synthesized
cgttgtttgtctttggcaattc

SEQ ID NO: 816864 - DNA, 22 bp, Artificial Sequence
  chemically synthesized
gttgtttgtctttggcaattca

SEQ ID NO: 816865 - DNA, 22 bp, Artificial Sequence
  chemically synthesized
tttgtctttggcaattcagtgt

SEQ ID NO: 816866 - DNA, 22 bp, Artificial Sequence
  chemically synthesized
gtctttggcaattcagtgtttt

SEQ ID NO: 816867 - DNA, 22 bp, Artificial Sequence
  chemically synthesized
tctttggcaattcagtgttttc

SEQ ID NO: 816868 - DNA, 22 bp, Artificial Sequence
  chemically synthesized
tggcaattcagtgttttcaaac

SEQ ID NO: 816869 - DNA, 22 bp, Artificial Sequence
  chemically synthesized
ggcaattcagtgttttcaaact

SEQ ID NO: 816870 - DNA, 22 bp, Artificial Sequence
  chemically synthesized
gcaattcagtgttttcaaactt

SEQ ID NO: 816871 - DNA, 22 bp, Artificial Sequence
  chemically synthesized
aagtgatgagatagcaagtttg

SEQ ID NO: 816872 - DNA, 22 bp, Artificial Sequence
  chemically synthesized
caagtgatgagatagcaagttt

SEQ ID NO: 816873 - DNA, 22 bp, Artificial Sequence
  chemically synthesized
agtgttttcaaacttgctatct

SEQ ID NO: 816874 - DNA, 22 bp, Artificial Sequence
  chemically synthesized
tcaaacttgctatctcatcact

SEQ ID NO: 816875 - DNA, 22 bp, Artificial Sequence
  chemically synthesized
aaatatgtttcaagtgatgaga

SEQ ID NO: 816876 - DNA, 22 bp, Artificial Sequence
  chemically synthesized
caaacttgctatctcatcactt

SEQ ID NO: 816877 - DNA, 22 bp, Artificial Sequence
  chemically synthesized
gaaatatgtttcaagtgatgag

SEQ ID NO: 816878 - DNA, 22 bp, Artificial Sequence
  chemically synthesized
aaacttgctatctcatcacttg

SEQ ID NO: 816879 - DNA, 22 bp, Artificial Sequence
  chemically synthesized
tgaaatatgtttcaagtgatga

SEQ ID NO: 816880 - DNA, 22 bp, Artificial Sequence
  chemically synthesized
tttgaaatatgtttcaagtgat

SEQ ID NO: 816881 - DNA, 22 bp, Artificial Sequence
  chemically synthesized
ctttgaaatatgtttcaagtga

SEQ ID NO: 816882 - DNA, 22 bp, Artificial Sequence
  chemically synthesized
tctttgaaatatgtttcaagtg

SEQ ID NO: 816883 - DNA, 22 bp, Artificial Sequence
  chemically synthesized
gctatctcatcacttgaaacat

SEQ ID NO: 816884 - DNA, 22 bp, Artificial Sequence
  chemically synthesized
tttctttgaaatatgtttcaag

SEQ ID NO: 816885 - DNA, 22 bp, Artificial Sequence
  chemically synthesized
ctatctcatcacttgaaacata

SEQ ID NO: 816886 - DNA, 22 bp, Artificial Sequence
  chemically synthesized
ctttctttgaaatatgtttcaa

SEQ ID NO: 816887 - DNA, 22 bp, Artificial Sequence
  chemically synthesized
tctcatcacttgaaacatattt

SEQ ID NO: 816888 - DNA, 22 bp, Artificial Sequence
  chemically synthesized
acttctttctttgaaatatgtt

SEQ ID NO: 816889 - DNA, 22 bp, Artificial Sequence
  chemically synthesized
atcacttgaaacatatttcaaa

SEQ ID NO: 816890 - DNA, 22 bp, Artificial Sequence
  chemically synthesized
attgacttctttctttgaaata

SEQ ID NO: 816891 - DNA, 22 bp, Artificial Sequence
  chemically synthesized
gaaacatatttcaaagaaagaa

SEQ ID NO: 816892 - DNA, 22 bp, Artificial Sequence
  chemically synthesized
ccattaattgacttctttcttt

SEQ ID NO: 816893 - DNA, 22 bp, Artificial Sequence
  chemically synthesized
aaacatatttcaaagaaagaag

SEQ ID NO: 816894 - DNA, 22 bp, Artificial Sequence
  chemically synthesized
caaagaaagaagtcaattaatg

SEQ ID NO: 816895 - DNA, 22 bp, Artificial Sequence
  chemically synthesized
aaagaaagaagtcaattaatgg

SEQ ID NO: 816896 - DNA, 22 bp, Artificial Sequence
  chemically synthesized
gagataaaacctaccattaatt

SEQ ID NO: 816897 - DNA, 22 bp, Artificial Sequence
  chemically synthesized
cgagataaaacctaccattaat

SEQ ID NO: 816898 - DNA, 22 bp, Artificial Sequence
  chemically synthesized
atatgcttcgagataaaaccta

SEQ ID NO: 816899 - DNA, 22 bp, Artificial Sequence
  chemically synthesized
aggttgatatgcttcgagataa

SEQ ID NO: 816900 - DNA, 22 bp, Artificial Sequence
  chemically synthesized
caggttgatatgcttcgagata

SEQ ID NO: 816901 - DNA, 22 bp, Artificial Sequence
  chemically synthesized
atggtaggttttatctcgaagc

SEQ ID NO: 816902 - DNA, 22 bp, Artificial Sequence
  chemically synthesized
atagaaatttcaggttgatatg

SEQ ID NO: 816903 - DNA, 22 bp, Artificial Sequence
  chemically synthesized
aatagaaatttcaggttgatat

SEQ ID NO: 816904 - DNA, 22 bp, Artificial Sequence
  chemically synthesized
tatctcgaagcatatcaacctg

SEQ ID NO: 816905 - DNA, 22 bp, Artificial Sequence
  chemically synthesized
atctcgaagcatatcaacctga

SEQ ID NO: 816906 - DNA, 22 bp, Artificial Sequence
  chemically synthesized
tctcgaagcatatcaacctgaa

SEQ ID NO: 816907 - DNA, 22 bp, Artificial Sequence
  chemically synthesized
gaagcatatcaacctgaaattt

SEQ ID NO: 816908 - DNA, 22 bp, Artificial Sequence
  chemically synthesized
cagaaatgtttaatagaaattt

SEQ ID NO: 816909 - DNA, 22 bp, Artificial Sequence
  chemically synthesized
gcagaaatgtttaatagaaatt

SEQ ID NO: 816910 - DNA, 22 bp, Artificial Sequence
  chemically synthesized
cacttgcagaaatgtttaatag

SEQ ID NO: 816911 - DNA, 22 bp, Artificial Sequence
  chemically synthesized
tgcacttgcagaaatgtttaat

SEQ ID NO: 816912 - DNA, 22 bp, Artificial Sequence
  chemically synthesized
tctgcacttgcagaaatgttta

SEQ ID NO: 816913 - DNA, 22 bp, Artificial Sequence
  chemically synthesized
aaatttctattaaacatttctg

SEQ ID NO: 816914 - DNA, 22 bp, Artificial Sequence
  chemically synthesized
ctctctgcacttgcagaaatgt

SEQ ID NO: 816915 - DNA, 22 bp, Artificial Sequence
  chemically synthesized
ctattaaacatttctgcaagtg

SEQ ID NO: 816916 - DNA, 22 bp, Artificial Sequence
  chemically synthesized
tattaaacatttctgcaagtgc

SEQ ID NO: 816917 - DNA, 22 bp, Artificial Sequence
  chemically synthesized
ttaaacatttctgcaagtgcag

SEQ ID NO: 816918 - DNA, 22 bp, Artificial Sequence
  chemically synthesized
gaagcctcctctctgcacttgc

SEQ ID NO: 816919 - DNA, 22 bp, Artificial Sequence
  chemically synthesized
agaagcctcctctctgcacttg

SEQ ID NO: 816920 - DNA, 22 bp, Artificial Sequence
  chemically synthesized
aacatttctgcaagtgcagaga

SEQ ID NO: 816921 - DNA, 22 bp, Artificial Sequence
  chemically synthesized
atgcttagaagcctcctctctg

SEQ ID NO: 816922 - DNA, 22 bp, Artificial Sequence
  chemically synthesized
aatgcttagaagcctcctctct

SEQ ID NO: 816923 - DNA, 22 bp, Artificial Sequence
  chemically synthesized
ctgcaagtgcagagaggaggct

SEQ ID NO: 816924 - DNA, 22 bp, Artificial Sequence
  chemically synthesized
tgcaagtgcagagaggaggctt

SEQ ID NO: 816925 - DNA, 22 bp, Artificial Sequence
  chemically synthesized
tcttaatgcttagaagcctcct

SEQ ID NO: 816926 - DNA, 22 bp, Artificial Sequence
  chemically synthesized
caagtgcagagaggaggcttct

SEQ ID NO: 816927 - DNA, 22 bp, Artificial Sequence
  chemically synthesized
gtattatcttaatgcttagaag

SEQ ID NO: 816928 - DNA, 22 bp, Artificial Sequence
  chemically synthesized
acaattagtattatcttaatgc

SEQ ID NO: 816929 - DNA, 22 bp, Artificial Sequence
  chemically synthesized
aacaattagtattatcttaatg

SEQ ID NO: 816930 - DNA, 22 bp, Artificial Sequence
  chemically synthesized
tcttaacaattagtattatctt

SEQ ID NO: 816931 - DNA, 22 bp, Artificial Sequence
  chemically synthesized
ctaagcattaagataatactaa

SEQ ID NO: 816932 - DNA, 22 bp, Artificial Sequence
  chemically synthesized
taagcattaagataatactaat

SEQ ID NO: 816933 - DNA, 22 bp, Artificial Sequence
  chemically synthesized
agcattaagataatactaattg

SEQ ID NO: 816934 - DNA, 22 bp, Artificial Sequence
  chemically synthesized
atataactatcttaacaattag

SEQ ID NO: 816935 - DNA, 22 bp, Artificial Sequence
  chemically synthesized
gatataactatcttaacaatta

SEQ ID NO: 816936 - DNA, 22 bp, Artificial Sequence
  chemically synthesized
agataatactaattgttaagat

SEQ ID NO: 816937 - DNA, 22 bp, Artificial Sequence
  chemically synthesized
aatttgatataactatcttaac

SEQ ID NO: 816938 - DNA, 22 bp, Artificial Sequence
  chemically synthesized
ttgaatttgatataactatctt

SEQ ID NO: 816939 - DNA, 22 bp, Artificial Sequence
  chemically synthesized
attgttaagatagttatatcaa

SEQ ID NO: 816940 - DNA, 22 bp, Artificial Sequence
  chemically synthesized
ttaagatagttatatcaaattc

SEQ ID NO: 816941 - DNA, 22 bp, Artificial Sequence
  chemically synthesized
acccatcctattgaatttgata

SEQ ID NO: 816942 - DNA, 22 bp, Artificial Sequence
  chemically synthesized
aacccatcctattgaatttgat

SEQ ID NO: 816943 - DNA, 22 bp, Artificial Sequence
  chemically synthesized
agatagttatatcaaattcaat

SEQ ID NO: 816944 - DNA, 22 bp, Artificial Sequence
  chemically synthesized
tcaatgacttaacccatcctat

SEQ ID NO: 816945 - DNA, 22 bp, Artificial Sequence
  chemically synthesized
tatcaaattcaataggatgggt

SEQ ID NO: 816946 - DNA, 22 bp, Artificial Sequence
  chemically synthesized
atcaatgacttaacccatccta

SEQ ID NO: 816947 - DNA, 22 bp, Artificial Sequence
  chemically synthesized
tgtccatttatcaatgacttaa

SEQ ID NO: 816948 - DNA, 22 bp, Artificial Sequence
  chemically synthesized
aataggatgggttaagtcattg

SEQ ID NO: 816949 - DNA, 22 bp, Artificial Sequence
  chemically synthesized
ctgtgtccatttatcaatgact

SEQ ID NO: 816950 - DNA, 22 bp, Artificial Sequence
  chemically synthesized
ttcctgtgtccatttatcaatg

SEQ ID NO: 816951 - DNA, 22 bp, Artificial Sequence
  chemically synthesized
ctattcctgtgtccatttatca

SEQ ID NO: 816952 - DNA, 22 bp, Artificial Sequence
  chemically synthesized
ttcctattcctgtgtccattta

SEQ ID NO: 816953 - DNA, 22 bp, Artificial Sequence
  chemically synthesized
agtcattgataaatggacacag

SEQ ID NO: 816954 - DNA, 22 bp, Artificial Sequence
  chemically synthesized
cctgttcctattcctgtgtcca

SEQ ID NO: 816955 - DNA, 22 bp, Artificial Sequence
  chemically synthesized
aactacctgttcctattcctgt

SEQ ID NO: 816956 - DNA, 22 bp, Artificial Sequence
  chemically synthesized
gaactacctgttcctattcctg

SEQ ID NO: 816957 - DNA, 22 bp, Artificial Sequence
  chemically synthesized
ataaatggacacaggaatagga

SEQ ID NO: 816958 - DNA, 22 bp, Artificial Sequence
  chemically synthesized
tttgaactacctgttcctattc

SEQ ID NO: 816959 - DNA, 22 bp, Artificial Sequence
  chemically synthesized
gtttgaactacctgttcctatt

SEQ ID NO: 816960 - DNA, 22 bp, Artificial Sequence
  chemically synthesized
ttgtttgaactacctgttccta

SEQ ID NO: 816961 - DNA, 22 bp, Artificial Sequence
  chemically synthesized
tcttgtttgaactacctgttcc

SEQ ID NO: 816962 - DNA, 22 bp, Artificial Sequence
  chemically synthesized
ctcttgtttgaactacctgttc

SEQ ID NO: 816963 - DNA, 22 bp, Artificial Sequence
  chemically synthesized
tctcttgtttgaactacctgtt

SEQ ID NO: 816964 - DNA, 22 bp, Artificial Sequence
  chemically synthesized
tttctcttgtttgaactacctg

SEQ ID NO: 816965 - DNA, 22 bp, Artificial Sequence
  chemically synthesized
aataaaatcatcccactctttc

SEQ ID NO: 816966 - DNA, 22 bp, Artificial Sequence
  chemically synthesized
aaataaaatcatcccactcttt

SEQ ID NO: 816967 - DNA, 22 bp, Artificial Sequence
  chemically synthesized
taaataaaatcatcccactctt

SEQ ID NO: 816968 - DNA, 22 bp, Artificial Sequence
  chemically synthesized
ttaaataaaatcatcccactct

SEQ ID NO: 816969 - DNA, 22 bp, Artificial Sequence
  chemically synthesized
aaacaagagaaagagtgggatg

SEQ ID NO: 816970 - DNA, 22 bp, Artificial Sequence
  chemically synthesized
tttaaataaaatcatcccactc

SEQ ID NO: 816971 - DNA, 22 bp, Artificial Sequence
  chemically synthesized
tttttaaataaaatcatcccac

SEQ ID NO: 816972 - DNA, 22 bp, Artificial Sequence
  chemically synthesized
ctttttaaataaaatcatccca

SEQ ID NO: 816973 - DNA, 22 bp, Artificial Sequence
  chemically synthesized
tctttttaaataaaatcatccc

SEQ ID NO: 816974 - DNA, 22 bp, Artificial Sequence
  chemically synthesized
ttctttttaaataaaatcatcc

SEQ ID NO: 816975 - DNA, 22 bp, Artificial Sequence
  chemically synthesized
tttctttttaaataaaatcatc

SEQ ID NO: 816976 - DNA, 22 bp, Artificial Sequence
  chemically synthesized
ttttctttttaaataaaatcat

SEQ ID NO: 816977 - DNA, 22 bp, Artificial Sequence
  chemically synthesized
acttttttctttttaaataaaa

SEQ ID NO: 816978 - DNA, 22 bp, Artificial Sequence
  chemically synthesized
aaagttaacttttttcttttta

SEQ ID NO: 816979 - DNA, 22 bp, Artificial Sequence
  chemically synthesized
gaaagttaacttttttcttttt

SEQ ID NO: 816980 - DNA, 22 bp, Artificial Sequence
  chemically synthesized
cttgaaagttaacttttttctt

SEQ ID NO: 816981 - DNA, 22 bp, Artificial Sequence
  chemically synthesized
ttacttgaaagttaactttttt

SEQ ID NO: 816982 - DNA, 22 bp, Artificial Sequence
  chemically synthesized
tatttaaaaagaaaaaagttaa

SEQ ID NO: 816983 - DNA, 22 bp, Artificial Sequence
  chemically synthesized
attacttgaaagttaacttttt

SEQ ID NO: 816984 - DNA, 22 bp, Artificial Sequence
  chemically synthesized
atttaaaaagaaaaaagttaac

SEQ ID NO: 816985 - DNA, 22 bp, Artificial Sequence
  chemically synthesized
tattacttgaaagttaactttt

SEQ ID NO: 816986 - DNA, 22 bp, Artificial Sequence
  chemically synthesized
tttaaaaagaaaaaagttaact

SEQ ID NO: 816987 - DNA, 22 bp, Artificial Sequence
  chemically synthesized
ttattacttgaaagttaacttt

SEQ ID NO: 816988 - DNA, 22 bp, Artificial Sequence
  chemically synthesized
tttattacttgaaagttaactt

SEQ ID NO: 816989 - DNA, 22 bp, Artificial Sequence
  chemically synthesized
aaaaagaaaaaagttaactttc

SEQ ID NO: 816990 - DNA, 22 bp, Artificial Sequence
  chemically synthesized
aaaagaaaaaagttaactttca

SEQ ID NO: 816991 - DNA, 22 bp, Artificial Sequence
  chemically synthesized
ttttttattacttgaaagttaa

SEQ ID NO: 816992 - DNA, 22 bp, Artificial Sequence
  chemically synthesized
tattttttattacttgaaagtt

SEQ ID NO: 816993 - DNA, 22 bp, Artificial Sequence
  chemically synthesized
atactctattttttattacttg

SEQ ID NO: 816994 - DNA, 22 bp, Artificial Sequence
  chemically synthesized
aatactctattttttattactt

SEQ ID NO: 816995 - DNA, 22 bp, Artificial Sequence
  chemically synthesized
aatttaatactctattttttat

SEQ ID NO: 816996 - DNA, 22 bp, Artificial Sequence
  chemically synthesized
actttcaagtaataaaaaatag

SEQ ID NO: 816997 - DNA, 22 bp, Artificial Sequence
  chemically synthesized
caatttaatactctatttttta

SEQ ID NO: 816998 - DNA, 22 bp, Artificial Sequence
  chemically synthesized
tcaatttaatactctatttttt

SEQ ID NO: 816999 - DNA, 22 bp, Artificial Sequence
  chemically synthesized
ttcaatttaatactctattttt

SEQ ID NO: 817000 - DNA, 22 bp, Artificial Sequence
  chemically synthesized
tcaagtaataaaaaatagagta

SEQ ID NO: 817001 - DNA, 22 bp, Artificial Sequence
  chemically synthesized
caagtaataaaaaatagagtat

SEQ ID NO: 817002 - DNA, 22 bp, Artificial Sequence
  chemically synthesized
aagtaataaaaaatagagtatt

SEQ ID NO: 817003 - DNA, 22 bp, Artificial Sequence
  chemically synthesized
taccttttcaatttaatactct

SEQ ID NO: 817004 - DNA, 22 bp, Artificial Sequence
  chemically synthesized
gtgtccaattgtaccttttcaa

SEQ ID NO: 817005 - DNA, 22 bp, Artificial Sequence
  chemically synthesized
attggtgtccaattgtaccttt

SEQ ID NO: 817006 - DNA, 22 bp, Artificial Sequence
  chemically synthesized
aattggtgtccaattgtacctt

SEQ ID NO: 817007 - DNA, 22 bp, Artificial Sequence
  chemically synthesized
atttaattggtgtccaattgta

SEQ ID NO: 817008 - DNA, 22 bp, Artificial Sequence
  chemically synthesized
aattgaaaaggtacaattggac

SEQ ID NO: 817009 - DNA, 22 bp, Artificial Sequence
  chemically synthesized
ttaatttaattggtgtccaatt

SEQ ID NO: 817010 - DNA, 22 bp, Artificial Sequence
  chemically synthesized
gttaatttaattggtgtccaat

SEQ ID NO: 817011 - DNA, 22 bp, Artificial Sequence
  chemically synthesized
tgttaatttaattggtgtccaa

SEQ ID NO: 817012 - DNA, 22 bp, Artificial Sequence
  chemically synthesized
aaaaggtacaattggacaccaa

SEQ ID NO: 817013 - DNA, 22 bp, Artificial Sequence
  chemically synthesized
ttgttaatttaattggtgtcca

SEQ ID NO: 817014 - DNA, 22 bp, Artificial Sequence
  chemically synthesized
tttgttaatttaattggtgtcc

SEQ ID NO: 817015 - DNA, 22 bp, Artificial Sequence
  chemically synthesized
ttttttgttaatttaattggtg

SEQ ID NO: 817016 - DNA, 22 bp, Artificial Sequence
  chemically synthesized
attttttgttaatttaattggt

SEQ ID NO: 817017 - DNA, 22 bp, Artificial Sequence
  chemically synthesized
tattttttgttaatttaattgg

SEQ ID NO: 817018 - DNA, 22 bp, Artificial Sequence
  chemically synthesized
gattttattttttgttaattta

SEQ ID NO: 817019 - DNA, 22 bp, Artificial Sequence
  chemically synthesized
ggattttattttttgttaattt

SEQ ID NO: 817020 - DNA, 22 bp, Artificial Sequence
  chemically synthesized
tggattttattttttgttaatt

SEQ ID NO: 817021 - DNA, 22 bp, Artificial Sequence
  chemically synthesized
gacaccaattaaattaacaaaa

SEQ ID NO: 817022 - DNA, 22 bp, Artificial Sequence
  chemically synthesized
agctttggattttattttttgt

SEQ ID NO: 817023 - DNA, 22 bp, Artificial Sequence
  chemically synthesized
cagctttggattttattttttg

SEQ ID NO: 817024 - DNA, 22 bp, Artificial Sequence
  chemically synthesized
tcagctttggattttatttttt

SEQ ID NO: 817025 - DNA, 22 bp, Artificial Sequence
  chemically synthesized
ttcagctttggattttattttt

SEQ ID NO: 817026 - DNA, 22 bp, Artificial Sequence
  chemically synthesized
aattaacaaaaaataaaatcca

SEQ ID NO: 817027 - DNA, 22 bp, Artificial Sequence
  chemically synthesized
gtcttttcagctttggatttta

SEQ ID NO: 817028 - DNA, 22 bp, Artificial Sequence
  chemically synthesized
ctggtcttttcagctttggatt

SEQ ID NO: 817029 - DNA, 22 bp, Artificial Sequence
  chemically synthesized
acaaaaaataaaatccaaagct

SEQ ID NO: 817030 - DNA, 22 bp, Artificial Sequence
  chemically synthesized
actggtcttttcagctttggat

SEQ ID NO: 817031 - DNA, 22 bp, Artificial Sequence
  chemically synthesized
tactggtcttttcagctttgga

SEQ ID NO: 817032 - DNA, 22 bp, Artificial Sequence
  chemically synthesized
gttttactggtcttttcagctt

SEQ ID NO: 817033 - DNA, 22 bp, Artificial Sequence
  chemically synthesized
aaaagaccagtaaaactagcac

SEQ ID NO: 817034 - DNA, 22 bp, Artificial Sequence
  chemically synthesized
gcacattcacgtattactgctg

SEQ ID NO: 817035 - DNA, 22 bp, Artificial Sequence
  chemically synthesized
atagataacggtccccagcagt

SEQ ID NO: 817036 - DNA, 22 bp, Artificial Sequence
  chemically synthesized
acgtattactgctggggaccgt

SEQ ID NO: 817037 - DNA, 22 bp, Artificial Sequence
  chemically synthesized
tcctaatagataacggtcccca

SEQ ID NO: 817038 - DNA, 22 bp, Artificial Sequence
  chemically synthesized
ctgctggggaccgttatctatt

SEQ ID NO: 817039 - DNA, 22 bp, Artificial Sequence
  chemically synthesized
ccaaattgtcctaatagataac

SEQ ID NO: 817040 - DNA, 22 bp, Artificial Sequence
  chemically synthesized
ctggggaccgttatctattagg

SEQ ID NO: 817041 - DNA, 22 bp, Artificial Sequence
  chemically synthesized
ttgccaaattgtcctaatagat

SEQ ID NO: 817042 - DNA, 22 bp, Artificial Sequence
  chemically synthesized
gggaccgttatctattaggaca

SEQ ID NO: 817043 - DNA, 22 bp, Artificial Sequence
  chemically synthesized
gtatctattgccaaattgtcct

SEQ ID NO: 817044 - DNA, 22 bp, Artificial Sequence
  chemically synthesized
ggtatctattgccaaattgtcc

SEQ ID NO: 817045 - DNA, 22 bp, Artificial Sequence
  chemically synthesized
tctattaggacaatttggcaat

SEQ ID NO: 817046 - DNA, 22 bp, Artificial Sequence
  chemically synthesized
ttaggacaatttggcaatagat

SEQ ID NO: 817047 - DNA, 22 bp, Artificial Sequence
  chemically synthesized
tatgtcacttggtatctattgc

SEQ ID NO: 817048 - DNA, 22 bp, Artificial Sequence
  chemically synthesized
gtatgtcacttggtatctattg

SEQ ID NO: 817049 - DNA, 22 bp, Artificial Sequence
  chemically synthesized
ggacaatttggcaatagatacc

SEQ ID NO: 817050 - DNA, 22 bp, Artificial Sequence
  chemically synthesized
ggcaatagataccaagtgacat

SEQ ID NO: 817051 - DNA, 22 bp, Artificial Sequence
  chemically synthesized
gcaatagataccaagtgacata

SEQ ID NO: 817052 - DNA, 22 bp, Artificial Sequence
  chemically synthesized
agtcaatgggaataagcatttg

SEQ ID NO: 817053 - DNA, 22 bp, Artificial Sequence
  chemically synthesized
ttgagtcaatgggaataagcat

SEQ ID NO: 817054 - DNA, 22 bp, Artificial Sequence
  chemically synthesized
attcccattgactcaataatct

SEQ ID NO: 817055 - DNA, 22 bp, Artificial Sequence
  chemically synthesized
ttcccattgactcaataatctc

SEQ ID NO: 817056 - DNA, 22 bp, Artificial Sequence
  chemically synthesized
ccattgactcaataatctcact

SEQ ID NO: 817057 - DNA, 22 bp, Artificial Sequence
  chemically synthesized
actcaataatctcacttttggt

SEQ ID NO: 817058 - DNA, 22 bp, Artificial Sequence
  chemically synthesized
tcaggataaagtaccaaaagtg

SEQ ID NO: 817059 - DNA, 22 bp, Artificial Sequence
  chemically synthesized
atcaggataaagtaccaaaagt

SEQ ID NO: 817060 - DNA, 22 bp, Artificial Sequence
  chemically synthesized
tatcaggataaagtaccaaaag

SEQ ID NO: 817061 - DNA, 22 bp, Artificial Sequence
  chemically synthesized
aataatctcacttttggtactt

SEQ ID NO: 817062 - DNA, 22 bp, Artificial Sequence
  chemically synthesized
aagattttatcaggataaagta

SEQ ID NO: 817063 - DNA, 22 bp, Artificial Sequence
  chemically synthesized
gaagattttatcaggataaagt

SEQ ID NO: 817064 - DNA, 22 bp, Artificial Sequence
  chemically synthesized
tgaagattttatcaggataaag

SEQ ID NO: 817065 - DNA, 22 bp, Artificial Sequence
  chemically synthesized
ttgaagattttatcaggataaa

SEQ ID NO: 817066 - DNA, 22 bp, Artificial Sequence
  chemically synthesized
acttttggtactttatcctgat

SEQ ID NO: 817067 - DNA, 22 bp, Artificial Sequence
  chemically synthesized
ttttgaagattttatcaggata

SEQ ID NO: 817068 - DNA, 22 bp, Artificial Sequence
  chemically synthesized
cttttgaagattttatcaggat

SEQ ID NO: 817069 - DNA, 22 bp, Artificial Sequence
  chemically synthesized
ttggtactttatcctgataaaa

SEQ ID NO: 817070 - DNA, 22 bp, Artificial Sequence
  chemically synthesized
tggtactttatcctgataaaat

SEQ ID NO: 817071 - DNA, 22 bp, Artificial Sequence
  chemically synthesized
ggtactttatcctgataaaatc

SEQ ID NO: 817072 - DNA, 22 bp, Artificial Sequence
  chemically synthesized
gtactttatcctgataaaatct

SEQ ID NO: 817073 - DNA, 22 bp, Artificial Sequence
  chemically synthesized
atcttcttttgaagattttatc

SEQ ID NO: 817074 - DNA, 22 bp, Artificial Sequence
  chemically synthesized
tatcctgataaaatcttcaaaa

SEQ ID NO: 817075 - DNA, 22 bp, Artificial Sequence
  chemically synthesized
atcctgataaaatcttcaaaag

SEQ ID NO: 817076 - DNA, 22 bp, Artificial Sequence
  chemically synthesized
tcctgataaaatcttcaaaaga

SEQ ID NO: 817077 - DNA, 22 bp, Artificial Sequence
  chemically synthesized
ataaaatcttcaaaagaagatc

SEQ ID NO: 817078 - DNA, 22 bp, Artificial Sequence
  chemically synthesized
agtcatatagtatattgatctt

SEQ ID NO: 817079 - DNA, 22 bp, Artificial Sequence
  chemically synthesized
aagtcatatagtatattgatct

SEQ ID NO: 817080 - DNA, 22 bp, Artificial Sequence
  chemically synthesized
taagtcatatagtatattgatc

SEQ ID NO: 817081 - DNA, 22 bp, Artificial Sequence
  chemically synthesized
caaaagaagatcaatatactat

SEQ ID NO: 817082 - DNA, 22 bp, Artificial Sequence
  chemically synthesized
aaaagaagatcaatatactata

SEQ ID NO: 817083 - DNA, 22 bp, Artificial Sequence
  chemically synthesized
atgaagattttaagtcatatag

SEQ ID NO: 817084 - DNA, 22 bp, Artificial Sequence
  chemically synthesized
gttaatgaagattttaagtcat

SEQ ID NO: 817085 - DNA, 22 bp, Artificial Sequence
  chemically synthesized
ggttaatgaagattttaagtca

SEQ ID NO: 817086 - DNA, 22 bp, Artificial Sequence
  chemically synthesized
tggttaatgaagattttaagtc

SEQ ID NO: 817087 - DNA, 22 bp, Artificial Sequence
  chemically synthesized
ctttggttaatgaagattttaa

SEQ ID NO: 817088 - DNA, 22 bp, Artificial Sequence
  chemically synthesized
ctgctttggttaatgaagattt

SEQ ID NO: 817089 - DNA, 22 bp, Artificial Sequence
  chemically synthesized
actgctttggttaatgaagatt

SEQ ID NO: 817090 - DNA, 22 bp, Artificial Sequence
  chemically synthesized
tactgctttggttaatgaagat

SEQ ID NO: 817091 - DNA, 22 bp, Artificial Sequence
  chemically synthesized
tatgacttaaaatcttcattaa

SEQ ID NO: 817092 - DNA, 22 bp, Artificial Sequence
  chemically synthesized
ttactgctttggttaatgaaga

SEQ ID NO: 817093 - DNA, 22 bp, Artificial Sequence
  chemically synthesized
tttactgctttggttaatgaag

SEQ ID NO: 817094 - DNA, 22 bp, Artificial Sequence
  chemically synthesized
ttttactgctttggttaatgaa

SEQ ID NO: 817095 - DNA, 22 bp, Artificial Sequence
  chemically synthesized
atttttttactgctttggttaa

SEQ ID NO: 817096 - DNA, 22 bp, Artificial Sequence
  chemically synthesized
aaaatcttcattaaccaaagca

SEQ ID NO: 817097 - DNA, 22 bp, Artificial Sequence
  chemically synthesized
tcatttttttactgctttggtt

SEQ ID NO: 817098 - DNA, 22 bp, Artificial Sequence
  chemically synthesized
aaatcttcattaaccaaagcag

SEQ ID NO: 817099 - DNA, 22 bp, Artificial Sequence
  chemically synthesized
ctcatttttttactgctttggt

SEQ ID NO: 817100 - DNA, 22 bp, Artificial Sequence
  chemically synthesized
tttctcatttttttactgcttt

SEQ ID NO: 817101 - DNA, 22 bp, Artificial Sequence
  chemically synthesized
cattaaccaaagcagtaaaaaa

SEQ ID NO: 817102 - DNA, 22 bp, Artificial Sequence
  chemically synthesized
attaaccaaagcagtaaaaaaa

SEQ ID NO: 817103 - DNA, 22 bp, Artificial Sequence
  chemically synthesized
accaaagcagtaaaaaaatgag

SEQ ID NO: 817104 - DNA, 22 bp, Artificial Sequence
  chemically synthesized
caggcatgagccaccgcacccg

SEQ ID NO: 817105 - DNA, 22 bp, Artificial Sequence
  chemically synthesized
ggattacaggcatgagccaccg

SEQ ID NO: 817106 - DNA, 22 bp, Artificial Sequence
  chemically synthesized
agtgctgggattacaggcatga

SEQ ID NO: 817107 - DNA, 22 bp, Artificial Sequence
  chemically synthesized
cctaagtgctgggattacaggc

SEQ ID NO: 817108 - DNA, 22 bp, Artificial Sequence
  chemically synthesized
gcctccctaagtgctgggatta

SEQ ID NO: 817109 - DNA, 22 bp, Artificial Sequence
  chemically synthesized
ggcctccctaagtgctgggatt

SEQ ID NO: 817110 - DNA, 22 bp, Artificial Sequence
  chemically synthesized
atgcctgtaatcccagcactta

SEQ ID NO: 817111 - DNA, 22 bp, Artificial Sequence
  chemically synthesized
taatcccagcacttagggaggc

SEQ ID NO: 817112 - DNA, 22 bp, Artificial Sequence
  chemically synthesized
gtgatccacccgccttggcctc

SEQ ID NO: 817113 - DNA, 22 bp, Artificial Sequence
  chemically synthesized
acctcgtgatccacccgccttg

SEQ ID NO: 817114 - DNA, 22 bp, Artificial Sequence
  chemically synthesized
ctgacctcgtgatccacccgcc

SEQ ID NO: 817115 - DNA, 22 bp, Artificial Sequence
  chemically synthesized
agggaggccaaggcgggtggat

SEQ ID NO: 817116 - DNA, 22 bp, Artificial Sequence
  chemically synthesized
gggaggccaaggcgggtggatc

SEQ ID NO: 817117 - DNA, 22 bp, Artificial Sequence
  chemically synthesized
aactcctgacctcgtgatccac

SEQ ID NO: 817118 - DNA, 22 bp, Artificial Sequence
  chemically synthesized
gaactcctgacctcgtgatcca

SEQ ID NO: 817119 - DNA, 22 bp, Artificial Sequence
  chemically synthesized
gtcttgaactcctgacctcgtg

SEQ ID NO: 817120 - DNA, 22 bp, Artificial Sequence
  chemically synthesized
gccagactggtcttgaactcct

SEQ ID NO: 817121 - DNA, 22 bp, Artificial Sequence
  chemically synthesized
ggccagactggtcttgaactcc

SEQ ID NO: 817122 - DNA, 22 bp, Artificial Sequence
  chemically synthesized
accatcttggccagactggtct

SEQ ID NO: 817123 - DNA, 22 bp, Artificial Sequence
  chemically synthesized
caccatcttggccagactggtc

SEQ ID NO: 817124 - DNA, 22 bp, Artificial Sequence
  chemically synthesized
aagaccagtctggccaagatgg

SEQ ID NO: 817125 - DNA, 22 bp, Artificial Sequence
  chemically synthesized
gtagagacggtgtttcaccatc

SEQ ID NO: 817126 - DNA, 22 bp, Artificial Sequence
  chemically synthesized
agtagagacggtgtttcaccat

SEQ ID NO: 817127 - DNA, 22 bp, Artificial Sequence
  chemically synthesized
tagtagagacggtgtttcacca

SEQ ID NO: 817128 - DNA, 22 bp, Artificial Sequence
  chemically synthesized
ttagtagagacggtgtttcacc

SEQ ID NO: 817129 - DNA, 22 bp, Artificial Sequence
  chemically synthesized
gccaagatggtgaaacaccgtc

SEQ ID NO: 817130 - DNA, 22 bp, Artificial Sequence
  chemically synthesized
tatttttagtagagacggtgtt

SEQ ID NO: 817131 - DNA, 22 bp, Artificial Sequence
  chemically synthesized
atatttttagtagagacggtgt

SEQ ID NO: 817132 - DNA, 22 bp, Artificial Sequence
  chemically synthesized
tatatttttagtagagacggtg

SEQ ID NO: 817133 - DNA, 22 bp, Artificial Sequence
  chemically synthesized
ttatatttttagtagagacggt

SEQ ID NO: 817134 - DNA, 22 bp, Artificial Sequence
  chemically synthesized
atttttatatttttagtagaga

SEQ ID NO: 817135 - DNA, 22 bp, Artificial Sequence
  chemically synthesized
tactaaaaatataaaaattagc

SEQ ID NO: 817136 - DNA, 22 bp, Artificial Sequence
  chemically synthesized
ccagcacacccggctaattttt

SEQ ID NO: 817137 - DNA, 22 bp, Artificial Sequence
  chemically synthesized
ctaaaaatataaaaattagccg

SEQ ID NO: 817138 - DNA, 22 bp, Artificial Sequence
  chemically synthesized
aaaatataaaaattagccgggt

SEQ ID NO: 817139 - DNA, 22 bp, Artificial Sequence
  chemically synthesized
caggagcctaccagcacacccg

SEQ ID NO: 817140 - DNA, 22 bp, Artificial Sequence
  chemically synthesized
ggattacaggagcctaccagca

SEQ ID NO: 817141 - DNA, 22 bp, Artificial Sequence
  chemically synthesized
gccgggtgtgctggtaggctcc

SEQ ID NO: 817142 - DNA, 22 bp, Artificial Sequence
  chemically synthesized
ccgagtagctgggattacagga

SEQ ID NO: 817143 - DNA, 22 bp, Artificial Sequence
  chemically synthesized
gtaggctcctgtaatcccagct

SEQ ID NO: 817144 - DNA, 22 bp, Artificial Sequence
  chemically synthesized
agcctcccgagtagctgggatt

SEQ ID NO: 817145 - DNA, 22 bp, Artificial Sequence
  chemically synthesized
cctcagcctcccgagtagctgg

SEQ ID NO: 817146 - DNA, 22 bp, Artificial Sequence
  chemically synthesized
tgcctcagcctcccgagtagct

SEQ ID NO: 817147 - DNA, 22 bp, Artificial Sequence
  chemically synthesized
ctgtaatcccagctactcggga

SEQ ID NO: 817148 - DNA, 22 bp, Artificial Sequence
  chemically synthesized
tctgcctcagcctcccgagtag

SEQ ID NO: 817149 - DNA, 22 bp, Artificial Sequence
  chemically synthesized
taatcccagctactcgggaggc

SEQ ID NO: 817150 - DNA, 22 bp, Artificial Sequence
  chemically synthesized
aagcaattctctgcctcagcct

SEQ ID NO: 817151 - DNA, 22 bp, Artificial Sequence
  chemically synthesized
ggttcaagcaattctctgcctc

SEQ ID NO: 817152 - DNA, 22 bp, Artificial Sequence
  chemically synthesized
ctcgggaggctgaggcagagaa

SEQ ID NO: 817153 - DNA, 22 bp, Artificial Sequence
  chemically synthesized
ctgggttcaagcaattctctgc

SEQ ID NO: 817154 - DNA, 22 bp, Artificial Sequence
  chemically synthesized
gggaggctgaggcagagaattg

SEQ ID NO: 817155 - DNA, 22 bp, Artificial Sequence
  chemically synthesized
catctcctgggttcaagcaatt

SEQ ID NO: 817156 - DNA, 22 bp, Artificial Sequence
  chemically synthesized
ccatctcctgggttcaagcaat

SEQ ID NO: 817157 - DNA, 22 bp, Artificial Sequence
  chemically synthesized
aggcagagaattgcttgaaccc

SEQ ID NO: 817158 - DNA, 22 bp, Artificial Sequence
  chemically synthesized
caacttccatctcctgggttca

SEQ ID NO: 817159 - DNA, 22 bp, Artificial Sequence
  chemically synthesized
actgcaacttccatctcctggg

SEQ ID NO: 817160 - DNA, 22 bp, Artificial Sequence
  chemically synthesized
gctcactgcaacttccatctcc

SEQ ID NO: 817161 - DNA, 22 bp, Artificial Sequence
  chemically synthesized
ggctcactgcaacttccatctc

SEQ ID NO: 817162 - DNA, 22 bp, Artificial Sequence
  chemically synthesized
cttgaacccaggagatggaagt

SEQ ID NO: 817163 - DNA, 22 bp, Artificial Sequence
  chemically synthesized
gaacccaggagatggaagttgc

SEQ ID NO: 817164 - DNA, 22 bp, Artificial Sequence
  chemically synthesized
aacccaggagatggaagttgca

SEQ ID NO: 817165 - DNA, 22 bp, Artificial Sequence
  chemically synthesized
gagtgcagtggcgtgatcttgg

SEQ ID NO: 817166 - DNA, 22 bp, Artificial Sequence
  chemically synthesized
cagtgagccaagatcacgccac

SEQ ID NO: 817167 - DNA, 22 bp, Artificial Sequence
  chemically synthesized
tcgcccaggctggagtgcagtg

SEQ ID NO: 817168 - DNA, 22 bp, Artificial Sequence
  chemically synthesized
tgtcgcccaggctggagtgcag

SEQ ID NO: 817169 - DNA, 22 bp, Artificial Sequence
  chemically synthesized
actctgtcgcccaggctggagt

SEQ ID NO: 817170 - DNA, 22 bp, Artificial Sequence
  chemically synthesized
cactccagcctgggcgacagag

SEQ ID NO: 817171 - DNA, 22 bp, Artificial Sequence
  chemically synthesized
cgagatggagtctcactctgtc

SEQ ID NO: 817172 - DNA, 22 bp, Artificial Sequence
  chemically synthesized
ccgagatggagtctcactctgt

SEQ ID NO: 817173 - DNA, 22 bp, Artificial Sequence
  chemically synthesized
cagcctgggcgacagagtgaga

SEQ ID NO: 817174 - DNA, 22 bp, Artificial Sequence
  chemically synthesized
tccgagatggagtctcactctg

SEQ ID NO: 817175 - DNA, 22 bp, Artificial Sequence
  chemically synthesized
ttccgagatggagtctcactct

SEQ ID NO: 817176 - DNA, 22 bp, Artificial Sequence
  chemically synthesized
tttccgagatggagtctcactc

SEQ ID NO: 817177 - DNA, 22 bp, Artificial Sequence
  chemically synthesized
ttttccgagatggagtctcact

SEQ ID NO: 817178 - DNA, 22 bp, Artificial Sequence
  chemically synthesized
tttttccgagatggagtctcac

SEQ ID NO: 817179 - DNA, 22 bp, Artificial Sequence
  chemically synthesized
ttttttccgagatggagtctca

SEQ ID NO: 817180 - DNA, 22 bp, Artificial Sequence
  chemically synthesized
tttttttccgagatggagtctc

SEQ ID NO: 817181 - DNA, 22 bp, Artificial Sequence
  chemically synthesized
ggcgacagagtgagactccatc

SEQ ID NO: 817182 - DNA, 22 bp, Artificial Sequence
  chemically synthesized
ttttttttccgagatggagtct

SEQ ID NO: 817183 - DNA, 22 bp, Artificial Sequence
  chemically synthesized
tttttttttccgagatggagtc

SEQ ID NO: 817184 - DNA, 22 bp, Artificial Sequence
  chemically synthesized
ttttttttttccgagatggagt

SEQ ID NO: 817185 - DNA, 22 bp, Artificial Sequence
  chemically synthesized
tttttttttttccgagatggag

SEQ ID NO: 817186 - DNA, 22 bp, Artificial Sequence
  chemically synthesized
ttttttttttttccgagatgga

SEQ ID NO: 817187 - DNA, 22 bp, Artificial Sequence
  chemically synthesized
tttttttttttttccgagatgg

SEQ ID NO: 817188 - DNA, 22 bp, Artificial Sequence
  chemically synthesized
ttttttttttttttccgagatg

SEQ ID NO: 817189 - DNA, 22 bp, Artificial Sequence
  chemically synthesized
tttttttttttttttccgagat

SEQ ID NO: 817190 - DNA, 22 bp, Artificial Sequence
  chemically synthesized
ttttttttttttttttccgaga

SEQ ID NO: 817191 - DNA, 22 bp, Artificial Sequence
  chemically synthesized
tttttttttttttttttccgag

SEQ ID NO: 817192 - DNA, 22 bp, Artificial Sequence
  chemically synthesized
ttttttttttttttttttccga

SEQ ID NO: 817193 - DNA, 22 bp, Artificial Sequence
  chemically synthesized
tttttttttttttttttttccg

SEQ ID NO: 817194 - DNA, 22 bp, Artificial Sequence
  chemically synthesized
ttttttttttttttttttttcc

SEQ ID NO: 817195 - DNA, 22 bp, Artificial Sequence
  chemically synthesized
tttttttttttttttttttttc

SEQ ID NO: 817196 - DNA, 22 bp, Artificial Sequence
  chemically synthesized
tttttttttttttttttttttt

SEQ ID NO: 817197 - DNA, 22 bp, Artificial Sequence
  chemically synthesized
tttttttttttttttttttttt

SEQ ID NO: 817198 - DNA, 22 bp, Artificial Sequence
  chemically synthesized
tttttttttttttttttttttt

SEQ ID NO: 817199 - DNA, 22 bp, Artificial Sequence
  chemically synthesized
tttttttttttttttttttttt

SEQ ID NO: 817200 - DNA, 22 bp, Artificial Sequence
  chemically synthesized
catctcggaaaaaaaaaaaaaa

SEQ ID NO: 817201 - DNA, 22 bp, Artificial Sequence
  chemically synthesized
tttttttttttttttttttttt

SEQ ID NO: 817202 - DNA, 22 bp, Artificial Sequence
  chemically synthesized
tttttttttttttttttttttt

SEQ ID NO: 817203 - DNA, 22 bp, Artificial Sequence
  chemically synthesized
tttttttttttttttttttttt

SEQ ID NO: 817204 - DNA, 22 bp, Artificial Sequence
  chemically synthesized
tctttttttttttttttttttt

SEQ ID NO: 817205 - DNA, 22 bp, Artificial Sequence
  chemically synthesized
ggaaaaaaaaaaaaaaaaaaaa

SEQ ID NO: 817206 - DNA, 22 bp, Artificial Sequence
  chemically synthesized
ctcttttttttttttttttttt

SEQ ID NO: 817207 - DNA, 22 bp, Artificial Sequence
  chemically synthesized
tttctctttttttttttttttt

SEQ ID NO: 817208 - DNA, 22 bp, Artificial Sequence
  chemically synthesized
aacatcgacattgtttctcttt

SEQ ID NO: 817209 - DNA, 22 bp, Artificial Sequence
  chemically synthesized
cattaaacatcgacattgtttc

SEQ ID NO: 817210 - DNA, 22 bp, Artificial Sequence
  chemically synthesized
atgtccctgcattaaacatcga

SEQ ID NO: 817211 - DNA, 22 bp, Artificial Sequence
  chemically synthesized
aatgtccctgcattaaacatcg

SEQ ID NO: 817212 - DNA, 22 bp, Artificial Sequence
  chemically synthesized
taatgtccctgcattaaacatc

SEQ ID NO: 817213 - DNA, 22 bp, Artificial Sequence
  chemically synthesized
ttaatgtccctgcattaaacat

SEQ ID NO: 817214 - DNA, 22 bp, Artificial Sequence
  chemically synthesized
ttttaatgtccctgcattaaac

SEQ ID NO: 817215 - DNA, 22 bp, Artificial Sequence
  chemically synthesized
tgttcttttaatgtccctgcat

SEQ ID NO: 817216 - DNA, 22 bp, Artificial Sequence
  chemically synthesized
aatgcagggacattaaaagaac

SEQ ID NO: 817217 - DNA, 22 bp, Artificial Sequence
  chemically synthesized
atgcagggacattaaaagaaca

SEQ ID NO: 817218 - DNA, 22 bp, Artificial Sequence
  chemically synthesized
gaatgatgtattatgttctttt

SEQ ID NO: 817219 - DNA, 22 bp, Artificial Sequence
  chemically synthesized
gaccattggaatgatgtattat

SEQ ID NO: 817220 - DNA, 22 bp, Artificial Sequence
  chemically synthesized
aaagaacataatacatcattcc

SEQ ID NO: 817221 - DNA, 22 bp, Artificial Sequence
  chemically synthesized
catattggaccattggaatgat

SEQ ID NO: 817222 - DNA, 22 bp, Artificial Sequence
  chemically synthesized
ctacatattggaccattggaat

SEQ ID NO: 817223 - DNA, 22 bp, Artificial Sequence
  chemically synthesized
gctacatattggaccattggaa

SEQ ID NO: 817224 - DNA, 22 bp, Artificial Sequence
  chemically synthesized
tgcacatttgctacatattgga

SEQ ID NO: 817225 - DNA, 22 bp, Artificial Sequence
  chemically synthesized
ctgtgcacatttgctacatatt

SEQ ID NO: 817226 - DNA, 22 bp, Artificial Sequence
  chemically synthesized
caatggtccaatatgtagcaaa

SEQ ID NO: 817227 - DNA, 22 bp, Artificial Sequence
  chemically synthesized
cagtgattactgtgcacatttg

SEQ ID NO: 817228 - DNA, 22 bp, Artificial Sequence
  chemically synthesized
acagtgattactgtgcacattt

SEQ ID NO: 817229 - DNA, 22 bp, Artificial Sequence
  chemically synthesized
tacagtgattactgtgcacatt

SEQ ID NO: 817230 - DNA, 22 bp, Artificial Sequence
  chemically synthesized
ttacagtgattactgtgcacat

SEQ ID NO: 817231 - DNA, 22 bp, Artificial Sequence
  chemically synthesized
tttacagtgattactgtgcaca

SEQ ID NO: 817232 - DNA, 22 bp, Artificial Sequence
  chemically synthesized
tttttacagtgattactgtgca

SEQ ID NO: 817233 - DNA, 22 bp, Artificial Sequence
  chemically synthesized
tgctctttttacagtgattact

SEQ ID NO: 817234 - DNA, 22 bp, Artificial Sequence
  chemically synthesized
cacaagaaaattgtgctctttt

SEQ ID NO: 817235 - DNA, 22 bp, Artificial Sequence
  chemically synthesized
acacaagaaaattgtgctcttt

SEQ ID NO: 817236 - DNA, 22 bp, Artificial Sequence
  chemically synthesized
tacacaagaaaattgtgctctt

SEQ ID NO: 817237 - DNA, 22 bp, Artificial Sequence
  chemically synthesized
ttacacaagaaaattgtgctct

SEQ ID NO: 817238 - DNA, 22 bp, Artificial Sequence
  chemically synthesized
tttacacaagaaaattgtgctc

SEQ ID NO: 817239 - DNA, 22 bp, Artificial Sequence
  chemically synthesized
ttttttacacaagaaaattgtg

SEQ ID NO: 817240 - DNA, 22 bp, Artificial Sequence
  chemically synthesized
tgttttttacacaagaaaattg

SEQ ID NO: 817241 - DNA, 22 bp, Artificial Sequence
  chemically synthesized
taaaaagagcacaattttcttg

SEQ ID NO: 817242 - DNA, 22 bp, Artificial Sequence
  chemically synthesized
tgttctgttttttacacaagaa

SEQ ID NO: 817243 - DNA, 22 bp, Artificial Sequence
  chemically synthesized
aaaattgtgttctgttttttac

SEQ ID NO: 817244 - DNA, 22 bp, Artificial Sequence
  chemically synthesized
tcttgtgtaaaaaacagaacac

SEQ ID NO: 817245 - DNA, 22 bp, Artificial Sequence
  chemically synthesized
cttgtgtaaaaaacagaacaca

SEQ ID NO: 817246 - DNA, 22 bp, Artificial Sequence
  chemically synthesized
ttgtgtaaaaaacagaacacaa

SEQ ID NO: 817247 - DNA, 22 bp, Artificial Sequence
  chemically synthesized
gtgtaaaaaacagaacacaatt

SEQ ID NO: 817248 - DNA, 22 bp, Artificial Sequence
  chemically synthesized
tgtaaaaaacagaacacaattt

SEQ ID NO: 817249 - DNA, 22 bp, Artificial Sequence
  chemically synthesized
gagataaacacagtgtagttaa

SEQ ID NO: 817250 - DNA, 22 bp, Artificial Sequence
  chemically synthesized
agagataaacacagtgtagtta

SEQ ID NO: 817251 - DNA, 22 bp, Artificial Sequence
  chemically synthesized
ttagagataaacacagtgtagt

SEQ ID NO: 817252 - DNA, 22 bp, Artificial Sequence
  chemically synthesized
tgtattcttagagataaacaca

SEQ ID NO: 817253 - DNA, 22 bp, Artificial Sequence
  chemically synthesized
ttaactacactgtgtttatctc

SEQ ID NO: 817254 - DNA, 22 bp, Artificial Sequence
  chemically synthesized
taactacactgtgtttatctct

SEQ ID NO: 817255 - DNA, 22 bp, Artificial Sequence
  chemically synthesized
aactacactgtgtttatctcta

SEQ ID NO: 817256 - DNA, 22 bp, Artificial Sequence
  chemically synthesized
actacactgtgtttatctctaa

SEQ ID NO: 817257 - DNA, 22 bp, Artificial Sequence
  chemically synthesized
atgattatgtattcttagagat

SEQ ID NO: 817258 - DNA, 22 bp, Artificial Sequence
  chemically synthesized
cactgtgtttatctctaagaat

SEQ ID NO: 817259 - DNA, 22 bp, Artificial Sequence
  chemically synthesized
agctcatgattatgtattctta

SEQ ID NO: 817260 - DNA, 22 bp, Artificial Sequence
  chemically synthesized
tgtttatctctaagaatacata

SEQ ID NO: 817261 - DNA, 22 bp, Artificial Sequence
  chemically synthesized
gtgttcagctcatgattatgta

SEQ ID NO: 817262 - DNA, 22 bp, Artificial Sequence
  chemically synthesized
atctctaagaatacataatcat

SEQ ID NO: 817263 - DNA, 22 bp, Artificial Sequence
  chemically synthesized
cgtgttcagctcatgattatgt

SEQ ID NO: 817264 - DNA, 22 bp, Artificial Sequence
  chemically synthesized
tctctaagaatacataatcatg

SEQ ID NO: 817265 - DNA, 22 bp, Artificial Sequence
  chemically synthesized
taagaatacataatcatgagct

SEQ ID NO: 817266 - DNA, 22 bp, Artificial Sequence
  chemically synthesized
catttcgtgttcagctcatgat

SEQ ID NO: 817267 - DNA, 22 bp, Artificial Sequence
  chemically synthesized
ccatttcgtgttcagctcatga

SEQ ID NO: 817268 - DNA, 22 bp, Artificial Sequence
  chemically synthesized
agaatacataatcatgagctga

SEQ ID NO: 817269 - DNA, 22 bp, Artificial Sequence
  chemically synthesized
ttccatttcgtgttcagctcat

SEQ ID NO: 817270 - DNA, 22 bp, Artificial Sequence
  chemically synthesized
cttccatttcgtgttcagctca

SEQ ID NO: 817271 - DNA, 22 bp, Artificial Sequence
  chemically synthesized
aatttcttccatttcgtgttca

SEQ ID NO: 817272 - DNA, 22 bp, Artificial Sequence
  chemically synthesized
caatttcttccatttcgtgttc

SEQ ID NO: 817273 - DNA, 22 bp, Artificial Sequence
  chemically synthesized
tcaatttcttccatttcgtgtt

SEQ ID NO: 817274 - DNA, 22 bp, Artificial Sequence
  chemically synthesized
ttttcaatttcttccatttcgt

SEQ ID NO: 817275 - DNA, 22 bp, Artificial Sequence
  chemically synthesized
aacacgaaatggaagaaattga

SEQ ID NO: 817276 - DNA, 22 bp, Artificial Sequence
  chemically synthesized
agaagcattattttcaatttct

SEQ ID NO: 817277 - DNA, 22 bp, Artificial Sequence
  chemically synthesized
ctcagaagcattattttcaatt

SEQ ID NO: 817278 - DNA, 22 bp, Artificial Sequence
  chemically synthesized
tcctcagaagcattattttcaa

SEQ ID NO: 817279 - DNA, 22 bp, Artificial Sequence
  chemically synthesized
ctcctcagaagcattattttca

SEQ ID NO: 817280 - DNA, 22 bp, Artificial Sequence
  chemically synthesized
tctcctcagaagcattattttc

SEQ ID NO: 817281 - DNA, 22 bp, Artificial Sequence
  chemically synthesized
ttctcctcagaagcattatttt

SEQ ID NO: 817282 - DNA, 22 bp, Artificial Sequence
  chemically synthesized
aaaataatgcttctgaggagaa

SEQ ID NO: 817283 - DNA, 22 bp, Artificial Sequence
  chemically synthesized
aaacaaaaatgatttttctcct

SEQ ID NO: 817284 - DNA, 22 bp, Artificial Sequence
  chemically synthesized
ctgaggagaaaaatcatttttg

SEQ ID NO: 817285 - DNA, 22 bp, Artificial Sequence
  chemically synthesized
tgaggagaaaaatcatttttgt

SEQ ID NO: 817286 - DNA, 22 bp, Artificial Sequence
  chemically synthesized
aggagaaaaatcatttttgttt

SEQ ID NO: 817287 - DNA, 22 bp, Artificial Sequence
  chemically synthesized
acgcaaaagaacaaatattaaa

SEQ ID NO: 817288 - DNA, 22 bp, Artificial Sequence
  chemically synthesized
ttgttttaatatttgttctttt

SEQ ID NO: 817289 - DNA, 22 bp, Artificial Sequence
  chemically synthesized
tgttttaatatttgttcttttg

SEQ ID NO: 817290 - DNA, 22 bp, Artificial Sequence
  chemically synthesized
gttttaatatttgttcttttgc

SEQ ID NO: 817291 - DNA, 22 bp, Artificial Sequence
  chemically synthesized
ttttaatatttgttcttttgcg

SEQ ID NO: 817292 - DNA, 22 bp, Artificial Sequence
  chemically synthesized
taatatttgttcttttgcgtta

SEQ ID NO: 817293 - DNA, 22 bp, Artificial Sequence
  chemically synthesized
taaatatcatactaacgcaaaa

SEQ ID NO: 817294 - DNA, 22 bp, Artificial Sequence
  chemically synthesized
aatatttgttcttttgcgttag

SEQ ID NO: 817295 - DNA, 22 bp, Artificial Sequence
  chemically synthesized
atatttgttcttttgcgttagt

SEQ ID NO: 817296 - DNA, 22 bp, Artificial Sequence
  chemically synthesized
tgtaaatatcatactaacgcaa

SEQ ID NO: 817297 - DNA, 22 bp, Artificial Sequence
  chemically synthesized
ttctgtaaatatcatactaacg

SEQ ID NO: 817298 - DNA, 22 bp, Artificial Sequence
  chemically synthesized
attctgtaaatatcatactaac

SEQ ID NO: 817299 - DNA, 22 bp, Artificial Sequence
  chemically synthesized
tattctgtaaatatcatactaa

SEQ ID NO: 817300 - DNA, 22 bp, Artificial Sequence
  chemically synthesized
gttcttttgcgttagtatgata

SEQ ID NO: 817301 - DNA, 22 bp, Artificial Sequence
  chemically synthesized
ttattctgtaaatatcatacta

SEQ ID NO: 817302 - DNA, 22 bp, Artificial Sequence
  chemically synthesized
ttcttttgcgttagtatgatat

SEQ ID NO: 817303 - DNA, 22 bp, Artificial Sequence
  chemically synthesized
ttttgcgttagtatgatattta

SEQ ID NO: 817304 - DNA, 22 bp, Artificial Sequence
  chemically synthesized
atttttattctgtaaatatcat

SEQ ID NO: 817305 - DNA, 22 bp, Artificial Sequence
  chemically synthesized
gatttttattctgtaaatatca

SEQ ID NO: 817306 - DNA, 22 bp, Artificial Sequence
  chemically synthesized
ttgcgttagtatgatatttaca

SEQ ID NO: 817307 - DNA, 22 bp, Artificial Sequence
  chemically synthesized
tgcgttagtatgatatttacag

SEQ ID NO: 817308 - DNA, 22 bp, Artificial Sequence
  chemically synthesized
gcgttagtatgatatttacaga

SEQ ID NO: 817309 - DNA, 22 bp, Artificial Sequence
  chemically synthesized
tttgatttttattctgtaaata

SEQ ID NO: 817310 - DNA, 22 bp, Artificial Sequence
  chemically synthesized
cgttagtatgatatttacagaa

SEQ ID NO: 817311 - DNA, 22 bp, Artificial Sequence
  chemically synthesized
gtatgatatttacagaataaaa

SEQ ID NO: 817312 - DNA, 22 bp, Artificial Sequence
  chemically synthesized
agaacactgtttgatttttatt

SEQ ID NO: 817313 - DNA, 22 bp, Artificial Sequence
  chemically synthesized
tgctaagaacactgtttgattt

SEQ ID NO: 817314 - DNA, 22 bp, Artificial Sequence
  chemically synthesized
acagaataaaaatcaaacagtg

SEQ ID NO: 817315 - DNA, 22 bp, Artificial Sequence
  chemically synthesized
cagaataaaaatcaaacagtgt

SEQ ID NO: 817316 - DNA, 22 bp, Artificial Sequence
  chemically synthesized
aaattatgctaagaacactgtt

SEQ ID NO: 817317 - DNA, 22 bp, Artificial Sequence
  chemically synthesized
accaaacacgctgaaattatgc

SEQ ID NO: 817318 - DNA, 22 bp, Artificial Sequence
  chemically synthesized
ttagcataatttcagcgtgttt

SEQ ID NO: 817319 - DNA, 22 bp, Artificial Sequence
  chemically synthesized
agcataatttcagcgtgtttgg

SEQ ID NO: 817320 - DNA, 22 bp, Artificial Sequence
  chemically synthesized
aataggagttcaccaaacacgc

SEQ ID NO: 817321 - DNA, 22 bp, Artificial Sequence
  chemically synthesized
gcataatttcagcgtgtttggt

SEQ ID NO: 817322 - DNA, 22 bp, Artificial Sequence
  chemically synthesized
tatatgttcaataggagttcac

SEQ ID NO: 817323 - DNA, 22 bp, Artificial Sequence
  chemically synthesized
cagcgtgtttggtgaactccta

SEQ ID NO: 817324 - DNA, 22 bp, Artificial Sequence
  chemically synthesized
agcgtgtttggtgaactcctat

SEQ ID NO: 817325 - DNA, 22 bp, Artificial Sequence
  chemically synthesized
ggtgaactcctattgaacatat

SEQ ID NO: 817326 - DNA, 22 bp, Artificial Sequence
  chemically synthesized
tatatagattgtatatgttcaa

SEQ ID NO: 817327 - DNA, 22 bp, Artificial Sequence
  chemically synthesized
gtgaactcctattgaacatata

SEQ ID NO: 817328 - DNA, 22 bp, Artificial Sequence
  chemically synthesized
cattatatatagattgtatatg

SEQ ID NO: 817329 - DNA, 22 bp, Artificial Sequence
  chemically synthesized
ctattgaacatatacaatctat

SEQ ID NO: 817330 - DNA, 22 bp, Artificial Sequence
  chemically synthesized
ttgaacatatacaatctatata

SEQ ID NO: 817331 - DNA, 22 bp, Artificial Sequence
  chemically synthesized
agaaattacattatatatagat

SEQ ID NO: 817332 - DNA, 22 bp, Artificial Sequence
  chemically synthesized
aacatatacaatctatatataa

SEQ ID NO: 817333 - DNA, 22 bp, Artificial Sequence
  chemically synthesized
actgagaaattacattatatat

SEQ ID NO: 817334 - DNA, 22 bp, Artificial Sequence
  chemically synthesized
gttaactgagaaattacattat

SEQ ID NO: 817335 - DNA, 22 bp, Artificial Sequence
  chemically synthesized
agttaactgagaaattacatta

SEQ ID NO: 817336 - DNA, 22 bp, Artificial Sequence
  chemically synthesized
tagttaactgagaaattacatt

SEQ ID NO: 817337 - DNA, 22 bp, Artificial Sequence
  chemically synthesized
tatataatgtaatttctcagtt

SEQ ID NO: 817338 - DNA, 22 bp, Artificial Sequence
  chemically synthesized
ggatgttttagttaactgagaa

SEQ ID NO: 817339 - DNA, 22 bp, Artificial Sequence
  chemically synthesized
taggatgttttagttaactgag

SEQ ID NO: 817340 - DNA, 22 bp, Artificial Sequence
  chemically synthesized
attctaggatgttttagttaac

SEQ ID NO: 817341 - DNA, 22 bp, Artificial Sequence
  chemically synthesized
gattctaggatgttttagttaa

SEQ ID NO: 817342 - DNA, 22 bp, Artificial Sequence
  chemically synthesized
gtttgattctaggatgttttag

SEQ ID NO: 817343 - DNA, 22 bp, Artificial Sequence
  chemically synthesized
ggtttgattctaggatgtttta

SEQ ID NO: 817344 - DNA, 22 bp, Artificial Sequence
  chemically synthesized
ctcagttaactaaaacatccta

SEQ ID NO: 817345 - DNA, 22 bp, Artificial Sequence
  chemically synthesized
tcagttaactaaaacatcctag

SEQ ID NO: 817346 - DNA, 22 bp, Artificial Sequence
  chemically synthesized
cttggtttgattctaggatgtt

SEQ ID NO: 817347 - DNA, 22 bp, Artificial Sequence
  chemically synthesized
agttaactaaaacatcctagaa

SEQ ID NO: 817348 - DNA, 22 bp, Artificial Sequence
  chemically synthesized
ttacttggtttgattctaggat

SEQ ID NO: 817349 - DNA, 22 bp, Artificial Sequence
  chemically synthesized
actaaaacatcctagaatcaaa

SEQ ID NO: 817350 - DNA, 22 bp, Artificial Sequence
  chemically synthesized
aaacatcctagaatcaaaccaa

SEQ ID NO: 817351 - DNA, 22 bp, Artificial Sequence
  chemically synthesized
tatgcagtaaatactattactt

SEQ ID NO: 817352 - DNA, 22 bp, Artificial Sequence
  chemically synthesized
gaatcaaaccaagtaatagtat

SEQ ID NO: 817353 - DNA, 22 bp, Artificial Sequence
  chemically synthesized
ctatatgcagtaaatactatta

SEQ ID NO: 817354 - DNA, 22 bp, Artificial Sequence
  chemically synthesized
gctatatgcagtaaatactatt

SEQ ID NO: 817355 - DNA, 22 bp, Artificial Sequence
  chemically synthesized
tttgctatatgcagtaaatact

SEQ ID NO: 817356 - DNA, 22 bp, Artificial Sequence
  chemically synthesized
ggtctatttgctatatgcagta

SEQ ID NO: 817357 - DNA, 22 bp, Artificial Sequence
  chemically synthesized
gtaatctgggtctatttgctat

SEQ ID NO: 817358 - DNA, 22 bp, Artificial Sequence
  chemically synthesized
ggtaatctgggtctatttgcta

SEQ ID NO: 817359 - DNA, 22 bp, Artificial Sequence
  chemically synthesized
actgcatatagcaaatagaccc

SEQ ID NO: 817360 - DNA, 22 bp, Artificial Sequence
  chemically synthesized
ctgcatatagcaaatagaccca

SEQ ID NO: 817361 - DNA, 22 bp, Artificial Sequence
  chemically synthesized
catatagcaaatagacccagat

SEQ ID NO: 817362 - DNA, 22 bp, Artificial Sequence
  chemically synthesized
ataatagtttggtaatctgggt

SEQ ID NO: 817363 - DNA, 22 bp, Artificial Sequence
  chemically synthesized
gataatagtttggtaatctggg

SEQ ID NO: 817364 - DNA, 22 bp, Artificial Sequence
  chemically synthesized
ttgataatagtttggtaatctg

SEQ ID NO: 817365 - DNA, 22 bp, Artificial Sequence
  chemically synthesized
cttgataatagtttggtaatct

SEQ ID NO: 817366 - DNA, 22 bp, Artificial Sequence
  chemically synthesized
gcttcttgataatagtttggta

SEQ ID NO: 817367 - DNA, 22 bp, Artificial Sequence
  chemically synthesized
gcattagcttcttgataatagt

SEQ ID NO: 817368 - DNA, 22 bp, Artificial Sequence
  chemically synthesized
ccaaactattatcaagaagcta

SEQ ID NO: 817369 - DNA, 22 bp, Artificial Sequence
  chemically synthesized
ttatcaagaagctaatgccaat

SEQ ID NO: 817370 - DNA, 22 bp, Artificial Sequence
  chemically synthesized
tcaagaagctaatgccaatatc

SEQ ID NO: 817371 - DNA, 22 bp, Artificial Sequence
  chemically synthesized
atagcaaaagtcagtgatattg

SEQ ID NO: 817372 - DNA, 22 bp, Artificial Sequence
  chemically synthesized
catagcaaaagtcagtgatatt

SEQ ID NO: 817373 - DNA, 22 bp, Artificial Sequence
  chemically synthesized
tcatagcaaaagtcagtgatat

SEQ ID NO: 817374 - DNA, 22 bp, Artificial Sequence
  chemically synthesized
ctttcatagcaaaagtcagtga

SEQ ID NO: 817375 - DNA, 22 bp, Artificial Sequence
  chemically synthesized
tgctttcatagcaaaagtcagt

SEQ ID NO: 817376 - DNA, 22 bp, Artificial Sequence
  chemically synthesized
atgccaatatcactgacttttg

SEQ ID NO: 817377 - DNA, 22 bp, Artificial Sequence
  chemically synthesized
tcctctgctttcatagcaaaag

SEQ ID NO: 817378 - DNA, 22 bp, Artificial Sequence
  chemically synthesized
gacactgtcctctgctttcata

SEQ ID NO: 817379 - DNA, 22 bp, Artificial Sequence
  chemically synthesized
agacactgtcctctgctttcat

SEQ ID NO: 817380 - DNA, 22 bp, Artificial Sequence
  chemically synthesized
tagacactgtcctctgctttca

SEQ ID NO: 817381 - DNA, 22 bp, Artificial Sequence
  chemically synthesized
acttttgctatgaaagcagagg

SEQ ID NO: 817382 - DNA, 22 bp, Artificial Sequence
  chemically synthesized
ttgctatgaaagcagaggacag

SEQ ID NO: 817383 - DNA, 22 bp, Artificial Sequence
  chemically synthesized
tgcctttagacactgtcctctg

SEQ ID NO: 817384 - DNA, 22 bp, Artificial Sequence
  chemically synthesized
tgctatgaaagcagaggacagt

SEQ ID NO: 817385 - DNA, 22 bp, Artificial Sequence
  chemically synthesized
gctatgaaagcagaggacagtg

SEQ ID NO: 817386 - DNA, 22 bp, Artificial Sequence
  chemically synthesized
tgtgcctttagacactgtcctc

SEQ ID NO: 817387 - DNA, 22 bp, Artificial Sequence
  chemically synthesized
ctatgaaagcagaggacagtgt

SEQ ID NO: 817388 - DNA, 22 bp, Artificial Sequence
  chemically synthesized
tgaaagcagaggacagtgtcta

SEQ ID NO: 817389 - DNA, 22 bp, Artificial Sequence
  chemically synthesized
tgctctgtgcctttagacactg

SEQ ID NO: 817390 - DNA, 22 bp, Artificial Sequence
  chemically synthesized
taatagcagcaactatgctctg

SEQ ID NO: 817391 - DNA, 22 bp, Artificial Sequence
  chemically synthesized
gtaatagcagcaactatgctct

SEQ ID NO: 817392 - DNA, 22 bp, Artificial Sequence
  chemically synthesized
tgtaatagcagcaactatgctc

SEQ ID NO: 817393 - DNA, 22 bp, Artificial Sequence
  chemically synthesized
ttttgtaatagcagcaactatg

SEQ ID NO: 817394 - DNA, 22 bp, Artificial Sequence
  chemically synthesized
aaggcacagagcatagttgctg

SEQ ID NO: 817395 - DNA, 22 bp, Artificial Sequence
  chemically synthesized
attgttttgtaatagcagcaac

SEQ ID NO: 817396 - DNA, 22 bp, Artificial Sequence
  chemically synthesized
ctgctattacaaaacaattaac

SEQ ID NO: 817397 - DNA, 22 bp, Artificial Sequence
  chemically synthesized
cacgcggataaatgttaattgt

SEQ ID NO: 817398 - DNA, 22 bp, Artificial Sequence
  chemically synthesized
ctattacaaaacaattaacatt

SEQ ID NO: 817399 - DNA, 22 bp, Artificial Sequence
  chemically synthesized
ttacaaaacaattaacatttat

SEQ ID NO: 817400 - DNA, 22 bp, Artificial Sequence
  chemically synthesized
caaaacaattaacatttatccg

SEQ ID NO: 817401 - DNA, 22 bp, Artificial Sequence
  chemically synthesized
acatttatccgcgtggaatgcc

SEQ ID NO: 817402 - DNA, 22 bp, Artificial Sequence
  chemically synthesized
atccgcgtggaatgcctgcctt

SEQ ID NO: 817403 - DNA, 22 bp, Artificial Sequence
  chemically synthesized
tccgcgtggaatgcctgccttt

SEQ ID NO: 817404 - DNA, 22 bp, Artificial Sequence
  chemically synthesized
ataaaaggagtatggaagaaaa

SEQ ID NO: 817405 - DNA, 22 bp, Artificial Sequence
  chemically synthesized
gataaaaggagtatggaagaaa

SEQ ID NO: 817406 - DNA, 22 bp, Artificial Sequence
  chemically synthesized
taatgcttgataaaaggagtat

SEQ ID NO: 817407 - DNA, 22 bp, Artificial Sequence
  chemically synthesized
ccttttcttccatactcctttt

SEQ ID NO: 817408 - DNA, 22 bp, Artificial Sequence
  chemically synthesized
ttcttccatactccttttatca

SEQ ID NO: 817409 - DNA, 22 bp, Artificial Sequence
  chemically synthesized
tcttccatactccttttatcaa

SEQ ID NO: 817410 - DNA, 22 bp, Artificial Sequence
  chemically synthesized
cttccatactccttttatcaag

SEQ ID NO: 817411 - DNA, 22 bp, Artificial Sequence
  chemically synthesized
ttccatactccttttatcaagc

SEQ ID NO: 817412 - DNA, 22 bp, Artificial Sequence
  chemically synthesized
ccatactccttttatcaagcat

SEQ ID NO: 817413 - DNA, 22 bp, Artificial Sequence
  chemically synthesized
catactccttttatcaagcatt

SEQ ID NO: 817414 - DNA, 22 bp, Artificial Sequence
  chemically synthesized
cttttatcaagcattacagttt

SEQ ID NO: 817415 - DNA, 22 bp, Artificial Sequence
  chemically synthesized
ttatcaagcattacagtttcta

SEQ ID NO: 817416 - DNA, 22 bp, Artificial Sequence
  chemically synthesized
aaaagtggagaatagaaactgt

SEQ ID NO: 817417 - DNA, 22 bp, Artificial Sequence
  chemically synthesized
tatcaagcattacagtttctat

SEQ ID NO: 817418 - DNA, 22 bp, Artificial Sequence
  chemically synthesized
atcaagcattacagtttctatt

SEQ ID NO: 817419 - DNA, 22 bp, Artificial Sequence
  chemically synthesized
tcaagcattacagtttctattc

SEQ ID NO: 817420 - DNA, 22 bp, Artificial Sequence
  chemically synthesized
cagtttctattctccacttttc

SEQ ID NO: 817421 - DNA, 22 bp, Artificial Sequence
  chemically synthesized
aaatagtgcgaggatctgaaaa

SEQ ID NO: 817422 - DNA, 22 bp, Artificial Sequence
  chemically synthesized
ctattctccacttttcagatcc

SEQ ID NO: 817423 - DNA, 22 bp, Artificial Sequence
  chemically synthesized
caaatagtgcgaggatctgaaa

SEQ ID NO: 817424 - DNA, 22 bp, Artificial Sequence
  chemically synthesized
tattctccacttttcagatcct

SEQ ID NO: 817425 - DNA, 22 bp, Artificial Sequence
  chemically synthesized
tcaaatagtgcgaggatctgaa

SEQ ID NO: 817426 - DNA, 22 bp, Artificial Sequence
  chemically synthesized
ttctccacttttcagatcctcg

SEQ ID NO: 817427 - DNA, 22 bp, Artificial Sequence
  chemically synthesized
tccacttttcagatcctcgcac

SEQ ID NO: 817428 - DNA, 22 bp, Artificial Sequence
  chemically synthesized
cacttttcagatcctcgcacta

SEQ ID NO: 817429 - DNA, 22 bp, Artificial Sequence
  chemically synthesized
agaagggctttcaaatagtgcg

SEQ ID NO: 817430 - DNA, 22 bp, Artificial Sequence
  chemically synthesized
ttcagatcctcgcactatttga

SEQ ID NO: 817431 - DNA, 22 bp, Artificial Sequence
  chemically synthesized
tcagatcctcgcactatttgaa

SEQ ID NO: 817432 - DNA, 22 bp, Artificial Sequence
  chemically synthesized
cagatcctcgcactatttgaaa

SEQ ID NO: 817433 - DNA, 22 bp, Artificial Sequence
  chemically synthesized
cctcagaagggctttcaaatag

SEQ ID NO: 817434 - DNA, 22 bp, Artificial Sequence
  chemically synthesized
agatcctcgcactatttgaaag

SEQ ID NO: 817435 - DNA, 22 bp, Artificial Sequence
  chemically synthesized
gcactatttgaaagcccttctg

SEQ ID NO: 817436 - DNA, 22 bp, Artificial Sequence
  chemically synthesized
gcagaagttccctcagaagggc

SEQ ID NO: 817437 - DNA, 22 bp, Artificial Sequence
  chemically synthesized
ggcagaagttccctcagaaggg

SEQ ID NO: 817438 - DNA, 22 bp, Artificial Sequence
  chemically synthesized
tggcagaagttccctcagaagg

SEQ ID NO: 817439 - DNA, 22 bp, Artificial Sequence
  chemically synthesized
tttgaaagcccttctgagggaa

SEQ ID NO: 817440 - DNA, 22 bp, Artificial Sequence
  chemically synthesized
gaaagcccttctgagggaactt

SEQ ID NO: 817441 - DNA, 22 bp, Artificial Sequence
  chemically synthesized
aaagcccttctgagggaacttc

SEQ ID NO: 817442 - DNA, 22 bp, Artificial Sequence
  chemically synthesized
gaaaaggcaagcctttggcaga

SEQ ID NO: 817443 - DNA, 22 bp, Artificial Sequence
  chemically synthesized
ctgagggaacttctgccaaagg

SEQ ID NO: 817444 - DNA, 22 bp, Artificial Sequence
  chemically synthesized
tgagggaacttctgccaaaggc

SEQ ID NO: 817445 - DNA, 22 bp, Artificial Sequence
  chemically synthesized
tagaaaaggcaagcctttggca

SEQ ID NO: 817446 - DNA, 22 bp, Artificial Sequence
  chemically synthesized
ctagaaaaggcaagcctttggc

SEQ ID NO: 817447 - DNA, 22 bp, Artificial Sequence
  chemically synthesized
agggaacttctgccaaaggctt

SEQ ID NO: 817448 - DNA, 22 bp, Artificial Sequence
  chemically synthesized
ggatatttctagaaaaggcaag

SEQ ID NO: 817449 - DNA, 22 bp, Artificial Sequence
  chemically synthesized
ctgccaaaggcttgccttttct

SEQ ID NO: 817450 - DNA, 22 bp, Artificial Sequence
  chemically synthesized
tgccaaaggcttgccttttcta

SEQ ID NO: 817451 - DNA, 22 bp, Artificial Sequence
  chemically synthesized
ccaaaggcttgccttttctaga

SEQ ID NO: 817452 - DNA, 22 bp, Artificial Sequence
  chemically synthesized
taccctaggatatttctagaaa

SEQ ID NO: 817453 - DNA, 22 bp, Artificial Sequence
  chemically synthesized
gtaccctaggatatttctagaa

SEQ ID NO: 817454 - DNA, 22 bp, Artificial Sequence
  chemically synthesized
tgtaccctaggatatttctaga

SEQ ID NO: 817455 - DNA, 22 bp, Artificial Sequence
  chemically synthesized
gccttttctagaaatatcctag

SEQ ID NO: 817456 - DNA, 22 bp, Artificial Sequence
  chemically synthesized
ccttttctagaaatatcctagg

SEQ ID NO: 817457 - DNA, 22 bp, Artificial Sequence
  chemically synthesized
ttctagaaatatcctagggtac

SEQ ID NO: 817458 - DNA, 22 bp, Artificial Sequence
  chemically synthesized
tctagaaatatcctagggtaca

SEQ ID NO: 817459 - DNA, 22 bp, Artificial Sequence
  chemically synthesized
ctagaaatatcctagggtacaa

SEQ ID NO: 817460 - DNA, 22 bp, Artificial Sequence
  chemically synthesized
tagaaatatcctagggtacaaa

SEQ ID NO: 817461 - DNA, 22 bp, Artificial Sequence
  chemically synthesized
gaaatatcctagggtacaaaat

SEQ ID NO: 817462 - DNA, 22 bp, Artificial Sequence
  chemically synthesized
gggtacaaaattaccacttctt

SEQ ID NO: 817463 - DNA, 22 bp, Artificial Sequence
  chemically synthesized
agtgaggaggagaaagaaagaa

SEQ ID NO: 817464 - DNA, 22 bp, Artificial Sequence
  chemically synthesized
aagtgaggaggagaaagaaaga

SEQ ID NO: 817465 - DNA, 22 bp, Artificial Sequence
  chemically synthesized
gcttaagtgaggaggagaaaga

SEQ ID NO: 817466 - DNA, 22 bp, Artificial Sequence
  chemically synthesized
ggcttaagtgaggaggagaaag

SEQ ID NO: 817467 - DNA, 22 bp, Artificial Sequence
  chemically synthesized
ccacttctttctttctcctcct

SEQ ID NO: 817468 - DNA, 22 bp, Artificial Sequence
  chemically synthesized
ggtttggcttaagtgaggagga

SEQ ID NO: 817469 - DNA, 22 bp, Artificial Sequence
  chemically synthesized
aggtttggcttaagtgaggagg

SEQ ID NO: 817470 - DNA, 22 bp, Artificial Sequence
  chemically synthesized
taggtttggcttaagtgaggag

SEQ ID NO: 817471 - DNA, 22 bp, Artificial Sequence
  chemically synthesized
ctttctttctcctcctcactta

SEQ ID NO: 817472 - DNA, 22 bp, Artificial Sequence
  chemically synthesized
tttctttctcctcctcacttaa

SEQ ID NO: 817473 - DNA, 22 bp, Artificial Sequence
  chemically synthesized
tctttctcctcctcacttaagc

SEQ ID NO: 817474 - DNA, 22 bp, Artificial Sequence
  chemically synthesized
ctttctcctcctcacttaagcc

SEQ ID NO: 817475 - DNA, 22 bp, Artificial Sequence
  chemically synthesized
tttctcctcctcacttaagcca

SEQ ID NO: 817476 - DNA, 22 bp, Artificial Sequence
  chemically synthesized
tcactttaggtttggcttaagt

SEQ ID NO: 817477 - DNA, 22 bp, Artificial Sequence
  chemically synthesized
atcactttaggtttggcttaag

SEQ ID NO: 817478 - DNA, 22 bp, Artificial Sequence
  chemically synthesized
tctcctcctcacttaagccaaa

SEQ ID NO: 817479 - DNA, 22 bp, Artificial Sequence
  chemically synthesized
tatcactttaggtttggcttaa

SEQ ID NO: 817480 - DNA, 22 bp, Artificial Sequence
  chemically synthesized
ctcctcctcacttaagccaaac

SEQ ID NO: 817481 - DNA, 22 bp, Artificial Sequence
  chemically synthesized
ttatcactttaggtttggctta

SEQ ID NO: 817482 - DNA, 22 bp, Artificial Sequence
  chemically synthesized
tcctcctcacttaagccaaacc

SEQ ID NO: 817483 - DNA, 22 bp, Artificial Sequence
  chemically synthesized
ttttatcactttaggtttggct

SEQ ID NO: 817484 - DNA, 22 bp, Artificial Sequence
  chemically synthesized
ctcctcacttaagccaaaccta

SEQ ID NO: 817485 - DNA, 22 bp, Artificial Sequence
  chemically synthesized
cttttatcactttaggtttggc

SEQ ID NO: 817486 - DNA, 22 bp, Artificial Sequence
  chemically synthesized
ctcacttaagccaaacctaaag

SEQ ID NO: 817487 - DNA, 22 bp, Artificial Sequence
  chemically synthesized
acttaagccaaacctaaagtga

SEQ ID NO: 817488 - DNA, 22 bp, Artificial Sequence
  chemically synthesized
aagccaaacctaaagtgataaa

SEQ ID NO: 817489 - DNA, 22 bp, Artificial Sequence
  chemically synthesized
gaatacatttcttttatcactt

SEQ ID NO: 817490 - DNA, 22 bp, Artificial Sequence
  chemically synthesized
agccaaacctaaagtgataaaa

SEQ ID NO: 817491 - DNA, 22 bp, Artificial Sequence
  chemically synthesized
ggaatacatttcttttatcact

SEQ ID NO: 817492 - DNA, 22 bp, Artificial Sequence
  chemically synthesized
gtatcttggaatacatttcttt

SEQ ID NO: 817493 - DNA, 22 bp, Artificial Sequence
  chemically synthesized
cgtatcttggaatacatttctt

SEQ ID NO: 817494 - DNA, 22 bp, Artificial Sequence
  chemically synthesized
tcgtatcttggaatacatttct

SEQ ID NO: 817495 - DNA, 22 bp, Artificial Sequence
  chemically synthesized
aagtgataaaagaaatgtattc

SEQ ID NO: 817496 - DNA, 22 bp, Artificial Sequence
  chemically synthesized
tttcgtatcttggaatacattt

SEQ ID NO: 817497 - DNA, 22 bp, Artificial Sequence
  chemically synthesized
catgttctttcgtatcttggaa

SEQ ID NO: 817498 - DNA, 22 bp, Artificial Sequence
  chemically synthesized
agggccaattacatgttctttc

SEQ ID NO: 817499 - DNA, 22 bp, Artificial Sequence
  chemically synthesized
caagatacgaaagaacatgtaa

SEQ ID NO: 817500 - DNA, 22 bp, Artificial Sequence
  chemically synthesized
gatactaagggccaattacatg

SEQ ID NO: 817501 - DNA, 22 bp, Artificial Sequence
  chemically synthesized
tggatactaagggccaattaca

SEQ ID NO: 817502 - DNA, 22 bp, Artificial Sequence
  chemically synthesized
aaatgcaaatagcaccctctgg

SEQ ID NO: 817503 - DNA, 22 bp, Artificial Sequence
  chemically synthesized
gcccttagtatccagagggtgc

SEQ ID NO: 817504 - DNA, 22 bp, Artificial Sequence
  chemically synthesized
aaaatgcaaatagcaccctctg

SEQ ID NO: 817505 - DNA, 22 bp, Artificial Sequence
  chemically synthesized
taaaatgcaaatagcaccctct

SEQ ID NO: 817506 - DNA, 22 bp, Artificial Sequence
  chemically synthesized
ttaaaatgcaaatagcaccctc

SEQ ID NO: 817507 - DNA, 22 bp, Artificial Sequence
  chemically synthesized
ttttaaaatgcaaatagcaccc

SEQ ID NO: 817508 - DNA, 22 bp, Artificial Sequence
  chemically synthesized
cttttaaaatgcaaatagcacc

SEQ ID NO: 817509 - DNA, 22 bp, Artificial Sequence
  chemically synthesized
agtatccagagggtgctatttg

SEQ ID NO: 817510 - DNA, 22 bp, Artificial Sequence
  chemically synthesized
gtatccagagggtgctatttgc

SEQ ID NO: 817511 - DNA, 22 bp, Artificial Sequence
  chemically synthesized
ttcttttaaaatgcaaatagca

SEQ ID NO: 817512 - DNA, 22 bp, Artificial Sequence
  chemically synthesized
tttgcattttaaaagaagagct

SEQ ID NO: 817513 - DNA, 22 bp, Artificial Sequence
  chemically synthesized
gcattttaaaagaagagcttat

SEQ ID NO: 817514 - DNA, 22 bp, Artificial Sequence
  chemically synthesized
cattttaaaagaagagcttatt

SEQ ID NO: 817515 - DNA, 22 bp, Artificial Sequence
  chemically synthesized
atagatgagagataataagctc

SEQ ID NO: 817516 - DNA, 22 bp, Artificial Sequence
  chemically synthesized
aatagatgagagataataagct

SEQ ID NO: 817517 - DNA, 22 bp, Artificial Sequence
  chemically synthesized
taaaagaagagcttattatctc

SEQ ID NO: 817518 - DNA, 22 bp, Artificial Sequence
  chemically synthesized
aaaagaagagcttattatctct

SEQ ID NO: 817519 - DNA, 22 bp, Artificial Sequence
  chemically synthesized
aaagaagagcttattatctctc

SEQ ID NO: 817520 - DNA, 22 bp, Artificial Sequence
  chemically synthesized
gcaatttaatagatgagagata

SEQ ID NO: 817521 - DNA, 22 bp, Artificial Sequence
  chemically synthesized
attagcaatttaatagatgaga

SEQ ID NO: 817522 - DNA, 22 bp, Artificial Sequence
  chemically synthesized
ttaattagcaatttaatagatg

SEQ ID NO: 817523 - DNA, 22 bp, Artificial Sequence
  chemically synthesized
attatctctcatctattaaatt

SEQ ID NO: 817524 - DNA, 22 bp, Artificial Sequence
  chemically synthesized
ttatctctcatctattaaattg

SEQ ID NO: 817525 - DNA, 22 bp, Artificial Sequence
  chemically synthesized
atgctattaattagcaatttaa

SEQ ID NO: 817526 - DNA, 22 bp, Artificial Sequence
  chemically synthesized
tctctcatctattaaattgcta

SEQ ID NO: 817527 - DNA, 22 bp, Artificial Sequence
  chemically synthesized
tcatctattaaattgctaatta

SEQ ID NO: 817528 - DNA, 22 bp, Artificial Sequence
  chemically synthesized
atctattaaattgctaattaat

SEQ ID NO: 817529 - DNA, 22 bp, Artificial Sequence
  chemically synthesized
tggatgttcatgctattaatta

SEQ ID NO: 817530 - DNA, 22 bp, Artificial Sequence
  chemically synthesized
gtggatgttcatgctattaatt

SEQ ID NO: 817531 - DNA, 22 bp, Artificial Sequence
  chemically synthesized
tgtggatgttcatgctattaat

SEQ ID NO: 817532 - DNA, 22 bp, Artificial Sequence
  chemically synthesized
ttaaattgctaattaatagcat

SEQ ID NO: 817533 - DNA, 22 bp, Artificial Sequence
  chemically synthesized
aattgctaattaatagcatgaa

SEQ ID NO: 817534 - DNA, 22 bp, Artificial Sequence
  chemically synthesized
agttttgtggatgttcatgcta

SEQ ID NO: 817535 - DNA, 22 bp, Artificial Sequence
  chemically synthesized
ctaattaatagcatgaacatcc

SEQ ID NO: 817536 - DNA, 22 bp, Artificial Sequence
  chemically synthesized
gtctcagttttgtggatgttca

SEQ ID NO: 817537 - DNA, 22 bp, Artificial Sequence
  chemically synthesized
attaatagcatgaacatccaca

SEQ ID NO: 817538 - DNA, 22 bp, Artificial Sequence
  chemically synthesized
ttggtctcagttttgtggatgt

SEQ ID NO: 817539 - DNA, 22 bp, Artificial Sequence
  chemically synthesized
atagcatgaacatccacaaaac

SEQ ID NO: 817540 - DNA, 22 bp, Artificial Sequence
  chemically synthesized
aaaaaaaggtaaccaagttatt

SEQ ID NO: 817541 - DNA, 22 bp, Artificial Sequence
  chemically synthesized
gaaaaaaaggtaaccaagttat

SEQ ID NO: 817542 - DNA, 22 bp, Artificial Sequence
  chemically synthesized
atttgaaaaaaaggtaaccaag

SEQ ID NO: 817543 - DNA, 22 bp, Artificial Sequence
  chemically synthesized
agaccaataacttggttacctt

SEQ ID NO: 817544 - DNA, 22 bp, Artificial Sequence
  chemically synthesized
taaaaggaattcatttgaaaaa

SEQ ID NO: 817545 - DNA, 22 bp, Artificial Sequence
  chemically synthesized
ataaaaggaattcatttgaaaa

SEQ ID NO: 817546 - DNA, 22 bp, Artificial Sequence
  chemically synthesized
tataaaaggaattcatttgaaa

SEQ ID NO: 817547 - DNA, 22 bp, Artificial Sequence
  chemically synthesized
ggttacctttttttcaaatgaa

SEQ ID NO: 817548 - DNA, 22 bp, Artificial Sequence
  chemically synthesized
gttacctttttttcaaatgaat

SEQ ID NO: 817549 - DNA, 22 bp, Artificial Sequence
  chemically synthesized
cctttttttcaaatgaattcct

SEQ ID NO: 817550 - DNA, 22 bp, Artificial Sequence
  chemically synthesized
agtgttttataaaaggaattca

SEQ ID NO: 817551 - DNA, 22 bp, Artificial Sequence
  chemically synthesized
tttttcaaatgaattcctttta

SEQ ID NO: 817552 - DNA, 22 bp, Artificial Sequence
  chemically synthesized
ttttcaaatgaattccttttat

SEQ ID NO: 817553 - DNA, 22 bp, Artificial Sequence
  chemically synthesized
tttcaaatgaattccttttata

SEQ ID NO: 817554 - DNA, 22 bp, Artificial Sequence
  chemically synthesized
ttcaaatgaattccttttataa

SEQ ID NO: 817555 - DNA, 22 bp, Artificial Sequence
  chemically synthesized
tcaaatgaattccttttataaa

SEQ ID NO: 817556 - DNA, 22 bp, Artificial Sequence
  chemically synthesized
acaattcagtgttttataaaag

SEQ ID NO: 817557 - DNA, 22 bp, Artificial Sequence
  chemically synthesized
caaatgaattccttttataaaa

SEQ ID NO: 817558 - DNA, 22 bp, Artificial Sequence
  chemically synthesized
aaatgaattccttttataaaac

SEQ ID NO: 817559 - DNA, 22 bp, Artificial Sequence
  chemically synthesized
ttaacaattcagtgttttataa

SEQ ID NO: 817560 - DNA, 22 bp, Artificial Sequence
  chemically synthesized
attaacaattcagtgttttata

SEQ ID NO: 817561 - DNA, 22 bp, Artificial Sequence
  chemically synthesized
tattaacaattcagtgttttat

SEQ ID NO: 817562 - DNA, 22 bp, Artificial Sequence
  chemically synthesized
cttttataaaacactgaattgt

SEQ ID NO: 817563 - DNA, 22 bp, Artificial Sequence
  chemically synthesized
ttataaaacactgaattgttaa

SEQ ID NO: 817564 - DNA, 22 bp, Artificial Sequence
  chemically synthesized
tataaaacactgaattgttaat

SEQ ID NO: 817565 - DNA, 22 bp, Artificial Sequence
  chemically synthesized
ataaaacactgaattgttaata

SEQ ID NO: 817566 - DNA, 22 bp, Artificial Sequence
  chemically synthesized
taaaacactgaattgttaataa

SEQ ID NO: 817567 - DNA, 22 bp, Artificial Sequence
  chemically synthesized
gtccatcataagtattttatta

SEQ ID NO: 817568 - DNA, 22 bp, Artificial Sequence
  chemically synthesized
aattgttaataaaatacttatg

SEQ ID NO: 817569 - DNA, 22 bp, Artificial Sequence
  chemically synthesized
atactggtccatcataagtatt

SEQ ID NO: 817570 - DNA, 22 bp, Artificial Sequence
  chemically synthesized
tgatactggtccatcataagta

SEQ ID NO: 817571 - DNA, 22 bp, Artificial Sequence
  chemically synthesized
ttaataaaatacttatgatgga

SEQ ID NO: 817572 - DNA, 22 bp, Artificial Sequence
  chemically synthesized
ataaaatacttatgatggacca

SEQ ID NO: 817573 - DNA, 22 bp, Artificial Sequence
  chemically synthesized
catatatgctctgatactggtc

SEQ ID NO: 817574 - DNA, 22 bp, Artificial Sequence
  chemically synthesized
acatatatgctctgatactggt

SEQ ID NO: 817575 - DNA, 22 bp, Artificial Sequence
  chemically synthesized
tacatatatgctctgatactgg

SEQ ID NO: 817576 - DNA, 22 bp, Artificial Sequence
  chemically synthesized
ttacatatatgctctgatactg

SEQ ID NO: 817577 - DNA, 22 bp, Artificial Sequence
  chemically synthesized
atgatggaccagtatcagagca

SEQ ID NO: 817578 - DNA, 22 bp, Artificial Sequence
  chemically synthesized
tgatggaccagtatcagagcat

SEQ ID NO: 817579 - DNA, 22 bp, Artificial Sequence
  chemically synthesized
agcttttacatatatgctctga

SEQ ID NO: 817580 - DNA, 22 bp, Artificial Sequence
  chemically synthesized
ctgagcttttacatatatgctc

SEQ ID NO: 817581 - DNA, 22 bp, Artificial Sequence
  chemically synthesized
tattcctgagcttttacatata

SEQ ID NO: 817582 - DNA, 22 bp, Artificial Sequence
  chemically synthesized
gtattcctgagcttttacatat

SEQ ID NO: 817583 - DNA, 22 bp, Artificial Sequence
  chemically synthesized
tgtattcctgagcttttacata

SEQ ID NO: 817584 - DNA, 22 bp, Artificial Sequence
  chemically synthesized
ttttgtattcctgagcttttac

SEQ ID NO: 817585 - DNA, 22 bp, Artificial Sequence
  chemically synthesized
attttgtattcctgagctttta

SEQ ID NO: 817586 - DNA, 22 bp, Artificial Sequence
  chemically synthesized
tattttgtattcctgagctttt

SEQ ID NO: 817587 - DNA, 22 bp, Artificial Sequence
  chemically synthesized
ttattttgtattcctgagcttt

SEQ ID NO: 817588 - DNA, 22 bp, Artificial Sequence
  chemically synthesized
tttttattttgtattcctgagc

SEQ ID NO: 817589 - DNA, 22 bp, Artificial Sequence
  chemically synthesized
gtttttattttgtattcctgag

SEQ ID NO: 817590 - DNA, 22 bp, Artificial Sequence
  chemically synthesized
tgtttttattttgtattcctga

SEQ ID NO: 817591 - DNA, 22 bp, Artificial Sequence
  chemically synthesized
aaaattttgtttttattttgta

SEQ ID NO: 817592 - DNA, 22 bp, Artificial Sequence
  chemically synthesized
ctaaaaattttgtttttatttt

SEQ ID NO: 817593 - DNA, 22 bp, Artificial Sequence
  chemically synthesized
actaaaaattttgtttttattt

SEQ ID NO: 817594 - DNA, 22 bp, Artificial Sequence
  chemically synthesized
aggaatacaaaataaaaacaaa

SEQ ID NO: 817595 - DNA, 22 bp, Artificial Sequence
  chemically synthesized
tatatttactaaaaattttgtt

SEQ ID NO: 817596 - DNA, 22 bp, Artificial Sequence
  chemically synthesized
attatatatttactaaaaattt

SEQ ID NO: 817597 - DNA, 22 bp, Artificial Sequence
  chemically synthesized
aattatatatttactaaaaatt

SEQ ID NO: 817598 - DNA, 22 bp, Artificial Sequence
  chemically synthesized
taattatatatttactaaaaat

SEQ ID NO: 817599 - DNA, 22 bp, Artificial Sequence
  chemically synthesized
ttagtaaatatataattaaaat

SEQ ID NO: 817600 - DNA, 22 bp, Artificial Sequence
  chemically synthesized
tagtaaatatataattaaaatc

SEQ ID NO: 817601 - DNA, 22 bp, Artificial Sequence
  chemically synthesized
agtaaaataaatgattttaatt

SEQ ID NO: 817602 - DNA, 22 bp, Artificial Sequence
  chemically synthesized
agtaaatatataattaaaatca

SEQ ID NO: 817603 - DNA, 22 bp, Artificial Sequence
  chemically synthesized
gagtaaaataaatgattttaat

SEQ ID NO: 817604 - DNA, 22 bp, Artificial Sequence
  chemically synthesized
gtaaatatataattaaaatcat

SEQ ID NO: 817605 - DNA, 22 bp, Artificial Sequence
  chemically synthesized
cttgagtaaaataaatgatttt

SEQ ID NO: 817606 - DNA, 22 bp, Artificial Sequence
  chemically synthesized
gcttgagtaaaataaatgattt

SEQ ID NO: 817607 - DNA, 22 bp, Artificial Sequence
  chemically synthesized
acttgcttgagtaaaataaatg

SEQ ID NO: 817608 - DNA, 22 bp, Artificial Sequence
  chemically synthesized
aacttgcttgagtaaaataaat

SEQ ID NO: 817609 - DNA, 22 bp, Artificial Sequence
  chemically synthesized
tttaacttgcttgagtaaaata

SEQ ID NO: 817610 - DNA, 22 bp, Artificial Sequence
  chemically synthesized
aaatcatttattttactcaagc

SEQ ID NO: 817611 - DNA, 22 bp, Artificial Sequence
  chemically synthesized
caaggttatttaacttgcttga

SEQ ID NO: 817612 - DNA, 22 bp, Artificial Sequence
  chemically synthesized
ccaaggttatttaacttgcttg

SEQ ID NO: 817613 - DNA, 22 bp, Artificial Sequence
  chemically synthesized
attttactcaagcaagttaaat

SEQ ID NO: 817614 - DNA, 22 bp, Artificial Sequence
  chemically synthesized
ttttactcaagcaagttaaata

SEQ ID NO: 817615 - DNA, 22 bp, Artificial Sequence
  chemically synthesized
tactcaagcaagttaaataacc

SEQ ID NO: 817616 - DNA, 22 bp, Artificial Sequence
  chemically synthesized
actcaagcaagttaaataacct

SEQ ID NO: 817617 - DNA, 22 bp, Artificial Sequence
  chemically synthesized
ctcaagcaagttaaataacctt

SEQ ID NO: 817618 - DNA, 22 bp, Artificial Sequence
  chemically synthesized
aagcaagttaaataaccttgga

SEQ ID NO: 817619 - DNA, 22 bp, Artificial Sequence
  chemically synthesized
tgagtgatgggtggcttccaag

SEQ ID NO: 817620 - DNA, 22 bp, Artificial Sequence
  chemically synthesized
aataaccttggaagccacccat

SEQ ID NO: 817621 - DNA, 22 bp, Artificial Sequence
  chemically synthesized
aaacaggaacctatgagtgatg

SEQ ID NO: 817622 - DNA, 22 bp, Artificial Sequence
  chemically synthesized
caaacaggaacctatgagtgat

SEQ ID NO: 817623 - DNA, 22 bp, Artificial Sequence
  chemically synthesized
ggaagccacccatcactcatag

SEQ ID NO: 817624 - DNA, 22 bp, Artificial Sequence
  chemically synthesized
tcaaacaggaacctatgagtga

SEQ ID NO: 817625 - DNA, 22 bp, Artificial Sequence
  chemically synthesized
gaagccacccatcactcatagg

SEQ ID NO: 817626 - DNA, 22 bp, Artificial Sequence
  chemically synthesized
ttcaaacaggaacctatgagtg

SEQ ID NO: 817627 - DNA, 22 bp, Artificial Sequence
  chemically synthesized
gacttttcaaacaggaacctat

SEQ ID NO: 817628 - DNA, 22 bp, Artificial Sequence
  chemically synthesized
tatctagacttttcaaacagga

SEQ ID NO: 817629 - DNA, 22 bp, Artificial Sequence
  chemically synthesized
atatctagacttttcaaacagg

SEQ ID NO: 817630 - DNA, 22 bp, Artificial Sequence
  chemically synthesized
ttatatctagacttttcaaaca

SEQ ID NO: 817631 - DNA, 22 bp, Artificial Sequence
  chemically synthesized
ataggttcctgtttgaaaagtc

SEQ ID NO: 817632 - DNA, 22 bp, Artificial Sequence
  chemically synthesized
ctgtttgaaaagtctagatata

SEQ ID NO: 817633 - DNA, 22 bp, Artificial Sequence
  chemically synthesized
tttgaaaagtctagatataaga

SEQ ID NO: 817634 - DNA, 22 bp, Artificial Sequence
  chemically synthesized
gaaaagtctagatataagaggt

SEQ ID NO: 817635 - DNA, 22 bp, Artificial Sequence
  chemically synthesized
aaaagtctagatataagaggtt

SEQ ID NO: 817636 - DNA, 22 bp, Artificial Sequence
  chemically synthesized
gatataagaggttataccattt

SEQ ID NO: 817637 - DNA, 22 bp, Artificial Sequence
  chemically synthesized
taccatttggatggtttcatgg

SEQ ID NO: 817638 - DNA, 22 bp, Artificial Sequence
  chemically synthesized
gaacatgtgcatatacccatga

SEQ ID NO: 817639 - DNA, 22 bp, Artificial Sequence
  chemically synthesized
ggatggtttcatgggtatatgc

SEQ ID NO: 817640 - DNA, 22 bp, Artificial Sequence
  chemically synthesized
gatggtttcatgggtatatgca

SEQ ID NO: 817641 - DNA, 22 bp, Artificial Sequence
  chemically synthesized
tatgggctagaacatgtgcata

SEQ ID NO: 817642 - DNA, 22 bp, Artificial Sequence
  chemically synthesized
catgggtatatgcacatgttct

SEQ ID NO: 817643 - DNA, 22 bp, Artificial Sequence
  chemically synthesized
atgggtatatgcacatgttcta

SEQ ID NO: 817644 - DNA, 22 bp, Artificial Sequence
  chemically synthesized
cataaaattatatgggctagaa

SEQ ID NO: 817645 - DNA, 22 bp, Artificial Sequence
  chemically synthesized
atatacaaaaactgcataaaat

SEQ ID NO: 817646 - DNA, 22 bp, Artificial Sequence
  chemically synthesized
tagcccatataattttatgcag

SEQ ID NO: 817647 - DNA, 22 bp, Artificial Sequence
  chemically synthesized
gcccatataattttatgcagtt

SEQ ID NO: 817648 - DNA, 22 bp, Artificial Sequence
  chemically synthesized
aagtgtaattgatatacaaaaa

SEQ ID NO: 817649 - DNA, 22 bp, Artificial Sequence
  chemically synthesized
ttgaagtgtaattgatatacaa

SEQ ID NO: 817650 - DNA, 22 bp, Artificial Sequence
  chemically synthesized
attgaagtgtaattgatataca

SEQ ID NO: 817651 - DNA, 22 bp, Artificial Sequence
  chemically synthesized
tatgcagtttttgtatatcaat

SEQ ID NO: 817652 - DNA, 22 bp, Artificial Sequence
  chemically synthesized
tattgaagtgtaattgatatac

SEQ ID NO: 817653 - DNA, 22 bp, Artificial Sequence
  chemically synthesized
atgcagtttttgtatatcaatt

SEQ ID NO: 817654 - DNA, 22 bp, Artificial Sequence
  chemically synthesized
tgcagtttttgtatatcaatta

SEQ ID NO: 817655 - DNA, 22 bp, Artificial Sequence
  chemically synthesized
acagctttattgaagtgtaatt

SEQ ID NO: 817656 - DNA, 22 bp, Artificial Sequence
  chemically synthesized
aacagctttattgaagtgtaat

SEQ ID NO: 817657 - DNA, 22 bp, Artificial Sequence
  chemically synthesized
taacagctttattgaagtgtaa

SEQ ID NO: 817658 - DNA, 22 bp, Artificial Sequence
  chemically synthesized
ttgtatatcaattacacttcaa

SEQ ID NO: 817659 - DNA, 22 bp, Artificial Sequence
  chemically synthesized
tgtatatcaattacacttcaat

SEQ ID NO: 817660 - DNA, 22 bp, Artificial Sequence
  chemically synthesized
gtatatcaattacacttcaata

SEQ ID NO: 817661 - DNA, 22 bp, Artificial Sequence
  chemically synthesized
tatatcaattacacttcaataa

SEQ ID NO: 817662 - DNA, 22 bp, Artificial Sequence
  chemically synthesized
attttaacagctttattgaagt

SEQ ID NO: 817663 - DNA, 22 bp, Artificial Sequence
  chemically synthesized
aattttaacagctttattgaag

SEQ ID NO: 817664 - DNA, 22 bp, Artificial Sequence
  chemically synthesized
taattttaacagctttattgaa

SEQ ID NO: 817665 - DNA, 22 bp, Artificial Sequence
  chemically synthesized
ttaattttaacagctttattga

SEQ ID NO: 817666 - DNA, 22 bp, Artificial Sequence
  chemically synthesized
tttaattttaacagctttattg

SEQ ID NO: 817667 - DNA, 22 bp, Artificial Sequence
  chemically synthesized
tgttttttaattttaacagctt

SEQ ID NO: 817668 - DNA, 22 bp, Artificial Sequence
  chemically synthesized
atgttttttaattttaacagct

SEQ ID NO: 817669 - DNA, 22 bp, Artificial Sequence
  chemically synthesized
cacttcaataaagctgttaaaa

SEQ ID NO: 817670 - DNA, 22 bp, Artificial Sequence
  chemically synthesized
tatgttttttaattttaacagc

SEQ ID NO: 817671 - DNA, 22 bp, Artificial Sequence
  chemically synthesized
caataaagctgttaaaattaaa

SEQ ID NO: 817672 - DNA, 22 bp, Artificial Sequence
  chemically synthesized
cattttatgttttttaatttta

SEQ ID NO: 817673 - DNA, 22 bp, Artificial Sequence
  chemically synthesized
aataaagctgttaaaattaaaa

SEQ ID NO: 817674 - DNA, 22 bp, Artificial Sequence
  chemically synthesized
tgcattttatgttttttaattt

SEQ ID NO: 817675 - DNA, 22 bp, Artificial Sequence
  chemically synthesized
ctgcattttatgttttttaatt

SEQ ID NO: 817676 - DNA, 22 bp, Artificial Sequence
  chemically synthesized
gcaccttctgcattttatgttt

SEQ ID NO: 817677 - DNA, 22 bp, Artificial Sequence
  chemically synthesized
ttaaaattaaaaaacataaaat

SEQ ID NO: 817678 - DNA, 22 bp, Artificial Sequence
  chemically synthesized
aaattaaaaaacataaaatgca

SEQ ID NO: 817679 - DNA, 22 bp, Artificial Sequence
  chemically synthesized
attggcaccttctgcattttat

SEQ ID NO: 817680 - DNA, 22 bp, Artificial Sequence
  chemically synthesized
gattcattggcaccttctgcat

SEQ ID NO: 817681 - DNA, 22 bp, Artificial Sequence
  chemically synthesized
aaaaacataaaatgcagaaggt

SEQ ID NO: 817682 - DNA, 22 bp, Artificial Sequence
  chemically synthesized
agattcattggcaccttctgca

SEQ ID NO: 817683 - DNA, 22 bp, Artificial Sequence
  chemically synthesized
tagattcattggcaccttctgc

SEQ ID NO: 817684 - DNA, 22 bp, Artificial Sequence
  chemically synthesized
ttagattcattggcaccttctg

SEQ ID NO: 817685 - DNA, 22 bp, Artificial Sequence
  chemically synthesized
tgtttttagattcattggcacc

SEQ ID NO: 817686 - DNA, 22 bp, Artificial Sequence
  chemically synthesized
attatgtttttagattcattgg

SEQ ID NO: 817687 - DNA, 22 bp, Artificial Sequence
  chemically synthesized
ttgattatgtttttagattcat

SEQ ID NO: 817688 - DNA, 22 bp, Artificial Sequence
  chemically synthesized
tgatctattgattatgttttta

SEQ ID NO: 817689 - DNA, 22 bp, Artificial Sequence
  chemically synthesized
atgatctattgattatgttttt

SEQ ID NO: 817690 - DNA, 22 bp, Artificial Sequence
  chemically synthesized
tatgatctattgattatgtttt

SEQ ID NO: 817691 - DNA, 22 bp, Artificial Sequence
  chemically synthesized
ttatgatctattgattatgttt

SEQ ID NO: 817692 - DNA, 22 bp, Artificial Sequence
  chemically synthesized
ggcatttttatgatctattgat

SEQ ID NO: 817693 - DNA, 22 bp, Artificial Sequence
  chemically synthesized
aggcatttttatgatctattga

SEQ ID NO: 817694 - DNA, 22 bp, Artificial Sequence
  chemically synthesized
taggcatttttatgatctattg

SEQ ID NO: 817695 - DNA, 22 bp, Artificial Sequence
  chemically synthesized
aaaacataatcaatagatcata

SEQ ID NO: 817696 - DNA, 22 bp, Artificial Sequence
  chemically synthesized
taattttaggcatttttatgat

SEQ ID NO: 817697 - DNA, 22 bp, Artificial Sequence
  chemically synthesized
ataattttaggcatttttatga

SEQ ID NO: 817698 - DNA, 22 bp, Artificial Sequence
  chemically synthesized
taatttataattttaggcattt

SEQ ID NO: 817699 - DNA, 22 bp, Artificial Sequence
  chemically synthesized
ggatatgttataatttataatt

SEQ ID NO: 817700 - DNA, 22 bp, Artificial Sequence
  chemically synthesized
taggatatgttataatttataa

SEQ ID NO: 817701 - DNA, 22 bp, Artificial Sequence
  chemically synthesized
gaaaattctaggatatgttata

SEQ ID NO: 817702 - DNA, 22 bp, Artificial Sequence
  chemically synthesized
aaattataaattataacatatc

SEQ ID NO: 817703 - DNA, 22 bp, Artificial Sequence
  chemically synthesized
ggaaaattctaggatatgttat

SEQ ID NO: 817704 - DNA, 22 bp, Artificial Sequence
  chemically synthesized
tggaaaattctaggatatgtta

SEQ ID NO: 817705 - DNA, 22 bp, Artificial Sequence
  chemically synthesized
taaattataacatatcctagaa

SEQ ID NO: 817706 - DNA, 22 bp, Artificial Sequence
  chemically synthesized
agagattttggaaaattctagg

SEQ ID NO: 817707 - DNA, 22 bp, Artificial Sequence
  chemically synthesized
cagagattttggaaaattctag

SEQ ID NO: 817708 - DNA, 22 bp, Artificial Sequence
  chemically synthesized
tcagagattttggaaaattcta

SEQ ID NO: 817709 - DNA, 22 bp, Artificial Sequence
  chemically synthesized
taacatatcctagaattttcca

SEQ ID NO: 817710 - DNA, 22 bp, Artificial Sequence
  chemically synthesized
tttcagagattttggaaaattc

SEQ ID NO: 817711 - DNA, 22 bp, Artificial Sequence
  chemically synthesized
ctttcagagattttggaaaatt

SEQ ID NO: 817712 - DNA, 22 bp, Artificial Sequence
  chemically synthesized
tttctttcagagattttggaaa

SEQ ID NO: 817713 - DNA, 22 bp, Artificial Sequence
  chemically synthesized
ctatttctttcagagattttgg

SEQ ID NO: 817714 - DNA, 22 bp, Artificial Sequence
  chemically synthesized
actatttctttcagagattttg

SEQ ID NO: 817715 - DNA, 22 bp, Artificial Sequence
  chemically synthesized
gaattttccaaaatctctgaaa

SEQ ID NO: 817716 - DNA, 22 bp, Artificial Sequence
  chemically synthesized
gcttactatttctttcagagat

SEQ ID NO: 817717 - DNA, 22 bp, Artificial Sequence
  chemically synthesized
tagcttactatttctttcagag

SEQ ID NO: 817718 - DNA, 22 bp, Artificial Sequence
  chemically synthesized
tccaaaatctctgaaagaaata

SEQ ID NO: 817719 - DNA, 22 bp, Artificial Sequence
  chemically synthesized
actctagcttactatttctttc

SEQ ID NO: 817720 - DNA, 22 bp, Artificial Sequence
  chemically synthesized
ccaaaatctctgaaagaaatag

SEQ ID NO: 817721 - DNA, 22 bp, Artificial Sequence
  chemically synthesized
aactctagcttactatttcttt

SEQ ID NO: 817722 - DNA, 22 bp, Artificial Sequence
  chemically synthesized
caaaatctctgaaagaaatagt

SEQ ID NO: 817723 - DNA, 22 bp, Artificial Sequence
  chemically synthesized
tcatttaactctagcttactat

SEQ ID NO: 817724 - DNA, 22 bp, Artificial Sequence
  chemically synthesized
tgaaagaaatagtaagctagag

SEQ ID NO: 817725 - DNA, 22 bp, Artificial Sequence
  chemically synthesized
aaagaaatagtaagctagagtt

SEQ ID NO: 817726 - DNA, 22 bp, Artificial Sequence
  chemically synthesized
gtaggaaatctgtcatttaact

SEQ ID NO: 817727 - DNA, 22 bp, Artificial Sequence
  chemically synthesized
agtaggaaatctgtcatttaac

SEQ ID NO: 817728 - DNA, 22 bp, Artificial Sequence
  chemically synthesized
tttagtaggaaatctgtcattt

SEQ ID NO: 817729 - DNA, 22 bp, Artificial Sequence
  chemically synthesized
gtttagtaggaaatctgtcatt

SEQ ID NO: 817730 - DNA, 22 bp, Artificial Sequence
  chemically synthesized
ccttgtttagtaggaaatctgt

SEQ ID NO: 817731 - DNA, 22 bp, Artificial Sequence
  chemically synthesized
gagttaaatgacagatttccta

SEQ ID NO: 817732 - DNA, 22 bp, Artificial Sequence
  chemically synthesized
ctaccttgtttagtaggaaatc

SEQ ID NO: 817733 - DNA, 22 bp, Artificial Sequence
  chemically synthesized
actaccttgtttagtaggaaat

SEQ ID NO: 817734 - DNA, 22 bp, Artificial Sequence
  chemically synthesized
tactaccttgtttagtaggaaa

SEQ ID NO: 817735 - DNA, 22 bp, Artificial Sequence
  chemically synthesized
tttactaccttgtttagtagga

SEQ ID NO: 817736 - DNA, 22 bp, Artificial Sequence
  chemically synthesized
aatgacagatttcctactaaac

SEQ ID NO: 817737 - DNA, 22 bp, Artificial Sequence
  chemically synthesized
actctttactaccttgtttagt

SEQ ID NO: 817738 - DNA, 22 bp, Artificial Sequence
  chemically synthesized
cctactaaacaaggtagtaaag

SEQ ID NO: 817739 - DNA, 22 bp, Artificial Sequence
  chemically synthesized
ctactaaacaaggtagtaaaga

SEQ ID NO: 817740 - DNA, 22 bp, Artificial Sequence
  chemically synthesized
acgtcaagcctcactctttact

SEQ ID NO: 817741 - DNA, 22 bp, Artificial Sequence
  chemically synthesized
ctaaacaaggtagtaaagagtg

SEQ ID NO: 817742 - DNA, 22 bp, Artificial Sequence
  chemically synthesized
gacgtcaagcctcactctttac

SEQ ID NO: 817743 - DNA, 22 bp, Artificial Sequence
  chemically synthesized
aacaaggtagtaaagagtgagg

SEQ ID NO: 817744 - DNA, 22 bp, Artificial Sequence
  chemically synthesized
gtttgacgtcaagcctcactct

SEQ ID NO: 817745 - DNA, 22 bp, Artificial Sequence
  chemically synthesized
tggtttgacgtcaagcctcact

SEQ ID NO: 817746 - DNA, 22 bp, Artificial Sequence
  chemically synthesized
aagtacatcaaaaagttctggt

SEQ ID NO: 817747 - DNA, 22 bp, Artificial Sequence
  chemically synthesized
gacgtcaaaccagaactttttg

SEQ ID NO: 817748 - DNA, 22 bp, Artificial Sequence
  chemically synthesized
acgtcaaaccagaactttttga

SEQ ID NO: 817749 - DNA, 22 bp, Artificial Sequence
  chemically synthesized
aagcattaaagtacatcaaaaa

SEQ ID NO: 817750 - DNA, 22 bp, Artificial Sequence
  chemically synthesized
caagcattaaagtacatcaaaa

SEQ ID NO: 817751 - DNA, 22 bp, Artificial Sequence
  chemically synthesized
tcaagcattaaagtacatcaaa

SEQ ID NO: 817752 - DNA, 22 bp, Artificial Sequence
  chemically synthesized
cctttcaagcattaaagtacat

SEQ ID NO: 817753 - DNA, 22 bp, Artificial Sequence
  chemically synthesized
tacctttcaagcattaaagtac

SEQ ID NO: 817754 - DNA, 22 bp, Artificial Sequence
  chemically synthesized
ctacctttcaagcattaaagta

SEQ ID NO: 817755 - DNA, 22 bp, Artificial Sequence
  chemically synthesized
tttgatgtactttaatgcttga

SEQ ID NO: 817756 - DNA, 22 bp, Artificial Sequence
  chemically synthesized
ttgatgtactttaatgcttgaa

SEQ ID NO: 817757 - DNA, 22 bp, Artificial Sequence
  chemically synthesized
tgatgtactttaatgcttgaaa

SEQ ID NO: 817758 - DNA, 22 bp, Artificial Sequence
  chemically synthesized
gatgtactttaatgcttgaaag

SEQ ID NO: 817759 - DNA, 22 bp, Artificial Sequence
  chemically synthesized
atgtactttaatgcttgaaagg

SEQ ID NO: 817760 - DNA, 22 bp, Artificial Sequence
  chemically synthesized
taatgcttgaaaggtagaaata

SEQ ID NO: 817761 - DNA, 22 bp, Artificial Sequence
  chemically synthesized
aatgcttgaaaggtagaaatac

SEQ ID NO: 817762 - DNA, 22 bp, Artificial Sequence
  chemically synthesized
atgcttgaaaggtagaaatacg

SEQ ID NO: 817763 - DNA, 22 bp, Artificial Sequence
  chemically synthesized
gaaaggtagaaatacgcgtgcc

SEQ ID NO: 817764 - DNA, 22 bp, Artificial Sequence
  chemically synthesized
aaaggtagaaatacgcgtgcca

SEQ ID NO: 817765 - DNA, 22 bp, Artificial Sequence
  chemically synthesized
cagaaaaatatatggcacgcgt

SEQ ID NO: 817766 - DNA, 22 bp, Artificial Sequence
  chemically synthesized
gcagaaaaatatatggcacgcg

SEQ ID NO: 817767 - DNA, 22 bp, Artificial Sequence
  chemically synthesized
tgcagaaaaatatatggcacgc

SEQ ID NO: 817768 - DNA, 22 bp, Artificial Sequence
  chemically synthesized
tgaatacaattttgcagaaaaa

SEQ ID NO: 817769 - DNA, 22 bp, Artificial Sequence
  chemically synthesized
gctgtgaatacaattttgcaga

SEQ ID NO: 817770 - DNA, 22 bp, Artificial Sequence
  chemically synthesized
cgctgtgaatacaattttgcag

SEQ ID NO: 817771 - DNA, 22 bp, Artificial Sequence
  chemically synthesized
tcgctgtgaatacaattttgca

SEQ ID NO: 817772 - DNA, 22 bp, Artificial Sequence
  chemically synthesized
actttcgctgtgaatacaattt

SEQ ID NO: 817773 - DNA, 22 bp, Artificial Sequence
  chemically synthesized
ttctgcaaaattgtattcacag

SEQ ID NO: 817774 - DNA, 22 bp, Artificial Sequence
  chemically synthesized
tctgcaaaattgtattcacagc

SEQ ID NO: 817775 - DNA, 22 bp, Artificial Sequence
  chemically synthesized
ctgcaaaattgtattcacagcg

SEQ ID NO: 817776 - DNA, 22 bp, Artificial Sequence
  chemically synthesized
tgcaaaattgtattcacagcga

SEQ ID NO: 817777 - DNA, 22 bp, Artificial Sequence
  chemically synthesized
caaaattgtattcacagcgaaa

SEQ ID NO: 817778 - DNA, 22 bp, Artificial Sequence
  chemically synthesized
ggtataacagtcctaactttcg

SEQ ID NO: 817779 - DNA, 22 bp, Artificial Sequence
  chemically synthesized
aggtataacagtcctaactttc

SEQ ID NO: 817780 - DNA, 22 bp, Artificial Sequence
  chemically synthesized
tattcacagcgaaagttaggac

SEQ ID NO: 817781 - DNA, 22 bp, Artificial Sequence
  chemically synthesized
cttaggtataacagtcctaact

SEQ ID NO: 817782 - DNA, 22 bp, Artificial Sequence
  chemically synthesized
ccttaggtataacagtcctaac

SEQ ID NO: 817783 - DNA, 22 bp, Artificial Sequence
  chemically synthesized
acagcgaaagttaggactgtta

SEQ ID NO: 817784 - DNA, 22 bp, Artificial Sequence
  chemically synthesized
agtcaagatttccttaggtata

SEQ ID NO: 817785 - DNA, 22 bp, Artificial Sequence
  chemically synthesized
ggactgttatacctaaggaaat

SEQ ID NO: 817786 - DNA, 22 bp, Artificial Sequence
  chemically synthesized
gcactcagtcaagatttcctta

SEQ ID NO: 817787 - DNA, 22 bp, Artificial Sequence
  chemically synthesized
ttatacctaaggaaatcttgac

SEQ ID NO: 817788 - DNA, 22 bp, Artificial Sequence
  chemically synthesized
tacctaaggaaatcttgactga

SEQ ID NO: 817789 - DNA, 22 bp, Artificial Sequence
  chemically synthesized
agtgagggttagcactcagtca

SEQ ID NO: 817790 - DNA, 22 bp, Artificial Sequence
  chemically synthesized
aggaaatcttgactgagtgcta

SEQ ID NO: 817791 - DNA, 22 bp, Artificial Sequence
  chemically synthesized
ggcagtattcagtgagggttag

SEQ ID NO: 817792 - DNA, 22 bp, Artificial Sequence
  chemically synthesized
gactgagtgctaaccctcactg

SEQ ID NO: 817793 - DNA, 22 bp, Artificial Sequence
  chemically synthesized
actgagtgctaaccctcactga

SEQ ID NO: 817794 - DNA, 22 bp, Artificial Sequence
  chemically synthesized
agtgctaaccctcactgaatac

SEQ ID NO: 817795 - DNA, 22 bp, Artificial Sequence
  chemically synthesized
acaaaacctgggcagtattcag

SEQ ID NO: 817796 - DNA, 22 bp, Artificial Sequence
  chemically synthesized
accctcactgaatactgcccag

SEQ ID NO: 817797 - DNA, 22 bp, Artificial Sequence
  chemically synthesized
catcctcacaaaacctgggcag

SEQ ID NO: 817798 - DNA, 22 bp, Artificial Sequence
  chemically synthesized
actgaatactgcccaggttttg

SEQ ID NO: 817799 - DNA, 22 bp, Artificial Sequence
  chemically synthesized
atcctacatcctcacaaaacct

SEQ ID NO: 817800 - DNA, 22 bp, Artificial Sequence
  chemically synthesized
aatcctacatcctcacaaaacc

SEQ ID NO: 817801 - DNA, 22 bp, Artificial Sequence
  chemically synthesized
aatactgcccaggttttgtgag

SEQ ID NO: 817802 - DNA, 22 bp, Artificial Sequence
  chemically synthesized
taatcctacatcctcacaaaac

SEQ ID NO: 817803 - DNA, 22 bp, Artificial Sequence
  chemically synthesized
ttaatcctacatcctcacaaaa

SEQ ID NO: 817804 - DNA, 22 bp, Artificial Sequence
  chemically synthesized
tttaatcctacatcctcacaaa

SEQ ID NO: 817805 - DNA, 22 bp, Artificial Sequence
  chemically synthesized
ctttttaatcctacatcctcac

SEQ ID NO: 817806 - DNA, 22 bp, Artificial Sequence
  chemically synthesized
actttttaatcctacatcctca

SEQ ID NO: 817807 - DNA, 22 bp, Artificial Sequence
  chemically synthesized
cccaggttttgtgaggatgtag

SEQ ID NO: 817808 - DNA, 22 bp, Artificial Sequence
  chemically synthesized
tactttttaatcctacatcctc

SEQ ID NO: 817809 - DNA, 22 bp, Artificial Sequence
  chemically synthesized
tgtgaggatgtaggattaaaaa

SEQ ID NO: 817810 - DNA, 22 bp, Artificial Sequence
  chemically synthesized
gtgaggatgtaggattaaaaag

SEQ ID NO: 817811 - DNA, 22 bp, Artificial Sequence
  chemically synthesized
tgaggatgtaggattaaaaagt

SEQ ID NO: 817812 - DNA, 22 bp, Artificial Sequence
  chemically synthesized
aaaagtaaaactcccactgacc

SEQ ID NO: 817813 - DNA, 22 bp, Artificial Sequence
  chemically synthesized
aatgtcagtcaaggtcagtggg

SEQ ID NO: 817814 - DNA, 22 bp, Artificial Sequence
  chemically synthesized
agccccctcaatgtcagtcaag

SEQ ID NO: 817815 - DNA, 22 bp, Artificial Sequence
  chemically synthesized
ccactgaccttgactgacattg

SEQ ID NO: 817816 - DNA, 22 bp, Artificial Sequence
  chemically synthesized
accttgactgacattgaggggg

SEQ ID NO: 817817 - DNA, 22 bp, Artificial Sequence
  chemically synthesized
tataagggcctgagccccctca

SEQ ID NO: 817818 - DNA, 22 bp, Artificial Sequence
  chemically synthesized
atataagggcctgagccccctc

SEQ ID NO: 817819 - DNA, 22 bp, Artificial Sequence
  chemically synthesized
gactgacattgagggggctcag

SEQ ID NO: 817820 - DNA, 22 bp, Artificial Sequence
  chemically synthesized
actgacattgagggggctcagg

SEQ ID NO: 817821 - DNA, 22 bp, Artificial Sequence
  chemically synthesized
tgtttatataagggcctgagcc

SEQ ID NO: 817822 - DNA, 22 bp, Artificial Sequence
  chemically synthesized
gtgtttatataagggcctgagc

SEQ ID NO: 817823 - DNA, 22 bp, Artificial Sequence
  chemically synthesized
acattgagggggctcaggccct

SEQ ID NO: 817824 - DNA, 22 bp, Artificial Sequence
  chemically synthesized
tgtgtttatataagggcctgag

SEQ ID NO: 817825 - DNA, 22 bp, Artificial Sequence
  chemically synthesized
agggggctcaggcccttatata

SEQ ID NO: 817826 - DNA, 22 bp, Artificial Sequence
  chemically synthesized
agaacctttgtgtttatataag

SEQ ID NO: 817827 - DNA, 22 bp, Artificial Sequence
  chemically synthesized
gagaacctttgtgtttatataa

SEQ ID NO: 817828 - DNA, 22 bp, Artificial Sequence
  chemically synthesized
tgagaacctttgtgtttatata

SEQ ID NO: 817829 - DNA, 22 bp, Artificial Sequence
  chemically synthesized
cctttgagaacctttgtgttta

SEQ ID NO: 817830 - DNA, 22 bp, Artificial Sequence
  chemically synthesized
aggcccttatataaacacaaag

SEQ ID NO: 817831 - DNA, 22 bp, Artificial Sequence
  chemically synthesized
atataaacacaaaggttctcaa

SEQ ID NO: 817832 - DNA, 22 bp, Artificial Sequence
  chemically synthesized
tataaacacaaaggttctcaaa

SEQ ID NO: 817833 - DNA, 22 bp, Artificial Sequence
  chemically synthesized
agaagggagaaaaaaaaaaaag

SEQ ID NO: 817834 - DNA, 22 bp, Artificial Sequence
  chemically synthesized
tcaaaggtagcctttttttttt

SEQ ID NO: 817835 - DNA, 22 bp, Artificial Sequence
  chemically synthesized
aagaagggagaaaaaaaaaaaa

SEQ ID NO: 817836 - DNA, 22 bp, Artificial Sequence
  chemically synthesized
taagaagggagaaaaaaaaaaa

SEQ ID NO: 817837 - DNA, 22 bp, Artificial Sequence
  chemically synthesized
aaaggtagcctttttttttttt

SEQ ID NO: 817838 - DNA, 22 bp, Artificial Sequence
  chemically synthesized
ttttttttttctcccttcttaa

SEQ ID NO: 817839 - DNA, 22 bp, Artificial Sequence
  chemically synthesized
tttttttttctcccttcttaaa

SEQ ID NO: 817840 - DNA, 22 bp, Artificial Sequence
  chemically synthesized
ttttttttctcccttcttaaag

SEQ ID NO: 817841 - DNA, 22 bp, Artificial Sequence
  chemically synthesized
tgtggggaatgtctttaagaag

SEQ ID NO: 817842 - DNA, 22 bp, Artificial Sequence
  chemically synthesized
tttttttctcccttcttaaaga

SEQ ID NO: 817843 - DNA, 22 bp, Artificial Sequence
  chemically synthesized
ttttttctcccttcttaaagac

SEQ ID NO: 817844 - DNA, 22 bp, Artificial Sequence
  chemically synthesized
tgtgtggggaatgtctttaaga

SEQ ID NO: 817845 - DNA, 22 bp, Artificial Sequence
  chemically synthesized
tttttctcccttcttaaagaca

SEQ ID NO: 817846 - DNA, 22 bp, Artificial Sequence
  chemically synthesized
ttttctcccttcttaaagacat

SEQ ID NO: 817847 - DNA, 22 bp, Artificial Sequence
  chemically synthesized
tttctcccttcttaaagacatt

SEQ ID NO: 817848 - DNA, 22 bp, Artificial Sequence
  chemically synthesized
ttctcccttcttaaagacattc

SEQ ID NO: 817849 - DNA, 22 bp, Artificial Sequence
  chemically synthesized
tctcccttcttaaagacattcc

SEQ ID NO: 817850 - DNA, 22 bp, Artificial Sequence
  chemically synthesized
ctcccttcttaaagacattccc

SEQ ID NO: 817851 - DNA, 22 bp, Artificial Sequence
  chemically synthesized
tcccttcttaaagacattcccc

SEQ ID NO: 817852 - DNA, 22 bp, Artificial Sequence
  chemically synthesized
ccttcttaaagacattccccac

SEQ ID NO: 817853 - DNA, 22 bp, Artificial Sequence
  chemically synthesized
cttaaagacattccccacacag

SEQ ID NO: 817854 - DNA, 22 bp, Artificial Sequence
  chemically synthesized
ttaaagacattccccacacaga

SEQ ID NO: 817855 - DNA, 22 bp, Artificial Sequence
  chemically synthesized
aaagacattccccacacagaat

SEQ ID NO: 817856 - DNA, 22 bp, Artificial Sequence
  chemically synthesized
aagacattccccacacagaatg

SEQ ID NO: 817857 - DNA, 22 bp, Artificial Sequence
  chemically synthesized
ccgtaggagaaagggaaaacat

SEQ ID NO: 817858 - DNA, 22 bp, Artificial Sequence
  chemically synthesized
cccacacagaatgttttccctt

SEQ ID NO: 817859 - DNA, 22 bp, Artificial Sequence
  chemically synthesized
tccctttctcctacggtaatat

SEQ ID NO: 817860 - DNA, 22 bp, Artificial Sequence
  chemically synthesized
ccctttctcctacggtaatatt

SEQ ID NO: 817861 - DNA, 22 bp, Artificial Sequence
  chemically synthesized
cctttctcctacggtaatattc

SEQ ID NO: 817862 - DNA, 22 bp, Artificial Sequence
  chemically synthesized
tctcctacggtaatattctgcc

SEQ ID NO: 817863 - DNA, 22 bp, Artificial Sequence
  chemically synthesized
ctcctacggtaatattctgccc

SEQ ID NO: 817864 - DNA, 22 bp, Artificial Sequence
  chemically synthesized
tcctacggtaatattctgcccg

SEQ ID NO: 817865 - DNA, 22 bp, Artificial Sequence
  chemically synthesized
ctacggtaatattctgcccgcc

SEQ ID NO: 817866 - DNA, 22 bp, Artificial Sequence
  chemically synthesized
cggtaatattctgcccgcccac

SEQ ID NO: 817867 - DNA, 22 bp, Artificial Sequence
  chemically synthesized
ggtaaaacccaaggtgggcggg

SEQ ID NO: 817868 - DNA, 22 bp, Artificial Sequence
  chemically synthesized
gggtaaaacccaaggtgggcgg

SEQ ID NO: 817869 - DNA, 22 bp, Artificial Sequence
  chemically synthesized
tgcccgcccaccttgggtttta

SEQ ID NO: 817870 - DNA, 22 bp, Artificial Sequence
  chemically synthesized
cccgcccaccttgggttttacc

SEQ ID NO: 817871 - DNA, 22 bp, Artificial Sequence
  chemically synthesized
gtgtgaatgacacttgggtaaa

SEQ ID NO: 817872 - DNA, 22 bp, Artificial Sequence
  chemically synthesized
ctagtgtgaatgacacttgggt

SEQ ID NO: 817873 - DNA, 22 bp, Artificial Sequence
  chemically synthesized
gggttttacccaagtgtcattc

SEQ ID NO: 817874 - DNA, 22 bp, Artificial Sequence
  chemically synthesized
ggttttacccaagtgtcattca

SEQ ID NO: 817875 - DNA, 22 bp, Artificial Sequence
  chemically synthesized
tacccaagtgtcattcacacta

SEQ ID NO: 817876 - DNA, 22 bp, Artificial Sequence
  chemically synthesized
acccaagtgtcattcacactag

SEQ ID NO: 817877 - DNA, 22 bp, Artificial Sequence
  chemically synthesized
cccaagtgtcattcacactagg

SEQ ID NO: 817878 - DNA, 22 bp, Artificial Sequence
  chemically synthesized
gtcaaggtcatggttcctagtg

SEQ ID NO: 817879 - DNA, 22 bp, Artificial Sequence
  chemically synthesized
acactaggaaccatgaccttga

SEQ ID NO: 817880 - DNA, 22 bp, Artificial Sequence
  chemically synthesized
ggaaccatgaccttgaccagct

SEQ ID NO: 817881 - DNA, 22 bp, Artificial Sequence
  chemically synthesized
acagcagtaggcaaagctggtc

SEQ ID NO: 817882 - DNA, 22 bp, Artificial Sequence
  chemically synthesized
cacagcagtaggcaaagctggt

SEQ ID NO: 817883 - DNA, 22 bp, Artificial Sequence
  chemically synthesized
gaccagctttgcctactgctgt

SEQ ID NO: 817884 - DNA, 22 bp, Artificial Sequence
  chemically synthesized
accagctttgcctactgctgtg

SEQ ID NO: 817885 - DNA, 22 bp, Artificial Sequence
  chemically synthesized
tcccagtagtaaatttcacagc

SEQ ID NO: 817886 - DNA, 22 bp, Artificial Sequence
  chemically synthesized
tgcctactgctgtgaaatttac

SEQ ID NO: 817887 - DNA, 22 bp, Artificial Sequence
  chemically synthesized
gcctactgctgtgaaatttact

SEQ ID NO: 817888 - DNA, 22 bp, Artificial Sequence
  chemically synthesized
cctactgctgtgaaatttacta

SEQ ID NO: 817889 - DNA, 22 bp, Artificial Sequence
  chemically synthesized
gagttatcccagtagtaaattt

SEQ ID NO: 817890 - DNA, 22 bp, Artificial Sequence
  chemically synthesized
ctgctgtgaaatttactactgg

SEQ ID NO: 817891 - DNA, 22 bp, Artificial Sequence
  chemically synthesized
ctgtgaaatttactactgggat

SEQ ID NO: 817892 - DNA, 22 bp, Artificial Sequence
  chemically synthesized
aggtctggagttatcccagtag

SEQ ID NO: 817893 - DNA, 22 bp, Artificial Sequence
  chemically synthesized
tgaggtctggagttatcccagt

SEQ ID NO: 817894 - DNA, 22 bp, Artificial Sequence
  chemically synthesized
tgaaatttactactgggataac

SEQ ID NO: 817895 - DNA, 22 bp, Artificial Sequence
  chemically synthesized
ctgaggtctggagttatcccag

SEQ ID NO: 817896 - DNA, 22 bp, Artificial Sequence
  chemically synthesized
cttctgaggtctggagttatcc

SEQ ID NO: 817897 - DNA, 22 bp, Artificial Sequence
  chemically synthesized
actactgggataactccagacc

SEQ ID NO: 817898 - DNA, 22 bp, Artificial Sequence
  chemically synthesized
cactccttctgaggtctggagt

SEQ ID NO: 817899 - DNA, 22 bp, Artificial Sequence
  chemically synthesized
ctactgggataactccagacct

SEQ ID NO: 817900 - DNA, 22 bp, Artificial Sequence
  chemically synthesized
acactccttctgaggtctggag

SEQ ID NO: 817901 - DNA, 22 bp, Artificial Sequence
  chemically synthesized
ctgggataactccagacctcag

SEQ ID NO: 817902 - DNA, 22 bp, Artificial Sequence
  chemically synthesized
aatttacactccttctgaggtc

SEQ ID NO: 817903 - DNA, 22 bp, Artificial Sequence
  chemically synthesized
ggataactccagacctcagaag

SEQ ID NO: 817904 - DNA, 22 bp, Artificial Sequence
  chemically synthesized
gaatttacactccttctgaggt

SEQ ID NO: 817905 - DNA, 22 bp, Artificial Sequence
  chemically synthesized
tgaatttacactccttctgagg

SEQ ID NO: 817906 - DNA, 22 bp, Artificial Sequence
  chemically synthesized
ttgaatttacactccttctgag

SEQ ID NO: 817907 - DNA, 22 bp, Artificial Sequence
  chemically synthesized
tatttttgaatttacactcctt

SEQ ID NO: 817908 - DNA, 22 bp, Artificial Sequence
  chemically synthesized
cagacctcagaaggagtgtaaa

SEQ ID NO: 817909 - DNA, 22 bp, Artificial Sequence
  chemically synthesized
ttgtatttttgaatttacactc

SEQ ID NO: 817910 - DNA, 22 bp, Artificial Sequence
  chemically synthesized
agaaggagtgtaaattcaaaaa

SEQ ID NO: 817911 - DNA, 22 bp, Artificial Sequence
  chemically synthesized
aaaaatacaacagacttcacac

SEQ ID NO: 817912 - DNA, 22 bp, Artificial Sequence
  chemically synthesized
agaaagagaaaagggtgtgtgt

SEQ ID NO: 817913 - DNA, 22 bp, Artificial Sequence
  chemically synthesized
cacacacacccttttctctttc

SEQ ID NO: 817914 - DNA, 22 bp, Artificial Sequence
  chemically synthesized
acacacacccttttctctttct

SEQ ID NO: 817915 - DNA, 22 bp, Artificial Sequence
  chemically synthesized
tcaatggaattcagaaagagaa

SEQ ID NO: 817916 - DNA, 22 bp, Artificial Sequence
  chemically synthesized
ttctctttctgaattccattga

SEQ ID NO: 817917 - DNA, 22 bp, Artificial Sequence
  chemically synthesized
tctctttctgaattccattgac

SEQ ID NO: 817918 - DNA, 22 bp, Artificial Sequence
  chemically synthesized
ctctttctgaattccattgaca

SEQ ID NO: 817919 - DNA, 22 bp, Artificial Sequence
  chemically synthesized
tctttctgaattccattgacaa

SEQ ID NO: 817920 - DNA, 22 bp, Artificial Sequence
  chemically synthesized
tggtgtacaccattgtcaatgg

SEQ ID NO: 817921 - DNA, 22 bp, Artificial Sequence
  chemically synthesized
tttctgaattccattgacaatg

SEQ ID NO: 817922 - DNA, 22 bp, Artificial Sequence
  chemically synthesized
tctgaattccattgacaatggt

SEQ ID NO: 817923 - DNA, 22 bp, Artificial Sequence
  chemically synthesized
cctgtggtgtacaccattgtca

SEQ ID NO: 817924 - DNA, 22 bp, Artificial Sequence
  chemically synthesized
ctgaattccattgacaatggtg

SEQ ID NO: 817925 - DNA, 22 bp, Artificial Sequence
  chemically synthesized
tgaattccattgacaatggtgt

SEQ ID NO: 817926 - DNA, 22 bp, Artificial Sequence
  chemically synthesized
aattccattgacaatggtgtac

SEQ ID NO: 817927 - DNA, 22 bp, Artificial Sequence
  chemically synthesized
cattgacaatggtgtacaccac

SEQ ID NO: 817928 - DNA, 22 bp, Artificial Sequence
  chemically synthesized
acaatggtgtacaccacaggga

SEQ ID NO: 817929 - DNA, 22 bp, Artificial Sequence
  chemically synthesized
acacaccatgatcaccacacaa

SEQ ID NO: 817930 - DNA, 22 bp, Artificial Sequence
  chemically synthesized
cacacaccatgatcaccacaca

SEQ ID NO: 817931 - DNA, 22 bp, Artificial Sequence
  chemically synthesized
ttcacacaccatgatcaccaca

SEQ ID NO: 817932 - DNA, 22 bp, Artificial Sequence
  chemically synthesized
cttcacacaccatgatcaccac

SEQ ID NO: 817933 - DNA, 22 bp, Artificial Sequence
  chemically synthesized
aatttcttcacacaccatgatc

SEQ ID NO: 817934 - DNA, 22 bp, Artificial Sequence
  chemically synthesized
aaatttcttcacacaccatgat

SEQ ID NO: 817935 - DNA, 22 bp, Artificial Sequence
  chemically synthesized
cttgtgtggtgatcatggtgtg

SEQ ID NO: 817936 - DNA, 22 bp, Artificial Sequence
  chemically synthesized
taaatttcttcacacaccatga

SEQ ID NO: 817937 - DNA, 22 bp, Artificial Sequence
  chemically synthesized
gtgtggtgatcatggtgtgtga

SEQ ID NO: 817938 - DNA, 22 bp, Artificial Sequence
  chemically synthesized
tgtggtgatcatggtgtgtgaa

SEQ ID NO: 817939 - DNA, 22 bp, Artificial Sequence
  chemically synthesized
acagtattttaaatttcttcac

SEQ ID NO: 817940 - DNA, 22 bp, Artificial Sequence
  chemically synthesized
gtgctcacagtattttaaattt

SEQ ID NO: 817941 - DNA, 22 bp, Artificial Sequence
  chemically synthesized
taagctagtgctcacagtattt

SEQ ID NO: 817942 - DNA, 22 bp, Artificial Sequence
  chemically synthesized
ataagctagtgctcacagtatt

SEQ ID NO: 817943 - DNA, 22 bp, Artificial Sequence
  chemically synthesized
tataagctagtgctcacagtat

SEQ ID NO: 817944 - DNA, 22 bp, Artificial Sequence
  chemically synthesized
ttataagctagtgctcacagta

SEQ ID NO: 817945 - DNA, 22 bp, Artificial Sequence
  chemically synthesized
tttataagctagtgctcacagt

SEQ ID NO: 817946 - DNA, 22 bp, Artificial Sequence
  chemically synthesized
ttttataagctagtgctcacag

SEQ ID NO: 817947 - DNA, 22 bp, Artificial Sequence
  chemically synthesized
tttttataagctagtgctcaca

SEQ ID NO: 817948 - DNA, 22 bp, Artificial Sequence
  chemically synthesized
aaaatactgtgagcactagctt

SEQ ID NO: 817949 - DNA, 22 bp, Artificial Sequence
  chemically synthesized
aaatactgtgagcactagctta

SEQ ID NO: 817950 - DNA, 22 bp, Artificial Sequence
  chemically synthesized
tgagcactagcttataaaaaaa

SEQ ID NO: 817951 - DNA, 22 bp, Artificial Sequence
  chemically synthesized
gcttataaaaaaagattgcctt

SEQ ID NO: 817952 - DNA, 22 bp, Artificial Sequence
  chemically synthesized
ataaaaaaagattgcctttgta

SEQ ID NO: 817953 - DNA, 22 bp, Artificial Sequence
  chemically synthesized
taaaaaaagattgcctttgtat

SEQ ID NO: 817954 - DNA, 22 bp, Artificial Sequence
  chemically synthesized
cctttgtatatgtgtgtgtgtg

SEQ ID NO: 817955 - DNA, 22 bp, Artificial Sequence
  chemically synthesized
tgtatatgtgtgtgtgtgtatg

SEQ ID NO: 817956 - DNA, 22 bp, Artificial Sequence
  chemically synthesized
gtatatgtgtgtgtgtgtatgt

SEQ ID NO: 817957 - DNA, 22 bp, Artificial Sequence
  chemically synthesized
tatatgtgtgtgtgtgtatgtg

SEQ ID NO: 817958 - DNA, 22 bp, Artificial Sequence
  chemically synthesized
atagaaaacacacacacataca

SEQ ID NO: 817959 - DNA, 22 bp, Artificial Sequence
  chemically synthesized
catagaaaacacacacacatac

SEQ ID NO: 817960 - DNA, 22 bp, Artificial Sequence
  chemically synthesized
ttcatagaaaacacacacacat

SEQ ID NO: 817961 - DNA, 22 bp, Artificial Sequence
  chemically synthesized
tattcttcatagaaaacacaca

SEQ ID NO: 817962 - DNA, 22 bp, Artificial Sequence
  chemically synthesized
atattcttcatagaaaacacac

SEQ ID NO: 817963 - DNA, 22 bp, Artificial Sequence
  chemically synthesized
tatattcttcatagaaaacaca

SEQ ID NO: 817964 - DNA, 22 bp, Artificial Sequence
  chemically synthesized
gcattttatattcttcatagaa

SEQ ID NO: 817965 - DNA, 22 bp, Artificial Sequence
  chemically synthesized
agcattttatattcttcataga

SEQ ID NO: 817966 - DNA, 22 bp, Artificial Sequence
  chemically synthesized
gggatttagcattttatattct

SEQ ID NO: 817967 - DNA, 22 bp, Artificial Sequence
  chemically synthesized
ggggatttagcattttatattc

SEQ ID NO: 817968 - DNA, 22 bp, Artificial Sequence
  chemically synthesized
tggggatttagcattttatatt

SEQ ID NO: 817969 - DNA, 22 bp, Artificial Sequence
  chemically synthesized
ttggggatttagcattttatat

SEQ ID NO: 817970 - DNA, 22 bp, Artificial Sequence
  chemically synthesized
tctatgaagaatataaaatgct

SEQ ID NO: 817971 - DNA, 22 bp, Artificial Sequence
  chemically synthesized
ctatgaagaatataaaatgcta

SEQ ID NO: 817972 - DNA, 22 bp, Artificial Sequence
  chemically synthesized
tatgaagaatataaaatgctaa

SEQ ID NO: 817973 - DNA, 22 bp, Artificial Sequence
  chemically synthesized
tgaagaatataaaatgctaaat

SEQ ID NO: 817974 - DNA, 22 bp, Artificial Sequence
  chemically synthesized
gggaaacaatcttttggggatt

SEQ ID NO: 817975 - DNA, 22 bp, Artificial Sequence
  chemically synthesized
gttggggaaacaatcttttggg

SEQ ID NO: 817976 - DNA, 22 bp, Artificial Sequence
  chemically synthesized
ctggttggggaaacaatctttt

SEQ ID NO: 817977 - DNA, 22 bp, Artificial Sequence
  chemically synthesized
cctggttggggaaacaatcttt

SEQ ID NO: 817978 - DNA, 22 bp, Artificial Sequence
  chemically synthesized
tcctggttggggaaacaatctt

SEQ ID NO: 817979 - DNA, 22 bp, Artificial Sequence
  chemically synthesized
tttcctggttggggaaacaatc

SEQ ID NO: 817980 - DNA, 22 bp, Artificial Sequence
  chemically synthesized
aatccccaaaagattgtttccc

SEQ ID NO: 817981 - DNA, 22 bp, Artificial Sequence
  chemically synthesized
ctttcctggttggggaaacaat

SEQ ID NO: 817982 - DNA, 22 bp, Artificial Sequence
  chemically synthesized
aatgtgaaacatttctttcctg

SEQ ID NO: 817983 - DNA, 22 bp, Artificial Sequence
  chemically synthesized
gaatgtgaaacatttctttcct

SEQ ID NO: 817984 - DNA, 22 bp, Artificial Sequence
  chemically synthesized
tttccccaaccaggaaagaaat

SEQ ID NO: 817985 - DNA, 22 bp, Artificial Sequence
  chemically synthesized
ccccaaccaggaaagaaatgtt

SEQ ID NO: 817986 - DNA, 22 bp, Artificial Sequence
  chemically synthesized
cccaaccaggaaagaaatgttt

SEQ ID NO: 817987 - DNA, 22 bp, Artificial Sequence
  chemically synthesized
cacattcaaacccattatgctg

SEQ ID NO: 817988 - DNA, 22 bp, Artificial Sequence
  chemically synthesized
acattcaaacccattatgctgc

SEQ ID NO: 817989 - DNA, 22 bp, Artificial Sequence
  chemically synthesized
aaacccattatgctgctactgc

SEQ ID NO: 817990 - DNA, 22 bp, Artificial Sequence
  chemically synthesized
tgctgctactgcactatgtgct

SEQ ID NO: 817991 - DNA, 22 bp, Artificial Sequence
  chemically synthesized
tgaatatatatcaagcacatag

SEQ ID NO: 817992 - DNA, 22 bp, Artificial Sequence
  chemically synthesized
ctactgcactatgtgcttgata

SEQ ID NO: 817993 - DNA, 22 bp, Artificial Sequence
  chemically synthesized
ctgcactatgtgcttgatatat

SEQ ID NO: 817994 - DNA, 22 bp, Artificial Sequence
  chemically synthesized
agatactgtgaatatatatcaa

SEQ ID NO: 817995 - DNA, 22 bp, Artificial Sequence
  chemically synthesized
cactatgtgcttgatatatatt

SEQ ID NO: 817996 - DNA, 22 bp, Artificial Sequence
  chemically synthesized
cctaagatactgtgaatatata

SEQ ID NO: 817997 - DNA, 22 bp, Artificial Sequence
  chemically synthesized
tacctaagatactgtgaatata

SEQ ID NO: 817998 - DNA, 22 bp, Artificial Sequence
  chemically synthesized
tgtgcttgatatatattcacag

SEQ ID NO: 817999 - DNA, 22 bp, Artificial Sequence
  chemically synthesized
ctacctaagatactgtgaatat

SEQ ID NO: 818000 - DNA, 22 bp, Artificial Sequence
  chemically synthesized
tctacctaagatactgtgaata

SEQ ID NO: 818001 - DNA, 22 bp, Artificial Sequence
  chemically synthesized
ttctacctaagatactgtgaat

SEQ ID NO: 818002 - DNA, 22 bp, Artificial Sequence
  chemically synthesized
tttctacctaagatactgtgaa

SEQ ID NO: 818003 - DNA, 22 bp, Artificial Sequence
  chemically synthesized
gatatatattcacagtatctta

SEQ ID NO: 818004 - DNA, 22 bp, Artificial Sequence
  chemically synthesized
atatatattcacagtatcttag

SEQ ID NO: 818005 - DNA, 22 bp, Artificial Sequence
  chemically synthesized
acagtatcttaggtagaaaaag

SEQ ID NO: 818006 - DNA, 22 bp, Artificial Sequence
  chemically synthesized
atagtccacaatcactttttct

SEQ ID NO: 818007 - DNA, 22 bp, Artificial Sequence
  chemically synthesized
tctcatagtccacaatcacttt

SEQ ID NO: 818008 - DNA, 22 bp, Artificial Sequence
  chemically synthesized
aggtagaaaaagtgattgtgga

SEQ ID NO: 818009 - DNA, 22 bp, Artificial Sequence
  chemically synthesized
ggtagaaaaagtgattgtggac

SEQ ID NO: 818010 - DNA, 22 bp, Artificial Sequence
  chemically synthesized
aggttgtctcatagtccacaat

SEQ ID NO: 818011 - DNA, 22 bp, Artificial Sequence
  chemically synthesized
attcaggttgtctcatagtcca

SEQ ID NO: 818012 - DNA, 22 bp, Artificial Sequence
  chemically synthesized
aaattaattcaggttgtctcat

SEQ ID NO: 818013 - DNA, 22 bp, Artificial Sequence
  chemically synthesized
gaaattaattcaggttgtctca

SEQ ID NO: 818014 - DNA, 22 bp, Artificial Sequence
  chemically synthesized
ttgaaattaattcaggttgtct

SEQ ID NO: 818015 - DNA, 22 bp, Artificial Sequence
  chemically synthesized
tggactatgagacaacctgaat

SEQ ID NO: 818016 - DNA, 22 bp, Artificial Sequence
  chemically synthesized
aaaattcttgaaattaattcag

SEQ ID NO: 818017 - DNA, 22 bp, Artificial Sequence
  chemically synthesized
tgagacaacctgaattaatttc

SEQ ID NO: 818018 - DNA, 22 bp, Artificial Sequence
  chemically synthesized
aattaatttcaagaattttgag

SEQ ID NO: 818019 - DNA, 22 bp, Artificial Sequence
  chemically synthesized
aagtagaaaaaaatactcaaaa

SEQ ID NO: 818020 - DNA, 22 bp, Artificial Sequence
  chemically synthesized
atttcaagaattttgagtattt

SEQ ID NO: 818021 - DNA, 22 bp, Artificial Sequence
  chemically synthesized
caagaattttgagtattttttt

SEQ ID NO: 818022 - DNA, 22 bp, Artificial Sequence
  chemically synthesized
aagaattttgagtatttttttc

SEQ ID NO: 818023 - DNA, 22 bp, Artificial Sequence
  chemically synthesized
tgagtatttttttctactttaa

SEQ ID NO: 818024 - DNA, 22 bp, Artificial Sequence
  chemically synthesized
gagtatttttttctactttaat

SEQ ID NO: 818025 - DNA, 22 bp, Artificial Sequence
  chemically synthesized
agtatttttttctactttaatt

SEQ ID NO: 818026 - DNA, 22 bp, Artificial Sequence
  chemically synthesized
ttttctactttaattgtttgtc

SEQ ID NO: 818027 - DNA, 22 bp, Artificial Sequence
  chemically synthesized
tttctactttaattgtttgtct

SEQ ID NO: 818028 - DNA, 22 bp, Artificial Sequence
  chemically synthesized
ttctactttaattgtttgtctt

SEQ ID NO: 818029 - DNA, 22 bp, Artificial Sequence
  chemically synthesized
tctactttaattgtttgtcttc

SEQ ID NO: 818030 - DNA, 22 bp, Artificial Sequence
  chemically synthesized
ctactttaattgtttgtcttct

SEQ ID NO: 818031 - DNA, 22 bp, Artificial Sequence
  chemically synthesized
tactttaattgtttgtcttctc

SEQ ID NO: 818032 - DNA, 22 bp, Artificial Sequence
  chemically synthesized
ctttaattgtttgtcttctctc

SEQ ID NO: 818033 - DNA, 22 bp, Artificial Sequence
  chemically synthesized
cacataaaagaaatgagagaag

SEQ ID NO: 818034 - DNA, 22 bp, Artificial Sequence
  chemically synthesized
taattgtttgtcttctctcatt

SEQ ID NO: 818035 - DNA, 22 bp, Artificial Sequence
  chemically synthesized
acacataaaagaaatgagagaa

SEQ ID NO: 818036 - DNA, 22 bp, Artificial Sequence
  chemically synthesized
aattgtttgtcttctctcattt

SEQ ID NO: 818037 - DNA, 22 bp, Artificial Sequence
  chemically synthesized
attgtttgtcttctctcatttc

SEQ ID NO: 818038 - DNA, 22 bp, Artificial Sequence
  chemically synthesized
ttacacataaaagaaatgagag

SEQ ID NO: 818039 - DNA, 22 bp, Artificial Sequence
  chemically synthesized
tttgtcttctctcatttctttt

SEQ ID NO: 818040 - DNA, 22 bp, Artificial Sequence
  chemically synthesized
gtcttctctcatttcttttatg

SEQ ID NO: 818041 - DNA, 22 bp, Artificial Sequence
  chemically synthesized
tcttctctcatttcttttatgt

SEQ ID NO: 818042 - DNA, 22 bp, Artificial Sequence
  chemically synthesized
aaataagttcttacacataaaa

SEQ ID NO: 818043 - DNA, 22 bp, Artificial Sequence
  chemically synthesized
ctctcatttcttttatgtgtaa

SEQ ID NO: 818044 - DNA, 22 bp, Artificial Sequence
  chemically synthesized
tctcatttcttttatgtgtaag

SEQ ID NO: 818045 - DNA, 22 bp, Artificial Sequence
  chemically synthesized
tcatttcttttatgtgtaagaa

SEQ ID NO: 818046 - DNA, 22 bp, Artificial Sequence
  chemically synthesized
atttcttttatgtgtaagaact

SEQ ID NO: 818047 - DNA, 22 bp, Artificial Sequence
  chemically synthesized
cttttatgtgtaagaacttatt

SEQ ID NO: 818048 - DNA, 22 bp, Artificial Sequence
  chemically synthesized
ttttatgtgtaagaacttattt

SEQ ID NO: 818049 - DNA, 22 bp, Artificial Sequence
  chemically synthesized
ttatgtgtaagaacttatttta

SEQ ID NO: 818050 - DNA, 22 bp, Artificial Sequence
  chemically synthesized
tatgtgtaagaacttattttag

SEQ ID NO: 818051 - DNA, 22 bp, Artificial Sequence
  chemically synthesized
atgtgtaagaacttattttagt

SEQ ID NO: 818052 - DNA, 22 bp, Artificial Sequence
  chemically synthesized
tgtgtaagaacttattttagtg

SEQ ID NO: 818053 - DNA, 22 bp, Artificial Sequence
  chemically synthesized
ccatgtagggtcaatatcacta

SEQ ID NO: 818054 - DNA, 22 bp, Artificial Sequence
  chemically synthesized
taccatgtagggtcaatatcac

SEQ ID NO: 818055 - DNA, 22 bp, Artificial Sequence
  chemically synthesized
ctaccatgtagggtcaatatca

SEQ ID NO: 818056 - DNA, 22 bp, Artificial Sequence
  chemically synthesized
tctaccatgtagggtcaatatc

SEQ ID NO: 818057 - DNA, 22 bp, Artificial Sequence
  chemically synthesized
ttctaccatgtagggtcaatat

SEQ ID NO: 818058 - DNA, 22 bp, Artificial Sequence
  chemically synthesized
ttttctaccatgtagggtcaat

SEQ ID NO: 818059 - DNA, 22 bp, Artificial Sequence
  chemically synthesized
attttagtgatattgaccctac

SEQ ID NO: 818060 - DNA, 22 bp, Artificial Sequence
  chemically synthesized
ttttagtgatattgaccctaca

SEQ ID NO: 818061 - DNA, 22 bp, Artificial Sequence
  chemically synthesized
tcttttctaccatgtagggtca

SEQ ID NO: 818062 - DNA, 22 bp, Artificial Sequence
  chemically synthesized
tagtgatattgaccctacatgg

SEQ ID NO: 818063 - DNA, 22 bp, Artificial Sequence
  chemically synthesized
ctctcttttctaccatgtaggg

SEQ ID NO: 818064 - DNA, 22 bp, Artificial Sequence
  chemically synthesized
agtgatattgaccctacatggt

SEQ ID NO: 818065 - DNA, 22 bp, Artificial Sequence
  chemically synthesized
gtgatattgaccctacatggta

SEQ ID NO: 818066 - DNA, 22 bp, Artificial Sequence
  chemically synthesized
ctcctctcttttctaccatgta

SEQ ID NO: 818067 - DNA, 22 bp, Artificial Sequence
  chemically synthesized
cctcctctcttttctaccatgt

SEQ ID NO: 818068 - DNA, 22 bp, Artificial Sequence
  chemically synthesized
ttcctcctctcttttctaccat

SEQ ID NO: 818069 - DNA, 22 bp, Artificial Sequence
  chemically synthesized
tcttcctcctctcttttctacc

SEQ ID NO: 818070 - DNA, 22 bp, Artificial Sequence
  chemically synthesized
ctcttcctcctctcttttctac

SEQ ID NO: 818071 - DNA, 22 bp, Artificial Sequence
  chemically synthesized
tctcttcctcctctcttttcta

SEQ ID NO: 818072 - DNA, 22 bp, Artificial Sequence
  chemically synthesized
accctacatggtagaaaagaga

SEQ ID NO: 818073 - DNA, 22 bp, Artificial Sequence
  chemically synthesized
tttctcttcctcctctcttttc

SEQ ID NO: 818074 - DNA, 22 bp, Artificial Sequence
  chemically synthesized
ctctttctcttcctcctctctt

SEQ ID NO: 818075 - DNA, 22 bp, Artificial Sequence
  chemically synthesized
catggtagaaaagagaggagga

SEQ ID NO: 818076 - DNA, 22 bp, Artificial Sequence
  chemically synthesized
gctactctttctcttcctcctc

SEQ ID NO: 818077 - DNA, 22 bp, Artificial Sequence
  chemically synthesized
agctactctttctcttcctcct

SEQ ID NO: 818078 - DNA, 22 bp, Artificial Sequence
  chemically synthesized
tagctactctttctcttcctcc

SEQ ID NO: 818079 - DNA, 22 bp, Artificial Sequence
  chemically synthesized
ttagctactctttctcttcctc

SEQ ID NO: 818080 - DNA, 22 bp, Artificial Sequence
  chemically synthesized
aggcttttagctactctttctc

SEQ ID NO: 818081 - DNA, 22 bp, Artificial Sequence
  chemically synthesized
ctcaggcttttagctactcttt

SEQ ID NO: 818082 - DNA, 22 bp, Artificial Sequence
  chemically synthesized
tattgctcaggcttttagctac

SEQ ID NO: 818083 - DNA, 22 bp, Artificial Sequence
  chemically synthesized
attgtattgctcaggcttttag

SEQ ID NO: 818084 - DNA, 22 bp, Artificial Sequence
  chemically synthesized
aaagcctgagcaatacaatgag

SEQ ID NO: 818085 - DNA, 22 bp, Artificial Sequence
  chemically synthesized
aaacccagcaggctcattgtat

SEQ ID NO: 818086 - DNA, 22 bp, Artificial Sequence
  chemically synthesized
agcaatacaatgagcctgctgg

SEQ ID NO: 818087 - DNA, 22 bp, Artificial Sequence
  chemically synthesized
agcgatcacgccaggattcaaa

SEQ ID NO: 818088 - DNA, 22 bp, Artificial Sequence
  chemically synthesized
ccactaagcgatcacgccagga

SEQ ID NO: 818089 - DNA, 22 bp, Artificial Sequence
  chemically synthesized
ctgggtttgaatcctggcgtga

SEQ ID NO: 818090 - DNA, 22 bp, Artificial Sequence
  chemically synthesized
gccactaagcgatcacgccagg

SEQ ID NO: 818091 - DNA, 22 bp, Artificial Sequence
  chemically synthesized
ggtttgaatcctggcgtgatcg

SEQ ID NO: 818092 - DNA, 22 bp, Artificial Sequence
  chemically synthesized
ccatttgccactaagcgatcac

SEQ ID NO: 818093 - DNA, 22 bp, Artificial Sequence
  chemically synthesized
gaatcctggcgtgatcgcttag

SEQ ID NO: 818094 - DNA, 22 bp, Artificial Sequence
  chemically synthesized
tcccatttgccactaagcgatc

SEQ ID NO: 818095 - DNA, 22 bp, Artificial Sequence
  chemically synthesized
aatcctggcgtgatcgcttagt

SEQ ID NO: 818096 - DNA, 22 bp, Artificial Sequence
  chemically synthesized
actctcccatttgccactaagc

SEQ ID NO: 818097 - DNA, 22 bp, Artificial Sequence
  chemically synthesized
gcgtgatcgcttagtggcaaat

SEQ ID NO: 818098 - DNA, 22 bp, Artificial Sequence
  chemically synthesized
agtggcaaatgggagagttaat

SEQ ID NO: 818099 - DNA, 22 bp, Artificial Sequence
  chemically synthesized
gtggcaaatgggagagttaatt

SEQ ID NO: 818100 - DNA, 22 bp, Artificial Sequence
  chemically synthesized
aggcacagaaaagataattaac

SEQ ID NO: 818101 - DNA, 22 bp, Artificial Sequence
  chemically synthesized
attatcttttctgtgcctcagt

SEQ ID NO: 818102 - DNA, 22 bp, Artificial Sequence
  chemically synthesized
gcaaaggaggaaactgaggcac

SEQ ID NO: 818103 - DNA, 22 bp, Artificial Sequence
  chemically synthesized
agcaaaggaggaaactgaggca

SEQ ID NO: 818104 - DNA, 22 bp, Artificial Sequence
  chemically synthesized
tcttttctgtgcctcagtttcc

SEQ ID NO: 818105 - DNA, 22 bp, Artificial Sequence
  chemically synthesized
ccatttagcaaaggaggaaact

SEQ ID NO: 818106 - DNA, 22 bp, Artificial Sequence
  chemically synthesized
ttctgtgcctcagtttcctcct

SEQ ID NO: 818107 - DNA, 22 bp, Artificial Sequence
  chemically synthesized
tctgtgcctcagtttcctcctt

SEQ ID NO: 818108 - DNA, 22 bp, Artificial Sequence
  chemically synthesized
ctgtgcctcagtttcctccttt

SEQ ID NO: 818109 - DNA, 22 bp, Artificial Sequence
  chemically synthesized
tgtgcctcagtttcctcctttg

SEQ ID NO: 818110 - DNA, 22 bp, Artificial Sequence
  chemically synthesized
tgcctcagtttcctcctttgct

SEQ ID NO: 818111 - DNA, 22 bp, Artificial Sequence
  chemically synthesized
atattcccatttagcaaaggag

SEQ ID NO: 818112 - DNA, 22 bp, Artificial Sequence
  chemically synthesized
ttaatattcccatttagcaaag

SEQ ID NO: 818113 - DNA, 22 bp, Artificial Sequence
  chemically synthesized
agtttcctcctttgctaaatgg

SEQ ID NO: 818114 - DNA, 22 bp, Artificial Sequence
  chemically synthesized
cctcctttgctaaatgggaata

SEQ ID NO: 818115 - DNA, 22 bp, Artificial Sequence
  chemically synthesized
ctcctttgctaaatgggaatat

SEQ ID NO: 818116 - DNA, 22 bp, Artificial Sequence
  chemically synthesized
ctttgctaaatgggaatattaa

SEQ ID NO: 818117 - DNA, 22 bp, Artificial Sequence
  chemically synthesized
cacataaatactgttaatattc

SEQ ID NO: 818118 - DNA, 22 bp, Artificial Sequence
  chemically synthesized
ccacataaatactgttaatatt

SEQ ID NO: 818119 - DNA, 22 bp, Artificial Sequence
  chemically synthesized
tgctaaatgggaatattaacag

SEQ ID NO: 818120 - DNA, 22 bp, Artificial Sequence
  chemically synthesized
gctaaatgggaatattaacagt

SEQ ID NO: 818121 - DNA, 22 bp, Artificial Sequence
  chemically synthesized
ctaaatgggaatattaacagta

SEQ ID NO: 818122 - DNA, 22 bp, Artificial Sequence
  chemically synthesized
aatgggaatattaacagtattt

SEQ ID NO: 818123 - DNA, 22 bp, Artificial Sequence
  chemically synthesized
atcatatttccacataaatact

SEQ ID NO: 818124 - DNA, 22 bp, Artificial Sequence
  chemically synthesized
acccacctaatcatatttccac

SEQ ID NO: 818125 - DNA, 22 bp, Artificial Sequence
  chemically synthesized
acagtatttatgtggaaatatg

SEQ ID NO: 818126 - DNA, 22 bp, Artificial Sequence
  chemically synthesized
agttaacccacctaatcatatt

SEQ ID NO: 818127 - DNA, 22 bp, Artificial Sequence
  chemically synthesized
taagttaacccacctaatcata

SEQ ID NO: 818128 - DNA, 22 bp, Artificial Sequence
  chemically synthesized
tctaagttaacccacctaatca

SEQ ID NO: 818129 - DNA, 22 bp, Artificial Sequence
  chemically synthesized
atgtggaaatatgattaggtgg

SEQ ID NO: 818130 - DNA, 22 bp, Artificial Sequence
  chemically synthesized
tgtggaaatatgattaggtggg

SEQ ID NO: 818131 - DNA, 22 bp, Artificial Sequence
  chemically synthesized
aattctctaagttaacccacct

SEQ ID NO: 818132 - DNA, 22 bp, Artificial Sequence
  chemically synthesized
cctgaattctctaagttaaccc

SEQ ID NO: 818133 - DNA, 22 bp, Artificial Sequence
  chemically synthesized
tccctgaattctctaagttaac

SEQ ID NO: 818134 - DNA, 22 bp, Artificial Sequence
  chemically synthesized
ggtgggttaacttagagaattc

SEQ ID NO: 818135 - DNA, 22 bp, Artificial Sequence
  chemically synthesized
taaatgttctccctgaattctc

SEQ ID NO: 818136 - DNA, 22 bp, Artificial Sequence
  chemically synthesized
gtaaatgttctccctgaattct

SEQ ID NO: 818137 - DNA, 22 bp, Artificial Sequence
  chemically synthesized
tgtaaatgttctccctgaattc

SEQ ID NO: 818138 - DNA, 22 bp, Artificial Sequence
  chemically synthesized
acttagagaattcagggagaac

SEQ ID NO: 818139 - DNA, 22 bp, Artificial Sequence
  chemically synthesized
agagaattcagggagaacattt

SEQ ID NO: 818140 - DNA, 22 bp, Artificial Sequence
  chemically synthesized
gagaattcagggagaacattta

SEQ ID NO: 818141 - DNA, 22 bp, Artificial Sequence
  chemically synthesized
agggagaacatttacaaaggtg

SEQ ID NO: 818142 - DNA, 22 bp, Artificial Sequence
  chemically synthesized
gggcacgccaggcacctttgta

SEQ ID NO: 818143 - DNA, 22 bp, Artificial Sequence
  chemically synthesized
cgggcacgccaggcacctttgt

SEQ ID NO: 818144 - DNA, 22 bp, Artificial Sequence
  chemically synthesized
atccttcgggcacgccaggcac

SEQ ID NO: 818145 - DNA, 22 bp, Artificial Sequence
  chemically synthesized
aatccttcgggcacgccaggca

SEQ ID NO: 818146 - DNA, 22 bp, Artificial Sequence
  chemically synthesized
tttaatccttcgggcacgccag

SEQ ID NO: 818147 - DNA, 22 bp, Artificial Sequence
  chemically synthesized
atttaatccttcgggcacgcca

SEQ ID NO: 818148 - DNA, 22 bp, Artificial Sequence
  chemically synthesized
acaaaggtgcctggcgtgcccg

SEQ ID NO: 818149 - DNA, 22 bp, Artificial Sequence
  chemically synthesized
caaaggtgcctggcgtgcccga

SEQ ID NO: 818150 - DNA, 22 bp, Artificial Sequence
  chemically synthesized
atatttatttaatccttcgggc

SEQ ID NO: 818151 - DNA, 22 bp, Artificial Sequence
  chemically synthesized
gcgtgcccgaaggattaaataa

SEQ ID NO: 818152 - DNA, 22 bp, Artificial Sequence
  chemically synthesized
atgatgattaatatttatttaa

SEQ ID NO: 818153 - DNA, 22 bp, Artificial Sequence
  chemically synthesized
atgctgatgatgattaatattt

SEQ ID NO: 818154 - DNA, 22 bp, Artificial Sequence
  chemically synthesized
aataaatattaatcatcatcag

SEQ ID NO: 818155 - DNA, 22 bp, Artificial Sequence
  chemically synthesized
atcatcatcagcatcagcatca

SEQ ID NO: 818156 - DNA, 22 bp, Artificial Sequence
  chemically synthesized
gcagtagtaatgatgatgatga

SEQ ID NO: 818157 - DNA, 22 bp, Artificial Sequence
  chemically synthesized
gtagtagatgtgctagcagtag

SEQ ID NO: 818158 - DNA, 22 bp, Artificial Sequence
  chemically synthesized
aaattagtagtagatgtgctag

SEQ ID NO: 818159 - DNA, 22 bp, Artificial Sequence
  chemically synthesized
attaaaattagtagtagatgtg

SEQ ID NO: 818160 - DNA, 22 bp, Artificial Sequence
  chemically synthesized
ctactgctagcacatctactac

SEQ ID NO: 818161 - DNA, 22 bp, Artificial Sequence
  chemically synthesized
actcattaaaattagtagtaga

SEQ ID NO: 818162 - DNA, 22 bp, Artificial Sequence
  chemically synthesized
ctgctagcacatctactactaa

SEQ ID NO: 818163 - DNA, 22 bp, Artificial Sequence
  chemically synthesized
gactcattaaaattagtagtag

SEQ ID NO: 818164 - DNA, 22 bp, Artificial Sequence
  chemically synthesized
ctagcacatctactactaattt

SEQ ID NO: 818165 - DNA, 22 bp, Artificial Sequence
  chemically synthesized
gcacatctactactaattttaa

SEQ ID NO: 818166 - DNA, 22 bp, Artificial Sequence
  chemically synthesized
ctactaattttaatgagtcaaa

SEQ ID NO: 818167 - DNA, 22 bp, Artificial Sequence
  chemically synthesized
tggggaatatagtttgactcat

SEQ ID NO: 818168 - DNA, 22 bp, Artificial Sequence
  chemically synthesized
ctaattttaatgagtcaaacta

SEQ ID NO: 818169 - DNA, 22 bp, Artificial Sequence
  chemically synthesized
attttaatgagtcaaactatat

SEQ ID NO: 818170 - DNA, 22 bp, Artificial Sequence
  chemically synthesized
acactgtggggaatatagtttg

SEQ ID NO: 818171 - DNA, 22 bp, Artificial Sequence
  chemically synthesized
taatgagtcaaactatattccc

SEQ ID NO: 818172 - DNA, 22 bp, Artificial Sequence
  chemically synthesized
aatgagtcaaactatattcccc

SEQ ID NO: 818173 - DNA, 22 bp, Artificial Sequence
  chemically synthesized
atgagtcaaactatattcccca

SEQ ID NO: 818174 - DNA, 22 bp, Artificial Sequence
  chemically synthesized
agaaggggctcacactgtgggg

SEQ ID NO: 818175 - DNA, 22 bp, Artificial Sequence
  chemically synthesized
cattcagaaggggctcacactg

SEQ ID NO: 818176 - DNA, 22 bp, Artificial Sequence
  chemically synthesized
gcattcagaaggggctcacact

SEQ ID NO: 818177 - DNA, 22 bp, Artificial Sequence
  chemically synthesized
tgcattcagaaggggctcacac

SEQ ID NO: 818178 - DNA, 22 bp, Artificial Sequence
  chemically synthesized
tattccccacagtgtgagcccc

SEQ ID NO: 818179 - DNA, 22 bp, Artificial Sequence
  chemically synthesized
ctttgcattcagaaggggctca

SEQ ID NO: 818180 - DNA, 22 bp, Artificial Sequence
  chemically synthesized
gctttgcattcagaaggggctc

SEQ ID NO: 818181 - DNA, 22 bp, Artificial Sequence
  chemically synthesized
cccacagtgtgagccccttctg

SEQ ID NO: 818182 - DNA, 22 bp, Artificial Sequence
  chemically synthesized
cttgctttgcattcagaagggg

SEQ ID NO: 818183 - DNA, 22 bp, Artificial Sequence
  chemically synthesized
ctgaatgcaaagcaagtagctc

SEQ ID NO: 818184 - DNA, 22 bp, Artificial Sequence
  chemically synthesized
tgaatgcaaagcaagtagctcg

SEQ ID NO: 818185 - DNA, 22 bp, Artificial Sequence
  chemically synthesized
aatgcaaagcaagtagctcgct

SEQ ID NO: 818186 - DNA, 22 bp, Artificial Sequence
  chemically synthesized
gacaatgtccataaaacagcga

SEQ ID NO: 818187 - DNA, 22 bp, Artificial Sequence
  chemically synthesized
tagacaatgtccataaaacagc

SEQ ID NO: 818188 - DNA, 22 bp, Artificial Sequence
  chemically synthesized
ctagacaatgtccataaaacag

SEQ ID NO: 818189 - DNA, 22 bp, Artificial Sequence
  chemically synthesized
cagcatttctagacaatgtcca

SEQ ID NO: 818190 - DNA, 22 bp, Artificial Sequence
  chemically synthesized
gctgttttatggacattgtcta

SEQ ID NO: 818191 - DNA, 22 bp, Artificial Sequence
  chemically synthesized
gagttgcagcatttctagacaa

SEQ ID NO: 818192 - DNA, 22 bp, Artificial Sequence
  chemically synthesized
ttttatggacattgtctagaaa

SEQ ID NO: 818193 - DNA, 22 bp, Artificial Sequence
  chemically synthesized
agagttgcagcatttctagaca

SEQ ID NO: 818194 - DNA, 22 bp, Artificial Sequence
  chemically synthesized
tagagttgcagcatttctagac

SEQ ID NO: 818195 - DNA, 22 bp, Artificial Sequence
  chemically synthesized
tatggacattgtctagaaatgc

SEQ ID NO: 818196 - DNA, 22 bp, Artificial Sequence
  chemically synthesized
atggacattgtctagaaatgct

SEQ ID NO: 818197 - DNA, 22 bp, Artificial Sequence
  chemically synthesized
tggacattgtctagaaatgctg

SEQ ID NO: 818198 - DNA, 22 bp, Artificial Sequence
  chemically synthesized
aagggagaattttagagttgca

SEQ ID NO: 818199 - DNA, 22 bp, Artificial Sequence
  chemically synthesized
tctagaaatgctgcaactctaa

SEQ ID NO: 818200 - DNA, 22 bp, Artificial Sequence
  chemically synthesized
gaaatgctgcaactctaaaatt

SEQ ID NO: 818201 - DNA, 22 bp, Artificial Sequence
  chemically synthesized
caagttaaagggagaattttag

SEQ ID NO: 818202 - DNA, 22 bp, Artificial Sequence
  chemically synthesized
ccaagttaaagggagaatttta

SEQ ID NO: 818203 - DNA, 22 bp, Artificial Sequence
  chemically synthesized
tcttccaagttaaagggagaat

SEQ ID NO: 818204 - DNA, 22 bp, Artificial Sequence
  chemically synthesized
atcttccaagttaaagggagaa

SEQ ID NO: 818205 - DNA, 22 bp, Artificial Sequence
  chemically synthesized
caactctaaaattctcccttta

SEQ ID NO: 818206 - DNA, 22 bp, Artificial Sequence
  chemically synthesized
tatcttccaagttaaagggaga

SEQ ID NO: 818207 - DNA, 22 bp, Artificial Sequence
  chemically synthesized
ttatcttccaagttaaagggag

SEQ ID NO: 818208 - DNA, 22 bp, Artificial Sequence
  chemically synthesized
cttttatcttccaagttaaagg

SEQ ID NO: 818209 - DNA, 22 bp, Artificial Sequence
  chemically synthesized
gcttttatcttccaagttaaag

SEQ ID NO: 818210 - DNA, 22 bp, Artificial Sequence
  chemically synthesized
taaaattctccctttaacttgg

SEQ ID NO: 818211 - DNA, 22 bp, Artificial Sequence
  chemically synthesized
aaattctccctttaacttggaa

SEQ ID NO: 818212 - DNA, 22 bp, Artificial Sequence
  chemically synthesized
tgcacttgcttttatcttccaa

SEQ ID NO: 818213 - DNA, 22 bp, Artificial Sequence
  chemically synthesized
tccctttaacttggaagataaa

SEQ ID NO: 818214 - DNA, 22 bp, Artificial Sequence
  chemically synthesized
cctttaacttggaagataaaag

SEQ ID NO: 818215 - DNA, 22 bp, Artificial Sequence
  chemically synthesized
taacttggaagataaaagcaag

SEQ ID NO: 818216 - DNA, 22 bp, Artificial Sequence
  chemically synthesized
aacttggaagataaaagcaagt

SEQ ID NO: 818217 - DNA, 22 bp, Artificial Sequence
  chemically synthesized
acttggaagataaaagcaagtg

SEQ ID NO: 818218 - DNA, 22 bp, Artificial Sequence
  chemically synthesized
atgatagagctatgcacttgct

SEQ ID NO: 818219 - DNA, 22 bp, Artificial Sequence
  chemically synthesized
aatgatagagctatgcacttgc

SEQ ID NO: 818220 - DNA, 22 bp, Artificial Sequence
  chemically synthesized
ggaagataaaagcaagtgcata

SEQ ID NO: 818221 - DNA, 22 bp, Artificial Sequence
  chemically synthesized
taatgatagagctatgcacttg

SEQ ID NO: 818222 - DNA, 22 bp, Artificial Sequence
  chemically synthesized
gaagataaaagcaagtgcatag

SEQ ID NO: 818223 - DNA, 22 bp, Artificial Sequence
  chemically synthesized
aaattttaatgatagagctatg

SEQ ID NO: 818224 - DNA, 22 bp, Artificial Sequence
  chemically synthesized
aaaattttaatgatagagctat

SEQ ID NO: 818225 - DNA, 22 bp, Artificial Sequence
  chemically synthesized
aaccttaaaattttaatgatag

SEQ ID NO: 818226 - DNA, 22 bp, Artificial Sequence
  chemically synthesized
accaatattcaaccttaaaatt

SEQ ID NO: 818227 - DNA, 22 bp, Artificial Sequence
  chemically synthesized
aaccaatattcaaccttaaaat

SEQ ID NO: 818228 - DNA, 22 bp, Artificial Sequence
  chemically synthesized
tatcattaaaattttaaggttg

SEQ ID NO: 818229 - DNA, 22 bp, Artificial Sequence
  chemically synthesized
tcattaaaattttaaggttgaa

SEQ ID NO: 818230 - DNA, 22 bp, Artificial Sequence
  chemically synthesized
aaattttaaggttgaatattgg

SEQ ID NO: 818231 - DNA, 22 bp, Artificial Sequence
  chemically synthesized
aaaggaaatttaaccaatattc

SEQ ID NO: 818232 - DNA, 22 bp, Artificial Sequence
  chemically synthesized
aaaaggaaatttaaccaatatt

SEQ ID NO: 818233 - DNA, 22 bp, Artificial Sequence
  chemically synthesized
taaaaggaaatttaaccaatat

SEQ ID NO: 818234 - DNA, 22 bp, Artificial Sequence
  chemically synthesized
taaggttgaatattggttaaat

SEQ ID NO: 818235 - DNA, 22 bp, Artificial Sequence
  chemically synthesized
aaggttgaatattggttaaatt

SEQ ID NO: 818236 - DNA, 22 bp, Artificial Sequence
  chemically synthesized
aggttgaatattggttaaattt

SEQ ID NO: 818237 - DNA, 22 bp, Artificial Sequence
  chemically synthesized
aatattggttaaatttcctttt

SEQ ID NO: 818238 - DNA, 22 bp, Artificial Sequence
  chemically synthesized
gttaaatttccttttaaaatgt

SEQ ID NO: 818239 - DNA, 22 bp, Artificial Sequence
  chemically synthesized
aatttccttttaaaatgtgttt

SEQ ID NO: 818240 - DNA, 22 bp, Artificial Sequence
  chemically synthesized
taggtgaatatcacaaaacaca

SEQ ID NO: 818241 - DNA, 22 bp, Artificial Sequence
  chemically synthesized
gtaggtgaatatcacaaaacac

SEQ ID NO: 818242 - DNA, 22 bp, Artificial Sequence
  chemically synthesized
ccttttaaaatgtgttttgtga

SEQ ID NO: 818243 - DNA, 22 bp, Artificial Sequence
  chemically synthesized
cttttaaaatgtgttttgtgat

SEQ ID NO: 818244 - DNA, 22 bp, Artificial Sequence
  chemically synthesized
cttgtaggtgaatatcacaaaa

SEQ ID NO: 818245 - DNA, 22 bp, Artificial Sequence
  chemically synthesized
acttgtaggtgaatatcacaaa

SEQ ID NO: 818246 - DNA, 22 bp, Artificial Sequence
  chemically synthesized
ttaaaatgtgttttgtgatatt

SEQ ID NO: 818247 - DNA, 22 bp, Artificial Sequence
  chemically synthesized
tacttgtaggtgaatatcacaa

SEQ ID NO: 818248 - DNA, 22 bp, Artificial Sequence
  chemically synthesized
taaaatgtgttttgtgatattc

SEQ ID NO: 818249 - DNA, 22 bp, Artificial Sequence
  chemically synthesized
aaaatgtgttttgtgatattca

SEQ ID NO: 818250 - DNA, 22 bp, Artificial Sequence
  chemically synthesized
aaatgtgttttgtgatattcac

SEQ ID NO: 818251 - DNA, 22 bp, Artificial Sequence
  chemically synthesized
ttttacttgtaggtgaatatca

SEQ ID NO: 818252 - DNA, 22 bp, Artificial Sequence
  chemically synthesized
attttacttgtaggtgaatatc

SEQ ID NO: 818253 - DNA, 22 bp, Artificial Sequence
  chemically synthesized
tgtgatattcacctacaagtaa

SEQ ID NO: 818254 - DNA, 22 bp, Artificial Sequence
  chemically synthesized
gtgatattcacctacaagtaaa

SEQ ID NO: 818255 - DNA, 22 bp, Artificial Sequence
  chemically synthesized
tgatattcacctacaagtaaaa

SEQ ID NO: 818256 - DNA, 22 bp, Artificial Sequence
  chemically synthesized
acccggaacaaacatttatttt

SEQ ID NO: 818257 - DNA, 22 bp, Artificial Sequence
  chemically synthesized
acctacaagtaaaataaatgtt

SEQ ID NO: 818258 - DNA, 22 bp, Artificial Sequence
  chemically synthesized
caagtaaaataaatgtttgttc

SEQ ID NO: 818259 - DNA, 22 bp, Artificial Sequence
  chemically synthesized
agtaatagttcacccggaacaa

SEQ ID NO: 818260 - DNA, 22 bp, Artificial Sequence
  chemically synthesized
aagtaatagttcacccggaaca

SEQ ID NO: 818261 - DNA, 22 bp, Artificial Sequence
  chemically synthesized
aaaatttaagtaatagttcacc

SEQ ID NO: 818262 - DNA, 22 bp, Artificial Sequence
  chemically synthesized
gttccgggtgaactattactta

SEQ ID NO: 818263 - DNA, 22 bp, Artificial Sequence
  chemically synthesized
ttccgggtgaactattacttaa

SEQ ID NO: 818264 - DNA, 22 bp, Artificial Sequence
  chemically synthesized
cgggtgaactattacttaaatt

SEQ ID NO: 818265 - DNA, 22 bp, Artificial Sequence
  chemically synthesized
agacacagtcattaaaaattta

SEQ ID NO: 818266 - DNA, 22 bp, Artificial Sequence
  chemically synthesized
gagacacagtcattaaaaattt

SEQ ID NO: 818267 - DNA, 22 bp, Artificial Sequence
  chemically synthesized
tgagacacagtcattaaaaatt

SEQ ID NO: 818268 - DNA, 22 bp, Artificial Sequence
  chemically synthesized
ctttgagacacagtcattaaaa

SEQ ID NO: 818269 - DNA, 22 bp, Artificial Sequence
  chemically synthesized
ttacttaaatttttaatgactg

SEQ ID NO: 818270 - DNA, 22 bp, Artificial Sequence
  chemically synthesized
cttaaatttttaatgactgtgt

SEQ ID NO: 818271 - DNA, 22 bp, Artificial Sequence
  chemically synthesized
aagttcctttgagacacagtca

SEQ ID NO: 818272 - DNA, 22 bp, Artificial Sequence
  chemically synthesized
gaagttcctttgagacacagtc

SEQ ID NO: 818273 - DNA, 22 bp, Artificial Sequence
  chemically synthesized
aaatttttaatgactgtgtctc

SEQ ID NO: 818274 - DNA, 22 bp, Artificial Sequence
  chemically synthesized
aatttttaatgactgtgtctca

SEQ ID NO: 818275 - DNA, 22 bp, Artificial Sequence
  chemically synthesized
ttgaagttcctttgagacacag

SEQ ID NO: 818276 - DNA, 22 bp, Artificial Sequence
  chemically synthesized
cttgaagttcctttgagacaca

SEQ ID NO: 818277 - DNA, 22 bp, Artificial Sequence
  chemically synthesized
tcttgaagttcctttgagacac

SEQ ID NO: 818278 - DNA, 22 bp, Artificial Sequence
  chemically synthesized
ttaatgactgtgtctcaaagga

SEQ ID NO: 818279 - DNA, 22 bp, Artificial Sequence
  chemically synthesized
taatgactgtgtctcaaaggaa

SEQ ID NO: 818280 - DNA, 22 bp, Artificial Sequence
  chemically synthesized
cctttcttgaagttcctttgag

SEQ ID NO: 818281 - DNA, 22 bp, Artificial Sequence
  chemically synthesized
aatgactgtgtctcaaaggaac

SEQ ID NO: 818282 - DNA, 22 bp, Artificial Sequence
  chemically synthesized
atgactgtgtctcaaaggaact

SEQ ID NO: 818283 - DNA, 22 bp, Artificial Sequence
  chemically synthesized
cactgcctttcttgaagttcct

SEQ ID NO: 818284 - DNA, 22 bp, Artificial Sequence
  chemically synthesized
tgcactgcctttcttgaagttc

SEQ ID NO: 818285 - DNA, 22 bp, Artificial Sequence
  chemically synthesized
tgtctcaaaggaacttcaagaa

SEQ ID NO: 818286 - DNA, 22 bp, Artificial Sequence
  chemically synthesized
ctctgcactgcctttcttgaag

SEQ ID NO: 818287 - DNA, 22 bp, Artificial Sequence
  chemically synthesized
gttactctgcactgcctttctt

SEQ ID NO: 818288 - DNA, 22 bp, Artificial Sequence
  chemically synthesized
aaaggaacttcaagaaaggcag

SEQ ID NO: 818289 - DNA, 22 bp, Artificial Sequence
  chemically synthesized
cgttactctgcactgcctttct

SEQ ID NO: 818290 - DNA, 22 bp, Artificial Sequence
  chemically synthesized
tcgttactctgcactgcctttc

SEQ ID NO: 818291 - DNA, 22 bp, Artificial Sequence
  chemically synthesized
caagaaaggcagtgcagagtaa

SEQ ID NO: 818292 - DNA, 22 bp, Artificial Sequence
  chemically synthesized
aagaaaggcagtgcagagtaac

SEQ ID NO: 818293 - DNA, 22 bp, Artificial Sequence
  chemically synthesized
ggaagatgtcctttcgttactc

SEQ ID NO: 818294 - DNA, 22 bp, Artificial Sequence
  chemically synthesized
ctgggaagatgtcctttcgtta

SEQ ID NO: 818295 - DNA, 22 bp, Artificial Sequence
  chemically synthesized
cctgggaagatgtcctttcgtt

SEQ ID NO: 818296 - DNA, 22 bp, Artificial Sequence
  chemically synthesized
cagaacaatggacaagcaaaac

SEQ ID NO: 818297 - DNA, 22 bp, Artificial Sequence
  chemically synthesized
cccaggaagttttgcttgtcca

SEQ ID NO: 818298 - DNA, 22 bp, Artificial Sequence
  chemically synthesized
ccaggaagttttgcttgtccat

SEQ ID NO: 818299 - DNA, 22 bp, Artificial Sequence
  chemically synthesized
agatcaaactgcagaacaatgg

SEQ ID NO: 818300 - DNA, 22 bp, Artificial Sequence
  chemically synthesized
aagatcaaactgcagaacaatg

SEQ ID NO: 818301 - DNA, 22 bp, Artificial Sequence
  chemically synthesized
cttaagatcaaactgcagaaca

SEQ ID NO: 818302 - DNA, 22 bp, Artificial Sequence
  chemically synthesized
tgcttgtccattgttctgcagt

SEQ ID NO: 818303 - DNA, 22 bp, Artificial Sequence
  chemically synthesized
ccttaagatcaaactgcagaac

SEQ ID NO: 818304 - DNA, 22 bp, Artificial Sequence
  chemically synthesized
gcttgtccattgttctgcagtt

SEQ ID NO: 818305 - DNA, 22 bp, Artificial Sequence
  chemically synthesized
cttgtccattgttctgcagttt

SEQ ID NO: 818306 - DNA, 22 bp, Artificial Sequence
  chemically synthesized
gtccattgttctgcagtttgat

SEQ ID NO: 818307 - DNA, 22 bp, Artificial Sequence
  chemically synthesized
tccattgttctgcagtttgatc

SEQ ID NO: 818308 - DNA, 22 bp, Artificial Sequence
  chemically synthesized
atgacttccttaagatcaaact

SEQ ID NO: 818309 - DNA, 22 bp, Artificial Sequence
  chemically synthesized
ttctgcagtttgatcttaagga

SEQ ID NO: 818310 - DNA, 22 bp, Artificial Sequence
  chemically synthesized
caaggttaatgacttccttaag

SEQ ID NO: 818311 - DNA, 22 bp, Artificial Sequence
  chemically synthesized
tgcagtttgatcttaaggaagt

SEQ ID NO: 818312 - DNA, 22 bp, Artificial Sequence
  chemically synthesized
acaaggttaatgacttccttaa

SEQ ID NO: 818313 - DNA, 22 bp, Artificial Sequence
  chemically synthesized
cagtttgatcttaaggaagtca

SEQ ID NO: 818314 - DNA, 22 bp, Artificial Sequence
  chemically synthesized
ggacttacaaggttaatgactt

SEQ ID NO: 818315 - DNA, 22 bp, Artificial Sequence
  chemically synthesized
gatcttaaggaagtcattaacc

SEQ ID NO: 818316 - DNA, 22 bp, Artificial Sequence
  chemically synthesized
atcttaaggaagtcattaacct

SEQ ID NO: 818317 - DNA, 22 bp, Artificial Sequence
  chemically synthesized
aaggaagtcattaaccttgtaa

SEQ ID NO: 818318 - DNA, 22 bp, Artificial Sequence
  chemically synthesized
aggaagtcattaaccttgtaag

SEQ ID NO: 818319 - DNA, 22 bp, Artificial Sequence
  chemically synthesized
cagatgacaaaactgggactta

SEQ ID NO: 818320 - DNA, 22 bp, Artificial Sequence
  chemically synthesized
acagatgacaaaactgggactt

SEQ ID NO: 818321 - DNA, 22 bp, Artificial Sequence
  chemically synthesized
gtttacagatgacaaaactggg

SEQ ID NO: 818322 - DNA, 22 bp, Artificial Sequence
  chemically synthesized
accttgtaagtcccagttttgt

SEQ ID NO: 818323 - DNA, 22 bp, Artificial Sequence
  chemically synthesized
gtaagtcccagttttgtcatct

SEQ ID NO: 818324 - DNA, 22 bp, Artificial Sequence
  chemically synthesized
taagtcccagttttgtcatctg

SEQ ID NO: 818325 - DNA, 22 bp, Artificial Sequence
  chemically synthesized
tgtcatctgtaaactaggatgg

SEQ ID NO: 818326 - DNA, 22 bp, Artificial Sequence
  chemically synthesized
gtcatctgtaaactaggatggg

SEQ ID NO: 818327 - DNA, 22 bp, Artificial Sequence
  chemically synthesized
tcatctgtaaactaggatgggg

SEQ ID NO: 818328 - DNA, 22 bp, Artificial Sequence
  chemically synthesized
taaactaggatggggttacttg

SEQ ID NO: 818329 - DNA, 22 bp, Artificial Sequence
  chemically synthesized
ggatggggttacttgctctgac

SEQ ID NO: 818330 - DNA, 22 bp, Artificial Sequence
  chemically synthesized
aggacaagccggaggcatggtc

SEQ ID NO: 818331 - DNA, 22 bp, Artificial Sequence
  chemically synthesized
caggacaagccggaggcatggt

SEQ ID NO: 818332 - DNA, 22 bp, Artificial Sequence
  chemically synthesized
cttgctctgaccatgcctccgg

SEQ ID NO: 818333 - DNA, 22 bp, Artificial Sequence
  chemically synthesized
gctctgaccatgcctccggctt

SEQ ID NO: 818334 - DNA, 22 bp, Artificial Sequence
  chemically synthesized
acacttcaggacaagccggagg

SEQ ID NO: 818335 - DNA, 22 bp, Artificial Sequence
  chemically synthesized
ctctgaccatgcctccggcttg

SEQ ID NO: 818336 - DNA, 22 bp, Artificial Sequence
  chemically synthesized
gacacttcaggacaagccggag

SEQ ID NO: 818337 - DNA, 22 bp, Artificial Sequence
  chemically synthesized
tgacacttcaggacaagccgga

SEQ ID NO: 818338 - DNA, 22 bp, Artificial Sequence
  chemically synthesized
tgaccatgcctccggcttgtcc

SEQ ID NO: 818339 - DNA, 22 bp, Artificial Sequence
  chemically synthesized
accatgcctccggcttgtcctg

SEQ ID NO: 818340 - DNA, 22 bp, Artificial Sequence
  chemically synthesized
attttgacacttcaggacaagc

SEQ ID NO: 818341 - DNA, 22 bp, Artificial Sequence
  chemically synthesized
gattttgacacttcaggacaag

SEQ ID NO: 818342 - DNA, 22 bp, Artificial Sequence
  chemically synthesized
cttgattttgacacttcaggac

SEQ ID NO: 818343 - DNA, 22 bp, Artificial Sequence
  chemically synthesized
cggcttgtcctgaagtgtcaaa

SEQ ID NO: 818344 - DNA, 22 bp, Artificial Sequence
  chemically synthesized
cgagcaattgcttgattttgac

SEQ ID NO: 818345 - DNA, 22 bp, Artificial Sequence
  chemically synthesized
ccgagcaattgcttgattttga

SEQ ID NO: 818346 - DNA, 22 bp, Artificial Sequence
  chemically synthesized
gtcctgaagtgtcaaaatcaag

SEQ ID NO: 818347 - DNA, 22 bp, Artificial Sequence
  chemically synthesized
tccgagcaattgcttgattttg

SEQ ID NO: 818348 - DNA, 22 bp, Artificial Sequence
  chemically synthesized
tcctgaagtgtcaaaatcaagc

SEQ ID NO: 818349 - DNA, 22 bp, Artificial Sequence
  chemically synthesized
aagtgtcaaaatcaagcaattg

SEQ ID NO: 818350 - DNA, 22 bp, Artificial Sequence
  chemically synthesized
caattttccgagcaattgcttg

SEQ ID NO: 818351 - DNA, 22 bp, Artificial Sequence
  chemically synthesized
acaattttccgagcaattgctt

SEQ ID NO: 818352 - DNA, 22 bp, Artificial Sequence
  chemically synthesized
tacaattttccgagcaattgct

SEQ ID NO: 818353 - DNA, 22 bp, Artificial Sequence
  chemically synthesized
ttttacaattttccgagcaatt

SEQ ID NO: 818354 - DNA, 22 bp, Artificial Sequence
  chemically synthesized
ggatcctgttttacaattttcc

SEQ ID NO: 818355 - DNA, 22 bp, Artificial Sequence
  chemically synthesized
ctcggaaaattgtaaaacagga

SEQ ID NO: 818356 - DNA, 22 bp, Artificial Sequence
  chemically synthesized
ggaaaattgtaaaacaggatcc

SEQ ID NO: 818357 - DNA, 22 bp, Artificial Sequence
  chemically synthesized
ataagcatattaggatcctgtt

SEQ ID NO: 818358 - DNA, 22 bp, Artificial Sequence
  chemically synthesized
ttcataagcatattaggatcct

SEQ ID NO: 818359 - DNA, 22 bp, Artificial Sequence
  chemically synthesized
gttcataagcatattaggatcc

SEQ ID NO: 818360 - DNA, 22 bp, Artificial Sequence
  chemically synthesized
tgttcataagcatattaggatc

SEQ ID NO: 818361 - DNA, 22 bp, Artificial Sequence
  chemically synthesized
ttgttcataagcatattaggat

SEQ ID NO: 818362 - DNA, 22 bp, Artificial Sequence
  chemically synthesized
tttgttcataagcatattagga

SEQ ID NO: 818363 - DNA, 22 bp, Artificial Sequence
  chemically synthesized
taaaacaggatcctaatatgct

SEQ ID NO: 818364 - DNA, 22 bp, Artificial Sequence
  chemically synthesized
atatgcttatgaacaaaaagtt

SEQ ID NO: 818365 - DNA, 22 bp, Artificial Sequence
  chemically synthesized
atgaacaaaaagttctacatgt

SEQ ID NO: 818366 - DNA, 22 bp, Artificial Sequence
  chemically synthesized
tgaacaaaaagttctacatgtt

SEQ ID NO: 818367 - DNA, 22 bp, Artificial Sequence
  chemically synthesized
tacatgttggatttgttatttt

SEQ ID NO: 818368 - DNA, 22 bp, Artificial Sequence
  chemically synthesized
catgttggatttgttatttttc

SEQ ID NO: 818369 - DNA, 22 bp, Artificial Sequence
  chemically synthesized
gatttgttatttttccttggat

SEQ ID NO: 818370 - DNA, 22 bp, Artificial Sequence
  chemically synthesized
gttatttttccttggatcctgt

SEQ ID NO: 818371 - DNA, 22 bp, Artificial Sequence
  chemically synthesized
atgaatgtaaatacaggatcca

SEQ ID NO: 818372 - DNA, 22 bp, Artificial Sequence
  chemically synthesized
ttatttttccttggatcctgta

SEQ ID NO: 818373 - DNA, 22 bp, Artificial Sequence
  chemically synthesized
tttttccttggatcctgtattt

SEQ ID NO: 818374 - DNA, 22 bp, Artificial Sequence
  chemically synthesized
gttcatgaatgtaaatacagga

SEQ ID NO: 818375 - DNA, 22 bp, Artificial Sequence
  chemically synthesized
ggttcatgaatgtaaatacagg

SEQ ID NO: 818376 - DNA, 22 bp, Artificial Sequence
  chemically synthesized
ttccttggatcctgtatttaca

SEQ ID NO: 818377 - DNA, 22 bp, Artificial Sequence
  chemically synthesized
tccttggatcctgtatttacat

SEQ ID NO: 818378 - DNA, 22 bp, Artificial Sequence
  chemically synthesized
ccttggatcctgtatttacatt

SEQ ID NO: 818379 - DNA, 22 bp, Artificial Sequence
  chemically synthesized
cttggatcctgtatttacattc

SEQ ID NO: 818380 - DNA, 22 bp, Artificial Sequence
  chemically synthesized
ggatcctgtatttacattcatg

SEQ ID NO: 818381 - DNA, 22 bp, Artificial Sequence
  chemically synthesized
gatcctgtatttacattcatga

SEQ ID NO: 818382 - DNA, 22 bp, Artificial Sequence
  chemically synthesized
catgaatcccttggttcatgaa

SEQ ID NO: 818383 - DNA, 22 bp, Artificial Sequence
  chemically synthesized
ccatgaatcccttggttcatga

SEQ ID NO: 818384 - DNA, 22 bp, Artificial Sequence
  chemically synthesized
tccatgaatcccttggttcatg

SEQ ID NO: 818385 - DNA, 22 bp, Artificial Sequence
  chemically synthesized
ttccatgaatcccttggttcat

SEQ ID NO: 818386 - DNA, 22 bp, Artificial Sequence
  chemically synthesized
tatttacattcatgaaccaagg

SEQ ID NO: 818387 - DNA, 22 bp, Artificial Sequence
  chemically synthesized
aatttttccatgaatcccttgg

SEQ ID NO: 818388 - DNA, 22 bp, Artificial Sequence
  chemically synthesized
acattcatgaaccaagggattc

SEQ ID NO: 818389 - DNA, 22 bp, Artificial Sequence
  chemically synthesized
cattcatgaaccaagggattca

SEQ ID NO: 818390 - DNA, 22 bp, Artificial Sequence
  chemically synthesized
atgaaccaagggattcatggaa

SEQ ID NO: 818391 - DNA, 22 bp, Artificial Sequence
  chemically synthesized
acagagttaaatttttccatga

SEQ ID NO: 818392 - DNA, 22 bp, Artificial Sequence
  chemically synthesized
gctaacagagttaaatttttcc

SEQ ID NO: 818393 - DNA, 22 bp, Artificial Sequence
  chemically synthesized
gtggttagctaacagagttaaa

SEQ ID NO: 818394 - DNA, 22 bp, Artificial Sequence
  chemically synthesized
ggtggttagctaacagagttaa

SEQ ID NO: 818395 - DNA, 22 bp, Artificial Sequence
  chemically synthesized
atggaaaaatttaactctgtta

SEQ ID NO: 818396 - DNA, 22 bp, Artificial Sequence
  chemically synthesized
ttggtggttagctaacagagtt

SEQ ID NO: 818397 - DNA, 22 bp, Artificial Sequence
  chemically synthesized
aactctgttagctaaccaccaa

SEQ ID NO: 818398 - DNA, 22 bp, Artificial Sequence
  chemically synthesized
actctgttagctaaccaccaag

SEQ ID NO: 818399 - DNA, 22 bp, Artificial Sequence
  chemically synthesized
agagcaaacgacctcttggtgg

SEQ ID NO: 818400 - DNA, 22 bp, Artificial Sequence
  chemically synthesized
tgttagctaaccaccaagaggt

SEQ ID NO: 818401 - DNA, 22 bp, Artificial Sequence
  chemically synthesized
ttagctaaccaccaagaggtcg

SEQ ID NO: 818402 - DNA, 22 bp, Artificial Sequence
  chemically synthesized
gctaaccaccaagaggtcgttt

SEQ ID NO: 818403 - DNA, 22 bp, Artificial Sequence
  chemically synthesized
accaccaagaggtcgtttgctc

SEQ ID NO: 818404 - DNA, 22 bp, Artificial Sequence
  chemically synthesized
gctcttagatccattctctacc

SEQ ID NO: 818405 - DNA, 22 bp, Artificial Sequence
  chemically synthesized
ctcttagatccattctctaccc

SEQ ID NO: 818406 - DNA, 22 bp, Artificial Sequence
  chemically synthesized
ttagatccattctctacccatt

SEQ ID NO: 818407 - DNA, 22 bp, Artificial Sequence
  chemically synthesized
agtggagtaggaaatgggtaga

SEQ ID NO: 818408 - DNA, 22 bp, Artificial Sequence
  chemically synthesized
agatccattctctacccatttc

SEQ ID NO: 818409 - DNA, 22 bp, Artificial Sequence
  chemically synthesized
gatccattctctacccatttcc

SEQ ID NO: 818410 - DNA, 22 bp, Artificial Sequence
  chemically synthesized
aatactgagtggagtaggaaat

SEQ ID NO: 818411 - DNA, 22 bp, Artificial Sequence
  chemically synthesized
tctacccatttcctactccact

SEQ ID NO: 818412 - DNA, 22 bp, Artificial Sequence
  chemically synthesized
tacccatttcctactccactca

SEQ ID NO: 818413 - DNA, 22 bp, Artificial Sequence
  chemically synthesized
cccatttcctactccactcagt

SEQ ID NO: 818414 - DNA, 22 bp, Artificial Sequence
  chemically synthesized
gtacatctcaatactgagtgga

SEQ ID NO: 818415 - DNA, 22 bp, Artificial Sequence
  chemically synthesized
cctactccactcagtattgaga

SEQ ID NO: 818416 - DNA, 22 bp, Artificial Sequence
  chemically synthesized
ctactccactcagtattgagat

SEQ ID NO: 818417 - DNA, 22 bp, Artificial Sequence
  chemically synthesized
tgggagttagtacatctcaata

SEQ ID NO: 818418 - DNA, 22 bp, Artificial Sequence
  chemically synthesized
ctccactcagtattgagatgta

SEQ ID NO: 818419 - DNA, 22 bp, Artificial Sequence
  chemically synthesized
ctatgggagttagtacatctca

SEQ ID NO: 818420 - DNA, 22 bp, Artificial Sequence
  chemically synthesized
cactcagtattgagatgtacta

SEQ ID NO: 818421 - DNA, 22 bp, Artificial Sequence
  chemically synthesized
acctcctatgggagttagtaca

SEQ ID NO: 818422 - DNA, 22 bp, Artificial Sequence
  chemically synthesized
agtattgagatgtactaactcc

SEQ ID NO: 818423 - DNA, 22 bp, Artificial Sequence
  chemically synthesized
tgacctcctatgggagttagta

SEQ ID NO: 818424 - DNA, 22 bp, Artificial Sequence
  chemically synthesized
agatgtactaactcccatagga

SEQ ID NO: 818425 - DNA, 22 bp, Artificial Sequence
  chemically synthesized
actcccataggaggtcagaatt

SEQ ID NO: 818426 - DNA, 22 bp, Artificial Sequence
  chemically synthesized
ccataggaggtcagaatttcct

SEQ ID NO: 818427 - DNA, 22 bp, Artificial Sequence
  chemically synthesized
gcaagaaatcccaggaaattct

SEQ ID NO: 818428 - DNA, 22 bp, Artificial Sequence
  chemically synthesized
gaagccagctagcaagaaatcc

SEQ ID NO: 818429 - DNA, 22 bp, Artificial Sequence
  chemically synthesized
gttagaagccagctagcaagaa

SEQ ID NO: 818430 - DNA, 22 bp, Artificial Sequence
  chemically synthesized
cctgggatttcttgctagctgg

SEQ ID NO: 818431 - DNA, 22 bp, Artificial Sequence
  chemically synthesized
ctgggatttcttgctagctggc

SEQ ID NO: 818432 - DNA, 22 bp, Artificial Sequence
  chemically synthesized
acctagttagaagccagctagc

SEQ ID NO: 818433 - DNA, 22 bp, Artificial Sequence
  chemically synthesized
aacctagttagaagccagctag

SEQ ID NO: 818434 - DNA, 22 bp, Artificial Sequence
  chemically synthesized
ggatttcttgctagctggcttc

SEQ ID NO: 818435 - DNA, 22 bp, Artificial Sequence
  chemically synthesized
atgacttaacctagttagaagc

SEQ ID NO: 818436 - DNA, 22 bp, Artificial Sequence
  chemically synthesized
cttgctagctggcttctaacta

SEQ ID NO: 818437 - DNA, 22 bp, Artificial Sequence
  chemically synthesized
ttgctagctggcttctaactag

SEQ ID NO: 818438 - DNA, 22 bp, Artificial Sequence
  chemically synthesized
gctagctggcttctaactaggt

SEQ ID NO: 818439 - DNA, 22 bp, Artificial Sequence
  chemically synthesized
ctagctggcttctaactaggtt

SEQ ID NO: 818440 - DNA, 22 bp, Artificial Sequence
  chemically synthesized
gctggcttctaactaggttaag

SEQ ID NO: 818441 - DNA, 22 bp, Artificial Sequence
  chemically synthesized
gtgtgtctcatgacttaaccta

SEQ ID NO: 818442 - DNA, 22 bp, Artificial Sequence
  chemically synthesized
gcttctaactaggttaagtcat

SEQ ID NO: 818443 - DNA, 22 bp, Artificial Sequence
  chemically synthesized
ccactagtgtgtctcatgactt

SEQ ID NO: 818444 - DNA, 22 bp, Artificial Sequence
  chemically synthesized
ctaactaggttaagtcatgaga

SEQ ID NO: 818445 - DNA, 22 bp, Artificial Sequence
  chemically synthesized
taactaggttaagtcatgagac

SEQ ID NO: 818446 - DNA, 22 bp, Artificial Sequence
  chemically synthesized
actaggttaagtcatgagacac

SEQ ID NO: 818447 - DNA, 22 bp, Artificial Sequence
  chemically synthesized
tctcccactagtgtgtctcatg

SEQ ID NO: 818448 - DNA, 22 bp, Artificial Sequence
  chemically synthesized
tgtctcccactagtgtgtctca

SEQ ID NO: 818449 - DNA, 22 bp, Artificial Sequence
  chemically synthesized
ctgtctcccactagtgtgtctc

SEQ ID NO: 818450 - DNA, 22 bp, Artificial Sequence
  chemically synthesized
ggttaagtcatgagacacacta

SEQ ID NO: 818451 - DNA, 22 bp, Artificial Sequence
  chemically synthesized
ttctgtctcccactagtgtgtc

SEQ ID NO: 818452 - DNA, 22 bp, Artificial Sequence
  chemically synthesized
agtcatgagacacactagtggg

SEQ ID NO: 818453 - DNA, 22 bp, Artificial Sequence
  chemically synthesized
atgctcttctgtctcccactag

SEQ ID NO: 818454 - DNA, 22 bp, Artificial Sequence
  chemically synthesized
tcatgctcttctgtctcccact

SEQ ID NO: 818455 - DNA, 22 bp, Artificial Sequence
  chemically synthesized
ctcatgctcttctgtctcccac

SEQ ID NO: 818456 - DNA, 22 bp, Artificial Sequence
  chemically synthesized
tctcatgctcttctgtctccca

SEQ ID NO: 818457 - DNA, 22 bp, Artificial Sequence
  chemically synthesized
accctttctcatgctcttctgt

SEQ ID NO: 818458 - DNA, 22 bp, Artificial Sequence
  chemically synthesized
caccctttctcatgctcttctg

SEQ ID NO: 818459 - DNA, 22 bp, Artificial Sequence
  chemically synthesized
tttcaccctttctcatgctctt

SEQ ID NO: 818460 - DNA, 22 bp, Artificial Sequence
  chemically synthesized
gtgggagacagaagagcatgag

SEQ ID NO: 818461 - DNA, 22 bp, Artificial Sequence
  chemically synthesized
gtttcaccctttctcatgctct

SEQ ID NO: 818462 - DNA, 22 bp, Artificial Sequence
  chemically synthesized
tcttgtttcaccctttctcatg

SEQ ID NO: 818463 - DNA, 22 bp, Artificial Sequence
  chemically synthesized
ccaagacagagagagaaggggg

SEQ ID NO: 818464 - DNA, 22 bp, Artificial Sequence
  chemically synthesized
tcccccttctctctctgtcttg

SEQ ID NO: 818465 - DNA, 22 bp, Artificial Sequence
  chemically synthesized
ctctctctgtcttggcagtatc

SEQ ID NO: 818466 - DNA, 22 bp, Artificial Sequence
  chemically synthesized
tctctctgtcttggcagtatct

SEQ ID NO: 818467 - DNA, 22 bp, Artificial Sequence
  chemically synthesized
tctctgtcttggcagtatctcc

SEQ ID NO: 818468 - DNA, 22 bp, Artificial Sequence
  chemically synthesized
tctgtcttggcagtatctcctt

SEQ ID NO: 818469 - DNA, 22 bp, Artificial Sequence
  chemically synthesized
tgtcttggcagtatctcctttg

SEQ ID NO: 818470 - DNA, 22 bp, Artificial Sequence
  chemically synthesized
tcttggcagtatctcctttgtc

SEQ ID NO: 818471 - DNA, 22 bp, Artificial Sequence
  chemically synthesized
ggcagtatctcctttgtctccg

SEQ ID NO: 818472 - DNA, 22 bp, Artificial Sequence
  chemically synthesized
gcagtatctcctttgtctccgt

SEQ ID NO: 818473 - DNA, 22 bp, Artificial Sequence
  chemically synthesized
ctttgtctccgtttcccactgg

SEQ ID NO: 818474 - DNA, 22 bp, Artificial Sequence
  chemically synthesized
tgtctccgtttcccactggacg

SEQ ID NO: 818475 - DNA, 22 bp, Artificial Sequence
  chemically synthesized
gtctccgtttcccactggacgg

SEQ ID NO: 818476 - DNA, 22 bp, Artificial Sequence
  chemically synthesized
cagagggagcagccgtccagtg

SEQ ID NO: 818477 - DNA, 22 bp, Artificial Sequence
  chemically synthesized
tctccgtttcccactggacggc

SEQ ID NO: 818478 - DNA, 22 bp, Artificial Sequence
  chemically synthesized
cgtttcccactggacggctgct

SEQ ID NO: 818479 - DNA, 22 bp, Artificial Sequence
  chemically synthesized
cccactggacggctgctccctc

SEQ ID NO: 818480 - DNA, 22 bp, Artificial Sequence
  chemically synthesized
ccactggacggctgctccctct

SEQ ID NO: 818481 - DNA, 22 bp, Artificial Sequence
  chemically synthesized
gacggctgctccctctgtaatt

SEQ ID NO: 818482 - DNA, 22 bp, Artificial Sequence
  chemically synthesized
cacagcaggtaatggaattaca

SEQ ID NO: 818483 - DNA, 22 bp, Artificial Sequence
  chemically synthesized
ctccctctgtaattccattacc

SEQ ID NO: 818484 - DNA, 22 bp, Artificial Sequence
  chemically synthesized
cctctgtaattccattacctgc

SEQ ID NO: 818485 - DNA, 22 bp, Artificial Sequence
  chemically synthesized
tgtaattccattacctgctgtg

SEQ ID NO: 818486 - DNA, 22 bp, Artificial Sequence
  chemically synthesized
taattccattacctgctgtgca

SEQ ID NO: 818487 - DNA, 22 bp, Artificial Sequence
  chemically synthesized
acccaatgtaaggtctgcacag

SEQ ID NO: 818488 - DNA, 22 bp, Artificial Sequence
  chemically synthesized
cattacctgctgtgcagacctt

SEQ ID NO: 818489 - DNA, 22 bp, Artificial Sequence
  chemically synthesized
attcacccaatgtaaggtctgc

SEQ ID NO: 818490 - DNA, 22 bp, Artificial Sequence
  chemically synthesized
cctgctgtgcagaccttacatt

SEQ ID NO: 818491 - DNA, 22 bp, Artificial Sequence
  chemically synthesized
ctgtgcagaccttacattgggt

SEQ ID NO: 818492 - DNA, 22 bp, Artificial Sequence
  chemically synthesized
tgcagaccttacattgggtgaa

SEQ ID NO: 818493 - DNA, 22 bp, Artificial Sequence
  chemically synthesized
acattgggtgaattagcacccg

SEQ ID NO: 818494 - DNA, 22 bp, Artificial Sequence
  chemically synthesized
cattgggtgaattagcacccga

SEQ ID NO: 818495 - DNA, 22 bp, Artificial Sequence
  chemically synthesized
ggtgaattagcacccgatggtt

SEQ ID NO: 818496 - DNA, 22 bp, Artificial Sequence
  chemically synthesized
ccaaagcccagaaaccagaacc

SEQ ID NO: 818497 - DNA, 22 bp, Artificial Sequence
  chemically synthesized
accaaagcccagaaaccagaac

SEQ ID NO: 818498 - DNA, 22 bp, Artificial Sequence
  chemically synthesized
taccaaagcccagaaaccagaa

SEQ ID NO: 818499 - DNA, 22 bp, Artificial Sequence
  chemically synthesized
gcacccgatggttctggtttct

SEQ ID NO: 818500 - DNA, 22 bp, Artificial Sequence
  chemically synthesized
tggtttctgggctttggtaaaa

SEQ ID NO: 818501 - DNA, 22 bp, Artificial Sequence
  chemically synthesized
gggaaccgacaagttttaccaa

SEQ ID NO: 818502 - DNA, 22 bp, Artificial Sequence
  chemically synthesized
gtttctgggctttggtaaaact

SEQ ID NO: 818503 - DNA, 22 bp, Artificial Sequence
  chemically synthesized
ctgggctttggtaaaacttgtc

SEQ ID NO: 818504 - DNA, 22 bp, Artificial Sequence
  chemically synthesized
tgggctttggtaaaacttgtcg

SEQ ID NO: 818505 - DNA, 22 bp, Artificial Sequence
  chemically synthesized
ggctttggtaaaacttgtcggt

SEQ ID NO: 818506 - DNA, 22 bp, Artificial Sequence
  chemically synthesized
aagggctggggaaccgacaagt

SEQ ID NO: 818507 - DNA, 22 bp, Artificial Sequence
  chemically synthesized
tggtaaaacttgtcggttcccc

SEQ ID NO: 818508 - DNA, 22 bp, Artificial Sequence
  chemically synthesized
ggtaaaacttgtcggttcccca

SEQ ID NO: 818509 - DNA, 22 bp, Artificial Sequence
  chemically synthesized
gtaaaacttgtcggttccccag

SEQ ID NO: 818510 - DNA, 22 bp, Artificial Sequence
  chemically synthesized
ccacctcaagggctggggaacc

SEQ ID NO: 818511 - DNA, 22 bp, Artificial Sequence
  chemically synthesized
ttaccacctcaagggctgggga

SEQ ID NO: 818512 - DNA, 22 bp, Artificial Sequence
  chemically synthesized
gtcggttccccagcccttgagg

SEQ ID NO: 818513 - DNA, 22 bp, Artificial Sequence
  chemically synthesized
tcggttccccagcccttgaggt

SEQ ID NO: 818514 - DNA, 22 bp, Artificial Sequence
  chemically synthesized
aggaaactattaccacctcaag

SEQ ID NO: 818515 - DNA, 22 bp, Artificial Sequence
  chemically synthesized
caggaaactattaccacctcaa

SEQ ID NO: 818516 - DNA, 22 bp, Artificial Sequence
  chemically synthesized
cccagcccttgaggtggtaata

SEQ ID NO: 818517 - DNA, 22 bp, Artificial Sequence
  chemically synthesized
gcaacttcaggaaactattacc

SEQ ID NO: 818518 - DNA, 22 bp, Artificial Sequence
  chemically synthesized
agcaacttcaggaaactattac

SEQ ID NO: 818519 - DNA, 22 bp, Artificial Sequence
  chemically synthesized
gaggtggtaatagtttcctgaa

SEQ ID NO: 818520 - DNA, 22 bp, Artificial Sequence
  chemically synthesized
aggtggtaatagtttcctgaag

SEQ ID NO: 818521 - DNA, 22 bp, Artificial Sequence
  chemically synthesized
cctgaagttgctaaactctggg

SEQ ID NO: 818522 - DNA, 22 bp, Artificial Sequence
  chemically synthesized
ctgaagttgctaaactctgggt

SEQ ID NO: 818523 - DNA, 22 bp, Artificial Sequence
  chemically synthesized
aagttgctaaactctgggttgc

SEQ ID NO: 818524 - DNA, 22 bp, Artificial Sequence
  chemically synthesized
ctaaactctgggttgcctcact

SEQ ID NO: 818525 - DNA, 22 bp, Artificial Sequence
  chemically synthesized
aactctgggttgcctcactgtc

SEQ ID NO: 818526 - DNA, 22 bp, Artificial Sequence
  chemically synthesized
acaaacccaacagaggacagtg

SEQ ID NO: 818527 - DNA, 22 bp, Artificial Sequence
  chemically synthesized
tgggttgcctcactgtcctctg

SEQ ID NO: 818528 - DNA, 22 bp, Artificial Sequence
  chemically synthesized
ggttgcctcactgtcctctgtt

SEQ ID NO: 818529 - DNA, 22 bp, Artificial Sequence
  chemically synthesized
cctcactgtcctctgttgggtt

SEQ ID NO: 818530 - DNA, 22 bp, Artificial Sequence
  chemically synthesized
actgtcctctgttgggtttgtc

SEQ ID NO: 818531 - DNA, 22 bp, Artificial Sequence
  chemically synthesized
tcctctgttgggtttgtcagct

SEQ ID NO: 818532 - DNA, 22 bp, Artificial Sequence
  chemically synthesized
cataggaatgaaggagctgaca

SEQ ID NO: 818533 - DNA, 22 bp, Artificial Sequence
  chemically synthesized
tgttgggtttgtcagctccttc

SEQ ID NO: 818534 - DNA, 22 bp, Artificial Sequence
  chemically synthesized
ctccataggaatgaaggagctg

SEQ ID NO: 818535 - DNA, 22 bp, Artificial Sequence
  chemically synthesized
ttgggtttgtcagctccttcat

SEQ ID NO: 818536 - DNA, 22 bp, Artificial Sequence
  chemically synthesized
gctcctccataggaatgaagga

SEQ ID NO: 818537 - DNA, 22 bp, Artificial Sequence
  chemically synthesized
ggtttgtcagctccttcattcc

SEQ ID NO: 818538 - DNA, 22 bp, Artificial Sequence
  chemically synthesized
gtcagctccttcattcctatgg

SEQ ID NO: 818539 - DNA, 22 bp, Artificial Sequence
  chemically synthesized
tcagctccttcattcctatgga

SEQ ID NO: 818540 - DNA, 22 bp, Artificial Sequence
  chemically synthesized
cttcattcctatggaggagcca

SEQ ID NO: 818541 - DNA, 22 bp, Artificial Sequence
  chemically synthesized
aatacagaggactggctcctcc

SEQ ID NO: 818542 - DNA, 22 bp, Artificial Sequence
  chemically synthesized
cattcctatggaggagccagtc

SEQ ID NO: 818543 - DNA, 22 bp, Artificial Sequence
  chemically synthesized
attcctatggaggagccagtcc

SEQ ID NO: 818544 - DNA, 22 bp, Artificial Sequence
  chemically synthesized
ctatggaggagccagtcctctg

SEQ ID NO: 818545 - DNA, 22 bp, Artificial Sequence
  chemically synthesized
tggaggagccagtcctctgtat

SEQ ID NO: 818546 - DNA, 22 bp, Artificial Sequence
  chemically synthesized
aaacagaggaaattcaatacag

SEQ ID NO: 818547 - DNA, 22 bp, Artificial Sequence
  chemically synthesized
caaacagaggaaattcaataca

SEQ ID NO: 818548 - DNA, 22 bp, Artificial Sequence
  chemically synthesized
gatatttcaaacagaggaaatt

SEQ ID NO: 818549 - DNA, 22 bp, Artificial Sequence
  chemically synthesized
tgtattgaatttcctctgtttg

SEQ ID NO: 818550 - DNA, 22 bp, Artificial Sequence
  chemically synthesized
tattgaatttcctctgtttgaa

SEQ ID NO: 818551 - DNA, 22 bp, Artificial Sequence
  chemically synthesized
aatttcctctgtttgaaatatc

SEQ ID NO: 818552 - DNA, 22 bp, Artificial Sequence
  chemically synthesized
taaaccacattcgatatttcaa

SEQ ID NO: 818553 - DNA, 22 bp, Artificial Sequence
  chemically synthesized
cctctgtttgaaatatcgaatg

SEQ ID NO: 818554 - DNA, 22 bp, Artificial Sequence
  chemically synthesized
gtctgtaaaccacattcgatat

SEQ ID NO: 818555 - DNA, 22 bp, Artificial Sequence
  chemically synthesized
ctctgtttgaaatatcgaatgt

SEQ ID NO: 818556 - DNA, 22 bp, Artificial Sequence
  chemically synthesized
tgtttgaaatatcgaatgtggt

SEQ ID NO: 818557 - DNA, 22 bp, Artificial Sequence
  chemically synthesized
tttgaaatatcgaatgtggttt

SEQ ID NO: 818558 - DNA, 22 bp, Artificial Sequence
  chemically synthesized
gaaatatcgaatgtggtttaca

SEQ ID NO: 818559 - DNA, 22 bp, Artificial Sequence
  chemically synthesized
aaatatcgaatgtggtttacag

SEQ ID NO: 818560 - DNA, 22 bp, Artificial Sequence
  chemically synthesized
tcaggaattagtctgtaaacca

SEQ ID NO: 818561 - DNA, 22 bp, Artificial Sequence
  chemically synthesized
gtgttgtcaggaattagtctgt

SEQ ID NO: 818562 - DNA, 22 bp, Artificial Sequence
  chemically synthesized
agttcgtgttgtcaggaattag

SEQ ID NO: 818563 - DNA, 22 bp, Artificial Sequence
  chemically synthesized
cagttcgtgttgtcaggaatta

SEQ ID NO: 818564 - DNA, 22 bp, Artificial Sequence
  chemically synthesized
tcagttcgtgttgtcaggaatt

SEQ ID NO: 818565 - DNA, 22 bp, Artificial Sequence
  chemically synthesized
tttcagttcgtgttgtcaggaa

SEQ ID NO: 818566 - DNA, 22 bp, Artificial Sequence
  chemically synthesized
ctttcagttcgtgttgtcagga

SEQ ID NO: 818567 - DNA, 22 bp, Artificial Sequence
  chemically synthesized
acagactaattcctgacaacac

SEQ ID NO: 818568 - DNA, 22 bp, Artificial Sequence
  chemically synthesized
cagactaattcctgacaacacg

SEQ ID NO: 818569 - DNA, 22 bp, Artificial Sequence
  chemically synthesized
tgagatttctttcagttcgtgt

SEQ ID NO: 818570 - DNA, 22 bp, Artificial Sequence
  chemically synthesized
attcctgacaacacgaactgaa

SEQ ID NO: 818571 - DNA, 22 bp, Artificial Sequence
  chemically synthesized
ctgtgagatttctttcagttcg

SEQ ID NO: 818572 - DNA, 22 bp, Artificial Sequence
  chemically synthesized
actgtgagatttctttcagttc

SEQ ID NO: 818573 - DNA, 22 bp, Artificial Sequence
  chemically synthesized
ctgacaacacgaactgaaagaa

SEQ ID NO: 818574 - DNA, 22 bp, Artificial Sequence
  chemically synthesized
acaacacgaactgaaagaaatc

SEQ ID NO: 818575 - DNA, 22 bp, Artificial Sequence
  chemically synthesized
taggtaggatcatttactgtga

SEQ ID NO: 818576 - DNA, 22 bp, Artificial Sequence
  chemically synthesized
aaagaaatctcacagtaaatga

SEQ ID NO: 818577 - DNA, 22 bp, Artificial Sequence
  chemically synthesized
tggaattgtaggtaggatcatt

SEQ ID NO: 818578 - DNA, 22 bp, Artificial Sequence
  chemically synthesized
acagtaaatgatcctacctaca

SEQ ID NO: 818579 - DNA, 22 bp, Artificial Sequence
  chemically synthesized
cccctgtggaattgtaggtagg

SEQ ID NO: 818580 - DNA, 22 bp, Artificial Sequence
  chemically synthesized
ccccctgtggaattgtaggtag

SEQ ID NO: 818581 - DNA, 22 bp, Artificial Sequence
  chemically synthesized
aatttccccctgtggaattgta

SEQ ID NO: 818582 - DNA, 22 bp, Artificial Sequence
  chemically synthesized
atatattaaatttccccctgtg

SEQ ID NO: 818583 - DNA, 22 bp, Artificial Sequence
  chemically synthesized
gatatattaaatttccccctgt

SEQ ID NO: 818584 - DNA, 22 bp, Artificial Sequence
  chemically synthesized
cctacaattccacagggggaaa

SEQ ID NO: 818585 - DNA, 22 bp, Artificial Sequence
  chemically synthesized
caattccacagggggaaattta

SEQ ID NO: 818586 - DNA, 22 bp, Artificial Sequence
  chemically synthesized
cacagggggaaatttaatatat

SEQ ID NO: 818587 - DNA, 22 bp, Artificial Sequence
  chemically synthesized
atgaaatgtatgtttgatatat

SEQ ID NO: 818588 - DNA, 22 bp, Artificial Sequence
  chemically synthesized
catgaaatgtatgtttgatata

SEQ ID NO: 818589 - DNA, 22 bp, Artificial Sequence
  chemically synthesized
atatttcatgaaatgtatgttt

SEQ ID NO: 818590 - DNA, 22 bp, Artificial Sequence
  chemically synthesized
aatatatcaaacatacatttca

SEQ ID NO: 818591 - DNA, 22 bp, Artificial Sequence
  chemically synthesized
atatatcaaacatacatttcat

SEQ ID NO: 818592 - DNA, 22 bp, Artificial Sequence
  chemically synthesized
catgaaatatcagactttacat

SEQ ID NO: 818593 - DNA, 22 bp, Artificial Sequence
  chemically synthesized
atgaaatatcagactttacatc

SEQ ID NO: 818594 - DNA, 22 bp, Artificial Sequence
  chemically synthesized
gagagaaggatgcaagatgtaa

SEQ ID NO: 818595 - DNA, 22 bp, Artificial Sequence
  chemically synthesized
agactagagagaaggatgcaag

SEQ ID NO: 818596 - DNA, 22 bp, Artificial Sequence
  chemically synthesized
tgagactagagagaaggatgca

SEQ ID NO: 818597 - DNA, 22 bp, Artificial Sequence
  chemically synthesized
ctctgagactagagagaaggat

SEQ ID NO: 818598 - DNA, 22 bp, Artificial Sequence
  chemically synthesized
cctctgagactagagagaagga

SEQ ID NO: 818599 - DNA, 22 bp, Artificial Sequence
  chemically synthesized
tacatcttgcatccttctctct

SEQ ID NO: 818600 - DNA, 22 bp, Artificial Sequence
  chemically synthesized
acatcttgcatccttctctcta

SEQ ID NO: 818601 - DNA, 22 bp, Artificial Sequence
  chemically synthesized
ttcctctgagactagagagaag

SEQ ID NO: 818602 - DNA, 22 bp, Artificial Sequence
  chemically synthesized
catcttgcatccttctctctag

SEQ ID NO: 818603 - DNA, 22 bp, Artificial Sequence
  chemically synthesized
gcatccttctctctagtctcag

SEQ ID NO: 818604 - DNA, 22 bp, Artificial Sequence
  chemically synthesized
catccttctctctagtctcaga

SEQ ID NO: 818605 - DNA, 22 bp, Artificial Sequence
  chemically synthesized
ctctctagtctcagaggaagag

SEQ ID NO: 818606 - DNA, 22 bp, Artificial Sequence
  chemically synthesized
tctctagtctcagaggaagagg

SEQ ID NO: 818607 - DNA, 22 bp, Artificial Sequence
  chemically synthesized
tctagtctcagaggaagaggcg

SEQ ID NO: 818608 - DNA, 22 bp, Artificial Sequence
  chemically synthesized
tagtctcagaggaagaggcgac

SEQ ID NO: 818609 - DNA, 22 bp, Artificial Sequence
  chemically synthesized
caatagcagaaaagtcgcctct

SEQ ID NO: 818610 - DNA, 22 bp, Artificial Sequence
  chemically synthesized
gtctcagaggaagaggcgactt

SEQ ID NO: 818611 - DNA, 22 bp, Artificial Sequence
  chemically synthesized
ccaatagcagaaaagtcgcctc

SEQ ID NO: 818612 - DNA, 22 bp, Artificial Sequence
  chemically synthesized
agaggaagaggcgacttttctg

SEQ ID NO: 818613 - DNA, 22 bp, Artificial Sequence
  chemically synthesized
ttctgctattggaagttgattt

SEQ ID NO: 818614 - DNA, 22 bp, Artificial Sequence
  chemically synthesized
tctgctattggaagttgatttc

SEQ ID NO: 818615 - DNA, 22 bp, Artificial Sequence
  chemically synthesized
ctgctattggaagttgatttca

SEQ ID NO: 818616 - DNA, 22 bp, Artificial Sequence
  chemically synthesized
tgctattggaagttgatttcac

SEQ ID NO: 818617 - DNA, 22 bp, Artificial Sequence
  chemically synthesized
ctattggaagttgatttcacca

SEQ ID NO: 818618 - DNA, 22 bp, Artificial Sequence
  chemically synthesized
ttggaagttgatttcaccatct

SEQ ID NO: 818619 - DNA, 22 bp, Artificial Sequence
  chemically synthesized
gaagttgatttcaccatctggg

SEQ ID NO: 818620 - DNA, 22 bp, Artificial Sequence
  chemically synthesized
atttcaccatctgggcacccat

SEQ ID NO: 818621 - DNA, 22 bp, Artificial Sequence
  chemically synthesized
caccatctgggcacccatctat

SEQ ID NO: 818622 - DNA, 22 bp, Artificial Sequence
  chemically synthesized
accatctgggcacccatctatt

SEQ ID NO: 818623 - DNA, 22 bp, Artificial Sequence
  chemically synthesized
ggcacccatctattctgggatc

SEQ ID NO: 818624 - DNA, 22 bp, Artificial Sequence
  chemically synthesized
ttctgggatcctcctccacata

SEQ ID NO: 818625 - DNA, 22 bp, Artificial Sequence
  chemically synthesized
tgggatcctcctccacatactc

SEQ ID NO: 818626 - DNA, 22 bp, Artificial Sequence
  chemically synthesized
ggatcctcctccacatactccc

SEQ ID NO: 818627 - DNA, 22 bp, Artificial Sequence
  chemically synthesized
gaacacacaaagagagagggag

SEQ ID NO: 818628 - DNA, 22 bp, Artificial Sequence
  chemically synthesized
ctccacatactccctctctctt

SEQ ID NO: 818629 - DNA, 22 bp, Artificial Sequence
  chemically synthesized
cacatactccctctctctttgt

SEQ ID NO: 818630 - DNA, 22 bp, Artificial Sequence
  chemically synthesized
cctctctctttgtgtgttccaa

SEQ ID NO: 818631 - DNA, 22 bp, Artificial Sequence
  chemically synthesized
tctctttgtgtgttccaacttc

SEQ ID NO: 818632 - DNA, 22 bp, Artificial Sequence
  chemically synthesized
tctttgtgtgttccaacttctt

SEQ ID NO: 818633 - DNA, 22 bp, Artificial Sequence
  chemically synthesized
tttgtgtgttccaacttcttgc

SEQ ID NO: 818634 - DNA, 22 bp, Artificial Sequence
  chemically synthesized
tgtgtgttccaacttcttgcct

SEQ ID NO: 818635 - DNA, 22 bp, Artificial Sequence
  chemically synthesized
gtgtgttccaacttcttgcctc

SEQ ID NO: 818636 - DNA, 22 bp, Artificial Sequence
  chemically synthesized
tgtgttccaacttcttgcctct

SEQ ID NO: 818637 - DNA, 22 bp, Artificial Sequence
  chemically synthesized
gagaaggtccccgcagagaggc

SEQ ID NO: 818638 - DNA, 22 bp, Artificial Sequence
  chemically synthesized
tagagaaggtccccgcagagag

SEQ ID NO: 818639 - DNA, 22 bp, Artificial Sequence
  chemically synthesized
caacttcttgcctctctgcggg

SEQ ID NO: 818640 - DNA, 22 bp, Artificial Sequence
  chemically synthesized
cttgcctctctgcggggacctt

SEQ ID NO: 818641 - DNA, 22 bp, Artificial Sequence
  chemically synthesized
aagtctctagagaaggtccccg

SEQ ID NO: 818642 - DNA, 22 bp, Artificial Sequence
  chemically synthesized
ttgcctctctgcggggaccttc

SEQ ID NO: 818643 - DNA, 22 bp, Artificial Sequence
  chemically synthesized
gaagtctctagagaaggtcccc

SEQ ID NO: 818644 - DNA, 22 bp, Artificial Sequence
  chemically synthesized
gcctctctgcggggaccttctc

SEQ ID NO: 818645 - DNA, 22 bp, Artificial Sequence
  chemically synthesized
cctctctgcggggaccttctct

SEQ ID NO: 818646 - DNA, 22 bp, Artificial Sequence
  chemically synthesized
atgtttgaagtctctagagaag

SEQ ID NO: 818647 - DNA, 22 bp, Artificial Sequence
  chemically synthesized
tctgcggggaccttctctagag

SEQ ID NO: 818648 - DNA, 22 bp, Artificial Sequence
  chemically synthesized
tgcggggaccttctctagagac

SEQ ID NO: 818649 - DNA, 22 bp, Artificial Sequence
  chemically synthesized
cggggaccttctctagagactt

SEQ ID NO: 818650 - DNA, 22 bp, Artificial Sequence
  chemically synthesized
ctctagagacttcaaacatgag

SEQ ID NO: 818651 - DNA, 22 bp, Artificial Sequence
  chemically synthesized
tctagagacttcaaacatgagt

SEQ ID NO: 818652 - DNA, 22 bp, Artificial Sequence
  chemically synthesized
tagagacttcaaacatgagtgt

SEQ ID NO: 818653 - DNA, 22 bp, Artificial Sequence
  chemically synthesized
aagatgagagagacactcatgt

SEQ ID NO: 818654 - DNA, 22 bp, Artificial Sequence
  chemically synthesized
aaagatgagagagacactcatg

SEQ ID NO: 818655 - DNA, 22 bp, Artificial Sequence
  chemically synthesized
gagacttcaaacatgagtgtct

SEQ ID NO: 818656 - DNA, 22 bp, Artificial Sequence
  chemically synthesized
tttaaagatgagagagacactc

SEQ ID NO: 818657 - DNA, 22 bp, Artificial Sequence
  chemically synthesized
ttgtttaaagatgagagagaca

SEQ ID NO: 818658 - DNA, 22 bp, Artificial Sequence
  chemically synthesized
caaacatgagtgtctctctcat

SEQ ID NO: 818659 - DNA, 22 bp, Artificial Sequence
  chemically synthesized
aaacatgagtgtctctctcatc

SEQ ID NO: 818660 - DNA, 22 bp, Artificial Sequence
  chemically synthesized
ttgttgtttaaagatgagagag

SEQ ID NO: 818661 - DNA, 22 bp, Artificial Sequence
  chemically synthesized
ttgttgttgtttaaagatgaga

SEQ ID NO: 818662 - DNA, 22 bp, Artificial Sequence
  chemically synthesized
ttgttgttgttgtttaaagatg

SEQ ID NO: 818663 - DNA, 22 bp, Artificial Sequence
  chemically synthesized
ttgttgttgttgttgtttaaag

SEQ ID NO: 818664 - DNA, 22 bp, Artificial Sequence
  chemically synthesized
tctcatctttaaacaacaacaa

SEQ ID NO: 818665 - DNA, 22 bp, Artificial Sequence
  chemically synthesized
tcatctttaaacaacaacaaca

SEQ ID NO: 818666 - DNA, 22 bp, Artificial Sequence
  chemically synthesized
atctttaaacaacaacaacaac

SEQ ID NO: 818667 - DNA, 22 bp, Artificial Sequence
  chemically synthesized
taaacaacaacaacaacaataa

SEQ ID NO: 818668 - DNA, 22 bp, Artificial Sequence
  chemically synthesized
aaacaacaacaacaacaataat

SEQ ID NO: 818669 - DNA, 22 bp, Artificial Sequence
  chemically synthesized
aacaacaacaacaacaataatc

SEQ ID NO: 818670 - DNA, 22 bp, Artificial Sequence
  chemically synthesized
tgaaaggaaagaaaatgataga

SEQ ID NO: 818671 - DNA, 22 bp, Artificial Sequence
  chemically synthesized
cactctatcattttctttcctt

SEQ ID NO: 818672 - DNA, 22 bp, Artificial Sequence
  chemically synthesized
aagagtgtgactgtgaaaggaa

SEQ ID NO: 818673 - DNA, 22 bp, Artificial Sequence
  chemically synthesized
tatcattttctttcctttcaca

SEQ ID NO: 818674 - DNA, 22 bp, Artificial Sequence
  chemically synthesized
taaagagtgtgactgtgaaagg

SEQ ID NO: 818675 - DNA, 22 bp, Artificial Sequence
  chemically synthesized
tcattttctttcctttcacagt

SEQ ID NO: 818676 - DNA, 22 bp, Artificial Sequence
  chemically synthesized
ctaaagagtgtgactgtgaaag

SEQ ID NO: 818677 - DNA, 22 bp, Artificial Sequence
  chemically synthesized
ccttctaaagagtgtgactgtg

SEQ ID NO: 818678 - DNA, 22 bp, Artificial Sequence
  chemically synthesized
tctttcctttcacagtcacact

SEQ ID NO: 818679 - DNA, 22 bp, Artificial Sequence
  chemically synthesized
ctttcctttcacagtcacactc

SEQ ID NO: 818680 - DNA, 22 bp, Artificial Sequence
  chemically synthesized
tttcctttcacagtcacactct

SEQ ID NO: 818681 - DNA, 22 bp, Artificial Sequence
  chemically synthesized
tcctttcacagtcacactcttt

SEQ ID NO: 818682 - DNA, 22 bp, Artificial Sequence
  chemically synthesized
cctttcacagtcacactcttta

SEQ ID NO: 818683 - DNA, 22 bp, Artificial Sequence
  chemically synthesized
ctttcacagtcacactctttag

SEQ ID NO: 818684 - DNA, 22 bp, Artificial Sequence
  chemically synthesized
tcacagtcacactctttagaag

SEQ ID NO: 818685 - DNA, 22 bp, Artificial Sequence
  chemically synthesized
cacagtcacactctttagaagg

SEQ ID NO: 818686 - DNA, 22 bp, Artificial Sequence
  chemically synthesized
acagtcacactctttagaaggc

SEQ ID NO: 818687 - DNA, 22 bp, Artificial Sequence
  chemically synthesized
agataatgagtgaatatctgcc

SEQ ID NO: 818688 - DNA, 22 bp, Artificial Sequence
  chemically synthesized
tttagaaggcagatattcactc

SEQ ID NO: 818689 - DNA, 22 bp, Artificial Sequence
  chemically synthesized
tagaaggcagatattcactcat

SEQ ID NO: 818690 - DNA, 22 bp, Artificial Sequence
  chemically synthesized
agaaggcagatattcactcatt

SEQ ID NO: 818691 - DNA, 22 bp, Artificial Sequence
  chemically synthesized
gaaggcagatattcactcatta

SEQ ID NO: 818692 - DNA, 22 bp, Artificial Sequence
  chemically synthesized
actcattatctcaacttgacta

SEQ ID NO: 818693 - DNA, 22 bp, Artificial Sequence
  chemically synthesized
attatctcaacttgactacatt

SEQ ID NO: 818694 - DNA, 22 bp, Artificial Sequence
  chemically synthesized
gagagtggcacgaatgtagtca

SEQ ID NO: 818695 - DNA, 22 bp, Artificial Sequence
  chemically synthesized
tctcaacttgactacattcgtg

SEQ ID NO: 818696 - DNA, 22 bp, Artificial Sequence
  chemically synthesized
aacttgactacattcgtgccac

SEQ ID NO: 818697 - DNA, 22 bp, Artificial Sequence
  chemically synthesized
atgaattggagagtggcacgaa

SEQ ID NO: 818698 - DNA, 22 bp, Artificial Sequence
  chemically synthesized
catgaattggagagtggcacga

SEQ ID NO: 818699 - DNA, 22 bp, Artificial Sequence
  chemically synthesized
tcatgaattggagagtggcacg

SEQ ID NO: 818700 - DNA, 22 bp, Artificial Sequence
  chemically synthesized
gactacattcgtgccactctcc

SEQ ID NO: 818701 - DNA, 22 bp, Artificial Sequence
  chemically synthesized
actacattcgtgccactctcca

SEQ ID NO: 818702 - DNA, 22 bp, Artificial Sequence
  chemically synthesized
attttcatgaattggagagtgg

SEQ ID NO: 818703 - DNA, 22 bp, Artificial Sequence
  chemically synthesized
cattcgtgccactctccaattc

SEQ ID NO: 818704 - DNA, 22 bp, Artificial Sequence
  chemically synthesized
gtgccactctccaattcatgaa

SEQ ID NO: 818705 - DNA, 22 bp, Artificial Sequence
  chemically synthesized
tccaattcatgaaaatcaggct

SEQ ID NO: 818706 - DNA, 22 bp, Artificial Sequence
  chemically synthesized
caattcatgaaaatcaggcttc

SEQ ID NO: 818707 - DNA, 22 bp, Artificial Sequence
  chemically synthesized
gtggaacgatgatggcagaagc

SEQ ID NO: 818708 - DNA, 22 bp, Artificial Sequence
  chemically synthesized
atgaaaatcaggcttctgccat

SEQ ID NO: 818709 - DNA, 22 bp, Artificial Sequence
  chemically synthesized
agtggaacgatgatggcagaag

SEQ ID NO: 818710 - DNA, 22 bp, Artificial Sequence
  chemically synthesized
tagtggaacgatgatggcagaa

SEQ ID NO: 818711 - DNA, 22 bp, Artificial Sequence
  chemically synthesized
tcagaatagttttagtggaacg

SEQ ID NO: 818712 - DNA, 22 bp, Artificial Sequence
  chemically synthesized
ctgccatcatcgttccactaaa

SEQ ID NO: 818713 - DNA, 22 bp, Artificial Sequence
  chemically synthesized
tgtcagaatagttttagtggaa

SEQ ID NO: 818714 - DNA, 22 bp, Artificial Sequence
  chemically synthesized
tgccatcatcgttccactaaaa

SEQ ID NO: 818715 - DNA, 22 bp, Artificial Sequence
  chemically synthesized
ctgtcagaatagttttagtgga

SEQ ID NO: 818716 - DNA, 22 bp, Artificial Sequence
  chemically synthesized
ccatcatcgttccactaaaact

SEQ ID NO: 818717 - DNA, 22 bp, Artificial Sequence
  chemically synthesized
ccatagtgacttctgtcagaat

SEQ ID NO: 818718 - DNA, 22 bp, Artificial Sequence
  chemically synthesized
gccatagtgacttctgtcagaa

SEQ ID NO: 818719 - DNA, 22 bp, Artificial Sequence
  chemically synthesized
cactaaaactattctgacagaa

SEQ ID NO: 818720 - DNA, 22 bp, Artificial Sequence
  chemically synthesized
aatttgccatagtgacttctgt

SEQ ID NO: 818721 - DNA, 22 bp, Artificial Sequence
  chemically synthesized
aaactattctgacagaagtcac

SEQ ID NO: 818722 - DNA, 22 bp, Artificial Sequence
  chemically synthesized
ttctgacagaagtcactatggc

SEQ ID NO: 818723 - DNA, 22 bp, Artificial Sequence
  chemically synthesized
tgacagaagtcactatggcaaa

SEQ ID NO: 818724 - DNA, 22 bp, Artificial Sequence
  chemically synthesized
acagaagtcactatggcaaatt

SEQ ID NO: 818725 - DNA, 22 bp, Artificial Sequence
  chemically synthesized
gggccagtaattcaatttgcca

SEQ ID NO: 818726 - DNA, 22 bp, Artificial Sequence
  chemically synthesized
tggcaaattgaattactggccc

SEQ ID NO: 818727 - DNA, 22 bp, Artificial Sequence
  chemically synthesized
aattactggccccaattcttta

SEQ ID NO: 818728 - DNA, 22 bp, Artificial Sequence
  chemically synthesized
ctggccccaattctttacctct

SEQ ID NO: 818729 - DNA, 22 bp, Artificial Sequence
  chemically synthesized
gccccaattctttacctctccc

SEQ ID NO: 818730 - DNA, 22 bp, Artificial Sequence
  chemically synthesized
gcaaagggcatggatacaggga

SEQ ID NO: 818731 - DNA, 22 bp, Artificial Sequence
  chemically synthesized
agcaaagggcatggatacaggg

SEQ ID NO: 818732 - DNA, 22 bp, Artificial Sequence
  chemically synthesized
tttacctctccctgtatccatg

SEQ ID NO: 818733 - DNA, 22 bp, Artificial Sequence
  chemically synthesized
cttagcaaagggcatggataca

SEQ ID NO: 818734 - DNA, 22 bp, Artificial Sequence
  chemically synthesized
tacctctccctgtatccatgcc

SEQ ID NO: 818735 - DNA, 22 bp, Artificial Sequence
  chemically synthesized
acctctccctgtatccatgccc

SEQ ID NO: 818736 - DNA, 22 bp, Artificial Sequence
  chemically synthesized
cctctccctgtatccatgccct

SEQ ID NO: 818737 - DNA, 22 bp, Artificial Sequence
  chemically synthesized
agagttacttagcaaagggcat

SEQ ID NO: 818738 - DNA, 22 bp, Artificial Sequence
  chemically synthesized
tccctgtatccatgccctttgc

SEQ ID NO: 818739 - DNA, 22 bp, Artificial Sequence
  chemically synthesized
cagagttacttagcaaagggca

SEQ ID NO: 818740 - DNA, 22 bp, Artificial Sequence
  chemically synthesized
cctgtatccatgccctttgcta

SEQ ID NO: 818741 - DNA, 22 bp, Artificial Sequence
  chemically synthesized
tatccatgccctttgctaagta

SEQ ID NO: 818742 - DNA, 22 bp, Artificial Sequence
  chemically synthesized
gtaggaagaatttcagagttac

SEQ ID NO: 818743 - DNA, 22 bp, Artificial Sequence
  chemically synthesized
cgtaggaagaatttcagagtta

SEQ ID NO: 818744 - DNA, 22 bp, Artificial Sequence
  chemically synthesized
tcgtaggaagaatttcagagtt

SEQ ID NO: 818745 - DNA, 22 bp, Artificial Sequence
  chemically synthesized
tgctaagtaactctgaaattct

SEQ ID NO: 818746 - DNA, 22 bp, Artificial Sequence
  chemically synthesized
tctttcgtaggaagaatttcag

SEQ ID NO: 818747 - DNA, 22 bp, Artificial Sequence
  chemically synthesized
gctaagtaactctgaaattctt

SEQ ID NO: 818748 - DNA, 22 bp, Artificial Sequence
  chemically synthesized
ctaagtaactctgaaattcttc

SEQ ID NO: 818749 - DNA, 22 bp, Artificial Sequence
  chemically synthesized
agtaactctgaaattcttccta

SEQ ID NO: 818750 - DNA, 22 bp, Artificial Sequence
  chemically synthesized
tgaaattcttcctacgaaagac

SEQ ID NO: 818751 - DNA, 22 bp, Artificial Sequence
  chemically synthesized
aaattcttcctacgaaagacag

SEQ ID NO: 818752 - DNA, 22 bp, Artificial Sequence
  chemically synthesized
aatgtcaagggcatgctgtctt

SEQ ID NO: 818753 - DNA, 22 bp, Artificial Sequence
  chemically synthesized
ttcctacgaaagacagcatgcc

SEQ ID NO: 818754 - DNA, 22 bp, Artificial Sequence
  chemically synthesized
cctacgaaagacagcatgccct

SEQ ID NO: 818755 - DNA, 22 bp, Artificial Sequence
  chemically synthesized
ctacgaaagacagcatgccctt

SEQ ID NO: 818756 - DNA, 22 bp, Artificial Sequence
  chemically synthesized
cgaaagacagcatgcccttgac

SEQ ID NO: 818757 - DNA, 22 bp, Artificial Sequence
  chemically synthesized
ggcaaagcaaggcgcatgacca

SEQ ID NO: 818758 - DNA, 22 bp, Artificial Sequence
  chemically synthesized
gacattgagcttggtcatgcgc

SEQ ID NO: 818759 - DNA, 22 bp, Artificial Sequence
  chemically synthesized
acattgagcttggtcatgcgcc

SEQ ID NO: 818760 - DNA, 22 bp, Artificial Sequence
  chemically synthesized
ggattaggcaaagcaaggcgca

SEQ ID NO: 818761 - DNA, 22 bp, Artificial Sequence
  chemically synthesized
agcttggtcatgcgccttgctt

SEQ ID NO: 818762 - DNA, 22 bp, Artificial Sequence
  chemically synthesized
ggtcatgcgccttgctttgcct

SEQ ID NO: 818763 - DNA, 22 bp, Artificial Sequence
  chemically synthesized
gtcatgcgccttgctttgccta

SEQ ID NO: 818764 - DNA, 22 bp, Artificial Sequence
  chemically synthesized
gtaatatcccactgggattagg

SEQ ID NO: 818765 - DNA, 22 bp, Artificial Sequence
  chemically synthesized
tagtaatatcccactgggatta

SEQ ID NO: 818766 - DNA, 22 bp, Artificial Sequence
  chemically synthesized
ctagtaatatcccactgggatt

SEQ ID NO: 818767 - DNA, 22 bp, Artificial Sequence
  chemically synthesized
gctttgcctaatcccagtggga

SEQ ID NO: 818768 - DNA, 22 bp, Artificial Sequence
  chemically synthesized
cttctagtaatatcccactggg

SEQ ID NO: 818769 - DNA, 22 bp, Artificial Sequence
  chemically synthesized
ctttgcctaatcccagtgggat

SEQ ID NO: 818770 - DNA, 22 bp, Artificial Sequence
  chemically synthesized
tgcctaatcccagtgggatatt

SEQ ID NO: 818771 - DNA, 22 bp, Artificial Sequence
  chemically synthesized
gcctaatcccagtgggatatta

SEQ ID NO: 818772 - DNA, 22 bp, Artificial Sequence
  chemically synthesized
tgttacttctagtaatatccca

SEQ ID NO: 818773 - DNA, 22 bp, Artificial Sequence
  chemically synthesized
cctaatcccagtgggatattac

SEQ ID NO: 818774 - DNA, 22 bp, Artificial Sequence
  chemically synthesized
gtgttacttctagtaatatccc

SEQ ID NO: 818775 - DNA, 22 bp, Artificial Sequence
  chemically synthesized
cttgtgttacttctagtaatat

SEQ ID NO: 818776 - DNA, 22 bp, Artificial Sequence
  chemically synthesized
atcccagtgggatattactaga

SEQ ID NO: 818777 - DNA, 22 bp, Artificial Sequence
  chemically synthesized
tgcttgtgttacttctagtaat

SEQ ID NO: 818778 - DNA, 22 bp, Artificial Sequence
  chemically synthesized
aagcctctgcttgtgttacttc

SEQ ID NO: 818779 - DNA, 22 bp, Artificial Sequence
  chemically synthesized
caagcctctgcttgtgttactt

SEQ ID NO: 818780 - DNA, 22 bp, Artificial Sequence
  chemically synthesized
ctagaagtaacacaagcagagg

SEQ ID NO: 818781 - DNA, 22 bp, Artificial Sequence
  chemically synthesized
gaagtaacacaagcagaggctt

SEQ ID NO: 818782 - DNA, 22 bp, Artificial Sequence
  chemically synthesized
cataaatacatttcaagcctct

SEQ ID NO: 818783 - DNA, 22 bp, Artificial Sequence
  chemically synthesized
gaaatgtatttatgcagtgtgg

SEQ ID NO: 818784 - DNA, 22 bp, Artificial Sequence
  chemically synthesized
aaatgtatttatgcagtgtggc

SEQ ID NO: 818785 - DNA, 22 bp, Artificial Sequence
  chemically synthesized
atgcagtgtggctatccctttt

SEQ ID NO: 818786 - DNA, 22 bp, Artificial Sequence
  chemically synthesized
tgcagtgtggctatcccttttg

SEQ ID NO: 818787 - DNA, 22 bp, Artificial Sequence
  chemically synthesized
aggtaatggtgaagtgcaaaag

SEQ ID NO: 818788 - DNA, 22 bp, Artificial Sequence
  chemically synthesized
aaggtaatggtgaagtgcaaaa

SEQ ID NO: 818789 - DNA, 22 bp, Artificial Sequence
  chemically synthesized
tcttaaggtaatggtgaagtgc

SEQ ID NO: 818790 - DNA, 22 bp, Artificial Sequence
  chemically synthesized
gtcttaaggtaatggtgaagtg

SEQ ID NO: 818791 - DNA, 22 bp, Artificial Sequence
  chemically synthesized
tcccttttgcacttcaccatta

SEQ ID NO: 818792 - DNA, 22 bp, Artificial Sequence
  chemically synthesized
ttgcacttcaccattaccttaa

SEQ ID NO: 818793 - DNA, 22 bp, Artificial Sequence
  chemically synthesized
tgcacttcaccattaccttaag

SEQ ID NO: 818794 - DNA, 22 bp, Artificial Sequence
  chemically synthesized
gcacttcaccattaccttaaga

SEQ ID NO: 818795 - DNA, 22 bp, Artificial Sequence
  chemically synthesized
cacttcaccattaccttaagac

SEQ ID NO: 818796 - DNA, 22 bp, Artificial Sequence
  chemically synthesized
gtccagagcatgtttgtcttaa

SEQ ID NO: 818797 - DNA, 22 bp, Artificial Sequence
  chemically synthesized
caccattaccttaagacaaaca

SEQ ID NO: 818798 - DNA, 22 bp, Artificial Sequence
  chemically synthesized
accattaccttaagacaaacat

SEQ ID NO: 818799 - DNA, 22 bp, Artificial Sequence
  chemically synthesized
ccttaagacaaacatgctctgg

SEQ ID NO: 818800 - DNA, 22 bp, Artificial Sequence
  chemically synthesized
aagacaaacatgctctggacta

SEQ ID NO: 818801 - DNA, 22 bp, Artificial Sequence
  chemically synthesized
agatgagtaggctagtccagag

SEQ ID NO: 818802 - DNA, 22 bp, Artificial Sequence
  chemically synthesized
agacaaacatgctctggactag

SEQ ID NO: 818803 - DNA, 22 bp, Artificial Sequence
  chemically synthesized
ctgagatgagtaggctagtcca

SEQ ID NO: 818804 - DNA, 22 bp, Artificial Sequence
  chemically synthesized
ctcctgagatgagtaggctagt

SEQ ID NO: 818805 - DNA, 22 bp, Artificial Sequence
  chemically synthesized
tcctcctgagatgagtaggcta

SEQ ID NO: 818806 - DNA, 22 bp, Artificial Sequence
  chemically synthesized
attctcctcctgagatgagtag

SEQ ID NO: 818807 - DNA, 22 bp, Artificial Sequence
  chemically synthesized
tggactagcctactcatctcag

SEQ ID NO: 818808 - DNA, 22 bp, Artificial Sequence
  chemically synthesized
gactagcctactcatctcagga

SEQ ID NO: 818809 - DNA, 22 bp, Artificial Sequence
  chemically synthesized
gcctactcatctcaggaggaga

SEQ ID NO: 818810 - DNA, 22 bp, Artificial Sequence
  chemically synthesized
catatgtcactcattctcctcc

SEQ ID NO: 818811 - DNA, 22 bp, Artificial Sequence
  chemically synthesized
ctcatctcaggaggagaatgag

SEQ ID NO: 818812 - DNA, 22 bp, Artificial Sequence
  chemically synthesized
ctccatatgtcactcattctcc

SEQ ID NO: 818813 - DNA, 22 bp, Artificial Sequence
  chemically synthesized
tgctccatatgtcactcattct

SEQ ID NO: 818814 - DNA, 22 bp, Artificial Sequence
  chemically synthesized
atctcaggaggagaatgagtga

SEQ ID NO: 818815 - DNA, 22 bp, Artificial Sequence
  chemically synthesized
aggaggagaatgagtgacatat

SEQ ID NO: 818816 - DNA, 22 bp, Artificial Sequence
  chemically synthesized
gggtcgctctgctccatatgtc

SEQ ID NO: 818817 - DNA, 22 bp, Artificial Sequence
  chemically synthesized
attggggtcgctctgctccata

SEQ ID NO: 818818 - DNA, 22 bp, Artificial Sequence
  chemically synthesized
caggttgattggggtcgctctg

SEQ ID NO: 818819 - DNA, 22 bp, Artificial Sequence
  chemically synthesized
atgttgcaggttgattggggtc

SEQ ID NO: 818820 - DNA, 22 bp, Artificial Sequence
  chemically synthesized
catgttgcaggttgattggggt

SEQ ID NO: 818821 - DNA, 22 bp, Artificial Sequence
  chemically synthesized
ttcatgttgcaggttgattggg

SEQ ID NO: 818822 - DNA, 22 bp, Artificial Sequence
  chemically synthesized
cttcatgttgcaggttgattgg

SEQ ID NO: 818823 - DNA, 22 bp, Artificial Sequence
  chemically synthesized
ggtggggtggcacttcttcatg

SEQ ID NO: 818824 - DNA, 22 bp, Artificial Sequence
  chemically synthesized
gggtggggtggcacttcttcat

SEQ ID NO: 818825 - DNA, 22 bp, Artificial Sequence
  chemically synthesized
agcttgggtggggtggcacttc

SEQ ID NO: 818826 - DNA, 22 bp, Artificial Sequence
  chemically synthesized
cagcttgggtggggtggcactt

SEQ ID NO: 818827 - DNA, 22 bp, Artificial Sequence
  chemically synthesized
tcagcttgggtggggtggcact

SEQ ID NO: 818828 - DNA, 22 bp, Artificial Sequence
  chemically synthesized
caacatgaagaagtgccacccc

SEQ ID NO: 818829 - DNA, 22 bp, Artificial Sequence
  chemically synthesized
atgaattttcagcttgggtggg

SEQ ID NO: 818830 - DNA, 22 bp, Artificial Sequence
  chemically synthesized
catgaattttcagcttgggtgg

SEQ ID NO: 818831 - DNA, 22 bp, Artificial Sequence
  chemically synthesized
tcatgaattttcagcttgggtg

SEQ ID NO: 818832 - DNA, 22 bp, Artificial Sequence
  chemically synthesized
cctttcatgaattttcagcttg

SEQ ID NO: 818833 - DNA, 22 bp, Artificial Sequence
  chemically synthesized
aaaattcatgaaaggcaatatg

SEQ ID NO: 818834 - DNA, 22 bp, Artificial Sequence
  chemically synthesized
atgaaaggcaatatgggcttat

SEQ ID NO: 818835 - DNA, 22 bp, Artificial Sequence
  chemically synthesized
acaaatgtgagtggcatatagc

SEQ ID NO: 818836 - DNA, 22 bp, Artificial Sequence
  chemically synthesized
cacaaatgtgagtggcatatag

SEQ ID NO: 818837 - DNA, 22 bp, Artificial Sequence
  chemically synthesized
tcacaaatgtgagtggcatata

SEQ ID NO: 818838 - DNA, 22 bp, Artificial Sequence
  chemically synthesized
ttttcacaaatgtgagtggcat

SEQ ID NO: 818839 - DNA, 22 bp, Artificial Sequence
  chemically synthesized
attgctatatgccactcacatt

SEQ ID NO: 818840 - DNA, 22 bp, Artificial Sequence
  chemically synthesized
actattttcacaaatgtgagtg

SEQ ID NO: 818841 - DNA, 22 bp, Artificial Sequence
  chemically synthesized
ttgctatatgccactcacattt

SEQ ID NO: 818842 - DNA, 22 bp, Artificial Sequence
  chemically synthesized
ctatatgccactcacatttgtg

SEQ ID NO: 818843 - DNA, 22 bp, Artificial Sequence
  chemically synthesized
tatgccactcacatttgtgaaa

SEQ ID NO: 818844 - DNA, 22 bp, Artificial Sequence
  chemically synthesized
aatcagttaactattttcacaa

SEQ ID NO: 818845 - DNA, 22 bp, Artificial Sequence
  chemically synthesized
gtaactgaatcagttaactatt

SEQ ID NO: 818846 - DNA, 22 bp, Artificial Sequence
  chemically synthesized
acatttgtgaaaatagttaact

SEQ ID NO: 818847 - DNA, 22 bp, Artificial Sequence
  chemically synthesized
ggtaactgaatcagttaactat

SEQ ID NO: 818848 - DNA, 22 bp, Artificial Sequence
  chemically synthesized
tggtaactgaatcagttaacta

SEQ ID NO: 818849 - DNA, 22 bp, Artificial Sequence
  chemically synthesized
ttggtaactgaatcagttaact

SEQ ID NO: 818850 - DNA, 22 bp, Artificial Sequence
  chemically synthesized
gtgaaaatagttaactgattca

SEQ ID NO: 818851 - DNA, 22 bp, Artificial Sequence
  chemically synthesized
gcttttggtaactgaatcagtt

SEQ ID NO: 818852 - DNA, 22 bp, Artificial Sequence
  chemically synthesized
tgaaaatagttaactgattcag

SEQ ID NO: 818853 - DNA, 22 bp, Artificial Sequence
  chemically synthesized
cataggcattggcttttggtaa

SEQ ID NO: 818854 - DNA, 22 bp, Artificial Sequence
  chemically synthesized
ccataggcattggcttttggta

SEQ ID NO: 818855 - DNA, 22 bp, Artificial Sequence
  chemically synthesized
actgattcagttaccaaaagcc

SEQ ID NO: 818856 - DNA, 22 bp, Artificial Sequence
  chemically synthesized
tccataggcattggcttttggt

SEQ ID NO: 818857 - DNA, 22 bp, Artificial Sequence
  chemically synthesized
attcagttaccaaaagccaatg

SEQ ID NO: 818858 - DNA, 22 bp, Artificial Sequence
  chemically synthesized
aatctttccataggcattggct

SEQ ID NO: 818859 - DNA, 22 bp, Artificial Sequence
  chemically synthesized
aaatctttccataggcattggc

SEQ ID NO: 818860 - DNA, 22 bp, Artificial Sequence
  chemically synthesized
agttaccaaaagccaatgccta

SEQ ID NO: 818861 - DNA, 22 bp, Artificial Sequence
  chemically synthesized
ccaaaagccaatgcctatggaa

SEQ ID NO: 818862 - DNA, 22 bp, Artificial Sequence
  chemically synthesized
tggaaagatttaagttcttatt

SEQ ID NO: 818863 - DNA, 22 bp, Artificial Sequence
  chemically synthesized
caaataaatcaagtaaataaga

SEQ ID NO: 818864 - DNA, 22 bp, Artificial Sequence
  chemically synthesized
ctgcaaataaatcaagtaaata

SEQ ID NO: 818865 - DNA, 22 bp, Artificial Sequence
  chemically synthesized
aagttcttatttacttgattta

SEQ ID NO: 818866 - DNA, 22 bp, Artificial Sequence
  chemically synthesized
agttcttatttacttgatttat

SEQ ID NO: 818867 - DNA, 22 bp, Artificial Sequence
  chemically synthesized
ttatttacttgatttatttgca

SEQ ID NO: 818868 - DNA, 22 bp, Artificial Sequence
  chemically synthesized
atttacttgatttatttgcagc

SEQ ID NO: 818869 - DNA, 22 bp, Artificial Sequence
  chemically synthesized
tttacttgatttatttgcagca

SEQ ID NO: 818870 - DNA, 22 bp, Artificial Sequence
  chemically synthesized
acttgatttatttgcagcaact

SEQ ID NO: 818871 - DNA, 22 bp, Artificial Sequence
  chemically synthesized
cttgatttatttgcagcaactg

SEQ ID NO: 818872 - DNA, 22 bp, Artificial Sequence
  chemically synthesized
gatttatttgcagcaactggtg

SEQ ID NO: 818873 - DNA, 22 bp, Artificial Sequence
  chemically synthesized
atttatttgcagcaactggtgc

SEQ ID NO: 818874 - DNA, 22 bp, Artificial Sequence
  chemically synthesized
atttgcagcaactggtgctgct

SEQ ID NO: 818875 - DNA, 22 bp, Artificial Sequence
  chemically synthesized
tttgcagcaactggtgctgctg

SEQ ID NO: 818876 - DNA, 22 bp, Artificial Sequence
  chemically synthesized
gagaagagaatagtcagcagca

SEQ ID NO: 818877 - DNA, 22 bp, Artificial Sequence
  chemically synthesized
gcagcaactggtgctgctgact

SEQ ID NO: 818878 - DNA, 22 bp, Artificial Sequence
  chemically synthesized
cgagaagagaatagtcagcagc

SEQ ID NO: 818879 - DNA, 22 bp, Artificial Sequence
  chemically synthesized
cagcaactggtgctgctgacta

SEQ ID NO: 818880 - DNA, 22 bp, Artificial Sequence
  chemically synthesized
gtgctgctgactattctcttct

SEQ ID NO: 818881 - DNA, 22 bp, Artificial Sequence
  chemically synthesized
ctgactattctcttctcgaagt

SEQ ID NO: 818882 - DNA, 22 bp, Artificial Sequence
  chemically synthesized
actattctcttctcgaagttct

SEQ ID NO: 818883 - DNA, 22 bp, Artificial Sequence
  chemically synthesized
ttctcttctcgaagttctctgc

SEQ ID NO: 818884 - DNA, 22 bp, Artificial Sequence
  chemically synthesized
tcttctcgaagttctctgcttt

SEQ ID NO: 818885 - DNA, 22 bp, Artificial Sequence
  chemically synthesized
ttctcgaagttctctgctttct

SEQ ID NO: 818886 - DNA, 22 bp, Artificial Sequence
  chemically synthesized
ctcgaagttctctgctttcttg

SEQ ID NO: 818887 - DNA, 22 bp, Artificial Sequence
  chemically synthesized
tcgaagttctctgctttcttgg

SEQ ID NO: 818888 - DNA, 22 bp, Artificial Sequence
  chemically synthesized
gaagttctctgctttcttggct

SEQ ID NO: 818889 - DNA, 22 bp, Artificial Sequence
  chemically synthesized
tctgctttcttggcttccactc

SEQ ID NO: 818890 - DNA, 22 bp, Artificial Sequence
  chemically synthesized
tgctttcttggcttccactctt

SEQ ID NO: 818891 - DNA, 22 bp, Artificial Sequence
  chemically synthesized
ctttcttggcttccactctttt

SEQ ID NO: 818892 - DNA, 22 bp, Artificial Sequence
  chemically synthesized
tcttggcttccactcttttggt

SEQ ID NO: 818893 - DNA, 22 bp, Artificial Sequence
  chemically synthesized
cttggcttccactcttttggtc

SEQ ID NO: 818894 - DNA, 22 bp, Artificial Sequence
  chemically synthesized
ttggcttccactcttttggtcg

SEQ ID NO: 818895 - DNA, 22 bp, Artificial Sequence
  chemically synthesized
ggcttccactcttttggtcgcc

SEQ ID NO: 818896 - DNA, 22 bp, Artificial Sequence
  chemically synthesized
agagaatacagaggcgaccaaa

SEQ ID NO: 818897 - DNA, 22 bp, Artificial Sequence
  chemically synthesized
gcttccactcttttggtcgcct

SEQ ID NO: 818898 - DNA, 22 bp, Artificial Sequence
  chemically synthesized
ccactcttttggtcgcctctgt

SEQ ID NO: 818899 - DNA, 22 bp, Artificial Sequence
  chemically synthesized
cactcttttggtcgcctctgta

SEQ ID NO: 818900 - DNA, 22 bp, Artificial Sequence
  chemically synthesized
aacactcagagaatacagaggc

SEQ ID NO: 818901 - DNA, 22 bp, Artificial Sequence
  chemically synthesized
gaacactcagagaatacagagg

SEQ ID NO: 818902 - DNA, 22 bp, Artificial Sequence
  chemically synthesized
ttttggtcgcctctgtattctc

SEQ ID NO: 818903 - DNA, 22 bp, Artificial Sequence
  chemically synthesized
ttggtcgcctctgtattctctg

SEQ ID NO: 818904 - DNA, 22 bp, Artificial Sequence
  chemically synthesized
tggtcgcctctgtattctctga

SEQ ID NO: 818905 - DNA, 22 bp, Artificial Sequence
  chemically synthesized
ggtcgcctctgtattctctgag

SEQ ID NO: 818906 - DNA, 22 bp, Artificial Sequence
  chemically synthesized
gtcgcctctgtattctctgagt

SEQ ID NO: 818907 - DNA, 22 bp, Artificial Sequence
  chemically synthesized
tgtattctctgagtgttcaagc

SEQ ID NO: 818908 - DNA, 22 bp, Artificial Sequence
  chemically synthesized
tattctctgagtgttcaagctt

SEQ ID NO: 818909 - DNA, 22 bp, Artificial Sequence
  chemically synthesized
tctgagtgttcaagcttttttt

SEQ ID NO: 818910 - DNA, 22 bp, Artificial Sequence
  chemically synthesized
tgagtgttcaagcttttttttt

SEQ ID NO: 818911 - DNA, 22 bp, Artificial Sequence
  chemically synthesized
agtgttcaagcttttttttttt

SEQ ID NO: 818912 - DNA, 22 bp, Artificial Sequence
  chemically synthesized
aaggacaggcaaaaaaaaaaaa

SEQ ID NO: 818913 - DNA, 22 bp, Artificial Sequence
  chemically synthesized
aaaggacaggcaaaaaaaaaaa

SEQ ID NO: 818914 - DNA, 22 bp, Artificial Sequence
  chemically synthesized
aagctttttttttttttttttt

SEQ ID NO: 818915 - DNA, 22 bp, Artificial Sequence
  chemically synthesized
atatttaaaggacaggcaaaaa

SEQ ID NO: 818916 - DNA, 22 bp, Artificial Sequence
  chemically synthesized
ttttttttttttttttgcctgt

SEQ ID NO: 818917 - DNA, 22 bp, Artificial Sequence
  chemically synthesized
tttttttttttttttgcctgtc

SEQ ID NO: 818918 - DNA, 22 bp, Artificial Sequence
  chemically synthesized
ttttttttttttttgcctgtcc

SEQ ID NO: 818919 - DNA, 22 bp, Artificial Sequence
  chemically synthesized
tttttttttttttgcctgtcct

SEQ ID NO: 818920 - DNA, 22 bp, Artificial Sequence
  chemically synthesized
ttttttttttttgcctgtcctt

SEQ ID NO: 818921 - DNA, 22 bp, Artificial Sequence
  chemically synthesized
tttttttttttgcctgtccttt

SEQ ID NO: 818922 - DNA, 22 bp, Artificial Sequence
  chemically synthesized
ttttttttttgcctgtccttta

SEQ ID NO: 818923 - DNA, 22 bp, Artificial Sequence
  chemically synthesized
tttttttttgcctgtcctttaa

SEQ ID NO: 818924 - DNA, 22 bp, Artificial Sequence
  chemically synthesized
ttttttttgcctgtcctttaaa

SEQ ID NO: 818925 - DNA, 22 bp, Artificial Sequence
  chemically synthesized
tttttttgcctgtcctttaaat

SEQ ID NO: 818926 - DNA, 22 bp, Artificial Sequence
  chemically synthesized
gagaacattaatatttaaagga

SEQ ID NO: 818927 - DNA, 22 bp, Artificial Sequence
  chemically synthesized
ttttttgcctgtcctttaaata

SEQ ID NO: 818928 - DNA, 22 bp, Artificial Sequence
  chemically synthesized
ggagaacattaatatttaaagg

SEQ ID NO: 818929 - DNA, 22 bp, Artificial Sequence
  chemically synthesized
tttttgcctgtcctttaaatat

SEQ ID NO: 818930 - DNA, 22 bp, Artificial Sequence
  chemically synthesized
tggagaacattaatatttaaag

SEQ ID NO: 818931 - DNA, 22 bp, Artificial Sequence
  chemically synthesized
ttttgcctgtcctttaaatatt

SEQ ID NO: 818932 - DNA, 22 bp, Artificial Sequence
  chemically synthesized
tttgcctgtcctttaaatatta

SEQ ID NO: 818933 - DNA, 22 bp, Artificial Sequence
  chemically synthesized
ttgcctgtcctttaaatattaa

SEQ ID NO: 818934 - DNA, 22 bp, Artificial Sequence
  chemically synthesized
tgcctgtcctttaaatattaat

SEQ ID NO: 818935 - DNA, 22 bp, Artificial Sequence
  chemically synthesized
gcctgtcctttaaatattaatg

SEQ ID NO: 818936 - DNA, 22 bp, Artificial Sequence
  chemically synthesized
cctgtcctttaaatattaatgt

SEQ ID NO: 818937 - DNA, 22 bp, Artificial Sequence
  chemically synthesized
tcctttaaatattaatgttctc

SEQ ID NO: 818938 - DNA, 22 bp, Artificial Sequence
  chemically synthesized
taaatattaatgttctccaaaa

SEQ ID NO: 818939 - DNA, 22 bp, Artificial Sequence
  chemically synthesized
aaatattaatgttctccaaaat

SEQ ID NO: 818940 - DNA, 22 bp, Artificial Sequence
  chemically synthesized
aatattaatgttctccaaaatt

SEQ ID NO: 818941 - DNA, 22 bp, Artificial Sequence
  chemically synthesized
atccagagacagaattttggag

SEQ ID NO: 818942 - DNA, 22 bp, Artificial Sequence
  chemically synthesized
atgttctccaaaattctgtctc

SEQ ID NO: 818943 - DNA, 22 bp, Artificial Sequence
  chemically synthesized
tccaaaattctgtctctggatc

SEQ ID NO: 818944 - DNA, 22 bp, Artificial Sequence
  chemically synthesized
caaaattctgtctctggatcaa

SEQ ID NO: 818945 - DNA, 22 bp, Artificial Sequence
  chemically synthesized
aggaccaacatatcagattgat

SEQ ID NO: 818946 - DNA, 22 bp, Artificial Sequence
  chemically synthesized
tgtctctggatcaatctgatat

SEQ ID NO: 818947 - DNA, 22 bp, Artificial Sequence
  chemically synthesized
tctctggatcaatctgatatgt

SEQ ID NO: 818948 - DNA, 22 bp, Artificial Sequence
  chemically synthesized
cagttgaggaccaacatatcag

SEQ ID NO: 818949 - DNA, 22 bp, Artificial Sequence
  chemically synthesized
tggatcaatctgatatgttggt

SEQ ID NO: 818950 - DNA, 22 bp, Artificial Sequence
  chemically synthesized
ctccagttgaggaccaacatat

SEQ ID NO: 818951 - DNA, 22 bp, Artificial Sequence
  chemically synthesized
gatcaatctgatatgttggtcc

SEQ ID NO: 818952 - DNA, 22 bp, Artificial Sequence
  chemically synthesized
ctgctccagttgaggaccaaca

SEQ ID NO: 818953 - DNA, 22 bp, Artificial Sequence
  chemically synthesized
cctcctgctccagttgaggacc

SEQ ID NO: 818954 - DNA, 22 bp, Artificial Sequence
  chemically synthesized
cctgcctcctgctccagttgag

SEQ ID NO: 818955 - DNA, 22 bp, Artificial Sequence
  chemically synthesized
atatgttggtcctcaactggag

SEQ ID NO: 818956 - DNA, 22 bp, Artificial Sequence
  chemically synthesized
gtcctcaactggagcaggaggc

SEQ ID NO: 818957 - DNA, 22 bp, Artificial Sequence
  chemically synthesized
aactggagcaggaggcagggaa

SEQ ID NO: 818958 - DNA, 22 bp, Artificial Sequence
  chemically synthesized
cccagggagtatgttccctgcc

SEQ ID NO: 818959 - DNA, 22 bp, Artificial Sequence
  chemically synthesized
gagcaggaggcagggaacatac

SEQ ID NO: 818960 - DNA, 22 bp, Artificial Sequence
  chemically synthesized
tgatacaactacccagggagta

SEQ ID NO: 818961 - DNA, 22 bp, Artificial Sequence
  chemically synthesized
atgatacaactacccagggagt

SEQ ID NO: 818962 - DNA, 22 bp, Artificial Sequence
  chemically synthesized
cctgggtagttgtatcataagt

SEQ ID NO: 818963 - DNA, 22 bp, Artificial Sequence
  chemically synthesized
ggtagttgtatcataagttttt

SEQ ID NO: 818964 - DNA, 22 bp, Artificial Sequence
  chemically synthesized
aaaaaaaaaaaaaaaaaactta

SEQ ID NO: 818965 - DNA, 22 bp, Artificial Sequence
  chemically synthesized
tatcataagttttttttttttt

SEQ ID NO: 818966 - DNA, 22 bp, Artificial Sequence
  chemically synthesized
gataaaagttaaaaaaaaaaaa

SEQ ID NO: 818967 - DNA, 22 bp, Artificial Sequence
  chemically synthesized
ggataaaagttaaaaaaaaaaa

SEQ ID NO: 818968 - DNA, 22 bp, Artificial Sequence
  chemically synthesized
ttttttttttttttttaacttt

SEQ ID NO: 818969 - DNA, 22 bp, Artificial Sequence
  chemically synthesized
tttttttttttttttaactttt

SEQ ID NO: 818970 - DNA, 22 bp, Artificial Sequence
  chemically synthesized
ttttttttttttttaactttta

SEQ ID NO: 818971 - DNA, 22 bp, Artificial Sequence
  chemically synthesized
tttttttttttttaacttttat

SEQ ID NO: 818972 - DNA, 22 bp, Artificial Sequence
  chemically synthesized
ttttttttttttaacttttatc

SEQ ID NO: 818973 - DNA, 22 bp, Artificial Sequence
  chemically synthesized
tttttttttttaacttttatcc

SEQ ID NO: 818974 - DNA, 22 bp, Artificial Sequence
  chemically synthesized
ttttttttttaacttttatcca

SEQ ID NO: 818975 - DNA, 22 bp, Artificial Sequence
  chemically synthesized
tttttttttaacttttatccaa

SEQ ID NO: 818976 - DNA, 22 bp, Artificial Sequence
  chemically synthesized
ttttttttaacttttatccaaa

SEQ ID NO: 818977 - DNA, 22 bp, Artificial Sequence
  chemically synthesized
tttttttaacttttatccaaat

SEQ ID NO: 818978 - DNA, 22 bp, Artificial Sequence
  chemically synthesized
ttttttaacttttatccaaatc

SEQ ID NO: 818979 - DNA, 22 bp, Artificial Sequence
  chemically synthesized
tttttaacttttatccaaatct

SEQ ID NO: 818980 - DNA, 22 bp, Artificial Sequence
  chemically synthesized
ttttaacttttatccaaatctt

SEQ ID NO: 818981 - DNA, 22 bp, Artificial Sequence
  chemically synthesized
tttaacttttatccaaatcttc

SEQ ID NO: 818982 - DNA, 22 bp, Artificial Sequence
  chemically synthesized
ttaacttttatccaaatcttct

SEQ ID NO: 818983 - DNA, 22 bp, Artificial Sequence
  chemically synthesized
taacttttatccaaatcttcta

SEQ ID NO: 818984 - DNA, 22 bp, Artificial Sequence
  chemically synthesized
aacttttatccaaatcttctac

SEQ ID NO: 818985 - DNA, 22 bp, Artificial Sequence
  chemically synthesized
acttttatccaaatcttctact

SEQ ID NO: 818986 - DNA, 22 bp, Artificial Sequence
  chemically synthesized
ttatccaaatcttctacttcca

SEQ ID NO: 818987 - DNA, 22 bp, Artificial Sequence
  chemically synthesized
aggtagtgtcaatggaagtaga

SEQ ID NO: 818988 - DNA, 22 bp, Artificial Sequence
  chemically synthesized
tatccaaatcttctacttccat

SEQ ID NO: 818989 - DNA, 22 bp, Artificial Sequence
  chemically synthesized
atccaaatcttctacttccatt

SEQ ID NO: 818990 - DNA, 22 bp, Artificial Sequence
  chemically synthesized
tccaaatcttctacttccattg

SEQ ID NO: 818991 - DNA, 22 bp, Artificial Sequence
  chemically synthesized
ctacttccattgacactacctt

SEQ ID NO: 818992 - DNA, 22 bp, Artificial Sequence
  chemically synthesized
tacttccattgacactacctta

SEQ ID NO: 818993 - DNA, 22 bp, Artificial Sequence
  chemically synthesized
cttccattgacactaccttaat

SEQ ID NO: 818994 - DNA, 22 bp, Artificial Sequence
  chemically synthesized
ccattgacactaccttaattta

SEQ ID NO: 818995 - DNA, 22 bp, Artificial Sequence
  chemically synthesized
cattgacactaccttaatttac

SEQ ID NO: 818996 - DNA, 22 bp, Artificial Sequence
  chemically synthesized
acactaccttaatttacgtccc

SEQ ID NO: 818997 - DNA, 22 bp, Artificial Sequence
  chemically synthesized
agcaagagatgatagggacgta

SEQ ID NO: 818998 - DNA, 22 bp, Artificial Sequence
  chemically synthesized
ccttaatttacgtccctatcat

SEQ ID NO: 818999 - DNA, 22 bp, Artificial Sequence
  chemically synthesized
gtacctgagcaagagatgatag

SEQ ID NO: 819000 - DNA, 22 bp, Artificial Sequence
  chemically synthesized
aatttacgtccctatcatctct

SEQ ID NO: 819001 - DNA, 22 bp, Artificial Sequence
  chemically synthesized
agtacctgagcaagagatgata

SEQ ID NO: 819002 - DNA, 22 bp, Artificial Sequence
  chemically synthesized
atttacgtccctatcatctctt

SEQ ID NO: 819003 - DNA, 22 bp, Artificial Sequence
  chemically synthesized
tagtacctgagcaagagatgat

SEQ ID NO: 819004 - DNA, 22 bp, Artificial Sequence
  chemically synthesized
ttttagtacctgagcaagagat

SEQ ID NO: 819005 - DNA, 22 bp, Artificial Sequence
  chemically synthesized
acgtccctatcatctcttgctc

SEQ ID NO: 819006 - DNA, 22 bp, Artificial Sequence
  chemically synthesized
cgtccctatcatctcttgctca

SEQ ID NO: 819007 - DNA, 22 bp, Artificial Sequence
  chemically synthesized
tcatctcttgctcaggtactaa

SEQ ID NO: 819008 - DNA, 22 bp, Artificial Sequence
  chemically synthesized
ttgctcaggtactaaaataatc

SEQ ID NO: 819009 - DNA, 22 bp, Artificial Sequence
  chemically synthesized
gctcaggtactaaaataatctt

SEQ ID NO: 819010 - DNA, 22 bp, Artificial Sequence
  chemically synthesized
ctcaggtactaaaataatcttt

SEQ ID NO: 819011 - DNA, 22 bp, Artificial Sequence
  chemically synthesized
aggtactaaaataatctttttt

SEQ ID NO: 819012 - DNA, 22 bp, Artificial Sequence
  chemically synthesized
aaataatcttttttattggctc

SEQ ID NO: 819013 - DNA, 22 bp, Artificial Sequence
  chemically synthesized
agagtggagggagggagccaat

SEQ ID NO: 819014 - DNA, 22 bp, Artificial Sequence
  chemically synthesized
gagagtggagggagggagccaa

SEQ ID NO: 819015 - DNA, 22 bp, Artificial Sequence
  chemically synthesized
ttttattggctccctccctcca

SEQ ID NO: 819016 - DNA, 22 bp, Artificial Sequence
  chemically synthesized
tttattggctccctccctccac

SEQ ID NO: 819017 - DNA, 22 bp, Artificial Sequence
  chemically synthesized
ttattggctccctccctccact

SEQ ID NO: 819018 - DNA, 22 bp, Artificial Sequence
  chemically synthesized
tattggctccctccctccactc

SEQ ID NO: 819019 - DNA, 22 bp, Artificial Sequence
  chemically synthesized
attggctccctccctccactct

SEQ ID NO: 819020 - DNA, 22 bp, Artificial Sequence
  chemically synthesized
ttggctccctccctccactctc

SEQ ID NO: 819021 - DNA, 22 bp, Artificial Sequence
  chemically synthesized
gctccctccctccactctcaaa

SEQ ID NO: 819022 - DNA, 22 bp, Artificial Sequence
  chemically synthesized
cctccctccactctcaaaccac

SEQ ID NO: 819023 - DNA, 22 bp, Artificial Sequence
  chemically synthesized
tatgtaggtggaagggtggttt

SEQ ID NO: 819024 - DNA, 22 bp, Artificial Sequence
  chemically synthesized
cctccactctcaaaccaccctt

SEQ ID NO: 819025 - DNA, 22 bp, Artificial Sequence
  chemically synthesized
cactctcaaaccacccttccac

SEQ ID NO: 819026 - DNA, 22 bp, Artificial Sequence
  chemically synthesized
cgcagttgtatgtaggtggaag

SEQ ID NO: 819027 - DNA, 22 bp, Artificial Sequence
  chemically synthesized
acgcagttgtatgtaggtggaa

SEQ ID NO: 819028 - DNA, 22 bp, Artificial Sequence
  chemically synthesized
tcaaaccacccttccacctaca

SEQ ID NO: 819029 - DNA, 22 bp, Artificial Sequence
  chemically synthesized
aaaccacccttccacctacata

SEQ ID NO: 819030 - DNA, 22 bp, Artificial Sequence
  chemically synthesized
ccacctacatacaactgcgtaa

SEQ ID NO: 819031 - DNA, 22 bp, Artificial Sequence
  chemically synthesized
caaaaagatcatttacgcagtt

SEQ ID NO: 819032 - DNA, 22 bp, Artificial Sequence
  chemically synthesized
cacctacatacaactgcgtaaa

SEQ ID NO: 819033 - DNA, 22 bp, Artificial Sequence
  chemically synthesized
cattacaaaaagatcatttacg

SEQ ID NO: 819034 - DNA, 22 bp, Artificial Sequence
  chemically synthesized
gcattacaaaaagatcatttac

SEQ ID NO: 819035 - DNA, 22 bp, Artificial Sequence
  chemically synthesized
catacaactgcgtaaatgatct

SEQ ID NO: 819036 - DNA, 22 bp, Artificial Sequence
  chemically synthesized
tttgcattacaaaaagatcatt

SEQ ID NO: 819037 - DNA, 22 bp, Artificial Sequence
  chemically synthesized
tatttgcattacaaaaagatca

SEQ ID NO: 819038 - DNA, 22 bp, Artificial Sequence
  chemically synthesized
cgtaaatgatctttttgtaatg

SEQ ID NO: 819039 - DNA, 22 bp, Artificial Sequence
  chemically synthesized
tttgtaatgcaaatagaacctc

SEQ ID NO: 819040 - DNA, 22 bp, Artificial Sequence
  chemically synthesized
ttgtaatgcaaatagaacctca

SEQ ID NO: 819041 - DNA, 22 bp, Artificial Sequence
  chemically synthesized
tgtaatgcaaatagaacctcat

SEQ ID NO: 819042 - DNA, 22 bp, Artificial Sequence
  chemically synthesized
cacagaggagaaatgaggttct

SEQ ID NO: 819043 - DNA, 22 bp, Artificial Sequence
  chemically synthesized
gtaatgcaaatagaacctcatt

SEQ ID NO: 819044 - DNA, 22 bp, Artificial Sequence
  chemically synthesized
acacagaggagaaatgaggttc

SEQ ID NO: 819045 - DNA, 22 bp, Artificial Sequence
  chemically synthesized
taatgcaaatagaacctcattt

SEQ ID NO: 819046 - DNA, 22 bp, Artificial Sequence
  chemically synthesized
tacacagaggagaaatgaggtt

SEQ ID NO: 819047 - DNA, 22 bp, Artificial Sequence
  chemically synthesized
aaaggttttacacagaggagaa

SEQ ID NO: 819048 - DNA, 22 bp, Artificial Sequence
  chemically synthesized
atttctcctctgtgtaaaacct

SEQ ID NO: 819049 - DNA, 22 bp, Artificial Sequence
  chemically synthesized
ctcctctgtgtaaaacctttca

SEQ ID NO: 819050 - DNA, 22 bp, Artificial Sequence
  chemically synthesized
tcctctgtgtaaaacctttcaa

SEQ ID NO: 819051 - DNA, 22 bp, Artificial Sequence
  chemically synthesized
ctctgtgtaaaacctttcaatg

SEQ ID NO: 819052 - DNA, 22 bp, Artificial Sequence
  chemically synthesized
tgtgtaaaacctttcaatggtt

SEQ ID NO: 819053 - DNA, 22 bp, Artificial Sequence
  chemically synthesized
caggtaatagcaaaccattgaa

SEQ ID NO: 819054 - DNA, 22 bp, Artificial Sequence
  chemically synthesized
gcaggtaatagcaaaccattga

SEQ ID NO: 819055 - DNA, 22 bp, Artificial Sequence
  chemically synthesized
tgtaaaacctttcaatggtttg

SEQ ID NO: 819056 - DNA, 22 bp, Artificial Sequence
  chemically synthesized
tcttgcaggtaatagcaaacca

SEQ ID NO: 819057 - DNA, 22 bp, Artificial Sequence
  chemically synthesized
gtcttgcaggtaatagcaaacc

SEQ ID NO: 819058 - DNA, 22 bp, Artificial Sequence
  chemically synthesized
tgtcttgcaggtaatagcaaac

SEQ ID NO: 819059 - DNA, 22 bp, Artificial Sequence
  chemically synthesized
tcaatggtttgctattacctgc

SEQ ID NO: 819060 - DNA, 22 bp, Artificial Sequence
  chemically synthesized
ggactttgtcttgcaggtaata

SEQ ID NO: 819061 - DNA, 22 bp, Artificial Sequence
  chemically synthesized
caatggtttgctattacctgca

SEQ ID NO: 819062 - DNA, 22 bp, Artificial Sequence
  chemically synthesized
aatggtttgctattacctgcaa

SEQ ID NO: 819063 - DNA, 22 bp, Artificial Sequence
  chemically synthesized
gctattacctgcaagacaaagt

SEQ ID NO: 819064 - DNA, 22 bp, Artificial Sequence
  chemically synthesized
ctattacctgcaagacaaagtc

SEQ ID NO: 819065 - DNA, 22 bp, Artificial Sequence
  chemically synthesized
ttacctgcaagacaaagtccta

SEQ ID NO: 819066 - DNA, 22 bp, Artificial Sequence
  chemically synthesized
cctgcaagacaaagtcctaacc

SEQ ID NO: 819067 - DNA, 22 bp, Artificial Sequence
  chemically synthesized
taatccaaagagagaggttagg

SEQ ID NO: 819068 - DNA, 22 bp, Artificial Sequence
  chemically synthesized
caagacaaagtcctaacctctc

SEQ ID NO: 819069 - DNA, 22 bp, Artificial Sequence
  chemically synthesized
gtaatccaaagagagaggttag

SEQ ID NO: 819070 - DNA, 22 bp, Artificial Sequence
  chemically synthesized
gagggccttgtaatccaaagag

SEQ ID NO: 819071 - DNA, 22 bp, Artificial Sequence
  chemically synthesized
acctctctctttggattacaag

SEQ ID NO: 819072 - DNA, 22 bp, Artificial Sequence
  chemically synthesized
tctctttggattacaaggccct

SEQ ID NO: 819073 - DNA, 22 bp, Artificial Sequence
  chemically synthesized
tctttggattacaaggccctcg

SEQ ID NO: 819074 - DNA, 22 bp, Artificial Sequence
  chemically synthesized
tttggattacaaggccctcgaa

SEQ ID NO: 819075 - DNA, 22 bp, Artificial Sequence
  chemically synthesized
tggattacaaggccctcgaata

SEQ ID NO: 819076 - DNA, 22 bp, Artificial Sequence
  chemically synthesized
ggattacaaggccctcgaatat

SEQ ID NO: 819077 - DNA, 22 bp, Artificial Sequence
  chemically synthesized
gattacaaggccctcgaatata

SEQ ID NO: 819078 - DNA, 22 bp, Artificial Sequence
  chemically synthesized
caaggccctcgaatatatgacc

SEQ ID NO: 819079 - DNA, 22 bp, Artificial Sequence
  chemically synthesized
gaatatatgacccctacctaca

SEQ ID NO: 819080 - DNA, 22 bp, Artificial Sequence
  chemically synthesized
cctacatattcactttcatctt

SEQ ID NO: 819081 - DNA, 22 bp, Artificial Sequence
  chemically synthesized
catattcactttcatcttttga

SEQ ID NO: 819082 - DNA, 22 bp, Artificial Sequence
  chemically synthesized
aaaaaggaagaagatatcaaaa

SEQ ID NO: 819083 - DNA, 22 bp, Artificial Sequence
  chemically synthesized
actttcatcttttgatatcttc

SEQ ID NO: 819084 - DNA, 22 bp, Artificial Sequence
  chemically synthesized
ctcaaaaaggaagaagatatca

SEQ ID NO: 819085 - DNA, 22 bp, Artificial Sequence
  chemically synthesized
tcatcttttgatatcttcttcc

SEQ ID NO: 819086 - DNA, 22 bp, Artificial Sequence
  chemically synthesized
catcttttgatatcttcttcct

SEQ ID NO: 819087 - DNA, 22 bp, Artificial Sequence
  chemically synthesized
atcttttgatatcttcttcctt

SEQ ID NO: 819088 - DNA, 22 bp, Artificial Sequence
  chemically synthesized
tggaattgctcaaaaaggaaga

SEQ ID NO: 819089 - DNA, 22 bp, Artificial Sequence
  chemically synthesized
ttgatatcttcttcctttttga

SEQ ID NO: 819090 - DNA, 22 bp, Artificial Sequence
  chemically synthesized
tgatatcttcttcctttttgag

SEQ ID NO: 819091 - DNA, 22 bp, Artificial Sequence
  chemically synthesized
gatatcttcttcctttttgagc

SEQ ID NO: 819092 - DNA, 22 bp, Artificial Sequence
  chemically synthesized
atatcttcttcctttttgagca

SEQ ID NO: 819093 - DNA, 22 bp, Artificial Sequence
  chemically synthesized
cttcctttttgagcaattccat

SEQ ID NO: 819094 - DNA, 22 bp, Artificial Sequence
  chemically synthesized
atgtggacaattatggaattgc

SEQ ID NO: 819095 - DNA, 22 bp, Artificial Sequence
  chemically synthesized
ttcctttttgagcaattccata

SEQ ID NO: 819096 - DNA, 22 bp, Artificial Sequence
  chemically synthesized
tcatgtggacaattatggaatt

SEQ ID NO: 819097 - DNA, 22 bp, Artificial Sequence
  chemically synthesized
cctttttgagcaattccataat

SEQ ID NO: 819098 - DNA, 22 bp, Artificial Sequence
  chemically synthesized
ctttttgagcaattccataatt

SEQ ID NO: 819099 - DNA, 22 bp, Artificial Sequence
  chemically synthesized
tttgagcaattccataattgtc

SEQ ID NO: 819100 - DNA, 22 bp, Artificial Sequence
  chemically synthesized
tattctcatgtggacaattatg

SEQ ID NO: 819101 - DNA, 22 bp, Artificial Sequence
  chemically synthesized
ttgagcaattccataattgtcc

SEQ ID NO: 819102 - DNA, 22 bp, Artificial Sequence
  chemically synthesized
atattctcatgtggacaattat

SEQ ID NO: 819103 - DNA, 22 bp, Artificial Sequence
  chemically synthesized
tgagcaattccataattgtcca

SEQ ID NO: 819104 - DNA, 22 bp, Artificial Sequence
  chemically synthesized
gagcaattccataattgtccac

SEQ ID NO: 819105 - DNA, 22 bp, Artificial Sequence
  chemically synthesized
agcaattccataattgtccaca

SEQ ID NO: 819106 - DNA, 22 bp, Artificial Sequence
  chemically synthesized
agagcatttatattctcatgtg

SEQ ID NO: 819107 - DNA, 22 bp, Artificial Sequence
  chemically synthesized
cagagcatttatattctcatgt

SEQ ID NO: 819108 - DNA, 22 bp, Artificial Sequence
  chemically synthesized
cataattgtccacatgagaata

SEQ ID NO: 819109 - DNA, 22 bp, Artificial Sequence
  chemically synthesized
tcagagcatttatattctcatg

SEQ ID NO: 819110 - DNA, 22 bp, Artificial Sequence
  chemically synthesized
acctttcagagcatttatattc

SEQ ID NO: 819111 - DNA, 22 bp, Artificial Sequence
  chemically synthesized
aacctttcagagcatttatatt

SEQ ID NO: 819112 - DNA, 22 bp, Artificial Sequence
  chemically synthesized
tccacatgagaatataaatgct

SEQ ID NO: 819113 - DNA, 22 bp, Artificial Sequence
  chemically synthesized
aacaagtcacttaacctttcag

SEQ ID NO: 819114 - DNA, 22 bp, Artificial Sequence
  chemically synthesized
gaacaagtcacttaacctttca

SEQ ID NO: 819115 - DNA, 22 bp, Artificial Sequence
  chemically synthesized
tgtcaccttgaacaagtcactt

SEQ ID NO: 819116 - DNA, 22 bp, Artificial Sequence
  chemically synthesized
tgaaaggttaagtgacttgttc

SEQ ID NO: 819117 - DNA, 22 bp, Artificial Sequence
  chemically synthesized
gctatgtcaccttgaacaagtc

SEQ ID NO: 819118 - DNA, 22 bp, Artificial Sequence
  chemically synthesized
aaaggttaagtgacttgttcaa

SEQ ID NO: 819119 - DNA, 22 bp, Artificial Sequence
  chemically synthesized
actagctatgtcaccttgaaca

SEQ ID NO: 819120 - DNA, 22 bp, Artificial Sequence
  chemically synthesized
actgactagctatgtcaccttg

SEQ ID NO: 819121 - DNA, 22 bp, Artificial Sequence
  chemically synthesized
agtgacttgttcaaggtgacat

SEQ ID NO: 819122 - DNA, 22 bp, Artificial Sequence
  chemically synthesized
cactgactagctatgtcacctt

SEQ ID NO: 819123 - DNA, 22 bp, Artificial Sequence
  chemically synthesized
tcactgactagctatgtcacct

SEQ ID NO: 819124 - DNA, 22 bp, Artificial Sequence
  chemically synthesized
tttcactgactagctatgtcac

SEQ ID NO: 819125 - DNA, 22 bp, Artificial Sequence
  chemically synthesized
gttcaaggtgacatagctagtc

SEQ ID NO: 819126 - DNA, 22 bp, Artificial Sequence
  chemically synthesized
ttcaaggtgacatagctagtca

SEQ ID NO: 819127 - DNA, 22 bp, Artificial Sequence
  chemically synthesized
aaggtgacatagctagtcagtg

SEQ ID NO: 819128 - DNA, 22 bp, Artificial Sequence
  chemically synthesized
tgatgactctttcactgactag

SEQ ID NO: 819129 - DNA, 22 bp, Artificial Sequence
  chemically synthesized
atgatgactctttcactgacta

SEQ ID NO: 819130 - DNA, 22 bp, Artificial Sequence
  chemically synthesized
tatgatgactctttcactgact

SEQ ID NO: 819131 - DNA, 22 bp, Artificial Sequence
  chemically synthesized
ttatgatgactctttcactgac

SEQ ID NO: 819132 - DNA, 22 bp, Artificial Sequence
  chemically synthesized
catttttatgatgactctttca

SEQ ID NO: 819133 - DNA, 22 bp, Artificial Sequence
  chemically synthesized
gtcagtgaaagagtcatcataa

SEQ ID NO: 819134 - DNA, 22 bp, Artificial Sequence
  chemically synthesized
agagtccagaaacctgcatttt

SEQ ID NO: 819135 - DNA, 22 bp, Artificial Sequence
  chemically synthesized
aattgagagtccagaaacctgc

SEQ ID NO: 819136 - DNA, 22 bp, Artificial Sequence
  chemically synthesized
aaatgaaacctgaattgagagt

SEQ ID NO: 819137 - DNA, 22 bp, Artificial Sequence
  chemically synthesized
aattgaaatgaaacctgaattg

SEQ ID NO: 819138 - DNA, 22 bp, Artificial Sequence
  chemically synthesized
ctggactctcaattcaggtttc

SEQ ID NO: 819139 - DNA, 22 bp, Artificial Sequence
  chemically synthesized
tggactctcaattcaggtttca

SEQ ID NO: 819140 - DNA, 22 bp, Artificial Sequence
  chemically synthesized
actgaattgaaatgaaacctga

SEQ ID NO: 819141 - DNA, 22 bp, Artificial Sequence
  chemically synthesized
aactgaattgaaatgaaacctg

SEQ ID NO: 819142 - DNA, 22 bp, Artificial Sequence
  chemically synthesized
gactctcaattcaggtttcatt

SEQ ID NO: 819143 - DNA, 22 bp, Artificial Sequence
  chemically synthesized
taactgaattgaaatgaaacct

SEQ ID NO: 819144 - DNA, 22 bp, Artificial Sequence
  chemically synthesized
tttaactgaattgaaatgaaac

SEQ ID NO: 819145 - DNA, 22 bp, Artificial Sequence
  chemically synthesized
ctttaactgaattgaaatgaaa

SEQ ID NO: 819146 - DNA, 22 bp, Artificial Sequence
  chemically synthesized
tcaattcaggtttcatttcaat

SEQ ID NO: 819147 - DNA, 22 bp, Artificial Sequence
  chemically synthesized
aattcaggtttcatttcaattc

SEQ ID NO: 819148 - DNA, 22 bp, Artificial Sequence
  chemically synthesized
aggtttcatttcaattcagtta

SEQ ID NO: 819149 - DNA, 22 bp, Artificial Sequence
  chemically synthesized
catttcaattcagttaaagaag

SEQ ID NO: 819150 - DNA, 22 bp, Artificial Sequence
  chemically synthesized
atttcaattcagttaaagaagt

SEQ ID NO: 819151 - DNA, 22 bp, Artificial Sequence
  chemically synthesized
tatggatgcataacttctttaa

SEQ ID NO: 819152 - DNA, 22 bp, Artificial Sequence
  chemically synthesized
atatggatgcataacttcttta

SEQ ID NO: 819153 - DNA, 22 bp, Artificial Sequence
  chemically synthesized
tatatggatgcataacttcttt

SEQ ID NO: 819154 - DNA, 22 bp, Artificial Sequence
  chemically synthesized
caattcagttaaagaagttatg

SEQ ID NO: 819155 - DNA, 22 bp, Artificial Sequence
  chemically synthesized
tttatatggatgcataacttct

SEQ ID NO: 819156 - DNA, 22 bp, Artificial Sequence
  chemically synthesized
aattcagttaaagaagttatgc

SEQ ID NO: 819157 - DNA, 22 bp, Artificial Sequence
  chemically synthesized
ctttatatggatgcataacttc

SEQ ID NO: 819158 - DNA, 22 bp, Artificial Sequence
  chemically synthesized
agttaaagaagttatgcatcca

SEQ ID NO: 819159 - DNA, 22 bp, Artificial Sequence
  chemically synthesized
aatttctttatatggatgcata

SEQ ID NO: 819160 - DNA, 22 bp, Artificial Sequence
  chemically synthesized
aaatttctttatatggatgcat

SEQ ID NO: 819161 - DNA, 22 bp, Artificial Sequence
  chemically synthesized
cttaaatttctttatatggatg

SEQ ID NO: 819162 - DNA, 22 bp, Artificial Sequence
  chemically synthesized
aagaagttatgcatccatataa

SEQ ID NO: 819163 - DNA, 22 bp, Artificial Sequence
  chemically synthesized
ccttaaatttctttatatggat

SEQ ID NO: 819164 - DNA, 22 bp, Artificial Sequence
  chemically synthesized
tccttaaatttctttatatgga

SEQ ID NO: 819165 - DNA, 22 bp, Artificial Sequence
  chemically synthesized
ttccttaaatttctttatatgg

SEQ ID NO: 819166 - DNA, 22 bp, Artificial Sequence
  chemically synthesized
tgcatccatataaagaaattta

SEQ ID NO: 819167 - DNA, 22 bp, Artificial Sequence
  chemically synthesized
aaataaacccagtccttttcct

SEQ ID NO: 819168 - DNA, 22 bp, Artificial Sequence
  chemically synthesized
agttaaaataaacccagtcctt

SEQ ID NO: 819169 - DNA, 22 bp, Artificial Sequence
  chemically synthesized
aaggaaaaggactgggtttatt

SEQ ID NO: 819170 - DNA, 22 bp, Artificial Sequence
  chemically synthesized
aggaaaaggactgggtttattt

SEQ ID NO: 819171 - DNA, 22 bp, Artificial Sequence
  chemically synthesized
aaagctcagttaaaataaaccc

SEQ ID NO: 819172 - DNA, 22 bp, Artificial Sequence
  chemically synthesized
caaagctcagttaaaataaacc

SEQ ID NO: 819173 - DNA, 22 bp, Artificial Sequence
  chemically synthesized
ttcaaagctcagttaaaataaa

SEQ ID NO: 819174 - DNA, 22 bp, Artificial Sequence
  chemically synthesized
tattcttcaaagctcagttaaa

SEQ ID NO: 819175 - DNA, 22 bp, Artificial Sequence
  chemically synthesized
atattcttcaaagctcagttaa

SEQ ID NO: 819176 - DNA, 22 bp, Artificial Sequence
  chemically synthesized
tatattcttcaaagctcagtta

SEQ ID NO: 819177 - DNA, 22 bp, Artificial Sequence
  chemically synthesized
ggtttattttaactgagctttg

SEQ ID NO: 819178 - DNA, 22 bp, Artificial Sequence
  chemically synthesized
ttttatattcttcaaagctcag

SEQ ID NO: 819179 - DNA, 22 bp, Artificial Sequence
  chemically synthesized
attttaactgagctttgaagaa

SEQ ID NO: 819180 - DNA, 22 bp, Artificial Sequence
  chemically synthesized
ttttaactgagctttgaagaat

SEQ ID NO: 819181 - DNA, 22 bp, Artificial Sequence
  chemically synthesized
taactgagctttgaagaatata

SEQ ID NO: 819182 - DNA, 22 bp, Artificial Sequence
  chemically synthesized
aactgagctttgaagaatataa

SEQ ID NO: 819183 - DNA, 22 bp, Artificial Sequence
  chemically synthesized
actgagctttgaagaatataaa

SEQ ID NO: 819184 - DNA, 22 bp, Artificial Sequence
  chemically synthesized
agctttgaagaatataaaacaa

SEQ ID NO: 819185 - DNA, 22 bp, Artificial Sequence
  chemically synthesized
taatcatcaagattgttttata

SEQ ID NO: 819186 - DNA, 22 bp, Artificial Sequence
  chemically synthesized
tgaagaatataaaacaatcttg

SEQ ID NO: 819187 - DNA, 22 bp, Artificial Sequence
  chemically synthesized
gaagaatataaaacaatcttga

SEQ ID NO: 819188 - DNA, 22 bp, Artificial Sequence
  chemically synthesized
aagaatataaaacaatcttgat

SEQ ID NO: 819189 - DNA, 22 bp, Artificial Sequence
  chemically synthesized
cagtcatgctataatcatcaag

SEQ ID NO: 819190 - DNA, 22 bp, Artificial Sequence
  chemically synthesized
ccagtcatgctataatcatcaa

SEQ ID NO: 819191 - DNA, 22 bp, Artificial Sequence
  chemically synthesized
tccagtcatgctataatcatca

SEQ ID NO: 819192 - DNA, 22 bp, Artificial Sequence
  chemically synthesized
gatgattatagcatgactggaa

SEQ ID NO: 819193 - DNA, 22 bp, Artificial Sequence
  chemically synthesized
tacataataattttccagtcat

SEQ ID NO: 819194 - DNA, 22 bp, Artificial Sequence
  chemically synthesized
atgattatagcatgactggaaa

SEQ ID NO: 819195 - DNA, 22 bp, Artificial Sequence
  chemically synthesized
ttatacataataattttccagt

SEQ ID NO: 819196 - DNA, 22 bp, Artificial Sequence
  chemically synthesized
attatacataataattttccag

SEQ ID NO: 819197 - DNA, 22 bp, Artificial Sequence
  chemically synthesized
tattatacataataattttcca

SEQ ID NO: 819198 - DNA, 22 bp, Artificial Sequence
  chemically synthesized
tagcatgactggaaaattatta

SEQ ID NO: 819199 - DNA, 22 bp, Artificial Sequence
  chemically synthesized
ctttattatacataataatttt

SEQ ID NO: 819200 - DNA, 22 bp, Artificial Sequence
  chemically synthesized
actttattatacataataattt

SEQ ID NO: 819201 - DNA, 22 bp, Artificial Sequence
  chemically synthesized
gaaaattattatgtataataaa

SEQ ID NO: 819202 - DNA, 22 bp, Artificial Sequence
  chemically synthesized
agaaatgccttactttattata

SEQ ID NO: 819203 - DNA, 22 bp, Artificial Sequence
  chemically synthesized
cagaaatgccttactttattat

SEQ ID NO: 819204 - DNA, 22 bp, Artificial Sequence
  chemically synthesized
tcagaaatgccttactttatta

SEQ ID NO: 819205 - DNA, 22 bp, Artificial Sequence
  chemically synthesized
ttcagaaatgccttactttatt

SEQ ID NO: 819206 - DNA, 22 bp, Artificial Sequence
  chemically synthesized
tttcagaaatgccttactttat

SEQ ID NO: 819207 - DNA, 22 bp, Artificial Sequence
  chemically synthesized
ttttcagaaatgccttacttta

SEQ ID NO: 819208 - DNA, 22 bp, Artificial Sequence
  chemically synthesized
tttttcagaaatgccttacttt

SEQ ID NO: 819209 - DNA, 22 bp, Artificial Sequence
  chemically synthesized
ttatgtataataaagtaaggca

SEQ ID NO: 819210 - DNA, 22 bp, Artificial Sequence
  chemically synthesized
tgtataataaagtaaggcattt

SEQ ID NO: 819211 - DNA, 22 bp, Artificial Sequence
  chemically synthesized
tctttttttcagaaatgcctta

SEQ ID NO: 819212 - DNA, 22 bp, Artificial Sequence
  chemically synthesized
ctgtctttttttcagaaatgcc

SEQ ID NO: 819213 - DNA, 22 bp, Artificial Sequence
  chemically synthesized
tgctgtctttttttcagaaatg

SEQ ID NO: 819214 - DNA, 22 bp, Artificial Sequence
  chemically synthesized
ctgctgtctttttttcagaaat

SEQ ID NO: 819215 - DNA, 22 bp, Artificial Sequence
  chemically synthesized
tctgctgtctttttttcagaaa

SEQ ID NO: 819216 - DNA, 22 bp, Artificial Sequence
  chemically synthesized
ttctgctgtctttttttcagaa

SEQ ID NO: 819217 - DNA, 22 bp, Artificial Sequence
  chemically synthesized
tgtatttttctgctgtcttttt

SEQ ID NO: 819218 - DNA, 22 bp, Artificial Sequence
  chemically synthesized
ctgaaaaaaagacagcagaaaa

SEQ ID NO: 819219 - DNA, 22 bp, Artificial Sequence
  chemically synthesized
tgaaaaaaagacagcagaaaaa

SEQ ID NO: 819220 - DNA, 22 bp, Artificial Sequence
  chemically synthesized
aaaaaaagacagcagaaaaata

SEQ ID NO: 819221 - DNA, 22 bp, Artificial Sequence
  chemically synthesized
aaaaataaactatgtatttttc

SEQ ID NO: 819222 - DNA, 22 bp, Artificial Sequence
  chemically synthesized
caaaaataaactatgtattttt

SEQ ID NO: 819223 - DNA, 22 bp, Artificial Sequence
  chemically synthesized
tcaaaaataaactatgtatttt

SEQ ID NO: 819224 - DNA, 22 bp, Artificial Sequence
  chemically synthesized
gtgattttcaaaaataaactat

SEQ ID NO: 819225 - DNA, 22 bp, Artificial Sequence
  chemically synthesized
agtgattttcaaaaataaacta

SEQ ID NO: 819226 - DNA, 22 bp, Artificial Sequence
  chemically synthesized
tttagtgattttcaaaaataaa

SEQ ID NO: 819227 - DNA, 22 bp, Artificial Sequence
  chemically synthesized
ggaccaaattgtttagtgattt

SEQ ID NO: 819228 - DNA, 22 bp, Artificial Sequence
  chemically synthesized
gggaccaaattgtttagtgatt

SEQ ID NO: 819229 - DNA, 22 bp, Artificial Sequence
  chemically synthesized
ttgggaccaaattgtttagtga

SEQ ID NO: 819230 - DNA, 22 bp, Artificial Sequence
  chemically synthesized
atttttgaaaatcactaaacaa

SEQ ID NO: 819231 - DNA, 22 bp, Artificial Sequence
  chemically synthesized
tttttgaaaatcactaaacaat

SEQ ID NO: 819232 - DNA, 22 bp, Artificial Sequence
  chemically synthesized
attcttgggaccaaattgttta

SEQ ID NO: 819233 - DNA, 22 bp, Artificial Sequence
  chemically synthesized
ttgaaaatcactaaacaatttg

SEQ ID NO: 819234 - DNA, 22 bp, Artificial Sequence
  chemically synthesized
tgaaaatcactaaacaatttgg

SEQ ID NO: 819235 - DNA, 22 bp, Artificial Sequence
  chemically synthesized
gaaaatcactaaacaatttggt

SEQ ID NO: 819236 - DNA, 22 bp, Artificial Sequence
  chemically synthesized
aaaatcactaaacaatttggtc

SEQ ID NO: 819237 - DNA, 22 bp, Artificial Sequence
  chemically synthesized
attcattcttgggaccaaattg

SEQ ID NO: 819238 - DNA, 22 bp, Artificial Sequence
  chemically synthesized
aacaatttggtcccaagaatga

SEQ ID NO: 819239 - DNA, 22 bp, Artificial Sequence
  chemically synthesized
tagaacattaattcattcttgg

SEQ ID NO: 819240 - DNA, 22 bp, Artificial Sequence
  chemically synthesized
atagaacattaattcattcttg

SEQ ID NO: 819241 - DNA, 22 bp, Artificial Sequence
  chemically synthesized
ggtcccaagaatgaattaatgt

SEQ ID NO: 819242 - DNA, 22 bp, Artificial Sequence
  chemically synthesized
gtcccaagaatgaattaatgtt

SEQ ID NO: 819243 - DNA, 22 bp, Artificial Sequence
  chemically synthesized
ccaataaggatttatagaacat

SEQ ID NO: 819244 - DNA, 22 bp, Artificial Sequence
  chemically synthesized
cccaataaggatttatagaaca

SEQ ID NO: 819245 - DNA, 22 bp, Artificial Sequence
  chemically synthesized
tcccaataaggatttatagaac

SEQ ID NO: 819246 - DNA, 22 bp, Artificial Sequence
  chemically synthesized
ttcccaataaggatttatagaa

SEQ ID NO: 819247 - DNA, 22 bp, Artificial Sequence
  chemically synthesized
ttttcccaataaggatttatag

SEQ ID NO: 819248 - DNA, 22 bp, Artificial Sequence
  chemically synthesized
tcttttcccaataaggatttat

SEQ ID NO: 819249 - DNA, 22 bp, Artificial Sequence
  chemically synthesized
ctcttttcccaataaggattta

SEQ ID NO: 819250 - DNA, 22 bp, Artificial Sequence
  chemically synthesized
atgttctataaatccttattgg

SEQ ID NO: 819251 - DNA, 22 bp, Artificial Sequence
  chemically synthesized
tgcttctcttttcccaataagg

SEQ ID NO: 819252 - DNA, 22 bp, Artificial Sequence
  chemically synthesized
tataaatccttattgggaaaag

SEQ ID NO: 819253 - DNA, 22 bp, Artificial Sequence
  chemically synthesized
taaatccttattgggaaaagag

SEQ ID NO: 819254 - DNA, 22 bp, Artificial Sequence
  chemically synthesized
attgggaaaagagaagcacaat

SEQ ID NO: 819255 - DNA, 22 bp, Artificial Sequence
  chemically synthesized
ttgggaaaagagaagcacaatt

SEQ ID NO: 819256 - DNA, 22 bp, Artificial Sequence
  chemically synthesized
ggaaaagagaagcacaatttct

SEQ ID NO: 819257 - DNA, 22 bp, Artificial Sequence
  chemically synthesized
acacaaggagggaagaaattgt

SEQ ID NO: 819258 - DNA, 22 bp, Artificial Sequence
  chemically synthesized
attcacacaaggagggaagaaa

SEQ ID NO: 819259 - DNA, 22 bp, Artificial Sequence
  chemically synthesized
aattcacacaaggagggaagaa

SEQ ID NO: 819260 - DNA, 22 bp, Artificial Sequence
  chemically synthesized
taattcacacaaggagggaaga

SEQ ID NO: 819261 - DNA, 22 bp, Artificial Sequence
  chemically synthesized
taggtcgttttaattcacacaa

SEQ ID NO: 819262 - DNA, 22 bp, Artificial Sequence
  chemically synthesized
ataggtcgttttaattcacaca

SEQ ID NO: 819263 - DNA, 22 bp, Artificial Sequence
  chemically synthesized
tataggtcgttttaattcacac

SEQ ID NO: 819264 - DNA, 22 bp, Artificial Sequence
  chemically synthesized
cttccctccttgtgtgaattaa

SEQ ID NO: 819265 - DNA, 22 bp, Artificial Sequence
  chemically synthesized
ttccctccttgtgtgaattaaa

SEQ ID NO: 819266 - DNA, 22 bp, Artificial Sequence
  chemically synthesized
ccctccttgtgtgaattaaaac

SEQ ID NO: 819267 - DNA, 22 bp, Artificial Sequence
  chemically synthesized
cctccttgtgtgaattaaaacg

SEQ ID NO: 819268 - DNA, 22 bp, Artificial Sequence
  chemically synthesized
cttgtgtgaattaaaacgacct

SEQ ID NO: 819269 - DNA, 22 bp, Artificial Sequence
  chemically synthesized
gtgtgaattaaaacgacctata

SEQ ID NO: 819270 - DNA, 22 bp, Artificial Sequence
  chemically synthesized
tgtgaattaaaacgacctataa

SEQ ID NO: 819271 - DNA, 22 bp, Artificial Sequence
  chemically synthesized
taaatccataaagaggttttat

SEQ ID NO: 819272 - DNA, 22 bp, Artificial Sequence
  chemically synthesized
aaacgacctataaaacctcttt

SEQ ID NO: 819273 - DNA, 22 bp, Artificial Sequence
  chemically synthesized
ttataaatccataaagaggttt

SEQ ID NO: 819274 - DNA, 22 bp, Artificial Sequence
  chemically synthesized
tattataaatccataaagaggt

SEQ ID NO: 819275 - DNA, 22 bp, Artificial Sequence
  chemically synthesized
ctattataaatccataaagagg

SEQ ID NO: 819276 - DNA, 22 bp, Artificial Sequence
  chemically synthesized
acatttctattataaatccata

SEQ ID NO: 819277 - DNA, 22 bp, Artificial Sequence
  chemically synthesized
taaaacctctttatggatttat

SEQ ID NO: 819278 - DNA, 22 bp, Artificial Sequence
  chemically synthesized
aacatttctattataaatccat

SEQ ID NO: 819279 - DNA, 22 bp, Artificial Sequence
  chemically synthesized
taacatttctattataaatcca

SEQ ID NO: 819280 - DNA, 22 bp, Artificial Sequence
  chemically synthesized
ttttaacatttctattataaat

SEQ ID NO: 819281 - DNA, 22 bp, Artificial Sequence
  chemically synthesized
tttatggatttataatagaaat

SEQ ID NO: 819282 - DNA, 22 bp, Artificial Sequence
  chemically synthesized
cagctattttaacatttctatt

SEQ ID NO: 819283 - DNA, 22 bp, Artificial Sequence
  chemically synthesized
tatggatttataatagaaatgt

SEQ ID NO: 819284 - DNA, 22 bp, Artificial Sequence
  chemically synthesized
acagctattttaacatttctat

SEQ ID NO: 819285 - DNA, 22 bp, Artificial Sequence
  chemically synthesized
atggatttataatagaaatgtt

SEQ ID NO: 819286 - DNA, 22 bp, Artificial Sequence
  chemically synthesized
tggatttataatagaaatgtta

SEQ ID NO: 819287 - DNA, 22 bp, Artificial Sequence
  chemically synthesized
ttacagctattttaacatttct

SEQ ID NO: 819288 - DNA, 22 bp, Artificial Sequence
  chemically synthesized
cttacagctattttaacatttc

SEQ ID NO: 819289 - DNA, 22 bp, Artificial Sequence
  chemically synthesized
tcttacagctattttaacattt

SEQ ID NO: 819290 - DNA, 22 bp, Artificial Sequence
  chemically synthesized
ataatagaaatgttaaaatagc

SEQ ID NO: 819291 - DNA, 22 bp, Artificial Sequence
  chemically synthesized
taatagaaatgttaaaatagct

SEQ ID NO: 819292 - DNA, 22 bp, Artificial Sequence
  chemically synthesized
aaatggctttcttacagctatt

SEQ ID NO: 819293 - DNA, 22 bp, Artificial Sequence
  chemically synthesized
gaaatggctttcttacagctat

SEQ ID NO: 819294 - DNA, 22 bp, Artificial Sequence
  chemically synthesized
tgaaatggctttcttacagcta

SEQ ID NO: 819295 - DNA, 22 bp, Artificial Sequence
  chemically synthesized
ttgaaatggctttcttacagct

SEQ ID NO: 819296 - DNA, 22 bp, Artificial Sequence
  chemically synthesized
cttttgaaatggctttcttaca

SEQ ID NO: 819297 - DNA, 22 bp, Artificial Sequence
  chemically synthesized
acttttgaaatggctttcttac

SEQ ID NO: 819298 - DNA, 22 bp, Artificial Sequence
  chemically synthesized
tacttttgaaatggctttctta

SEQ ID NO: 819299 - DNA, 22 bp, Artificial Sequence
  chemically synthesized
aaatagctgtaagaaagccatt

SEQ ID NO: 819300 - DNA, 22 bp, Artificial Sequence
  chemically synthesized
taagaaagccatttcaaaagta

SEQ ID NO: 819301 - DNA, 22 bp, Artificial Sequence
  chemically synthesized
atggtgagaggctttacttttg

SEQ ID NO: 819302 - DNA, 22 bp, Artificial Sequence
  chemically synthesized
aagttaatggtgagaggcttta

SEQ ID NO: 819303 - DNA, 22 bp, Artificial Sequence
  chemically synthesized
gaagttaatggtgagaggcttt

SEQ ID NO: 819304 - DNA, 22 bp, Artificial Sequence
  chemically synthesized
caaaagtaaagcctctcaccat

SEQ ID NO: 819305 - DNA, 22 bp, Artificial Sequence
  chemically synthesized
aaaagtaaagcctctcaccatt

SEQ ID NO: 819306 - DNA, 22 bp, Artificial Sequence
  chemically synthesized
atagatgagtcttgaagttaat

SEQ ID NO: 819307 - DNA, 22 bp, Artificial Sequence
  chemically synthesized
aatagatgagtcttgaagttaa

SEQ ID NO: 819308 - DNA, 22 bp, Artificial Sequence
  chemically synthesized
tcaccattaacttcaagactca

SEQ ID NO: 819309 - DNA, 22 bp, Artificial Sequence
  chemically synthesized
accattaacttcaagactcatc

SEQ ID NO: 819310 - DNA, 22 bp, Artificial Sequence
  chemically synthesized
acttcaagactcatctattaaa

SEQ ID NO: 819311 - DNA, 22 bp, Artificial Sequence
  chemically synthesized
gtaatgtcagaggtttaataga

SEQ ID NO: 819312 - DNA, 22 bp, Artificial Sequence
  chemically synthesized
ggtaatgtcagaggtttaatag

SEQ ID NO: 819313 - DNA, 22 bp, Artificial Sequence
  chemically synthesized
caagactcatctattaaacctc

SEQ ID NO: 819314 - DNA, 22 bp, Artificial Sequence
  chemically synthesized
aagactcatctattaaacctct

SEQ ID NO: 819315 - DNA, 22 bp, Artificial Sequence
  chemically synthesized
tttggtaatgtcagaggtttaa

SEQ ID NO: 819316 - DNA, 22 bp, Artificial Sequence
  chemically synthesized
atctattaaacctctgacatta

SEQ ID NO: 819317 - DNA, 22 bp, Artificial Sequence
  chemically synthesized
aaacagagttgtttggtaatgt

SEQ ID NO: 819318 - DNA, 22 bp, Artificial Sequence
  chemically synthesized
ttaaacctctgacattaccaaa

SEQ ID NO: 819319 - DNA, 22 bp, Artificial Sequence
  chemically synthesized
tgaaacagagttgtttggtaat

SEQ ID NO: 819320 - DNA, 22 bp, Artificial Sequence
  chemically synthesized
ctgaaacagagttgtttggtaa

SEQ ID NO: 819321 - DNA, 22 bp, Artificial Sequence
  chemically synthesized
aacctctgacattaccaaacaa

SEQ ID NO: 819322 - DNA, 22 bp, Artificial Sequence
  chemically synthesized
ccttctgaaacagagttgtttg

SEQ ID NO: 819323 - DNA, 22 bp, Artificial Sequence
  chemically synthesized
tgacattaccaaacaactctgt

SEQ ID NO: 819324 - DNA, 22 bp, Artificial Sequence
  chemically synthesized
acattaccaaacaactctgttt

SEQ ID NO: 819325 - DNA, 22 bp, Artificial Sequence
  chemically synthesized
ccaaacaactctgtttcagaag

SEQ ID NO: 819326 - DNA, 22 bp, Artificial Sequence
  chemically synthesized
tatagagtgttaccttctgaaa

SEQ ID NO: 819327 - DNA, 22 bp, Artificial Sequence
  chemically synthesized
tgtttcagaaggtaacactcta

SEQ ID NO: 819328 - DNA, 22 bp, Artificial Sequence
  chemically synthesized
tttcagaaggtaacactctata

SEQ ID NO: 819329 - DNA, 22 bp, Artificial Sequence
  chemically synthesized
aatagtatgccctgtatagagt

SEQ ID NO: 819330 - DNA, 22 bp, Artificial Sequence
  chemically synthesized
cagaaggtaacactctatacag

SEQ ID NO: 819331 - DNA, 22 bp, Artificial Sequence
  chemically synthesized
aaatagtatgccctgtatagag

SEQ ID NO: 819332 - DNA, 22 bp, Artificial Sequence
  chemically synthesized
agaaggtaacactctatacagg

SEQ ID NO: 819333 - DNA, 22 bp, Artificial Sequence
  chemically synthesized
ttaaatagtatgccctgtatag

SEQ ID NO: 819334 - DNA, 22 bp, Artificial Sequence
  chemically synthesized
cttaaatagtatgccctgtata

SEQ ID NO: 819335 - DNA, 22 bp, Artificial Sequence
  chemically synthesized
tcttaaatagtatgccctgtat

SEQ ID NO: 819336 - DNA, 22 bp, Artificial Sequence
  chemically synthesized
tatacagggcatactatttaag

SEQ ID NO: 819337 - DNA, 22 bp, Artificial Sequence
  chemically synthesized
tacagggcatactatttaagaa

SEQ ID NO: 819338 - DNA, 22 bp, Artificial Sequence
  chemically synthesized
agtaagccggaaaatgagggcc

SEQ ID NO: 819339 - DNA, 22 bp, Artificial Sequence
  chemically synthesized
tttaagaaaatggccctcattt

SEQ ID NO: 819340 - DNA, 22 bp, Artificial Sequence
  chemically synthesized
cagtaagccggaaaatgagggc

SEQ ID NO: 819341 - DNA, 22 bp, Artificial Sequence
  chemically synthesized
tcagtaagccggaaaatgaggg

SEQ ID NO: 819342 - DNA, 22 bp, Artificial Sequence
  chemically synthesized
aagaaaatggccctcattttcc

SEQ ID NO: 819343 - DNA, 22 bp, Artificial Sequence
  chemically synthesized
agaaaatggccctcattttccg

SEQ ID NO: 819344 - DNA, 22 bp, Artificial Sequence
  chemically synthesized
atcattttcagtaagccggaaa

SEQ ID NO: 819345 - DNA, 22 bp, Artificial Sequence
  chemically synthesized
taaagattaatcattttcagta

SEQ ID NO: 819346 - DNA, 22 bp, Artificial Sequence
  chemically synthesized
attttccggcttactgaaaatg

SEQ ID NO: 819347 - DNA, 22 bp, Artificial Sequence
  chemically synthesized
ttgtaaagattaatcattttca

SEQ ID NO: 819348 - DNA, 22 bp, Artificial Sequence
  chemically synthesized
tccggcttactgaaaatgatta

SEQ ID NO: 819349 - DNA, 22 bp, Artificial Sequence
  chemically synthesized
ccggcttactgaaaatgattaa

SEQ ID NO: 819350 - DNA, 22 bp, Artificial Sequence
  chemically synthesized
cggcttactgaaaatgattaat

SEQ ID NO: 819351 - DNA, 22 bp, Artificial Sequence
  chemically synthesized
aaagctattgtaaagattaatc

SEQ ID NO: 819352 - DNA, 22 bp, Artificial Sequence
  chemically synthesized
caaagctattgtaaagattaat

SEQ ID NO: 819353 - DNA, 22 bp, Artificial Sequence
  chemically synthesized
actgaaaatgattaatctttac

SEQ ID NO: 819354 - DNA, 22 bp, Artificial Sequence
  chemically synthesized
ctgaaaatgattaatctttaca

SEQ ID NO: 819355 - DNA, 22 bp, Artificial Sequence
  chemically synthesized
aaaatgattaatctttacaata

SEQ ID NO: 819356 - DNA, 22 bp, Artificial Sequence
  chemically synthesized
gtatgtagtcttcaaagctatt

SEQ ID NO: 819357 - DNA, 22 bp, Artificial Sequence
  chemically synthesized
atctttacaatagctttgaaga

SEQ ID NO: 819358 - DNA, 22 bp, Artificial Sequence
  chemically synthesized
tacaatagctttgaagactaca

SEQ ID NO: 819359 - DNA, 22 bp, Artificial Sequence
  chemically synthesized
acaatagctttgaagactacat

SEQ ID NO: 819360 - DNA, 22 bp, Artificial Sequence
  chemically synthesized
caatagctttgaagactacata

SEQ ID NO: 819361 - DNA, 22 bp, Artificial Sequence
  chemically synthesized
tgaagactacataccaacgtcg

SEQ ID NO: 819362 - DNA, 22 bp, Artificial Sequence
  chemically synthesized
gaagactacataccaacgtcgt

SEQ ID NO: 819363 - DNA, 22 bp, Artificial Sequence
  chemically synthesized
aagactacataccaacgtcgtt

SEQ ID NO: 819364 - DNA, 22 bp, Artificial Sequence
  chemically synthesized
aaaggacagaaaagtaacgacg

SEQ ID NO: 819365 - DNA, 22 bp, Artificial Sequence
  chemically synthesized
ttgaaaggacagaaaagtaacg

SEQ ID NO: 819366 - DNA, 22 bp, Artificial Sequence
  chemically synthesized
cataccaacgtcgttacttttc

SEQ ID NO: 819367 - DNA, 22 bp, Artificial Sequence
  chemically synthesized
tagtcattgttgaaaggacaga

SEQ ID NO: 819368 - DNA, 22 bp, Artificial Sequence
  chemically synthesized
gtagtcattgttgaaaggacag

SEQ ID NO: 819369 - DNA, 22 bp, Artificial Sequence
  chemically synthesized
agcttgtagtcattgttgaaag

SEQ ID NO: 819370 - DNA, 22 bp, Artificial Sequence
  chemically synthesized
cttttctgtcctttcaacaatg

SEQ ID NO: 819371 - DNA, 22 bp, Artificial Sequence
  chemically synthesized
tcagcttgtagtcattgttgaa

SEQ ID NO: 819372 - DNA, 22 bp, Artificial Sequence
  chemically synthesized
ttctgtcctttcaacaatgact

SEQ ID NO: 819373 - DNA, 22 bp, Artificial Sequence
  chemically synthesized
ctctcagcttgtagtcattgtt

SEQ ID NO: 819374 - DNA, 22 bp, Artificial Sequence
  chemically synthesized
tctgtcctttcaacaatgacta

SEQ ID NO: 819375 - DNA, 22 bp, Artificial Sequence
  chemically synthesized
ctgtcctttcaacaatgactac

SEQ ID NO: 819376 - DNA, 22 bp, Artificial Sequence
  chemically synthesized
tgtcctttcaacaatgactaca

SEQ ID NO: 819377 - DNA, 22 bp, Artificial Sequence
  chemically synthesized
tcctttcaacaatgactacaag

SEQ ID NO: 819378 - DNA, 22 bp, Artificial Sequence
  chemically synthesized
gtctgctctcagcttgtagtca

SEQ ID NO: 819379 - DNA, 22 bp, Artificial Sequence
  chemically synthesized
ctagtctgctctcagcttgtag

SEQ ID NO: 819380 - DNA, 22 bp, Artificial Sequence
  chemically synthesized
actagtctgctctcagcttgta

SEQ ID NO: 819381 - DNA, 22 bp, Artificial Sequence
  chemically synthesized
tcaacaatgactacaagctgag

SEQ ID NO: 819382 - DNA, 22 bp, Artificial Sequence
  chemically synthesized
caacaatgactacaagctgaga

SEQ ID NO: 819383 - DNA, 22 bp, Artificial Sequence
  chemically synthesized
aacaatgactacaagctgagag

SEQ ID NO: 819384 - DNA, 22 bp, Artificial Sequence
  chemically synthesized
caagctgagagcagactagtaa

SEQ ID NO: 819385 - DNA, 22 bp, Artificial Sequence
  chemically synthesized
gccgataacacatttactagtc

SEQ ID NO: 819386 - DNA, 22 bp, Artificial Sequence
  chemically synthesized
agagcagactagtaaatgtgtt

SEQ ID NO: 819387 - DNA, 22 bp, Artificial Sequence
  chemically synthesized
atgggttggccgataacacatt

SEQ ID NO: 819388 - DNA, 22 bp, Artificial Sequence
  chemically synthesized
taatgggttggccgataacaca

SEQ ID NO: 819389 - DNA, 22 bp, Artificial Sequence
  chemically synthesized
gtaaatgtgttatcggccaacc

SEQ ID NO: 819390 - DNA, 22 bp, Artificial Sequence
  chemically synthesized
tcggccaacccattagagttcc

SEQ ID NO: 819391 - DNA, 22 bp, Artificial Sequence
  chemically synthesized
gagttccattattttctgtctt

SEQ ID NO: 819392 - DNA, 22 bp, Artificial Sequence
  chemically synthesized
catgaagccatgtaagacagaa

SEQ ID NO: 819393 - DNA, 22 bp, Artificial Sequence
  chemically synthesized
attacatgaagccatgtaagac

SEQ ID NO: 819394 - DNA, 22 bp, Artificial Sequence
  chemically synthesized
cattattttctgtcttacatgg

SEQ ID NO: 819395 - DNA, 22 bp, Artificial Sequence
  chemically synthesized
ttttctgtcttacatggcttca

SEQ ID NO: 819396 - DNA, 22 bp, Artificial Sequence
  chemically synthesized
tctgtcttacatggcttcatgt

SEQ ID NO: 819397 - DNA, 22 bp, Artificial Sequence
  chemically synthesized
taaaaattcattacatgaagcc

SEQ ID NO: 819398 - DNA, 22 bp, Artificial Sequence
  chemically synthesized
ctgtcttacatggcttcatgta

SEQ ID NO: 819399 - DNA, 22 bp, Artificial Sequence
  chemically synthesized
tgtcttacatggcttcatgtaa

SEQ ID NO: 819400 - DNA, 22 bp, Artificial Sequence
  chemically synthesized
tcttacatggcttcatgtaatg

SEQ ID NO: 819401 - DNA, 22 bp, Artificial Sequence
  chemically synthesized
attataaaaattcattacatga

SEQ ID NO: 819402 - DNA, 22 bp, Artificial Sequence
  chemically synthesized
aattataaaaattcattacatg

SEQ ID NO: 819403 - DNA, 22 bp, Artificial Sequence
  chemically synthesized
acatggcttcatgtaatgaatt

SEQ ID NO: 819404 - DNA, 22 bp, Artificial Sequence
  chemically synthesized
catggcttcatgtaatgaattt

SEQ ID NO: 819405 - DNA, 22 bp, Artificial Sequence
  chemically synthesized
gtttaattataaaaattcatta

SEQ ID NO: 819406 - DNA, 22 bp, Artificial Sequence
  chemically synthesized
catgtaatgaatttttataatt

SEQ ID NO: 819407 - DNA, 22 bp, Artificial Sequence
  chemically synthesized
atgtaatgaatttttataatta

SEQ ID NO: 819408 - DNA, 22 bp, Artificial Sequence
  chemically synthesized
tatgccattagtttaattataa

SEQ ID NO: 819409 - DNA, 22 bp, Artificial Sequence
  chemically synthesized
ttataattaaactaatggcata

SEQ ID NO: 819410 - DNA, 22 bp, Artificial Sequence
  chemically synthesized
tataattaaactaatggcatac

SEQ ID NO: 819411 - DNA, 22 bp, Artificial Sequence
  chemically synthesized
ataattaaactaatggcataca

SEQ ID NO: 819412 - DNA, 22 bp, Artificial Sequence
  chemically synthesized
taattaaactaatggcatacaa

SEQ ID NO: 819413 - DNA, 22 bp, Artificial Sequence
  chemically synthesized
aactaatggcatacaatatatt

SEQ ID NO: 819414 - DNA, 22 bp, Artificial Sequence
  chemically synthesized
atggcatacaatatatttttcc

SEQ ID NO: 819415 - DNA, 22 bp, Artificial Sequence
  chemically synthesized
aaagtaaagaggggaaaaatat

SEQ ID NO: 819416 - DNA, 22 bp, Artificial Sequence
  chemically synthesized
ttcccctctttactttcaggcc

SEQ ID NO: 819417 - DNA, 22 bp, Artificial Sequence
  chemically synthesized
gaagagaaatggggcctgaaag

SEQ ID NO: 819418 - DNA, 22 bp, Artificial Sequence
  chemically synthesized
tcccctctttactttcaggccc

SEQ ID NO: 819419 - DNA, 22 bp, Artificial Sequence
  chemically synthesized
cccctctttactttcaggcccc

SEQ ID NO: 819420 - DNA, 22 bp, Artificial Sequence
  chemically synthesized
ccctctttactttcaggcccca

SEQ ID NO: 819421 - DNA, 22 bp, Artificial Sequence
  chemically synthesized
tttactttcaggccccatttct

SEQ ID NO: 819422 - DNA, 22 bp, Artificial Sequence
  chemically synthesized
tactttcaggccccatttctct

SEQ ID NO: 819423 - DNA, 22 bp, Artificial Sequence
  chemically synthesized
actttcaggccccatttctctt

SEQ ID NO: 819424 - DNA, 22 bp, Artificial Sequence
  chemically synthesized
caaagcagctggaagagaaatg

SEQ ID NO: 819425 - DNA, 22 bp, Artificial Sequence
  chemically synthesized
ctttcaggccccatttctcttc

SEQ ID NO: 819426 - DNA, 22 bp, Artificial Sequence
  chemically synthesized
ttccaaagcagctggaagagaa

SEQ ID NO: 819427 - DNA, 22 bp, Artificial Sequence
  chemically synthesized
tcaggccccatttctcttccag

SEQ ID NO: 819428 - DNA, 22 bp, Artificial Sequence
  chemically synthesized
attccaaagcagctggaagaga

SEQ ID NO: 819429 - DNA, 22 bp, Artificial Sequence
  chemically synthesized
caggccccatttctcttccagc

SEQ ID NO: 819430 - DNA, 22 bp, Artificial Sequence
  chemically synthesized
aggccccatttctcttccagct

SEQ ID NO: 819431 - DNA, 22 bp, Artificial Sequence
  chemically synthesized
tatgaaacttattccaaagcag

SEQ ID NO: 819432 - DNA, 22 bp, Artificial Sequence
  chemically synthesized
gtatgaaacttattccaaagca

SEQ ID NO: 819433 - DNA, 22 bp, Artificial Sequence
  chemically synthesized
tgtatgaaacttattccaaagc

SEQ ID NO: 819434 - DNA, 22 bp, Artificial Sequence
  chemically synthesized
ctcttccagctgctttggaata

SEQ ID NO: 819435 - DNA, 22 bp, Artificial Sequence
  chemically synthesized
ttgtatgaaacttattccaaag

SEQ ID NO: 819436 - DNA, 22 bp, Artificial Sequence
  chemically synthesized
tcttccagctgctttggaataa

SEQ ID NO: 819437 - DNA, 22 bp, Artificial Sequence
  chemically synthesized
tttgtatgaaacttattccaaa

SEQ ID NO: 819438 - DNA, 22 bp, Artificial Sequence
  chemically synthesized
ttccagctgctttggaataagt

SEQ ID NO: 819439 - DNA, 22 bp, Artificial Sequence
  chemically synthesized
tttttgtatgaaacttattcca

SEQ ID NO: 819440 - DNA, 22 bp, Artificial Sequence
  chemically synthesized
ctttttgtatgaaacttattcc

SEQ ID NO: 819441 - DNA, 22 bp, Artificial Sequence
  chemically synthesized
ccagctgctttggaataagttt

SEQ ID NO: 819442 - DNA, 22 bp, Artificial Sequence
  chemically synthesized
cagctgctttggaataagtttc

SEQ ID NO: 819443 - DNA, 22 bp, Artificial Sequence
  chemically synthesized
ccttctttttgtatgaaactta

SEQ ID NO: 819444 - DNA, 22 bp, Artificial Sequence
  chemically synthesized
ctcccttctttttgtatgaaac

SEQ ID NO: 819445 - DNA, 22 bp, Artificial Sequence
  chemically synthesized
ctttggaataagtttcatacaa

SEQ ID NO: 819446 - DNA, 22 bp, Artificial Sequence
  chemically synthesized
tcctcccttctttttgtatgaa

SEQ ID NO: 819447 - DNA, 22 bp, Artificial Sequence
  chemically synthesized
tggaataagtttcatacaaaaa

SEQ ID NO: 819448 - DNA, 22 bp, Artificial Sequence
  chemically synthesized
ggaataagtttcatacaaaaag

SEQ ID NO: 819449 - DNA, 22 bp, Artificial Sequence
  chemically synthesized
gaataagtttcatacaaaaaga

SEQ ID NO: 819450 - DNA, 22 bp, Artificial Sequence
  chemically synthesized
gagacctctcctcccttctttt

SEQ ID NO: 819451 - DNA, 22 bp, Artificial Sequence
  chemically synthesized
ggagacctctcctcccttcttt

SEQ ID NO: 819452 - DNA, 22 bp, Artificial Sequence
  chemically synthesized
catacaaaaagaagggaggaga

SEQ ID NO: 819453 - DNA, 22 bp, Artificial Sequence
  chemically synthesized
atacaaaaagaagggaggagag

SEQ ID NO: 819454 - DNA, 22 bp, Artificial Sequence
  chemically synthesized
aggtaacgaagcacttggagac

SEQ ID NO: 819455 - DNA, 22 bp, Artificial Sequence
  chemically synthesized
caagtgcttcgttaccttaatt

SEQ ID NO: 819456 - DNA, 22 bp, Artificial Sequence
  chemically synthesized
aaaaatgtcataatgaaattaa

SEQ ID NO: 819457 - DNA, 22 bp, Artificial Sequence
  chemically synthesized
caaaaatgtcataatgaaatta

SEQ ID NO: 819458 - DNA, 22 bp, Artificial Sequence
  chemically synthesized
tcaaaaatgtcataatgaaatt

SEQ ID NO: 819459 - DNA, 22 bp, Artificial Sequence
  chemically synthesized
cgttaccttaatttcattatga

SEQ ID NO: 819460 - DNA, 22 bp, Artificial Sequence
  chemically synthesized
gttaccttaatttcattatgac

SEQ ID NO: 819461 - DNA, 22 bp, Artificial Sequence
  chemically synthesized
ccttaatttcattatgacattt

SEQ ID NO: 819462 - DNA, 22 bp, Artificial Sequence
  chemically synthesized
aatttcattatgacatttttga

SEQ ID NO: 819463 - DNA, 22 bp, Artificial Sequence
  chemically synthesized
atttcattatgacatttttgaa

SEQ ID NO: 819464 - DNA, 22 bp, Artificial Sequence
  chemically synthesized
cattatgacatttttgaaagca

SEQ ID NO: 819465 - DNA, 22 bp, Artificial Sequence
  chemically synthesized
attatgacatttttgaaagcat

SEQ ID NO: 819466 - DNA, 22 bp, Artificial Sequence
  chemically synthesized
tgacatttttgaaagcattctc

SEQ ID NO: 819467 - DNA, 22 bp, Artificial Sequence
  chemically synthesized
aagagagagcccagataaagag

SEQ ID NO: 819468 - DNA, 22 bp, Artificial Sequence
  chemically synthesized
ttgaaagcattctctttatctg

SEQ ID NO: 819469 - DNA, 22 bp, Artificial Sequence
  chemically synthesized
tgaaagcattctctttatctgg

SEQ ID NO: 819470 - DNA, 22 bp, Artificial Sequence
  chemically synthesized
gaaagcattctctttatctggg

SEQ ID NO: 819471 - DNA, 22 bp, Artificial Sequence
  chemically synthesized
aaagcattctctttatctgggc

SEQ ID NO: 819472 - DNA, 22 bp, Artificial Sequence
  chemically synthesized
tctttatctgggctctctcttt

SEQ ID NO: 819473 - DNA, 22 bp, Artificial Sequence
  chemically synthesized
tttatctgggctctctctttaa

SEQ ID NO: 819474 - DNA, 22 bp, Artificial Sequence
  chemically synthesized
tatctgggctctctctttaatt

SEQ ID NO: 819475 - DNA, 22 bp, Artificial Sequence
  chemically synthesized
ataaagtcagcaaattaaagag

SEQ ID NO: 819476 - DNA, 22 bp, Artificial Sequence
  chemically synthesized
atctgggctctctctttaattt

SEQ ID NO: 819477 - DNA, 22 bp, Artificial Sequence
  chemically synthesized
aataaagtcagcaaattaaaga

SEQ ID NO: 819478 - DNA, 22 bp, Artificial Sequence
  chemically synthesized
tctgggctctctctttaatttg

SEQ ID NO: 819479 - DNA, 22 bp, Artificial Sequence
  chemically synthesized
taataaagtcagcaaattaaag

SEQ ID NO: 819480 - DNA, 22 bp, Artificial Sequence
  chemically synthesized
ttaataaagtcagcaaattaaa

SEQ ID NO: 819481 - DNA, 22 bp, Artificial Sequence
  chemically synthesized
ggctctctctttaatttgctga

SEQ ID NO: 819482 - DNA, 22 bp, Artificial Sequence
  chemically synthesized
agccttttaataaagtcagcaa

SEQ ID NO: 819483 - DNA, 22 bp, Artificial Sequence
  chemically synthesized
aagccttttaataaagtcagca

SEQ ID NO: 819484 - DNA, 22 bp, Artificial Sequence
  chemically synthesized
tctctttaatttgctgacttta

SEQ ID NO: 819485 - DNA, 22 bp, Artificial Sequence
  chemically synthesized
tctttaatttgctgactttatt

SEQ ID NO: 819486 - DNA, 22 bp, Artificial Sequence
  chemically synthesized
cttaagccttttaataaagtca

SEQ ID NO: 819487 - DNA, 22 bp, Artificial Sequence
  chemically synthesized
tttaatttgctgactttattaa

SEQ ID NO: 819488 - DNA, 22 bp, Artificial Sequence
  chemically synthesized
taatttgctgactttattaaaa

SEQ ID NO: 819489 - DNA, 22 bp, Artificial Sequence
  chemically synthesized
aatttgctgactttattaaaag

SEQ ID NO: 819490 - DNA, 22 bp, Artificial Sequence
  chemically synthesized
atttgctgactttattaaaagg

SEQ ID NO: 819491 - DNA, 22 bp, Artificial Sequence
  chemically synthesized
cagtattgcttaagccttttaa

SEQ ID NO: 819492 - DNA, 22 bp, Artificial Sequence
  chemically synthesized
gctgactttattaaaaggctta

SEQ ID NO: 819493 - DNA, 22 bp, Artificial Sequence
  chemically synthesized
ctgactttattaaaaggcttaa

SEQ ID NO: 819494 - DNA, 22 bp, Artificial Sequence
  chemically synthesized
attacagtattgcttaagcctt

SEQ ID NO: 819495 - DNA, 22 bp, Artificial Sequence
  chemically synthesized
actttattaaaaggcttaagca

SEQ ID NO: 819496 - DNA, 22 bp, Artificial Sequence
  chemically synthesized
ttaattacagtattgcttaagc

SEQ ID NO: 819497 - DNA, 22 bp, Artificial Sequence
  chemically synthesized
gttaattacagtattgcttaag

SEQ ID NO: 819498 - DNA, 22 bp, Artificial Sequence
  chemically synthesized
tattaaaaggcttaagcaatac

SEQ ID NO: 819499 - DNA, 22 bp, Artificial Sequence
  chemically synthesized
attaaaaggcttaagcaatact

SEQ ID NO: 819500 - DNA, 22 bp, Artificial Sequence
  chemically synthesized
ttaaaaggcttaagcaatactg

SEQ ID NO: 819501 - DNA, 22 bp, Artificial Sequence
  chemically synthesized
aaaggcttaagcaatactgtaa

SEQ ID NO: 819502 - DNA, 22 bp, Artificial Sequence
  chemically synthesized
ggtgatttgttaattacagtat

SEQ ID NO: 819503 - DNA, 22 bp, Artificial Sequence
  chemically synthesized
aagcaatactgtaattaacaaa

SEQ ID NO: 819504 - DNA, 22 bp, Artificial Sequence
  chemically synthesized
agcaatactgtaattaacaaat

SEQ ID NO: 819505 - DNA, 22 bp, Artificial Sequence
  chemically synthesized
gggtagctgggtgatttgttaa

SEQ ID NO: 819506 - DNA, 22 bp, Artificial Sequence
  chemically synthesized
taattaacaaatcacccagcta

SEQ ID NO: 819507 - DNA, 22 bp, Artificial Sequence
  chemically synthesized
agatgcctggggtagctgggtg

SEQ ID NO: 819508 - DNA, 22 bp, Artificial Sequence
  chemically synthesized
tcagatgcctggggtagctggg

SEQ ID NO: 819509 - DNA, 22 bp, Artificial Sequence
  chemically synthesized
ctcagatgcctggggtagctgg

SEQ ID NO: 819510 - DNA, 22 bp, Artificial Sequence
  chemically synthesized
tctcagatgcctggggtagctg

SEQ ID NO: 819511 - DNA, 22 bp, Artificial Sequence
  chemically synthesized
ttctcagatgcctggggtagct

SEQ ID NO: 819512 - DNA, 22 bp, Artificial Sequence
  chemically synthesized
acaaatcacccagctaccccag

SEQ ID NO: 819513 - DNA, 22 bp, Artificial Sequence
  chemically synthesized
acttttctcagatgcctggggt

SEQ ID NO: 819514 - DNA, 22 bp, Artificial Sequence
  chemically synthesized
aactgacttttctcagatgcct

SEQ ID NO: 819515 - DNA, 22 bp, Artificial Sequence
  chemically synthesized
tcaactgacttttctcagatgc

SEQ ID NO: 819516 - DNA, 22 bp, Artificial Sequence
  chemically synthesized
ccccaggcatctgagaaaagtc

SEQ ID NO: 819517 - DNA, 22 bp, Artificial Sequence
  chemically synthesized
caccctctcaactgacttttct

SEQ ID NO: 819518 - DNA, 22 bp, Artificial Sequence
  chemically synthesized
tacaccctctcaactgactttt

SEQ ID NO: 819519 - DNA, 22 bp, Artificial Sequence
  chemically synthesized
ctacaccctctcaactgacttt

SEQ ID NO: 819520 - DNA, 22 bp, Artificial Sequence
  chemically synthesized
agaaaagtcagttgagagggtg

SEQ ID NO: 819521 - DNA, 22 bp, Artificial Sequence
  chemically synthesized
cacccatccatttctacaccct

SEQ ID NO: 819522 - DNA, 22 bp, Artificial Sequence
  chemically synthesized
ccacccatccatttctacaccc

SEQ ID NO: 819523 - DNA, 22 bp, Artificial Sequence
  chemically synthesized
agagggtgtagaaatggatggg

SEQ ID NO: 819524 - DNA, 22 bp, Artificial Sequence
  chemically synthesized
gaatcgtttccacccatccatt

SEQ ID NO: 819525 - DNA, 22 bp, Artificial Sequence
  chemically synthesized
tggaatcgtttccacccatcca

SEQ ID NO: 819526 - DNA, 22 bp, Artificial Sequence
  chemically synthesized
ctggaatcgtttccacccatcc

SEQ ID NO: 819527 - DNA, 22 bp, Artificial Sequence
  chemically synthesized
tttctggaatcgtttccaccca

SEQ ID NO: 819528 - DNA, 22 bp, Artificial Sequence
  chemically synthesized
gcattgtttctggaatcgtttc

SEQ ID NO: 819529 - DNA, 22 bp, Artificial Sequence
  chemically synthesized
tggcattgtttctggaatcgtt

SEQ ID NO: 819530 - DNA, 22 bp, Artificial Sequence
  chemically synthesized
tcctctggcattgtttctggaa

SEQ ID NO: 819531 - DNA, 22 bp, Artificial Sequence
  chemically synthesized
tgtcctctggcattgtttctgg

SEQ ID NO: 819532 - DNA, 22 bp, Artificial Sequence
  chemically synthesized
gggttctgtcctctggcattgt

SEQ ID NO: 819533 - DNA, 22 bp, Artificial Sequence
  chemically synthesized
tggggttctgtcctctggcatt

SEQ ID NO: 819534 - DNA, 22 bp, Artificial Sequence
  chemically synthesized
ctggggttctgtcctctggcat

SEQ ID NO: 819535 - DNA, 22 bp, Artificial Sequence
  chemically synthesized
tctggggttctgtcctctggca

SEQ ID NO: 819536 - DNA, 22 bp, Artificial Sequence
  chemically synthesized
cagaaacaatgccagaggacag

SEQ ID NO: 819537 - DNA, 22 bp, Artificial Sequence
  chemically synthesized
aaaaaacgccattttctggggt

SEQ ID NO: 819538 - DNA, 22 bp, Artificial Sequence
  chemically synthesized
aaaaggagctgaaaaaacgcca

SEQ ID NO: 819539 - DNA, 22 bp, Artificial Sequence
  chemically synthesized
atggggtctgaaaaggagctga

SEQ ID NO: 819540 - DNA, 22 bp, Artificial Sequence
  chemically synthesized
tttcagctccttttcagacccc

SEQ ID NO: 819541 - DNA, 22 bp, Artificial Sequence
  chemically synthesized
ttcagctccttttcagacccca

SEQ ID NO: 819542 - DNA, 22 bp, Artificial Sequence
  chemically synthesized
tcagctccttttcagaccccat

SEQ ID NO: 819543 - DNA, 22 bp, Artificial Sequence
  chemically synthesized
cagctccttttcagaccccatg

SEQ ID NO: 819544 - DNA, 22 bp, Artificial Sequence
  chemically synthesized
ccacaatatgctcatggggtct

SEQ ID NO: 819545 - DNA, 22 bp, Artificial Sequence
  chemically synthesized
agctccttttcagaccccatga

SEQ ID NO: 819546 - DNA, 22 bp, Artificial Sequence
  chemically synthesized
cttttcagaccccatgagcata

SEQ ID NO: 819547 - DNA, 22 bp, Artificial Sequence
  chemically synthesized
ttcagaccccatgagcatattg

SEQ ID NO: 819548 - DNA, 22 bp, Artificial Sequence
  chemically synthesized
tcagaccccatgagcatattgt

SEQ ID NO: 819549 - DNA, 22 bp, Artificial Sequence
  chemically synthesized
cagaccccatgagcatattgtg

SEQ ID NO: 819550 - DNA, 22 bp, Artificial Sequence
  chemically synthesized
agaccccatgagcatattgtgg

SEQ ID NO: 819551 - DNA, 22 bp, Artificial Sequence
  chemically synthesized
agaacaataatgcagtctacca

SEQ ID NO: 819552 - DNA, 22 bp, Artificial Sequence
  chemically synthesized
gagaacaataatgcagtctacc

SEQ ID NO: 819553 - DNA, 22 bp, Artificial Sequence
  chemically synthesized
gatatttgagaacaataatgca

SEQ ID NO: 819554 - DNA, 22 bp, Artificial Sequence
  chemically synthesized
tggtagactgcattattgttct

SEQ ID NO: 819555 - DNA, 22 bp, Artificial Sequence
  chemically synthesized
cattattgttctcaaatatcca

SEQ ID NO: 819556 - DNA, 22 bp, Artificial Sequence
  chemically synthesized
gcgtgaaaaggcactggatatt

SEQ ID NO: 819557 - DNA, 22 bp, Artificial Sequence
  chemically synthesized
tggcgtgaaaaggcactggata

SEQ ID NO: 819558 - DNA, 22 bp, Artificial Sequence
  chemically synthesized
ttgttctcaaatatccagtgcc

SEQ ID NO: 819559 - DNA, 22 bp, Artificial Sequence
  chemically synthesized
ctggcgtgaaaaggcactggat

SEQ ID NO: 819560 - DNA, 22 bp, Artificial Sequence
  chemically synthesized
ttctcaaatatccagtgccttt

SEQ ID NO: 819561 - DNA, 22 bp, Artificial Sequence
  chemically synthesized
tcaaatatccagtgccttttca

SEQ ID NO: 819562 - DNA, 22 bp, Artificial Sequence
  chemically synthesized
aaatatccagtgccttttcacg

SEQ ID NO: 819563 - DNA, 22 bp, Artificial Sequence
  chemically synthesized
ttcacgccagaagattatacat

SEQ ID NO: 819564 - DNA, 22 bp, Artificial Sequence
  chemically synthesized
tcacgccagaagattatacatc

SEQ ID NO: 819565 - DNA, 22 bp, Artificial Sequence
  chemically synthesized
aatgggaatgccgatgtataat

SEQ ID NO: 819566 - DNA, 22 bp, Artificial Sequence
  chemically synthesized
cacgccagaagattatacatcg

SEQ ID NO: 819567 - DNA, 22 bp, Artificial Sequence
  chemically synthesized
acgccagaagattatacatcgg

SEQ ID NO: 819568 - DNA, 22 bp, Artificial Sequence
  chemically synthesized
agttcaatgggaatgccgatgt

SEQ ID NO: 819569 - DNA, 22 bp, Artificial Sequence
  chemically synthesized
ctgagttcaatgggaatgccga

SEQ ID NO: 819570 - DNA, 22 bp, Artificial Sequence
  chemically synthesized
tacatcggcattcccattgaac

SEQ ID NO: 819571 - DNA, 22 bp, Artificial Sequence
  chemically synthesized
ccattgaactcaggaatggcca

SEQ ID NO: 819572 - DNA, 22 bp, Artificial Sequence
  chemically synthesized
aactcaggaatggccatgtgac

SEQ ID NO: 819573 - DNA, 22 bp, Artificial Sequence
  chemically synthesized
aggaatggccatgtgactggtt

SEQ ID NO: 819574 - DNA, 22 bp, Artificial Sequence
  chemically synthesized
gaagtgaccagtagacaaaacc

SEQ ID NO: 819575 - DNA, 22 bp, Artificial Sequence
  chemically synthesized
cctggaagtgaccagtagacaa

SEQ ID NO: 819576 - DNA, 22 bp, Artificial Sequence
  chemically synthesized
tgcctggaagtgaccagtagac

SEQ ID NO: 819577 - DNA, 22 bp, Artificial Sequence
  chemically synthesized
ctgcctggaagtgaccagtaga

SEQ ID NO: 819578 - DNA, 22 bp, Artificial Sequence
  chemically synthesized
gttttgtctactggtcacttcc

SEQ ID NO: 819579 - DNA, 22 bp, Artificial Sequence
  chemically synthesized
agccttctgcctggaagtgacc

SEQ ID NO: 819580 - DNA, 22 bp, Artificial Sequence
  chemically synthesized
gagccttctgcctggaagtgac

SEQ ID NO: 819581 - DNA, 22 bp, Artificial Sequence
  chemically synthesized
ttgagccttctgcctggaagtg

SEQ ID NO: 819582 - DNA, 22 bp, Artificial Sequence
  chemically synthesized
tgtctactggtcacttccaggc

SEQ ID NO: 819583 - DNA, 22 bp, Artificial Sequence
  chemically synthesized
gtctactggtcacttccaggca

SEQ ID NO: 819584 - DNA, 22 bp, Artificial Sequence
  chemically synthesized
tctactggtcacttccaggcag

SEQ ID NO: 819585 - DNA, 22 bp, Artificial Sequence
  chemically synthesized
ctggtcacttccaggcagaagg

SEQ ID NO: 819586 - DNA, 22 bp, Artificial Sequence
  chemically synthesized
gtcacttccaggcagaaggctc

SEQ ID NO: 819587 - DNA, 22 bp, Artificial Sequence
  chemically synthesized
ccaggcagaaggctcaagaacc

SEQ ID NO: 819588 - DNA, 22 bp, Artificial Sequence
  chemically synthesized
caggcagaaggctcaagaacca

SEQ ID NO: 819589 - DNA, 22 bp, Artificial Sequence
  chemically synthesized
atgatcatagaggcaaggaaca

SEQ ID NO: 819590 - DNA, 22 bp, Artificial Sequence
  chemically synthesized
catgatcatagaggcaaggaac

SEQ ID NO: 819591 - DNA, 22 bp, Artificial Sequence
  chemically synthesized
tcatgatcatagaggcaaggaa

SEQ ID NO: 819592 - DNA, 22 bp, Artificial Sequence
  chemically synthesized
aagaaccatgttccttgcctct

SEQ ID NO: 819593 - DNA, 22 bp, Artificial Sequence
  chemically synthesized
tttcatgatcatagaggcaagg

SEQ ID NO: 819594 - DNA, 22 bp, Artificial Sequence
  chemically synthesized
gtacattctttcatgatcatag

SEQ ID NO: 819595 - DNA, 22 bp, Artificial Sequence
  chemically synthesized
ggtacattctttcatgatcata

SEQ ID NO: 819596 - DNA, 22 bp, Artificial Sequence
  chemically synthesized
cttgcctctatgatcatgaaag

SEQ ID NO: 819597 - DNA, 22 bp, Artificial Sequence
  chemically synthesized
catcttggtacattctttcatg

SEQ ID NO: 819598 - DNA, 22 bp, Artificial Sequence
  chemically synthesized
gcctctatgatcatgaaagaat

SEQ ID NO: 819599 - DNA, 22 bp, Artificial Sequence
  chemically synthesized
cctctatgatcatgaaagaatg

SEQ ID NO: 819600 - DNA, 22 bp, Artificial Sequence
  chemically synthesized
tatgatcatgaaagaatgtacc

SEQ ID NO: 819601 - DNA, 22 bp, Artificial Sequence
  chemically synthesized
tgatcatgaaagaatgtaccaa

SEQ ID NO: 819602 - DNA, 22 bp, Artificial Sequence
  chemically synthesized
atggtatctccatcttggtaca

SEQ ID NO: 819603 - DNA, 22 bp, Artificial Sequence
  chemically synthesized
ggggaccatggctgatggtatc

SEQ ID NO: 819604 - DNA, 22 bp, Artificial Sequence
  chemically synthesized
gtcactcggggaccatggctga

SEQ ID NO: 819605 - DNA, 22 bp, Artificial Sequence
  chemically synthesized
agtcactcggggaccatggctg

SEQ ID NO: 819606 - DNA, 22 bp, Artificial Sequence
  chemically synthesized
gcttagtcactcggggaccatg

SEQ ID NO: 819607 - DNA, 22 bp, Artificial Sequence
  chemically synthesized
agcttagtcactcggggaccat

SEQ ID NO: 819608 - DNA, 22 bp, Artificial Sequence
  chemically synthesized
cttagcttagtcactcggggac

SEQ ID NO: 819609 - DNA, 22 bp, Artificial Sequence
  chemically synthesized
tacttagcttagtcactcgggg

SEQ ID NO: 819610 - DNA, 22 bp, Artificial Sequence
  chemically synthesized
atgagagcattctacttagctt

SEQ ID NO: 819611 - DNA, 22 bp, Artificial Sequence
  chemically synthesized
tagactgatgagagcattctac

SEQ ID NO: 819612 - DNA, 22 bp, Artificial Sequence
  chemically synthesized
gttgtagactgatgagagcatt

SEQ ID NO: 819613 - DNA, 22 bp, Artificial Sequence
  chemically synthesized
agctaagtagaatgctctcatc

SEQ ID NO: 819614 - DNA, 22 bp, Artificial Sequence
  chemically synthesized
agtagaatgctctcatcagtct

SEQ ID NO: 819615 - DNA, 22 bp, Artificial Sequence
  chemically synthesized
catgttcgttgtagactgatga

SEQ ID NO: 819616 - DNA, 22 bp, Artificial Sequence
  chemically synthesized
atgttacatgttcgttgtagac

SEQ ID NO: 819617 - DNA, 22 bp, Artificial Sequence
  chemically synthesized
ctcatgttacatgttcgttgta

SEQ ID NO: 819618 - DNA, 22 bp, Artificial Sequence
  chemically synthesized
actcatgttacatgttcgttgt

SEQ ID NO: 819619 - DNA, 22 bp, Artificial Sequence
  chemically synthesized
tactcatgttacatgttcgttg

SEQ ID NO: 819620 - DNA, 22 bp, Artificial Sequence
  chemically synthesized
tcatcagtctacaacgaacatg

SEQ ID NO: 819621 - DNA, 22 bp, Artificial Sequence
  chemically synthesized
atcagtctacaacgaacatgta

SEQ ID NO: 819622 - DNA, 22 bp, Artificial Sequence
  chemically synthesized
tattttactcatgttacatgtt

SEQ ID NO: 819623 - DNA, 22 bp, Artificial Sequence
  chemically synthesized
caacgaacatgtaacatgagta

SEQ ID NO: 819624 - DNA, 22 bp, Artificial Sequence
  chemically synthesized
atagtctatattttactcatgt

SEQ ID NO: 819625 - DNA, 22 bp, Artificial Sequence
  chemically synthesized
aatagtctatattttactcatg

SEQ ID NO: 819626 - DNA, 22 bp, Artificial Sequence
  chemically synthesized
gaggcttaatagtctatatttt

SEQ ID NO: 819627 - DNA, 22 bp, Artificial Sequence
  chemically synthesized
aaatctagaggcttaatagtct

SEQ ID NO: 819628 - DNA, 22 bp, Artificial Sequence
  chemically synthesized
cagtaataagcaacctcaaatc

SEQ ID NO: 819629 - DNA, 22 bp, Artificial Sequence
  chemically synthesized
ttaagcctctagatttgaggtt

SEQ ID NO: 819630 - DNA, 22 bp, Artificial Sequence
  chemically synthesized
agcctctagatttgaggttgct

SEQ ID NO: 819631 - DNA, 22 bp, Artificial Sequence
  chemically synthesized
agctacagtaataagcaacctc

SEQ ID NO: 819632 - DNA, 22 bp, Artificial Sequence
  chemically synthesized
tagatttgaggttgcttattac

SEQ ID NO: 819633 - DNA, 22 bp, Artificial Sequence
  chemically synthesized
gatttgaggttgcttattactg

SEQ ID NO: 819634 - DNA, 22 bp, Artificial Sequence
  chemically synthesized
gaggttgcttattactgtagct

SEQ ID NO: 819635 - DNA, 22 bp, Artificial Sequence
  chemically synthesized
aggttgcttattactgtagctt

SEQ ID NO: 819636 - DNA, 22 bp, Artificial Sequence
  chemically synthesized
cttattactgtagcttagccta

SEQ ID NO: 819637 - DNA, 22 bp, Artificial Sequence
  chemically synthesized
attactgtagcttagcctatgc

SEQ ID NO: 819638 - DNA, 22 bp, Artificial Sequence
  chemically synthesized
ttactgtagcttagcctatgct

SEQ ID NO: 819639 - DNA, 22 bp, Artificial Sequence
  chemically synthesized
ctgtagcttagcctatgctgac

SEQ ID NO: 819640 - DNA, 22 bp, Artificial Sequence
  chemically synthesized
aataggtatgtcagtcagcata

SEQ ID NO: 819641 - DNA, 22 bp, Artificial Sequence
  chemically synthesized
tagcttagcctatgctgactga

SEQ ID NO: 819642 - DNA, 22 bp, Artificial Sequence
  chemically synthesized
agcctatgctgactgacatacc

SEQ ID NO: 819643 - DNA, 22 bp, Artificial Sequence
  chemically synthesized
gcctatgctgactgacatacct

SEQ ID NO: 819644 - DNA, 22 bp, Artificial Sequence
  chemically synthesized
tgctgactgacatacctattca

SEQ ID NO: 819645 - DNA, 22 bp, Artificial Sequence
  chemically synthesized
actgacatacctattcagatat

SEQ ID NO: 819646 - DNA, 22 bp, Artificial Sequence
  chemically synthesized
tgtgaaataaggtcatatctga

SEQ ID NO: 819647 - DNA, 22 bp, Artificial Sequence
  chemically synthesized
acatacctattcagatatgacc

SEQ ID NO: 819648 - DNA, 22 bp, Artificial Sequence
  chemically synthesized
tatgtgaaataaggtcatatct

SEQ ID NO: 819649 - DNA, 22 bp, Artificial Sequence
  chemically synthesized
ctctatgtgaaataaggtcata

SEQ ID NO: 819650 - DNA, 22 bp, Artificial Sequence
  chemically synthesized
ccctactctatgtgaaataagg

SEQ ID NO: 819651 - DNA, 22 bp, Artificial Sequence
  chemically synthesized
ttcagatatgaccttatttcac

SEQ ID NO: 819652 - DNA, 22 bp, Artificial Sequence
  chemically synthesized
agatatgaccttatttcacata

SEQ ID NO: 819653 - DNA, 22 bp, Artificial Sequence
  chemically synthesized
gaattgccctactctatgtgaa

SEQ ID NO: 819654 - DNA, 22 bp, Artificial Sequence
  chemically synthesized
gaggtattagaattgccctact

SEQ ID NO: 819655 - DNA, 22 bp, Artificial Sequence
  chemically synthesized
atttcacatagagtagggcaat

SEQ ID NO: 819656 - DNA, 22 bp, Artificial Sequence
  chemically synthesized
tttcacatagagtagggcaatt

SEQ ID NO: 819657 - DNA, 22 bp, Artificial Sequence
  chemically synthesized
tctggaggtattagaattgccc

SEQ ID NO: 819658 - DNA, 22 bp, Artificial Sequence
  chemically synthesized
cacatagagtagggcaattcta

SEQ ID NO: 819659 - DNA, 22 bp, Artificial Sequence
  chemically synthesized
acatagagtagggcaattctaa

SEQ ID NO: 819660 - DNA, 22 bp, Artificial Sequence
  chemically synthesized
gtccaggactgtctggaggtat

SEQ ID NO: 819661 - DNA, 22 bp, Artificial Sequence
  chemically synthesized
gtcctggtccaggactgtctgg

SEQ ID NO: 819662 - DNA, 22 bp, Artificial Sequence
  chemically synthesized
taatacctccagacagtcctgg

SEQ ID NO: 819663 - DNA, 22 bp, Artificial Sequence
  chemically synthesized
atacctccagacagtcctggac

SEQ ID NO: 819664 - DNA, 22 bp, Artificial Sequence
  chemically synthesized
gccctggtcctggtccaggact

SEQ ID NO: 819665 - DNA, 22 bp, Artificial Sequence
  chemically synthesized
tagccctggtcctggtccagga

SEQ ID NO: 819666 - DNA, 22 bp, Artificial Sequence
  chemically synthesized
ttctagccctggtcctggtcca

SEQ ID NO: 819667 - DNA, 22 bp, Artificial Sequence
  chemically synthesized
attctagccctggtcctggtcc

SEQ ID NO: 819668 - DNA, 22 bp, Artificial Sequence
  chemically synthesized
cagacagtcctggaccaggacc

SEQ ID NO: 819669 - DNA, 22 bp, Artificial Sequence
  chemically synthesized
gtttattctagccctggtcctg

SEQ ID NO: 819670 - DNA, 22 bp, Artificial Sequence
  chemically synthesized
tactagtttattctagccctgg

SEQ ID NO: 819671 - DNA, 22 bp, Artificial Sequence
  chemically synthesized
gaccaggaccagggctagaata

SEQ ID NO: 819672 - DNA, 22 bp, Artificial Sequence
  chemically synthesized
tgtgtcattatactagtttatt

SEQ ID NO: 819673 - DNA, 22 bp, Artificial Sequence
  chemically synthesized
atgtgtcattatactagtttat

SEQ ID NO: 819674 - DNA, 22 bp, Artificial Sequence
  chemically synthesized
tatgtgtcattatactagttta

SEQ ID NO: 819675 - DNA, 22 bp, Artificial Sequence
  chemically synthesized
tttatgtgtcattatactagtt

SEQ ID NO: 819676 - DNA, 22 bp, Artificial Sequence
  chemically synthesized
ttctttatgtgtcattatacta

SEQ ID NO: 819677 - DNA, 22 bp, Artificial Sequence
  chemically synthesized
gaataaactagtataatgacac

SEQ ID NO: 819678 - DNA, 22 bp, Artificial Sequence
  chemically synthesized
ataagagaacctgttctttatg

SEQ ID NO: 819679 - DNA, 22 bp, Artificial Sequence
  chemically synthesized
gtataatgacacataaagaaca

SEQ ID NO: 819680 - DNA, 22 bp, Artificial Sequence
  chemically synthesized
ttaataagagaacctgttcttt

SEQ ID NO: 819681 - DNA, 22 bp, Artificial Sequence
  chemically synthesized
attaataagagaacctgttctt

SEQ ID NO: 819682 - DNA, 22 bp, Artificial Sequence
  chemically synthesized
tttattaataagagaacctgtt

SEQ ID NO: 819683 - DNA, 22 bp, Artificial Sequence
  chemically synthesized
ctatttattaataagagaacct

SEQ ID NO: 819684 - DNA, 22 bp, Artificial Sequence
  chemically synthesized
cctatttattaataagagaacc

SEQ ID NO: 819685 - DNA, 22 bp, Artificial Sequence
  chemically synthesized
tgtggcttcctatttattaata

SEQ ID NO: 819686 - DNA, 22 bp, Artificial Sequence
  chemically synthesized
atgtggcttcctatttattaat

SEQ ID NO: 819687 - DNA, 22 bp, Artificial Sequence
  chemically synthesized
aacatttatgtggcttcctatt

SEQ ID NO: 819688 - DNA, 22 bp, Artificial Sequence
  chemically synthesized
tcttattaataaataggaagcc

SEQ ID NO: 819689 - DNA, 22 bp, Artificial Sequence
  chemically synthesized
ttattaataaataggaagccac

SEQ ID NO: 819690 - DNA, 22 bp, Artificial Sequence
  chemically synthesized
ctcaacatttatgtggcttcct

SEQ ID NO: 819691 - DNA, 22 bp, Artificial Sequence
  chemically synthesized
cctcaacatttatgtggcttcc

SEQ ID NO: 819692 - DNA, 22 bp, Artificial Sequence
  chemically synthesized
attaataaataggaagccacat

SEQ ID NO: 819693 - DNA, 22 bp, Artificial Sequence
  chemically synthesized
ttaataaataggaagccacata

SEQ ID NO: 819694 - DNA, 22 bp, Artificial Sequence
  chemically synthesized
ataaataggaagccacataaat

SEQ ID NO: 819695 - DNA, 22 bp, Artificial Sequence
  chemically synthesized
aacatttcctcaacatttatgt

SEQ ID NO: 819696 - DNA, 22 bp, Artificial Sequence
  chemically synthesized
taaacatttcctcaacatttat

SEQ ID NO: 819697 - DNA, 22 bp, Artificial Sequence
  chemically synthesized
ttctaaacatttcctcaacatt

SEQ ID NO: 819698 - DNA, 22 bp, Artificial Sequence
  chemically synthesized
ttgttctaaacatttcctcaac

SEQ ID NO: 819699 - DNA, 22 bp, Artificial Sequence
  chemically synthesized
aggaaatgtttagaacaacaat

SEQ ID NO: 819700 - DNA, 22 bp, Artificial Sequence
  chemically synthesized
agaaaaacagggatattgttgt

SEQ ID NO: 819701 - DNA, 22 bp, Artificial Sequence
  chemically synthesized
tagttcagaaaaacagggatat

SEQ ID NO: 819702 - DNA, 22 bp, Artificial Sequence
  chemically synthesized
agaacaacaatatccctgtttt

SEQ ID NO: 819703 - DNA, 22 bp, Artificial Sequence
  chemically synthesized
gaacaacaatatccctgttttt

SEQ ID NO: 819704 - DNA, 22 bp, Artificial Sequence
  chemically synthesized
cctgtagttcagaaaaacaggg

SEQ ID NO: 819705 - DNA, 22 bp, Artificial Sequence
  chemically synthesized
agatgttacctgtagttcagaa

SEQ ID NO: 819706 - DNA, 22 bp, Artificial Sequence
  chemically synthesized
tgagatgttacctgtagttcag

SEQ ID NO: 819707 - DNA, 22 bp, Artificial Sequence
  chemically synthesized
tttttctgaactacaggtaaca

SEQ ID NO: 819708 - DNA, 22 bp, Artificial Sequence
  chemically synthesized
ttctgaactacaggtaacatct

SEQ ID NO: 819709 - DNA, 22 bp, Artificial Sequence
  chemically synthesized
tctgaactacaggtaacatctc

SEQ ID NO: 819710 - DNA, 22 bp, Artificial Sequence
  chemically synthesized
ctgaactacaggtaacatctca

SEQ ID NO: 819711 - DNA, 22 bp, Artificial Sequence
  chemically synthesized
tagaatatattctgagatgtta

SEQ ID NO: 819712 - DNA, 22 bp, Artificial Sequence
  chemically synthesized
tgaactacaggtaacatctcag

SEQ ID NO: 819713 - DNA, 22 bp, Artificial Sequence
  chemically synthesized
aactacaggtaacatctcagaa

SEQ ID NO: 819714 - DNA, 22 bp, Artificial Sequence
  chemically synthesized
tcctatagaatatattctgaga

SEQ ID NO: 819715 - DNA, 22 bp, Artificial Sequence
  chemically synthesized
tgtcctatagaatatattctga

SEQ ID NO: 819716 - DNA, 22 bp, Artificial Sequence
  chemically synthesized
caggtaacatctcagaatatat

SEQ ID NO: 819717 - DNA, 22 bp, Artificial Sequence
  chemically synthesized
agaatatattctataggacaga

SEQ ID NO: 819718 - DNA, 22 bp, Artificial Sequence
  chemically synthesized
tggtcaagataggcaggttctg

SEQ ID NO: 819719 - DNA, 22 bp, Artificial Sequence
  chemically synthesized
atggtcaagataggcaggttct

SEQ ID NO: 819720 - DNA, 22 bp, Artificial Sequence
  chemically synthesized
tatggtcaagataggcaggttc

SEQ ID NO: 819721 - DNA, 22 bp, Artificial Sequence
  chemically synthesized
ttatggtcaagataggcaggtt

SEQ ID NO: 819722 - DNA, 22 bp, Artificial Sequence
  chemically synthesized
tataggacagaacctgcctatc

SEQ ID NO: 819723 - DNA, 22 bp, Artificial Sequence
  chemically synthesized
ttttatggtcaagataggcagg

SEQ ID NO: 819724 - DNA, 22 bp, Artificial Sequence
  chemically synthesized
cttttatggtcaagataggcag

SEQ ID NO: 819725 - DNA, 22 bp, Artificial Sequence
  chemically synthesized
taggacagaacctgcctatctt

SEQ ID NO: 819726 - DNA, 22 bp, Artificial Sequence
  chemically synthesized
tcttttatggtcaagataggca

SEQ ID NO: 819727 - DNA, 22 bp, Artificial Sequence
  chemically synthesized
ttttcttttatggtcaagatag

SEQ ID NO: 819728 - DNA, 22 bp, Artificial Sequence
  chemically synthesized
cctatcttgaccataaaagaaa

SEQ ID NO: 819729 - DNA, 22 bp, Artificial Sequence
  chemically synthesized
tcttgaccataaaagaaaatag

SEQ ID NO: 819730 - DNA, 22 bp, Artificial Sequence
  chemically synthesized
gaccataaaagaaaatagctcc

SEQ ID NO: 819731 - DNA, 22 bp, Artificial Sequence
  chemically synthesized
accataaaagaaaatagctccc

SEQ ID NO: 819732 - DNA, 22 bp, Artificial Sequence
  chemically synthesized
catcacacaatggatagggagc

SEQ ID NO: 819733 - DNA, 22 bp, Artificial Sequence
  chemically synthesized
gatgggagcctccatcacacaa

SEQ ID NO: 819734 - DNA, 22 bp, Artificial Sequence
  chemically synthesized
cctatccattgtgtgatggagg

SEQ ID NO: 819735 - DNA, 22 bp, Artificial Sequence
  chemically synthesized
cctagatgggagcctccatcac

SEQ ID NO: 819736 - DNA, 22 bp, Artificial Sequence
  chemically synthesized
ctacctagatgggagcctccat

SEQ ID NO: 819737 - DNA, 22 bp, Artificial Sequence
  chemically synthesized
tccattgtgtgatggaggctcc

SEQ ID NO: 819738 - DNA, 22 bp, Artificial Sequence
  chemically synthesized
tgtgatggaggctcccatctag

SEQ ID NO: 819739 - DNA, 22 bp, Artificial Sequence
  chemically synthesized
tggaacataactgctacctaga

SEQ ID NO: 819740 - DNA, 22 bp, Artificial Sequence
  chemically synthesized
ccatctaggtagcagttatgtt

SEQ ID NO: 819741 - DNA, 22 bp, Artificial Sequence
  chemically synthesized
ggtagcagttatgttccacaga

SEQ ID NO: 819742 - DNA, 22 bp, Artificial Sequence
  chemically synthesized
tagaaatgaaaaaatagccatg

SEQ ID NO: 819743 - DNA, 22 bp, Artificial Sequence
  chemically synthesized
tgttccacagacatggctattt

SEQ ID NO: 819744 - DNA, 22 bp, Artificial Sequence
  chemically synthesized
cacagacatggctattttttca

SEQ ID NO: 819745 - DNA, 22 bp, Artificial Sequence
  chemically synthesized
ccagctatagaaatgaaaaaat

SEQ ID NO: 819746 - DNA, 22 bp, Artificial Sequence
  chemically synthesized
gccagctatagaaatgaaaaaa

SEQ ID NO: 819747 - DNA, 22 bp, Artificial Sequence
  chemically synthesized
cttgccagctatagaaatgaaa

SEQ ID NO: 819748 - DNA, 22 bp, Artificial Sequence
  chemically synthesized
ttttttcatttctatagctggc

SEQ ID NO: 819749 - DNA, 22 bp, Artificial Sequence
  chemically synthesized
atgaagctgcttgccagctata

SEQ ID NO: 819750 - DNA, 22 bp, Artificial Sequence
  chemically synthesized
catgaagctgcttgccagctat

SEQ ID NO: 819751 - DNA, 22 bp, Artificial Sequence
  chemically synthesized
tcatgaagctgcttgccagcta

SEQ ID NO: 819752 - DNA, 22 bp, Artificial Sequence
  chemically synthesized
tttcatttctatagctggcaag

SEQ ID NO: 819753 - DNA, 22 bp, Artificial Sequence
  chemically synthesized
ttcatttctatagctggcaagc

SEQ ID NO: 819754 - DNA, 22 bp, Artificial Sequence
  chemically synthesized
tttcatgaagctgcttgccagc

SEQ ID NO: 819755 - DNA, 22 bp, Artificial Sequence
  chemically synthesized
tcatttctatagctggcaagca

SEQ ID NO: 819756 - DNA, 22 bp, Artificial Sequence
  chemically synthesized
catttctatagctggcaagcag

SEQ ID NO: 819757 - DNA, 22 bp, Artificial Sequence
  chemically synthesized
tctttcatgaagctgcttgcca

SEQ ID NO: 819758 - DNA, 22 bp, Artificial Sequence
  chemically synthesized
atttctatagctggcaagcagc

SEQ ID NO: 819759 - DNA, 22 bp, Artificial Sequence
  chemically synthesized
ctctttcatgaagctgcttgcc

SEQ ID NO: 819760 - DNA, 22 bp, Artificial Sequence
  chemically synthesized
tctctttcatgaagctgcttgc

SEQ ID NO: 819761 - DNA, 22 bp, Artificial Sequence
  chemically synthesized
ttctctttcatgaagctgcttg

SEQ ID NO: 819762 - DNA, 22 bp, Artificial Sequence
  chemically synthesized
ctatagctggcaagcagcttca

SEQ ID NO: 819763 - DNA, 22 bp, Artificial Sequence
  chemically synthesized
tatagctggcaagcagcttcat

SEQ ID NO: 819764 - DNA, 22 bp, Artificial Sequence
  chemically synthesized
tagctggcaagcagcttcatga

SEQ ID NO: 819765 - DNA, 22 bp, Artificial Sequence
  chemically synthesized
catttttctctttcatgaagct

SEQ ID NO: 819766 - DNA, 22 bp, Artificial Sequence
  chemically synthesized
gcaagcagcttcatgaaagaga

SEQ ID NO: 819767 - DNA, 22 bp, Artificial Sequence
  chemically synthesized
gaaacatagtctccatttttct

SEQ ID NO: 819768 - DNA, 22 bp, Artificial Sequence
  chemically synthesized
agaaacatagtctccatttttc

SEQ ID NO: 819769 - DNA, 22 bp, Artificial Sequence
  chemically synthesized
tagaaacatagtctccattttt

SEQ ID NO: 819770 - DNA, 22 bp, Artificial Sequence
  chemically synthesized
catgaaagagaaaaatggagac

SEQ ID NO: 819771 - DNA, 22 bp, Artificial Sequence
  chemically synthesized
atgaaagagaaaaatggagact

SEQ ID NO: 819772 - DNA, 22 bp, Artificial Sequence
  chemically synthesized
tgaacacagttttagaaacata

SEQ ID NO: 819773 - DNA, 22 bp, Artificial Sequence
  chemically synthesized
atgaacacagttttagaaacat

SEQ ID NO: 819774 - DNA, 22 bp, Artificial Sequence
  chemically synthesized
tatgaacacagttttagaaaca

SEQ ID NO: 819775 - DNA, 22 bp, Artificial Sequence
  chemically synthesized
aagttttatgaacacagtttta

SEQ ID NO: 819776 - DNA, 22 bp, Artificial Sequence
  chemically synthesized
caagttttatgaacacagtttt

SEQ ID NO: 819777 - DNA, 22 bp, Artificial Sequence
  chemically synthesized
tcaagttttatgaacacagttt

SEQ ID NO: 819778 - DNA, 22 bp, Artificial Sequence
  chemically synthesized
ttcaagttttatgaacacagtt

SEQ ID NO: 819779 - DNA, 22 bp, Artificial Sequence
  chemically synthesized
tttcaagttttatgaacacagt

SEQ ID NO: 819780 - DNA, 22 bp, Artificial Sequence
  chemically synthesized
tgtttctaaaactgtgttcata

SEQ ID NO: 819781 - DNA, 22 bp, Artificial Sequence
  chemically synthesized
ttttttcaagttttatgaacac

SEQ ID NO: 819782 - DNA, 22 bp, Artificial Sequence
  chemically synthesized
attttttcaagttttatgaaca

SEQ ID NO: 819783 - DNA, 22 bp, Artificial Sequence
  chemically synthesized
ttattttttcaagttttatgaa

SEQ ID NO: 819784 - DNA, 22 bp, Artificial Sequence
  chemically synthesized
ctaaaactgtgttcataaaact

SEQ ID NO: 819785 - DNA, 22 bp, Artificial Sequence
  chemically synthesized
cttattttttcaagttttatga

SEQ ID NO: 819786 - DNA, 22 bp, Artificial Sequence
  chemically synthesized
taaaactgtgttcataaaactt

SEQ ID NO: 819787 - DNA, 22 bp, Artificial Sequence
  chemically synthesized
tcttattttttcaagttttatg

SEQ ID NO: 819788 - DNA, 22 bp, Artificial Sequence
  chemically synthesized
ttcttattttttcaagttttat

SEQ ID NO: 819789 - DNA, 22 bp, Artificial Sequence
  chemically synthesized
aaactgtgttcataaaacttga

SEQ ID NO: 819790 - DNA, 22 bp, Artificial Sequence
  chemically synthesized
tgttcataaaacttgaaaaaat

SEQ ID NO: 819791 - DNA, 22 bp, Artificial Sequence
  chemically synthesized
cagatcttttcttattttttca

SEQ ID NO: 819792 - DNA, 22 bp, Artificial Sequence
  chemically synthesized
ataaaacttgaaaaaataagaa

SEQ ID NO: 819793 - DNA, 22 bp, Artificial Sequence
  chemically synthesized
actacagatcttttcttatttt

SEQ ID NO: 819794 - DNA, 22 bp, Artificial Sequence
  chemically synthesized
gaaaaaataagaaaagatctgt

SEQ ID NO: 819795 - DNA, 22 bp, Artificial Sequence
  chemically synthesized
aaaaaataagaaaagatctgta

SEQ ID NO: 819796 - DNA, 22 bp, Artificial Sequence
  chemically synthesized
catgtcattgactacagatctt

SEQ ID NO: 819797 - DNA, 22 bp, Artificial Sequence
  chemically synthesized
aaaagtatatctgcatgtcatt

SEQ ID NO: 819798 - DNA, 22 bp, Artificial Sequence
  chemically synthesized
tagtcaatgacatgcagatata

SEQ ID NO: 819799 - DNA, 22 bp, Artificial Sequence
  chemically synthesized
tggtatgttaaaaagtatatct

SEQ ID NO: 819800 - DNA, 22 bp, Artificial Sequence
  chemically synthesized
atggtatgttaaaaagtatatc

SEQ ID NO: 819801 - DNA, 22 bp, Artificial Sequence
  chemically synthesized
tatggtatgttaaaaagtatat

SEQ ID NO: 819802 - DNA, 22 bp, Artificial Sequence
  chemically synthesized
agtgggagaattttatggtatg

SEQ ID NO: 819803 - DNA, 22 bp, Artificial Sequence
  chemically synthesized
aagtgggagaattttatggtat

SEQ ID NO: 819804 - DNA, 22 bp, Artificial Sequence
  chemically synthesized
taagtgggagaattttatggta

SEQ ID NO: 819805 - DNA, 22 bp, Artificial Sequence
  chemically synthesized
tttaacataccataaaattctc

SEQ ID NO: 819806 - DNA, 22 bp, Artificial Sequence
  chemically synthesized
ttaacataccataaaattctcc

SEQ ID NO: 819807 - DNA, 22 bp, Artificial Sequence
  chemically synthesized
taacataccataaaattctccc

SEQ ID NO: 819808 - DNA, 22 bp, Artificial Sequence
  chemically synthesized
tgcactttaagtgggagaattt

SEQ ID NO: 819809 - DNA, 22 bp, Artificial Sequence
  chemically synthesized
aacataccataaaattctccca

SEQ ID NO: 819810 - DNA, 22 bp, Artificial Sequence
  chemically synthesized
acataccataaaattctcccac

SEQ ID NO: 819811 - DNA, 22 bp, Artificial Sequence
  chemically synthesized
agaaccagaaaattatgcactt

SEQ ID NO: 819812 - DNA, 22 bp, Artificial Sequence
  chemically synthesized
tcccacttaaagtgcataattt

SEQ ID NO: 819813 - DNA, 22 bp, Artificial Sequence
  chemically synthesized
ccacttaaagtgcataattttc

SEQ ID NO: 819814 - DNA, 22 bp, Artificial Sequence
  chemically synthesized
aatacattaagaaccagaaaat

SEQ ID NO: 819815 - DNA, 22 bp, Artificial Sequence
  chemically synthesized
aaagtgcataattttctggttc

SEQ ID NO: 819816 - DNA, 22 bp, Artificial Sequence
  chemically synthesized
aagtgcataattttctggttct

SEQ ID NO: 819817 - DNA, 22 bp, Artificial Sequence
  chemically synthesized
cacaaccctgaatacattaaga

SEQ ID NO: 819818 - DNA, 22 bp, Artificial Sequence
  chemically synthesized
tctggttcttaatgtattcagg

SEQ ID NO: 819819 - DNA, 22 bp, Artificial Sequence
  chemically synthesized
ctggttcttaatgtattcaggg

SEQ ID NO: 819820 - DNA, 22 bp, Artificial Sequence
  chemically synthesized
tggttcttaatgtattcagggt

SEQ ID NO: 819821 - DNA, 22 bp, Artificial Sequence
  chemically synthesized
gttcttaatgtattcagggttg

SEQ ID NO: 819822 - DNA, 22 bp, Artificial Sequence
  chemically synthesized
ttaatgtattcagggttgtgca

SEQ ID NO: 819823 - DNA, 22 bp, Artificial Sequence
  chemically synthesized
aatgtattcagggttgtgcaac

SEQ ID NO: 819824 - DNA, 22 bp, Artificial Sequence
  chemically synthesized
atgtattcagggttgtgcaacc

SEQ ID NO: 819825 - DNA, 22 bp, Artificial Sequence
  chemically synthesized
gatcataataatggttgcacaa

SEQ ID NO: 819826 - DNA, 22 bp, Artificial Sequence
  chemically synthesized
aaattagatcataataatggtt

SEQ ID NO: 819827 - DNA, 22 bp, Artificial Sequence
  chemically synthesized
agggttgtgcaaccattattat

SEQ ID NO: 819828 - DNA, 22 bp, Artificial Sequence
  chemically synthesized
tcaaattagatcataataatgg

SEQ ID NO: 819829 - DNA, 22 bp, Artificial Sequence
  chemically synthesized
tgcaaccattattatgatctaa

SEQ ID NO: 819830 - DNA, 22 bp, Artificial Sequence
  chemically synthesized
ttatgatctaatttgagaacat

SEQ ID NO: 819831 - DNA, 22 bp, Artificial Sequence
  chemically synthesized
ggggcaaataaaatgttctcaa

SEQ ID NO: 819832 - DNA, 22 bp, Artificial Sequence
  chemically synthesized
tgatctaatttgagaacatttt

SEQ ID NO: 819833 - DNA, 22 bp, Artificial Sequence
  chemically synthesized
attgggggcaaataaaatgttc

SEQ ID NO: 819834 - DNA, 22 bp, Artificial Sequence
  chemically synthesized
cattgggggcaaataaaatgtt

SEQ ID NO: 819835 - DNA, 22 bp, Artificial Sequence
  chemically synthesized
atttgagaacattttatttgcc

SEQ ID NO: 819836 - DNA, 22 bp, Artificial Sequence
  chemically synthesized
gagaacattttatttgccccca

SEQ ID NO: 819837 - DNA, 22 bp, Artificial Sequence
  chemically synthesized
agaacattttatttgcccccaa

SEQ ID NO: 819838 - DNA, 22 bp, Artificial Sequence
  chemically synthesized
gtatgggtttcattgggggcaa

SEQ ID NO: 819839 - DNA, 22 bp, Artificial Sequence
  chemically synthesized
attggtatgggtttcattgggg

SEQ ID NO: 819840 - DNA, 22 bp, Artificial Sequence
  chemically synthesized
ttaattggtatgggtttcattg

SEQ ID NO: 819841 - DNA, 22 bp, Artificial Sequence
  chemically synthesized
tatttgcccccaatgaaaccca

SEQ ID NO: 819842 - DNA, 22 bp, Artificial Sequence
  chemically synthesized
atttgcccccaatgaaacccat

SEQ ID NO: 819843 - DNA, 22 bp, Artificial Sequence
  chemically synthesized
tttgcccccaatgaaacccata

SEQ ID NO: 819844 - DNA, 22 bp, Artificial Sequence
  chemically synthesized
gcccccaatgaaacccatacca

SEQ ID NO: 819845 - DNA, 22 bp, Artificial Sequence
  chemically synthesized
cccccaatgaaacccataccaa

SEQ ID NO: 819846 - DNA, 22 bp, Artificial Sequence
  chemically synthesized
acagtccctttctattgtctat

SEQ ID NO: 819847 - DNA, 22 bp, Artificial Sequence
  chemically synthesized
aaggaggaggagaatagacaat

SEQ ID NO: 819848 - DNA, 22 bp, Artificial Sequence
  chemically synthesized
tctattgtctattctcctcctc

SEQ ID NO: 819849 - DNA, 22 bp, Artificial Sequence
  chemically synthesized
ctattgtctattctcctcctcc

SEQ ID NO: 819850 - DNA, 22 bp, Artificial Sequence
  chemically synthesized
tattgtctattctcctcctcct

SEQ ID NO: 819851 - DNA, 22 bp, Artificial Sequence
  chemically synthesized
ttgtctattctcctcctccttc

SEQ ID NO: 819852 - DNA, 22 bp, Artificial Sequence
  chemically synthesized
tctattctcctcctccttcagt

SEQ ID NO: 819853 - DNA, 22 bp, Artificial Sequence
  chemically synthesized
ttctcctcctccttcagtcttt

SEQ ID NO: 819854 - DNA, 22 bp, Artificial Sequence
  chemically synthesized
tcctcctccttcagtctttact

SEQ ID NO: 819855 - DNA, 22 bp, Artificial Sequence
  chemically synthesized
atataaaacatccagtaaagac

SEQ ID NO: 819856 - DNA, 22 bp, Artificial Sequence
  chemically synthesized
ctcctccttcagtctttactgg

SEQ ID NO: 819857 - DNA, 22 bp, Artificial Sequence
  chemically synthesized
ctccttcagtctttactggatg

SEQ ID NO: 819858 - DNA, 22 bp, Artificial Sequence
  chemically synthesized
cttcagtctttactggatgttt

SEQ ID NO: 819859 - DNA, 22 bp, Artificial Sequence
  chemically synthesized
cagtctttactggatgttttat

SEQ ID NO: 819860 - DNA, 22 bp, Artificial Sequence
  chemically synthesized
agtctttactggatgttttata

SEQ ID NO: 819861 - DNA, 22 bp, Artificial Sequence
  chemically synthesized
tatcaatacattcatataaaac

SEQ ID NO: 819862 - DNA, 22 bp, Artificial Sequence
  chemically synthesized
tactggatgttttatatgaatg

SEQ ID NO: 819863 - DNA, 22 bp, Artificial Sequence
  chemically synthesized
actggatgttttatatgaatgt

SEQ ID NO: 819864 - DNA, 22 bp, Artificial Sequence
  chemically synthesized
ctggatgttttatatgaatgta

SEQ ID NO: 819865 - DNA, 22 bp, Artificial Sequence
  chemically synthesized
gatgttttatatgaatgtattg

SEQ ID NO: 819866 - DNA, 22 bp, Artificial Sequence
  chemically synthesized
tatatgaatgtattgatacaat

SEQ ID NO: 819867 - DNA, 22 bp, Artificial Sequence
  chemically synthesized
atatgaatgtattgatacaatt

SEQ ID NO: 819868 - DNA, 22 bp, Artificial Sequence
  chemically synthesized
tatgaatgtattgatacaattt

SEQ ID NO: 819869 - DNA, 22 bp, Artificial Sequence
  chemically synthesized
atacaatttggggtcttttgtg

SEQ ID NO: 819870 - DNA, 22 bp, Artificial Sequence
  chemically synthesized
agtgatggaatccagtcacaaa

SEQ ID NO: 819871 - DNA, 22 bp, Artificial Sequence
  chemically synthesized
ggggtcttttgtgactggattc

SEQ ID NO: 819872 - DNA, 22 bp, Artificial Sequence
  chemically synthesized
gggtcttttgtgactggattcc

SEQ ID NO: 819873 - DNA, 22 bp, Artificial Sequence
  chemically synthesized
aaaaatatgctaagtgatggaa

SEQ ID NO: 819874 - DNA, 22 bp, Artificial Sequence
  chemically synthesized
ttgtgactggattccatcactt

SEQ ID NO: 819875 - DNA, 22 bp, Artificial Sequence
  chemically synthesized
tgtgactggattccatcactta

SEQ ID NO: 819876 - DNA, 22 bp, Artificial Sequence
  chemically synthesized
gtgactggattccatcacttag

SEQ ID NO: 819877 - DNA, 22 bp, Artificial Sequence
  chemically synthesized
tgactggattccatcacttagc

SEQ ID NO: 819878 - DNA, 22 bp, Artificial Sequence
  chemically synthesized
gattccatcacttagcatattt

SEQ ID NO: 819879 - DNA, 22 bp, Artificial Sequence
  chemically synthesized
catcacttagcatatttttgag

SEQ ID NO: 819880 - DNA, 22 bp, Artificial Sequence
  chemically synthesized
taacatgagtgaacctcaaaaa

SEQ ID NO: 819881 - DNA, 22 bp, Artificial Sequence
  chemically synthesized
agcatatttttgaggttcactc

SEQ ID NO: 819882 - DNA, 22 bp, Artificial Sequence
  chemically synthesized
gcatatttttgaggttcactca

SEQ ID NO: 819883 - DNA, 22 bp, Artificial Sequence
  chemically synthesized
atatgcactgtaacatgagtga

SEQ ID NO: 819884 - DNA, 22 bp, Artificial Sequence
  chemically synthesized
ttgaggttcactcatgttacag

SEQ ID NO: 819885 - DNA, 22 bp, Artificial Sequence
  chemically synthesized
tgaggttcactcatgttacagt

SEQ ID NO: 819886 - DNA, 22 bp, Artificial Sequence
  chemically synthesized
gaggttcactcatgttacagtg

SEQ ID NO: 819887 - DNA, 22 bp, Artificial Sequence
  chemically synthesized
aggttcactcatgttacagtgc

SEQ ID NO: 819888 - DNA, 22 bp, Artificial Sequence
  chemically synthesized
actcatgttacagtgcatatca

SEQ ID NO: 819889 - DNA, 22 bp, Artificial Sequence
  chemically synthesized
atgttacagtgcatatcagtat

SEQ ID NO: 819890 - DNA, 22 bp, Artificial Sequence
  chemically synthesized
cagtgcatatcagtatttcatt

SEQ ID NO: 819891 - DNA, 22 bp, Artificial Sequence
  chemically synthesized
gcaataaaaagaaatgaaatac

SEQ ID NO: 819892 - DNA, 22 bp, Artificial Sequence
  chemically synthesized
agcaataaaaagaaatgaaata

SEQ ID NO: 819893 - DNA, 22 bp, Artificial Sequence
  chemically synthesized
tttagcaataaaaagaaatgaa

SEQ ID NO: 819894 - DNA, 22 bp, Artificial Sequence
  chemically synthesized
catttctttttattgctaaata

SEQ ID NO: 819895 - DNA, 22 bp, Artificial Sequence
  chemically synthesized
atttctttttattgctaaataa

SEQ ID NO: 819896 - DNA, 22 bp, Artificial Sequence
  chemically synthesized
ctttttattgctaaataatatt

SEQ ID NO: 819897 - DNA, 22 bp, Artificial Sequence
  chemically synthesized
tttttattgctaaataatattc

SEQ ID NO: 819898 - DNA, 22 bp, Artificial Sequence
  chemically synthesized
catccaaaaatggaatattatt

SEQ ID NO: 819899 - DNA, 22 bp, Artificial Sequence
  chemically synthesized
tttattgctaaataatattcca

SEQ ID NO: 819900 - DNA, 22 bp, Artificial Sequence
  chemically synthesized
tacatccaaaaatggaatatta

SEQ ID NO: 819901 - DNA, 22 bp, Artificial Sequence
  chemically synthesized
ttattgctaaataatattccat

SEQ ID NO: 819902 - DNA, 22 bp, Artificial Sequence
  chemically synthesized
tattgctaaataatattccatt

SEQ ID NO: 819903 - DNA, 22 bp, Artificial Sequence
  chemically synthesized
attgctaaataatattccattt

SEQ ID NO: 819904 - DNA, 22 bp, Artificial Sequence
  chemically synthesized
ttgctaaataatattccatttt

SEQ ID NO: 819905 - DNA, 22 bp, Artificial Sequence
  chemically synthesized
ctaaataatattccatttttgg

SEQ ID NO: 819906 - DNA, 22 bp, Artificial Sequence
  chemically synthesized
aataatattccatttttggatg

SEQ ID NO: 819907 - DNA, 22 bp, Artificial Sequence
  chemically synthesized
aaatgtcctctacatccaaaaa

SEQ ID NO: 819908 - DNA, 22 bp, Artificial Sequence
  chemically synthesized
aaaatgtcctctacatccaaaa

SEQ ID NO: 819909 - DNA, 22 bp, Artificial Sequence
  chemically synthesized
taaaatgtcctctacatccaaa

SEQ ID NO: 819910 - DNA, 22 bp, Artificial Sequence
  chemically synthesized
catttttggatgtagaggacat

SEQ ID NO: 819911 - DNA, 22 bp, Artificial Sequence
  chemically synthesized
atgaataaattttaaaatgtcc

SEQ ID NO: 819912 - DNA, 22 bp, Artificial Sequence
  chemically synthesized
ttggatgtagaggacattttaa

SEQ ID NO: 819913 - DNA, 22 bp, Artificial Sequence
  chemically synthesized
tggatgtagaggacattttaaa

SEQ ID NO: 819914 - DNA, 22 bp, Artificial Sequence
  chemically synthesized
ggatgtagaggacattttaaaa

SEQ ID NO: 819915 - DNA, 22 bp, Artificial Sequence
  chemically synthesized
gatgtagaggacattttaaaat

SEQ ID NO: 819916 - DNA, 22 bp, Artificial Sequence
  chemically synthesized
taaaatttattcattagctgat

SEQ ID NO: 819917 - DNA, 22 bp, Artificial Sequence
  chemically synthesized
aaaatttattcattagctgatg

SEQ ID NO: 819918 - DNA, 22 bp, Artificial Sequence
  chemically synthesized
aaatttattcattagctgatgg

SEQ ID NO: 819919 - DNA, 22 bp, Artificial Sequence
  chemically synthesized
attcattagctgatggacattt

SEQ ID NO: 819920 - DNA, 22 bp, Artificial Sequence
  chemically synthesized
ttcattagctgatggacatttg

SEQ ID NO: 819921 - DNA, 22 bp, Artificial Sequence
  chemically synthesized
attagctgatggacatttgggt

SEQ ID NO: 819922 - DNA, 22 bp, Artificial Sequence
  chemically synthesized
gctgatggacatttgggttggt

SEQ ID NO: 819923 - DNA, 22 bp, Artificial Sequence
  chemically synthesized
atggacatttgggttggttcta

SEQ ID NO: 819924 - DNA, 22 bp, Artificial Sequence
  chemically synthesized
taatagccaaaaagtagaacca

SEQ ID NO: 819925 - DNA, 22 bp, Artificial Sequence
  chemically synthesized
ataatagccaaaaagtagaacc

SEQ ID NO: 819926 - DNA, 22 bp, Artificial Sequence
  chemically synthesized
tttataatagccaaaaagtaga

SEQ ID NO: 819927 - DNA, 22 bp, Artificial Sequence
  chemically synthesized
gggttggttctactttttggct

SEQ ID NO: 819928 - DNA, 22 bp, Artificial Sequence
  chemically synthesized
ggttggttctactttttggcta

SEQ ID NO: 819929 - DNA, 22 bp, Artificial Sequence
  chemically synthesized
gttctactttttggctattata

SEQ ID NO: 819930 - DNA, 22 bp, Artificial Sequence
  chemically synthesized
atagcagcattatttataatag

SEQ ID NO: 819931 - DNA, 22 bp, Artificial Sequence
  chemically synthesized
tactttttggctattataaata

SEQ ID NO: 819932 - DNA, 22 bp, Artificial Sequence
  chemically synthesized
ctttttggctattataaataat

SEQ ID NO: 819933 - DNA, 22 bp, Artificial Sequence
  chemically synthesized
tttggctattataaataatgct

SEQ ID NO: 819934 - DNA, 22 bp, Artificial Sequence
  chemically synthesized
ttggctattataaataatgctg

SEQ ID NO: 819935 - DNA, 22 bp, Artificial Sequence
  chemically synthesized
tggctattataaataatgctgc

SEQ ID NO: 819936 - DNA, 22 bp, Artificial Sequence
  chemically synthesized
ggctattataaataatgctgct

SEQ ID NO: 819937 - DNA, 22 bp, Artificial Sequence
  chemically synthesized
gctattataaataatgctgcta

SEQ ID NO: 819938 - DNA, 22 bp, Artificial Sequence
  chemically synthesized
tacagatgttcatagcagcatt

SEQ ID NO: 819939 - DNA, 22 bp, Artificial Sequence
  chemically synthesized
atacagatgttcatagcagcat

SEQ ID NO: 819940 - DNA, 22 bp, Artificial Sequence
  chemically synthesized
tatacagatgttcatagcagca

SEQ ID NO: 819941 - DNA, 22 bp, Artificial Sequence
  chemically synthesized
ttataaataatgctgctatgaa

SEQ ID NO: 819942 - DNA, 22 bp, Artificial Sequence
  chemically synthesized
taaataatgctgctatgaacat

SEQ ID NO: 819943 - DNA, 22 bp, Artificial Sequence
  chemically synthesized
ctatgaacatctgtataaaggt

SEQ ID NO: 819944 - DNA, 22 bp, Artificial Sequence
  chemically synthesized
tgaacatctgtataaaggtttt

SEQ ID NO: 819945 - DNA, 22 bp, Artificial Sequence
  chemically synthesized
tataaaggttttctgtgtacat

SEQ ID NO: 819946 - DNA, 22 bp, Artificial Sequence
  chemically synthesized
aacagaaataaaaatacatatg

SEQ ID NO: 819947 - DNA, 22 bp, Artificial Sequence
  chemically synthesized
tctgtgtacatatgtattttta

SEQ ID NO: 819948 - DNA, 22 bp, Artificial Sequence
  chemically synthesized
ctgtgtacatatgtatttttat

SEQ ID NO: 819949 - DNA, 22 bp, Artificial Sequence
  chemically synthesized
tgtgtacatatgtatttttatt

SEQ ID NO: 819950 - DNA, 22 bp, Artificial Sequence
  chemically synthesized
tgtacatatgtatttttatttc

SEQ ID NO: 819951 - DNA, 22 bp, Artificial Sequence
  chemically synthesized
ccaggtgtatgctgaacagaaa

SEQ ID NO: 819952 - DNA, 22 bp, Artificial Sequence
  chemically synthesized
ctcccaggtgtatgctgaacag

SEQ ID NO: 819953 - DNA, 22 bp, Artificial Sequence
  chemically synthesized
tactcccaggtgtatgctgaac

SEQ ID NO: 819954 - DNA, 22 bp, Artificial Sequence
  chemically synthesized
ttatttctgttcagcatacacc

SEQ ID NO: 819955 - DNA, 22 bp, Artificial Sequence
  chemically synthesized
tatttctgttcagcatacacct

SEQ ID NO: 819956 - DNA, 22 bp, Artificial Sequence
  chemically synthesized
atttctgttcagcatacacctg

SEQ ID NO: 819957 - DNA, 22 bp, Artificial Sequence
  chemically synthesized
tttctgttcagcatacacctgg

SEQ ID NO: 819958 - DNA, 22 bp, Artificial Sequence
  chemically synthesized
ctgttcagcatacacctgggag

SEQ ID NO: 819959 - DNA, 22 bp, Artificial Sequence
  chemically synthesized
tgttcagcatacacctgggagt

SEQ ID NO: 819960 - DNA, 22 bp, Artificial Sequence
  chemically synthesized
ttcagcatacacctgggagtag

SEQ ID NO: 819961 - DNA, 22 bp, Artificial Sequence
  chemically synthesized
agcatacacctgggagtagaat

SEQ ID NO: 819962 - DNA, 22 bp, Artificial Sequence
  chemically synthesized
ccatatgacaaaaccattctac

SEQ ID NO: 819963 - DNA, 22 bp, Artificial Sequence
  chemically synthesized
ggagtagaatggttttgtcata

SEQ ID NO: 819964 - DNA, 22 bp, Artificial Sequence
  chemically synthesized
aacatgaagctaccatatgaca

SEQ ID NO: 819965 - DNA, 22 bp, Artificial Sequence
  chemically synthesized
gaaatattaaacatgaagctac

SEQ ID NO: 819966 - DNA, 22 bp, Artificial Sequence
  chemically synthesized
tgtcatatggtagcttcatgtt

SEQ ID NO: 819967 - DNA, 22 bp, Artificial Sequence
  chemically synthesized
ctggaaatattaaacatgaagc

SEQ ID NO: 819968 - DNA, 22 bp, Artificial Sequence
  chemically synthesized
gtcatatggtagcttcatgttt

SEQ ID NO: 819969 - DNA, 22 bp, Artificial Sequence
  chemically synthesized
tcatatggtagcttcatgttta

SEQ ID NO: 819970 - DNA, 22 bp, Artificial Sequence
  chemically synthesized
ccagtctcctggaaatattaaa

SEQ ID NO: 819971 - DNA, 22 bp, Artificial Sequence
  chemically synthesized
cccagtctcctggaaatattaa

SEQ ID NO: 819972 - DNA, 22 bp, Artificial Sequence
  chemically synthesized
cccttcccagtctcctggaaat

SEQ ID NO: 819973 - DNA, 22 bp, Artificial Sequence
  chemically synthesized
catgtttaatatttccaggaga

SEQ ID NO: 819974 - DNA, 22 bp, Artificial Sequence
  chemically synthesized
atgtttaatatttccaggagac

SEQ ID NO: 819975 - DNA, 22 bp, Artificial Sequence
  chemically synthesized
ccactacccttcccagtctcct

SEQ ID NO: 819976 - DNA, 22 bp, Artificial Sequence
  chemically synthesized
aatatttccaggagactgggaa

SEQ ID NO: 819977 - DNA, 22 bp, Artificial Sequence
  chemically synthesized
atatttccaggagactgggaag

SEQ ID NO: 819978 - DNA, 22 bp, Artificial Sequence
  chemically synthesized
cccctaccactacccttcccag

SEQ ID NO: 819979 - DNA, 22 bp, Artificial Sequence
  chemically synthesized
ccccctaccactacccttccca

SEQ ID NO: 819980 - DNA, 22 bp, Artificial Sequence
  chemically synthesized
tccccctaccactacccttccc

SEQ ID NO: 819981 - DNA, 22 bp, Artificial Sequence
  chemically synthesized
ccaggagactgggaagggtagt

SEQ ID NO: 819982 - DNA, 22 bp, Artificial Sequence
  chemically synthesized
caggagactgggaagggtagtg

SEQ ID NO: 819983 - DNA, 22 bp, Artificial Sequence
  chemically synthesized
ggaagggtagtggtagggggaa

SEQ ID NO: 819984 - DNA, 22 bp, Artificial Sequence
  chemically synthesized
gccatccccccctttcccccta

SEQ ID NO: 819985 - DNA, 22 bp, Artificial Sequence
  chemically synthesized
cccattagccatcccccccttt

SEQ ID NO: 819986 - DNA, 22 bp, Artificial Sequence
  chemically synthesized
actacccattagccatcccccc

SEQ ID NO: 819987 - DNA, 22 bp, Artificial Sequence
  chemically synthesized
cactacccattagccatccccc

SEQ ID NO: 819988 - DNA, 22 bp, Artificial Sequence
  chemically synthesized
taaatttcactacccattagcc

SEQ ID NO: 819989 - DNA, 22 bp, Artificial Sequence
  chemically synthesized
tattataaatttcactacccat

SEQ ID NO: 819990 - DNA, 22 bp, Artificial Sequence
  chemically synthesized
gtattataaatttcactaccca

SEQ ID NO: 819991 - DNA, 22 bp, Artificial Sequence
  chemically synthesized
tgtattataaatttcactaccc

SEQ ID NO: 819992 - DNA, 22 bp, Artificial Sequence
  chemically synthesized
ttgtattataaatttcactacc

SEQ ID NO: 819993 - DNA, 22 bp, Artificial Sequence
  chemically synthesized
tatttttgtattataaatttca

SEQ ID NO: 819994 - DNA, 22 bp, Artificial Sequence
  chemically synthesized
atgggtagtgaaatttataata

SEQ ID NO: 819995 - DNA, 22 bp, Artificial Sequence
  chemically synthesized
tcaaactatatttttgtattat

SEQ ID NO: 819996 - DNA, 22 bp, Artificial Sequence
  chemically synthesized
tatcaaactatatttttgtatt

SEQ ID NO: 819997 - DNA, 22 bp, Artificial Sequence
  chemically synthesized
attctatcaaactatatttttg

SEQ ID NO: 819998 - DNA, 22 bp, Artificial Sequence
  chemically synthesized
ttcattctatcaaactatattt

SEQ ID NO: 819999 - DNA, 22 bp, Artificial Sequence
  chemically synthesized
attcattctatcaaactatatt

SEQ ID NO: 820000 - DNA, 22 bp, Artificial Sequence
  chemically synthesized
ataatacaaaaatatagtttga

SEQ ID NO: 820001 - DNA, 22 bp, Artificial Sequence
  chemically synthesized
taatacaaaaatatagtttgat

SEQ ID NO: 820002 - DNA, 22 bp, Artificial Sequence
  chemically synthesized
gatcttattcattctatcaaac

SEQ ID NO: 820003 - DNA, 22 bp, Artificial Sequence
  chemically synthesized
tcaaatactagatcttattcat

SEQ ID NO: 820004 - DNA, 22 bp, Artificial Sequence
  chemically synthesized
tgctatcaaatactagatctta

SEQ ID NO: 820005 - DNA, 22 bp, Artificial Sequence
  chemically synthesized
gatagaatgaataagatctagt

SEQ ID NO: 820006 - DNA, 22 bp, Artificial Sequence
  chemically synthesized
gtgctatcaaatactagatctt

SEQ ID NO: 820007 - DNA, 22 bp, Artificial Sequence
  chemically synthesized
atagaatgaataagatctagta

SEQ ID NO: 820008 - DNA, 22 bp, Artificial Sequence
  chemically synthesized
ttgtgctatcaaatactagatc

SEQ ID NO: 820009 - DNA, 22 bp, Artificial Sequence
  chemically synthesized
tagtcatcctcttgtgctatca

SEQ ID NO: 820010 - DNA, 22 bp, Artificial Sequence
  chemically synthesized
actgtagtcatcctcttgtgct

SEQ ID NO: 820011 - DNA, 22 bp, Artificial Sequence
  chemically synthesized
gactgtagtcatcctcttgtgc

SEQ ID NO: 820012 - DNA, 22 bp, Artificial Sequence
  chemically synthesized
tgactgtagtcatcctcttgtg

SEQ ID NO: 820013 - DNA, 22 bp, Artificial Sequence
  chemically synthesized
gtatttgatagcacaagaggat

SEQ ID NO: 820014 - DNA, 22 bp, Artificial Sequence
  chemically synthesized
ttgactgtagtcatcctcttgt

SEQ ID NO: 820015 - DNA, 22 bp, Artificial Sequence
  chemically synthesized
tttgactgtagtcatcctcttg

SEQ ID NO: 820016 - DNA, 22 bp, Artificial Sequence
  chemically synthesized
gatagcacaagaggatgactac

SEQ ID NO: 820017 - DNA, 22 bp, Artificial Sequence
  chemically synthesized
atagcacaagaggatgactaca

SEQ ID NO: 820018 - DNA, 22 bp, Artificial Sequence
  chemically synthesized
acaataaattttttgactgtag

SEQ ID NO: 820019 - DNA, 22 bp, Artificial Sequence
  chemically synthesized
aattcacaataaattttttgac

SEQ ID NO: 820020 - DNA, 22 bp, Artificial Sequence
  chemically synthesized
aaattcacaataaattttttga

SEQ ID NO: 820021 - DNA, 22 bp, Artificial Sequence
  chemically synthesized
taaattcacaataaattttttg

SEQ ID NO: 820022 - DNA, 22 bp, Artificial Sequence
  chemically synthesized
ttaaattcacaataaatttttt

SEQ ID NO: 820023 - DNA, 22 bp, Artificial Sequence
  chemically synthesized
tttttaaattcacaataaattt

SEQ ID NO: 820024 - DNA, 22 bp, Artificial Sequence
  chemically synthesized
cagtcaaaaaatttattgtgaa

SEQ ID NO: 820025 - DNA, 22 bp, Artificial Sequence
  chemically synthesized
ataataatcagttatttttaaa

SEQ ID NO: 820026 - DNA, 22 bp, Artificial Sequence
  chemically synthesized
attgtgaatttaaaaataactg

SEQ ID NO: 820027 - DNA, 22 bp, Artificial Sequence
  chemically synthesized
ttgtgaatttaaaaataactga

SEQ ID NO: 820028 - DNA, 22 bp, Artificial Sequence
  chemically synthesized
tgaatttaaaaataactgatta

SEQ ID NO: 820029 - DNA, 22 bp, Artificial Sequence
  chemically synthesized
caaacgacaatctaataataat

SEQ ID NO: 820030 - DNA, 22 bp, Artificial Sequence
  chemically synthesized
aaaaataactgattattattag

SEQ ID NO: 820031 - DNA, 22 bp, Artificial Sequence
  chemically synthesized
aaaataactgattattattaga

SEQ ID NO: 820032 - DNA, 22 bp, Artificial Sequence
  chemically synthesized
ttacaaacgacaatctaataat

SEQ ID NO: 820033 - DNA, 22 bp, Artificial Sequence
  chemically synthesized
tgttacaaacgacaatctaata

SEQ ID NO: 820034 - DNA, 22 bp, Artificial Sequence
  chemically synthesized
ctgttacaaacgacaatctaat

SEQ ID NO: 820035 - DNA, 22 bp, Artificial Sequence
  chemically synthesized
tctgttacaaacgacaatctaa

SEQ ID NO: 820036 - DNA, 22 bp, Artificial Sequence
  chemically synthesized
ttctgttacaaacgacaatcta

SEQ ID NO: 820037 - DNA, 22 bp, Artificial Sequence
  chemically synthesized
attattattagattgtcgtttg

SEQ ID NO: 820038 - DNA, 22 bp, Artificial Sequence
  chemically synthesized
tcttttctgttacaaacgacaa

SEQ ID NO: 820039 - DNA, 22 bp, Artificial Sequence
  chemically synthesized
ttattagattgtcgtttgtaac

SEQ ID NO: 820040 - DNA, 22 bp, Artificial Sequence
  chemically synthesized
ttagattgtcgtttgtaacaga

SEQ ID NO: 820041 - DNA, 22 bp, Artificial Sequence
  chemically synthesized
aagcaattatcttttctgttac

SEQ ID NO: 820042 - DNA, 22 bp, Artificial Sequence
  chemically synthesized
gattgtcgtttgtaacagaaaa

SEQ ID NO: 820043 - DNA, 22 bp, Artificial Sequence
  chemically synthesized
acctcaagcaattatcttttct

SEQ ID NO: 820044 - DNA, 22 bp, Artificial Sequence
  chemically synthesized
tcgtttgtaacagaaaagataa

SEQ ID NO: 820045 - DNA, 22 bp, Artificial Sequence
  chemically synthesized
tccctcacctcaagcaattatc

SEQ ID NO: 820046 - DNA, 22 bp, Artificial Sequence
  chemically synthesized
gtaacagaaaagataattgctt

SEQ ID NO: 820047 - DNA, 22 bp, Artificial Sequence
  chemically synthesized
taacagaaaagataattgcttg

SEQ ID NO: 820048 - DNA, 22 bp, Artificial Sequence
  chemically synthesized
gcctatccctcacctcaagcaa

SEQ ID NO: 820049 - DNA, 22 bp, Artificial Sequence
  chemically synthesized
gggtacctggcctatccctcac

SEQ ID NO: 820050 - DNA, 22 bp, Artificial Sequence
  chemically synthesized
cttgaggtgagggataggccag

SEQ ID NO: 820051 - DNA, 22 bp, Artificial Sequence
  chemically synthesized
gaggtgagggataggccaggta

SEQ ID NO: 820052 - DNA, 22 bp, Artificial Sequence
  chemically synthesized
aggtgagggataggccaggtac

SEQ ID NO: 820053 - DNA, 22 bp, Artificial Sequence
  chemically synthesized
atataggcatacaatgtgtaac

SEQ ID NO: 820054 - DNA, 22 bp, Artificial Sequence
  chemically synthesized
gatataggcatacaatgtgtaa

SEQ ID NO: 820055 - DNA, 22 bp, Artificial Sequence
  chemically synthesized
tgatataggcatacaatgtgta

SEQ ID NO: 820056 - DNA, 22 bp, Artificial Sequence
  chemically synthesized
ttacacattgtatgcctatatc

SEQ ID NO: 820057 - DNA, 22 bp, Artificial Sequence
  chemically synthesized
cacattgtatgcctatatcaaa

SEQ ID NO: 820058 - DNA, 22 bp, Artificial Sequence
  chemically synthesized
tgggatacaggaaatattttga

SEQ ID NO: 820059 - DNA, 22 bp, Artificial Sequence
  chemically synthesized
atgggatacaggaaatattttg

SEQ ID NO: 820060 - DNA, 22 bp, Artificial Sequence
  chemically synthesized
tatgcctatatcaaaatatttc

SEQ ID NO: 820061 - DNA, 22 bp, Artificial Sequence
  chemically synthesized
tatcaaaatatttcctgtatcc

SEQ ID NO: 820062 - DNA, 22 bp, Artificial Sequence
  chemically synthesized
cctgtatcccataaatatatat

SEQ ID NO: 820063 - DNA, 22 bp, Artificial Sequence
  chemically synthesized
ctgtatcccataaatatatata

SEQ ID NO: 820064 - DNA, 22 bp, Artificial Sequence
  chemically synthesized
tatcccataaatatatatacct

SEQ ID NO: 820065 - DNA, 22 bp, Artificial Sequence
  chemically synthesized
tgggtacacagtaggtatatat

SEQ ID NO: 820066 - DNA, 22 bp, Artificial Sequence
  chemically synthesized
gtgggtacacagtaggtatata

SEQ ID NO: 820067 - DNA, 22 bp, Artificial Sequence
  chemically synthesized
tgtgggtacacagtaggtatat

SEQ ID NO: 820068 - DNA, 22 bp, Artificial Sequence
  chemically synthesized
ttgtgggtacacagtaggtata

SEQ ID NO: 820069 - DNA, 22 bp, Artificial Sequence
  chemically synthesized
atttttgtgggtacacagtagg

SEQ ID NO: 820070 - DNA, 22 bp, Artificial Sequence
  chemically synthesized
aatttttgtgggtacacagtag

SEQ ID NO: 820071 - DNA, 22 bp, Artificial Sequence
  chemically synthesized
taatttttgtgggtacacagta

SEQ ID NO: 820072 - DNA, 22 bp, Artificial Sequence
  chemically synthesized
ttaatttttgtgggtacacagt

SEQ ID NO: 820073 - DNA, 22 bp, Artificial Sequence
  chemically synthesized
atttttaatttttgtgggtaca

SEQ ID NO: 820074 - DNA, 22 bp, Artificial Sequence
  chemically synthesized
aatttttaatttttgtgggtac

SEQ ID NO: 820075 - DNA, 22 bp, Artificial Sequence
  chemically synthesized
taatttttaatttttgtgggta

SEQ ID NO: 820076 - DNA, 22 bp, Artificial Sequence
  chemically synthesized
ttaatttttaatttttgtgggt

SEQ ID NO: 820077 - DNA, 22 bp, Artificial Sequence
  chemically synthesized
tttaatttttaatttttgtggg

SEQ ID NO: 820078 - DNA, 22 bp, Artificial Sequence
  chemically synthesized
ttttaatttttaatttttgtgg

SEQ ID NO: 820079 - DNA, 22 bp, Artificial Sequence
  chemically synthesized
ctgtgtacccacaaaaattaaa

SEQ ID NO: 820080 - DNA, 22 bp, Artificial Sequence
  chemically synthesized
tgtacccacaaaaattaaaaat

SEQ ID NO: 820081 - DNA, 22 bp, Artificial Sequence
  chemically synthesized
gaaatatttttttaatttttaa

SEQ ID NO: 820082 - DNA, 22 bp, Artificial Sequence
  chemically synthesized
ctggaaatatttttttaatttt

SEQ ID NO: 820083 - DNA, 22 bp, Artificial Sequence
  chemically synthesized
gaagttcctggaaatatttttt

SEQ ID NO: 820084 - DNA, 22 bp, Artificial Sequence
  chemically synthesized
ggaagttcctggaaatattttt

SEQ ID NO: 820085 - DNA, 22 bp, Artificial Sequence
  chemically synthesized
aaaattaaaaaaatatttccag

SEQ ID NO: 820086 - DNA, 22 bp, Artificial Sequence
  chemically synthesized
aaaacagtttggaagttcctgg

SEQ ID NO: 820087 - DNA, 22 bp, Artificial Sequence
  chemically synthesized
aaaaaatatttccaggaacttc

SEQ ID NO: 820088 - DNA, 22 bp, Artificial Sequence
  chemically synthesized
gaaaacagtttggaagttcctg

SEQ ID NO: 820089 - DNA, 22 bp, Artificial Sequence
  chemically synthesized
tgaaaacagtttggaagttcct

SEQ ID NO: 820090 - DNA, 22 bp, Artificial Sequence
  chemically synthesized
ccaggaacttccaaactgtttt

SEQ ID NO: 820091 - DNA, 22 bp, Artificial Sequence
  chemically synthesized
caggaacttccaaactgttttc

SEQ ID NO: 820092 - DNA, 22 bp, Artificial Sequence
  chemically synthesized
ccaaactgttttcaaagttgtt

SEQ ID NO: 820093 - DNA, 22 bp, Artificial Sequence
  chemically synthesized
caaactgttttcaaagttgttt

SEQ ID NO: 820094 - DNA, 22 bp, Artificial Sequence
  chemically synthesized
ttttcaaagttgtttcaccatt

SEQ ID NO: 820095 - DNA, 22 bp, Artificial Sequence
  chemically synthesized
gtggaaatgtaaaatggtgaaa

SEQ ID NO: 820096 - DNA, 22 bp, Artificial Sequence
  chemically synthesized
tcaaagttgtttcaccatttta

SEQ ID NO: 820097 - DNA, 22 bp, Artificial Sequence
  chemically synthesized
ctggtggaaatgtaaaatggtg

SEQ ID NO: 820098 - DNA, 22 bp, Artificial Sequence
  chemically synthesized
caaagttgtttcaccattttac

SEQ ID NO: 820099 - DNA, 22 bp, Artificial Sequence
  chemically synthesized
aaagttgtttcaccattttaca

SEQ ID NO: 820100 - DNA, 22 bp, Artificial Sequence
  chemically synthesized
acattactggtggaaatgtaaa

SEQ ID NO: 820101 - DNA, 22 bp, Artificial Sequence
  chemically synthesized
cacattactggtggaaatgtaa

SEQ ID NO: 820102 - DNA, 22 bp, Artificial Sequence
  chemically synthesized
tcacattactggtggaaatgta

SEQ ID NO: 820103 - DNA, 22 bp, Artificial Sequence
  chemically synthesized
tttcaccattttacatttccac

SEQ ID NO: 820104 - DNA, 22 bp, Artificial Sequence
  chemically synthesized
caccattttacatttccaccag

SEQ ID NO: 820105 - DNA, 22 bp, Artificial Sequence
  chemically synthesized
accattttacatttccaccagt

SEQ ID NO: 820106 - DNA, 22 bp, Artificial Sequence
  chemically synthesized
gaattttcacattactggtgga

SEQ ID NO: 820107 - DNA, 22 bp, Artificial Sequence
  chemically synthesized
ggaattttcacattactggtgg

SEQ ID NO: 820108 - DNA, 22 bp, Artificial Sequence
  chemically synthesized
tacatttccaccagtaatgtga

SEQ ID NO: 820109 - DNA, 22 bp, Artificial Sequence
  chemically synthesized
acatttccaccagtaatgtgaa

SEQ ID NO: 820110 - DNA, 22 bp, Artificial Sequence
  chemically synthesized
catttccaccagtaatgtgaaa

SEQ ID NO: 820111 - DNA, 22 bp, Artificial Sequence
  chemically synthesized
ccaccagtaatgtgaaaattcc

SEQ ID NO: 820112 - DNA, 22 bp, Artificial Sequence
  chemically synthesized
caccagtaatgtgaaaattcca

SEQ ID NO: 820113 - DNA, 22 bp, Artificial Sequence
  chemically synthesized
agaagatgaagaatgcttggaa

SEQ ID NO: 820114 - DNA, 22 bp, Artificial Sequence
  chemically synthesized
caagcattcttcatcttctcaa

SEQ ID NO: 820115 - DNA, 22 bp, Artificial Sequence
  chemically synthesized
ttcatcttctcaacacttgtta

SEQ ID NO: 820116 - DNA, 22 bp, Artificial Sequence
  chemically synthesized
catcttctcaacacttgttatt

SEQ ID NO: 820117 - DNA, 22 bp, Artificial Sequence
  chemically synthesized
atcttctcaacacttgttattg

SEQ ID NO: 820118 - DNA, 22 bp, Artificial Sequence
  chemically synthesized
atacaaaaaatacagacaataa

SEQ ID NO: 820119 - DNA, 22 bp, Artificial Sequence
  chemically synthesized
ctcaacacttgttattgtctgt

SEQ ID NO: 820120 - DNA, 22 bp, Artificial Sequence
  chemically synthesized
tcaacacttgttattgtctgta

SEQ ID NO: 820121 - DNA, 22 bp, Artificial Sequence
  chemically synthesized
aacacttgttattgtctgtatt

SEQ ID NO: 820122 - DNA, 22 bp, Artificial Sequence
  chemically synthesized
ggatggctaatacaaaaaatac

SEQ ID NO: 820123 - DNA, 22 bp, Artificial Sequence
  chemically synthesized
gttattgtctgtattttttgta

SEQ ID NO: 820124 - DNA, 22 bp, Artificial Sequence
  chemically synthesized
ttattgtctgtattttttgtat

SEQ ID NO: 820125 - DNA, 22 bp, Artificial Sequence
  chemically synthesized
ttgtctgtattttttgtattag

SEQ ID NO: 820126 - DNA, 22 bp, Artificial Sequence
  chemically synthesized
cccactaggatggctaatacaa

SEQ ID NO: 820127 - DNA, 22 bp, Artificial Sequence
  chemically synthesized
acccactaggatggctaataca

SEQ ID NO: 820128 - DNA, 22 bp, Artificial Sequence
  chemically synthesized
tctgtattttttgtattagcca

SEQ ID NO: 820129 - DNA, 22 bp, Artificial Sequence
  chemically synthesized
tacccactaggatggctaatac

SEQ ID NO: 820130 - DNA, 22 bp, Artificial Sequence
  chemically synthesized
ttacccactaggatggctaata

SEQ ID NO: 820131 - DNA, 22 bp, Artificial Sequence
  chemically synthesized
tttacccactaggatggctaat

SEQ ID NO: 820132 - DNA, 22 bp, Artificial Sequence
  chemically synthesized
tattttttgtattagccatcct

SEQ ID NO: 820133 - DNA, 22 bp, Artificial Sequence
  chemically synthesized
tttgtattagccatcctagtgg

SEQ ID NO: 820134 - DNA, 22 bp, Artificial Sequence
  chemically synthesized
ttgtattagccatcctagtggg

SEQ ID NO: 820135 - DNA, 22 bp, Artificial Sequence
  chemically synthesized
tgtattagccatcctagtgggt

SEQ ID NO: 820136 - DNA, 22 bp, Artificial Sequence
  chemically synthesized
gtattagccatcctagtgggta

SEQ ID NO: 820137 - DNA, 22 bp, Artificial Sequence
  chemically synthesized
tattagccatcctagtgggtaa

SEQ ID NO: 820138 - DNA, 22 bp, Artificial Sequence
  chemically synthesized
gccatcctagtgggtaaaaagt

SEQ ID NO: 820139 - DNA, 22 bp, Artificial Sequence
  chemically synthesized
gtgggtaaaaagtactatctcc

SEQ ID NO: 820140 - DNA, 22 bp, Artificial Sequence
  chemically synthesized
aaaaatgcaaatgaaaaccaca

SEQ ID NO: 820141 - DNA, 22 bp, Artificial Sequence
  chemically synthesized
aaaaaatgcaaatgaaaaccac

SEQ ID NO: 820142 - DNA, 22 bp, Artificial Sequence
  chemically synthesized
tttaaaaaatgcaaatgaaaac

SEQ ID NO: 820143 - DNA, 22 bp, Artificial Sequence
  chemically synthesized
tctccttgtggttttcatttgc

SEQ ID NO: 820144 - DNA, 22 bp, Artificial Sequence
  chemically synthesized
attgtttaaaaaatgcaaatga

SEQ ID NO: 820145 - DNA, 22 bp, Artificial Sequence
  chemically synthesized
cttgtggttttcatttgcattt

SEQ ID NO: 820146 - DNA, 22 bp, Artificial Sequence
  chemically synthesized
gtggttttcatttgcatttttt

SEQ ID NO: 820147 - DNA, 22 bp, Artificial Sequence
  chemically synthesized
tggttttcatttgcatttttta

SEQ ID NO: 820148 - DNA, 22 bp, Artificial Sequence
  chemically synthesized
acatcattgattgtttaaaaaa

SEQ ID NO: 820149 - DNA, 22 bp, Artificial Sequence
  chemically synthesized
tcatttgcattttttaaacaat

SEQ ID NO: 820150 - DNA, 22 bp, Artificial Sequence
  chemically synthesized
catttgcattttttaaacaatc

SEQ ID NO: 820151 - DNA, 22 bp, Artificial Sequence
  chemically synthesized
atttgcattttttaaacaatca

SEQ ID NO: 820152 - DNA, 22 bp, Artificial Sequence
  chemically synthesized
gcattttttaaacaatcaatga

SEQ ID NO: 820153 - DNA, 22 bp, Artificial Sequence
  chemically synthesized
cattttttaaacaatcaatgat

SEQ ID NO: 820154 - DNA, 22 bp, Artificial Sequence
  chemically synthesized
tttaaacaatcaatgatgttaa

SEQ ID NO: 820155 - DNA, 22 bp, Artificial Sequence
  chemically synthesized
ttaaacaatcaatgatgttaac

SEQ ID NO: 820156 - DNA, 22 bp, Artificial Sequence
  chemically synthesized
taaacaatcaatgatgttaacc

SEQ ID NO: 820157 - DNA, 22 bp, Artificial Sequence
  chemically synthesized
aaacaatcaatgatgttaacca

SEQ ID NO: 820158 - DNA, 22 bp, Artificial Sequence
  chemically synthesized
aacaatcaatgatgttaaccat

SEQ ID NO: 820159 - DNA, 22 bp, Artificial Sequence
  chemically synthesized
cataagcacatgaaaagatggt

SEQ ID NO: 820160 - DNA, 22 bp, Artificial Sequence
  chemically synthesized
accatcttttcatgtgcttatg

SEQ ID NO: 820161 - DNA, 22 bp, Artificial Sequence
  chemically synthesized
ttcatgtgcttatggagatcta

SEQ ID NO: 820162 - DNA, 22 bp, Artificial Sequence
  chemically synthesized
tcatgtgcttatggagatctat

SEQ ID NO: 820163 - DNA, 22 bp, Artificial Sequence
  chemically synthesized
caaagtagatgtatagatctcc

SEQ ID NO: 820164 - DNA, 22 bp, Artificial Sequence
  chemically synthesized
catgtgcttatggagatctata

SEQ ID NO: 820165 - DNA, 22 bp, Artificial Sequence
  chemically synthesized
atgtgcttatggagatctatac

SEQ ID NO: 820166 - DNA, 22 bp, Artificial Sequence
  chemically synthesized
tccaaagtagatgtatagatct

SEQ ID NO: 820167 - DNA, 22 bp, Artificial Sequence
  chemically synthesized
ctccaaagtagatgtatagatc

SEQ ID NO: 820168 - DNA, 22 bp, Artificial Sequence
  chemically synthesized
atggagatctatacatctactt

SEQ ID NO: 820169 - DNA, 22 bp, Artificial Sequence
  chemically synthesized
tggagatctatacatctacttt

SEQ ID NO: 820170 - DNA, 22 bp, Artificial Sequence
  chemically synthesized
aataggcatttctccaaagtag

SEQ ID NO: 820171 - DNA, 22 bp, Artificial Sequence
  chemically synthesized
gaataggcatttctccaaagta

SEQ ID NO: 820172 - DNA, 22 bp, Artificial Sequence
  chemically synthesized
tacatctactttggagaaatgc

SEQ ID NO: 820173 - DNA, 22 bp, Artificial Sequence
  chemically synthesized
ctttggagaaatgcctattcaa

SEQ ID NO: 820174 - DNA, 22 bp, Artificial Sequence
  chemically synthesized
tggagaaatgcctattcaaact

SEQ ID NO: 820175 - DNA, 22 bp, Artificial Sequence
  chemically synthesized
ggagaaatgcctattcaaactg

SEQ ID NO: 820176 - DNA, 22 bp, Artificial Sequence
  chemically synthesized
caagtgaagaaacagtttgaat

SEQ ID NO: 820177 - DNA, 22 bp, Artificial Sequence
  chemically synthesized
gagaaatgcctattcaaactgt

SEQ ID NO: 820178 - DNA, 22 bp, Artificial Sequence
  chemically synthesized
attacaagtgaagaaacagttt

SEQ ID NO: 820179 - DNA, 22 bp, Artificial Sequence
  chemically synthesized
aattacaagtgaagaaacagtt

SEQ ID NO: 820180 - DNA, 22 bp, Artificial Sequence
  chemically synthesized
ttcaaactgtttcttcacttgt

SEQ ID NO: 820181 - DNA, 22 bp, Artificial Sequence
  chemically synthesized
aaactgtttcttcacttgtaat

SEQ ID NO: 820182 - DNA, 22 bp, Artificial Sequence
  chemically synthesized
tttcttcacttgtaattaagtc

SEQ ID NO: 820183 - DNA, 22 bp, Artificial Sequence
  chemically synthesized
cttcacttgtaattaagtcatt

SEQ ID NO: 820184 - DNA, 22 bp, Artificial Sequence
  chemically synthesized
ttcacttgtaattaagtcattt

SEQ ID NO: 820185 - DNA, 22 bp, Artificial Sequence
  chemically synthesized
cacttgtaattaagtcatttat

SEQ ID NO: 820186 - DNA, 22 bp, Artificial Sequence
  chemically synthesized
acttgtaattaagtcatttatc

SEQ ID NO: 820187 - DNA, 22 bp, Artificial Sequence
  chemically synthesized
aacaacaaaaaggataaatgac

SEQ ID NO: 820188 - DNA, 22 bp, Artificial Sequence
  chemically synthesized
gtaattaagtcatttatccttt

SEQ ID NO: 820189 - DNA, 22 bp, Artificial Sequence
  chemically synthesized
taattaagtcatttatcctttt

SEQ ID NO: 820190 - DNA, 22 bp, Artificial Sequence
  chemically synthesized
ataattcaacaacaaaaaggat

SEQ ID NO: 820191 - DNA, 22 bp, Artificial Sequence
  chemically synthesized
agtcatttatcctttttgttgt

SEQ ID NO: 820192 - DNA, 22 bp, Artificial Sequence
  chemically synthesized
atcctttttgttgttgaattat

SEQ ID NO: 820193 - DNA, 22 bp, Artificial Sequence
  chemically synthesized
tcctttttgttgttgaattatg

SEQ ID NO: 820194 - DNA, 22 bp, Artificial Sequence
  chemically synthesized
tttgttgttgaattatgagttt

SEQ ID NO: 820195 - DNA, 22 bp, Artificial Sequence
  chemically synthesized
ttgttgttgaattatgagtttt

SEQ ID NO: 820196 - DNA, 22 bp, Artificial Sequence
  chemically synthesized
tgttgttgaattatgagttttt

SEQ ID NO: 820197 - DNA, 22 bp, Artificial Sequence
  chemically synthesized
gttgttgaattatgagttttta

SEQ ID NO: 820198 - DNA, 22 bp, Artificial Sequence
  chemically synthesized
ttgttgaattatgagtttttat

SEQ ID NO: 820199 - DNA, 22 bp, Artificial Sequence
  chemically synthesized
tatcaagaatatataaaaactc

SEQ ID NO: 820200 - DNA, 22 bp, Artificial Sequence
  chemically synthesized
gtatcaagaatatataaaaact

SEQ ID NO: 820201 - DNA, 22 bp, Artificial Sequence
  chemically synthesized
ttgaattatgagtttttatata

SEQ ID NO: 820202 - DNA, 22 bp, Artificial Sequence
  chemically synthesized
aattatgagtttttatatattc

SEQ ID NO: 820203 - DNA, 22 bp, Artificial Sequence
  chemically synthesized
tgagtttttatatattcttgat

SEQ ID NO: 820204 - DNA, 22 bp, Artificial Sequence
  chemically synthesized
ataagatacttgtatcaagaat

SEQ ID NO: 820205 - DNA, 22 bp, Artificial Sequence
  chemically synthesized
gataagatacttgtatcaagaa

SEQ ID NO: 820206 - DNA, 22 bp, Artificial Sequence
  chemically synthesized
ttatatattcttgatacaagta

SEQ ID NO: 820207 - DNA, 22 bp, Artificial Sequence
  chemically synthesized
tatatattcttgatacaagtat

SEQ ID NO: 820208 - DNA, 22 bp, Artificial Sequence
  chemically synthesized
atatattcttgatacaagtatc

SEQ ID NO: 820209 - DNA, 22 bp, Artificial Sequence
  chemically synthesized
tatattcttgatacaagtatct

SEQ ID NO: 820210 - DNA, 22 bp, Artificial Sequence
  chemically synthesized
taaatcatatatttgataagat

SEQ ID NO: 820211 - DNA, 22 bp, Artificial Sequence
  chemically synthesized
ttgatacaagtatcttatcaaa

SEQ ID NO: 820212 - DNA, 22 bp, Artificial Sequence
  chemically synthesized
gtaaatcatatatttgataaga

SEQ ID NO: 820213 - DNA, 22 bp, Artificial Sequence
  chemically synthesized
gatacaagtatcttatcaaata

SEQ ID NO: 820214 - DNA, 22 bp, Artificial Sequence
  chemically synthesized
atacaagtatcttatcaaatat

SEQ ID NO: 820215 - DNA, 22 bp, Artificial Sequence
  chemically synthesized
atcaaatatatgatttacaaat

SEQ ID NO: 820216 - DNA, 22 bp, Artificial Sequence
  chemically synthesized
tcaaatatatgatttacaaata

SEQ ID NO: 820217 - DNA, 22 bp, Artificial Sequence
  chemically synthesized
agaatgggtaaaaatatttgta

SEQ ID NO: 820218 - DNA, 22 bp, Artificial Sequence
  chemically synthesized
acaaatatttttacccattctg

SEQ ID NO: 820219 - DNA, 22 bp, Artificial Sequence
  chemically synthesized
caaatatttttacccattctga

SEQ ID NO: 820220 - DNA, 22 bp, Artificial Sequence
  chemically synthesized
ttacccattctgaggattgtct

SEQ ID NO: 820221 - DNA, 22 bp, Artificial Sequence
  chemically synthesized
tacccattctgaggattgtctt

SEQ ID NO: 820222 - DNA, 22 bp, Artificial Sequence
  chemically synthesized
acccattctgaggattgtcttt

SEQ ID NO: 820223 - DNA, 22 bp, Artificial Sequence
  chemically synthesized
taaagaaagggaaaagacaatc

SEQ ID NO: 820224 - DNA, 22 bp, Artificial Sequence
  chemically synthesized
cccattctgaggattgtctttt

SEQ ID NO: 820225 - DNA, 22 bp, Artificial Sequence
  chemically synthesized
tgaggattgtcttttccctttc

SEQ ID NO: 820226 - DNA, 22 bp, Artificial Sequence
  chemically synthesized
aggattgtcttttccctttctt

SEQ ID NO: 820227 - DNA, 22 bp, Artificial Sequence
  chemically synthesized
caagcaatattgtaaagaaagg

SEQ ID NO: 820228 - DNA, 22 bp, Artificial Sequence
  chemically synthesized
tcttttccctttctttacaata

SEQ ID NO: 820229 - DNA, 22 bp, Artificial Sequence
  chemically synthesized
tactgcaagcaatattgtaaag

SEQ ID NO: 820230 - DNA, 22 bp, Artificial Sequence
  chemically synthesized
gtactgcaagcaatattgtaaa

SEQ ID NO: 820231 - DNA, 22 bp, Artificial Sequence
  chemically synthesized
tgtactgcaagcaatattgtaa

SEQ ID NO: 820232 - DNA, 22 bp, Artificial Sequence
  chemically synthesized
ttgtactgcaagcaatattgta

SEQ ID NO: 820233 - DNA, 22 bp, Artificial Sequence
  chemically synthesized
ttccctttctttacaatattgc

SEQ ID NO: 820234 - DNA, 22 bp, Artificial Sequence
  chemically synthesized
tccctttctttacaatattgct

SEQ ID NO: 820235 - DNA, 22 bp, Artificial Sequence
  chemically synthesized
ccctttctttacaatattgctt

SEQ ID NO: 820236 - DNA, 22 bp, Artificial Sequence
  chemically synthesized
cctttctttacaatattgcttg

SEQ ID NO: 820237 - DNA, 22 bp, Artificial Sequence
  chemically synthesized
aaacttttgtactgcaagcaat

SEQ ID NO: 820238 - DNA, 22 bp, Artificial Sequence
  chemically synthesized
tctttacaatattgcttgcagt

SEQ ID NO: 820239 - DNA, 22 bp, Artificial Sequence
  chemically synthesized
ctttacaatattgcttgcagta

SEQ ID NO: 820240 - DNA, 22 bp, Artificial Sequence
  chemically synthesized
tttacaatattgcttgcagtac

SEQ ID NO: 820241 - DNA, 22 bp, Artificial Sequence
  chemically synthesized
tacaatattgcttgcagtacaa

SEQ ID NO: 820242 - DNA, 22 bp, Artificial Sequence
  chemically synthesized
acaatattgcttgcagtacaaa

SEQ ID NO: 820243 - DNA, 22 bp, Artificial Sequence
  chemically synthesized
caatattgcttgcagtacaaaa

SEQ ID NO: 820244 - DNA, 22 bp, Artificial Sequence
  chemically synthesized
acaaaattaaaacttttgtact

SEQ ID NO: 820245 - DNA, 22 bp, Artificial Sequence
  chemically synthesized
aacaaaattaaaacttttgtac

SEQ ID NO: 820246 - DNA, 22 bp, Artificial Sequence
  chemically synthesized
taacaaaattaaaacttttgta

SEQ ID NO: 820247 - DNA, 22 bp, Artificial Sequence
  chemically synthesized
cttgcagtacaaaagttttaat

SEQ ID NO: 820248 - DNA, 22 bp, Artificial Sequence
  chemically synthesized
gactttaacaaaattaaaactt

SEQ ID NO: 820249 - DNA, 22 bp, Artificial Sequence
  chemically synthesized
ggactttaacaaaattaaaact

SEQ ID NO: 820250 - DNA, 22 bp, Artificial Sequence
  chemically synthesized
gcagtacaaaagttttaatttt

SEQ ID NO: 820251 - DNA, 22 bp, Artificial Sequence
  chemically synthesized
cagtacaaaagttttaattttg

SEQ ID NO: 820252 - DNA, 22 bp, Artificial Sequence
  chemically synthesized
taattttgttaaagtccaaatt

SEQ ID NO: 820253 - DNA, 22 bp, Artificial Sequence
  chemically synthesized
aattttgttaaagtccaaattg

SEQ ID NO: 820254 - DNA, 22 bp, Artificial Sequence
  chemically synthesized
attttgttaaagtccaaattgt

SEQ ID NO: 820255 - DNA, 22 bp, Artificial Sequence
  chemically synthesized
tgttaaagtccaaattgtgtat

SEQ ID NO: 820256 - DNA, 22 bp, Artificial Sequence
  chemically synthesized
gttaaagtccaaattgtgtatt

SEQ ID NO: 820257 - DNA, 22 bp, Artificial Sequence
  chemically synthesized
ttaaagtccaaattgtgtattt

SEQ ID NO: 820258 - DNA, 22 bp, Artificial Sequence
  chemically synthesized
aagtccaaattgtgtatttttc

SEQ ID NO: 820259 - DNA, 22 bp, Artificial Sequence
  chemically synthesized
tgtatttttcggttacttttgc

SEQ ID NO: 820260 - DNA, 22 bp, Artificial Sequence
  chemically synthesized
gatatgacaccaaaagcaaaag

SEQ ID NO: 820261 - DNA, 22 bp, Artificial Sequence
  chemically synthesized
agatatgacaccaaaagcaaaa

SEQ ID NO: 820262 - DNA, 22 bp, Artificial Sequence
  chemically synthesized
ttagatatgacaccaaaagcaa

SEQ ID NO: 820263 - DNA, 22 bp, Artificial Sequence
  chemically synthesized
ttcggttacttttgcttttggt

SEQ ID NO: 820264 - DNA, 22 bp, Artificial Sequence
  chemically synthesized
cttagatatgacaccaaaagca

SEQ ID NO: 820265 - DNA, 22 bp, Artificial Sequence
  chemically synthesized
tcggttacttttgcttttggtg

SEQ ID NO: 820266 - DNA, 22 bp, Artificial Sequence
  chemically synthesized
tcttagatatgacaccaaaagc

SEQ ID NO: 820267 - DNA, 22 bp, Artificial Sequence
  chemically synthesized
cggttacttttgcttttggtgt

SEQ ID NO: 820268 - DNA, 22 bp, Artificial Sequence
  chemically synthesized
ggttacttttgcttttggtgtc

SEQ ID NO: 820269 - DNA, 22 bp, Artificial Sequence
  chemically synthesized
cttttgcttttggtgtcatatc

SEQ ID NO: 820270 - DNA, 22 bp, Artificial Sequence
  chemically synthesized
ttgcttttggtgtcatatctaa

SEQ ID NO: 820271 - DNA, 22 bp, Artificial Sequence
  chemically synthesized
tgcagtgttttcttagatatga

SEQ ID NO: 820272 - DNA, 22 bp, Artificial Sequence
  chemically synthesized
tgcttttggtgtcatatctaag

SEQ ID NO: 820273 - DNA, 22 bp, Artificial Sequence
  chemically synthesized
gcttttggtgtcatatctaaga

SEQ ID NO: 820274 - DNA, 22 bp, Artificial Sequence
  chemically synthesized
cttttggtgtcatatctaagaa

SEQ ID NO: 820275 - DNA, 22 bp, Artificial Sequence
  chemically synthesized
ttggtgtcatatctaagaaaac

SEQ ID NO: 820276 - DNA, 22 bp, Artificial Sequence
  chemically synthesized
tggtgtcatatctaagaaaaca

SEQ ID NO: 820277 - DNA, 22 bp, Artificial Sequence
  chemically synthesized
ggtgtcatatctaagaaaacac

SEQ ID NO: 820278 - DNA, 22 bp, Artificial Sequence
  chemically synthesized
gtgtcatatctaagaaaacact

SEQ ID NO: 820279 - DNA, 22 bp, Artificial Sequence
  chemically synthesized
agaaaacactgcataatccatt

SEQ ID NO: 820280 - DNA, 22 bp, Artificial Sequence
  chemically synthesized
agaaaatgtaggaatacaatgg

SEQ ID NO: 820281 - DNA, 22 bp, Artificial Sequence
  chemically synthesized
taagaaaatgtaggaatacaat

SEQ ID NO: 820282 - DNA, 22 bp, Artificial Sequence
  chemically synthesized
ctaagaaaatgtaggaatacaa

SEQ ID NO: 820283 - DNA, 22 bp, Artificial Sequence
  chemically synthesized
ttctaagaaaatgtaggaatac

SEQ ID NO: 820284 - DNA, 22 bp, Artificial Sequence
  chemically synthesized
cataatccattgtattcctaca

SEQ ID NO: 820285 - DNA, 22 bp, Artificial Sequence
  chemically synthesized
aaactcttctaagaaaatgtag

SEQ ID NO: 820286 - DNA, 22 bp, Artificial Sequence
  chemically synthesized
aaaactcttctaagaaaatgta

SEQ ID NO: 820287 - DNA, 22 bp, Artificial Sequence
  chemically synthesized
taaaactcttctaagaaaatgt

SEQ ID NO: 820288 - DNA, 22 bp, Artificial Sequence
  chemically synthesized
tattcctacattttcttagaag

SEQ ID NO: 820289 - DNA, 22 bp, Artificial Sequence
  chemically synthesized
aaactttaaaactcttctaaga

SEQ ID NO: 820290 - DNA, 22 bp, Artificial Sequence
  chemically synthesized
ctacattttcttagaagagttt

SEQ ID NO: 820291 - DNA, 22 bp, Artificial Sequence
  chemically synthesized
cattttcttagaagagttttaa

SEQ ID NO: 820292 - DNA, 22 bp, Artificial Sequence
  chemically synthesized
ataagaactaaaactttaaaac

SEQ ID NO: 820293 - DNA, 22 bp, Artificial Sequence
  chemically synthesized
tcttagaagagttttaaagttt

SEQ ID NO: 820294 - DNA, 22 bp, Artificial Sequence
  chemically synthesized
cttagaagagttttaaagtttt

SEQ ID NO: 820295 - DNA, 22 bp, Artificial Sequence
  chemically synthesized
ttagaagagttttaaagtttta

SEQ ID NO: 820296 - DNA, 22 bp, Artificial Sequence
  chemically synthesized
agaagagttttaaagttttagt

SEQ ID NO: 820297 - DNA, 22 bp, Artificial Sequence
  chemically synthesized
gaagagttttaaagttttagtt

SEQ ID NO: 820298 - DNA, 22 bp, Artificial Sequence
  chemically synthesized
aatatattaataagaactaaaa

SEQ ID NO: 820299 - DNA, 22 bp, Artificial Sequence
  chemically synthesized
taaagttttagttcttattaat

SEQ ID NO: 820300 - DNA, 22 bp, Artificial Sequence
  chemically synthesized
aaagttttagttcttattaata

SEQ ID NO: 820301 - DNA, 22 bp, Artificial Sequence
  chemically synthesized
aagttttagttcttattaatat

SEQ ID NO: 820302 - DNA, 22 bp, Artificial Sequence
  chemically synthesized
tagttcttattaatatatttag

SEQ ID NO: 820303 - DNA, 22 bp, Artificial Sequence
  chemically synthesized
agttcttattaatatatttagc

SEQ ID NO: 820304 - DNA, 22 bp, Artificial Sequence
  chemically synthesized
atgaatcatagagctaaatata

SEQ ID NO: 820305 - DNA, 22 bp, Artificial Sequence
  chemically synthesized
gttcttattaatatatttagct

SEQ ID NO: 820306 - DNA, 22 bp, Artificial Sequence
  chemically synthesized
aatgaatcatagagctaaatat

SEQ ID NO: 820307 - DNA, 22 bp, Artificial Sequence
  chemically synthesized
taatgaatcatagagctaaata

SEQ ID NO: 820308 - DNA, 22 bp, Artificial Sequence
  chemically synthesized
ttaatgaatcatagagctaaat

SEQ ID NO: 820309 - DNA, 22 bp, Artificial Sequence
  chemically synthesized
ttattaatatatttagctctat

SEQ ID NO: 820310 - DNA, 22 bp, Artificial Sequence
  chemically synthesized
attaatatatttagctctatga

SEQ ID NO: 820311 - DNA, 22 bp, Artificial Sequence
  chemically synthesized
ttaatatatttagctctatgat

SEQ ID NO: 820312 - DNA, 22 bp, Artificial Sequence
  chemically synthesized
atatatttagctctatgattca

SEQ ID NO: 820313 - DNA, 22 bp, Artificial Sequence
  chemically synthesized
agctctatgattcattaaaaat

SEQ ID NO: 820314 - DNA, 22 bp, Artificial Sequence
  chemically synthesized
taataataatatatttttaatg

SEQ ID NO: 820315 - DNA, 22 bp, Artificial Sequence
  chemically synthesized
gctctatgattcattaaaaata

SEQ ID NO: 820316 - DNA, 22 bp, Artificial Sequence
  chemically synthesized
ataataataatatatttttaat

SEQ ID NO: 820317 - DNA, 22 bp, Artificial Sequence
  chemically synthesized
tataataataatatatttttaa

SEQ ID NO: 820318 - DNA, 22 bp, Artificial Sequence
  chemically synthesized
tatgattcattaaaaatatatt

SEQ ID NO: 820319 - DNA, 22 bp, Artificial Sequence
  chemically synthesized
tgattcattaaaaatatattat

SEQ ID NO: 820320 - DNA, 22 bp, Artificial Sequence
  chemically synthesized
attaaaaatatattattattat

SEQ ID NO: 820321 - DNA, 22 bp, Artificial Sequence
  chemically synthesized
taaaataaactttataataata

SEQ ID NO: 820322 - DNA, 22 bp, Artificial Sequence
  chemically synthesized
gtaaaataaactttataataat

SEQ ID NO: 820323 - DNA, 22 bp, Artificial Sequence
  chemically synthesized
tgtaaaataaactttataataa

SEQ ID NO: 820324 - DNA, 22 bp, Artificial Sequence
  chemically synthesized
aaaatatattattattataaag

SEQ ID NO: 820325 - DNA, 22 bp, Artificial Sequence
  chemically synthesized
ttgtaaaataaactttataata

SEQ ID NO: 820326 - DNA, 22 bp, Artificial Sequence
  chemically synthesized
aaacttttgtaaaataaacttt

SEQ ID NO: 820327 - DNA, 22 bp, Artificial Sequence
  chemically synthesized
aaaacttttgtaaaataaactt

SEQ ID NO: 820328 - DNA, 22 bp, Artificial Sequence
  chemically synthesized
taaaacttttgtaaaataaact

SEQ ID NO: 820329 - DNA, 22 bp, Artificial Sequence
  chemically synthesized
ttattataaagtttattttaca

SEQ ID NO: 820330 - DNA, 22 bp, Artificial Sequence
  chemically synthesized
ttataaagtttattttacaaaa

SEQ ID NO: 820331 - DNA, 22 bp, Artificial Sequence
  chemically synthesized
taaagtttattttacaaaagtt

SEQ ID NO: 820332 - DNA, 22 bp, Artificial Sequence
  chemically synthesized
aaaataaaatgttttaaaactt

SEQ ID NO: 820333 - DNA, 22 bp, Artificial Sequence
  chemically synthesized
attttacaaaagttttaaaaca

SEQ ID NO: 820334 - DNA, 22 bp, Artificial Sequence
  chemically synthesized
ttttacaaaagttttaaaacat

SEQ ID NO: 820335 - DNA, 22 bp, Artificial Sequence
  chemically synthesized
tacaaaagttttaaaacatttt

SEQ ID NO: 820336 - DNA, 22 bp, Artificial Sequence
  chemically synthesized
acaaaagttttaaaacatttta

SEQ ID NO: 820337 - DNA, 22 bp, Artificial Sequence
  chemically synthesized
caaaagttttaaaacattttat

SEQ ID NO: 820338 - DNA, 22 bp, Artificial Sequence
  chemically synthesized
taaaacattttatttttaattt

SEQ ID NO: 820339 - DNA, 22 bp, Artificial Sequence
  chemically synthesized
aaaacattttatttttaatttt

SEQ ID NO: 820340 - DNA, 22 bp, Artificial Sequence
  chemically synthesized
tcaaagcaaaataaaattaaaa

SEQ ID NO: 820341 - DNA, 22 bp, Artificial Sequence
  chemically synthesized
aaacattttatttttaatttta

SEQ ID NO: 820342 - DNA, 22 bp, Artificial Sequence
  chemically synthesized
gtcaaagcaaaataaaattaaa

SEQ ID NO: 820343 - DNA, 22 bp, Artificial Sequence
  chemically synthesized
tttgtcaaagcaaaataaaatt

SEQ ID NO: 820344 - DNA, 22 bp, Artificial Sequence
  chemically synthesized
tatttttaattttattttgctt

SEQ ID NO: 820345 - DNA, 22 bp, Artificial Sequence
  chemically synthesized
atttttaattttattttgcttt

SEQ ID NO: 820346 - DNA, 22 bp, Artificial Sequence
  chemically synthesized
tttttaattttattttgctttg

SEQ ID NO: 820347 - DNA, 22 bp, Artificial Sequence
  chemically synthesized
ttaattttattttgctttgaca

SEQ ID NO: 820348 - DNA, 22 bp, Artificial Sequence
  chemically synthesized
taattttattttgctttgacaa

SEQ ID NO: 820349 - DNA, 22 bp, Artificial Sequence
  chemically synthesized
aattttattttgctttgacaaa

SEQ ID NO: 820350 - DNA, 22 bp, Artificial Sequence
  chemically synthesized
attttattttgctttgacaaat

SEQ ID NO: 820351 - DNA, 22 bp, Artificial Sequence
  chemically synthesized
tattttgctttgacaaataatt

SEQ ID NO: 820352 - DNA, 22 bp, Artificial Sequence
  chemically synthesized
attttgctttgacaaataatta

SEQ ID NO: 820353 - DNA, 22 bp, Artificial Sequence
  chemically synthesized
ttttgctttgacaaataattat

SEQ ID NO: 820354 - DNA, 22 bp, Artificial Sequence
  chemically synthesized
tgctttgacaaataattatata

SEQ ID NO: 820355 - DNA, 22 bp, Artificial Sequence
  chemically synthesized
gctttgacaaataattatatac

SEQ ID NO: 820356 - DNA, 22 bp, Artificial Sequence
  chemically synthesized
ctttgacaaataattatataca

SEQ ID NO: 820357 - DNA, 22 bp, Artificial Sequence
  chemically synthesized
tgacaaataattatatacattt

SEQ ID NO: 820358 - DNA, 22 bp, Artificial Sequence
  chemically synthesized
gacaaataattatatacattta

SEQ ID NO: 820359 - DNA, 22 bp, Artificial Sequence
  chemically synthesized
acaaataattatatacatttat

SEQ ID NO: 820360 - DNA, 22 bp, Artificial Sequence
  chemically synthesized
tatacatttatggggtacatgt

SEQ ID NO: 820361 - DNA, 22 bp, Artificial Sequence
  chemically synthesized
atggggtacatgtatgttctga

SEQ ID NO: 820362 - DNA, 22 bp, Artificial Sequence
  chemically synthesized
tggggtacatgtatgttctgat

SEQ ID NO: 820363 - DNA, 22 bp, Artificial Sequence
  chemically synthesized
cacagtgtatacatatatcaga

SEQ ID NO: 820364 - DNA, 22 bp, Artificial Sequence
  chemically synthesized
gatataatcattccacagtgta

SEQ ID NO: 820365 - DNA, 22 bp, Artificial Sequence
  chemically synthesized
tgatatatgtatacactgtgga

SEQ ID NO: 820366 - DNA, 22 bp, Artificial Sequence
  chemically synthesized
atatatgtatacactgtggaat

SEQ ID NO: 820367 - DNA, 22 bp, Artificial Sequence
  chemically synthesized
ctcgatataatcattccacagt

SEQ ID NO: 820368 - DNA, 22 bp, Artificial Sequence
  chemically synthesized
aattgctcgatataatcattcc

SEQ ID NO: 820369 - DNA, 22 bp, Artificial Sequence
  chemically synthesized
tggaatgattatatcgagcaat

SEQ ID NO: 820370 - DNA, 22 bp, Artificial Sequence
  chemically synthesized
tatcgagcaatttaacgtatct

SEQ ID NO: 820371 - DNA, 22 bp, Artificial Sequence
  chemically synthesized
aacgtatctatcactgcatata

SEQ ID NO: 820372 - DNA, 22 bp, Artificial Sequence
  chemically synthesized
acgtatctatcactgcatatat

SEQ ID NO: 820373 - DNA, 22 bp, Artificial Sequence
  chemically synthesized
taaaatatgataaatatatgca

SEQ ID NO: 820374 - DNA, 22 bp, Artificial Sequence
  chemically synthesized
ctataaaatatgataaatatat

SEQ ID NO: 820375 - DNA, 22 bp, Artificial Sequence
  chemically synthesized
gctataaaatatgataaatata

SEQ ID NO: 820376 - DNA, 22 bp, Artificial Sequence
  chemically synthesized
ttgctataaaatatgataaata

SEQ ID NO: 820377 - DNA, 22 bp, Artificial Sequence
  chemically synthesized
tcactgcatatatttatcatat

SEQ ID NO: 820378 - DNA, 22 bp, Artificial Sequence
  chemically synthesized
aatgttcttgctataaaatatg

SEQ ID NO: 820379 - DNA, 22 bp, Artificial Sequence
  chemically synthesized
catatatttatcatattttata

SEQ ID NO: 820380 - DNA, 22 bp, Artificial Sequence
  chemically synthesized
aaatgttcttgctataaaatat

SEQ ID NO: 820381 - DNA, 22 bp, Artificial Sequence
  chemically synthesized
taaatgttcttgctataaaata

SEQ ID NO: 820382 - DNA, 22 bp, Artificial Sequence
  chemically synthesized
atcatattttatagcaagaaca

SEQ ID NO: 820383 - DNA, 22 bp, Artificial Sequence
  chemically synthesized
tcatattttatagcaagaacat

SEQ ID NO: 820384 - DNA, 22 bp, Artificial Sequence
  chemically synthesized
aaataacagattttaaatgttc

SEQ ID NO: 820385 - DNA, 22 bp, Artificial Sequence
  chemically synthesized
ctaaaataacagattttaaatg

SEQ ID NO: 820386 - DNA, 22 bp, Artificial Sequence
  chemically synthesized
tatagcaagaacatttaaaatc

SEQ ID NO: 820387 - DNA, 22 bp, Artificial Sequence
  chemically synthesized
atagcaagaacatttaaaatct

SEQ ID NO: 820388 - DNA, 22 bp, Artificial Sequence
  chemically synthesized
tagcaagaacatttaaaatctg

SEQ ID NO: 820389 - DNA, 22 bp, Artificial Sequence
  chemically synthesized
aaaattgctaaaataacagatt

SEQ ID NO: 820390 - DNA, 22 bp, Artificial Sequence
  chemically synthesized
caaaattgctaaaataacagat

SEQ ID NO: 820391 - DNA, 22 bp, Artificial Sequence
  chemically synthesized
tatatttcaaaattgctaaaat

SEQ ID NO: 820392 - DNA, 22 bp, Artificial Sequence
  chemically synthesized
aaaatctgttattttagcaatt

SEQ ID NO: 820393 - DNA, 22 bp, Artificial Sequence
  chemically synthesized
aaatctgttattttagcaattt

SEQ ID NO: 820394 - DNA, 22 bp, Artificial Sequence
  chemically synthesized
tattgtatatttcaaaattgct

SEQ ID NO: 820395 - DNA, 22 bp, Artificial Sequence
  chemically synthesized
ttattttagcaattttgaaata

SEQ ID NO: 820396 - DNA, 22 bp, Artificial Sequence
  chemically synthesized
ttttagcaattttgaaatatac

SEQ ID NO: 820397 - DNA, 22 bp, Artificial Sequence
  chemically synthesized
ataatattatattgtatatttc

SEQ ID NO: 820398 - DNA, 22 bp, Artificial Sequence
  chemically synthesized
tagcaattttgaaatatacaat

SEQ ID NO: 820399 - DNA, 22 bp, Artificial Sequence
  chemically synthesized
agcaattttgaaatatacaata

SEQ ID NO: 820400 - DNA, 22 bp, Artificial Sequence
  chemically synthesized
gcaattttgaaatatacaatat

SEQ ID NO: 820401 - DNA, 22 bp, Artificial Sequence
  chemically synthesized
tgaaatatacaatataatatta

SEQ ID NO: 820402 - DNA, 22 bp, Artificial Sequence
  chemically synthesized
gaaatatacaatataatattat

SEQ ID NO: 820403 - DNA, 22 bp, Artificial Sequence
  chemically synthesized
aaatatacaatataatattatt

SEQ ID NO: 820404 - DNA, 22 bp, Artificial Sequence
  chemically synthesized
gtgaccatagttaataatatta

SEQ ID NO: 820405 - DNA, 22 bp, Artificial Sequence
  chemically synthesized
tgacacaacctggtgaccatag

SEQ ID NO: 820406 - DNA, 22 bp, Artificial Sequence
  chemically synthesized
atgacacaacctggtgaccata

SEQ ID NO: 820407 - DNA, 22 bp, Artificial Sequence
  chemically synthesized
tatgacacaacctggtgaccat

SEQ ID NO: 820408 - DNA, 22 bp, Artificial Sequence
  chemically synthesized
ttaactatggtcaccaggttgt

SEQ ID NO: 820409 - DNA, 22 bp, Artificial Sequence
  chemically synthesized
agactttatgacacaacctggt

SEQ ID NO: 820410 - DNA, 22 bp, Artificial Sequence
  chemically synthesized
gagactttatgacacaacctgg

SEQ ID NO: 820411 - DNA, 22 bp, Artificial Sequence
  chemically synthesized
tgagactttatgacacaacctg

SEQ ID NO: 820412 - DNA, 22 bp, Artificial Sequence
  chemically synthesized
actatggtcaccaggttgtgtc

SEQ ID NO: 820413 - DNA, 22 bp, Artificial Sequence
  chemically synthesized
ttgagactttatgacacaacct

SEQ ID NO: 820414 - DNA, 22 bp, Artificial Sequence
  chemically synthesized
tggtcaccaggttgtgtcataa

SEQ ID NO: 820415 - DNA, 22 bp, Artificial Sequence
  chemically synthesized
tgtcataaagtctcaaaaactt

SEQ ID NO: 820416 - DNA, 22 bp, Artificial Sequence
  chemically synthesized
gtcaggaggaataagtttttga

SEQ ID NO: 820417 - DNA, 22 bp, Artificial Sequence
  chemically synthesized
agtcaggaggaataagtttttg

SEQ ID NO: 820418 - DNA, 22 bp, Artificial Sequence
  chemically synthesized
tagtcaggaggaataagttttt

SEQ ID NO: 820419 - DNA, 22 bp, Artificial Sequence
  chemically synthesized
aaaactttagtcaggaggaata

SEQ ID NO: 820420 - DNA, 22 bp, Artificial Sequence
  chemically synthesized
aaaaacttattcctcctgacta

SEQ ID NO: 820421 - DNA, 22 bp, Artificial Sequence
  chemically synthesized
attcctcctgactaaagttttt

SEQ ID NO: 820422 - DNA, 22 bp, Artificial Sequence
  chemically synthesized
ttcctcctgactaaagttttta

SEQ ID NO: 820423 - DNA, 22 bp, Artificial Sequence
  chemically synthesized
atcaaaaggggttaaaaacttt

SEQ ID NO: 820424 - DNA, 22 bp, Artificial Sequence
  chemically synthesized
ctcctgactaaagtttttaacc

SEQ ID NO: 820425 - DNA, 22 bp, Artificial Sequence
  chemically synthesized
ctgactaaagtttttaacccct

SEQ ID NO: 820426 - DNA, 22 bp, Artificial Sequence
  chemically synthesized
actaaagtttttaacccctttt

SEQ ID NO: 820427 - DNA, 22 bp, Artificial Sequence
  chemically synthesized
aagtttttaaccccttttgatc

SEQ ID NO: 820428 - DNA, 22 bp, Artificial Sequence
  chemically synthesized
ttaaccccttttgatcaacatc

SEQ ID NO: 820429 - DNA, 22 bp, Artificial Sequence
  chemically synthesized
taaccccttttgatcaacatct

SEQ ID NO: 820430 - DNA, 22 bp, Artificial Sequence
  chemically synthesized
aaccccttttgatcaacatctc

SEQ ID NO: 820431 - DNA, 22 bp, Artificial Sequence
  chemically synthesized
accccttttgatcaacatctcc

SEQ ID NO: 820432 - DNA, 22 bp, Artificial Sequence
  chemically synthesized
ggggtggaaaatggggagatgt

SEQ ID NO: 820433 - DNA, 22 bp, Artificial Sequence
  chemically synthesized
aggggtggaaaatggggagatg

SEQ ID NO: 820434 - DNA, 22 bp, Artificial Sequence
  chemically synthesized
ttgatcaacatctccccatttt

SEQ ID NO: 820435 - DNA, 22 bp, Artificial Sequence
  chemically synthesized
tgatcaacatctccccattttc

SEQ ID NO: 820436 - DNA, 22 bp, Artificial Sequence
  chemically synthesized
gatcaacatctccccattttcc

SEQ ID NO: 820437 - DNA, 22 bp, Artificial Sequence
  chemically synthesized
atcaacatctccccattttcca

SEQ ID NO: 820438 - DNA, 22 bp, Artificial Sequence
  chemically synthesized
tggatttaggggtggaaaatgg

SEQ ID NO: 820439 - DNA, 22 bp, Artificial Sequence
  chemically synthesized
ccagaggctgtggatttagggg

SEQ ID NO: 820440 - DNA, 22 bp, Artificial Sequence
  chemically synthesized
cccattttccacccctaaatcc

SEQ ID NO: 820441 - DNA, 22 bp, Artificial Sequence
  chemically synthesized
tccacccctaaatccacagcct

SEQ ID NO: 820442 - DNA, 22 bp, Artificial Sequence
  chemically synthesized
ccacccctaaatccacagcctc

SEQ ID NO: 820443 - DNA, 22 bp, Artificial Sequence
  chemically synthesized
cacccctaaatccacagcctct

SEQ ID NO: 820444 - DNA, 22 bp, Artificial Sequence
  chemically synthesized
aatccacagcctctggtaacca

SEQ ID NO: 820445 - DNA, 22 bp, Artificial Sequence
  chemically synthesized
aagtagagagtagaatggtggt

SEQ ID NO: 820446 - DNA, 22 bp, Artificial Sequence
  chemically synthesized
attgaagtagagagtagaatgg

SEQ ID NO: 820447 - DNA, 22 bp, Artificial Sequence
  chemically synthesized
tggtaaccaccattctactctc

SEQ ID NO: 820448 - DNA, 22 bp, Artificial Sequence
  chemically synthesized
gtaaccaccattctactctcta

SEQ ID NO: 820449 - DNA, 22 bp, Artificial Sequence
  chemically synthesized
aaaaagtcaaactcattgaagt

SEQ ID NO: 820450 - DNA, 22 bp, Artificial Sequence
  chemically synthesized
tactctctacttcaatgagttt

SEQ ID NO: 820451 - DNA, 22 bp, Artificial Sequence
  chemically synthesized
ctctctacttcaatgagtttga

SEQ ID NO: 820452 - DNA, 22 bp, Artificial Sequence
  chemically synthesized
tctacttcaatgagtttgactt

SEQ ID NO: 820453 - DNA, 22 bp, Artificial Sequence
  chemically synthesized
tacttcaatgagtttgactttt

SEQ ID NO: 820454 - DNA, 22 bp, Artificial Sequence
  chemically synthesized
cttcaatgagtttgactttttt

SEQ ID NO: 820455 - DNA, 22 bp, Artificial Sequence
  chemically synthesized
tgtgtggaatctaaaaaagtca

SEQ ID NO: 820456 - DNA, 22 bp, Artificial Sequence
  chemically synthesized
atgtgtggaatctaaaaaagtc

SEQ ID NO: 820457 - DNA, 22 bp, Artificial Sequence
  chemically synthesized
caatgagtttgacttttttaga

SEQ ID NO: 820458 - DNA, 22 bp, Artificial Sequence
  chemically synthesized
aatgagtttgacttttttagat

SEQ ID NO: 820459 - DNA, 22 bp, Artificial Sequence
  chemically synthesized
acttatgtgtggaatctaaaaa

SEQ ID NO: 820460 - DNA, 22 bp, Artificial Sequence
  chemically synthesized
gacttttttagattccacacat

SEQ ID NO: 820461 - DNA, 22 bp, Artificial Sequence
  chemically synthesized
acttttttagattccacacata

SEQ ID NO: 820462 - DNA, 22 bp, Artificial Sequence
  chemically synthesized
cgtgatctcacttatgtgtgga

SEQ ID NO: 820463 - DNA, 22 bp, Artificial Sequence
  chemically synthesized
ttttagattccacacataagtg

SEQ ID NO: 820464 - DNA, 22 bp, Artificial Sequence
  chemically synthesized
tttagattccacacataagtga

SEQ ID NO: 820465 - DNA, 22 bp, Artificial Sequence
  chemically synthesized
ttagattccacacataagtgag

SEQ ID NO: 820466 - DNA, 22 bp, Artificial Sequence
  chemically synthesized
tagattccacacataagtgaga

SEQ ID NO: 820467 - DNA, 22 bp, Artificial Sequence
  chemically synthesized
agattccacacataagtgagat

SEQ ID NO: 820468 - DNA, 22 bp, Artificial Sequence
  chemically synthesized
gattccacacataagtgagatc

SEQ ID NO: 820469 - DNA, 22 bp, Artificial Sequence
  chemically synthesized
cacacataagtgagatcacgca

SEQ ID NO: 820470 - DNA, 22 bp, Artificial Sequence
  chemically synthesized
aatgaaataagccaggcacaga

SEQ ID NO: 820471 - DNA, 22 bp, Artificial Sequence
  chemically synthesized
tactaaatgaaataagccaggc

SEQ ID NO: 820472 - DNA, 22 bp, Artificial Sequence
  chemically synthesized
gactttctgtgcctggcttatt

SEQ ID NO: 820473 - DNA, 22 bp, Artificial Sequence
  chemically synthesized
actttctgtgcctggcttattt

SEQ ID NO: 820474 - DNA, 22 bp, Artificial Sequence
  chemically synthesized
tctgtgcctggcttatttcatt

SEQ ID NO: 820475 - DNA, 22 bp, Artificial Sequence
  chemically synthesized
ctgtgcctggcttatttcattt

SEQ ID NO: 820476 - DNA, 22 bp, Artificial Sequence
  chemically synthesized
tgtgcctggcttatttcattta

SEQ ID NO: 820477 - DNA, 22 bp, Artificial Sequence
  chemically synthesized
gaggacattatactaaatgaaa

SEQ ID NO: 820478 - DNA, 22 bp, Artificial Sequence
  chemically synthesized
tgcctggcttatttcatttagt

SEQ ID NO: 820479 - DNA, 22 bp, Artificial Sequence
  chemically synthesized
gcttatttcatttagtataatg

SEQ ID NO: 820480 - DNA, 22 bp, Artificial Sequence
  chemically synthesized
atttcatttagtataatgtcct

SEQ ID NO: 820481 - DNA, 22 bp, Artificial Sequence
  chemically synthesized
tttcatttagtataatgtcctc

SEQ ID NO: 820482 - DNA, 22 bp, Artificial Sequence
  chemically synthesized
catttagtataatgtcctccag

SEQ ID NO: 820483 - DNA, 22 bp, Artificial Sequence
  chemically synthesized
atttagtataatgtcctccagg

SEQ ID NO: 820484 - DNA, 22 bp, Artificial Sequence
  chemically synthesized
agtataatgtcctccaggttca

SEQ ID NO: 820485 - DNA, 22 bp, Artificial Sequence
  chemically synthesized
tgacagcgtggatgaacctgga

SEQ ID NO: 820486 - DNA, 22 bp, Artificial Sequence
  chemically synthesized
gtataatgtcctccaggttcat

SEQ ID NO: 820487 - DNA, 22 bp, Artificial Sequence
  chemically synthesized
atgacagcgtggatgaacctgg

SEQ ID NO: 820488 - DNA, 22 bp, Artificial Sequence
  chemically synthesized
tttatgacagcgtggatgaacc

SEQ ID NO: 820489 - DNA, 22 bp, Artificial Sequence
  chemically synthesized
gtttatgacagcgtggatgaac

SEQ ID NO: 820490 - DNA, 22 bp, Artificial Sequence
  chemically synthesized
tgtttatgacagcgtggatgaa

SEQ ID NO: 820491 - DNA, 22 bp, Artificial Sequence
  chemically synthesized
ttgtttatgacagcgtggatga

SEQ ID NO: 820492 - DNA, 22 bp, Artificial Sequence
  chemically synthesized
caggttcatccacgctgtcata

SEQ ID NO: 820493 - DNA, 22 bp, Artificial Sequence
  chemically synthesized
atccacgctgtcataaacaaaa

SEQ ID NO: 820494 - DNA, 22 bp, Artificial Sequence
  chemically synthesized
aataaagaatatccttttgttt

SEQ ID NO: 820495 - DNA, 22 bp, Artificial Sequence
  chemically synthesized
aaataaagaatatccttttgtt

SEQ ID NO: 820496 - DNA, 22 bp, Artificial Sequence
  chemically synthesized
agccttaaataaagaatatcct

SEQ ID NO: 820497 - DNA, 22 bp, Artificial Sequence
  chemically synthesized
tcataaacaaaaggatattctt

SEQ ID NO: 820498 - DNA, 22 bp, Artificial Sequence
  chemically synthesized
ttcagccttaaataaagaatat

SEQ ID NO: 820499 - DNA, 22 bp, Artificial Sequence
  chemically synthesized
tttatttaaggctgaataatac

SEQ ID NO: 820500 - DNA, 22 bp, Artificial Sequence
  chemically synthesized
tatttaaggctgaataatactc

SEQ ID NO: 820501 - DNA, 22 bp, Artificial Sequence
  chemically synthesized
atttaaggctgaataatactcc

SEQ ID NO: 820502 - DNA, 22 bp, Artificial Sequence
  chemically synthesized
tttaaggctgaataatactcca

SEQ ID NO: 820503 - DNA, 22 bp, Artificial Sequence
  chemically synthesized
aaggctgaataatactccattg

SEQ ID NO: 820504 - DNA, 22 bp, Artificial Sequence
  chemically synthesized
aggctgaataatactccattgt

SEQ ID NO: 820505 - DNA, 22 bp, Artificial Sequence
  chemically synthesized
aataatactccattgtgtatat

SEQ ID NO: 820506 - DNA, 22 bp, Artificial Sequence
  chemically synthesized
cattgtgtatatgtaccacatt

SEQ ID NO: 820507 - DNA, 22 bp, Artificial Sequence
  chemically synthesized
tgtatatgtaccacattttctt

SEQ ID NO: 820508 - DNA, 22 bp, Artificial Sequence
  chemically synthesized
catcagtggatgaatggataaa

SEQ ID NO: 820509 - DNA, 22 bp, Artificial Sequence
  chemically synthesized
ccatcagtggatgaatggataa

SEQ ID NO: 820510 - DNA, 22 bp, Artificial Sequence
  chemically synthesized
agtttccatcagtggatgaatg

SEQ ID NO: 820511 - DNA, 22 bp, Artificial Sequence
  chemically synthesized
tctttatccattcatccactga

SEQ ID NO: 820512 - DNA, 22 bp, Artificial Sequence
  chemically synthesized
ctttatccattcatccactgat

SEQ ID NO: 820513 - DNA, 22 bp, Artificial Sequence
  chemically synthesized
tttatccattcatccactgatg

SEQ ID NO: 820514 - DNA, 22 bp, Artificial Sequence
  chemically synthesized
tatccattcatccactgatgga

SEQ ID NO: 820515 - DNA, 22 bp, Artificial Sequence
  chemically synthesized
atccattcatccactgatggaa

SEQ ID NO: 820516 - DNA, 22 bp, Artificial Sequence
  chemically synthesized
tccattcatccactgatggaaa

SEQ ID NO: 820517 - DNA, 22 bp, Artificial Sequence
  chemically synthesized
atccactgatggaaacttaggt

SEQ ID NO: 820518 - DNA, 22 bp, Artificial Sequence
  chemically synthesized
atggaaacttaggttgattcca

SEQ ID NO: 820519 - DNA, 22 bp, Artificial Sequence
  chemically synthesized
gtcacaaaagccatgatatgga

SEQ ID NO: 820520 - DNA, 22 bp, Artificial Sequence
  chemically synthesized
aggttgattccatatcatggct

SEQ ID NO: 820521 - DNA, 22 bp, Artificial Sequence
  chemically synthesized
ggttgattccatatcatggctt

SEQ ID NO: 820522 - DNA, 22 bp, Artificial Sequence
  chemically synthesized
cagcattagtcacaaaagccat

SEQ ID NO: 820523 - DNA, 22 bp, Artificial Sequence
  chemically synthesized
attccatatcatggcttttgtg

SEQ ID NO: 820524 - DNA, 22 bp, Artificial Sequence
  chemically synthesized
ttgcagcattagtcacaaaagc

SEQ ID NO: 820525 - DNA, 22 bp, Artificial Sequence
  chemically synthesized
attgcagcattagtcacaaaag

SEQ ID NO: 820526 - DNA, 22 bp, Artificial Sequence
  chemically synthesized
catatcatggcttttgtgacta

SEQ ID NO: 820527 - DNA, 22 bp, Artificial Sequence
  chemically synthesized
tgtttattgcagcattagtcac

SEQ ID NO: 820528 - DNA, 22 bp, Artificial Sequence
  chemically synthesized
ctgtgtttattgcagcattagt

SEQ ID NO: 820529 - DNA, 22 bp, Artificial Sequence
  chemically synthesized
actcctgtgtttattgcagcat

SEQ ID NO: 820530 - DNA, 22 bp, Artificial Sequence
  chemically synthesized
cactcctgtgtttattgcagca

SEQ ID NO: 820531 - DNA, 22 bp, Artificial Sequence
  chemically synthesized
ttgtgactaatgctgcaataaa

SEQ ID NO: 820532 - DNA, 22 bp, Artificial Sequence
  chemically synthesized
tgtgactaatgctgcaataaac

SEQ ID NO: 820533 - DNA, 22 bp, Artificial Sequence
  chemically synthesized
gtgactaatgctgcaataaaca

SEQ ID NO: 820534 - DNA, 22 bp, Artificial Sequence
  chemically synthesized
tgactaatgctgcaataaacac

SEQ ID NO: 820535 - DNA, 22 bp, Artificial Sequence
  chemically synthesized
atgctgcaataaacacaggagt

SEQ ID NO: 820536 - DNA, 22 bp, Artificial Sequence
  chemically synthesized
caataaacacaggagtgaagat

SEQ ID NO: 820537 - DNA, 22 bp, Artificial Sequence
  chemically synthesized
aaccagtatgtcaaagagatat

SEQ ID NO: 820538 - DNA, 22 bp, Artificial Sequence
  chemically synthesized
aaaccagtatgtcaaagagata

SEQ ID NO: 820539 - DNA, 22 bp, Artificial Sequence
  chemically synthesized
tttgacatactggtttaaattc

SEQ ID NO: 820540 - DNA, 22 bp, Artificial Sequence
  chemically synthesized
tgacatactggtttaaattctt

SEQ ID NO: 820541 - DNA, 22 bp, Artificial Sequence
  chemically synthesized
gacatactggtttaaattcttt

SEQ ID NO: 820542 - DNA, 22 bp, Artificial Sequence
  chemically synthesized
acatactggtttaaattctttt

SEQ ID NO: 820543 - DNA, 22 bp, Artificial Sequence
  chemically synthesized
cgggtatatatccaaaagaatt

SEQ ID NO: 820544 - DNA, 22 bp, Artificial Sequence
  chemically synthesized
ccgggtatatatccaaaagaat

SEQ ID NO: 820545 - DNA, 22 bp, Artificial Sequence
  chemically synthesized
gtttaaattcttttggatatat

SEQ ID NO: 820546 - DNA, 22 bp, Artificial Sequence
  chemically synthesized
aaattcttttggatatataccc

SEQ ID NO: 820547 - DNA, 22 bp, Artificial Sequence
  chemically synthesized
aattcttttggatatatacccg

SEQ ID NO: 820548 - DNA, 22 bp, Artificial Sequence
  chemically synthesized
ttttggatatatacccggaagt

SEQ ID NO: 820549 - DNA, 22 bp, Artificial Sequence
  chemically synthesized
ttggatatatacccggaagtgg

SEQ ID NO: 820550 - DNA, 22 bp, Artificial Sequence
  chemically synthesized
tggatatatacccggaagtggg

SEQ ID NO: 820551 - DNA, 22 bp, Artificial Sequence
  chemically synthesized
ggatatatacccggaagtggga

SEQ ID NO: 820552 - DNA, 22 bp, Artificial Sequence
  chemically synthesized
gatatatacccggaagtgggat

SEQ ID NO: 820553 - DNA, 22 bp, Artificial Sequence
  chemically synthesized
ccataggatccagcaatcccac

SEQ ID NO: 820554 - DNA, 22 bp, Artificial Sequence
  chemically synthesized
aaaacagaattaccataggatc

SEQ ID NO: 820555 - DNA, 22 bp, Artificial Sequence
  chemically synthesized
ctggatcctatggtaattctgt

SEQ ID NO: 820556 - DNA, 22 bp, Artificial Sequence
  chemically synthesized
aaaaaactgaaaacagaattac

SEQ ID NO: 820557 - DNA, 22 bp, Artificial Sequence
  chemically synthesized
gatcctatggtaattctgtttt

SEQ ID NO: 820558 - DNA, 22 bp, Artificial Sequence
  chemically synthesized
ctcaaaaaactgaaaacagaat

SEQ ID NO: 820559 - DNA, 22 bp, Artificial Sequence
  chemically synthesized
tggtaattctgttttcagtttt

SEQ ID NO: 820560 - DNA, 22 bp, Artificial Sequence
  chemically synthesized
tgttttcagttttttgaggagc

SEQ ID NO: 820561 - DNA, 22 bp, Artificial Sequence
  chemically synthesized
ttttcagttttttgaggagcta

SEQ ID NO: 820562 - DNA, 22 bp, Artificial Sequence
  chemically synthesized
tcagttttttgaggagctacca

SEQ ID NO: 820563 - DNA, 22 bp, Artificial Sequence
  chemically synthesized
tggagaacagtatggtagctcc

SEQ ID NO: 820564 - DNA, 22 bp, Artificial Sequence
  chemically synthesized
cagttttttgaggagctaccat

SEQ ID NO: 820565 - DNA, 22 bp, Artificial Sequence
  chemically synthesized
agttttttgaggagctaccata

SEQ ID NO: 820566 - DNA, 22 bp, Artificial Sequence
  chemically synthesized
tttgaggagctaccatactgtt

SEQ ID NO: 820567 - DNA, 22 bp, Artificial Sequence
  chemically synthesized
ttgaggagctaccatactgttc

SEQ ID NO: 820568 - DNA, 22 bp, Artificial Sequence
  chemically synthesized
tgaggagctaccatactgttct

SEQ ID NO: 820569 - DNA, 22 bp, Artificial Sequence
  chemically synthesized
gaggagctaccatactgttctc

SEQ ID NO: 820570 - DNA, 22 bp, Artificial Sequence
  chemically synthesized
aggagctaccatactgttctcc

SEQ ID NO: 820571 - DNA, 22 bp, Artificial Sequence
  chemically synthesized
gtacaaccattatggagaacag

SEQ ID NO: 820572 - DNA, 22 bp, Artificial Sequence
  chemically synthesized
ccatactgttctccataatggt

SEQ ID NO: 820573 - DNA, 22 bp, Artificial Sequence
  chemically synthesized
ttctccataatggttgtactaa

SEQ ID NO: 820574 - DNA, 22 bp, Artificial Sequence
  chemically synthesized
gtgggaatgtatattagtacaa

SEQ ID NO: 820575 - DNA, 22 bp, Artificial Sequence
  chemically synthesized
tccataatggttgtactaatat

SEQ ID NO: 820576 - DNA, 22 bp, Artificial Sequence
  chemically synthesized
cataatggttgtactaatatac

SEQ ID NO: 820577 - DNA, 22 bp, Artificial Sequence
  chemically synthesized
tatatcattggtgggaatgtat

SEQ ID NO: 820578 - DNA, 22 bp, Artificial Sequence
  chemically synthesized
gtatatcattggtgggaatgta

SEQ ID NO: 820579 - DNA, 22 bp, Artificial Sequence
  chemically synthesized
tactaatatacattcccaccaa

SEQ ID NO: 820580 - DNA, 22 bp, Artificial Sequence
  chemically synthesized
atatacattcccaccaatgata

SEQ ID NO: 820581 - DNA, 22 bp, Artificial Sequence
  chemically synthesized
ccaccaatgatatacaagtgtt

SEQ ID NO: 820582 - DNA, 22 bp, Artificial Sequence
  chemically synthesized
atcaaggatatggaaaaaaggt

SEQ ID NO: 820583 - DNA, 22 bp, Artificial Sequence
  chemically synthesized
ccttttttccatatccttgatc

SEQ ID NO: 820584 - DNA, 22 bp, Artificial Sequence
  chemically synthesized
ttttccatatccttgatcaaca

SEQ ID NO: 820585 - DNA, 22 bp, Artificial Sequence
  chemically synthesized
tttccatatccttgatcaacac

SEQ ID NO: 820586 - DNA, 22 bp, Artificial Sequence
  chemically synthesized
ttccatatccttgatcaacact

SEQ ID NO: 820587 - DNA, 22 bp, Artificial Sequence
  chemically synthesized
tccatatccttgatcaacactt

SEQ ID NO: 820588 - DNA, 22 bp, Artificial Sequence
  chemically synthesized
ccatatccttgatcaacacttg

SEQ ID NO: 820589 - DNA, 22 bp, Artificial Sequence
  chemically synthesized
catatccttgatcaacacttgt

SEQ ID NO: 820590 - DNA, 22 bp, Artificial Sequence
  chemically synthesized
taaaaagagaagaatgataaca

SEQ ID NO: 820591 - DNA, 22 bp, Artificial Sequence
  chemically synthesized
gatcaacacttgttatcattct

SEQ ID NO: 820592 - DNA, 22 bp, Artificial Sequence
  chemically synthesized
atcaacacttgttatcattctt

SEQ ID NO: 820593 - DNA, 22 bp, Artificial Sequence
  chemically synthesized
ttataaaaagagaagaatgata

SEQ ID NO: 820594 - DNA, 22 bp, Artificial Sequence
  chemically synthesized
gaatggctgttataaaaagaga

SEQ ID NO: 820595 - DNA, 22 bp, Artificial Sequence
  chemically synthesized
gttatcattcttctctttttat

SEQ ID NO: 820596 - DNA, 22 bp, Artificial Sequence
  chemically synthesized
ttatcattcttctctttttata

SEQ ID NO: 820597 - DNA, 22 bp, Artificial Sequence
  chemically synthesized
ttagaatggctgttataaaaag

SEQ ID NO: 820598 - DNA, 22 bp, Artificial Sequence
  chemically synthesized
tcattcttctctttttataaca

SEQ ID NO: 820599 - DNA, 22 bp, Artificial Sequence
  chemically synthesized
cacctgttagaatggctgttat

SEQ ID NO: 820600 - DNA, 22 bp, Artificial Sequence
  chemically synthesized
acacctgttagaatggctgtta

SEQ ID NO: 820601 - DNA, 22 bp, Artificial Sequence
  chemically synthesized
ttctctttttataacagccatt

SEQ ID NO: 820602 - DNA, 22 bp, Artificial Sequence
  chemically synthesized
ctctttttataacagccattct

SEQ ID NO: 820603 - DNA, 22 bp, Artificial Sequence
  chemically synthesized
tctttttataacagccattcta

SEQ ID NO: 820604 - DNA, 22 bp, Artificial Sequence
  chemically synthesized
tttttataacagccattctaac

SEQ ID NO: 820605 - DNA, 22 bp, Artificial Sequence
  chemically synthesized
tttataacagccattctaacag

SEQ ID NO: 820606 - DNA, 22 bp, Artificial Sequence
  chemically synthesized
ttataacagccattctaacagg

SEQ ID NO: 820607 - DNA, 22 bp, Artificial Sequence
  chemically synthesized
tataacagccattctaacaggt

SEQ ID NO: 820608 - DNA, 22 bp, Artificial Sequence
  chemically synthesized
ataacagccattctaacaggtg

SEQ ID NO: 820609 - DNA, 22 bp, Artificial Sequence
  chemically synthesized
taacagccattctaacaggtgt

SEQ ID NO: 820610 - DNA, 22 bp, Artificial Sequence
  chemically synthesized
caatcgcagtgagatgtcacct

SEQ ID NO: 820611 - DNA, 22 bp, Artificial Sequence
  chemically synthesized
taacaggtgtaaggtgacatct

SEQ ID NO: 820612 - DNA, 22 bp, Artificial Sequence
  chemically synthesized
acaggtgtaaggtgacatctca

SEQ ID NO: 820613 - DNA, 22 bp, Artificial Sequence
  chemically synthesized
gggaaatgcatattacaatcgc

SEQ ID NO: 820614 - DNA, 22 bp, Artificial Sequence
  chemically synthesized
atcattggggaaatgcatatta

SEQ ID NO: 820615 - DNA, 22 bp, Artificial Sequence
  chemically synthesized
actgcgattgtaatatgcattt

SEQ ID NO: 820616 - DNA, 22 bp, Artificial Sequence
  chemically synthesized
cgattgtaatatgcatttcccc

SEQ ID NO: 820617 - DNA, 22 bp, Artificial Sequence
  chemically synthesized
aacatcactaatcattggggaa

SEQ ID NO: 820618 - DNA, 22 bp, Artificial Sequence
  chemically synthesized
taatatgcatttccccaatgat

SEQ ID NO: 820619 - DNA, 22 bp, Artificial Sequence
  chemically synthesized
tgaaaaatgctcaacatcacta

SEQ ID NO: 820620 - DNA, 22 bp, Artificial Sequence
  chemically synthesized
gtgaaaaatgctcaacatcact

SEQ ID NO: 820621 - DNA, 22 bp, Artificial Sequence
  chemically synthesized
ccccaatgattagtgatgttga

SEQ ID NO: 820622 - DNA, 22 bp, Artificial Sequence
  chemically synthesized
cccaatgattagtgatgttgag

SEQ ID NO: 820623 - DNA, 22 bp, Artificial Sequence
  chemically synthesized
acgggtttgtgaaaaatgctca

SEQ ID NO: 820624 - DNA, 22 bp, Artificial Sequence
  chemically synthesized
gtgatgttgagcatttttcaca

SEQ ID NO: 820625 - DNA, 22 bp, Artificial Sequence
  chemically synthesized
agcatttttcacaaacccgtta

SEQ ID NO: 820626 - DNA, 22 bp, Artificial Sequence
  chemically synthesized
ttcacaaacccgttagctattt

SEQ ID NO: 820627 - DNA, 22 bp, Artificial Sequence
  chemically synthesized
tcacaaacccgttagctatttg

SEQ ID NO: 820628 - DNA, 22 bp, Artificial Sequence
  chemically synthesized
cacaaacccgttagctatttgt

SEQ ID NO: 820629 - DNA, 22 bp, Artificial Sequence
  chemically synthesized
aaaagaagatgtacaaatagct

SEQ ID NO: 820630 - DNA, 22 bp, Artificial Sequence
  chemically synthesized
acaaacccgttagctatttgta

SEQ ID NO: 820631 - DNA, 22 bp, Artificial Sequence
  chemically synthesized
tcaaaagaagatgtacaaatag

SEQ ID NO: 820632 - DNA, 22 bp, Artificial Sequence
  chemically synthesized
ctcaaaagaagatgtacaaata

SEQ ID NO: 820633 - DNA, 22 bp, Artificial Sequence
  chemically synthesized
aacatttctcaaaagaagatgt

SEQ ID NO: 820634 - DNA, 22 bp, Artificial Sequence
  chemically synthesized
aaacatttctcaaaagaagatg

SEQ ID NO: 820635 - DNA, 22 bp, Artificial Sequence
  chemically synthesized
gctatttgtacatcttcttttg

SEQ ID NO: 820636 - DNA, 22 bp, Artificial Sequence
  chemically synthesized
tttgtacatcttcttttgagaa

SEQ ID NO: 820637 - DNA, 22 bp, Artificial Sequence
  chemically synthesized
gtacatcttcttttgagaaatg

SEQ ID NO: 820638 - DNA, 22 bp, Artificial Sequence
  chemically synthesized
tacatcttcttttgagaaatgt

SEQ ID NO: 820639 - DNA, 22 bp, Artificial Sequence
  chemically synthesized
aaatgggcaaaacacttaaaca

SEQ ID NO: 820640 - DNA, 22 bp, Artificial Sequence
  chemically synthesized
cttttgagaaatgtttaagtgt

SEQ ID NO: 820641 - DNA, 22 bp, Artificial Sequence
  chemically synthesized
ttttgagaaatgtttaagtgtt

SEQ ID NO: 820642 - DNA, 22 bp, Artificial Sequence
  chemically synthesized
ttgagaaatgtttaagtgtttt

SEQ ID NO: 820643 - DNA, 22 bp, Artificial Sequence
  chemically synthesized
attaaaatgggcaaaacactta

SEQ ID NO: 820644 - DNA, 22 bp, Artificial Sequence
  chemically synthesized
tgagaaatgtttaagtgttttg

SEQ ID NO: 820645 - DNA, 22 bp, Artificial Sequence
  chemically synthesized
gagaaatgtttaagtgttttgc

SEQ ID NO: 820646 - DNA, 22 bp, Artificial Sequence
  chemically synthesized
agaaatgtttaagtgttttgcc

SEQ ID NO: 820647 - DNA, 22 bp, Artificial Sequence
  chemically synthesized
aagtgttttgcccattttaatc

SEQ ID NO: 820648 - DNA, 22 bp, Artificial Sequence
  chemically synthesized
agtgttttgcccattttaatca

SEQ ID NO: 820649 - DNA, 22 bp, Artificial Sequence
  chemically synthesized
tgcccattttaatcagattatt

SEQ ID NO: 820650 - DNA, 22 bp, Artificial Sequence
  chemically synthesized
gcccattttaatcagattattt

SEQ ID NO: 820651 - DNA, 22 bp, Artificial Sequence
  chemically synthesized
cccattttaatcagattatttg

SEQ ID NO: 820652 - DNA, 22 bp, Artificial Sequence
  chemically synthesized
taatcagattatttgttttctt

SEQ ID NO: 820653 - DNA, 22 bp, Artificial Sequence
  chemically synthesized
aatgtatcataaaagaaaacaa

SEQ ID NO: 820654 - DNA, 22 bp, Artificial Sequence
  chemically synthesized
aatcagattatttgttttcttt

SEQ ID NO: 820655 - DNA, 22 bp, Artificial Sequence
  chemically synthesized
aaatgtatcataaaagaaaaca

SEQ ID NO: 820656 - DNA, 22 bp, Artificial Sequence
  chemically synthesized
atcagattatttgttttctttt

SEQ ID NO: 820657 - DNA, 22 bp, Artificial Sequence
  chemically synthesized
gcttaaatgtatcataaaagaa

SEQ ID NO: 820658 - DNA, 22 bp, Artificial Sequence
  chemically synthesized
tttgttttcttttatgatacat

SEQ ID NO: 820659 - DNA, 22 bp, Artificial Sequence
  chemically synthesized
gttttcttttatgatacattta

SEQ ID NO: 820660 - DNA, 22 bp, Artificial Sequence
  chemically synthesized
ttttcttttatgatacatttaa

SEQ ID NO: 820661 - DNA, 22 bp, Artificial Sequence
  chemically synthesized
tcttttatgatacatttaagct

SEQ ID NO: 820662 - DNA, 22 bp, Artificial Sequence
  chemically synthesized
cttttatgatacatttaagcta

SEQ ID NO: 820663 - DNA, 22 bp, Artificial Sequence
  chemically synthesized
ttttatgatacatttaagctaa

SEQ ID NO: 820664 - DNA, 22 bp, Artificial Sequence
  chemically synthesized
ttatgatacatttaagctaatt

SEQ ID NO: 820665 - DNA, 22 bp, Artificial Sequence
  chemically synthesized
tatgatacatttaagctaattt

SEQ ID NO: 820666 - DNA, 22 bp, Artificial Sequence
  chemically synthesized
atgatacatttaagctaatttt

SEQ ID NO: 820667 - DNA, 22 bp, Artificial Sequence
  chemically synthesized
acaccatacacaaaaattagct

SEQ ID NO: 820668 - DNA, 22 bp, Artificial Sequence
  chemically synthesized
tgatacatttaagctaattttt

SEQ ID NO: 820669 - DNA, 22 bp, Artificial Sequence
  chemically synthesized
gccccacctcacaccatacaca

SEQ ID NO: 820670 - DNA, 22 bp, Artificial Sequence
  chemically synthesized
aagctaatttttgtgtatggtg

SEQ ID NO: 820671 - DNA, 22 bp, Artificial Sequence
  chemically synthesized
ggccccacctcacaccatacac

SEQ ID NO: 820672 - DNA, 22 bp, Artificial Sequence
  chemically synthesized
agctaatttttgtgtatggtgt

SEQ ID NO: 820673 - DNA, 22 bp, Artificial Sequence
  chemically synthesized
atttttgtgtatggtgtgaggt

SEQ ID NO: 820674 - DNA, 22 bp, Artificial Sequence
  chemically synthesized
ttgtgtatggtgtgaggtgggg

SEQ ID NO: 820675 - DNA, 22 bp, Artificial Sequence
  chemically synthesized
tgtgtatggtgtgaggtggggc

SEQ ID NO: 820676 - DNA, 22 bp, Artificial Sequence
  chemically synthesized
gtgtatggtgtgaggtggggcc

SEQ ID NO: 820677 - DNA, 22 bp, Artificial Sequence
  chemically synthesized
tgtatggtgtgaggtggggcca

SEQ ID NO: 820678 - DNA, 22 bp, Artificial Sequence
  chemically synthesized
gatatacacatgaaaaataatg

SEQ ID NO: 820679 - DNA, 22 bp, Artificial Sequence
  chemically synthesized
gaataactggatatacacatga

SEQ ID NO: 820680 - DNA, 22 bp, Artificial Sequence
  chemically synthesized
cattatttttcatgtgtatatc

SEQ ID NO: 820681 - DNA, 22 bp, Artificial Sequence
  chemically synthesized
attatttttcatgtgtatatcc

SEQ ID NO: 820682 - DNA, 22 bp, Artificial Sequence
  chemically synthesized
gtgctagaataactggatatac

SEQ ID NO: 820683 - DNA, 22 bp, Artificial Sequence
  chemically synthesized
tttttcatgtgtatatccagtt

SEQ ID NO: 820684 - DNA, 22 bp, Artificial Sequence
  chemically synthesized
ttcatgtgtatatccagttatt

SEQ ID NO: 820685 - DNA, 22 bp, Artificial Sequence
  chemically synthesized
tcatgtgtatatccagttattc

SEQ ID NO: 820686 - DNA, 22 bp, Artificial Sequence
  chemically synthesized
catgtgtatatccagttattct

SEQ ID NO: 820687 - DNA, 22 bp, Artificial Sequence
  chemically synthesized
atgtgtatatccagttattcta

SEQ ID NO: 820688 - DNA, 22 bp, Artificial Sequence
  chemically synthesized
acaacctggtgctagaataact

SEQ ID NO: 820689 - DNA, 22 bp, Artificial Sequence
  chemically synthesized
cacaacctggtgctagaataac

SEQ ID NO: 820690 - DNA, 22 bp, Artificial Sequence
  chemically synthesized
tcacaacctggtgctagaataa

SEQ ID NO: 820691 - DNA, 22 bp, Artificial Sequence
  chemically synthesized
ttctagcaccaggttgtgaaag

SEQ ID NO: 820692 - DNA, 22 bp, Artificial Sequence
  chemically synthesized
tagcaccaggttgtgaaagact

SEQ ID NO: 820693 - DNA, 22 bp, Artificial Sequence
  chemically synthesized
gcaccaggttgtgaaagactat

SEQ ID NO: 820694 - DNA, 22 bp, Artificial Sequence
  chemically synthesized
aatggaaaaagaatagtctttc

SEQ ID NO: 820695 - DNA, 22 bp, Artificial Sequence
  chemically synthesized
tgaaagactattctttttccat

SEQ ID NO: 820696 - DNA, 22 bp, Artificial Sequence
  chemically synthesized
ttctttttccattgaattctct

SEQ ID NO: 820697 - DNA, 22 bp, Artificial Sequence
  chemically synthesized
acaagggtaccaagagaattca

SEQ ID NO: 820698 - DNA, 22 bp, Artificial Sequence
  chemically synthesized
gacaagggtaccaagagaattc

SEQ ID NO: 820699 - DNA, 22 bp, Artificial Sequence
  chemically synthesized
tgacaagggtaccaagagaatt

SEQ ID NO: 820700 - DNA, 22 bp, Artificial Sequence
  chemically synthesized
tttttccattgaattctcttgg

SEQ ID NO: 820701 - DNA, 22 bp, Artificial Sequence
  chemically synthesized
ttgacaagggtaccaagagaat

SEQ ID NO: 820702 - DNA, 22 bp, Artificial Sequence
  chemically synthesized
tttccattgaattctcttggta

SEQ ID NO: 820703 - DNA, 22 bp, Artificial Sequence
  chemically synthesized
ttccattgaattctcttggtac

SEQ ID NO: 820704 - DNA, 22 bp, Artificial Sequence
  chemically synthesized
tccattgaattctcttggtacc

SEQ ID NO: 820705 - DNA, 22 bp, Artificial Sequence
  chemically synthesized
atttttgacaagggtaccaaga

SEQ ID NO: 820706 - DNA, 22 bp, Artificial Sequence
  chemically synthesized
ccattgaattctcttggtaccc

SEQ ID NO: 820707 - DNA, 22 bp, Artificial Sequence
  chemically synthesized
cattgaattctcttggtaccct

SEQ ID NO: 820708 - DNA, 22 bp, Artificial Sequence
  chemically synthesized
aattctcttggtacccttgtca

SEQ ID NO: 820709 - DNA, 22 bp, Artificial Sequence
  chemically synthesized
tggtcaactgatttttgacaag

SEQ ID NO: 820710 - DNA, 22 bp, Artificial Sequence
  chemically synthesized
atggtcaactgatttttgacaa

SEQ ID NO: 820711 - DNA, 22 bp, Artificial Sequence
  chemically synthesized
tcttggtacccttgtcaaaaat

SEQ ID NO: 820712 - DNA, 22 bp, Artificial Sequence
  chemically synthesized
ttggtacccttgtcaaaaatca

SEQ ID NO: 820713 - DNA, 22 bp, Artificial Sequence
  chemically synthesized
ggtacccttgtcaaaaatcagt

SEQ ID NO: 820714 - DNA, 22 bp, Artificial Sequence
  chemically synthesized
catttatggtcaactgattttt

SEQ ID NO: 820715 - DNA, 22 bp, Artificial Sequence
  chemically synthesized
gtacccttgtcaaaaatcagtt

SEQ ID NO: 820716 - DNA, 22 bp, Artificial Sequence
  chemically synthesized
gcatttatggtcaactgatttt

SEQ ID NO: 820717 - DNA, 22 bp, Artificial Sequence
  chemically synthesized
tgcatttatggtcaactgattt

SEQ ID NO: 820718 - DNA, 22 bp, Artificial Sequence
  chemically synthesized
gtcaaaaatcagttgaccataa

SEQ ID NO: 820719 - DNA, 22 bp, Artificial Sequence
  chemically synthesized
tcaaaaatcagttgaccataaa

SEQ ID NO: 820720 - DNA, 22 bp, Artificial Sequence
  chemically synthesized
aaaagtaaacctttgcatttat

SEQ ID NO: 820721 - DNA, 22 bp, Artificial Sequence
  chemically synthesized
aaagttcaaaagtaaacctttg

SEQ ID NO: 820722 - DNA, 22 bp, Artificial Sequence
  chemically synthesized
accataaatgcaaaggtttact

SEQ ID NO: 820723 - DNA, 22 bp, Artificial Sequence
  chemically synthesized
acttttgaactttcaattctat

SEQ ID NO: 820724 - DNA, 22 bp, Artificial Sequence
  chemically synthesized
cttttgaactttcaattctatt

SEQ ID NO: 820725 - DNA, 22 bp, Artificial Sequence
  chemically synthesized
ttgaactttcaattctatttca

SEQ ID NO: 820726 - DNA, 22 bp, Artificial Sequence
  chemically synthesized
tgaactttcaattctatttcat

SEQ ID NO: 820727 - DNA, 22 bp, Artificial Sequence
  chemically synthesized
gaactttcaattctatttcatt

SEQ ID NO: 820728 - DNA, 22 bp, Artificial Sequence
  chemically synthesized
aactttcaattctatttcattg

SEQ ID NO: 820729 - DNA, 22 bp, Artificial Sequence
  chemically synthesized
tcaattctatttcattgatcta

SEQ ID NO: 820730 - DNA, 22 bp, Artificial Sequence
  chemically synthesized
caattctatttcattgatctat

SEQ ID NO: 820731 - DNA, 22 bp, Artificial Sequence
  chemically synthesized
aattctatttcattgatctata

SEQ ID NO: 820732 - DNA, 22 bp, Artificial Sequence
  chemically synthesized
gaatgtgaatagacatatagat

SEQ ID NO: 820733 - DNA, 22 bp, Artificial Sequence
  chemically synthesized
tatttcattgatctatatgtct

SEQ ID NO: 820734 - DNA, 22 bp, Artificial Sequence
  chemically synthesized
tttcattgatctatatgtctat

SEQ ID NO: 820735 - DNA, 22 bp, Artificial Sequence
  chemically synthesized
cattgatctatatgtctattca

SEQ ID NO: 820736 - DNA, 22 bp, Artificial Sequence
  chemically synthesized
attgatctatatgtctattcac

SEQ ID NO: 820737 - DNA, 22 bp, Artificial Sequence
  chemically synthesized
atctatatgtctattcacattc

SEQ ID NO: 820738 - DNA, 22 bp, Artificial Sequence
  chemically synthesized
agtcaatgtggtactagaatgt

SEQ ID NO: 820739 - DNA, 22 bp, Artificial Sequence
  chemically synthesized
tatgtctattcacattctagta

SEQ ID NO: 820740 - DNA, 22 bp, Artificial Sequence
  chemically synthesized
ttaagtcaatgtggtactagaa

SEQ ID NO: 820741 - DNA, 22 bp, Artificial Sequence
  chemically synthesized
ttcacattctagtaccacattg

SEQ ID NO: 820742 - DNA, 22 bp, Artificial Sequence
  chemically synthesized
caattattaagtcaatgtggta

SEQ ID NO: 820743 - DNA, 22 bp, Artificial Sequence
  chemically synthesized
acattctagtaccacattgact

SEQ ID NO: 820744 - DNA, 22 bp, Artificial Sequence
  chemically synthesized
caaagctacaattattaagtca

SEQ ID NO: 820745 - DNA, 22 bp, Artificial Sequence
  chemically synthesized
tagtaccacattgacttaataa

SEQ ID NO: 820746 - DNA, 22 bp, Artificial Sequence
  chemically synthesized
gtaccacattgacttaataatt

SEQ ID NO: 820747 - DNA, 22 bp, Artificial Sequence
  chemically synthesized
ctacaaagctacaattattaag

SEQ ID NO: 820748 - DNA, 22 bp, Artificial Sequence
  chemically synthesized
aaaaactactacaaagctacaa

SEQ ID NO: 820749 - DNA, 22 bp, Artificial Sequence
  chemically synthesized
caaaaactactacaaagctaca

SEQ ID NO: 820750 - DNA, 22 bp, Artificial Sequence
  chemically synthesized
acttaataattgtagctttgta

SEQ ID NO: 820751 - DNA, 22 bp, Artificial Sequence
  chemically synthesized
aataattgtagctttgtagtag

SEQ ID NO: 820752 - DNA, 22 bp, Artificial Sequence
  chemically synthesized
caatttcaaaaactactacaaa

SEQ ID NO: 820753 - DNA, 22 bp, Artificial Sequence
  chemically synthesized
ataattgtagctttgtagtagt

SEQ ID NO: 820754 - DNA, 22 bp, Artificial Sequence
  chemically synthesized
ccaatttcaaaaactactacaa

SEQ ID NO: 820755 - DNA, 22 bp, Artificial Sequence
  chemically synthesized
tccaatttcaaaaactactaca

SEQ ID NO: 820756 - DNA, 22 bp, Artificial Sequence
  chemically synthesized
actttccaatttcaaaaactac

SEQ ID NO: 820757 - DNA, 22 bp, Artificial Sequence
  chemically synthesized
tagctttgtagtagtttttgaa

SEQ ID NO: 820758 - DNA, 22 bp, Artificial Sequence
  chemically synthesized
tgtagtagtttttgaaattgga

SEQ ID NO: 820759 - DNA, 22 bp, Artificial Sequence
  chemically synthesized
gtagtagtttttgaaattggaa

SEQ ID NO: 820760 - DNA, 22 bp, Artificial Sequence
  chemically synthesized
gaggagttaactttccaatttc

SEQ ID NO: 820761 - DNA, 22 bp, Artificial Sequence
  chemically synthesized
tagtagtttttgaaattggaaa

SEQ ID NO: 820762 - DNA, 22 bp, Artificial Sequence
  chemically synthesized
ttgaaattggaaagttaactcc

SEQ ID NO: 820763 - DNA, 22 bp, Artificial Sequence
  chemically synthesized
tgaaattggaaagttaactcct

SEQ ID NO: 820764 - DNA, 22 bp, Artificial Sequence
  chemically synthesized
gaaattggaaagttaactcctc

SEQ ID NO: 820765 - DNA, 22 bp, Artificial Sequence
  chemically synthesized
aaattggaaagttaactcctcc

SEQ ID NO: 820766 - DNA, 22 bp, Artificial Sequence
  chemically synthesized
aaaaaagaacaacattggagga

SEQ ID NO: 820767 - DNA, 22 bp, Artificial Sequence
  chemically synthesized
gaaaaaagaacaacattggagg

SEQ ID NO: 820768 - DNA, 22 bp, Artificial Sequence
  chemically synthesized
gaaagttaactcctccaatgtt

SEQ ID NO: 820769 - DNA, 22 bp, Artificial Sequence
  chemically synthesized
actcctccaatgttgttctttt

SEQ ID NO: 820770 - DNA, 22 bp, Artificial Sequence
  chemically synthesized
ctccaatgttgttcttttttca

SEQ ID NO: 820771 - DNA, 22 bp, Artificial Sequence
  chemically synthesized
caatgttgttcttttttcaagg

SEQ ID NO: 820772 - DNA, 22 bp, Artificial Sequence
  chemically synthesized
ttcttttttcaaggttgttttg

SEQ ID NO: 820773 - DNA, 22 bp, Artificial Sequence
  chemically synthesized
ttttttcaaggttgttttgact

SEQ ID NO: 820774 - DNA, 22 bp, Artificial Sequence
  chemically synthesized
ttttcaaggttgttttgactat

SEQ ID NO: 820775 - DNA, 22 bp, Artificial Sequence
  chemically synthesized
tttcaaggttgttttgactatt

SEQ ID NO: 820776 - DNA, 22 bp, Artificial Sequence
  chemically synthesized
ttcaaggttgttttgactattc

SEQ ID NO: 820777 - DNA, 22 bp, Artificial Sequence
  chemically synthesized
tcaaggttgttttgactattct

SEQ ID NO: 820778 - DNA, 22 bp, Artificial Sequence
  chemically synthesized
caaggttgttttgactattcta

SEQ ID NO: 820779 - DNA, 22 bp, Artificial Sequence
  chemically synthesized
aaggttgttttgactattctac

SEQ ID NO: 820780 - DNA, 22 bp, Artificial Sequence
  chemically synthesized
aaatgcaagggatgtagaatag

SEQ ID NO: 820781 - DNA, 22 bp, Artificial Sequence
  chemically synthesized
ttgaaatgcaagggatgtagaa

SEQ ID NO: 820782 - DNA, 22 bp, Artificial Sequence
  chemically synthesized
tattgaaatgcaagggatgtag

SEQ ID NO: 820783 - DNA, 22 bp, Artificial Sequence
  chemically synthesized
ttttgactattctacatccctt

SEQ ID NO: 820784 - DNA, 22 bp, Artificial Sequence
  chemically synthesized
ctattgaaatgcaagggatgta

SEQ ID NO: 820785 - DNA, 22 bp, Artificial Sequence
  chemically synthesized
tgactattctacatcccttgca

SEQ ID NO: 820786 - DNA, 22 bp, Artificial Sequence
  chemically synthesized
gactattctacatcccttgcat

SEQ ID NO: 820787 - DNA, 22 bp, Artificial Sequence
  chemically synthesized
actattctacatcccttgcatt

SEQ ID NO: 820788 - DNA, 22 bp, Artificial Sequence
  chemically synthesized
ccatttctattgaaatgcaagg

SEQ ID NO: 820789 - DNA, 22 bp, Artificial Sequence
  chemically synthesized
ttctacatcccttgcatttcaa

SEQ ID NO: 820790 - DNA, 22 bp, Artificial Sequence
  chemically synthesized
tacatcccttgcatttcaatag

SEQ ID NO: 820791 - DNA, 22 bp, Artificial Sequence
  chemically synthesized
catcccttgcatttcaatagaa

SEQ ID NO: 820792 - DNA, 22 bp, Artificial Sequence
  chemically synthesized
acaagtggatcctaccatttct

SEQ ID NO: 820793 - DNA, 22 bp, Artificial Sequence
  chemically synthesized
gcatttcaatagaaatggtagg

SEQ ID NO: 820794 - DNA, 22 bp, Artificial Sequence
  chemically synthesized
catttcaatagaaatggtagga

SEQ ID NO: 820795 - DNA, 22 bp, Artificial Sequence
  chemically synthesized
caatagaaatggtaggatccac

SEQ ID NO: 820796 - DNA, 22 bp, Artificial Sequence
  chemically synthesized
agaaattgacaagtggatccta

SEQ ID NO: 820797 - DNA, 22 bp, Artificial Sequence
  chemically synthesized
aatagaaatggtaggatccact

SEQ ID NO: 820798 - DNA, 22 bp, Artificial Sequence
  chemically synthesized
cagaaattgacaagtggatcct

SEQ ID NO: 820799 - DNA, 22 bp, Artificial Sequence
  chemically synthesized
tcagaaattgacaagtggatcc

SEQ ID NO: 820800 - DNA, 22 bp, Artificial Sequence
  chemically synthesized
ttcagaaattgacaagtggatc

SEQ ID NO: 820801 - DNA, 22 bp, Artificial Sequence
  chemically synthesized
tttcagaaattgacaagtggat

SEQ ID NO: 820802 - DNA, 22 bp, Artificial Sequence
  chemically synthesized
ttttcagaaattgacaagtgga

SEQ ID NO: 820803 - DNA, 22 bp, Artificial Sequence
  chemically synthesized
tttttcagaaattgacaagtgg

SEQ ID NO: 820804 - DNA, 22 bp, Artificial Sequence
  chemically synthesized
ttttttcagaaattgacaagtg

SEQ ID NO: 820805 - DNA, 22 bp, Artificial Sequence
  chemically synthesized
tttttttcagaaattgacaagt

SEQ ID NO: 820806 - DNA, 22 bp, Artificial Sequence
  chemically synthesized
ttttttttcagaaattgacaag

SEQ ID NO: 820807 - DNA, 22 bp, Artificial Sequence
  chemically synthesized
tttttttttcagaaattgacaa

SEQ ID NO: 820808 - DNA, 22 bp, Artificial Sequence
  chemically synthesized
ttttttttttcagaaattgaca

SEQ ID NO: 820809 - DNA, 22 bp, Artificial Sequence
  chemically synthesized
tttttttttttcagaaattgac

SEQ ID NO: 820810 - DNA, 22 bp, Artificial Sequence
  chemically synthesized
ttttttttttttcagaaattga

SEQ ID NO: 820811 - DNA, 22 bp, Artificial Sequence
  chemically synthesized
gcttttttttttttttcagaaa

SEQ ID NO: 820812 - DNA, 22 bp, Artificial Sequence
  chemically synthesized
gtcaatttctgaaaaaaaaaaa

SEQ ID NO: 820813 - DNA, 22 bp, Artificial Sequence
  chemically synthesized
tcaatttctgaaaaaaaaaaaa

SEQ ID NO: 820814 - DNA, 22 bp, Artificial Sequence
  chemically synthesized
ctgaaaaaaaaaaaaaagccag

SEQ ID NO: 820815 - DNA, 22 bp, Artificial Sequence
  chemically synthesized
tcaaaatcacaactggcttttt

SEQ ID NO: 820816 - DNA, 22 bp, Artificial Sequence
  chemically synthesized
tgaaaaaaaaaaaaaagccagt

SEQ ID NO: 820817 - DNA, 22 bp, Artificial Sequence
  chemically synthesized
aaaaaaaaaaaaaagccagttg

SEQ ID NO: 820818 - DNA, 22 bp, Artificial Sequence
  chemically synthesized
tggaatcattatcaaaatcaca

SEQ ID NO: 820819 - DNA, 22 bp, Artificial Sequence
  chemically synthesized
tatggaatcattatcaaaatca

SEQ ID NO: 820820 - DNA, 22 bp, Artificial Sequence
  chemically synthesized
cagactctatggaatcattatc

SEQ ID NO: 820821 - DNA, 22 bp, Artificial Sequence
  chemically synthesized
tgattttgataatgattccata

SEQ ID NO: 820822 - DNA, 22 bp, Artificial Sequence
  chemically synthesized
atctacagactctatggaatca

SEQ ID NO: 820823 - DNA, 22 bp, Artificial Sequence
  chemically synthesized
tgataatgattccatagagtct

SEQ ID NO: 820824 - DNA, 22 bp, Artificial Sequence
  chemically synthesized
gataatgattccatagagtctg

SEQ ID NO: 820825 - DNA, 22 bp, Artificial Sequence
  chemically synthesized
ataatgattccatagagtctgt

SEQ ID NO: 820826 - DNA, 22 bp, Artificial Sequence
  chemically synthesized
catagagtctgtagatcaattg

SEQ ID NO: 820827 - DNA, 22 bp, Artificial Sequence
  chemically synthesized
agatatcaatatccccccaatt

SEQ ID NO: 820828 - DNA, 22 bp, Artificial Sequence
  chemically synthesized
ttaagatatcaatatcccccca

SEQ ID NO: 820829 - DNA, 22 bp, Artificial Sequence
  chemically synthesized
tagatcaattggggggatattg

SEQ ID NO: 820830 - DNA, 22 bp, Artificial Sequence
  chemically synthesized
atattattaagatatcaatatc

SEQ ID NO: 820831 - DNA, 22 bp, Artificial Sequence
  chemically synthesized
aatattattaagatatcaatat

SEQ ID NO: 820832 - DNA, 22 bp, Artificial Sequence
  chemically synthesized
gggggatattgatatcttaata

SEQ ID NO: 820833 - DNA, 22 bp, Artificial Sequence
  chemically synthesized
agatcaaaagacttaatattat

SEQ ID NO: 820834 - DNA, 22 bp, Artificial Sequence
  chemically synthesized
tcagatcaaaagacttaatatt

SEQ ID NO: 820835 - DNA, 22 bp, Artificial Sequence
  chemically synthesized
atatcttaataatattaagtct

SEQ ID NO: 820836 - DNA, 22 bp, Artificial Sequence
  chemically synthesized
aataatattaagtcttttgatc

SEQ ID NO: 820837 - DNA, 22 bp, Artificial Sequence
  chemically synthesized
ataatattaagtcttttgatct

SEQ ID NO: 820838 - DNA, 22 bp, Artificial Sequence
  chemically synthesized
agtcttttgatctgagaacatg

SEQ ID NO: 820839 - DNA, 22 bp, Artificial Sequence
  chemically synthesized
ttgatctgagaacatgtgatat

SEQ ID NO: 820840 - DNA, 22 bp, Artificial Sequence
  chemically synthesized
tgatctgagaacatgtgatatt

SEQ ID NO: 820841 - DNA, 22 bp, Artificial Sequence
  chemically synthesized
gatctgagaacatgtgatattt

SEQ ID NO: 820842 - DNA, 22 bp, Artificial Sequence
  chemically synthesized
atctgagaacatgtgatatttt

SEQ ID NO: 820843 - DNA, 22 bp, Artificial Sequence
  chemically synthesized
aagataaaaaaatagaaaaata

SEQ ID NO: 820844 - DNA, 22 bp, Artificial Sequence
  chemically synthesized
agaacatgtgatatttttctat

SEQ ID NO: 820845 - DNA, 22 bp, Artificial Sequence
  chemically synthesized
aaagaaattaaagataaaaaaa

SEQ ID NO: 820846 - DNA, 22 bp, Artificial Sequence
  chemically synthesized
ttctatttttttatctttaatt

SEQ ID NO: 820847 - DNA, 22 bp, Artificial Sequence
  chemically synthesized
tctatttttttatctttaattt

SEQ ID NO: 820848 - DNA, 22 bp, Artificial Sequence
  chemically synthesized
ctatttttttatctttaatttc

SEQ ID NO: 820849 - DNA, 22 bp, Artificial Sequence
  chemically synthesized
tatttttttatctttaatttct

SEQ ID NO: 820850 - DNA, 22 bp, Artificial Sequence
  chemically synthesized
tttttttatctttaatttcttt

SEQ ID NO: 820851 - DNA, 22 bp, Artificial Sequence
  chemically synthesized
ttttatctttaatttctttcaa

SEQ ID NO: 820852 - DNA, 22 bp, Artificial Sequence
  chemically synthesized
tttatctttaatttctttcaac

SEQ ID NO: 820853 - DNA, 22 bp, Artificial Sequence
  chemically synthesized
ttatctttaatttctttcaaca

SEQ ID NO: 820854 - DNA, 22 bp, Artificial Sequence
  chemically synthesized
tatctttaatttctttcaacac

SEQ ID NO: 820855 - DNA, 22 bp, Artificial Sequence
  chemically synthesized
atctttaatttctttcaacact

SEQ ID NO: 820856 - DNA, 22 bp, Artificial Sequence
  chemically synthesized
tctttaatttctttcaacactg

SEQ ID NO: 820857 - DNA, 22 bp, Artificial Sequence
  chemically synthesized
aagaatacaaagcagtgttgaa

SEQ ID NO: 820858 - DNA, 22 bp, Artificial Sequence
  chemically synthesized
taatttctttcaacactgcttt

SEQ ID NO: 820859 - DNA, 22 bp, Artificial Sequence
  chemically synthesized
aatttctttcaacactgctttg

SEQ ID NO: 820860 - DNA, 22 bp, Artificial Sequence
  chemically synthesized
atttctttcaacactgctttgt

SEQ ID NO: 820861 - DNA, 22 bp, Artificial Sequence
  chemically synthesized
tatactgaagaatacaaagcag

SEQ ID NO: 820862 - DNA, 22 bp, Artificial Sequence
  chemically synthesized
gtatactgaagaatacaaagca

SEQ ID NO: 820863 - DNA, 22 bp, Artificial Sequence
  chemically synthesized
ctttcaacactgctttgtattc

SEQ ID NO: 820864 - DNA, 22 bp, Artificial Sequence
  chemically synthesized
tttcaacactgctttgtattct

SEQ ID NO: 820865 - DNA, 22 bp, Artificial Sequence
  chemically synthesized
tcaacactgctttgtattcttc

SEQ ID NO: 820866 - DNA, 22 bp, Artificial Sequence
  chemically synthesized
caacactgctttgtattcttca

SEQ ID NO: 820867 - DNA, 22 bp, Artificial Sequence
  chemically synthesized
aacactgctttgtattcttcag

SEQ ID NO: 820868 - DNA, 22 bp, Artificial Sequence
  chemically synthesized
ctttgtattcttcagtatacaa

SEQ ID NO: 820869 - DNA, 22 bp, Artificial Sequence
  chemically synthesized
tgtattcttcagtatacaagcc

SEQ ID NO: 820870 - DNA, 22 bp, Artificial Sequence
  chemically synthesized
gtattcttcagtatacaagcct

SEQ ID NO: 820871 - DNA, 22 bp, Artificial Sequence
  chemically synthesized
tattcttcagtatacaagcctt

SEQ ID NO: 820872 - DNA, 22 bp, Artificial Sequence
  chemically synthesized
ggaataaaagagatgcaaggct

SEQ ID NO: 820873 - DNA, 22 bp, Artificial Sequence
  chemically synthesized
ttcagtatacaagccttgcatc

SEQ ID NO: 820874 - DNA, 22 bp, Artificial Sequence
  chemically synthesized
aggaataaaagagatgcaaggc

SEQ ID NO: 820875 - DNA, 22 bp, Artificial Sequence
  chemically synthesized
cagtatacaagccttgcatctc

SEQ ID NO: 820876 - DNA, 22 bp, Artificial Sequence
  chemically synthesized
agtatacaagccttgcatctct

SEQ ID NO: 820877 - DNA, 22 bp, Artificial Sequence
  chemically synthesized
aaaacttaggaataaaagagat

SEQ ID NO: 820878 - DNA, 22 bp, Artificial Sequence
  chemically synthesized
gcatctcttttattcctaagtt

SEQ ID NO: 820879 - DNA, 22 bp, Artificial Sequence
  chemically synthesized
catctcttttattcctaagttt

SEQ ID NO: 820880 - DNA, 22 bp, Artificial Sequence
  chemically synthesized
ttttattcctaagtttttaaca

SEQ ID NO: 820881 - DNA, 22 bp, Artificial Sequence
  chemically synthesized
ttattcctaagtttttaacatt

SEQ ID NO: 820882 - DNA, 22 bp, Artificial Sequence
  chemically synthesized
tattcctaagtttttaacattt

SEQ ID NO: 820883 - DNA, 22 bp, Artificial Sequence
  chemically synthesized
attcctaagtttttaacatttt

SEQ ID NO: 820884 - DNA, 22 bp, Artificial Sequence
  chemically synthesized
caatggcatcaaaaaatgttaa

SEQ ID NO: 820885 - DNA, 22 bp, Artificial Sequence
  chemically synthesized
ttcctaagtttttaacattttt

SEQ ID NO: 820886 - DNA, 22 bp, Artificial Sequence
  chemically synthesized
acaatggcatcaaaaaatgtta

SEQ ID NO: 820887 - DNA, 22 bp, Artificial Sequence
  chemically synthesized
ctaagtttttaacattttttga

SEQ ID NO: 820888 - DNA, 22 bp, Artificial Sequence
  chemically synthesized
agtttttaacattttttgatgc

SEQ ID NO: 820889 - DNA, 22 bp, Artificial Sequence
  chemically synthesized
ttaacattttttgatgccattg

SEQ ID NO: 820890 - DNA, 22 bp, Artificial Sequence
  chemically synthesized
agaaaatatttacaatggcatc

SEQ ID NO: 820891 - DNA, 22 bp, Artificial Sequence
  chemically synthesized
taacattttttgatgccattgt

SEQ ID NO: 820892 - DNA, 22 bp, Artificial Sequence
  chemically synthesized
aacattttttgatgccattgta

SEQ ID NO: 820893 - DNA, 22 bp, Artificial Sequence
  chemically synthesized
acattttttgatgccattgtaa

SEQ ID NO: 820894 - DNA, 22 bp, Artificial Sequence
  chemically synthesized
tttgatgccattgtaaatattt

SEQ ID NO: 820895 - DNA, 22 bp, Artificial Sequence
  chemically synthesized
ttgatgccattgtaaatatttt

SEQ ID NO: 820896 - DNA, 22 bp, Artificial Sequence
  chemically synthesized
tgatgccattgtaaatattttc

SEQ ID NO: 820897 - DNA, 22 bp, Artificial Sequence
  chemically synthesized
gatgccattgtaaatattttct

SEQ ID NO: 820898 - DNA, 22 bp, Artificial Sequence
  chemically synthesized
aaagtgaaattaagaaaatatt

SEQ ID NO: 820899 - DNA, 22 bp, Artificial Sequence
  chemically synthesized
atgccattgtaaatattttctt

SEQ ID NO: 820900 - DNA, 22 bp, Artificial Sequence
  chemically synthesized
taaatattttcttaatttcact

SEQ ID NO: 820901 - DNA, 22 bp, Artificial Sequence
  chemically synthesized
aaaatgaataatctaaaagtga

SEQ ID NO: 820902 - DNA, 22 bp, Artificial Sequence
  chemically synthesized
tcttaatttcacttttagatta

SEQ ID NO: 820903 - DNA, 22 bp, Artificial Sequence
  chemically synthesized
cttaatttcacttttagattat

SEQ ID NO: 820904 - DNA, 22 bp, Artificial Sequence
  chemically synthesized
ttaatttcacttttagattatt

SEQ ID NO: 820905 - DNA, 22 bp, Artificial Sequence
  chemically synthesized
tacattaaaaatgaataatcta

SEQ ID NO: 820906 - DNA, 22 bp, Artificial Sequence
  chemically synthesized
aatttcacttttagattattca

SEQ ID NO: 820907 - DNA, 22 bp, Artificial Sequence
  chemically synthesized
atacattaaaaatgaataatct

SEQ ID NO: 820908 - DNA, 22 bp, Artificial Sequence
  chemically synthesized
atttcacttttagattattcat

SEQ ID NO: 820909 - DNA, 22 bp, Artificial Sequence
  chemically synthesized
tatacattaaaaatgaataatc

SEQ ID NO: 820910 - DNA, 22 bp, Artificial Sequence
  chemically synthesized
ttttatacattaaaaatgaata

SEQ ID NO: 820911 - DNA, 22 bp, Artificial Sequence
  chemically synthesized
cacttttagattattcattttt

SEQ ID NO: 820912 - DNA, 22 bp, Artificial Sequence
  chemically synthesized
acttttagattattcattttta

SEQ ID NO: 820913 - DNA, 22 bp, Artificial Sequence
  chemically synthesized
ttagattattcatttttaatgt

SEQ ID NO: 820914 - DNA, 22 bp, Artificial Sequence
  chemically synthesized
tagattattcatttttaatgta

SEQ ID NO: 820915 - DNA, 22 bp, Artificial Sequence
  chemically synthesized
agattattcatttttaatgtat

SEQ ID NO: 820916 - DNA, 22 bp, Artificial Sequence
  chemically synthesized
gattattcatttttaatgtata

SEQ ID NO: 820917 - DNA, 22 bp, Artificial Sequence
  chemically synthesized
ttcatttttaatgtataaaata

SEQ ID NO: 820918 - DNA, 22 bp, Artificial Sequence
  chemically synthesized
atttttaatgtataaaataatt

SEQ ID NO: 820919 - DNA, 22 bp, Artificial Sequence
  chemically synthesized
ttaatgtataaaataattcatt

SEQ ID NO: 820920 - DNA, 22 bp, Artificial Sequence
  chemically synthesized
taatgtataaaataattcattt

SEQ ID NO: 820921 - DNA, 22 bp, Artificial Sequence
  chemically synthesized
aatgtataaaataattcatttt

SEQ ID NO: 820922 - DNA, 22 bp, Artificial Sequence
  chemically synthesized
atgtataaaataattcattttg

SEQ ID NO: 820923 - DNA, 22 bp, Artificial Sequence
  chemically synthesized
taggatacaagatcaatataca

SEQ ID NO: 820924 - DNA, 22 bp, Artificial Sequence
  chemically synthesized
gtaggatacaagatcaatatac

SEQ ID NO: 820925 - DNA, 22 bp, Artificial Sequence
  chemically synthesized
attttgtatattgatcttgtat

SEQ ID NO: 820926 - DNA, 22 bp, Artificial Sequence
  chemically synthesized
agcaaatttgtaggatacaaga

SEQ ID NO: 820927 - DNA, 22 bp, Artificial Sequence
  chemically synthesized
tgtatattgatcttgtatccta

SEQ ID NO: 820928 - DNA, 22 bp, Artificial Sequence
  chemically synthesized
gtatattgatcttgtatcctac

SEQ ID NO: 820929 - DNA, 22 bp, Artificial Sequence
  chemically synthesized
tatattgatcttgtatcctaca

SEQ ID NO: 820930 - DNA, 22 bp, Artificial Sequence
  chemically synthesized
atcttgtatcctacaaatttgc

SEQ ID NO: 820931 - DNA, 22 bp, Artificial Sequence
  chemically synthesized
gtatcctacaaatttgctgaat

SEQ ID NO: 820932 - DNA, 22 bp, Artificial Sequence
  chemically synthesized
tatcctacaaatttgctgaatt

SEQ ID NO: 820933 - DNA, 22 bp, Artificial Sequence
  chemically synthesized
gaaataataaaataattcagca

SEQ ID NO: 820934 - DNA, 22 bp, Artificial Sequence
  chemically synthesized
caaatttgctgaattattttat

SEQ ID NO: 820935 - DNA, 22 bp, Artificial Sequence
  chemically synthesized
gctgaattattttattatttct

SEQ ID NO: 820936 - DNA, 22 bp, Artificial Sequence
  chemically synthesized
tgaaaaaatattagaaataata

SEQ ID NO: 820937 - DNA, 22 bp, Artificial Sequence
  chemically synthesized
ctgaattattttattatttcta

SEQ ID NO: 820938 - DNA, 22 bp, Artificial Sequence
  chemically synthesized
aattattttattatttctaata

SEQ ID NO: 820939 - DNA, 22 bp, Artificial Sequence
  chemically synthesized
ttttattatttctaatattttt

SEQ ID NO: 820940 - DNA, 22 bp, Artificial Sequence
  chemically synthesized
aagaatctatgaaaaaatatta

SEQ ID NO: 820941 - DNA, 22 bp, Artificial Sequence
  chemically synthesized
gaagaatctatgaaaaaatatt

SEQ ID NO: 820942 - DNA, 22 bp, Artificial Sequence
  chemically synthesized
tgaagaatctatgaaaaaatat

SEQ ID NO: 820943 - DNA, 22 bp, Artificial Sequence
  chemically synthesized
tattatttctaatattttttca

SEQ ID NO: 820944 - DNA, 22 bp, Artificial Sequence
  chemically synthesized
attatttctaatattttttcat

SEQ ID NO: 820945 - DNA, 22 bp, Artificial Sequence
  chemically synthesized
ttatttctaatattttttcata

SEQ ID NO: 820946 - DNA, 22 bp, Artificial Sequence
  chemically synthesized
tttctaatattttttcatagat

SEQ ID NO: 820947 - DNA, 22 bp, Artificial Sequence
  chemically synthesized
gaaaattttgaagaatctatga

SEQ ID NO: 820948 - DNA, 22 bp, Artificial Sequence
  chemically synthesized
ctaatattttttcatagattct

SEQ ID NO: 820949 - DNA, 22 bp, Artificial Sequence
  chemically synthesized
taatattttttcatagattctt

SEQ ID NO: 820950 - DNA, 22 bp, Artificial Sequence
  chemically synthesized
atattttttcatagattcttca

SEQ ID NO: 820951 - DNA, 22 bp, Artificial Sequence
  chemically synthesized
taattagaaaattttgaagaat

SEQ ID NO: 820952 - DNA, 22 bp, Artificial Sequence
  chemically synthesized
gtaattagaaaattttgaagaa

SEQ ID NO: 820953 - DNA, 22 bp, Artificial Sequence
  chemically synthesized
tttcatagattcttcaaaattt

SEQ ID NO: 820954 - DNA, 22 bp, Artificial Sequence
  chemically synthesized
ttcatagattcttcaaaatttt

SEQ ID NO: 820955 - DNA, 22 bp, Artificial Sequence
  chemically synthesized
tcatagattcttcaaaattttc

SEQ ID NO: 820956 - DNA, 22 bp, Artificial Sequence
  chemically synthesized
catagattcttcaaaattttct

SEQ ID NO: 820957 - DNA, 22 bp, Artificial Sequence
  chemically synthesized
atagattcttcaaaattttcta

SEQ ID NO: 820958 - DNA, 22 bp, Artificial Sequence
  chemically synthesized
ttcaaaattttctaattacaag

SEQ ID NO: 820959 - DNA, 22 bp, Artificial Sequence
  chemically synthesized
cagacaacatgaccttgtaatt

SEQ ID NO: 820960 - DNA, 22 bp, Artificial Sequence
  chemically synthesized
caaaattttctaattacaaggt

SEQ ID NO: 820961 - DNA, 22 bp, Artificial Sequence
  chemically synthesized
gcagacaacatgaccttgtaat

SEQ ID NO: 820962 - DNA, 22 bp, Artificial Sequence
  chemically synthesized
aaaattttctaattacaaggtc

SEQ ID NO: 820963 - DNA, 22 bp, Artificial Sequence
  chemically synthesized
cttgcagacaacatgaccttgt

SEQ ID NO: 820964 - DNA, 22 bp, Artificial Sequence
  chemically synthesized
tacttgcagacaacatgacctt

SEQ ID NO: 820965 - DNA, 22 bp, Artificial Sequence
  chemically synthesized
tctaattacaaggtcatgttgt

SEQ ID NO: 820966 - DNA, 22 bp, Artificial Sequence
  chemically synthesized
ctaattacaaggtcatgttgtc

SEQ ID NO: 820967 - DNA, 22 bp, Artificial Sequence
  chemically synthesized
tctctacttgcagacaacatga

SEQ ID NO: 820968 - DNA, 22 bp, Artificial Sequence
  chemically synthesized
taattacaaggtcatgttgtct

SEQ ID NO: 820969 - DNA, 22 bp, Artificial Sequence
  chemically synthesized
attacaaggtcatgttgtctgc

SEQ ID NO: 820970 - DNA, 22 bp, Artificial Sequence
  chemically synthesized
caaggtcatgttgtctgcaagt

SEQ ID NO: 820971 - DNA, 22 bp, Artificial Sequence
  chemically synthesized
tctgcaagtagagataatttta

SEQ ID NO: 820972 - DNA, 22 bp, Artificial Sequence
  chemically synthesized
gaaaggaataagtaaaattatc

SEQ ID NO: 820973 - DNA, 22 bp, Artificial Sequence
  chemically synthesized
caagtagagataattttactta

SEQ ID NO: 820974 - DNA, 22 bp, Artificial Sequence
  chemically synthesized
tacttattcctttctaatctgg

SEQ ID NO: 820975 - DNA, 22 bp, Artificial Sequence
  chemically synthesized
acttattcctttctaatctgga

SEQ ID NO: 820976 - DNA, 22 bp, Artificial Sequence
  chemically synthesized
cttattcctttctaatctggat

SEQ ID NO: 820977 - DNA, 22 bp, Artificial Sequence
  chemically synthesized
attcctttctaatctggatgtc

SEQ ID NO: 820978 - DNA, 22 bp, Artificial Sequence
  chemically synthesized
ttcctttctaatctggatgtct

SEQ ID NO: 820979 - DNA, 22 bp, Artificial Sequence
  chemically synthesized
ctttctaatctggatgtctttt

SEQ ID NO: 820980 - DNA, 22 bp, Artificial Sequence
  chemically synthesized
tctaatctggatgtcttttatt

SEQ ID NO: 820981 - DNA, 22 bp, Artificial Sequence
  chemically synthesized
ctaatctggatgtcttttattt

SEQ ID NO: 820982 - DNA, 22 bp, Artificial Sequence
  chemically synthesized
ggcaagaaaaataaataaaaga

SEQ ID NO: 820983 - DNA, 22 bp, Artificial Sequence
  chemically synthesized
taatctggatgtcttttattta

SEQ ID NO: 820984 - DNA, 22 bp, Artificial Sequence
  chemically synthesized
atctggatgtcttttatttatt

SEQ ID NO: 820985 - DNA, 22 bp, Artificial Sequence
  chemically synthesized
gatgtcttttatttatttttct

SEQ ID NO: 820986 - DNA, 22 bp, Artificial Sequence
  chemically synthesized
aggccagggaaattaggcaaga

SEQ ID NO: 820987 - DNA, 22 bp, Artificial Sequence
  chemically synthesized
ttatttatttttcttgcctaat

SEQ ID NO: 820988 - DNA, 22 bp, Artificial Sequence
  chemically synthesized
tatttatttttcttgcctaatt

SEQ ID NO: 820989 - DNA, 22 bp, Artificial Sequence
  chemically synthesized
atttatttttcttgcctaattt

SEQ ID NO: 820990 - DNA, 22 bp, Artificial Sequence
  chemically synthesized
tttatttttcttgcctaatttc

SEQ ID NO: 820991 - DNA, 22 bp, Artificial Sequence
  chemically synthesized
atttttcttgcctaatttccct

SEQ ID NO: 820992 - DNA, 22 bp, Artificial Sequence
  chemically synthesized
gaagttcaggccagggaaatta

SEQ ID NO: 820993 - DNA, 22 bp, Artificial Sequence
  chemically synthesized
tttttcttgcctaatttccctg

SEQ ID NO: 820994 - DNA, 22 bp, Artificial Sequence
  chemically synthesized
ttcttgcctaatttccctggcc

SEQ ID NO: 820995 - DNA, 22 bp, Artificial Sequence
  chemically synthesized
tcttgcctaatttccctggcct

SEQ ID NO: 820996 - DNA, 22 bp, Artificial Sequence
  chemically synthesized
tactggaagttcaggccaggga

SEQ ID NO: 820997 - DNA, 22 bp, Artificial Sequence
  chemically synthesized
cttgcctaatttccctggcctg

SEQ ID NO: 820998 - DNA, 22 bp, Artificial Sequence
  chemically synthesized
ttgcctaatttccctggcctga

SEQ ID NO: 820999 - DNA, 22 bp, Artificial Sequence
  chemically synthesized
gcctaatttccctggcctgaac

SEQ ID NO: 821000 - DNA, 22 bp, Artificial Sequence
  chemically synthesized
cctaatttccctggcctgaact

SEQ ID NO: 821001 - DNA, 22 bp, Artificial Sequence
  chemically synthesized
agtattgtactggaagttcagg

SEQ ID NO: 821002 - DNA, 22 bp, Artificial Sequence
  chemically synthesized
atttccctggcctgaacttcca

SEQ ID NO: 821003 - DNA, 22 bp, Artificial Sequence
  chemically synthesized
ttcagtattgtactggaagttc

SEQ ID NO: 821004 - DNA, 22 bp, Artificial Sequence
  chemically synthesized
tattcagtattgtactggaagt

SEQ ID NO: 821005 - DNA, 22 bp, Artificial Sequence
  chemically synthesized
ccctggcctgaacttccagtac

SEQ ID NO: 821006 - DNA, 22 bp, Artificial Sequence
  chemically synthesized
ctattcagtattgtactggaag

SEQ ID NO: 821007 - DNA, 22 bp, Artificial Sequence
  chemically synthesized
cctggcctgaacttccagtaca

SEQ ID NO: 821008 - DNA, 22 bp, Artificial Sequence
  chemically synthesized
gcctgaacttccagtacaatac

SEQ ID NO: 821009 - DNA, 22 bp, Artificial Sequence
  chemically synthesized
accacttctattcagtattgta

SEQ ID NO: 821010 - DNA, 22 bp, Artificial Sequence
  chemically synthesized
aacttccagtacaatactgaat

SEQ ID NO: 821011 - DNA, 22 bp, Artificial Sequence
  chemically synthesized
gtctcaccacttctattcagta

SEQ ID NO: 821012 - DNA, 22 bp, Artificial Sequence
  chemically synthesized
ccagtacaatactgaatagaag

SEQ ID NO: 821013 - DNA, 22 bp, Artificial Sequence
  chemically synthesized
cagtacaatactgaatagaagt

SEQ ID NO: 821014 - DNA, 22 bp, Artificial Sequence
  chemically synthesized
aatagaagtggtgagaccaggc

SEQ ID NO: 821015 - DNA, 22 bp, Artificial Sequence
  chemically synthesized
agatcaggaaatagtgaaggat

SEQ ID NO: 821016 - DNA, 22 bp, Artificial Sequence
  chemically synthesized
ccctaagatcaggaaatagtga

SEQ ID NO: 821017 - DNA, 22 bp, Artificial Sequence
  chemically synthesized
cccctaagatcaggaaatagtg

SEQ ID NO: 821018 - DNA, 22 bp, Artificial Sequence
  chemically synthesized
tcccctaagatcaggaaatagt

SEQ ID NO: 821019 - DNA, 22 bp, Artificial Sequence
  chemically synthesized
aatgctttcccctaagatcagg

SEQ ID NO: 821020 - DNA, 22 bp, Artificial Sequence
  chemically synthesized
cactatttcctgatcttagggg

SEQ ID NO: 821021 - DNA, 22 bp, Artificial Sequence
  chemically synthesized
actatttcctgatcttagggga

SEQ ID NO: 821022 - DNA, 22 bp, Artificial Sequence
  chemically synthesized
tttcctgatcttaggggaaagc

SEQ ID NO: 821023 - DNA, 22 bp, Artificial Sequence
  chemically synthesized
tgaaacactgaatgctttcccc

SEQ ID NO: 821024 - DNA, 22 bp, Artificial Sequence
  chemically synthesized
cctgatcttaggggaaagcatt

SEQ ID NO: 821025 - DNA, 22 bp, Artificial Sequence
  chemically synthesized
ctgatcttaggggaaagcattc

SEQ ID NO: 821026 - DNA, 22 bp, Artificial Sequence
  chemically synthesized
ttgtgaaacactgaatgctttc

SEQ ID NO: 821027 - DNA, 22 bp, Artificial Sequence
  chemically synthesized
atcttaggggaaagcattcagt

SEQ ID NO: 821028 - DNA, 22 bp, Artificial Sequence
  chemically synthesized
atgttattgtgaaacactgaat

SEQ ID NO: 821029 - DNA, 22 bp, Artificial Sequence
  chemically synthesized
aggggaaagcattcagtgtttc

SEQ ID NO: 821030 - DNA, 22 bp, Artificial Sequence
  chemically synthesized
ggggaaagcattcagtgtttca

SEQ ID NO: 821031 - DNA, 22 bp, Artificial Sequence
  chemically synthesized
cacagctaatgttattgtgaaa

SEQ ID NO: 821032 - DNA, 22 bp, Artificial Sequence
  chemically synthesized
agtgtttcacaataacattagc

SEQ ID NO: 821033 - DNA, 22 bp, Artificial Sequence
  chemically synthesized
caaaaattccacagctaatgtt

SEQ ID NO: 821034 - DNA, 22 bp, Artificial Sequence
  chemically synthesized
cacaataacattagctgtggaa

SEQ ID NO: 821035 - DNA, 22 bp, Artificial Sequence
  chemically synthesized
acaataacattagctgtggaat

SEQ ID NO: 821036 - DNA, 22 bp, Artificial Sequence
  chemically synthesized
ataaaaggcagctacaaaaatt

SEQ ID NO: 821037 - DNA, 22 bp, Artificial Sequence
  chemically synthesized
gctgtggaatttttgtagctgc

SEQ ID NO: 821038 - DNA, 22 bp, Artificial Sequence
  chemically synthesized
aacctgataaaaggcagctaca

SEQ ID NO: 821039 - DNA, 22 bp, Artificial Sequence
  chemically synthesized
tggaatttttgtagctgccttt

SEQ ID NO: 821040 - DNA, 22 bp, Artificial Sequence
  chemically synthesized
ctcaacctgataaaaggcagct

SEQ ID NO: 821041 - DNA, 22 bp, Artificial Sequence
  chemically synthesized
cctcaacctgataaaaggcagc

SEQ ID NO: 821042 - DNA, 22 bp, Artificial Sequence
  chemically synthesized
ttgtagctgccttttatcaggt

SEQ ID NO: 821043 - DNA, 22 bp, Artificial Sequence
  chemically synthesized
tgtagctgccttttatcaggtt

SEQ ID NO: 821044 - DNA, 22 bp, Artificial Sequence
  chemically synthesized
gtagctgccttttatcaggttg

SEQ ID NO: 821045 - DNA, 22 bp, Artificial Sequence
  chemically synthesized
tagctgccttttatcaggttga

SEQ ID NO: 821046 - DNA, 22 bp, Artificial Sequence
  chemically synthesized
ccttttatcaggttgaggaaat

SEQ ID NO: 821047 - DNA, 22 bp, Artificial Sequence
  chemically synthesized
ttatcaggttgaggaaatcctc

SEQ ID NO: 821048 - DNA, 22 bp, Artificial Sequence
  chemically synthesized
tatcaggttgaggaaatcctct

SEQ ID NO: 821049 - DNA, 22 bp, Artificial Sequence
  chemically synthesized
atcaggttgaggaaatcctctt

SEQ ID NO: 821050 - DNA, 22 bp, Artificial Sequence
  chemically synthesized
tcaggttgaggaaatcctcttc

SEQ ID NO: 821051 - DNA, 22 bp, Artificial Sequence
  chemically synthesized
aggaaatcctcttctgtattcg

SEQ ID NO: 821052 - DNA, 22 bp, Artificial Sequence
  chemically synthesized
cagaagcccgaggaaacgaata

SEQ ID NO: 821053 - DNA, 22 bp, Artificial Sequence
  chemically synthesized
attacagaagcccgaggaaacg

SEQ ID NO: 821054 - DNA, 22 bp, Artificial Sequence
  chemically synthesized
aattacagaagcccgaggaaac

SEQ ID NO: 821055 - DNA, 22 bp, Artificial Sequence
  chemically synthesized
ttctgtattcgtttcctcgggc

SEQ ID NO: 821056 - DNA, 22 bp, Artificial Sequence
  chemically synthesized
ctgtattcgtttcctcgggctt

SEQ ID NO: 821057 - DNA, 22 bp, Artificial Sequence
  chemically synthesized
tgtattcgtttcctcgggcttc

SEQ ID NO: 821058 - DNA, 22 bp, Artificial Sequence
  chemically synthesized
tattcgtttcctcgggcttctg

SEQ ID NO: 821059 - DNA, 22 bp, Artificial Sequence
  chemically synthesized
tgacacttaattacagaagccc

SEQ ID NO: 821060 - DNA, 22 bp, Artificial Sequence
  chemically synthesized
gtttcctcgggcttctgtaatt

SEQ ID NO: 821061 - DNA, 22 bp, Artificial Sequence
  chemically synthesized
cctcgggcttctgtaattaagt

SEQ ID NO: 821062 - DNA, 22 bp, Artificial Sequence
  chemically synthesized
ctcgggcttctgtaattaagtg

SEQ ID NO: 821063 - DNA, 22 bp, Artificial Sequence
  chemically synthesized
cgcaaattgtgacacttaatta

SEQ ID NO: 821064 - DNA, 22 bp, Artificial Sequence
  chemically synthesized
gggcttctgtaattaagtgtca

SEQ ID NO: 821065 - DNA, 22 bp, Artificial Sequence
  chemically synthesized
cccagctacgcaaattgtgaca

SEQ ID NO: 821066 - DNA, 22 bp, Artificial Sequence
  chemically synthesized
ctgtaattaagtgtcacaattt

SEQ ID NO: 821067 - DNA, 22 bp, Artificial Sequence
  chemically synthesized
tgtaattaagtgtcacaatttg

SEQ ID NO: 821068 - DNA, 22 bp, Artificial Sequence
  chemically synthesized
taattaagtgtcacaatttgcg

SEQ ID NO: 821069 - DNA, 22 bp, Artificial Sequence
  chemically synthesized
tctacccagctacgcaaattgt

SEQ ID NO: 821070 - DNA, 22 bp, Artificial Sequence
  chemically synthesized
gtctacccagctacgcaaattg

SEQ ID NO: 821071 - DNA, 22 bp, Artificial Sequence
  chemically synthesized
tgtctacccagctacgcaaatt

SEQ ID NO: 821072 - DNA, 22 bp, Artificial Sequence
  chemically synthesized
agtgtcacaatttgcgtagctg

SEQ ID NO: 821073 - DNA, 22 bp, Artificial Sequence
  chemically synthesized
agacaatgagttttgtctaccc

SEQ ID NO: 821074 - DNA, 22 bp, Artificial Sequence
  chemically synthesized
gcgtagctgggtagacaaaact

SEQ ID NO: 821075 - DNA, 22 bp, Artificial Sequence
  chemically synthesized
cgtagctgggtagacaaaactc

SEQ ID NO: 821076 - DNA, 22 bp, Artificial Sequence
  chemically synthesized
cagaagtctgagacaatgagtt

SEQ ID NO: 821077 - DNA, 22 bp, Artificial Sequence
  chemically synthesized
ggtagacaaaactcattgtctc

SEQ ID NO: 821078 - DNA, 22 bp, Artificial Sequence
  chemically synthesized
gcctccagaagtctgagacaat

SEQ ID NO: 821079 - DNA, 22 bp, Artificial Sequence
  chemically synthesized
gatctagcctccagaagtctga

SEQ ID NO: 821080 - DNA, 22 bp, Artificial Sequence
  chemically synthesized
ggatctagcctccagaagtctg

SEQ ID NO: 821081 - DNA, 22 bp, Artificial Sequence
  chemically synthesized
tggatctagcctccagaagtct

SEQ ID NO: 821082 - DNA, 22 bp, Artificial Sequence
  chemically synthesized
attgtctcagacttctggaggc

SEQ ID NO: 821083 - DNA, 22 bp, Artificial Sequence
  chemically synthesized
attttggatctagcctccagaa

SEQ ID NO: 821084 - DNA, 22 bp, Artificial Sequence
  chemically synthesized
gattttggatctagcctccaga

SEQ ID NO: 821085 - DNA, 22 bp, Artificial Sequence
  chemically synthesized
tctcagacttctggaggctaga

SEQ ID NO: 821086 - DNA, 22 bp, Artificial Sequence
  chemically synthesized
agacttctggaggctagatcca

SEQ ID NO: 821087 - DNA, 22 bp, Artificial Sequence
  chemically synthesized
gaatcttgattttggatctagc

SEQ ID NO: 821088 - DNA, 22 bp, Artificial Sequence
  chemically synthesized
ctggaatcttgattttggatct

SEQ ID NO: 821089 - DNA, 22 bp, Artificial Sequence
  chemically synthesized
ctggaggctagatccaaaatca

SEQ ID NO: 821090 - DNA, 22 bp, Artificial Sequence
  chemically synthesized
tggaggctagatccaaaatcaa

SEQ ID NO: 821091 - DNA, 22 bp, Artificial Sequence
  chemically synthesized
gaggctagatccaaaatcaaga

SEQ ID NO: 821092 - DNA, 22 bp, Artificial Sequence
  chemically synthesized
gatccaaaatcaagattccagc

SEQ ID NO: 821093 - DNA, 22 bp, Artificial Sequence
  chemically synthesized
agcaggagtatgggcctgctgg

SEQ ID NO: 821094 - DNA, 22 bp, Artificial Sequence
  chemically synthesized
cagcaggagtatgggcctgctg

SEQ ID NO: 821095 - DNA, 22 bp, Artificial Sequence
  chemically synthesized
caggtttcagcaggagtatggg

SEQ ID NO: 821096 - DNA, 22 bp, Artificial Sequence
  chemically synthesized
cagcaggcccatactcctgctg

SEQ ID NO: 821097 - DNA, 22 bp, Artificial Sequence
  chemically synthesized
ccctacaggtttcagcaggagt

SEQ ID NO: 821098 - DNA, 22 bp, Artificial Sequence
  chemically synthesized
tcccctacaggtttcagcagga

SEQ ID NO: 821099 - DNA, 22 bp, Artificial Sequence
  chemically synthesized
ctgctgaaacctgtaggggaga

SEQ ID NO: 821100 - DNA, 22 bp, Artificial Sequence
  chemically synthesized
ctgaaacctgtaggggagaatt

SEQ ID NO: 821101 - DNA, 22 bp, Artificial Sequence
  chemically synthesized
aaacctgtaggggagaattttt

SEQ ID NO: 821102 - DNA, 22 bp, Artificial Sequence
  chemically synthesized
taggggagaatttttccttgcc

SEQ ID NO: 821103 - DNA, 22 bp, Artificial Sequence
  chemically synthesized
gaagcaaggaagaggcaaggaa

SEQ ID NO: 821104 - DNA, 22 bp, Artificial Sequence
  chemically synthesized
ttccttgcctcttccttgcttc

SEQ ID NO: 821105 - DNA, 22 bp, Artificial Sequence
  chemically synthesized
tccttgcctcttccttgcttct

SEQ ID NO: 821106 - DNA, 22 bp, Artificial Sequence
  chemically synthesized
acggccatcattagaagcaagg

SEQ ID NO: 821107 - DNA, 22 bp, Artificial Sequence
  chemically synthesized
ccttgcctcttccttgcttcta

SEQ ID NO: 821108 - DNA, 22 bp, Artificial Sequence
  chemically synthesized
cttgcctcttccttgcttctaa

SEQ ID NO: 821109 - DNA, 22 bp, Artificial Sequence
  chemically synthesized
gcctcttccttgcttctaatga

SEQ ID NO: 821110 - DNA, 22 bp, Artificial Sequence
  chemically synthesized
cctcttccttgcttctaatgat

SEQ ID NO: 821111 - DNA, 22 bp, Artificial Sequence
  chemically synthesized
atgattaacggccatcattaga

SEQ ID NO: 821112 - DNA, 22 bp, Artificial Sequence
  chemically synthesized
ttccttgcttctaatgatggcc

SEQ ID NO: 821113 - DNA, 22 bp, Artificial Sequence
  chemically synthesized
ccttgcttctaatgatggccgt

SEQ ID NO: 821114 - DNA, 22 bp, Artificial Sequence
  chemically synthesized
cttgcttctaatgatggccgtt

SEQ ID NO: 821115 - DNA, 22 bp, Artificial Sequence
  chemically synthesized
gcttctaatgatggccgttaat

SEQ ID NO: 821116 - DNA, 22 bp, Artificial Sequence
  chemically synthesized
cttctaatgatggccgttaatc

SEQ ID NO: 821117 - DNA, 22 bp, Artificial Sequence
  chemically synthesized
ctaatgatggccgttaatcatt

SEQ ID NO: 821118 - DNA, 22 bp, Artificial Sequence
  chemically synthesized
taatgatggccgttaatcatta

SEQ ID NO: 821119 - DNA, 22 bp, Artificial Sequence
  chemically synthesized
atgatggccgttaatcattagt

SEQ ID NO: 821120 - DNA, 22 bp, Artificial Sequence
  chemically synthesized
caagacaagtaaaactaatgat

SEQ ID NO: 821121 - DNA, 22 bp, Artificial Sequence
  chemically synthesized
cagttgcaagacaagtaaaact

SEQ ID NO: 821122 - DNA, 22 bp, Artificial Sequence
  chemically synthesized
atcattagttttacttgtcttg

SEQ ID NO: 821123 - DNA, 22 bp, Artificial Sequence
  chemically synthesized
aagtgctacagttgcaagacaa

SEQ ID NO: 821124 - DNA, 22 bp, Artificial Sequence
  chemically synthesized
gttttacttgtcttgcaactgt

SEQ ID NO: 821125 - DNA, 22 bp, Artificial Sequence
  chemically synthesized
gagattaaagtgctacagttgc

SEQ ID NO: 821126 - DNA, 22 bp, Artificial Sequence
  chemically synthesized
tacttgtcttgcaactgtagca

SEQ ID NO: 821127 - DNA, 22 bp, Artificial Sequence
  chemically synthesized
acttgtcttgcaactgtagcac

SEQ ID NO: 821128 - DNA, 22 bp, Artificial Sequence
  chemically synthesized
cttgtcttgcaactgtagcact

SEQ ID NO: 821129 - DNA, 22 bp, Artificial Sequence
  chemically synthesized
cagttagagattaaagtgctac

SEQ ID NO: 821130 - DNA, 22 bp, Artificial Sequence
  chemically synthesized
gtcttgcaactgtagcacttta

SEQ ID NO: 821131 - DNA, 22 bp, Artificial Sequence
  chemically synthesized
tcttgcaactgtagcactttaa

SEQ ID NO: 821132 - DNA, 22 bp, Artificial Sequence
  chemically synthesized
gcaactgtagcactttaatctc

SEQ ID NO: 821133 - DNA, 22 bp, Artificial Sequence
  chemically synthesized
caactgtagcactttaatctct

SEQ ID NO: 821134 - DNA, 22 bp, Artificial Sequence
  chemically synthesized
tagcactttaatctctaactgt

SEQ ID NO: 821135 - DNA, 22 bp, Artificial Sequence
  chemically synthesized
taatctctaactgtaacatcac

SEQ ID NO: 821136 - DNA, 22 bp, Artificial Sequence
  chemically synthesized
aatctctaactgtaacatcaca

SEQ ID NO: 821137 - DNA, 22 bp, Artificial Sequence
  chemically synthesized
atctctaactgtaacatcacat

SEQ ID NO: 821138 - DNA, 22 bp, Artificial Sequence
  chemically synthesized
taactgtaacatcacatggtgt

SEQ ID NO: 821139 - DNA, 22 bp, Artificial Sequence
  chemically synthesized
accacgggaaaaacaccatgtg

SEQ ID NO: 821140 - DNA, 22 bp, Artificial Sequence
  chemically synthesized
actgtaacatcacatggtgttt

SEQ ID NO: 821141 - DNA, 22 bp, Artificial Sequence
  chemically synthesized
taacatcacatggtgtttttcc

SEQ ID NO: 821142 - DNA, 22 bp, Artificial Sequence
  chemically synthesized
ttcccgtggtcagtgcctttat

SEQ ID NO: 821143 - DNA, 22 bp, Artificial Sequence
  chemically synthesized
tcccgtggtcagtgcctttatg

SEQ ID NO: 821144 - DNA, 22 bp, Artificial Sequence
  chemically synthesized
cccgtggtcagtgcctttatgt

SEQ ID NO: 821145 - DNA, 22 bp, Artificial Sequence
  chemically synthesized
ccgtggtcagtgcctttatgtg

SEQ ID NO: 821146 - DNA, 22 bp, Artificial Sequence
  chemically synthesized
tatgtggcattcttctctctgt

SEQ ID NO: 821147 - DNA, 22 bp, Artificial Sequence
  chemically synthesized
atgtggcattcttctctctgtg

SEQ ID NO: 821148 - DNA, 22 bp, Artificial Sequence
  chemically synthesized
tgtggcattcttctctctgtgt

SEQ ID NO: 821149 - DNA, 22 bp, Artificial Sequence
  chemically synthesized
taagaagaggaaaagaggcata

SEQ ID NO: 821150 - DNA, 22 bp, Artificial Sequence
  chemically synthesized
ttctctctgtgtatgcctcttt

SEQ ID NO: 821151 - DNA, 22 bp, Artificial Sequence
  chemically synthesized
ataagaagaggaaaagaggcat

SEQ ID NO: 821152 - DNA, 22 bp, Artificial Sequence
  chemically synthesized
tataagaagaggaaaagaggca

SEQ ID NO: 821153 - DNA, 22 bp, Artificial Sequence
  chemically synthesized
ctctctgtgtatgcctcttttc

SEQ ID NO: 821154 - DNA, 22 bp, Artificial Sequence
  chemically synthesized
ttataagaagaggaaaagaggc

SEQ ID NO: 821155 - DNA, 22 bp, Artificial Sequence
  chemically synthesized
tctctgtgtatgcctcttttcc

SEQ ID NO: 821156 - DNA, 22 bp, Artificial Sequence
  chemically synthesized
tctgtgtatgcctcttttcctc

SEQ ID NO: 821157 - DNA, 22 bp, Artificial Sequence
  chemically synthesized
tgtgtatgcctcttttcctctt

SEQ ID NO: 821158 - DNA, 22 bp, Artificial Sequence
  chemically synthesized
tgtatgcctcttttcctcttct

SEQ ID NO: 821159 - DNA, 22 bp, Artificial Sequence
  chemically synthesized
agatggtatttttataagaaga

SEQ ID NO: 821160 - DNA, 22 bp, Artificial Sequence
  chemically synthesized
ttttcctcttcttataaaaata

SEQ ID NO: 821161 - DNA, 22 bp, Artificial Sequence
  chemically synthesized
ttcctcttcttataaaaatacc

SEQ ID NO: 821162 - DNA, 22 bp, Artificial Sequence
  chemically synthesized
tcctcttcttataaaaatacca

SEQ ID NO: 821163 - DNA, 22 bp, Artificial Sequence
  chemically synthesized
cctcttcttataaaaataccat

SEQ ID NO: 821164 - DNA, 22 bp, Artificial Sequence
  chemically synthesized
ctcttcttataaaaataccatc

SEQ ID NO: 821165 - DNA, 22 bp, Artificial Sequence
  chemically synthesized
ttcttataaaaataccatctta

SEQ ID NO: 821166 - DNA, 22 bp, Artificial Sequence
  chemically synthesized
cttataaaaataccatcttaac

SEQ ID NO: 821167 - DNA, 22 bp, Artificial Sequence
  chemically synthesized
ttataaaaataccatcttaact

SEQ ID NO: 821168 - DNA, 22 bp, Artificial Sequence
  chemically synthesized
cagatgcagtcaagttaagatg

SEQ ID NO: 821169 - DNA, 22 bp, Artificial Sequence
  chemically synthesized
gcagatgcagtcaagttaagat

SEQ ID NO: 821170 - DNA, 22 bp, Artificial Sequence
  chemically synthesized
ataaaaataccatcttaacttg

SEQ ID NO: 821171 - DNA, 22 bp, Artificial Sequence
  chemically synthesized
tgcagatgcagtcaagttaaga

SEQ ID NO: 821172 - DNA, 22 bp, Artificial Sequence
  chemically synthesized
taaaaataccatcttaacttga

SEQ ID NO: 821173 - DNA, 22 bp, Artificial Sequence
  chemically synthesized
aacttgactgcatctgcaaaga

SEQ ID NO: 821174 - DNA, 22 bp, Artificial Sequence
  chemically synthesized
acttgactgcatctgcaaagac

SEQ ID NO: 821175 - DNA, 22 bp, Artificial Sequence
  chemically synthesized
tgtagaaatagagtctttgcag

SEQ ID NO: 821176 - DNA, 22 bp, Artificial Sequence
  chemically synthesized
atgtagaaatagagtctttgca

SEQ ID NO: 821177 - DNA, 22 bp, Artificial Sequence
  chemically synthesized
gactgcatctgcaaagactcta

SEQ ID NO: 821178 - DNA, 22 bp, Artificial Sequence
  chemically synthesized
actgcatctgcaaagactctat

SEQ ID NO: 821179 - DNA, 22 bp, Artificial Sequence
  chemically synthesized
catctgcaaagactctatttct

SEQ ID NO: 821180 - DNA, 22 bp, Artificial Sequence
  chemically synthesized
caaatgtgaccttatgtagaaa

SEQ ID NO: 821181 - DNA, 22 bp, Artificial Sequence
  chemically synthesized
caaagactctatttctacataa

SEQ ID NO: 821182 - DNA, 22 bp, Artificial Sequence
  chemically synthesized
tatttctacataaggtcacatt

SEQ ID NO: 821183 - DNA, 22 bp, Artificial Sequence
  chemically synthesized
tttctacataaggtcacatttg

SEQ ID NO: 821184 - DNA, 22 bp, Artificial Sequence
  chemically synthesized
agcccaggtatctgcaaatgtg

SEQ ID NO: 821185 - DNA, 22 bp, Artificial Sequence
  chemically synthesized
ctacataaggtcacatttgcag

SEQ ID NO: 821186 - DNA, 22 bp, Artificial Sequence
  chemically synthesized
tacataaggtcacatttgcaga

SEQ ID NO: 821187 - DNA, 22 bp, Artificial Sequence
  chemically synthesized
cataaggtcacatttgcagata

SEQ ID NO: 821188 - DNA, 22 bp, Artificial Sequence
  chemically synthesized
aaagcctgagcccaggtatctg

SEQ ID NO: 821189 - DNA, 22 bp, Artificial Sequence
  chemically synthesized
gcagatacctgggctcaggctt

SEQ ID NO: 821190 - DNA, 22 bp, Artificial Sequence
  chemically synthesized
cagatacctgggctcaggcttt

SEQ ID NO: 821191 - DNA, 22 bp, Artificial Sequence
  chemically synthesized
ccaaaagacatactaaaagcct

SEQ ID NO: 821192 - DNA, 22 bp, Artificial Sequence
  chemically synthesized
ggctcaggcttttagtatgtct

SEQ ID NO: 821193 - DNA, 22 bp, Artificial Sequence
  chemically synthesized
aggcttttagtatgtcttttgg

SEQ ID NO: 821194 - DNA, 22 bp, Artificial Sequence
  chemically synthesized
aatagtgtcccccgctcccaaa

SEQ ID NO: 821195 - DNA, 22 bp, Artificial Sequence
  chemically synthesized
ttagtatgtcttttgggagcgg

SEQ ID NO: 821196 - DNA, 22 bp, Artificial Sequence
  chemically synthesized
tagtatgtcttttgggagcggg

SEQ ID NO: 821197 - DNA, 22 bp, Artificial Sequence
  chemically synthesized
agtatgtcttttgggagcgggg

SEQ ID NO: 821198 - DNA, 22 bp, Artificial Sequence
  chemically synthesized
gtatgtcttttgggagcggggg

SEQ ID NO: 821199 - DNA, 22 bp, Artificial Sequence
  chemically synthesized
tggattgaatagtgtcccccgc

SEQ ID NO: 821200 - DNA, 22 bp, Artificial Sequence
  chemically synthesized
gtggattgaatagtgtcccccg

SEQ ID NO: 821201 - DNA, 22 bp, Artificial Sequence
  chemically synthesized
tgtggattgaatagtgtccccc

SEQ ID NO: 821202 - DNA, 22 bp, Artificial Sequence
  chemically synthesized
ttgggagcgggggacactattc

SEQ ID NO: 821203 - DNA, 22 bp, Artificial Sequence
  chemically synthesized
tgggagcgggggacactattca

SEQ ID NO: 821204 - DNA, 22 bp, Artificial Sequence
  chemically synthesized
gggagcgggggacactattcaa

SEQ ID NO: 821205 - DNA, 22 bp, Artificial Sequence
  chemically synthesized
ggagcgggggacactattcaat

SEQ ID NO: 821206 - DNA, 22 bp, Artificial Sequence
  chemically synthesized
ttcaatccacaaaaccttcttt

SEQ ID NO: 821207 - DNA, 22 bp, Artificial Sequence
  chemically synthesized
aaaaaaaaaaaaaaaagaaggt

SEQ ID NO: 821208 - DNA, 22 bp, Artificial Sequence
  chemically synthesized
aatccacaaaaccttctttttt

SEQ ID NO: 821209 - DNA, 22 bp, Artificial Sequence
  chemically synthesized
cgtctaaaaaaaaaaaaaaaaa

SEQ ID NO: 821210 - DNA, 22 bp, Artificial Sequence
  chemically synthesized
ctttttttttttttttttagac

SEQ ID NO: 821211 - DNA, 22 bp, Artificial Sequence
  chemically synthesized
tttttttttttttttttagacg

SEQ ID NO: 821212 - DNA, 22 bp, Artificial Sequence
  chemically synthesized
tttttttttttttttagacgga

SEQ ID NO: 821213 - DNA, 22 bp, Artificial Sequence
  chemically synthesized
ttttttttttttttagacggag

SEQ ID NO: 821214 - DNA, 22 bp, Artificial Sequence
  chemically synthesized
tttttttttttttagacggagt

SEQ ID NO: 821215 - DNA, 22 bp, Artificial Sequence
  chemically synthesized
ttttttttttttagacggagtc

SEQ ID NO: 821216 - DNA, 22 bp, Artificial Sequence
  chemically synthesized
tttttttttttagacggagtct

SEQ ID NO: 821217 - DNA, 22 bp, Artificial Sequence
  chemically synthesized
ggcgaaagagcgagactccgtc

SEQ ID NO: 821218 - DNA, 22 bp, Artificial Sequence
  chemically synthesized
ttttttttttagacggagtctc

SEQ ID NO: 821219 - DNA, 22 bp, Artificial Sequence
  chemically synthesized
tttttttttagacggagtctcg

SEQ ID NO: 821220 - DNA, 22 bp, Artificial Sequence
  chemically synthesized
ttttttttagacggagtctcgc

SEQ ID NO: 821221 - DNA, 22 bp, Artificial Sequence
  chemically synthesized
tttttttagacggagtctcgct

SEQ ID NO: 821222 - DNA, 22 bp, Artificial Sequence
  chemically synthesized
ttttttagacggagtctcgctc

SEQ ID NO: 821223 - DNA, 22 bp, Artificial Sequence
  chemically synthesized
tttttagacggagtctcgctct

SEQ ID NO: 821224 - DNA, 22 bp, Artificial Sequence
  chemically synthesized
ttttagacggagtctcgctctt

SEQ ID NO: 821225 - DNA, 22 bp, Artificial Sequence
  chemically synthesized
tttagacggagtctcgctcttt

SEQ ID NO: 821226 - DNA, 22 bp, Artificial Sequence
  chemically synthesized
ttagacggagtctcgctctttc

SEQ ID NO: 821227 - DNA, 22 bp, Artificial Sequence
  chemically synthesized
tagacggagtctcgctctttcg

SEQ ID NO: 821228 - DNA, 22 bp, Artificial Sequence
  chemically synthesized
agacggagtctcgctctttcgc

SEQ ID NO: 821229 - DNA, 22 bp, Artificial Sequence
  chemically synthesized
gacggagtctcgctctttcgcc

SEQ ID NO: 821230 - DNA, 22 bp, Artificial Sequence
  chemically synthesized
cagtccggcctgggcgaaagag

SEQ ID NO: 821231 - DNA, 22 bp, Artificial Sequence
  chemically synthesized
gctctttcgcccaggccggact

SEQ ID NO: 821232 - DNA, 22 bp, Artificial Sequence
  chemically synthesized
tttcgcccaggccggactgcag

SEQ ID NO: 821233 - DNA, 22 bp, Artificial Sequence
  chemically synthesized
tcgcccaggccggactgcagtg

SEQ ID NO: 821234 - DNA, 22 bp, Artificial Sequence
  chemically synthesized
cgcccaggccggactgcagtgc

SEQ ID NO: 821235 - DNA, 22 bp, Artificial Sequence
  chemically synthesized
gcccaggccggactgcagtgct

SEQ ID NO: 821236 - DNA, 22 bp, Artificial Sequence
  chemically synthesized
cagtgagccgagacagcagcac

SEQ ID NO: 821237 - DNA, 22 bp, Artificial Sequence
  chemically synthesized
gcagtgagccgagacagcagca

SEQ ID NO: 821238 - DNA, 22 bp, Artificial Sequence
  chemically synthesized
cagtgctgctgtctcggctcac

SEQ ID NO: 821239 - DNA, 22 bp, Artificial Sequence
  chemically synthesized
gaggcagagtttgcagtgagcc

SEQ ID NO: 821240 - DNA, 22 bp, Artificial Sequence
  chemically synthesized
ctgtctcggctcactgcaaact

SEQ ID NO: 821241 - DNA, 22 bp, Artificial Sequence
  chemically synthesized
tctcggctcactgcaaactctg

SEQ ID NO: 821242 - DNA, 22 bp, Artificial Sequence
  chemically synthesized
ggctcactgcaaactctgcctc

SEQ ID NO: 821243 - DNA, 22 bp, Artificial Sequence
  chemically synthesized
actgcaaactctgcctccaggg

SEQ ID NO: 821244 - DNA, 22 bp, Artificial Sequence
  chemically synthesized
caaactctgcctccagggttcg

SEQ ID NO: 821245 - DNA, 22 bp, Artificial Sequence
  chemically synthesized
aggcaggagaatggcgcgaacc

SEQ ID NO: 821246 - DNA, 22 bp, Artificial Sequence
  chemically synthesized
tgcctccagggttcgcgccatt

SEQ ID NO: 821247 - DNA, 22 bp, Artificial Sequence
  chemically synthesized
cctccagggttcgcgccattct

SEQ ID NO: 821248 - DNA, 22 bp, Artificial Sequence
  chemically synthesized
cagggttcgcgccattctcctg

SEQ ID NO: 821249 - DNA, 22 bp, Artificial Sequence
  chemically synthesized
aggaggctgaggcaggagaatg

SEQ ID NO: 821250 - DNA, 22 bp, Artificial Sequence
  chemically synthesized
ctcaggaggctgaggcaggaga

SEQ ID NO: 821251 - DNA, 22 bp, Artificial Sequence
  chemically synthesized
gcgccattctcctgcctcagcc

SEQ ID NO: 821252 - DNA, 22 bp, Artificial Sequence
  chemically synthesized
tagtcccagctactcaggaggc

SEQ ID NO: 821253 - DNA, 22 bp, Artificial Sequence
  chemically synthesized
tcctgcctcagcctcctgagta

SEQ ID NO: 821254 - DNA, 22 bp, Artificial Sequence
  chemically synthesized
ctgcctcagcctcctgagtagc

SEQ ID NO: 821255 - DNA, 22 bp, Artificial Sequence
  chemically synthesized
cctcagcctcctgagtagctgg

SEQ ID NO: 821256 - DNA, 22 bp, Artificial Sequence
  chemically synthesized
agcctcctgagtagctgggact

SEQ ID NO: 821257 - DNA, 22 bp, Artificial Sequence
  chemically synthesized
ctgagtagctgggactacaggc

SEQ ID NO: 821258 - DNA, 22 bp, Artificial Sequence
  chemically synthesized
agtagctgggactacaggcgcc

SEQ ID NO: 821259 - DNA, 22 bp, Artificial Sequence
  chemically synthesized
ggcacggtggcgggcgcctgta

SEQ ID NO: 821260 - DNA, 22 bp, Artificial Sequence
  chemically synthesized
gctgggcacggtggcgggcgcc

SEQ ID NO: 821261 - DNA, 22 bp, Artificial Sequence
  chemically synthesized
ggactacaggcgcccgccaccg

SEQ ID NO: 821262 - DNA, 22 bp, Artificial Sequence
  chemically synthesized
caggcgcccgccaccgtgccca

SEQ ID NO: 821263 - DNA, 22 bp, Artificial Sequence
  chemically synthesized
aaaatacaaaaaattagctggg

SEQ ID NO: 821264 - DNA, 22 bp, Artificial Sequence
  chemically synthesized
ctaaaaatacaaaaaattagct

SEQ ID NO: 821265 - DNA, 22 bp, Artificial Sequence
  chemically synthesized
tgctaaaaatacaaaaaattag

SEQ ID NO: 821266 - DNA, 22 bp, Artificial Sequence
  chemically synthesized
attttttgtatttttagcagag

SEQ ID NO: 821267 - DNA, 22 bp, Artificial Sequence
  chemically synthesized
tttgtatttttagcagagacgg

SEQ ID NO: 821268 - DNA, 22 bp, Artificial Sequence
  chemically synthesized
ttgtatttttagcagagacggg

SEQ ID NO: 821269 - DNA, 22 bp, Artificial Sequence
  chemically synthesized
acacggtaaaaccccgtctctg

SEQ ID NO: 821270 - DNA, 22 bp, Artificial Sequence
  chemically synthesized
tgtatttttagcagagacgggg

SEQ ID NO: 821271 - DNA, 22 bp, Artificial Sequence
  chemically synthesized
gtatttttagcagagacggggt

SEQ ID NO: 821272 - DNA, 22 bp, Artificial Sequence
  chemically synthesized
tatttttagcagagacggggtt

SEQ ID NO: 821273 - DNA, 22 bp, Artificial Sequence
  chemically synthesized
gctaacacggtaaaaccccgtc

SEQ ID NO: 821274 - DNA, 22 bp, Artificial Sequence
  chemically synthesized
ttagcagagacggggttttacc

SEQ ID NO: 821275 - DNA, 22 bp, Artificial Sequence
  chemically synthesized
tagcagagacggggttttaccg

SEQ ID NO: 821276 - DNA, 22 bp, Artificial Sequence
  chemically synthesized
agcagagacggggttttaccgt

SEQ ID NO: 821277 - DNA, 22 bp, Artificial Sequence
  chemically synthesized
gcagagacggggttttaccgtg

SEQ ID NO: 821278 - DNA, 22 bp, Artificial Sequence
  chemically synthesized
agaccatcctggctaacacggt

SEQ ID NO: 821279 - DNA, 22 bp, Artificial Sequence
  chemically synthesized
taccgtgttagccaggatggtc

SEQ ID NO: 821280 - DNA, 22 bp, Artificial Sequence
  chemically synthesized
accgtgttagccaggatggtct

SEQ ID NO: 821281 - DNA, 22 bp, Artificial Sequence
  chemically synthesized
ccgtgttagccaggatggtctc

SEQ ID NO: 821282 - DNA, 22 bp, Artificial Sequence
  chemically synthesized
gccaggatggtctcaatctcct

SEQ ID NO: 821283 - DNA, 22 bp, Artificial Sequence
  chemically synthesized
gatcacgaggtcaggagattga

SEQ ID NO: 821284 - DNA, 22 bp, Artificial Sequence
  chemically synthesized
aatctcctgacctcgtgatcca

SEQ ID NO: 821285 - DNA, 22 bp, Artificial Sequence
  chemically synthesized
ggaggccgaggcagttggatca

SEQ ID NO: 821286 - DNA, 22 bp, Artificial Sequence
  chemically synthesized
gggaggccgaggcagttggatc

SEQ ID NO: 821287 - DNA, 22 bp, Artificial Sequence
  chemically synthesized
tgggaggccgaggcagttggat

SEQ ID NO: 821288 - DNA, 22 bp, Artificial Sequence
  chemically synthesized
ctgacctcgtgatccaactgcc

SEQ ID NO: 821289 - DNA, 22 bp, Artificial Sequence
  chemically synthesized
acctcgtgatccaactgcctcg

SEQ ID NO: 821290 - DNA, 22 bp, Artificial Sequence
  chemically synthesized
gtgatccaactgcctcggcctc

SEQ ID NO: 821291 - DNA, 22 bp, Artificial Sequence
  chemically synthesized
taatcccagcactttgggaggc

SEQ ID NO: 821292 - DNA, 22 bp, Artificial Sequence
  chemically synthesized
cctcggcctcccaaagtgctgg

SEQ ID NO: 821293 - DNA, 22 bp, Artificial Sequence
  chemically synthesized
acgcctgtaatcccagcacttt

SEQ ID NO: 821294 - DNA, 22 bp, Artificial Sequence
  chemically synthesized
ggcctcccaaagtgctgggatt

SEQ ID NO: 821295 - DNA, 22 bp, Artificial Sequence
  chemically synthesized
ccaaagtgctgggattacaggc

SEQ ID NO: 821296 - DNA, 22 bp, Artificial Sequence
  chemically synthesized
gccaggtgtggtggctcacgcc

SEQ ID NO: 821297 - DNA, 22 bp, Artificial Sequence
  chemically synthesized
ggattacaggcgtgagccacca

SEQ ID NO: 821298 - DNA, 22 bp, Artificial Sequence
  chemically synthesized
caggcgtgagccaccacacctg

SEQ ID NO: 821299 - DNA, 22 bp, Artificial Sequence
  chemically synthesized
acaaatgaagaatagaaggtat

SEQ ID NO: 821300 - DNA, 22 bp, Artificial Sequence
  chemically synthesized
aacaaatgaagaatagaaggta

SEQ ID NO: 821301 - DNA, 22 bp, Artificial Sequence
  chemically synthesized
gccaataccttctattcttcat

SEQ ID NO: 821302 - DNA, 22 bp, Artificial Sequence
  chemically synthesized
aaaaataaagaacacttaacaa

SEQ ID NO: 821303 - DNA, 22 bp, Artificial Sequence
  chemically synthesized
ctattcttcatttgttaagtgt

SEQ ID NO: 821304 - DNA, 22 bp, Artificial Sequence
  chemically synthesized
gaaaaataaagaacacttaaca

SEQ ID NO: 821305 - DNA, 22 bp, Artificial Sequence
  chemically synthesized
tattcttcatttgttaagtgtt

SEQ ID NO: 821306 - DNA, 22 bp, Artificial Sequence
  chemically synthesized
ttcttcatttgttaagtgttct

SEQ ID NO: 821307 - DNA, 22 bp, Artificial Sequence
  chemically synthesized
ttcatttgttaagtgttcttta

SEQ ID NO: 821308 - DNA, 22 bp, Artificial Sequence
  chemically synthesized
aagcttgaaaaataaagaacac

SEQ ID NO: 821309 - DNA, 22 bp, Artificial Sequence
  chemically synthesized
caagcttgaaaaataaagaaca

SEQ ID NO: 821310 - DNA, 22 bp, Artificial Sequence
  chemically synthesized
catttgttaagtgttctttatt

SEQ ID NO: 821311 - DNA, 22 bp, Artificial Sequence
  chemically synthesized
tcaagcttgaaaaataaagaac

SEQ ID NO: 821312 - DNA, 22 bp, Artificial Sequence
  chemically synthesized
atttgttaagtgttctttattt

SEQ ID NO: 821313 - DNA, 22 bp, Artificial Sequence
  chemically synthesized
gttaagtgttctttatttttca

SEQ ID NO: 821314 - DNA, 22 bp, Artificial Sequence
  chemically synthesized
ttaagtgttctttatttttcaa

SEQ ID NO: 821315 - DNA, 22 bp, Artificial Sequence
  chemically synthesized
agtgttctttatttttcaagct

SEQ ID NO: 821316 - DNA, 22 bp, Artificial Sequence
  chemically synthesized
tttatttttcaagcttgaaagg

SEQ ID NO: 821317 - DNA, 22 bp, Artificial Sequence
  chemically synthesized
tatttttcaagcttgaaagggt

SEQ ID NO: 821318 - DNA, 22 bp, Artificial Sequence
  chemically synthesized
atttttcaagcttgaaagggtt

SEQ ID NO: 821319 - DNA, 22 bp, Artificial Sequence
  chemically synthesized
tttttcaagcttgaaagggttt

SEQ ID NO: 821320 - DNA, 22 bp, Artificial Sequence
  chemically synthesized
ttcaagcttgaaagggttttgt

SEQ ID NO: 821321 - DNA, 22 bp, Artificial Sequence
  chemically synthesized
atgtgacaaagtacaaaaccct

SEQ ID NO: 821322 - DNA, 22 bp, Artificial Sequence
  chemically synthesized
tcaagcttgaaagggttttgta

SEQ ID NO: 821323 - DNA, 22 bp, Artificial Sequence
  chemically synthesized
caagcttgaaagggttttgtac

SEQ ID NO: 821324 - DNA, 22 bp, Artificial Sequence
  chemically synthesized
aagcttgaaagggttttgtact

SEQ ID NO: 821325 - DNA, 22 bp, Artificial Sequence
  chemically synthesized
gaaagggttttgtactttgtca

SEQ ID NO: 821326 - DNA, 22 bp, Artificial Sequence
  chemically synthesized
aaagggttttgtactttgtcac

SEQ ID NO: 821327 - DNA, 22 bp, Artificial Sequence
  chemically synthesized
tgtactttgtcacatgaatttt

SEQ ID NO: 821328 - DNA, 22 bp, Artificial Sequence
  chemically synthesized
gtactttgtcacatgaattttc

SEQ ID NO: 821329 - DNA, 22 bp, Artificial Sequence
  chemically synthesized
tactttgtcacatgaattttct

SEQ ID NO: 821330 - DNA, 22 bp, Artificial Sequence
  chemically synthesized
tgtcacatgaattttctatatt

SEQ ID NO: 821331 - DNA, 22 bp, Artificial Sequence
  chemically synthesized
gtcacatgaattttctatattt

SEQ ID NO: 821332 - DNA, 22 bp, Artificial Sequence
  chemically synthesized
tcacatgaattttctatattta

SEQ ID NO: 821333 - DNA, 22 bp, Artificial Sequence
  chemically synthesized
tctatatttattgtgatgacca

SEQ ID NO: 821334 - DNA, 22 bp, Artificial Sequence
  chemically synthesized
ctatatttattgtgatgaccat

SEQ ID NO: 821335 - DNA, 22 bp, Artificial Sequence
  chemically synthesized
tatatttattgtgatgaccata

SEQ ID NO: 821336 - DNA, 22 bp, Artificial Sequence
  chemically synthesized
tatttattgtgatgaccatacg

SEQ ID NO: 821337 - DNA, 22 bp, Artificial Sequence
  chemically synthesized
attgtgatgaccatacgatttt

SEQ ID NO: 821338 - DNA, 22 bp, Artificial Sequence
  chemically synthesized
ttgtgatgaccatacgattttt

SEQ ID NO: 821339 - DNA, 22 bp, Artificial Sequence
  chemically synthesized
tgatgaccatacgatttttgtc

SEQ ID NO: 821340 - DNA, 22 bp, Artificial Sequence
  chemically synthesized
taccatatcaatagaataaagg

SEQ ID NO: 821341 - DNA, 22 bp, Artificial Sequence
  chemically synthesized
ttgtcctttattctattgatat

SEQ ID NO: 821342 - DNA, 22 bp, Artificial Sequence
  chemically synthesized
tgtcctttattctattgatatg

SEQ ID NO: 821343 - DNA, 22 bp, Artificial Sequence
  chemically synthesized
gtcctttattctattgatatgg

SEQ ID NO: 821344 - DNA, 22 bp, Artificial Sequence
  chemically synthesized
tcctttattctattgatatggt

SEQ ID NO: 821345 - DNA, 22 bp, Artificial Sequence
  chemically synthesized
atcaatgtattataccatatca

SEQ ID NO: 821346 - DNA, 22 bp, Artificial Sequence
  chemically synthesized
aatcaatgtattataccatatc

SEQ ID NO: 821347 - DNA, 22 bp, Artificial Sequence
  chemically synthesized
tattctattgatatggtataat

SEQ ID NO: 821348 - DNA, 22 bp, Artificial Sequence
  chemically synthesized
attctattgatatggtataata

SEQ ID NO: 821349 - DNA, 22 bp, Artificial Sequence
  chemically synthesized
ttctattgatatggtataatac

SEQ ID NO: 821350 - DNA, 22 bp, Artificial Sequence
  chemically synthesized
tattgatatggtataatacatt

SEQ ID NO: 821351 - DNA, 22 bp, Artificial Sequence
  chemically synthesized
ttgatatggtataatacattga

SEQ ID NO: 821352 - DNA, 22 bp, Artificial Sequence
  chemically synthesized
atatggtataatacattgatta

SEQ ID NO: 821353 - DNA, 22 bp, Artificial Sequence
  chemically synthesized
acatccaaaatttaatcaatgt

SEQ ID NO: 821354 - DNA, 22 bp, Artificial Sequence
  chemically synthesized
aacatccaaaatttaatcaatg

SEQ ID NO: 821355 - DNA, 22 bp, Artificial Sequence
  chemically synthesized
gtttaacatccaaaatttaatc

SEQ ID NO: 821356 - DNA, 22 bp, Artificial Sequence
  chemically synthesized
attaaattttggatgttaaacc

SEQ ID NO: 821357 - DNA, 22 bp, Artificial Sequence
  chemically synthesized
aattttggatgttaaaccaacc

SEQ ID NO: 821358 - DNA, 22 bp, Artificial Sequence
  chemically synthesized
tcacaggaatgtaaggttggtt

SEQ ID NO: 821359 - DNA, 22 bp, Artificial Sequence
  chemically synthesized
atcacaggaatgtaaggttggt

SEQ ID NO: 821360 - DNA, 22 bp, Artificial Sequence
  chemically synthesized
tggatgttaaaccaaccttaca

SEQ ID NO: 821361 - DNA, 22 bp, Artificial Sequence
  chemically synthesized
ggatgttaaaccaaccttacat

SEQ ID NO: 821362 - DNA, 22 bp, Artificial Sequence
  chemically synthesized
gatgttaaaccaaccttacatt

SEQ ID NO: 821363 - DNA, 22 bp, Artificial Sequence
  chemically synthesized
aaccaaccttacattcctgtga

SEQ ID NO: 821364 - DNA, 22 bp, Artificial Sequence
  chemically synthesized
ccataaccaggtaagatttatc

SEQ ID NO: 821365 - DNA, 22 bp, Artificial Sequence
  chemically synthesized
acattcctgtgataaatcttac

SEQ ID NO: 821366 - DNA, 22 bp, Artificial Sequence
  chemically synthesized
cattcctgtgataaatcttacc

SEQ ID NO: 821367 - DNA, 22 bp, Artificial Sequence
  chemically synthesized
ctaccataaccaggtaagattt

SEQ ID NO: 821368 - DNA, 22 bp, Artificial Sequence
  chemically synthesized
ctgtgataaatcttacctggtt

SEQ ID NO: 821369 - DNA, 22 bp, Artificial Sequence
  chemically synthesized
tgataaatcttacctggttatg

SEQ ID NO: 821370 - DNA, 22 bp, Artificial Sequence
  chemically synthesized
acatgattgctaccataaccag

SEQ ID NO: 821371 - DNA, 22 bp, Artificial Sequence
  chemically synthesized
acctggttatggtagcaatcat

SEQ ID NO: 821372 - DNA, 22 bp, Artificial Sequence
  chemically synthesized
cctggttatggtagcaatcatg

SEQ ID NO: 821373 - DNA, 22 bp, Artificial Sequence
  chemically synthesized
gttatggtagcaatcatgttaa

SEQ ID NO: 821374 - DNA, 22 bp, Artificial Sequence
  chemically synthesized
atacaacaacatattaacatga

SEQ ID NO: 821375 - DNA, 22 bp, Artificial Sequence
  chemically synthesized
tggtagcaatcatgttaatatg

SEQ ID NO: 821376 - DNA, 22 bp, Artificial Sequence
  chemically synthesized
tcaaacctaatacaacaacata

SEQ ID NO: 821377 - DNA, 22 bp, Artificial Sequence
  chemically synthesized
aaaaaattatcaaacctaatac

SEQ ID NO: 821378 - DNA, 22 bp, Artificial Sequence
  chemically synthesized
atatgttgttgtattaggtttg

SEQ ID NO: 821379 - DNA, 22 bp, Artificial Sequence
  chemically synthesized
aaacgcctcaaaaaattatcaa

SEQ ID NO: 821380 - DNA, 22 bp, Artificial Sequence
  chemically synthesized
ttgtattaggtttgataatttt

SEQ ID NO: 821381 - DNA, 22 bp, Artificial Sequence
  chemically synthesized
gaaacgcctcaaaaaattatca

SEQ ID NO: 821382 - DNA, 22 bp, Artificial Sequence
  chemically synthesized
tattaggtttgataattttttg

SEQ ID NO: 821383 - DNA, 22 bp, Artificial Sequence
  chemically synthesized
ggtttgataattttttgaggcg

SEQ ID NO: 821384 - DNA, 22 bp, Artificial Sequence
  chemically synthesized
gataattttttgaggcgtttca

SEQ ID NO: 821385 - DNA, 22 bp, Artificial Sequence
  chemically synthesized
tgaatatagacttgaaacgcct

SEQ ID NO: 821386 - DNA, 22 bp, Artificial Sequence
  chemically synthesized
ataattttttgaggcgtttcaa

SEQ ID NO: 821387 - DNA, 22 bp, Artificial Sequence
  chemically synthesized
atgaatatagacttgaaacgcc

SEQ ID NO: 821388 - DNA, 22 bp, Artificial Sequence
  chemically synthesized
tttgaggcgtttcaagtctata

SEQ ID NO: 821389 - DNA, 22 bp, Artificial Sequence
  chemically synthesized
ttgaggcgtttcaagtctatat

SEQ ID NO: 821390 - DNA, 22 bp, Artificial Sequence
  chemically synthesized
tgaggcgtttcaagtctatatt

SEQ ID NO: 821391 - DNA, 22 bp, Artificial Sequence
  chemically synthesized
gaggcgtttcaagtctatattc

SEQ ID NO: 821392 - DNA, 22 bp, Artificial Sequence
  chemically synthesized
aggcgtttcaagtctatattca

SEQ ID NO: 821393 - DNA, 22 bp, Artificial Sequence
  chemically synthesized
cagagcaatatgccttatgaat

SEQ ID NO: 821394 - DNA, 22 bp, Artificial Sequence
  chemically synthesized
caagtctatattcataaggcat

SEQ ID NO: 821395 - DNA, 22 bp, Artificial Sequence
  chemically synthesized
aagtctatattcataaggcata

SEQ ID NO: 821396 - DNA, 22 bp, Artificial Sequence
  chemically synthesized
tattcataaggcatattgctct

SEQ ID NO: 821397 - DNA, 22 bp, Artificial Sequence
  chemically synthesized
ataaggcatattgctctgtagc

SEQ ID NO: 821398 - DNA, 22 bp, Artificial Sequence
  chemically synthesized
ctctgtagcttgttttcttgtg

SEQ ID NO: 821399 - DNA, 22 bp, Artificial Sequence
  chemically synthesized
tgtagcttgttttcttgtgata

SEQ ID NO: 821400 - DNA, 22 bp, Artificial Sequence
  chemically synthesized
accagacaaagatatcacaaga

SEQ ID NO: 821401 - DNA, 22 bp, Artificial Sequence
  chemically synthesized
tagcttgttttcttgtgatatc

SEQ ID NO: 821402 - DNA, 22 bp, Artificial Sequence
  chemically synthesized
ctaaccagacaaagatatcaca

SEQ ID NO: 821403 - DNA, 22 bp, Artificial Sequence
  chemically synthesized
cctaaccagacaaagatatcac

SEQ ID NO: 821404 - DNA, 22 bp, Artificial Sequence
  chemically synthesized
gttttcttgtgatatctttgtc

SEQ ID NO: 821405 - DNA, 22 bp, Artificial Sequence
  chemically synthesized
ttttcttgtgatatctttgtct

SEQ ID NO: 821406 - DNA, 22 bp, Artificial Sequence
  chemically synthesized
tcttgtgatatctttgtctggt

SEQ ID NO: 821407 - DNA, 22 bp, Artificial Sequence
  chemically synthesized
cttgtgatatctttgtctggtt

SEQ ID NO: 821408 - DNA, 22 bp, Artificial Sequence
  chemically synthesized
ttgtgatatctttgtctggtta

SEQ ID NO: 821409 - DNA, 22 bp, Artificial Sequence
  chemically synthesized
gtgatatctttgtctggttagg

SEQ ID NO: 821410 - DNA, 22 bp, Artificial Sequence
  chemically synthesized
tgatatctttgtctggttagga

SEQ ID NO: 821411 - DNA, 22 bp, Artificial Sequence
  chemically synthesized
tgtctggttaggaagtgttcct

SEQ ID NO: 821412 - DNA, 22 bp, Artificial Sequence
  chemically synthesized
gtctggttaggaagtgttcctt

SEQ ID NO: 821413 - DNA, 22 bp, Artificial Sequence
  chemically synthesized
tctggttaggaagtgttccttt

SEQ ID NO: 821414 - DNA, 22 bp, Artificial Sequence
  chemically synthesized
caaaaaatagaagagaaaggaa

SEQ ID NO: 821415 - DNA, 22 bp, Artificial Sequence
  chemically synthesized
gttaggaagtgttcctttctct

SEQ ID NO: 821416 - DNA, 22 bp, Artificial Sequence
  chemically synthesized
ccaaaaaatagaagagaaagga

SEQ ID NO: 821417 - DNA, 22 bp, Artificial Sequence
  chemically synthesized
ttccaaaaaatagaagagaaag

SEQ ID NO: 821418 - DNA, 22 bp, Artificial Sequence
  chemically synthesized
ggaagtgttcctttctcttcta

SEQ ID NO: 821419 - DNA, 22 bp, Artificial Sequence
  chemically synthesized
ctttctcttctattttttggaa

SEQ ID NO: 821420 - DNA, 22 bp, Artificial Sequence
  chemically synthesized
tctcttctattttttggaagag

SEQ ID NO: 821421 - DNA, 22 bp, Artificial Sequence
  chemically synthesized
ctcttctattttttggaagagt

SEQ ID NO: 821422 - DNA, 22 bp, Artificial Sequence
  chemically synthesized
tcttctattttttggaagagtt

SEQ ID NO: 821423 - DNA, 22 bp, Artificial Sequence
  chemically synthesized
ttctattttttggaagagttgt

SEQ ID NO: 821424 - DNA, 22 bp, Artificial Sequence
  chemically synthesized
ccaaacatataaacaactcttc

SEQ ID NO: 821425 - DNA, 22 bp, Artificial Sequence
  chemically synthesized
ctattttttggaagagttgttt

SEQ ID NO: 821426 - DNA, 22 bp, Artificial Sequence
  chemically synthesized
taccaaacatataaacaactct

SEQ ID NO: 821427 - DNA, 22 bp, Artificial Sequence
  chemically synthesized
tattttttggaagagttgttta

SEQ ID NO: 821428 - DNA, 22 bp, Artificial Sequence
  chemically synthesized
ttttttggaagagttgtttata

SEQ ID NO: 821429 - DNA, 22 bp, Artificial Sequence
  chemically synthesized
tttggaagagttgtttatatgt

SEQ ID NO: 821430 - DNA, 22 bp, Artificial Sequence
  chemically synthesized
ttggaagagttgtttatatgtt

SEQ ID NO: 821431 - DNA, 22 bp, Artificial Sequence
  chemically synthesized
tggaagagttgtttatatgttt

SEQ ID NO: 821432 - DNA, 22 bp, Artificial Sequence
  chemically synthesized
ggaagagttgtttatatgtttg

SEQ ID NO: 821433 - DNA, 22 bp, Artificial Sequence
  chemically synthesized
gaagagttgtttatatgtttgg

SEQ ID NO: 821434 - DNA, 22 bp, Artificial Sequence
  chemically synthesized
ccccgatgaattctaccaaaca

SEQ ID NO: 821435 - DNA, 22 bp, Artificial Sequence
  chemically synthesized
cccccgatgaattctaccaaac

SEQ ID NO: 821436 - DNA, 22 bp, Artificial Sequence
  chemically synthesized
tttatatgtttggtagaattca

SEQ ID NO: 821437 - DNA, 22 bp, Artificial Sequence
  chemically synthesized
atatgtttggtagaattcatcg

SEQ ID NO: 821438 - DNA, 22 bp, Artificial Sequence
  chemically synthesized
tatgtttggtagaattcatcgg

SEQ ID NO: 821439 - DNA, 22 bp, Artificial Sequence
  chemically synthesized
aggcccagaagtcttcccccga

SEQ ID NO: 821440 - DNA, 22 bp, Artificial Sequence
  chemically synthesized
ggtagaattcatcgggggaaga

SEQ ID NO: 821441 - DNA, 22 bp, Artificial Sequence
  chemically synthesized
gtagaattcatcgggggaagac

SEQ ID NO: 821442 - DNA, 22 bp, Artificial Sequence
  chemically synthesized
atcgggggaagacttctgggcc

SEQ ID NO: 821443 - DNA, 22 bp, Artificial Sequence
  chemically synthesized
ccaatgaaaggctcaggcccag

SEQ ID NO: 821444 - DNA, 22 bp, Artificial Sequence
  chemically synthesized
tcccaatgaaaggctcaggccc

SEQ ID NO: 821445 - DNA, 22 bp, Artificial Sequence
  chemically synthesized
ctcccaatgaaaggctcaggcc

SEQ ID NO: 821446 - DNA, 22 bp, Artificial Sequence
  chemically synthesized
aaaacttctcccaatgaaaggc

SEQ ID NO: 821447 - DNA, 22 bp, Artificial Sequence
  chemically synthesized
ctgggcctgagcctttcattgg

SEQ ID NO: 821448 - DNA, 22 bp, Artificial Sequence
  chemically synthesized
tgggcctgagcctttcattggg

SEQ ID NO: 821449 - DNA, 22 bp, Artificial Sequence
  chemically synthesized
ggcctgagcctttcattgggag

SEQ ID NO: 821450 - DNA, 22 bp, Artificial Sequence
  chemically synthesized
gtattaaaaacttctcccaatg

SEQ ID NO: 821451 - DNA, 22 bp, Artificial Sequence
  chemically synthesized
agcctttcattgggagaagttt

SEQ ID NO: 821452 - DNA, 22 bp, Artificial Sequence
  chemically synthesized
aattggtattaaaaacttctcc

SEQ ID NO: 821453 - DNA, 22 bp, Artificial Sequence
  chemically synthesized
tcattgggagaagtttttaata

SEQ ID NO: 821454 - DNA, 22 bp, Artificial Sequence
  chemically synthesized
cattgggagaagtttttaatac

SEQ ID NO: 821455 - DNA, 22 bp, Artificial Sequence
  chemically synthesized
attgggagaagtttttaatacc

SEQ ID NO: 821456 - DNA, 22 bp, Artificial Sequence
  chemically synthesized
ggagaagtttttaataccaatt

SEQ ID NO: 821457 - DNA, 22 bp, Artificial Sequence
  chemically synthesized
taacaagaaattgaattggtat

SEQ ID NO: 821458 - DNA, 22 bp, Artificial Sequence
  chemically synthesized
ttaataccaattcaatttcttg

SEQ ID NO: 821459 - DNA, 22 bp, Artificial Sequence
  chemically synthesized
taataccaattcaatttcttgt

SEQ ID NO: 821460 - DNA, 22 bp, Artificial Sequence
  chemically synthesized
gatagacctataacaagaaatt

SEQ ID NO: 821461 - DNA, 22 bp, Artificial Sequence
  chemically synthesized
aataccaattcaatttcttgtt

SEQ ID NO: 821462 - DNA, 22 bp, Artificial Sequence
  chemically synthesized
ataccaattcaatttcttgtta

SEQ ID NO: 821463 - DNA, 22 bp, Artificial Sequence
  chemically synthesized
aatttcttgttataggtctatc

SEQ ID NO: 821464 - DNA, 22 bp, Artificial Sequence
  chemically synthesized
cttgttataggtctatccaggt

SEQ ID NO: 821465 - DNA, 22 bp, Artificial Sequence
  chemically synthesized
aacaaatagataacctggatag

SEQ ID NO: 821466 - DNA, 22 bp, Artificial Sequence
  chemically synthesized
ttgttataggtctatccaggtt

SEQ ID NO: 821467 - DNA, 22 bp, Artificial Sequence
  chemically synthesized
gttataggtctatccaggttat

SEQ ID NO: 821468 - DNA, 22 bp, Artificial Sequence
  chemically synthesized
ttataggtctatccaggttatc

SEQ ID NO: 821469 - DNA, 22 bp, Artificial Sequence
  chemically synthesized
taggtctatccaggttatctat

SEQ ID NO: 821470 - DNA, 22 bp, Artificial Sequence
  chemically synthesized
tgaacaactaaacaaatagata

SEQ ID NO: 821471 - DNA, 22 bp, Artificial Sequence
  chemically synthesized
tccaggttatctatttgtttag

SEQ ID NO: 821472 - DNA, 22 bp, Artificial Sequence
  chemically synthesized
tctatttgtttagttgttcata

SEQ ID NO: 821473 - DNA, 22 bp, Artificial Sequence
  chemically synthesized
tttgtttagttgttcataatat

SEQ ID NO: 821474 - DNA, 22 bp, Artificial Sequence
  chemically synthesized
gtttagttgttcataatatcct

SEQ ID NO: 821475 - DNA, 22 bp, Artificial Sequence
  chemically synthesized
tttagttgttcataatatcctc

SEQ ID NO: 821476 - DNA, 22 bp, Artificial Sequence
  chemically synthesized
agttgttcataatatcctcttt

SEQ ID NO: 821477 - DNA, 22 bp, Artificial Sequence
  chemically synthesized
gttgttcataatatcctctttt

SEQ ID NO: 821478 - DNA, 22 bp, Artificial Sequence
  chemically synthesized
ttcataatatcctcttttactt

SEQ ID NO: 821479 - DNA, 22 bp, Artificial Sequence
  chemically synthesized
cagaaataaaaagaagtaaaag

SEQ ID NO: 821480 - DNA, 22 bp, Artificial Sequence
  chemically synthesized
ataatatcctcttttacttctt

SEQ ID NO: 821481 - DNA, 22 bp, Artificial Sequence
  chemically synthesized
ccaacattacagaaataaaaag

SEQ ID NO: 821482 - DNA, 22 bp, Artificial Sequence
  chemically synthesized
ctaccaacattacagaaataaa

SEQ ID NO: 821483 - DNA, 22 bp, Artificial Sequence
  chemically synthesized
ttttacttctttttatttctgt

SEQ ID NO: 821484 - DNA, 22 bp, Artificial Sequence
  chemically synthesized
ttacttctttttatttctgtaa

SEQ ID NO: 821485 - DNA, 22 bp, Artificial Sequence
  chemically synthesized
tacttctttttatttctgtaat

SEQ ID NO: 821486 - DNA, 22 bp, Artificial Sequence
  chemically synthesized
acttctttttatttctgtaatg

SEQ ID NO: 821487 - DNA, 22 bp, Artificial Sequence
  chemically synthesized
cttctttttatttctgtaatgt

SEQ ID NO: 821488 - DNA, 22 bp, Artificial Sequence
  chemically synthesized
ctttttatttctgtaatgttgg

SEQ ID NO: 821489 - DNA, 22 bp, Artificial Sequence
  chemically synthesized
tttttatttctgtaatgttggt

SEQ ID NO: 821490 - DNA, 22 bp, Artificial Sequence
  chemically synthesized
tttatttctgtaatgttggtag

SEQ ID NO: 821491 - DNA, 22 bp, Artificial Sequence
  chemically synthesized
ttatttctgtaatgttggtagt

SEQ ID NO: 821492 - DNA, 22 bp, Artificial Sequence
  chemically synthesized
tatttctgtaatgttggtagta

SEQ ID NO: 821493 - DNA, 22 bp, Artificial Sequence
  chemically synthesized
atttctgtaatgttggtagtaa

SEQ ID NO: 821494 - DNA, 22 bp, Artificial Sequence
  chemically synthesized
tttctgtaatgttggtagtaat

SEQ ID NO: 821495 - DNA, 22 bp, Artificial Sequence
  chemically synthesized
ctgtaatgttggtagtaatgca

SEQ ID NO: 821496 - DNA, 22 bp, Artificial Sequence
  chemically synthesized
tgtaatgttggtagtaatgcac

SEQ ID NO: 821497 - DNA, 22 bp, Artificial Sequence
  chemically synthesized
gagaaaaagagggtgcattact

SEQ ID NO: 821498 - DNA, 22 bp, Artificial Sequence
  chemically synthesized
taatgttggtagtaatgcaccc

SEQ ID NO: 821499 - DNA, 22 bp, Artificial Sequence
  chemically synthesized
atattagagaaaaagagggtgc

SEQ ID NO: 821500 - DNA, 22 bp, Artificial Sequence
  chemically synthesized
ctaatattagagaaaaagaggg

SEQ ID NO: 821501 - DNA, 22 bp, Artificial Sequence
  chemically synthesized
gtagtaatgcaccctctttttc

SEQ ID NO: 821502 - DNA, 22 bp, Artificial Sequence
  chemically synthesized
tttttctctaatattagtaatt

SEQ ID NO: 821503 - DNA, 22 bp, Artificial Sequence
  chemically synthesized
tttctctaatattagtaatttg

SEQ ID NO: 821504 - DNA, 22 bp, Artificial Sequence
  chemically synthesized
ttctctaatattagtaatttga

SEQ ID NO: 821505 - DNA, 22 bp, Artificial Sequence
  chemically synthesized
ggaaagaaatggtcaaattact

SEQ ID NO: 821506 - DNA, 22 bp, Artificial Sequence
  chemically synthesized
tctctaatattagtaatttgac

SEQ ID NO: 821507 - DNA, 22 bp, Artificial Sequence
  chemically synthesized
ctctaatattagtaatttgacc

SEQ ID NO: 821508 - DNA, 22 bp, Artificial Sequence
  chemically synthesized
tctaatattagtaatttgacca

SEQ ID NO: 821509 - DNA, 22 bp, Artificial Sequence
  chemically synthesized
gttaggaaagaaatggtcaaat

SEQ ID NO: 821510 - DNA, 22 bp, Artificial Sequence
  chemically synthesized
taatattagtaatttgaccatt

SEQ ID NO: 821511 - DNA, 22 bp, Artificial Sequence
  chemically synthesized
atattagtaatttgaccatttc

SEQ ID NO: 821512 - DNA, 22 bp, Artificial Sequence
  chemically synthesized
attggttaggaaagaaatggtc

SEQ ID NO: 821513 - DNA, 22 bp, Artificial Sequence
  chemically synthesized
gctgattggttaggaaagaaat

SEQ ID NO: 821514 - DNA, 22 bp, Artificial Sequence
  chemically synthesized
gtaatttgaccatttctttcct

SEQ ID NO: 821515 - DNA, 22 bp, Artificial Sequence
  chemically synthesized
agctgattggttaggaaagaaa

SEQ ID NO: 821516 - DNA, 22 bp, Artificial Sequence
  chemically synthesized
tagctgattggttaggaaagaa

SEQ ID NO: 821517 - DNA, 22 bp, Artificial Sequence
  chemically synthesized
gaccatttctttcctaaccaat

SEQ ID NO: 821518 - DNA, 22 bp, Artificial Sequence
  chemically synthesized
accatttctttcctaaccaatc

SEQ ID NO: 821519 - DNA, 22 bp, Artificial Sequence
  chemically synthesized
acaaagttttagctgattggtt

SEQ ID NO: 821520 - DNA, 22 bp, Artificial Sequence
  chemically synthesized
ctttcctaaccaatcagctaaa

SEQ ID NO: 821521 - DNA, 22 bp, Artificial Sequence
  chemically synthesized
tttcctaaccaatcagctaaaa

SEQ ID NO: 821522 - DNA, 22 bp, Artificial Sequence
  chemically synthesized
tcctaaccaatcagctaaaact

SEQ ID NO: 821523 - DNA, 22 bp, Artificial Sequence
  chemically synthesized
cctaaccaatcagctaaaactt

SEQ ID NO: 821524 - DNA, 22 bp, Artificial Sequence
  chemically synthesized
ctaaccaatcagctaaaacttt

SEQ ID NO: 821525 - DNA, 22 bp, Artificial Sequence
  chemically synthesized
accaatcagctaaaactttgtc

SEQ ID NO: 821526 - DNA, 22 bp, Artificial Sequence
  chemically synthesized
aaaaggtcaacaaaattgacaa

SEQ ID NO: 821527 - DNA, 22 bp, Artificial Sequence
  chemically synthesized
gaaaaggtcaacaaaattgaca

SEQ ID NO: 821528 - DNA, 22 bp, Artificial Sequence
  chemically synthesized
tttgaaaaggtcaacaaaattg

SEQ ID NO: 821529 - DNA, 22 bp, Artificial Sequence
  chemically synthesized
aaactttgtcaattttgttgac

SEQ ID NO: 821530 - DNA, 22 bp, Artificial Sequence
  chemically synthesized
gttatttgaaaaggtcaacaaa

SEQ ID NO: 821531 - DNA, 22 bp, Artificial Sequence
  chemically synthesized
agttatttgaaaaggtcaacaa

SEQ ID NO: 821532 - DNA, 22 bp, Artificial Sequence
  chemically synthesized
tgtcaattttgttgaccttttc

SEQ ID NO: 821533 - DNA, 22 bp, Artificial Sequence
  chemically synthesized
gtcaattttgttgaccttttca

SEQ ID NO: 821534 - DNA, 22 bp, Artificial Sequence
  chemically synthesized
tcaattttgttgaccttttcaa

SEQ ID NO: 821535 - DNA, 22 bp, Artificial Sequence
  chemically synthesized
gaaatttagttatttgaaaagg

SEQ ID NO: 821536 - DNA, 22 bp, Artificial Sequence
  chemically synthesized
tgttgaccttttcaaataacta

SEQ ID NO: 821537 - DNA, 22 bp, Artificial Sequence
  chemically synthesized
gttgaccttttcaaataactaa

SEQ ID NO: 821538 - DNA, 22 bp, Artificial Sequence
  chemically synthesized
ttgaccttttcaaataactaaa

SEQ ID NO: 821539 - DNA, 22 bp, Artificial Sequence
  chemically synthesized
accttttcaaataactaaattt

SEQ ID NO: 821540 - DNA, 22 bp, Artificial Sequence
  chemically synthesized
ttcaaataactaaatttctaga

SEQ ID NO: 821541 - DNA, 22 bp, Artificial Sequence
  chemically synthesized
tcaaataactaaatttctagat

SEQ ID NO: 821542 - DNA, 22 bp, Artificial Sequence
  chemically synthesized
caaataactaaatttctagatt

SEQ ID NO: 821543 - DNA, 22 bp, Artificial Sequence
  chemically synthesized
aaataactaaatttctagattt

SEQ ID NO: 821544 - DNA, 22 bp, Artificial Sequence
  chemically synthesized
aatttctagattttggttttgt

SEQ ID NO: 821545 - DNA, 22 bp, Artificial Sequence
  chemically synthesized
ctagattttggttttgttgatt

SEQ ID NO: 821546 - DNA, 22 bp, Artificial Sequence
  chemically synthesized
tagattttggttttgttgattt

SEQ ID NO: 821547 - DNA, 22 bp, Artificial Sequence
  chemically synthesized
gattttggttttgttgattttt

SEQ ID NO: 821548 - DNA, 22 bp, Artificial Sequence
  chemically synthesized
tggttttgttgattttttctat

SEQ ID NO: 821549 - DNA, 22 bp, Artificial Sequence
  chemically synthesized
ggttttgttgattttttctatt

SEQ ID NO: 821550 - DNA, 22 bp, Artificial Sequence
  chemically synthesized
gttttgttgattttttctatta

SEQ ID NO: 821551 - DNA, 22 bp, Artificial Sequence
  chemically synthesized
tgttgattttttctattatatt

SEQ ID NO: 821552 - DNA, 22 bp, Artificial Sequence
  chemically synthesized
gttgattttttctattatattt

SEQ ID NO: 821553 - DNA, 22 bp, Artificial Sequence
  chemically synthesized
ttgattttttctattatatttt

SEQ ID NO: 821554 - DNA, 22 bp, Artificial Sequence
  chemically synthesized
attttttctattatattttctt

SEQ ID NO: 821555 - DNA, 22 bp, Artificial Sequence
  chemically synthesized
tttctattatattttcttcctc

SEQ ID NO: 821556 - DNA, 22 bp, Artificial Sequence
  chemically synthesized
ttctattatattttcttcctct

SEQ ID NO: 821557 - DNA, 22 bp, Artificial Sequence
  chemically synthesized
tctattatattttcttcctcta

SEQ ID NO: 821558 - DNA, 22 bp, Artificial Sequence
  chemically synthesized
ctattatattttcttcctctat

SEQ ID NO: 821559 - DNA, 22 bp, Artificial Sequence
  chemically synthesized
tattatattttcttcctctatc

SEQ ID NO: 821560 - DNA, 22 bp, Artificial Sequence
  chemically synthesized
ttatattttcttcctctatctg

SEQ ID NO: 821561 - DNA, 22 bp, Artificial Sequence
  chemically synthesized
gtgtgaaaaaaatcagatagag

SEQ ID NO: 821562 - DNA, 22 bp, Artificial Sequence
  chemically synthesized
tattttcttcctctatctgatt

SEQ ID NO: 821563 - DNA, 22 bp, Artificial Sequence
  chemically synthesized
tcttcctctatctgattttttt

SEQ ID NO: 821564 - DNA, 22 bp, Artificial Sequence
  chemically synthesized
cttcctctatctgatttttttc

SEQ ID NO: 821565 - DNA, 22 bp, Artificial Sequence
  chemically synthesized
ttcctctatctgatttttttca

SEQ ID NO: 821566 - DNA, 22 bp, Artificial Sequence
  chemically synthesized
cctctatctgatttttttcaca

SEQ ID NO: 821567 - DNA, 22 bp, Artificial Sequence
  chemically synthesized
ctctatctgatttttttcacac

SEQ ID NO: 821568 - DNA, 22 bp, Artificial Sequence
  chemically synthesized
tatctgatttttttcacactaa

SEQ ID NO: 821569 - DNA, 22 bp, Artificial Sequence
  chemically synthesized
tctgatttttttcacactaatt

SEQ ID NO: 821570 - DNA, 22 bp, Artificial Sequence
  chemically synthesized
atttttttcacactaattgtta

SEQ ID NO: 821571 - DNA, 22 bp, Artificial Sequence
  chemically synthesized
ttttcacactaattgttattac

SEQ ID NO: 821572 - DNA, 22 bp, Artificial Sequence
  chemically synthesized
tttcacactaattgttattact

SEQ ID NO: 821573 - DNA, 22 bp, Artificial Sequence
  chemically synthesized
ttcacactaattgttattactt

SEQ ID NO: 821574 - DNA, 22 bp, Artificial Sequence
  chemically synthesized
tcacactaattgttattacttc

SEQ ID NO: 821575 - DNA, 22 bp, Artificial Sequence
  chemically synthesized
cacactaattgttattacttcc

SEQ ID NO: 821576 - DNA, 22 bp, Artificial Sequence
  chemically synthesized
cagtaagcagcaggaagtaata

SEQ ID NO: 821577 - DNA, 22 bp, Artificial Sequence
  chemically synthesized
acactaattgttattacttcct

SEQ ID NO: 821578 - DNA, 22 bp, Artificial Sequence
  chemically synthesized
attgttattacttcctgctgct

SEQ ID NO: 821579 - DNA, 22 bp, Artificial Sequence
  chemically synthesized
ttattacttcctgctgcttact

SEQ ID NO: 821580 - DNA, 22 bp, Artificial Sequence
  chemically synthesized
ttacttcctgctgcttactgta

SEQ ID NO: 821581 - DNA, 22 bp, Artificial Sequence
  chemically synthesized
cttcctgctgcttactgtagat

SEQ ID NO: 821582 - DNA, 22 bp, Artificial Sequence
  chemically synthesized
cctgctgcttactgtagattta

SEQ ID NO: 821583 - DNA, 22 bp, Artificial Sequence
  chemically synthesized
ctgctgcttactgtagatttac

SEQ ID NO: 821584 - DNA, 22 bp, Artificial Sequence
  chemically synthesized
ctgcttactgtagatttacttt

SEQ ID NO: 821585 - DNA, 22 bp, Artificial Sequence
  chemically synthesized
gaaaaagaagagaaaagtaaat

SEQ ID NO: 821586 - DNA, 22 bp, Artificial Sequence
  chemically synthesized
cttactgtagatttacttttct

SEQ ID NO: 821587 - DNA, 22 bp, Artificial Sequence
  chemically synthesized
actgtagatttacttttctctt

SEQ ID NO: 821588 - DNA, 22 bp, Artificial Sequence
  chemically synthesized
ctgtagatttacttttctcttc

SEQ ID NO: 821589 - DNA, 22 bp, Artificial Sequence
  chemically synthesized
agaaactagaaaaagaagagaa

SEQ ID NO: 821590 - DNA, 22 bp, Artificial Sequence
  chemically synthesized
tagatttacttttctcttcttt

SEQ ID NO: 821591 - DNA, 22 bp, Artificial Sequence
  chemically synthesized
aagaaactagaaaaagaagaga

SEQ ID NO: 821592 - DNA, 22 bp, Artificial Sequence
  chemically synthesized
ccttaagaaactagaaaaagaa

SEQ ID NO: 821593 - DNA, 22 bp, Artificial Sequence
  chemically synthesized
taccttaagaaactagaaaaag

SEQ ID NO: 821594 - DNA, 22 bp, Artificial Sequence
  chemically synthesized
acttttctcttctttttctagt

SEQ ID NO: 821595 - DNA, 22 bp, Artificial Sequence
  chemically synthesized
ctaccttaagaaactagaaaaa

SEQ ID NO: 821596 - DNA, 22 bp, Artificial Sequence
  chemically synthesized
cttttctcttctttttctagtt

SEQ ID NO: 821597 - DNA, 22 bp, Artificial Sequence
  chemically synthesized
ttctcttctttttctagtttct

SEQ ID NO: 821598 - DNA, 22 bp, Artificial Sequence
  chemically synthesized
tctcttctttttctagtttctt

SEQ ID NO: 821599 - DNA, 22 bp, Artificial Sequence
  chemically synthesized
agcttctaccttaagaaactag

SEQ ID NO: 821600 - DNA, 22 bp, Artificial Sequence
  chemically synthesized
ctcttctttttctagtttctta

SEQ ID NO: 821601 - DNA, 22 bp, Artificial Sequence
  chemically synthesized
tcttctttttctagtttcttaa

SEQ ID NO: 821602 - DNA, 22 bp, Artificial Sequence
  chemically synthesized
ttctttttctagtttcttaagg

SEQ ID NO: 821603 - DNA, 22 bp, Artificial Sequence
  chemically synthesized
ctttttctagtttcttaaggta

SEQ ID NO: 821604 - DNA, 22 bp, Artificial Sequence
  chemically synthesized
tttttctagtttcttaaggtag

SEQ ID NO: 821605 - DNA, 22 bp, Artificial Sequence
  chemically synthesized
tttctagtttcttaaggtagaa

SEQ ID NO: 821606 - DNA, 22 bp, Artificial Sequence
  chemically synthesized
ttctagtttcttaaggtagaag

SEQ ID NO: 821607 - DNA, 22 bp, Artificial Sequence
  chemically synthesized
tctagtttcttaaggtagaagc

SEQ ID NO: 821608 - DNA, 22 bp, Artificial Sequence
  chemically synthesized
ctagtttcttaaggtagaagct

SEQ ID NO: 821609 - DNA, 22 bp, Artificial Sequence
  chemically synthesized
tagtttcttaaggtagaagctt

SEQ ID NO: 821610 - DNA, 22 bp, Artificial Sequence
  chemically synthesized
aaatcagtagcctaagcttcta

SEQ ID NO: 821611 - DNA, 22 bp, Artificial Sequence
  chemically synthesized
gtttcttaaggtagaagcttag

SEQ ID NO: 821612 - DNA, 22 bp, Artificial Sequence
  chemically synthesized
cttaaggtagaagcttaggcta

SEQ ID NO: 821613 - DNA, 22 bp, Artificial Sequence
  chemically synthesized
ttaaggtagaagcttaggctac

SEQ ID NO: 821614 - DNA, 22 bp, Artificial Sequence
  chemically synthesized
aaggtagaagcttaggctactg

SEQ ID NO: 821615 - DNA, 22 bp, Artificial Sequence
  chemically synthesized
aggtagaagcttaggctactga

SEQ ID NO: 821616 - DNA, 22 bp, Artificial Sequence
  chemically synthesized
aaaaggaaaaagatctgaaatc

SEQ ID NO: 821617 - DNA, 22 bp, Artificial Sequence
  chemically synthesized
aaaaaggaaaaagatctgaaat

SEQ ID NO: 821618 - DNA, 22 bp, Artificial Sequence
  chemically synthesized
aggctactgatttcagatcttt

SEQ ID NO: 821619 - DNA, 22 bp, Artificial Sequence
  chemically synthesized
ggctactgatttcagatctttt

SEQ ID NO: 821620 - DNA, 22 bp, Artificial Sequence
  chemically synthesized
tatttaaaaaggaaaaagatct

SEQ ID NO: 821621 - DNA, 22 bp, Artificial Sequence
  chemically synthesized
ctgatttcagatctttttcctt

SEQ ID NO: 821622 - DNA, 22 bp, Artificial Sequence
  chemically synthesized
atttcagatctttttccttttt

SEQ ID NO: 821623 - DNA, 22 bp, Artificial Sequence
  chemically synthesized
taaatacctatatttaaaaagg

SEQ ID NO: 821624 - DNA, 22 bp, Artificial Sequence
  chemically synthesized
cagatctttttcctttttaaat

SEQ ID NO: 821625 - DNA, 22 bp, Artificial Sequence
  chemically synthesized
agatctttttcctttttaaata

SEQ ID NO: 821626 - DNA, 22 bp, Artificial Sequence
  chemically synthesized
tttcctttttaaatataggtat

SEQ ID NO: 821627 - DNA, 22 bp, Artificial Sequence
  chemically synthesized
ttcctttttaaatataggtatt

SEQ ID NO: 821628 - DNA, 22 bp, Artificial Sequence
  chemically synthesized
tcctttttaaatataggtattt

SEQ ID NO: 821629 - DNA, 22 bp, Artificial Sequence
  chemically synthesized
cctttttaaatataggtattta
